United States Patent 11,640,849 (METHODS FOR HISTOLOGICAL DIAGNOSIS AND TREATMENT OF DISEASES) - sequence listing, part 86

SEQ ID NO: 3277803 - protein, 25 aa, Plasmodium falciparum
YCNPREIYEIIIILFELARKKNFYH

SEQ ID NO: 3277804 - protein, 29 aa, Plasmodium falciparum
YCNYIIRKRLEYICKCEGIFGCIRFLNYP

SEQ ID NO: 3277805 - protein, 36 aa, Plasmodium falciparum
YCPDCGKYCSSYRKWIERKGKEFIKQKNAYKEQKTN

SEQ ID NO: 3277806 - protein, 25 aa, Plasmodium falciparum
YCPYPRKLVGLSFYYCISLLILFGN

SEQ ID NO: 3277807 - protein, 23 aa, Plasmodium falciparum
YCQPCPACVVECDGGKCEEKKNS

SEQ ID NO: 3277808 - protein, 17 aa, Plasmodium falciparum
YCQPCPHCGVKMKDGKW

SEQ ID NO: 3277809 - protein, 17 aa, Plasmodium falciparum
YCQPCPHCGVRKANNGN

SEQ ID NO: 3277810 - protein, 18 aa, Plasmodium falciparum
YCQRTCIIPENINYAYKN

SEQ ID NO: 3277811 - protein, 18 aa, Plasmodium falciparum
YCRLDVKKSTLILAYKLN

SEQ ID NO: 3277812 - protein, 17 aa, Plasmodium falciparum
YCSYIKWNNYFEYYNKE

SEQ ID NO: 3277813 - protein, 24 aa, Plasmodium falciparum
YCTLKLKDSIIFKIVIDHFTNIYQ

SEQ ID NO: 3277814 - protein, 22 aa, Plasmodium falciparum
YCTNKWILKTTFFLKKEDDMLF

SEQ ID NO: 3277815 - protein, 47 aa, Plasmodium falciparum
YCVIYHKNCKNMWLKQKLHSYYKICGFICFLLYAFLYILSYEQYEVF

SEQ ID NO: 3277816 - protein, 20 aa, Plasmodium falciparum
YCYIKKNYLFISILKIWYLF

SEQ ID NO: 3277817 - protein, 23 aa, Plasmodium falciparum
YDAFTYLQNCHFILGNELLLDAV

SEQ ID NO: 3277818 - protein, 19 aa, Plasmodium falciparum
YDCNNEIYLKDINKIKYKK

SEQ ID NO: 3277819 - protein, 20 aa, Plasmodium falciparum
YDCTQTIRGNEHFVEKDDCK

SEQ ID NO: 3277820 - protein, 26 aa, Plasmodium falciparum
YDDAYKACFQNCALVNEKKCSLYSEC

SEQ ID NO: 3277821 - protein, 18 aa, Plasmodium falciparum
YDDICDQINYVFNYKTHK

SEQ ID NO: 3277822 - protein, 25 aa, Plasmodium falciparum
YDDINCCDSFYGLKVWDILFNYVSF

SEQ ID NO: 3277823 - protein, 32 aa, Plasmodium falciparum
YDDISINAICHGWSEWSPCSVTCNMGYHFSKR

SEQ ID NO: 3277824 - protein, 18 aa, Plasmodium falciparum
YDDSFFFFNSIVLSKEQS

SEQ ID NO: 3277825 - protein, 17 aa, Plasmodium falciparum
YDEFFMLKHREYYKEDI

SEQ ID NO: 3277826 - protein, 23 aa, Plasmodium falciparum
YDEKLRRISVHMGDKREHKRGYI

SEQ ID NO: 3277827 - protein, 24 aa, Plasmodium falciparum
YDEKRKLLDFSKLLFPGWKYYAED

SEQ ID NO: 3277828 - protein, 26 aa, Plasmodium falciparum
YDELLRCFTMKLNIERNNKNIIRSNY

SEQ ID NO: 3277829 - protein, 23 aa, Plasmodium falciparum
YDERKNKCLHFLNITENKFYENF

SEQ ID NO: 3277830 - protein, 34 aa, Plasmodium falciparum
YDEYILLRGSFRFRVIKGLIKFNGEIIKPSYEYR

SEQ ID NO: 3277831 - protein, 23 aa, Plasmodium falciparum
YDEYYCLKKLLKKRINLQKDEIK

SEQ ID NO: 3277832 - protein, 21 aa, Plasmodium falciparum
YDFFRLVFVKFLIKVQYLNKH

SEQ ID NO: 3277833 - protein, 23 aa, Plasmodium falciparum
YDFNIIKYLMKYKNVVSNLNQDH

SEQ ID NO: 3277834 - protein, 18 aa, Plasmodium falciparum
YDFSYYILMHYYISSLKE

SEQ ID NO: 3277835 - protein, 19 aa, Plasmodium falciparum
YDFVFLKNRLNFIKITYKN

SEQ ID NO: 3277836 - protein, 22 aa, Plasmodium falciparum
YDGKARLSKSFMSRCPRSLLGL

SEQ ID NO: 3277837 - protein, 19 aa, Plasmodium falciparum
YDGLNCFDNVYIKNKTLVK

SEQ ID NO: 3277838 - protein, 19 aa, Plasmodium falciparum
YDGNINRNVPLIVVSLFNL

SEQ ID NO: 3277839 - protein, 17 aa, Plasmodium falciparum
YDHIISFLLNTQDKELK

SEQ ID NO: 3277840 - protein, 19 aa, Plasmodium falciparum
YDHIYDNFKLFDLSYNYNS

SEQ ID NO: 3277841 - protein, 17 aa, Plasmodium falciparum
YDHIYKIITKLKDFNFL

SEQ ID NO: 3277842 - protein, 23 aa, Plasmodium falciparum
YDHKDFILSPLIGYSYSKFYGLK

SEQ ID NO: 3277843 - protein, 20 aa, Plasmodium falciparum
YDHMHHVFNYISNIRKFGLL

SEQ ID NO: 3277844 - protein, 18 aa, Plasmodium falciparum
YDHMLRVGKKDMGISNDN

SEQ ID NO: 3277845 - protein, 31 aa, Plasmodium falciparum
YDIFDELYLQIKLVKEYFGLIKYKPNILDTE

SEQ ID NO: 3277846 - protein, 25 aa, Plasmodium falciparum
YDIFKRDMHEIIKCTVQNLNYCIDA

SEQ ID NO: 3277847 - protein, 24 aa, Plasmodium falciparum
YDIFLSANCKVHIKKTSGKKKYVY

SEQ ID NO: 3277848 - protein, 26 aa, Plasmodium falciparum
YDIFYKKSRLNVVGIWKKGKRNPYNR

SEQ ID NO: 3277849 - protein, 20 aa, Plasmodium falciparum
YDIHIYIKCMKQLLNMFEYF

SEQ ID NO: 3277850 - protein, 17 aa, Plasmodium falciparum
YDIIKYSTFVDHKIVPS

SEQ ID NO: 3277851 - protein, 23 aa, Plasmodium falciparum
YDIILAFSVIKWIHLNNGDEHLI

SEQ ID NO: 3277852 - protein, 36 aa, Plasmodium falciparum
YDILKCLCTDHIFFFYRTIKALFLYNYKYYNNIYKK

SEQ ID NO: 3277853 - protein, 26 aa, Plasmodium falciparum
YDILLHLYDYFSFISIQQIQKNEKEG

SEQ ID NO: 3277854 - protein, 17 aa, Plasmodium falciparum
YDILNLLLKNELKNINN

SEQ ID NO: 3277855 - protein, 17 aa, Plasmodium falciparum
YDILSIYTSNCVVDTQE

SEQ ID NO: 3277856 - protein, 19 aa, Plasmodium falciparum
YDINNLLNCLKYFCKNIIL

SEQ ID NO: 3277857 - protein, 17 aa, Plasmodium falciparum
YDIPLVLNNMLKNRNFY

SEQ ID NO: 3277858 - protein, 19 aa, Plasmodium falciparum
YDISCIILDSSIYDNEKVK

SEQ ID NO: 3277859 - protein, 17 aa, Plasmodium falciparum
YDISSDMNLIDYKKQST

SEQ ID NO: 3277860 - protein, 21 aa, Plasmodium falciparum
YDISTPINFLCIFIPTLFDMN

SEQ ID NO: 3277861 - protein, 24 aa, Plasmodium falciparum
YDIYNLFLCPKIYVQDHEDNINGL

SEQ ID NO: 3277862 - protein, 19 aa, Plasmodium falciparum
YDKDILYYNYCIKILLICY

SEQ ID NO: 3277863 - protein, 19 aa, Plasmodium falciparum
YDKEKLFLFTYAYDKIQTY

SEQ ID NO: 3277864 - protein, 19 aa, Plasmodium falciparum
YDKIKTCTSNICGDDNTIR

SEQ ID NO: 3277865 - protein, 20 aa, Plasmodium falciparum
YDKIYTYLCVHLEQDNDRKD

SEQ ID NO: 3277866 - protein, 25 aa, Plasmodium falciparum
YDKNKRIPISYIYDMKNLIYEYQKV

SEQ ID NO: 3277867 - protein, 19 aa, Plasmodium falciparum
YDKNTILSTEEFECNSTIS

SEQ ID NO: 3277868 - protein, 18 aa, Plasmodium falciparum
YDKYEFLFENPFFEKKNK

SEQ ID NO: 3277869 - protein, 21 aa, Plasmodium falciparum
YDKYTFFLYLFYMKNSSYILK

SEQ ID NO: 3277870 - protein, 22 aa, Plasmodium falciparum
YDLKCYDDIYNILMKKNYLDIF

SEQ ID NO: 3277871 - protein, 23 aa, Plasmodium falciparum
YDLKIYRKKINMLQKNEDVQSYI

SEQ ID NO: 3277872 - protein, 24 aa, Plasmodium falciparum
YDLKKSCNYFSIYYDDFNKYYDNL

SEQ ID NO: 3277873 - protein, 24 aa, Plasmodium falciparum
YDLKTECKRDFNISQESGLDYKDE

SEQ ID NO: 3277874 - protein, 28 aa, Plasmodium falciparum
YDLLCILFSDIFCKKGNMYTNRDKKIAM

SEQ ID NO: 3277875 - protein, 18 aa, Plasmodium falciparum
YDLLKKISHIKCIKYTYV

SEQ ID NO: 3277876 - protein, 22 aa, Plasmodium falciparum
YDLRTVKKITYVMGKIKEDKTD

SEQ ID NO: 3277877 - protein, 17 aa, Plasmodium falciparum
YDLSQLIYNHFITTKIY

SEQ ID NO: 3277878 - protein, 26 aa, Plasmodium falciparum
YDLVLLLYFLKICFFYLNEHIHFVLH

SEQ ID NO: 3277879 - protein, 25 aa, Plasmodium falciparum
YDLYKRIMNILKLFYNEDCYNFIIH

SEQ ID NO: 3277880 - protein, 21 aa, Plasmodium falciparum
YDLYTPPLLLMLASAMLSENL

SEQ ID NO: 3277881 - protein, 28 aa, Plasmodium falciparum
YDMFIDIHFRLRKGIQCTDMLSIFSFDN

SEQ ID NO: 3277882 - protein, 20 aa, Plasmodium falciparum
YDMIKMFIPINMPSLNILNI

SEQ ID NO: 3277883 - protein, 21 aa, Plasmodium falciparum
YDMLYHPFVCSIQINNENYNI

SEQ ID NO: 3277884 - protein, 17 aa, Plasmodium falciparum
YDMNEEWFILKKKLEHV

SEQ ID NO: 3277885 - protein, 26 aa, Plasmodium falciparum
YDNAKKFCVCYDMFILYWRNSQILNN

SEQ ID NO: 3277886 - protein, 33 aa, Plasmodium falciparum
YDNDFCIFNLDIIRSIIIFSRYYINNLIYKEDK

SEQ ID NO: 3277887 - protein, 17 aa, Plasmodium falciparum
YDNFKLFDLSYNYNSFL

SEQ ID NO: 3277888 - protein, 29 aa, Plasmodium falciparum
YDNIFLKTIMRFYLLLNFSIELLTILYED

SEQ ID NO: 3277889 - protein, 20 aa, Plasmodium falciparum
YDNILFCLNTFKSFYELQKH

SEQ ID NO: 3277890 - protein, 24 aa, Plasmodium falciparum
YDNKECLFHNSTFFLNTQMTMNNN

SEQ ID NO: 3277891 - protein, 24 aa, Plasmodium falciparum
YDNKLKILIIHSVMDNNIFLNSLD

SEQ ID NO: 3277892 - protein, 20 aa, Plasmodium falciparum
YDNKRMECIGNNTCEGYFHS

SEQ ID NO: 3277893 - protein, 28 aa, Plasmodium falciparum
YDNKSCIKKVCNAEEYLLISTPVYYSND

SEQ ID NO: 3277894 - protein, 20 aa, Plasmodium falciparum
YDNLGSALWALSSLNKNILK

SEQ ID NO: 3277895 - protein, 25 aa, Plasmodium falciparum
YDNLIKKFCRYFLKMNEHINRKLYK

SEQ ID NO: 3277896 - protein, 23 aa, Plasmodium falciparum
YDNLKYIYFDLHLEKNSSKISSG

SEQ ID NO: 3277897 - protein, 17 aa, Plasmodium falciparum
YDNMYNVYMNLRNEKNI

SEQ ID NO: 3277898 - protein, 19 aa, Plasmodium falciparum
YDNVHFLEIIILNNFHHNR

SEQ ID NO: 3277899 - protein, 26 aa, Plasmodium falciparum
YDPKTRLFMYYGLYGLGGRLGANIKR

SEQ ID NO: 3277900 - protein, 20 aa, Plasmodium falciparum
YDQIAYRFIIDIQNMNLDSI

SEQ ID NO: 3277901 - protein, 19 aa, Plasmodium falciparum
YDRNILHCITLMINNIRFC

SEQ ID NO: 3277902 - protein, 20 aa, Plasmodium falciparum
YDRPDIRALFNNNLISQIEN

SEQ ID NO: 3277903 - protein, 24 aa, Plasmodium falciparum
YDRPLKWNLTSDFLEITRDPTINL

SEQ ID NO: 3277904 - protein, 17 aa, Plasmodium falciparum
YDSCGYKKVYLKCSNFW

SEQ ID NO: 3277905 - protein, 30 aa, Plasmodium falciparum
YDSFYFLMEIKKIYSCDGFFDSLINSEKLS

SEQ ID NO: 3277906 - protein, 19 aa, Plasmodium falciparum
YDSIYYYDYFEIIKDIYVK

SEQ ID NO: 3277907 - protein, 18 aa, Plasmodium falciparum
YDSKGMLARQIFTKGGFA

SEQ ID NO: 3277908 - protein, 18 aa, Plasmodium falciparum
YDSLKKFIKDKVKNNEYI

SEQ ID NO: 3277909 - protein, 19 aa, Plasmodium falciparum
YDSNSEWNKYLKYSLRNPH

SEQ ID NO: 3277910 - protein, 18 aa, Plasmodium falciparum
YDSRNFVTFFSPVHSALS

SEQ ID NO: 3277911 - protein, 30 aa, Plasmodium falciparum
YDTLPSLECPGCGRHCSFYKKWIKIKKDEY

SEQ ID NO: 3277912 - protein, 17 aa, Plasmodium falciparum
YDVFLKFSGNNQISDEI

SEQ ID NO: 3277913 - protein, 17 aa, Plasmodium falciparum
YDVLKELPMNIVGNVLD

SEQ ID NO: 3277914 - protein, 20 aa, Plasmodium falciparum
YDWERWTLRPAGVFHTYVYG

SEQ ID NO: 3277915 - protein, 26 aa, Plasmodium falciparum
YDYFLPKMFYLFAIHLIFIIFCLLVF

SEQ ID NO: 3277916 - protein, 23 aa, Plasmodium falciparum
YDYKKIGYLFAEFKKELKKDKMN

SEQ ID NO: 3277917 - protein, 21 aa, Plasmodium falciparum
YDYKLNIPSVLNFVKSKKKKN

SEQ ID NO: 3277918 - protein, 25 aa, Plasmodium falciparum
YDYKLYICACFKYYYTNDLVICSTD

SEQ ID NO: 3277919 - protein, 24 aa, Plasmodium falciparum
YDYLCDFRPTMYLFEQILGESNKF

SEQ ID NO: 3277920 - protein, 20 aa, Plasmodium falciparum
YDYLFICFDKQDVTTYSFNL

SEQ ID NO: 3277921 - protein, 26 aa, Plasmodium falciparum
YDYLFKRLKYLLHFYRNKLIYLKEKK

SEQ ID NO: 3277922 - protein, 20 aa, Plasmodium falciparum
YDYLKYLFFSLYKEYIHSNY

SEQ ID NO: 3277923 - protein, 21 aa, Plasmodium falciparum
YDYNRRCVIYDKANKRWKLRN

SEQ ID NO: 3277924 - protein, 20 aa, Plasmodium falciparum
YDYPEYLNLCLEEYRNNIYD

SEQ ID NO: 3277925 - protein, 17 aa, Plasmodium falciparum
YDYYATVGLSTLGDRIK

SEQ ID NO: 3277926 - protein, 18 aa, Plasmodium falciparum
YEAFILLRNLYLFEKNKK

SEQ ID NO: 3277927 - protein, 20 aa, Plasmodium falciparum
YECVEYISSLQIDFRKKKKK

SEQ ID NO: 3277928 - protein, 25 aa, Plasmodium falciparum
YEDCTCYQFNLLGWKEFSEDGHKND

SEQ ID NO: 3277929 - protein, 18 aa, Plasmodium falciparum
YEDEHFINLNEKWYNNKG

SEQ ID NO: 3277930 - protein, 22 aa, Plasmodium falciparum
YEDIDLYSIHIFYLYEKLNEYI

SEQ ID NO: 3277931 - protein, 20 aa, Plasmodium falciparum
YEDIDNLYLCNKKLVNEQIK

SEQ ID NO: 3277932 - protein, 24 aa, Plasmodium falciparum
YEDIKTKEGGTCTDVNRNKKNTSM

SEQ ID NO: 3277933 - protein, 25 aa, Plasmodium falciparum
YEDILCYDLKWCFNMLKVNSGTTNE

SEQ ID NO: 3277934 - protein, 27 aa, Plasmodium falciparum
YEDIPKRFLKRACLHLYIKFKKEIYTN

SEQ ID NO: 3277935 - protein, 23 aa, Plasmodium falciparum
YEDIRSTFIYSISKLVLINDYNL

SEQ ID NO: 3277936 - protein, 20 aa, Plasmodium falciparum
YEDLKNFNIFEIIDKNKFLN

SEQ ID NO: 3277937 - protein, 20 aa, Plasmodium falciparum
YEDLNFLPSIILWIFVILTT

SEQ ID NO: 3277938 - protein, 18 aa, Plasmodium falciparum
YEEIQKWTILPVYVNYKS

SEQ ID NO: 3277939 - protein, 17 aa, Plasmodium falciparum
YEEKKKSIDILKIKNIK

SEQ ID NO: 3277940 - protein, 17 aa, Plasmodium falciparum
YEELKCTCKDGYFTEKK

SEQ ID NO: 3277941 - protein, 35 aa, Plasmodium falciparum
YEERKEKRRNWILRSLRRDKLREIEQLEKLNAQLE

SEQ ID NO: 3277942 - protein, 25 aa, Plasmodium falciparum
YEESELYCLEKIRKVSCNIKKLLKK

SEQ ID NO: 3277943 - protein, 21 aa, Plasmodium falciparum
YEFEKSPMIRHMLVAEERKNA

SEQ ID NO: 3277944 - protein, 17 aa, Plasmodium falciparum
YEFLLSPIIKIICNEND

SEQ ID NO: 3277945 - protein, 19 aa, Plasmodium falciparum
YEFLPFSNLTQIKKKELQD

SEQ ID NO: 3277946 - protein, 22 aa, Plasmodium falciparum
YEGLKLKSALLTQIRNYIEEEN

SEQ ID NO: 3277947 - protein, 26 aa, Plasmodium falciparum
YEGYQYRLVKCFDFLHKKNISYYKDQ

SEQ ID NO: 3277948 - protein, 20 aa, Plasmodium falciparum
YEHIKLLYQFIIKKKEEIHW

SEQ ID NO: 3277949 - protein, 20 aa, Plasmodium falciparum
YEHKNCIITLSYINFEIIKS

SEQ ID NO: 3277950 - protein, 17 aa, Plasmodium falciparum
YEHLKIYILSNFRETDN

SEQ ID NO: 3277951 - protein, 26 aa, Plasmodium falciparum
YEHNCEAYFKKCFGSVIKEGEDNEIM

SEQ ID NO: 3277952 - protein, 25 aa, Plasmodium falciparum
YEIDLPYKFVRRLPYIYQLSRRKYF

SEQ ID NO: 3277953 - protein, 20 aa, Plasmodium falciparum
YEIIQMIILGLYSIHNNNIM

SEQ ID NO: 3277954 - protein, 21 aa, Plasmodium falciparum
YEILCFKKGVCLNVKEKNSCL

SEQ ID NO: 3277955 - protein, 17 aa, Plasmodium falciparum
YEILKNYFEKIFEIYKT

SEQ ID NO: 3277956 - protein, 21 aa, Plasmodium falciparum
YEIRALVAYMLHELRRGYINE

SEQ ID NO: 3277957 - protein, 27 aa, Plasmodium falciparum
YEIRLLNKFLFKSFLMFSLFPNFNENI

SEQ ID NO: 3277958 - protein, 30 aa, Plasmodium falciparum
YEIVYLSGLFLKLLELRNIHYDIFLFVICS

SEQ ID NO: 3277959 - protein, 24 aa, Plasmodium falciparum
YEIWSNNRIPDWERLSSKFNEVKG

SEQ ID NO: 3277960 - protein, 21 aa, Plasmodium falciparum
YEIYMRRSVLYNLHLFLKEIY

SEQ ID NO: 3277961 - protein, 18 aa, Plasmodium falciparum
YEKACSCEDYYKAADPQD

SEQ ID NO: 3277962 - protein, 25 aa, Plasmodium falciparum
YEKAVDYGFRESRILAEGEDTCARK

SEQ ID NO: 3277963 - protein, 19 aa, Plasmodium falciparum
YEKEIPKYVSKKVKTNSTI

SEQ ID NO: 3277964 - protein, 26 aa, Plasmodium falciparum
YEKHIIRYPKIIKYFLKNNILIKNIS

SEQ ID NO: 3277965 - protein, 25 aa, Plasmodium falciparum
YEKIRRKEEEAARRIERERRADINR

SEQ ID NO: 3277966 - protein, 19 aa, Plasmodium falciparum
YEKKCIFGNMSLQGNTEDY

SEQ ID NO: 3277967 - protein, 21 aa, Plasmodium falciparum
YEKKLKVVVHMNEKNKVFVKS

SEQ ID NO: 3277968 - protein, 25 aa, Plasmodium falciparum
YEKKNLFEPFNIFKNIIVNSISSLI

SEQ ID NO: 3277969 - protein, 21 aa, Plasmodium falciparum
YEKNEECLFIFNEKDCIKIYN

SEQ ID NO: 3277970 - protein, 17 aa, Plasmodium falciparum
YEKNLKKRLSILRTTKC

SEQ ID NO: 3277971 - protein, 41 aa, Plasmodium falciparum
YEKNRYSISLDHLWKSNINIYFKKILLFLLLLLLLFSSYNN

SEQ ID NO: 3277972 - protein, 18 aa, Plasmodium falciparum
YEKRHRINTIPKYYMNGR

SEQ ID NO: 3277973 - protein, 25 aa, Plasmodium falciparum
YEKSKELYENLSFISDKLIQSINSF

SEQ ID NO: 3277974 - protein, 24 aa, Plasmodium falciparum
YEKSTEGTYRYNVPNNDNNNNNNN

SEQ ID NO: 3277975 - protein, 20 aa, Plasmodium falciparum
YEKVFKVIYIKNLKDKKDEN

SEQ ID NO: 3277976 - protein, 18 aa, Plasmodium falciparum
YEKYCLYESYSSNFRSVF

SEQ ID NO: 3277977 - protein, 22 aa, Plasmodium falciparum
YEKYECTCCGNKIRNEEIYNIL

SEQ ID NO: 3277978 - protein, 30 aa, Plasmodium falciparum
YEKYFKFNYLRLFFKTLLKVIHIYPLYDRY

SEQ ID NO: 3277979 - protein, 25 aa, Plasmodium falciparum
YEKYKINIHFPKDFIIKMKSRQCND

SEQ ID NO: 3277980 - protein, 27 aa, Plasmodium falciparum
YEKYTCPGKGYLKRYVDEEHMYSLKLP

SEQ ID NO: 3277981 - protein, 17 aa, Plasmodium falciparum
YELCKDVNNYLFDEVIK

SEQ ID NO: 3277982 - protein, 20 aa, Plasmodium falciparum
YELCYIDLCINNYIFTMKLS

SEQ ID NO: 3277983 - protein, 18 aa, Plasmodium falciparum
YELFDFKNDSFFINRNKE

SEQ ID NO: 3277984 - protein, 18 aa, Plasmodium falciparum
YELFLKKKIDDNIRKSKM

SEQ ID NO: 3277985 - protein, 20 aa, Plasmodium falciparum
YELFYNFYFTYLRKKENNND

SEQ ID NO: 3277986 - protein, 17 aa, Plasmodium falciparum
YELKKVHIEPIKKEDIN

SEQ ID NO: 3277987 - protein, 17 aa, Plasmodium falciparum
YELLAGEPFKLNSYYYR

SEQ ID NO: 3277988 - protein, 20 aa, Plasmodium falciparum
YELLDKLYIRNIKYNSVPII

SEQ ID NO: 3277989 - protein, 19 aa, Plasmodium falciparum
YELLKKLNFKNIYFPENSK

SEQ ID NO: 3277990 - protein, 17 aa, Plasmodium falciparum
YELPYLLYLKEIVYSLK

SEQ ID NO: 3277991 - protein, 18 aa, Plasmodium falciparum
YELTKLIEVIQFVDNIEN

SEQ ID NO: 3277992 - protein, 26 aa, Plasmodium falciparum
YELYPKIHQIWIYLKINFYKNNYMND

SEQ ID NO: 3277993 - protein, 24 aa, Plasmodium falciparum
YEMNKKILLFLLTFLKKSKYNETL

SEQ ID NO: 3277994 - protein, 27 aa, Plasmodium falciparum
YEMRIIAQFYLDFIFFFIENIKNNLII

SEQ ID NO: 3277995 - protein, 42 aa, Plasmodium falciparum
YEMVTYLLKNIYRIHISKFFYIFVALSKFFLMNSYQQSNTNK

SEQ ID NO: 3277996 - protein, 23 aa, Plasmodium falciparum
YENCRICCLHENALIKKKKKEKG

SEQ ID NO: 3277997 - protein, 19 aa, Plasmodium falciparum
YENIKVFSFLHEQLIISKN

SEQ ID NO: 3277998 - protein, 24 aa, Plasmodium falciparum
YENIPTFFVPIIFVILHGGKNIVN

SEQ ID NO: 3277999 - protein, 25 aa, Plasmodium falciparum
YENIWIRNIFTLINLKKMDTLDNYF

SEQ ID NO: 3278000 - protein, 29 aa, Plasmodium falciparum
YENKESILFIFLIEFCLFIYSNFNIKICL

SEQ ID NO: 3278001 - protein, 37 aa, Plasmodium falciparum
YENKLSKKMLIILSFFIYHSYIYIRLSNLKTEYNCDE

SEQ ID NO: 3278002 - protein, 25 aa, Plasmodium falciparum
YENVFSVICYFFFSNKKFPQINDDI

SEQ ID NO: 3278003 - protein, 19 aa, Plasmodium falciparum
YENVMCVECLYKFLFKKYP

SEQ ID NO: 3278004 - protein, 37 aa, Plasmodium falciparum
YENYKFCYNFSFDLLFYILFYCFKRLHIYCLPHHIKN

SEQ ID NO: 3278005 - protein, 30 aa, Plasmodium falciparum
YEPALNICVDPDCSIWYFYTLNDQTKKCES

SEQ ID NO: 3278006 - protein, 19 aa, Plasmodium falciparum
YEPLVYLLLNSLGFLLYHE

SEQ ID NO: 3278007 - protein, 30 aa, Plasmodium falciparum
YEPSVGYCQGMNFLVGLLLIISNFNELETF

SEQ ID NO: 3278008 - protein, 30 aa, Plasmodium falciparum
YERKILEKNASAFFYLLINLLFNLSIDRFR

SEQ ID NO: 3278009 - protein, 33 aa, Plasmodium falciparum
YERKSNINLLSFFKYNFKKAYILEMLEKYDESM

SEQ ID NO: 3278010 - protein, 24 aa, Plasmodium falciparum
YERLESITQYFLKKKNKSILALDN

SEQ ID NO: 3278011 - protein, 21 aa, Plasmodium falciparum
YERMSTYFKYFIFSSAKNIFY

SEQ ID NO: 3278012 - protein, 18 aa, Plasmodium falciparum
YERNFLKDFELLKSKSYD

SEQ ID NO: 3278013 - protein, 20 aa, Plasmodium falciparum
YERYIKRKKQNVIYVKNNEE

SEQ ID NO: 3278014 - protein, 29 aa, Plasmodium falciparum
YERYVKKRIYLYFQFVYLFKNKFNNEENK

SEQ ID NO: 3278015 - protein, 25 aa, Plasmodium falciparum
YESFLKPLFVLLFTFLQHYKNDIIK

SEQ ID NO: 3278016 - protein, 22 aa, Plasmodium falciparum
YESKWGQCLKLINQGGDNLEER

SEQ ID NO: 3278017 - protein, 48 aa, Plasmodium falciparum
YESLGRVMGMCVCIASALNICFNPIIWKKICGVPLELQDLADYDFVAV

SEQ ID NO: 3278018 - protein, 20 aa, Plasmodium falciparum
YESPDFLFLEIYSKTISLCF

SEQ ID NO: 3278019 - protein, 22 aa, Plasmodium falciparum
YESPIHILSFSFKNIYNKISSY

SEQ ID NO: 3278020 - protein, 18 aa, Plasmodium falciparum
YESQYGIKNRNILKQSIY

SEQ ID NO: 3278021 - protein, 24 aa, Plasmodium falciparum
YESRICTVLARSFADIGDIVRGKD

SEQ ID NO: 3278022 - protein, 21 aa, Plasmodium falciparum
YESYLPKCLNKIHDFKNLFYL

SEQ ID NO: 3278023 - protein, 30 aa, Plasmodium falciparum
YESYRKILYEFPILYLFFPNKLLCKISKKS

SEQ ID NO: 3278024 - protein, 25 aa, Plasmodium falciparum
YETKCPPRYPLKSKVFGTFDQKTGK

SEQ ID NO: 3278025 - protein, 26 aa, Plasmodium falciparum
YEVDFKNSLYLLVIIKLHKFINNLFE

SEQ ID NO: 3278026 - protein, 25 aa, Plasmodium falciparum
YEVDLNYWKLWGLQTTHKLIKNKMI

SEQ ID NO: 3278027 - protein, 36 aa, Plasmodium falciparum
YEVLPYKFTIIVESLFRLGFVKIIFSNKNLSLGINI

SEQ ID NO: 3278028 - protein, 24 aa, Plasmodium falciparum
YEVNCKEILLLIWGGLRGGIVLVL

SEQ ID NO: 3278029 - protein, 17 aa, Plasmodium falciparum
YEVPKNINFMVVFPNGD

SEQ ID NO: 3278030 - protein, 23 aa, Plasmodium falciparum
YEYDSHYLLASVILFFLALLSIF

SEQ ID NO: 3278031 - protein, 19 aa, Plasmodium falciparum
YEYFSKLYMGYNIELSLMN

SEQ ID NO: 3278032 - protein, 39 aa, Plasmodium falciparum
YEYICKYTNIHFVFYFRFIYLFFNKVCIDILNIINCFNH

SEQ ID NO: 3278033 - protein, 19 aa, Plasmodium falciparum
YEYIIKYYTTFKYLQTLNK

SEQ ID NO: 3278034 - protein, 24 aa, Plasmodium falciparum
YEYILRTCTVYARMKPKDKSDLIL

SEQ ID NO: 3278035 - protein, 20 aa, Plasmodium falciparum
YEYISTVCYFLGKKNIYFWL

SEQ ID NO: 3278036 - protein, 20 aa, Plasmodium falciparum
YEYLFLLLFYKKGIHKIFDY

SEQ ID NO: 3278037 - protein, 17 aa, Plasmodium falciparum
YEYLKMLDCDYILVSYG

SEQ ID NO: 3278038 - protein, 19 aa, Plasmodium falciparum
YEYNDDFNIFINSNKNKDK

SEQ ID NO: 3278039 - protein, 24 aa, Plasmodium falciparum
YEYRISTDYVGWVTNVSFWDPQNN

SEQ ID NO: 3278040 - protein, 21 aa, Plasmodium falciparum
YEYVYIIDIILNIIITIINYN

SEQ ID NO: 3278041 - protein, 25 aa, Plasmodium falciparum
YFCDEKICLIDLIFTILKENINLKE

SEQ ID NO: 3278042 - protein, 18 aa, Plasmodium falciparum
YFCNFKVISIYLQEHENP

SEQ ID NO: 3278043 - protein, 19 aa, Plasmodium falciparum
YFDCYLHSLWIENLNSVLD

SEQ ID NO: 3278044 - protein, 21 aa, Plasmodium falciparum
YFDLIYKLNIKNVCIIEGGID

SEQ ID NO: 3278045 - protein, 26 aa, Plasmodium falciparum
YFDNIIDIMYLYGVSQAHDLFKRNHH

SEQ ID NO: 3278046 - protein, 17 aa, Plasmodium falciparum
YFDVLRIKHALEYYKKK

SEQ ID NO: 3278047 - protein, 21 aa, Plasmodium falciparum
YFEDTCIYSSINILYNILEVT

SEQ ID NO: 3278048 - protein, 21 aa, Plasmodium falciparum
YFEFWISLDPIRIPQKRKRHC

SEQ ID NO: 3278049 - protein, 28 aa, Plasmodium falciparum
YFEKIHFVEIVLFLLCDVLKIYNKIKKL

SEQ ID NO: 3278050 - protein, 25 aa, Plasmodium falciparum
YFELFTIWCSIKFISHVVYLTLYDD

SEQ ID NO: 3278051 - protein, 17 aa, Plasmodium falciparum
YFELTIDRKAWIIGDKI

SEQ ID NO: 3278052 - protein, 25 aa, Plasmodium falciparum
YFEYILINILLCFINNLQNIESSKR

SEQ ID NO: 3278053 - protein, 23 aa, Plasmodium falciparum
YFEYPRLYQLLKCNFQNTKELLL

SEQ ID NO: 3278054 - protein, 22 aa, Plasmodium falciparum
YFFEFYDCIPINYKKKPHNIEK

SEQ ID NO: 3278055 - protein, 19 aa, Plasmodium falciparum
YFFEIYFVINFVHEKLYSM

SEQ ID NO: 3278056 - protein, 18 aa, Plasmodium falciparum
YFFESPFTLYKKLTPEEI

SEQ ID NO: 3278057 - protein, 18 aa, Plasmodium falciparum
YFFFINIIVYCILTVLYD

SEQ ID NO: 3278058 - protein, 40 aa, Plasmodium falciparum
YFFHEIQKYFSCFNFLGIFEWPYLLKCVLKSQDEYIKDEK

SEQ ID NO: 3278059 - protein, 27 aa, Plasmodium falciparum
YFFHKSFFKYDIFMIDFVHIIKNKRKA

SEQ ID NO: 3278060 - protein, 18 aa, Plasmodium falciparum
YFFKNIIDKEKRKIHGSF

SEQ ID NO: 3278061 - protein, 19 aa, Plasmodium falciparum
YFFKYFFCNNKDNLKGSLQ

SEQ ID NO: 3278062 - protein, 18 aa, Plasmodium falciparum
YFFLTFAVIPSFKIIRNI

SEQ ID NO: 3278063 - protein, 18 aa, Plasmodium falciparum
YFFLYLFINDILLFYEEE

SEQ ID NO: 3278064 - protein, 19 aa, Plasmodium falciparum
YFFNKRLKKKYSEEKENVI

SEQ ID NO: 3278065 - protein, 26 aa, Plasmodium falciparum
YFFSAFSFLNSYFIYKLHSLEKKSIN

SEQ ID NO: 3278066 - protein, 19 aa, Plasmodium falciparum
YFFVRTCLFNELKKQNNLF

SEQ ID NO: 3278067 - protein, 20 aa, Plasmodium falciparum
YFGGHSFFFYFVCVIPSIYL

SEQ ID NO: 3278068 - protein, 22 aa, Plasmodium falciparum
YFGSMFHILRFQGYHINPFSFL

SEQ ID NO: 3278069 - protein, 20 aa, Plasmodium falciparum
YFHGPSLYKRYILIKNDIPE

SEQ ID NO: 3278070 - protein, 20 aa, Plasmodium falciparum
YFHICLICSYNILNQDKIFM

SEQ ID NO: 3278071 - protein, 19 aa, Plasmodium falciparum
YFHSECALNIYINNKSKEE

SEQ ID NO: 3278072 - protein, 27 aa, Plasmodium falciparum
YFHSMCLRIVYYLFELIFNISTYIYYN

SEQ ID NO: 3278073 - protein, 23 aa, Plasmodium falciparum
YFHTVRSSLRFKKNLENLKIQNN

SEQ ID NO: 3278074 - protein, 17 aa, Plasmodium falciparum
YFIFKKKYIFIVTCYFN

SEQ ID NO: 3278075 - protein, 26 aa, Plasmodium falciparum
YFIKILYYYINLVFLKIKNIFCDDCI

SEQ ID NO: 3278076 - protein, 24 aa, Plasmodium falciparum
YFILFYCFISFYFIFFHSPISDDK

SEQ ID NO: 3278077 - protein, 34 aa, Plasmodium falciparum
YFILLIYDKICFLKRKMNFCKYIHVDLLSLINRG

SEQ ID NO: 3278078 - protein, 17 aa, Plasmodium falciparum
YFILQIFIRDCKTTINI

SEQ ID NO: 3278079 - protein, 25 aa, Plasmodium falciparum
YFILYEKCFLPIERIVHVNYMKYLY

SEQ ID NO: 3278080 - protein, 18 aa, Plasmodium falciparum
YFINCLNGNIGNDNNNYD

SEQ ID NO: 3278081 - protein, 25 aa, Plasmodium falciparum
YFINEYWPVFNFLQFIYIILHYTLF

SEQ ID NO: 3278082 - protein, 20 aa, Plasmodium falciparum
YFINMRVFAVRARLTKSKEI

SEQ ID NO: 3278083 - protein, 18 aa, Plasmodium falciparum
YFIQCLRNSPTVFFNAVT

SEQ ID NO: 3278084 - protein, 17 aa, Plasmodium falciparum
YFIQSRVYNPILFHNIA

SEQ ID NO: 3278085 - protein, 22 aa, Plasmodium falciparum
YFIRMKRRILKYNYIILHLSYF

SEQ ID NO: 3278086 - protein, 25 aa, Plasmodium falciparum
YFIRNLKHGTPFICIHNYEHINKYY

SEQ ID NO: 3278087 - protein, 23 aa, Plasmodium falciparum
YFISLWINVLFSFFKKNIDVYVS

SEQ ID NO: 3278088 - protein, 25 aa, Plasmodium falciparum
YFITRPEFLFIDNLYSIFKDYIKNR

SEQ ID NO: 3278089 - protein, 17 aa, Plasmodium falciparum
YFIYGGIVFSILTRSLY

SEQ ID NO: 3278090 - protein, 21 aa, Plasmodium falciparum
YFIYRNIYRPIKYHYDITNKI

SEQ ID NO: 3278091 - protein, 21 aa, Plasmodium falciparum
YFKEVIEIFRNMAFKNSNLFK

SEQ ID NO: 3278092 - protein, 18 aa, Plasmodium falciparum
YFKKCYHLNMCMYKLEAC

SEQ ID NO: 3278093 - protein, 18 aa, Plasmodium falciparum
YFKKISIYDNMMKIPYDI

SEQ ID NO: 3278094 - protein, 25 aa, Plasmodium falciparum
YFKNIKLKSIEIINSSSLENNYSSF

SEQ ID NO: 3278095 - protein, 18 aa, Plasmodium falciparum
YFKNINIMQNIKRIEQVN

SEQ ID NO: 3278096 - protein, 23 aa, Plasmodium falciparum
YFKVIDIFYKICFTNLDNINILS

SEQ ID NO: 3278097 - protein, 18 aa, Plasmodium falciparum
YFLDIDISLINFMKNFQI

SEQ ID NO: 3278098 - protein, 19 aa, Plasmodium falciparum
YFLELGAKYCNDIMDNYTK

SEQ ID NO: 3278099 - protein, 19 aa, Plasmodium falciparum
YFLFLCIFTYFFKLYQQHK

SEQ ID NO: 3278100 - protein, 27 aa, Plasmodium falciparum
YFLHKPNKCFLYLEGVEFYCKKKTITN

SEQ ID NO: 3278101 - protein, 17 aa, Plasmodium falciparum
YFLIPYFILPLYTLSIG

SEQ ID NO: 3278102 - protein, 29 aa, Plasmodium falciparum
YFLIYKFMKLKGLDVLCMIEIFFKNVLIE

SEQ ID NO: 3278103 - protein, 20 aa, Plasmodium falciparum
YFLKLTRLIKNVLKKFEPKK

SEQ ID NO: 3278104 - protein, 26 aa, Plasmodium falciparum
YFLKVLKILYTKGLCRDVDHKNDQEE

SEQ ID NO: 3278105 - protein, 34 aa, Plasmodium falciparum
YFLLLKENFRVFKFFIFVIIINWITTKSVVIMNT

SEQ ID NO: 3278106 - protein, 17 aa, Plasmodium falciparum
YFLNFVFERWKHKVKSV

SEQ ID NO: 3278107 - protein, 51 aa, Plasmodium falciparum
YFLNHKRLGLKIFKYSHIILVYFIPFFKKYYFLWKFIEHEIDKDIMNLIKY

SEQ ID NO: 3278108 - protein, 17 aa, Plasmodium falciparum
YFLNKKMLKIPVSKHNY

SEQ ID NO: 3278109 - protein, 19 aa, Plasmodium falciparum
YFLNYCMLSTISSFLLFSF

SEQ ID NO: 3278110 - protein, 17 aa, Plasmodium falciparum
YFLPIFLYIILRLIFFV

SEQ ID NO: 3278111 - protein, 18 aa, Plasmodium falciparum
YFLRNVKVSKCLHLLYSI

SEQ ID NO: 3278112 - protein, 17 aa, Plasmodium falciparum
YFLSYLYNNIYLYYCDI

SEQ ID NO: 3278113 - protein, 25 aa, Plasmodium falciparum
YFLTIFILIYIFRLYSSYKKWMRQY

SEQ ID NO: 3278114 - protein, 21 aa, Plasmodium falciparum
YFLVMRISWTHAFTTGQHLIS

SEQ ID NO: 3278115 - protein, 19 aa, Plasmodium falciparum
YFMSLSLICNQLAINKYEN

SEQ ID NO: 3278116 - protein, 21 aa, Plasmodium falciparum
YFNDCKKEFLVDKNFNDEYYE

SEQ ID NO: 3278117 - protein, 18 aa, Plasmodium falciparum
YFNESCRNIKNSIVGTIM

SEQ ID NO: 3278118 - protein, 23 aa, Plasmodium falciparum
YFNFKNIFFYITINREDLYLNKC

SEQ ID NO: 3278119 - protein, 22 aa, Plasmodium falciparum
YFNIRTFISWVMNSLFHGSVVF

SEQ ID NO: 3278120 - protein, 17 aa, Plasmodium falciparum
YFNKYIDEFEYYKKYKI

SEQ ID NO: 3278121 - protein, 29 aa, Plasmodium falciparum
YFNLPKSMCHYFLNIYLMFFKKKNIKPVH

SEQ ID NO: 3278122 - protein, 17 aa, Plasmodium falciparum
YFNTLPCNFYFYHFEAS

SEQ ID NO: 3278123 - protein, 20 aa, Plasmodium falciparum
YFNYYELMVKVFTRNMIMFD

SEQ ID NO: 3278124 - protein, 21 aa, Plasmodium falciparum
YFPNLSFSYVCYGYIILILIP

SEQ ID NO: 3278125 - protein, 27 aa, Plasmodium falciparum
YFQDLDFFGCYKFINIDGIESMTYNKS

SEQ ID NO: 3278126 - protein, 17 aa, Plasmodium falciparum
YFQLREDWWTANRATVW

SEQ ID NO: 3278127 - protein, 25 aa, Plasmodium falciparum
YFSFDEIFFFLIIFYGFFSFTSTIL

SEQ ID NO: 3278128 - protein, 26 aa, Plasmodium falciparum
YFSKFVGKFYFVYNCSSNINFEFLKN

SEQ ID NO: 3278129 - protein, 25 aa, Plasmodium falciparum
YFTPDFKRHGIGILIDNHNKILYHG

SEQ ID NO: 3278130 - protein, 19 aa, Plasmodium falciparum
YFTRFNTYLIFSLYERIAM

SEQ ID NO: 3278131 - protein, 24 aa, Plasmodium falciparum
YFTRYKHVFLNSNIFFHFINNQKV

SEQ ID NO: 3278132 - protein, 18 aa, Plasmodium falciparum
YFVILPIISLVTSGICFS

SEQ ID NO: 3278133 - protein, 21 aa, Plasmodium falciparum
YFVKICISYLITTFLFFCVYI

SEQ ID NO: 3278134 - protein, 27 aa, Plasmodium falciparum
YFVKNIIRRISLILANRYILRKDLNLI

SEQ ID NO: 3278135 - protein, 23 aa, Plasmodium falciparum
YFVKSMAKFVRYNPFLDKEFVGE

SEQ ID NO: 3278136 - protein, 41 aa, Plasmodium falciparum
YFVYFVFNLYVLICITLSASIYKLVVCINILSKEGYNTENI

SEQ ID NO: 3278137 - protein, 18 aa, Plasmodium falciparum
YFYDILCSYNNNSFKKFK

SEQ ID NO: 3278138 - protein, 20 aa, Plasmodium falciparum
YFYEYVCVNICNKYATKRYN

SEQ ID NO: 3278139 - protein, 18 aa, Plasmodium falciparum
YFYGKAWGYATDYEIDIS

SEQ ID NO: 3278140 - protein, 17 aa, Plasmodium falciparum
YFYHLYPVLIITPASLK

SEQ ID NO: 3278141 - protein, 19 aa, Plasmodium falciparum
YFYIFFLSCLQPVQMMNPI

SEQ ID NO: 3278142 - protein, 36 aa, Plasmodium falciparum
YFYIKELNNYLSLKMALNIWPMFLKITLQGLLTSRH

SEQ ID NO: 3278143 - protein, 22 aa, Plasmodium falciparum
YFYKKSFYKCFSYFLHNKLSLC

SEQ ID NO: 3278144 - protein, 17 aa, Plasmodium falciparum
YFYKTFYNFHTKKNEQG

SEQ ID NO: 3278145 - protein, 24 aa, Plasmodium falciparum
YFYLKYFLFDAYIEYNLEYIYKLY

SEQ ID NO: 3278146 - protein, 17 aa, Plasmodium falciparum
YFYMFFFDLPREEEIKM

SEQ ID NO: 3278147 - protein, 17 aa, Plasmodium falciparum
YFYMITKIYKMLMHMKI

SEQ ID NO: 3278148 - protein, 23 aa, Plasmodium falciparum
YFYNLDHYNLYLSINKYNILKDI

SEQ ID NO: 3278149 - protein, 34 aa, Plasmodium falciparum
YFYPKLKTDIILFFFKEIFLNDNILKIDRKFLKK

SEQ ID NO: 3278150 - protein, 19 aa, Plasmodium falciparum
YFYQKCINSIIKYGKLNIS

SEQ ID NO: 3278151 - protein, 26 aa, Plasmodium falciparum
YFYVYKCLMNYFILFFLIYFFLMNSL

SEQ ID NO: 3278152 - protein, 18 aa, Plasmodium falciparum
YFYYHYFVYILLPKLNYL

SEQ ID NO: 3278153 - protein, 17 aa, Plasmodium falciparum
YGAIWTFILYFKFNYCI

SEQ ID NO: 3278154 - protein, 21 aa, Plasmodium falciparum
YGDEIYKEIYELYVERNIPEY

SEQ ID NO: 3278155 - protein, 28 aa, Plasmodium falciparum
YGDTCYFVDEFIRYCDVLKLYTNILKNC

SEQ ID NO: 3278156 - protein, 20 aa, Plasmodium falciparum
YGDYYLSWIMEGLKDDTPTF

SEQ ID NO: 3278157 - protein, 18 aa, Plasmodium falciparum
YGEEKICFFNYEKYINND

SEQ ID NO: 3278158 - protein, 24 aa, Plasmodium falciparum
YGEGPKKYKIIYSIPGRKKSVIDD

SEQ ID NO: 3278159 - protein, 17 aa, Plasmodium falciparum
YGEKCFFFNFPQIKEII

SEQ ID NO: 3278160 - protein, 23 aa, Plasmodium falciparum
YGENQIFHFSKDKGILFGKTYDM

SEQ ID NO: 3278161 - protein, 26 aa, Plasmodium falciparum
YGFREKFPTTRILVKRKRNKEQKKLK

SEQ ID NO: 3278162 - protein, 17 aa, Plasmodium falciparum
YGGICCFCCLSNDIEKK

SEQ ID NO: 3278163 - protein, 21 aa, Plasmodium falciparum
YGGNGRLGLGNIKSYNKPQLI

SEQ ID NO: 3278164 - protein, 24 aa, Plasmodium falciparum
YGGREKKKLLGLISRKCKPTKISI

SEQ ID NO: 3278165 - protein, 25 aa, Plasmodium falciparum
YGHREFKGGIYAFLGYDNCTIEVNK

SEQ ID NO: 3278166 - protein, 17 aa, Plasmodium falciparum
YGIEKHFTKNEVIQKIK

SEQ ID NO: 3278167 - protein, 25 aa, Plasmodium falciparum
YGIERGCSECCYYLINEKNVNIFLK

SEQ ID NO: 3278168 - protein, 21 aa, Plasmodium falciparum
YGINLIIGIFLTFLGGYYGSL

SEQ ID NO: 3278169 - protein, 17 aa, Plasmodium falciparum
YGIWGYWNYTYITFYKF

SEQ ID NO: 3278170 - protein, 17 aa, Plasmodium falciparum
YGKCIPCPPHTFTKITG

SEQ ID NO: 3278171 - protein, 21 aa, Plasmodium falciparum
YGKDRYCDLNGYDCEKTKRGR

SEQ ID NO: 3278172 - protein, 23 aa, Plasmodium falciparum
YGKNAPTSWKCVTPSGNTSDTTV

SEQ ID NO: 3278173 - protein, 18 aa, Plasmodium falciparum
YGKNAPVSWKCIPTSGSG

SEQ ID NO: 3278174 - protein, 24 aa, Plasmodium falciparum
YGKTAPTGWKCVTPSGDKAATSSE

SEQ ID NO: 3278175 - protein, 17 aa, Plasmodium falciparum
YGKTFVFSNYFMLASQI

SEQ ID NO: 3278176 - protein, 19 aa, Plasmodium falciparum
YGLSCLLYGLYNLIDKKKE

SEQ ID NO: 3278177 - protein, 25 aa, Plasmodium falciparum
YGLSVLCLLKSLKRIKIETTTMEEK

SEQ ID NO: 3278178 - protein, 20 aa, Plasmodium falciparum
YGMNMLLFLLLKDRNSNDKN

SEQ ID NO: 3278179 - protein, 25 aa, Plasmodium falciparum
YGNFLKLIICLPFILITVLWIFLTI

SEQ ID NO: 3278180 - protein, 17 aa, Plasmodium falciparum
YGNYRIRGPMNYNLKGK

SEQ ID NO: 3278181 - protein, 24 aa, Plasmodium falciparum
YGPKAPTSWKCIPTGNTSNEGAAT

SEQ ID NO: 3278182 - protein, 25 aa, Plasmodium falciparum
YGPPGCGKTLLAKAIANECKANFIS

SEQ ID NO: 3278183 - protein, 18 aa, Plasmodium falciparum
YGRFPFFFEIPKYHIDDP

SEQ ID NO: 3278184 - protein, 17 aa, Plasmodium falciparum
YGRNIPINFKNMCKEVL

SEQ ID NO: 3278185 - protein, 21 aa, Plasmodium falciparum
YGSDTFRVFEDFDVRRKNKIW

SEQ ID NO: 3278186 - protein, 21 aa, Plasmodium falciparum
YGSEFLKKVCNYYNEYNSKQR

SEQ ID NO: 3278187 - protein, 18 aa, Plasmodium falciparum
YGSNFAFSLPNASDLRYN

SEQ ID NO: 3278188 - protein, 24 aa, Plasmodium falciparum
YGTLKIGIYLSYAFITLLNALISS

SEQ ID NO: 3278189 - protein, 26 aa, Plasmodium falciparum
YGWFKVCSRLSPWVYVWAVYAVSIVF

SEQ ID NO: 3278190 - protein, 21 aa, Plasmodium falciparum
YGWGLCLNSNMHGDLGNVDFI

SEQ ID NO: 3278191 - protein, 27 aa, Plasmodium falciparum
YGWMLLKLLHIIIIKFRSLTPLKTIMR

SEQ ID NO: 3278192 - protein, 18 aa, Plasmodium falciparum
YGYLNRISSFRSNKDKDL

SEQ ID NO: 3278193 - protein, 18 aa, Plasmodium falciparum
YHAFRPVFLAIILTLLMF

SEQ ID NO: 3278194 - protein, 17 aa, Plasmodium falciparum
YHEAFCTDSLKISINKE

SEQ ID NO: 3278195 - protein, 22 aa, Plasmodium falciparum
YHEAGHAIVAYFLQPKTDPIHK

SEQ ID NO: 3278196 - protein, 34 aa, Plasmodium falciparum
YHETGHALIGWFLEFADPVLKVSIIPRNNGALGY

SEQ ID NO: 3278197 - protein, 19 aa, Plasmodium falciparum
YHFDYRCFVVSAKNVPTRN

SEQ ID NO: 3278198 - protein, 23 aa, Plasmodium falciparum
YHFMFSFNYSFHYDNIIKTIKKK

SEQ ID NO: 3278199 - protein, 26 aa, Plasmodium falciparum
YHIKNELIWLIYLFYFYNIKKNIIQT

SEQ ID NO: 3278200 - protein, 23 aa, Plasmodium falciparum
YHIKNNMMIFCFVLFENSTYMQT

SEQ ID NO: 3278201 - protein, 26 aa, Plasmodium falciparum
YHIMIRYVIFTSFFMLIIQYHSFITC

SEQ ID NO: 3278202 - protein, 21 aa, Plasmodium falciparum
YHIPIFLCTTNSILESVLYEK

SEQ ID NO: 3278203 - protein, 27 aa, Plasmodium falciparum
YHKFYKNELEKILFNLKDSLKLLREGY

SEQ ID NO: 3278204 - protein, 23 aa, Plasmodium falciparum
YHKLKYTNCFNRKKYLKKIKKKK

SEQ ID NO: 3278205 - protein, 17 aa, Plasmodium falciparum
YHKTLRYVLEKLKLYPN

SEQ ID NO: 3278206 - protein, 27 aa, Plasmodium falciparum
YHLCKKRYFFNFLYNIFLHKYKNDKID

SEQ ID NO: 3278207 - protein, 17 aa, Plasmodium falciparum
YHLEGFLNYLISKNALS

SEQ ID NO: 3278208 - protein, 20 aa, Plasmodium falciparum
YHLILGRLFFMKNSKFLFLS

SEQ ID NO: 3278209 - protein, 19 aa, Plasmodium falciparum
YHLLFRPSVFIYLHNLIEN

SEQ ID NO: 3278210 - protein, 26 aa, Plasmodium falciparum
YHLLIEIRNPYSFLFFIKYTSLVEKL

SEQ ID NO: 3278211 - protein, 23 aa, Plasmodium falciparum
YHLQELFQYLLVKKISININNVD

SEQ ID NO: 3278212 - protein, 26 aa, Plasmodium falciparum
YHMFTICQPLLREVHISGDYLKKKLL

SEQ ID NO: 3278213 - protein, 20 aa, Plasmodium falciparum
YHMILNRILYISTIKFYPFL

SEQ ID NO: 3278214 - protein, 17 aa, Plasmodium falciparum
YHMLFYIHMLRISYLLK

SEQ ID NO: 3278215 - protein, 25 aa, Plasmodium falciparum
YHNAKWKECYEIIKMGEEDIEKRLN

SEQ ID NO: 3278216 - protein, 18 aa, Plasmodium falciparum
YHNFYCSINRLFISNYIL

SEQ ID NO: 3278217 - protein, 18 aa, Plasmodium falciparum
YHPGIAPKFYKFLYEPDM

SEQ ID NO: 3278218 - protein, 23 aa, Plasmodium falciparum
YHPNICPKLYKILYEPPNKEYIK

SEQ ID NO: 3278219 - protein, 19 aa, Plasmodium falciparum
YHRSLCECEIYTSIYDNDP

SEQ ID NO: 3278220 - protein, 24 aa, Plasmodium falciparum
YHSEYCKPCPGCGVKLEDNVWKEK

SEQ ID NO: 3278221 - protein, 18 aa, Plasmodium falciparum
YHTSKFFFNEKSMKFPLY

SEQ ID NO: 3278222 - protein, 18 aa, Plasmodium falciparum
YHYIFLLTYIKRNEYKME

SEQ ID NO: 3278223 - protein, 18 aa, Plasmodium falciparum
YHYNKSFMLKRWCLKILY

SEQ ID NO: 3278224 - protein, 37 aa, Plasmodium falciparum
YHYYAHRIYELMPKLSFSTCKKVYMYLDDVKPHVLNE

SEQ ID NO: 3278225 - protein, 19 aa, Plasmodium falciparum
YIADFKVPRNIYFVNNFLK

SEQ ID NO: 3278226 - protein, 24 aa, Plasmodium falciparum
YIALKCLSNLFILHPEYSLLEYEY

SEQ ID NO: 3278227 - protein, 17 aa, Plasmodium falciparum
YICAKCRLEMKLSNNPY

SEQ ID NO: 3278228 - protein, 18 aa, Plasmodium falciparum
YICEPYIINKKICLTHHS

SEQ ID NO: 3278229 - protein, 17 aa, Plasmodium falciparum
YICFLKILNKPLSMNEV

SEQ ID NO: 3278230 - protein, 22 aa, Plasmodium falciparum
YICIFICSVMLFFFSYFHMSAL

SEQ ID NO: 3278231 - protein, 18 aa, Plasmodium falciparum
YICIPKINDFNFFKEENK

SEQ ID NO: 3278232 - protein, 25 aa, Plasmodium falciparum
YICNEGKTWMVIYKPAYYHCSAYTS

SEQ ID NO: 3278233 - protein, 25 aa, Plasmodium falciparum
YICNKLLFIYFCLKNYHHYNDSFDI

SEQ ID NO: 3278234 - protein, 17 aa, Plasmodium falciparum
YICNNNMNMCYSNNNNN

SEQ ID NO: 3278235 - protein, 21 aa, Plasmodium falciparum
YIDEIILQLSIEKEYKKKNIM

SEQ ID NO: 3278236 - protein, 24 aa, Plasmodium falciparum
YIDELKAGVSFASILGEESAHTTE

SEQ ID NO: 3278237 - protein, 17 aa, Plasmodium falciparum
YIDGEICHDLFLLLGKY

SEQ ID NO: 3278238 - protein, 18 aa, Plasmodium falciparum
YIDIVKYLVNQGANINVE

SEQ ID NO: 3278239 - protein, 22 aa, Plasmodium falciparum
YIDKIYIYRIIKQIQKNVNKNG

SEQ ID NO: 3278240 - protein, 24 aa, Plasmodium falciparum
YIDKNVKCKIGLEVHIQLSTKYKA

SEQ ID NO: 3278241 - protein, 18 aa, Plasmodium falciparum
YIDNFKHNSISNHNNNNN

SEQ ID NO: 3278242 - protein, 17 aa, Plasmodium falciparum
YIDSLFINRNFKDIFLD

SEQ ID NO: 3278243 - protein, 26 aa, Plasmodium falciparum
YIDSYALCMVIKYLLKTNIDDINLIY

SEQ ID NO: 3278244 - protein, 18 aa, Plasmodium falciparum
YIEKEIFLLEDINNNVNI

SEQ ID NO: 3278245 - protein, 20 aa, Plasmodium falciparum
YIEMKEDWVRNEYKYLSSIK

SEQ ID NO: 3278246 - protein, 18 aa, Plasmodium falciparum
YIFETICYINISTDLMKS

SEQ ID NO: 3278247 - protein, 20 aa, Plasmodium falciparum
YIFGPTIYNLECKFLEKLKK

SEQ ID NO: 3278248 - protein, 17 aa, Plasmodium falciparum
YIFHNIEDIFDCLYRIF

SEQ ID NO: 3278249 - protein, 24 aa, Plasmodium falciparum
YIFIKIVYFFHIHKLYTFPIYKDE

SEQ ID NO: 3278250 - protein, 25 aa, Plasmodium falciparum
YIFLCCYKLRNMFLWDKEKIKIYDN

SEQ ID NO: 3278251 - protein, 17 aa, Plasmodium falciparum
YIFLEICTNNMNKEQYS

SEQ ID NO: 3278252 - protein, 24 aa, Plasmodium falciparum
YIFPACFLFFSLIEFVVLYFKIEK

SEQ ID NO: 3278253 - protein, 20 aa, Plasmodium falciparum
YIFPNINYLRLSEMLYEQKK

SEQ ID NO: 3278254 - protein, 17 aa, Plasmodium falciparum
YIFPSCNKINVKEVISK

SEQ ID NO: 3278255 - protein, 23 aa, Plasmodium falciparum
YIFPTMDFNYLFDFNSFNFTNKY

SEQ ID NO: 3278256 - protein, 17 aa, Plasmodium falciparum
YIFQSAVYHSYYFLTIF

SEQ ID NO: 3278257 - protein, 25 aa, Plasmodium falciparum
YIFSHANCITFMYISRFVNGLCQAI

SEQ ID NO: 3278258 - protein, 17 aa, Plasmodium falciparum
YIFTGKFPFDVITYKLR

SEQ ID NO: 3278259 - protein, 31 aa, Plasmodium falciparum
YIFVYKFKGLCFLFVPVCNNFYLLFYHFFFH

SEQ ID NO: 3278260 - protein, 18 aa, Plasmodium falciparum
YIGLFLFFHGYIIYELED

SEQ ID NO: 3278261 - protein, 29 aa, Plasmodium falciparum
YIGNSFIATDFFDRWGRYLYATERFNEIF

SEQ ID NO: 3278262 - protein, 30 aa, Plasmodium falciparum
YIGSAMHLVCLVFYVYIFKVIVNHLLTNKE

SEQ ID NO: 3278263 - protein, 51 aa, Plasmodium falciparum
YIGTLRILLILLHDFPEFLASYYVTLCSIFPINFIQLRNLVLSAFPRNIKL

SEQ ID NO: 3278264 - protein, 17 aa, Plasmodium falciparum
YIHGFHIFGESKKKKII

SEQ ID NO: 3278265 - protein, 29 aa, Plasmodium falciparum
YIHKNCKIIMKLGFFFDKVMNISINQWLR

SEQ ID NO: 3278266 - protein, 33 aa, Plasmodium falciparum
YIHKYFLKKKINIYEYIILLSYLFYKKSKYLGI

SEQ ID NO: 3278267 - protein, 18 aa, Plasmodium falciparum
YIHLIWNIYNVRTLYTER

SEQ ID NO: 3278268 - protein, 19 aa, Plasmodium falciparum
YIHMIYKKLMCHNNKMCMD

SEQ ID NO: 3278269 - protein, 22 aa, Plasmodium falciparum
YIHMKCFKKVYAHIKNKLLLNA

SEQ ID NO: 3278270 - protein, 24 aa, Plasmodium falciparum
YIHNLYKICYFFILSKKLITNVEF

SEQ ID NO: 3278271 - protein, 18 aa, Plasmodium falciparum
YIHSDMLYNYRVVQNDLY

SEQ ID NO: 3278272 - protein, 29 aa, Plasmodium falciparum
YIHSECLKWSLNCTQCCYEENKNKTIVNN

SEQ ID NO: 3278273 - protein, 18 aa, Plasmodium falciparum
YIICGTNYDIKEMLLCIK

SEQ ID NO: 3278274 - protein, 19 aa, Plasmodium falciparum
YIICVIFIINVIRTRGEED

SEQ ID NO: 3278275 - protein, 18 aa, Plasmodium falciparum
YIIDNCEEFEKICFNDQG

SEQ ID NO: 3278276 - protein, 18 aa, Plasmodium falciparum
YIIEIQRRLAFHSWNKQI

SEQ ID NO: 3278277 - protein, 25 aa, Plasmodium falciparum
YIIEIWFKRMMDELEKAQGNLGKSS

SEQ ID NO: 3278278 - protein, 21 aa, Plasmodium falciparum
YIIFICISILMYLKKYLINIT

SEQ ID NO: 3278279 - protein, 17 aa, Plasmodium falciparum
YIIFLFYNYHLLIEKEK

SEQ ID NO: 3278280 - protein, 28 aa, Plasmodium falciparum
YIIGVLKYKIIYMLSEVYFLLECKYSKK

SEQ ID NO: 3278281 - protein, 20 aa, Plasmodium falciparum
YIIHDFLKWFENVHFEVPKV

SEQ ID NO: 3278282 - protein, 23 aa, Plasmodium falciparum
YIIIKCYYYLLTHSIKHEKWKIK

SEQ ID NO: 3278283 - protein, 23 aa, Plasmodium falciparum
YIIKEAMCVIKLHDQIIDIKYLN

SEQ ID NO: 3278284 - protein, 25 aa, Plasmodium falciparum
YIIKELKKLSSILPLLVDLNNECIF

SEQ ID NO: 3278285 - protein, 23 aa, Plasmodium falciparum
YIIKLKENYIKKCVLVDNQNIMI

SEQ ID NO: 3278286 - protein, 26 aa, Plasmodium falciparum
YIIKLSYLKKIYCILNLLDSTNLEHL

SEQ ID NO: 3278287 - protein, 19 aa, Plasmodium falciparum
YIIKSTINYYNHRKSNMPL

SEQ ID NO: 3278288 - protein, 28 aa, Plasmodium falciparum
YIIKTHYYKCIFDYIYLEKNIHDVEKTD

SEQ ID NO: 3278289 - protein, 18 aa, Plasmodium falciparum
YIILFILFCSYYINGRGV

SEQ ID NO: 3278290 - protein, 21 aa, Plasmodium falciparum
YIILPEHHWTILAVINLTHIN

SEQ ID NO: 3278291 - protein, 26 aa, Plasmodium falciparum
YIILSRKDLIYNIIVMVHMMVLDQFK

SEQ ID NO: 3278292 - protein, 22 aa, Plasmodium falciparum
YIINIKFKYDVIQAHKLNLLRG

SEQ ID NO: 3278293 - protein, 21 aa, Plasmodium falciparum
YIINTFVRFFLEKKLQETTVE

SEQ ID NO: 3278294 - protein, 17 aa, Plasmodium falciparum
YIIPKISNFLLNFSDSY

SEQ ID NO: 3278295 - protein, 18 aa, Plasmodium falciparum
YIISIKITIKNNMNVMEN

SEQ ID NO: 3278296 - protein, 30 aa, Plasmodium falciparum
YIITCLSGLFIKGINNILCLIITENINAKY

SEQ ID NO: 3278297 - protein, 18 aa, Plasmodium falciparum
YIIVRGSIPVLWKQQPTL

SEQ ID NO: 3278298 - protein, 17 aa, Plasmodium falciparum
YIIYIILLFNHIKKENN

SEQ ID NO: 3278299 - protein, 18 aa, Plasmodium falciparum
YIKAERDFQNSLYKLNDK

SEQ ID NO: 3278300 - protein, 27 aa, Plasmodium falciparum
YIKIILKVFMNTCFYFINIIKYENFHM

SEQ ID NO: 3278301 - protein, 19 aa, Plasmodium falciparum
YIKKKICNIQDEIDVNGNN

SEQ ID NO: 3278302 - protein, 20 aa, Plasmodium falciparum
YIKLKKRISSILNKDNKNEL

SEQ ID NO: 3278303 - protein, 24 aa, Plasmodium falciparum
YIKMKKKSAAVLLNSEYDMEKLHD

SEQ ID NO: 3278304 - protein, 20 aa, Plasmodium falciparum
YIKMSIYINMFLNKYYTYIN

SEQ ID NO: 3278305 - protein, 23 aa, Plasmodium falciparum
YIKNNLCELQKCFINLENKIERN

SEQ ID NO: 3278306 - protein, 22 aa, Plasmodium falciparum
YIKNTYIYYNTFFKYVKYFITK

SEQ ID NO: 3278307 - protein, 21 aa, Plasmodium falciparum
YIKPEINVLYILTKSDKKDKY

SEQ ID NO: 3278308 - protein, 17 aa, Plasmodium falciparum
YIKRIIEIYMERVNKIQ

SEQ ID NO: 3278309 - protein, 18 aa, Plasmodium falciparum
YIKRKRYIHMYKNTNDYN

SEQ ID NO: 3278310 - protein, 22 aa, Plasmodium falciparum
YIKSHISMCLYYLSMLVYNINK

SEQ ID NO: 3278311 - protein, 22 aa, Plasmodium falciparum
YIKSLYQYFLLYSHYEDAYNKY

SEQ ID NO: 3278312 - protein, 18 aa, Plasmodium falciparum
YILCESLYNVVRRFFNFQ

SEQ ID NO: 3278313 - protein, 26 aa, Plasmodium falciparum
YILEIFKCICRFIMSVDIFILIPEGI

SEQ ID NO: 3278314 - protein, 17 aa, Plasmodium falciparum
YILELSFSSGTLLRDVN

SEQ ID NO: 3278315 - protein, 28 aa, Plasmodium falciparum
YILEVWIYNLICLFIKTRRNSLLENETR

SEQ ID NO: 3278316 - protein, 32 aa, Plasmodium falciparum
YILFEYNKLILLLCLFDIYIFIHFFFNNSQSF

SEQ ID NO: 3278317 - protein, 18 aa, Plasmodium falciparum
YILHEHLQNCIITYNTFQ

SEQ ID NO: 3278318 - protein, 17 aa, Plasmodium falciparum
YILHIYDLISSYMDSPE

SEQ ID NO: 3278319 - protein, 25 aa, Plasmodium falciparum
YILKHLFKKMWVENGDIISTHYTGT

SEQ ID NO: 3278320 - protein, 22 aa, Plasmodium falciparum
YILKNIICSILYKHSNKIYYAQ

SEQ ID NO: 3278321 - protein, 18 aa, Plasmodium falciparum
YILLCIFMGFFYAVGYGI

SEQ ID NO: 3278322 - protein, 31 aa, Plasmodium falciparum
YILLFFCILSFILMCVYYFRTPCESCDVFNR

SEQ ID NO: 3278323 - protein, 17 aa, Plasmodium falciparum
YILLKIDSFCCIFNSFK

SEQ ID NO: 3278324 - protein, 23 aa, Plasmodium falciparum
YILMYTLNVPILFNDNTFTQDSN

SEQ ID NO: 3278325 - protein, 25 aa, Plasmodium falciparum
YILRNIRIDNIFLLKNHFNLIYGLR

SEQ ID NO: 3278326 - protein, 25 aa, Plasmodium falciparum
YILRSICIYIIESQCFKFFHLNNYI

SEQ ID NO: 3278327 - protein, 17 aa, Plasmodium falciparum
YILSFWFLLNLLNTPFF

SEQ ID NO: 3278328 - protein, 19 aa, Plasmodium falciparum
YILSTLCFIIMKLIDKYET

SEQ ID NO: 3278329 - protein, 21 aa, Plasmodium falciparum
YILSTLCKLNIHDDYIYNKCV

SEQ ID NO: 3278330 - protein, 27 aa, Plasmodium falciparum
YIMKKRYITFYSIRALLYLIKKKKLFI

SEQ ID NO: 3278331 - protein, 32 aa, Plasmodium falciparum
YIMKLYNCIYIKYSKCECLFFFHIINQLNKEE

SEQ ID NO: 3278332 - protein, 25 aa, Plasmodium falciparum
YIMKPDCGSMGIGVKIINKYNDINI

SEQ ID NO: 3278333 - protein, 18 aa, Plasmodium falciparum
YIMLICLIFSILQDDGNY

SEQ ID NO: 3278334 - protein, 19 aa, Plasmodium falciparum
YIMNEILNILYIYPQLYVS

SEQ ID NO: 3278335 - protein, 25 aa, Plasmodium falciparum
YIMYHKSEILNYVFSFLQIQKVSHE

SEQ ID NO: 3278336 - protein, 19 aa, Plasmodium falciparum
YINCIIKVDILLIEMDNGN

SEQ ID NO: 3278337 - protein, 27 aa, Plasmodium falciparum
YINEILCGCILCLTMLPEMISFCMIAK

SEQ ID NO: 3278338 - protein, 18 aa, Plasmodium falciparum
YINFKKILSFCLYNLYTD

SEQ ID NO: 3278339 - protein, 26 aa, Plasmodium falciparum
YINFLNYRMDIFYQYMNIFVNKKKNI

SEQ ID NO: 3278340 - protein, 18 aa, Plasmodium falciparum
YINICNINDIFFISIENI

SEQ ID NO: 3278341 - protein, 21 aa, Plasmodium falciparum
YINILLSFLIYVYKFKICNFV

SEQ ID NO: 3278342 - protein, 30 aa, Plasmodium falciparum
YINKLYWIWTDNFFRYLRIKTYIYENEEIY

SEQ ID NO: 3278343 - protein, 20 aa, Plasmodium falciparum
YINKWVLKLLDTHSSKEEKE

SEQ ID NO: 3278344 - protein, 19 aa, Plasmodium falciparum
YINKYRMDNIYNYNDIIKN

SEQ ID NO: 3278345 - protein, 19 aa, Plasmodium falciparum
YINLFICIIENFRNFLYFL

SEQ ID NO: 3278346 - protein, 17 aa, Plasmodium falciparum
YINNFFNIFCSIMDNIF

SEQ ID NO: 3278347 - protein, 37 aa, Plasmodium falciparum
YINNFRISYFFKWLINIWASLYIKIFILLLTTYIIMH

SEQ ID NO: 3278348 - protein, 30 aa, Plasmodium falciparum
YINNLWRTYKMCISCKNNLKSCICCEKKIM

SEQ ID NO: 3278349 - protein, 22 aa, Plasmodium falciparum
YINVYCPYVLKKHNWLYKSIDN

SEQ ID NO: 3278350 - protein, 24 aa, Plasmodium falciparum
YINYIVKYIHTFLKNLIINISNTN

SEQ ID NO: 3278351 - protein, 18 aa, Plasmodium falciparum
YINYPIKMFDNLYLGNII

SEQ ID NO: 3278352 - protein, 25 aa, Plasmodium falciparum
YIPECLTNYLSFIFKHFKNYITNIE

SEQ ID NO: 3278353 - protein, 17 aa, Plasmodium falciparum
YIPGKSIETNCSKENMV

SEQ ID NO: 3278354 - protein, 19 aa, Plasmodium falciparum
YIPNFILNIISLCIKHLKN

SEQ ID NO: 3278355 - protein, 17 aa, Plasmodium falciparum
YIPNISSYILNFISIYD

SEQ ID NO: 3278356 - protein, 31 aa, Plasmodium falciparum
YIPNLNMRIGLHYGSCVGGVIGSGRLRYDLW

SEQ ID NO: 3278357 - protein, 17 aa, Plasmodium falciparum
YIQNCIQSSITWNTYLK

SEQ ID NO: 3278358 - protein, 21 aa, Plasmodium falciparum
YIRCFKKYSLYKEFKKHEIRK

SEQ ID NO: 3278359 - protein, 21 aa, Plasmodium falciparum
YIRFFCIFLFIFGITSFFLCS

SEQ ID NO: 3278360 - protein, 17 aa, Plasmodium falciparum
YIRKCYNNNYIMNKDII

SEQ ID NO: 3278361 - protein, 25 aa, Plasmodium falciparum
YIRKKTILCFYKLVISNLSILHTFF

SEQ ID NO: 3278362 - protein, 21 aa, Plasmodium falciparum
YIRLMWLSIYMFLRYYVSEDC

SEQ ID NO: 3278363 - protein, 22 aa, Plasmodium falciparum
YIRLYYLYKEFQIFKKTNNDIQ

SEQ ID NO: 3278364 - protein, 19 aa, Plasmodium falciparum
YIRRCAKNIKLLNYQHFRF

SEQ ID NO: 3278365 - protein, 19 aa, Plasmodium falciparum
YIRRMYRSLISLKPRGFII

SEQ ID NO: 3278366 - protein, 21 aa, Plasmodium falciparum
YISDIKFCYDYFFNTQNVQNK

SEQ ID NO: 3278367 - protein, 24 aa, Plasmodium falciparum
YISDILECFNFCAKKKARIINASF

SEQ ID NO: 3278368 - protein, 26 aa, Plasmodium falciparum
YISFGCVSAGLTFMLKYILRNIRIDN

SEQ ID NO: 3278369 - protein, 18 aa, Plasmodium falciparum
YISGFLFSSRALCKLENY

SEQ ID NO: 3278370 - protein, 24 aa, Plasmodium falciparum
YISGYRVNKLLSFVNFNKRIHTLR

SEQ ID NO: 3278371 - protein, 26 aa, Plasmodium falciparum
YISHLCIYNTIYPYRKDFFDKLNDQE

SEQ ID NO: 3278372 - protein, 17 aa, Plasmodium falciparum
YISLFFEKFFIFYQRMI

SEQ ID NO: 3278373 - protein, 18 aa, Plasmodium falciparum
YISLLGNLSMNFKNIKDE

SEQ ID NO: 3278374 - protein, 27 aa, Plasmodium falciparum
YISSCFILFDLCFSFHLLKMKYKNHMN

SEQ ID NO: 3278375 - protein, 28 aa, Plasmodium falciparum
YISSFLFLYKVVHPFEQNGIQPWVLSNS

SEQ ID NO: 3278376 - protein, 24 aa, Plasmodium falciparum
YISSRNNKCFLFFQSKKNLILLFV

SEQ ID NO: 3278377 - protein, 24 aa, Plasmodium falciparum
YISSSLKFLFIFIYALFMKIYNLV

SEQ ID NO: 3278378 - protein, 24 aa, Plasmodium falciparum
YISTLKIIFINTFMLIKNNHYKLI

SEQ ID NO: 3278379 - protein, 18 aa, Plasmodium falciparum
YISYDMSYMIYKNHILNE

SEQ ID NO: 3278380 - protein, 27 aa, Plasmodium falciparum
YISYELSSYISFCLYFLKKIILNNDKL

SEQ ID NO: 3278381 - protein, 23 aa, Plasmodium falciparum
YITCSEFFIYYIIKHYKDISSSI

SEQ ID NO: 3278382 - protein, 18 aa, Plasmodium falciparum
YITDGKCDSLLYTNDDTF

SEQ ID NO: 3278383 - protein, 17 aa, Plasmodium falciparum
YITIRGKGSHDARNELD

SEQ ID NO: 3278384 - protein, 24 aa, Plasmodium falciparum
YITNFRFMLVILLDYILKCGITFF

SEQ ID NO: 3278385 - protein, 17 aa, Plasmodium falciparum
YITRISKYMYFQKIYTN

SEQ ID NO: 3278386 - protein, 28 aa, Plasmodium falciparum
YITTTIFIKFLREFGIIPHFFNNDRCLS

SEQ ID NO: 3278387 - protein, 17 aa, Plasmodium falciparum
YIVCGLKGDNGQKVNEK

SEQ ID NO: 3278388 - protein, 22 aa, Plasmodium falciparum
YIWDLYCDWGLLKEYNHLLRKN

SEQ ID NO: 3278389 - protein, 19 aa, Plasmodium falciparum
YIWLIFSFFQFPIIYVPTL

SEQ ID NO: 3278390 - protein, 20 aa, Plasmodium falciparum
YIWLYRRRKHSWKHECKKHL

SEQ ID NO: 3278391 - protein, 20 aa, Plasmodium falciparum
YIWMRKRRKRSWKHEYKKHL

SEQ ID NO: 3278392 - protein, 18 aa, Plasmodium falciparum
YIWNGMICALTYEEKTSG

SEQ ID NO: 3278393 - protein, 17 aa, Plasmodium falciparum
YIWNGMICALTYTDSEK

SEQ ID NO: 3278394 - protein, 19 aa, Plasmodium falciparum
YIYELNMLEDFILIIINLY

SEQ ID NO: 3278395 - protein, 22 aa, Plasmodium falciparum
YIYFCSFCYNFITTQNSFYKKF

SEQ ID NO: 3278396 - protein, 18 aa, Plasmodium falciparum
YIYFFVIFYSLNLNNKNE

SEQ ID NO: 3278397 - protein, 23 aa, Plasmodium falciparum
YIYFIIDILLYFLVISKGKYMHY

SEQ ID NO: 3278398 - protein, 18 aa, Plasmodium falciparum
YIYFPFIIINLLELVWCQ

SEQ ID NO: 3278399 - protein, 17 aa, Plasmodium falciparum
YIYIITCVKITQRELRK

SEQ ID NO: 3278400 - protein, 25 aa, Plasmodium falciparum
YIYKCDHSNHFACTNLCYVCDYESA

SEQ ID NO: 3278401 - protein, 18 aa, Plasmodium falciparum
YIYKEHFVLYFFKLNLYE

SEQ ID NO: 3278402 - protein, 19 aa, Plasmodium falciparum
YIYKNSYSSLNFVKNFVLH

SEQ ID NO: 3278403 - protein, 19 aa, Plasmodium falciparum
YIYKSFKVMPYSCKCNTPI

SEQ ID NO: 3278404 - protein, 17 aa, Plasmodium falciparum
YIYMYIIFFFLCIYVEK

SEQ ID NO: 3278405 - protein, 25 aa, Plasmodium falciparum
YIYNIRRIKIINSFKQFDLYYFYVY

SEQ ID NO: 3278406 - protein, 26 aa, Plasmodium falciparum
YIYNLKRLFDFLNISYIQFICKNKKN

SEQ ID NO: 3278407 - protein, 20 aa, Plasmodium falciparum
YIYNNCCIDILLLSLCKNND

SEQ ID NO: 3278408 - protein, 17 aa, Plasmodium falciparum
YIYSFIHISALWKEIKI

SEQ ID NO: 3278409 - protein, 18 aa, Plasmodium falciparum
YIYSLRFIENKAISEYMD

SEQ ID NO: 3278410 - protein, 17 aa, Plasmodium falciparum
YIYSYPLLNYNITYLQY

SEQ ID NO: 3278411 - protein, 25 aa, Plasmodium falciparum
YIYTQCLYKLKSYEKCIGYMEKYLN

SEQ ID NO: 3278412 - protein, 26 aa, Plasmodium falciparum
YIYWNIFELNLFFFLVGIPKEILEIF

SEQ ID NO: 3278413 - protein, 25 aa, Plasmodium falciparum
YIYYKWKGIMNYLFMYFDKIKNRKI

SEQ ID NO: 3278414 - protein, 29 aa, Plasmodium falciparum
YIYYRDILFLLKFVFTLNFCENTKYKFLK

SEQ ID NO: 3278415 - protein, 25 aa, Plasmodium falciparum
YKAFANFFADFSFHFDENYIYDILY

SEQ ID NO: 3278416 - protein, 17 aa, Plasmodium falciparum
YKAKDDMFCLNYRCKRK

SEQ ID NO: 3278417 - protein, 22 aa, Plasmodium falciparum
YKAMSLISHINKYILFLMKKEY

SEQ ID NO: 3278418 - protein, 31 aa, Plasmodium falciparum
YKANCPKGIRIPIMRYFYGLIFLMAFVPITQ

SEQ ID NO: 3278419 - protein, 22 aa, Plasmodium falciparum
YKATELYKLLNYIYDDKKKKKI

SEQ ID NO: 3278420 - protein, 20 aa, Plasmodium falciparum
YKCKLFTDMCIFKNIKYICL

SEQ ID NO: 3278421 - protein, 28 aa, Plasmodium falciparum
YKCKNILILHIFNFLLILLFTENICINK

SEQ ID NO: 3278422 - protein, 17 aa, Plasmodium falciparum
YKCLCYSSTCNFTKHRK

SEQ ID NO: 3278423 - protein, 18 aa, Plasmodium falciparum
YKCLSINHIYPFIFLNKY

SEQ ID NO: 3278424 - protein, 19 aa, Plasmodium falciparum
YKCSFTMKNKNNFYINYFF

SEQ ID NO: 3278425 - protein, 22 aa, Plasmodium falciparum
YKDESFLFFFLQHKNTFNQIFE

SEQ ID NO: 3278426 - protein, 21 aa, Plasmodium falciparum
YKDFLEKGVHYFEDINNILKG

SEQ ID NO: 3278427 - protein, 24 aa, Plasmodium falciparum
YKDFLKSKLFYKSINYTNFQTRNI

SEQ ID NO: 3278428 - protein, 20 aa, Plasmodium falciparum
YKDFLNKECFATLPSSYSKL

SEQ ID NO: 3278429 - protein, 17 aa, Plasmodium falciparum
YKDKIWLKLPYHFRLYL

SEQ ID NO: 3278430 - protein, 18 aa, Plasmodium falciparum
YKDMKPPPGLEYLNPLIW

SEQ ID NO: 3278431 - protein, 22 aa, Plasmodium falciparum
YKDNLNFFFNLKMIKRKKKNVD

SEQ ID NO: 3278432 - protein, 22 aa, Plasmodium falciparum
YKDSFIFVIHILYKVFYLNNIL

SEQ ID NO: 3278433 - protein, 21 aa, Plasmodium falciparum
YKDSVEFSSKVLGIYVQLQSK

SEQ ID NO: 3278434 - protein, 18 aa, Plasmodium falciparum
YKDVDEIRLLASSVDSIL

SEQ ID NO: 3278435 - protein, 22 aa, Plasmodium falciparum
YKECNYKLFFFIIQLQQKIKDL

SEQ ID NO: 3278436 - protein, 28 aa, Plasmodium falciparum
YKEFYKINCNTGAMGLLYFKNEQCAMDF

SEQ ID NO: 3278437 - protein, 17 aa, Plasmodium falciparum
YKEGQYLNKGEKYINNI

SEQ ID NO: 3278438 - protein, 18 aa, Plasmodium falciparum
YKEKCYIKYETPKFLLDR

SEQ ID NO: 3278439 - protein, 24 aa, Plasmodium falciparum
YKEKEFFYNLKYEVVEYYKYAENN

SEQ ID NO: 3278440 - protein, 17 aa, Plasmodium falciparum
YKELIILLYSYSYVNFR

SEQ ID NO: 3278441 - protein, 17 aa, Plasmodium falciparum
YKELKLSDRRFKEVTKY

SEQ ID NO: 3278442 - protein, 21 aa, Plasmodium falciparum
YKEMMFKGILGNMVYEKSGSK

SEQ ID NO: 3278443 - protein, 18 aa, Plasmodium falciparum
YKEQLLIKKRIIINNEIV

SEQ ID NO: 3278444 - protein, 17 aa, Plasmodium falciparum
YKESFSLNQVMKNIKVK

SEQ ID NO: 3278445 - protein, 19 aa, Plasmodium falciparum
YKEYKIFINNLIFKKLKNK

SEQ ID NO: 3278446 - protein, 17 aa, Plasmodium falciparum
YKFEYIKNMYIIPPYNK

SEQ ID NO: 3278447 - protein, 19 aa, Plasmodium falciparum
YKFFFYKKNIDIFEQLLCT

SEQ ID NO: 3278448 - protein, 17 aa, Plasmodium falciparum
YKFISFIKTIEDVKEKW

SEQ ID NO: 3278449 - protein, 18 aa, Plasmodium falciparum
YKFLKRRENTYKKKYKDM

SEQ ID NO: 3278450 - protein, 20 aa, Plasmodium falciparum
YKFNIFNVLLYYLFNETYFY

SEQ ID NO: 3278451 - protein, 20 aa, Plasmodium falciparum
YKGDKVYAGSKCVEGVVIIY

SEQ ID NO: 3278452 - protein, 28 aa, Plasmodium falciparum
YKGFKQIKWTKCYDMLISLSNVGNNILV

SEQ ID NO: 3278453 - protein, 19 aa, Plasmodium falciparum
YKGIPMVSLTSHFLFESKK

SEQ ID NO: 3278454 - protein, 20 aa, Plasmodium falciparum
YKGKAWDVFFNKLKILNLSL

SEQ ID NO: 3278455 - protein, 17 aa, Plasmodium falciparum
YKGMEIISGSQRIHNLP

SEQ ID NO: 3278456 - protein, 23 aa, Plasmodium falciparum
YKGQQKFSQFKCFGFADRDELKE

SEQ ID NO: 3278457 - protein, 17 aa, Plasmodium falciparum
YKGTCDFSVNKKKNDNI

SEQ ID NO: 3278458 - protein, 20 aa, Plasmodium falciparum
YKGYDFLNNKTHFIYSYVYK

SEQ ID NO: 3278459 - protein, 18 aa, Plasmodium falciparum
YKHFACIQSNINDMDHTK

SEQ ID NO: 3278460 - protein, 26 aa, Plasmodium falciparum
YKHIICGPYMSLSWIIHDAYLKKYPL

SEQ ID NO: 3278461 - protein, 19 aa, Plasmodium falciparum
YKHSISYFLKMKNKKYIID

SEQ ID NO: 3278462 - protein, 20 aa, Plasmodium falciparum
YKHVYISTFLQRYKTLLHIT

SEQ ID NO: 3278463 - protein, 17 aa, Plasmodium falciparum
YKHYDNMNLIDLISYNN

SEQ ID NO: 3278464 - protein, 18 aa, Plasmodium falciparum
YKHYNYREPLKRSISLQQ

SEQ ID NO: 3278465 - protein, 17 aa, Plasmodium falciparum
YKIDECLNMLCKNDNSY

SEQ ID NO: 3278466 - protein, 21 aa, Plasmodium falciparum
YKIEFLEICIKEFFKERKIDG

SEQ ID NO: 3278467 - protein, 18 aa, Plasmodium falciparum
YKIILKLFIHNNLQKADE

SEQ ID NO: 3278468 - protein, 23 aa, Plasmodium falciparum
YKIKDVLNVIKFIQKRNYIVDTS

SEQ ID NO: 3278469 - protein, 21 aa, Plasmodium falciparum
YKIKENILIQICRHIIEHFST

SEQ ID NO: 3278470 - protein, 26 aa, Plasmodium falciparum
YKIKFPAAFLNIHFVTIVQYMYMNYN

SEQ ID NO: 3278471 - protein, 24 aa, Plasmodium falciparum
YKIKTRIILCKRCYRLQHYKSTDL

SEQ ID NO: 3278472 - protein, 25 aa, Plasmodium falciparum
YKILKDIYFSMLYNMNNMKNCGIQY

SEQ ID NO: 3278473 - protein, 24 aa, Plasmodium falciparum
YKILRDLIILLGPIVPHLSEDIYY

SEQ ID NO: 3278474 - protein, 20 aa, Plasmodium falciparum
YKINEMYYIKSTLYFIDIYK

SEQ ID NO: 3278475 - protein, 23 aa, Plasmodium falciparum
YKINKKKVTIYLKLNEGLENIKQ

SEQ ID NO: 3278476 - protein, 26 aa, Plasmodium falciparum
YKINNSCFHLLLFFLPLSVPPFKSKI

SEQ ID NO: 3278477 - protein, 34 aa, Plasmodium falciparum
YKISLTCYERVEFLNCLKYIFSYNKEMYSFLRSV

SEQ ID NO: 3278478 - protein, 18 aa, Plasmodium falciparum
YKISPFYFCEIHFEENSG

SEQ ID NO: 3278479 - protein, 18 aa, Plasmodium falciparum
YKITLNIYFFLLLFLNNY

SEQ ID NO: 3278480 - protein, 20 aa, Plasmodium falciparum
YKITLNYFIYFVNAHISYSV

SEQ ID NO: 3278481 - protein, 18 aa, Plasmodium falciparum
YKITSLNYKYICTKNEIL

SEQ ID NO: 3278482 - protein, 30 aa, Plasmodium falciparum
YKIVIIKENIHSILISCLIFLFNNFLNEHE

SEQ ID NO: 3278483 - protein, 18 aa, Plasmodium falciparum
YKIYCETIIDILENKSDD

SEQ ID NO: 3278484 - protein, 24 aa, Plasmodium falciparum
YKIYIVNQICKYFIYLKLNLINEL

SEQ ID NO: 3278485 - protein, 17 aa, Plasmodium falciparum
YKIYLIKLTNVYNNNNN

SEQ ID NO: 3278486 - protein, 18 aa, Plasmodium falciparum
YKKAIRFFYNNIMSKYFN

SEQ ID NO: 3278487 - protein, 18 aa, Plasmodium falciparum
YKKDIMNFLKESIYFKYI

SEQ ID NO: 3278488 - protein, 19 aa, Plasmodium falciparum
YKKEEILSLFSKYEKKVKD

SEQ ID NO: 3278489 - protein, 18 aa, Plasmodium falciparum
YKKESFWCKGLEKQVNNK

SEQ ID NO: 3278490 - protein, 18 aa, Plasmodium falciparum
YKKEWALQKLAELQRNGD

SEQ ID NO: 3278491 - protein, 20 aa, Plasmodium falciparum
YKKFLLDNIEVIVNQIKSMM

SEQ ID NO: 3278492 - protein, 20 aa, Plasmodium falciparum
YKKFRNVPIIHFNRNNELIL

SEQ ID NO: 3278493 - protein, 31 aa, Plasmodium falciparum
YKKGCLPYFLVIEIFSVIILGFIYVTFLDTR

SEQ ID NO: 3278494 - protein, 18 aa, Plasmodium falciparum
YKKGNCFIHNKINYEKSR

SEQ ID NO: 3278495 - protein, 38 aa, Plasmodium falciparum
YKKIYFYDFFFIYLLRKLFWNIFSLYYIYLQKYNDRRE

SEQ ID NO: 3278496 - protein, 25 aa, Plasmodium falciparum
YKKIYKNAYINISYIKQFYTQIINI

SEQ ID NO: 3278497 - protein, 45 aa, Plasmodium falciparum
YKKIYYYKIKEGMLPFLCDHIFKCNYNLFYIFNRYNFQFNAYNIL

SEQ ID NO: 3278498 - protein, 20 aa, Plasmodium falciparum
YKKKGDIYIENAFPNILSNK

SEQ ID NO: 3278499 - protein, 23 aa, Plasmodium falciparum
YKKKKLKRALLLTNKTLIDLFPP

SEQ ID NO: 3278500 - protein, 22 aa, Plasmodium falciparum
YKKKKRISNNIMEPSYINDSSY

SEQ ID NO: 3278501 - protein, 18 aa, Plasmodium falciparum
YKKKNEWILKREDNAIYL

SEQ ID NO: 3278502 - protein, 25 aa, Plasmodium falciparum
YKKKNIYEGTKWNSDIYWTLSNVSF

SEQ ID NO: 3278503 - protein, 20 aa, Plasmodium falciparum
YKKKNIYGYNILRYNKRNII

SEQ ID NO: 3278504 - protein, 31 aa, Plasmodium falciparum
YKKKSQLIHIMFLTFFPFFKLYNLTDLLNNI

SEQ ID NO: 3278505 - protein, 20 aa, Plasmodium falciparum
YKKLEGLKKYFINNIKNIYI

SEQ ID NO: 3278506 - protein, 18 aa, Plasmodium falciparum
YKKLKIFEIPIIYFNTLP

SEQ ID NO: 3278507 - protein, 20 aa, Plasmodium falciparum
YKKLNFFSLLWKEDNIPCFI

SEQ ID NO: 3278508 - protein, 23 aa, Plasmodium falciparum
YKKMMKGKVWSYIKDGKYPNELY

SEQ ID NO: 3278509 - protein, 20 aa, Plasmodium falciparum
YKKNLGMKILRNKYYDDYYH

SEQ ID NO: 3278510 - protein, 20 aa, Plasmodium falciparum
YKKNRLSIILKELRKDKKNR

SEQ ID NO: 3278511 - protein, 29 aa, Plasmodium falciparum
YKKNYLMYIEFCKKCFINTYIKNKTSKKF

SEQ ID NO: 3278512 - protein, 17 aa, Plasmodium falciparum
YKKRANVVINNIVQCTN

SEQ ID NO: 3278513 - protein, 22 aa, Plasmodium falciparum
YKKSNPFLLYLIGHICNISCMI

SEQ ID NO: 3278514 - protein, 20 aa, Plasmodium falciparum
YKKTLQYGIEKDMTYIKNKL

SEQ ID NO: 3278515 - protein, 25 aa, Plasmodium falciparum
YKKTYRYIISFLLYFINILYAQKIW

SEQ ID NO: 3278516 - protein, 17 aa, Plasmodium falciparum
YKKVFIYDIMIEKNDMI

SEQ ID NO: 3278517 - protein, 18 aa, Plasmodium falciparum
YKKVLYLYKKIRRFNWNC

SEQ ID NO: 3278518 - protein, 26 aa, Plasmodium falciparum
YKKWISNCTTLFVLGLPFQMNEYNLL

SEQ ID NO: 3278519 - protein, 23 aa, Plasmodium falciparum
YKKWWQKHGHEIWEGMLCALSYN

SEQ ID NO: 3278520 - protein, 18 aa, Plasmodium falciparum
YKKYCLELEKSLEHYSAT

SEQ ID NO: 3278521 - protein, 27 aa, Plasmodium falciparum
YKKYKIKCYCMKDIINFIYKKSLNDEN

SEQ ID NO: 3278522 - protein, 26 aa, Plasmodium falciparum
YKLCKLCTSCYYNFFNFNERKEEIHN

SEQ ID NO: 3278523 - protein, 28 aa, Plasmodium falciparum
YKLCLEKGKELFPIFTAKQLVIFTEGMI

SEQ ID NO: 3278524 - protein, 18 aa, Plasmodium falciparum
YKLENIMSRSGSFDYKEW

SEQ ID NO: 3278525 - protein, 20 aa, Plasmodium falciparum
YKLENSFLYDMDDDGDNSLI

SEQ ID NO: 3278526 - protein, 23 aa, Plasmodium falciparum
YKLFKIICILLLIGLLLCVFQYI

SEQ ID NO: 3278527 - protein, 19 aa, Plasmodium falciparum
YKLIICICIPKLIFYMLLW

SEQ ID NO: 3278528 - protein, 19 aa, Plasmodium falciparum
YKLKILIEYLKIYQTYMKL

SEQ ID NO: 3278529 - protein, 35 aa, Plasmodium falciparum
YKLKYCYTCNIYRGIRTVHCSICDNCVEKFDHHCP

SEQ ID NO: 3278530 - protein, 34 aa, Plasmodium falciparum
YKLLVTRLKICLYYPHYFFLACLFNYKYDTNLSN

SEQ ID NO: 3278531 - protein, 18 aa, Plasmodium falciparum
YKLMHFIYYNNLYKKVDV

SEQ ID NO: 3278532 - protein, 21 aa, Plasmodium falciparum
YKLNNFELMHFLKNKTNSIPY

SEQ ID NO: 3278533 - protein, 17 aa, Plasmodium falciparum
YKLNSYIHIFDDEFFVI

SEQ ID NO: 3278534 - protein, 27 aa, Plasmodium falciparum
YKLPMDLKRDIVLLLKNIRSMDLCLNT

SEQ ID NO: 3278535 - protein, 17 aa, Plasmodium falciparum
YKLRCFSKKKLDHLKFH

SEQ ID NO: 3278536 - protein, 20 aa, Plasmodium falciparum
YKLSTFFFNCVYKMKRNIYN

SEQ ID NO: 3278537 - protein, 18 aa, Plasmodium falciparum
YKLVKLFKRKLKEKIEDK

SEQ ID NO: 3278538 - protein, 21 aa, Plasmodium falciparum
YKLYYDIYKGLDFTHVIHCTY

SEQ ID NO: 3278539 - protein, 17 aa, Plasmodium falciparum
YKMKRAFHYYIYNFDQF

SEQ ID NO: 3278540 - protein, 21 aa, Plasmodium falciparum
YKMKRAFVCKNMIKLRTNEKI

SEQ ID NO: 3278541 - protein, 23 aa, Plasmodium falciparum
YKMLNILISLYIEKVTDKKGNML

SEQ ID NO: 3278542 - protein, 19 aa, Plasmodium falciparum
YKMNLCIHTLKYVHVKLYK

SEQ ID NO: 3278543 - protein, 28 aa, Plasmodium falciparum
YKMQIDFFFFYHCLKHYIPCDDENVLFV

SEQ ID NO: 3278544 - protein, 31 aa, Plasmodium falciparum
YKMSDISFKCACKFLYTLGLLNIRNENYILI

SEQ ID NO: 3278545 - protein, 25 aa, Plasmodium falciparum
YKNACIFEKKGRVIIKNMFNMTNEY

SEQ ID NO: 3278546 - protein, 17 aa, Plasmodium falciparum
YKNAVGFQSNNFHNRNL

SEQ ID NO: 3278547 - protein, 17 aa, Plasmodium falciparum
YKNCSSNYVFLVNKRTP

SEQ ID NO: 3278548 - protein, 21 aa, Plasmodium falciparum
YKNDIFCLGLCFYYIIMMNED

SEQ ID NO: 3278549 - protein, 25 aa, Plasmodium falciparum
YKNDIRNGIFFNIFLLKDTYEEMFS

SEQ ID NO: 3278550 - protein, 20 aa, Plasmodium falciparum
YKNDKSLWKRFVNKMSEVNK

SEQ ID NO: 3278551 - protein, 20 aa, Plasmodium falciparum
YKNDVLLLRYKIYLRALLFP

SEQ ID NO: 3278552 - protein, 17 aa, Plasmodium falciparum
YKNEMYDFLNLQMNEEN

SEQ ID NO: 3278553 - protein, 30 aa, Plasmodium falciparum
YKNEPFFTIKRKKVIDLIYFFFVTKEKKAE

SEQ ID NO: 3278554 - protein, 25 aa, Plasmodium falciparum
YKNEYPYYFLFSLIYNFFFIPMIIV

SEQ ID NO: 3278555 - protein, 19 aa, Plasmodium falciparum
YKNFDCLMNLINRLKNNSI

SEQ ID NO: 3278556 - protein, 27 aa, Plasmodium falciparum
YKNFFWKEIITSLIWMIISILSVIKKI

SEQ ID NO: 3278557 - protein, 25 aa, Plasmodium falciparum
YKNFGESFIRIGFLLKKETSINKNN

SEQ ID NO: 3278558 - protein, 18 aa, Plasmodium falciparum
YKNFQGFFYEESHNFYPY

SEQ ID NO: 3278559 - protein, 26 aa, Plasmodium falciparum
YKNHKCKCLYFFAYAPTYLGKYYNHY

SEQ ID NO: 3278560 - protein, 21 aa, Plasmodium falciparum
YKNIFPVNYFIKYKNDDKLIN

SEQ ID NO: 3278561 - protein, 19 aa, Plasmodium falciparum
YKNIKCINKLLIHKYNDIH

SEQ ID NO: 3278562 - protein, 18 aa, Plasmodium falciparum
YKNILFFYYMIYKTFKKI

SEQ ID NO: 3278563 - protein, 29 aa, Plasmodium falciparum
YKNILNIYFHYSYFINFFEYLNSVSHLSL

SEQ ID NO: 3278564 - protein, 19 aa, Plasmodium falciparum
YKNINYISCNNMIEILVRN

SEQ ID NO: 3278565 - protein, 23 aa, Plasmodium falciparum
YKNIRFKDYFRIGNVNSLSNTYL

SEQ ID NO: 3278566 - protein, 20 aa, Plasmodium falciparum
YKNKCILNKFVLLKKIESEN

SEQ ID NO: 3278567 - protein, 22 aa, Plasmodium falciparum
YKNKELQNVPCIDTNQNFVLND

SEQ ID NO: 3278568 - protein, 23 aa, Plasmodium falciparum
YKNKHIYNKCNFYIIDYKQFHIL

SEQ ID NO: 3278569 - protein, 21 aa, Plasmodium falciparum
YKNKIIISAFFTFTLELFICL

SEQ ID NO: 3278570 - protein, 23 aa, Plasmodium falciparum
YKNKKCKGVEEMDFGMDMCEEEY

SEQ ID NO: 3278571 - protein, 17 aa, Plasmodium falciparum
YKNKLIISVFNKKIDIC

SEQ ID NO: 3278572 - protein, 17 aa, Plasmodium falciparum
YKNLKSIALTFFKDKNL

SEQ ID NO: 3278573 - protein, 17 aa, Plasmodium falciparum
YKNLLGIIFYLCGYILL

SEQ ID NO: 3278574 - protein, 18 aa, Plasmodium falciparum
YKNLVSLKEDEKWKEYFS

SEQ ID NO: 3278575 - protein, 17 aa, Plasmodium falciparum
YKNMMSHIYAHRNFLYI

SEQ ID NO: 3278576 - protein, 25 aa, Plasmodium falciparum
YKNNCYEYMKTVLYTEKIIKDNNSD

SEQ ID NO: 3278577 - protein, 18 aa, Plasmodium falciparum
YKNNYGFLYVNSKNIITY

SEQ ID NO: 3278578 - protein, 19 aa, Plasmodium falciparum
YKNSFFKKNHMKLIKDYLY

SEQ ID NO: 3278579 - protein, 21 aa, Plasmodium falciparum
YKNSLCGFLLKNISIVLYLLT

SEQ ID NO: 3278580 - protein, 21 aa, Plasmodium falciparum
YKNTFICLLQQILIKLNEFNI

SEQ ID NO: 3278581 - protein, 18 aa, Plasmodium falciparum
YKNTLFLYNLMKECKVYF

SEQ ID NO: 3278582 - protein, 20 aa, Plasmodium falciparum
YKNTRSLTFEKLHRKNNYLK

SEQ ID NO: 3278583 - protein, 17 aa, Plasmodium falciparum
YKNTYPIYDYHKDILNN

SEQ ID NO: 3278584 - protein, 21 aa, Plasmodium falciparum
YKNVEHILKIFSKFFVIPKLS

SEQ ID NO: 3278585 - protein, 17 aa, Plasmodium falciparum
YKNVFLTIINSMYVSIH

SEQ ID NO: 3278586 - protein, 26 aa, Plasmodium falciparum
YKNVYLCDNFYEFLCLDNITKYLYKL

SEQ ID NO: 3278587 - protein, 19 aa, Plasmodium falciparum
YKNYCKLFYEYTINKYRKI

SEQ ID NO: 3278588 - protein, 18 aa, Plasmodium falciparum
YKNYEHYIQYIVNKEKLN

SEQ ID NO: 3278589 - protein, 43 aa, Plasmodium falciparum
YKNYIICDKDIFKTIGRLCFSEIPYVLFLYMDCYKSLGRGDLV

SEQ ID NO: 3278590 - protein, 27 aa, Plasmodium falciparum
YKNYKRIICFVWIYKIIKNIHFLVSLY

SEQ ID NO: 3278591 - protein, 23 aa, Plasmodium falciparum
YKPEFNRCYQLLCSFPDESIVQV

SEQ ID NO: 3278592 - protein, 24 aa, Plasmodium falciparum
YKPHHICNILLYLTIYKDVYLMGV

SEQ ID NO: 3278593 - protein, 17 aa, Plasmodium falciparum
YKQDYKITLNIYFFLLL

SEQ ID NO: 3278594 - protein, 26 aa, Plasmodium falciparum
YKQGLNEVLALFFYLKGKHFNMVDVY

SEQ ID NO: 3278595 - protein, 21 aa, Plasmodium falciparum
YKQKWINTFPFYIIYQNDHFK

SEQ ID NO: 3278596 - protein, 19 aa, Plasmodium falciparum
YKQLDSALIRAKRFDKVIH

SEQ ID NO: 3278597 - protein, 18 aa, Plasmodium falciparum
YKQRFYLSYSDIKNNVDD

SEQ ID NO: 3278598 - protein, 27 aa, Plasmodium falciparum
YKREIALKCALLLKDIFICKKFNTFNE

SEQ ID NO: 3278599 - protein, 19 aa, Plasmodium falciparum
YKRFLRLDLPSIYLNEQGR

SEQ ID NO: 3278600 - protein, 28 aa, Plasmodium falciparum
YKRGEIIKRKICIKLIDFEYCQIIYDKN

SEQ ID NO: 3278601 - protein, 26 aa, Plasmodium falciparum
YKRKKLRPSLHLYNIIKKCNINIEIY

SEQ ID NO: 3278602 - protein, 47 aa, Plasmodium falciparum
YKRKLEDELILSIKINLLYSIHNLIKMFSHVYINDWNKVLYYYNEPI

SEQ ID NO: 3278603 - protein, 24 aa, Plasmodium falciparum
YKRLKKILSNLCSSREKIYDLSKE

SEQ ID NO: 3278604 - protein, 18 aa, Plasmodium falciparum
YKRRLQIFNNLRKNMNYY

SEQ ID NO: 3278605 - protein, 17 aa, Plasmodium falciparum
YKRYLVNNCKYIIIHDY

SEQ ID NO: 3278606 - protein, 23 aa, Plasmodium falciparum
YKSCLRPIYLGSFIVSLFLISSG

SEQ ID NO: 3278607 - protein, 18 aa, Plasmodium falciparum
YKSDSKFSYNKDFDNNIQ

SEQ ID NO: 3278608 - protein, 21 aa, Plasmodium falciparum
YKSFYNIFVKYVLRCTTAAPG

SEQ ID NO: 3278609 - protein, 17 aa, Plasmodium falciparum
YKSGVPYNIPNINMEDE

SEQ ID NO: 3278610 - protein, 23 aa, Plasmodium falciparum
YKSKISIYAVGWMKDERLYRSFE

SEQ ID NO: 3278611 - protein, 24 aa, Plasmodium falciparum
YKSKLELISDITFHSHKKKRRRQK

SEQ ID NO: 3278612 - protein, 26 aa, Plasmodium falciparum
YKSLLRRILRILFFYVNSVINSNDSK

SEQ ID NO: 3278613 - protein, 17 aa, Plasmodium falciparum
YKSRKKIFIIFKPLERH

SEQ ID NO: 3278614 - protein, 19 aa, Plasmodium falciparum
YKSSCFLYESLNTFFKINN

SEQ ID NO: 3278615 - protein, 18 aa, Plasmodium falciparum
YKSSSSWNSKAKKSSYIN

SEQ ID NO: 3278616 - protein, 17 aa, Plasmodium falciparum
YKSYYYILMYWKFIILR

SEQ ID NO: 3278617 - protein, 34 aa, Plasmodium falciparum
YKTDEDFYYKVKMNPSYFFLLYAIKKDYDKRNKN

SEQ ID NO: 3278618 - protein, 26 aa, Plasmodium falciparum
YKTEFNICIKEYILLLKSMDKLLDKR

SEQ ID NO: 3278619 - protein, 30 aa, Plasmodium falciparum
YKTFDLHKSYKLKFCRKENDTFKFVSLDNI

SEQ ID NO: 3278620 - protein, 18 aa, Plasmodium falciparum
YKTFRYCDSLNVLAKSYI

SEQ ID NO: 3278621 - protein, 18 aa, Plasmodium falciparum
YKTHINICEYKRCKNYIL

SEQ ID NO: 3278622 - protein, 20 aa, Plasmodium falciparum
YKTHMPRSNVNLIKLNKNSW

SEQ ID NO: 3278623 - protein, 17 aa, Plasmodium falciparum
YKTLELFLNKIKNNDEI

SEQ ID NO: 3278624 - protein, 22 aa, Plasmodium falciparum
YKTLHKNKCKMNNSFYYYKKRI

SEQ ID NO: 3278625 - protein, 17 aa, Plasmodium falciparum
YKTLIEVVLEPSKRDIP

SEQ ID NO: 3278626 - protein, 18 aa, Plasmodium falciparum
YKTLIKVLLKSSSKTYNK

SEQ ID NO: 3278627 - protein, 20 aa, Plasmodium falciparum
YKTTELFSLFMKEEQMLNIL

SEQ ID NO: 3278628 - protein, 25 aa, Plasmodium falciparum
YKVGASLDRNGLRPARYSITNYGLF

SEQ ID NO: 3278629 - protein, 18 aa, Plasmodium falciparum
YKVIKCIIKPTSFLYPDE

SEQ ID NO: 3278630 - protein, 20 aa, Plasmodium falciparum
YKVPSVLFVLYINFHKYLYH

SEQ ID NO: 3278631 - protein, 24 aa, Plasmodium falciparum
YKVSPILMCILNIVIPVLLTVFTY

SEQ ID NO: 3278632 - protein, 22 aa, Plasmodium falciparum
YKYFHKCLIRLLKEKMKKKKII

SEQ ID NO: 3278633 - protein, 18 aa, Plasmodium falciparum
YKYFHLVMKILFLHNYLL

SEQ ID NO: 3278634 - protein, 23 aa, Plasmodium falciparum
YKYFKNFEHRHCYINDSINILKI

SEQ ID NO: 3278635 - protein, 17 aa, Plasmodium falciparum
YKYFMKWIKNTKDIINT

SEQ ID NO: 3278636 - protein, 23 aa, Plasmodium falciparum
YKYFYNCFFCCGSYISLNEEEMF

SEQ ID NO: 3278637 - protein, 17 aa, Plasmodium falciparum
YKYGKFVPPYYKKKNLF

SEQ ID NO: 3278638 - protein, 20 aa, Plasmodium falciparum
YKYHCEEFFIYPQINKHLEK

SEQ ID NO: 3278639 - protein, 20 aa, Plasmodium falciparum
YKYHFLWENNYFNILKTNND

SEQ ID NO: 3278640 - protein, 19 aa, Plasmodium falciparum
YKYIDDFYDDINLPLMNLA

SEQ ID NO: 3278641 - protein, 25 aa, Plasmodium falciparum
YKYIFDIIMCILEQYIAHVNYYIYK

SEQ ID NO: 3278642 - protein, 18 aa, Plasmodium falciparum
YKYIGFILLIKLCSIFER

SEQ ID NO: 3278643 - protein, 17 aa, Plasmodium falciparum
YKYIIFTVLILANILYD

SEQ ID NO: 3278644 - protein, 24 aa, Plasmodium falciparum
YKYIKEFVNYIPITIKNINILLAL

SEQ ID NO: 3278645 - protein, 17 aa, Plasmodium falciparum
YKYIKILSKFSAKSVST

SEQ ID NO: 3278646 - protein, 17 aa, Plasmodium falciparum
YKYIKYLSFKTFKKIYS

SEQ ID NO: 3278647 - protein, 19 aa, Plasmodium falciparum
YKYINKYANTEFMKLNEFL

SEQ ID NO: 3278648 - protein, 24 aa, Plasmodium falciparum
YKYIYHEILTFFVFSNDNENCVIP

SEQ ID NO: 3278649 - protein, 19 aa, Plasmodium falciparum
YKYKEFLLSISSCIFFLYV

SEQ ID NO: 3278650 - protein, 21 aa, Plasmodium falciparum
YKYKKCFDCGKNYVLNSYGKV

SEQ ID NO: 3278651 - protein, 22 aa, Plasmodium falciparum
YKYLIINKFEFHTAGINISLKE

SEQ ID NO: 3278652 - protein, 31 aa, Plasmodium falciparum
YKYLKYFFFSNFYFYNPIFLFYYFSFISCTE

SEQ ID NO: 3278653 - protein, 25 aa, Plasmodium falciparum
YKYLKYFIEACIYFDIDYFIIQMYI

SEQ ID NO: 3278654 - protein, 18 aa, Plasmodium falciparum
YKYLNYILNEKIKDDVDN

SEQ ID NO: 3278655 - protein, 17 aa, Plasmodium falciparum
YKYMPIVGFSRSFEGAK

SEQ ID NO: 3278656 - protein, 19 aa, Plasmodium falciparum
YKYMWTYIYFLQKRIMMKK

SEQ ID NO: 3278657 - protein, 18 aa, Plasmodium falciparum
YKYNCNIISCPIYGDTEK

SEQ ID NO: 3278658 - protein, 25 aa, Plasmodium falciparum
YKYNCPVNVCKYHYNNTLVACGYYD

SEQ ID NO: 3278659 - protein, 17 aa, Plasmodium falciparum
YKYNELEGGGKEEEDGK

SEQ ID NO: 3278660 - protein, 23 aa, Plasmodium falciparum
YKYNIQYKRIFKHYKIPYNKHWE

SEQ ID NO: 3278661 - protein, 17 aa, Plasmodium falciparum
YKYSAITYMLLCNILNR

SEQ ID NO: 3278662 - protein, 27 aa, Plasmodium falciparum
YKYTMLKKEKKIISCIINVYSNDSVEN

SEQ ID NO: 3278663 - protein, 17 aa, Plasmodium falciparum
YKYVFPFFFNSTNKIIK

SEQ ID NO: 3278664 - protein, 19 aa, Plasmodium falciparum
YKYVWPISQFYIFNHIFFP

SEQ ID NO: 3278665 - protein, 32 aa, Plasmodium falciparum
YLAEPFDIYHLMFICKVFWYIFLYADNFVILR

SEQ ID NO: 3278666 - protein, 19 aa, Plasmodium falciparum
YLCECIGLLIPYMKDKQKI

SEQ ID NO: 3278667 - protein, 20 aa, Plasmodium falciparum
YLDILSLLYFLSRNNLKIKK

SEQ ID NO: 3278668 - protein, 23 aa, Plasmodium falciparum
YLDKIKINFIFNTIIQRIKQEYN

SEQ ID NO: 3278669 - protein, 20 aa, Plasmodium falciparum
YLDLIDMLKCFCLQTKMFFS

SEQ ID NO: 3278670 - protein, 25 aa, Plasmodium falciparum
YLDNSSFIDICFFSYIKDIMKLYIM

SEQ ID NO: 3278671 - protein, 19 aa, Plasmodium falciparum
YLDPHMVQIILTWLKENKV

SEQ ID NO: 3278672 - protein, 26 aa, Plasmodium falciparum
YLDYYFKRWYVTDIYNNLKLPDKIRY

SEQ ID NO: 3278673 - protein, 27 aa, Plasmodium falciparum
YLEKQQSAWPFLKPVSLSEAPDYYDII

SEQ ID NO: 3278674 - protein, 18 aa, Plasmodium falciparum
YLENVYLYSKKYFLSDKM

SEQ ID NO: 3278675 - protein, 20 aa, Plasmodium falciparum
YLERNHIYHILSDHITQDKI

SEQ ID NO: 3278676 - protein, 17 aa, Plasmodium falciparum
YLFAPMAGLAVWNILKS

SEQ ID NO: 3278677 - protein, 17 aa, Plasmodium falciparum
YLFEMFSKNIYELHEHK

SEQ ID NO: 3278678 - protein, 27 aa, Plasmodium falciparum
YLFERCPKYYLLFPFHLQIEGSSINEK

SEQ ID NO: 3278679 - protein, 18 aa, Plasmodium falciparum
YLFFFSLKVQEFSRFQIM

SEQ ID NO: 3278680 - protein, 18 aa, Plasmodium falciparum
YLFHNFDKVHLLKYKKEN

SEQ ID NO: 3278681 - protein, 24 aa, Plasmodium falciparum
YLFHSCITLSKLDNIFCILTECVF

SEQ ID NO: 3278682 - protein, 19 aa, Plasmodium falciparum
YLFICFNDINNIILFLNLY

SEQ ID NO: 3278683 - protein, 17 aa, Plasmodium falciparum
YLFIIPDIYEYFTRYNL

SEQ ID NO: 3278684 - protein, 17 aa, Plasmodium falciparum
YLFLLFYFIFINCSYIH

SEQ ID NO: 3278685 - protein, 30 aa, Plasmodium falciparum
YLFLNNVPRFNIKFLKLFNSFYEFSTKKYN

SEQ ID NO: 3278686 - protein, 23 aa, Plasmodium falciparum
YLFPCASKLLIKYKDVEGYHISF

SEQ ID NO: 3278687 - protein, 26 aa, Plasmodium falciparum
YLFVNILLFYVCFHFVVRALTYPGSL

SEQ ID NO: 3278688 - protein, 33 aa, Plasmodium falciparum
YLFYPTQFFKALLIKYSFIYQKKIKDCILICKT

SEQ ID NO: 3278689 - protein, 18 aa, Plasmodium falciparum
YLHCIKYKHVYISTFLQR

SEQ ID NO: 3278690 - protein, 19 aa, Plasmodium falciparum
YLHCSYNTIYLFIKKNYIF

SEQ ID NO: 3278691 - protein, 28 aa, Plasmodium falciparum
YLHFKLKEDFYIHPFLSVLQFKKMDNAK

SEQ ID NO: 3278692 - protein, 24 aa, Plasmodium falciparum
YLHFLEHFDYLFFIKKKEYDKHID

SEQ ID NO: 3278693 - protein, 22 aa, Plasmodium falciparum
YLHKHIKNLIKYKIYTYINEMN

SEQ ID NO: 3278694 - protein, 25 aa, Plasmodium falciparum
YLHNMELYGGIPYPFEYKYIDDFYD

SEQ ID NO: 3278695 - protein, 21 aa, Plasmodium falciparum
YLHSLFDSRFCMITLNYSLQK

SEQ ID NO: 3278696 - protein, 21 aa, Plasmodium falciparum
YLHSLNVLSFLKVIKSVQSYK

SEQ ID NO: 3278697 - protein, 17 aa, Plasmodium falciparum
YLHSLWIENLNSVLDES

SEQ ID NO: 3278698 - protein, 24 aa, Plasmodium falciparum
YLHTPRNAIAYSFGESYVIFVNEN

SEQ ID NO: 3278699 - protein, 30 aa, Plasmodium falciparum
YLIAGACIFLAWKLREDFELLKKSRKLYDI

SEQ ID NO: 3278700 - protein, 22 aa, Plasmodium falciparum
YLICAYSIMKLFKSTIFRSYIN

SEQ ID NO: 3278701 - protein, 24 aa, Plasmodium falciparum
YLIDISLALGISGRNNLKLWNYID

SEQ ID NO: 3278702 - protein, 19 aa, Plasmodium falciparum
YLIFKGKSSIFDSVSKSSN

SEQ ID NO: 3278703 - protein, 21 aa, Plasmodium falciparum
YLIICKYDILKFVDNMTLVNL

SEQ ID NO: 3278704 - protein, 18 aa, Plasmodium falciparum
YLIIKIIVFIFSYVLENK

SEQ ID NO: 3278705 - protein, 24 aa, Plasmodium falciparum
YLIINYLFMWDNLYDFVNVILSYS

SEQ ID NO: 3278706 - protein, 19 aa, Plasmodium falciparum
YLIIQMWMEIHMMILEDCK

SEQ ID NO: 3278707 - protein, 24 aa, Plasmodium falciparum
YLIKAHCLLMLNCIDKVKKNKNKI

SEQ ID NO: 3278708 - protein, 17 aa, Plasmodium falciparum
YLIKILITLLFINLNNI

SEQ ID NO: 3278709 - protein, 23 aa, Plasmodium falciparum
YLIKKNGKHIYIFIGDIDGVLSY

SEQ ID NO: 3278710 - protein, 19 aa, Plasmodium falciparum
YLILRYRRKEIIKKKLQYI

SEQ ID NO: 3278711 - protein, 18 aa, Plasmodium falciparum
YLILRYRRKIKMNKKLQY

SEQ ID NO: 3278712 - protein, 17 aa, Plasmodium falciparum
YLINILFALSDVKGIST

SEQ ID NO: 3278713 - protein, 19 aa, Plasmodium falciparum
YLIPKKMFMASFIPSILNK

SEQ ID NO: 3278714 - protein, 20 aa, Plasmodium falciparum
YLIRTHFLQIILASYYLFED

SEQ ID NO: 3278715 - protein, 28 aa, Plasmodium falciparum
YLISIPLKLGFTGYIFFAFICQIPLVQF

SEQ ID NO: 3278716 - protein, 17 aa, Plasmodium falciparum
YLISKMWNIVKNWEAAD

SEQ ID NO: 3278717 - protein, 17 aa, Plasmodium falciparum
YLISSIFQYFFFLNNND

SEQ ID NO: 3278718 - protein, 27 aa, Plasmodium falciparum
YLIVTFPALCKILESIKNSKIFRPPNP

SEQ ID NO: 3278719 - protein, 19 aa, Plasmodium falciparum
YLIYCILINIYMIRDQHYE

SEQ ID NO: 3278720 - protein, 23 aa, Plasmodium falciparum
YLKDFYSYYVFFEFLVNIQNTYF

SEQ ID NO: 3278721 - protein, 19 aa, Plasmodium falciparum
YLKECKKLDVSYTKPLFYE

SEQ ID NO: 3278722 - protein, 22 aa, Plasmodium falciparum
YLKEKDAILVHKWEQIQEFLYQ

SEQ ID NO: 3278723 - protein, 17 aa, Plasmodium falciparum
YLKETKQYYEIIKNKEE

SEQ ID NO: 3278724 - protein, 25 aa, Plasmodium falciparum
YLKFLKLVCRLAIWVFGVNKIENNY

SEQ ID NO: 3278725 - protein, 18 aa, Plasmodium falciparum
YLKISKKIFIHFKSLTPA

SEQ ID NO: 3278726 - protein, 17 aa, Plasmodium falciparum
YLKKCLEKNEFINEYVN

SEQ ID NO: 3278727 - protein, 19 aa, Plasmodium falciparum
YLKKFHIYQKFKISQSEKK

SEQ ID NO: 3278728 - protein, 17 aa, Plasmodium falciparum
YLKKRRKDIFVVNKKRY

SEQ ID NO: 3278729 - protein, 20 aa, Plasmodium falciparum
YLKMRKKLNILFVTLKIEKK

SEQ ID NO: 3278730 - protein, 19 aa, Plasmodium falciparum
YLKNIFIFMDLFKMNKYIY

SEQ ID NO: 3278731 - protein, 19 aa, Plasmodium falciparum
YLKNIRSNKIISHIDDYYK

SEQ ID NO: 3278732 - protein, 19 aa, Plasmodium falciparum
YLKNYFLQIYYHFFYNNQI

SEQ ID NO: 3278733 - protein, 33 aa, Plasmodium falciparum
YLKQLKPNPSFVLPFIFVYSCIEIENLHNELHK

SEQ ID NO: 3278734 - protein, 26 aa, Plasmodium falciparum
YLKRKDKKIVCSFSRDKNKKNVPLKT

SEQ ID NO: 3278735 - protein, 25 aa, Plasmodium falciparum
YLKRRQCLWRYYIFNYFINENDTML

SEQ ID NO: 3278736 - protein, 17 aa, Plasmodium falciparum
YLKSFHLVSYYKLNELI

SEQ ID NO: 3278737 - protein, 18 aa, Plasmodium falciparum
YLKSYSVDIFIKQFNETL

SEQ ID NO: 3278738 - protein, 23 aa, Plasmodium falciparum
YLKVETCIWLIFLLLVILLMNTY

SEQ ID NO: 3278739 - protein, 18 aa, Plasmodium falciparum
YLKVYSNILFKYTEAQEK

SEQ ID NO: 3278740 - protein, 25 aa, Plasmodium falciparum
YLKYSLRNPHSFIYPDISSRINNLN

SEQ ID NO: 3278741 - protein, 27 aa, Plasmodium falciparum
YLLCIINTCIFLKRILQNINNLYMNYK

SEQ ID NO: 3278742 - protein, 29 aa, Plasmodium falciparum
YLLCILKKKDVFHLYTLLKILKYYCKSHI

SEQ ID NO: 3278743 - protein, 19 aa, Plasmodium falciparum
YLLCNDVILIEMLKKKCKI

SEQ ID NO: 3278744 - protein, 28 aa, Plasmodium falciparum
YLLDCSTHLYLYFGYHCDQDFTADIIGD

SEQ ID NO: 3278745 - protein, 19 aa, Plasmodium falciparum
YLLFILFYHPDMYASYIFF

SEQ ID NO: 3278746 - protein, 19 aa, Plasmodium falciparum
YLLICPFNLIYIFDLPSYI

SEQ ID NO: 3278747 - protein, 18 aa, Plasmodium falciparum
YLLIELNNALSIQYLNND

SEQ ID NO: 3278748 - protein, 18 aa, Plasmodium falciparum
YLLILKRLLNNIIPNDRT

SEQ ID NO: 3278749 - protein, 18 aa, Plasmodium falciparum
YLLILVCLLTLCKFAIIS

SEQ ID NO: 3278750 - protein, 24 aa, Plasmodium falciparum
YLLKEIKQIFNISRYKDLYKLHNI

SEQ ID NO: 3278751 - protein, 19 aa, Plasmodium falciparum
YLLKKGKISSFYKSTNSKV

SEQ ID NO: 3278752 - protein, 17 aa, Plasmodium falciparum
YLLKVLLKYFSKYFNFY

SEQ ID NO: 3278753 - protein, 18 aa, Plasmodium falciparum
YLLKYLKGYIYYRYIFNI

SEQ ID NO: 3278754 - protein, 30 aa, Plasmodium falciparum
YLLLCATKLVWRIVMENIKHSCMGILTKCF

SEQ ID NO: 3278755 - protein, 17 aa, Plasmodium falciparum
YLLLHVFGFVKSILDSQ

SEQ ID NO: 3278756 - protein, 19 aa, Plasmodium falciparum
YLLNICINEYTYLYNTSNL

SEQ ID NO: 3278757 - protein, 28 aa, Plasmodium falciparum
YLLNKFNIYFENCLPITSILFNKPVINL

SEQ ID NO: 3278758 - protein, 22 aa, Plasmodium falciparum
YLLRYFEKWNYLFFINLLYFFV

SEQ ID NO: 3278759 - protein, 24 aa, Plasmodium falciparum
YLLSCLFIIIFRIFVILNIPIFFF

SEQ ID NO: 3278760 - protein, 28 aa, Plasmodium falciparum
YLLSLSLLFLCIFIYRLYYISINEHLFK

SEQ ID NO: 3278761 - protein, 17 aa, Plasmodium falciparum
YLLSNIIYVYDKNKRIP

SEQ ID NO: 3278762 - protein, 24 aa, Plasmodium falciparum
YLLSVSWDQYIHIWKIQKNEKKIY

SEQ ID NO: 3278763 - protein, 23 aa, Plasmodium falciparum
YLLVFVCEYIYFLVLPSIFLFPL

SEQ ID NO: 3278764 - protein, 17 aa, Plasmodium falciparum
YLLYCYDKLLDYNDNIM

SEQ ID NO: 3278765 - protein, 18 aa, Plasmodium falciparum
YLMKEFKSFATSELISTM

SEQ ID NO: 3278766 - protein, 19 aa, Plasmodium falciparum
YLMLYAKARITAINGGPGY

SEQ ID NO: 3278767 - protein, 19 aa, Plasmodium falciparum
YLMMIKVFFSTVQILLVCY

SEQ ID NO: 3278768 - protein, 21 aa, Plasmodium falciparum
YLNCLELFKKVYISGKKNNQF

SEQ ID NO: 3278769 - protein, 20 aa, Plasmodium falciparum
YLNDKIKSFIKIFSTNNMNY

SEQ ID NO: 3278770 - protein, 25 aa, Plasmodium falciparum
YLNELLCNIPDNWARVYYPNLNIYK

SEQ ID NO: 3278771 - protein, 27 aa, Plasmodium falciparum
YLNIYLIPFFHKIHISIINYISVYYKN

SEQ ID NO: 3278772 - protein, 26 aa, Plasmodium falciparum
YLNKKSFYLYDVFNIEPIKYKYLPSP

SEQ ID NO: 3278773 - protein, 20 aa, Plasmodium falciparum
YLNLKYYILFALGFTIVHNT

SEQ ID NO: 3278774 - protein, 18 aa, Plasmodium falciparum
YLNPCVLNNIPISVDEHK

SEQ ID NO: 3278775 - protein, 30 aa, Plasmodium falciparum
YLNPTYKILRICFLPSSIHYVVYLAYVLIN

SEQ ID NO: 3278776 - protein, 19 aa, Plasmodium falciparum
YLNTCEEVYNWKHKKNFIK

SEQ ID NO: 3278777 - protein, 27 aa, Plasmodium falciparum
YLNVNKIPLFLSFSIAKKILMTGKSVY

SEQ ID NO: 3278778 - protein, 18 aa, Plasmodium falciparum
YLPCKNIVKVSWDTLLSS

SEQ ID NO: 3278779 - protein, 20 aa, Plasmodium falciparum
YLPFHLLLLILLNYDNKNIL

SEQ ID NO: 3278780 - protein, 19 aa, Plasmodium falciparum
YLPFHLLYYNFKIVNFENS

SEQ ID NO: 3278781 - protein, 17 aa, Plasmodium falciparum
YLPSPPIINEEKGVIIA

SEQ ID NO: 3278782 - protein, 26 aa, Plasmodium falciparum
YLQFSWIFKNHFFKKLYNDRDVSTHN

SEQ ID NO: 3278783 - protein, 23 aa, Plasmodium falciparum
YLQIFKKNVDIFLEKTNNLNYNS

SEQ ID NO: 3278784 - protein, 18 aa, Plasmodium falciparum
YLRIKTYIYENEEIYESI

SEQ ID NO: 3278785 - protein, 27 aa, Plasmodium falciparum
YLRKYGVLRKFNIEWFMFVADKQENIR

SEQ ID NO: 3278786 - protein, 22 aa, Plasmodium falciparum
YLRRKNFKSVHLKKLENYQYFE

SEQ ID NO: 3278787 - protein, 24 aa, Plasmodium falciparum
YLSEIYNILFFYKMYKECVHILLL

SEQ ID NO: 3278788 - protein, 29 aa, Plasmodium falciparum
YLSGKREAYRIIERLNKVIYMDKLTKCFY

SEQ ID NO: 3278789 - protein, 18 aa, Plasmodium falciparum
YLSIYIKEYYFFHKSFFK

SEQ ID NO: 3278790 - protein, 22 aa, Plasmodium falciparum
YLSKPVYKYMVHILINNIVQNE

SEQ ID NO: 3278791 - protein, 27 aa, Plasmodium falciparum
YLSLEEHPRIVLFAANKTLYYEVLKFI

SEQ ID NO: 3278792 - protein, 17 aa, Plasmodium falciparum
YLSLTFNLGYFISASIN

SEQ ID NO: 3278793 - protein, 25 aa, Plasmodium falciparum
YLSSFCFLLYYYLVVNMFNQLIDIN

SEQ ID NO: 3278794 - protein, 26 aa, Plasmodium falciparum
YLSSIECICKVFVAIEDIPSFLHLQD

SEQ ID NO: 3278795 - protein, 20 aa, Plasmodium falciparum
YLSTLKIAIINNRHIILYGS

SEQ ID NO: 3278796 - protein, 25 aa, Plasmodium falciparum
YLSYMSFISLVAFIKYPEIITQDNI

SEQ ID NO: 3278797 - protein, 18 aa, Plasmodium falciparum
YLTIGEEFLNVMKEILLK

SEQ ID NO: 3278798 - protein, 17 aa, Plasmodium falciparum
YLTLGLINKGKQFLKSK

SEQ ID NO: 3278799 - protein, 27 aa, Plasmodium falciparum
YLTNSLFWLCLYRLYIFPNADNVDILY

SEQ ID NO: 3278800 - protein, 19 aa, Plasmodium falciparum
YLTYWRLSISDIYVPHKQY

SEQ ID NO: 3278801 - protein, 18 aa, Plasmodium falciparum
YLVIFRFIREDNIKNFVT

SEQ ID NO: 3278802 - protein, 28 aa, Plasmodium falciparum
YLVLTKHMCLRKCINIDHNIVFWGTNDI

SEQ ID NO: 3278803 - protein, 23 aa, Plasmodium falciparum
YLVQSLRFWLVVILGLFTALLRD

SEQ ID NO: 3278804 - protein, 19 aa, Plasmodium falciparum
YLVYDCFKLNIIKNNQEIK

SEQ ID NO: 3278805 - protein, 17 aa, Plasmodium falciparum
YLWIYKFFFFFFLNIMK

SEQ ID NO: 3278806 - protein, 39 aa, Plasmodium falciparum
YLYELKRASFFINYYFYHLHLFIYFKNYFINYQKNYKLF

SEQ ID NO: 3278807 - protein, 18 aa, Plasmodium falciparum
YLYERMWNEYISRFYETI

SEQ ID NO: 3278808 - protein, 24 aa, Plasmodium falciparum
YLYFCSRFNYIPTIKYVDEYLDTF

SEQ ID NO: 3278809 - protein, 19 aa, Plasmodium falciparum
YLYIYNIFLGNFIWTKTKE

SEQ ID NO: 3278810 - protein, 17 aa, Plasmodium falciparum
YLYKCSFTMKNKNNFYI

SEQ ID NO: 3278811 - protein, 17 aa, Plasmodium falciparum
YLYKINEMYYIKSTLYF

SEQ ID NO: 3278812 - protein, 18 aa, Plasmodium falciparum
YLYLCKYYQLNISFQNIY

SEQ ID NO: 3278813 - protein, 19 aa, Plasmodium falciparum
YLYLYKFVYIKDMPFYLYN

SEQ ID NO: 3278814 - protein, 18 aa, Plasmodium falciparum
YLYMYCFNDKIKVQKNIR

SEQ ID NO: 3278815 - protein, 18 aa, Plasmodium falciparum
YLYNACLNFSNTDIYQEY

SEQ ID NO: 3278816 - protein, 19 aa, Plasmodium falciparum
YLYNCCKQYILNNIYNVDP

SEQ ID NO: 3278817 - protein, 20 aa, Plasmodium falciparum
YLYNCLKTSDFLYNIYKDRL

SEQ ID NO: 3278818 - protein, 22 aa, Plasmodium falciparum
YLYQCVISLYNLKILKHDIFAT

SEQ ID NO: 3278819 - protein, 30 aa, Plasmodium falciparum
YLYRLNEGMFYSWKLRYFVIKNNKLCYYVN

SEQ ID NO: 3278820 - protein, 19 aa, Plasmodium falciparum
YLYSFSGCFIFFTKPFLFY

SEQ ID NO: 3278821 - protein, 30 aa, Plasmodium falciparum
YLYTFSIDICPICKYDLIFFPKGLANKYGI

SEQ ID NO: 3278822 - protein, 19 aa, Plasmodium falciparum
YLYYFKINLLQKIFQQNNF

SEQ ID NO: 3278823 - protein, 17 aa, Plasmodium falciparum
YMDKYRSIYKIEKVHYI

SEQ ID NO: 3278824 - protein, 18 aa, Plasmodium falciparum
YMFCFSTKHIPYIVFVSH

SEQ ID NO: 3278825 - protein, 19 aa, Plasmodium falciparum
YMFLLCIKNNISLKSCGHI

SEQ ID NO: 3278826 - protein, 28 aa, Plasmodium falciparum
YMFLMVVCVNKLYAFFAYTFDERHQRNL

SEQ ID NO: 3278827 - protein, 19 aa, Plasmodium falciparum
YMFLVLSSYCHFTLYLNWW

SEQ ID NO: 3278828 - protein, 18 aa, Plasmodium falciparum
YMFSNYLLSVSWDQYIHI

SEQ ID NO: 3278829 - protein, 18 aa, Plasmodium falciparum
YMGNPWTEYMAKYDIEEV

SEQ ID NO: 3278830 - protein, 17 aa, Plasmodium falciparum
YMHKCIFYNFKKFIQNI

SEQ ID NO: 3278831 - protein, 26 aa, Plasmodium falciparum
YMHVEMPPFEWVRVIIPNTCKVPPQR

SEQ ID NO: 3278832 - protein, 23 aa, Plasmodium falciparum
YMIEFLKHPKFYASKKVKESVCF

SEQ ID NO: 3278833 - protein, 24 aa, Plasmodium falciparum
YMIEKWKKEDWFCDLKETLKNEFE

SEQ ID NO: 3278834 - protein, 18 aa, Plasmodium falciparum
YMIHTNFILLILFMNKIS

SEQ ID NO: 3278835 - protein, 20 aa, Plasmodium falciparum
YMIICWKRQDQLSNYINDKL

SEQ ID NO: 3278836 - protein, 23 aa, Plasmodium falciparum
YMKTIKLTLCCTHSNEHDTKAVM

SEQ ID NO: 3278837 - protein, 22 aa, Plasmodium falciparum
YMKVECIDGFVFQNYNEYNKKI

SEQ ID NO: 3278838 - protein, 23 aa, Plasmodium falciparum
YMKYNLLLIWYIKYGKDVFFSML

SEQ ID NO: 3278839 - protein, 17 aa, Plasmodium falciparum
YMLCLFMLHGELLFFCK

SEQ ID NO: 3278840 - protein, 18 aa, Plasmodium falciparum
YMLGIFFIFLWNDGYLWD

SEQ ID NO: 3278841 - protein, 17 aa, Plasmodium falciparum
YMLGIMLIWIWDYKYLW

SEQ ID NO: 3278842 - protein, 18 aa, Plasmodium falciparum
YMLLNIMIIFFSMFVYFF

SEQ ID NO: 3278843 - protein, 24 aa, Plasmodium falciparum
YMLMYETRIFKPLRIQQKLNNIGN

SEQ ID NO: 3278844 - protein, 20 aa, Plasmodium falciparum
YMMKICLLTKNCAHEICSIN

SEQ ID NO: 3278845 - protein, 28 aa, Plasmodium falciparum
YMMNMYFIKNSFCSKSYNENILEYITNM

SEQ ID NO: 3278846 - protein, 28 aa, Plasmodium falciparum
YMMTLPFIKWNILKSYINSFHMFINIFK

SEQ ID NO: 3278847 - protein, 19 aa, Plasmodium falciparum
YMNCFIYNYLSNIIDKEIN

SEQ ID NO: 3278848 - protein, 17 aa, Plasmodium falciparum
YMNEYYKLLSYIESDIN

SEQ ID NO: 3278849 - protein, 22 aa, Plasmodium falciparum
YMNICTPIFDSIFITILLFAVI

SEQ ID NO: 3278850 - protein, 19 aa, Plasmodium falciparum
YMNQWSCGSARTMKRGYKN

SEQ ID NO: 3278851 - protein, 19 aa, Plasmodium falciparum
YMNSYKLSSDYISKLHLFI

SEQ ID NO: 3278852 - protein, 18 aa, Plasmodium falciparum
YMPPECWNLLRKYKKMKI

SEQ ID NO: 3278853 - protein, 22 aa, Plasmodium falciparum
YMPQVRGAVMVYNYIIRPILLK

SEQ ID NO: 3278854 - protein, 20 aa, Plasmodium falciparum
YMQAPYFGHFIGKWQKKRQQ

SEQ ID NO: 3278855 - protein, 19 aa, Plasmodium falciparum
YMRKADVKRTYKLLRKSLP

SEQ ID NO: 3278856 - protein, 25 aa, Plasmodium falciparum
YMRYSKENYFSVSIYDKKLVYKNIK

SEQ ID NO: 3278857 - protein, 25 aa, Plasmodium falciparum
YMSDLKLYFYVKSFKRHTYFTKLLN

SEQ ID NO: 3278858 - protein, 18 aa, Plasmodium falciparum
YMSHICNFYNVYKNNFHY

SEQ ID NO: 3278859 - protein, 23 aa, Plasmodium falciparum
YMSIFLSLWVFEGENNISLQNPN

SEQ ID NO: 3278860 - protein, 19 aa, Plasmodium falciparum
YMSKKVCNYLFDEHHLKYF

SEQ ID NO: 3278861 - protein, 21 aa, Plasmodium falciparum
YMTYLRLVIKENINYKELCDG

SEQ ID NO: 3278862 - protein, 18 aa, Plasmodium falciparum
YMYCKNLQGKKCKLLCME

SEQ ID NO: 3278863 - protein, 17 aa, Plasmodium falciparum
YMYCNIYPILKRTFESF

SEQ ID NO: 3278864 - protein, 17 aa, Plasmodium falciparum
YMYNIFMNYIFYKDDTF

SEQ ID NO: 3278865 - protein, 26 aa, Plasmodium falciparum
YNAPEVIWNYYLLKILYFLYHIHLKR

SEQ ID NO: 3278866 - protein, 24 aa, Plasmodium falciparum
YNATDKCLFSFLYNNITHLSYNKR

SEQ ID NO: 3278867 - protein, 18 aa, Plasmodium falciparum
YNCFRFNFDKDTNISSDQ

SEQ ID NO: 3278868 - protein, 25 aa, Plasmodium falciparum
YNCKTGTAIFNWRIVYPNITHPLNT

SEQ ID NO: 3278869 - protein, 31 aa, Plasmodium falciparum
YNCNTLSIYFFIKLIYKFFKVIQRGTAPNIF

SEQ ID NO: 3278870 - protein, 19 aa, Plasmodium falciparum
YNCNYCLDYFYEGNLSIYD

SEQ ID NO: 3278871 - protein, 21 aa, Plasmodium falciparum
YNCYFLLHLILNIFKTSKKER

SEQ ID NO: 3278872 - protein, 25 aa, Plasmodium falciparum
YNDCYKGDNIILIITEYIKKDCILD

SEQ ID NO: 3278873 - protein, 18 aa, Plasmodium falciparum
YNDEIVFFHVYDFCVRLN

SEQ ID NO: 3278874 - protein, 31 aa, Plasmodium falciparum
YNDFDKHFEKVFLIWLALSEGFDVFEYKMLI

SEQ ID NO: 3278875 - protein, 25 aa, Plasmodium falciparum
YNDFFNFWVAHMLKDSIHWKKKLEK

SEQ ID NO: 3278876 - protein, 27 aa, Plasmodium falciparum
YNDFFNFWVAHMLKDSIHWRTKKIKGC

SEQ ID NO: 3278877 - protein, 25 aa, Plasmodium falciparum
YNDFFNFWVAHMLKDSIYWKKKLQR

SEQ ID NO: 3278878 - protein, 25 aa, Plasmodium falciparum
YNDFFNFWVAHVLKDSIHWRTKKIK

SEQ ID NO: 3278879 - protein, 23 aa, Plasmodium falciparum
YNDIIQYWIWFFLKDEKENKNDS

SEQ ID NO: 3278880 - protein, 24 aa, Plasmodium falciparum
YNDIRFQIDIYFNKLCVDLLQIKK

SEQ ID NO: 3278881 - protein, 21 aa, Plasmodium falciparum
YNDKHIYSWIDDIKELSLDGW

SEQ ID NO: 3278882 - protein, 20 aa, Plasmodium falciparum
YNDKWDVINNFNIQMNSIGN

SEQ ID NO: 3278883 - protein, 21 aa, Plasmodium falciparum
YNEFISLGLFNFIKQKKRKKE

SEQ ID NO: 3278884 - protein, 22 aa, Plasmodium falciparum
YNEFKLDDCLNYGLENLLKLKK

SEQ ID NO: 3278885 - protein, 18 aa, Plasmodium falciparum
YNEILLFLQYFYKYMDCS

SEQ ID NO: 3278886 - protein, 17 aa, Plasmodium falciparum
YNEKCLYELCNAYHYID

SEQ ID NO: 3278887 - protein, 23 aa, Plasmodium falciparum
YNEKISRCPIWIPLKNIPKNVQG

SEQ ID NO: 3278888 - protein, 22 aa, Plasmodium falciparum
YNELKIAYDQKVHEFNKLYNML

SEQ ID NO: 3278889 - protein, 31 aa, Plasmodium falciparum
YNEPIYFRYLLNFLIFFVCEYINRIILYKSK

SEQ ID NO: 3278890 - protein, 28 aa, Plasmodium falciparum
YNEQIKFLFCFHSLYFPLKNLLFISFIN

SEQ ID NO: 3278891 - protein, 24 aa, Plasmodium falciparum
YNESICPNIWLFYYPFLMNNININ

SEQ ID NO: 3278892 - protein, 24 aa, Plasmodium falciparum
YNEYKLKNPFTFQTIHKIKDVRCI

SEQ ID NO: 3278893 - protein, 17 aa, Plasmodium falciparum
YNFCCDDKYKGCNLYLH

SEQ ID NO: 3278894 - protein, 19 aa, Plasmodium falciparum
YNFDRKERCAGKVDNTNGG

SEQ ID NO: 3278895 - protein, 17 aa, Plasmodium falciparum
YNFEYFFLLFLNIHYFI

SEQ ID NO: 3278896 - protein, 27 aa, Plasmodium falciparum
YNFFEYFKGKLFDFLDCITHDEIIQNK

SEQ ID NO: 3278897 - protein, 18 aa, Plasmodium falciparum
YNFFHFLTNLCIHNKINV

SEQ ID NO: 3278898 - protein, 25 aa, Plasmodium falciparum
YNFFKSSVDLFLLNVIRIIYTVILF

SEQ ID NO: 3278899 - protein, 17 aa, Plasmodium falciparum
YNFFLLPTIDYMKNNIC

SEQ ID NO: 3278900 - protein, 18 aa, Plasmodium falciparum
YNFFQFPFYYSIEKILHD

SEQ ID NO: 3278901 - protein, 21 aa, Plasmodium falciparum
YNFFSSLYILYTLYVTYFLYI

SEQ ID NO: 3278902 - protein, 19 aa, Plasmodium falciparum
YNFHNNFYFYQLIGLDILL

SEQ ID NO: 3278903 - protein, 24 aa, Plasmodium falciparum
YNFIRRLISFDAILVYSLFLTVYI

SEQ ID NO: 3278904 - protein, 24 aa, Plasmodium falciparum
YNFKGKEGLNDFVRITSDITNPTS

SEQ ID NO: 3278905 - protein, 19 aa, Plasmodium falciparum
YNFLLCFNENIKNNKEYLK

SEQ ID NO: 3278906 - protein, 27 aa, Plasmodium falciparum
YNFLVPLYILLCRKETKKIYYSFLKFI

SEQ ID NO: 3278907 - protein, 22 aa, Plasmodium falciparum
YNFPCFSCNLFNKCNSDINTTI

SEQ ID NO: 3278908 - protein, 23 aa, Plasmodium falciparum
YNFRPQLWLTSIVESYLFLLNSD

SEQ ID NO: 3278909 - protein, 19 aa, Plasmodium falciparum
YNFVFKISVNKCFYLPFIC

SEQ ID NO: 3278910 - protein, 29 aa, Plasmodium falciparum
YNFYILATLLDFLNLFTIIQSKTRLAKLS

SEQ ID NO: 3278911 - protein, 30 aa, Plasmodium falciparum
YNFYLKSNCAPLPDNKRLLIKPDGNPYEIE

SEQ ID NO: 3278912 - protein, 29 aa, Plasmodium falciparum
YNGFLFLETMMKFIIQMVVNKTIPLHSYM

SEQ ID NO: 3278913 - protein, 24 aa, Plasmodium falciparum
YNGNQLLCDFEFPLNDILEIINIC

SEQ ID NO: 3278914 - protein, 17 aa, Plasmodium falciparum
YNGSIYKKNIQNYDNPM

SEQ ID NO: 3278915 - protein, 18 aa, Plasmodium falciparum
YNHHSSIYILRYNIIYIL

SEQ ID NO: 3278916 - protein, 24 aa, Plasmodium falciparum
YNHILFDYTHLWDNAQFTRTKENI

SEQ ID NO: 3278917 - protein, 25 aa, Plasmodium falciparum
YNHKETKGLCLFGNIDMQTLLHKYF

SEQ ID NO: 3278918 - protein, 27 aa, Plasmodium falciparum
YNHRSTYEYPFIWSYIQSTWGRCILNL

SEQ ID NO: 3278919 - protein, 26 aa, Plasmodium falciparum
YNIFGYKNRFNGIGILFQLKKSTNKS

SEQ ID NO: 3278920 - protein, 27 aa, Plasmodium falciparum
YNIFILLSNCLINFTNLMELLFIFNNM

SEQ ID NO: 3278921 - protein, 18 aa, Plasmodium falciparum
YNIFPVDYLKYIFNNKKK

SEQ ID NO: 3278922 - protein, 18 aa, Plasmodium falciparum
YNIHIINLLITFVLINKN

SEQ ID NO: 3278923 - protein, 17 aa, Plasmodium falciparum
YNIIILSLHVPKFNYEN

SEQ ID NO: 3278924 - protein, 24 aa, Plasmodium falciparum
YNIIKTKWNSLGAYKYVIMIALLD

SEQ ID NO: 3278925 - protein, 21 aa, Plasmodium falciparum
YNIKGMFSYNFPQLKKIIYQL

SEQ ID NO: 3278926 - protein, 25 aa, Plasmodium falciparum
YNIKINFIIGLKFSFYNLNSYYNKT

SEQ ID NO: 3278927 - protein, 17 aa, Plasmodium falciparum
YNIKKDIGIIIANNNNN

SEQ ID NO: 3278928 - protein, 39 aa, Plasmodium falciparum
YNIKKNRMWYYIFVKILFLSFFICILNGSSYDTYCKEGN

SEQ ID NO: 3278929 - protein, 21 aa, Plasmodium falciparum
YNILFKCIKGIIYDKNKETFF

SEQ ID NO: 3278930 - protein, 27 aa, Plasmodium falciparum
YNILKEILERSAFLGAFVLDKLKNSDE

SEQ ID NO: 3278931 - protein, 18 aa, Plasmodium falciparum
YNILNFILSYYLKKKIFN

SEQ ID NO: 3278932 - protein, 17 aa, Plasmodium falciparum
YNILNMCIKCLYKDNNN

SEQ ID NO: 3278933 - protein, 36 aa, Plasmodium falciparum
YNIMEHIYKFILYFVIKKLHISFMFYESPNDHDNNN

SEQ ID NO: 3278934 - protein, 18 aa, Plasmodium falciparum
YNINKFHVIFKLNDKLFI

SEQ ID NO: 3278935 - protein, 24 aa, Plasmodium falciparum
YNIQCLLPYIYIHIFILLKHKQVE

SEQ ID NO: 3278936 - protein, 31 aa, Plasmodium falciparum
YNIQLKYILKHIKGIIPYKLIYNNSYFLYNK

SEQ ID NO: 3278937 - protein, 19 aa, Plasmodium falciparum
YNIRGMSLNSYFTEKKNIN

SEQ ID NO: 3278938 - protein, 22 aa, Plasmodium falciparum
YNIRKLNKCFTIKGYKFAYNKI

SEQ ID NO: 3278939 - protein, 17 aa, Plasmodium falciparum
YNIVFPFVIQMKNRNIY

SEQ ID NO: 3278940 - protein, 26 aa, Plasmodium falciparum
YNIVLEKMFAWLFYYIINIDDNKIRK

SEQ ID NO: 3278941 - protein, 17 aa, Plasmodium falciparum
YNIYDKYVCFILNQNVK

SEQ ID NO: 3278942 - protein, 17 aa, Plasmodium falciparum
YNIYKIKFPAAFLNIHF

SEQ ID NO: 3278943 - protein, 22 aa, Plasmodium falciparum
YNIYNLEVCIDFLLNSIFLYND

SEQ ID NO: 3278944 - protein, 20 aa, Plasmodium falciparum
YNKCKCLLNYQDIYGDSNFF

SEQ ID NO: 3278945 - protein, 21 aa, Plasmodium falciparum
YNKCKEYILGLSKKSQIYKIN

SEQ ID NO: 3278946 - protein, 18 aa, Plasmodium falciparum
YNKCYIKFSSIRKRGYHK

SEQ ID NO: 3278947 - protein, 17 aa, Plasmodium falciparum
YNKDIPYICNEGKTWMV

SEQ ID NO: 3278948 - protein, 24 aa, Plasmodium falciparum
YNKDKIKLCKNFKEVTNNTYDDKM

SEQ ID NO: 3278949 - protein, 19 aa, Plasmodium falciparum
YNKEIFLNSFIKEIKKEKD

SEQ ID NO: 3278950 - protein, 17 aa, Plasmodium falciparum
YNKEILEDINFFEDSND

SEQ ID NO: 3278951 - protein, 23 aa, Plasmodium falciparum
YNKEVKGSGGICILQKTNGEENG

SEQ ID NO: 3278952 - protein, 23 aa, Plasmodium falciparum
YNKGKDKNVCPAKDTNEYFNNTD

SEQ ID NO: 3278953 - protein, 21 aa, Plasmodium falciparum
YNKGKNYGWRCIPTGNTSNDN

SEQ ID NO: 3278954 - protein, 18 aa, Plasmodium falciparum
YNKIKMVVQKGGMNKTEK

SEQ ID NO: 3278955 - protein, 25 aa, Plasmodium falciparum
YNKILKEYLCHLFVNNPGTKPLERL

SEQ ID NO: 3278956 - protein, 23 aa, Plasmodium falciparum
YNKKISVNCSFNILIKKLNFCLC

SEQ ID NO: 3278957 - protein, 24 aa, Plasmodium falciparum
YNKKSIDSKGMFYNTHGFVKMMTD

SEQ ID NO: 3278958 - protein, 18 aa, Plasmodium falciparum
YNKLKFDSEKQIEDFKEE

SEQ ID NO: 3278959 - protein, 18 aa, Plasmodium falciparum
YNKLKVELNEEWDIRASL

SEQ ID NO: 3278960 - protein, 19 aa, Plasmodium falciparum
YNKMYNILPFCLFHEHPIT

SEQ ID NO: 3278961 - protein, 18 aa, Plasmodium falciparum
YNKNVERHFISARNTTSS

SEQ ID NO: 3278962 - protein, 17 aa, Plasmodium falciparum
YNKRFIDLIYFISNEGT

SEQ ID NO: 3278963 - protein, 23 aa, Plasmodium falciparum
YNKRYVHIQIIDYFRYIKKEILL

SEQ ID NO: 3278964 - protein, 19 aa, Plasmodium falciparum
YNKVFYSFIKREAVTKHAL

SEQ ID NO: 3278965 - protein, 25 aa, Plasmodium falciparum
YNLAFCGFIKMLKYLNDFHLKGVMP

SEQ ID NO: 3278966 - protein, 18 aa, Plasmodium falciparum
YNLAKGIYKEFYKYSLKN

SEQ ID NO: 3278967 - protein, 20 aa, Plasmodium falciparum
YNLCKYKLRCFSKKKLDHLK

SEQ ID NO: 3278968 - protein, 18 aa, Plasmodium falciparum
YNLCVSSLKGTIHSNNSN

SEQ ID NO: 3278969 - protein, 21 aa, Plasmodium falciparum
YNLESKLLLDNFVIPLENVCG

SEQ ID NO: 3278970 - protein, 17 aa, Plasmodium falciparum
YNLETFKELKLEKKFYE

SEQ ID NO: 3278971 - protein, 26 aa, Plasmodium falciparum
YNLFFEFIGSFLFVFFISIYMLNSNS

SEQ ID NO: 3278972 - protein, 19 aa, Plasmodium falciparum
YNLGYCNFNDVMIDKNIEC

SEQ ID NO: 3278973 - protein, 17 aa, Plasmodium falciparum
YNLINLITLALLGCVTY

SEQ ID NO: 3278974 - protein, 18 aa, Plasmodium falciparum
YNLKHIIFEDIEFNNISI

SEQ ID NO: 3278975 - protein, 22 aa, Plasmodium falciparum
YNLKINKCLYICKNFLIRHNIY

SEQ ID NO: 3278976 - protein, 21 aa, Plasmodium falciparum
YNLKLIIYILYLLKYYSSYIY

SEQ ID NO: 3278977 - protein, 24 aa, Plasmodium falciparum
YNLKLNTYTTFYFYDVKSLKCNFD

SEQ ID NO: 3278978 - protein, 20 aa, Plasmodium falciparum
YNLLKEIQFHLIIVDESHFI

SEQ ID NO: 3278979 - protein, 24 aa, Plasmodium falciparum
YNLMPHALLRFKLDQQDENFVFSS

SEQ ID NO: 3278980 - protein, 19 aa, Plasmodium falciparum
YNLNDLIPFFYKNNYIYVD

SEQ ID NO: 3278981 - protein, 29 aa, Plasmodium falciparum
YNLNKSFMNSFCFFQNYFFENNQYKIIKR

SEQ ID NO: 3278982 - protein, 19 aa, Plasmodium falciparum
YNLPFKTFMLWYMCISVSF

SEQ ID NO: 3278983 - protein, 26 aa, Plasmodium falciparum
YNLQLPLRLVDEIKKELLLRKEEDTK

SEQ ID NO: 3278984 - protein, 25 aa, Plasmodium falciparum
YNLSKTRFYYFLLLIHNQFDLKENV

SEQ ID NO: 3278985 - protein, 18 aa, Plasmodium falciparum
YNLSVIFRKFNRFEQAKY

SEQ ID NO: 3278986 - protein, 22 aa, Plasmodium falciparum
YNLYCKRIRRSEFSMIKYCTIL

SEQ ID NO: 3278987 - protein, 25 aa, Plasmodium falciparum
YNLYDFIPLYLIQNILIHYYDIYQH

SEQ ID NO: 3278988 - protein, 17 aa, Plasmodium falciparum
YNLYKNKILLFNKYIIK

SEQ ID NO: 3278989 - protein, 18 aa, Plasmodium falciparum
YNMKKRKYVSNFYKNDEV

SEQ ID NO: 3278990 - protein, 23 aa, Plasmodium falciparum
YNMLCTINYTLFHFLFNKNIISV

SEQ ID NO: 3278991 - protein, 24 aa, Plasmodium falciparum
YNMNEIYIILKYYFELYNFLKKNI

SEQ ID NO: 3278992 - protein, 19 aa, Plasmodium falciparum
YNMSIRRSMAESKPSTGAG

SEQ ID NO: 3278993 - protein, 22 aa, Plasmodium falciparum
YNMTCDNCGKKIINFLKDKKLI

SEQ ID NO: 3278994 - protein, 33 aa, Plasmodium falciparum
YNMYLMEFFFKIVLRIVPFFKVKNKKKPVNMMK

SEQ ID NO: 3278995 - protein, 24 aa, Plasmodium falciparum
YNNCVSQILPFYVHTDNYNSNIMY

SEQ ID NO: 3278996 - protein, 21 aa, Plasmodium falciparum
YNNFHSKSHFSLVVKTGGTDA

SEQ ID NO: 3278997 - protein, 18 aa, Plasmodium falciparum
YNNFIFLPFFVISINDDK

SEQ ID NO: 3278998 - protein, 18 aa, Plasmodium falciparum
YNNFLKIYDLRNIDMKNK

SEQ ID NO: 3278999 - protein, 28 aa, Plasmodium falciparum
YNNICIKKKDILHNFILFCKMNMFECSY

SEQ ID NO: 3279000 - protein, 18 aa, Plasmodium falciparum
YNNICVICSERINDKSPL

SEQ ID NO: 3279001 - protein, 26 aa, Plasmodium falciparum
YNNICVPSCVYSFINLLKMYYKNYPF

SEQ ID NO: 3279002 - protein, 24 aa, Plasmodium falciparum
YNNIFEIIKPENLYSSLLLLSNEK

SEQ ID NO: 3279003 - protein, 18 aa, Plasmodium falciparum
YNNIFLYIYMLSFILKKN

SEQ ID NO: 3279004 - protein, 19 aa, Plasmodium falciparum
YNNIFSWLCEHFINNSQYK

SEQ ID NO: 3279005 - protein, 18 aa, Plasmodium falciparum
YNNILNVRYCRLLEEHAE

SEQ ID NO: 3279006 - protein, 23 aa, Plasmodium falciparum
YNNKEIINDFIIKGQNIYILLKD

SEQ ID NO: 3279007 - protein, 26 aa, Plasmodium falciparum
YNNKRSYHSLSYFPFPILSYKNVHAF

SEQ ID NO: 3279008 - protein, 18 aa, Plasmodium falciparum
YNNLCCYNTFNIFCKKII

SEQ ID NO: 3279009 - protein, 26 aa, Plasmodium falciparum
YNNLQLFCKMFWKFGNSKVIENLSYE

SEQ ID NO: 3279010 - protein, 23 aa, Plasmodium falciparum
YNNNFLFSLDYFDILNTIRSVKC

SEQ ID NO: 3279011 - protein, 34 aa, Plasmodium falciparum
YNNNYSYIPFCFFYKYFEHFVFQQSLSYCILLSN

SEQ ID NO: 3279012 - protein, 24 aa, Plasmodium falciparum
YNNSEAISLLGYIYLLGLGVPINY

SEQ ID NO: 3279013 - protein, 40 aa, Plasmodium falciparum
YNNSLHMLSRGLLLLLSRLLKPVMFINLFSYEKYRDVNVF

SEQ ID NO: 3279014 - protein, 24 aa, Plasmodium falciparum
YNNSRKILCSNNMLNDHLVMNNKN

SEQ ID NO: 3279015 - protein, 33 aa, Plasmodium falciparum
YNNSSLKKYMKFCLCTIICVFLLDIYTNCESPT

SEQ ID NO: 3279016 - protein, 23 aa, Plasmodium falciparum
YNNVEIIDIFSLKELSYVLYSLS

SEQ ID NO: 3279017 - protein, 23 aa, Plasmodium falciparum
YNNVIRIALYIWLIQLYIYSIDL

SEQ ID NO: 3279018 - protein, 24 aa, Plasmodium falciparum
YNPHVRYGAALALGIACSATANEE

SEQ ID NO: 3279019 - protein, 23 aa, Plasmodium falciparum
YNPKKFFKCLSKIQKSFNNIYLP

SEQ ID NO: 3279020 - protein, 24 aa, Plasmodium falciparum
YNPKVESMLCEFTKLINRNPFDCS

SEQ ID NO: 3279021 - protein, 22 aa, Plasmodium falciparum
YNPKVVDSYGVIERIKHLDING

SEQ ID NO: 3279022 - protein, 23 aa, Plasmodium falciparum
YNPREFKCMRIDVPVTLSTVQKY

SEQ ID NO: 3279023 - protein, 23 aa, Plasmodium falciparum
YNQCIKNIYKYVIYLLHNYYYTN

SEQ ID NO: 3279024 - protein, 17 aa, Plasmodium falciparum
YNQEVYATFFVRTELIE

SEQ ID NO: 3279025 - protein, 28 aa, Plasmodium falciparum
YNQKRLILCSDFMKNIYIFFKNSKKSSL

SEQ ID NO: 3279026 - protein, 23 aa, Plasmodium falciparum
YNRIKQKISHCIKNSDGSKCENK

SEQ ID NO: 3279027 - protein, 24 aa, Plasmodium falciparum
YNRNFCFFFLKFVLYYYYILISFF

SEQ ID NO: 3279028 - protein, 24 aa, Plasmodium falciparum
YNRTKSFFKKAFGTKYTQPKRNER

SEQ ID NO: 3279029 - protein, 23 aa, Plasmodium falciparum
YNRYLFYFRTLEQINEFVKNPTF

SEQ ID NO: 3279030 - protein, 17 aa, Plasmodium falciparum
YNSCNCSILSSLQKDND

SEQ ID NO: 3279031 - protein, 17 aa, Plasmodium falciparum
YNSDFYTPYVFTVSTQM

SEQ ID NO: 3279032 - protein, 17 aa, Plasmodium falciparum
YNSLLLIHNNYKGCVGI

SEQ ID NO: 3279033 - protein, 18 aa, Plasmodium falciparum
YNSLNFTKVRNFDICEIK

SEQ ID NO: 3279034 - protein, 20 aa, Plasmodium falciparum
YNSLYMCIKEQWLYKYHVKK

SEQ ID NO: 3279035 - protein, 24 aa, Plasmodium falciparum
YNSPFLKHTYSIQSYVQYNNLDNL

SEQ ID NO: 3279036 - protein, 28 aa, Plasmodium falciparum
YNSSNNFWLYPGYFCFIGTYQQLANAFF

SEQ ID NO: 3279037 - protein, 21 aa, Plasmodium falciparum
YNSTIPYMCFQSIKKKFTNII

SEQ ID NO: 3279038 - protein, 24 aa, Plasmodium falciparum
YNSTLMILLDICFINICDDEKIKY

SEQ ID NO: 3279039 - protein, 36 aa, Plasmodium falciparum
YNSYNYEKFYVFILLCIKCIVSIRNDKLINFVPHNG

SEQ ID NO: 3279040 - protein, 28 aa, Plasmodium falciparum
YNTFRTDLKFNLSIIFKAYARKALALFI

SEQ ID NO: 3279041 - protein, 18 aa, Plasmodium falciparum
YNTLMDIPVELLKNKNYD

SEQ ID NO: 3279042 - protein, 26 aa, Plasmodium falciparum
YNTYLRKILFSFFFKNSNIFYMYMNH

SEQ ID NO: 3279043 - protein, 18 aa, Plasmodium falciparum
YNVIQLYLSVIVKIIELG

SEQ ID NO: 3279044 - protein, 17 aa, Plasmodium falciparum
YNVKIIIPKEYILLEKT

SEQ ID NO: 3279045 - protein, 25 aa, Plasmodium falciparum
YNVKYRISFFFIRQFINILIIPLLS

SEQ ID NO: 3279046 - protein, 18 aa, Plasmodium falciparum
YNVLKKNVLQKIRNNTKY

SEQ ID NO: 3279047 - protein, 18 aa, Plasmodium falciparum
YNVQKLKKALSYLEDYSL

SEQ ID NO: 3279048 - protein, 17 aa, Plasmodium falciparum
YNVRIFIKLFSKNDYSI

SEQ ID NO: 3279049 - protein, 17 aa, Plasmodium falciparum
YNVVPLFYHILQYINYI

SEQ ID NO: 3279050 - protein, 22 aa, Plasmodium falciparum
YNWSYSVLFSLLFVIPISILHN

SEQ ID NO: 3279051 - protein, 24 aa, Plasmodium falciparum
YNYCTFKRIKLRSHNNINNTHYNI

SEQ ID NO: 3279052 - protein, 20 aa, Plasmodium falciparum
YNYDHGCIHECLVFPMIESL

SEQ ID NO: 3279053 - protein, 19 aa, Plasmodium falciparum
YNYDICILNDYPYICMNKK

SEQ ID NO: 3279054 - protein, 21 aa, Plasmodium falciparum
YNYFLGLEVLQNFDIVNYLIA

SEQ ID NO: 3279055 - protein, 23 aa, Plasmodium falciparum
YNYICILFINAPNYKNCSSNYVF

SEQ ID NO: 3279056 - protein, 19 aa, Plasmodium falciparum
YNYIDSWTKMIITMLKLVD

SEQ ID NO: 3279057 - protein, 26 aa, Plasmodium falciparum
YNYIFLYKMNFMFLHRLYSLSIYQLY

SEQ ID NO: 3279058 - protein, 17 aa, Plasmodium falciparum
YNYIHFLMLKKCQDKIN

SEQ ID NO: 3279059 - protein, 22 aa, Plasmodium falciparum
YNYIILHLSYFVSLKKKKNKIE

SEQ ID NO: 3279060 - protein, 32 aa, Plasmodium falciparum
YNYIRKCAFRFFHLAKNMWPSNVKLESIENKS

SEQ ID NO: 3279061 - protein, 18 aa, Plasmodium falciparum
YNYIVKFFHSYSHFVDLY

SEQ ID NO: 3279062 - protein, 20 aa, Plasmodium falciparum
YNYKHKFIYLDALYDSQNNL

SEQ ID NO: 3279063 - protein, 25 aa, Plasmodium falciparum
YNYKSELPVHCTIYNCDKYIFLLLL

SEQ ID NO: 3279064 - protein, 19 aa, Plasmodium falciparum
YNYLKYVINCVGVEKNNVK

SEQ ID NO: 3279065 - protein, 23 aa, Plasmodium falciparum
YNYLLDLLFEYSFNQSHTCNMTN

SEQ ID NO: 3279066 - protein, 18 aa, Plasmodium falciparum
YNYLLKEYIHVMNKKYFH

SEQ ID NO: 3279067 - protein, 19 aa, Plasmodium falciparum
YNYMEFLGMNIIKKKISVD

SEQ ID NO: 3279068 - protein, 22 aa, Plasmodium falciparum
YNYNSLFILFQLVNTEFPPLLM

SEQ ID NO: 3279069 - protein, 20 aa, Plasmodium falciparum
YNYTYSIKLLRYINTILSFN

SEQ ID NO: 3279070 - protein, 17 aa, Plasmodium falciparum
YNYWRLSAIPTINYSVR

SEQ ID NO: 3279071 - protein, 19 aa, Plasmodium falciparum
YNYYFSYLYAKKMLTYDNV

SEQ ID NO: 3279072 - protein, 17 aa, Plasmodium falciparum
YPCLGRKTVRFSDKEGA

SEQ ID NO: 3279073 - protein, 25 aa, Plasmodium falciparum
YPDLRLKSCDFVYNLPFFGLCIGGC

SEQ ID NO: 3279074 - protein, 18 aa, Plasmodium falciparum
YPFEPRGSNYGNIDARSD

SEQ ID NO: 3279075 - protein, 19 aa, Plasmodium falciparum
YPFEYKYIDDFYDDINLPL

SEQ ID NO: 3279076 - protein, 20 aa, Plasmodium falciparum
YPFGGYPLMVWCKEKEKFVL

SEQ ID NO: 3279077 - protein, 18 aa, Plasmodium falciparum
YPFICGCLSSTITTFITH

SEQ ID NO: 3279078 - protein, 26 aa, Plasmodium falciparum
YPFLEFKKPFCILNNYNITYNAQDKF

SEQ ID NO: 3279079 - protein, 18 aa, Plasmodium falciparum
YPHNFPMRNESVGGPYYR

SEQ ID NO: 3279080 - protein, 17 aa, Plasmodium falciparum
YPHPPVGLMNLGNTCYL

SEQ ID NO: 3279081 - protein, 19 aa, Plasmodium falciparum
YPHYAVIKNDLWKNIKNIK

SEQ ID NO: 3279082 - protein, 32 aa, Plasmodium falciparum
YPIIRKQFLHRIVCYLGIAILIFIISLVVYFK

SEQ ID NO: 3279083 - protein, 29 aa, Plasmodium falciparum
YPIKFYLKKIISTYFIKYFAFFKNKVKKI

SEQ ID NO: 3279084 - protein, 18 aa, Plasmodium falciparum
YPKCELFQNKKHIRFLTQ

SEQ ID NO: 3279085 - protein, 23 aa, Plasmodium falciparum
YPKILYIIWNIVLLIKQYLVIIL

SEQ ID NO: 3279086 - protein, 24 aa, Plasmodium falciparum
YPKKKGFLSYIFVRKLSLFMNNLF

SEQ ID NO: 3279087 - protein, 23 aa, Plasmodium falciparum
YPKNDVAVLFSFLTGFKPIADLI

SEQ ID NO: 3279088 - protein, 17 aa, Plasmodium falciparum
YPLDSLILYLLSFNIKN

SEQ ID NO: 3279089 - protein, 17 aa, Plasmodium falciparum
YPLIKNFIKNGVGKNND

SEQ ID NO: 3279090 - protein, 17 aa, Plasmodium falciparum
YPLITFKYLTSTYELIC

SEQ ID NO: 3279091 - protein, 17 aa, Plasmodium falciparum
YPLLKKQTCQLLYELNI

SEQ ID NO: 3279092 - protein, 17 aa, Plasmodium falciparum
YPLMLLFLYVYLNITYF

SEQ ID NO: 3279093 - protein, 27 aa, Plasmodium falciparum
YPLQLKSHVLWGYYLYIIQDTVESRYS

SEQ ID NO: 3279094 - protein, 26 aa, Plasmodium falciparum
YPLSYLKRCIEWNCLKDKVKEKVGIE

SEQ ID NO: 3279095 - protein, 17 aa, Plasmodium falciparum
YPLVIYFILKIFNYNYI

SEQ ID NO: 3279096 - protein, 26 aa, Plasmodium falciparum
YPLYESLKPFLFINYFQHLVKLNYIQ

SEQ ID NO: 3279097 - protein, 19 aa, Plasmodium falciparum
YPMEEFLLLFLNYNKNKIK

SEQ ID NO: 3279098 - protein, 19 aa, Plasmodium falciparum
YPMIKNEINELFLTSYNIK

SEQ ID NO: 3279099 - protein, 20 aa, Plasmodium falciparum
YPMNMFFFEIYLKLLTLINI

SEQ ID NO: 3279100 - protein, 19 aa, Plasmodium falciparum
YPNAFKINIMYQKRSQVLE

SEQ ID NO: 3279101 - protein, 28 aa, Plasmodium falciparum
YPNICPKFYRLLYEPHYYFNLKSISCFE

SEQ ID NO: 3279102 - protein, 19 aa, Plasmodium falciparum
YPNNGCSVVQISIVTNEDF

SEQ ID NO: 3279103 - protein, 17 aa, Plasmodium falciparum
YPNQFFRNSTYHNSTSN

SEQ ID NO: 3279104 - protein, 19 aa, Plasmodium falciparum
YPNYVKLNLSYKENCYIYI

SEQ ID NO: 3279105 - protein, 17 aa, Plasmodium falciparum
YPPTCFEEVYASRNMMH

SEQ ID NO: 3279106 - protein, 30 aa, Plasmodium falciparum
YPQKRYLTLHFLKELYIFIIEKEKALEEYV

SEQ ID NO: 3279107 - protein, 27 aa, Plasmodium falciparum
YPSFPLFLENLFNIFFFVRNNLITFFI

SEQ ID NO: 3279108 - protein, 20 aa, Plasmodium falciparum
YPSIFYWTPPEILRGKKNKK

SEQ ID NO: 3279109 - protein, 17 aa, Plasmodium falciparum
YPSQCFTLSKKVEFTNR

SEQ ID NO: 3279110 - protein, 17 aa, Plasmodium falciparum
YPTGLRLTEKFIESDTF

SEQ ID NO: 3279111 - protein, 21 aa, Plasmodium falciparum
YPTHCFCKGGFFYSKGYCLEC

SEQ ID NO: 3279112 - protein, 21 aa, Plasmodium falciparum
YPTHYLLYFLYIISFTSLYWS

SEQ ID NO: 3279113 - protein, 17 aa, Plasmodium falciparum
YPTKSCFPMKRIIFEFT

SEQ ID NO: 3279114 - protein, 35 aa, Plasmodium falciparum
YPTPPRFLSSRAFPCVVSRAYIYKSNFGKMEYEVE

SEQ ID NO: 3279115 - protein, 26 aa, Plasmodium falciparum
YPVITCLQWLIEILIYKSNEIKTYYD

SEQ ID NO: 3279116 - protein, 20 aa, Plasmodium falciparum
YPVTLYFIYLFNKLNEYTNY

SEQ ID NO: 3279117 - protein, 27 aa, Plasmodium falciparum
YPYLENHLRGIISLKNSNSLILNQSVN

SEQ ID NO: 3279118 - protein, 19 aa, Plasmodium falciparum
YPYLKILLDKEEIYRSRIL

SEQ ID NO: 3279119 - protein, 27 aa, Plasmodium falciparum
YPYLSKFLTFLPCQKIKFIKNNILMNE

SEQ ID NO: 3279120 - protein, 21 aa, Plasmodium falciparum
YPYQYIPPMLIKADRCKLQNV

SEQ ID NO: 3279121 - protein, 20 aa, Plasmodium falciparum
YQAAFSYCLYLLNNQKHINK

SEQ ID NO: 3279122 - protein, 17 aa, Plasmodium falciparum
YQDSICIYKYLIKILRG

SEQ ID NO: 3279123 - protein, 24 aa, Plasmodium falciparum
YQEKKQHYRILADYHNISDTSTNK

SEQ ID NO: 3279124 - protein, 18 aa, Plasmodium falciparum
YQFIHSWYHIKLADQNKE

SEQ ID NO: 3279125 - protein, 24 aa, Plasmodium falciparum
YQFKIFLHEFNVIYNYKKSIIEKN

SEQ ID NO: 3279126 - protein, 24 aa, Plasmodium falciparum
YQFLRNEFEKCLNKYDENINKKIY

SEQ ID NO: 3279127 - protein, 17 aa, Plasmodium falciparum
YQFRILTVVLFSFIILK

SEQ ID NO: 3279128 - protein, 18 aa, Plasmodium falciparum
YQHELLCINNDYTHHNKT

SEQ ID NO: 3279129 - protein, 20 aa, Plasmodium falciparum
YQILFCIHLFILYIENELKM

SEQ ID NO: 3279130 - protein, 19 aa, Plasmodium falciparum
YQINMIVEGYEKFIMQKLY

SEQ ID NO: 3279131 - protein, 23 aa, Plasmodium falciparum
YQKEEIFLNFDLLRMQEINRKIK

SEQ ID NO: 3279132 - protein, 22 aa, Plasmodium falciparum
YQKKLKEYYLKRNHVNNYNRCM

SEQ ID NO: 3279133 - protein, 18 aa, Plasmodium falciparum
YQKLLEREKRENPDGEPL

SEQ ID NO: 3279134 - protein, 17 aa, Plasmodium falciparum
YQKRVMKQVEKITENIY

SEQ ID NO: 3279135 - protein, 22 aa, Plasmodium falciparum
YQLYKILSCYLKIYKTVDKLKK

SEQ ID NO: 3279136 - protein, 17 aa, Plasmodium falciparum
YQNCNYLNLIDLFIFEH

SEQ ID NO: 3279137 - protein, 19 aa, Plasmodium falciparum
YQNFFVCIFNFLKEPDTNI

SEQ ID NO: 3279138 - protein, 18 aa, Plasmodium falciparum
YQNMSYYYSLIFLNTDRK

SEQ ID NO: 3279139 - protein, 18 aa, Plasmodium falciparum
YQQLYPLNSNWSLSDYFS

SEQ ID NO: 3279140 - protein, 22 aa, Plasmodium falciparum
YQRIACSSFDKKTFHSSYNLHN

SEQ ID NO: 3279141 - protein, 18 aa, Plasmodium falciparum
YQRLRHMAYDKAQVRRTG

SEQ ID NO: 3279142 - protein, 25 aa, Plasmodium falciparum
YQSIIKKILKYIINLFRDVLNNTDL

SEQ ID NO: 3279143 - protein, 18 aa, Plasmodium falciparum
YQSLINVIEIHINKKKRK

SEQ ID NO: 3279144 - protein, 22 aa, Plasmodium falciparum
YQSTCLPQYVGHGADLSKPICH

SEQ ID NO: 3279145 - protein, 17 aa, Plasmodium falciparum
YQTVKFFKALKDRVKRK

SEQ ID NO: 3279146 - protein, 25 aa, Plasmodium falciparum
YQVAMCIIIIPSLFIDLACMVKDYN

SEQ ID NO: 3279147 - protein, 19 aa, Plasmodium falciparum
YQYCKRNYFIPIYEYILSF

SEQ ID NO: 3279148 - protein, 18 aa, Plasmodium falciparum
YQYLPQCIEQGNTKKGFV

SEQ ID NO: 3279149 - protein, 17 aa, Plasmodium falciparum
YRCCSYNFNLFDPSNNK

SEQ ID NO: 3279150 - protein, 24 aa, Plasmodium falciparum
YRCIRTILISLLIYIWLSKNVMTY

SEQ ID NO: 3279151 - protein, 20 aa, Plasmodium falciparum
YRCSLPPPSLNKGMLDKKMN

SEQ ID NO: 3279152 - protein, 18 aa, Plasmodium falciparum
YRDICLGKDIGNDVDGIN

SEQ ID NO: 3279153 - protein, 17 aa, Plasmodium falciparum
YRDICVGNTPSGIDTND

SEQ ID NO: 3279154 - protein, 18 aa, Plasmodium falciparum
YREKENFINIFLTHMDKY

SEQ ID NO: 3279155 - protein, 21 aa, Plasmodium falciparum
YREKYSFLIYLFNLFDEATLH

SEQ ID NO: 3279156 - protein, 25 aa, Plasmodium falciparum
YRFDKLDTLLFFLLPFRNINGKIYD

SEQ ID NO: 3279157 - protein, 20 aa, Plasmodium falciparum
YRFDTFPIFHLKSILINKHY

SEQ ID NO: 3279158 - protein, 17 aa, Plasmodium falciparum
YRFMPYIINNITNNLYF

SEQ ID NO: 3279159 - protein, 25 aa, Plasmodium falciparum
YRFQFPECMRGFLFQTASEYLYQKY

SEQ ID NO: 3279160 - protein, 25 aa, Plasmodium falciparum
YRICTKEVIKNILLHKEKIHIDILW

SEQ ID NO: 3279161 - protein, 21 aa, Plasmodium falciparum
YRIFFLFEFYFNIIVYILNVK

SEQ ID NO: 3279162 - protein, 23 aa, Plasmodium falciparum
YRIKEQYIIYNFIIKIILNYLYN

SEQ ID NO: 3279163 - protein, 26 aa, Plasmodium falciparum
YRIKICSYPFFNSCKTYGMKIEADKK

SEQ ID NO: 3279164 - protein, 18 aa, Plasmodium falciparum
YRIYDCNEEEFFLDNSNK

SEQ ID NO: 3279165 - protein, 25 aa, Plasmodium falciparum
YRIYLDTLLNFACMNILLITRRKHN

SEQ ID NO: 3279166 - protein, 18 aa, Plasmodium falciparum
YRKAEIYRNYYRNWFSYK

SEQ ID NO: 3279167 - protein, 24 aa, Plasmodium falciparum
YRKEDKCVLCLSNYYCPGNELIKP

SEQ ID NO: 3279168 - protein, 23 aa, Plasmodium falciparum
YRKIEVILYEWLYFHYNNVYNTK

SEQ ID NO: 3279169 - protein, 21 aa, Plasmodium falciparum
YRKINNYCLCFDECMHENSNV

SEQ ID NO: 3279170 - protein, 24 aa, Plasmodium falciparum
YRKKEFKNSLILLNLYNIIMENTL

SEQ ID NO: 3279171 - protein, 17 aa, Plasmodium falciparum
YRKKLIHIEKMIEEAPT

SEQ ID NO: 3279172 - protein, 24 aa, Plasmodium falciparum
YRKRFKRSRIKNVSFKKKQKKPLF

SEQ ID NO: 3279173 - protein, 26 aa, Plasmodium falciparum
YRKRKIFRHKFSFYNINKILYDKDDL

SEQ ID NO: 3279174 - protein, 20 aa, Plasmodium falciparum
YRKRTVIERGLLDSKAQMQK

SEQ ID NO: 3279175 - protein, 24 aa, Plasmodium falciparum
YRKVPGDICVNGWVPEKVPVPCPS

SEQ ID NO: 3279176 - protein, 19 aa, Plasmodium falciparum
YRKYICLAVQKYIYNKNNI

SEQ ID NO: 3279177 - protein, 26 aa, Plasmodium falciparum
YRLKKKEIDEIFILKRDLFVIDYLQN

SEQ ID NO: 3279178 - protein, 25 aa, Plasmodium falciparum
YRLSRLAIKILIVYLNIFKSSKIII

SEQ ID NO: 3279179 - protein, 18 aa, Plasmodium falciparum
YRMGNQCISCLYACNPYV

SEQ ID NO: 3279180 - protein, 27 aa, Plasmodium falciparum
YRMGNQCTKCLFACNPYVEWIENQRKQ

SEQ ID NO: 3279181 - protein, 19 aa, Plasmodium falciparum
YRMHAYNEILKCFNNQDND

SEQ ID NO: 3279182 - protein, 17 aa, Plasmodium falciparum
YRMRKDFFLKDSSFNVI

SEQ ID NO: 3279183 - protein, 26 aa, Plasmodium falciparum
YRMYYYIKFLYLHNILRHTDLLLNFL

SEQ ID NO: 3279184 - protein, 19 aa, Plasmodium falciparum
YRNIKEIEYIYKYLFYESF

SEQ ID NO: 3279185 - protein, 18 aa, Plasmodium falciparum
YRNIKIIFITALSMMEFP

SEQ ID NO: 3279186 - protein, 21 aa, Plasmodium falciparum
YRNNELFYSLLYLLNKLLSFN

SEQ ID NO: 3279187 - protein, 21 aa, Plasmodium falciparum
YRNSTFYWICPNFYKEKKHLE

SEQ ID NO: 3279188 - protein, 18 aa, Plasmodium falciparum
YRNTLVARTINLNATNNV

SEQ ID NO: 3279189 - protein, 29 aa, Plasmodium falciparum
YRNVYYIWNILKSPFSFHSKYIEKEINNK

SEQ ID NO: 3279190 - protein, 20 aa, Plasmodium falciparum
YRPHSECLAHLIDNEVRSLI

SEQ ID NO: 3279191 - protein, 17 aa, Plasmodium falciparum
YRPPHIIERSNYYKNPK

SEQ ID NO: 3279192 - protein, 21 aa, Plasmodium falciparum
YRPSCCYLQNVIFLIGIHFNG

SEQ ID NO: 3279193 - protein, 17 aa, Plasmodium falciparum
YRQNLYHQLNMKRIDKI

SEQ ID NO: 3279194 - protein, 22 aa, Plasmodium falciparum
YRQTYNYLYKHYNYREPLKRSI

SEQ ID NO: 3279195 - protein, 19 aa, Plasmodium falciparum
YRRERVKLLVLGVAAAEDN

SEQ ID NO: 3279196 - protein, 17 aa, Plasmodium falciparum
YRRTTGINVEMINRRGK

SEQ ID NO: 3279197 - protein, 22 aa, Plasmodium falciparum
YRSGEYKGKTYLYVEGDTSGDE

SEQ ID NO: 3279198 - protein, 20 aa, Plasmodium falciparum
YRSKEKIFGTKVCQQKKKKK

SEQ ID NO: 3279199 - protein, 21 aa, Plasmodium falciparum
YRSLCERELYAPANYDNDTEM

SEQ ID NO: 3279200 - protein, 20 aa, Plasmodium falciparum
YRSLQSFRTSYVDVYEDLPL

SEQ ID NO: 3279201 - protein, 22 aa, Plasmodium falciparum
YRSRLCKMLVLSAPLVVTGIWH

SEQ ID NO: 3279202 - protein, 18 aa, Plasmodium falciparum
YRTNYYLILTKLLFMEQN

SEQ ID NO: 3279203 - protein, 24 aa, Plasmodium falciparum
YRTTYCEACPWCGAEKVNGQNGKG

SEQ ID NO: 3279204 - protein, 17 aa, Plasmodium falciparum
YRYFKIYNNNMNMNNNN

SEQ ID NO: 3279205 - protein, 20 aa, Plasmodium falciparum
YRYIENSSLILILYSILCRI

SEQ ID NO: 3279206 - protein, 17 aa, Plasmodium falciparum
YRYIIKMECKKNVGNNF

SEQ ID NO: 3279207 - protein, 17 aa, Plasmodium falciparum
YRYLMNISSNLRLYVKK

SEQ ID NO: 3279208 - protein, 19 aa, Plasmodium falciparum
YRYMEWKINVAGLIAVKVP

SEQ ID NO: 3279209 - protein, 22 aa, Plasmodium falciparum
YSAIDAWNPWTKQIINIAFTSL

SEQ ID NO: 3279210 - protein, 19 aa, Plasmodium falciparum
YSAKLFLYTFIKLNYMMQN

SEQ ID NO: 3279211 - protein, 24 aa, Plasmodium falciparum
YSCDMKWYIGFIVYCFGSFLHIIA

SEQ ID NO: 3279212 - protein, 20 aa, Plasmodium falciparum
YSCGYGEPILSEKFNIRCPN

SEQ ID NO: 3279213 - protein, 21 aa, Plasmodium falciparum
YSCNIEWKINNKLYQASAQHE

SEQ ID NO: 3279214 - protein, 25 aa, Plasmodium falciparum
YSCPKSCSSYRKWIERKKTQYEKQE

SEQ ID NO: 3279215 - protein, 19 aa, Plasmodium falciparum
YSCSTCRKKCFKHMYKMQK

SEQ ID NO: 3279216 - protein, 17 aa, Plasmodium falciparum
YSCYKFIRRVLNEDLME

SEQ ID NO: 3279217 - protein, 24 aa, Plasmodium falciparum
YSDLNCYNYYKSMDFDGIYPPVKY

SEQ ID NO: 3279218 - protein, 23 aa, Plasmodium falciparum
YSEECHRILKLLIDEEETIIHQR

SEQ ID NO: 3279219 - protein, 23 aa, Plasmodium falciparum
YSEEFLNEISFGFLNKKYKLPIE

SEQ ID NO: 3279220 - protein, 24 aa, Plasmodium falciparum
YSELRKGCEDCRSWKCMKGDSKCE

SEQ ID NO: 3279221 - protein, 22 aa, Plasmodium falciparum
YSENNFFYVLFDYIIGVLKYKI

SEQ ID NO: 3279222 - protein, 17 aa, Plasmodium falciparum
YSFADLGDIIRGRDIYI

SEQ ID NO: 3279223 - protein, 24 aa, Plasmodium falciparum
YSFEKYPKMCVEVNYFHLTGQEKD

SEQ ID NO: 3279224 - protein, 20 aa, Plasmodium falciparum
YSFILFKFVKMLSLLLPSIL

SEQ ID NO: 3279225 - protein, 24 aa, Plasmodium falciparum
YSFLIYKIKWEHIKKINEHVLNNI

SEQ ID NO: 3279226 - protein, 23 aa, Plasmodium falciparum
YSFLSLKFFPFILTSLLHTGINQ

SEQ ID NO: 3279227 - protein, 22 aa, Plasmodium falciparum
YSFSKLFSIHTCQTHICCSIIL

SEQ ID NO: 3279228 - protein, 23 aa, Plasmodium falciparum
YSFSQCVMCLIIGLFSSINRKHL

SEQ ID NO: 3279229 - protein, 24 aa, Plasmodium falciparum
YSFWFQNMCLAFYTIIFSYFTKNF

SEQ ID NO: 3279230 - protein, 17 aa, Plasmodium falciparum
YSFYDFFYQYWKKNHLN

SEQ ID NO: 3279231 - protein, 21 aa, Plasmodium falciparum
YSFYLSLFVHPYFKQRFAFKL

SEQ ID NO: 3279232 - protein, 26 aa, Plasmodium falciparum
YSGKIPPDFLRLMFYTLGDYRDICIG

SEQ ID NO: 3279233 - protein, 25 aa, Plasmodium falciparum
YSGKIPPPFLRQMFYTLADYKDILF

SEQ ID NO: 3279234 - protein, 23 aa, Plasmodium falciparum
YSGSEFDGILGLGWKDLSIGSID

SEQ ID NO: 3279235 - protein, 21 aa, Plasmodium falciparum
YSHSILACLGFIVGYSSLINI

SEQ ID NO: 3279236 - protein, 19 aa, Plasmodium falciparum
YSIFISKCAHDYYKKYRIM

SEQ ID NO: 3279237 - protein, 20 aa, Plasmodium falciparum
YSIKEICDICFVCSKLNIIY

SEQ ID NO: 3279238 - protein, 21 aa, Plasmodium falciparum
YSIKNDILYNLNIDKQDKYLI

SEQ ID NO: 3279239 - protein, 19 aa, Plasmodium falciparum
YSILNKCRFYKNIVEHFFN

SEQ ID NO: 3279240 - protein, 26 aa, Plasmodium falciparum
YSILSDMWSIGIIFYILMTGITPLPM

SEQ ID NO: 3279241 - protein, 35 aa, Plasmodium falciparum
YSKDLYHTLILCENCKGFYVDMFLINIFNEYINYY

SEQ ID NO: 3279242 - protein, 25 aa, Plasmodium falciparum
YSKDRAGSWISIFITMFPLGGCVGY

SEQ ID NO: 3279243 - protein, 23 aa, Plasmodium falciparum
YSKEHFGKLCGIMFAVSAICLSI

SEQ ID NO: 3279244 - protein, 22 aa, Plasmodium falciparum
YSKELMNFFYLIINKELNSLIK

SEQ ID NO: 3279245 - protein, 17 aa, Plasmodium falciparum
YSKFLFIIEKHMKTELY

SEQ ID NO: 3279246 - protein, 17 aa, Plasmodium falciparum
YSKKYICYNKEEHINIS

SEQ ID NO: 3279247 - protein, 20 aa, Plasmodium falciparum
YSKLKKGIIKNLKHYELANN

SEQ ID NO: 3279248 - protein, 25 aa, Plasmodium falciparum
YSKTIKVATAFAISACIFGILSAHL

SEQ ID NO: 3279249 - protein, 25 aa, Plasmodium falciparum
YSKYLNIFFKSSFVRYININQVFNG

SEQ ID NO: 3279250 - protein, 18 aa, Plasmodium falciparum
YSLDNVVGIKYYFYLYDT

SEQ ID NO: 3279251 - protein, 25 aa, Plasmodium falciparum
YSLILEIMKTCFPKIDSDDVNEENG

SEQ ID NO: 3279252 - protein, 21 aa, Plasmodium falciparum
YSLKKDIHMTNVFLNYLNKII

SEQ ID NO: 3279253 - protein, 30 aa, Plasmodium falciparum
YSLKNWIVQYSCSFLKRYDSIQLPIIDKDI

SEQ ID NO: 3279254 - protein, 23 aa, Plasmodium falciparum
YSLLDEYICFSLNGIVRGPFTYL

SEQ ID NO: 3279255 - protein, 18 aa, Plasmodium falciparum
YSLMFKFFIYVLYPFIPA

SEQ ID NO: 3279256 - protein, 24 aa, Plasmodium falciparum
YSLNPSIWFDILFFNVMKGTCNNK

SEQ ID NO: 3279257 - protein, 24 aa, Plasmodium falciparum
YSLPLKFSSLFLSFQSNIKSFFLK

SEQ ID NO: 3279258 - protein, 27 aa, Plasmodium falciparum
YSLSLLIRTSFKVQHYGVFKKDKEIFV

SEQ ID NO: 3279259 - protein, 23 aa, Plasmodium falciparum
YSLYYIGCKEFKLCIDSYDSIFP

SEQ ID NO: 3279260 - protein, 27 aa, Plasmodium falciparum
YSMALCFLILCAFNYGTSFYLFDEKEI

SEQ ID NO: 3279261 - protein, 21 aa, Plasmodium falciparum
YSMKLNERFSLRSLTPLVCME

SEQ ID NO: 3279262 - protein, 33 aa, Plasmodium falciparum
YSMSNHFIVHFFSLCPLLFVKNKIHADISIYII

SEQ ID NO: 3279263 - protein, 18 aa, Plasmodium falciparum
YSNDLLIYLNCFSEIFLL

SEQ ID NO: 3279264 - protein, 26 aa, Plasmodium falciparum
YSNFLSWCHNIYLFTMDGMKNWKYLC

SEQ ID NO: 3279265 - protein, 20 aa, Plasmodium falciparum
YSNIKILCMNTMIKLIIKNN

SEQ ID NO: 3279266 - protein, 21 aa, Plasmodium falciparum
YSNKCSFIKLYLYSDNINIYK

SEQ ID NO: 3279267 - protein, 24 aa, Plasmodium falciparum
YSNLEKAFVHFANFMERKDIYNLY

SEQ ID NO: 3279268 - protein, 24 aa, Plasmodium falciparum
YSNNLKSYFLFNGHNYQNRCWEII

SEQ ID NO: 3279269 - protein, 17 aa, Plasmodium falciparum
YSNRAACNIFLKKWNTV

SEQ ID NO: 3279270 - protein, 18 aa, Plasmodium falciparum
YSNVLLLLCQEGFDSILN

SEQ ID NO: 3279271 - protein, 25 aa, Plasmodium falciparum
YSNYFYNFHNLFLFFNKDNDLFNSL

SEQ ID NO: 3279272 - protein, 18 aa, Plasmodium falciparum
YSPIISFEKYRSIYNSLN

SEQ ID NO: 3279273 - protein, 18 aa, Plasmodium falciparum
YSQFCWAISSMASRKPIT

SEQ ID NO: 3279274 - protein, 23 aa, Plasmodium falciparum
YSSCTKYSLLFPLKVNGYMVTGI

SEQ ID NO: 3279275 - protein, 24 aa, Plasmodium falciparum
YSSDWKPYIRIIDGEYVFPLKYFY

SEQ ID NO: 3279276 - protein, 19 aa, Plasmodium falciparum
YSSFLLSFIEIYKFHINEF

SEQ ID NO: 3279277 - protein, 26 aa, Plasmodium falciparum
YSSFLSSFCTCNYVVVKNLDFSMNKI

SEQ ID NO: 3279278 - protein, 17 aa, Plasmodium falciparum
YSSHPVIALYLKSNIVS

SEQ ID NO: 3279279 - protein, 26 aa, Plasmodium falciparum
YSSLYACCRKLYALYEQTFPSFLTLP

SEQ ID NO: 3279280 - protein, 20 aa, Plasmodium falciparum
YSSNISRIFYHLNEKLKNVR

SEQ ID NO: 3279281 - protein, 40 aa, Plasmodium falciparum
YSSSCKLKIFEIIFYYTLKVYLCFINKNYIGTFISKIARM

SEQ ID NO: 3279282 - protein, 21 aa, Plasmodium falciparum
YSSSIGFLLLFYANFLDLSEK

SEQ ID NO: 3279283 - protein, 21 aa, Plasmodium falciparum
YSSVFFDKLFHNFYDVLYTDK

SEQ ID NO: 3279284 - protein, 23 aa, Plasmodium falciparum
YSTCTACAVANAKVISCVTSKIS

SEQ ID NO: 3279285 - protein, 24 aa, Plasmodium falciparum
YSTEFFKNTSCNYVDKNVNNGNIF

SEQ ID NO: 3279286 - protein, 17 aa, Plasmodium falciparum
YSTIAIIILCWKIQIIA

SEQ ID NO: 3279287 - protein, 18 aa, Plasmodium falciparum
YSTITVIPCWANEMKSDV

SEQ ID NO: 3279288 - protein, 18 aa, Plasmodium falciparum
YSTTCTWLKSGATAHPAC

SEQ ID NO: 3279289 - protein, 26 aa, Plasmodium falciparum
YSVIFFICSLCNIITYEDIHKYVNCC

SEQ ID NO: 3279290 - protein, 24 aa, Plasmodium falciparum
YSVIIFFVFKSWSYKYTVEGKEVK

SEQ ID NO: 3279291 - protein, 23 aa, Plasmodium falciparum
YSVVLKFTIQYIFVLAYILIHAF

SEQ ID NO: 3279292 - protein, 19 aa, Plasmodium falciparum
YSYCKDILLKIEKYFDEVD

SEQ ID NO: 3279293 - protein, 18 aa, Plasmodium falciparum
YSYFPSISLYMYKLKILI

SEQ ID NO: 3279294 - protein, 37 aa, Plasmodium falciparum
YSYKSNYKNRCNFYDNPWCHIKFSSIVNILLYIFMKV

SEQ ID NO: 3279295 - protein, 21 aa, Plasmodium falciparum
YSYSHFCYVPYYKKHKLTILL

SEQ ID NO: 3279296 - protein, 24 aa, Plasmodium falciparum
YSYTKEEFNIILYLKKRNKKLNKI

SEQ ID NO: 3279297 - protein, 18 aa, Plasmodium falciparum
YSYYNFSPFFPMSSSDII

SEQ ID NO: 3279298 - protein, 19 aa, Plasmodium falciparum
YTALYPAFILLIFIIHIVA

SEQ ID NO: 3279299 - protein, 17 aa, Plasmodium falciparum
YTANPYLIFSLGEKTSN

SEQ ID NO: 3279300 - protein, 21 aa, Plasmodium falciparum
YTATCCIYTILDIYPNSIKYI

SEQ ID NO: 3279301 - protein, 17 aa, Plasmodium falciparum
YTDCLKTDNSFFMTTLS

SEQ ID NO: 3279302 - protein, 28 aa, Plasmodium falciparum
YTDDICLSIKPKALEVEYLRNINKHINK

SEQ ID NO: 3279303 - protein, 19 aa, Plasmodium falciparum
YTDILYYDYLYLFNKNKIT

SEQ ID NO: 3279304 - protein, 23 aa, Plasmodium falciparum
YTDTNLYLGNFVFNSYEIEKHID

SEQ ID NO: 3279305 - protein, 18 aa, Plasmodium falciparum
YTECLKMAEYVDVDTSGV

SEQ ID NO: 3279306 - protein, 26 aa, Plasmodium falciparum
YTEFKKILLPYLWPSKRIDMKGNSSI

SEQ ID NO: 3279307 - protein, 18 aa, Plasmodium falciparum
YTELCKFLQHYNDEIKKN

SEQ ID NO: 3279308 - protein, 26 aa, Plasmodium falciparum
YTEYLCVLCTPLVQIIFDDLIQAIHN

SEQ ID NO: 3279309 - protein, 24 aa, Plasmodium falciparum
YTFFRYIDQVQFFMSLKRSKNFPI

SEQ ID NO: 3279310 - protein, 17 aa, Plasmodium falciparum
YTFIEIMEIFNILISCI

SEQ ID NO: 3279311 - protein, 28 aa, Plasmodium falciparum
YTFKNFKKKCLMCGSLIDTKLLEEQKKS

SEQ ID NO: 3279312 - protein, 21 aa, Plasmodium falciparum
YTFLCGYNMTHFFFMTVKHNC

SEQ ID NO: 3279313 - protein, 20 aa, Plasmodium falciparum
YTFMFSALDTMHFTKRLLDK

SEQ ID NO: 3279314 - protein, 25 aa, Plasmodium falciparum
YTFNLIHAMFKWAILLRNMLMKSKQ

SEQ ID NO: 3279315 - protein, 25 aa, Plasmodium falciparum
YTFRNNTCLCCLIINVLAEIFSYLE

SEQ ID NO: 3279316 - protein, 24 aa, Plasmodium falciparum
YTFYDLIYEPPFYYLKSHKTVQNY

SEQ ID NO: 3279317 - protein, 26 aa, Plasmodium falciparum
YTGEFIRPSFILILIINELKNYDDMF

SEQ ID NO: 3279318 - protein, 22 aa, Plasmodium falciparum
YTHNIHSCFYKKIHTNVHSQEI

SEQ ID NO: 3279319 - protein, 23 aa, Plasmodium falciparum
YTIDCAYFNFLLSFISERKSSDS

SEQ ID NO: 3279320 - protein, 17 aa, Plasmodium falciparum
YTITCYMYKKANATHIY

SEQ ID NO: 3279321 - protein, 26 aa, Plasmodium falciparum
YTKFEMSLCLPVFPGVDPVPGAVRDP

SEQ ID NO: 3279322 - protein, 21 aa, Plasmodium falciparum
YTKFMLKRKKYAQFWEMFFHI

SEQ ID NO: 3279323 - protein, 17 aa, Plasmodium falciparum
YTKKCLTLMNMEESLYS

SEQ ID NO: 3279324 - protein, 18 aa, Plasmodium falciparum
YTKKRNNIYISFNKDKNR

SEQ ID NO: 3279325 - protein, 18 aa, Plasmodium falciparum
YTKNIKINLSRNMSDDSS

SEQ ID NO: 3279326 - protein, 19 aa, Plasmodium falciparum
YTKNMCCNFFDPTQIFNYL

SEQ ID NO: 3279327 - protein, 17 aa, Plasmodium falciparum
YTLFLFLSKELDMEGRY

SEQ ID NO: 3279328 - protein, 23 aa, Plasmodium falciparum
YTLKRNCLDYHHFVNNLKNICYS

SEQ ID NO: 3279329 - protein, 31 aa, Plasmodium falciparum
YTLYFCIFIPVLVSLLICYFLYKRKIKNKQN

SEQ ID NO: 3279330 - protein, 24 aa, Plasmodium falciparum
YTLYWLKNEHNLFNYHMDILNEED

SEQ ID NO: 3279331 - protein, 26 aa, Plasmodium falciparum
YTNDNRLALKAGFTMILYSSSIGFLL

SEQ ID NO: 3279332 - protein, 17 aa, Plasmodium falciparum
YTNKCKLFKYNMRRNHF

SEQ ID NO: 3279333 - protein, 18 aa, Plasmodium falciparum
YTNLILIDISRTFPELLI

SEQ ID NO: 3279334 - protein, 27 aa, Plasmodium falciparum
YTNRLLKRYICKSIIFLDSYKEESYYS

SEQ ID NO: 3279335 - protein, 19 aa, Plasmodium falciparum
YTNSSLNVWGKFKNTNSTE

SEQ ID NO: 3279336 - protein, 24 aa, Plasmodium falciparum
YTNYLCFIYKFIIILNNMNSTHKF

SEQ ID NO: 3279337 - protein, 18 aa, Plasmodium falciparum
YTPLLAYIMIPNFFVHFS

SEQ ID NO: 3279338 - protein, 21 aa, Plasmodium falciparum
YTRKVRKYPYLPYLISNKVLV

SEQ ID NO: 3279339 - protein, 22 aa, Plasmodium falciparum
YTSETPYAIIFTGHSFGAALAQ

SEQ ID NO: 3279340 - protein, 23 aa, Plasmodium falciparum
YTSHNRYNFLVNINKYSDYFYNI

SEQ ID NO: 3279341 - protein, 17 aa, Plasmodium falciparum
YTSLSLFFFILSVLTIN

SEQ ID NO: 3279342 - protein, 18 aa, Plasmodium falciparum
YTSLYIYLIDISLSYLFT

SEQ ID NO: 3279343 - protein, 20 aa, Plasmodium falciparum
YTSPKYKTLIEVVLEPSKSN

SEQ ID NO: 3279344 - protein, 31 aa, Plasmodium falciparum
YTTFKVFLEYWLDDFLYGYYLLKKRKIIEKC

SEQ ID NO: 3279345 - protein, 30 aa, Plasmodium falciparum
YTTFKVFLEYWLQDFIEGYYILKKRKIIEQ

SEQ ID NO: 3279346 - protein, 31 aa, Plasmodium falciparum
YTTFKVLLIYWLEDFIEGYYILKKRKVFEQC

SEQ ID NO: 3279347 - protein, 31 aa, Plasmodium falciparum
YTTFKVLLIYWLEDFIEGYYLLKKRKIIEKC

SEQ ID NO: 3279348 - protein, 25 aa, Plasmodium falciparum
YTTFKVLLIYWLEDFLYGYYLLKKK

SEQ ID NO: 3279349 - protein, 23 aa, Plasmodium falciparum
YTTFSISLDRGFILQFPSSQTDY

SEQ ID NO: 3279350 - protein, 18 aa, Plasmodium falciparum
YTTGRLGLFRTFSDMVKK

SEQ ID NO: 3279351 - protein, 24 aa, Plasmodium falciparum
YTVICKEIGKLIFPYDMNYIDIFE

SEQ ID NO: 3279352 - protein, 20 aa, Plasmodium falciparum
YTYILHLYIPIYPYMHKPTC

SEQ ID NO: 3279353 - protein, 17 aa, Plasmodium falciparum
YTYIYSIFIVTKKMKDN

SEQ ID NO: 3279354 - protein, 17 aa, Plasmodium falciparum
YTYKYRNIKNVKENFGD

SEQ ID NO: 3279355 - protein, 28 aa, Plasmodium falciparum
YTYLFLSILICFVIRIFIFFLLNILEGS

SEQ ID NO: 3279356 - protein, 30 aa, Plasmodium falciparum
YTYNELHMFKHILLSAVIKYKHTQKVYTKQ

SEQ ID NO: 3279357 - protein, 19 aa, Plasmodium falciparum
YTYSFPKYSFLKEEERIQE

SEQ ID NO: 3279358 - protein, 23 aa, Plasmodium falciparum
YVAILCLSRILLLLLSFKIKNLT

SEQ ID NO: 3279359 - protein, 26 aa, Plasmodium falciparum
YVCIPDRRIQLCIVNLSIIKTYTKET

SEQ ID NO: 3279360 - protein, 19 aa, Plasmodium falciparum
YVCSCYELTEGHCQSGNYF

SEQ ID NO: 3279361 - protein, 25 aa, Plasmodium falciparum
YVDEKYCSYVLCLHILLLPLEMILI

SEQ ID NO: 3279362 - protein, 32 aa, Plasmodium falciparum
YVDIFPVHIIYKIKKIWCNKCWNKKKIYNLFY

SEQ ID NO: 3279363 - protein, 17 aa, Plasmodium falciparum
YVDNILLCKKNMLKSYL

SEQ ID NO: 3279364 - protein, 25 aa, Plasmodium falciparum
YVDRCIHFYNLIYTYRKVHNKYVLD

SEQ ID NO: 3279365 - protein, 22 aa, Plasmodium falciparum
YVDWSLHFPLYFEKNQIKDEYI

SEQ ID NO: 3279366 - protein, 18 aa, Plasmodium falciparum
YVFSKLGIILSIILIILN

SEQ ID NO: 3279367 - protein, 18 aa, Plasmodium falciparum
YVFTKFVFHVKITEENDE

SEQ ID NO: 3279368 - protein, 24 aa, Plasmodium falciparum
YVHINEYNNLFLIYSDSFLYEPEY

SEQ ID NO: 3279369 - protein, 19 aa, Plasmodium falciparum
YVHLCLFLYCDEEIMIERC

SEQ ID NO: 3279370 - protein, 34 aa, Plasmodium falciparum
YVHLYKNLELCRICVSSIFKIFGDLFRYKYYFFE

SEQ ID NO: 3279371 - protein, 22 aa, Plasmodium falciparum
YVHRDIWIYLILKALKKKNDST

SEQ ID NO: 3279372 - protein, 18 aa, Plasmodium falciparum
YVHVFIIRYTSRLKMHSF

SEQ ID NO: 3279373 - protein, 28 aa, Plasmodium falciparum
YVIFLFVLLCLCIYLITGVECSLFGIYI

SEQ ID NO: 3279374 - protein, 24 aa, Plasmodium falciparum
YVIKKRIYKHISYFFIYNYKYLIK

SEQ ID NO: 3279375 - protein, 23 aa, Plasmodium falciparum
YVKDKIKIIKNVLNFSAISMCNN

SEQ ID NO: 3279376 - protein, 19 aa, Plasmodium falciparum
YVKECIVHKILVKIHSCDK

SEQ ID NO: 3279377 - protein, 24 aa, Plasmodium falciparum
YVKEFELINYLLIHEDSDIFLETY

SEQ ID NO: 3279378 - protein, 20 aa, Plasmodium falciparum
YVKEPVISEMFLIVYEKIYK

SEQ ID NO: 3279379 - protein, 18 aa, Plasmodium falciparum
YVKESFKFFKSGYAQKGY

SEQ ID NO: 3279380 - protein, 22 aa, Plasmodium falciparum
YVKEYFLILNRLVENYNEPKLR

SEQ ID NO: 3279381 - protein, 25 aa, Plasmodium falciparum
YVKGIKYNLFFEILNMKKCFHSFLN

SEQ ID NO: 3279382 - protein, 17 aa, Plasmodium falciparum
YVKGRLQPTRSFGDFHL

SEQ ID NO: 3279383 - protein, 21 aa, Plasmodium falciparum
YVKIPKYFFKNIIDKEKRKIH

SEQ ID NO: 3279384 - protein, 18 aa, Plasmodium falciparum
YVKKCKYKDMNSFMSNIN

SEQ ID NO: 3279385 - protein, 21 aa, Plasmodium falciparum
YVKMIYIIIVCIARVHTILNC

SEQ ID NO: 3279386 - protein, 21 aa, Plasmodium falciparum
YVKNVKWYPQRINHYYINGVV

SEQ ID NO: 3279387 - protein, 18 aa, Plasmodium falciparum
YVKSKCCDSISESNMVDR

SEQ ID NO: 3279388 - protein, 25 aa, Plasmodium falciparum
YVKWKKKRIKYLVTCINSQKRYAFF

SEQ ID NO: 3279389 - protein, 70 aa, Plasmodium falciparum
YVKYILNAFIQFLPKCYHYLRKLNFDLAAWTARCIQDGFSRMLPFDFVLRIYGIYLFEGQKTLCLYCLAL

SEQ ID NO: 3279390 - protein, 19 aa, Plasmodium falciparum
YVLCSTCSRDATLSKILGT

SEQ ID NO: 3279391 - protein, 21 aa, Plasmodium falciparum
YVLCVSDVGLVYGWGKNDKSQ

SEQ ID NO: 3279392 - protein, 20 aa, Plasmodium falciparum
YVLEEFYFPLIQEAYGDAQA

SEQ ID NO: 3279393 - protein, 18 aa, Plasmodium falciparum
YVLKFVLNIDELFQNIKS

SEQ ID NO: 3279394 - protein, 24 aa, Plasmodium falciparum
YVLKIFKYTFSFFSFQKNLYLKRD

SEQ ID NO: 3279395 - protein, 25 aa, Plasmodium falciparum
YVLLERIAYIYIYKRISIASDTPQK

SEQ ID NO: 3279396 - protein, 27 aa, Plasmodium falciparum
YVLLNISYFLTFFFNHMVFCNRDFNLF

SEQ ID NO: 3279397 - protein, 20 aa, Plasmodium falciparum
YVLNEKWLNMYIKRNEKKKY

SEQ ID NO: 3279398 - protein, 17 aa, Plasmodium falciparum
YVLNFLLQNIHVLNNQE

SEQ ID NO: 3279399 - protein, 32 aa, Plasmodium falciparum
YVLNKIFFLFHLLKIRIIYGHILAVKKSKKNR

SEQ ID NO: 3279400 - protein, 17 aa, Plasmodium falciparum
YVLSDLCIDDKKGNENL

SEQ ID NO: 3279401 - protein, 25 aa, Plasmodium falciparum
YVLSSLIYSPSIFFFHIINNIDIAT

SEQ ID NO: 3279402 - protein, 18 aa, Plasmodium falciparum
YVMCLRYCLIGLICIAII

SEQ ID NO: 3279403 - protein, 19 aa, Plasmodium falciparum
YVMFDCLKIDDAELGNITN

SEQ ID NO: 3279404 - protein, 25 aa, Plasmodium falciparum
YVMNKKCVHKCCSVCCKKLRYICIN

SEQ ID NO: 3279405 - protein, 19 aa, Plasmodium falciparum
YVNDYNVRIFIKLFSKNDY

SEQ ID NO: 3279406 - protein, 19 aa, Plasmodium falciparum
YVPFNSIKLILDIFLNKIY

SEQ ID NO: 3279407 - protein, 21 aa, Plasmodium falciparum
YVPINAVRVSRILSFLDSRIN

SEQ ID NO: 3279408 - protein, 19 aa, Plasmodium falciparum
YVPNKWYWEIIVFSRKICV

SEQ ID NO: 3279409 - protein, 22 aa, Plasmodium falciparum
YVPQFLRWFEEWAEDFCRKKKH

SEQ ID NO: 3279410 - protein, 23 aa, Plasmodium falciparum
YVPQFLRWFEEWAEDFCRKKKKY

SEQ ID NO: 3279411 - protein, 26 aa, Plasmodium falciparum
YVPQFLRWFEEWAEDFCRLRKHKLKD

SEQ ID NO: 3279412 - protein, 19 aa, Plasmodium falciparum
YVPYYKKHKLTILLKPKTI

SEQ ID NO: 3279413 - protein, 23 aa, Plasmodium falciparum
YVQGMSYIALVFLLYSNLEKAFV

SEQ ID NO: 3279414 - protein, 18 aa, Plasmodium falciparum
YVRKSCADVIPSIYNIDK

SEQ ID NO: 3279415 - protein, 18 aa, Plasmodium falciparum
YVRTYCCTATATKFVEKD

SEQ ID NO: 3279416 - protein, 28 aa, Plasmodium falciparum
YVSCFKNFIKYVIRICINLELKKNNEEE

SEQ ID NO: 3279417 - protein, 25 aa, Plasmodium falciparum
YVTFISSLYLAFYILTFDRNLSAPK

SEQ ID NO: 3279418 - protein, 27 aa, Plasmodium falciparum
YVTFSELSLFFSLRLSIIRNYIFSKIY

SEQ ID NO: 3279419 - protein, 18 aa, Plasmodium falciparum
YVTIYPEQIIHLFKHYVK

SEQ ID NO: 3279420 - protein, 25 aa, Plasmodium falciparum
YVTLECMKYFSILMFPFIPNISLAI

SEQ ID NO: 3279421 - protein, 20 aa, Plasmodium falciparum
YVTNCGYNFNYLSNLNKVKI

SEQ ID NO: 3279422 - protein, 25 aa, Plasmodium falciparum
YVVCAEIFVIFMLFFEIFLRLLTEG

SEQ ID NO: 3279423 - protein, 17 aa, Plasmodium falciparum
YVVCNKLKNKITSIYIN

SEQ ID NO: 3279424 - protein, 17 aa, Plasmodium falciparum
YVVLCTYVLGISEEYLK

SEQ ID NO: 3279425 - protein, 18 aa, Plasmodium falciparum
YVWLRKRRKNSWKHECKK

SEQ ID NO: 3279426 - protein, 18 aa, Plasmodium falciparum
YVWVRKLLIDSIKWENEL

SEQ ID NO: 3279427 - protein, 18 aa, Plasmodium falciparum
YVYNKALHIFFFIVEYTN

SEQ ID NO: 3279428 - protein, 17 aa, Plasmodium falciparum
YVYPYHKLLLFIQKNIQ

SEQ ID NO: 3279429 - protein, 18 aa, Plasmodium falciparum
YVYYNCYDYIILNNPYSN

SEQ ID NO: 3279430 - protein, 22 aa, Plasmodium falciparum
YWEEIKKKFKVIHAEEIYLFEW

SEQ ID NO: 3279431 - protein, 23 aa, Plasmodium falciparum
YWFLILGPLRFLRLVRAESTISS

SEQ ID NO: 3279432 - protein, 19 aa, Plasmodium falciparum
YWIKLSDGCIVKMINASIT

SEQ ID NO: 3279433 - protein, 26 aa, Plasmodium falciparum
YWKTIPRPCCVLIFMFLVVMFGIIVG

SEQ ID NO: 3279434 - protein, 23 aa, Plasmodium falciparum
YWLKETINLIKIFKILFTSKYYI

SEQ ID NO: 3279435 - protein, 17 aa, Plasmodium falciparum
YWLLTLKNKYMFSFLKK

SEQ ID NO: 3279436 - protein, 21 aa, Plasmodium falciparum
YWLVAENSFIWLSIQNEEIYK

SEQ ID NO: 3279437 - protein, 18 aa, Plasmodium falciparum
YWNNRDGFHYSDNTKKII

SEQ ID NO: 3279438 - protein, 17 aa, Plasmodium falciparum
YWRNINTAVDFFKIYWI

SEQ ID NO: 3279439 - protein, 20 aa, Plasmodium falciparum
YWTSICLSNIYNIRALGLFR

SEQ ID NO: 3279440 - protein, 19 aa, Plasmodium falciparum
YWVAHMLKDSIYWRTKKIK

SEQ ID NO: 3279441 - protein, 18 aa, Plasmodium falciparum
YWYLYKTAFSYHMKIFAY

SEQ ID NO: 3279442 - protein, 18 aa, Plasmodium falciparum
YWYTLSIKLTSILKEKNV

SEQ ID NO: 3279443 - protein, 17 aa, Plasmodium falciparum
YYAEDEMKDDQNKRYKN

SEQ ID NO: 3279444 - protein, 18 aa, Plasmodium falciparum
YYAIIELMYNKSLSLDIE

SEQ ID NO: 3279445 - protein, 21 aa, Plasmodium falciparum
YYALICSFPLAAFKMFTNVSQ

SEQ ID NO: 3279446 - protein, 26 aa, Plasmodium falciparum
YYALMERLNIINVCYIRLYDKINKRS

SEQ ID NO: 3279447 - protein, 22 aa, Plasmodium falciparum
YYARRRFLISNMNIYKKMVDSY

SEQ ID NO: 3279448 - protein, 17 aa, Plasmodium falciparum
YYDCTKIEFADPLYRCF

SEQ ID NO: 3279449 - protein, 17 aa, Plasmodium falciparum
YYDHLKFNFPYLKKNMS

SEQ ID NO: 3279450 - protein, 20 aa, Plasmodium falciparum
YYDYFEIIKDIYVKKSKNKK

SEQ ID NO: 3279451 - protein, 30 aa, Plasmodium falciparum
YYDYIFLKTHKIFFSKKGVKIYDHSNNLYN

SEQ ID NO: 3279452 - protein, 22 aa, Plasmodium falciparum
YYECDLNCRLCNYYYNNPIRYT

SEQ ID NO: 3279453 - protein, 17 aa, Plasmodium falciparum
YYECLHNKFIRSITYNY

SEQ ID NO: 3279454 - protein, 17 aa, Plasmodium falciparum
YYEGEHITIRYEEEEDI

SEQ ID NO: 3279455 - protein, 17 aa, Plasmodium falciparum
YYEIPLTVFKKVDKNKR

SEQ ID NO: 3279456 - protein, 22 aa, Plasmodium falciparum
YYEKDYMCHIFFNNDNKVNDNM

SEQ ID NO: 3279457 - protein, 22 aa, Plasmodium falciparum
YYEKELYDIVDIYEDIQNNKKE

SEQ ID NO: 3279458 - protein, 18 aa, Plasmodium falciparum
YYEKRFISFLINEKDINK

SEQ ID NO: 3279459 - protein, 25 aa, Plasmodium falciparum
YYFDIYFYVCKTLSTIEDRFFISQA

SEQ ID NO: 3279460 - protein, 18 aa, Plasmodium falciparum
YYFKIPYDIKNTFINLFT

SEQ ID NO: 3279461 - protein, 17 aa, Plasmodium falciparum
YYFNLKSISCFENINDI

SEQ ID NO: 3279462 - protein, 17 aa, Plasmodium falciparum
YYFYIFQIFLSIIQLHS

SEQ ID NO: 3279463 - protein, 17 aa, Plasmodium falciparum
YYFYKYRNSNIIIETLN

SEQ ID NO: 3279464 - protein, 17 aa, Plasmodium falciparum
YYFYTIIIFYELGLVVT

SEQ ID NO: 3279465 - protein, 19 aa, Plasmodium falciparum
YYGKQENWYSLKKNSRSLG

SEQ ID NO: 3279466 - protein, 21 aa, Plasmodium falciparum
YYHIGNLFKDIYIYRIYECFL

SEQ ID NO: 3279467 - protein, 25 aa, Plasmodium falciparum
YYHKTEFIFSFYLIHFMLQNMIYKH

SEQ ID NO: 3279468 - protein, 24 aa, Plasmodium falciparum
YYHLKCKLLCVFKFINMSDDDFMT

SEQ ID NO: 3279469 - protein, 28 aa, Plasmodium falciparum
YYHLRQKIKLCLSRTFANLKTTRETCVL

SEQ ID NO: 3279470 - protein, 23 aa, Plasmodium falciparum
YYHNTILYKFCPKIKKNNIKKTC

SEQ ID NO: 3279471 - protein, 19 aa, Plasmodium falciparum
YYHPSVLPIILYKYIQIIM

SEQ ID NO: 3279472 - protein, 19 aa, Plasmodium falciparum
YYHTCYALSGLSLVQNHLS

SEQ ID NO: 3279473 - protein, 21 aa, Plasmodium falciparum
YYIENDIFYFIPLSKRKNVYL

SEQ ID NO: 3279474 - protein, 32 aa, Plasmodium falciparum
YYIFFKLLLYWFIKIFFKFYYIKIEQVHVNIY

SEQ ID NO: 3279475 - protein, 17 aa, Plasmodium falciparum
YYIFYLLNYMDTYIQFL

SEQ ID NO: 3279476 - protein, 17 aa, Plasmodium falciparum
YYIIKVEMLYNYIYNNI

SEQ ID NO: 3279477 - protein, 19 aa, Plasmodium falciparum
YYIIPFIFKTTQTYHHHKH

SEQ ID NO: 3279478 - protein, 17 aa, Plasmodium falciparum
YYILFALGFTIVHNTIQ

SEQ ID NO: 3279479 - protein, 25 aa, Plasmodium falciparum
YYILMYWKFIILRILQRNKTFKNYM

SEQ ID NO: 3279480 - protein, 22 aa, Plasmodium falciparum
YYIPHIDLLFIIIDLEVYYYYG

SEQ ID NO: 3279481 - protein, 25 aa, Plasmodium falciparum
YYISFKLLCLSLYIIGFYYVLLNNS

SEQ ID NO: 3279482 - protein, 17 aa, Plasmodium falciparum
YYISICGNQTTKIFHMN

SEQ ID NO: 3279483 - protein, 25 aa, Plasmodium falciparum
YYIYKNVLKNIRWYRSENDENNLAS

SEQ ID NO: 3279484 - protein, 17 aa, Plasmodium falciparum
YYKDEFKKIINKFLDEV

SEQ ID NO: 3279485 - protein, 22 aa, Plasmodium falciparum
YYKDFNLRDALPINKTHYSMLL

SEQ ID NO: 3279486 - protein, 17 aa, Plasmodium falciparum
YYKEDFYKYLFINKNNP

SEQ ID NO: 3279487 - protein, 18 aa, Plasmodium falciparum
YYKFMSWNNTKEIKNFDL

SEQ ID NO: 3279488 - protein, 18 aa, Plasmodium falciparum
YYKFPVPPNHTFVGFPIH

SEQ ID NO: 3279489 - protein, 19 aa, Plasmodium falciparum
YYKHKKLYINKSVDQKEDD

SEQ ID NO: 3279490 - protein, 17 aa, Plasmodium falciparum
YYKKFLSSYTYEEIVNI

SEQ ID NO: 3279491 - protein, 23 aa, Plasmodium falciparum
YYKKRFLSNIKKYVFYYVPIYSF

SEQ ID NO: 3279492 - protein, 17 aa, Plasmodium falciparum
YYKKYLEDINMDTLRLS

SEQ ID NO: 3279493 - protein, 25 aa, Plasmodium falciparum
YYKNILNKNICFFFDNNIQDIYLKK

SEQ ID NO: 3279494 - protein, 17 aa, Plasmodium falciparum
YYKQMILLSYKKITESI

SEQ ID NO: 3279495 - protein, 18 aa, Plasmodium falciparum
YYKSGGFSYIVEALKYGL

SEQ ID NO: 3279496 - protein, 24 aa, Plasmodium falciparum
YYKTIIDFGLSFGFVSSYILILIL

SEQ ID NO: 3279497 - protein, 24 aa, Plasmodium falciparum
YYLDISCNFFSYFYNNYIFSKKYF

SEQ ID NO: 3279498 - protein, 24 aa, Plasmodium falciparum
YYLDSRKIYKCKYKNHLLRQKIKL

SEQ ID NO: 3279499 - protein, 17 aa, Plasmodium falciparum
YYLFFLNIEKNISCSCS

SEQ ID NO: 3279500 - protein, 26 aa, Plasmodium falciparum
YYLFTCLYKYEFLFFNKNECVRFYLN

SEQ ID NO: 3279501 - protein, 19 aa, Plasmodium falciparum
YYLISHIHYSYLFNKDIFI

SEQ ID NO: 3279502 - protein, 18 aa, Plasmodium falciparum
YYLKSHKTVQNYIIYINS

SEQ ID NO: 3279503 - protein, 25 aa, Plasmodium falciparum
YYLKSLKKKIVFNSLLLKTIYCKKN

SEQ ID NO: 3279504 - protein, 24 aa, Plasmodium falciparum
YYLKVKEFLLKHHVIKTFLNVLNQ

SEQ ID NO: 3279505 - protein, 19 aa, Plasmodium falciparum
YYLKYLKFLLTSFFLMIEF

SEQ ID NO: 3279506 - protein, 19 aa, Plasmodium falciparum
YYLLFKIKPFNFIDNSLVY

SEQ ID NO: 3279507 - protein, 17 aa, Plasmodium falciparum
YYLNISLHVFITGLNVL

SEQ ID NO: 3279508 - protein, 19 aa, Plasmodium falciparum
YYLNIYRKNERLIIKNHED

SEQ ID NO: 3279509 - protein, 18 aa, Plasmodium falciparum
YYLNKSCINYNEKFEGKK

SEQ ID NO: 3279510 - protein, 19 aa, Plasmodium falciparum
YYLQQIFDFGISLCMVSII

SEQ ID NO: 3279511 - protein, 19 aa, Plasmodium falciparum
YYLTHYKNKKYICIEKKTD

SEQ ID NO: 3279512 - protein, 29 aa, Plasmodium falciparum
YYLYHPFKLIIPVYFLKRLSFLRKVDEDL

SEQ ID NO: 3279513 - protein, 25 aa, Plasmodium falciparum
YYLYQCKIYKSLSLIIIKGLCTYET

SEQ ID NO: 3279514 - protein, 19 aa, Plasmodium falciparum
YYLYYLYYYDCMVSQHIFQ

SEQ ID NO: 3279515 - protein, 25 aa, Plasmodium falciparum
YYMKFLKKKKFRNYIMNTSKFIIIL

SEQ ID NO: 3279516 - protein, 22 aa, Plasmodium falciparum
YYMLTCQAINFKKTWSSKERRN

SEQ ID NO: 3279517 - protein, 22 aa, Plasmodium falciparum
YYMNIHAWKIFLYNTRFNQLLF

SEQ ID NO: 3279518 - protein, 24 aa, Plasmodium falciparum
YYNECMKLYLTVIDLIKAADKEIL

SEQ ID NO: 3279519 - protein, 21 aa, Plasmodium falciparum
YYNICSFNKFTQKLAVVNNIN

SEQ ID NO: 3279520 - protein, 26 aa, Plasmodium falciparum
YYNISKCFYYKINIENIHFKNKIILF

SEQ ID NO: 3279521 - protein, 17 aa, Plasmodium falciparum
YYNISVMNENIYKELNV

SEQ ID NO: 3279522 - protein, 18 aa, Plasmodium falciparum
YYNIWIWVERIFSENFYE

SEQ ID NO: 3279523 - protein, 17 aa, Plasmodium falciparum
YYNKCVIFLLLNLSTLI

SEQ ID NO: 3279524 - protein, 24 aa, Plasmodium falciparum
YYNKEIIESLIYICKKYRFDKLDT

SEQ ID NO: 3279525 - protein, 19 aa, Plasmodium falciparum
YYNKKIQKFYGYVNKQNDH

SEQ ID NO: 3279526 - protein, 18 aa, Plasmodium falciparum
YYNLKPSYFFSFDEGEIN

SEQ ID NO: 3279527 - protein, 25 aa, Plasmodium falciparum
YYNMLKTNMCYKLKGMLYEIIQKCY

SEQ ID NO: 3279528 - protein, 17 aa, Plasmodium falciparum
YYNNRWSKEMIIEKLTE

SEQ ID NO: 3279529 - protein, 27 aa, Plasmodium falciparum
YYNRLRFQKNLFILINFTNKYYDYFYS

SEQ ID NO: 3279530 - protein, 18 aa, Plasmodium falciparum
YYNSYLFFNIPKYKLNIH

SEQ ID NO: 3279531 - protein, 21 aa, Plasmodium falciparum
YYNTFFKYVKYFITKIKNYNV

SEQ ID NO: 3279532 - protein, 19 aa, Plasmodium falciparum
YYNYCIKILLICYYLSKNN

SEQ ID NO: 3279533 - protein, 22 aa, Plasmodium falciparum
YYPFYKIMSPIIYKKKITHVNN

SEQ ID NO: 3279534 - protein, 18 aa, Plasmodium falciparum
YYPGIAPKLYRVLFQPDV

SEQ ID NO: 3279535 - protein, 18 aa, Plasmodium falciparum
YYPKIYNDFIYKEQLKNK

SEQ ID NO: 3279536 - protein, 25 aa, Plasmodium falciparum
YYQKLKFKVAYSLCHFDDEVTIYSN

SEQ ID NO: 3279537 - protein, 25 aa, Plasmodium falciparum
YYQKYFLKIFIKLLYWDEQQTMNNL

SEQ ID NO: 3279538 - protein, 17 aa, Plasmodium falciparum
YYQWKHPVVNKFNILNF

SEQ ID NO: 3279539 - protein, 24 aa, Plasmodium falciparum
YYRINKIHIEYSLSPFIHKNEYFD

SEQ ID NO: 3279540 - protein, 21 aa, Plasmodium falciparum
YYRMPLKNVLLYNEKISRCPI

SEQ ID NO: 3279541 - protein, 18 aa, Plasmodium falciparum
YYRYLYKLYNVLIKKTKD

SEQ ID NO: 3279542 - protein, 27 aa, Plasmodium falciparum
YYSFLSYVFHCVNICGSSVINQIISFN

SEQ ID NO: 3279543 - protein, 24 aa, Plasmodium falciparum
YYSGFSFLPYLGWVIASIYASFCK

SEQ ID NO: 3279544 - protein, 23 aa, Plasmodium falciparum
YYSKKRFFDMVKRYIRRNRKRDI

SEQ ID NO: 3279545 - protein, 18 aa, Plasmodium falciparum
YYSLFLLLDFINNILSHN

SEQ ID NO: 3279546 - protein, 17 aa, Plasmodium falciparum
YYSQIIIIPYLTCYNNK

SEQ ID NO: 3279547 - protein, 19 aa, Plasmodium falciparum
YYTGINMHLLRNCLQNGIL

SEQ ID NO: 3279548 - protein, 27 aa, Plasmodium falciparum
YYTICLYIKKIILINSISVKKKINIFN

SEQ ID NO: 3279549 - protein, 26 aa, Plasmodium falciparum
YYTKNYILCITIGYIINAIVSIYFSQ

SEQ ID NO: 3279550 - protein, 33 aa, Plasmodium falciparum
YYTLYAHKYLIISLCILNFLFNFLYISFFIIYN

SEQ ID NO: 3279551 - protein, 27 aa, Plasmodium falciparum
YYTNDFYKSFCLKSMEIINDIEPLQRV

SEQ ID NO: 3279552 - protein, 18 aa, Plasmodium falciparum
YYVLCSMLITTIPLLYPF

SEQ ID NO: 3279553 - protein, 18 aa, Plasmodium falciparum
YYVSLPLSFIKEIQYFMI

SEQ ID NO: 3279554 - protein, 18 aa, Plasmodium falciparum
YYWEIHFDGLYIDHQKFC

SEQ ID NO: 3279555 - protein, 18 aa, Plasmodium falciparum
YYYIILFFNSCFLNCSNI

SEQ ID NO: 3279556 - protein, 17 aa, Plasmodium falciparum
YYYKHHNSIVVNYFNNV

SEQ ID NO: 3279557 - protein, 25 aa, Plasmodium falciparum
YYYKNENFFKILSLLSNIRYLLTCN

SEQ ID NO: 3279558 - protein, 26 aa, Plasmodium falciparum
YYYNELIFNYYIYYILPYEKRLLFYK

SEQ ID NO: 3279559 - protein, 18 aa, Plasmodium falciparum
YYYNIFINLLKTVKHQDQ

SEQ ID NO: 3279560 - protein, 25 aa, Plasmodium falciparum
YYYNSAKMYFPLIISSLISHSFFFI

SEQ ID NO: 3279561 - protein, 17 aa, Plasmodium falciparum
YYYSFLFLFHFHIFLYP

SEQ ID NO: 3279562 - protein, 18 aa, Plasmodium falciparum
YYYSKYIKNIFHFKFITL

SEQ ID NO: 3279563 - protein, 20 aa, Plasmodium falciparum
YYYYNNCCTYSCCIDKMNKK

SEQ ID NO: 3279564 - protein, 23 aa, Plasmodium falciparum
YYYYYYCCCYFFYYTKKKHYILS

SEQ ID NO: 3279565 - protein, 19 aa, Plasmodium falciparum
KGSNFWKGLGIYLGTLSGA

SEQ ID NO: 3279566 - protein, 17 aa, Plasmodium falciparum
FRWLHEWGSDFCGKRAR

SEQ ID NO: 3279567 - protein, 17 aa, Plasmodium falciparum
KKLICIIWIKIYMMIIE

SEQ ID NO: 3279568 - protein, 18 aa, Plasmodium falciparum
NFDGCLKKEVSVPRLSVS

SEQ ID NO: 3279569 - protein, 17 aa, Plasmodium falciparum
DFFNFWVAHMLKDSIHW

SEQ ID NO: 3279570 - protein, 22 aa, Plasmodium falciparum
ECEEFRYHFSFYLLDHTLFLSE

SEQ ID NO: 3279571 - protein, 20 aa, Plasmodium falciparum
ISFCNIIFFFLELSHEHFVG

SEQ ID NO: 3279572 - protein, 23 aa, Plasmodium falciparum
ISHIFKIINIFSCLIKSPSCAPT

SEQ ID NO: 3279573 - protein, 17 aa, Plasmodium falciparum
KEKLWGCTGDNLKEGED

SEQ ID NO: 3279574 - protein, 20 aa, Plasmodium falciparum
KFFLFKCIFVVIIGILCMGI

SEQ ID NO: 3279575 - protein, 18 aa, Plasmodium falciparum
KGSNFWKGLGIYLGTLSG

SEQ ID NO: 3279576 - protein, 23 aa, Plasmodium falciparum
KTLKLRLEVFLNYIYNLCNNIYK

SEQ ID NO: 3279577 - protein, 17 aa, Plasmodium falciparum
LSNHFSFTKNSVLKEKD

SEQ ID NO: 3279578 - protein, 19 aa, Plasmodium falciparum
NCKNYDFCKSLSSSNESSM

SEQ ID NO: 3279579 - protein, 23 aa, Plasmodium falciparum
NKISDIYLLLSIQFIYNYLNTSD

SEQ ID NO: 3279580 - protein, 23 aa, Plasmodium falciparum
RALFKRWLEYFLEDYNKIRKKLK

SEQ ID NO: 3279581 - protein, 20 aa, Plasmodium falciparum
RSISLYKWRSLIKINTEIDL

SEQ ID NO: 3279582 - protein, 18 aa, Plasmodium falciparum
SSFFTILVCYLRNNLIKM

SEQ ID NO: 3279583 - protein, 21 aa, Plasmodium falciparum
VKSFCFNYIYSFRPFFLRCIL

SEQ ID NO: 3279584 - protein, 17 aa, Plasmodium falciparum
ACALCLYSNFIGAINKE

SEQ ID NO: 3279585 - protein, 19 aa, Plasmodium falciparum
ADGAICFNNPTLLSLNELK

SEQ ID NO: 3279586 - protein, 21 aa, Plasmodium falciparum
AEELLKLCTMIKMFKGHEKIK

SEQ ID NO: 3279587 - protein, 20 aa, Plasmodium falciparum
AFHSRFFICICVLLHMMVFG

SEQ ID NO: 3279588 - protein, 18 aa, Plasmodium falciparum
AFIKCLIAPRILNSEKDS

SEQ ID NO: 3279589 - protein, 18 aa, Plasmodium falciparum
AFNCIRMVFILIKHVIIK

SEQ ID NO: 3279590 - protein, 21 aa, Plasmodium falciparum
AGGLTREWYSILAKEIFNPNY

SEQ ID NO: 3279591 - protein, 19 aa, Plasmodium falciparum
AGILRWRLNTPLPKVRQQS

SEQ ID NO: 3279592 - protein, 19 aa, Plasmodium falciparum
AGLFVLLASVLVFKKVKGF

SEQ ID NO: 3279593 - protein, 24 aa, Plasmodium falciparum
AHDYYKKYRIMLALELQANLAQSI

SEQ ID NO: 3279594 - protein, 17 aa, Plasmodium falciparum
AIFTLSIWTTLLYSNKN

SEQ ID NO: 3279595 - protein, 17 aa, Plasmodium falciparum
AIIKFLFLLTCRDINLS

SEQ ID NO: 3279596 - protein, 21 aa, Plasmodium falciparum
AINCFLCPSLYLFKFDIINSS

SEQ ID NO: 3279597 - protein, 18 aa, Plasmodium falciparum
AINFLFLYIINFCLLHYL

SEQ ID NO: 3279598 - protein, 18 aa, Plasmodium falciparum
AIVFPNLVGLILGILYCV

SEQ ID NO: 3279599 - protein, 17 aa, Plasmodium falciparum
AKTEFYYLFNIFYSQNI

SEQ ID NO: 3279600 - protein, 19 aa, Plasmodium falciparum
ALFEYKCPVEWIITPFLEF

SEQ ID NO: 3279601 - protein, 21 aa, Plasmodium falciparum
ALGCEFLKLLAISGVSSNMDK

SEQ ID NO: 3279602 - protein, 22 aa, Plasmodium falciparum
ALIKRWLEYFLEDYNKIKHKIS

SEQ ID NO: 3279603 - protein, 22 aa, Plasmodium falciparum
ALIKRWLEYFLEDYNKIKKKLK

SEQ ID NO: 3279604 - protein, 22 aa, Plasmodium falciparum
ALIKRWLEYFLEDYNKIRKKLK

SEQ ID NO: 3279605 - protein, 22 aa, Plasmodium falciparum
ALLKRWVEYFLEDYNKIKHKIS

SEQ ID NO: 3279606 - protein, 18 aa, Plasmodium falciparum
ALNRYLYRFCEWNNGDYK

SEQ ID NO: 3279607 - protein, 24 aa, Plasmodium falciparum
ALSIWICLFLFKIILSIMIVSYTI

SEQ ID NO: 3279608 - protein, 18 aa, Plasmodium falciparum
ALYLMDCFDNIYIDKLID

SEQ ID NO: 3279609 - protein, 18 aa, Plasmodium falciparum
ANYALRYLFRENFESDLN

SEQ ID NO: 3279610 - protein, 20 aa, Plasmodium falciparum
APLMFCFDDKILLRLFFFKW

SEQ ID NO: 3279611 - protein, 17 aa, Plasmodium falciparum
APWKVRVSIDFYRCPIT

SEQ ID NO: 3279612 - protein, 17 aa, Plasmodium falciparum
AQFWEMFFHILLNFCNI

SEQ ID NO: 3279613 - protein, 17 aa, Plasmodium falciparum
AQFYLDFIFFFIENIKN

SEQ ID NO: 3279614 - protein, 18 aa, Plasmodium falciparum
ARAASPCIIFFDEIDSLA

SEQ ID NO: 3279615 - protein, 17 aa, Plasmodium falciparum
ARKLAIEYRERWIQLKA

SEQ ID NO: 3279616 - protein, 18 aa, Plasmodium falciparum
ASFSRISLILSLASVIFS

SEQ ID NO: 3279617 - protein, 17 aa, Plasmodium falciparum
ASYPDIFKDFTFESPLW

SEQ ID NO: 3279618 - protein, 22 aa, Plasmodium falciparum
AVKKKLKYFFLHLCLESGISIN

SEQ ID NO: 3279619 - protein, 17 aa, Plasmodium falciparum
AYAIKIFLQEGLFDSDY

SEQ ID NO: 3279620 - protein, 17 aa, Plasmodium falciparum
AYLALWLVNIVKYNEVY

SEQ ID NO: 3279621 - protein, 18 aa, Plasmodium falciparum
AYTCLKKKKKGYIEKQLK

SEQ ID NO: 3279622 - protein, 20 aa, Plasmodium falciparum
CAANHPWLKYFHILNKTQKN

SEQ ID NO: 3279623 - protein, 22 aa, Plasmodium falciparum
CADEVLPLLIYVIIKTNPPEII

SEQ ID NO: 3279624 - protein, 25 aa, Plasmodium falciparum
CAIISRSVLKWKWFKITDTYERLES

SEQ ID NO: 3279625 - protein, 22 aa, Plasmodium falciparum
CARLKLSNVILFSFQIESALNF

SEQ ID NO: 3279626 - protein, 17 aa, Plasmodium falciparum
CDIKFFLYICSYIIYYI

SEQ ID NO: 3279627 - protein, 19 aa, Plasmodium falciparum
CDVCKFWIHLSCDKNESRN

SEQ ID NO: 3279628 - protein, 23 aa, Plasmodium falciparum
CDWKKYYLSNVISFLNCKYVDLN

SEQ ID NO: 3279629 - protein, 19 aa, Plasmodium falciparum
CEENVSFNILRRSNKKDQL

SEQ ID NO: 3279630 - protein, 19 aa, Plasmodium falciparum
CEGLECLPQVLFLYVIFLL

SEQ ID NO: 3279631 - protein, 17 aa, Plasmodium falciparum
CEKNGKGKLLFKYFNIW

SEQ ID NO: 3279632 - protein, 17 aa, Plasmodium falciparum
CFEFVYLILYILNNLFL

SEQ ID NO: 3279633 - protein, 18 aa, Plasmodium falciparum
CFELIKFICIQECNHTYC

SEQ ID NO: 3279634 - protein, 17 aa, Plasmodium falciparum
CFLLKYFITTIFIFLLI

SEQ ID NO: 3279635 - protein, 17 aa, Plasmodium falciparum
CFVLKYYWSIFGIKEGY

SEQ ID NO: 3279636 - protein, 17 aa, Plasmodium falciparum
CGFFNFFLEKSIFNVLK

SEQ ID NO: 3279637 - protein, 18 aa, Plasmodium falciparum
CGFNCKKFNHSTIQPFNH

SEQ ID NO: 3279638 - protein, 21 aa, Plasmodium falciparum
CGKKICNSDCDCFKRWVDQKK

SEQ ID NO: 3279639 - protein, 22 aa, Plasmodium falciparum
CGKYIHPLCAYMCGLFIKCKNS

SEQ ID NO: 3279640 - protein, 23 aa, Plasmodium falciparum
CGPAGRNALIRWIEYNYKMKNDE

SEQ ID NO: 3279641 - protein, 19 aa, Plasmodium falciparum
CGYLNMRIFYNLPSYYLFQ

SEQ ID NO: 3279642 - protein, 17 aa, Plasmodium falciparum
CHFFCWFYFYSICRTSS

SEQ ID NO: 3279643 - protein, 24 aa, Plasmodium falciparum
CHLYNLCYFCKIYVNSAPLHDMNR

SEQ ID NO: 3279644 - protein, 20 aa, Plasmodium falciparum
CHYFAYHVFIIFCNIMQNDI

SEQ ID NO: 3279645 - protein, 19 aa, Plasmodium falciparum
CIDIYWGIKCFTCEKKYHA

SEQ ID NO: 3279646 - protein, 17 aa, Plasmodium falciparum
CIDQIYFLNQMFKRQNS

SEQ ID NO: 3279647 - protein, 18 aa, Plasmodium falciparum
CIFEDFYPLYMLETLCVI

SEQ ID NO: 3279648 - protein, 19 aa, Plasmodium falciparum
CIFLKGGILNVEFLKFSKK

SEQ ID NO: 3279649 - protein, 20 aa, Plasmodium falciparum
CIFPVFMLYMLVRFFPDMKM

SEQ ID NO: 3279650 - protein, 22 aa, Plasmodium falciparum
CIKFKTKCCSFKINKLEKKKKE

SEQ ID NO: 3279651 - protein, 18 aa, Plasmodium falciparum
CIMLKIMKILITFLKFDI

SEQ ID NO: 3279652 - protein, 19 aa, Plasmodium falciparum
CIPFLKFMCEFVYNKSQRI

SEQ ID NO: 3279653 - protein, 18 aa, Plasmodium falciparum
CITKVKFLPLFSSNNVNK

SEQ ID NO: 3279654 - protein, 25 aa, Plasmodium falciparum
CIYIYYKMRVRVCFFFKNTYSNVCR

SEQ ID NO: 3279655 - protein, 20 aa, Plasmodium falciparum
CKACPLNGVICRGRSQCAAN

SEQ ID NO: 3279656 - protein, 18 aa, Plasmodium falciparum
CKCLYFFAYAPTYLGKYY

SEQ ID NO: 3279657 - protein, 20 aa, Plasmodium falciparum
CKEPLRISLTQHLRQLLQPT

SEQ ID NO: 3279658 - protein, 17 aa, Plasmodium falciparum
CKFVFNFLSKVLINSCN

SEQ ID NO: 3279659 - protein, 20 aa, Plasmodium falciparum
CKHPSIYTCGHFIHTKCLHN

SEQ ID NO: 3279660 - protein, 22 aa, Plasmodium falciparum
CKIEIANFISFYFFFLHIKDIL

SEQ ID NO: 3279661 - protein, 24 aa, Plasmodium falciparum
CKKKFSFFISEIFLKENIKKINIK

SEQ ID NO: 3279662 - protein, 25 aa, Plasmodium falciparum
CKKKIKCLICVYISILIIYYLRNEE

SEQ ID NO: 3279663 - protein, 20 aa, Plasmodium falciparum
CKKMFRCLFCKRYKKEERLD

SEQ ID NO: 3279664 - protein, 17 aa, Plasmodium falciparum
CKNKIMLCELIYQSLDY

SEQ ID NO: 3279665 - protein, 19 aa, Plasmodium falciparum
CKNMWLKQKLHSYYKICGF

SEQ ID NO: 3279666 - protein, 22 aa, Plasmodium falciparum
CKPKVIKCFLIIQKNDVYVFSC

SEQ ID NO: 3279667 - protein, 20 aa, Plasmodium falciparum
CKSSLLFGWQRIFYQCVVSW

SEQ ID NO: 3279668 - protein, 17 aa, Plasmodium falciparum
CKTNHLINVPSKIDKNK

SEQ ID NO: 3279669 - protein, 17 aa, Plasmodium falciparum
CLALWLLFLLDVRKCEK

SEQ ID NO: 3279670 - protein, 17 aa, Plasmodium falciparum
CLCNFGYEYIKNPSDPQ

SEQ ID NO: 3279671 - protein, 21 aa, Plasmodium falciparum
CLEKGKELFPIFTAKQLVIFT

SEQ ID NO: 3279672 - protein, 20 aa, Plasmodium falciparum
CLHDPFHLLGLIYEREYKNL

SEQ ID NO: 3279673 - protein, 18 aa, Plasmodium falciparum
CLYFSILIFYDIYETSII

SEQ ID NO: 3279674 - protein, 17 aa, Plasmodium falciparum
CMDFLALLYIAKNEKSK

SEQ ID NO: 3279675 - protein, 23 aa, Plasmodium falciparum
CMKCKIKTKFMCITCKDMENICS

SEQ ID NO: 3279676 - protein, 18 aa, Plasmodium falciparum
CNFFNIFLFHFFNYTFNF

SEQ ID NO: 3279677 - protein, 23 aa, Plasmodium falciparum
CNHTYCFLCFYRLLYMEKKENDN

SEQ ID NO: 3279678 - protein, 20 aa, Plasmodium falciparum
CNISKPLIRRSITFMNTGKN

SEQ ID NO: 3279679 - protein, 22 aa, Plasmodium falciparum
CNKKRNALKWNEIISPPCHLIL

SEQ ID NO: 3279680 - protein, 21 aa, Plasmodium falciparum
CNKYFLKRRGFFFLNSISDND

SEQ ID NO: 3279681 - protein, 17 aa, Plasmodium falciparum
CNLYRGFTLHSFKLIPE

SEQ ID NO: 3279682 - protein, 17 aa, Plasmodium falciparum
CNVCHKCSICTHENGEA

SEQ ID NO: 3279683 - protein, 19 aa, Plasmodium falciparum
CNYKTNFLWINNMNNTTNN

SEQ ID NO: 3279684 - protein, 18 aa, Plasmodium falciparum
CPEAFGLKKAAKVPEKRP

SEQ ID NO: 3279685 - protein, 17 aa, Plasmodium falciparum
CPLRLPLCVSEFPSEKI

SEQ ID NO: 3279686 - protein, 18 aa, Plasmodium falciparum
CPVEWIITPFLEFLNNFI

SEQ ID NO: 3279687 - protein, 19 aa, Plasmodium falciparum
CQLKFKWPINKDENITEYD

SEQ ID NO: 3279688 - protein, 17 aa, Plasmodium falciparum
CQNKCNCVGEWIKLKKE

SEQ ID NO: 3279689 - protein, 18 aa, Plasmodium falciparum
CRKYRKWIDIKFEEFQNQ

SEQ ID NO: 3279690 - protein, 17 aa, Plasmodium falciparum
CRLLWRKTLATLKEEGM

SEQ ID NO: 3279691 - protein, 18 aa, Plasmodium falciparum
CRNECGLDVCGLKKGDNN

SEQ ID NO: 3279692 - protein, 18 aa, Plasmodium falciparum
CRNVCGYVVCKLEKVNEK

SEQ ID NO: 3279693 - protein, 21 aa, Plasmodium falciparum
CRPEDFIYCPGYKPYENDYYN

SEQ ID NO: 3279694 - protein, 18 aa, Plasmodium falciparum
CRSLCECDPYISIYDNHP

SEQ ID NO: 3279695 - protein, 18 aa, Plasmodium falciparum
CSDIILQQCELFDNNMII

SEQ ID NO: 3279696 - protein, 21 aa, Plasmodium falciparum
CSFWCGFYKKWLANQKQEFLK

SEQ ID NO: 3279697 - protein, 23 aa, Plasmodium falciparum
CSFWCGFYKKWLENQKQEFLKQK

SEQ ID NO: 3279698 - protein, 20 aa, Plasmodium falciparum
CSGIRRIDIKSGDYLNEILL

SEQ ID NO: 3279699 - protein, 17 aa, Plasmodium falciparum
CSHEIFKLIIINNEHIT

SEQ ID NO: 3279700 - protein, 21 aa, Plasmodium falciparum
CSHLYFGDGVFCVKNSQTKQT

SEQ ID NO: 3279701 - protein, 21 aa, Plasmodium falciparum
CSICSCLSCVLPLYYSSIYRI

SEQ ID NO: 3279702 - protein, 28 aa, Plasmodium falciparum
CSNYNILLCFLLYVICFGFVISSLCYDS

SEQ ID NO: 3279703 - protein, 20 aa, Plasmodium falciparum
CSPYKWKIKIIKVVGIKNNL

SEQ ID NO: 3279704 - protein, 17 aa, Plasmodium falciparum
CSRCYMHVHKFCYISTK

SEQ ID NO: 3279705 - protein, 20 aa, Plasmodium falciparum
CSSKAEWCILPFNKILIINN

SEQ ID NO: 3279706 - protein, 22 aa, Plasmodium falciparum
CTDCLYACYPYVHWIDKKKEEF

SEQ ID NO: 3279707 - protein, 23 aa, Plasmodium falciparum
CTDKCKGDCKCFERWVEQKREEW

SEQ ID NO: 3279708 - protein, 20 aa, Plasmodium falciparum
CTKFPFNIHDFKKYSINIYF

SEQ ID NO: 3279709 - protein, 21 aa, Plasmodium falciparum
CTYAYKILLCTIFIWICQCFY

SEQ ID NO: 3279710 - protein, 17 aa, Plasmodium falciparum
CVKVFIIFFHYTRDLII

SEQ ID NO: 3279711 - protein, 19 aa, Plasmodium falciparum
CVLMACKLYYPMFTNDFFC

SEQ ID NO: 3279712 - protein, 24 aa, Plasmodium falciparum
CVMRYKWITIIPFNFPPRKYKYIH

SEQ ID NO: 3279713 - protein, 18 aa, Plasmodium falciparum
CVTFCPFTLIPNCNNVVN

SEQ ID NO: 3279714 - protein, 20 aa, Plasmodium falciparum
CVTIELFLKIIILCFKHIND

SEQ ID NO: 3279715 - protein, 18 aa, Plasmodium falciparum
CVYIFFPLQFHYLRKLLC

SEQ ID NO: 3279716 - protein, 21 aa, Plasmodium falciparum
CYINTLFLRRVLFCYSYNLSQ

SEQ ID NO: 3279717 - protein, 27 aa, Plasmodium falciparum
CYNSRIVKISCFFMIFIIMNKKINRYK

SEQ ID NO: 3279718 - protein, 17 aa, Plasmodium falciparum
DCFKKWIGKKKEEWDAI

SEQ ID NO: 3279719 - protein, 17 aa, Plasmodium falciparum
DCFKRWIDKKEKDEWDK

SEQ ID NO: 3279720 - protein, 21 aa, Plasmodium falciparum
DCIYIKGFIKGVGFNYHNPIH

SEQ ID NO: 3279721 - protein, 23 aa, Plasmodium falciparum
DCSTHLYLYFGYHCDQDFTADII

SEQ ID NO: 3279722 - protein, 20 aa, Plasmodium falciparum
DCYRCIYCCESIYDYKQTPN

SEQ ID NO: 3279723 - protein, 18 aa, Plasmodium falciparum
DDSICFLSSCNKEHIITN

SEQ ID NO: 3279724 - protein, 18 aa, Plasmodium falciparum
DDYHSGYVVGLWRDFPRN

SEQ ID NO: 3279725 - protein, 21 aa, Plasmodium falciparum
DEFSEKILPYFFFKEDEQVWD

SEQ ID NO: 3279726 - protein, 21 aa, Plasmodium falciparum
DEIYMYFFLFKKFIFSCYIYF

SEQ ID NO: 3279727 - protein, 25 aa, Plasmodium falciparum
DEIYWFICFFGDYIIKYNIIRCYGE

SEQ ID NO: 3279728 - protein, 21 aa, Plasmodium falciparum
DELYIYLSWVRRQLHLLYMSL

SEQ ID NO: 3279729 - protein, 19 aa, Plasmodium falciparum
DEYTRRALLILSNEQSLKK

SEQ ID NO: 3279730 - protein, 17 aa, Plasmodium falciparum
DFFNFWVAHMLKDSIYW

SEQ ID NO: 3279731 - protein, 20 aa, Plasmodium falciparum
DFGKSVFNAVEFFNVKNHQR

SEQ ID NO: 3279732 - protein, 19 aa, Plasmodium falciparum
DFLNCIKLTINLNDQHVLA

SEQ ID NO: 3279733 - protein, 17 aa, Plasmodium falciparum
DFPEFLCVYNFSFCNVI

SEQ ID NO: 3279734 - protein, 19 aa, Plasmodium falciparum
DFRNYFFLIFCNYRKFIDM

SEQ ID NO: 3279735 - protein, 18 aa, Plasmodium falciparum
DFRREFHNILSIHEDTDL

SEQ ID NO: 3279736 - protein, 20 aa, Plasmodium falciparum
DGDCLNGFICKKCKKTHAKS

SEQ ID NO: 3279737 - protein, 17 aa, Plasmodium falciparum
DGICPFSKLKLQIKRRA

SEQ ID NO: 3279738 - protein, 20 aa, Plasmodium falciparum
DGTFCFKKDPSFIPVLYIYH

SEQ ID NO: 3279739 - protein, 24 aa, Plasmodium falciparum
DHIFKCNYNLFYIFNRYNFQFNAY

SEQ ID NO: 3279740 - protein, 21 aa, Plasmodium falciparum
DICILPCNYLHYYHKDCIFTW

SEQ ID NO: 3279741 - protein, 18 aa, Plasmodium falciparum
DICPICKYDLIFFPKGLA

SEQ ID NO: 3279742 - protein, 21 aa, Plasmodium falciparum
DIHLFFSFNICIKSVKNNLFL

SEQ ID NO: 3279743 - protein, 17 aa, Plasmodium falciparum
DILKCLLILLSSYMYYN

SEQ ID NO: 3279744 - protein, 24 aa, Plasmodium falciparum
DILSWRMIYIFKKYLYIYGKVVKG

SEQ ID NO: 3279745 - protein, 22 aa, Plasmodium falciparum
DIMLRMTVSWDWESVNIDEEIN

SEQ ID NO: 3279746 - protein, 18 aa, Plasmodium falciparum
DINMPISFYISRRNVESF

SEQ ID NO: 3279747 - protein, 24 aa, Plasmodium falciparum
DIYVCFVLYISICFMYISYIFNIW

SEQ ID NO: 3279748 - protein, 21 aa, Plasmodium falciparum
DKHFEKVFLIWLALSEGFDVF

SEQ ID NO: 3279749 - protein, 22 aa, Plasmodium falciparum
DKLKCVLEVLNIFKFISRIKSY

SEQ ID NO: 3279750 - protein, 21 aa, Plasmodium falciparum
DKLNFRCCKFLNHSNSFKDFT

SEQ ID NO: 3279751 - protein, 20 aa, Plasmodium falciparum
DKRKIKCFLFYMWLNIFIPL

SEQ ID NO: 3279752 - protein, 22 aa, Plasmodium falciparum
DKTWFFLLYFYKLLFEKLYEYF

SEQ ID NO: 3279753 - protein, 23 aa, Plasmodium falciparum
DLKCPGCGRECRKYKKWIEKKKE

SEQ ID NO: 3279754 - protein, 18 aa, Plasmodium falciparum
DLKSRYSIFKAILKNTPL

SEQ ID NO: 3279755 - protein, 20 aa, Plasmodium falciparum
DLLNILSIFVIYDISLKDEN

SEQ ID NO: 3279756 - protein, 26 aa, Plasmodium falciparum
DLRVTIFNVFWLREWTEFNYRLTGSI

SEQ ID NO: 3279757 - protein, 24 aa, Plasmodium falciparum
DLSLFRYKLCWILIDFFFYPICKK

SEQ ID NO: 3279758 - protein, 17 aa, Plasmodium falciparum
DLYIPLMSSITYILLYT

SEQ ID NO: 3279759 - protein, 22 aa, Plasmodium falciparum
DMCILSCAFLIYNFEYNNFEIK

SEQ ID NO: 3279760 - protein, 17 aa, Plasmodium falciparum
DMILKERIFEYAKHKTS

SEQ ID NO: 3279761 - protein, 24 aa, Plasmodium falciparum
DNFHICFLYPLFVTYFFYYHLFVK

SEQ ID NO: 3279762 - protein, 19 aa, Plasmodium falciparum
DNIKLMIYLCDMIYIYFYI

SEQ ID NO: 3279763 - protein, 22 aa, Plasmodium falciparum
DNILSLCCSIIFSMITQRTRLL

SEQ ID NO: 3279764 - protein, 20 aa, Plasmodium falciparum
DNYKQLPLCIGIQPEDGDEN

SEQ ID NO: 3279765 - protein, 19 aa, Plasmodium falciparum
DPKRLMYHFPFFDEKKNKN

SEQ ID NO: 3279766 - protein, 21 aa, Plasmodium falciparum
DPLEIFSFFQGINWLPELKNR

SEQ ID NO: 3279767 - protein, 21 aa, Plasmodium falciparum
DQGNCAISWIFASKYYLETLK

SEQ ID NO: 3279768 - protein, 19 aa, Plasmodium falciparum
DRIPIMFNKFGILLEALIY

SEQ ID NO: 3279769 - protein, 18 aa, Plasmodium falciparum
DSKFFLNKMLLLILGGSS

SEQ ID NO: 3279770 - protein, 19 aa, Plasmodium falciparum
DSLCLLYSFIFVIYKILIS

SEQ ID NO: 3279771 - protein, 18 aa, Plasmodium falciparum
DSYLFKSLRTEEWECRFN

SEQ ID NO: 3279772 - protein, 22 aa, Plasmodium falciparum
DTDCGRDSFFSCSDVEISATKL

SEQ ID NO: 3279773 - protein, 18 aa, Plasmodium falciparum
DTLKEFYLYGGRIFLSAN

SEQ ID NO: 3279774 - protein, 18 aa, Plasmodium falciparum
DVRRAAVIALGFVLCNSP

SEQ ID NO: 3279775 - protein, 19 aa, Plasmodium falciparum
DYFFWYRLNIVVQLNEPMK

SEQ ID NO: 3279776 - protein, 18 aa, Plasmodium falciparum
DYFIKFFFEKAFYIKNED

SEQ ID NO: 3279777 - protein, 22 aa, Plasmodium falciparum
DYKCPTCSIGTFHDKIERILYL

SEQ ID NO: 3279778 - protein, 23 aa, Plasmodium falciparum
DYRRLTVACIIAWKALSNYVQNS

SEQ ID NO: 3279779 - protein, 17 aa, Plasmodium falciparum
ECALLVFLLSSLNKSDQ

SEQ ID NO: 3279780 - protein, 19 aa, Plasmodium falciparum
ECGKVCGVDICNLKKKDNI

SEQ ID NO: 3279781 - protein, 21 aa, Plasmodium falciparum
ECLYIQLLLFFFKYMIQTLSY

SEQ ID NO: 3279782 - protein, 22 aa, Plasmodium falciparum
ECMYFMRYCIDKCINLKDEIIK

SEQ ID NO: 3279783 - protein, 18 aa, Plasmodium falciparum
ECNEIICLSAHYLQRHLN

SEQ ID NO: 3279784 - protein, 21 aa, Plasmodium falciparum
ECVCLSYIFSLFCDKYKILDS

SEQ ID NO: 3279785 - protein, 22 aa, Plasmodium falciparum
ECVFSFLILFPIRSFRLVGGSL

SEQ ID NO: 3279786 - protein, 24 aa, Plasmodium falciparum
EDQFLRFFAEWEEEFCDGLNKHEE

SEQ ID NO: 3279787 - protein, 21 aa, Plasmodium falciparum
EEFLKLFLLVRLFSAVNLVVF

SEQ ID NO: 3279788 - protein, 19 aa, Plasmodium falciparum
EEHPRIVLFAANKTLYYEV

SEQ ID NO: 3279789 - protein, 26 aa, Plasmodium falciparum
EEILNIFSIMYLFRICIYYLGRSKDF

SEQ ID NO: 3279790 - protein, 21 aa, Plasmodium falciparum
EEVYEYILFCYKKCYENYTRT

SEQ ID NO: 3279791 - protein, 18 aa, Plasmodium falciparum
EEWFPTIYYNWLAYVNNL

SEQ ID NO: 3279792 - protein, 20 aa, Plasmodium falciparum
EFAYVYKIYVDKVLNKFLKS

SEQ ID NO: 3279793 - protein, 19 aa, Plasmodium falciparum
EFFNIWFLFVMKRKKERNT

SEQ ID NO: 3279794 - protein, 17 aa, Plasmodium falciparum
EFIELFLTFLLKNYSLL

SEQ ID NO: 3279795 - protein, 19 aa, Plasmodium falciparum
EFIRPSFILILIINELKNY

SEQ ID NO: 3279796 - protein, 26 aa, Plasmodium falciparum
EFKIPKRVKIILNIKAGMVFGAAIIS

SEQ ID NO: 3279797 - protein, 19 aa, Plasmodium falciparum
EFTCPLCRSIANSFVVYIP

SEQ ID NO: 3279798 - protein, 24 aa, Plasmodium falciparum
EGYQYRLVKCFDFLHKKNISYYKD

SEQ ID NO: 3279799 - protein, 19 aa, Plasmodium falciparum
EHFPCIKLAYQAGIKGNFY

SEQ ID NO: 3279800 - protein, 18 aa, Plasmodium falciparum
EIALKCALLLKDIFICKK

SEQ ID NO: 3279801 - protein, 20 aa, Plasmodium falciparum
EIFFFYDYVCEFIKRKRWEK

SEQ ID NO: 3279802 - protein, 18 aa, Plasmodium falciparum
EIFLVGWIIDLLKQYLSL

SEQ ID NO: 3279803 - protein, 19 aa, Plasmodium falciparum
EIFYIRWYWFFLTIMTLGI

SEQ ID NO: 3279804 - protein, 25 aa, Plasmodium falciparum
EIIEYCFWRLVSIFESECIPNSWIL

SEQ ID NO: 3279805 - protein, 22 aa, Plasmodium falciparum
EIIYRKDVDCIFIYNIFFHMNR

SEQ ID NO: 3279806 - protein, 21 aa, Plasmodium falciparum
EIKELWPLIITFNFTLVFGNI

SEQ ID NO: 3279807 - protein, 18 aa, Plasmodium falciparum
EILEDILFCCSALNEYSA

SEQ ID NO: 3279808 - protein, 18 aa, Plasmodium falciparum
EILERSAFLGAFVLDKLK

SEQ ID NO: 3279809 - protein, 22 aa, Plasmodium falciparum
EILKHWIEYGVLKDKYNETFIA

SEQ ID NO: 3279810 - protein, 20 aa, Plasmodium falciparum
EILMILSLNCPIKFKNNFYM

SEQ ID NO: 3279811 - protein, 20 aa, Plasmodium falciparum
EILRCPKCYSYLHATILEDI

SEQ ID NO: 3279812 - protein, 18 aa, Plasmodium falciparum
EIYSDYCMIIFGSCNNDI

SEQ ID NO: 3279813 - protein, 23 aa, Plasmodium falciparum
EKCYKFSFEFVNIYLNRNESKKL

SEQ ID NO: 3279814 - protein, 26 aa, Plasmodium falciparum
EKDKFKRLYVLAALGLIAKLKLILFF

SEQ ID NO: 3279815 - protein, 18 aa, Plasmodium falciparum
EKELLWKLFMTVRNLKEV

SEQ ID NO: 3279816 - protein, 17 aa, Plasmodium falciparum
EKFCLNCGFGLGSGVLQ

SEQ ID NO: 3279817 - protein, 22 aa, Plasmodium falciparum
EKFIYCIKNFPGPFSRKSNKVD

SEQ ID NO: 3279818 - protein, 21 aa, Plasmodium falciparum
EKGKILLMLGCERGFSELELY

SEQ ID NO: 3279819 - protein, 23 aa, Plasmodium falciparum
EKLKQILCYNGIFLSWAEIYDFF

SEQ ID NO: 3279820 - protein, 23 aa, Plasmodium falciparum
EKLYEYFKLYFIYPMKNEEENKN

SEQ ID NO: 3279821 - protein, 18 aa, Plasmodium falciparum
EKNKWLDIFWKYFHKNEE

SEQ ID NO: 3279822 - protein, 26 aa, Plasmodium falciparum
EKQKIIWKSWIVKNVNNIENWFDEMW

SEQ ID NO: 3279823 - protein, 20 aa, Plasmodium falciparum
EKRVPIHLVHGAPGSGKSEL

SEQ ID NO: 3279824 - protein, 29 aa, Plasmodium falciparum
EKSMHYHPFFWKWVTEMLIDSMYWRKELK

SEQ ID NO: 3279825 - protein, 19 aa, Plasmodium falciparum
EKVCYKLKLLTCADDIGNT

SEQ ID NO: 3279826 - protein, 18 aa, Plasmodium falciparum
EKYLKCIPDINGIKIYIE

SEQ ID NO: 3279827 - protein, 22 aa, Plasmodium falciparum
ELFTIWCSIKFISHVVYLTLYD

SEQ ID NO: 3279828 - protein, 18 aa, Plasmodium falciparum
ELIKLLFDIMIRYLNDML

SEQ ID NO: 3279829 - protein, 18 aa, Plasmodium falciparum
ELKFSNIFKHVWEGTYTN

SEQ ID NO: 3279830 - protein, 22 aa, Plasmodium falciparum
ELKYINCIFIFMFLSLLIIFTS

SEQ ID NO: 3279831 - protein, 18 aa, Plasmodium falciparum
ELPFDRAVLLNVIDKKDK

SEQ ID NO: 3279832 - protein, 20 aa, Plasmodium falciparum
ELRMSIKYNVSRLIQEKKKD

SEQ ID NO: 3279833 - protein, 18 aa, Plasmodium falciparum
ELRNALKIYSNWPTFPQL

SEQ ID NO: 3279834 - protein, 24 aa, Plasmodium falciparum
EMKAEFYLYISFLLLIVFSKIQRK

SEQ ID NO: 3279835 - protein, 20 aa, Plasmodium falciparum
EMTKPFFLFFRIFNRILVEK

SEQ ID NO: 3279836 - protein, 21 aa, Plasmodium falciparum
ENCKFLFKYFHYIFFHKNGGT

SEQ ID NO: 3279837 - protein, 19 aa, Plasmodium falciparum
ENITNCVLYKSIIYNNCNK

SEQ ID NO: 3279838 - protein, 17 aa, Plasmodium falciparum
ENKLICFNRSFINNESC

SEQ ID NO: 3279839 - protein, 22 aa, Plasmodium falciparum
ENKRLLSILIFYTFVYYYNNNN

SEQ ID NO: 3279840 - protein, 21 aa, Plasmodium falciparum
ENKRNVCLSIIFSININHKEK

SEQ ID NO: 3279841 - protein, 21 aa, Plasmodium falciparum
ENLKKGFSFLGFWRNQYDQKY

SEQ ID NO: 3279842 - protein, 17 aa, Plasmodium falciparum
ENLKRAFTFFSPDDYEE

SEQ ID NO: 3279843 - protein, 25 aa, Plasmodium falciparum
EPPRRQTLCLGRTYLLHRGHEEDYK

SEQ ID NO: 3279844 - protein, 24 aa, Plasmodium falciparum
EPQIFLLRWIRLFYCREFPIDDTV

SEQ ID NO: 3279845 - protein, 17 aa, Plasmodium falciparum
ERLPFYVLHGFVHLMHK

SEQ ID NO: 3279846 - protein, 19 aa, Plasmodium falciparum
ERLRYTLIIIYIFFCLTLH

SEQ ID NO: 3279847 - protein, 17 aa, Plasmodium falciparum
ERMKICTFQGVMNMNIN

SEQ ID NO: 3279848 - protein, 23 aa, Plasmodium falciparum
ESFLACIWFCFQIVNSALILTFG

SEQ ID NO: 3279849 - protein, 19 aa, Plasmodium falciparum
ESIFILCFFYLYNFLSFEI

SEQ ID NO: 3279850 - protein, 19 aa, Plasmodium falciparum
ESILFIFLIEFCLFIYSNF

SEQ ID NO: 3279851 - protein, 20 aa, Plasmodium falciparum
ESKELLALCLKKVNKLKKLK

SEQ ID NO: 3279852 - protein, 19 aa, Plasmodium falciparum
ESLFRLGFVKIIFSNKNLS

SEQ ID NO: 3279853 - protein, 17 aa, Plasmodium falciparum
ESNFAYFSHLIQAIQFD

SEQ ID NO: 3279854 - protein, 22 aa, Plasmodium falciparum
ESNNCLNYSWGIDKYDYTLLQT

SEQ ID NO: 3279855 - protein, 20 aa, Plasmodium falciparum
ESWTHVFSIMMIRYLILKKP

SEQ ID NO: 3279856 - protein, 20 aa, Plasmodium falciparum
ETFNLLKNRFHIIGESNNIN

SEQ ID NO: 3279857 - protein, 17 aa, Plasmodium falciparum
ETGCLKYGCGLGGVAGS

SEQ ID NO: 3279858 - protein, 23 aa, Plasmodium falciparum
ETKSGNCITRFIKNITFGKNRNN

SEQ ID NO: 3279859 - protein, 17 aa, Plasmodium falciparum
ETMCFMFKKLIYSNFKL

SEQ ID NO: 3279860 - protein, 17 aa, Plasmodium falciparum
ETMMKFIIQMVVNKTIP

SEQ ID NO: 3279861 - protein, 17 aa, Plasmodium falciparum
ETVKKWHKLECGLCHRI

SEQ ID NO: 3279862 - protein, 18 aa, Plasmodium falciparum
EVLNKFIFVFFLFYLTSI

SEQ ID NO: 3279863 - protein, 17 aa, Plasmodium falciparum
EVLSIICVLGLNINGEP

SEQ ID NO: 3279864 - protein, 30 aa, Plasmodium falciparum
EVRSSIRLRSLLKAVLKWGNYVNYGINDNE

SEQ ID NO: 3279865 - protein, 25 aa, Plasmodium falciparum
EVTMGSLLCSFLWLTYGFTLKDGFI

SEQ ID NO: 3279866 - protein, 26 aa, Plasmodium falciparum
EYFKIELSINFSITFIFINILLVFFS

SEQ ID NO: 3279867 - protein, 20 aa, Plasmodium falciparum
EYFSCLRSLVFLEINDYMLP

SEQ ID NO: 3279868 - protein, 25 aa, Plasmodium falciparum
EYLPNVLILWCKRVKYAINIYNNNN

SEQ ID NO: 3279869 - protein, 17 aa, Plasmodium falciparum
EYMEVLEIISLIFYGMK

SEQ ID NO: 3279870 - protein, 18 aa, Plasmodium falciparum
EYNKACAYYFFKNLNFSI

SEQ ID NO: 3279871 - protein, 20 aa, Plasmodium falciparum
EYRREFKKILGYHNFSSKSS

SEQ ID NO: 3279872 - protein, 18 aa, Plasmodium falciparum
FADICGFTSWANGVDASE

SEQ ID NO: 3279873 - protein, 18 aa, Plasmodium falciparum
FAISYLLYCHIIWNGCYN

SEQ ID NO: 3279874 - protein, 17 aa, Plasmodium falciparum
FCHNCGYGLGSVAPNIG

SEQ ID NO: 3279875 - protein, 18 aa, Plasmodium falciparum
FCHNCGYGLGSVAPSIGL

SEQ ID NO: 3279876 - protein, 18 aa, Plasmodium falciparum
FCIFVFFSFFFVKMRKVI

SEQ ID NO: 3279877 - protein, 25 aa, Plasmodium falciparum
FCKNMKLPILFFLLIKRLLIMEVSN

SEQ ID NO: 3279878 - protein, 17 aa, Plasmodium falciparum
FCLFACPYLDKKGGKRV

SEQ ID NO: 3279879 - protein, 19 aa, Plasmodium falciparum
FCLNCGFGLGSGVLQSLGL

SEQ ID NO: 3279880 - protein, 23 aa, Plasmodium falciparum
FCLNVEMLFSFLFCKKKNYFYNI

SEQ ID NO: 3279881 - protein, 17 aa, Plasmodium falciparum
FCSFSLMFLQFLFNGVF

SEQ ID NO: 3279882 - protein, 19 aa, Plasmodium falciparum
FCVLECLKVFYLKRKEKKF

SEQ ID NO: 3279883 - protein, 25 aa, Plasmodium falciparum
FCVLKFKRINLGFLYMHDDKQIENK

SEQ ID NO: 3279884 - protein, 20 aa, Plasmodium falciparum
FCWRSDTPLIYRAIPAWFVR

SEQ ID NO: 3279885 - protein, 17 aa, Plasmodium falciparum
FCYKICIAGACNSGKSS

SEQ ID NO: 3279886 - protein, 17 aa, Plasmodium falciparum
FCYQLLHGATCKSYNEW

SEQ ID NO: 3279887 - protein, 17 aa, Plasmodium falciparum
FDFSFSLTEEIIFLYKI

SEQ ID NO: 3279888 - protein, 17 aa, Plasmodium falciparum
FDFTIRFAFVYISWIKK

SEQ ID NO: 3279889 - protein, 26 aa, Plasmodium falciparum
FDICADFFLSINIDLLWEEFNKTMQV

SEQ ID NO: 3279890 - protein, 17 aa, Plasmodium falciparum
FDIPSLIDEVGWIPVIF

SEQ ID NO: 3279891 - protein, 18 aa, Plasmodium falciparum
FDKIIKIRLCFKQAAFSM

SEQ ID NO: 3279892 - protein, 17 aa, Plasmodium falciparum
FDSFFLLLCIDKNKEHV

SEQ ID NO: 3279893 - protein, 18 aa, Plasmodium falciparum
FDSIKCRFILISKMKNTK

SEQ ID NO: 3279894 - protein, 20 aa, Plasmodium falciparum
FDYFFACGDFNFRINKNLEE

SEQ ID NO: 3279895 - protein, 18 aa, Plasmodium falciparum
FECLYRFLNIYPPNPFRI

SEQ ID NO: 3279896 - protein, 19 aa, Plasmodium falciparum
FEEYLLCYPSFLSSLLTMN

SEQ ID NO: 3279897 - protein, 23 aa, Plasmodium falciparum
FEFFKLLKFEVIYIILISLKYDL

SEQ ID NO: 3279898 - protein, 17 aa, Plasmodium falciparum
FEGADCKKCTVTCDNFV

SEQ ID NO: 3279899 - protein, 18 aa, Plasmodium falciparum
FEIIKRKWLNENNIKCTY

SEQ ID NO: 3279900 - protein, 17 aa, Plasmodium falciparum
FEVIYIILISLKYDLDI

SEQ ID NO: 3279901 - protein, 21 aa, Plasmodium falciparum
FEWKSICVIAFIFLLIFIGSN

SEQ ID NO: 3279902 - protein, 17 aa, Plasmodium falciparum
FFALSVWCFIKLLIYVT

SEQ ID NO: 3279903 - protein, 17 aa, Plasmodium falciparum
FFCSFCFILYNYDLTNC

SEQ ID NO: 3279904 - protein, 20 aa, Plasmodium falciparum
FFFFFKIHYLFFLIKFKCEN

SEQ ID NO: 3279905 - protein, 17 aa, Plasmodium falciparum
FFFFVCNYLCTLSLDAM

SEQ ID NO: 3279906 - protein, 18 aa, Plasmodium falciparum
FFGCYKFINIDGIESMTY

SEQ ID NO: 3279907 - protein, 18 aa, Plasmodium falciparum
FFICICVLLHMMVFGVCI

SEQ ID NO: 3279908 - protein, 18 aa, Plasmodium falciparum
FFILKFSYNYVFLLNIQK

SEQ ID NO: 3279909 - protein, 18 aa, Plasmodium falciparum
FFIVKLFFDYVVEKVEYL

SEQ ID NO: 3279910 - protein, 18 aa, Plasmodium falciparum
FFIYHSYIYIRLSNLKTE

SEQ ID NO: 3279911 - protein, 22 aa, Plasmodium falciparum
FFKCKICIFSNTFLFIYFVLFL

SEQ ID NO: 3279912 - protein, 20 aa, Plasmodium falciparum
FFKIVLRIVPFFKVKNKKKP

SEQ ID NO: 3279913 - protein, 18 aa, Plasmodium falciparum
FFLHLCLESGISINVALM

SEQ ID NO: 3279914 - protein, 18 aa, Plasmodium falciparum
FFLNCVISFFRRIRRSYI

SEQ ID NO: 3279915 - protein, 17 aa, Plasmodium falciparum
FFLSLVIILIFIYPVFR

SEQ ID NO: 3279916 - protein, 17 aa, Plasmodium falciparum
FFNPLFLSFLFFFSSSF

SEQ ID NO: 3279917 - protein, 20 aa, Plasmodium falciparum
FFQRFFPLFLLVGYANGNII

SEQ ID NO: 3279918 - protein, 17 aa, Plasmodium falciparum
FFSFFDFFKEDNIEELK

SEQ ID NO: 3279919 - protein, 18 aa, Plasmodium falciparum
FFSFPYEILCRIIIIQLK

SEQ ID NO: 3279920 - protein, 18 aa, Plasmodium falciparum
FFSKFSFFQCYKLLEYSL

SEQ ID NO: 3279921 - protein, 22 aa, Plasmodium falciparum
FFVVHFFLCFKIPNNKITNVLT

SEQ ID NO: 3279922 - protein, 17 aa, Plasmodium falciparum
FFWKEIITSLIWMIISI

SEQ ID NO: 3279923 - protein, 19 aa, Plasmodium falciparum
FGCVAPFLFAWIFSNGLIF

SEQ ID NO: 3279924 - protein, 21 aa, Plasmodium falciparum
FGIELKRMFDNCRLYNAPTTI

SEQ ID NO: 3279925 - protein, 19 aa, Plasmodium falciparum
FGMYEICRYILQAYLYNNL

SEQ ID NO: 3279926 - protein, 23 aa, Plasmodium falciparum
FHSKKILLIFGIIYVVLLNAYIC

SEQ ID NO: 3279927 - protein, 18 aa, Plasmodium falciparum
FHSSHIFASNPFIVSREH

SEQ ID NO: 3279928 - protein, 25 aa, Plasmodium falciparum
FICLLIRCLILFYICRIIRKKYSVL

SEQ ID NO: 3279929 - protein, 21 aa, Plasmodium falciparum
FICMNHIFKLINIINKFKLYQ

SEQ ID NO: 3279930 - protein, 17 aa, Plasmodium falciparum
FICPYGWNVADYLMDIL

SEQ ID NO: 3279931 - protein, 18 aa, Plasmodium falciparum
FIFSCYIYFNLVSIQIYS

SEQ ID NO: 3279932 - protein, 17 aa, Plasmodium falciparum
FIIKEILMILSLNCPIK

SEQ ID NO: 3279933 - protein, 24 aa, Plasmodium falciparum
FIKIICMFGKYVIQVILFISFFIY

SEQ ID NO: 3279934 - protein, 19 aa, Plasmodium falciparum
FIKKLHLFLNAPFYFFNMF

SEQ ID NO: 3279935 - protein, 18 aa, Plasmodium falciparum
FIKLCLCLNYFVNLNIKN

SEQ ID NO: 3279936 - protein, 23 aa, Plasmodium falciparum
FIKLYKYKLCFLINNTVVQLNNF

SEQ ID NO: 3279937 - protein, 21 aa, Plasmodium falciparum
FIKRFLPICEEFLLKNEDNVF

SEQ ID NO: 3279938 - protein, 18 aa, Plasmodium falciparum
FIKSLRVLQDMYKTNRRN

SEQ ID NO: 3279939 - protein, 20 aa, Plasmodium falciparum
FILLCIKCIVSIRNDKLINF

SEQ ID NO: 3279940 - protein, 18 aa, Plasmodium falciparum
FILLLIFLFQRIRAENEY

SEQ ID NO: 3279941 - protein, 18 aa, Plasmodium falciparum
FILNFLIELFRIIKINEI

SEQ ID NO: 3279942 - protein, 17 aa, Plasmodium falciparum
FIMPLIRRFFFLTKSEQ

SEQ ID NO: 3279943 - protein, 19 aa, Plasmodium falciparum
FINSPNFFFSFSVFYNILF

SEQ ID NO: 3279944 - protein, 18 aa, Plasmodium falciparum
FIPFFKKYYFLWKFIEHE

SEQ ID NO: 3279945 - protein, 28 aa, Plasmodium falciparum
FIQRLFRLLCFRLMCLFLSTVHLNKFTS

SEQ ID NO: 3279946 - protein, 24 aa, Plasmodium falciparum
FISIWNIMCILFWDTDEINNFTFL

SEQ ID NO: 3279947 - protein, 17 aa, Plasmodium falciparum
FISIYLYFIQSRVYNPI

SEQ ID NO: 3279948 - protein, 20 aa, Plasmodium falciparum
FKASFLFCCKFIISVWVSYY

SEQ ID NO: 3279949 - protein, 19 aa, Plasmodium falciparum
FKDNFLIRIYDTYINKYLI

SEQ ID NO: 3279950 - protein, 25 aa, Plasmodium falciparum
FKFKCLLSICFFRFTSAFASNLMSN

SEQ ID NO: 3279951 - protein, 20 aa, Plasmodium falciparum
FKISDTFLLHLLKEFKENKA

SEQ ID NO: 3279952 - protein, 27 aa, Plasmodium falciparum
FKIYCVLGLKVLRTFLIKYLRSIKLCI

SEQ ID NO: 3279953 - protein, 22 aa, Plasmodium falciparum
FKKKCLMCGSLIDTKLLEEQKK

SEQ ID NO: 3279954 - protein, 21 aa, Plasmodium falciparum
FKKKYSSNFLKMFNKNIVKEY

SEQ ID NO: 3279955 - protein, 20 aa, Plasmodium falciparum
FKLFRICYWFSILYIFMLTP

SEQ ID NO: 3279956 - protein, 17 aa, Plasmodium falciparum
FKLMCNKICNLEERNVV

SEQ ID NO: 3279957 - protein, 17 aa, Plasmodium falciparum
FKLNRFLSCVFFSVHFS

SEQ ID NO: 3279958 - protein, 19 aa, Plasmodium falciparum
FKMKFSFYQSVSKNKIIID

SEQ ID NO: 3279959 - protein, 18 aa, Plasmodium falciparum
FKMKFSIIIGFIHMTFGV

SEQ ID NO: 3279960 - protein, 17 aa, Plasmodium falciparum
FKNIFLVSAKTGYNVKK

SEQ ID NO: 3279961 - protein, 17 aa, Plasmodium falciparum
FKNIICIVVIIRYLLWN

SEQ ID NO: 3279962 - protein, 24 aa, Plasmodium falciparum
FKNKICLFIALSILFYVGDMLNES

SEQ ID NO: 3279963 - protein, 20 aa, Plasmodium falciparum
FKNVHLWGKYSYYNDLDLPK

SEQ ID NO: 3279964 - protein, 19 aa, Plasmodium falciparum
FKQRFAFKLAKHYKLVVRV

SEQ ID NO: 3279965 - protein, 17 aa, Plasmodium falciparum
FKRWLEYFFEDYNRIQK

SEQ ID NO: 3279966 - protein, 18 aa, Plasmodium falciparum
FKSFDIFYFTGFNSDDLI

SEQ ID NO: 3279967 - protein, 18 aa, Plasmodium falciparum
FKSFLWKNINIFKYSELD

SEQ ID NO: 3279968 - protein, 26 aa, Plasmodium falciparum
FKTIIRVFRIIYEFQDFSPILREDIF

SEQ ID NO: 3279969 - protein, 22 aa, Plasmodium falciparum
FKVGLCLHPLCYVNSFKNFSLL

SEQ ID NO: 3279970 - protein, 19 aa, Plasmodium falciparum
FKVHIAIPFNLSDILQVLD

SEQ ID NO: 3279971 - protein, 17 aa, Plasmodium falciparum
FKVSINVLNIWKKQLAR

SEQ ID NO: 3279972 - protein, 25 aa, Plasmodium falciparum
FKYICLTCAFKIYKLFKIIFENILL

SEQ ID NO: 3279973 - protein, 19 aa, Plasmodium falciparum
FKYLHFNFFYICSKLENKS

SEQ ID NO: 3279974 - protein, 20 aa, Plasmodium falciparum
FKYSKVCLLGYSLGSAMAYE

SEQ ID NO: 3279975 - protein, 19 aa, Plasmodium falciparum
FLCSIACMYNCLNVFIFYC

SEQ ID NO: 3279976 - protein, 18 aa, Plasmodium falciparum
FLCVYNFSFCNVIPLNCV

SEQ ID NO: 3279977 - protein, 21 aa, Plasmodium falciparum
FLFEHFSIFYVYRLISFLTLF

SEQ ID NO: 3279978 - protein, 19 aa, Plasmodium falciparum
FLFFFKIYIHNVLSNVHIC

SEQ ID NO: 3279979 - protein, 22 aa, Plasmodium falciparum
FLFKSKRFFNTWKEKGKWYTKN

SEQ ID NO: 3279980 - protein, 20 aa, Plasmodium falciparum
FLFLLTCRDINLSFLHILSF

SEQ ID NO: 3279981 - protein, 21 aa, Plasmodium falciparum
FLFNRFFYFLLMYIRKFCCFS

SEQ ID NO: 3279982 - protein, 19 aa, Plasmodium falciparum
FLFYCFKQLLSSFFTEDKN

SEQ ID NO: 3279983 - protein, 17 aa, Plasmodium falciparum
FLICYINTLFLRRVLFC

SEQ ID NO: 3279984 - protein, 19 aa, Plasmodium falciparum
FLKIFRYVKNWFPIKSSNN

SEQ ID NO: 3279985 - protein, 17 aa, Plasmodium falciparum
FLKRACLHLYIKFKKEI

SEQ ID NO: 3279986 - protein, 19 aa, Plasmodium falciparum
FLKRIYKAFFIFFRCILSS

SEQ ID NO: 3279987 - protein, 18 aa, Plasmodium falciparum
FLLCVLCFFLSYYNLYNF

SEQ ID NO: 3279988 - protein, 18 aa, Plasmodium falciparum
FLLGYPFVVEFIKNNEHK

SEQ ID NO: 3279989 - protein, 19 aa, Plasmodium falciparum
FLLICGFCIELYDNISNDI

SEQ ID NO: 3279990 - protein, 18 aa, Plasmodium falciparum
FLLKIGKSLIRFLIFIGN

SEQ ID NO: 3279991 - protein, 18 aa, Plasmodium falciparum
FLLLCFIITYGILTVRKH

SEQ ID NO: 3279992 - protein, 17 aa, Plasmodium falciparum
FLLMCFYHTVNYNGTNK

SEQ ID NO: 3279993 - protein, 18 aa, Plasmodium falciparum
FLLPIFLKIYPNLLPSTF

SEQ ID NO: 3279994 - protein, 17 aa, Plasmodium falciparum
FLNCLKYIFSYNKEMYS

SEQ ID NO: 3279995 - protein, 17 aa, Plasmodium falciparum
FLNFFIKYWNTISSEKK

SEQ ID NO: 3279996 - protein, 18 aa, Plasmodium falciparum
FLNFTLATSILLIIDTDI

SEQ ID NO: 3279997 - protein, 17 aa, Plasmodium falciparum
FLQKDIISIYNFLNFYL

SEQ ID NO: 3279998 - protein, 19 aa, Plasmodium falciparum
FLRAFKMIVMYLLIIILVL

SEQ ID NO: 3279999 - protein, 22 aa, Plasmodium falciparum
FLRKGSCEKREFLYFINSKRKG

SEQ ID NO: 3280000 - protein, 19 aa, Plasmodium falciparum
FLSDFSLNFLYEVVKSKNS

SEQ ID NO: 3280001 - protein, 17 aa, Plasmodium falciparum
FLSFFLFFFLFHNNNNT

SEQ ID NO: 3280002 - protein, 20 aa, Plasmodium falciparum
FLSICLFSSLYLHSYILFLF

SEQ ID NO: 3280003 - protein, 20 aa, Plasmodium falciparum
FLSMCPFNFDTKRNIYDNQT

SEQ ID NO: 3280004 - protein, 23 aa, Plasmodium falciparum
FLSQFFIWRARIFFHLAKFHKYV

SEQ ID NO: 3280005 - protein, 23 aa, Plasmodium falciparum
FLTCLPFNIYIRLFDIYTFNEKI

SEQ ID NO: 3280006 - protein, 17 aa, Plasmodium falciparum
FLTFLPCQKIKFIKNNI

SEQ ID NO: 3280007 - protein, 19 aa, Plasmodium falciparum
FLYDIFLKFCLKYIDGEIC

SEQ ID NO: 3280008 - protein, 22 aa, Plasmodium falciparum
FLYKRIYPIWFPLSWGGEQDLG

SEQ ID NO: 3280009 - protein, 18 aa, Plasmodium falciparum
FLYMSFICLLIRCLILFY

SEQ ID NO: 3280010 - protein, 17 aa, Plasmodium falciparum
FMAEFFKFLDLRNGKVI

SEQ ID NO: 3280011 - protein, 19 aa, Plasmodium falciparum
FMCVKSLFLFYLYSRCTKK

SEQ ID NO: 3280012 - protein, 18 aa, Plasmodium falciparum
FMEFLFIIACVSFTIIYS

SEQ ID NO: 3280013 - protein, 21 aa, Plasmodium falciparum
FMIKKLKSFFFFTTKFSYLHM

SEQ ID NO: 3280014 - protein, 18 aa, Plasmodium falciparum
FMNILWCASADLHAKKNN

SEQ ID NO: 3280015 - protein, 24 aa, Plasmodium falciparum
FMQPDYFNWLAFYIVKSRASKEVN

SEQ ID NO: 3280016 - protein, 18 aa, Plasmodium falciparum
FMSSFTFVFFFFIFIYAF

SEQ ID NO: 3280017 - protein, 18 aa, Plasmodium falciparum
FMYLNIICMIIKYIKLKK

SEQ ID NO: 3280018 - protein, 17 aa, Plasmodium falciparum
FNCPGCGRECRKYKNWI

SEQ ID NO: 3280019 - protein, 17 aa, Plasmodium falciparum
FNILYFKLFRLIFDKIE

SEQ ID NO: 3280020 - protein, 18 aa, Plasmodium falciparum
FNIPRITFTWIHRQDVII

SEQ ID NO: 3280021 - protein, 21 aa, Plasmodium falciparum
FNIPVSVIWFLYGMCTYVIAK

SEQ ID NO: 3280022 - protein, 17 aa, Plasmodium falciparum
FNIYYGLYYIVFLTLIL

SEQ ID NO: 3280023 - protein, 18 aa, Plasmodium falciparum
FNKYRLYIIFIFIILTFL

SEQ ID NO: 3280024 - protein, 21 aa, Plasmodium falciparum
FNLSINLCRLLLYGVLLDVTF

SEQ ID NO: 3280025 - protein, 23 aa, Plasmodium falciparum
FNLYKCTLDWEWKNGKNTCKAKS

SEQ ID NO: 3280026 - protein, 25 aa, Plasmodium falciparum
FNPIIWKKICGVPLELQDLADYDFV

SEQ ID NO: 3280027 - protein, 19 aa, Plasmodium falciparum
FNTIILFRASGGFRLLSIN

SEQ ID NO: 3280028 - protein, 20 aa, Plasmodium falciparum
FNVFFQRWLRNFVHDYNKLK

SEQ ID NO: 3280029 - protein, 24 aa, Plasmodium falciparum
FNVSGFLGVLVCNFTGMKIKIYDN

SEQ ID NO: 3280030 - protein, 17 aa, Plasmodium falciparum
FPKNCIRLLFSNLLAYD

SEQ ID NO: 3280031 - protein, 25 aa, Plasmodium falciparum
FPLLVMELFVSIAYTCLKKKKKGYI

SEQ ID NO: 3280032 - protein, 17 aa, Plasmodium falciparum
FPLNIFLSFSFIRYNSI

SEQ ID NO: 3280033 - protein, 22 aa, Plasmodium falciparum
FPNIRFKFFFFFLMLVDIFLPY

SEQ ID NO: 3280034 - protein, 29 aa, Plasmodium falciparum
FPRNTFLPWRFSVELFLWDLLNVLPHELP

SEQ ID NO: 3280035 - protein, 20 aa, Plasmodium falciparum
FQFPECMRGFLFQTASEYLY

SEQ ID NO: 3280036 - protein, 18 aa, Plasmodium falciparum
FQIMIVRCLSFLLKKKNI

SEQ ID NO: 3280037 - protein, 20 aa, Plasmodium falciparum
FQLSCAVCLEPLYSENLSKI

SEQ ID NO: 3280038 - protein, 17 aa, Plasmodium falciparum
FRFSRLIIGKNFIKNLE

SEQ ID NO: 3280039 - protein, 23 aa, Plasmodium falciparum
FRGFGATCSYEWIECDENVEVKI

SEQ ID NO: 3280040 - protein, 19 aa, Plasmodium falciparum
FRIDISFLKIFFLLNDVRQ

SEQ ID NO: 3280041 - protein, 17 aa, Plasmodium falciparum
FRKKYWWRVHYMLTEEV

SEQ ID NO: 3280042 - protein, 17 aa, Plasmodium falciparum
FRLPLCVVIYYIILMSQ

SEQ ID NO: 3280043 - protein, 24 aa, Plasmodium falciparum
FRNMIKMALSFYFLYKINVHLFIV

SEQ ID NO: 3280044 - protein, 21 aa, Plasmodium falciparum
FRNSCIFTMQFILNRINYCKE

SEQ ID NO: 3280045 - protein, 18 aa, Plasmodium falciparum
FRSVLKYTRLIPSYSTSG

SEQ ID NO: 3280046 - protein, 22 aa, Plasmodium falciparum
FRTDLKFNLSIIFKAYARKALA

SEQ ID NO: 3280047 - protein, 17 aa, Plasmodium falciparum
FRWLHEWGSDFCGTRKR

SEQ ID NO: 3280048 - protein, 19 aa, Plasmodium falciparum
FRYVPDYKKAINIYATSIQ

SEQ ID NO: 3280049 - protein, 35 aa, Plasmodium falciparum
FSAIICFFKSIFIFLYFCLCPWKLLKLKKKKSNDN

SEQ ID NO: 3280050 - protein, 19 aa, Plasmodium falciparum
FSARLGVIIKFLLCDYTHI

SEQ ID NO: 3280051 - protein, 17 aa, Plasmodium falciparum
FSCFNFLGIFEWPYLLK

SEQ ID NO: 3280052 - protein, 20 aa, Plasmodium falciparum
FSFFLYCLFLYKINTIYFFL

SEQ ID NO: 3280053 - protein, 20 aa, Plasmodium falciparum
FSILVSICYDGYMYIWKEHM

SEQ ID NO: 3280054 - protein, 22 aa, Plasmodium falciparum
FSKGLCCLFDILLRNLIYNLYY

SEQ ID NO: 3280055 - protein, 20 aa, Plasmodium falciparum
FSLDCSYTFEISLFGIQIRK

SEQ ID NO: 3280056 - protein, 20 aa, Plasmodium falciparum
FSLSFYRQWIRFIKIKNEDF

SEQ ID NO: 3280057 - protein, 22 aa, Plasmodium falciparum
FSNDFCKGMNLHFLISAEEIDS

SEQ ID NO: 3280058 - protein, 25 aa, Plasmodium falciparum
FSRMLPFDFVLRIYGIYLFEGQKTL

SEQ ID NO: 3280059 - protein, 17 aa, Plasmodium falciparum
FSTCKKVYMYLDDVKPH

SEQ ID NO: 3280060 - protein, 18 aa, Plasmodium falciparum
FSVCLEYLFLVSPKDLYN

SEQ ID NO: 3280061 - protein, 19 aa, Plasmodium falciparum
FTIRFAFVYISWIKKCNKK

SEQ ID NO: 3280062 - protein, 18 aa, Plasmodium falciparum
FTKNWKLLFKNIRNNIIT

SEQ ID NO: 3280063 - protein, 18 aa, Plasmodium falciparum
FTLSFLLSWVYFYRTIKI

SEQ ID NO: 3280064 - protein, 20 aa, Plasmodium falciparum
FTYWRKVRRSIYQNIQYKDY

SEQ ID NO: 3280065 - protein, 20 aa, Plasmodium falciparum
FVFILSLCRLYLPIYIYLYP

SEQ ID NO: 3280066 - protein, 18 aa, Plasmodium falciparum
FVGPFLRNTECVIINLIK

SEQ ID NO: 3280067 - protein, 17 aa, Plasmodium falciparum
FVLHLFYIIGIIILFLD

SEQ ID NO: 3280068 - protein, 20 aa, Plasmodium falciparum
FVLHVYRMMHILSYNIMDLK

SEQ ID NO: 3280069 - protein, 18 aa, Plasmodium falciparum
FVRYILCMIITFIFIYNQ

SEQ ID NO: 3280070 - protein, 18 aa, Plasmodium falciparum
FVTYCLFLLFQLYTHISL

SEQ ID NO: 3280071 - protein, 19 aa, Plasmodium falciparum
FVVELFIIFRIMYKKKKLI

SEQ ID NO: 3280072 - protein, 21 aa, Plasmodium falciparum
FWDIFCNLNYIFLFNSNNINM

SEQ ID NO: 3280073 - protein, 17 aa, Plasmodium falciparum
FWLCLYRLYIFPNADNV

SEQ ID NO: 3280074 - protein, 20 aa, Plasmodium falciparum
FYDNPWCHIKFSSIVNILLY

SEQ ID NO: 3280075 - protein, 17 aa, Plasmodium falciparum
FYDSIFLCEAAELSPHI

SEQ ID NO: 3280076 - protein, 17 aa, Plasmodium falciparum
FYFIFGLIFCLNNSFQK

SEQ ID NO: 3280077 - protein, 18 aa, Plasmodium falciparum
FYFLEFYDKLFVKREPLM

SEQ ID NO: 3280078 - protein, 20 aa, Plasmodium falciparum
FYFSCLNIDIDILKIFEIIK

SEQ ID NO: 3280079 - protein, 17 aa, Plasmodium falciparum
FYFWIGRFLNDSMYWRG

SEQ ID NO: 3280080 - protein, 27 aa, Plasmodium falciparum
FYIIKTCMYCTFKLILTKPIIVTDKTW

SEQ ID NO: 3280081 - protein, 17 aa, Plasmodium falciparum
FYINCLMLLNINIDIDY

SEQ ID NO: 3280082 - protein, 17 aa, Plasmodium falciparum
FYLEDMIKDGSLLYSDM

SEQ ID NO: 3280083 - protein, 25 aa, Plasmodium falciparum
FYLKCFLCVRIFFNILKNFPFCNTI

SEQ ID NO: 3280084 - protein, 21 aa, Plasmodium falciparum
FYNRLKIYFFRDNVNENYYNY

SEQ ID NO: 3280085 - protein, 24 aa, Plasmodium falciparum
FYPICKKLTVPMNVHFNINADYIN

SEQ ID NO: 3280086 - protein, 17 aa, Plasmodium falciparum
FYRLKIKIVKKINEYLK

SEQ ID NO: 3280087 - protein, 17 aa, Plasmodium falciparum
FYYLRMFFENHINYNNI

SEQ ID NO: 3280088 - protein, 17 aa, Plasmodium falciparum
FYYYKKRIDHFQSVLYD

SEQ ID NO: 3280089 - protein, 22 aa, Plasmodium falciparum
GCIIRYMSLRVFYKMTKLFILY

SEQ ID NO: 3280090 - protein, 20 aa, Plasmodium falciparum
GCLKYGCGLGGVAGSVGLFG

SEQ ID NO: 3280091 - protein, 24 aa, Plasmodium falciparum
GCYKSFYKFCFFPIRYIPYIQRYT

SEQ ID NO: 3280092 - protein, 19 aa, Plasmodium falciparum
GDARVAINIIDFAVQRMDK

SEQ ID NO: 3280093 - protein, 19 aa, Plasmodium falciparum
GDEEMLSCFHRFYESIEAN

SEQ ID NO: 3280094 - protein, 24 aa, Plasmodium falciparum
GDIKDCSISEYMSRYMKNNGNDKD

SEQ ID NO: 3280095 - protein, 19 aa, Plasmodium falciparum
GEKIVWVSFEFKNLHMLKK

SEQ ID NO: 3280096 - protein, 24 aa, Plasmodium falciparum
GEPRTLFYYEIYKKLFVYYECAIN

SEQ ID NO: 3280097 - protein, 19 aa, Plasmodium falciparum
GERRLTCDLLELVLNAIML

SEQ ID NO: 3280098 - protein, 20 aa, Plasmodium falciparum
GEYPLSMFLHDLIEIDMESN

SEQ ID NO: 3280099 - protein, 19 aa, Plasmodium falciparum
GFIGMACSYLFVILTRYYT

SEQ ID NO: 3280100 - protein, 22 aa, Plasmodium falciparum
GFKYIGYRVSFELKKDNKKKAQ

SEQ ID NO: 3280101 - protein, 23 aa, Plasmodium falciparum
GFLWPNPKCRLAFIDVSIGKPGS

SEQ ID NO: 3280102 - protein, 20 aa, Plasmodium falciparum
GGIFSPEFVPIGVLSSMTAA

SEQ ID NO: 3280103 - protein, 23 aa, Plasmodium falciparum
GGNECFICPSIIYDAVINSRALY

SEQ ID NO: 3280104 - protein, 18 aa, Plasmodium falciparum
GGVCFRPYFEQKFAEIAF

SEQ ID NO: 3280105 - protein, 18 aa, Plasmodium falciparum
GHPFKYQPTKGLKEYEES

SEQ ID NO: 3280106 - protein, 22 aa, Plasmodium falciparum
GHSLKIKVCYNVVSLNYQEDHI

SEQ ID NO: 3280107 - protein, 19 aa, Plasmodium falciparum
GICIQCYFIILSDTYYKTG

SEQ ID NO: 3280108 - protein, 17 aa, Plasmodium falciparum
GICLFKFINFLSYHKSS

SEQ ID NO: 3280109 - protein, 18 aa, Plasmodium falciparum
GIKGRFHKFISFKNKSNI

SEQ ID NO: 3280110 - protein, 18 aa, Plasmodium falciparum
GKEFSLDCSYTFEISLFG

SEQ ID NO: 3280111 - protein, 25 aa, Plasmodium falciparum
GKFFFPYEQLRAVFWIWIQSLFSDI

SEQ ID NO: 3280112 - protein, 17 aa, Plasmodium falciparum
GKISYPDAYWVISNEYK

SEQ ID NO: 3280113 - protein, 18 aa, Plasmodium falciparum
GKMFKKRSLIEMTLKVPA

SEQ ID NO: 3280114 - protein, 25 aa, Plasmodium falciparum
GKRVYEFFKKFHLLDWFYNPNDETC

SEQ ID NO: 3280115 - protein, 22 aa, Plasmodium falciparum
GKYTRQLICDYLKFLLNSIQNE

SEQ ID NO: 3280116 - protein, 25 aa, Plasmodium falciparum
GLIAKLKLILFFSTYVNSRNETNNS

SEQ ID NO: 3280117 - protein, 19 aa, Plasmodium falciparum
GLIFLYEFMRYILKIDKSI

SEQ ID NO: 3280118 - protein, 19 aa, Plasmodium falciparum
GLIICSSVGFIFRKEINNS

SEQ ID NO: 3280119 - protein, 19 aa, Plasmodium falciparum
GLINIIRFPLLYEINLKKL

SEQ ID NO: 3280120 - protein, 17 aa, Plasmodium falciparum
GLRLVYASLHYKYKNNN

SEQ ID NO: 3280121 - protein, 17 aa, Plasmodium falciparum
GLRTLECPLCFFMSNDS

SEQ ID NO: 3280122 - protein, 24 aa, Plasmodium falciparum
GLVYLSGYFLWLVAFLNNEKQEII

SEQ ID NO: 3280123 - protein, 25 aa, Plasmodium falciparum
GMCVCIASALNICFNPIIWKKICGV

SEQ ID NO: 3280124 - protein, 17 aa, Plasmodium falciparum
GMLKWKYHRVFNILKAF

SEQ ID NO: 3280125 - protein, 20 aa, Plasmodium falciparum
GNLFNFSIEWIFKSNNIVVR

SEQ ID NO: 3280126 - protein, 24 aa, Plasmodium falciparum
GNQCTKCFFACYPYEKWIDKKKEE

SEQ ID NO: 3280127 - protein, 18 aa, Plasmodium falciparum
GPNECKEKFLSLIKDDIY

SEQ ID NO: 3280128 - protein, 20 aa, Plasmodium falciparum
GQIMIRFNLSINLCRLLLYG

SEQ ID NO: 3280129 - protein, 20 aa, Plasmodium falciparum
GRCAPIPILVNIEYADNNCG

SEQ ID NO: 3280130 - protein, 21 aa, Plasmodium falciparum
GRIKYFFSYIFYKLFSHIYNK

SEQ ID NO: 3280131 - protein, 23 aa, Plasmodium falciparum
GSFFFKMIICFFCTYNYDGFLSG

SEQ ID NO: 3280132 - protein, 19 aa, Plasmodium falciparum
GSFPLCFYSSIMAIKKKKM

SEQ ID NO: 3280133 - protein, 17 aa, Plasmodium falciparum
GSSLCFCLYFDKNVINT

SEQ ID NO: 3280134 - protein, 18 aa, Plasmodium falciparum
GSSYLIIWKVYYNDKKEQ

SEQ ID NO: 3280135 - protein, 25 aa, Plasmodium falciparum
GSVLTYICFWQLIIGYTLREMEIRD

SEQ ID NO: 3280136 - protein, 19 aa, Plasmodium falciparum
GTIFFNFMKYKGLFNKYET

SEQ ID NO: 3280137 - protein, 18 aa, Plasmodium falciparum
GTTIFKHWLLQKSGWSII

SEQ ID NO: 3280138 - protein, 17 aa, Plasmodium falciparum
GVFLNIFPYYSGNNINN

SEQ ID NO: 3280139 - protein, 24 aa, Plasmodium falciparum
GVIIACLFAEWYFIYKNYLNILKM

SEQ ID NO: 3280140 - protein, 21 aa, Plasmodium falciparum
GVLKYKIIYMLSEVYFLLECK

SEQ ID NO: 3280141 - protein, 18 aa, Plasmodium falciparum
GVTWHLFGLVKIYQSFYI

SEQ ID NO: 3280142 - protein, 18 aa, Plasmodium falciparum
GWIPVIFGNVFVCSVAVF

SEQ ID NO: 3280143 - protein, 18 aa, Plasmodium falciparum
HAKFTYPFLLNIFKHMNT

SEQ ID NO: 3280144 - protein, 25 aa, Plasmodium falciparum
HEELFKRIVCDVARDKIKLNRKIKK

SEQ ID NO: 3280145 - protein, 17 aa, Plasmodium falciparum
HERICQLKFKWPINKDE

SEQ ID NO: 3280146 - protein, 21 aa, Plasmodium falciparum
HEYLRIIGLQTFFILIIASSL

SEQ ID NO: 3280147 - protein, 18 aa, Plasmodium falciparum
HFFIKDLFLMLSDENKDI

SEQ ID NO: 3280148 - protein, 19 aa, Plasmodium falciparum
HFNCPICFIYIILNIIRKK

SEQ ID NO: 3280149 - protein, 24 aa, Plasmodium falciparum
HFNEIPLLGGFLFKRNEESVDGNI

SEQ ID NO: 3280150 - protein, 17 aa, Plasmodium falciparum
HGDVFYSCIHKMLHNKR

SEQ ID NO: 3280151 - protein, 18 aa, Plasmodium falciparum
HGFFLLRCLPPIKMFPKQ

SEQ ID NO: 3280152 - protein, 29 aa, Plasmodium falciparum
HIFHSNCLKKCCFTSCPICRYKQYNYQIA

SEQ ID NO: 3280153 - protein, 20 aa, Plasmodium falciparum
HIIRYYCVYAIFYRNRKDHF

SEQ ID NO: 3280154 - protein, 17 aa, Plasmodium falciparum
HILKFSLLITHSMIEIS

SEQ ID NO: 3280155 - protein, 18 aa, Plasmodium falciparum
HINWKYRQKFILPFILSL

SEQ ID NO: 3280156 - protein, 18 aa, Plasmodium falciparum
HITCSMIIYILCIIYIIM

SEQ ID NO: 3280157 - protein, 18 aa, Plasmodium falciparum
HIWKGMVCALTYKDNTNG

SEQ ID NO: 3280158 - protein, 18 aa, Plasmodium falciparum
HIYCHLCNIYLYDFDTYM

SEQ ID NO: 3280159 - protein, 18 aa, Plasmodium falciparum
HLFYSFSFMNIFDKKKID

SEQ ID NO: 3280160 - protein, 23 aa, Plasmodium falciparum
HLLLLCIFQNIFLLTYMSKEYFL

SEQ ID NO: 3280161 - protein, 20 aa, Plasmodium falciparum
HLQLHREIYCFKPFDFPIFK

SEQ ID NO: 3280162 - protein, 23 aa, Plasmodium falciparum
HLRQKIKLCLSRTFANLKTTRET

SEQ ID NO: 3280163 - protein, 18 aa, Plasmodium falciparum
HLTFDVEYLWALCLGTLL

SEQ ID NO: 3280164 - protein, 28 aa, Plasmodium falciparum
HLYHKKCSVCLFNFPSLKCSIYNCYNFI

SEQ ID NO: 3280165 - protein, 25 aa, Plasmodium falciparum
HMFNFFDVFMIFSFSILAFFFIFIC

SEQ ID NO: 3280166 - protein, 18 aa, Plasmodium falciparum
HNAIRIFSKVCPKINNDN

SEQ ID NO: 3280167 - protein, 18 aa, Plasmodium falciparum
HNFCRDCIEKAKEYKNLC

SEQ ID NO: 3280168 - protein, 24 aa, Plasmodium falciparum
HNILKILFFWNFELYKNFRKNKIY

SEQ ID NO: 3280169 - protein, 17 aa, Plasmodium falciparum
HNIRLCLRVAKRYSHLF

SEQ ID NO: 3280170 - protein, 17 aa, Plasmodium falciparum
HNLPIVHLLLRIMETLL

SEQ ID NO: 3280171 - protein, 17 aa, Plasmodium falciparum
HPIFLINLLKWYSIITN

SEQ ID NO: 3280172 - protein, 23 aa, Plasmodium falciparum
HPLCPSKIRSCCITPMTVTSLFG

SEQ ID NO: 3280173 - protein, 19 aa, Plasmodium falciparum
HPWGLLITFIELIKNTKFN

SEQ ID NO: 3280174 - protein, 20 aa, Plasmodium falciparum
HRIIYCLLYIFNFISLSHIN

SEQ ID NO: 3280175 - protein, 17 aa, Plasmodium falciparum
HRPHPWGLLITFIELIK

SEQ ID NO: 3280176 - protein, 19 aa, Plasmodium falciparum
HRRVEWFYHWFIESASNIE

SEQ ID NO: 3280177 - protein, 22 aa, Plasmodium falciparum
HSIFYIMCNIFLYNLEKEKKIF

SEQ ID NO: 3280178 - protein, 18 aa, Plasmodium falciparum
HSLLRYKGASVYKKIFKV

SEQ ID NO: 3280179 - protein, 19 aa, Plasmodium falciparum
HVEEPFCILLFYKKKLFVS

SEQ ID NO: 3280180 - protein, 18 aa, Plasmodium falciparum
HYDPSCRNVFDYSMSIKE

SEQ ID NO: 3280181 - protein, 19 aa, Plasmodium falciparum
HYFSCLILFIFSQSNDIII

SEQ ID NO: 3280182 - protein, 18 aa, Plasmodium falciparum
HYLYKWKIAVSILLILSI

SEQ ID NO: 3280183 - protein, 17 aa, Plasmodium falciparum
HYYKCIFDYIYLEKNIH

SEQ ID NO: 3280184 - protein, 17 aa, Plasmodium falciparum
IACNLARQGVIDLISKS

SEQ ID NO: 3280185 - protein, 23 aa, Plasmodium falciparum
IAGACIFLAWKLREDFELLKKSR

SEQ ID NO: 3280186 - protein, 25 aa, Plasmodium falciparum
IAKAKCLECYYCLLHKYKFKPLNIS

SEQ ID NO: 3280187 - protein, 24 aa, Plasmodium falciparum
IAPWWGLVCGVGYAGWSHYVPFAI

SEQ ID NO: 3280188 - protein, 24 aa, Plasmodium falciparum
IAPWWGLVCGVGYAGWSHYVPIAV

SEQ ID NO: 3280189 - protein, 17 aa, Plasmodium falciparum
IATFVSLVFKHNFFANG

SEQ ID NO: 3280190 - protein, 17 aa, Plasmodium falciparum
ICACCLSVGLSVNKCYF

SEQ ID NO: 3280191 - protein, 18 aa, Plasmodium falciparum
ICENMLMSFGFIKANKLS

SEQ ID NO: 3280192 - protein, 19 aa, Plasmodium falciparum
ICFFFCLFLTNVVYEYVHV

SEQ ID NO: 3280193 - protein, 20 aa, Plasmodium falciparum
ICFIILKVCLSKNINLNDEG

SEQ ID NO: 3280194 - protein, 22 aa, Plasmodium falciparum
ICIFCFLKNYMILYSFLYNCRF

SEQ ID NO: 3280195 - protein, 19 aa, Plasmodium falciparum
ICILIFWLFFFDLVVLSPF

SEQ ID NO: 3280196 - protein, 22 aa, Plasmodium falciparum
ICILLFKYGYKFIKYYPQLTIY

SEQ ID NO: 3280197 - protein, 17 aa, Plasmodium falciparum
ICLEFIKYLIILNLYFN

SEQ ID NO: 3280198 - protein, 27 aa, Plasmodium falciparum
ICLFYIILLFCFFLWCIFKKYHENRIN

SEQ ID NO: 3280199 - protein, 18 aa, Plasmodium falciparum
ICLLKIKSLEELFLYCFE

SEQ ID NO: 3280200 - protein, 18 aa, Plasmodium falciparum
ICTLWRSFLDKMITLRLE

SEQ ID NO: 3280201 - protein, 22 aa, Plasmodium falciparum
IDACTRLNIKLPYGGDTHLNKE

SEQ ID NO: 3280202 - protein, 20 aa, Plasmodium falciparum
IDDMIKCNYETFQIVLNNKI

SEQ ID NO: 3280203 - protein, 18 aa, Plasmodium falciparum
IDDNWFCSIIQGYISYTS

SEQ ID NO: 3280204 - protein, 22 aa, Plasmodium falciparum
IDIFLNFYRFMDKFNIYHSTKY

SEQ ID NO: 3280205 - protein, 18 aa, Plasmodium falciparum
IDLIDIWKKFFFLLNHFV

SEQ ID NO: 3280206 - protein, 18 aa, Plasmodium falciparum
IDPIFSYHFQYFIWIISL

SEQ ID NO: 3280207 - protein, 17 aa, Plasmodium falciparum
IDVSNLFFDVLKNISIN

SEQ ID NO: 3280208 - protein, 17 aa, Plasmodium falciparum
IDYCFPRIFFYVKCILH

SEQ ID NO: 3280209 - protein, 19 aa, Plasmodium falciparum
IECTIEFLIYCENFNKKEN

SEQ ID NO: 3280210 - protein, 18 aa, Plasmodium falciparum
IEFCKECLLHFYCPGNVI

SEQ ID NO: 3280211 - protein, 19 aa, Plasmodium falciparum
IEIIKRFLLSISCVIKTYI

SEQ ID NO: 3280212 - protein, 20 aa, Plasmodium falciparum
IEIQRFYLLFVKLLKMLLLL

SEQ ID NO: 3280213 - protein, 20 aa, Plasmodium falciparum
IEKRSFLFFDCLLVNEYNTF

SEQ ID NO: 3280214 - protein, 18 aa, Plasmodium falciparum
IELSKLCALFYMKNEEEV

SEQ ID NO: 3280215 - protein, 17 aa, Plasmodium falciparum
IEMFIPLLICVDTKECY

SEQ ID NO: 3280216 - protein, 24 aa, Plasmodium falciparum
IENCKHCLYDIYPSIKYSYIELEK

SEQ ID NO: 3280217 - protein, 18 aa, Plasmodium falciparum
IESIFSLFLLFKKYYISI

SEQ ID NO: 3280218 - protein, 18 aa, Plasmodium falciparum
IESLRLLYNKLLRNRNLI

SEQ ID NO: 3280219 - protein, 18 aa, Plasmodium falciparum
IETKKGGLLMGIMKRKRF

SEQ ID NO: 3280220 - protein, 23 aa, Plasmodium falciparum
IEVFKIFIYYSIILKLCDDLIRY

SEQ ID NO: 3280221 - protein, 23 aa, Plasmodium falciparum
IEYDYRWSVILPYIIFKHDKSKP

SEQ ID NO: 3280222 - protein, 21 aa, Plasmodium falciparum
IFCFYVSFYILFITLFTKKNC

SEQ ID NO: 3280223 - protein, 17 aa, Plasmodium falciparum
IFCKIKLIKLMKIIYKI

SEQ ID NO: 3280224 - protein, 18 aa, Plasmodium falciparum
IFCNGCLVVFLGVSNNIC

SEQ ID NO: 3280225 - protein, 23 aa, Plasmodium falciparum
IFCRICCIFLFFQNMCFHKYDLI

SEQ ID NO: 3280226 - protein, 21 aa, Plasmodium falciparum
IFDCADYIYKHIFKNKKEKIN

SEQ ID NO: 3280227 - protein, 21 aa, Plasmodium falciparum
IFEVLCYFTPYVLIYPLILLF

SEQ ID NO: 3280228 - protein, 19 aa, Plasmodium falciparum
IFFFFCKKNFLLSSFFHSE

SEQ ID NO: 3280229 - protein, 21 aa, Plasmodium falciparum
IFFIMKFCQFLIEIFKLIYRD

SEQ ID NO: 3280230 - protein, 25 aa, Plasmodium falciparum
IFFLCLRIALIISRILYDIILFIYM

SEQ ID NO: 3280231 - protein, 19 aa, Plasmodium falciparum
IFFSKECFKHIFVPEPCDH

SEQ ID NO: 3280232 - protein, 17 aa, Plasmodium falciparum
IFFYIVYNIFKMCMKCF

SEQ ID NO: 3280233 - protein, 25 aa, Plasmodium falciparum
IFGHSLWFLHFFKYFLKESHKAKTN

SEQ ID NO: 3280234 - protein, 19 aa, Plasmodium falciparum
IFHLFKFAICEVAYQNIQK

SEQ ID NO: 3280235 - protein, 17 aa, Plasmodium falciparum
IFIFPFVIILIYFFVFK

SEQ ID NO: 3280236 - protein, 18 aa, Plasmodium falciparum
IFIKCYYLKINISNLEYI

SEQ ID NO: 3280237 - protein, 24 aa, Plasmodium falciparum
IFKIFKFFYYRSFMCFYKNKSQEE

SEQ ID NO: 3280238 - protein, 18 aa, Plasmodium falciparum
IFLKENFNLLTYDIKVYL

SEQ ID NO: 3280239 - protein, 18 aa, Plasmodium falciparum
IFLKFCLKYIDGEICHDL

SEQ ID NO: 3280240 - protein, 18 aa, Plasmodium falciparum
IFLLPIIWFTFYKISMLT

SEQ ID NO: 3280241 - protein, 19 aa, Plasmodium falciparum
IFLLTLLGIWVYKTLIINK

SEQ ID NO: 3280242 - protein, 17 aa, Plasmodium falciparum
IFLRVCVINLSIFSFTL

SEQ ID NO: 3280243 - protein, 17 aa, Plasmodium falciparum
IFNCLKGSFILFYIHYD

SEQ ID NO: 3280244 - protein, 21 aa, Plasmodium falciparum
IFQEVWFRLVQIITGFVEGDG

SEQ ID NO: 3280245 - protein, 18 aa, Plasmodium falciparum
IFTKICKQWDIIKKKEKD

SEQ ID NO: 3280246 - protein, 19 aa, Plasmodium falciparum
IFWEVVDEFLSWIINTSDL

SEQ ID NO: 3280247 - protein, 23 aa, Plasmodium falciparum
IFWSCANIGLGLYKDMYKDHKGL

SEQ ID NO: 3280248 - protein, 21 aa, Plasmodium falciparum
IFYCLSFRFNIHRNNLFNSID

SEQ ID NO: 3280249 - protein, 17 aa, Plasmodium falciparum
IFYEYFYIFSLCTLLTS

SEQ ID NO: 3280250 - protein, 19 aa, Plasmodium falciparum
IGCILRCIFSPVFGLLNFS

SEQ ID NO: 3280251 - protein, 22 aa, Plasmodium falciparum
IGEFIGCLIFKFYKYKDTNNEN

SEQ ID NO: 3280252 - protein, 18 aa, Plasmodium falciparum
IHFSDFFLDDGIKVARNI

SEQ ID NO: 3280253 - protein, 18 aa, Plasmodium falciparum
IHGNSGICTRQWKEGSFA

SEQ ID NO: 3280254 - protein, 17 aa, Plasmodium falciparum
IHLNCAYNYLSWPNYSK

SEQ ID NO: 3280255 - protein, 18 aa, Plasmodium falciparum
IHMKCTFLINEVKNLEKS

SEQ ID NO: 3280256 - protein, 18 aa, Plasmodium falciparum
IHMTYFYRHVCKQYFKNE

SEQ ID NO: 3280257 - protein, 25 aa, Plasmodium falciparum
IHNIIKFKLNFKIAIKKINILQDKI

SEQ ID NO: 3280258 - protein, 17 aa, Plasmodium falciparum
IHSILLFIKYYKIEMRD

SEQ ID NO: 3280259 - protein, 17 aa, Plasmodium falciparum
IHTILSFFFPFIGCLSY

SEQ ID NO: 3280260 - protein, 17 aa, Plasmodium falciparum
IICCIILSLLIINKTIK

SEQ ID NO: 3280261 - protein, 20 aa, Plasmodium falciparum
IICHFFKIYTLHAINTLHNV

SEQ ID NO: 3280262 - protein, 21 aa, Plasmodium falciparum
IIDFFIGVIIINVFFFEYVKC

SEQ ID NO: 3280263 - protein, 18 aa, Plasmodium falciparum
IIDLIKLIYSFFILLNQK

SEQ ID NO: 3280264 - protein, 17 aa, Plasmodium falciparum
IIEKCLQFIPSRRCTFK

SEQ ID NO: 3280265 - protein, 17 aa, Plasmodium falciparum
IIELRIINEFVIPYKKV

SEQ ID NO: 3280266 - protein, 19 aa, Plasmodium falciparum
IIFMLRFFLSLVIILIFIY

SEQ ID NO: 3280267 - protein, 25 aa, Plasmodium falciparum
IIFYYTLKVYLCFINKNYIGTFISK

SEQ ID NO: 3280268 - protein, 23 aa, Plasmodium falciparum
IIGYWPLRGDFDIEYDNDAELLL

SEQ ID NO: 3280269 - protein, 19 aa, Plasmodium falciparum
IIIDYFLCFICRIIDTHMM

SEQ ID NO: 3280270 - protein, 20 aa, Plasmodium falciparum
IIIKELFKYFIIYEKNLNDE

SEQ ID NO: 3280271 - protein, 21 aa, Plasmodium falciparum
IIKIRLCFKQAAFSMITLILN

SEQ ID NO: 3280272 - protein, 21 aa, Plasmodium falciparum
IILRIIMLMLFYFNIKHMYVI

SEQ ID NO: 3280273 - protein, 22 aa, Plasmodium falciparum
IINCYTLLFGIILYFFKNNIKR

SEQ ID NO: 3280274 - protein, 20 aa, Plasmodium falciparum
IINHFIDFIFSFIKKITQTS

SEQ ID NO: 3280275 - protein, 18 aa, Plasmodium falciparum
IIPQLFIKYVNFFYPYIY

SEQ ID NO: 3280276 - protein, 22 aa, Plasmodium falciparum
IISHPFLPFFALIHINNNEKNM

SEQ ID NO: 3280277 - protein, 19 aa, Plasmodium falciparum
IIVKCLFTYLREIKLDKKS

SEQ ID NO: 3280278 - protein, 20 aa, Plasmodium falciparum
IIWLSFCLYIPFKLKDVDKY

SEQ ID NO: 3280279 - protein, 22 aa, Plasmodium falciparum
IIYFTDLCLLKLKKLVNNKKIM

SEQ ID NO: 3280280 - protein, 18 aa, Plasmodium falciparum
IIYICLFIILKLSSNKNI

SEQ ID NO: 3280281 - protein, 19 aa, Plasmodium falciparum
IIYKKRVCNSFYFFYTFFK

SEQ ID NO: 3280282 - protein, 17 aa, Plasmodium falciparum
IIYKYIRIWLLRLKLQD

SEQ ID NO: 3280283 - protein, 18 aa, Plasmodium falciparum
IKAGDIILCRRSEFFCAD

SEQ ID NO: 3280284 - protein, 23 aa, Plasmodium falciparum
IKALLKWRICIYGIFNINQWVKL

SEQ ID NO: 3280285 - protein, 18 aa, Plasmodium falciparum
IKCGKNFQKNKMNYIHLD

SEQ ID NO: 3280286 - protein, 21 aa, Plasmodium falciparum
IKCLYNLIRIISLVMFFFVFI

SEQ ID NO: 3280287 - protein, 17 aa, Plasmodium falciparum
IKCYCMKDIINFIYKKS

SEQ ID NO: 3280288 - protein, 19 aa, Plasmodium falciparum
IKDELYINIDLIYKNKNNK

SEQ ID NO: 3280289 - protein, 23 aa, Plasmodium falciparum
IKEIISLFEFCMLSIKEYIKYIM

SEQ ID NO: 3280290 - protein, 18 aa, Plasmodium falciparum
IKEIKIICHFFKIYTLHA

SEQ ID NO: 3280291 - protein, 18 aa, Plasmodium falciparum
IKEPYILFISFFKYNIYE

SEQ ID NO: 3280292 - protein, 23 aa, Plasmodium falciparum
IKFKLTLPFPHLFLCKPNSLYLN

SEQ ID NO: 3280293 - protein, 21 aa, Plasmodium falciparum
IKFLLNILILCFKKDKSEINE

SEQ ID NO: 3280294 - protein, 20 aa, Plasmodium falciparum
IKFLTSRAAMWYQVEKNDDP

SEQ ID NO: 3280295 - protein, 20 aa, Plasmodium falciparum
IKFPAAFLNIHFVTIVQYMY

SEQ ID NO: 3280296 - protein, 24 aa, Plasmodium falciparum
IKICCLKILIYLCNYYNNSNKKIF

SEQ ID NO: 3280297 - protein, 18 aa, Plasmodium falciparum
IKIIFKYKFDFFNFYPYI

SEQ ID NO: 3280298 - protein, 21 aa, Plasmodium falciparum
IKILTCTILIWAVQYANNSDI

SEQ ID NO: 3280299 - protein, 17 aa, Plasmodium falciparum
IKKCKKLNCGIRIGGEL

SEQ ID NO: 3280300 - protein, 17 aa, Plasmodium falciparum
IKKEIYKLILFMNRKKK

SEQ ID NO: 3280301 - protein, 19 aa, Plasmodium falciparum
IKKGCPTYEMYKDLRKQKW

SEQ ID NO: 3280302 - protein, 20 aa, Plasmodium falciparum
IKKKLECIISLDYYKPLKKA

SEQ ID NO: 3280303 - protein, 19 aa, Plasmodium falciparum
IKKRLEEIMNFYYIKSNKH

SEQ ID NO: 3280304 - protein, 20 aa, Plasmodium falciparum
IKLIEICLDLSLVIFNNIDE

SEQ ID NO: 3280305 - protein, 23 aa, Plasmodium falciparum
IKLLIEFFYFYSIDFKLHDACIV

SEQ ID NO: 3280306 - protein, 19 aa, Plasmodium falciparum
IKLLYLLNCIPLIYLDPHM

SEQ ID NO: 3280307 - protein, 18 aa, Plasmodium falciparum
IKLYKSYYYHASILHYHT

SEQ ID NO: 3280308 - protein, 21 aa, Plasmodium falciparum
IKNKIFYFFTFFKVEKNLINL

SEQ ID NO: 3280309 - protein, 19 aa, Plasmodium falciparum
IKNKVCLLGVCVGNKENIR

SEQ ID NO: 3280310 - protein, 22 aa, Plasmodium falciparum
IKRGLTFLKCYPMIKNEINELF

SEQ ID NO: 3280311 - protein, 17 aa, Plasmodium falciparum
IKRKLIYKILFPDIQID

SEQ ID NO: 3280312 - protein, 17 aa, Plasmodium falciparum
IKRQICNKMCSHKEYNM

SEQ ID NO: 3280313 - protein, 20 aa, Plasmodium falciparum
IKRWLESFLKDYNKLKENLN

SEQ ID NO: 3280314 - protein, 17 aa, Plasmodium falciparum
IKSLILYGGTDIFESIK

SEQ ID NO: 3280315 - protein, 19 aa, Plasmodium falciparum
IKSNYLIRVLYKFFNTNMK

SEQ ID NO: 3280316 - protein, 23 aa, Plasmodium falciparum
IKSRKKLLPSFNVFEINGMNVVH

SEQ ID NO: 3280317 - protein, 19 aa, Plasmodium falciparum
IKSTILLPETYFKPFIKPL

SEQ ID NO: 3280318 - protein, 23 aa, Plasmodium falciparum
IKSYKTKHIWIYNNIIHMFNFFD

SEQ ID NO: 3280319 - protein, 17 aa, Plasmodium falciparum
IKTEWVLVELNNLEEKY

SEQ ID NO: 3280320 - protein, 17 aa, Plasmodium falciparum
IKVLNTFLLDFIIQLSK

SEQ ID NO: 3280321 - protein, 31 aa, Plasmodium falciparum
IKYILRFPHKFGLCLYGYILGFIYEHIYEDP

SEQ ID NO: 3280322 - protein, 17 aa, Plasmodium falciparum
IKYLRFLYYLKKIKFRK

SEQ ID NO: 3280323 - protein, 17 aa, Plasmodium falciparum
ILCCHYIIFNSFISIIA

SEQ ID NO: 3280324 - protein, 22 aa, Plasmodium falciparum
ILCDFGHIIPIHYISHFIHFFQ

SEQ ID NO: 3280325 - protein, 21 aa, Plasmodium falciparum
ILCELRILYELNIIDLIYLLE

SEQ ID NO: 3280326 - protein, 18 aa, Plasmodium falciparum
ILCGCILCLTMLPEMISF

SEQ ID NO: 3280327 - protein, 24 aa, Plasmodium falciparum
ILCSFQNLFMCISLNIKNEWRKSV

SEQ ID NO: 3280328 - protein, 21 aa, Plasmodium falciparum
ILFFIRMFFKLNVILPLFFAA

SEQ ID NO: 3280329 - protein, 18 aa, Plasmodium falciparum
ILFFPSLFWFNGQFCPPI

SEQ ID NO: 3280330 - protein, 18 aa, Plasmodium falciparum
ILFISFFIYIYFKKKPYK

SEQ ID NO: 3280331 - protein, 20 aa, Plasmodium falciparum
ILFLICYSISFIIYMFSYIP

SEQ ID NO: 3280332 - protein, 25 aa, Plasmodium falciparum
ILFLLKEKIILFIFYIYKKIYKNAY

SEQ ID NO: 3280333 - protein, 20 aa, Plasmodium falciparum
ILFMGRIFKSYIISMFLINL

SEQ ID NO: 3280334 - protein, 19 aa, Plasmodium falciparum
ILHFLPLKYLLDLLILYDL

SEQ ID NO: 3280335 - protein, 19 aa, Plasmodium falciparum
ILICLYIALNFCMELILRF

SEQ ID NO: 3280336 - protein, 22 aa, Plasmodium falciparum
ILIIRKFFRVFLNFAQKKFLSL

SEQ ID NO: 3280337 - protein, 23 aa, Plasmodium falciparum
ILIVLLICFNIYYGLYYIVFLTL

SEQ ID NO: 3280338 - protein, 22 aa, Plasmodium falciparum
ILKSAICNRMYNRLCKAIPKVH

SEQ ID NO: 3280339 - protein, 22 aa, Plasmodium falciparum
ILKSRLKTLFFVKSILNVLFNF

SEQ ID NO: 3280340 - protein, 18 aa, Plasmodium falciparum
ILLCTIFIWICQCFYNKS

SEQ ID NO: 3280341 - protein, 21 aa, Plasmodium falciparum
ILLFIMKRFVCIDIKNINIIF

SEQ ID NO: 3280342 - protein, 17 aa, Plasmodium falciparum
ILLIIVCDFIKTKNQNN

SEQ ID NO: 3280343 - protein, 17 aa, Plasmodium falciparum
ILLILSFRCIQNFEHVL

SEQ ID NO: 3280344 - protein, 18 aa, Plasmodium falciparum
ILLKRIRYIFLFSIISII

SEQ ID NO: 3280345 - protein, 17 aa, Plasmodium falciparum
ILLLILFYFSLPTFPFS

SEQ ID NO: 3280346 - protein, 21 aa, Plasmodium falciparum
ILLQCCYFCFSRLYVYEYRKL

SEQ ID NO: 3280347 - protein, 25 aa, Plasmodium falciparum
ILLRGSFRFRVIKGLIKFNGEIIKP

SEQ ID NO: 3280348 - protein, 18 aa, Plasmodium falciparum
ILLWSCKNIGYIFLNTDN

SEQ ID NO: 3280349 - protein, 18 aa, Plasmodium falciparum
ILNCLNNLLSIFVDIINK

SEQ ID NO: 3280350 - protein, 18 aa, Plasmodium falciparum
ILPQFICLNYPSLRSPYS

SEQ ID NO: 3280351 - protein, 17 aa, Plasmodium falciparum
ILQKLFWVYKINKHNIQ

SEQ ID NO: 3280352 - protein, 17 aa, Plasmodium falciparum
ILRCLYIFSTRLYELYP

SEQ ID NO: 3280353 - protein, 24 aa, Plasmodium falciparum
ILRKSVKFYASWLLKKYIIDMTCV

SEQ ID NO: 3280354 - protein, 19 aa, Plasmodium falciparum
ILSCLIAWAIIDIIRYLFY

SEQ ID NO: 3280355 - protein, 19 aa, Plasmodium falciparum
ILSGLFFKELNVIEGNYMP

SEQ ID NO: 3280356 - protein, 18 aa, Plasmodium falciparum
ILSYKPSLDFSYIIQGIK

SEQ ID NO: 3280357 - protein, 19 aa, Plasmodium falciparum
ILTELFKWIKLFENYPNKR

SEQ ID NO: 3280358 - protein, 25 aa, Plasmodium falciparum
ILVHCFPPWSCTYGYIKKEHYIINE

SEQ ID NO: 3280359 - protein, 17 aa, Plasmodium falciparum
ILWKMFLMPIVDKYLKE

SEQ ID NO: 3280360 - protein, 18 aa, Plasmodium falciparum
ILWSLSILNVYSRNVFED

SEQ ID NO: 3280361 - protein, 18 aa, Plasmodium falciparum
ILYELNIIDLIYLLEVEE

SEQ ID NO: 3280362 - protein, 17 aa, Plasmodium falciparum
ILYLCWLPQILLDIWRG

SEQ ID NO: 3280363 - protein, 20 aa, Plasmodium falciparum
ILYWNFFKNILLILPIFFYQ

SEQ ID NO: 3280364 - protein, 20 aa, Plasmodium falciparum
IMAFFPFFYIMLMKNCNYVI

SEQ ID NO: 3280365 - protein, 18 aa, Plasmodium falciparum
IMCKILYYSVFLRNFIFI

SEQ ID NO: 3280366 - protein, 17 aa, Plasmodium falciparum
IMCYKINYTYILYNILC

SEQ ID NO: 3280367 - protein, 23 aa, Plasmodium falciparum
IMEHIYKFILYFVIKKLHISFMF

SEQ ID NO: 3280368 - protein, 19 aa, Plasmodium falciparum
IMILNCCRIVTSVLYAAKR

SEQ ID NO: 3280369 - protein, 18 aa, Plasmodium falciparum
IMLDKLVKMGILLIRPYI

SEQ ID NO: 3280370 - protein, 18 aa, Plasmodium falciparum
IMNLYYAYIMYKRNIVTL

SEQ ID NO: 3280371 - protein, 24 aa, Plasmodium falciparum
INCSKGSICIGGFKFKSLRELIKN

SEQ ID NO: 3280372 - protein, 21 aa, Plasmodium falciparum
INDEIKRNIPFYINSNNNNNN

SEQ ID NO: 3280373 - protein, 23 aa, Plasmodium falciparum
INELRRIISFFLIYSIVFSIVYE

SEQ ID NO: 3280374 - protein, 18 aa, Plasmodium falciparum
INIHFPKDFIIKMKSRQC

SEQ ID NO: 3280375 - protein, 17 aa, Plasmodium falciparum
INITFFFSLKFYPYIEE

SEQ ID NO: 3280376 - protein, 22 aa, Plasmodium falciparum
INIVLCIFKLLILTKEILVYYI

SEQ ID NO: 3280377 - protein, 23 aa, Plasmodium falciparum
INKELVRALGLWLEFNDNPTNAS

SEQ ID NO: 3280378 - protein, 22 aa, Plasmodium falciparum
INKGAKHKLCFDEYDKEIMLPY

SEQ ID NO: 3280379 - protein, 17 aa, Plasmodium falciparum
INLFKLFFFFKKNYHTN

SEQ ID NO: 3280380 - protein, 22 aa, Plasmodium falciparum
INLKKLMKIFCFYEHIKKEEKI

SEQ ID NO: 3280381 - protein, 19 aa, Plasmodium falciparum
INLLICPKKLFHFYEKLKK

SEQ ID NO: 3280382 - protein, 20 aa, Plasmodium falciparum
INLYCLWLLLALTILLSLIL

SEQ ID NO: 3280383 - protein, 19 aa, Plasmodium falciparum
INMGIKFRIIYIFKKILSA

SEQ ID NO: 3280384 - protein, 24 aa, Plasmodium falciparum
INNFRISYFFKWLINIWASLYIKI

SEQ ID NO: 3280385 - protein, 22 aa, Plasmodium falciparum
INNIRFCICFCNFDIYKYIETK

SEQ ID NO: 3280386 - protein, 17 aa, Plasmodium falciparum
INPEFIKNIGICYNIIN

SEQ ID NO: 3280387 - protein, 18 aa, Plasmodium falciparum
INRACKYLEFSICSYYKN

SEQ ID NO: 3280388 - protein, 23 aa, Plasmodium falciparum
INSCNYCSCIFDSIKCRFILISK

SEQ ID NO: 3280389 - protein, 18 aa, Plasmodium falciparum
INSLLSYCYFPKYFSLKH

SEQ ID NO: 3280390 - protein, 18 aa, Plasmodium falciparum
INVKCLYTYLNVPLCILN

SEQ ID NO: 3280391 - protein, 17 aa, Plasmodium falciparum
INYEIIKSIHLFHLLLK

SEQ ID NO: 3280392 - protein, 17 aa, Plasmodium falciparum
INYLYPFFLENKKFIEH

SEQ ID NO: 3280393 - protein, 19 aa, Plasmodium falciparum
IPECVICMYDIVLKPNKYC

SEQ ID NO: 3280394 - protein, 19 aa, Plasmodium falciparum
IPNEFFSFFDFFKEDNIEE

SEQ ID NO: 3280395 - protein, 17 aa, Plasmodium falciparum
IPPEFPITLSLAVTISI

SEQ ID NO: 3280396 - protein, 19 aa, Plasmodium falciparum
IPPRRRKLYIGKIKEWANS

SEQ ID NO: 3280397 - protein, 22 aa, Plasmodium falciparum
IPPRRRKLYLGGFKRLTDGTSV

SEQ ID NO: 3280398 - protein, 20 aa, Plasmodium falciparum
IPPRVCKNSTLGIQVKKEKN

SEQ ID NO: 3280399 - protein, 23 aa, Plasmodium falciparum
IPTFCWKSIWSYSLLFYGFKFKE

SEQ ID NO: 3280400 - protein, 17 aa, Plasmodium falciparum
IQICLQKIFPLYLIQTA

SEQ ID NO: 3280401 - protein, 18 aa, Plasmodium falciparum
IQNNCLIGYILKENNFYI

SEQ ID NO: 3280402 - protein, 25 aa, Plasmodium falciparum
IRALFKIWLEYFLKDYNKINAKISY

SEQ ID NO: 3280403 - protein, 18 aa, Plasmodium falciparum
IRDFPFDINNLWKDKKKW

SEQ ID NO: 3280404 - protein, 17 aa, Plasmodium falciparum
IRFGVFFFITLSNFLLC

SEQ ID NO: 3280405 - protein, 32 aa, Plasmodium falciparum
IRGRKNILIFLLKIFLFSPLIWILIYSEYFTV

SEQ ID NO: 3280406 - protein, 18 aa, Plasmodium falciparum
IRHLLPFYAIFRFMSDVK

SEQ ID NO: 3280407 - protein, 25 aa, Plasmodium falciparum
IRIVLWCIVWIWAASYMERKPKNFE

SEQ ID NO: 3280408 - protein, 27 aa, Plasmodium falciparum
IRKILRIMRELYIGFIGLQLIYFITYI

SEQ ID NO: 3280409 - protein, 18 aa, Plasmodium falciparum
IRLASKMTPMFQVREIQP

SEQ ID NO: 3280410 - protein, 23 aa, Plasmodium falciparum
IRLKSVLLLIEIVMSFYSFFIRW

SEQ ID NO: 3280411 - protein, 21 aa, Plasmodium falciparum
IRLLILWKVQDTFTFFKKIPR

SEQ ID NO: 3280412 - protein, 17 aa, Plasmodium falciparum
IRMVFILIKHVIIKIYE

SEQ ID NO: 3280413 - protein, 18 aa, Plasmodium falciparum
IRNGIFFNIFLLKDTYEE

SEQ ID NO: 3280414 - protein, 17 aa, Plasmodium falciparum
IRPIILITHVNPANNSV

SEQ ID NO: 3280415 - protein, 18 aa, Plasmodium falciparum
IRSKYILKNGYKSMYQRN

SEQ ID NO: 3280416 - protein, 19 aa, Plasmodium falciparum
IRYMCCAYSLKNLAGVVKK

SEQ ID NO: 3280417 - protein, 25 aa, Plasmodium falciparum
ISASCPGELVILFGFALMKGIGSSS

SEQ ID NO: 3280418 - protein, 22 aa, Plasmodium falciparum
ISAYCYKHIKKLLDNVIKKIIC

SEQ ID NO: 3280419 - protein, 19 aa, Plasmodium falciparum
ISCCFGCQKIILINKYWKN

SEQ ID NO: 3280420 - protein, 18 aa, Plasmodium falciparum
ISCMLFKLNRIFGNHYKK

SEQ ID NO: 3280421 - protein, 19 aa, Plasmodium falciparum
ISCMYYKCLLAIIHMYLEI

SEQ ID NO: 3280422 - protein, 17 aa, Plasmodium falciparum
ISCSFLFKQEKLSSMKK

SEQ ID NO: 3280423 - protein, 18 aa, Plasmodium falciparum
ISFFSIDLIDIWKKFFFL

SEQ ID NO: 3280424 - protein, 21 aa, Plasmodium falciparum
ISFNHFRWPLLVDIQNIGLQW

SEQ ID NO: 3280425 - protein, 19 aa, Plasmodium falciparum
ISIPLSHSFLFYNNITNLQ

SEQ ID NO: 3280426 - protein, 18 aa, Plasmodium falciparum
ISKCFYYKINIENIHFKN

SEQ ID NO: 3280427 - protein, 19 aa, Plasmodium falciparum
ISKKFPRIVGVHYDSYATA

SEQ ID NO: 3280428 - protein, 19 aa, Plasmodium falciparum
ISLCILKWYIYQIYRYEEE

SEQ ID NO: 3280429 - protein, 22 aa, Plasmodium falciparum
ISLSLKCVHDFLYGANIMFACI

SEQ ID NO: 3280430 - protein, 23 aa, Plasmodium falciparum
ISLWLQYFNFCFIKKKYDELENA

SEQ ID NO: 3280431 - protein, 20 aa, Plasmodium falciparum
ISMWCVFAIYLTIRIMSPDN

SEQ ID NO: 3280432 - protein, 22 aa, Plasmodium falciparum
ISNDIKMFWFFMLNEIRPDLVP

SEQ ID NO: 3280433 - protein, 18 aa, Plasmodium falciparum
ISNTVCAANHPWLKYFHI

SEQ ID NO: 3280434 - protein, 20 aa, Plasmodium falciparum
ISSFCSLCLNNVYINPNTNK

SEQ ID NO: 3280435 - protein, 17 aa, Plasmodium falciparum
ISSKFLIHLSFGIRNFI

SEQ ID NO: 3280436 - protein, 17 aa, Plasmodium falciparum
ISVCLALLVSIAIKVYA

SEQ ID NO: 3280437 - protein, 24 aa, Plasmodium falciparum
ISYSNFLPFLWKKNMSSLNVEYDL

SEQ ID NO: 3280438 - protein, 18 aa, Plasmodium falciparum
ITASRIWLQYTIASTLSA

SEQ ID NO: 3280439 - protein, 20 aa, Plasmodium falciparum
ITCFGCFLFVFFPSLLFICF

SEQ ID NO: 3280440 - protein, 17 aa, Plasmodium falciparum
ITFLKFDILIILKCSRI

SEQ ID NO: 3280441 - protein, 17 aa, Plasmodium falciparum
ITILKMFYSTFIINIFV

SEQ ID NO: 3280442 - protein, 19 aa, Plasmodium falciparum
ITQRTRLLLGRHMNDIDKR

SEQ ID NO: 3280443 - protein, 18 aa, Plasmodium falciparum
ITSWKFCKSLILTTLGML

SEQ ID NO: 3280444 - protein, 20 aa, Plasmodium falciparum
IVDFIFKWIYMFISHNLRLC

SEQ ID NO: 3280445 - protein, 25 aa, Plasmodium falciparum
IVGNHLRFRGFRILAENEYEMKTKY

SEQ ID NO: 3280446 - protein, 19 aa, Plasmodium falciparum
IVIFCLQWESVVSISISPQ

SEQ ID NO: 3280447 - protein, 18 aa, Plasmodium falciparum
IVIFITFFYILLNILHDN

SEQ ID NO: 3280448 - protein, 24 aa, Plasmodium falciparum
IVKREISFFLGISVNDLFQPFGLC

SEQ ID NO: 3280449 - protein, 24 aa, Plasmodium falciparum
IVKYHCCIILSKICLLCIKNQLNR

SEQ ID NO: 3280450 - protein, 20 aa, Plasmodium falciparum
IVLNLIWLKFLNVIFYLLYV

SEQ ID NO: 3280451 - protein, 22 aa, Plasmodium falciparum
IVVSILFLFSFGFVINSKNNKQ

SEQ ID NO: 3280452 - protein, 20 aa, Plasmodium falciparum
IWKSNKWNGLNGWKKREWNF

SEQ ID NO: 3280453 - protein, 17 aa, Plasmodium falciparum
IWLKCYFVLYNIIYEYI

SEQ ID NO: 3280454 - protein, 17 aa, Plasmodium falciparum
IWSAACCIVEIFSSKYP

SEQ ID NO: 3280455 - protein, 18 aa, Plasmodium falciparum
IWYLRYNRKLIMNSSSFS

SEQ ID NO: 3280456 - protein, 27 aa, Plasmodium falciparum
IYCSHIRLSFFFPLLFYKTYYINDILS

SEQ ID NO: 3280457 - protein, 18 aa, Plasmodium falciparum
IYDKIKLMYQFKPQPYIT

SEQ ID NO: 3280458 - protein, 17 aa, Plasmodium falciparum
IYERSCIILANQYSNKI

SEQ ID NO: 3280459 - protein, 19 aa, Plasmodium falciparum
IYFFIKLIYKFFKVIQRGT

SEQ ID NO: 3280460 - protein, 18 aa, Plasmodium falciparum
IYFKDFHCTLNFFISLIF

SEQ ID NO: 3280461 - protein, 17 aa, Plasmodium falciparum
IYFKGRWNISDILFSKH

SEQ ID NO: 3280462 - protein, 17 aa, Plasmodium falciparum
IYFLLAILGTLSVVSLY

SEQ ID NO: 3280463 - protein, 18 aa, Plasmodium falciparum
IYHLMFICKVFWYIFLYA

SEQ ID NO: 3280464 - protein, 17 aa, Plasmodium falciparum
IYICKNVYFISLPILAS

SEQ ID NO: 3280465 - protein, 19 aa, Plasmodium falciparum
IYICRRLIRIASEDIGLAN

SEQ ID NO: 3280466 - protein, 19 aa, Plasmodium falciparum
IYICTSLLLKIFKRIIKKK

SEQ ID NO: 3280467 - protein, 18 aa, Plasmodium falciparum
IYIKLIWKYNMNELERLT

SEQ ID NO: 3280468 - protein, 17 aa, Plasmodium falciparum
IYIKYVFIYLLKYIFLF

SEQ ID NO: 3280469 - protein, 23 aa, Plasmodium falciparum
IYKCLKYNIKVCELLGYYKDIIV

SEQ ID NO: 3280470 - protein, 18 aa, Plasmodium falciparum
IYKFKWRPYDFLKLIYET

SEQ ID NO: 3280471 - protein, 19 aa, Plasmodium falciparum
IYKILKFVFNKKFYIPINT

SEQ ID NO: 3280472 - protein, 18 aa, Plasmodium falciparum
IYMKGFRLSIESKKKYLS

SEQ ID NO: 3280473 - protein, 18 aa, Plasmodium falciparum
IYMKIRMHRFSICSNFRI

SEQ ID NO: 3280474 - protein, 17 aa, Plasmodium falciparum
IYNNCYILFDFILNKYD

SEQ ID NO: 3280475 - protein, 24 aa, Plasmodium falciparum
IYNNFSFFFSYNFYNLHNKILDNL

SEQ ID NO: 3280476 - protein, 17 aa, Plasmodium falciparum
IYPCGYLNMRIFYNLPS

SEQ ID NO: 3280477 - protein, 19 aa, Plasmodium falciparum
IYRLIKYIIVWIFNTADSV

SEQ ID NO: 3280478 - protein, 22 aa, Plasmodium falciparum
IYSRCLCNISLHPSLADFFVEN

SEQ ID NO: 3280479 - protein, 22 aa, Plasmodium falciparum
IYTKRFYCIPIYIKKNNILIRP

SEQ ID NO: 3280480 - protein, 25 aa, Plasmodium falciparum
KAHLNEIEFLYNLLINKIFQKDTYA

SEQ ID NO: 3280481 - protein, 18 aa, Plasmodium falciparum
KALLIKYSFIYQKKIKDC

SEQ ID NO: 3280482 - protein, 19 aa, Plasmodium falciparum
KALRTFICKGLKKKINKLI

SEQ ID NO: 3280483 - protein, 17 aa, Plasmodium falciparum
KAVFSLNTIEQFLLLHK

SEQ ID NO: 3280484 - protein, 17 aa, Plasmodium falciparum
KCDCFKKWVVQKEQEWK

SEQ ID NO: 3280485 - protein, 17 aa, Plasmodium falciparum
KCGCGLGGVAASIGIFG

SEQ ID NO: 3280486 - protein, 23 aa, Plasmodium falciparum
KCGKKICNGDCDCFKRWVEQKRK

SEQ ID NO: 3280487 - protein, 22 aa, Plasmodium falciparum
KCGKKICNGDCECFKRWVEQKE

SEQ ID NO: 3280488 - protein, 22 aa, Plasmodium falciparum
KCGKKICNGDCECFQRWVEKKK

SEQ ID NO: 3280489 - protein, 25 aa, Plasmodium falciparum
KCHRDFYCSCCIYVSDNYFEMQNHF

SEQ ID NO: 3280490 - protein, 18 aa, Plasmodium falciparum
KCILCFLALGSIPIGYIN

SEQ ID NO: 3280491 - protein, 17 aa, Plasmodium falciparum
KCIVSIRNDKLINFVPH

SEQ ID NO: 3280492 - protein, 22 aa, Plasmodium falciparum
KCKKLNCGIRIGGELELCGVNC

SEQ ID NO: 3280493 - protein, 20 aa, Plasmodium falciparum
KCKMIESFDSFFLLLCIDKN

SEQ ID NO: 3280494 - protein, 20 aa, Plasmodium falciparum
KCLFFEKSLHVMLSVILNDD

SEQ ID NO: 3280495 - protein, 18 aa, Plasmodium falciparum
KCNLNFRSVLGFLSMCPF

SEQ ID NO: 3280496 - protein, 19 aa, Plasmodium falciparum
KCRDFKTGSGFMCIKIGYG

SEQ ID NO: 3280497 - protein, 20 aa, Plasmodium falciparum
KCSFNIYKPICWYKQKEMYH

SEQ ID NO: 3280498 - protein, 19 aa, Plasmodium falciparum
KDCKDKCKCVDEWINKKRT

SEQ ID NO: 3280499 - protein, 19 aa, Plasmodium falciparum
KDFHCTLNFFISLIFVSFS

SEQ ID NO: 3280500 - protein, 23 aa, Plasmodium falciparum
KDFICSTCLCIFSSNNHFVKLYN

SEQ ID NO: 3280501 - protein, 24 aa, Plasmodium falciparum
KDGEWKYFFCVLFYLQNNIGLKND

SEQ ID NO: 3280502 - protein, 17 aa, Plasmodium falciparum
KDIKAGDIILCRRSEFF

SEQ ID NO: 3280503 - protein, 17 aa, Plasmodium falciparum
KDIKCIFFYIVYNIFKM

SEQ ID NO: 3280504 - protein, 28 aa, Plasmodium falciparum
KDILSIIMKIFFFYLLKYVIYFNHGDVF

SEQ ID NO: 3280505 - protein, 18 aa, Plasmodium falciparum
KDKIKAFIHIYNMFSIYP

SEQ ID NO: 3280506 - protein, 17 aa, Plasmodium falciparum
KDKKLNCLILFINEDIS

SEQ ID NO: 3280507 - protein, 17 aa, Plasmodium falciparum
KDLIYNIIVMVHMMVLD

SEQ ID NO: 3280508 - protein, 18 aa, Plasmodium falciparum
KDPSFIPVLYIYHNDDEF

SEQ ID NO: 3280509 - protein, 24 aa, Plasmodium falciparum
KDRIRFHFYFYFFIVKIILLSLLI

SEQ ID NO: 3280510 - protein, 24 aa, Plasmodium falciparum
KDTTRGHCSWRCRWWENGRRLSKN

SEQ ID NO: 3280511 - protein, 18 aa, Plasmodium falciparum
KEALRYLGPISISIAASD

SEQ ID NO: 3280512 - protein, 20 aa, Plasmodium falciparum
KEGMLPFLCDHIFKCNYNLF

SEQ ID NO: 3280513 - protein, 20 aa, Plasmodium falciparum
KEIICRHSFDFLKYNLYAQT

SEQ ID NO: 3280514 - protein, 20 aa, Plasmodium falciparum
KEIIKLNSLYSFLDNLHKCV

SEQ ID NO: 3280515 - protein, 17 aa, Plasmodium falciparum
KEINCIFNLLNKLTYLK

SEQ ID NO: 3280516 - protein, 19 aa, Plasmodium falciparum
KEKKCPLNILLLLQEISDK

SEQ ID NO: 3280517 - protein, 27 aa, Plasmodium falciparum
KEKVADFIFCLNLFYSISMMKDIISLK

SEQ ID NO: 3280518 - protein, 20 aa, Plasmodium falciparum
KELIYLFGFSDLHIVKSKIN

SEQ ID NO: 3280519 - protein, 17 aa, Plasmodium falciparum
KELKIFLMKVFKILLNN

SEQ ID NO: 3280520 - protein, 22 aa, Plasmodium falciparum
KELLKRWLEYFFEDYNRIQKKL

SEQ ID NO: 3280521 - protein, 23 aa, Plasmodium falciparum
KELLKRWLEYFLEDYNKIKHKIS

SEQ ID NO: 3280522 - protein, 19 aa, Plasmodium falciparum
KELLYRKDINTFKKTYLTN

SEQ ID NO: 3280523 - protein, 17 aa, Plasmodium falciparum
KEMKCIFNILNKYYKMY

SEQ ID NO: 3280524 - protein, 20 aa, Plasmodium falciparum
KESFIPKFIDLVIWGHEHFS

SEQ ID NO: 3280525 - protein, 17 aa, Plasmodium falciparum
KESLFYKYINKIRREFN

SEQ ID NO: 3280526 - protein, 17 aa, Plasmodium falciparum
KEYPMHFLIYYYSGIHF

SEQ ID NO: 3280527 - protein, 21 aa, Plasmodium falciparum
KFCYLRKLLFIYGSKHLYTIS

SEQ ID NO: 3280528 - protein, 24 aa, Plasmodium falciparum
KFFLYICSYIIYYICKVLQIDDYN

SEQ ID NO: 3280529 - protein, 18 aa, Plasmodium falciparum
KFICKDCYRCIYCCESIY

SEQ ID NO: 3280530 - protein, 21 aa, Plasmodium falciparum
KFIECSLCFELIKFICIQECN

SEQ ID NO: 3280531 - protein, 19 aa, Plasmodium falciparum
KFIKRKLYLVKRILYMFIR

SEQ ID NO: 3280532 - protein, 18 aa, Plasmodium falciparum
KFINFNFSFFFIIYDYIT

SEQ ID NO: 3280533 - protein, 28 aa, Plasmodium falciparum
KFIWKGCLMCISMLWPDFKHSLFYIFFM

SEQ ID NO: 3280534 - protein, 18 aa, Plasmodium falciparum
KFKAIIMRLCLKQNNYYY

SEQ ID NO: 3280535 - protein, 18 aa, Plasmodium falciparum
KFKEIFISFIKRDDSKKT

SEQ ID NO: 3280536 - protein, 19 aa, Plasmodium falciparum
KFKICNFVLNKIEFIHISK

SEQ ID NO: 3280537 - protein, 19 aa, Plasmodium falciparum
KFKNEIIFIYNCLKSSLVS

SEQ ID NO: 3280538 - protein, 19 aa, Plasmodium falciparum
KFLKKKKFRNYIMNTSKFI

SEQ ID NO: 3280539 - protein, 19 aa, Plasmodium falciparum
KFLKLVCRLAIWVFGVNKI

SEQ ID NO: 3280540 - protein, 19 aa, Plasmodium falciparum
KFLNLIKRKLIYKILFPDI

SEQ ID NO: 3280541 - protein, 19 aa, Plasmodium falciparum
KFLQWLMEWARKYCSEKIK

SEQ ID NO: 3280542 - protein, 23 aa, Plasmodium falciparum
KFLRHLNLFLGMSMIKNLETYDH

SEQ ID NO: 3280543 - protein, 18 aa, Plasmodium falciparum
KFLYICIDKEKFWDESFL

SEQ ID NO: 3280544 - protein, 20 aa, Plasmodium falciparum
KFMIRRACCKLLYDMINLIF

SEQ ID NO: 3280545 - protein, 19 aa, Plasmodium falciparum
KFNYLRLFFKTLLKVIHIY

SEQ ID NO: 3280546 - protein, 17 aa, Plasmodium falciparum
KFTILCKVFNLFSQYLE

SEQ ID NO: 3280547 - protein, 18 aa, Plasmodium falciparum
KFYDCWYFDYYIDCKIVD

SEQ ID NO: 3280548 - protein, 19 aa, Plasmodium falciparum
KGCKNPCECYKRWVEKKKD

SEQ ID NO: 3280549 - protein, 18 aa, Plasmodium falciparum
KGDIRLLLMNSMESPSSH

SEQ ID NO: 3280550 - protein, 19 aa, Plasmodium falciparum
KGEIWRLFTPYLYIGNLYL

SEQ ID NO: 3280551 - protein, 20 aa, Plasmodium falciparum
KGIFNWRFVYNIKIPTNATN

SEQ ID NO: 3280552 - protein, 22 aa, Plasmodium falciparum
KGIKRSLSLFSFKSLPIRRRKF

SEQ ID NO: 3280553 - protein, 22 aa, Plasmodium falciparum
KGKDEWYHVCCLYYNNITRNNC

SEQ ID NO: 3280554 - protein, 24 aa, Plasmodium falciparum
KGKFKRLFLFIGFQSIPIIALMYL

SEQ ID NO: 3280555 - protein, 17 aa, Plasmodium falciparum
KGKLLFKYFNIWYLYEG

SEQ ID NO: 3280556 - protein, 18 aa, Plasmodium falciparum
KGLLCNLSYVLKNKSHIL

SEQ ID NO: 3280557 - protein, 18 aa, Plasmodium falciparum
KGLPKSFLNRFSKIYFED

SEQ ID NO: 3280558 - protein, 23 aa, Plasmodium falciparum
KGLSLRLFFIFVLSSFVYIYYGF

SEQ ID NO: 3280559 - protein, 20 aa, Plasmodium falciparum
KGRPHGFGYWRGINLEGEVL

SEQ ID NO: 3280560 - protein, 18 aa, Plasmodium falciparum
KGSNFWKGLGIYLCTLSG

SEQ ID NO: 3280561 - protein, 17 aa, Plasmodium falciparum
KGTCMKIRIKLGMILPD

SEQ ID NO: 3280562 - protein, 21 aa, Plasmodium falciparum
KGYCSPECALLVFLLSSLNKS

SEQ ID NO: 3280563 - protein, 17 aa, Plasmodium falciparum
KHIPFYNCLNICLLVFH

SEQ ID NO: 3280564 - protein, 21 aa, Plasmodium falciparum
KHLRIKYRWKKLLELRYIQPI

SEQ ID NO: 3280565 - protein, 18 aa, Plasmodium falciparum
KIERSRCSNLFNIEHDIY

SEQ ID NO: 3280566 - protein, 25 aa, Plasmodium falciparum
KIFKYSHIILVYFIPFFKKYYFLWK

SEQ ID NO: 3280567 - protein, 19 aa, Plasmodium falciparum
KIFLTCLIIELRIINEFVI

SEQ ID NO: 3280568 - protein, 19 aa, Plasmodium falciparum
KIFRILLLILFYFSLPTFP

SEQ ID NO: 3280569 - protein, 21 aa, Plasmodium falciparum
KIFSVFLEKHFHYFREEYEHI

SEQ ID NO: 3280570 - protein, 23 aa, Plasmodium falciparum
KIFWKIYIFFLFYKNRRFLKRRK

SEQ ID NO: 3280571 - protein, 20 aa, Plasmodium falciparum
KIGHVFFYNHIIGICFLIKK

SEQ ID NO: 3280572 - protein, 18 aa, Plasmodium falciparum
KIHMLLKLICTFTPCYNS

SEQ ID NO: 3280573 - protein, 19 aa, Plasmodium falciparum
KIILIILFLCLFKKNDVLI

SEQ ID NO: 3280574 - protein, 17 aa, Plasmodium falciparum
KIILRTELEYEKKHIII

SEQ ID NO: 3280575 - protein, 24 aa, Plasmodium falciparum
KIIPEIIDGIFICKNHRLIYNMKE

SEQ ID NO: 3280576 - protein, 22 aa, Plasmodium falciparum
KIISSIFLFCFIYSEFDIYQNV

SEQ ID NO: 3280577 - protein, 23 aa, Plasmodium falciparum
KIITRKKIRQFICENEKKKKKKY

SEQ ID NO: 3280578 - protein, 17 aa, Plasmodium falciparum
KIKEYLFFFQVNKKLNK

SEQ ID NO: 3280579 - protein, 24 aa, Plasmodium falciparum
KIKGKELRSKFIVDMYKQLFDNAI

SEQ ID NO: 3280580 - protein, 22 aa, Plasmodium falciparum
KIKSCIFKKLFDFGVKDEDILY

SEQ ID NO: 3280581 - protein, 22 aa, Plasmodium falciparum
KIKSNCIYPLFYGNIFNPDNII

SEQ ID NO: 3280582 - protein, 19 aa, Plasmodium falciparum
KIKYGICFERVFVSYKKKI

SEQ ID NO: 3280583 - protein, 20 aa, Plasmodium falciparum
KILKEYLCHLFVNNPGTKPL

SEQ ID NO: 3280584 - protein, 23 aa, Plasmodium falciparum
KILKISCFLLRYISIDNRQSKMV

SEQ ID NO: 3280585 - protein, 22 aa, Plasmodium falciparum
KIPACVIRLYIRVIKSLDKEIL

SEQ ID NO: 3280586 - protein, 17 aa, Plasmodium falciparum
KIPPDFLRLMFYTLGDY

SEQ ID NO: 3280587 - protein, 25 aa, Plasmodium falciparum
KIRKDIKCFFLMYYILYKQNVSNNI

SEQ ID NO: 3280588 - protein, 20 aa, Plasmodium falciparum
KIRLKRAEAMLILGNLMLEI

SEQ ID NO: 3280589 - protein, 18 aa, Plasmodium falciparum
KISYFVFFHIYRNYEKLS

SEQ ID NO: 3280590 - protein, 20 aa, Plasmodium falciparum
KIVWCLCVLKKNEIFIDLLR

SEQ ID NO: 3280591 - protein, 27 aa, Plasmodium falciparum
KIYFYDFFFIYLLRKLFWNIFSLYYIY

SEQ ID NO: 3280592 - protein, 17 aa, Plasmodium falciparum
KIYGMPVIEVWKSKQVI

SEQ ID NO: 3280593 - protein, 23 aa, Plasmodium falciparum
KIYKRTPFKFGFVDKSADYIIKQ

SEQ ID NO: 3280594 - protein, 24 aa, Plasmodium falciparum
KIYRRLEFSLIFTLCETRKKLHAY

SEQ ID NO: 3280595 - protein, 18 aa, Plasmodium falciparum
KKAFLCLANIYKKRHDLL

SEQ ID NO: 3280596 - protein, 17 aa, Plasmodium falciparum
KKAFPVFTKILLVSFLV

SEQ ID NO: 3280597 - protein, 19 aa, Plasmodium falciparum
KKAICKKLDMLLNHRIEGN

SEQ ID NO: 3280598 - protein, 27 aa, Plasmodium falciparum
KKCYNSFRNCWSIYINIIFKLVTIDLL

SEQ ID NO: 3280599 - protein, 17 aa, Plasmodium falciparum
KKDKCYLLYNENKDSSY

SEQ ID NO: 3280600 - protein, 21 aa, Plasmodium falciparum
KKELFSFIQYNSFFWYILYKQ

SEQ ID NO: 3280601 - protein, 21 aa, Plasmodium falciparum
KKELYKYFFLVLRKYNKKKYY

SEQ ID NO: 3280602 - protein, 19 aa, Plasmodium falciparum
KKFFCDFIYLPYTIKYGYI

SEQ ID NO: 3280603 - protein, 19 aa, Plasmodium falciparum
KKFFSSFKYGNLLAKKKCI

SEQ ID NO: 3280604 - protein, 20 aa, Plasmodium falciparum
KKFHASFLFLIILALFMVFG

SEQ ID NO: 3280605 - protein, 22 aa, Plasmodium falciparum
KKFLFKLCVDLCNPFIWIYIND

SEQ ID NO: 3280606 - protein, 17 aa, Plasmodium falciparum
KKGGLLMGIMKRKRFMS

SEQ ID NO: 3280607 - protein, 18 aa, Plasmodium falciparum
KKHFNIFLCCEGIDQIRG

SEQ ID NO: 3280608 - protein, 23 aa, Plasmodium falciparum
KKHVNCFFCDIYINKNNFDDSTK

SEQ ID NO: 3280609 - protein, 20 aa, Plasmodium falciparum
KKICFKNIFLRVCVINLSIF

SEQ ID NO: 3280610 - protein, 20 aa, Plasmodium falciparum
KKIFLCIVVYFLSIYFNIIN

SEQ ID NO: 3280611 - protein, 23 aa, Plasmodium falciparum
KKIKEIYFLLCLVWIFHNIKREG

SEQ ID NO: 3280612 - protein, 17 aa, Plasmodium falciparum
KKIKGIGLLSFIILFYL

SEQ ID NO: 3280613 - protein, 19 aa, Plasmodium falciparum
KKIKSQWIYKIIKHKKINK

SEQ ID NO: 3280614 - protein, 25 aa, Plasmodium falciparum
KKILICLYCGSTVCLHEGDHVSGPL

SEQ ID NO: 3280615 - protein, 23 aa, Plasmodium falciparum
KKILKISVLFLILTIFFLCLRIA

SEQ ID NO: 3280616 - protein, 18 aa, Plasmodium falciparum
KKINCKLNFCSDDFFFIL

SEQ ID NO: 3280617 - protein, 19 aa, Plasmodium falciparum
KKINKYMCTYPFFNYKYTH

SEQ ID NO: 3280618 - protein, 17 aa, Plasmodium falciparum
KKIYAYICIGDFSNCYE

SEQ ID NO: 3280619 - protein, 23 aa, Plasmodium falciparum
KKIYECIKVFSIKEFRWLINKLE

SEQ ID NO: 3280620 - protein, 17 aa, Plasmodium falciparum
KKIYICTSLLLKIFKRI

SEQ ID NO: 3280621 - protein, 18 aa, Plasmodium falciparum
KKKEIDEIFILKRDLFVI

SEQ ID NO: 3280622 - protein, 17 aa, Plasmodium falciparum
KKKEIIHDLSFPVPIST

SEQ ID NO: 3280623 - protein, 21 aa, Plasmodium falciparum
KKKFRYLSLKLKNILMSHCAG

SEQ ID NO: 3280624 - protein, 21 aa, Plasmodium falciparum
KKKFVFFFIQRLFRLLCFRLM

SEQ ID NO: 3280625 - protein, 21 aa, Plasmodium falciparum
KKKKELICPINLLNNKNEIQP

SEQ ID NO: 3280626 - protein, 21 aa, Plasmodium falciparum
KKKKNFMCTTRWIYQQNECKR

SEQ ID NO: 3280627 - protein, 20 aa, Plasmodium falciparum
KKKLLKGIGILNEFSDIKWI

SEQ ID NO: 3280628 - protein, 19 aa, Plasmodium falciparum
KKKLYQWLIKYANLNKNYQ

SEQ ID NO: 3280629 - protein, 21 aa, Plasmodium falciparum
KKKRIDLVFNITKKLLARNNI

SEQ ID NO: 3280630 - protein, 20 aa, Plasmodium falciparum
KKKRLIHIYIKYMYLYEYLY

SEQ ID NO: 3280631 - protein, 18 aa, Plasmodium falciparum
KKKVCYITLCILKRLNED

SEQ ID NO: 3280632 - protein, 20 aa, Plasmodium falciparum
KKKYQCVLQWISRKEEEWKK

SEQ ID NO: 3280633 - protein, 22 aa, Plasmodium falciparum
KKLDWFVFFLLKILMRKLWFDK

SEQ ID NO: 3280634 - protein, 19 aa, Plasmodium falciparum
KKLFILMFIRFIKIPMYDH

SEQ ID NO: 3280635 - protein, 21 aa, Plasmodium falciparum
KKLFKFFLHILILKQIIFESF

SEQ ID NO: 3280636 - protein, 17 aa, Plasmodium falciparum
KKLKFYCLRSFYHSGCL

SEQ ID NO: 3280637 - protein, 17 aa, Plasmodium falciparum
KKLKRRPTCIVDKENNC

SEQ ID NO: 3280638 - protein, 18 aa, Plasmodium falciparum
KKLLCILEIFLISYEKKI

SEQ ID NO: 3280639 - protein, 18 aa, Plasmodium falciparum
KKLNCLILFINEDISNYT

SEQ ID NO: 3280640 - protein, 19 aa, Plasmodium falciparum
KKLSCSWLWMLPKKLALST

SEQ ID NO: 3280641 - protein, 19 aa, Plasmodium falciparum
KKLYELIKFFSFSEGGFQN

SEQ ID NO: 3280642 - protein, 19 aa, Plasmodium falciparum
KKMCRHFLNVMLPGLKIEK

SEQ ID NO: 3280643 - protein, 24 aa, Plasmodium falciparum
KKMTIRTGYHFKFNINKKSIHNRN

SEQ ID NO: 3280644 - protein, 17 aa, Plasmodium falciparum
KKNFWNIFELIKNDTYN

SEQ ID NO: 3280645 - protein, 18 aa, Plasmodium falciparum
KKNKCCYYYGKKVHNQYY

SEQ ID NO: 3280646 - protein, 24 aa, Plasmodium falciparum
KKNKLCIIEILYICISFMINEYMN

SEQ ID NO: 3280647 - protein, 23 aa, Plasmodium falciparum
KKNKRDFLYICLKEINKLSEDTL

SEQ ID NO: 3280648 - protein, 18 aa, Plasmodium falciparum
KKRIKIIITQIWTLQYIL

SEQ ID NO: 3280649 - protein, 21 aa, Plasmodium falciparum
KKRIKKIWLKWLAITKENKLK

SEQ ID NO: 3280650 - protein, 17 aa, Plasmodium falciparum
KKSFISFYFKQPVILSE

SEQ ID NO: 3280651 - protein, 20 aa, Plasmodium falciparum
KKTILCFYKLVISNLSILHT

SEQ ID NO: 3280652 - protein, 18 aa, Plasmodium falciparum
KKVLEFFENLVLNKKKKE

SEQ ID NO: 3280653 - protein, 20 aa, Plasmodium falciparum
KKVVLEIIHLLKIHSNFQKK

SEQ ID NO: 3280654 - protein, 25 aa, Plasmodium falciparum
KKYACVEFFKMLFLVSLFLITSYYS

SEQ ID NO: 3280655 - protein, 20 aa, Plasmodium falciparum
KKYADDWLSSDVLLSCFLNF

SEQ ID NO: 3280656 - protein, 19 aa, Plasmodium falciparum
KKYRRCINYIPSVEHSDIT

SEQ ID NO: 3280657 - protein, 18 aa, Plasmodium falciparum
KLDNWKEEKWFKLFKRDL

SEQ ID NO: 3280658 - protein, 18 aa, Plasmodium falciparum
KLFIEMFIPLLICVDTKE

SEQ ID NO: 3280659 - protein, 23 aa, Plasmodium falciparum
KLFIPRFISVVSYSFEQKFISNI

SEQ ID NO: 3280660 - protein, 17 aa, Plasmodium falciparum
KLFLNKYNMQWLHFNEC

SEQ ID NO: 3280661 - protein, 24 aa, Plasmodium falciparum
KLFMKRIYCYPRFHKHIHISLNNK

SEQ ID NO: 3280662 - protein, 18 aa, Plasmodium falciparum
KLFWNIFSLYYIYLQKYN

SEQ ID NO: 3280663 - protein, 20 aa, Plasmodium falciparum
KLKCKFDYISYFFLNMENFM

SEQ ID NO: 3280664 - protein, 21 aa, Plasmodium falciparum
KLKEALRFLGPISISVAVSDD

SEQ ID NO: 3280665 - protein, 20 aa, Plasmodium falciparum
KLKIFEIIFYYTLKVYLCFI

SEQ ID NO: 3280666 - protein, 18 aa, Plasmodium falciparum
KLLFFFISKFEKFDSSLL

SEQ ID NO: 3280667 - protein, 21 aa, Plasmodium falciparum
KLPDRFELFFNYLLTYSEKNV

SEQ ID NO: 3280668 - protein, 17 aa, Plasmodium falciparum
KLRITLMNCLTNLNIYI

SEQ ID NO: 3280669 - protein, 19 aa, Plasmodium falciparum
KLTREMIMLLTIKSQKKQY

SEQ ID NO: 3280670 - protein, 19 aa, Plasmodium falciparum
KLYNCIYIKYSKCECLFFF

SEQ ID NO: 3280671 - protein, 29 aa, Plasmodium falciparum
KNARLTLCITCVFPLIYVCGVICNKKVKL

SEQ ID NO: 3280672 - protein, 20 aa, Plasmodium falciparum
KNCIYIRLFFGVLLEEINDM

SEQ ID NO: 3280673 - protein, 20 aa, Plasmodium falciparum
KNDFLRKYFNLIFYSRDYWS

SEQ ID NO: 3280674 - protein, 17 aa, Plasmodium falciparum
KNDIGGRVRFRRYGKDS

SEQ ID NO: 3280675 - protein, 22 aa, Plasmodium falciparum
KNEARMSMLLGRNLDDEISKEK

SEQ ID NO: 3280676 - protein, 19 aa, Plasmodium falciparum
KNEGKCILLIKSYFNDYLC

SEQ ID NO: 3280677 - protein, 31 aa, Plasmodium falciparum
KNELLFIGEVVFKFIYYYGLFKDKNKLFYFL

SEQ ID NO: 3280678 - protein, 17 aa, Plasmodium falciparum
KNFGCLNISKSAHIKLV

SEQ ID NO: 3280679 - protein, 20 aa, Plasmodium falciparum
KNFNVKRFGNDGALRMAITM

SEQ ID NO: 3280680 - protein, 17 aa, Plasmodium falciparum
KNIFEFLNPIFNYDNVQ

SEQ ID NO: 3280681 - protein, 21 aa, Plasmodium falciparum
KNILCMLHVFFTRGIYLDIDL

SEQ ID NO: 3280682 - protein, 19 aa, Plasmodium falciparum
KNKCTSCLITHNILNVPIE

SEQ ID NO: 3280683 - protein, 22 aa, Plasmodium falciparum
KNKKSNICVITFNRKDKNNESI

SEQ ID NO: 3280684 - protein, 21 aa, Plasmodium falciparum
KNKRIPISYIYDMKNLIYEYQ

SEQ ID NO: 3280685 - protein, 24 aa, Plasmodium falciparum
KNLCKEFKIELELLKNGHKGGSTT

SEQ ID NO: 3280686 - protein, 19 aa, Plasmodium falciparum
KNLMGMRGAQKMIIYKAYG

SEQ ID NO: 3280687 - protein, 23 aa, Plasmodium falciparum
KNNISGYCFLNFGLKKNAIIKKR

SEQ ID NO: 3280688 - protein, 17 aa, Plasmodium falciparum
KNNLVNIPFTWDKTTLD

SEQ ID NO: 3280689 - protein, 18 aa, Plasmodium falciparum
KNPLINFCLRKNIYCDNI

SEQ ID NO: 3280690 - protein, 18 aa, Plasmodium falciparum
KNRMEIIDLIKLIYSFFI

SEQ ID NO: 3280691 - protein, 22 aa, Plasmodium falciparum
KNSSWFFCIDIFRQHTNRIFNQ

SEQ ID NO: 3280692 - protein, 25 aa, Plasmodium falciparum
KNVILFKFYLRLVVSRIMLASKTLT

SEQ ID NO: 3280693 - protein, 19 aa, Plasmodium falciparum
KNVRINFEFLFKNIYFKDE

SEQ ID NO: 3280694 - protein, 23 aa, Plasmodium falciparum
KPKRFPFFIPLKIMKCRKEMHLI

SEQ ID NO: 3280695 - protein, 23 aa, Plasmodium falciparum
KPKRSFIKLIFNWINNKKDDLHK

SEQ ID NO: 3280696 - protein, 22 aa, Plasmodium falciparum
KPNPSFVLPFIFVYSCIEIENL

SEQ ID NO: 3280697 - protein, 25 aa, Plasmodium falciparum
KQKIISFFSICCIMTLLGKLNNVCI

SEQ ID NO: 3280698 - protein, 22 aa, Plasmodium falciparum
KQKIIWKRWIARYVKHIDDYII

SEQ ID NO: 3280699 - protein, 17 aa, Plasmodium falciparum
KQKNANCLYPFCEKTKK

SEQ ID NO: 3280700 - protein, 19 aa, Plasmodium falciparum
KQKYEIWMLLEILRSIKNN

SEQ ID NO: 3280701 - protein, 19 aa, Plasmodium falciparum
KQQSAWPFLKPVSLSEAPD

SEQ ID NO: 3280702 - protein, 23 aa, Plasmodium falciparum
KRAICIMCPYLSFDIYVSKNIYY

SEQ ID NO: 3280703 - protein, 21 aa, Plasmodium falciparum
KRASFFINYYFYHLHLFIYFK

SEQ ID NO: 3280704 - protein, 17 aa, Plasmodium falciparum
KRCIEFLDLFSSNKRTR

SEQ ID NO: 3280705 - protein, 24 aa, Plasmodium falciparum
KRELKFYQIRSYDDMDFYILRNQN

SEQ ID NO: 3280706 - protein, 18 aa, Plasmodium falciparum
KRFKKVVISWKMYCKYKK

SEQ ID NO: 3280707 - protein, 20 aa, Plasmodium falciparum
KRFNEILLYLTSWIDIFHTS

SEQ ID NO: 3280708 - protein, 19 aa, Plasmodium falciparum
KRIIYMLSILRMNKLLNMF

SEQ ID NO: 3280709 - protein, 19 aa, Plasmodium falciparum
KRINRKKCDKKDCLKDDEN

SEQ ID NO: 3280710 - protein, 19 aa, Plasmodium falciparum
KRIPLERNYEGFILEQKNI

SEQ ID NO: 3280711 - protein, 19 aa, Plasmodium falciparum
KRIQMCLKDSALAITVTTL

SEQ ID NO: 3280712 - protein, 20 aa, Plasmodium falciparum
KRIYLYFQFVYLFKNKFNNE

SEQ ID NO: 3280713 - protein, 20 aa, Plasmodium falciparum
KRKIYKTKIDSMLKNNEIID

SEQ ID NO: 3280714 - protein, 20 aa, Plasmodium falciparum
KRKRALLKLKKISAAYNINT

SEQ ID NO: 3280715 - protein, 20 aa, Plasmodium falciparum
KRLFSEPVMLCFQLFSDHYL

SEQ ID NO: 3280716 - protein, 22 aa, Plasmodium falciparum
KRLIYDILFCIKIFISKYLYNL

SEQ ID NO: 3280717 - protein, 19 aa, Plasmodium falciparum
KRLLNFIKLFFFIDIGISD

SEQ ID NO: 3280718 - protein, 24 aa, Plasmodium falciparum
KRMFCNICGYILKQNFLNDFFFFK

SEQ ID NO: 3280719 - protein, 20 aa, Plasmodium falciparum
KRMYEILKNILLKQNYENIY

SEQ ID NO: 3280720 - protein, 21 aa, Plasmodium falciparum
KRNSFDIFPFFKKFKGIRTKL

SEQ ID NO: 3280721 - protein, 18 aa, Plasmodium falciparum
KRRGFFFLNSISDNDDII

SEQ ID NO: 3280722 - protein, 19 aa, Plasmodium falciparum
KRRRSIMGWNILRNRIKCC

SEQ ID NO: 3280723 - protein, 17 aa, Plasmodium falciparum
KRSIVHFGLKLFLFSFC

SEQ ID NO: 3280724 - protein, 19 aa, Plasmodium falciparum
KRVYDLFCIYAIILKYFPY

SEQ ID NO: 3280725 - protein, 17 aa, Plasmodium falciparum
KRWSIWKSNKWNGLNGW

SEQ ID NO: 3280726 - protein, 21 aa, Plasmodium falciparum
KRYIFKFLKYFTIKKKFTDIV

SEQ ID NO: 3280727 - protein, 17 aa, Plasmodium falciparum
KRYIFLGIHSFLFAFEL

SEQ ID NO: 3280728 - protein, 20 aa, Plasmodium falciparum
KRYITFYSIRALLYLIKKKK

SEQ ID NO: 3280729 - protein, 20 aa, Plasmodium falciparum
KSCNDLICLYLFKHFSYILD

SEQ ID NO: 3280730 - protein, 17 aa, Plasmodium falciparum
KSFKLKIWIDGHKSSKK

SEQ ID NO: 3280731 - protein, 21 aa, Plasmodium falciparum
KSGTIPLDFLRLMFYTLGDYR

SEQ ID NO: 3280732 - protein, 19 aa, Plasmodium falciparum
KSKIKVIIEKCLQFIPSRR

SEQ ID NO: 3280733 - protein, 19 aa, Plasmodium falciparum
KSMLCAGIFGGIKNPIVNM

SEQ ID NO: 3280734 - protein, 18 aa, Plasmodium falciparum
KSNLFIKRLFLFCHFLIC

SEQ ID NO: 3280735 - protein, 18 aa, Plasmodium falciparum
KSPLPFIGVYTMIVPCTS

SEQ ID NO: 3280736 - protein, 19 aa, Plasmodium falciparum
KSRLLEFVYICLKHLNGDN

SEQ ID NO: 3280737 - protein, 18 aa, Plasmodium falciparum
KSSACAYLALWLVNIVKY

SEQ ID NO: 3280738 - protein, 18 aa, Plasmodium falciparum
KSSLIFFCITLLYLFYTY

SEQ ID NO: 3280739 - protein, 24 aa, Plasmodium falciparum
KSVKILKKRLNSISNDLEKRTEEI

SEQ ID NO: 3280740 - protein, 17 aa, Plasmodium falciparum
KSVKSYNGFFWKWVHDM

SEQ ID NO: 3280741 - protein, 19 aa, Plasmodium falciparum
KTFCIKLLYIMTLFNISFT

SEQ ID NO: 3280742 - protein, 23 aa, Plasmodium falciparum
KTFKFRIILIISFYILETLIVTL

SEQ ID NO: 3280743 - protein, 17 aa, Plasmodium falciparum
KTFKLMCNKICNLEERN

SEQ ID NO: 3280744 - protein, 19 aa, Plasmodium falciparum
KTGSSIPSNFVWKNSDDSK

SEQ ID NO: 3280745 - protein, 17 aa, Plasmodium falciparum
KTILKFLLGYPFVVEFI

SEQ ID NO: 3280746 - protein, 17 aa, Plasmodium falciparum
KTILLRKHLIVFVIINI

SEQ ID NO: 3280747 - protein, 24 aa, Plasmodium falciparum
KTLCLYCLALLKFLENDILKCTNI

SEQ ID NO: 3280748 - protein, 25 aa, Plasmodium falciparum
KTLKKVKCAYAYLLYIIYYYELTKY

SEQ ID NO: 3280749 - protein, 17 aa, Plasmodium falciparum
KVCNLYRGFTLHSFKLI

SEQ ID NO: 3280750 - protein, 21 aa, Plasmodium falciparum
KVGLCLHPLCYVNSFKNFSLL

SEQ ID NO: 3280751 - protein, 22 aa, Plasmodium falciparum
KVHLLICPFSFFFSVYKEKKNK

SEQ ID NO: 3280752 - protein, 17 aa, Plasmodium falciparum
KVICSHLLNIFAAFQMC

SEQ ID NO: 3280753 - protein, 24 aa, Plasmodium falciparum
KVILRFTFLVSFSFLAIIVSTLYV

SEQ ID NO: 3280754 - protein, 23 aa, Plasmodium falciparum
KVLFKRWLEYFLEDYNKLKEKLN

SEQ ID NO: 3280755 - protein, 21 aa, Plasmodium falciparum
KVSYYLSYICSYIFSNKYHML

SEQ ID NO: 3280756 - protein, 19 aa, Plasmodium falciparum
KWHKLECGLCHRIDLETSG

SEQ ID NO: 3280757 - protein, 17 aa, Plasmodium falciparum
KWKECYEIIKMGEEDIE

SEQ ID NO: 3280758 - protein, 18 aa, Plasmodium falciparum
KWLCSFISFYLKNVNALK

SEQ ID NO: 3280759 - protein, 19 aa, Plasmodium falciparum
KWLDIFWKYFHKNEEEIEK

SEQ ID NO: 3280760 - protein, 19 aa, Plasmodium falciparum
KWSKQHWNKLDNWKEEKWF

SEQ ID NO: 3280761 - protein, 19 aa, Plasmodium falciparum
KYECIPFHLLLILLTILLY

SEQ ID NO: 3280762 - protein, 18 aa, Plasmodium falciparum
KYEPKYNVAWKCLGDAYR

SEQ ID NO: 3280763 - protein, 19 aa, Plasmodium falciparum
KYFSFYFLISIVIVFIGVS

SEQ ID NO: 3280764 - protein, 19 aa, Plasmodium falciparum
KYHNIWKGFNIFTFNLFNV

SEQ ID NO: 3280765 - protein, 19 aa, Plasmodium falciparum
KYHRKAFCWIDEWIDLTID

SEQ ID NO: 3280766 - protein, 18 aa, Plasmodium falciparum
KYICSLSIDNNEYNINKK

SEQ ID NO: 3280767 - protein, 21 aa, Plasmodium falciparum
KYIKCILYKIELIKYNNNNNN

SEQ ID NO: 3280768 - protein, 17 aa, Plasmodium falciparum
KYLCNIFKRDSRRYIDM

SEQ ID NO: 3280769 - protein, 18 aa, Plasmodium falciparum
KYLSLSIIKKAIKIYAHK

SEQ ID NO: 3280770 - protein, 18 aa, Plasmodium falciparum
KYLTCDFVAYDLGMNDWK

SEQ ID NO: 3280771 - protein, 24 aa, Plasmodium falciparum
KYMKFCLCTIICVFLLDIYTNCES

SEQ ID NO: 3280772 - protein, 18 aa, Plasmodium falciparum
KYNICMFIQKNLFHYFKT

SEQ ID NO: 3280773 - protein, 19 aa, Plasmodium falciparum
KYNVAWKCLGDAYRSFRKF

SEQ ID NO: 3280774 - protein, 22 aa, Plasmodium falciparum
KYRKLHFGWKLFVNISPPAALA

SEQ ID NO: 3280775 - protein, 19 aa, Plasmodium falciparum
KYSEIYLLIHIIKYIYETY

SEQ ID NO: 3280776 - protein, 18 aa, Plasmodium falciparum
KYTLKMTIIYDIEKMKHI

SEQ ID NO: 3280777 - protein, 19 aa, Plasmodium falciparum
KYWRKIWLLIYTLINLILI

SEQ ID NO: 3280778 - protein, 19 aa, Plasmodium falciparum
KYYFYKLFHKFRMSYNHFI

SEQ ID NO: 3280779 - protein, 19 aa, Plasmodium falciparum
KYYHPLCAYLEGYYMDVEV

SEQ ID NO: 3280780 - protein, 23 aa, Plasmodium falciparum
KYYLKFSYLFSIYFSLHMKFFLQ

SEQ ID NO: 3280781 - protein, 21 aa, Plasmodium falciparum
LAIEYRERWIQLKAFHRLNNL

SEQ ID NO: 3280782 - protein, 19 aa, Plasmodium falciparum
LAKCLPRVSGVWYDLHKNS

SEQ ID NO: 3280783 - protein, 18 aa, Plasmodium falciparum
LAKIFLHLAYIHFEHGYI

SEQ ID NO: 3280784 - protein, 18 aa, Plasmodium falciparum
LCALIKFRFAGLCSAFLY

SEQ ID NO: 3280785 - protein, 20 aa, Plasmodium falciparum
LCCDIFCSFYKYDIFKKTFF

SEQ ID NO: 3280786 - protein, 24 aa, Plasmodium falciparum
LCEIPRMYYIFYLKDLRLFLEYLD

SEQ ID NO: 3280787 - protein, 17 aa, Plasmodium falciparum
LCHIKFNPTHPMFIVKL

SEQ ID NO: 3280788 - protein, 20 aa, Plasmodium falciparum
LCILGCLFFENFLFKDFDNS

SEQ ID NO: 3280789 - protein, 17 aa, Plasmodium falciparum
LCISIWCLFVNICKNSD

SEQ ID NO: 3280790 - protein, 21 aa, Plasmodium falciparum
LCKWLSFCFSCLIAFALISFT

SEQ ID NO: 3280791 - protein, 19 aa, Plasmodium falciparum
LCLIRCYVHNDVIKFGEEN

SEQ ID NO: 3280792 - protein, 17 aa, Plasmodium falciparum
LCNMSTYFIIFFFAIFI

SEQ ID NO: 3280793 - protein, 21 aa, Plasmodium falciparum
LCNVPVKWLISFYKNNITGDK

SEQ ID NO: 3280794 - protein, 18 aa, Plasmodium falciparum
LCRIFFKYVDNILLCKKN

SEQ ID NO: 3280795 - protein, 17 aa, Plasmodium falciparum
LCSSTAFFFIKNSNEPH

SEQ ID NO: 3280796 - protein, 19 aa, Plasmodium falciparum
LCVIDKYYLILKMNQDEFD

SEQ ID NO: 3280797 - protein, 18 aa, Plasmodium falciparum
LCVLKYKIYFFINTLYTY

SEQ ID NO: 3280798 - protein, 18 aa, Plasmodium falciparum
LCVYRIYKILLLKNKNKF

SEQ ID NO: 3280799 - protein, 20 aa, Plasmodium falciparum
LDCLKCILSPSIFKKLKGTY

SEQ ID NO: 3280800 - protein, 19 aa, Plasmodium falciparum
LDIIKICFFNNYKNNYNKL

SEQ ID NO: 3280801 - protein, 19 aa, Plasmodium falciparum
LDLKKIFYFLIIFLIYLYI

SEQ ID NO: 3280802 - protein, 22 aa, Plasmodium falciparum
LDLYKKHIFDIFSITHNDIINI

SEQ ID NO: 3280803 - protein, 19 aa, Plasmodium falciparum
LDMEGRYLLLSNIVNHIRY

SEQ ID NO: 3280804 - protein, 23 aa, Plasmodium falciparum
LDYEIIYRILLIFKNLTRYKSFY

SEQ ID NO: 3280805 - protein, 25 aa, Plasmodium falciparum
LDYILKCGITFFFIFILLRSHIFIQ

SEQ ID NO: 3280806 - protein, 17 aa, Plasmodium falciparum
LECPLCFFMSNDSYFPW

SEQ ID NO: 3280807 - protein, 17 aa, Plasmodium falciparum
LEGYKCAENFLKELKHC

SEQ ID NO: 3280808 - protein, 22 aa, Plasmodium falciparum
LEHVCEVFAFFGIDYISAEILR

SEQ ID NO: 3280809 - protein, 23 aa, Plasmodium falciparum
LEIDRIIKFLIKYDDICDQINYV

SEQ ID NO: 3280810 - protein, 24 aa, Plasmodium falciparum
LEIILGDECIVWWLHDIDPIFSYH

SEQ ID NO: 3280811 - protein, 17 aa, Plasmodium falciparum
LEIISLIFYGMKIRDLA

SEQ ID NO: 3280812 - protein, 19 aa, Plasmodium falciparum
LEKEIRPIILITHVNPANN

SEQ ID NO: 3280813 - protein, 19 aa, Plasmodium falciparum
LEKMFAWLFYYIINIDDNK

SEQ ID NO: 3280814 - protein, 19 aa, Plasmodium falciparum
LEKSCIFEDFYPLYMLETL

SEQ ID NO: 3280815 - protein, 19 aa, Plasmodium falciparum
LENCKNCIDQIYFLNQMFK

SEQ ID NO: 3280816 - protein, 17 aa, Plasmodium falciparum
LENHLRGIISLKNSNSL

SEQ ID NO: 3280817 - protein, 17 aa, Plasmodium falciparum
LEYWLFINILKFLKTAF

SEQ ID NO: 3280818 - protein, 19 aa, Plasmodium falciparum
LFCPKAFVIYEVLKRKLEN

SEQ ID NO: 3280819 - protein, 17 aa, Plasmodium falciparum
LFEKLYEYFKLYFIYPM

SEQ ID NO: 3280820 - protein, 21 aa, Plasmodium falciparum
LFFEFIGSFLFVFFISIYMLN

SEQ ID NO: 3280821 - protein, 20 aa, Plasmodium falciparum
LFFFKWKRYEIINIVKEKLA

SEQ ID NO: 3280822 - protein, 19 aa, Plasmodium falciparum
LFFICVSIIKNIYEDSRRS

SEQ ID NO: 3280823 - protein, 17 aa, Plasmodium falciparum
LFFVTCSYFIIRSYELT

SEQ ID NO: 3280824 - protein, 19 aa, Plasmodium falciparum
LFICLFCIYIFVYPNECKF

SEQ ID NO: 3280825 - protein, 17 aa, Plasmodium falciparum
LFIEFDIVFPKKLSPEQ

SEQ ID NO: 3280826 - protein, 18 aa, Plasmodium falciparum
LFIIRFIVIRGSKYRYEN

SEQ ID NO: 3280827 - protein, 18 aa, Plasmodium falciparum
LFIKLALAISFFFYNNII

SEQ ID NO: 3280828 - protein, 17 aa, Plasmodium falciparum
LFKCYKKLFYILEEQYD

SEQ ID NO: 3280829 - protein, 20 aa, Plasmodium falciparum
LFKICYKVTLPIFLYLLSCL

SEQ ID NO: 3280830 - protein, 23 aa, Plasmodium falciparum
LFKLKIIKTFECLIIFLRDSMIG

SEQ ID NO: 3280831 - protein, 20 aa, Plasmodium falciparum
LFKVLFERWLKYFIQDFNNV

SEQ ID NO: 3280832 - protein, 18 aa, Plasmodium falciparum
LFLKLCSLYCDRKEIKIL

SEQ ID NO: 3280833 - protein, 17 aa, Plasmodium falciparum
LFLSLYIHKYMHNICLD

SEQ ID NO: 3280834 - protein, 20 aa, Plasmodium falciparum
LFNFPVVFIFSSDSKNFNFN

SEQ ID NO: 3280835 - protein, 21 aa, Plasmodium falciparum
LFNKRFVEFLLPYSNNIAKYI

SEQ ID NO: 3280836 - protein, 20 aa, Plasmodium falciparum
LFPHQICVFAGTFDFLHLNN

SEQ ID NO: 3280837 - protein, 17 aa, Plasmodium falciparum
LFSIPFLFSSIFTFPHI

SEQ ID NO: 3280838 - protein, 17 aa, Plasmodium falciparum
LFSSLYLHSYILFLFFN

SEQ ID NO: 3280839 - protein, 18 aa, Plasmodium falciparum
LFTHLFKIINIIYYNSLF

SEQ ID NO: 3280840 - protein, 17 aa, Plasmodium falciparum
LFYEILHFILLKLLYYI

SEQ ID NO: 3280841 - protein, 25 aa, Plasmodium falciparum
LFYFFKLKKTLLYLLKCFGIEQIKK

SEQ ID NO: 3280842 - protein, 26 aa, Plasmodium falciparum
LGFFVGSFFFIWYITGEKIFKRKKKI

SEQ ID NO: 3280843 - protein, 22 aa, Plasmodium falciparum
LGHLYPFVDWVWLKSDLLAWAP

SEQ ID NO: 3280844 - protein, 17 aa, Plasmodium falciparum
LGILKFDLLFGSEYHLA

SEQ ID NO: 3280845 - protein, 19 aa, Plasmodium falciparum
LGIVLICIMNLWIYKNKGT

SEQ ID NO: 3280846 - protein, 24 aa, Plasmodium falciparum
LGKGTCFPFSFKGRFAHILYIFMT

SEQ ID NO: 3280847 - protein, 27 aa, Plasmodium falciparum
LGKWSWTGICCSCGYLQIPAFMINSSN

SEQ ID NO: 3280848 - protein, 17 aa, Plasmodium falciparum
LHAPYIWNGMIYALTYD

SEQ ID NO: 3280849 - protein, 18 aa, Plasmodium falciparum
LHCIKNIYYREGIRNFYH

SEQ ID NO: 3280850 - protein, 17 aa, Plasmodium falciparum
LHFILLKLLYYIIVIFI

SEQ ID NO: 3280851 - protein, 17 aa, Plasmodium falciparum
LHHNFKSLIKLTSSCIN

SEQ ID NO: 3280852 - protein, 19 aa, Plasmodium falciparum
LHILMCIADYLLYIFKIII

SEQ ID NO: 3280853 - protein, 26 aa, Plasmodium falciparum
LHNLCPRRILSILLFFYEQNIESEKQ

SEQ ID NO: 3280854 - protein, 18 aa, Plasmodium falciparum
LHNMELYGGIPYPFEYKY

SEQ ID NO: 3280855 - protein, 18 aa, Plasmodium falciparum
LHWYYKGYLRRYYKNVIL

SEQ ID NO: 3280856 - protein, 17 aa, Plasmodium falciparum
LIASFFYYFSIYKISPW

SEQ ID NO: 3280857 - protein, 20 aa, Plasmodium falciparum
LICACGLGGGVAPVWGLVSG

SEQ ID NO: 3280858 - protein, 17 aa, Plasmodium falciparum
LICGVGYVGWTQYAAAT

SEQ ID NO: 3280859 - protein, 25 aa, Plasmodium falciparum
LIDLCIFGFMCLCGITMNIISMVIL

SEQ ID NO: 3280860 - protein, 17 aa, Plasmodium falciparum
LIFCVMYLFEYCNIIEI

SEQ ID NO: 3280861 - protein, 19 aa, Plasmodium falciparum
LIFFYYYICKKICMQFFTL

SEQ ID NO: 3280862 - protein, 22 aa, Plasmodium falciparum
LIFYKIIYAYILLEYGILSQAQ

SEQ ID NO: 3280863 - protein, 18 aa, Plasmodium falciparum
LIHFSLFVSLIIKKGVEE

SEQ ID NO: 3280864 - protein, 23 aa, Plasmodium falciparum
LIHLFTFLKCFLKKIQVSKAIES

SEQ ID NO: 3280865 - protein, 20 aa, Plasmodium falciparum
LIKFKSCLMNCFKEINNTEK

SEQ ID NO: 3280866 - protein, 23 aa, Plasmodium falciparum
LILSIKINLLYSIHNLIKMFSHV

SEQ ID NO: 3280867 - protein, 18 aa, Plasmodium falciparum
LILSMILFLVFIFYMFNE

SEQ ID NO: 3280868 - protein, 21 aa, Plasmodium falciparum
LINKLEIIYFYFFCHLLLLCI

SEQ ID NO: 3280869 - protein, 17 aa, Plasmodium falciparum
LIQNAIIRKCYLDLKIN

SEQ ID NO: 3280870 - protein, 19 aa, Plasmodium falciparum
LIRIKCSYYIFVHSLLRYK

SEQ ID NO: 3280871 - protein, 24 aa, Plasmodium falciparum
LISKRMKSVFLFYKIDHTLFENSD

SEQ ID NO: 3280872 - protein, 23 aa, Plasmodium falciparum
LITFLLCWICHLYFLNNICNNKL

SEQ ID NO: 3280873 - protein, 18 aa, Plasmodium falciparum
LITNISFLFYIILIKFPN

SEQ ID NO: 3280874 - protein, 17 aa, Plasmodium falciparum
LIVSLLIFYLIIQLSYD

SEQ ID NO: 3280875 - protein, 22 aa, Plasmodium falciparum
LIVSTCYRWPLLIDPQLQGLKW

SEQ ID NO: 3280876 - protein, 17 aa, Plasmodium falciparum
LIWPFYLLYPIKRNANI

SEQ ID NO: 3280877 - protein, 27 aa, Plasmodium falciparum
LIYLNCFSEIFLLLSPLRIPAFCFSWV

SEQ ID NO: 3280878 - protein, 18 aa, Plasmodium falciparum
LIYWCYKNDIPIFCPGLT

SEQ ID NO: 3280879 - protein, 17 aa, Plasmodium falciparum
LKCNFDFLNKLNTQIYG

SEQ ID NO: 3280880 - protein, 20 aa, Plasmodium falciparum
LKCPGCGRECRKYKKWIERK

SEQ ID NO: 3280881 - protein, 17 aa, Plasmodium falciparum
LKCSRCYMHVHKFCYIS

SEQ ID NO: 3280882 - protein, 21 aa, Plasmodium falciparum
LKEALRFLGPISISIAVSDDF

SEQ ID NO: 3280883 - protein, 21 aa, Plasmodium falciparum
LKECCYICGSIEYKNNFIYCC

SEQ ID NO: 3280884 - protein, 21 aa, Plasmodium falciparum
LKENIIFSGIWVYGISKRNDL

SEQ ID NO: 3280885 - protein, 17 aa, Plasmodium falciparum
LKFNNFRIDNMMKKNGC

SEQ ID NO: 3280886 - protein, 17 aa, Plasmodium falciparum
LKGGMSLVSFFCFLSFF

SEQ ID NO: 3280887 - protein, 18 aa, Plasmodium falciparum
LKHKDFCFKFPTFINYKN

SEQ ID NO: 3280888 - protein, 22 aa, Plasmodium falciparum
LKHLEIMEGINFERLKIAQQEL

SEQ ID NO: 3280889 - protein, 20 aa, Plasmodium falciparum
LKHLLSIVIFLCYKYEEKGK

SEQ ID NO: 3280890 - protein, 17 aa, Plasmodium falciparum
LKICLYYPHYFFLACLF

SEQ ID NO: 3280891 - protein, 25 aa, Plasmodium falciparum
LKINICELLYICIYRSYIHANINTD

SEQ ID NO: 3280892 - protein, 17 aa, Plasmodium falciparum
LKINLGLLYTYIHTINM

SEQ ID NO: 3280893 - protein, 20 aa, Plasmodium falciparum
LKITDFYSGWLLIPKYYYEN

SEQ ID NO: 3280894 - protein, 19 aa, Plasmodium falciparum
LKKDIVCINRCLYILYKMD

SEQ ID NO: 3280895 - protein, 20 aa, Plasmodium falciparum
LKKIFFRYLHIIQRKMNDQG

SEQ ID NO: 3280896 - protein, 18 aa, Plasmodium falciparum
LKKKMLKYIYSDKKSDKI

SEQ ID NO: 3280897 - protein, 20 aa, Plasmodium falciparum
LKKYIFKYLMYMSIYQINNL

SEQ ID NO: 3280898 - protein, 17 aa, Plasmodium falciparum
LKLGIPFFLNKYLIFDN

SEQ ID NO: 3280899 - protein, 18 aa, Plasmodium falciparum
LKLICTFTPCYNSRIVKI

SEQ ID NO: 3280900 - protein, 17 aa, Plasmodium falciparum
LKLILWIQIYMYVWEEV

SEQ ID NO: 3280901 - protein, 20 aa, Plasmodium falciparum
LKLNFSFRSKKKFLIVNYND

SEQ ID NO: 3280902 - protein, 18 aa, Plasmodium falciparum
LKLWDLFFLFGMKILIKL

SEQ ID NO: 3280903 - protein, 18 aa, Plasmodium falciparum
LKMDMLHKISPMSHINAY

SEQ ID NO: 3280904 - protein, 20 aa, Plasmodium falciparum
LKNIILLFGRIAEPYYPKAV

SEQ ID NO: 3280905 - protein, 17 aa, Plasmodium falciparum
LKNKLCFEFSKTNHHHN

SEQ ID NO: 3280906 - protein, 18 aa, Plasmodium falciparum
LKNLAYRFLRLHYIHINL

SEQ ID NO: 3280907 - protein, 17 aa, Plasmodium falciparum
LKNRWFLILLKYFMHKY

SEQ ID NO: 3280908 - protein, 18 aa, Plasmodium falciparum
LKQVDSFLTLVVNEKLQK

SEQ ID NO: 3280909 - protein, 17 aa, Plasmodium falciparum
LKRKACDIIIDFCSVLK

SEQ ID NO: 3280910 - protein, 19 aa, Plasmodium falciparum
LKSFFFSILEKIRSSKLLL

SEQ ID NO: 3280911 - protein, 20 aa, Plasmodium falciparum
LKSNCIKTNFNMIKIGYVIF

SEQ ID NO: 3280912 - protein, 17 aa, Plasmodium falciparum
LKSVLFILLYNRQEINN

SEQ ID NO: 3280913 - protein, 18 aa, Plasmodium falciparum
LKSWLIKQWIQWKNMKIL

SEQ ID NO: 3280914 - protein, 26 aa, Plasmodium falciparum
LKSYFPKNFFKAVFLILPGLSFNIND

SEQ ID NO: 3280915 - protein, 22 aa, Plasmodium falciparum
LKTNFFWKEFISFLDFFNSRKS

SEQ ID NO: 3280916 - protein, 18 aa, Plasmodium falciparum
LKVLKFILISTINYDTNE

SEQ ID NO: 3280917 - protein, 18 aa, Plasmodium falciparum
LKWTGVWIVVGVIVIGIF

SEQ ID NO: 3280918 - protein, 23 aa, Plasmodium falciparum
LKYKLNKFLLFFIRFLLVLEPLL

SEQ ID NO: 3280919 - protein, 19 aa, Plasmodium falciparum
LKYRYKIGIHISDVSFFVT

SEQ ID NO: 3280920 - protein, 17 aa, Plasmodium falciparum
LLCGLRDGHFINMSQDD

SEQ ID NO: 3280921 - protein, 18 aa, Plasmodium falciparum
LLEKEIYYYVSINNKKNF

SEQ ID NO: 3280922 - protein, 18 aa, Plasmodium falciparum
LLELKFKVFNRLLKLNSY

SEQ ID NO: 3280923 - protein, 23 aa, Plasmodium falciparum
LLFHEVINLFVFYVYKFCNWDVL

SEQ ID NO: 3280924 - protein, 17 aa, Plasmodium falciparum
LLFSFFLFYASYFFFIN

SEQ ID NO: 3280925 - protein, 18 aa, Plasmodium falciparum
LLHIFFLISHNLRNILSN

SEQ ID NO: 3280926 - protein, 17 aa, Plasmodium falciparum
LLILLHDFPEFLASYYV

SEQ ID NO: 3280927 - protein, 19 aa, Plasmodium falciparum
LLIMIGCIFLKIKNVQKYL

SEQ ID NO: 3280928 - protein, 20 aa, Plasmodium falciparum
LLITFFICIFTRLNHGQFYE

SEQ ID NO: 3280929 - protein, 17 aa, Plasmodium falciparum
LLLCSSTAFFFIKNSNE

SEQ ID NO: 3280930 - protein, 20 aa, Plasmodium falciparum
LLLFWCKRDYKHFIDVVKKE

SEQ ID NO: 3280931 - protein, 23 aa, Plasmodium falciparum
LLNRFNFWIKLYIYQERMKIIKM

SEQ ID NO: 3280932 - protein, 17 aa, Plasmodium falciparum
LLNSIPLIESGIEGLKA

SEQ ID NO: 3280933 - protein, 18 aa, Plasmodium falciparum
LLQFLPCLLYVYNISYEN

SEQ ID NO: 3280934 - protein, 21 aa, Plasmodium falciparum
LLREFFFLFNFIKKELYNSWP

SEQ ID NO: 3280935 - protein, 17 aa, Plasmodium falciparum
LLSYCYFPKYFSLKHEN

SEQ ID NO: 3280936 - protein, 24 aa, Plasmodium falciparum
LLVIKFNFLFSFFINIFFILLASG

SEQ ID NO: 3280937 - protein, 19 aa, Plasmodium falciparum
LLYFLKIFFFFYDNEVYNK

SEQ ID NO: 3280938 - protein, 17 aa, Plasmodium falciparum
LLYWFIKIFFKFYYIKI

SEQ ID NO: 3280939 - protein, 18 aa, Plasmodium falciparum
LLYYWKWITHMIHKCSDY

SEQ ID NO: 3280940 - protein, 18 aa, Plasmodium falciparum
LMEFFFKIVLRIVPFFKV

SEQ ID NO: 3280941 - protein, 18 aa, Plasmodium falciparum
LMEIKKIYSCDGFFDSLI

SEQ ID NO: 3280942 - protein, 24 aa, Plasmodium falciparum
LMQIKRYYLATAFFILSGDIKDAI

SEQ ID NO: 3280943 - protein, 17 aa, Plasmodium falciparum
LMYHFPFFDEKKNKNKK

SEQ ID NO: 3280944 - protein, 18 aa, Plasmodium falciparum
LNAFDFHVLEFIKKSIKN

SEQ ID NO: 3280945 - protein, 19 aa, Plasmodium falciparum
LNCLVKFVFDDENYLKGKF

SEQ ID NO: 3280946 - protein, 18 aa, Plasmodium falciparum
LNCPIKFKNNFYMNCSDF

SEQ ID NO: 3280947 - protein, 21 aa, Plasmodium falciparum
LNEGMFYSWKLRYFVIKNNKL

SEQ ID NO: 3280948 - protein, 19 aa, Plasmodium falciparum
LNFFECILLILKKKGKFNV

SEQ ID NO: 3280949 - protein, 20 aa, Plasmodium falciparum
LNFFFFFLFHFMSFTPVSYF

SEQ ID NO: 3280950 - protein, 22 aa, Plasmodium falciparum
LNICVDPDCSIWYFYTLNDQTK

SEQ ID NO: 3280951 - protein, 20 aa, Plasmodium falciparum
LNIFLSFSFIRYNSISFKNN

SEQ ID NO: 3280952 - protein, 18 aa, Plasmodium falciparum
LNIKKYYSIMSFFLSEKL

SEQ ID NO: 3280953 - protein, 19 aa, Plasmodium falciparum
LNKKMKPFYCNNKNKNKNK

SEQ ID NO: 3280954 - protein, 25 aa, Plasmodium falciparum
LNLFLMQFLKLFPIPWLKKKKCHFK

SEQ ID NO: 3280955 - protein, 21 aa, Plasmodium falciparum
LNLKLKNMFTFFNPIKNNKFL

SEQ ID NO: 3280956 - protein, 19 aa, Plasmodium falciparum
LNRFLSCVFFSVHFSLSIL

SEQ ID NO: 3280957 - protein, 24 aa, Plasmodium falciparum
LNVVLFKYRFSKFLLNVYTNKYDD

SEQ ID NO: 3280958 - protein, 17 aa, Plasmodium falciparum
LNYQRLLFHEVINLFVF

SEQ ID NO: 3280959 - protein, 18 aa, Plasmodium falciparum
LPFFCIISNFSSWKKPLY

SEQ ID NO: 3280960 - protein, 18 aa, Plasmodium falciparum
LPIKSVIVIWDYLFSTSI

SEQ ID NO: 3280961 - protein, 21 aa, Plasmodium falciparum
LPKELFEFLTSYSLFSCDKKD

SEQ ID NO: 3280962 - protein, 24 aa, Plasmodium falciparum
LPLKYPEIFMSIGISAPKGVLMHG

SEQ ID NO: 3280963 - protein, 18 aa, Plasmodium falciparum
LPSWVYKIFYLFNFVIDI

SEQ ID NO: 3280964 - protein, 17 aa, Plasmodium falciparum
LQFLLCLIRCYVHNDVI

SEQ ID NO: 3280965 - protein, 22 aa, Plasmodium falciparum
LQFYFSYFFKCKICIFSNTFLF

SEQ ID NO: 3280966 - protein, 18 aa, Plasmodium falciparum
LQGGIIIYEFYEKRFKKL

SEQ ID NO: 3280967 - protein, 17 aa, Plasmodium falciparum
LQLKINFNLALSFLSAS

SEQ ID NO: 3280968 - protein, 17 aa, Plasmodium falciparum
LQLRATYIFSITLREQN

SEQ ID NO: 3280969 - protein, 23 aa, Plasmodium falciparum
LQMKGIFCILYILIVQIYIFFIN

SEQ ID NO: 3280970 - protein, 22 aa, Plasmodium falciparum
LQNCTYRSFLLFFNEEFYNFND

SEQ ID NO: 3280971 - protein, 22 aa, Plasmodium falciparum
LQTEFFKVFFFVYLEEVYYTIK

SEQ ID NO: 3280972 - protein, 21 aa, Plasmodium falciparum
LQTMWKFYISYILSIPNELEQ

SEQ ID NO: 3280973 - protein, 17 aa, Plasmodium falciparum
LRATYIFSITLREQNFF

SEQ ID NO: 3280974 - protein, 19 aa, Plasmodium falciparum
LRDARRLNVMLTRAKRGVI

SEQ ID NO: 3280975 - protein, 17 aa, Plasmodium falciparum
LRGSVPIFWNQQVNYKI

SEQ ID NO: 3280976 - protein, 20 aa, Plasmodium falciparum
LRIILLIIMILKFSLLYNKK

SEQ ID NO: 3280977 - protein, 18 aa, Plasmodium falciparum
LRILKLFREFLANKTVTL

SEQ ID NO: 3280978 - protein, 18 aa, Plasmodium falciparum
LRKHLIVFVIINILILFK

SEQ ID NO: 3280979 - protein, 22 aa, Plasmodium falciparum
LRKYNNCFILFFTILLMYITKL

SEQ ID NO: 3280980 - protein, 20 aa, Plasmodium falciparum
LRLFLYFGIVTFLSLDLLIN

SEQ ID NO: 3280981 - protein, 19 aa, Plasmodium falciparum
LRLLFLYDVPYKFNKDIKK

SEQ ID NO: 3280982 - protein, 20 aa, Plasmodium falciparum
LRNILKIILCDVETTVRRSA

SEQ ID NO: 3280983 - protein, 19 aa, Plasmodium falciparum
LRNKRLIKILSIREEGNKL

SEQ ID NO: 3280984 - protein, 20 aa, Plasmodium falciparum
LRQTYRLVFSKINFFDENIV

SEQ ID NO: 3280985 - protein, 21 aa, Plasmodium falciparum
LRRLFKCFSLFIGQQKYMDSL

SEQ ID NO: 3280986 - protein, 26 aa, Plasmodium falciparum
LRSICIINKFVICVSFGNIIKIINVR

SEQ ID NO: 3280987 - protein, 17 aa, Plasmodium falciparum
LRWFVEWGQNFCIRHEK

SEQ ID NO: 3280988 - protein, 17 aa, Plasmodium falciparum
LRYKWKFSHISEKYKNK

SEQ ID NO: 3280989 - protein, 18 aa, Plasmodium falciparum
LSDECIRYLSLVRLFLNR

SEQ ID NO: 3280990 - protein, 22 aa, Plasmodium falciparum
LSDLRRYVCKKSYLLINLLLRY

SEQ ID NO: 3280991 - protein, 22 aa, Plasmodium falciparum
LSEVFIYLNVCPKLIIYFFHII

SEQ ID NO: 3280992 - protein, 23 aa, Plasmodium falciparum
LSFITRFSICFIHWMKNHDENLI

SEQ ID NO: 3280993 - protein, 22 aa, Plasmodium falciparum
LSFKGANCSLLINNRKEDEGKE

SEQ ID NO: 3280994 - protein, 18 aa, Plasmodium falciparum
LSFLNFYLEDMIKDGSLL

SEQ ID NO: 3280995 - protein, 18 aa, Plasmodium falciparum
LSGTEFFFCLSWVVTYYS

SEQ ID NO: 3280996 - protein, 18 aa, Plasmodium falciparum
LSLHWPIYASYIFIICAV

SEQ ID NO: 3280997 - protein, 19 aa, Plasmodium falciparum
LSLKRLGILLGLDEIGDEN

SEQ ID NO: 3280998 - protein, 20 aa, Plasmodium falciparum
LSLLFLCIFIYRLYYISINE

SEQ ID NO: 3280999 - protein, 21 aa, Plasmodium falciparum
LSQLIPIKWFKLFSAHELKTL

SEQ ID NO: 3281000 - protein, 18 aa, Plasmodium falciparum
LSRRAYRNFHICSIFIHL

SEQ ID NO: 3281001 - protein, 18 aa, Plasmodium falciparum
LSSSSNICFNRKETSTQN

SEQ ID NO: 3281002 - protein, 24 aa, Plasmodium falciparum
LSSWGYKGSLLINFFYSYFYNTKH

SEQ ID NO: 3281003 - protein, 18 aa, Plasmodium falciparum
LSYLNVFLSFYRKYYMKN

SEQ ID NO: 3281004 - protein, 19 aa, Plasmodium falciparum
LSYNISCSFLFKQEKLSSM

SEQ ID NO: 3281005 - protein, 18 aa, Plasmodium falciparum
LTNYVCPMSWFFIIRRIV

SEQ ID NO: 3281006 - protein, 18 aa, Plasmodium falciparum
LTQLYFYITVTIQMIQIF

SEQ ID NO: 3281007 - protein, 24 aa, Plasmodium falciparum
LVFCTCILLSIICRNICEFFITEL

SEQ ID NO: 3281008 - protein, 19 aa, Plasmodium falciparum
LVLFCFIFGCLTKLCKPKK

SEQ ID NO: 3281009 - protein, 17 aa, Plasmodium falciparum
LVLLILSFLCFFYSSLS

SEQ ID NO: 3281010 - protein, 23 aa, Plasmodium falciparum
LVLSIRDAVKWISFMNTYINNKK

SEQ ID NO: 3281011 - protein, 18 aa, Plasmodium falciparum
LVMICLNKAFYLSYLCMY

SEQ ID NO: 3281012 - protein, 23 aa, Plasmodium falciparum
LVQIRGSIPLFWKQHSMSSHVNI

SEQ ID NO: 3281013 - protein, 17 aa, Plasmodium falciparum
LWLLLALTILLSLILYV

SEQ ID NO: 3281014 - protein, 23 aa, Plasmodium falciparum
LWSKCLWKPVFFILPDVNNNSDN

SEQ ID NO: 3281015 - protein, 24 aa, Plasmodium falciparum
LYEELKLFLLYFFHKLLYNLLTEQ

SEQ ID NO: 3281016 - protein, 18 aa, Plasmodium falciparum
LYEQCLFVVFDNKIDLCL

SEQ ID NO: 3281017 - protein, 17 aa, Plasmodium falciparum
LYFHMCIYNSKKATNVC

SEQ ID NO: 3281018 - protein, 20 aa, Plasmodium falciparum
LYGKELFNFLVYKKQVKENI

SEQ ID NO: 3281019 - protein, 19 aa, Plasmodium falciparum
LYHTLILCENCKGFYVDMF

SEQ ID NO: 3281020 - protein, 17 aa, Plasmodium falciparum
LYIELAYVIKKRKNLIN

SEQ ID NO: 3281021 - protein, 18 aa, Plasmodium falciparum
LYIFYNFCKHFFDIENLI

SEQ ID NO: 3281022 - protein, 17 aa, Plasmodium falciparum
LYIIFIFIILTFLLILS

SEQ ID NO: 3281023 - protein, 17 aa, Plasmodium falciparum
LYIKFHMHLALIYKYIG

SEQ ID NO: 3281024 - protein, 25 aa, Plasmodium falciparum
LYKCTKCNIYVHKYCYGIYPKNKSE

SEQ ID NO: 3281025 - protein, 18 aa, Plasmodium falciparum
LYMLRIILSINIVYNKIK

SEQ ID NO: 3281026 - protein, 18 aa, Plasmodium falciparum
LYNKLLRNRNLILILAKE

SEQ ID NO: 3281027 - protein, 17 aa, Plasmodium falciparum
LYPKFCIYRVPDHTRLP

SEQ ID NO: 3281028 - protein, 17 aa, Plasmodium falciparum
LYPLQICDIYIKIYNKI

SEQ ID NO: 3281029 - protein, 23 aa, Plasmodium falciparum
LYRDCIISFFLLYIFILYLYKYY

SEQ ID NO: 3281030 - protein, 21 aa, Plasmodium falciparum
LYREKKKWCSLYISTMNGPMS

SEQ ID NO: 3281031 - protein, 20 aa, Plasmodium falciparum
LYRFAINLFNPFSCNVCVKC

SEQ ID NO: 3281032 - protein, 18 aa, Plasmodium falciparum
LYSHSFIGYGWIDSLFRV

SEQ ID NO: 3281033 - protein, 25 aa, Plasmodium falciparum
LYSNKNLKCNFYYNNNNLSTYVIKH

SEQ ID NO: 3281034 - protein, 22 aa, Plasmodium falciparum
LYTCTHILCVLAYLNIKNDEYP

SEQ ID NO: 3281035 - protein, 17 aa, Plasmodium falciparum
LYVGIFFDKKYNYENNE

SEQ ID NO: 3281036 - protein, 17 aa, Plasmodium falciparum
LYYIFLFLFKYYKYPLR

SEQ ID NO: 3281037 - protein, 20 aa, Plasmodium falciparum
MCLRIVYYLFELIFNISTYI

SEQ ID NO: 3281038 - protein, 18 aa, Plasmodium falciparum
MCMIFPYYFISYFNYKIF

SEQ ID NO: 3281039 - protein, 19 aa, Plasmodium falciparum
MDKFCLLNSIPLIESGIEG

SEQ ID NO: 3281040 - protein, 22 aa, Plasmodium falciparum
MEYRLLNILLFDSFYTGMNNVK

SEQ ID NO: 3281041 - protein, 17 aa, Plasmodium falciparum
MFFHILLNFCNIYELNH

SEQ ID NO: 3281042 - protein, 17 aa, Plasmodium falciparum
MFIPLLICVDTKECYHN

SEQ ID NO: 3281043 - protein, 25 aa, Plasmodium falciparum
MFLLIKIFFVLFLFEVNVKMYFIVS

SEQ ID NO: 3281044 - protein, 26 aa, Plasmodium falciparum
MGLICKFPILWIIGSIVFCITPSEHR

SEQ ID NO: 3281045 - protein, 25 aa, Plasmodium falciparum
MGNQCTKCFFACYPYENWIEKQKEQ

SEQ ID NO: 3281046 - protein, 18 aa, Plasmodium falciparum
MHGLKWTGVWIVVGVIVI

SEQ ID NO: 3281047 - protein, 21 aa, Plasmodium falciparum
MHLGHLIPFYFCKYLQEAFNV

SEQ ID NO: 3281048 - protein, 17 aa, Plasmodium falciparum
MIIWRKSPLLYLFKIEI

SEQ ID NO: 3281049 - protein, 19 aa, Plasmodium falciparum
MILECLGNIKIKYEYTLHL

SEQ ID NO: 3281050 - protein, 17 aa, Plasmodium falciparum
MIYLCDMIYIYFYILKI

SEQ ID NO: 3281051 - protein, 17 aa, Plasmodium falciparum
MKDRNVCIGTKYPTWYK

SEQ ID NO: 3281052 - protein, 20 aa, Plasmodium falciparum
MKIYCLRYYTGIPITTTSYK

SEQ ID NO: 3281053 - protein, 24 aa, Plasmodium falciparum
MKKRIKLPFLRIFFEKMSKIAEEK

SEQ ID NO: 3281054 - protein, 17 aa, Plasmodium falciparum
MKKRYITFYSIRALLYL

SEQ ID NO: 3281055 - protein, 17 aa, Plasmodium falciparum
MKLCLDFYSDIFVHVLD

SEQ ID NO: 3281056 - protein, 23 aa, Plasmodium falciparum
MKRRYELQKAILLNVDENLKEVI

SEQ ID NO: 3281057 - protein, 19 aa, Plasmodium falciparum
MKVIKRFIKSFVILIYSDV

SEQ ID NO: 3281058 - protein, 17 aa, Plasmodium falciparum
MLCACPNCFLIVELVVI

SEQ ID NO: 3281059 - protein, 17 aa, Plasmodium falciparum
MLEKCLLFLSSVNNNKL

SEQ ID NO: 3281060 - protein, 17 aa, Plasmodium falciparum
MLFKHKFFFFVFFYIFL

SEQ ID NO: 3281061 - protein, 18 aa, Plasmodium falciparum
MLLGMLCIHICLNLYISY

SEQ ID NO: 3281062 - protein, 19 aa, Plasmodium falciparum
MLLKICLRLLESRRINVEN

SEQ ID NO: 3281063 - protein, 19 aa, Plasmodium falciparum
MLLKVCLSNIISINKLLYF

SEQ ID NO: 3281064 - protein, 19 aa, Plasmodium falciparum
MNFLICYSIFIVSIHFVTR

SEQ ID NO: 3281065 - protein, 20 aa, Plasmodium falciparum
MNICPLFYSFMIFFNQLNSR

SEQ ID NO: 3281066 - protein, 22 aa, Plasmodium falciparum
MNLCVYEILYVCFEKKIETLTI

SEQ ID NO: 3281067 - protein, 25 aa, Plasmodium falciparum
MPQFFRWFSQWAHFFCKEKEYWELK

SEQ ID NO: 3281068 - protein, 25 aa, Plasmodium falciparum
MPYHPFFWKWVHDMLHDSVEWKTEL

SEQ ID NO: 3281069 - protein, 17 aa, Plasmodium falciparum
MRFFPCIFYLDYNDDDL

SEQ ID NO: 3281070 - protein, 18 aa, Plasmodium falciparum
MRIGLHYGSCVGGIIGSV

SEQ ID NO: 3281071 - protein, 18 aa, Plasmodium falciparum
MRYRMEVFILLLIGVLSF

SEQ ID NO: 3281072 - protein, 18 aa, Plasmodium falciparum
MSFFCFLLLYGFNIFLSI

SEQ ID NO: 3281073 - protein, 18 aa, Plasmodium falciparum
MSPYCLKGIYSIRTDIYS

SEQ ID NO: 3281074 - protein, 24 aa, Plasmodium falciparum
MVSEIKLRINIFIDVVNKYKSCIN

SEQ ID NO: 3281075 - protein, 22 aa, Plasmodium falciparum
MVYHPFFWKWVTEMLDDSIKWR

SEQ ID NO: 3281076 - protein, 23 aa, Plasmodium falciparum
MYCASLFPICWLPIGLKVAETMP

SEQ ID NO: 3281077 - protein, 17 aa, Plasmodium falciparum
MYFLKAFIYRCVVRPTN

SEQ ID NO: 3281078 - protein, 19 aa, Plasmodium falciparum
MYILIILVFMYFKLILKGP

SEQ ID NO: 3281079 - protein, 23 aa, Plasmodium falciparum
MYVPELLCVVLALQTNMFMNKNI

SEQ ID NO: 3281080 - protein, 17 aa, Plasmodium falciparum
NACNLSYEELMYKMQNN

SEQ ID NO: 3281081 - protein, 23 aa, Plasmodium falciparum
NALFKRWLEYFLEDYKKIKHKIS

SEQ ID NO: 3281082 - protein, 23 aa, Plasmodium falciparum
NALLKRWVEYFLEDYKKIKHKIS

SEQ ID NO: 3281083 - protein, 17 aa, Plasmodium falciparum
NAPNLINCFSEFINWCD

SEQ ID NO: 3281084 - protein, 22 aa, Plasmodium falciparum
NCDYCNKHVYPLIKTYTPLFVY

SEQ ID NO: 3281085 - protein, 19 aa, Plasmodium falciparum
NCEMLRYYIIIGVLQAMSL

SEQ ID NO: 3281086 - protein, 23 aa, Plasmodium falciparum
NCFNLILCHWIFRLRRVCTDSGK

SEQ ID NO: 3281087 - protein, 22 aa, Plasmodium falciparum
NCPSCGTPCRYYKKWINTKKTE

SEQ ID NO: 3281088 - protein, 25 aa, Plasmodium falciparum
NCSKIKFPRLCSSSSSFLASYNTYN

SEQ ID NO: 3281089 - protein, 17 aa, Plasmodium falciparum
NCSLCKCTFNFNKIFHF

SEQ ID NO: 3281090 - protein, 22 aa, Plasmodium falciparum
NDIPEFIKRVNFNSMQKNNNDK

SEQ ID NO: 3281091 - protein, 22 aa, Plasmodium falciparum
NDKIKYSIIWSFTNDEKIVVYG

SEQ ID NO: 3281092 - protein, 18 aa, Plasmodium falciparum
NECNTKCDCFLKWITQKK

SEQ ID NO: 3281093 - protein, 24 aa, Plasmodium falciparum
NECNTNCKCFLKWIGKKKTEWGKI

SEQ ID NO: 3281094 - protein, 21 aa, Plasmodium falciparum
NEERRKRLVILKRRKGQNDKI

SEQ ID NO: 3281095 - protein, 20 aa, Plasmodium falciparum
NEFFYFWIGRFLNDSMYWRG

SEQ ID NO: 3281096 - protein, 18 aa, Plasmodium falciparum
NEFLKLYIFYGQKNLPSM

SEQ ID NO: 3281097 - protein, 22 aa, Plasmodium falciparum
NEFLKNCKFFSFVLKKKKKITI

SEQ ID NO: 3281098 - protein, 26 aa, Plasmodium falciparum
NEKIDFRYAEWFLKTYLFYKYKYSDN

SEQ ID NO: 3281099 - protein, 18 aa, Plasmodium falciparum
NEKLMLYLSFLLKHIHKL

SEQ ID NO: 3281100 - protein, 19 aa, Plasmodium falciparum
NELFNFFFFHIYTLIQGSI

SEQ ID NO: 3281101 - protein, 23 aa, Plasmodium falciparum
NELHMFKHILLSAVIKYKHTQKV

SEQ ID NO: 3281102 - protein, 23 aa, Plasmodium falciparum
NELIVHSFLRFFNYPFFKKPLIG

SEQ ID NO: 3281103 - protein, 20 aa, Plasmodium falciparum
NELKGALKIEFPFSTPINNE

SEQ ID NO: 3281104 - protein, 18 aa, Plasmodium falciparum
NEMKRYVSIDSIYGLHEI

SEQ ID NO: 3281105 - protein, 19 aa, Plasmodium falciparum
NEMSLPFCEANFFKNHFNV

SEQ ID NO: 3281106 - protein, 18 aa, Plasmodium falciparum
NENFCLFNKYLIVNNRDK

SEQ ID NO: 3281107 - protein, 17 aa, Plasmodium falciparum
NENRITIIIAHRLSTIR

SEQ ID NO: 3281108 - protein, 17 aa, Plasmodium falciparum
NEYKLCYNLFPYNIITN

SEQ ID NO: 3281109 - protein, 19 aa, Plasmodium falciparum
NFFFSFSVFYNILFLLIIM

SEQ ID NO: 3281110 - protein, 18 aa, Plasmodium falciparum
NFFLKMIIIFLIINAYLH

SEQ ID NO: 3281111 - protein, 17 aa, Plasmodium falciparum
NFFNFWVAHMLKDSIYW

SEQ ID NO: 3281112 - protein, 21 aa, Plasmodium falciparum
NFGESFIRIGFLLKKETSINK

SEQ ID NO: 3281113 - protein, 21 aa, Plasmodium falciparum
NFIHFIISFTIIFFICINNEK

SEQ ID NO: 3281114 - protein, 20 aa, Plasmodium falciparum
NFILCLRLLYLIINTLNYFL

SEQ ID NO: 3281115 - protein, 19 aa, Plasmodium falciparum
NFIPFKSFYYLLLSETNLN

SEQ ID NO: 3281116 - protein, 24 aa, Plasmodium falciparum
NFKVDCKNMLPCIENTNTSLNRAN

SEQ ID NO: 3281117 - protein, 19 aa, Plasmodium falciparum
NFLRILKFFSFFLEHYKNT

SEQ ID NO: 3281118 - protein, 20 aa, Plasmodium falciparum
NFTFRSCLFPFIYEKKYITD

SEQ ID NO: 3281119 - protein, 17 aa, Plasmodium falciparum
NFWRSIKSVNEIKSLTG

SEQ ID NO: 3281120 - protein, 17 aa, Plasmodium falciparum
NFYKYGIIYGFKINKVY

SEQ ID NO: 3281121 - protein, 17 aa, Plasmodium falciparum
NGICLNCPDGAYCEGGF

SEQ ID NO: 3281122 - protein, 25 aa, Plasmodium falciparum
NGNRLPIFLGIDVCRLVYWCCVVYI

SEQ ID NO: 3281123 - protein, 18 aa, Plasmodium falciparum
NGSYSIKCGKNFQKNKMN

SEQ ID NO: 3281124 - protein, 17 aa, Plasmodium falciparum
NICLECIKGYRLSRDRT

SEQ ID NO: 3281125 - protein, 21 aa, Plasmodium falciparum
NIEVVELFLSLYIHKYMHNIC

SEQ ID NO: 3281126 - protein, 19 aa, Plasmodium falciparum
NIFCFLKDGYICFMNLLNN

SEQ ID NO: 3281127 - protein, 17 aa, Plasmodium falciparum
NIFCFQGNFKLDKHPRS

SEQ ID NO: 3281128 - protein, 23 aa, Plasmodium falciparum
NIFDEFLDIYLLFRLRGGKGGFG

SEQ ID NO: 3281129 - protein, 18 aa, Plasmodium falciparum
NIFLVSAKTGYNVKKLIY

SEQ ID NO: 3281130 - protein, 19 aa, Plasmodium falciparum
NIFLYFFVMIFFHLYIQNS

SEQ ID NO: 3281131 - protein, 19 aa, Plasmodium falciparum
NIIFFKKFFIYKILKEEKH

SEQ ID NO: 3281132 - protein, 17 aa, Plasmodium falciparum
NIIFLGLFIIRFNGDHF

SEQ ID NO: 3281133 - protein, 21 aa, Plasmodium falciparum
NIIQLSCEIFKTLLNFIEITK

SEQ ID NO: 3281134 - protein, 17 aa, Plasmodium falciparum
NIKNIDCLSTFYHKKRH

SEQ ID NO: 3281135 - protein, 23 aa, Plasmodium falciparum
NIKPEVFELINFLKREKKKVYVC

SEQ ID NO: 3281136 - protein, 22 aa, Plasmodium falciparum
NIKSEGFIFFVLVFFICIIFGC

SEQ ID NO: 3281137 - protein, 24 aa, Plasmodium falciparum
NIKSFRFSLFFDIFFELKVNFNHF

SEQ ID NO: 3281138 - protein, 17 aa, Plasmodium falciparum
NILEEWGLMGFDEKTIY

SEQ ID NO: 3281139 - protein, 22 aa, Plasmodium falciparum
NILNCLYLHIFIMYIYYYNKLY

SEQ ID NO: 3281140 - protein, 24 aa, Plasmodium falciparum
NILRISFNFTYFFSAEFFFFNDNM

SEQ ID NO: 3281141 - protein, 17 aa, Plasmodium falciparum
NIPPLRLLFLYDVPYKF

SEQ ID NO: 3281142 - protein, 20 aa, Plasmodium falciparum
NIPSLVCSFKLFLNTQKHGL

SEQ ID NO: 3281143 - protein, 18 aa, Plasmodium falciparum
NIRINLFIDICWIYFRYM

SEQ ID NO: 3281144 - protein, 17 aa, Plasmodium falciparum
NITCLWKKINISGDSKN

SEQ ID NO: 3281145 - protein, 25 aa, Plasmodium falciparum
NITLFHLCFFGFLFVILNFTLDNSN

SEQ ID NO: 3281146 - protein, 21 aa, Plasmodium falciparum
NIYRFFLRVAQSISMTKYKDI

SEQ ID NO: 3281147 - protein, 24 aa, Plasmodium falciparum
NKAFLYCFIKLFVLIVLSLFTIYY

SEQ ID NO: 3281148 - protein, 19 aa, Plasmodium falciparum
NKCGIPLEFCFFDGSRNPI

SEQ ID NO: 3281149 - protein, 17 aa, Plasmodium falciparum
NKCKIDDNWFCSIIQGY

SEQ ID NO: 3281150 - protein, 22 aa, Plasmodium falciparum
NKCLPCLVSGCIRCIKSTLKKG

SEQ ID NO: 3281151 - protein, 23 aa, Plasmodium falciparum
NKDKCKGKCKCVSESKLMNESKI

SEQ ID NO: 3281152 - protein, 29 aa, Plasmodium falciparum
NKEFSCFYLFIYFRCCFENINFYLIEKFI

SEQ ID NO: 3281153 - protein, 26 aa, Plasmodium falciparum
NKESCIMCIYFLYPLYMNLEDIDFKT

SEQ ID NO: 3281154 - protein, 22 aa, Plasmodium falciparum
NKESDDLFCFNKRMSNLTNLIN

SEQ ID NO: 3281155 - protein, 19 aa, Plasmodium falciparum
NKFLYCLNLKTCLLKENKI

SEQ ID NO: 3281156 - protein, 19 aa, Plasmodium falciparum
NKGKIGIIYCFKRNTCDEI

SEQ ID NO: 3281157 - protein, 24 aa, Plasmodium falciparum
NKHYIGNILLCFLLYFHSFLDLLC

SEQ ID NO: 3281158 - protein, 21 aa, Plasmodium falciparum
NKILPFYIWRSFLKNIQFNVK

SEQ ID NO: 3281159 - protein, 20 aa, Plasmodium falciparum
NKITWNVLYALKLIYNNFSF

SEQ ID NO: 3281160 - protein, 22 aa, Plasmodium falciparum
NKKSFYLYDVFNIEPIKYKYLP

SEQ ID NO: 3281161 - protein, 24 aa, Plasmodium falciparum
NKLYAIKFLKIFSLKYMKKVKNMS

SEQ ID NO: 3281162 - protein, 22 aa, Plasmodium falciparum
NKNVCVGCGAIFQSKDMNKFGF

SEQ ID NO: 3281163 - protein, 18 aa, Plasmodium falciparum
NKRKRIIYMLSILRMNKL

SEQ ID NO: 3281164 - protein, 20 aa, Plasmodium falciparum
NKWILRMSMYFLNFKDVMFF

SEQ ID NO: 3281165 - protein, 18 aa, Plasmodium falciparum
NKYISIFHLFKFAICEVA

SEQ ID NO: 3281166 - protein, 18 aa, Plasmodium falciparum
NKYKPCSIFSFFKKKDKN

SEQ ID NO: 3281167 - protein, 24 aa, Plasmodium falciparum
NKYRKLHFGWKLFVNISPPAALAI

SEQ ID NO: 3281168 - protein, 17 aa, Plasmodium falciparum
NKYVYKWIHNRSPSFDY

SEQ ID NO: 3281169 - protein, 18 aa, Plasmodium falciparum
NLCLKKKIYLLGLNYDEY

SEQ ID NO: 3281170 - protein, 23 aa, Plasmodium falciparum
NLDEFRCSFILYEVLNALNTYLN

SEQ ID NO: 3281171 - protein, 19 aa, Plasmodium falciparum
NLFIFFKRLQLFYFMNTKK

SEQ ID NO: 3281172 - protein, 24 aa, Plasmodium falciparum
NLFKIKNLFFLKSFFSHIHNNVDI

SEQ ID NO: 3281173 - protein, 19 aa, Plasmodium falciparum
NLIFLGICIKIVICRISNL

SEQ ID NO: 3281174 - protein, 22 aa, Plasmodium falciparum
NLIKFLFERRGYFLYQEGYMKK

SEQ ID NO: 3281175 - protein, 17 aa, Plasmodium falciparum
NLNYIWKRADPPNDRTF

SEQ ID NO: 3281176 - protein, 18 aa, Plasmodium falciparum
NLPCCIHSILLFIKYYKI

SEQ ID NO: 3281177 - protein, 19 aa, Plasmodium falciparum
NLQVEWLRILTLELFYKNK

SEQ ID NO: 3281178 - protein, 26 aa, Plasmodium falciparum
NLRKFKYVKLKSVSMIGLFIIIFIDE

SEQ ID NO: 3281179 - protein, 17 aa, Plasmodium falciparum
NLVNIPFTWDKTTLDFS

SEQ ID NO: 3281180 - protein, 19 aa, Plasmodium falciparum
NMFSFLLDIIKICFFNNYK

SEQ ID NO: 3281181 - protein, 20 aa, Plasmodium falciparum
NMRIGLHYGSCVGGVIGSGR

SEQ ID NO: 3281182 - protein, 20 aa, Plasmodium falciparum
NMWNIRWCKYLENMMEEVNY

SEQ ID NO: 3281183 - protein, 19 aa, Plasmodium falciparum
NMYKMVIHYSKFYLLMLLI

SEQ ID NO: 3281184 - protein, 18 aa, Plasmodium falciparum
NNFFKLPLSYSFNKELEV

SEQ ID NO: 3281185 - protein, 25 aa, Plasmodium falciparum
NNFIYCCICGISVHYSCANIVHPFL

SEQ ID NO: 3281186 - protein, 20 aa, Plasmodium falciparum
NNFWLYPGYFCFIGTYQQLA

SEQ ID NO: 3281187 - protein, 20 aa, Plasmodium falciparum
NNICTNCFIYIYDDEMVGLN

SEQ ID NO: 3281188 - protein, 22 aa, Plasmodium falciparum
NNKCIPCPIGLYYSNSKSINQC

SEQ ID NO: 3281189 - protein, 18 aa, Plasmodium falciparum
NNLHCFYDPLSYYMLYEH

SEQ ID NO: 3281190 - protein, 23 aa, Plasmodium falciparum
NNLWYLNFIRFMLLFSSVIPISL

SEQ ID NO: 3281191 - protein, 23 aa, Plasmodium falciparum
NNNCVYCASIAKILGKPIYCSLC

SEQ ID NO: 3281192 - protein, 27 aa, Plasmodium falciparum
NNPVFKFRLSKLFILKYIDLYTIVKNK

SEQ ID NO: 3281193 - protein, 18 aa, Plasmodium falciparum
NNRLMVWYAITCGAPKEA

SEQ ID NO: 3281194 - protein, 17 aa, Plasmodium falciparum
NNSCFHLLLFFLPLSVP

SEQ ID NO: 3281195 - protein, 18 aa, Plasmodium falciparum
NNSLLCFNNNKVIVLNLI

SEQ ID NO: 3281196 - protein, 30 aa, Plasmodium falciparum
NNYSYIPFCFFYKYFEHFVFQQSLSYCILL

SEQ ID NO: 3281197 - protein, 22 aa, Plasmodium falciparum
NPIKCMFFYFLSIISHKPSMNR

SEQ ID NO: 3281198 - protein, 22 aa, Plasmodium falciparum
NQLLFKFLHLCMNYFLHVAYVY

SEQ ID NO: 3281199 - protein, 24 aa, Plasmodium falciparum
NQRPYFRLLHCLLIDINEQCIYSN

SEQ ID NO: 3281200 - protein, 17 aa, Plasmodium falciparum
NRAKVWYAITCGAGTSD

SEQ ID NO: 3281201 - protein, 17 aa, Plasmodium falciparum
NRFKVHIAIPFNLSDIL

SEQ ID NO: 3281202 - protein, 17 aa, Plasmodium falciparum
NRFPYFFQYLYKNHKCK

SEQ ID NO: 3281203 - protein, 18 aa, Plasmodium falciparum
NRISSLLSREFIFFKNNN

SEQ ID NO: 3281204 - protein, 20 aa, Plasmodium falciparum
NRLKKFCFTLFFSVTLKNLI

SEQ ID NO: 3281205 - protein, 17 aa, Plasmodium falciparum
NRLLFLLDFYEKNSNCN

SEQ ID NO: 3281206 - protein, 24 aa, Plasmodium falciparum
NRLLKRYICKSIIFLDSYKEESYY

SEQ ID NO: 3281207 - protein, 18 aa, Plasmodium falciparum
NRLNGCLHPSRVIGDYDI

SEQ ID NO: 3281208 - protein, 23 aa, Plasmodium falciparum
NRMWYYIFVKILFLSFFICILNG

SEQ ID NO: 3281209 - protein, 17 aa, Plasmodium falciparum
NRYSISLDHLWKSNINI

SEQ ID NO: 3281210 - protein, 19 aa, Plasmodium falciparum
NSFFSFEFLYLAYICSNSF

SEQ ID NO: 3281211 - protein, 17 aa, Plasmodium falciparum
NSFKMKFSIIIGFIHMT

SEQ ID NO: 3281212 - protein, 18 aa, Plasmodium falciparum
NSLKWKGKMFKKRSLIEM

SEQ ID NO: 3281213 - protein, 17 aa, Plasmodium falciparum
NSLKWKYFFYFKKNVNS

SEQ ID NO: 3281214 - protein, 21 aa, Plasmodium falciparum
NSLKWPLHFYRNLCYKNNYKV

SEQ ID NO: 3281215 - protein, 24 aa, Plasmodium falciparum
NSSFFLFNMSFQFVESMSKQNMRG

SEQ ID NO: 3281216 - protein, 21 aa, Plasmodium falciparum
NSYECSFPLLTNGPYYYENEN

SEQ ID NO: 3281217 - protein, 21 aa, Plasmodium falciparum
NSYIRWCLSKSFGNIMIYLNV

SEQ ID NO: 3281218 - protein, 23 aa, Plasmodium falciparum
NTKCNALLRKQRVLYEEKGDVVL

SEQ ID NO: 3281219 - protein, 21 aa, Plasmodium falciparum
NTLKIFPLFLLDSSTHNLPIV

SEQ ID NO: 3281220 - protein, 23 aa, Plasmodium falciparum
NTYFVRYIIRLMLYYADSDVNTI

SEQ ID NO: 3281221 - protein, 20 aa, Plasmodium falciparum
NVCMKELYYLYGYYKELVKN

SEQ ID NO: 3281222 - protein, 18 aa, Plasmodium falciparum
NVCPKYMVTSGFLNYIYF

SEQ ID NO: 3281223 - protein, 22 aa, Plasmodium falciparum
NVDEFRLLYELILIEEINEKIK

SEQ ID NO: 3281224 - protein, 23 aa, Plasmodium falciparum
NVFLEWLCVYLLYVQGLKKENKF

SEQ ID NO: 3281225 - protein, 18 aa, Plasmodium falciparum
NVLFKNIFLVSAKTGYNV

SEQ ID NO: 3281226 - protein, 24 aa, Plasmodium falciparum
NVLFLKKYYNIFSIILIAWFHNPL

SEQ ID NO: 3281227 - protein, 23 aa, Plasmodium falciparum
NVLYCGNCPFSSSPKDQCASIKT

SEQ ID NO: 3281228 - protein, 22 aa, Plasmodium falciparum
NVMIKKKCMLYLTFNRKENDNI

SEQ ID NO: 3281229 - protein, 20 aa, Plasmodium falciparum
NVSFINFYSWIFFKDISIKK

SEQ ID NO: 3281230 - protein, 18 aa, Plasmodium falciparum
NVVLCFKTPLTANLNIFN

SEQ ID NO: 3281231 - protein, 19 aa, Plasmodium falciparum
NVYCLKFIFVLNNVCDLDK

SEQ ID NO: 3281232 - protein, 20 aa, Plasmodium falciparum
NWFDEMWFKNVVNELKEKND

SEQ ID NO: 3281233 - protein, 18 aa, Plasmodium falciparum
NWLPWLKWISSKRAIVHV

SEQ ID NO: 3281234 - protein, 29 aa, Plasmodium falciparum
NYFRKEIQNEFSFRNGLYFSPTTVGEYNK

SEQ ID NO: 3281235 - protein, 18 aa, Plasmodium falciparum
NYIHIFEYHPIYSLIMKI

SEQ ID NO: 3281236 - protein, 26 aa, Plasmodium falciparum
NYISLICGLFCNFLSPAFAYISACES

SEQ ID NO: 3281237 - protein, 23 aa, Plasmodium falciparum
NYKFCYNFSFDLLFYILFYCFKR

SEQ ID NO: 3281238 - protein, 18 aa, Plasmodium falciparum
NYLFKGVLYISPFDTNKC

SEQ ID NO: 3281239 - protein, 18 aa, Plasmodium falciparum
NYLYGEGECVIFFYKNIS

SEQ ID NO: 3281240 - protein, 18 aa, Plasmodium falciparum
NYMKIFINFCNIYNDIII

SEQ ID NO: 3281241 - protein, 17 aa, Plasmodium falciparum
PCDLDFWFHTNVWRDKA

SEQ ID NO: 3281242 - protein, 23 aa, Plasmodium falciparum
PCNSDIWWIYSFSDIIHIEKIGL

SEQ ID NO: 3281243 - protein, 18 aa, Plasmodium falciparum
PDDCVFCTQLNCTIKKRW

SEQ ID NO: 3281244 - protein, 17 aa, Plasmodium falciparum
PEFGCLWESEAIFPEDE

SEQ ID NO: 3281245 - protein, 17 aa, Plasmodium falciparum
PEFLCVYNFSFCNVIPL

SEQ ID NO: 3281246 - protein, 19 aa, Plasmodium falciparum
PERLCSMSPYIIDKCYFVY

SEQ ID NO: 3281247 - protein, 20 aa, Plasmodium falciparum
PFAFCLGSTWFLLINGGILF

SEQ ID NO: 3281248 - protein, 19 aa, Plasmodium falciparum
PFFKRALYLMDCFDNIYID

SEQ ID NO: 3281249 - protein, 17 aa, Plasmodium falciparum
PFFRWLHEWGSDFCGKR

SEQ ID NO: 3281250 - protein, 20 aa, Plasmodium falciparum
PFKFPEIIENFILQIQEKLL

SEQ ID NO: 3281251 - protein, 22 aa, Plasmodium falciparum
PFKSLFLYRIINYFTMVDLYKV

SEQ ID NO: 3281252 - protein, 23 aa, Plasmodium falciparum
PFLFKRIQLYISKFFLYIQNDFL

SEQ ID NO: 3281253 - protein, 18 aa, Plasmodium falciparum
PFVNAVLCNIIFLGLFII

SEQ ID NO: 3281254 - protein, 18 aa, Plasmodium falciparum
PFYFRIFLFFILFFNFLC

SEQ ID NO: 3281255 - protein, 17 aa, Plasmodium falciparum
PGWGLICGVGYVGWTQY

SEQ ID NO: 3281256 - protein, 17 aa, Plasmodium falciparum
PIIKCFFNYTKLSVDIS

SEQ ID NO: 3281257 - protein, 20 aa, Plasmodium falciparum
PIIKEFILLLIFLFQRIRAE

SEQ ID NO: 3281258 - protein, 17 aa, Plasmodium falciparum
PIKYMWPSPFFYIYLFY

SEQ ID NO: 3281259 - protein, 23 aa, Plasmodium falciparum
PILSFEILDVFAFDNVRKRMSLI

SEQ ID NO: 3281260 - protein, 18 aa, Plasmodium falciparum
PIVFIFTIMFSFVCLYFQ

SEQ ID NO: 3281261 - protein, 24 aa, Plasmodium falciparum
PIYFRYLLNFLIFFVCEYINRIIL

SEQ ID NO: 3281262 - protein, 18 aa, Plasmodium falciparum
PKFKNLFYNYGFDTFENV

SEQ ID NO: 3281263 - protein, 18 aa, Plasmodium falciparum
PKKCPRGLGIPNIIKERN

SEQ ID NO: 3281264 - protein, 23 aa, Plasmodium falciparum
PKMPREYIVRLVFDRNHYTFCLL

SEQ ID NO: 3281265 - protein, 18 aa, Plasmodium falciparum
PKRFWLYIQKLFLYKCYL

SEQ ID NO: 3281266 - protein, 17 aa, Plasmodium falciparum
PKTRLFMYYGLYGLGGR

SEQ ID NO: 3281267 - protein, 17 aa, Plasmodium falciparum
PLFRVPRNFTLFKKVML

SEQ ID NO: 3281268 - protein, 20 aa, Plasmodium falciparum
PLGIYIFYIIKTCMYCTFKL

SEQ ID NO: 3281269 - protein, 19 aa, Plasmodium falciparum
PLGRLRLLYDFKDVEHMVC

SEQ ID NO: 3281270 - protein, 20 aa, Plasmodium falciparum
PLIIPFRGAFAFAISAFCIT

SEQ ID NO: 3281271 - protein, 24 aa, Plasmodium falciparum
PLISYRIALIIKIWTKCYKTSFPF

SEQ ID NO: 3281272 - protein, 23 aa, Plasmodium falciparum
PLKRFNSVLSFLGCHVCNKIFEV

SEQ ID NO: 3281273 - protein, 18 aa, Plasmodium falciparum
PLPMCLMINYKNTKDILL

SEQ ID NO: 3281274 - protein, 18 aa, Plasmodium falciparum
PLPNEPLHFMNINNDNND

SEQ ID NO: 3281275 - protein, 17 aa, Plasmodium falciparum
PMFYFFYYIELIRYVYC

SEQ ID NO: 3281276 - protein, 22 aa, Plasmodium falciparum
PNCKDYYFSLVFGDLKSSETLK

SEQ ID NO: 3281277 - protein, 19 aa, Plasmodium falciparum
PNIFALRKRFPLGMNDEDE

SEQ ID NO: 3281278 - protein, 18 aa, Plasmodium falciparum
PNYIKLFLFNWPSGKNLL

SEQ ID NO: 3281279 - protein, 28 aa, Plasmodium falciparum
PPCFYAPLFMCLYKIIINYSLYNFNDKN

SEQ ID NO: 3281280 - protein, 20 aa, Plasmodium falciparum
PPELCILCNAYANFNKRENT

SEQ ID NO: 3281281 - protein, 18 aa, Plasmodium falciparum
PPFFRWLHEWGSDFCDKR

SEQ ID NO: 3281282 - protein, 20 aa, Plasmodium falciparum
PPFFRWLHEWGSDFCGKRAR

SEQ ID NO: 3281283 - protein, 18 aa, Plasmodium falciparum
PPIYCPKGSLILGTTIES

SEQ ID NO: 3281284 - protein, 20 aa, Plasmodium falciparum
PPIYPPFEIWFFMSKKCASQ

SEQ ID NO: 3281285 - protein, 21 aa, Plasmodium falciparum
PPRRRKLYLGGFKRLTDGTAV

SEQ ID NO: 3281286 - protein, 17 aa, Plasmodium falciparum
PPYFRYLEEWGETFCRQ

SEQ ID NO: 3281287 - protein, 17 aa, Plasmodium falciparum
PPYFRYLEEWGQNFCKE

SEQ ID NO: 3281288 - protein, 17 aa, Plasmodium falciparum
PPYFRYLEEWGQNFCKK

SEQ ID NO: 3281289 - protein, 20 aa, Plasmodium falciparum
PQFLRWFREWGTYVCEESEK

SEQ ID NO: 3281290 - protein, 23 aa, Plasmodium falciparum
PQINRWILEWGKYNCRLMKEKEK

SEQ ID NO: 3281291 - protein, 21 aa, Plasmodium falciparum
PQINRWLMEWAYDTDYNKNLW

SEQ ID NO: 3281292 - protein, 20 aa, Plasmodium falciparum
PQPKFEEWWIIATYKNDDRI

SEQ ID NO: 3281293 - protein, 17 aa, Plasmodium falciparum
PRLWRLEFFIKYIHNLE

SEQ ID NO: 3281294 - protein, 19 aa, Plasmodium falciparum
PRRRKLYIKKIVDWAESQS

SEQ ID NO: 3281295 - protein, 19 aa, Plasmodium falciparum
PRSSFLFFVEYDKNDDHEL

SEQ ID NO: 3281296 - protein, 26 aa, Plasmodium falciparum
PRYFKKWEIMKIWSPIWITLSKVDDQ

SEQ ID NO: 3281297 - protein, 19 aa, Plasmodium falciparum
PSAKWKFIFRDIKKMDKNM

SEQ ID NO: 3281298 - protein, 18 aa, Plasmodium falciparum
PSCAISCRSYKTWINTKK

SEQ ID NO: 3281299 - protein, 17 aa, Plasmodium falciparum
PSCRNVFDYSMSIKEDF

SEQ ID NO: 3281300 - protein, 17 aa, Plasmodium falciparum
PSFLKDKIKAFIHIYNM

SEQ ID NO: 3281301 - protein, 23 aa, Plasmodium falciparum
PSLCNRYGFKFSYICDPNKILSR

SEQ ID NO: 3281302 - protein, 17 aa, Plasmodium falciparum
PSLDFSYIIQGIKHNNF

SEQ ID NO: 3281303 - protein, 22 aa, Plasmodium falciparum
PSLIDEVGWIPVIFGNVFVCSV

SEQ ID NO: 3281304 - protein, 21 aa, Plasmodium falciparum
PSMFRRFINFLSFSGNENETE

SEQ ID NO: 3281305 - protein, 20 aa, Plasmodium falciparum
PSRYPCVFCMKKGIKYDNKY

SEQ ID NO: 3281306 - protein, 22 aa, Plasmodium falciparum
PTCAICAKCFFASNHKNHIYRL

SEQ ID NO: 3281307 - protein, 20 aa, Plasmodium falciparum
PTIFWMMLCVKYCRISRERS

SEQ ID NO: 3281308 - protein, 23 aa, Plasmodium falciparum
PTNFLHKFLDTFLLKKDNAYIMT

SEQ ID NO: 3281309 - protein, 24 aa, Plasmodium falciparum
PTSFKLLSVISIHFSHMLFNYPYL

SEQ ID NO: 3281310 - protein, 18 aa, Plasmodium falciparum
PWGLLITFIELIRNPIFK

SEQ ID NO: 3281311 - protein, 17 aa, Plasmodium falciparum
PYYFLFSLIYNFFFIPM

SEQ ID NO: 3281312 - protein, 23 aa, Plasmodium falciparum
PYYKSIRIFPGRTFLPYYQNVKD

SEQ ID NO: 3281313 - protein, 19 aa, Plasmodium falciparum
QALIDICRLLFLKKEINKK

SEQ ID NO: 3281314 - protein, 20 aa, Plasmodium falciparum
QCFRFFKEWLEDVSNEKMKW

SEQ ID NO: 3281315 - protein, 20 aa, Plasmodium falciparum
QEVLKAIIIKALIIEEVIKY

SEQ ID NO: 3281316 - protein, 20 aa, Plasmodium falciparum
QFVCFLYCFIILVPFFFILI

SEQ ID NO: 3281317 - protein, 23 aa, Plasmodium falciparum
QHISDKDNIVWKQTYNNINIVGD

SEQ ID NO: 3281318 - protein, 24 aa, Plasmodium falciparum
QIFNYCPIEWPLLDISILIIVCQV

SEQ ID NO: 3281319 - protein, 22 aa, Plasmodium falciparum
QIKFLFCFHSLYFPLKNLLFIS

SEQ ID NO: 3281320 - protein, 18 aa, Plasmodium falciparum
QIKYRFKAIIGKINSIFE

SEQ ID NO: 3281321 - protein, 21 aa, Plasmodium falciparum
QIMCLPLYISIVGGLDIFLYN

SEQ ID NO: 3281322 - protein, 20 aa, Plasmodium falciparum
QKIKTGFLYPPFKEERFDEI

SEQ ID NO: 3281323 - protein, 20 aa, Plasmodium falciparum
QKIMPFDAFFFLWLTQMLDD

SEQ ID NO: 3281324 - protein, 27 aa, Plasmodium falciparum
QKLHSYYKICGFICFLLYAFLYILSYE

SEQ ID NO: 3281325 - protein, 19 aa, Plasmodium falciparum
QKLPLCKFIHSCVSCALNL

SEQ ID NO: 3281326 - protein, 22 aa, Plasmodium falciparum
QKSMLYRIFLKVMKSFKNLSVQ

SEQ ID NO: 3281327 - protein, 22 aa, Plasmodium falciparum
QKVQCQKCLFISKKKEIIHDLS

SEQ ID NO: 3281328 - protein, 17 aa, Plasmodium falciparum
QKYRWKIWFHITNAKNL

SEQ ID NO: 3281329 - protein, 23 aa, Plasmodium falciparum
QLFLFNKFHIVLSYIFRILYYIY

SEQ ID NO: 3281330 - protein, 21 aa, Plasmodium falciparum
QLKSHVLWGYYLYIIQDTVES

SEQ ID NO: 3281331 - protein, 24 aa, Plasmodium falciparum
QLNRWKYKNIKGIIVILPEIFYNY

SEQ ID NO: 3281332 - protein, 18 aa, Plasmodium falciparum
QLNWGLIVEEVFKKKVEP

SEQ ID NO: 3281333 - protein, 24 aa, Plasmodium falciparum
QLYSRRILFIFLKYFNVFIYCKIS

SEQ ID NO: 3281334 - protein, 22 aa, Plasmodium falciparum
QNLELLKGFALNFQTLSLFFLV

SEQ ID NO: 3281335 - protein, 19 aa, Plasmodium falciparum
QNLIICISLFYSIYICLEK

SEQ ID NO: 3281336 - protein, 22 aa, Plasmodium falciparum
QNTKELLLCIGFLIDSTSLFEQ

SEQ ID NO: 3281337 - protein, 19 aa, Plasmodium falciparum
QNVYLIICKKLLYYQKNQK

SEQ ID NO: 3281338 - protein, 19 aa, Plasmodium falciparum
QQKCPFFFLPFSKNYNKYF

SEQ ID NO: 3281339 - protein, 20 aa, Plasmodium falciparum
QQRFSWFLAVVTLLIFIYFL

SEQ ID NO: 3281340 - protein, 25 aa, Plasmodium falciparum
QRDWPRITFTFLVFVLGIKTVLCIL

SEQ ID NO: 3281341 - protein, 23 aa, Plasmodium falciparum
QRYYIKMSFIFNDFKLCYTKMQD

SEQ ID NO: 3281342 - protein, 18 aa, Plasmodium falciparum
QVCLKAFILLSIEKQCIN

SEQ ID NO: 3281343 - protein, 25 aa, Plasmodium falciparum
QVRCKRLLSEPAVEFDTIFDVFKES

SEQ ID NO: 3281344 - protein, 18 aa, Plasmodium falciparum
QYLELLLFWCKRDYKHFI

SEQ ID NO: 3281345 - protein, 17 aa, Plasmodium falciparum
QYWRLITCFLYFGSFGI

SEQ ID NO: 3281346 - protein, 18 aa, Plasmodium falciparum
QYWRLITCFLYFGSFGIH

SEQ ID NO: 3281347 - protein, 18 aa, Plasmodium falciparum
RAKRGVILFGDQFTLAND

SEQ ID NO: 3281348 - protein, 22 aa, Plasmodium falciparum
RALFKIWLEYFLEDYNKIKKKL

SEQ ID NO: 3281349 - protein, 23 aa, Plasmodium falciparum
RALFKRWLEYFLQDYNKINAKIS

SEQ ID NO: 3281350 - protein, 29 aa, Plasmodium falciparum
RAMFKVYLCTKLLYDRVCEELALYDVEVI

SEQ ID NO: 3281351 - protein, 24 aa, Plasmodium falciparum
RDINLSFLHILSFISYKFVIMCAL

SEQ ID NO: 3281352 - protein, 17 aa, Plasmodium falciparum
RDREFLSDFSLNFLYEV

SEQ ID NO: 3281353 - protein, 19 aa, Plasmodium falciparum
REAWWALNRQDVWKALTCD

SEQ ID NO: 3281354 - protein, 17 aa, Plasmodium falciparum
REGCLRKSYDIKNDVEE

SEQ ID NO: 3281355 - protein, 20 aa, Plasmodium falciparum
REILNTILFIWAKKNPDISY

SEQ ID NO: 3281356 - protein, 24 aa, Plasmodium falciparum
RELEEALCIYVSIKFLKYIQTDPY

SEQ ID NO: 3281357 - protein, 19 aa, Plasmodium falciparum
RFGNDGALRMAITMKLKKS

SEQ ID NO: 3281358 - protein, 20 aa, Plasmodium falciparum
RFSAHLCILRCLYIFSTRLY

SEQ ID NO: 3281359 - protein, 17 aa, Plasmodium falciparum
RFSPTCLIKYICRCFVF

SEQ ID NO: 3281360 - protein, 18 aa, Plasmodium falciparum
RGIIFKVKFFKSTKYICS

SEQ ID NO: 3281361 - protein, 19 aa, Plasmodium falciparum
RGKLKLVYVKSFYEECQKE

SEQ ID NO: 3281362 - protein, 17 aa, Plasmodium falciparum
RGVNFWKGLAIYLGALS

SEQ ID NO: 3281363 - protein, 17 aa, Plasmodium falciparum
RHIYFNLAFTYILLEDY

SEQ ID NO: 3281364 - protein, 17 aa, Plasmodium falciparum
RHPSRFISEEAYSFTQF

SEQ ID NO: 3281365 - protein, 25 aa, Plasmodium falciparum
RHSSFCYDCMKSLRQEKCPICRCLF

SEQ ID NO: 3281366 - protein, 17 aa, Plasmodium falciparum
RICIARCFLKDSKIIVL

SEQ ID NO: 3281367 - protein, 23 aa, Plasmodium falciparum
RIFVLKLNYILSVLNFVNQLKNT

SEQ ID NO: 3281368 - protein, 20 aa, Plasmodium falciparum
RIFYIMCFQKSFYINTAMHY

SEQ ID NO: 3281369 - protein, 19 aa, Plasmodium falciparum
RIHCYRIVISIFIFLLNHS

SEQ ID NO: 3281370 - protein, 17 aa, Plasmodium falciparum
RIKHLFITFNYNKEKKI

SEQ ID NO: 3281371 - protein, 19 aa, Plasmodium falciparum
RILRWLRKWNKFILPLKYW

SEQ ID NO: 3281372 - protein, 20 aa, Plasmodium falciparum
RILYMFIRIVYPFLQTCHKI

SEQ ID NO: 3281373 - protein, 17 aa, Plasmodium falciparum
RISEEIQKFLLLKEPEE

SEQ ID NO: 3281374 - protein, 20 aa, Plasmodium falciparum
RKDKKIVCSFSRDKNKKNVP

SEQ ID NO: 3281375 - protein, 17 aa, Plasmodium falciparum
RKFFGLISVCFSFLALY

SEQ ID NO: 3281376 - protein, 17 aa, Plasmodium falciparum
RKFFKRLILSSSVWIFF

SEQ ID NO: 3281377 - protein, 22 aa, Plasmodium falciparum
RKFNMSLSRIWYFFNNIDKIEE

SEQ ID NO: 3281378 - protein, 24 aa, Plasmodium falciparum
RKGCKGDCDCFLKWVNEKKTEWGK

SEQ ID NO: 3281379 - protein, 23 aa, Plasmodium falciparum
RKHKEIVELLALMGNSSIFIISG

SEQ ID NO: 3281380 - protein, 18 aa, Plasmodium falciparum
RKIFKKKLSFYLNNFYNK

SEQ ID NO: 3281381 - protein, 19 aa, Plasmodium falciparum
RKILKNIICTSGTDIAYCN

SEQ ID NO: 3281382 - protein, 19 aa, Plasmodium falciparum
RKILLCLYFELLFLKICNN

SEQ ID NO: 3281383 - protein, 24 aa, Plasmodium falciparum
RKKLSYKWIPKWHMCNDIFLSRLI

SEQ ID NO: 3281384 - protein, 18 aa, Plasmodium falciparum
RKLNCIGCGEFLQTTNEK

SEQ ID NO: 3281385 - protein, 18 aa, Plasmodium falciparum
RKLNCLFIRNNITDIRNL

SEQ ID NO: 3281386 - protein, 20 aa, Plasmodium falciparum
RKLNELRLINGIKEQKELKD

SEQ ID NO: 3281387 - protein, 20 aa, Plasmodium falciparum
RKNYIISFICYYILKDEDSA

SEQ ID NO: 3281388 - protein, 18 aa, Plasmodium falciparum
RKTCVLCYCVRRYYMNFL

SEQ ID NO: 3281389 - protein, 20 aa, Plasmodium falciparum
RKTIFYKKCYVFSCNHYFHS

SEQ ID NO: 3281390 - protein, 22 aa, Plasmodium falciparum
RLFLCLICLLVIIWLIYFCYKN

SEQ ID NO: 3281391 - protein, 20 aa, Plasmodium falciparum
RLFLRYSVGIFLGLFYIVLL

SEQ ID NO: 3281392 - protein, 18 aa, Plasmodium falciparum
RLILSSSVWIFFFFNFIT

SEQ ID NO: 3281393 - protein, 17 aa, Plasmodium falciparum
RLISFLTLFLFTPISIY

SEQ ID NO: 3281394 - protein, 17 aa, Plasmodium falciparum
RLIVKIAFIASTMTFCF

SEQ ID NO: 3281395 - protein, 18 aa, Plasmodium falciparum
RLKALFFVAVALAILGIV

SEQ ID NO: 3281396 - protein, 17 aa, Plasmodium falciparum
RLKICLEETFNYYSCSI

SEQ ID NO: 3281397 - protein, 18 aa, Plasmodium falciparum
RLLLLYTFLLFFLLFLMI

SEQ ID NO: 3281398 - protein, 19 aa, Plasmodium falciparum
RLLYDFKDVEHMVCGEREI

SEQ ID NO: 3281399 - protein, 17 aa, Plasmodium falciparum
RMHRKVLNCPFIKEEQE

SEQ ID NO: 3281400 - protein, 17 aa, Plasmodium falciparum
RMIMNFIYKNIVYDKNY

SEQ ID NO: 3281401 - protein, 17 aa, Plasmodium falciparum
RNECGLDVCGLKKGDNN

SEQ ID NO: 3281402 - protein, 20 aa, Plasmodium falciparum
RNFFRLSKFFFNKYKNKAYK

SEQ ID NO: 3281403 - protein, 21 aa, Plasmodium falciparum
RNIFISEILYRYKIIKKTEII

SEQ ID NO: 3281404 - protein, 18 aa, Plasmodium falciparum
RNSVKWSFYEIIETFNKL

SEQ ID NO: 3281405 - protein, 18 aa, Plasmodium falciparum
RNVKCILELFGILLHCLN

SEQ ID NO: 3281406 - protein, 19 aa, Plasmodium falciparum
RPFSRCFSSWGIQRRSQNE

SEQ ID NO: 3281407 - protein, 20 aa, Plasmodium falciparum
RPTNCLLCLIFCMMSLHSYF

SEQ ID NO: 3281408 - protein, 19 aa, Plasmodium falciparum
RPYYPWVPFMGDGRGYNFY

SEQ ID NO: 3281409 - protein, 18 aa, Plasmodium falciparum
RQCKSRFISIITNYYPFK

SEQ ID NO: 3281410 - protein, 25 aa, Plasmodium falciparum
RQKNIPIDYCLKGDESLPLGVLPME

SEQ ID NO: 3281411 - protein, 18 aa, Plasmodium falciparum
RRASRRPMMVKMQRGMKD

SEQ ID NO: 3281412 - protein, 22 aa, Plasmodium falciparum
RRIYIYKIKFFLSRTRKIRKRL

SEQ ID NO: 3281413 - protein, 17 aa, Plasmodium falciparum
RRLKKKMLKYIYSDKKS

SEQ ID NO: 3281414 - protein, 17 aa, Plasmodium falciparum
RRPKFFNCIIEESFENY

SEQ ID NO: 3281415 - protein, 17 aa, Plasmodium falciparum
RRRLYVGRLTKWAESKQ

SEQ ID NO: 3281416 - protein, 17 aa, Plasmodium falciparum
RRVLHIVDALPLDTPSM

SEQ ID NO: 3281417 - protein, 17 aa, Plasmodium falciparum
RSECYIKFFKYGNEGDK

SEQ ID NO: 3281418 - protein, 17 aa, Plasmodium falciparum
RSGHISFCYLFYSKEDV

SEQ ID NO: 3281419 - protein, 17 aa, Plasmodium falciparum
RSKVCIISSKFAGMLNK

SEQ ID NO: 3281420 - protein, 23 aa, Plasmodium falciparum
RTLFKRWLEYFLQDYIKINAKFS

SEQ ID NO: 3281421 - protein, 18 aa, Plasmodium falciparum
RTLINFILCINHFSIYSI

SEQ ID NO: 3281422 - protein, 24 aa, Plasmodium falciparum
RTMFYRLSELFPIVPRKDNELAVS

SEQ ID NO: 3281423 - protein, 19 aa, Plasmodium falciparum
RTNFELSLFILKNKNNEKI

SEQ ID NO: 3281424 - protein, 19 aa, Plasmodium falciparum
RVHYLWKYFSLHSIADYLY

SEQ ID NO: 3281425 - protein, 20 aa, Plasmodium falciparum
RVLFCYSYNLSQHFSLYNNS

SEQ ID NO: 3281426 - protein, 18 aa, Plasmodium falciparum
RVVIPWIVFGNSFNFYLY

SEQ ID NO: 3281427 - protein, 23 aa, Plasmodium falciparum
RWNQLRYSLFYTISLMNSSIQYN

SEQ ID NO: 3281428 - protein, 18 aa, Plasmodium falciparum
RYCFYRRIYENIQIIRAL

SEQ ID NO: 3281429 - protein, 17 aa, Plasmodium falciparum
RYNDFQNIFSLINKFKT

SEQ ID NO: 3281430 - protein, 20 aa, Plasmodium falciparum
RYNIIYILRIFYLWFNKTSD

SEQ ID NO: 3281431 - protein, 18 aa, Plasmodium falciparum
RYRIWRLISCYNYLNYLK

SEQ ID NO: 3281432 - protein, 20 aa, Plasmodium falciparum
RYVYCLFVWRVRKMSNINND

SEQ ID NO: 3281433 - protein, 19 aa, Plasmodium falciparum
RYVYRRSCFIFNIWNSSKV

SEQ ID NO: 3281434 - protein, 18 aa, Plasmodium falciparum
RYYHKIFILFLLYICNMY

SEQ ID NO: 3281435 - protein, 17 aa, Plasmodium falciparum
SAACCIVEIFSSKYPYY

SEQ ID NO: 3281436 - protein, 20 aa, Plasmodium falciparum
SAHYFLKLPIFVILMIVFSL

SEQ ID NO: 3281437 - protein, 24 aa, Plasmodium falciparum
SASAFPWTVGVAFMALSYWVMKKK

SEQ ID NO: 3281438 - protein, 21 aa, Plasmodium falciparum
SAWTFDFGYWYGFNTSILALI

SEQ ID NO: 3281439 - protein, 17 aa, Plasmodium falciparum
SCAISCSSYRKWIKGKK

SEQ ID NO: 3281440 - protein, 17 aa, Plasmodium falciparum
SCFPCPLYTYTLNQGAT

SEQ ID NO: 3281441 - protein, 19 aa, Plasmodium falciparum
SCFSFCLFVMLGILKLFYI

SEQ ID NO: 3281442 - protein, 21 aa, Plasmodium falciparum
SCGFLFFLCYILQYILKHLKY

SEQ ID NO: 3281443 - protein, 21 aa, Plasmodium falciparum
SCIYFFKFIIFYILEILKNSY

SEQ ID NO: 3281444 - protein, 17 aa, Plasmodium falciparum
SCLEKLFIHGFKHVENN

SEQ ID NO: 3281445 - protein, 20 aa, Plasmodium falciparum
SCNKFVFVLLRFFKHDNSFL

SEQ ID NO: 3281446 - protein, 22 aa, Plasmodium falciparum
SCSFPLLFCILFLNTLGKFGKS

SEQ ID NO: 3281447 - protein, 25 aa, Plasmodium falciparum
SCVRYEFYNTFTLFIMLWYSHINDH

SEQ ID NO: 3281448 - protein, 19 aa, Plasmodium falciparum
SDFKSGFIISVSWLCASLI

SEQ ID NO: 3281449 - protein, 24 aa, Plasmodium falciparum
SDISFKCACKFLYTLGLLNIRNEN

SEQ ID NO: 3281450 - protein, 17 aa, Plasmodium falciparum
SDLRYKWKFSHISEKYK

SEQ ID NO: 3281451 - protein, 40 aa, Plasmodium falciparum
SDVICDMKSDIICDMKSDIICDMKSDIICDMKSDVICDIT

SEQ ID NO: 3281452 - protein, 18 aa, Plasmodium falciparum
SEHIFKCLLKLLYGIISL

SEQ ID NO: 3281453 - protein, 17 aa, Plasmodium falciparum
SEHILVLCLKKLNEYEK

SEQ ID NO: 3281454 - protein, 24 aa, Plasmodium falciparum
SEKEFLRLIFSGVVIQKVQCQKCL

SEQ ID NO: 3281455 - protein, 19 aa, Plasmodium falciparum
SELISILACICTNIVIEFL

SEQ ID NO: 3281456 - protein, 18 aa, Plasmodium falciparum
SESFLFLYRIFKIKKAFL

SEQ ID NO: 3281457 - protein, 20 aa, Plasmodium falciparum
SFCNLCFFMEFPVNFFHLQQ

SEQ ID NO: 3281458 - protein, 18 aa, Plasmodium falciparum
SFDFYFYVVNCIFKNSRK

SEQ ID NO: 3281459 - protein, 20 aa, Plasmodium falciparum
SFEFPKECYWSSAFVQELVN

SEQ ID NO: 3281460 - protein, 19 aa, Plasmodium falciparum
SFFAFLLRMCFMSLNKINN

SEQ ID NO: 3281461 - protein, 17 aa, Plasmodium falciparum
SFFFVFFCLNWINQRKK

SEQ ID NO: 3281462 - protein, 24 aa, Plasmodium falciparum
SFFYSYMCIYIFLKNGHIYLIRRN

SEQ ID NO: 3281463 - protein, 18 aa, Plasmodium falciparum
SFPCKHPSIYTCGHFIHT

SEQ ID NO: 3281464 - protein, 18 aa, Plasmodium falciparum
SFSLMFLQFLFNGVFKNI

SEQ ID NO: 3281465 - protein, 22 aa, Plasmodium falciparum
SFTIHFFLPFLNFVTFFLFFLF

SEQ ID NO: 3281466 - protein, 18 aa, Plasmodium falciparum
SFVFKILFYFFKLKKTLL

SEQ ID NO: 3281467 - protein, 20 aa, Plasmodium falciparum
SGFKKENRLFFLLFYKTIKM

SEQ ID NO: 3281468 - protein, 19 aa, Plasmodium falciparum
SGIIPNDFLRLMFYTLADY

SEQ ID NO: 3281469 - protein, 20 aa, Plasmodium falciparum
SGPLSIVCYGLFINAYGHIA

SEQ ID NO: 3281470 - protein, 19 aa, Plasmodium falciparum
SGTIPIDFLRLMFYTIADY

SEQ ID NO: 3281471 - protein, 18 aa, Plasmodium falciparum
SHIKYLFVKLLRNQIKDI

SEQ ID NO: 3281472 - protein, 19 aa, Plasmodium falciparum
SHNKFMLKEMMWMSIDYYE

SEQ ID NO: 3281473 - protein, 18 aa, Plasmodium falciparum
SIDRFRLVINRKYIFFKK

SEQ ID NO: 3281474 - protein, 17 aa, Plasmodium falciparum
SIFLCLISIFLTSFGGI

SEQ ID NO: 3281475 - protein, 23 aa, Plasmodium falciparum
SIFYLCIFFPFFSCECNNIKLND

SEQ ID NO: 3281476 - protein, 20 aa, Plasmodium falciparum
SIIYFRFVYLTSLLYSNDIE

SEQ ID NO: 3281477 - protein, 20 aa, Plasmodium falciparum
SILCPCPWGPFKYSNFFLRD

SEQ ID NO: 3281478 - protein, 19 aa, Plasmodium falciparum
SILFKIFPCHIFFKPRKIV

SEQ ID NO: 3281479 - protein, 23 aa, Plasmodium falciparum
SILYKISQFYAILAYFANQRKNY

SEQ ID NO: 3281480 - protein, 20 aa, Plasmodium falciparum
SIMCCCIILRTLLEMNSDGY

SEQ ID NO: 3281481 - protein, 19 aa, Plasmodium falciparum
SIMTPMFKDFMETHRISSK

SEQ ID NO: 3281482 - protein, 24 aa, Plasmodium falciparum
SINCYKYMLLYGFMISFIKILLFM

SEQ ID NO: 3281483 - protein, 27 aa, Plasmodium falciparum
SKALSILFRKSFFFHLNKIHNFLKNIL

SEQ ID NO: 3281484 - protein, 19 aa, Plasmodium falciparum
SKCDCFKKWVVQKEQEWKQ

SEQ ID NO: 3281485 - protein, 18 aa, Plasmodium falciparum
SKDSFKLSYHFLNSLKNE

SEQ ID NO: 3281486 - protein, 23 aa, Plasmodium falciparum
SKFCGACPFYGVKCNWKTCTEVK

SEQ ID NO: 3281487 - protein, 20 aa, Plasmodium falciparum
SKICFNYFLNYLIKYKDNCS

SEQ ID NO: 3281488 - protein, 25 aa, Plasmodium falciparum
SKICLPLYCTWYYKNIEKLYSNILL

SEQ ID NO: 3281489 - protein, 17 aa, Plasmodium falciparum
SKKFFITYHNWRDTEKD

SEQ ID NO: 3281490 - protein, 26 aa, Plasmodium falciparum
SKKIICSSCLFLIFLSVIFCSEPDTN

SEQ ID NO: 3281491 - protein, 24 aa, Plasmodium falciparum
SKKKRCFYIPIAIYIGKRNELDKY

SEQ ID NO: 3281492 - protein, 18 aa, Plasmodium falciparum
SKLPALLWNKIIGKGNDN

SEQ ID NO: 3281493 - protein, 23 aa, Plasmodium falciparum
SKRLFRLANLYLYTTKFVEDNNN

SEQ ID NO: 3281494 - protein, 21 aa, Plasmodium falciparum
SLELFCFLNFTLATSILLIID

SEQ ID NO: 3281495 - protein, 18 aa, Plasmodium falciparum
SLFELFKLSFLNIQRKDE

SEQ ID NO: 3281496 - protein, 21 aa, Plasmodium falciparum
SLFYFNHFINIFLLYKINLAV

SEQ ID NO: 3281497 - protein, 19 aa, Plasmodium falciparum
SLICAVCLWGILDDIFLII

SEQ ID NO: 3281498 - protein, 19 aa, Plasmodium falciparum
SLKCLECYHNIESKIIQDK

SEQ ID NO: 3281499 - protein, 20 aa, Plasmodium falciparum
SLKIFWRAYHNFKMKFNKEQ

SEQ ID NO: 3281500 - protein, 17 aa, Plasmodium falciparum
SLLCSYKSIEVIKKNKK

SEQ ID NO: 3281501 - protein, 23 aa, Plasmodium falciparum
SLNSRLEGVYVFMKDSPACYLED

SEQ ID NO: 3281502 - protein, 24 aa, Plasmodium falciparum
SLSILCVACPCAVGLASPLSIAIS

SEQ ID NO: 3281503 - protein, 24 aa, Plasmodium falciparum
SLYFKFKRFMIFIPYLYNLYKRYN

SEQ ID NO: 3281504 - protein, 19 aa, Plasmodium falciparum
SLYFRRLLLLYTFLLFFLL

SEQ ID NO: 3281505 - protein, 21 aa, Plasmodium falciparum
SNAWSIFVVYLLRELLIDGNY

SEQ ID NO: 3281506 - protein, 18 aa, Plasmodium falciparum
SNCIKIFFIFYKYGYILK

SEQ ID NO: 3281507 - protein, 17 aa, Plasmodium falciparum
SNDMWKSKIKVIIEKCL

SEQ ID NO: 3281508 - protein, 17 aa, Plasmodium falciparum
SNFIKFWIIKSKQFEYF

SEQ ID NO: 3281509 - protein, 19 aa, Plasmodium falciparum
SNFLLCIIIYMKLIRNLGQ

SEQ ID NO: 3281510 - protein, 19 aa, Plasmodium falciparum
SNHAYKCFAGKGFSNMYYF

SEQ ID NO: 3281511 - protein, 20 aa, Plasmodium falciparum
SNIKIPWKLLSHFKNDNTFF

SEQ ID NO: 3281512 - protein, 17 aa, Plasmodium falciparum
SNINPEFGCLWESEAIF

SEQ ID NO: 3281513 - protein, 17 aa, Plasmodium falciparum
SNKALKCVISILKKTSN

SEQ ID NO: 3281514 - protein, 26 aa, Plasmodium falciparum
SNSLFHKMMCAFKKKLFKNEQVIEKD

SEQ ID NO: 3281515 - protein, 21 aa, Plasmodium falciparum
SNYKNRCNFYDNPWCHIKFSS

SEQ ID NO: 3281516 - protein, 19 aa, Plasmodium falciparum
SPHGIIYRGHIKNIFRNKN

SEQ ID NO: 3281517 - protein, 17 aa, Plasmodium falciparum
SPILRVQFFADFAKQAV

SEQ ID NO: 3281518 - protein, 17 aa, Plasmodium falciparum
SPLKPCEGLECLPQVLF

SEQ ID NO: 3281519 - protein, 21 aa, Plasmodium falciparum
SPLLCCFCSSPFFSSSAEDYP

SEQ ID NO: 3281520 - protein, 17 aa, Plasmodium falciparum
SQYCKACPVYGVNCKNS

SEQ ID NO: 3281521 - protein, 17 aa, Plasmodium falciparum
SRCWMYGTVYSFEGEYF

SEQ ID NO: 3281522 - protein, 17 aa, Plasmodium falciparum
SRIPICGKIRVFFFDKT

SEQ ID NO: 3281523 - protein, 19 aa, Plasmodium falciparum
SRKEMFEKAYIIKYISNNV

SEQ ID NO: 3281524 - protein, 28 aa, Plasmodium falciparum
SRLYIKCCSCIFLSYIIFFSLIFKNLEM

SEQ ID NO: 3281525 - protein, 19 aa, Plasmodium falciparum
SRMKLGLLYIIEKFFIRLI

SEQ ID NO: 3281526 - protein, 22 aa, Plasmodium falciparum
SRRRIDFYFPFFFENTTNVCLY

SEQ ID NO: 3281527 - protein, 20 aa, Plasmodium falciparum
SRTKYNWIIHLIFIFLNSSS

SEQ ID NO: 3281528 - protein, 19 aa, Plasmodium falciparum
SRYKKRICAGRDDSENNVS

SEQ ID NO: 3281529 - protein, 17 aa, Plasmodium falciparum
SSCCFYVKHVNRESDNG

SEQ ID NO: 3281530 - protein, 20 aa, Plasmodium falciparum
SSDVLLSCFLNFIKLKKYVN

SEQ ID NO: 3281531 - protein, 17 aa, Plasmodium falciparum
SSGIFCCLRRDMYRIKL

SEQ ID NO: 3281532 - protein, 21 aa, Plasmodium falciparum
SSGSCPLGFYLTYFTYLEIET

SEQ ID NO: 3281533 - protein, 18 aa, Plasmodium falciparum
SSIECICKVFVAIEDIPS

SEQ ID NO: 3281534 - protein, 20 aa, Plasmodium falciparum
SSIMKIKFLYNLIIIKQKNI

SEQ ID NO: 3281535 - protein, 18 aa, Plasmodium falciparum
SSQCNFDFCIKKSVELFH

SEQ ID NO: 3281536 - protein, 17 aa, Plasmodium falciparum
SSVWKVISSFALHHLKN

SEQ ID NO: 3281537 - protein, 23 aa, Plasmodium falciparum
STLFKIFFPLVIFALYNILIQIN

SEQ ID NO: 3281538 - protein, 19 aa, Plasmodium falciparum
STLFMLCFFSFMGFLSVVV

SEQ ID NO: 3281539 - protein, 18 aa, Plasmodium falciparum
STMTFCFSLLLYIVISLI

SEQ ID NO: 3281540 - protein, 23 aa, Plasmodium falciparum
STYSIEITRYFSIFDKFKIQLQT

SEQ ID NO: 3281541 - protein, 24 aa, Plasmodium falciparum
SVHKNVHVSFCFGNNGTFFYSKNS

SEQ ID NO: 3281542 - protein, 18 aa, Plasmodium falciparum
SVHPNICFMKRQKMKKKD

SEQ ID NO: 3281543 - protein, 17 aa, Plasmodium falciparum
SVLGFLSMCPFNFDTKR

SEQ ID NO: 3281544 - protein, 18 aa, Plasmodium falciparum
SVMFWYKVILIVIFAWLP

SEQ ID NO: 3281545 - protein, 19 aa, Plasmodium falciparum
SVNQKFKKLIPFYTIHGNH

SEQ ID NO: 3281546 - protein, 22 aa, Plasmodium falciparum
SVPIKWKLYVGIFFDKKYNYEN

SEQ ID NO: 3281547 - protein, 17 aa, Plasmodium falciparum
SVSSFLFVEALFQEYQC

SEQ ID NO: 3281548 - protein, 19 aa, Plasmodium falciparum
SWWKLHAPYIWNGMIYALT

SEQ ID NO: 3281549 - protein, 19 aa, Plasmodium falciparum
SYDSLVFFKRFFNCLNGYI

SEQ ID NO: 3281550 - protein, 21 aa, Plasmodium falciparum
SYEQYEVFVGFVAFISSIVNF

SEQ ID NO: 3281551 - protein, 26 aa, Plasmodium falciparum
SYGFCLNMFWVLLCLCEPITVNKIND

SEQ ID NO: 3281552 - protein, 18 aa, Plasmodium falciparum
SYLKVCYHNDLWLHKKNQ

SEQ ID NO: 3281553 - protein, 21 aa, Plasmodium falciparum
SYNAFFWKWVHDMLHDSVEWR

SEQ ID NO: 3281554 - protein, 25 aa, Plasmodium falciparum
SYNAFFWKWVHDMLIDSMQWRNEHG

SEQ ID NO: 3281555 - protein, 20 aa, Plasmodium falciparum
SYRANDLFGVKKFCYQLLHG

SEQ ID NO: 3281556 - protein, 26 aa, Plasmodium falciparum
SYSFIKLLFRKCIIFFIIYFLFIIPL

SEQ ID NO: 3281557 - protein, 17 aa, Plasmodium falciparum
SYSVFFYNLFIKGLYLN

SEQ ID NO: 3281558 - protein, 18 aa, Plasmodium falciparum
SYVSYPLCINECKGRMDN

SEQ ID NO: 3281559 - protein, 24 aa, Plasmodium falciparum
TANSIQIIWLWDVLQEFDENKKAS

SEQ ID NO: 3281560 - protein, 26 aa, Plasmodium falciparum
TASLMKCKRVFSYVIILHFLMNSICV

SEQ ID NO: 3281561 - protein, 18 aa, Plasmodium falciparum
TCARHCRFYKKWINTKRD

SEQ ID NO: 3281562 - protein, 18 aa, Plasmodium falciparum
TCDKKCNCAGKWIKLKQD

SEQ ID NO: 3281563 - protein, 18 aa, Plasmodium falciparum
TCFLCFLYKPFINTLHKL

SEQ ID NO: 3281564 - protein, 21 aa, Plasmodium falciparum
TCFYCLNIIKERCTYINNLWR

SEQ ID NO: 3281565 - protein, 24 aa, Plasmodium falciparum
TCKSYNEWSEWSGPCEFERRQRII

SEQ ID NO: 3281566 - protein, 25 aa, Plasmodium falciparum
TCLYLLRYIFKYIFNIYNYINNFSY

SEQ ID NO: 3281567 - protein, 20 aa, Plasmodium falciparum
TDCFFACYPYEKWIDNKKKE

SEQ ID NO: 3281568 - protein, 17 aa, Plasmodium falciparum
TDCLCSPGYEYSDKSSK

SEQ ID NO: 3281569 - protein, 24 aa, Plasmodium falciparum
TEFNYRLTGSIGRFSINITKNTVS

SEQ ID NO: 3281570 - protein, 23 aa, Plasmodium falciparum
TEIAYKMVTEWGMSDKLGPLNYK

SEQ ID NO: 3281571 - protein, 17 aa, Plasmodium falciparum
TEIRGQLRLKVMVCDEN

SEQ ID NO: 3281572 - protein, 25 aa, Plasmodium falciparum
TEKDRAICCIIRYIAFICKNINFFL

SEQ ID NO: 3281573 - protein, 19 aa, Plasmodium falciparum
TEKRLAVNLMKIYEETKDV

SEQ ID NO: 3281574 - protein, 21 aa, Plasmodium falciparum
TELFKVLLFVKVPYLSIFDIK

SEQ ID NO: 3281575 - protein, 23 aa, Plasmodium falciparum
TEYLCVLCTPLVQIIFDDLIQAI

SEQ ID NO: 3281576 - protein, 19 aa, Plasmodium falciparum
TFFFSLKFYPYIEEQNKIT

SEQ ID NO: 3281577 - protein, 27 aa, Plasmodium falciparum
TFFKLKNIFCGAAFKDKECVKQDIHHN

SEQ ID NO: 3281578 - protein, 17 aa, Plasmodium falciparum
TFFRWLHEWGSDFCRQR

SEQ ID NO: 3281579 - protein, 19 aa, Plasmodium falciparum
TFIKEFYPPLLRGGKDSDP

SEQ ID NO: 3281580 - protein, 20 aa, Plasmodium falciparum
TFVHLFCVIFFISNVFCYNI

SEQ ID NO: 3281581 - protein, 17 aa, Plasmodium falciparum
TFWLCFFSEVGLLRSLK

SEQ ID NO: 3281582 - protein, 20 aa, Plasmodium falciparum
THCFRIFLMFTLFYFIPKEA

SEQ ID NO: 3281583 - protein, 21 aa, Plasmodium falciparum
THIYADILFEFIVSIIDDIDI

SEQ ID NO: 3281584 - protein, 21 aa, Plasmodium falciparum
THYFSCLLLWIFKVSNTEIIN

SEQ ID NO: 3281585 - protein, 21 aa, Plasmodium falciparum
TICRLKLKIVFIIFNNNGIYG

SEQ ID NO: 3281586 - protein, 23 aa, Plasmodium falciparum
TIFCYYKYYHLYFLKGHIEEIKQ

SEQ ID NO: 3281587 - protein, 20 aa, Plasmodium falciparum
TIPRPCCVLIFMFLVVMFGI

SEQ ID NO: 3281588 - protein, 17 aa, Plasmodium falciparum
TIYYNWLAYVNNLEEDF

SEQ ID NO: 3281589 - protein, 22 aa, Plasmodium falciparum
TKCADVVLCLFKDGSIENSCFD

SEQ ID NO: 3281590 - protein, 17 aa, Plasmodium falciparum
TKCDKWGEWSECKDGRM

SEQ ID NO: 3281591 - protein, 19 aa, Plasmodium falciparum
TKEDFGIELKRMFDNCRLY

SEQ ID NO: 3281592 - protein, 25 aa, Plasmodium falciparum
TKFTIKWGSLIIRHIYYFIFFFLTI

SEQ ID NO: 3281593 - protein, 17 aa, Plasmodium falciparum
TKGLCLFGNIDMQTLLH

SEQ ID NO: 3281594 - protein, 19 aa, Plasmodium falciparum
TLDKKCLLCYFMLSVPHFL

SEQ ID NO: 3281595 - protein, 22 aa, Plasmodium falciparum
TLFKKRLLRALGYTVISVPISD

SEQ ID NO: 3281596 - protein, 19 aa, Plasmodium falciparum
TLFLMRSGIRFAITLNGKS

SEQ ID NO: 3281597 - protein, 20 aa, Plasmodium falciparum
TLHTYIFCNFVYFKTYIEEC

SEQ ID NO: 3281598 - protein, 24 aa, Plasmodium falciparum
TLILLCFCHPLLFYKNINNYKSQK

SEQ ID NO: 3281599 - protein, 23 aa, Plasmodium falciparum
TLIQSCFRRYRCMVQYEKKMYLK

SEQ ID NO: 3281600 - protein, 23 aa, Plasmodium falciparum
TLITYRYMYIFSLINILKTTSVI

SEQ ID NO: 3281601 - protein, 18 aa, Plasmodium falciparum
TNEGFHFYIHFYSSSLNM

SEQ ID NO: 3281602 - protein, 17 aa, Plasmodium falciparum
TNMCPPFRHDVFAANVQ

SEQ ID NO: 3281603 - protein, 21 aa, Plasmodium falciparum
TPAWCDRVLMSGKLVHLSEIE

SEQ ID NO: 3281604 - protein, 17 aa, Plasmodium falciparum
TQHFILFIGATNRYKQL

SEQ ID NO: 3281605 - protein, 22 aa, Plasmodium falciparum
TRFPEIYIHYSFSSFFMNIEKY

SEQ ID NO: 3281606 - protein, 19 aa, Plasmodium falciparum
TRISTGIGIMAYIQKNISL

SEQ ID NO: 3281607 - protein, 17 aa, Plasmodium falciparum
TRMKFSYGKQHRKQKKK

SEQ ID NO: 3281608 - protein, 24 aa, Plasmodium falciparum
TSDYYICCSLFLKLPFGILPGIYI

SEQ ID NO: 3281609 - protein, 26 aa, Plasmodium falciparum
TSFLSSQCIFNFLPIYINLISQAFKK

SEQ ID NO: 3281610 - protein, 21 aa, Plasmodium falciparum
TSLYWSFSIHKAFMEFLFIIA

SEQ ID NO: 3281611 - protein, 21 aa, Plasmodium falciparum
TSVICPTCPVSVICALALSTY

SEQ ID NO: 3281612 - protein, 19 aa, Plasmodium falciparum
TSWIKNFIHFNGLKILMTF

SEQ ID NO: 3281613 - protein, 17 aa, Plasmodium falciparum
TSWKFCKSLILTTLGML

SEQ ID NO: 3281614 - protein, 19 aa, Plasmodium falciparum
TTCIIIGCILRCIFSPVFG

SEQ ID NO: 3281615 - protein, 19 aa, Plasmodium falciparum
TTCLLWWQYLLAIFWALLN

SEQ ID NO: 3281616 - protein, 22 aa, Plasmodium falciparum
TTLRIYYFLILVTLEITYISMK

SEQ ID NO: 3281617 - protein, 25 aa, Plasmodium falciparum
TYDNVCYRKSMSISFVSHIMLSFLY

SEQ ID NO: 3281618 - protein, 19 aa, Plasmodium falciparum
TYFFIKLKWFHKLKTIRLL

SEQ ID NO: 3281619 - protein, 21 aa, Plasmodium falciparum
TYFRWLHEWGESFCRERKKRL

SEQ ID NO: 3281620 - protein, 17 aa, Plasmodium falciparum
TYFRWLHEWGSDFCGTR

SEQ ID NO: 3281621 - protein, 20 aa, Plasmodium falciparum
TYRYIISFLLYFINILYAQK

SEQ ID NO: 3281622 - protein, 22 aa, Plasmodium falciparum
TYVFCLAFALLIILTLMLIYKK

SEQ ID NO: 3281623 - protein, 25 aa, Plasmodium falciparum
TYVIKHNRFLSEYQSNFLGGGYSAA

SEQ ID NO: 3281624 - protein, 24 aa, Plasmodium falciparum
TYYKNCLLYRPFIKLNKLHLYRYM

SEQ ID NO: 3281625 - protein, 18 aa, Plasmodium falciparum
VAEDKMKLCLDFYSDIFV

SEQ ID NO: 3281626 - protein, 17 aa, Plasmodium falciparum
VAFSRARFGLYVLGNYN

SEQ ID NO: 3281627 - protein, 17 aa, Plasmodium falciparum
VAINIWKPVAFDAAITA

SEQ ID NO: 3281628 - protein, 24 aa, Plasmodium falciparum
VCEKYCLYHNFILKKEVSKIKEEK

SEQ ID NO: 3281629 - protein, 19 aa, Plasmodium falciparum
VCRLVYWCCVVYILQNNQM

SEQ ID NO: 3281630 - protein, 19 aa, Plasmodium falciparum
VDIKFVFILSLCRLYLPIY

SEQ ID NO: 3281631 - protein, 17 aa, Plasmodium falciparum
VDKKGSFSFHHLKGAYP

SEQ ID NO: 3281632 - protein, 17 aa, Plasmodium falciparum
VDLNYWKLWGLQTTHKL

SEQ ID NO: 3281633 - protein, 17 aa, Plasmodium falciparum
VECFPCPPNTFKENEYD

SEQ ID NO: 3281634 - protein, 25 aa, Plasmodium falciparum
VEINIPWRVIEQLLLLLEEETGYRR

SEQ ID NO: 3281635 - protein, 23 aa, Plasmodium falciparum
VETGCLKYGCGLGGVAGSVGIFG

SEQ ID NO: 3281636 - protein, 21 aa, Plasmodium falciparum
VFCKMLNLCRLYINGILPFVF

SEQ ID NO: 3281637 - protein, 17 aa, Plasmodium falciparum
VFCLLVWLWPSKKKLMG

SEQ ID NO: 3281638 - protein, 18 aa, Plasmodium falciparum
VFLEYWLDDFLYGYYLLK

SEQ ID NO: 3281639 - protein, 23 aa, Plasmodium falciparum
VFLILCVVSFYGLIVNTIKSLVL

SEQ ID NO: 3281640 - protein, 18 aa, Plasmodium falciparum
VGCLYLYPFIYADEICLT

SEQ ID NO: 3281641 - protein, 17 aa, Plasmodium falciparum
VGQRAQTNFLFLKKNHL

SEQ ID NO: 3281642 - protein, 18 aa, Plasmodium falciparum
VGVCAFLSLSFPGLLFSR

SEQ ID NO: 3281643 - protein, 23 aa, Plasmodium falciparum
VHFFLLKVAETFSFYEGDMKEKF

SEQ ID NO: 3281644 - protein, 19 aa, Plasmodium falciparum
VHVLKCTYLYLYNIYEQLN

SEQ ID NO: 3281645 - protein, 17 aa, Plasmodium falciparum
VHYKLMFFKSIYTLNFY

SEQ ID NO: 3281646 - protein, 17 aa, Plasmodium falciparum
VIGKRGAYIKNVIDNNN

SEQ ID NO: 3281647 - protein, 18 aa, Plasmodium falciparum
VIHYSKFYLLMLLINKIL

SEQ ID NO: 3281648 - protein, 20 aa, Plasmodium falciparum
VIKCYVHFILFYKKRKKEHM

SEQ ID NO: 3281649 - protein, 23 aa, Plasmodium falciparum
VIKKDVWNVISWVFKDKTVCKED

SEQ ID NO: 3281650 - protein, 18 aa, Plasmodium falciparum
VIQIKILLSKEGSYGNLQ

SEQ ID NO: 3281651 - protein, 22 aa, Plasmodium falciparum
VIYRCMCALFPYLNVDKNYDVI

SEQ ID NO: 3281652 - protein, 17 aa, Plasmodium falciparum
VKESVCFSLVIYFPNMD

SEQ ID NO: 3281653 - protein, 18 aa, Plasmodium falciparum
VKFKEVEKIIAFKISILT

SEQ ID NO: 3281654 - protein, 18 aa, Plasmodium falciparum
VKFLFLFCSLFNIYQKEY

SEQ ID NO: 3281655 - protein, 18 aa, Plasmodium falciparum
VKKFCYQLLHGATCKSYN

SEQ ID NO: 3281656 - protein, 18 aa, Plasmodium falciparum
VKLEMGFCVLFQIEKNED

SEQ ID NO: 3281657 - protein, 18 aa, Plasmodium falciparum
VKMLRSLFYIIKYKNLCD

SEQ ID NO: 3281658 - protein, 25 aa, Plasmodium falciparum
VKNYSCLCIYKFIIIYSSLYYLSNI

SEQ ID NO: 3281659 - protein, 23 aa, Plasmodium falciparum
VKPRYPLLGGWKFHFFNTFYHFS

SEQ ID NO: 3281660 - protein, 27 aa, Plasmodium falciparum
VKSYNGFFWKWVHDMLIDSMQWRDEHG

SEQ ID NO: 3281661 - protein, 22 aa, Plasmodium falciparum
VKYRLLLLFYKFIIILKHKELL

SEQ ID NO: 3281662 - protein, 18 aa, Plasmodium falciparum
VLCLLKVFFLFYTDDVLS

SEQ ID NO: 3281663 - protein, 25 aa, Plasmodium falciparum
VLDELGSKCKICFQLTNDNMNDENS

SEQ ID NO: 3281664 - protein, 33 aa, Plasmodium falciparum
VLFFPILYAEMIIRYNMKFFPLSKLYNIKNTAS

SEQ ID NO: 3281665 - protein, 18 aa, Plasmodium falciparum
VLLLYFLKICFFYLNEHI

SEQ ID NO: 3281666 - protein, 17 aa, Plasmodium falciparum
VLMFFKKYIYKLLNKQN

SEQ ID NO: 3281667 - protein, 18 aa, Plasmodium falciparum
VLYPLLFEYVVNIKNSYK

SEQ ID NO: 3281668 - protein, 20 aa, Plasmodium falciparum
VLYYWLEFCISKLLIEGKVE

SEQ ID NO: 3281669 - protein, 18 aa, Plasmodium falciparum
VNCCLSINLFKLFFFFKK

SEQ ID NO: 3281670 - protein, 18 aa, Plasmodium falciparum
VNEDIPLLLPQPLNIENT

SEQ ID NO: 3281671 - protein, 18 aa, Plasmodium falciparum
VNELFDMIIMFVIFLILL

SEQ ID NO: 3281672 - protein, 20 aa, Plasmodium falciparum
VNIKRINVLILIFSLSQIFL

SEQ ID NO: 3281673 - protein, 20 aa, Plasmodium falciparum
VNISFCIYQLIILCNIMEIF

SEQ ID NO: 3281674 - protein, 22 aa, Plasmodium falciparum
VNKIPLFLSFSIAKKILMTGKS

SEQ ID NO: 3281675 - protein, 21 aa, Plasmodium falciparum
VNVLFFLCFIFIFSRFNSGQF

SEQ ID NO: 3281676 - protein, 24 aa, Plasmodium falciparum
VPGWSIICSIGFYAFLNTNAMEAV

SEQ ID NO: 3281677 - protein, 22 aa, Plasmodium falciparum
VPIEVLRFFIPHYKQCRPEDFI

SEQ ID NO: 3281678 - protein, 20 aa, Plasmodium falciparum
VPKVQAAVMKIIFKNHESYY

SEQ ID NO: 3281679 - protein, 22 aa, Plasmodium falciparum
VPPRRRKLYLGGFKRLTDGTAV

SEQ ID NO: 3281680 - protein, 19 aa, Plasmodium falciparum
VRCIRFCGFFNFFLEKSIF

SEQ ID NO: 3281681 - protein, 17 aa, Plasmodium falciparum
VRCPLNYHGIFRKGNKL

SEQ ID NO: 3281682 - protein, 18 aa, Plasmodium falciparum
VRDGICVDYGIIKKEKKK

SEQ ID NO: 3281683 - protein, 17 aa, Plasmodium falciparum
VREIIRIGGDLFVNKYH

SEQ ID NO: 3281684 - protein, 17 aa, Plasmodium falciparum
VRLCKWLSFCFSCLIAF

SEQ ID NO: 3281685 - protein, 17 aa, Plasmodium falciparum
VRLFKISSIFSFVPEME

SEQ ID NO: 3281686 - protein, 17 aa, Plasmodium falciparum
VRLIEYMAAFKNNLQVF

SEQ ID NO: 3281687 - protein, 24 aa, Plasmodium falciparum
VSFPVLLFCLSFIILSYRSFNTEY

SEQ ID NO: 3281688 - protein, 25 aa, Plasmodium falciparum
VSKFCKKCNLLIKKNRDVLKIINSI

SEQ ID NO: 3281689 - protein, 17 aa, Plasmodium falciparum
VSLFFLLIFKYSYKNIV

SEQ ID NO: 3281690 - protein, 25 aa, Plasmodium falciparum
VSSLLCHICNLLICFPWITNGYNNK

SEQ ID NO: 3281691 - protein, 19 aa, Plasmodium falciparum
VTFIKNFLLFILIDIFFML

SEQ ID NO: 3281692 - protein, 17 aa, Plasmodium falciparum
VVEKWRLLSKFYYMDKY

SEQ ID NO: 3281693 - protein, 26 aa, Plasmodium falciparum
VVTKCGHLFCWLCLSAWIKKNNDCPV

SEQ ID NO: 3281694 - protein, 19 aa, Plasmodium falciparum
VWCSFLLDKMHMMSDLLRI

SEQ ID NO: 3281695 - protein, 23 aa, Plasmodium falciparum
VYDFCFLENIILNFSLSFYRQWI

SEQ ID NO: 3281696 - protein, 17 aa, Plasmodium falciparum
VYFCYKNNFSLLKSSIL

SEQ ID NO: 3281697 - protein, 17 aa, Plasmodium falciparum
VYIPWNFGVDTGMYTPL

SEQ ID NO: 3281698 - protein, 17 aa, Plasmodium falciparum
WALFFFLLVTLFKINNV

SEQ ID NO: 3281699 - protein, 21 aa, Plasmodium falciparum
WFNNIRCIFCNETQTINKYFI

SEQ ID NO: 3281700 - protein, 17 aa, Plasmodium falciparum
WGLICGVGYVGWTQYAA

SEQ ID NO: 3281701 - protein, 17 aa, Plasmodium falciparum
WGPFKYSNFFLRDANSK

SEQ ID NO: 3281702 - protein, 21 aa, Plasmodium falciparum
WIQKMCYLYFLIQIMKKNKME

SEQ ID NO: 3281703 - protein, 19 aa, Plasmodium falciparum
WIVQYSCSFLKRYDSIQLP

SEQ ID NO: 3281704 - protein, 17 aa, Plasmodium falciparum
WIYNLICLFIKTRRNSL

SEQ ID NO: 3281705 - protein, 23 aa, Plasmodium falciparum
WKCGKVCGLDVCGLKNANGKNYD

SEQ ID NO: 3281706 - protein, 20 aa, Plasmodium falciparum
WKLANVCQLVYLLTKFKHIH

SEQ ID NO: 3281707 - protein, 18 aa, Plasmodium falciparum
WKMYLYFFFYDFFCIAFN

SEQ ID NO: 3281708 - protein, 18 aa, Plasmodium falciparum
WKWVHDMLHDSVEWRERL

SEQ ID NO: 3281709 - protein, 18 aa, Plasmodium falciparum
WLLGFLYRYMEWKINVAG

SEQ ID NO: 3281710 - protein, 19 aa, Plasmodium falciparum
WNGLNGWKKREWNFEGDEM

SEQ ID NO: 3281711 - protein, 19 aa, Plasmodium falciparum
WRYMPCPFKIISYNKNKLD

SEQ ID NO: 3281712 - protein, 19 aa, Plasmodium falciparum
WSCGYFCGLDICTPNKTTG

SEQ ID NO: 3281713 - protein, 19 aa, Plasmodium falciparum
WTFPLEMLDKYIFKNKNHD

SEQ ID NO: 3281714 - protein, 17 aa, Plasmodium falciparum
WTYENFFIFPIFVIYAY

SEQ ID NO: 3281715 - protein, 20 aa, Plasmodium falciparum
WYKLCLGWGLAVFFGILVSA

SEQ ID NO: 3281716 - protein, 17 aa, Plasmodium falciparum
WYYEWLVLYYKELELHE

SEQ ID NO: 3281717 - protein, 21 aa, Plasmodium falciparum
YALCFLSLLLLDLFNKGKQKS

SEQ ID NO: 3281718 - protein, 17 aa, Plasmodium falciparum
YALVPLLFSQVIKDNYF

SEQ ID NO: 3281719 - protein, 17 aa, Plasmodium falciparum
YAPLSVRLIEYMAAFKN

SEQ ID NO: 3281720 - protein, 17 aa, Plasmodium falciparum
YAYFKALEVINHYEELV

SEQ ID NO: 3281721 - protein, 17 aa, Plasmodium falciparum
YAYKRLKILKILNISLK

SEQ ID NO: 3281722 - protein, 17 aa, Plasmodium falciparum
YCILNFITGNSYLFYFL

SEQ ID NO: 3281723 - protein, 22 aa, Plasmodium falciparum
YCITFSCSLGFVIKSLLYDYTH

SEQ ID NO: 3281724 - protein, 17 aa, Plasmodium falciparum
YCKSCPITDILCDDNEC

SEQ ID NO: 3281725 - protein, 20 aa, Plasmodium falciparum
YCLCKFPIILIDQAQPNNIN

SEQ ID NO: 3281726 - protein, 24 aa, Plasmodium falciparum
YCLFPDLFSSFLIEGFIKYIKLFH

SEQ ID NO: 3281727 - protein, 17 aa, Plasmodium falciparum
YCLKCGYGLGSVSPNVG

SEQ ID NO: 3281728 - protein, 23 aa, Plasmodium falciparum
YCNFDIPLILALLYIIQLHKFPD

SEQ ID NO: 3281729 - protein, 22 aa, Plasmodium falciparum
YCNFPRYDVFWNLLIKKEVENF

SEQ ID NO: 3281730 - protein, 18 aa, Plasmodium falciparum
YCQGMNFLVGLLLIISNF

SEQ ID NO: 3281731 - protein, 19 aa, Plasmodium falciparum
YCRCLQFLKLIHALAINYF

SEQ ID NO: 3281732 - protein, 23 aa, Plasmodium falciparum
YCSYSELFSLIFLFHKRNDMRPI

SEQ ID NO: 3281733 - protein, 20 aa, Plasmodium falciparum
YCSYSFFSSIHNFIFFFILC

SEQ ID NO: 3281734 - protein, 17 aa, Plasmodium falciparum
YCTYKFSKKYSFLSSLV

SEQ ID NO: 3281735 - protein, 17 aa, Plasmodium falciparum
YDLKWCFNMLKVNSGTT

SEQ ID NO: 3281736 - protein, 17 aa, Plasmodium falciparum
YDLRFSNSYDFIYKGME

SEQ ID NO: 3281737 - protein, 19 aa, Plasmodium falciparum
YDMKDIWIKKIYKLFYNMI

SEQ ID NO: 3281738 - protein, 22 aa, Plasmodium falciparum
YDNEIIKILSFSLSFYLICDEK

SEQ ID NO: 3281739 - protein, 18 aa, Plasmodium falciparum
YDQIKFSFIVKSIFQNSK

SEQ ID NO: 3281740 - protein, 19 aa, Plasmodium falciparum
YDTFLRWDVLLKQIVYSIT

SEQ ID NO: 3281741 - protein, 23 aa, Plasmodium falciparum
YDVRHKLRIYVGLICPKYRRKLF

SEQ ID NO: 3281742 - protein, 18 aa, Plasmodium falciparum
YEGFKILTIHDIQKLTNI

SEQ ID NO: 3281743 - protein, 17 aa, Plasmodium falciparum
YEHLHFMMARQAFSINL

SEQ ID NO: 3281744 - protein, 19 aa, Plasmodium falciparum
YEILCRIIIIQLKFFSNKI

SEQ ID NO: 3281745 - protein, 23 aa, Plasmodium falciparum
YELKEIFFLDVLRDVSKQMNKMS

SEQ ID NO: 3281746 - protein, 17 aa, Plasmodium falciparum
YELLRFLFFFIKQNDLI

SEQ ID NO: 3281747 - protein, 20 aa, Plasmodium falciparum
YELSSYISFCLYFLKKIILN

SEQ ID NO: 3281748 - protein, 19 aa, Plasmodium falciparum
YEMKKLKCYYSFINMDNST

SEQ ID NO: 3281749 - protein, 20 aa, Plasmodium falciparum
YENMFSFSLYFFLRPYIKKK

SEQ ID NO: 3281750 - protein, 21 aa, Plasmodium falciparum
YEVYRLLCLFSILTNGINQNY

SEQ ID NO: 3281751 - protein, 19 aa, Plasmodium falciparum
YEWLNRNICLFQFPDNYVD

SEQ ID NO: 3281752 - protein, 17 aa, Plasmodium falciparum
YEYFYIFSLCTLLTSYS

SEQ ID NO: 3281753 - protein, 19 aa, Plasmodium falciparum
YFFKLMVIIYCIIKHIKET

SEQ ID NO: 3281754 - protein, 25 aa, Plasmodium falciparum
YFIFRINIFFFNWFLLHIYKIKLKN

SEQ ID NO: 3281755 - protein, 18 aa, Plasmodium falciparum
YFKRVCKLLILSLWYILK

SEQ ID NO: 3281756 - protein, 20 aa, Plasmodium falciparum
YFKYRIPANINFTFEYNDGD

SEQ ID NO: 3281757 - protein, 17 aa, Plasmodium falciparum
YFLRRICCHNNDKFLSQ

SEQ ID NO: 3281758 - protein, 18 aa, Plasmodium falciparum
YFLSFKFWYFYLRYQGID

SEQ ID NO: 3281759 - protein, 25 aa, Plasmodium falciparum
YFNECLKYFISFLFPNKEFNIFIQF

SEQ ID NO: 3281760 - protein, 17 aa, Plasmodium falciparum
YFSVYGMVDLNWPEQFE

SEQ ID NO: 3281761 - protein, 19 aa, Plasmodium falciparum
YFVCFYMCPPLLYDTNKQT

SEQ ID NO: 3281762 - protein, 23 aa, Plasmodium falciparum
YFVKDFHSIFSFLSLKFLRHLNL

SEQ ID NO: 3281763 - protein, 22 aa, Plasmodium falciparum
YFWEMCIKNKLNLTEYFVQILI

SEQ ID NO: 3281764 - protein, 17 aa, Plasmodium falciparum
YFYCINKYYGCVKRTFY

SEQ ID NO: 3281765 - protein, 17 aa, Plasmodium falciparum
YHERFRFGFFSSTSLLV

SEQ ID NO: 3281766 - protein, 21 aa, Plasmodium falciparum
YHIMIRYVIFTSFFMLIIQYH

SEQ ID NO: 3281767 - protein, 19 aa, Plasmodium falciparum
YHPDMYASYIFFKTLTYSG

SEQ ID NO: 3281768 - protein, 17 aa, Plasmodium falciparum
YHSLSYFPFPILSYKNV

SEQ ID NO: 3281769 - protein, 21 aa, Plasmodium falciparum
YICLFINSWVKLNCRRKKNYV

SEQ ID NO: 3281770 - protein, 17 aa, Plasmodium falciparum
YIKLGLCEELYLYSYEN

SEQ ID NO: 3281771 - protein, 22 aa, Plasmodium falciparum
YIKYKICLMKSLLKISLKYIQE

SEQ ID NO: 3281772 - protein, 17 aa, Plasmodium falciparum
YILGEFQFAFILFHLGY

SEQ ID NO: 3281773 - protein, 18 aa, Plasmodium falciparum
YILKHIKGIIPYKLIYNN

SEQ ID NO: 3281774 - protein, 19 aa, Plasmodium falciparum
YILKYVFKKMMYKLYYNKY

SEQ ID NO: 3281775 - protein, 19 aa, Plasmodium falciparum
YILNEFSKFFKLFKFLNKN

SEQ ID NO: 3281776 - protein, 18 aa, Plasmodium falciparum
YILNHSIYFFKSCDNNII

SEQ ID NO: 3281777 - protein, 23 aa, Plasmodium falciparum
YIRKCAFRFFHLAKNMWPSNVKL

SEQ ID NO: 3281778 - protein, 17 aa, Plasmodium falciparum
YISFCFDDKINLYFQDA

SEQ ID NO: 3281779 - protein, 17 aa, Plasmodium falciparum
YISFKDFLMFASYNLNE

SEQ ID NO: 3281780 - protein, 19 aa, Plasmodium falciparum
YIWIWNLNYIWKRADPPND

SEQ ID NO: 3281781 - protein, 18 aa, Plasmodium falciparum
YIWKGMICALTYDTDSGA

SEQ ID NO: 3281782 - protein, 17 aa, Plasmodium falciparum
YIWWSWLLLQGVIVFGT

SEQ ID NO: 3281783 - protein, 18 aa, Plasmodium falciparum
YIYFCILFAFGFIVQHGF

SEQ ID NO: 3281784 - protein, 17 aa, Plasmodium falciparum
YIYHEILTFFVFSNDNE

SEQ ID NO: 3281785 - protein, 29 aa, Plasmodium falciparum
YIYNCIYCFFHIYINRFAFFIIFIKQEHM

SEQ ID NO: 3281786 - protein, 20 aa, Plasmodium falciparum
YKFVIMCALIITKIFFYFLY

SEQ ID NO: 3281787 - protein, 19 aa, Plasmodium falciparum
YKGYFPMCFICDKDVSLDS

SEQ ID NO: 3281788 - protein, 19 aa, Plasmodium falciparum
YKIFKGYILLLLWVIIILK

SEQ ID NO: 3281789 - protein, 18 aa, Plasmodium falciparum
YKKCRLLQKCLFYKIYIS

SEQ ID NO: 3281790 - protein, 17 aa, Plasmodium falciparum
YKKCYVFSCNHYFHSEC

SEQ ID NO: 3281791 - protein, 20 aa, Plasmodium falciparum
YKKKFDFRIYILLLPGKNYP

SEQ ID NO: 3281792 - protein, 17 aa, Plasmodium falciparum
YKKLLIHLFTFLKCFLK

SEQ ID NO: 3281793 - protein, 21 aa, Plasmodium falciparum
YKKYRCIENFKILKKILKLST

SEQ ID NO: 3281794 - protein, 18 aa, Plasmodium falciparum
YKLACVYFRKGLIQLDYS

SEQ ID NO: 3281795 - protein, 22 aa, Plasmodium falciparum
YKLDNFFSYKISNIFFSPHNNL

SEQ ID NO: 3281796 - protein, 20 aa, Plasmodium falciparum
YKLEGIECVELLSLASSSLN

SEQ ID NO: 3281797 - protein, 19 aa, Plasmodium falciparum
YKLFHKFRMSYNHFIKYTQ

SEQ ID NO: 3281798 - protein, 20 aa, Plasmodium falciparum
YKLKVVECLLEFIKNELYIL

SEQ ID NO: 3281799 - protein, 17 aa, Plasmodium falciparum
YKLLRIIILEAFDSLNE

SEQ ID NO: 3281800 - protein, 23 aa, Plasmodium falciparum
YKPPCLFCNINLCGSLLCSYKSI

SEQ ID NO: 3281801 - protein, 19 aa, Plasmodium falciparum
YKRIICFVWIYKIIKNIHF

SEQ ID NO: 3281802 - protein, 19 aa, Plasmodium falciparum
YKSTLYIVGNHLRFRGFRI

SEQ ID NO: 3281803 - protein, 17 aa, Plasmodium falciparum
YKTLYIIIVEKTFLSIF

SEQ ID NO: 3281804 - protein, 22 aa, Plasmodium falciparum
YKTSCILFYYMVRVFQTFQNHI

SEQ ID NO: 3281805 - protein, 19 aa, Plasmodium falciparum
YKYKFLLNRSIKEYINLIK

SEQ ID NO: 3281806 - protein, 20 aa, Plasmodium falciparum
YKYMNCLNVLGIRYINNNNN

SEQ ID NO: 3281807 - protein, 17 aa, Plasmodium falciparum
YLEEPFCTFPIYNNIFS

SEQ ID NO: 3281808 - protein, 17 aa, Plasmodium falciparum
YLFLLLYNSFHIIRENC

SEQ ID NO: 3281809 - protein, 17 aa, Plasmodium falciparum
YLIISLCILNFLFNFLY

SEQ ID NO: 3281810 - protein, 20 aa, Plasmodium falciparum
YLINNGFCLFACPYLDKKGG

SEQ ID NO: 3281811 - protein, 18 aa, Plasmodium falciparum
YLLCIFKYKDLKEDGNEK

SEQ ID NO: 3281812 - protein, 19 aa, Plasmodium falciparum
YLLCVSLFSSYLINKEKSS

SEQ ID NO: 3281813 - protein, 17 aa, Plasmodium falciparum
YLLSIICVLFFNITNNE

SEQ ID NO: 3281814 - protein, 20 aa, Plasmodium falciparum
YLMYYIIGVIVFFSLALVMQ

SEQ ID NO: 3281815 - protein, 23 aa, Plasmodium falciparum
YLPICLKCFYTLFFDYVAYYIYI

SEQ ID NO: 3281816 - protein, 19 aa, Plasmodium falciparum
YLPIEFCELPSFFYNSENI

SEQ ID NO: 3281817 - protein, 18 aa, Plasmodium falciparum
YLQFKYIYLQSLNITVSF

SEQ ID NO: 3281818 - protein, 17 aa, Plasmodium falciparum
YLYELNEIILFYKNFTK

SEQ ID NO: 3281819 - protein, 19 aa, Plasmodium falciparum
YMACNYFKMVIIKYQKYNK

SEQ ID NO: 3281820 - protein, 18 aa, Plasmodium falciparum
YMHEINYLYPFFLENKKF

SEQ ID NO: 3281821 - protein, 19 aa, Plasmodium falciparum
YMIEKCIYFDNNINNKESH

SEQ ID NO: 3281822 - protein, 21 aa, Plasmodium falciparum
YMIKKRINDLILYNLKNIFEK

SEQ ID NO: 3281823 - protein, 20 aa, Plasmodium falciparum
YMSLELFNGMKFLLDKYNFF

SEQ ID NO: 3281824 - protein, 21 aa, Plasmodium falciparum
YNEIFFLIFIYFIKIICMFGK

SEQ ID NO: 3281825 - protein, 17 aa, Plasmodium falciparum
YNFFFKKINKYMCTYPF

SEQ ID NO: 3281826 - protein, 17 aa, Plasmodium falciparum
YNFIQLYIIRSALNIHV

SEQ ID NO: 3281827 - protein, 23 aa, Plasmodium falciparum
YNFRCKHCNYVLFNDNEIIKHDF

SEQ ID NO: 3281828 - protein, 19 aa, Plasmodium falciparum
YNFSFEWINCMKLKNEYIT

SEQ ID NO: 3281829 - protein, 23 aa, Plasmodium falciparum
YNIFYKRYIKVHIEYGEKIGDQK

SEQ ID NO: 3281830 - protein, 17 aa, Plasmodium falciparum
YNIPAFYLNYIIINCYT

SEQ ID NO: 3281831 - protein, 23 aa, Plasmodium falciparum
YNISIPVGEIFFFKSEYNCRIAF

SEQ ID NO: 3281832 - protein, 18 aa, Plasmodium falciparum
YNKIFYKYYISVINDMLC

SEQ ID NO: 3281833 - protein, 19 aa, Plasmodium falciparum
YNLMLSVECFHSWAKNLLI

SEQ ID NO: 3281834 - protein, 17 aa, Plasmodium falciparum
YNVKCKYHYNNSRKILC

SEQ ID NO: 3281835 - protein, 21 aa, Plasmodium falciparum
YPHKDFRLFATITLCNRDHKN

SEQ ID NO: 3281836 - protein, 17 aa, Plasmodium falciparum
YPILKRTFESFVSYLSN

SEQ ID NO: 3281837 - protein, 18 aa, Plasmodium falciparum
YPMHFLIYYYSGIHFEPG

SEQ ID NO: 3281838 - protein, 25 aa, Plasmodium falciparum
YQTWSLREVIQWLMLCNVPVKWLIS

SEQ ID NO: 3281839 - protein, 20 aa, Plasmodium falciparum
YRDKLIYGYVQWKLLDRKIF

SEQ ID NO: 3281840 - protein, 20 aa, Plasmodium falciparum
YRIFYAGGITAVLLLCSSTA

SEQ ID NO: 3281841 - protein, 20 aa, Plasmodium falciparum
YRIHISKFFYIFVALSKFFL

SEQ ID NO: 3281842 - protein, 18 aa, Plasmodium falciparum
YRIVISIFIFLLNHSRCI

SEQ ID NO: 3281843 - protein, 22 aa, Plasmodium falciparum
YRKEILYIYSLFILKKKQKQYY

SEQ ID NO: 3281844 - protein, 22 aa, Plasmodium falciparum
YRKILYEFPILYLFFPNKLLCK

SEQ ID NO: 3281845 - protein, 20 aa, Plasmodium falciparum
YRLLSCSVPKIINCKKNENM

SEQ ID NO: 3281846 - protein, 18 aa, Plasmodium falciparum
YRNRSSVYFDEFDKNGEK

SEQ ID NO: 3281847 - protein, 20 aa, Plasmodium falciparum
YRPDIFDIYSLIKKDITYIK

SEQ ID NO: 3281848 - protein, 21 aa, Plasmodium falciparum
YRYGCSYEFINFVFTSFHVIT

SEQ ID NO: 3281849 - protein, 20 aa, Plasmodium falciparum
YSCFILRFLELWKRWYKIKY

SEQ ID NO: 3281850 - protein, 21 aa, Plasmodium falciparum
YSDKCIFKIIFIDEHKELLKF

SEQ ID NO: 3281851 - protein, 18 aa, Plasmodium falciparum
YSDWKFKSIPTVGFSKDG

SEQ ID NO: 3281852 - protein, 19 aa, Plasmodium falciparum
YSFSFSIMNFVGWLYEYFS

SEQ ID NO: 3281853 - protein, 17 aa, Plasmodium falciparum
YSFSFSYIFLNVCKKCT

SEQ ID NO: 3281854 - protein, 19 aa, Plasmodium falciparum
YSFTQFCSGIEFIKELGKT

SEQ ID NO: 3281855 - protein, 17 aa, Plasmodium falciparum
YSLFPRRVIYMSNKQSY

SEQ ID NO: 3281856 - protein, 18 aa, Plasmodium falciparum
YSQKFPFFLNFTNNITSN

SEQ ID NO: 3281857 - protein, 24 aa, Plasmodium falciparum
YSSFRCFIKLLALKHIRINKVIYE

SEQ ID NO: 3281858 - protein, 19 aa, Plasmodium falciparum
YTCHKECLYFNNYTFNHIY

SEQ ID NO: 3281859 - protein, 23 aa, Plasmodium falciparum
YTLCFKKSYLNHMLIFLNMDCLI

SEQ ID NO: 3281860 - protein, 23 aa, Plasmodium falciparum
YTLSSIEFIKFIFLLLDKNISTN

SEQ ID NO: 3281861 - protein, 19 aa, Plasmodium falciparum
YTNIHFVFYFRFIYLFFNK

SEQ ID NO: 3281862 - protein, 18 aa, Plasmodium falciparum
YTSLYIHKFFKSVTLLKG

SEQ ID NO: 3281863 - protein, 20 aa, Plasmodium falciparum
YVCPMSWFFIIRRIVEDVKI

SEQ ID NO: 3281864 - protein, 17 aa, Plasmodium falciparum
YVFFFLIIFYKYMQINL

SEQ ID NO: 3281865 - protein, 18 aa, Plasmodium falciparum
YVICTKGYCSPECALLVF

SEQ ID NO: 3281866 - protein, 18 aa, Plasmodium falciparum
YVIFTSFFMLIIQYHSFI

SEQ ID NO: 3281867 - protein, 22 aa, Plasmodium falciparum
YVKEFDRNLIICFLYSVLHSIF

SEQ ID NO: 3281868 - protein, 17 aa, Plasmodium falciparum
YVLICITLSASIYKLVV

SEQ ID NO: 3281869 - protein, 17 aa, Plasmodium falciparum
YVLKYNLFIFFKRLQLF

SEQ ID NO: 3281870 - protein, 22 aa, Plasmodium falciparum
YVYKCLMNYFILFFLIYFFLMN

SEQ ID NO: 3281871 - protein, 18 aa, Plasmodium falciparum
YWINISIIFNLTIDLIYV

SEQ ID NO: 3281872 - protein, 17 aa, Plasmodium falciparum
YYFKGNRAYVNFVKNKM

SEQ ID NO: 3281873 - protein, 17 aa, Plasmodium falciparum
YYFLWKFIEHEIDKDIM

SEQ ID NO: 3281874 - protein, 17 aa, Plasmodium falciparum
YYICKKICMQFFTLCIY

SEQ ID NO: 3281875 - protein, 18 aa, Plasmodium falciparum
YYIFVHSLLRYKGASVYK

SEQ ID NO: 3281876 - protein, 17 aa, Plasmodium falciparum
YYIKIFINKGIFKVWLN

SEQ ID NO: 3281877 - protein, 18 aa, Plasmodium falciparum
YYIKTCLNIFKSFFHEYF

SEQ ID NO: 3281878 - protein, 18 aa, Plasmodium falciparum
YYKIKSLILYGGTDIFES

SEQ ID NO: 3281879 - protein, 18 aa, Plasmodium falciparum
YYKILSLFYLAIKNITEL

SEQ ID NO: 3281880 - protein, 17 aa, Plasmodium falciparum
YYLFHIFKKLLLKKKDI

SEQ ID NO: 3281881 - protein, 17 aa, Plasmodium falciparum
YYPKAVEQFNHFKEPYS

SEQ ID NO: 3281882 - protein, 17 aa, Plasmodium falciparum
YYYKLDNFFSYKISNIF

SEQ ID NO: 3281883 - protein, 17 aa, Plasmodium falciparum
YYYLCIIYLYNLKINKC

SEQ ID NO: 3281884 - protein, 18 aa, Plasmodium falciparum
YYYTCIKILTGHNARVWD

SEQ ID NO: 3281885 - protein, 23 aa, Plasmodium falciparum
SGKYRGKRYIYLEGDSGTDSGYT

SEQ ID NO: 3281886 - protein, 26 aa, Plasmodium falciparum
IPTKLSPNRYIPYTSGKYRGKRYIYL

SEQ ID NO: 3281887 - protein, 26 aa, Plasmodium falciparum
KSTIDLLRVINIPKSDYDIPTKLSPN

SEQ ID NO: 3281888 - protein, 24 aa, Plasmodium falciparum
TSGKYRGKRYIYLEGDSGTDSGYT

SEQ ID NO: 3281889 - protein, 18 aa, Plasmodium falciparum
LLFALPLNILVYNQRNYY

SEQ ID NO: 3281890 - protein, 19 aa, Plasmodium falciparum
LLFELPLNILIYNQRNHKS

SEQ ID NO: 3281891 - protein, 27 aa, Plasmodium falciparum
LSIIIVICLLVWLWPSRGKLMGKDKTE

SEQ ID NO: 3281892 - protein, 19 aa, Plasmodium falciparum
SLYSIIFKGSNFWKGLGIY

SEQ ID NO: 3281893 - protein, 22 aa, Plasmodium falciparum
KSSNRYIPYASDRYKGKTYIYM

SEQ ID NO: 3281894 - protein, 24 aa, Plasmodium falciparum
SVGNLFQILQIPKGDYDIPTLKSS

SEQ ID NO: 3281895 - protein, 24 aa, Plasmodium falciparum
SVGNLFQILQIPKSDYDIPTKLSP

SEQ ID NO: 3281896 - protein, 21 aa, Plasmodium falciparum
IHNQLELFHTWLDRHRDMCEK

SEQ ID NO: 3281897 - protein, 18 aa, Plasmodium falciparum
LLFPLKLNILVNTHKKPH

SEQ ID NO: 3281898 - protein, 24 aa, Plasmodium falciparum
PTKLSPNRYIPYTSGKYRGKRYIY

SEQ ID NO: 3281899 - protein, 31 aa, Plasmodium falciparum
VAIVVIVLIMVIIYLILRYRRKKKMKKKLQY

SEQ ID NO: 3281900 - protein, 21 aa, Plasmodium falciparum
VGIVICLYLIIYKNSDIKWKK

SEQ ID NO: 3281901 - protein, 27 aa, Plasmodium falciparum
DIPTKLSPNRYIPYTSGKYRGKRYIYL

SEQ ID NO: 3281902 - protein, 25 aa, Plasmodium falciparum
DPEYRKHLEIFYKILTNTDPNDEVE

SEQ ID NO: 3281903 - protein, 46 aa, Plasmodium falciparum
EATIYNWYTTIGYTILAILIIVLIMIIIYLILRYRRKKKMKKKAQY

SEQ ID NO: 3281904 - protein, 23 aa, Plasmodium falciparum
FKEDLLNAAFSQGKLLGKKYSNY

SEQ ID NO: 3281905 - protein, 17 aa, Plasmodium falciparum
LLFALALNILLTSYYAH

SEQ ID NO: 3281906 - protein, 19 aa, Plasmodium falciparum
LLFALPLNILEHNKNEPHT

SEQ ID NO: 3281907 - protein, 23 aa, Plasmodium falciparum
LLFFFPLYILVTSYHVYSKNKPS

SEQ ID NO: 3281908 - protein, 19 aa, Plasmodium falciparum
LLFFFPSNILLTSYHVHSK

SEQ ID NO: 3281909 - protein, 18 aa, Plasmodium falciparum
LLFPLKLNILVNTHKKPS

SEQ ID NO: 3281910 - protein, 19 aa, Plasmodium falciparum
LLFPLKLNILVNTHKKPSI

SEQ ID NO: 3281911 - protein, 20 aa, Plasmodium falciparum
LLFTFLINTLALPHYDNYQN

SEQ ID NO: 3281912 - protein, 20 aa, Plasmodium falciparum
SPKYKTLIEVVLEPSKSNGN

SEQ ID NO: 3281913 - protein, 24 aa, Plasmodium falciparum
SSQGIRQDFPYKNENNHKMYNVNE

SEQ ID NO: 3281914 - protein, 18 aa, Plasmodium falciparum
ACAPLRRLHLCNKNMEKI

SEQ ID NO: 3281915 - protein, 37 aa, Plasmodium falciparum
AIGYSILAILIIVLIMLIIYLILRYRRKKKMKKKAQY

SEQ ID NO: 3281916 - protein, 33 aa, Plasmodium falciparum
AISQVKTLIIIMKSFYDIIISEKASMDEMEKKE

SEQ ID NO: 3281917 - protein, 30 aa, Plasmodium falciparum
AIVVIVLIMVIIYLILRYRRKKKMKKKLQY

SEQ ID NO: 3281918 - protein, 30 aa, Plasmodium falciparum
AIVVIVLVMVIIYLILRYRRKKKMKKKLQY

SEQ ID NO: 3281919 - protein, 36 aa, Plasmodium falciparum
APPSPPRPLPKPKPPKPDLPPALKNAMLSSTIMWSV

SEQ ID NO: 3281920 - protein, 34 aa, Plasmodium falciparum
ASIFAIVVIVLIMVIIYLILRYRRKKKMKKKLQY

SEQ ID NO: 3281921 - protein, 34 aa, Plasmodium falciparum
ASIIAIVVIVLIMVIIYLVLRYRRKKKMKKKLQY

SEQ ID NO: 3281922 - protein, 42 aa, Plasmodium falciparum
ASINRLYRKKPYMKRSLINLENDLFRLEPISYIQRYYKKNIN

SEQ ID NO: 3281923 - protein, 30 aa, Plasmodium falciparum
ATLKDFVEIPTYFRWLHEWGSDFCGKRARM

SEQ ID NO: 3281924 - protein, 21 aa, Plasmodium falciparum
ATVCRAIRYSFADLGDIIRGK

SEQ ID NO: 3281925 - protein, 18 aa, Plasmodium falciparum
AYMPPRREHICTSNLEYL

SEQ ID NO: 3281926 - protein, 35 aa, Plasmodium falciparum
CEKKRINDMLIVKLIIYFYFPIIGSFHNAIYFHGV

SEQ ID NO: 3281927 - protein, 17 aa, Plasmodium falciparum
CGDFCGIDICTLEKTNN

SEQ ID NO: 3281928 - protein, 33 aa, Plasmodium falciparum
CKRLFIDYEEWFRYRYNQWKGLSEKYIKIKKSK

SEQ ID NO: 3281929 - protein, 24 aa, Plasmodium falciparum
DEGIENLILLRSSFFTILVCYLRN

SEQ ID NO: 3281930 - protein, 23 aa, Plasmodium falciparum
DFKRQMFYTFGDYRDLCLDTDIS

SEQ ID NO: 3281931 - protein, 26 aa, Plasmodium falciparum
DFVNRPQFLRWFTEWSDEFCTERSIK

SEQ ID NO: 3281932 - protein, 30 aa, Plasmodium falciparum
DHLSSYTPLMYFLIVSITAFVIYKLLDVKY

SEQ ID NO: 3281933 - protein, 32 aa, Plasmodium falciparum
DKDIVFNEFFQRWLRYFVQDYNKLKDKINPCT

SEQ ID NO: 3281934 - protein, 24 aa, Plasmodium falciparum
DLAKAVFRHPFSAYRPNYGNPCEL

SEQ ID NO: 3281935 - protein, 20 aa, Plasmodium falciparum
DPEFFKLREDWWTANRATVW

SEQ ID NO: 3281936 - protein, 25 aa, Plasmodium falciparum
DPEYRKHLEIFYKILTNTDPNDDVE

SEQ ID NO: 3281937 - protein, 23 aa, Plasmodium falciparum
DPYLKLRADWWEANRAKVWKAMK

SEQ ID NO: 3281938 - protein, 18 aa, Plasmodium falciparum
DYRFHTNVWHRNAEDRNP

SEQ ID NO: 3281939 - protein, 22 aa, Plasmodium falciparum
EDFKRQMFYTLGDYRDILVGDK

SEQ ID NO: 3281940 - protein, 23 aa, Plasmodium falciparum
EEFKRQMFYTLGDYKDIFEGKSI

SEQ ID NO: 3281941 - protein, 28 aa, Plasmodium falciparum
EGFEDKVKYLWLYIEDYLKKYEYQCYHV

SEQ ID NO: 3281942 - protein, 28 aa, Plasmodium falciparum
EHRTIKSYYTLFPNWINEMLKDSIDWSK

SEQ ID NO: 3281943 - protein, 17 aa, Plasmodium falciparum
EIPEELVEVVPVELLEE

SEQ ID NO: 3281944 - protein, 24 aa, Plasmodium falciparum
EKNRYDEKLFLWKNTENDKYINPM

SEQ ID NO: 3281945 - protein, 25 aa, Plasmodium falciparum
EKYNEPYYYDFYKDDIYYDVNDDDK

SEQ ID NO: 3281946 - protein, 25 aa, Plasmodium falciparum
EKYNEPYYYDFYKNDIYYDVNDDDK

SEQ ID NO: 3281947 - protein, 33 aa, Plasmodium falciparum
ELRKAFIQCAAIETYWLWQKYKKDKNGGVAQAK

SEQ ID NO: 3281948 - protein, 23 aa, Plasmodium falciparum
ELSNPILLNFMLLTNIQKEKNIK

SEQ ID NO: 3281949 - protein, 24 aa, Plasmodium falciparum
EMKNFIYEFIKYYDTLKNDLFNTH

SEQ ID NO: 3281950 - protein, 28 aa, Plasmodium falciparum
ENFYQLREDWWALNRDQVWKALTCSDDL

SEQ ID NO: 3281951 - protein, 36 aa, Plasmodium falciparum
EQSDLHLRYASRSIYVIDLFIKHEIINPSDGKNFDI

SEQ ID NO: 3281952 - protein, 24 aa, Plasmodium falciparum
ESDKKYIIMKEFVKRWLEYFFEDY

SEQ ID NO: 3281953 - protein, 25 aa, Plasmodium falciparum
ESSRSISLYKWRSLIKINTEIDLKH

SEQ ID NO: 3281954 - protein, 24 aa, Plasmodium falciparum
EVKSTPIDLYLNRAKELLESSSKL

SEQ ID NO: 3281955 - protein, 28 aa, Plasmodium falciparum
EYRKKKLICIIWIKIYMMIIEEHKKEEY

SEQ ID NO: 3281956 - protein, 20 aa, Plasmodium falciparum
FCRTKYCQPCPLCGMKKNNN

SEQ ID NO: 3281957 - protein, 28 aa, Plasmodium falciparum
FIKYKKKVLVVILWIKIYMSMLEEYVKE

SEQ ID NO: 3281958 - protein, 29 aa, Plasmodium falciparum
FIQSAAIETFFLWHKYKAENTKTQGVGAG

SEQ ID NO: 3281959 - protein, 35 aa, Plasmodium falciparum
FKNFSLLYNYLINTNLSLFILIRSLNILKNDKINK

SEQ ID NO: 3281960 - protein, 28 aa, Plasmodium falciparum
FKVSNYNFLYIYWNIINVHINNLYLRII

SEQ ID NO: 3281961 - protein, 17 aa, Plasmodium falciparum
FSDPSQFSDACTLKYVT

SEQ ID NO: 3281962 - protein, 23 aa, Plasmodium falciparum
FTNKMHLALIKRYFMSLIFIMLS

SEQ ID NO: 3281963 - protein, 17 aa, Plasmodium falciparum
FVKRWLEYFFEDYNRIQ

SEQ ID NO: 3281964 - protein, 19 aa, Plasmodium falciparum
GACMPPRRIKLCVINLQYL

SEQ ID NO: 3281965 - protein, 24 aa, Plasmodium falciparum
GDPNKIIHSLLGDVLLAAKYEAEN

SEQ ID NO: 3281966 - protein, 26 aa, Plasmodium falciparum
GGLCIPPRRRRLYVGGLSQWASQRTQ

SEQ ID NO: 3281967 - protein, 23 aa, Plasmodium falciparum
GLLSGIVYTGWKAAALAAAKELA

SEQ ID NO: 3281968 - protein, 20 aa, Plasmodium falciparum
GNYIKLREDWWTANRDQVWK

SEQ ID NO: 3281969 - protein, 24 aa, Plasmodium falciparum
GSDFSMCTMLARSFADIGDIIRGK

SEQ ID NO: 3281970 - protein, 32 aa, Plasmodium falciparum
HINNLYLRIITLKLLVNLTLLYVQKIKDKSVC

SEQ ID NO: 3281971 - protein, 39 aa, Plasmodium falciparum
HKVPKHGYIMSFYAFFDLWVKNLLIDSINWKNDLTNCIN

SEQ ID NO: 3281972 - protein, 31 aa, Plasmodium falciparum
HVNQALIIFSYPLMLIDLYIDKNDNKKLIVH

SEQ ID NO: 3281973 - protein, 31 aa, Plasmodium falciparum
IAIVVIVLVMVIIYLILRYRRKKKMKKKVQY

SEQ ID NO: 3281974 - protein, 30 aa, Plasmodium falciparum
IALYTIASILLILYYILKYYRKIRMEKKEK

SEQ ID NO: 3281975 - protein, 18 aa, Plasmodium falciparum
IEEILPEELIEELVPEEI

SEQ ID NO: 3281976 - protein, 26 aa, Plasmodium falciparum
IEGHRYMLEKWKKEKWFIVLKENWKN

SEQ ID NO: 3281977 - protein, 25 aa, Plasmodium falciparum
IHNQLDLFHKWLDRHRDMCKKWNNK

SEQ ID NO: 3281978 - protein, 22 aa, Plasmodium falciparum
IHNQLELFHKWLDRHRDMCEKL

SEQ ID NO: 3281979 - protein, 23 aa, Plasmodium falciparum
IHNQLELFHKWLDRHRDMCEKWE

SEQ ID NO: 3281980 - protein, 24 aa, Plasmodium falciparum
IHNQLNLFHTWLDRHRDMCEKLKN

SEQ ID NO: 3281981 - protein, 22 aa, Plasmodium falciparum
IIETVIYIFYLSLKYDKGFLEK

SEQ ID NO: 3281982 - protein, 25 aa, Plasmodium falciparum
IININKFFYKSFKKNIYNFNLPVQE

SEQ ID NO: 3281983 - protein, 17 aa, Plasmodium falciparum
IIPLIFSYVLSFIVDIL

SEQ ID NO: 3281984 - protein, 18 aa, Plasmodium falciparum
IKTIEDVKFLLDSLNTIE

SEQ ID NO: 3281985 - protein, 33 aa, Plasmodium falciparum
ILKFFLFKCIFVVIIGILCMGILYLPNDRNNKV

SEQ ID NO: 3281986 - protein, 19 aa, Plasmodium falciparum
IMNQLDLLHKWLDRHRDIC

SEQ ID NO: 3281987 - protein, 17 aa, Plasmodium falciparum
IMSIHDRNLYTGEEISY

SEQ ID NO: 3281988 - protein, 17 aa, Plasmodium falciparum
IMSIHDRNLYTGEEYNY

SEQ ID NO: 3281989 - protein, 17 aa, Plasmodium falciparum
INFYITSNFRFLDRYYG

SEQ ID NO: 3281990 - protein, 26 aa, Plasmodium falciparum
INKVYITNIFILFKILKTALNIIKTV

SEQ ID NO: 3281991 - protein, 22 aa, Plasmodium falciparum
INNIFSFFFLFFENLEKYSEKD

SEQ ID NO: 3281992 - protein, 24 aa, Plasmodium falciparum
IPQRLRWMTEWAEWYCKKQSQEYE

SEQ ID NO: 3281993 - protein, 25 aa, Plasmodium falciparum
IPTKLSPNRYIPYTSGKYRGKRYIY

SEQ ID NO: 3281994 - protein, 25 aa, Plasmodium falciparum
IPVPVIFYYLSILLIFLKRNTKYKF

SEQ ID NO: 3281995 - protein, 20 aa, Plasmodium falciparum
IQLFNSYNIPFLRLVDNNFR

SEQ ID NO: 3281996 - protein, 26 aa, Plasmodium falciparum
IRKEEWKCRNECGLDVCGLKKGDNNG

SEQ ID NO: 3281997 - protein, 32 aa, Plasmodium falciparum
IVAILVIVLVMIIIYLILRYRRKKKMKKKLQY

SEQ ID NO: 3281998 - protein, 32 aa, Plasmodium falciparum
IVAIVVIVLIMVIIYLILRYRRKKKMKKKLQY

SEQ ID NO: 3281999 - protein, 31 aa, Plasmodium falciparum
IYNILKFENSFFYFLLNLIFYCRKYNQIQNI

SEQ ID NO: 3282000 - protein, 22 aa, Plasmodium falciparum
KAKRQVDMIRILQMSQNEYGIP

SEQ ID NO: 3282001 - protein, 26 aa, Plasmodium falciparum
KEDIKNLLKHVIKLANFSGIIVMSDT

SEQ ID NO: 3282002 - protein, 25 aa, Plasmodium falciparum
KEKKYIYIIFISSILFFLYNLYNLF

SEQ ID NO: 3282003 - protein, 23 aa, Plasmodium falciparum
KGCTDCFFACNPYIDWIEKQKEQ

SEQ ID NO: 3282004 - protein, 21 aa, Plasmodium falciparum
KHIWHGMICALTYNTDSNGKD

SEQ ID NO: 3282005 - protein, 18 aa, Plasmodium falciparum
KIKTWADQWKVISNKYED

SEQ ID NO: 3282006 - protein, 18 aa, Plasmodium falciparum
KKDRSVYDFLYELHLQNG

SEQ ID NO: 3282007 - protein, 23 aa, Plasmodium falciparum
KKIFIVRTLKTIKLMLIPLNSYK

SEQ ID NO: 3282008 - protein, 21 aa, Plasmodium falciparum
KLWHDNLLWQINNNLLKRFFI

SEQ ID NO: 3282009 - protein, 17 aa, Plasmodium falciparum
KMKKWYKDLKKEWIIEE

SEQ ID NO: 3282010 - protein, 27 aa, Plasmodium falciparum
KNKISDIYLLLSIQFIYNYLNTSDDDL

SEQ ID NO: 3282011 - protein, 41 aa, Plasmodium falciparum
KNKRKITSWKFCKSLILTTLGMLYIFLLKVDIGTIKNCTSK

SEQ ID NO: 3282012 - protein, 23 aa, Plasmodium falciparum
KNNFDGCLKKEVSVPRLSVSEFE

SEQ ID NO: 3282013 - protein, 23 aa, Plasmodium falciparum
KRSPNRYIPYTSGKYRGKRYIYL

SEQ ID NO: 3282014 - protein, 23 aa, Plasmodium falciparum
KSPVDLLRVLDIHKGDYGTPTPK

SEQ ID NO: 3282015 - protein, 23 aa, Plasmodium falciparum
KSSNRYIPYASDRYKGKTYIYME

SEQ ID NO: 3282016 - protein, 27 aa, Plasmodium falciparum
KVKHRPQPPLALPPPAPSGPPAEDQIE

SEQ ID NO: 3282017 - protein, 25 aa, Plasmodium falciparum
KYLLSVFLFYLIDSQLRIITFLFII

SEQ ID NO: 3282018 - protein, 24 aa, Plasmodium falciparum
KYNEPYYYDFYEYDIYYDVNDDDK

SEQ ID NO: 3282019 - protein, 24 aa, Plasmodium falciparum
KYNEPYYYDFYKDDIYYDVNDDDK

SEQ ID NO: 3282020 - protein, 25 aa, Plasmodium falciparum
LESELSHFLDTKYLFHEKKSVNELQ

SEQ ID NO: 3282021 - protein, 17 aa, Plasmodium falciparum
LEYHFIIFNFIFNKYDS

SEQ ID NO: 3282022 - protein, 26 aa, Plasmodium falciparum
LIQLFKSLRIIKIYRFVINFIKKHTK

SEQ ID NO: 3282023 - protein, 26 aa, Plasmodium falciparum
LKDSYILYYILFFGIIYLLDYAHTII

SEQ ID NO: 3282024 - protein, 18 aa, Plasmodium falciparum
LLFALPLNILIYNQRNHK

SEQ ID NO: 3282025 - protein, 19 aa, Plasmodium falciparum
LLFALPLNILIYNQRNHKS

SEQ ID NO: 3282026 - protein, 19 aa, Plasmodium falciparum
LLFALPLNILIYNQRNHNS

SEQ ID NO: 3282027 - protein, 17 aa, Plasmodium falciparum
LLFALPLNILVNNQRNH

SEQ ID NO: 3282028 - protein, 19 aa, Plasmodium falciparum
LLFALPLNILVYNQRNHYI

SEQ ID NO: 3282029 - protein, 18 aa, Plasmodium falciparum
LLFELPLNILIYNQRNHN

SEQ ID NO: 3282030 - protein, 19 aa, Plasmodium falciparum
LLFELPLNILIYNQRNHNS

SEQ ID NO: 3282031 - protein, 19 aa, Plasmodium falciparum
LLFELPLNILIYNQRNHYI

SEQ ID NO: 3282032 - protein, 20 aa, Plasmodium falciparum
LLFFFTLNILLTSYHAHNKN

SEQ ID NO: 3282033 - protein, 23 aa, Plasmodium falciparum
LLFSFTLIILLLSPSQVNNQMNH

SEQ ID NO: 3282034 - protein, 23 aa, Plasmodium falciparum
LLFSFTLIILLLSSSQVNNQMNH

SEQ ID NO: 3282035 - protein, 20 aa, Plasmodium falciparum
LLFSLPLNILEHNPWNHYMK

SEQ ID NO: 3282036 - protein, 20 aa, Plasmodium falciparum
LLFTFLINTLVLPHYENYLN

SEQ ID NO: 3282037 - protein, 17 aa, Plasmodium falciparum
LLHKWLDRHRDICENWG

SEQ ID NO: 3282038 - protein, 18 aa, Plasmodium falciparum
LLNLIFPHFTWKSFMVVI

SEQ ID NO: 3282039 - protein, 20 aa, Plasmodium falciparum
LLYILIINLICCLNGNSKKR

SEQ ID NO: 3282040 - protein, 23 aa, Plasmodium falciparum
LNQINLFHTWLDRHRDMCEKWEN

SEQ ID NO: 3282041 - protein, 24 aa, Plasmodium falciparum
LQRQKIIWRKWIAKNLYHIESNVI

SEQ ID NO: 3282042 - protein, 25 aa, Plasmodium falciparum
LSDQIIYIYYLIIKLRKYSVTSCNK

SEQ ID NO: 3282043 - protein, 23 aa, Plasmodium falciparum
LYRPIDGAIHTDINFLYSGDRHD

SEQ ID NO: 3282044 - protein, 32 aa, Plasmodium falciparum
LYVKRAPFSCFYLFYLMISRRLPKIKRINSIC

SEQ ID NO: 3282045 - protein, 23 aa, Plasmodium falciparum
MDGIYFISLFNSLFSKNTILKIK

SEQ ID NO: 3282046 - protein, 25 aa, Plasmodium falciparum
MDKKTKLKLLLFKKLILMNASLKYK

SEQ ID NO: 3282047 - protein, 23 aa, Plasmodium falciparum
MGEKPFIMSIHDRNLYTGEEISY

SEQ ID NO: 3282048 - protein, 19 aa, Plasmodium falciparum
MNQLDLLHKWLDRHRDMCE

SEQ ID NO: 3282049 - protein, 29 aa, Plasmodium falciparum
MWSVGIGFAAFTYFFLKKKTKASVGNLFQ

SEQ ID NO: 3282050 - protein, 18 aa, Plasmodium falciparum
NAMLSSTIMWSVGIGFAA

SEQ ID NO: 3282051 - protein, 35 aa, Plasmodium falciparum
NASIIAILIIVLIMVIIYLILRYRRKKKMKKKLQY

SEQ ID NO: 3282052 - protein, 25 aa, Plasmodium falciparum
NELKDPYFYAYFFDAHKKMNINKNT

SEQ ID NO: 3282053 - protein, 21 aa, Plasmodium falciparum
NGYEKIFYKKLKDSGYESVGE

SEQ ID NO: 3282054 - protein, 17 aa, Plasmodium falciparum
NHYTSIININKFFYKSF

SEQ ID NO: 3282055 - protein, 26 aa, Plasmodium falciparum
NILKTLKLRLEVFLNYIYNLCNNIYK

SEQ ID NO: 3282056 - protein, 25 aa, Plasmodium falciparum
NIREYKIFLDATKLSWRKLKEDVLN

SEQ ID NO: 3282057 - protein, 24 aa, Plasmodium falciparum
NNFIKVIQHLLFLEKQRDKYVYYI

SEQ ID NO: 3282058 - protein, 26 aa, Plasmodium falciparum
NNLLKRFFIYLITKFKYTNKNTDLCT

SEQ ID NO: 3282059 - protein, 28 aa, Plasmodium falciparum
NNYNHFFPFIIYIIKLELSLYASGEISE

SEQ ID NO: 3282060 - protein, 29 aa, Plasmodium falciparum
NPMLERQKYIWRKWIAKHLYHIDEWENEE

SEQ ID NO: 3282061 - protein, 46 aa, Plasmodium falciparum
NVLDHPAVIPALMSSTIMWSIGIGFATFTYFYLKKKTKSSVRNLFQ

SEQ ID NO: 3282062 - protein, 24 aa, Plasmodium falciparum
NVLNYFFHHIIFDSSPNSNIKAFN

SEQ ID NO: 3282063 - protein, 29 aa, Plasmodium falciparum
NVRLIRRKFLNLLSITGILLVVVLNNIII

SEQ ID NO: 3282064 - protein, 28 aa, Plasmodium falciparum
NYYKLREAWWALNRKDVWKALTCSAPRD

SEQ ID NO: 3282065 - protein, 18 aa, Plasmodium falciparum
PARPPPPPQAAQPPQPKP

SEQ ID NO: 3282066 - protein, 27 aa, Plasmodium falciparum
PDDDNIDQFLRWLTEWAQQYCKEKLIK

SEQ ID NO: 3282067 - protein, 23 aa, Plasmodium falciparum
PGVKSIPVPPLGVGVGGIPGVGA

SEQ ID NO: 3282068 - protein, 30 aa, Plasmodium falciparum
PLDDYIPQRLRWMTEWAEWYCKAQSQEYKK

SEQ ID NO: 3282069 - protein, 24 aa, Plasmodium falciparum
PLHNQLELFHKWLDRHRDMCEKWN

SEQ ID NO: 3282070 - protein, 37 aa, Plasmodium falciparum
PMVISFIVVVIIVIILLIIYLILRYRRKKKMKRKLQY

SEQ ID NO: 3282071 - protein, 31 aa, Plasmodium falciparum
PPVVDYIPQRLRWMSEWSEYFCNVLNKEIDE

SEQ ID NO: 3282072 - protein, 21 aa, Plasmodium falciparum
QAQPLTLLRPGVLGNGLQSPQ

SEQ ID NO: 3282073 - protein, 28 aa, Plasmodium falciparum
QEVIIHRLFFLLMVVKIKPLWFDITTCS

SEQ ID NO: 3282074 - protein, 18 aa, Plasmodium falciparum
QKIITLLSNIPLAGSFNT

SEQ ID NO: 3282075 - protein, 17 aa, Plasmodium falciparum
REHICTSNLEYLIHKRK

SEQ ID NO: 3282076 - protein, 19 aa, Plasmodium falciparum
RKHLEIFHKILTNTDPNDE

SEQ ID NO: 3282077 - protein, 25 aa, Plasmodium falciparum
RNKKRNFFFLLDFLKSLIDNVEIIF

SEQ ID NO: 3282078 - protein, 18 aa, Plasmodium falciparum
RRLYIKKIVDWAESQSKT

SEQ ID NO: 3282079 - protein, 28 aa, Plasmodium falciparum
RSLSFYILSLLILPFPKSPQNTSPLLIK

SEQ ID NO: 3282080 - protein, 28 aa, Plasmodium falciparum
RSNVKEIFMFFFFKNNIIIQKIITLLSN

SEQ ID NO: 3282081 - protein, 21 aa, Plasmodium falciparum
RSVYDFLYELHLQNGGKKGPP

SEQ ID NO: 3282082 - protein, 20 aa, Plasmodium falciparum
RWLEYFFEDYNRIQKKLKTC

SEQ ID NO: 3282083 - protein, 23 aa, Plasmodium falciparum
SAAIETFFAWHKYKVDKEIEEKE

SEQ ID NO: 3282084 - protein, 32 aa, Plasmodium falciparum
SADNYMLGILFILIWVYHFFWNKADASVDKEY

SEQ ID NO: 3282085 - protein, 24 aa, Plasmodium falciparum
SDKRIFSNLLTISGIFLVLVLNCI

SEQ ID NO: 3282086 - protein, 29 aa, Plasmodium falciparum
SIKIYCFFLLLVFIFYHLFSDGDFSFLLT

SEQ ID NO: 3282087 - protein, 17 aa, Plasmodium falciparum
SISLIHLLIYSIKNTNT

SEQ ID NO: 3282088 - protein, 33 aa, Plasmodium falciparum
SIVAILLIVLVMIIIYLILRYRRKKKMKKKLQY

SEQ ID NO: 3282089 - protein, 25 aa, Plasmodium falciparum
SKVRNFLETLIPRIAPKKNNGEVTE

SEQ ID NO: 3282090 - protein, 21 aa, Plasmodium falciparum
SMLQKFYVYLTKGLKIQKVSS

SEQ ID NO: 3282091 - protein, 25 aa, Plasmodium falciparum
SQEKVSYNLNKLYKGSFEELESELS

SEQ ID NO: 3282092 - protein, 54 aa, Plasmodium falciparum
SQPKRLLREFPSPELKNAMLFSTILWMVGIGFAAFTYFFLKKKPKSPVDLLRVL

SEQ ID NO: 3282093 - protein, 24 aa, Plasmodium falciparum
SVEKLTILHFLANSIKIITKYKSF

SEQ ID NO: 3282094 - protein, 24 aa, Plasmodium falciparum
SVGNLFQILQIPKSDYDIPTLKSK

SEQ ID NO: 3282095 - protein, 24 aa, Plasmodium falciparum
SVRNLFQILQIPKGDYDIPTKLSP

SEQ ID NO: 3282096 - protein, 23 aa, Plasmodium falciparum
SVVCTPFVKWIENKKLEFEKQKG

SEQ ID NO: 3282097 - protein, 18 aa, Plasmodium falciparum
SYYFIKKDKIYIAFQHIQ

SEQ ID NO: 3282098 - protein, 27 aa, Plasmodium falciparum
TDLCTYYIQFIYLITLQYNVLNYFFHH

SEQ ID NO: 3282099 - protein, 32 aa, Plasmodium falciparum
TDQVPTYFDYVPQFLRWFEEWAEDFCRKKKKK

SEQ ID NO: 3282100 - protein, 32 aa, Plasmodium falciparum
TDQVPTYFDYVPQFLRWFEEWAEDFCRKKKKY

SEQ ID NO: 3282101 - protein, 19 aa, Plasmodium falciparum
TDVECKRLFIDYEEWFRYR

SEQ ID NO: 3282102 - protein, 22 aa, Plasmodium falciparum
TISGIFLVLVLNCIIICDKSET

SEQ ID NO: 3282103 - protein, 29 aa, Plasmodium falciparum
TKLKNFVVRPTYFRWLEEWGEEFCRKQKH

SEQ ID NO: 3282104 - protein, 33 aa, Plasmodium falciparum
TLNNPKLSDFVLRPTYFRYLEEWGESFCGTRKR

SEQ ID NO: 3282105 - protein, 36 aa, Plasmodium falciparum
TPQQWLQQGHIPPDFLRLMFYTLADYRDICIGGDRD

SEQ ID NO: 3282106 - protein, 24 aa, Plasmodium falciparum
TQENNFFDIFISYVIKNLGTGDMT

SEQ ID NO: 3282107 - protein, 17 aa, Plasmodium falciparum
TRLLCECEWYAPSNYDN

SEQ ID NO: 3282108 - protein, 18 aa, Plasmodium falciparum
TSAFLTFAYVYNGSIMDS

SEQ ID NO: 3282109 - protein, 38 aa, Plasmodium falciparum
TSDILKTTIPFGIALALTSIALLFLKKKTKSSVGNLFQ

SEQ ID NO: 3282110 - protein, 28 aa, Plasmodium falciparum
TYIYTNTYILIFIYRKKPNITSGRTNLF

SEQ ID NO: 3282111 - protein, 31 aa, Plasmodium falciparum
VAILVIVLVMVIIYLILRYRRKKKMKKKLQY

SEQ ID NO: 3282112 - protein, 32 aa, Plasmodium falciparum
VDPPTYFDYVPQYLRWFEEWAEDFCRIRKHKL

SEQ ID NO: 3282113 - protein, 20 aa, Plasmodium falciparum
VGIVICLYLIIYKNSDIKWK

SEQ ID NO: 3282114 - protein, 24 aa, Plasmodium falciparum
VGQFLGRKFLPITTYFLVMRISWT

SEQ ID NO: 3282115 - protein, 32 aa, Plasmodium falciparum
VIAIVVIVLIMVIIYLILRYRRKKKMKKKLQY

SEQ ID NO: 3282116 - protein, 17 aa, Plasmodium falciparum
VIIASIVAILLIVLVMI

SEQ ID NO: 3282117 - protein, 27 aa, Plasmodium falciparum
VITIKNIIMFFKRFKGYFKLCRKNMYE

SEQ ID NO: 3282118 - protein, 30 aa, Plasmodium falciparum
VLICIAVILLIIYLILRYRRKKQMNKKLKY

SEQ ID NO: 3282119 - protein, 31 aa, Plasmodium falciparum
VLTNLDYVPQFLRWFEEWAEEFCRIKKIKLG

SEQ ID NO: 3282120 - protein, 29 aa, Plasmodium falciparum
VMCVECLYKFLFKKYPLYKKYLLFKSINN

SEQ ID NO: 3282121 - protein, 32 aa, Plasmodium falciparum
VTVILIIVLVMIIIYLILLYGRKKKMNKKLQY

SEQ ID NO: 3282122 - protein, 29 aa, Plasmodium falciparum
WEKQWKTVSAIYQILYAKARIVASNGGPG

SEQ ID NO: 3282123 - protein, 28 aa, Plasmodium falciparum
YFCEDNIFNHFIYLLKQKINKNIRIQIY

SEQ ID NO: 3282124 - protein, 22 aa, Plasmodium falciparum
YIFFILFHTFILSNTNIPRTNN

SEQ ID NO: 3282125 - protein, 24 aa, Plasmodium falciparum
YNYLFNFNCFTLNVLNFYNHNISV

SEQ ID NO: 3282126 - protein, 25 aa, Plasmodium falciparum
YTSGKYRGKRYIYLEGDSGTDSGYT

SEQ ID NO: 3282127 - protein, 15 aa, Plasmodium falciparum
KNYYIFNIYLLIFFF

SEQ ID NO: 3282128 - protein, 21 aa, Plasmodium falciparum
MIIIFKIFTILDYIKNNNHEK

SEQ ID NO: 3282129 - protein, 28 aa, Plasmodium falciparum
IWIILNLQMNLLIWIHTRTNILWILLII

SEQ ID NO: 3282130 - protein, 27 aa, Plasmodium falciparum
AADIYMLGILFIWISSNRYLWGNFDMS

SEQ ID NO: 3282131 - protein, 29 aa, Plasmodium falciparum
AAEASKYLFFYFFTNLYLDAYKSFPGGFG

SEQ ID NO: 3282132 - protein, 26 aa, Plasmodium falciparum
AAERTFLHYMLVSLYINILTLFLEKY

SEQ ID NO: 3282133 - protein, 24 aa, Plasmodium falciparum
AAFDFHLMIVDRYDALMLQNSEDR

SEQ ID NO: 3282134 - protein, 27 aa, Plasmodium falciparum
AAFPPYGIAALVLLILAVALIILYIWL

SEQ ID NO: 3282135 - protein, 22 aa, Plasmodium falciparum
AAIAPWWGLVCGSGYAGWLHSA

SEQ ID NO: 3282136 - protein, 20 aa, Plasmodium falciparum
AAIETFFSWHKFKKDKEKKK

SEQ ID NO: 3282137 - protein, 20 aa, Plasmodium falciparum
AAIFIGMVNVFLECKRLYGR

SEQ ID NO: 3282138 - protein, 20 aa, Plasmodium falciparum
AAILYLMKSLKNGEDPIYIC

SEQ ID NO: 3282139 - protein, 20 aa, Plasmodium falciparum
AAKEYEYIIKYYTTFKYLQT

SEQ ID NO: 3282140 - protein, 20 aa, Plasmodium falciparum
AALAIIGTAVAITSSTYCAI

SEQ ID NO: 3282141 - protein, 24 aa, Plasmodium falciparum
AANYEAQSLIPYHDKYKLTYGDSK

SEQ ID NO: 3282142 - protein, 30 aa, Plasmodium falciparum
AAQLFLNIYMFMKFIKLIKLIKKNDLSVQN

SEQ ID NO: 3282143 - protein, 25 aa, Plasmodium falciparum
AARIYRYIVILLIHNLKNTNLKYET

SEQ ID NO: 3282144 - protein, 29 aa, Plasmodium falciparum
AASTLIIMWIVLFIYLLNEKAYKSYSPLG

SEQ ID NO: 3282145 - protein, 43 aa, Plasmodium falciparum
AATIQLYFLFLLLFMFLLRIVLLIILYIWLYRRRKNSWKHECK

SEQ ID NO: 3282146 - protein, 19 aa, Plasmodium falciparum
ACAPFRRQNLCDKNLEYLI

SEQ ID NO: 3282147 - protein, 19 aa, Plasmodium falciparum
ACAPYRRLHICDHNLENIN

SEQ ID NO: 3282148 - protein, 23 aa, Plasmodium falciparum
ACAPYRRLHLCHHNLESIETTSK

SEQ ID NO: 3282149 - protein, 20 aa, Plasmodium falciparum
ACAPYRRLHLCNKNFPNMNS

SEQ ID NO: 3282150 - protein, 19 aa, Plasmodium falciparum
ACAPYRRLHLCSHNLESIQ

SEQ ID NO: 3282151 - protein, 17 aa, Plasmodium falciparum
ACAPYRRLHVCDKNMEK

SEQ ID NO: 3282152 - protein, 17 aa, Plasmodium falciparum
ACAPYRRLSLCNKNFPN

SEQ ID NO: 3282153 - protein, 18 aa, Plasmodium falciparum
ACAPYRRLYLCDKNLETI

SEQ ID NO: 3282154 - protein, 18 aa, Plasmodium falciparum
ACFLLFSAFLSEVSVHSK

SEQ ID NO: 3282155 - protein, 26 aa, Plasmodium falciparum
ACIDCCNILYYLKKLNYVNKDLINII

SEQ ID NO: 3282156 - protein, 38 aa, Plasmodium falciparum
ACIKNAIHIFLNPNYIYLIFFILSKIKYEYLFDSNTNN

SEQ ID NO: 3282157 - protein, 18 aa, Plasmodium falciparum
ACKNYSNFILIKKKEYQS

SEQ ID NO: 3282158 - protein, 17 aa, Plasmodium falciparum
ACKYRLKNNYLPQTSLV

SEQ ID NO: 3282159 - protein, 20 aa, Plasmodium falciparum
ACLYYKKRKIQFLKNRKISL

SEQ ID NO: 3282160 - protein, 25 aa, Plasmodium falciparum
ACNSNFHIIFFNVFNIFFEKKKNKL

SEQ ID NO: 3282161 - protein, 19 aa, Plasmodium falciparum
ACTLKYGTPNRYWGWKCIG

SEQ ID NO: 3282162 - protein, 21 aa, Plasmodium falciparum
ACYYKQMILLSYKKITESISK

SEQ ID NO: 3282163 - protein, 25 aa, Plasmodium falciparum
ADDLVYHILYPMKYISKKKDLLSNS

SEQ ID NO: 3282164 - protein, 44 aa, Plasmodium falciparum
ADEPFNRDILATTIPFGIAFALGSIAFLFLKKKTKSTIDLLRVI

SEQ ID NO: 3282165 - protein, 25 aa, Plasmodium falciparum
ADIDALFFIDLLSYILQIIGGNILY

SEQ ID NO: 3282166 - protein, 24 aa, Plasmodium falciparum
ADKDPTFVIIIIGVGFAVSSIPEG

SEQ ID NO: 3282167 - protein, 27 aa, Plasmodium falciparum
ADKYMLGILFIWIWNDGHIWHCSDAST

SEQ ID NO: 3282168 - protein, 26 aa, Plasmodium falciparum
ADNVDILYQILLPYLNNSFLTNNWNI

SEQ ID NO: 3282169 - protein, 21 aa, Plasmodium falciparum
ADVVLIMLLYLNSANELSEKG

SEQ ID NO: 3282170 - protein, 17 aa, Plasmodium falciparum
ADWWTLGIFIYEILVGC

SEQ ID NO: 3282171 - protein, 22 aa, Plasmodium falciparum
ADYIEHAFDFFKDLGITSYLFR

SEQ ID NO: 3282172 - protein, 32 aa, Plasmodium falciparum
ADYKEDIINFFIYLIHLLYEKKKNAEAQFLLL

SEQ ID NO: 3282173 - protein, 20 aa, Plasmodium falciparum
ADYLPLYFSDILRPFIVINN

SEQ ID NO: 3282174 - protein, 24 aa, Plasmodium falciparum
AEAASSFFFFLGFFLSLYILFYSS

SEQ ID NO: 3282175 - protein, 20 aa, Plasmodium falciparum
AEENVWIEKEVEEEGLDNEE

SEQ ID NO: 3282176 - protein, 26 aa, Plasmodium falciparum
AEGCKWKYGKMPLGLGWLCNDKEGEK

SEQ ID NO: 3282177 - protein, 39 aa, Plasmodium falciparum
AEGNNLPYFYFIPTLFFIFTIIFSFIFFLAIKSYIKRNK

SEQ ID NO: 3282178 - protein, 26 aa, Plasmodium falciparum
AEGTIYVWFDALLSYVSSMLYLHKIK

SEQ ID NO: 3282179 - protein, 26 aa, Plasmodium falciparum
AEISRNDLIFLYKKYLLQFMENEDVE

SEQ ID NO: 3282180 - protein, 34 aa, Plasmodium falciparum
AELNLVHYLFDRKNIILNIITRVAFKNYCHYIQQ

SEQ ID NO: 3282181 - protein, 22 aa, Plasmodium falciparum
AENFIIYKVPKYLKKKNIKCPF

SEQ ID NO: 3282182 - protein, 31 aa, Plasmodium falciparum
AENKTFKFVVYIKDNILTLKWKVYETGVTNN

SEQ ID NO: 3282183 - protein, 25 aa, Plasmodium falciparum
AENYLNFLQMNLLNLKKLFDDLDIN

SEQ ID NO: 3282184 - protein, 28 aa, Plasmodium falciparum
AENYVRSFLFFFIFYHDLIYIEIIKLCV

SEQ ID NO: 3282185 - protein, 36 aa, Plasmodium falciparum
AEPFDIYHLMFICKVFWYIFLYADNFVILRSTLFKN

SEQ ID NO: 3282186 - protein, 28 aa, Plasmodium falciparum
AESDTRYVWYSFFFFVSICVYITMRRLG

SEQ ID NO: 3282187 - protein, 26 aa, Plasmodium falciparum
AETFLKYFTSGYLLNEIILMKGQNEM

SEQ ID NO: 3282188 - protein, 28 aa, Plasmodium falciparum
AFAIIIILLILGTWMLVTWLWQHKEVYN

SEQ ID NO: 3282189 - protein, 21 aa, Plasmodium falciparum
AFAYLFIFIAINFTSTFLSAR

SEQ ID NO: 3282190 - protein, 18 aa, Plasmodium falciparum
AFDTFFFNNILYESLDDI

SEQ ID NO: 3282191 - protein, 20 aa, Plasmodium falciparum
AFDVLILQDISIVIQIVLFF

SEQ ID NO: 3282192 - protein, 31 aa, Plasmodium falciparum
AFEQKKIFFLFRFGCIVLWDFNIKEKEILFM

SEQ ID NO: 3282193 - protein, 28 aa, Plasmodium falciparum
AFFICKFLFFYYIYKKPILPFDSLKCKI

SEQ ID NO: 3282194 - protein, 28 aa, Plasmodium falciparum
AFGMGCIGGYIWHFLKGARNSPKGDVLS

SEQ ID NO: 3282195 - protein, 17 aa, Plasmodium falciparum
AFHFLKQNKINLGNLID

SEQ ID NO: 3282196 - protein, 31 aa, Plasmodium falciparum
AFIESAAVETFFLWDRYKKENTKRQSVLPLL

SEQ ID NO: 3282197 - protein, 30 aa, Plasmodium falciparum
AFIESAAVETFFLWHRYKKIKDKEKLEEQQ

SEQ ID NO: 3282198 - protein, 19 aa, Plasmodium falciparum
AFIIVLVTVLCVFVSVPNG

SEQ ID NO: 3282199 - protein, 29 aa, Plasmodium falciparum
AFIQSAAIETFFLWHKYKQEKKPPSEQNA

SEQ ID NO: 3282200 - protein, 30 aa, Plasmodium falciparum
AFIQSAAIETFFLWHRYKKIKEKEKKEKQE

SEQ ID NO: 3282201 - protein, 31 aa, Plasmodium falciparum
AFIQSAAVETFFLWDRYKKLNTKKPDATLGG

SEQ ID NO: 3282202 - protein, 30 aa, Plasmodium falciparum
AFIQSAAVETFFLWHRYKKEWELRQKEAEQ

SEQ ID NO: 3282203 - protein, 18 aa, Plasmodium falciparum
AFISILCPLLLSIRKLRN

SEQ ID NO: 3282204 - protein, 17 aa, Plasmodium falciparum
AFKYFFNNIICLCNDNS

SEQ ID NO: 3282205 - protein, 34 aa, Plasmodium falciparum
AFLLSIIHIFINYFFYIYLYVFNINIYVSNVYTI

SEQ ID NO: 3282206 - protein, 25 aa, Plasmodium falciparum
AFLNISFLFYYINICLYIDPSRKSK

SEQ ID NO: 3282207 - protein, 18 aa, Plasmodium falciparum
AFLTKYYPGISPKLYKVL

SEQ ID NO: 3282208 - protein, 23 aa, Plasmodium falciparum
AFLVLHALLYMKYKKNFKLSGLF

SEQ ID NO: 3282209 - protein, 28 aa, Plasmodium falciparum
AFLYIKKLMKDLKKYKLWNNYSVIPHVN

SEQ ID NO: 3282210 - protein, 18 aa, Plasmodium falciparum
AFNNQFYNYIYYEDYLRD

SEQ ID NO: 3282211 - protein, 25 aa, Plasmodium falciparum
AFRLFHYIFLFILSSGVILIHVLPE

SEQ ID NO: 3282212 - protein, 24 aa, Plasmodium falciparum
AFSMITLILNYINKYIFKKSDILK

SEQ ID NO: 3282213 - protein, 18 aa, Plasmodium falciparum
AFSVIKWIHLNNGDEHLI

SEQ ID NO: 3282214 - protein, 18 aa, Plasmodium falciparum
AFSYLFMTIGFIGMFVFY

SEQ ID NO: 3282215 - protein, 24 aa, Plasmodium falciparum
AFTYLQNCHFILGNELLLDAVQIC

SEQ ID NO: 3282216 - protein, 28 aa, Plasmodium falciparum
AFVESAAIETFFLWDRYKKEKEKEKEDI

SEQ ID NO: 3282217 - protein, 29 aa, Plasmodium falciparum
AFVESAAIETFFLWDRYKKEWEAQKKAEQ

SEQ ID NO: 3282218 - protein, 29 aa, Plasmodium falciparum
AFVESAAVETFFLWHKYKTVKQKELDEKK

SEQ ID NO: 3282219 - protein, 21 aa, Plasmodium falciparum
AFYDKLRTIYRTNDKFFEILN

SEQ ID NO: 3282220 - protein, 17 aa, Plasmodium falciparum
AFYIFLEIIILSLEFLL

SEQ ID NO: 3282221 - protein, 37 aa, Plasmodium falciparum
AFYMSSFQRYIYVFIAFVFLMLLFNVPSIEENTYSRD

SEQ ID NO: 3282222 - protein, 31 aa, Plasmodium falciparum
AGEVPTYFDYVPQYLRWFEEWAEDFCRKKKK

SEQ ID NO: 3282223 - protein, 29 aa, Plasmodium falciparum
AGGAFVGLGYVLLGWYILSCLKAQKKWTR

SEQ ID NO: 3282224 - protein, 30 aa, Plasmodium falciparum
AGGTGMTPFFRLINHLLLTKEKELPSDPVY

SEQ ID NO: 3282225 - protein, 24 aa, Plasmodium falciparum
AGKFLTMFIIITCISFVAAQFKRL

SEQ ID NO: 3282226 - protein, 39 aa, Plasmodium falciparum
AGKGFSNMYYFAGGGLFFIILFLLGAKSSILNWSEDNEL

SEQ ID NO: 3282227 - protein, 23 aa, Plasmodium falciparum
AGPQLQTLPSIDGALSPSGTLEP

SEQ ID NO: 3282228 - protein, 24 aa, Plasmodium falciparum
AGTCLFARIFIGIFVVLFVVFSII

SEQ ID NO: 3282229 - protein, 33 aa, Plasmodium falciparum
AGYDSLLTCLLFIFQCHYILKKNNLMWKDIYFS

SEQ ID NO: 3282230 - protein, 20 aa, Plasmodium falciparum
AHFFFIFHNGKKYYDPKYLL

SEQ ID NO: 3282231 - protein, 22 aa, Plasmodium falciparum
AHIFKAFREDVWTCGKVCGYNV

SEQ ID NO: 3282232 - protein, 22 aa, Plasmodium falciparum
AHIKNKLLLNAIRKYKKHNNHK

SEQ ID NO: 3282233 - protein, 36 aa, Plasmodium falciparum
AHIYKFDFFFYKTSICLLLKRLTLTYFYKLQEYFKL

SEQ ID NO: 3282234 - protein, 24 aa, Plasmodium falciparum
AHLCILRCLYIFSTRLYELYPKIH

SEQ ID NO: 3282235 - protein, 18 aa, Plasmodium falciparum
AHTLKKIQNYLKLQKLHN

SEQ ID NO: 3282236 - protein, 25 aa, Plasmodium falciparum
AHTYISFLGIQYFYLTYKKFNEQQH

SEQ ID NO: 3282237 - protein, 21 aa, Plasmodium falciparum
AHWMIDTFVRHPLCPSKIRSC

SEQ ID NO: 3282238 - protein, 22 aa, Plasmodium falciparum
AIAALFIYPLEIVKTRLIVSNK

SEQ ID NO: 3282239 - protein, 32 aa, Plasmodium falciparum
AIAILVIVIIMVIIYLILRYRRKQKIKKKLQY

SEQ ID NO: 3282240 - protein, 23 aa, Plasmodium falciparum
AIFFEWLIFFVGIIIRIIIYYYG

SEQ ID NO: 3282241 - protein, 38 aa, Plasmodium falciparum
AIGYSVLAIFIIVLVMVIIYLFLRYRRKKKMNKKLQYT

SEQ ID NO: 3282242 - protein, 19 aa, Plasmodium falciparum
AIIFTIFSLILYITINYLN

SEQ ID NO: 3282243 - protein, 30 aa, Plasmodium falciparum
AIIIIALVMIIIYLVLRYRRKKKMKKKLQY

SEQ ID NO: 3282244 - protein, 30 aa, Plasmodium falciparum
AIIIIVILVIILLVYLYYVIKKSGILENEH

SEQ ID NO: 3282245 - protein, 26 aa, Plasmodium falciparum
AIIRSMAQFILYKFIKIKGTSHLNPF

SEQ ID NO: 3282246 - protein, 28 aa, Plasmodium falciparum
AIIVLTIIVIILYVWLRKRRKNSWKHEC

SEQ ID NO: 3282247 - protein, 22 aa, Plasmodium falciparum
AIIYTPILLSTFIENVNLQKSL

SEQ ID NO: 3282248 - protein, 20 aa, Plasmodium falciparum
AILVYSLFLTVYIFSEINHG

SEQ ID NO: 3282249 - protein, 27 aa, Plasmodium falciparum
AINFLFLYIINFCLLHYLKECNTSNYS

SEQ ID NO: 3282250 - protein, 25 aa, Plasmodium falciparum
AINIMPHYIYKLILLKDNQKDKDKD

SEQ ID NO: 3282251 - protein, 23 aa, Plasmodium falciparum
AINIWLKILISKPMDDIWFKNII

SEQ ID NO: 3282252 - protein, 28 aa, Plasmodium falciparum
AINNISNVLFFLRPYFYEIKNIFEIIDK

SEQ ID NO: 3282253 - protein, 25 aa, Plasmodium falciparum
AINSHLFHHLTIKIFFSIKDYLRCT

SEQ ID NO: 3282254 - protein, 29 aa, Plasmodium falciparum
AIQLILGLYVLFMFLFVNIKQCYGKNINN

SEQ ID NO: 3282255 - protein, 21 aa, Plasmodium falciparum
AISHSSFVLMYPYLIKYLSHD

SEQ ID NO: 3282256 - protein, 18 aa, Plasmodium falciparum
AISYLLYCHIIWNGCYNI

SEQ ID NO: 3282257 - protein, 29 aa, Plasmodium falciparum
AITPIMLQYFYFFPSFIPSIITTLSEMPK

SEQ ID NO: 3282258 - protein, 25 aa, Plasmodium falciparum
AITRKYYYYIKIYGLDLYGTNIMDK

SEQ ID NO: 3282259 - protein, 26 aa, Plasmodium falciparum
AITVILIILYIWLYRRRKNSWKHECK

SEQ ID NO: 3282260 - protein, 30 aa, Plasmodium falciparum
AIVIIVMVMVIIYLILRYRRKKKLKKKLQY

SEQ ID NO: 3282261 - protein, 31 aa, Plasmodium falciparum
AIVPSLIIFIIFYIIYYWKDKNWSNSKKKIC

SEQ ID NO: 3282262 - protein, 27 aa, Plasmodium falciparum
AIVVIILIMVIIYKILRYRRKKKMKKK

SEQ ID NO: 3282263 - protein, 30 aa, Plasmodium falciparum
AIVVIILVMLIIYFILRYRRKKKITKKLQY

SEQ ID NO: 3282264 - protein, 30 aa, Plasmodium falciparum
AIVVIILVMVIIYLILRYRRKKKMKKKLQY

SEQ ID NO: 3282265 - protein, 30 aa, Plasmodium falciparum
AIVVIVLIMIIIYLILRYRRKKKMKKKLQY

SEQ ID NO: 3282266 - protein, 31 aa, Plasmodium falciparum
AIVVIVLIMIIIYLILRYRRKRKMTKKMQFM

SEQ ID NO: 3282267 - protein, 28 aa, Plasmodium falciparum
AIVVIVLIMVIIYKILRYRRKKKMKKKL

SEQ ID NO: 3282268 - protein, 30 aa, Plasmodium falciparum
AIVVIVLVMIIIYLILRYRRKKKMKKKLQY

SEQ ID NO: 3282269 - protein, 28 aa, Plasmodium falciparum
AIVVIVLVMVIIYLILRYGRKKKMKKKL

SEQ ID NO: 3282270 - protein, 31 aa, Plasmodium falciparum
AIVVIVLVMVIIYLILRYLRKSKMKKKLHYI

SEQ ID NO: 3282271 - protein, 25 aa, Plasmodium falciparum
AIYIIHIFINKWHIFKLLLHKQNKK

SEQ ID NO: 3282272 - protein, 27 aa, Plasmodium falciparum
AIYLFCYIFLIHYLCYTFKIDNIPIKN

SEQ ID NO: 3282273 - protein, 17 aa, Plasmodium falciparum
AIYMYMRLIGYPNDVIT

SEQ ID NO: 3282274 - protein, 40 aa, Plasmodium falciparum
AIYPCGIAALVLLILTVVLIILYIWLYRRRKNSWKHECKK

SEQ ID NO: 3282275 - protein, 40 aa, Plasmodium falciparum
AIYPCGIAALVLLILTVVLIILYIWLYRRRKRSWKHECKK

SEQ ID NO: 3282276 - protein, 17 aa, Plasmodium falciparum
AKDDTFLFLNKRMLCVY

SEQ ID NO: 3282277 - protein, 37 aa, Plasmodium falciparum
AKDHKPLLAWLLQYPIPLAFIPYFLFAFGLSFAFHHI

SEQ ID NO: 3282278 - protein, 25 aa, Plasmodium falciparum
AKDYQLEHEPPTKLPEYEKGHVSRE

SEQ ID NO: 3282279 - protein, 22 aa, Plasmodium falciparum
AKELMECFLKWKNKNYISKNWT

SEQ ID NO: 3282280 - protein, 24 aa, Plasmodium falciparum
AKEMHNLWNQLRGIERFLFEDTVS

SEQ ID NO: 3282281 - protein, 28 aa, Plasmodium falciparum
AKEMYDKFYYFLLIQNLHIDKNIPYLYI

SEQ ID NO: 3282282 - protein, 26 aa, Plasmodium falciparum
AKFHQPLLEAAKYVWYAPSNPCNFDF

SEQ ID NO: 3282283 - protein, 17 aa, Plasmodium falciparum
AKFKSPHGIIYRGHIKN

SEQ ID NO: 3282284 - protein, 20 aa, Plasmodium falciparum
AKFNDIFDFLINWASKKSSS

SEQ ID NO: 3282285 - protein, 22 aa, Plasmodium falciparum
AKHIWHGMICALTYDTNTASGD

SEQ ID NO: 3282286 - protein, 26 aa, Plasmodium falciparum
AKIFIIEFLKCYIYFSPYLKTIENKK

SEQ ID NO: 3282287 - protein, 22 aa, Plasmodium falciparum
AKIFIMMYTYLDNKEKVIYDII

SEQ ID NO: 3282288 - protein, 17 aa, Plasmodium falciparum
AKKPYIVGIISFFSWVV

SEQ ID NO: 3282289 - protein, 28 aa, Plasmodium falciparum
AKKTKVYIFFFSLYLTLLLITTYPNESI

SEQ ID NO: 3282290 - protein, 23 aa, Plasmodium falciparum
AKLLLLYFIFFFIHFVINLFNNF

SEQ ID NO: 3282291 - protein, 22 aa, Plasmodium falciparum
AKNEKFLSLLQLNLKGKKKEKN

SEQ ID NO: 3282292 - protein, 23 aa, Plasmodium falciparum
AKNFWDPAFIYKVVKLESNNVCF

SEQ ID NO: 3282293 - protein, 52 aa, Plasmodium falciparum
AKNNILDILYYLLLTNCVNFLLIFTITYLYMNKIYYIYMYSKHVHLKEMKKE

SEQ ID NO: 3282294 - protein, 24 aa, Plasmodium falciparum
AKPFFLRFFVARIFFKIIPYLEGL

SEQ ID NO: 3282295 - protein, 25 aa, Plasmodium falciparum
AKPGDILYLLGVKRKNKKYLYVDQD

SEQ ID NO: 3282296 - protein, 18 aa, Plasmodium falciparum
AKVPIIHFYCNNREKSFE

SEQ ID NO: 3282297 - protein, 17 aa, Plasmodium falciparum
AKYEAESLIPYHDQYKL

SEQ ID NO: 3282298 - protein, 17 aa, Plasmodium falciparum
AKYFKIDVYKKGKLLYP

SEQ ID NO: 3282299 - protein, 27 aa, Plasmodium falciparum
AKYFYQKKSFFLLDKKPHFIFNQFSYV

SEQ ID NO: 3282300 - protein, 19 aa, Plasmodium falciparum
ALADCVIVNLWYHSLGNFT

SEQ ID NO: 3282301 - protein, 23 aa, Plasmodium falciparum
ALAFFSLAILKFSYVWYIFFFLL

SEQ ID NO: 3282302 - protein, 32 aa, Plasmodium falciparum
ALAIFGICSLLLLVNILYPTLAFSKYPLLIVG

SEQ ID NO: 3282303 - protein, 24 aa, Plasmodium falciparum
ALEALNYISFLNSKILIIYNDNGQ

SEQ ID NO: 3282304 - protein, 21 aa, Plasmodium falciparum
ALEIFYFLRIYCINISSEQII

SEQ ID NO: 3282305 - protein, 19 aa, Plasmodium falciparum
ALEKAKFLFLKIPNTFNLN

SEQ ID NO: 3282306 - protein, 22 aa, Plasmodium falciparum
ALEKQINILFPNGVRKIPNEKT

SEQ ID NO: 3282307 - protein, 23 aa, Plasmodium falciparum
ALFFKEDISIYYFLSASYLKRGD

SEQ ID NO: 3282308 - protein, 18 aa, Plasmodium falciparum
ALFIYRKNGKCLEKRILK

SEQ ID NO: 3282309 - protein, 18 aa, Plasmodium falciparum
ALFNPLMDFFKLYLNKDD

SEQ ID NO: 3282310 - protein, 24 aa, Plasmodium falciparum
ALGLGLYWLLCAFICFVVTFYIFV

SEQ ID NO: 3282311 - protein, 26 aa, Plasmodium falciparum
ALGPAIIFQYLVQGIFHPSRKVREIY

SEQ ID NO: 3282312 - protein, 24 aa, Plasmodium falciparum
ALHGSPIPRRRFSRSYPLNTTTTL

SEQ ID NO: 3282313 - protein, 44 aa, Plasmodium falciparum
ALHLPLLILVFKEYFFRFFSHIFYFICTYPYYIIRKTMAYNFYD

SEQ ID NO: 3282314 - protein, 23 aa, Plasmodium falciparum
ALHPSTIPGLLEVGWKKETREIT

SEQ ID NO: 3282315 - protein, 21 aa, Plasmodium falciparum
ALIKGFQKYVLFLKKYSSIMK

SEQ ID NO: 3282316 - protein, 22 aa, Plasmodium falciparum
ALKEVLNLMFHLILGGDFGSTW

SEQ ID NO: 3282317 - protein, 26 aa, Plasmodium falciparum
ALKQEKFLLEYAFLSLNGKLCERKKF

SEQ ID NO: 3282318 - protein, 18 aa, Plasmodium falciparum
ALKQLSILFCILNSYLSF

SEQ ID NO: 3282319 - protein, 24 aa, Plasmodium falciparum
ALLFFYILLIKGYYGRTESKNILN

SEQ ID NO: 3282320 - protein, 20 aa, Plasmodium falciparum
ALLHSPFCEIKLKDISEYIR

SEQ ID NO: 3282321 - protein, 17 aa, Plasmodium falciparum
ALLIIIMYGLMFAFEFS

SEQ ID NO: 3282322 - protein, 18 aa, Plasmodium falciparum
ALLRKQRVLYEEKGDVVL

SEQ ID NO: 3282323 - protein, 17 aa, Plasmodium falciparum
ALLVLLIKICQLSCQRT

SEQ ID NO: 3282324 - protein, 25 aa, Plasmodium falciparum
ALNMAIQFIMQYSSNAWSIFVVYLL

SEQ ID NO: 3282325 - protein, 18 aa, Plasmodium falciparum
ALQIYDYVTHRKCGYYKD

SEQ ID NO: 3282326 - protein, 20 aa, Plasmodium falciparum
ALQQLWENNKKYVWYVMLCG

SEQ ID NO: 3282327 - protein, 23 aa, Plasmodium falciparum
ALQVGILGILFYYTFMYRQEQSP

SEQ ID NO: 3282328 - protein, 32 aa, Plasmodium falciparum
ALRLNNFYLLYVYLQDIWYIFFHYVISLKRKI

SEQ ID NO: 3282329 - protein, 28 aa, Plasmodium falciparum
ALSFFLSVLFMMMFLCLNILLINMIKFN

SEQ ID NO: 3282330 - protein, 18 aa, Plasmodium falciparum
ALSLLRNKKNRTPKIVIS

SEQ ID NO: 3282331 - protein, 20 aa, Plasmodium falciparum
ALSMMEFPVLPMLYIKYYIH

SEQ ID NO: 3282332 - protein, 27 aa, Plasmodium falciparum
ALTILILFILLMILLYKIFIKNKYENC

SEQ ID NO: 3282333 - protein, 19 aa, Plasmodium falciparum
ALTTYLFLGALGPEMVNRI

SEQ ID NO: 3282334 - protein, 21 aa, Plasmodium falciparum
ALVYLKFGYINRALQIFLKLN

SEQ ID NO: 3282335 - protein, 18 aa, Plasmodium falciparum
ALYEQTFPSFLTLPNEYK

SEQ ID NO: 3282336 - protein, 28 aa, Plasmodium falciparum
ALYPAFILLIFIIYIYARYFPEMKIGYK

SEQ ID NO: 3282337 - protein, 23 aa, Plasmodium falciparum
AMCRAIRYSFADLGDIIRGRDMW

SEQ ID NO: 3282338 - protein, 24 aa, Plasmodium falciparum
AMHVYWFFLILKMSRLFIIKTMKN

SEQ ID NO: 3282339 - protein, 39 aa, Plasmodium falciparum
AMNIFSNNFLFLYLYVYYIIHYFSLYDILFIWERKNTKK

SEQ ID NO: 3282340 - protein, 22 aa, Plasmodium falciparum
AMNLNINILQTLNIGINACNTN

SEQ ID NO: 3282341 - protein, 24 aa, Plasmodium falciparum
AMSIVFYIFYIKFDISYLKLILTD

SEQ ID NO: 3282342 - protein, 25 aa, Plasmodium falciparum
ANDGGRIFLFILQLINLNDGDVVYI

SEQ ID NO: 3282343 - protein, 25 aa, Plasmodium falciparum
ANDTSPLYFTKKSSILLFQFKCLDP

SEQ ID NO: 3282344 - protein, 22 aa, Plasmodium falciparum
ANEEKIFLNIYVERSFISHNDV

SEQ ID NO: 3282345 - protein, 22 aa, Plasmodium falciparum
ANFFCIFISYLLLTHIENKQLK

SEQ ID NO: 3282346 - protein, 28 aa, Plasmodium falciparum
ANFYKLREDWWYANRQQVWYAITCGAEG

SEQ ID NO: 3282347 - protein, 24 aa, Plasmodium falciparum
ANGEHIWKGMIYALTYKDNGEKKI

SEQ ID NO: 3282348 - protein, 36 aa, Plasmodium falciparum
ANGKNQIIFIRALFKIWLEYFLKDYNKINAKISYCK

SEQ ID NO: 3282349 - protein, 29 aa, Plasmodium falciparum
ANGKNYDQIILIRALFKRWVENFFDDYKK

SEQ ID NO: 3282350 - protein, 25 aa, Plasmodium falciparum
ANIHFDYLFIIRFLKEKRKEMFIPH

SEQ ID NO: 3282351 - protein, 23 aa, Plasmodium falciparum
ANIKFMFPSLYALNICSLNMLMN

SEQ ID NO: 3282352 - protein, 25 aa, Plasmodium falciparum
ANITNFILKIFLISSNQILLYYYKN

SEQ ID NO: 3282353 - protein, 32 aa, Plasmodium falciparum
ANIVPTYFDYVPQYLRWFEEWAEDFCRKRKYK

SEQ ID NO: 3282354 - protein, 26 aa, Plasmodium falciparum
ANIYKYIYFFIVHFIHKFDIYNLCQA

SEQ ID NO: 3282355 - protein, 27 aa, Plasmodium falciparum
ANKNYAFYFIIKFLINKKITSNCTAIL

SEQ ID NO: 3282356 - protein, 44 aa, Plasmodium falciparum
ANKSPISIIKINSIKALWFNITPQLINLLFLFVPVFSEKVSNGL

SEQ ID NO: 3282357 - protein, 17 aa, Plasmodium falciparum
ANKYIWLTLINSKNYNT

SEQ ID NO: 3282358 - protein, 27 aa, Plasmodium falciparum
ANLIQPKNALFPLRINNKILNFFVNNF

SEQ ID NO: 3282359 - protein, 23 aa, Plasmodium falciparum
ANLNQYLLWFSQSGTPHVSFKYN

SEQ ID NO: 3282360 - protein, 27 aa, Plasmodium falciparum
ANMEPRHFLHIFYILVKNTYRDLNKLL

SEQ ID NO: 3282361 - protein, 25 aa, Plasmodium falciparum
ANQMASLTMIFYALNNMVKLITKND

SEQ ID NO: 3282362 - protein, 19 aa, Plasmodium falciparum
ANRAKVWEAMQCPTIPPVT

SEQ ID NO: 3282363 - protein, 27 aa, Plasmodium falciparum
ANYEKCYIVILYLPIRKLIDTFHTLNE

SEQ ID NO: 3282364 - protein, 30 aa, Plasmodium falciparum
ANYLFNNIFKEHFFLDLQFLPNNQLNKKNK

SEQ ID NO: 3282365 - protein, 20 aa, Plasmodium falciparum
APAFNIFSNLLLPASMVGFV

SEQ ID NO: 3282366 - protein, 25 aa, Plasmodium falciparum
APAWGLISGLWYATWSQYVSAKILE

SEQ ID NO: 3282367 - protein, 28 aa, Plasmodium falciparum
APDFYQLREDWWALNRQDVWKAITCDAH

SEQ ID NO: 3282368 - protein, 18 aa, Plasmodium falciparum
APEIIKGFNYSILSDMWS

SEQ ID NO: 3282369 - protein, 21 aa, Plasmodium falciparum
APILKLVILKDIFLNKKKKNI

SEQ ID NO: 3282370 - protein, 19 aa, Plasmodium falciparum
APIYIPMYVIHKPTCQHTC

SEQ ID NO: 3282371 - protein, 22 aa, Plasmodium falciparum
APKYKTLIEVILEPSKRDTQND

SEQ ID NO: 3282372 - protein, 25 aa, Plasmodium falciparum
APNLINCFSEFINWCDNNLIQIKLQ

SEQ ID NO: 3282373 - protein, 18 aa, Plasmodium falciparum
APRWFNIYYNPQNQIMPR

SEQ ID NO: 3282374 - protein, 25 aa, Plasmodium falciparum
APTSPPRPPLVTSTLAWSVGIGFAA

SEQ ID NO: 3282375 - protein, 22 aa, Plasmodium falciparum
APYRRLHVCVRNLENINDYSKI

SEQ ID NO: 3282376 - protein, 18 aa, Plasmodium falciparum
AQGLLYMGKGLLTINPLH

SEQ ID NO: 3282377 - protein, 24 aa, Plasmodium falciparum
AQNTLEKFGIFKKVNILKKSRDAE

SEQ ID NO: 3282378 - protein, 36 aa, Plasmodium falciparum
AQRNYSFVQILIFLIMFLIFFLSSHFEQPKAVYSLQ

SEQ ID NO: 3282379 - protein, 30 aa, Plasmodium falciparum
AQSYYYIYDNLLSIPFNDFDFCKLSYCLDF

SEQ ID NO: 3282380 - protein, 23 aa, Plasmodium falciparum
AQVKVGIIKYYSPKYKQFFIHHL

SEQ ID NO: 3282381 - protein, 23 aa, Plasmodium falciparum
AQVVRVYWWWANPFGMGLIFYLG

SEQ ID NO: 3282382 - protein, 25 aa, Plasmodium falciparum
ARFNDPHLKPCYLFAVVAGDLKHLS

SEQ ID NO: 3282383 - protein, 17 aa, Plasmodium falciparum
ARIFIHCLLLDVSEFFF

SEQ ID NO: 3282384 - protein, 22 aa, Plasmodium falciparum
ARKYYSVQKFGFHEARKLAIKT

SEQ ID NO: 3282385 - protein, 21 aa, Plasmodium falciparum
ARSNDLLIKRGWRTSGKSNGD

SEQ ID NO: 3282386 - protein, 19 aa, Plasmodium falciparum
ASAPLFAAFFSYFFMNNKM

SEQ ID NO: 3282387 - protein, 31 aa, Plasmodium falciparum
ASASNIYLLAHFLVLSLAYLSYNEYFTTGTK

SEQ ID NO: 3282388 - protein, 25 aa, Plasmodium falciparum
ASFKIQDLVLIKYLLNKLIKTNNLI

SEQ ID NO: 3282389 - protein, 31 aa, Plasmodium falciparum
ASFNKWVSFFFPFNVYYFNFFNFSKNDNTNN

SEQ ID NO: 3282390 - protein, 23 aa, Plasmodium falciparum
ASGLAFIVSLFGAGGAGLTGYKY

SEQ ID NO: 3282391 - protein, 32 aa, Plasmodium falciparum
ASGTKLTDFIKRPPYFRYLEEWGENFCKKRTE

SEQ ID NO: 3282392 - protein, 23 aa, Plasmodium falciparum
ASHDFHITKIWIAIIFSAITDIE

SEQ ID NO: 3282393 - protein, 26 aa, Plasmodium falciparum
ASHKRYFYYMYDLIKNKNKRVENNTF

SEQ ID NO: 3282394 - protein, 26 aa, Plasmodium falciparum
ASHQLYMYFIYFQKKLKGRNMSLIFN

SEQ ID NO: 3282395 - protein, 35 aa, Plasmodium falciparum
ASIAAIFIIVLVMVIIYLILRYRRKKKMKKKLQYI

SEQ ID NO: 3282396 - protein, 19 aa, Plasmodium falciparum
ASIFLRGVVLMLTTYILTI

SEQ ID NO: 3282397 - protein, 33 aa, Plasmodium falciparum
ASIIAILIIVLIMVIIYLILRYQRKKKMKKKLQ

SEQ ID NO: 3282398 - protein, 34 aa, Plasmodium falciparum
ASIIAILIIVLIMVIIYLILRYRRKKKMKKKLQY

SEQ ID NO: 3282399 - protein, 34 aa, Plasmodium falciparum
ASIIAIVIIVLIMVIIYLILRYRRKKKMKKKLQY

SEQ ID NO: 3282400 - protein, 35 aa, Plasmodium falciparum
ASIIAIVIIVLIMVIIYLILRYRRKKKMKKKLQYI

SEQ ID NO: 3282401 - protein, 28 aa, Plasmodium falciparum
ASIKEVPYILLLYIRCVVVTHAIMDIHD

SEQ ID NO: 3282402 - protein, 26 aa, Plasmodium falciparum
ASILIYAILLFGYSLLNYIPLSFLCG

SEQ ID NO: 3282403 - protein, 24 aa, Plasmodium falciparum
ASKIFYYMPIYLLSKQHTIEFIYE

SEQ ID NO: 3282404 - protein, 23 aa, Plasmodium falciparum
ASKLILFAHNDLIIHSFLECEVN

SEQ ID NO: 3282405 - protein, 34 aa, Plasmodium falciparum
ASLIAIVVIVLIMIIIYLVLRYRRKKKMKKKLQY

SEQ ID NO: 3282406 - protein, 31 aa, Plasmodium falciparum
ASLIISLYISILPLIILMTYQFIKKPTMEQI

SEQ ID NO: 3282407 - protein, 17 aa, Plasmodium falciparum
ASLLLVVNPYKEIKGLY

SEQ ID NO: 3282408 - protein, 18 aa, Plasmodium falciparum
ASLRKWFIESSAVETFFL

SEQ ID NO: 3282409 - protein, 25 aa, Plasmodium falciparum
ASLRKWFIESSAVETFFLWHEYKME

SEQ ID NO: 3282410 - protein, 24 aa, Plasmodium falciparum
ASLSSRCLYLYLNSYEKTELELII

SEQ ID NO: 3282411 - protein, 26 aa, Plasmodium falciparum
ASLWGDFAQYIWNGMICALTYEEKTS

SEQ ID NO: 3282412 - protein, 22 aa, Plasmodium falciparum
ASMGLLLMWNLDEGLSQIDKFQ

SEQ ID NO: 3282413 - protein, 30 aa, Plasmodium falciparum
ASNIEYDYRWSVILPYIIFKHDKSKPFAKN

SEQ ID NO: 3282414 - protein, 24 aa, Plasmodium falciparum
ASQLLLVTFVAIFSLCLHFIFQPF

SEQ ID NO: 3282415 - protein, 25 aa, Plasmodium falciparum
ASQYHIMFCCSIFFVINPNLFFNNK

SEQ ID NO: 3282416 - protein, 21 aa, Plasmodium falciparum
ASRIWLQYTIASTLSAALTWP

SEQ ID NO: 3282417 - protein, 23 aa, Plasmodium falciparum
ASSTFLPYGIAIIAIIVLTIIVI

SEQ ID NO: 3282418 - protein, 18 aa, Plasmodium falciparum
ASSYPYTYSYLSEYLCLI

SEQ ID NO: 3282419 - protein, 24 aa, Plasmodium falciparum
ASVFKVPFLSLYVTTCGNTKLPTL

SEQ ID NO: 3282420 - protein, 27 aa, Plasmodium falciparum
ASVGKRWMLMFWFIPFSKKKENKTNNN

SEQ ID NO: 3282421 - protein, 25 aa, Plasmodium falciparum
ASVGNLFQILQIPKGDYDISTLKSS

SEQ ID NO: 3282422 - protein, 25 aa, Plasmodium falciparum
ASVGNLFQILQIPKSDYGTPTPKSK

SEQ ID NO: 3282423 - protein, 25 aa, Plasmodium falciparum
ASVLIHEAVLAINLKLSAFDLAYMV

SEQ ID NO: 3282424 - protein, 34 aa, Plasmodium falciparum
ASVVALLIIVLIMIIIYLVLRYRRKKKMKKKAEY

SEQ ID NO: 3282425 - protein, 34 aa, Plasmodium falciparum
ASVVALLIIVLIMIIIYLVLRYRRKNKMNKKAHY

SEQ ID NO: 3282426 - protein, 19 aa, Plasmodium falciparum
ASYFYIILQKGCPNLYKFF

SEQ ID NO: 3282427 - protein, 19 aa, Plasmodium falciparum
ASYLCFGGMIFFGCLRFFS

SEQ ID NO: 3282428 - protein, 22 aa, Plasmodium falciparum
ASYNNYLKKKLYIKKYYSKLKK

SEQ ID NO: 3282429 - protein, 29 aa, Plasmodium falciparum
ASYYLKYLKFLLTSFFLMIEFHTSFHVYL

SEQ ID NO: 3282430 - protein, 20 aa, Plasmodium falciparum
ATFTWETFFSSPLGISLLVT

SEQ ID NO: 3282431 - protein, 25 aa, Plasmodium falciparum
ATGGLCIPPRRRKLYVGKLEEWASD

SEQ ID NO: 3282432 - protein, 26 aa, Plasmodium falciparum
ATHFLTLFTIMIDNLSRYEIYFNLKK

SEQ ID NO: 3282433 - protein, 27 aa, Plasmodium falciparum
ATHIYRKKILLLKKNFLIINKYKQNMN

SEQ ID NO: 3282434 - protein, 45 aa, Plasmodium falciparum
ATIYNWYTTIGYSILAILIIVLIMLIIYLILRYRRKKKMKKKAQY

SEQ ID NO: 3282435 - protein, 24 aa, Plasmodium falciparum
ATKLFFLVCFYYIISQILKLFALA

SEQ ID NO: 3282436 - protein, 19 aa, Plasmodium falciparum
ATPKYFSVYGMVDLNWPEQ

SEQ ID NO: 3282437 - protein, 25 aa, Plasmodium falciparum
ATTTIFPFSIAIYVLIAITVILIIL

SEQ ID NO: 3282438 - protein, 26 aa, Plasmodium falciparum
ATVSIFVYWFLFYPDSDMHTLINFYQ

SEQ ID NO: 3282439 - protein, 41 aa, Plasmodium falciparum
AVAITSSTYCAIPFALMAGILFFQVYRLTKKHYYNRKKTVT

SEQ ID NO: 3282440 - protein, 20 aa, Plasmodium falciparum
AVCFFLNLLNIFILNKYCDK

SEQ ID NO: 3282441 - protein, 34 aa, Plasmodium falciparum
AVCNYYNYDMLILLYNYALKIFEKLLLKDISTIL

SEQ ID NO: 3282442 - protein, 19 aa, Plasmodium falciparum
AVETFFLWDRYKKENKTQN

SEQ ID NO: 3282443 - protein, 18 aa, Plasmodium falciparum
AVIFFVCVLIIKYFVYHF

SEQ ID NO: 3282444 - protein, 23 aa, Plasmodium falciparum
AVIRNMFYNPKDINYFKPVELHT

SEQ ID NO: 3282445 - protein, 21 aa, Plasmodium falciparum
AVISFTVTLLLFFFTHDKYNT

SEQ ID NO: 3282446 - protein, 18 aa, Plasmodium falciparum
AVIYIYIDKIVNLSKKHF

SEQ ID NO: 3282447 - protein, 23 aa, Plasmodium falciparum
AVLEAFFILPRFSKSSITAAGKI

SEQ ID NO: 3282448 - protein, 26 aa, Plasmodium falciparum
AVLIFLPIFLTLLINIYLIYKQLKSS

SEQ ID NO: 3282449 - protein, 24 aa, Plasmodium falciparum
AVLNTFFLFTYEFVPNIYIENFMK

SEQ ID NO: 3282450 - protein, 20 aa, Plasmodium falciparum
AVLVGGIIGTALYASRKSSK

SEQ ID NO: 3282451 - protein, 19 aa, Plasmodium falciparum
AVMGIFCGFLGFLSGSGFL

SEQ ID NO: 3282452 - protein, 27 aa, Plasmodium falciparum
AVNYKNIMYIFFLLKNNLYLHDETMEI

SEQ ID NO: 3282453 - protein, 25 aa, Plasmodium falciparum
AVTFHIFFILFILSFIKCASTDPGK

SEQ ID NO: 3282454 - protein, 28 aa, Plasmodium falciparum
AVTLLRCFLFGQDNPTYRFRKLNKIQIN

SEQ ID NO: 3282455 - protein, 30 aa, Plasmodium falciparum
AVVVIVLIMVIIYLILRYRRKKKMKKKLQY

SEQ ID NO: 3282456 - protein, 24 aa, Plasmodium falciparum
AVVYIIIAIVIILHLYLNEEHIVI

SEQ ID NO: 3282457 - protein, 18 aa, Plasmodium falciparum
AWKRRTYVLYNSDSFYFL

SEQ ID NO: 3282458 - protein, 43 aa, Plasmodium falciparum
AWKYVQKLIKLYYNDFDKHFEKVFLIWLALSEGFDVFEYKMLI

SEQ ID NO: 3282459 - protein, 43 aa, Plasmodium falciparum
AWLYLNCAYYFFYKLYFLLFVFFFLFKWLTFKIIRNIFVAHMM

SEQ ID NO: 3282460 - protein, 29 aa, Plasmodium falciparum
AWSVGIGFAAFTYFFLKKKTKASVGNLFQ

SEQ ID NO: 3282461 - protein, 26 aa, Plasmodium falciparum
AWSVGIGFAAFTYFYLKKKTKSSVGN

SEQ ID NO: 3282462 - protein, 23 aa, Plasmodium falciparum
AYAKQWYDTLPRKYKKNLKNLYL

SEQ ID NO: 3282463 - protein, 22 aa, Plasmodium falciparum
AYDNILFHMRDLYDLEESKYDV

SEQ ID NO: 3282464 - protein, 28 aa, Plasmodium falciparum
AYEKAPYFYPWSLKYPENYLSTHKPELL

SEQ ID NO: 3282465 - protein, 20 aa, Plasmodium falciparum
AYFDKYFELYDKTYKLSKDD

SEQ ID NO: 3282466 - protein, 21 aa, Plasmodium falciparum
AYIAVFPVTYPKKLAFLFLND

SEQ ID NO: 3282467 - protein, 24 aa, Plasmodium falciparum
AYILILPCIIITVIIFFIGSIIIY

SEQ ID NO: 3282468 - protein, 25 aa, Plasmodium falciparum
AYKLKYFVKNIIRRISLILANRYIL

SEQ ID NO: 3282469 - protein, 28 aa, Plasmodium falciparum
AYLEATKEVLYLIPKDKDYHKFYKNELE

SEQ ID NO: 3282470 - protein, 30 aa, Plasmodium falciparum
AYNAFSDYYYFFPYFIQKLLEKGGMIERLI

SEQ ID NO: 3282471 - protein, 27 aa, Plasmodium falciparum
AYNLIYITPFIYLLFSLRSRNILENIL

SEQ ID NO: 3282472 - protein, 17 aa, Plasmodium falciparum
AYNTPRVLILIHSFLFI

SEQ ID NO: 3282473 - protein, 24 aa, Plasmodium falciparum
AYRIIERLNKVIYMDKLTKCFYNN

SEQ ID NO: 3282474 - protein, 18 aa, Plasmodium falciparum
AYRMRKDFFLKDSSFNVI

SEQ ID NO: 3282475 - protein, 35 aa, Plasmodium falciparum
AYSILAILIIVLIMVIIYLILRYRRKKKMKKKLQY

SEQ ID NO: 3282476 - protein, 18 aa, Plasmodium falciparum
AYSLFIKNSRDLYLFTLM

SEQ ID NO: 3282477 - protein, 23 aa, Plasmodium falciparum
AYTDFHHIVFYISVSLNNEIYKE

SEQ ID NO: 3282478 - protein, 17 aa, Plasmodium falciparum
AYVYLLLNILSKCNKIE

SEQ ID NO: 3282479 - protein, 17 aa, Plasmodium falciparum
AYYLLPLLKDAEVDLYI

SEQ ID NO: 3282480 - protein, 20 aa, Plasmodium falciparum
AYYRMPLKNVLLYNEKISRC

SEQ ID NO: 3282481 - protein, 26 aa, Plasmodium falciparum
CADGFSRLNFFYPLPILVNQILKMKD

SEQ ID NO: 3282482 - protein, 29 aa, Plasmodium falciparum
CADKFMLGVLFIWIWTSGNLWVCSDPLQD

SEQ ID NO: 3282483 - protein, 17 aa, Plasmodium falciparum
CAEGIYYGCQSFINILT

SEQ ID NO: 3282484 - protein, 27 aa, Plasmodium falciparum
CAEIFVIFMLFFEIFLRLLTEGTSYFY

SEQ ID NO: 3282485 - protein, 27 aa, Plasmodium falciparum
CAHDYYKKYRIMLALELQANLAQSIQE

SEQ ID NO: 3282486 - protein, 36 aa, Plasmodium falciparum
CAIHGVPTYFDYVPQYLRWFEEWAEEFCRLRKHKLQ

SEQ ID NO: 3282487 - protein, 17 aa, Plasmodium falciparum
CAIICLYNLFRKNVIIP

SEQ ID NO: 3282488 - protein, 18 aa, Plasmodium falciparum
CAKCRLEMKLSNNPYLCF

SEQ ID NO: 3282489 - protein, 19 aa, Plasmodium falciparum
CALCSLYFKKWAIWKNIPI

SEQ ID NO: 3282490 - protein, 28 aa, Plasmodium falciparum
CALKNFPYTCKLPYPIFSTLFMATSAVW

SEQ ID NO: 3282491 - protein, 17 aa, Plasmodium falciparum
CALTFLEAYLKQNLFNF

SEQ ID NO: 3282492 - protein, 22 aa, Plasmodium falciparum
CAPYRRLHLCHHNLESIDTTST

SEQ ID NO: 3282493 - protein, 23 aa, Plasmodium falciparum
CAPYRRLHLCHHNLESIQTKNYN

SEQ ID NO: 3282494 - protein, 20 aa, Plasmodium falciparum
CAPYRRLHLCHHNLETIETT

SEQ ID NO: 3282495 - protein, 18 aa, Plasmodium falciparum
CAPYRRLHLCSHNLESID

SEQ ID NO: 3282496 - protein, 36 aa, Plasmodium falciparum
CASQLHKLHLTIYMVYQKIIYNFSNILLQINNDMNI

SEQ ID NO: 3282497 - protein, 22 aa, Plasmodium falciparum
CASYIIIYSLIVKIITQISKNI

SEQ ID NO: 3282498 - protein, 40 aa, Plasmodium falciparum
CATYFLTVLIVNFKILFETYYLNILPISGIALSIFSFVLL

SEQ ID NO: 3282499 - protein, 19 aa, Plasmodium falciparum
CAYYKKVIFFVFSSLERFK

SEQ ID NO: 3282500 - protein, 23 aa, Plasmodium falciparum
CCHFFCWFYFYSICRTSSHSFEC

SEQ ID NO: 3282501 - protein, 26 aa, Plasmodium falciparum
CCHTCKPIWKILFPSKNIINLKGSPV

SEQ ID NO: 3282502 - protein, 22 aa, Plasmodium falciparum
CCLSITLLKFIEWEQYNYDCVV

SEQ ID NO: 3282503 - protein, 29 aa, Plasmodium falciparum
CCMFPVWPLRLKLALWHISVAFLTLISII

SEQ ID NO: 3282504 - protein, 20 aa, Plasmodium falciparum
CDCFLKWITQKKTEWDKIVQ

SEQ ID NO: 3282505 - protein, 24 aa, Plasmodium falciparum
CDDFLKISFLYPNTINYFASLLKK

SEQ ID NO: 3282506 - protein, 29 aa, Plasmodium falciparum
CDDIPTIDLIPQYLRFLQEWVEHFCKQRQ

SEQ ID NO: 3282507 - protein, 28 aa, Plasmodium falciparum
CDDYDYLLFYIIILYINDYNYIDLVHIF

SEQ ID NO: 3282508 - protein, 25 aa, Plasmodium falciparum
CDFIEPLVIVLILILNAAVGVWQEC

SEQ ID NO: 3282509 - protein, 17 aa, Plasmodium falciparum
CDFILSKTMSKCKNSKH

SEQ ID NO: 3282510 - protein, 29 aa, Plasmodium falciparum
CDICDQKFYFFSLYTLLKRHIYKCIWCNK

SEQ ID NO: 3282511 - protein, 55 aa, Plasmodium falciparum
CDTKYSFYSFIEYFPKYFYTYIEMLYINIILIFMYIYCFFIITVHGGLENDLPLY

SEQ ID NO: 3282512 - protein, 27 aa, Plasmodium falciparum
CDTQSIANILWSLSILNVYSRNVFEDG

SEQ ID NO: 3282513 - protein, 26 aa, Plasmodium falciparum
CDVYKSFTIFSFLSILFSYISIVKLD

SEQ ID NO: 3282514 - protein, 23 aa, Plasmodium falciparum
CDYLDVYNFLLKLLQRYEYSNIL

SEQ ID NO: 3282515 - protein, 23 aa, Plasmodium falciparum
CEACIRCMIFNSLKLKDTYPCCP

SEQ ID NO: 3282516 - protein, 20 aa, Plasmodium falciparum
CECELYAPVNYYSDPQMKEV

SEQ ID NO: 3282517 - protein, 51 aa, Plasmodium falciparum
CEDEHLLGHLYPFVDWVWLKSDLLAWAPVLNRFDDLLRKYIIHNKLVMQKK

SEQ ID NO: 3282518 - protein, 36 aa, Plasmodium falciparum
CEEKEILLYKILKKLNILNLIYFRFLKEEDIEDVHD

SEQ ID NO: 3282519 - protein, 23 aa, Plasmodium falciparum
CEETILIKFEPIYNMLLASCHVL

SEQ ID NO: 3282520 - protein, 24 aa, Plasmodium falciparum
CEEYKKFIEIWKKQFETQNEAYKE

SEQ ID NO: 3282521 - protein, 25 aa, Plasmodium falciparum
CEEYKKFIEIWKKQFETQNKAYQEI

SEQ ID NO: 3282522 - protein, 36 aa, Plasmodium falciparum
CEHYNYHNYIPIPKYDFPLYKLNWSAEEELLLLDGI

SEQ ID NO: 3282523 - protein, 17 aa, Plasmodium falciparum
CEIFKTLLNFIEITKDS

SEQ ID NO: 3282524 - protein, 17 aa, Plasmodium falciparum
CEIFLRSLKNDQGSVKY

SEQ ID NO: 3282525 - protein, 28 aa, Plasmodium falciparum
CEKKKVTNFFYLLLKNVIKEILISNNII

SEQ ID NO: 3282526 - protein, 24 aa, Plasmodium falciparum
CEKKYVNYYKIKSLILYGGTDIFE

SEQ ID NO: 3282527 - protein, 27 aa, Plasmodium falciparum
CEKNCYNYILKLEKYKNIIKDKINKWK

SEQ ID NO: 3282528 - protein, 26 aa, Plasmodium falciparum
CEKTKNCLVFVPNSYLSPIPEEKSII

SEQ ID NO: 3282529 - protein, 30 aa, Plasmodium falciparum
CEKVYTPLIVQLIISLLRTIMIYDISKLKN

SEQ ID NO: 3282530 - protein, 31 aa, Plasmodium falciparum
CENKNKFYFWCFLFLHIIRINFNKSLLKNYK

SEQ ID NO: 3282531 - protein, 27 aa, Plasmodium falciparum
CENTLLIPCRILLCSYIFDINNHLHYI

SEQ ID NO: 3282532 - protein, 18 aa, Plasmodium falciparum
CESNDFNLLIYPMSLYKN

SEQ ID NO: 3282533 - protein, 25 aa, Plasmodium falciparum
CFDNYKIFRLLSFLYIQLLSKKKTF

SEQ ID NO: 3282534 - protein, 18 aa, Plasmodium falciparum
CFFMKKKIKNILSYNPYY

SEQ ID NO: 3282535 - protein, 19 aa, Plasmodium falciparum
CFFSYICLVLFLSSFDDST

SEQ ID NO: 3282536 - protein, 22 aa, Plasmodium falciparum
CFHINIYLYTYFQKCDEKKLID

SEQ ID NO: 3282537 - protein, 38 aa, Plasmodium falciparum
CFKRESFFFEIYKYKNYIINVFFKGLRGKRILVDSIYN

SEQ ID NO: 3282538 - protein, 27 aa, Plasmodium falciparum
CFLSLTLIFMFFLNSLLKILIFQCIKD

SEQ ID NO: 3282539 - protein, 23 aa, Plasmodium falciparum
CFNFIFYRYLYYFSRTIYISKSS

SEQ ID NO: 3282540 - protein, 18 aa, Plasmodium falciparum
CFNIALYYCFLKLLNKKL

SEQ ID NO: 3282541 - protein, 17 aa, Plasmodium falciparum
CFNKIFSFFNYIPKSKL

SEQ ID NO: 3282542 - protein, 30 aa, Plasmodium falciparum
CFNKKIYNIIFMYFYDIFNNKMYIKKNDDK

SEQ ID NO: 3282543 - protein, 33 aa, Plasmodium falciparum
CFQNLIKGPSILFYLYIDILERSLPVQKNKYEE

SEQ ID NO: 3282544 - protein, 23 aa, Plasmodium falciparum
CFRNYFFFFRNVRNSKYLAHRYD

SEQ ID NO: 3282545 - protein, 29 aa, Plasmodium falciparum
CFSDDIYQSYLLVITLRSGVHTLYIYNLK

SEQ ID NO: 3282546 - protein, 24 aa, Plasmodium falciparum
CFVNTNFKIFKKKWLKFIKKNKSY

SEQ ID NO: 3282547 - protein, 24 aa, Plasmodium falciparum
CFVVTFYIFVLDKSTLKIFKDDKD

SEQ ID NO: 3282548 - protein, 23 aa, Plasmodium falciparum
CFYEWLLFIIITNFMLLSCAGED

SEQ ID NO: 3282549 - protein, 25 aa, Plasmodium falciparum
CFYIKNFSFFLSPIYIRLSSTHVEE

SEQ ID NO: 3282550 - protein, 17 aa, Plasmodium falciparum
CFYIYKKNRPLNDETLE

SEQ ID NO: 3282551 - protein, 29 aa, Plasmodium falciparum
CGHIEKLTFINFYLYEFPKSINNEDMLLK

SEQ ID NO: 3282552 - protein, 36 aa, Plasmodium falciparum
CGIAALVLLILAVVLIILYIWLYRRRKNSWKHECKK

SEQ ID NO: 3282553 - protein, 36 aa, Plasmodium falciparum
CGIAALVLLILAVVLIILYIWLYRRRKNSYKHECKK

SEQ ID NO: 3282554 - protein, 57 aa, Plasmodium falciparum
CGINIIKTFYLDNSNMYIFFYIYNINGLYYIYQFYNYSIITLLYSFSISELNTSVEC

SEQ ID NO: 3282555 - protein, 36 aa, Plasmodium falciparum
CGITALVLLILAVILIILYIWLYRRRKNSWKHECKK

SEQ ID NO: 3282556 - protein, 42 aa, Plasmodium falciparum
CGKYFNTQLLKYKLNKFLLFFIRFLLVLEPLLPIYIKNITDH

SEQ ID NO: 3282557 - protein, 27 aa, Plasmodium falciparum
CGMNIPFYLFCELYKLPLPMLNNFFSF

SEQ ID NO: 3282558 - protein, 38 aa, Plasmodium falciparum
CGRKELIVPTYLDYVPQFLRWLNEWSEEFCRIKNIKIG

SEQ ID NO: 3282559 - protein, 19 aa, Plasmodium falciparum
CGVLWLLINFFFIILTIYL

SEQ ID NO: 3282560 - protein, 29 aa, Plasmodium falciparum
CGYNKPQYFYIFFHFYLNNTKKYNIVLEI

SEQ ID NO: 3282561 - protein, 17 aa, Plasmodium falciparum
CHDGILLVYIKNLGKFV

SEQ ID NO: 3282562 - protein, 34 aa, Plasmodium falciparum
CHEMKAEFYLYISFLLLIVFSKIQRKIKTNIFFK

SEQ ID NO: 3282563 - protein, 20 aa, Plasmodium falciparum
CHICNLLICFPWITNGYNNK

SEQ ID NO: 3282564 - protein, 23 aa, Plasmodium falciparum
CHKKFLRLLFLLCNICNYKDTGE

SEQ ID NO: 3282565 - protein, 19 aa, Plasmodium falciparum
CICANYFDLTYIEVPTLNS

SEQ ID NO: 3282566 - protein, 20 aa, Plasmodium falciparum
CICIGSVFNFYFNFGNFPNC

SEQ ID NO: 3282567 - protein, 27 aa, Plasmodium falciparum
CICIPKLIFYMLLWMKNLLLHQYKIDF

SEQ ID NO: 3282568 - protein, 17 aa, Plasmodium falciparum
CIEFFIDLLSQLYSRRI

SEQ ID NO: 3282569 - protein, 26 aa, Plasmodium falciparum
CIEFHYHIPYIILKENKYIFQVFNNL

SEQ ID NO: 3282570 - protein, 28 aa, Plasmodium falciparum
CIEFQPLYQCLLFYKNGTYQFGFKFDTF

SEQ ID NO: 3282571 - protein, 17 aa, Plasmodium falciparum
CIEKLGEKDILLDYIRF

SEQ ID NO: 3282572 - protein, 20 aa, Plasmodium falciparum
CIFLSLVSFLLQCKNTLANV

SEQ ID NO: 3282573 - protein, 23 aa, Plasmodium falciparum
CIFNIIDYKYLFNLLYEYLSNNN

SEQ ID NO: 3282574 - protein, 26 aa, Plasmodium falciparum
CIFRVFFTIIWFCFFFPYHQNIPKKK

SEQ ID NO: 3282575 - protein, 17 aa, Plasmodium falciparum
CIHFIRTNNKNYYQKTF

SEQ ID NO: 3282576 - protein, 17 aa, Plasmodium falciparum
CIIMVNIVPDNKCLFLK

SEQ ID NO: 3282577 - protein, 27 aa, Plasmodium falciparum
CIIRKEKYLFYKLLYFQCFSSGQVQMI

SEQ ID NO: 3282578 - protein, 35 aa, Plasmodium falciparum
CIIRYMSLRVFYKMTKLFILYIKNRKLEYEELILK

SEQ ID NO: 3282579 - protein, 19 aa, Plasmodium falciparum
CIISYYEDILLSNIYEKMI

SEQ ID NO: 3282580 - protein, 18 aa, Plasmodium falciparum
CIIYHNLYILMKARFNLI

SEQ ID NO: 3282581 - protein, 18 aa, Plasmodium falciparum
CIKDILLEIFMGDNKLLE

SEQ ID NO: 3282582 - protein, 17 aa, Plasmodium falciparum
CIKENYEIILDLELLQM

SEQ ID NO: 3282583 - protein, 32 aa, Plasmodium falciparum
CIKFMLYFLWLLYLLFLNIEFIKFKTFQSLVS

SEQ ID NO: 3282584 - protein, 29 aa, Plasmodium falciparum
CIKKFCYLRKLLFIYGSKHLYTISIILYW

SEQ ID NO: 3282585 - protein, 26 aa, Plasmodium falciparum
CIKNRYFLVYILLKKWVLQNKICSKL

SEQ ID NO: 3282586 - protein, 18 aa, Plasmodium falciparum
CILGIIVIVNVCCSFESN

SEQ ID NO: 3282587 - protein, 19 aa, Plasmodium falciparum
CILPMVCKILESIKLSKNF

SEQ ID NO: 3282588 - protein, 19 aa, Plasmodium falciparum
CIMSYYYNSKLYNFYSQNN

SEQ ID NO: 3282589 - protein, 26 aa, Plasmodium falciparum
CINDDLWKTVLNPFDFFHLNNDVNVF

SEQ ID NO: 3282590 - protein, 17 aa, Plasmodium falciparum
CININNIGVKCICKDGY

SEQ ID NO: 3282591 - protein, 21 aa, Plasmodium falciparum
CINIYFIHLLMQFENKKYKKF

SEQ ID NO: 3282592 - protein, 24 aa, Plasmodium falciparum
CINSIFILLFPLLTISYYDTEPTL

SEQ ID NO: 3282593 - protein, 34 aa, Plasmodium falciparum
CINSMTLLCGFMNIFKIAFLIRNIKELNDFFLKR

SEQ ID NO: 3282594 - protein, 33 aa, Plasmodium falciparum
CINTNKLWSKCLWKPVFFILPDVNNNSDNNVDV

SEQ ID NO: 3282595 - protein, 25 aa, Plasmodium falciparum
CIPFLKFMCEFVYNKSQRITFPKSS

SEQ ID NO: 3282596 - protein, 17 aa, Plasmodium falciparum
CIPPRRRRLYIQKLHEW

SEQ ID NO: 3282597 - protein, 17 aa, Plasmodium falciparum
CIPPRRRRLYVKNLQDL

SEQ ID NO: 3282598 - protein, 22 aa, Plasmodium falciparum
CIQQMYFNNSIFNKLYNCDQLN

SEQ ID NO: 3282599 - protein, 17 aa, Plasmodium falciparum
CIRYKVMLTLIVKNILF

SEQ ID NO: 3282600 - protein, 27 aa, Plasmodium falciparum
CISTCLLCMELLDNDIFLLLTRNEKIC

SEQ ID NO: 3282601 - protein, 17 aa, Plasmodium falciparum
CIVVCGILSSLFSGLSL

SEQ ID NO: 3282602 - protein, 20 aa, Plasmodium falciparum
CIYVSIKFLKYIQTDPYYNI

SEQ ID NO: 3282603 - protein, 42 aa, Plasmodium falciparum
CKALRSYINIFILYKKHFFIYNEIFINILLNTLKKGSSKNIT

SEQ ID NO: 3282604 - protein, 25 aa, Plasmodium falciparum
CKDELVYIYLIIKNYMIPYIYTKSN

SEQ ID NO: 3282605 - protein, 19 aa, Plasmodium falciparum
CKDSFIYLNLKLKNMFTFF

SEQ ID NO: 3282606 - protein, 23 aa, Plasmodium falciparum
CKEDFFFFFVNKNYKRRIIVYEY

SEQ ID NO: 3282607 - protein, 19 aa, Plasmodium falciparum
CKEFKIELELLKNGHKGGS

SEQ ID NO: 3282608 - protein, 19 aa, Plasmodium falciparum
CKFEDWLQPILNKMLHEQN

SEQ ID NO: 3282609 - protein, 30 aa, Plasmodium falciparum
CKIEIANFISFYFFFLHIKDILNKNNDNGL

SEQ ID NO: 3282610 - protein, 26 aa, Plasmodium falciparum
CKIIFIPYVIRYLLNELICLNVTIRL

SEQ ID NO: 3282611 - protein, 24 aa, Plasmodium falciparum
CKKNKMWYLYKRGEIIKRKICIKL

SEQ ID NO: 3282612 - protein, 28 aa, Plasmodium falciparum
CKKQLCNIFFFFTPFLYIITLNVDDIDK

SEQ ID NO: 3282613 - protein, 21 aa, Plasmodium falciparum
CKKVYMYLDDVKPHVLNELAR

SEQ ID NO: 3282614 - protein, 23 aa, Plasmodium falciparum
CKMFIKYIYLMFNILFNICSSLY

SEQ ID NO: 3282615 - protein, 31 aa, Plasmodium falciparum
CKNILILHIFNFLLILLFTENICINKKENVN

SEQ ID NO: 3282616 - protein, 19 aa, Plasmodium falciparum
CKRRISFFGVLPFELEKKG

SEQ ID NO: 3282617 - protein, 18 aa, Plasmodium falciparum
CKRSYPFYPRIQRYRRKL

SEQ ID NO: 3282618 - protein, 26 aa, Plasmodium falciparum
CKTQLKELLFILLNNYRPSLKQRNKR

SEQ ID NO: 3282619 - protein, 19 aa, Plasmodium falciparum
CKVIIDHYPFLNKNLVLMS

SEQ ID NO: 3282620 - protein, 22 aa, Plasmodium falciparum
CKYIEMLVIYILYSYEILRTIL

SEQ ID NO: 3282621 - protein, 33 aa, Plasmodium falciparum
CKYIKLLHYYQMNAKSFFFFISTDKKKKKNDYI

SEQ ID NO: 3282622 - protein, 24 aa, Plasmodium falciparum
CLALWLLFLLDVRKCEKLISKLTK

SEQ ID NO: 3282623 - protein, 18 aa, Plasmodium falciparum
CLCPYPYVRILNNCLHPL

SEQ ID NO: 3282624 - protein, 32 aa, Plasmodium falciparum
CLCYISNHKLYFNLLLKSLPSCDQRRLNDSLD

SEQ ID NO: 3282625 - protein, 27 aa, Plasmodium falciparum
CLEFIKYLIILNLYFNKYLELLKKKKR

SEQ ID NO: 3282626 - protein, 24 aa, Plasmodium falciparum
CLENVLFEIYYNYDVNLYASDLLQ

SEQ ID NO: 3282627 - protein, 17 aa, Plasmodium falciparum
CLFIKGKYKGTFDNVYE

SEQ ID NO: 3282628 - protein, 23 aa, Plasmodium falciparum
CLFKVYIIFLKDYSSFFLSSIMT

SEQ ID NO: 3282629 - protein, 19 aa, Plasmodium falciparum
CLGISFVLYILLSVCEGHK

SEQ ID NO: 3282630 - protein, 22 aa, Plasmodium falciparum
CLGTLLFIYSLISFVVIRTFVL

SEQ ID NO: 3282631 - protein, 25 aa, Plasmodium falciparum
CLKGDESLPLGVLPMEYEQNDKHHH

SEQ ID NO: 3282632 - protein, 23 aa, Plasmodium falciparum
CLKGSFILFYIHYDITNINVYFF

SEQ ID NO: 3282633 - protein, 22 aa, Plasmodium falciparum
CLKKGIIMFLSFAVFGIIPLSA

SEQ ID NO: 3282634 - protein, 35 aa, Plasmodium falciparum
CLKKKIYLLGLNYDEYILLRGSFRFRVIKGLIKFN

SEQ ID NO: 3282635 - protein, 24 aa, Plasmodium falciparum
CLKYKFLYFKYNVAIEAPLLIETK

SEQ ID NO: 3282636 - protein, 26 aa, Plasmodium falciparum
CLLDLLIYTFISYFGFFQVSSDFFKM

SEQ ID NO: 3282637 - protein, 29 aa, Plasmodium falciparum
CLLSFSMYLILVMTLFLLLWCIMGNNLPS

SEQ ID NO: 3282638 - protein, 34 aa, Plasmodium falciparum
CLLSNSFILDEAFIQYFFFIKNKNEEPVICKDGN

SEQ ID NO: 3282639 - protein, 26 aa, Plasmodium falciparum
CLLSVVLLMFLILRYMMEERNRLLFF

SEQ ID NO: 3282640 - protein, 17 aa, Plasmodium falciparum
CLMIIVIFKIFKKKQHI

SEQ ID NO: 3282641 - protein, 25 aa, Plasmodium falciparum
CLNIYDHFPIYFFKDNFSNKNNTKR

SEQ ID NO: 3282642 - protein, 30 aa, Plasmodium falciparum
CLPQVLFLYVIFLLLCTGIFMHNKNKLKKQ

SEQ ID NO: 3282643 - protein, 18 aa, Plasmodium falciparum
CLREEMYLILLASYPKHF

SEQ ID NO: 3282644 - protein, 25 aa, Plasmodium falciparum
CLRIVYYLFELIFNISTYIYYNFND

SEQ ID NO: 3282645 - protein, 28 aa, Plasmodium falciparum
CLRKYYNNISLWLQYFNFCFIKKKYDEL

SEQ ID NO: 3282646 - protein, 20 aa, Plasmodium falciparum
CLSKNKYLFKYLIVDRKKLD

SEQ ID NO: 3282647 - protein, 26 aa, Plasmodium falciparum
CLSMKYYEIFYLKKKFLFRYKQKVNL

SEQ ID NO: 3282648 - protein, 26 aa, Plasmodium falciparum
CLSSNHDIFILCKIIVYVCENCTNKN

SEQ ID NO: 3282649 - protein, 18 aa, Plasmodium falciparum
CLSYRILGLEYFLDEYFF

SEQ ID NO: 3282650 - protein, 35 aa, Plasmodium falciparum
CLVGNLNIIYILLYLNVDLFIYNYKSELPVHCTIY

SEQ ID NO: 3282651 - protein, 32 aa, Plasmodium falciparum
CLVGYKGLYTLYFCIFIPVLVSLLICYFLYKR

SEQ ID NO: 3282652 - protein, 17 aa, Plasmodium falciparum
CMGVQHIGIAKPQFIRW

SEQ ID NO: 3282653 - protein, 37 aa, Plasmodium falciparum
CMHQIMIMKLYIYIYIYIYILYKNDIYMHLLYIYYYK

SEQ ID NO: 3282654 - protein, 25 aa, Plasmodium falciparum
CMILQVLYLIIFLTNKFYIKNTHKE

SEQ ID NO: 3282655 - protein, 26 aa, Plasmodium falciparum
CMLELWRKEKWFQELKERWINEEKYI

SEQ ID NO: 3282656 - protein, 26 aa, Plasmodium falciparum
CMNKIIIIFVIHKYWQILKTEDTIKY

SEQ ID NO: 3282657 - protein, 51 aa, Plasmodium falciparum
CNDELYIYLSWVRRQLHLLYMSLYFKFKRFMIFIPYLYNLYKRYNNNNNNN

SEQ ID NO: 3282658 - protein, 53 aa, Plasmodium falciparum
CNDIEIRNFFYYLSNLYILHDYFIFRINIFFFNWFLLHIYKIKLKNTSYIEDI

SEQ ID NO: 3282659 - protein, 18 aa, Plasmodium falciparum
CNDIFLSRLISYDEIQIC

SEQ ID NO: 3282660 - protein, 17 aa, Plasmodium falciparum
CNDINNINIFFKKINKN

SEQ ID NO: 3282661 - protein, 21 aa, Plasmodium falciparum
CNDLPPCTRDQRKNGDHTLYA

SEQ ID NO: 3282662 - protein, 23 aa, Plasmodium falciparum
CNEHFYLIIIKYIKYLFVHIYGN

SEQ ID NO: 3282663 - protein, 27 aa, Plasmodium falciparum
CNFDIPLILALLYIIQLHKFPDIKKII

SEQ ID NO: 3282664 - protein, 20 aa, Plasmodium falciparum
CNFFSYFYNNYIFSKKYFNN

SEQ ID NO: 3282665 - protein, 27 aa, Plasmodium falciparum
CNFIDTLIMFYILLKNKLNYKNKQLYM

SEQ ID NO: 3282666 - protein, 37 aa, Plasmodium falciparum
CNFIYINVLLLSLFEYNLFFVFKFISYYCLINSCALL

SEQ ID NO: 3282667 - protein, 26 aa, Plasmodium falciparum
CNGNNKCIYFFEYELRKKTQSFRNKN

SEQ ID NO: 3282668 - protein, 33 aa, Plasmodium falciparum
CNICQRYVHICYYLFIYCTYKYHCELCDATYSE

SEQ ID NO: 3282669 - protein, 17 aa, Plasmodium falciparum
CNIKKLLKKYSNTIVIQ

SEQ ID NO: 3282670 - protein, 28 aa, Plasmodium falciparum
CNKGYTNIFFLYPYNNYFPLLKKFCTIN

SEQ ID NO: 3282671 - protein, 28 aa, Plasmodium falciparum
CNKILNIYEYLYIRKILLKGNGKGKRKI

SEQ ID NO: 3282672 - protein, 32 aa, Plasmodium falciparum
CNKYISYRIFFLFEFYFNIIVYILNVKYKNNM

SEQ ID NO: 3282673 - protein, 58 aa, Plasmodium falciparum
CNLFNIQTWKNMYKICFFYVYPYRFTFNKYKKFFNKIKKIHFLNNLSFIPLSVDVLKL

SEQ ID NO: 3282674 - protein, 19 aa, Plasmodium falciparum
CNLNYDILNLLLKNELKNI

SEQ ID NO: 3282675 - protein, 26 aa, Plasmodium falciparum
CNLVDIICMDVFLGSILNFVTHNINE

SEQ ID NO: 3282676 - protein, 17 aa, Plasmodium falciparum
CNLYISSLSLLCCKNYE

SEQ ID NO: 3282677 - protein, 43 aa, Plasmodium falciparum
CNMRILNLIYMIFLLEKNPFFYFYFSLALLILHRNIFLCVDNS

SEQ ID NO: 3282678 - protein, 26 aa, Plasmodium falciparum
CNMRNVIYLILLNYNYHILLKKSYEK

SEQ ID NO: 3282679 - protein, 37 aa, Plasmodium falciparum
CNNIIFNSIFFDTFISLIFIYYLNNYMKPKKQDNIKN

SEQ ID NO: 3282680 - protein, 19 aa, Plasmodium falciparum
CNNIYMNTKLAYSYMNGFI

SEQ ID NO: 3282681 - protein, 31 aa, Plasmodium falciparum
CNNKELIVLIDLFKIFLTPMQKQLILYHIKS

SEQ ID NO: 3282682 - protein, 36 aa, Plasmodium falciparum
CNNKFTFISICRIYILYFENLIQNIKWYWIKKNEEN

SEQ ID NO: 3282683 - protein, 22 aa, Plasmodium falciparum
CNNKLYIYVKQYNKDPLKNQNN

SEQ ID NO: 3282684 - protein, 34 aa, Plasmodium falciparum
CNNKNLFLYMFINITFFFSLKFYPYIEEQNKITN

SEQ ID NO: 3282685 - protein, 23 aa, Plasmodium falciparum
CNNMIEILVRNLFLYKYELNILK

SEQ ID NO: 3282686 - protein, 24 aa, Plasmodium falciparum
CNNVINFFFDKISFIKNYFVDRNI

SEQ ID NO: 3282687 - protein, 24 aa, Plasmodium falciparum
CNQIQMNQPYTFPPYQKELSSYLK

SEQ ID NO: 3282688 - protein, 28 aa, Plasmodium falciparum
CNTIHQYCFFLFFNYFKSKGKVIQSTKF

SEQ ID NO: 3282689 - protein, 26 aa, Plasmodium falciparum
CNTNCKCFLKWIGKKKTEWGKIVEHF

SEQ ID NO: 3282690 - protein, 18 aa, Plasmodium falciparum
CNVKFHLNCAFYSTVIKD

SEQ ID NO: 3282691 - protein, 35 aa, Plasmodium falciparum
CNYFNLNSLILRFIDDFLFITLNKKNIKIFKNLLL

SEQ ID NO: 3282692 - protein, 19 aa, Plasmodium falciparum
CNYILFLQNNKIYVPIYNY

SEQ ID NO: 3282693 - protein, 29 aa, Plasmodium falciparum
CNYNFFICQLFYNLIFPLLFITNNYQATS

SEQ ID NO: 3282694 - protein, 30 aa, Plasmodium falciparum
CNYNNWKLLINVFLHHLPFIDPYIQNEVII

SEQ ID NO: 3282695 - protein, 28 aa, Plasmodium falciparum
CNYTDYNYLYYFKYKLKLNVCDFYYICK

SEQ ID NO: 3282696 - protein, 34 aa, Plasmodium falciparum
CNYVEKYHIFLTIKNILLLYMLSHEINKIFFKKE

SEQ ID NO: 3282697 - protein, 23 aa, Plasmodium falciparum
CPGCGRHCSFYKKWIKIKKDEYE

SEQ ID NO: 3282698 - protein, 18 aa, Plasmodium falciparum
CPINNYNFFFVDKNKYKC

SEQ ID NO: 3282699 - protein, 19 aa, Plasmodium falciparum
CPPINLYKPIDDKGGITIN

SEQ ID NO: 3282700 - protein, 19 aa, Plasmodium falciparum
CPPRFPLNHTMFGYFNYST

SEQ ID NO: 3282701 - protein, 34 aa, Plasmodium falciparum
CPSRDDFYVFTKKVPIFLRYLKLITSLENRTNDF

SEQ ID NO: 3282702 - protein, 38 aa, Plasmodium falciparum
CQNLFYEILHFILLKLLYYIIVIFICSLNGNILNKLHV

SEQ ID NO: 3282703 - protein, 24 aa, Plasmodium falciparum
CRLKLKIVFIIFNNNGIYGNRDIP

SEQ ID NO: 3282704 - protein, 20 aa, Plasmodium falciparum
CRLVYWCCVVYILQNNQMHK

SEQ ID NO: 3282705 - protein, 21 aa, Plasmodium falciparum
CRPEDFIYCPGYKPYENDYYN

SEQ ID NO: 3282706 - protein, 18 aa, Plasmodium falciparum
CRSRLAFGRLVFSPYKGD

SEQ ID NO: 3282707 - protein, 17 aa, Plasmodium falciparum
CRSSAWNNKIITSAWWV

SEQ ID NO: 3282708 - protein, 25 aa, Plasmodium falciparum
CSATSAIYPYLTYTKHIITTNFLNN

SEQ ID NO: 3282709 - protein, 20 aa, Plasmodium falciparum
CSCMVIIAYFYKYSSEFLGI

SEQ ID NO: 3282710 - protein, 34 aa, Plasmodium falciparum
CSDKRIFSNLLTISGIFLVLVLNCIIICDKSETE

SEQ ID NO: 3282711 - protein, 35 aa, Plasmodium falciparum
CSDKRIFSNLLTISGIFLVLVLNCIIICDKSETEN

SEQ ID NO: 3282712 - protein, 35 aa, Plasmodium falciparum
CSDPLCASPFSLVFSIFLCLISIFLTSFGGILREI

SEQ ID NO: 3282713 - protein, 34 aa, Plasmodium falciparum
CSEKKYLDLILMYIFYFLFFHDSDFMNINFQEKF

SEQ ID NO: 3282714 - protein, 26 aa, Plasmodium falciparum
CSELIQLFYYILKKNSTYYKTKNKYY

SEQ ID NO: 3282715 - protein, 24 aa, Plasmodium falciparum
CSFKYFNNFFFNYSLYFPTNDSIN

SEQ ID NO: 3282716 - protein, 23 aa, Plasmodium falciparum
CSFLLYILVLYYEILIFLINKNV

SEQ ID NO: 3282717 - protein, 17 aa, Plasmodium falciparum
CSFVINERFLMSSDGHE

SEQ ID NO: 3282718 - protein, 22 aa, Plasmodium falciparum
CSHCFYVFMITTGIYALCFLSL

SEQ ID NO: 3282719 - protein, 24 aa, Plasmodium falciparum
CSICILFIFIHFLINLIENDMQTF

SEQ ID NO: 3282720 - protein, 24 aa, Plasmodium falciparum
CSIDRDPKYLLYKNYKLVECVIGK

SEQ ID NO: 3282721 - protein, 23 aa, Plasmodium falciparum
CSINRLFISNYILNLYLTNLVSV

SEQ ID NO: 3282722 - protein, 18 aa, Plasmodium falciparum
CSISDYCMKFFNFNSSGY

SEQ ID NO: 3282723 - protein, 24 aa, Plasmodium falciparum
CSIYNQFLIKFYLYNNSKINIDVY

SEQ ID NO: 3282724 - protein, 23 aa, Plasmodium falciparum
CSKIKFPRLCSSSSSFLASYNTY

SEQ ID NO: 3282725 - protein, 28 aa, Plasmodium falciparum
CSKYIQIKYFIFQLKLVQMFNLPMFLHM

SEQ ID NO: 3282726 - protein, 25 aa, Plasmodium falciparum
CSLILYYMYILKVSVFLLISKSFLI

SEQ ID NO: 3282727 - protein, 30 aa, Plasmodium falciparum
CSLNIIYKYIRIWLLRLKLQDVDVFFCILN

SEQ ID NO: 3282728 - protein, 30 aa, Plasmodium falciparum
CSNNIKINYFPRNPYFFTIYQIFNPKNNEN

SEQ ID NO: 3282729 - protein, 17 aa, Plasmodium falciparum
CSQIYINIILKNILLYN

SEQ ID NO: 3282730 - protein, 23 aa, Plasmodium falciparum
CSSILIASFYFIGKKFSYNSYST

SEQ ID NO: 3282731 - protein, 32 aa, Plasmodium falciparum
CSVKLNNLWYLNFIRFMLLFSSVIPISLSVNL

SEQ ID NO: 3282732 - protein, 27 aa, Plasmodium falciparum
CSVNQKFKKLIPFYTIHGNHDYPYSYE

SEQ ID NO: 3282733 - protein, 23 aa, Plasmodium falciparum
CSVTCIPFGPWIDNQKKEFLKQR

SEQ ID NO: 3282734 - protein, 17 aa, Plasmodium falciparum
CSYIKYTKYLGKYILRR

SEQ ID NO: 3282735 - protein, 24 aa, Plasmodium falciparum
CSYVLCLHILLLPLEMILIQKKLL

SEQ ID NO: 3282736 - protein, 23 aa, Plasmodium falciparum
CSYYMNKIIYFYLNEYNDKELLN

SEQ ID NO: 3282737 - protein, 21 aa, Plasmodium falciparum
CTCDVVIACRITAKQKAFLVQ

SEQ ID NO: 3282738 - protein, 23 aa, Plasmodium falciparum
CTDCLFACHRYEKWIDNQRKQFL

SEQ ID NO: 3282739 - protein, 25 aa, Plasmodium falciparum
CTEDKFFFLLWISVVLFNCYINFVI

SEQ ID NO: 3282740 - protein, 24 aa, Plasmodium falciparum
CTEYKYLEKLKIFTLDTFIKKINK

SEQ ID NO: 3282741 - protein, 24 aa, Plasmodium falciparum
CTFLSLISILFYWPRGYPFLGNSL

SEQ ID NO: 3282742 - protein, 21 aa, Plasmodium falciparum
CTGCFLSCSHFRTWIDNQKEQ

SEQ ID NO: 3282743 - protein, 17 aa, Plasmodium falciparum
CTILLELSKNILKKLLG

SEQ ID NO: 3282744 - protein, 17 aa, Plasmodium falciparum
CTIRKYVKYFLYLKDSS

SEQ ID NO: 3282745 - protein, 28 aa, Plasmodium falciparum
CTIVILSVGWNLLFSKSIFILMGCFIFS

SEQ ID NO: 3282746 - protein, 24 aa, Plasmodium falciparum
CTKCNIYVHKYCYGIYPKNKSEDF

SEQ ID NO: 3282747 - protein, 24 aa, Plasmodium falciparum
CTKCSFLCGFYKKWIDNQKKEFLK

SEQ ID NO: 3282748 - protein, 53 aa, Plasmodium falciparum
CTKIEFADPLYRCFKKKEFSNMVYFAGAGIVLILLFVIGSKMIIGKWFEEATF

SEQ ID NO: 3282749 - protein, 25 aa, Plasmodium falciparum
CTKTNMIRPLINLVYRKINRKQKVR

SEQ ID NO: 3282750 - protein, 23 aa, Plasmodium falciparum
CTKYIYFLLFYNSYIFILFIYTF

SEQ ID NO: 3282751 - protein, 35 aa, Plasmodium falciparum
CTLLYGRNNILIVLILNIILWNVCITNNGITLDSK

SEQ ID NO: 3282752 - protein, 18 aa, Plasmodium falciparum
CTNMNYWTYTRKLAYEIQ

SEQ ID NO: 3282753 - protein, 18 aa, Plasmodium falciparum
CTPFTYEGLIDHFFGIDN

SEQ ID NO: 3282754 - protein, 41 aa, Plasmodium falciparum
CTQERNLLFLFQIFIRIKLLLFFFISLFYSSARTLSNNFVY

SEQ ID NO: 3282755 - protein, 22 aa, Plasmodium falciparum
CTQNKLIFILNVTPKEYNIFLK

SEQ ID NO: 3282756 - protein, 29 aa, Plasmodium falciparum
CTSNNKKFLLLFNIVLIKLPEYNIHYSII

SEQ ID NO: 3282757 - protein, 42 aa, Plasmodium falciparum
CTSYANFINTWKPQWVPMQIQYALLYSYVGKSGTIGLGGYPD

SEQ ID NO: 3282758 - protein, 32 aa, Plasmodium falciparum
CTVKWFPWLVALLIIFWFIINVFNIITIYATP

SEQ ID NO: 3282759 - protein, 17 aa, Plasmodium falciparum
CTWYYKNIEKLYSNILL

SEQ ID NO: 3282760 - protein, 18 aa, Plasmodium falciparum
CTYGYIKKEHYIINECLY

SEQ ID NO: 3282761 - protein, 21 aa, Plasmodium falciparum
CVDWLYFYELLKERKILENII

SEQ ID NO: 3282762 - protein, 22 aa, Plasmodium falciparum
CVELFKLHLLEEVLIEDAEMDR

SEQ ID NO: 3282763 - protein, 23 aa, Plasmodium falciparum
CVELSCLIPFRLKVKNIIMVGDP

SEQ ID NO: 3282764 - protein, 28 aa, Plasmodium falciparum
CVENKRLLSILIFYTFVYYYNNNNNNNN

SEQ ID NO: 3282765 - protein, 22 aa, Plasmodium falciparum
CVHLWSNFLYNADKLEYFTFCN

SEQ ID NO: 3282766 - protein, 27 aa, Plasmodium falciparum
CVLFYFFCTHLFFLHVITKHNLKKEKG

SEQ ID NO: 3282767 - protein, 22 aa, Plasmodium falciparum
CVNGWVPEKVPVPCPSYAPFNK

SEQ ID NO: 3282768 - protein, 25 aa, Plasmodium falciparum
CVPNIKYPNFFINKNNIPYTNENNK

SEQ ID NO: 3282769 - protein, 23 aa, Plasmodium falciparum
CVPNTFLIMIYKKIMKNLNLSNK

SEQ ID NO: 3282770 - protein, 25 aa, Plasmodium falciparum
CVPPRRRKLYIGKIKEWAGIQLKSQ

SEQ ID NO: 3282771 - protein, 23 aa, Plasmodium falciparum
CVPPRRRKLYIHDLQSLIGKDST

SEQ ID NO: 3282772 - protein, 18 aa, Plasmodium falciparum
CVPPRRRKLYVGELTKWA

SEQ ID NO: 3282773 - protein, 24 aa, Plasmodium falciparum
CVPPRRRRLYIQKLHDWAEKVGDT

SEQ ID NO: 3282774 - protein, 18 aa, Plasmodium falciparum
CVPPRRRRLYVGRLTKWA

SEQ ID NO: 3282775 - protein, 27 aa, Plasmodium falciparum
CVPPRRRRLYVTPLTRLAGDNTAASVS

SEQ ID NO: 3282776 - protein, 25 aa, Plasmodium falciparum
CVPPRRRRLYVTPLTRLAGGDGNTQ

SEQ ID NO: 3282777 - protein, 26 aa, Plasmodium falciparum
CVPPRRRRLYVTPLTRLAGGDGNTQA

SEQ ID NO: 3282778 - protein, 26 aa, Plasmodium falciparum
CVPPRRRRLYVTPLTRLAGGGNTAAS

SEQ ID NO: 3282779 - protein, 22 aa, Plasmodium falciparum
CVPPRRRRLYVTPLTRLTGGDS

SEQ ID NO: 3282780 - protein, 25 aa, Plasmodium falciparum
CVPSRRRKLYIQKLHDWAEKQVGTT

SEQ ID NO: 3282781 - protein, 26 aa, Plasmodium falciparum
CVQLRNLILSAFPRNIKLPHPFNPNL

SEQ ID NO: 3282782 - protein, 17 aa, Plasmodium falciparum
CVRIKYRTLYKSKDDIG

SEQ ID NO: 3282783 - protein, 26 aa, Plasmodium falciparum
CVSAGLTFMLKYILRNIRIDNIFLLK

SEQ ID NO: 3282784 - protein, 24 aa, Plasmodium falciparum
CVSDTFFEFLFKITINISNLIHTI

SEQ ID NO: 3282785 - protein, 32 aa, Plasmodium falciparum
CVSKKYELIFISYGQYIYVYEMNKFINNSHFF

SEQ ID NO: 3282786 - protein, 24 aa, Plasmodium falciparum
CVTKKYLKFITRDDFYYFKYKNEN

SEQ ID NO: 3282787 - protein, 22 aa, Plasmodium falciparum
CVYSYIVFIFISIEKYIKCCTN

SEQ ID NO: 3282788 - protein, 17 aa, Plasmodium falciparum
CWENILILSKFKEFENL

SEQ ID NO: 3282789 - protein, 27 aa, Plasmodium falciparum
CWNKKKIYNLFYIQKCFMSPYYYDNIK

SEQ ID NO: 3282790 - protein, 19 aa, Plasmodium falciparum
CYCMKDIINFIYKKSLNDE

SEQ ID NO: 3282791 - protein, 20 aa, Plasmodium falciparum
CYFYELLNYLKIKGISMKPK

SEQ ID NO: 3282792 - protein, 24 aa, Plasmodium falciparum
CYGHQLICYFYGNKIEKVKNMFHG

SEQ ID NO: 3282793 - protein, 38 aa, Plasmodium falciparum
CYIKKNYLFISILKIWYLFIICFIPYSFIMEPIENHLK

SEQ ID NO: 3282794 - protein, 17 aa, Plasmodium falciparum
CYIYQFFDKQNYLNFIK

SEQ ID NO: 3282795 - protein, 27 aa, Plasmodium falciparum
CYKLIKYKKVLYLYKKIRRFNWNCINY

SEQ ID NO: 3282796 - protein, 24 aa, Plasmodium falciparum
CYKNFLLILAQMFKIYHENELINR

SEQ ID NO: 3282797 - protein, 17 aa, Plasmodium falciparum
CYLFLEWSLKGDENIRS

SEQ ID NO: 3282798 - protein, 26 aa, Plasmodium falciparum
CYLITSFIFFIFFLSTINNLDKYIHI

SEQ ID NO: 3282799 - protein, 32 aa, Plasmodium falciparum
CYNYLNYLKIYFNIFFLLYYSICNKYNIKLIY

SEQ ID NO: 3282800 - protein, 40 aa, Plasmodium falciparum
CYRSLIRYINVFIQNTILRIFVLRNYKFIDKTRIDYFKIH

SEQ ID NO: 3282801 - protein, 19 aa, Plasmodium falciparum
CYYLIYFLCFLSFLYGIRK

SEQ ID NO: 3282802 - protein, 24 aa, Plasmodium falciparum
DACKLKYNGKYYGWKCISGATTGG

SEQ ID NO: 3282803 - protein, 20 aa, Plasmodium falciparum
DACTRLNIKLPYGGDTHLNK

SEQ ID NO: 3282804 - protein, 24 aa, Plasmodium falciparum
DADKYEQIYLLVKKLIRSEELSKG

SEQ ID NO: 3282805 - protein, 19 aa, Plasmodium falciparum
DAFIKKLNTLLGLDEAEEI

SEQ ID NO: 3282806 - protein, 30 aa, Plasmodium falciparum
DAFIQSAAIETFFLWHKYKMDKEIEKKQQQ

SEQ ID NO: 3282807 - protein, 25 aa, Plasmodium falciparum
DAIRSIILIYRLTNDIFNKFKEHLS

SEQ ID NO: 3282808 - protein, 22 aa, Plasmodium falciparum
DAKHLLDIIGEDIYKIANDAAL

SEQ ID NO: 3282809 - protein, 18 aa, Plasmodium falciparum
DAKIIFHNSLRKNIQLMF

SEQ ID NO: 3282810 - protein, 21 aa, Plasmodium falciparum
DAKVLYNWKLGKSILGKMINS

SEQ ID NO: 3282811 - protein, 22 aa, Plasmodium falciparum
DALKHLLIIVALLRIEKRTNRY

SEQ ID NO: 3282812 - protein, 27 aa, Plasmodium falciparum
DALYTHQIIFLYEYLKNVIIKRCNMIF

SEQ ID NO: 3282813 - protein, 25 aa, Plasmodium falciparum
DANPDVYYIYLMDTLDIEKIEDINL

SEQ ID NO: 3282814 - protein, 23 aa, Plasmodium falciparum
DAPSCYFLSYLYNNIYLYYCDIL

SEQ ID NO: 3282815 - protein, 31 aa, Plasmodium falciparum
DAQLIYLPAFFLLIFIIYIVARYFPDMKIGF

SEQ ID NO: 3282816 - protein, 24 aa, Plasmodium falciparum
DAQLSIFLIRLINISYNVSTHENK

SEQ ID NO: 3282817 - protein, 18 aa, Plasmodium falciparum
DCDKICECVTKWIEKKRT

SEQ ID NO: 3282818 - protein, 35 aa, Plasmodium falciparum
DCFINSTICFFLSLILFIFKNIHTIKIIRSHIYLS

SEQ ID NO: 3282819 - protein, 26 aa, Plasmodium falciparum
DCHKCSFWCGFYKKWLANQKQEFLKQ

SEQ ID NO: 3282820 - protein, 38 aa, Plasmodium falciparum
DCLDRTNVFQYYYALFFILYILHLSRNDMFLKAVNKSY

SEQ ID NO: 3282821 - protein, 24 aa, Plasmodium falciparum
DCLKYLMYNIFSLKNHGFFFFVRK

SEQ ID NO: 3282822 - protein, 26 aa, Plasmodium falciparum
DCNIHILNFLLDLLEKRKLSCDVYFK

SEQ ID NO: 3282823 - protein, 30 aa, Plasmodium falciparum
DCNNFNWLIQLKYFYYNKNLYVKYLNESHI

SEQ ID NO: 3282824 - protein, 27 aa, Plasmodium falciparum
DCSFIPLLNLIYLFPRNHTIYTVILGC

SEQ ID NO: 3282825 - protein, 19 aa, Plasmodium falciparum
DCYLFPYVLSYLYTNDYNI

SEQ ID NO: 3282826 - protein, 27 aa, Plasmodium falciparum
DCYLSYDDLLLLYESKKIKLHVWDDNL

SEQ ID NO: 3282827 - protein, 26 aa, Plasmodium falciparum
DCYNISQILLKYIYNTYLEKTIEHIY

SEQ ID NO: 3282828 - protein, 26 aa, Plasmodium falciparum
DDDFIHDILTIILILINNNKNKFVLD

SEQ ID NO: 3282829 - protein, 25 aa, Plasmodium falciparum
DDDIPYIYFCILFAFGFIVQHGFGL

SEQ ID NO: 3282830 - protein, 28 aa, Plasmodium falciparum
DDDKKQIDFFFSILSAILLLGNIQMIKS

SEQ ID NO: 3282831 - protein, 24 aa, Plasmodium falciparum
DDDPNYYKLRNAWWEANRQEVWKA

SEQ ID NO: 3282832 - protein, 18 aa, Plasmodium falciparum
DDDYYFESFTNYLREYDT

SEQ ID NO: 3282833 - protein, 24 aa, Plasmodium falciparum
DDEDNFYFYISLNNLTFYIYKHYN

SEQ ID NO: 3282834 - protein, 25 aa, Plasmodium falciparum
DDEIMPYYISMIKSISFFLNYHTSK

SEQ ID NO: 3282835 - protein, 25 aa, Plasmodium falciparum
DDEKYFKWLQLIFSNCWKIENGCIN

SEQ ID NO: 3282836 - protein, 34 aa, Plasmodium falciparum
DDELLPCADEVLPLLIYVIIKTNPPEIISNIIYI

SEQ ID NO: 3282837 - protein, 29 aa, Plasmodium falciparum
DDERVISIKVFIKRWLESFLKDYNKLKEN

SEQ ID NO: 3282838 - protein, 25 aa, Plasmodium falciparum
DDEYTFFRYIDQVQFFMSLKRSKNF

SEQ ID NO: 3282839 - protein, 21 aa, Plasmodium falciparum
DDFFSICILFSHFILSNINEN

SEQ ID NO: 3282840 - protein, 20 aa, Plasmodium falciparum
DDFILFLFIIQYCIYKKENK

SEQ ID NO: 3282841 - protein, 24 aa, Plasmodium falciparum
DDFMKSLFTFIFTGSYAGKLMSLK

SEQ ID NO: 3282842 - protein, 25 aa, Plasmodium falciparum
DDFSFAYFCDIPKPLIKISSKQTKK

SEQ ID NO: 3282843 - protein, 17 aa, Plasmodium falciparum
DDFTLVEWYLSTKIGSN

SEQ ID NO: 3282844 - protein, 22 aa, Plasmodium falciparum
DDFVKYISFFYIKPQDTNIIKS

SEQ ID NO: 3282845 - protein, 20 aa, Plasmodium falciparum
DDFYQFLVFIRDIISQNNLE

SEQ ID NO: 3282846 - protein, 25 aa, Plasmodium falciparum
DDGIATIFIKLILQIVKNKSEIYTD

SEQ ID NO: 3282847 - protein, 29 aa, Plasmodium falciparum
DDGKNSIFGIPFPNFFDYTDFNLSDFSLS

SEQ ID NO: 3282848 - protein, 23 aa, Plasmodium falciparum
DDIALIIIILSYTINLYNFIFYY

SEQ ID NO: 3282849 - protein, 23 aa, Plasmodium falciparum
DDIGCFDIKFILDKRIFNNTYED

SEQ ID NO: 3282850 - protein, 28 aa, Plasmodium falciparum
DDIKKVKSFFFFLNLYEKKKTMEILQNI

SEQ ID NO: 3282851 - protein, 19 aa, Plasmodium falciparum
DDILILLYFPFPSKYWAAV

SEQ ID NO: 3282852 - protein, 40 aa, Plasmodium falciparum
DDINLPLMNLAEYDKYTFFLYLFYMKNSSYILKKQMKKDK

SEQ ID NO: 3282853 - protein, 26 aa, Plasmodium falciparum
DDIYKNNIYFLYDLAKRLINICTSIW

SEQ ID NO: 3282854 - protein, 31 aa, Plasmodium falciparum
DDKDCMDLLYFLIISLERIKMILGCLKNPYM

SEQ ID NO: 3282855 - protein, 23 aa, Plasmodium falciparum
DDKDKKCHILYIAAQENNGPRYC

SEQ ID NO: 3282856 - protein, 23 aa, Plasmodium falciparum
DDKGGITINFLYSGDEPTEIGKK

SEQ ID NO: 3282857 - protein, 25 aa, Plasmodium falciparum
DDKKKKKIFPVNDYGFVESKALSIL

SEQ ID NO: 3282858 - protein, 26 aa, Plasmodium falciparum
DDKKQYLELLLFWCKRDYKHFIDVVK

SEQ ID NO: 3282859 - protein, 23 aa, Plasmodium falciparum
DDKYILEKFPFMFDLLKEAQKKS

SEQ ID NO: 3282860 - protein, 17 aa, Plasmodium falciparum
DDLFHHLYNYIKYINSS

SEQ ID NO: 3282861 - protein, 24 aa, Plasmodium falciparum
DDLIIMLTYCAYKIENKEIIEYCF

SEQ ID NO: 3282862 - protein, 25 aa, Plasmodium falciparum
DDLKKLFILMFIRFIKIPMYDHNMD

SEQ ID NO: 3282863 - protein, 17 aa, Plasmodium falciparum
DDLKYITFINLLKIIMN

SEQ ID NO: 3282864 - protein, 21 aa, Plasmodium falciparum
DDLNFLRYNILTVAGGAENVY

SEQ ID NO: 3282865 - protein, 35 aa, Plasmodium falciparum
DDMFNSNIFLIKNLSFLLYLFYKVTNDNEFLNTYL

SEQ ID NO: 3282866 - protein, 33 aa, Plasmodium falciparum
DDMKYNDFYKYTLWYEPRELIYGDIRGMQMKKK

SEQ ID NO: 3282867 - protein, 21 aa, Plasmodium falciparum
DDMVSILIIFITCIRNIIYSL

SEQ ID NO: 3282868 - protein, 27 aa, Plasmodium falciparum
DDNEYLIYIYNILFLKDNNLFYQNKHI

SEQ ID NO: 3282869 - protein, 25 aa, Plasmodium falciparum
DDNFIKPFHVLFHPINKDIYTNRNQ

SEQ ID NO: 3282870 - protein, 22 aa, Plasmodium falciparum
DDNKKFNIFMYFGKNKKNDEDM

SEQ ID NO: 3282871 - protein, 27 aa, Plasmodium falciparum
DDNKNFYIVMEKLYGKELFNFLVYKKQ

SEQ ID NO: 3282872 - protein, 23 aa, Plasmodium falciparum
DDNKYVFPYIFNTFDSNVVSKDM

SEQ ID NO: 3282873 - protein, 25 aa, Plasmodium falciparum
DDNSLLAFFLLIQLEVPYFLDGLSS

SEQ ID NO: 3282874 - protein, 17 aa, Plasmodium falciparum
DDPLLNQLELFHKWLDR

SEQ ID NO: 3282875 - protein, 24 aa, Plasmodium falciparum
DDQIREYWWTANRETVWKAITCDE

SEQ ID NO: 3282876 - protein, 25 aa, Plasmodium falciparum
DDQIREYWWTANRHTVWKAITCKAD

SEQ ID NO: 3282877 - protein, 21 aa, Plasmodium falciparum
DDQIREYWWTENRETVWKAMT

SEQ ID NO: 3282878 - protein, 31 aa, Plasmodium falciparum
DDQVPTYFDYVPQYLRWFEEWGEDFCRKKKK

SEQ ID NO: 3282879 - protein, 29 aa, Plasmodium falciparum
DDSAILNYVYPYHKLLLFIQKNIQKGNYF

SEQ ID NO: 3282880 - protein, 40 aa, Plasmodium falciparum
DDSIFKKNFMKISVLYNVLFKIVVYDQRNLFEKEKILYSL

SEQ ID NO: 3282881 - protein, 23 aa, Plasmodium falciparum
DDSKVLMFLSTKLFSHATINCGG

SEQ ID NO: 3282882 - protein, 25 aa, Plasmodium falciparum
DDSLFSFNNLFYKLANYSIYLDMDT

SEQ ID NO: 3282883 - protein, 28 aa, Plasmodium falciparum
DDSPCFFFHFFIYYFLNDSNVLVKKAIL

SEQ ID NO: 3282884 - protein, 25 aa, Plasmodium falciparum
DDSTSFYYAIFYLSPKKYHHFHAPF

SEQ ID NO: 3282885 - protein, 26 aa, Plasmodium falciparum
DDTFELTVYVLLLSNIIFCYKVNFEY

SEQ ID NO: 3282886 - protein, 26 aa, Plasmodium falciparum
DDTLDISLYKLLFSFFMNLGSVDSTI

SEQ ID NO: 3282887 - protein, 18 aa, Plasmodium falciparum
DDTYYDLFLFFCTLLTSK

SEQ ID NO: 3282888 - protein, 31 aa, Plasmodium falciparum
DDYIPQRLRWMTEWAEWFCKAQSQEYDKLFM

SEQ ID NO: 3282889 - protein, 28 aa, Plasmodium falciparum
DDYIPQRLRWMTEWAEWFCKMQSQEYNK

SEQ ID NO: 3282890 - protein, 25 aa, Plasmodium falciparum
DDYSYVLTYLPLILLLHQKVSMKRI

SEQ ID NO: 3282891 - protein, 42 aa, Plasmodium falciparum
DECDTYFNIEFLYTLHTFELYYLFHIFKKLLLKKKDIEDDLI

SEQ ID NO: 3282892 - protein, 24 aa, Plasmodium falciparum
DECTKCSFWCRMYETWIDNQKKEF

SEQ ID NO: 3282893 - protein, 27 aa, Plasmodium falciparum
DEECKLKEYYILENKKLEISLNIIKPN

SEQ ID NO: 3282894 - protein, 25 aa, Plasmodium falciparum
DEEDLFIYLFLNYCNLINFNITNNN

SEQ ID NO: 3282895 - protein, 33 aa, Plasmodium falciparum
DEEIICEQFFFSKYNLPYVLKIPFSDLRLIDTC

SEQ ID NO: 3282896 - protein, 21 aa, Plasmodium falciparum
DEERILLLKYDSDAFVRYNSC

SEQ ID NO: 3282897 - protein, 24 aa, Plasmodium falciparum
DEEYNFLRILKFFSFFLEHYKNTC

SEQ ID NO: 3282898 - protein, 25 aa, Plasmodium falciparum
DEEYTPYTIPKLNKEEFINLGDIKD

SEQ ID NO: 3282899 - protein, 25 aa, Plasmodium falciparum
DEFITFLLNWKIYIIYRINNNNNDY

SEQ ID NO: 3282900 - protein, 23 aa, Plasmodium falciparum
DEFKRQMFYTLGDYKDILYSGDT

SEQ ID NO: 3282901 - protein, 17 aa, Plasmodium falciparum
DEFLFHKNKYYDNVIIN

SEQ ID NO: 3282902 - protein, 31 aa, Plasmodium falciparum
DEFQKTFNEFFYFWIGRFLNDSMYWRGKVGG

SEQ ID NO: 3282903 - protein, 27 aa, Plasmodium falciparum
DEFSEKILPYFFFKEDEQVWDKYIENE

SEQ ID NO: 3282904 - protein, 24 aa, Plasmodium falciparum
DEGTKELPLTPPAPAPAAPSSTPA

SEQ ID NO: 3282905 - protein, 31 aa, Plasmodium falciparum
DEGYLYIYNIFLGNFIWTKTKERALYKKNLT

SEQ ID NO: 3282906 - protein, 23 aa, Plasmodium falciparum
DEHKELLKFKNFTVFNVLNNEKI

SEQ ID NO: 3282907 - protein, 28 aa, Plasmodium falciparum
DEHLILFFDRVYFMLRKNGYFILEYNKE

SEQ ID NO: 3282908 - protein, 24 aa, Plasmodium falciparum
DEHLIYYYNYISKLRNRLIKGLKY

SEQ ID NO: 3282909 - protein, 25 aa, Plasmodium falciparum
DEHMNKLIISFRKTIYSWINRGLLE

SEQ ID NO: 3282910 - protein, 34 aa, Plasmodium falciparum
DEHVIKFLNLIKRKLIYKILFPDIQIDTKSKGRN

SEQ ID NO: 3282911 - protein, 24 aa, Plasmodium falciparum
DEIIYMRFIHKIKIKNMFALINNI

SEQ ID NO: 3282912 - protein, 34 aa, Plasmodium falciparum
DEIKTWFLIPHKYVINIIYLFLNILLTDESNFKL

SEQ ID NO: 3282913 - protein, 22 aa, Plasmodium falciparum
DEILNILKKNLIISPNIQLIKI

SEQ ID NO: 3282914 - protein, 28 aa, Plasmodium falciparum
DEILNQIYYILYIFTKKSLFNYKIFWFY

SEQ ID NO: 3282915 - protein, 24 aa, Plasmodium falciparum
DEIMPYYISMIKSISFFLNYHTSK

SEQ ID NO: 3282916 - protein, 30 aa, Plasmodium falciparum
DEIQKTFHDFFYYWVAHMLKDSIHWRTKKL

SEQ ID NO: 3282917 - protein, 30 aa, Plasmodium falciparum
DEIQKTFHNFFYYWVAHMLKDSIHWRTKKL

SEQ ID NO: 3282918 - protein, 24 aa, Plasmodium falciparum
DEISFYLHKKNYFINLLEKNKSNH

SEQ ID NO: 3282919 - protein, 20 aa, Plasmodium falciparum
DEIYCLYLKDCISKINLTYQ

SEQ ID NO: 3282920 - protein, 24 aa, Plasmodium falciparum
DEKEIFIIDKLLLTLTKKIHVLVK

SEQ ID NO: 3282921 - protein, 28 aa, Plasmodium falciparum
DEKIYTKINCLQWIELKHLEIMEGINFE

SEQ ID NO: 3282922 - protein, 17 aa, Plasmodium falciparum
DEKKFFNEIKEYLNKKY

SEQ ID NO: 3282923 - protein, 29 aa, Plasmodium falciparum
DEKKFYKNIYLWYLNCIHIINLQIYVMCH

SEQ ID NO: 3282924 - protein, 48 aa, Plasmodium falciparum
DEKKYIMNEILNILYIYPQLYVSCIISLFYLFILDNEIFEKYFNADDL

SEQ ID NO: 3282925 - protein, 25 aa, Plasmodium falciparum
DEKLFEKIYNDMFLRIGKIVTNKRK

SEQ ID NO: 3282926 - protein, 27 aa, Plasmodium falciparum
DEKLVDQLLIIIQSELLYHLIGSVAQS

SEQ ID NO: 3282927 - protein, 27 aa, Plasmodium falciparum
DEKRKLLDFSKLLFPGWKYYAEDEMKD

SEQ ID NO: 3282928 - protein, 24 aa, Plasmodium falciparum
DEKTYFFIYTLISTHIFGKGKLNK

SEQ ID NO: 3282929 - protein, 25 aa, Plasmodium falciparum
DEKWRNLTYLVWKNSIYSNIVPIHL

SEQ ID NO: 3282930 - protein, 20 aa, Plasmodium falciparum
DELCLLFYDKKKELIHFSLF

SEQ ID NO: 3282931 - protein, 29 aa, Plasmodium falciparum
DELDKLHNFLKNFQKILFHNGDNLKLKND

SEQ ID NO: 3282932 - protein, 27 aa, Plasmodium falciparum
DELKFYVKDKSLYAIIPPISENLKNEI

SEQ ID NO: 3282933 - protein, 21 aa, Plasmodium falciparum
DELMFFFPTIKFLFDKKKKKN

SEQ ID NO: 3282934 - protein, 17 aa, Plasmodium falciparum
DELVTLYDPIYSSNYES

SEQ ID NO: 3282935 - protein, 17 aa, Plasmodium falciparum
DELYIQDIIYKYFCLHY

SEQ ID NO: 3282936 - protein, 26 aa, Plasmodium falciparum
DENDIWIFLEYSSIGTLYSYVGFNIL

SEQ ID NO: 3282937 - protein, 26 aa, Plasmodium falciparum
DENEIYIIIPTFISLILQIYHVERIK

SEQ ID NO: 3282938 - protein, 21 aa, Plasmodium falciparum
DENILNHLPAHFNWKLYGQEN

SEQ ID NO: 3282939 - protein, 27 aa, Plasmodium falciparum
DENKYFGFMTMHILTLILWDIEETTQY

SEQ ID NO: 3282940 - protein, 21 aa, Plasmodium falciparum
DENNLFCKHKFFYANKNINEQ

SEQ ID NO: 3282941 - protein, 39 aa, Plasmodium falciparum
DENNLFLYKSYFYKIKKIFSLFYFDFFVCIINENISLEQ

SEQ ID NO: 3282942 - protein, 20 aa, Plasmodium falciparum
DENRINLIELYFDNVYNYVD

SEQ ID NO: 3282943 - protein, 30 aa, Plasmodium falciparum
DENYNIYLIKYKPLFMFVEDSSSFLYAFNK

SEQ ID NO: 3282944 - protein, 28 aa, Plasmodium falciparum
DEPPPTILNYLLPLMEAYLFIEEVILVS

SEQ ID NO: 3282945 - protein, 28 aa, Plasmodium falciparum
DEPQINRWLMEWAYDTDYNKNLWYNKLD

SEQ ID NO: 3282946 - protein, 31 aa, Plasmodium falciparum
DERKIYSLYKLCLIKIPYYSSLYKILPTMYD

SEQ ID NO: 3282947 - protein, 21 aa, Plasmodium falciparum
DESHFIFYNFSMSFQNEEEKE

SEQ ID NO: 3282948 - protein, 17 aa, Plasmodium falciparum
DESILHTTIPFGVALAL

SEQ ID NO: 3282949 - protein, 26 aa, Plasmodium falciparum
DESINLEVLLWLKKWNDKIRNEKNIN

SEQ ID NO: 3282950 - protein, 37 aa, Plasmodium falciparum
DESSEYCYYFYLFGLATTYTFFTFQFDRNRISQFLIF

SEQ ID NO: 3282951 - protein, 19 aa, Plasmodium falciparum
DEVPHYSALRYNKVEKNVT

SEQ ID NO: 3282952 - protein, 29 aa, Plasmodium falciparum
DEWELEETNFLLILTKTYMNYINMDEIIK

SEQ ID NO: 3282953 - protein, 18 aa, Plasmodium falciparum
DEWNYKIYLIKLTNVYNN

SEQ ID NO: 3282954 - protein, 24 aa, Plasmodium falciparum
DEYFNVKSFLETWIPKIAVVNDQD

SEQ ID NO: 3282955 - protein, 24 aa, Plasmodium falciparum
DEYGCIFILYINIPIQIDENNKII

SEQ ID NO: 3282956 - protein, 30 aa, Plasmodium falciparum
DEYIYGSLKYLLYFLSNKLICKKKIKCLIC

SEQ ID NO: 3282957 - protein, 23 aa, Plasmodium falciparum
DEYYKLMDVILNILKKHNKHVEC

SEQ ID NO: 3282958 - protein, 26 aa, Plasmodium falciparum
DFAKKPQFLRWMIEWGEEFCAERGKL

SEQ ID NO: 3282959 - protein, 26 aa, Plasmodium falciparum
DFANRPQFLRWFIEWSDEFCRERKKK

SEQ ID NO: 3282960 - protein, 22 aa, Plasmodium falciparum
DFCGTRKRMLDKIIFECRGNGK

SEQ ID NO: 3282961 - protein, 22 aa, Plasmodium falciparum
DFDFCKLSYCLDFLCFCDNMEY

SEQ ID NO: 3282962 - protein, 21 aa, Plasmodium falciparum
DFDFFFNFMNDPTDLPQCFIP

SEQ ID NO: 3282963 - protein, 23 aa, Plasmodium falciparum
DFDNTLMLLERKTNWIKDQNIMT

SEQ ID NO: 3282964 - protein, 33 aa, Plasmodium falciparum
DFEKGKNVMPYHPFFWKWVHDMLHDSVEWKTEL

SEQ ID NO: 3282965 - protein, 34 aa, Plasmodium falciparum
DFEKYVINIFKKKCFIIYIVDVLDLYVYSNLKKL

SEQ ID NO: 3282966 - protein, 18 aa, Plasmodium falciparum
DFFKKMLIIKKTDNNYIF

SEQ ID NO: 3282967 - protein, 26 aa, Plasmodium falciparum
DFFNEINYLPLTWKPRKDYIKAGIFP

SEQ ID NO: 3282968 - protein, 26 aa, Plasmodium falciparum
DFFQLREDWWALNREKVWSAITCNAQ

SEQ ID NO: 3282969 - protein, 20 aa, Plasmodium falciparum
DFFQLREDWWTANRETVWKA

SEQ ID NO: 3282970 - protein, 25 aa, Plasmodium falciparum
DFHAKNVSFLLWFDENYFCTCSEDG

SEQ ID NO: 3282971 - protein, 19 aa, Plasmodium falciparum
DFHQFLRKGSCEKREFLYF

SEQ ID NO: 3282972 - protein, 20 aa, Plasmodium falciparum
DFIKNELSNFLFLKKKISDL

SEQ ID NO: 3282973 - protein, 18 aa, Plasmodium falciparum
DFKHSLFYIFFMLPSDEC

SEQ ID NO: 3282974 - protein, 37 aa, Plasmodium falciparum
DFKNKNIYALPKLVWIIGITIFILLTGTHPFSKINND

SEQ ID NO: 3282975 - protein, 18 aa, Plasmodium falciparum
DFKPFFEFEYGKYEEKCM

SEQ ID NO: 3282976 - protein, 26 aa, Plasmodium falciparum
DFKRQMFYTFGDYKDILFGKYIGIDM

SEQ ID NO: 3282977 - protein, 21 aa, Plasmodium falciparum
DFLCSNILKYNLKITFETLEG

SEQ ID NO: 3282978 - protein, 20 aa, Plasmodium falciparum
DFLEYYLKLQFFEEVSEEKS

SEQ ID NO: 3282979 - protein, 20 aa, Plasmodium falciparum
DFLKQLLPRNSAAARNRVIR

SEQ ID NO: 3282980 - protein, 17 aa, Plasmodium falciparum
DFLNYYKCKCRFVIRTE

SEQ ID NO: 3282981 - protein, 18 aa, Plasmodium falciparum
DFLSLRKIFKTSKKIYSC

SEQ ID NO: 3282982 - protein, 26 aa, Plasmodium falciparum
DFLSNHFCISFPYVSHFKDNFLIRIY

SEQ ID NO: 3282983 - protein, 21 aa, Plasmodium falciparum
DFMGMRIIAEPLIPLNEQYIP

SEQ ID NO: 3282984 - protein, 27 aa, Plasmodium falciparum
DFMHDKWEFWLNWKKEDWEKLIDSEWT

SEQ ID NO: 3282985 - protein, 18 aa, Plasmodium falciparum
DFMKTFDSLLKKVYVCKG

SEQ ID NO: 3282986 - protein, 23 aa, Plasmodium falciparum
DFNHLILFLYSYVKLNGYIKKSI

SEQ ID NO: 3282987 - protein, 29 aa, Plasmodium falciparum
DFNLLPNFIHFFQRLFLSTIKLNEGEKKM

SEQ ID NO: 3282988 - protein, 27 aa, Plasmodium falciparum
DFNMEYRLLNILLFDSFYTGMNNVKSI

SEQ ID NO: 3282989 - protein, 19 aa, Plasmodium falciparum
DFPYDNLIILYLPIEFCEL

SEQ ID NO: 3282990 - protein, 19 aa, Plasmodium falciparum
DFQYFLENVLLLEDLVLKK

SEQ ID NO: 3282991 - protein, 19 aa, Plasmodium falciparum
DFRNFFFSSLSYENIQVSN

SEQ ID NO: 3282992 - protein, 17 aa, Plasmodium falciparum
DFRVNCKNSIYECRGIC

SEQ ID NO: 3282993 - protein, 20 aa, Plasmodium falciparum
DFRYYEYVTFISSLYLAFYI

SEQ ID NO: 3282994 - protein, 28 aa, Plasmodium falciparum
DFSNCIKIFFIFYKYGYILKKELINIFQ

SEQ ID NO: 3282995 - protein, 23 aa, Plasmodium falciparum
DFSSLYFYHYYPCTNINLNFLYA

SEQ ID NO: 3282996 - protein, 24 aa, Plasmodium falciparum
DFTSRPTYFRYLEEWGETFCRQRT

SEQ ID NO: 3282997 - protein, 27 aa, Plasmodium falciparum
DFVIIYFLIYIVLMSITILPFFHRIFS

SEQ ID NO: 3282998 - protein, 18 aa, Plasmodium falciparum
DFVLDIEKLPILTKNQMK

SEQ ID NO: 3282999 - protein, 17 aa, Plasmodium falciparum
DFYCSVVILSNLCFHID

SEQ ID NO: 3283000 - protein, 26 aa, Plasmodium falciparum
DFYDKKILSFLNIPLSYFLLQDQNKD

SEQ ID NO: 3283001 - protein, 23 aa, Plasmodium falciparum
DFYRKYICLAVQKYIYNKNNIKH

SEQ ID NO: 3283002 - protein, 25 aa, Plasmodium falciparum
DFYSSTFIHFAFADPYDTFDLLKIK

SEQ ID NO: 3283003 - protein, 24 aa, Plasmodium falciparum
DGAICIPPRRRKLYLHKIEGVDTT

SEQ ID NO: 3283004 - protein, 31 aa, Plasmodium falciparum
DGAICVPPRRRKLYLGGFKRLTDGTAVSSEA

SEQ ID NO: 3283005 - protein, 42 aa, Plasmodium falciparum
DGDKIIYPCGYLNMRIFYNLPSYYLFQIYKNANIDDINRKTK

SEQ ID NO: 3283006 - protein, 27 aa, Plasmodium falciparum
DGEMERKKFIIVGQNNFIIDSDDMKNP

SEQ ID NO: 3283007 - protein, 24 aa, Plasmodium falciparum
DGGINKEIYTPKIYVSEFKNNDDG

SEQ ID NO: 3283008 - protein, 18 aa, Plasmodium falciparum
DGIDINLFLLSYISMYPY

SEQ ID NO: 3283009 - protein, 25 aa, Plasmodium falciparum
DGIDIRGILWMPIAITSFLSSQCIF

SEQ ID NO: 3283010 - protein, 40 aa, Plasmodium falciparum
DGIERLYICIFICSVMLFFFSYFHMSALIQLIPTPVFIGY

SEQ ID NO: 3283011 - protein, 37 aa, Plasmodium falciparum
DGIIQSICYIVLLICIILLIKLGIPSTYLFAGRLTIL

SEQ ID NO: 3283012 - protein, 18 aa, Plasmodium falciparum
DGIYYLIRQENGLNICQK

SEQ ID NO: 3283013 - protein, 24 aa, Plasmodium falciparum
DGKFVNHSFLGDVLLAANHEAKKI

SEQ ID NO: 3283014 - protein, 17 aa, Plasmodium falciparum
DGKNQFMQFLKKNVFFS

SEQ ID NO: 3283015 - protein, 35 aa, Plasmodium falciparum
DGKNSVFLLLFLFFGFVFCLLYHAFLYHSIKSEHK

SEQ ID NO: 3283016 - protein, 18 aa, Plasmodium falciparum
DGLDFHFLSRTDALKFCD

SEQ ID NO: 3283017 - protein, 24 aa, Plasmodium falciparum
DGNNPVLCEMYENKIKELNKRLDE

SEQ ID NO: 3283018 - protein, 25 aa, Plasmodium falciparum
DGTISIFIDTLIKFFLKQNSNNENK

SEQ ID NO: 3283019 - protein, 23 aa, Plasmodium falciparum
DGTYDIIFFKGNIIELYGLKAYK

SEQ ID NO: 3283020 - protein, 19 aa, Plasmodium falciparum
DGTYYYNSIINLNKILLRK

SEQ ID NO: 3283021 - protein, 45 aa, Plasmodium falciparum
DGVFQAVLFPLYTFVILRLPFVNAVLCNIIFLGLFIIRFNGDHFL

SEQ ID NO: 3283022 - protein, 26 aa, Plasmodium falciparum
DGVRYKKFFSSFKYGNLLAKKKCIEW

SEQ ID NO: 3283023 - protein, 22 aa, Plasmodium falciparum
DGYESKFYKILKIDYQNVEDFL

SEQ ID NO: 3283024 - protein, 24 aa, Plasmodium falciparum
DHCSSVWKVISSFALHHLKNPDSL

SEQ ID NO: 3283025 - protein, 22 aa, Plasmodium falciparum
DHIIFIWLEQNIRLFNDLLLFY

SEQ ID NO: 3283026 - protein, 28 aa, Plasmodium falciparum
DHKKDLQDLLLFIQQIKQYNILTDHKIT

SEQ ID NO: 3283027 - protein, 23 aa, Plasmodium falciparum
DHKWRDDMWNKQWGKYLDAAHDN

SEQ ID NO: 3283028 - protein, 22 aa, Plasmodium falciparum
DHLKSELKKIKLNNLMIIQDNF

SEQ ID NO: 3283029 - protein, 39 aa, Plasmodium falciparum
DHLWKSNINIYFKKILLFLLLLLLLFSSYNNLNNTNVLQ

SEQ ID NO: 3283030 - protein, 36 aa, Plasmodium falciparum
DHLYSIRNYIECLRNAPYIDDPLWGSVVTDKRNNCL

SEQ ID NO: 3283031 - protein, 21 aa, Plasmodium falciparum
DHNFTHFIHLFLSIHEESYNN

SEQ ID NO: 3283032 - protein, 21 aa, Plasmodium falciparum
DHNIDYYCNTPFDDELDKLHN

SEQ ID NO: 3283033 - protein, 19 aa, Plasmodium falciparum
DHNLLGYKLGNNLKSYLIE

SEQ ID NO: 3283034 - protein, 20 aa, Plasmodium falciparum
DHSSVIFFTYKYGRNIPINF

SEQ ID NO: 3283035 - protein, 27 aa, Plasmodium falciparum
DHYKKYEEFLVCYGKIIYFNEMKNIYI

SEQ ID NO: 3283036 - protein, 18 aa, Plasmodium falciparum
DIAKYNMILLNEQCIYIS

SEQ ID NO: 3283037 - protein, 31 aa, Plasmodium falciparum
DIANSYLIDIYHILSFEKNQKLFFNKINNNR

SEQ ID NO: 3283038 - protein, 22 aa, Plasmodium falciparum
DICDSYIGYGVHLLINLNSTLY

SEQ ID NO: 3283039 - protein, 19 aa, Plasmodium falciparum
DICEILNKFKMNLSKKNTD

SEQ ID NO: 3283040 - protein, 51 aa, Plasmodium falciparum
DICNNFYNILKYNSYNYEKFYVFILLCIKCIVSIRNDKLINFVPHNGRKKF

SEQ ID NO: 3283041 - protein, 20 aa, Plasmodium falciparum
DICPEKVLFNLIFEFTKTPI

SEQ ID NO: 3283042 - protein, 19 aa, Plasmodium falciparum
DICTLLKHKNMYEFIHIPV

SEQ ID NO: 3283043 - protein, 23 aa, Plasmodium falciparum
DIDKFPILHYFDFLTYMKKHKQF

SEQ ID NO: 3283044 - protein, 29 aa, Plasmodium falciparum
DIDQNQIILIRALFKRWVEYFFEDYNKIK

SEQ ID NO: 3283045 - protein, 25 aa, Plasmodium falciparum
DIDYDDYYFLIYDDFPHTYDIKNEI

SEQ ID NO: 3283046 - protein, 32 aa, Plasmodium falciparum
DIEKKIFYEYFYIFSLCTLLTSYSCLVSPCID

SEQ ID NO: 3283047 - protein, 28 aa, Plasmodium falciparum
DIENIVWIYKYILLFLNIQIYCINIFLY

SEQ ID NO: 3283048 - protein, 29 aa, Plasmodium falciparum
DIERNNLFDILYMLKRIDSYVKNIYSIIS

SEQ ID NO: 3283049 - protein, 28 aa, Plasmodium falciparum
DIERVPQFLRWFQEWTEIFCIKRKTLYD

SEQ ID NO: 3283050 - protein, 24 aa, Plasmodium falciparum
DIEVFKIFIYYSIILKLCDDLIRY

SEQ ID NO: 3283051 - protein, 23 aa, Plasmodium falciparum
DIFISNFYIFQLQKCILYEFLNS

SEQ ID NO: 3283052 - protein, 23 aa, Plasmodium falciparum
DIFKNYVFLMNKEKYFFDISFFK

SEQ ID NO: 3283053 - protein, 17 aa, Plasmodium falciparum
DIFLEKIFNLIFSTNKE

SEQ ID NO: 3283054 - protein, 26 aa, Plasmodium falciparum
DIFMKFYTVYLFIKHYGHLNLVYNRA

SEQ ID NO: 3283055 - protein, 20 aa, Plasmodium falciparum
DIFRIKTLSKIYKLIKCISK

SEQ ID NO: 3283056 - protein, 19 aa, Plasmodium falciparum
DIFYLYYNLNKYKNIQRVM

SEQ ID NO: 3283057 - protein, 20 aa, Plasmodium falciparum
DIFYNLINNFILKKIKEKKY

SEQ ID NO: 3283058 - protein, 19 aa, Plasmodium falciparum
DIFYWFHMLYNINYNEELM

SEQ ID NO: 3283059 - protein, 21 aa, Plasmodium falciparum
DIHKYIFKSIDMYIYIICYYF

SEQ ID NO: 3283060 - protein, 18 aa, Plasmodium falciparum
DIHNYIYEENPFNILDNI

SEQ ID NO: 3283061 - protein, 23 aa, Plasmodium falciparum
DIHPYLVVDILNKGLHAMKAYAS

SEQ ID NO: 3283062 - protein, 27 aa, Plasmodium falciparum
DIHRWKIIVPALVGLWSGLIIGFTTEF

SEQ ID NO: 3283063 - protein, 27 aa, Plasmodium falciparum
DIIHVIYSFYLFQNYHFFISKNNFCDL

SEQ ID NO: 3283064 - protein, 17 aa, Plasmodium falciparum
DIIINKYIYLYVTEILK

SEQ ID NO: 3283065 - protein, 25 aa, Plasmodium falciparum
DIIKKIIKIIFTIKKINFLLNHSES

SEQ ID NO: 3283066 - protein, 18 aa, Plasmodium falciparum
DIIKLVGISIFDCIHKSY

SEQ ID NO: 3283067 - protein, 17 aa, Plasmodium falciparum
DIIKWIYRYINNCNIFF

SEQ ID NO: 3283068 - protein, 21 aa, Plasmodium falciparum
DIIKYFLSFLLYDPQVIKKRK

SEQ ID NO: 3283069 - protein, 30 aa, Plasmodium falciparum
DIILGRAIIPLFLILNTYKWKIKKIKNKIR

SEQ ID NO: 3283070 - protein, 37 aa, Plasmodium falciparum
DIILLRNKIVLDIIEIFVYIPWNFGVDTGMYTPLVPM

SEQ ID NO: 3283071 - protein, 38 aa, Plasmodium falciparum
DIILRIKRILIINNIHIYLIKKIYLFWCYSCKSNDNSF

SEQ ID NO: 3283072 - protein, 20 aa, Plasmodium falciparum
DIILRIKVIFIIITIFHVIL

SEQ ID NO: 3283073 - protein, 27 aa, Plasmodium falciparum
DIINEFYFLIEFFNNLPILLNGKEDEL

SEQ ID NO: 3283074 - protein, 21 aa, Plasmodium falciparum
DIINKLVWEDLYFLQLCFEEC

SEQ ID NO: 3283075 - protein, 25 aa, Plasmodium falciparum
DIIQRWIRVIFNIIITSLIVTLIYY

SEQ ID NO: 3283076 - protein, 24 aa, Plasmodium falciparum
DIKKKMIFNKESFFLPIREGNTYN

SEQ ID NO: 3283077 - protein, 24 aa, Plasmodium falciparum
DIKNIIWTDKWRYLISGDYKDNYI

SEQ ID NO: 3283078 - protein, 26 aa, Plasmodium falciparum
DIKSPYLNFVLLKNYIESLFTHINLN

SEQ ID NO: 3283079 - protein, 21 aa, Plasmodium falciparum
DIKYIYGLYGIPINKIIYSFI

SEQ ID NO: 3283080 - protein, 25 aa, Plasmodium falciparum
DIKYVTYIFKSFLRISLFNPGHLKN

SEQ ID NO: 3283081 - protein, 23 aa, Plasmodium falciparum
DILGYILPFSFIPCVLLGNLSDK

SEQ ID NO: 3283082 - protein, 21 aa, Plasmodium falciparum
DILHDIMSLIIFLVFILVFVL

SEQ ID NO: 3283083 - protein, 21 aa, Plasmodium falciparum
DILKQDDLFYKCTNEHLGNAT

SEQ ID NO: 3283084 - protein, 20 aa, Plasmodium falciparum
DILLRNLIYNLYYAFDQIKE

SEQ ID NO: 3283085 - protein, 19 aa, Plasmodium falciparum
DILMNILRDSIPPHMMNMN

SEQ ID NO: 3283086 - protein, 34 aa, Plasmodium falciparum
DILNNKFYRKWKSKNIMFDIISINLALHYVIYNE

SEQ ID NO: 3283087 - protein, 37 aa, Plasmodium falciparum
DILQTPFLNIYMKISIYIFDILTIAPGIYVYCIATRY

SEQ ID NO: 3283088 - protein, 30 aa, Plasmodium falciparum
DILSLILLTPYYFLIFVFRNLKGEIIIIEK

SEQ ID NO: 3283089 - protein, 38 aa, Plasmodium falciparum
DILSSTIPFGIAIALTSIVFLFLKVINIVKKTKSTIDL

SEQ ID NO: 3283090 - protein, 17 aa, Plasmodium falciparum
DILTMRRKARHGDYKTK

SEQ ID NO: 3283091 - protein, 18 aa, Plasmodium falciparum
DILYCSTGPRISPKNMKW

SEQ ID NO: 3283092 - protein, 25 aa, Plasmodium falciparum
DIMDELYYLYQCKIYKSLSLIIIKG

SEQ ID NO: 3283093 - protein, 27 aa, Plasmodium falciparum
DIMERRMKWYAFRLKKDKTIFEWITFL

SEQ ID NO: 3283094 - protein, 41 aa, Plasmodium falciparum
DIMQIMSVMFWYKVILIVIFAWLPFFIIKKVKNIITPSQFF

SEQ ID NO: 3283095 - protein, 29 aa, Plasmodium falciparum
DIMRTKHIFMMLWNYIYNTDYYIKSKQVN

SEQ ID NO: 3283096 - protein, 18 aa, Plasmodium falciparum
DINCCDSFYGLKVWDILF

SEQ ID NO: 3283097 - protein, 27 aa, Plasmodium falciparum
DINCVYKILFYMYEICLYYLCSSIYFI

SEQ ID NO: 3283098 - protein, 38 aa, Plasmodium falciparum
DINIRTNIFLFVYLFAGKLISFVDFDYILNNTIFYNDY

SEQ ID NO: 3283099 - protein, 36 aa, Plasmodium falciparum
DINIYILINHVIIPSLFYLYMNFLKFIVTNHIKLDF

SEQ ID NO: 3283100 - protein, 25 aa, Plasmodium falciparum
DINKGVLLPPRRKNLFLKIDESDIC

SEQ ID NO: 3283101 - protein, 25 aa, Plasmodium falciparum
DINNFYLTYNAYISLILDMKCNSYL

SEQ ID NO: 3283102 - protein, 23 aa, Plasmodium falciparum
DINNIYNYYKYNFLLCFNENIKN

SEQ ID NO: 3283103 - protein, 24 aa, Plasmodium falciparum
DINNKIFYVAYNYPIININNKNND

SEQ ID NO: 3283104 - protein, 18 aa, Plasmodium falciparum
DINTHILLQIQTDLQYLI

SEQ ID NO: 3283105 - protein, 20 aa, Plasmodium falciparum
DINYIYKLINIITNIFNMLD

SEQ ID NO: 3283106 - protein, 27 aa, Plasmodium falciparum
DIPDGFLRQMFYTLGDYRDILEGKNDI

SEQ ID NO: 3283107 - protein, 27 aa, Plasmodium falciparum
DIPKVIFKLLNYFYKKKKLKKKIHSIE

SEQ ID NO: 3283108 - protein, 29 aa, Plasmodium falciparum
DIPRSPCDLDFWFHTNVWRDKAYERDPCY

SEQ ID NO: 3283109 - protein, 27 aa, Plasmodium falciparum
DIPTPFLRQMFYTLGDYRDILVRGGNT

SEQ ID NO: 3283110 - protein, 24 aa, Plasmodium falciparum
DIQIIQYIFLNISNDTLFSCYNMI

SEQ ID NO: 3283111 - protein, 26 aa, Plasmodium falciparum
DIQNEMLDFLFWILSNNSNENVMDII

SEQ ID NO: 3283112 - protein, 21 aa, Plasmodium falciparum
DIRFLIHVNKRIPIFSGVGGG

SEQ ID NO: 3283113 - protein, 21 aa, Plasmodium falciparum
DIRHFDFIFTKQEINNMFNMS

SEQ ID NO: 3283114 - protein, 21 aa, Plasmodium falciparum
DIRSILNTIYFLSIGSRNTIT

SEQ ID NO: 3283115 - protein, 26 aa, Plasmodium falciparum
DISKFISIFEIILLKNLENILYYEKV

SEQ ID NO: 3283116 - protein, 17 aa, Plasmodium falciparum
DISLPWNKDKMVKLFLN

SEQ ID NO: 3283117 - protein, 25 aa, Plasmodium falciparum
DISNNIFMWLTYINSTSVKIGNLGR

SEQ ID NO: 3283118 - protein, 21 aa, Plasmodium falciparum
DISTFFYIISKFNQQVYNCKN

SEQ ID NO: 3283119 - protein, 17 aa, Plasmodium falciparum
DISTILYSLSLFSSDCI

SEQ ID NO: 3283120 - protein, 26 aa, Plasmodium falciparum
DISTLLIEFFKFYGYKYKSGIIAIRD

SEQ ID NO: 3283121 - protein, 29 aa, Plasmodium falciparum
DISTPINFLCIFIPTLFDMNNMDLLKQAL

SEQ ID NO: 3283122 - protein, 26 aa, Plasmodium falciparum
DISYKLFISSWINLLNNNIAKTEFYY

SEQ ID NO: 3283123 - protein, 50 aa, Plasmodium falciparum
DITMASFSRISLILSLASVIFSRLSNFFYVFYDNFYYQNFTNSYNRYPGS

SEQ ID NO: 3283124 - protein, 37 aa, Plasmodium falciparum
DITNFIYSGMMYFEKLRKRLLYKYKHTFRSKIKNLPD

SEQ ID NO: 3283125 - protein, 19 aa, Plasmodium falciparum
DIVNYLIAGIVLLALILAV

SEQ ID NO: 3283126 - protein, 24 aa, Plasmodium falciparum
DIVTLKNAIIFVSKLYIEKPILLH

SEQ ID NO: 3283127 - protein, 17 aa, Plasmodium falciparum
DIWNGMVCALTYKEDTS

SEQ ID NO: 3283128 - protein, 36 aa, Plasmodium falciparum
DIYEQGLYYNTYLRKILFSFFFKNSNIFYMYMNHGQ

SEQ ID NO: 3283129 - protein, 21 aa, Plasmodium falciparum
DIYFYIFNRFGEYSDTLYVEL

SEQ ID NO: 3283130 - protein, 34 aa, Plasmodium falciparum
DIYHIAPFLNIIRNNNIFYKIKLIALHSLDHILK

SEQ ID NO: 3283131 - protein, 36 aa, Plasmodium falciparum
DIYIKHMKYLISFNKLILNDLYIYKKIRKPKNEKIC

SEQ ID NO: 3283132 - protein, 26 aa, Plasmodium falciparum
DIYIRNIYLHYVLNEKWLNMYIKRNE

SEQ ID NO: 3283133 - protein, 17 aa, Plasmodium falciparum
DIYLYDLTQNKWKKLIT

SEQ ID NO: 3283134 - protein, 21 aa, Plasmodium falciparum
DIYLYSTISNKNYVKYVGGHT

SEQ ID NO: 3283135 - protein, 20 aa, Plasmodium falciparum
DIYNFYKIPLKKKITKCLFC

SEQ ID NO: 3283136 - protein, 28 aa, Plasmodium falciparum
DIYRLHFIKYFMFLNIRNIFKKYTLSNN

SEQ ID NO: 3283137 - protein, 29 aa, Plasmodium falciparum
DIYSAALILLELLCPRFTTIMERYKRLND

SEQ ID NO: 3283138 - protein, 18 aa, Plasmodium falciparum
DKCIFKIIFIDEHKELLK

SEQ ID NO: 3283139 - protein, 26 aa, Plasmodium falciparum
DKDEILSIIIYLTIYLCCKLNIMKRI

SEQ ID NO: 3283140 - protein, 21 aa, Plasmodium falciparum
DKDFFIQYIALKCLSNLFILH

SEQ ID NO: 3283141 - protein, 31 aa, Plasmodium falciparum
DKDFLKYRRKKLEVILWVKIYMSVLEEEKNE

SEQ ID NO: 3283142 - protein, 26 aa, Plasmodium falciparum
DKDKLLTYLEFFKFNFGSSTKNIKQA

SEQ ID NO: 3283143 - protein, 20 aa, Plasmodium falciparum
DKEGWYGCKVAMLVSTGIIG

SEQ ID NO: 3283144 - protein, 22 aa, Plasmodium falciparum
DKEKKRFLGLKNVLRKYQEEFP

SEQ ID NO: 3283145 - protein, 36 aa, Plasmodium falciparum
DKEMEFNVFFQRWLRYFVYDYNILKDKIKACVITKD

SEQ ID NO: 3283146 - protein, 37 aa, Plasmodium falciparum
DKENCIMYRKVNFFIFVYILIYIIKTSTRKIQAIKDD

SEQ ID NO: 3283147 - protein, 24 aa, Plasmodium falciparum
DKENYLINLLYKLNQNKKYNIIVI

SEQ ID NO: 3283148 - protein, 24 aa, Plasmodium falciparum
DKESLHMLIPMEIPIRKMNKSKSN

SEQ ID NO: 3283149 - protein, 25 aa, Plasmodium falciparum
DKEYIQIRALLKRWVDHFLEDYIKI

SEQ ID NO: 3283150 - protein, 32 aa, Plasmodium falciparum
DKFDLSFIIFKNIFFFLKIYIDNDINIYILIN

SEQ ID NO: 3283151 - protein, 20 aa, Plasmodium falciparum
DKFFQLREDWWTANRHTVWK

SEQ ID NO: 3283152 - protein, 32 aa, Plasmodium falciparum
DKFFRKFINFNFSFFFIIYDYITNSKSYPEHS

SEQ ID NO: 3283153 - protein, 26 aa, Plasmodium falciparum
DKFMLGVLFIWIWNNDYLWKSSDIEQ

SEQ ID NO: 3283154 - protein, 22 aa, Plasmodium falciparum
DKGCAFLYEDIYYRNVAQTNSP

SEQ ID NO: 3283155 - protein, 31 aa, Plasmodium falciparum
DKGTLLDFFNKAYIKWLRFLNLKEKTDELIF

SEQ ID NO: 3283156 - protein, 26 aa, Plasmodium falciparum
DKHEEKPFIMLIQDRNLLIREEYSYN

SEQ ID NO: 3283157 - protein, 25 aa, Plasmodium falciparum
DKIHDSFFYEDTLNYKAYFDKLKDL

SEQ ID NO: 3283158 - protein, 22 aa, Plasmodium falciparum
DKINDIYLLKKKKIYTILNTQK

SEQ ID NO: 3283159 - protein, 19 aa, Plasmodium falciparum
DKINIFYIKNILQTNIDIY

SEQ ID NO: 3283160 - protein, 24 aa, Plasmodium falciparum
DKIYYFMCFFDEKKRFQIGSNNYV

SEQ ID NO: 3283161 - protein, 24 aa, Plasmodium falciparum
DKKCLLCYFMLSVPHFLYPFKLYN

SEQ ID NO: 3283162 - protein, 25 aa, Plasmodium falciparum
DKKFTFPDFFFLTDQELFDLLSNSD

SEQ ID NO: 3283163 - protein, 24 aa, Plasmodium falciparum
DKKIKIFLDYILSSAYKNVTKELT

SEQ ID NO: 3283164 - protein, 21 aa, Plasmodium falciparum
DKKILERRLILMKKEGILMKN

SEQ ID NO: 3283165 - protein, 27 aa, Plasmodium falciparum
DKKILKFRLFILKGILKRFLFCCSYFN

SEQ ID NO: 3283166 - protein, 19 aa, Plasmodium falciparum
DKKIRKQIFYLAKRKRSMN

SEQ ID NO: 3283167 - protein, 27 aa, Plasmodium falciparum
DKKKKSNFFVKIKNGTDLKDTKKDRIR

SEQ ID NO: 3283168 - protein, 47 aa, Plasmodium falciparum
DKKKLFKFFLHILILKQIIFESFINLAIKMSILLHVVKRYLTYNKKN

SEQ ID NO: 3283169 - protein, 22 aa, Plasmodium falciparum
DKKKLFNFLSDNNILSLPRTKI

SEQ ID NO: 3283170 - protein, 26 aa, Plasmodium falciparum
DKKLNKYNFLMEYQKIISSDKITSGI

SEQ ID NO: 3283171 - protein, 24 aa, Plasmodium falciparum
DKKNKFSFLNYWNDKDIPKEGSAD

SEQ ID NO: 3283172 - protein, 33 aa, Plasmodium falciparum
DKKYITMKELLKRWLEYFFEDYNRIQKKLKPCT

SEQ ID NO: 3283173 - protein, 32 aa, Plasmodium falciparum
DKLFYKTYFDLYYNLRGLYLDLYKYEKKKFNE

SEQ ID NO: 3283174 - protein, 26 aa, Plasmodium falciparum
DKLGPLILVLTLTFSLSTVVILNIYS

SEQ ID NO: 3283175 - protein, 26 aa, Plasmodium falciparum
DKLKEAFPIPNLFDPSFEKAITTETY

SEQ ID NO: 3283176 - protein, 22 aa, Plasmodium falciparum
DKLKIFPLLLDYQKNCIYVEKT

SEQ ID NO: 3283177 - protein, 26 aa, Plasmodium falciparum
DKLKRDTFPLFLRKKKKKLFQAQNYI

SEQ ID NO: 3283178 - protein, 24 aa, Plasmodium falciparum
DKLLSTIFIYVFSVKENKFIYHTE

SEQ ID NO: 3283179 - protein, 27 aa, Plasmodium falciparum
DKLNDTLMWFSFLNIIIIVIAAIVQDF

SEQ ID NO: 3283180 - protein, 21 aa, Plasmodium falciparum
DKLQDFFLSPHQYLPITNEQT

SEQ ID NO: 3283181 - protein, 18 aa, Plasmodium falciparum
DKLYDYKKIGYLFAEFKK

SEQ ID NO: 3283182 - protein, 19 aa, Plasmodium falciparum
DKMIYSCYLSLENNLNFIE

SEQ ID NO: 3283183 - protein, 17 aa, Plasmodium falciparum
DKMYLIIIICHSLTNTR

SEQ ID NO: 3283184 - protein, 27 aa, Plasmodium falciparum
DKNEFITLISACRLLWRKLADDMTKAC

SEQ ID NO: 3283185 - protein, 24 aa, Plasmodium falciparum
DKNIFMNIIFLIENAHLTYFTFIN

SEQ ID NO: 3283186 - protein, 17 aa, Plasmodium falciparum
DKNIILFLKHKKNLCFQ

SEQ ID NO: 3283187 - protein, 31 aa, Plasmodium falciparum
DKNIVYMTINLYKYLFIIPDIYEYFTRYNLL

SEQ ID NO: 3283188 - protein, 30 aa, Plasmodium falciparum
DKNKNCLKILDFLTIYLPEISNSPLKREKW

SEQ ID NO: 3283189 - protein, 27 aa, Plasmodium falciparum
DKNMNSFFYLQIYIYNLNTLDKCLFFN

SEQ ID NO: 3283190 - protein, 36 aa, Plasmodium falciparum
DKNNKLVYMPFYLTESFLNLIPHYNLNKSFMNSFCF

SEQ ID NO: 3283191 - protein, 30 aa, Plasmodium falciparum
DKNNTWYIGVLLYLFLFGTYPFISNNVLLN

SEQ ID NO: 3283192 - protein, 22 aa, Plasmodium falciparum
DKNQFHILRRMPISKSGDDVNL

SEQ ID NO: 3283193 - protein, 19 aa, Plasmodium falciparum
DKNTFLCMCTDIKINNIID

SEQ ID NO: 3283194 - protein, 33 aa, Plasmodium falciparum
DKQFLLNELFANNILNIIFIPSQIYEILLKLSK

SEQ ID NO: 3283195 - protein, 19 aa, Plasmodium falciparum
DKQHKLIEQLQKDIQDRKN

SEQ ID NO: 3283196 - protein, 27 aa, Plasmodium falciparum
DKQNAPIRVLFKRWIENFLKDHNKIKD

SEQ ID NO: 3283197 - protein, 30 aa, Plasmodium falciparum
DKRKIKCFLFYMWLNIFIPLEYAKKIMNIL

SEQ ID NO: 3283198 - protein, 25 aa, Plasmodium falciparum
DKRLHLCCEISDYCLKFFNPKSIEY

SEQ ID NO: 3283199 - protein, 26 aa, Plasmodium falciparum
DKRNIILIIILLYISSSPLNILSIRL

SEQ ID NO: 3283200 - protein, 23 aa, Plasmodium falciparum
DKRNNCLQHIKLLEMQESERRKQ

SEQ ID NO: 3283201 - protein, 47 aa, Plasmodium falciparum
DKRNYNICLLCEIPRMYYIFYLKDLRLFLEYLDDGILNVFISKSYKK

SEQ ID NO: 3283202 - protein, 28 aa, Plasmodium falciparum
DKSIITLYFLFFQFFYKYLVFHCEDIFK

SEQ ID NO: 3283203 - protein, 24 aa, Plasmodium falciparum
DKSIQFTIFFTKLLKCLLRGYEID

SEQ ID NO: 3283204 - protein, 37 aa, Plasmodium falciparum
DKSLRKWFIESAAVETFFLWDRYKKLNTPQSGSPLLG

SEQ ID NO: 3283205 - protein, 28 aa, Plasmodium falciparum
DKSNYLIKNCKFVFNFLSKVLINSCNQN

SEQ ID NO: 3283206 - protein, 26 aa, Plasmodium falciparum
DKSVSYFYMFFFDLPREEEIKMYISD

SEQ ID NO: 3283207 - protein, 30 aa, Plasmodium falciparum
DKSVTCFILYKYQKMLWFQILFNLNEESNN

SEQ ID NO: 3283208 - protein, 29 aa, Plasmodium falciparum
DKTAISFVQMNNSMIPFVCSHRSKEILYT

SEQ ID NO: 3283209 - protein, 32 aa, Plasmodium falciparum
DKVPTYFDYVPQYLRWFEEWAEDFCRLRKHKL

SEQ ID NO: 3283210 - protein, 22 aa, Plasmodium falciparum
DKYFPILLELKNNPKCAICLID

SEQ ID NO: 3283211 - protein, 21 aa, Plasmodium falciparum
DKYFYFIEFINNIIKDGIVNF

SEQ ID NO: 3283212 - protein, 20 aa, Plasmodium falciparum
DKYKLFFNFCKDSYLKIPII

SEQ ID NO: 3283213 - protein, 24 aa, Plasmodium falciparum
DKYKNEFLLTKDILKRVQDKYQEM

SEQ ID NO: 3283214 - protein, 26 aa, Plasmodium falciparum
DKYKNILFFYYMIYKTFKKIKKNIIN

SEQ ID NO: 3283215 - protein, 23 aa, Plasmodium falciparum
DKYKYIGFILLIKLCSIFERNIF

SEQ ID NO: 3283216 - protein, 28 aa, Plasmodium falciparum
DKYMLGIMLIWIWDYKYLWNKADSLEDN

SEQ ID NO: 3283217 - protein, 27 aa, Plasmodium falciparum
DKYMLGVFFIWVWNNGYLWSRSDPEQD

SEQ ID NO: 3283218 - protein, 24 aa, Plasmodium falciparum
DLDGATYAYQYLSKKLKPICQNGT

SEQ ID NO: 3283219 - protein, 28 aa, Plasmodium falciparum
DLEKTHLVLMYFGSLFKNNHTFKFILNK

SEQ ID NO: 3283220 - protein, 27 aa, Plasmodium falciparum
DLEKYNEPYYYDFYKHDIYYDVNDDKA

SEQ ID NO: 3283221 - protein, 32 aa, Plasmodium falciparum
DLFCIYAIILKYFPYSFKLWYHYIKDSIEMIT

SEQ ID NO: 3283222 - protein, 18 aa, Plasmodium falciparum
DLFECNKLVFELSASDQP

SEQ ID NO: 3283223 - protein, 21 aa, Plasmodium falciparum
DLFFVLNNKYFIFPSAMYIIF

SEQ ID NO: 3283224 - protein, 25 aa, Plasmodium falciparum
DLFNYNFITARFRYKKNFEISMLQK

SEQ ID NO: 3283225 - protein, 45 aa, Plasmodium falciparum
DLGRSDAHLWLFVEYLNVGIYLYKRIYTIYIKLLTVFESLIYLTN

SEQ ID NO: 3283226 - protein, 24 aa, Plasmodium falciparum
DLHKELFPVKYHSDFYFSICNFDD

SEQ ID NO: 3283227 - protein, 20 aa, Plasmodium falciparum
DLIHLMRWNITYKFMATIKT

SEQ ID NO: 3283228 - protein, 34 aa, Plasmodium falciparum
DLIIVKLLFLPKQLWFYIIWNIKWVIKYNILNED

SEQ ID NO: 3283229 - protein, 27 aa, Plasmodium falciparum
DLIIVLAIYFLFFYFIVMENNICVYDC

SEQ ID NO: 3283230 - protein, 17 aa, Plasmodium falciparum
DLIKIRIRIPRNTKKIL

SEQ ID NO: 3283231 - protein, 18 aa, Plasmodium falciparum
DLILKFLNIIYTTKYINI

SEQ ID NO: 3283232 - protein, 26 aa, Plasmodium falciparum
DLILPNNLALMFLNLHEIINIGTFNT

SEQ ID NO: 3283233 - protein, 30 aa, Plasmodium falciparum
DLIYERLRTKVLWYIQKIEYLKFKYQYDII

SEQ ID NO: 3283234 - protein, 30 aa, Plasmodium falciparum
DLKEIVYKKLYFINIFFFRELKTHDCYDNT

SEQ ID NO: 3283235 - protein, 49 aa, Plasmodium falciparum
DLKKWKSQVITKKYADDWLSSDVLLSCFLNFIKLKKYVNITELSVKFQT

SEQ ID NO: 3283236 - protein, 31 aa, Plasmodium falciparum
DLKLAYNMLPCKYYGFFLSNLCSTISTLSYY

SEQ ID NO: 3283237 - protein, 20 aa, Plasmodium falciparum
DLKLFYFIKEAFEKKKRIED

SEQ ID NO: 3283238 - protein, 46 aa, Plasmodium falciparum
DLKLRVFKLKCIMLKIMKILITFLKFDILIILKCSRIFLKEDNLII

SEQ ID NO: 3283239 - protein, 24 aa, Plasmodium falciparum
DLKNFYIFMIPLDKDKQILGQAKP

SEQ ID NO: 3283240 - protein, 23 aa, Plasmodium falciparum
DLKNIILLFGRIAEPYYPKAVEQ

SEQ ID NO: 3283241 - protein, 23 aa, Plasmodium falciparum
DLKYFILAFSNMLIYLCLYESIK

SEQ ID NO: 3283242 - protein, 21 aa, Plasmodium falciparum
DLLFKTFFFKKNKINKIQKEE

SEQ ID NO: 3283243 - protein, 20 aa, Plasmodium falciparum
DLLIIFKLIENCNTKYINVC

SEQ ID NO: 3283244 - protein, 22 aa, Plasmodium falciparum
DLLIKTYFYNKTNMFTLFRNNY

SEQ ID NO: 3283245 - protein, 23 aa, Plasmodium falciparum
DLLKEFIQHLIKYMNERYQNMQQ

SEQ ID NO: 3283246 - protein, 37 aa, Plasmodium falciparum
DLLKHIIQLFLKVYLKFPCYIYNLITLLVNYITIINA

SEQ ID NO: 3283247 - protein, 41 aa, Plasmodium falciparum
DLLNRKVALSEFYFLLIELKLKYFRNLPSYFYMFKVYKKLE

SEQ ID NO: 3283248 - protein, 36 aa, Plasmodium falciparum
DLLPEIKIVPKILTNISFLLFKNRLKFLLDEYFHKK

SEQ ID NO: 3283249 - protein, 25 aa, Plasmodium falciparum
DLLYNTLYEKLFSDILRKLNYRKYV

SEQ ID NO: 3283250 - protein, 31 aa, Plasmodium falciparum
DLNDAYLFLYVYLYSNVYYKSFFSLMNMQYR

SEQ ID NO: 3283251 - protein, 41 aa, Plasmodium falciparum
DLNEYTTFKVLLIYWLEDFLYGYYLLKKKKKIYLCTQNKEQ

SEQ ID NO: 3283252 - protein, 21 aa, Plasmodium falciparum
DLNKALTIDPNLLKNYQVKQR

SEQ ID NO: 3283253 - protein, 22 aa, Plasmodium falciparum
DLNKFLWILKITNKKYKFINPL

SEQ ID NO: 3283254 - protein, 18 aa, Plasmodium falciparum
DLNKFYLLRSIYNFDYSS

SEQ ID NO: 3283255 - protein, 36 aa, Plasmodium falciparum
DLNQYTTFKVLLIYWLEDFIEGYYLLKKRKIIEKCT

SEQ ID NO: 3283256 - protein, 38 aa, Plasmodium falciparum
DLPFDHFVLRNNNINILLKITYLLNLKTNISIKLLKSI

SEQ ID NO: 3283257 - protein, 24 aa, Plasmodium falciparum
DLQNIIFFKKFFIYKILKEEKHRN

SEQ ID NO: 3283258 - protein, 24 aa, Plasmodium falciparum
DLQNLSFNFFPSINTYTCVPKLSA

SEQ ID NO: 3283259 - protein, 20 aa, Plasmodium falciparum
DLQNMCTCYLFLEWSLKGDE

SEQ ID NO: 3283260 - protein, 22 aa, Plasmodium falciparum
DLQYLYQCVISLYNLKILKHDI

SEQ ID NO: 3283261 - protein, 19 aa, Plasmodium falciparum
DLRILKLFREFLANKTVTL

SEQ ID NO: 3283262 - protein, 25 aa, Plasmodium falciparum
DLRKKYPYMPFVKSPFHNFYLYMNT

SEQ ID NO: 3283263 - protein, 31 aa, Plasmodium falciparum
DLSGPLIIVLSLGFILLLAGKASFSYIYLIG

SEQ ID NO: 3283264 - protein, 18 aa, Plasmodium falciparum
DLSKPICHTVYTLDFVQG

SEQ ID NO: 3283265 - protein, 20 aa, Plasmodium falciparum
DLTVIPKLIYPAKDEVRFFN

SEQ ID NO: 3283266 - protein, 29 aa, Plasmodium falciparum
DLVFSDVKGWYSPYFYNIKILNNYKEFER

SEQ ID NO: 3283267 - protein, 17 aa, Plasmodium falciparum
DLVLLINRKRKYENYNV

SEQ ID NO: 3283268 - protein, 19 aa, Plasmodium falciparum
DLVLLYNDFPFDNGMISSD

SEQ ID NO: 3283269 - protein, 30 aa, Plasmodium falciparum
DLYCFIHLPDFIFINSFLIYSFASLSNNPN

SEQ ID NO: 3283270 - protein, 29 aa, Plasmodium falciparum
DLYDEEFLKLFLLVRLFSAVNLVVFLYLH

SEQ ID NO: 3283271 - protein, 24 aa, Plasmodium falciparum
DLYIPLEIYKLILNLLKKCISFFY

SEQ ID NO: 3283272 - protein, 25 aa, Plasmodium falciparum
DLYSIHIFYLYEKLNEYIYNEHQLC

SEQ ID NO: 3283273 - protein, 22 aa, Plasmodium falciparum
DLYTFLLEMNYLKILLSMLNIC

SEQ ID NO: 3283274 - protein, 26 aa, Plasmodium falciparum
DMCYTIIWYISLYYWRRDTYNMIWGF

SEQ ID NO: 3283275 - protein, 34 aa, Plasmodium falciparum
DMEIYSYHFCLYMLFFTLYNVLHKYNIAKNLILN

SEQ ID NO: 3283276 - protein, 35 aa, Plasmodium falciparum
DMEKLKFVRILLFDNIAVLFKYFGNILLKKNTRLV

SEQ ID NO: 3283277 - protein, 25 aa, Plasmodium falciparum
DMERDRVLWWELHKKIIWAGMINQI

SEQ ID NO: 3283278 - protein, 31 aa, Plasmodium falciparum
DMETFYSNIFIFFIFPYLKEYINNLGTHIYK

SEQ ID NO: 3283279 - protein, 18 aa, Plasmodium falciparum
DMFYHNYLVIYNPFNITI

SEQ ID NO: 3283280 - protein, 18 aa, Plasmodium falciparum
DMGYMYMYYWISANILKK

SEQ ID NO: 3283281 - protein, 23 aa, Plasmodium falciparum
DMHLHMLFTFWLRIKYDHSNLHL

SEQ ID NO: 3283282 - protein, 30 aa, Plasmodium falciparum
DMIEKRKKLKLILWIQIYMYVWEEVEKDYG

SEQ ID NO: 3283283 - protein, 31 aa, Plasmodium falciparum
DMKDEFLTSSLIRLPKKLRKQLWESEVDENL

SEQ ID NO: 3283284 - protein, 32 aa, Plasmodium falciparum
DMKKKLNTLLQMYVLFKPELGYVQGMSYIALV

SEQ ID NO: 3283285 - protein, 25 aa, Plasmodium falciparum
DMKLKILIIWWLEKCGIENPEELLI

SEQ ID NO: 3283286 - protein, 42 aa, Plasmodium falciparum
DMLEKLYENKLSKKMLIILSFFIYHSYIYIRLSNLKTEYNCD

SEQ ID NO: 3283287 - protein, 21 aa, Plasmodium falciparum
DMLKSLISYTWNIYQILFLYY

SEQ ID NO: 3283288 - protein, 21 aa, Plasmodium falciparum
DMLLSETRLKAYSKYINEHFN

SEQ ID NO: 3283289 - protein, 19 aa, Plasmodium falciparum
DMLQLKEILKFIMNDTDLE

SEQ ID NO: 3283290 - protein, 24 aa, Plasmodium falciparum
DMMKTLFLKIFKKNNDKYNIYKRI

SEQ ID NO: 3283291 - protein, 19 aa, Plasmodium falciparum
DMMSSLLCKYKVNNLKETI

SEQ ID NO: 3283292 - protein, 36 aa, Plasmodium falciparum
DMNISIMCKILYYSVFLRNFIFINNVIHLFINYENE

SEQ ID NO: 3283293 - protein, 19 aa, Plasmodium falciparum
DMNLFLDIFNMCSKLIIRE

SEQ ID NO: 3283294 - protein, 25 aa, Plasmodium falciparum
DMNYVKYIMQLENFLKGMNFNNKFF

SEQ ID NO: 3283295 - protein, 20 aa, Plasmodium falciparum
DMRFMFCSLCTLYLLNKLFK

SEQ ID NO: 3283296 - protein, 26 aa, Plasmodium falciparum
DMSVRKLCVLFHLYFCKMKVDVYDKS

SEQ ID NO: 3283297 - protein, 37 aa, Plasmodium falciparum
DMTKYGLVLYLYKYFLTPFICIIDLKNIFIKTYKKRA

SEQ ID NO: 3283298 - protein, 20 aa, Plasmodium falciparum
DMYFCSFSSRTIVYKGLLTP

SEQ ID NO: 3283299 - protein, 17 aa, Plasmodium falciparum
DMYIQKLEFNTLEMNEI

SEQ ID NO: 3283300 - protein, 22 aa, Plasmodium falciparum
DMYVFFMYNFLNTVDIKFLNNE

SEQ ID NO: 3283301 - protein, 34 aa, Plasmodium falciparum
DNAFNILKLLNTQILLYFTRFYQLTKKIFSNIQP

SEQ ID NO: 3283302 - protein, 27 aa, Plasmodium falciparum
DNCLLHFDSSLKHNLYFKLKNLNVSCN

SEQ ID NO: 3283303 - protein, 35 aa, Plasmodium falciparum
DNDFDLIKILFFFQVPHLFIMYVYIITCDKNKNNS

SEQ ID NO: 3283304 - protein, 27 aa, Plasmodium falciparum
DNDKIIVYVKPLYLPSSHYLSITYKEL

SEQ ID NO: 3283305 - protein, 22 aa, Plasmodium falciparum
DNDLFNSLFKLRFKIDQAKQMD

SEQ ID NO: 3283306 - protein, 23 aa, Plasmodium falciparum
DNEDIILNLFPLKSKYNPNIKKI

SEQ ID NO: 3283307 - protein, 27 aa, Plasmodium falciparum
DNEDWKLYDFKNLKEKYKFQMNMKDSE

SEQ ID NO: 3283308 - protein, 30 aa, Plasmodium falciparum
DNEFLHLFINLFENVLLIYSLFNDMIRTNY

SEQ ID NO: 3283309 - protein, 23 aa, Plasmodium falciparum
DNEFLTIFSKFVPKSKFAFSSEV

SEQ ID NO: 3283310 - protein, 17 aa, Plasmodium falciparum
DNEIIIIFKYIQNYHDN

SEQ ID NO: 3283311 - protein, 31 aa, Plasmodium falciparum
DNEMYILIILVFMYFKLILKGPLPNDNNNNK

SEQ ID NO: 3283312 - protein, 22 aa, Plasmodium falciparum
DNENILIQLLMINNYNINFINN

SEQ ID NO: 3283313 - protein, 22 aa, Plasmodium falciparum
DNESLYILLTLNKDIFSLDKVS

SEQ ID NO: 3283314 - protein, 27 aa, Plasmodium falciparum
DNEYSLLGFLRLRLRKKNNYCDDRPFK

SEQ ID NO: 3283315 - protein, 25 aa, Plasmodium falciparum
DNFDGLILNIYFTPNNNLYTKVKVG

SEQ ID NO: 3283316 - protein, 41 aa, Plasmodium falciparum
DNFHILIQYYRNVLYKKKNPLFFLKIFLCGVLHMCPEDFNL

SEQ ID NO: 3283317 - protein, 19 aa, Plasmodium falciparum
DNFIFSNDWNELNSKSLEK

SEQ ID NO: 3283318 - protein, 18 aa, Plasmodium falciparum
DNFIIEFNFFMERKYYKE

SEQ ID NO: 3283319 - protein, 20 aa, Plasmodium falciparum
DNFLFLFDNISSFKNLSIKD

SEQ ID NO: 3283320 - protein, 33 aa, Plasmodium falciparum
DNFLNNIDIWKKKKLMWNKWIEKNRYIMNNWKD

SEQ ID NO: 3283321 - protein, 24 aa, Plasmodium falciparum
DNFNLSFYLNWKGLLDYPKGKDIN

SEQ ID NO: 3283322 - protein, 31 aa, Plasmodium falciparum
DNFRSLLFDLLKIKWYKFYANLFSYIIILTS

SEQ ID NO: 3283323 - protein, 23 aa, Plasmodium falciparum
DNFSNLHKLICKIPLHEYESLKL

SEQ ID NO: 3283324 - protein, 25 aa, Plasmodium falciparum
DNGKKLFCRSPLGLVSYYRCTEGTA

SEQ ID NO: 3283325 - protein, 27 aa, Plasmodium falciparum
DNGKNIFWWVLPLDKFYYKAQTLLNLK

SEQ ID NO: 3283326 - protein, 25 aa, Plasmodium falciparum
DNHIHTKPFTLEFFVKSFKIDELSK

SEQ ID NO: 3283327 - protein, 21 aa, Plasmodium falciparum
DNHIIYFIICTDKKLALFLIG

SEQ ID NO: 3283328 - protein, 25 aa, Plasmodium falciparum
DNIDFLFMFIVKFLDKNVNINKINH

SEQ ID NO: 3283329 - protein, 24 aa, Plasmodium falciparum
DNIEYKTYYPYGDYSSICSCEQVK

SEQ ID NO: 3283330 - protein, 26 aa, Plasmodium falciparum
DNIFSNFLYKSLFYKKKLSLYVKKSY

SEQ ID NO: 3283331 - protein, 27 aa, Plasmodium falciparum
DNIFVCNEYFLYNFLRKEYLQCEVFLK

SEQ ID NO: 3283332 - protein, 25 aa, Plasmodium falciparum
DNIFYKLFSSFINIIFPIFKRKEKN

SEQ ID NO: 3283333 - protein, 26 aa, Plasmodium falciparum
DNIHKYILHIMLPKYNSKFILATHNT

SEQ ID NO: 3283334 - protein, 51 aa, Plasmodium falciparum
DNIIELYIYYYNKIVLLLLLLILGHWDILYLPFSIFVYKYINIYINVLHYT

SEQ ID NO: 3283335 - protein, 20 aa, Plasmodium falciparum
DNIIILNKKMKNSNSIIDIM

SEQ ID NO: 3283336 - protein, 23 aa, Plasmodium falciparum
DNIKEFYIIDFFKNYMKDKEQRS

SEQ ID NO: 3283337 - protein, 17 aa, Plasmodium falciparum
DNIKLVLVLSFLSNIYN

SEQ ID NO: 3283338 - protein, 29 aa, Plasmodium falciparum
DNIKNIPLFKPSYFHMFITQILKKKNEKK

SEQ ID NO: 3283339 - protein, 24 aa, Plasmodium falciparum
DNIKYFIDDPVDIIRKGENQYCDT

SEQ ID NO: 3283340 - protein, 17 aa, Plasmodium falciparum
DNILKFFSKNKFYITLF

SEQ ID NO: 3283341 - protein, 29 aa, Plasmodium falciparum
DNINHNYWFLILGPLRFLRLVRAESTISS

SEQ ID NO: 3283342 - protein, 26 aa, Plasmodium falciparum
DNINNFEFIYLFKRSFRLYNKNLNNS

SEQ ID NO: 3283343 - protein, 25 aa, Plasmodium falciparum
DNINYIIISLIILSQILLCIKINEE

SEQ ID NO: 3283344 - protein, 22 aa, Plasmodium falciparum
DNITYIIFVITNISSFILHYFY

SEQ ID NO: 3283345 - protein, 41 aa, Plasmodium falciparum
DNIYDCINIYPFCKYVNHITFFLLDLGLKVLLPYYEIDNLI

SEQ ID NO: 3283346 - protein, 22 aa, Plasmodium falciparum
DNKFYDFNIIKYLMKYKNVVSN

SEQ ID NO: 3283347 - protein, 27 aa, Plasmodium falciparum
DNKGLSYILPILLKKLYKLNSYIHIFD

SEQ ID NO: 3283348 - protein, 25 aa, Plasmodium falciparum
DNKINFIQVIYKLVKSYYYIENYIK

SEQ ID NO: 3283349 - protein, 27 aa, Plasmodium falciparum
DNKKIFDLLFNAFYKKLIIKKKKKRII

SEQ ID NO: 3283350 - protein, 17 aa, Plasmodium falciparum
DNKKMKYYKKRKNIKLF

SEQ ID NO: 3283351 - protein, 19 aa, Plasmodium falciparum
DNKNKILLIIVCDFIKTKN

SEQ ID NO: 3283352 - protein, 30 aa, Plasmodium falciparum
DNKVHIYIYIWYIQRFLKIAEPIFDCILFT

SEQ ID NO: 3283353 - protein, 17 aa, Plasmodium falciparum
DNKYHINFFKYAMNNYK

SEQ ID NO: 3283354 - protein, 19 aa, Plasmodium falciparum
DNLFNKINPLSSDNTSSII

SEQ ID NO: 3283355 - protein, 28 aa, Plasmodium falciparum
DNLHFINLLILILKYNKTNKIIQSLLII

SEQ ID NO: 3283356 - protein, 22 aa, Plasmodium falciparum
DNLIILYLPIEFCELPSFFYNS

SEQ ID NO: 3283357 - protein, 22 aa, Plasmodium falciparum
DNLISFIFTKLYNYLSLIPPKI

SEQ ID NO: 3283358 - protein, 19 aa, Plasmodium falciparum
DNLIVYLSFLYSLLKDNIN

SEQ ID NO: 3283359 - protein, 17 aa, Plasmodium falciparum
DNLKYYFKKMEILLNKD

SEQ ID NO: 3283360 - protein, 26 aa, Plasmodium falciparum
DNLLEPNFHYPYMYNMNPMNHVNNMN

SEQ ID NO: 3283361 - protein, 43 aa, Plasmodium falciparum
DNLTILVNTLYNIDLFKIIVLKYNGNLYNRILMKYIKKKRKEK

SEQ ID NO: 3283362 - protein, 25 aa, Plasmodium falciparum
DNLYAFMETFYIISILVHYSNNVLE

SEQ ID NO: 3283363 - protein, 17 aa, Plasmodium falciparum
DNMIVLGLFGLDDNLKR

SEQ ID NO: 3283364 - protein, 24 aa, Plasmodium falciparum
DNNDPLIDLIISKILFNLNNRVEY

SEQ ID NO: 3283365 - protein, 22 aa, Plasmodium falciparum
DNNIIIIYDKYKLYVYQIMLKG

SEQ ID NO: 3283366 - protein, 22 aa, Plasmodium falciparum
DNNIYLYYPYSILCNNLDLNNN

SEQ ID NO: 3283367 - protein, 43 aa, Plasmodium falciparum
DNNKRCIINLMLYKIFKGYILLLLWVIIILKNEYIYEDSYIKL

SEQ ID NO: 3283368 - protein, 29 aa, Plasmodium falciparum
DNNNLFISFYLFINKYFYLLLQNINNDSN

SEQ ID NO: 3283369 - protein, 24 aa, Plasmodium falciparum
DNNQIILHYILNIIFNRFNFKEYN

SEQ ID NO: 3283370 - protein, 36 aa, Plasmodium falciparum
DNNSYFFINDKIFFSFLLNAFYFYYEFYNIDLEIIY

SEQ ID NO: 3283371 - protein, 42 aa, Plasmodium falciparum
DNNTKSFFFYISSSLKFLFIFIYALFMKIYNLVLGTIMDKFC

SEQ ID NO: 3283372 - protein, 31 aa, Plasmodium falciparum
DNNYEKLIIYFLYFWNLIFTHGLMNKNPYIQ

SEQ ID NO: 3283373 - protein, 23 aa, Plasmodium falciparum
DNPLFYFSNTFLLFGDAKHTTNQ

SEQ ID NO: 3283374 - protein, 23 aa, Plasmodium falciparum
DNQLDLFHTWLDRHRDMCEKLKN

SEQ ID NO: 3283375 - protein, 23 aa, Plasmodium falciparum
DNQLDLFHTWLDRHRDMCEKWNN

SEQ ID NO: 3283376 - protein, 24 aa, Plasmodium falciparum
DNQLNLFHTWLDRHRDMCEQWNNK

SEQ ID NO: 3283377 - protein, 26 aa, Plasmodium falciparum
DNQQLIRKKFYLIKKKIIMHNLLISQ

SEQ ID NO: 3283378 - protein, 34 aa, Plasmodium falciparum
DNQVPTYFDYVPQYLRWFEEWAEDFCRLRKHKLK

SEQ ID NO: 3283379 - protein, 23 aa, Plasmodium falciparum
DNRLTFEHRSALFCLALADCVIV

SEQ ID NO: 3283380 - protein, 25 aa, Plasmodium falciparum
DNSKVILQIVYNNQIFLSKKIKINQ

SEQ ID NO: 3283381 - protein, 25 aa, Plasmodium falciparum
DNSRKDLFSFLKDLDFEQLKEYTKK

SEQ ID NO: 3283382 - protein, 30 aa, Plasmodium falciparum
DNSRYMLSYFIAFLKKWKYMLSIYLSQLTE

SEQ ID NO: 3283383 - protein, 26 aa, Plasmodium falciparum
DNSTFKILMIILPIVLVISIITILYH

SEQ ID NO: 3283384 - protein, 33 aa, Plasmodium falciparum
DNSYLHFKLKEDFYIHPFLSVLQFKKMDNAKNE

SEQ ID NO: 3283385 - protein, 18 aa, Plasmodium falciparum
DNTIFIFEPKIDLLSLLK

SEQ ID NO: 3283386 - protein, 38 aa, Plasmodium falciparum
DNTIIVMPLFHVHGLIGVLLPIIYCKGNILFQLGHSFS

SEQ ID NO: 3283387 - protein, 32 aa, Plasmodium falciparum
DNTPLTQFVKIPTFFRWLHEWGSDFCGTRKRM

SEQ ID NO: 3283388 - protein, 33 aa, Plasmodium falciparum
DNTPTFLSHFVLRPPYFRYLEEWGETFCKERKK

SEQ ID NO: 3283389 - protein, 26 aa, Plasmodium falciparum
DNTSTFFYLYKYFYYYRNANNKDGTK

SEQ ID NO: 3283390 - protein, 32 aa, Plasmodium falciparum
DNTYIIYTIIFYLFLFIPNVSLFLFSINYFHT

SEQ ID NO: 3283391 - protein, 27 aa, Plasmodium falciparum
DNVHKSFPLFFHYAKKYLHIYVQNGSN

SEQ ID NO: 3283392 - protein, 33 aa, Plasmodium falciparum
DNVIKKIICSILLKYKYVYKYFKKYYYNKYVNV

SEQ ID NO: 3283393 - protein, 21 aa, Plasmodium falciparum
DNVIQFFFYSCFINLFYFEKH

SEQ ID NO: 3283394 - protein, 24 aa, Plasmodium falciparum
DNVPFIHFNFYICNFYSLPYHEEA

SEQ ID NO: 3283395 - protein, 27 aa, Plasmodium falciparum
DNVVGIKYYFYLYDTIDAHEFVIPQTY

SEQ ID NO: 3283396 - protein, 31 aa, Plasmodium falciparum
DNYELINIRKYDVILFCFLFHMYNFCLKQNG

SEQ ID NO: 3283397 - protein, 21 aa, Plasmodium falciparum
DNYISFWLISSNALTPFFLLK

SEQ ID NO: 3283398 - protein, 25 aa, Plasmodium falciparum
DNYKEKVFLLKYNQYLSFNYKDSVD

SEQ ID NO: 3283399 - protein, 17 aa, Plasmodium falciparum
DNYKIRFFFLPEDFGDE

SEQ ID NO: 3283400 - protein, 26 aa, Plasmodium falciparum
DNYLFFCSFCFILYNYDLTNCVRCNK

SEQ ID NO: 3283401 - protein, 26 aa, Plasmodium falciparum
DNYLYKHIIYIYYFSVCLINIKIKNN

SEQ ID NO: 3283402 - protein, 21 aa, Plasmodium falciparum
DNYMNALYISKILGIKKENVS

SEQ ID NO: 3283403 - protein, 25 aa, Plasmodium falciparum
DNYNKKRIFIYENTVYYTPDDCVFC

SEQ ID NO: 3283404 - protein, 20 aa, Plasmodium falciparum
DNYNNSVFLNFNKLNKNSNT

SEQ ID NO: 3283405 - protein, 24 aa, Plasmodium falciparum
DNYVDFFYINLFVESIHVICNYIE

SEQ ID NO: 3283406 - protein, 27 aa, Plasmodium falciparum
DNYVGYSWLCLILLEYLNVLDSYIKYQ

SEQ ID NO: 3283407 - protein, 17 aa, Plasmodium falciparum
DNYYINRSIILYNLCNI

SEQ ID NO: 3283408 - protein, 23 aa, Plasmodium falciparum
DPCMVKLMFKLEKIFIKFIDKKL

SEQ ID NO: 3283409 - protein, 24 aa, Plasmodium falciparum
DPDCSIWYFYTLNDQTKKCESLSS

SEQ ID NO: 3283410 - protein, 28 aa, Plasmodium falciparum
DPENNYVYYYYFDFDTNQYYTYKITKIG

SEQ ID NO: 3283411 - protein, 26 aa, Plasmodium falciparum
DPGVTLQWVLILDFLKDESTEDKENK

SEQ ID NO: 3283412 - protein, 27 aa, Plasmodium falciparum
DPIRFKKFYMYYKKITFNLINKKNINY

SEQ ID NO: 3283413 - protein, 27 aa, Plasmodium falciparum
DPKDIDYIFNLFLKLGSILLLTSEIVF

SEQ ID NO: 3283414 - protein, 24 aa, Plasmodium falciparum
DPKRLENRFILYNMLRDHIIEKEG

SEQ ID NO: 3283415 - protein, 34 aa, Plasmodium falciparum
DPLLLTAFVESAAIETFFLWDRYKKIKEKEIEEK

SEQ ID NO: 3283416 - protein, 19 aa, Plasmodium falciparum
DPMCMFMEKGPFKFAEITR

SEQ ID NO: 3283417 - protein, 22 aa, Plasmodium falciparum
DPNHYMWKDLYPQLSEHHKNKT

SEQ ID NO: 3283418 - protein, 36 aa, Plasmodium falciparum
DPNNIYSGKIPPPFLRQMFYTLADYKDILFGDKGEK

SEQ ID NO: 3283419 - protein, 26 aa, Plasmodium falciparum
DPNVLNHSFLGDVLLAAKFEADFIKE

SEQ ID NO: 3283420 - protein, 25 aa, Plasmodium falciparum
DPSAKWKFIFRDIKKMDKNMFHERI

SEQ ID NO: 3283421 - protein, 37 aa, Plasmodium falciparum
DPSCVQILFFMGLICKFPILWIIGSIVFCITPSEHRK

SEQ ID NO: 3283422 - protein, 23 aa, Plasmodium falciparum
DPSDYMLILPNSSKDHALYNNIN

SEQ ID NO: 3283423 - protein, 25 aa, Plasmodium falciparum
DPSIFGRKKIQITPPIIGVPPSILE

SEQ ID NO: 3283424 - protein, 18 aa, Plasmodium falciparum
DPSMFIKQKIKTGFLYPP

SEQ ID NO: 3283425 - protein, 24 aa, Plasmodium falciparum
DPVDIIHYYTPENLFMISEDYNIT

SEQ ID NO: 3283426 - protein, 26 aa, Plasmodium falciparum
DPVNNRLCLSIFFYMDSSGKIDHNSF

SEQ ID NO: 3283427 - protein, 33 aa, Plasmodium falciparum
DPVVTKCGHLFCWLCLSAWIKKNNDCPVCKAEV

SEQ ID NO: 3283428 - protein, 23 aa, Plasmodium falciparum
DQFKEIINLLLKLYEKDKKGYVN

SEQ ID NO: 3283429 - protein, 18 aa, Plasmodium falciparum
DQFKENINLNPYTTFKVL

SEQ ID NO: 3283430 - protein, 31 aa, Plasmodium falciparum
DQFQKTFHDFFYYWVAHMLKDSIHWKKKLQR

SEQ ID NO: 3283431 - protein, 23 aa, Plasmodium falciparum
DQIITIRALVTHWVHNFLEDYNR

SEQ ID NO: 3283432 - protein, 21 aa, Plasmodium falciparum
DQIITIRALVTHWVQNFLDDY

SEQ ID NO: 3283433 - protein, 21 aa, Plasmodium falciparum
DQILGVLDYLEKQQSAWPFLK

SEQ ID NO: 3283434 - protein, 32 aa, Plasmodium falciparum
DQLIFVKILNQILVFTILILSASILCKMYENF

SEQ ID NO: 3283435 - protein, 26 aa, Plasmodium falciparum
DQLLNNFLGKKLFLFNIKSIQIQDIL

SEQ ID NO: 3283436 - protein, 26 aa, Plasmodium falciparum
DQLPSDFFSYLPILKKINMSTINDTN

SEQ ID NO: 3283437 - protein, 41 aa, Plasmodium falciparum
DQTHYLFELLQKHLLKTSPYNIFLFLKLCTEYKYLEKLKIF

SEQ ID NO: 3283438 - protein, 29 aa, Plasmodium falciparum
DQTIMSFESFFWSWVSRMLNDSIKWRNQH

SEQ ID NO: 3283439 - protein, 27 aa, Plasmodium falciparum
DQTRGWFYTLLVISTLLFNKAPFKNLI

SEQ ID NO: 3283440 - protein, 31 aa, Plasmodium falciparum
DQVPTYFDYVPQYLRWFEEWAEDFCRKKKIK

SEQ ID NO: 3283441 - protein, 31 aa, Plasmodium falciparum
DQVPTYFDYVPQYLRWFEEWAEDFCRKKKIY

SEQ ID NO: 3283442 - protein, 31 aa, Plasmodium falciparum
DQVPTYFDYVPQYLRWFEEWAEDFCRKKKKK

SEQ ID NO: 3283443 - protein, 30 aa, Plasmodium falciparum
DQVPTYFDYVPQYLRWFEEWAEDFCRKKNK

SEQ ID NO: 3283444 - protein, 28 aa, Plasmodium falciparum
DQWTKMDGIYQMLYLQAQTTARNAGDTA

SEQ ID NO: 3283445 - protein, 23 aa, Plasmodium falciparum
DQYIGLFLFFHGYIIYELEDKKI

SEQ ID NO: 3283446 - protein, 28 aa, Plasmodium falciparum
DQYYRIPYIRFFCIFLFIFGITSFFLCS

SEQ ID NO: 3283447 - protein, 22 aa, Plasmodium falciparum
DRAKYIAQILPLILEKFYNTDG

SEQ ID NO: 3283448 - protein, 25 aa, Plasmodium falciparum
DRERLKALFFVAVALAILGIVFIIY

SEQ ID NO: 3283449 - protein, 17 aa, Plasmodium falciparum
DRIFKWSCEKTKNCLVF

SEQ ID NO: 3283450 - protein, 19 aa, Plasmodium falciparum
DRKFLISIVLFFCSHTFVE

SEQ ID NO: 3283451 - protein, 28 aa, Plasmodium falciparum
DRKNMYHLIYIWFIPLSLNDTSKSLCKL

SEQ ID NO: 3283452 - protein, 24 aa, Plasmodium falciparum
DRKNSYLVIFRFIREDNIKNFVTQ

SEQ ID NO: 3283453 - protein, 17 aa, Plasmodium falciparum
DRKTGWRVLKRPYADRF

SEQ ID NO: 3283454 - protein, 25 aa, Plasmodium falciparum
DRKYFPYFFFLFEIYSIISIFCLFD

SEQ ID NO: 3283455 - protein, 20 aa, Plasmodium falciparum
DRLKVQMLLKNAFETEDGNV

SEQ ID NO: 3283456 - protein, 24 aa, Plasmodium falciparum
DRMNRDELYRVYLEELEKIDKEEK

SEQ ID NO: 3283457 - protein, 26 aa, Plasmodium falciparum
DRNRISQFLIFPPMQCKGLGMQVLEK

SEQ ID NO: 3283458 - protein, 31 aa, Plasmodium falciparum
DRPFYKNILNIYFHYSYFINFFEYLNSVSHL

SEQ ID NO: 3283459 - protein, 19 aa, Plasmodium falciparum
DRRMAVYNALYEKAQSYNL

SEQ ID NO: 3283460 - protein, 18 aa, Plasmodium falciparum
DRVIFNYINLVLLSKAGT

SEQ ID NO: 3283461 - protein, 37 aa, Plasmodium falciparum
DRYITKLIQLYNMINFHTGILFLSYPLSKTTSYKILS

SEQ ID NO: 3283462 - protein, 18 aa, Plasmodium falciparum
DRYKLYFKFFDKLQKGRK

SEQ ID NO: 3283463 - protein, 24 aa, Plasmodium falciparum
DSADMLTWFVHNFFGFSKKFRQYL

SEQ ID NO: 3283464 - protein, 27 aa, Plasmodium falciparum
DSCACRLKIFLTLSKQIKIILQKKRYR

SEQ ID NO: 3283465 - protein, 24 aa, Plasmodium falciparum
DSCDLIYHFIAIICLFISQKYYNY

SEQ ID NO: 3283466 - protein, 17 aa, Plasmodium falciparum
DSCELQSFLISNINLKC

SEQ ID NO: 3283467 - protein, 21 aa, Plasmodium falciparum
DSCFPCPLYTYTLNQGATSIL

SEQ ID NO: 3283468 - protein, 27 aa, Plasmodium falciparum
DSCNVLCLFLFFLSLFFIMIISADNNT

SEQ ID NO: 3283469 - protein, 18 aa, Plasmodium falciparum
DSDEYYPVRSVLETFLVQ

SEQ ID NO: 3283470 - protein, 18 aa, Plasmodium falciparum
DSDEYYYVRSCLEDFESR

SEQ ID NO: 3283471 - protein, 36 aa, Plasmodium falciparum
DSDKIIPFNVFFQRWLRNFVHDYNKLKQKIHPCIKN

SEQ ID NO: 3283472 - protein, 17 aa, Plasmodium falciparum
DSEFMMGLLANYGFKFV

SEQ ID NO: 3283473 - protein, 31 aa, Plasmodium falciparum
DSEIYFLILHRFIFFYILRGIFYKYKEFLLS

SEQ ID NO: 3283474 - protein, 23 aa, Plasmodium falciparum
DSEKGFICINGNNYIINPGTYHI

SEQ ID NO: 3283475 - protein, 34 aa, Plasmodium falciparum
DSEKTVITYITIGYLFKLFLHHKNMYKKFTHVII

SEQ ID NO: 3283476 - protein, 30 aa, Plasmodium falciparum
DSFCNIYIYKILINDFLFLSKLDIYSTSTT

SEQ ID NO: 3283477 - protein, 26 aa, Plasmodium falciparum
DSFFIDLIFSIFLYFDNFVYKMDYII

SEQ ID NO: 3283478 - protein, 30 aa, Plasmodium falciparum
DSFKIANMQLLFFSFALTGYAYYNLITLFF

SEQ ID NO: 3283479 - protein, 20 aa, Plasmodium falciparum
DSFMLRKMYTIYVPGLRDPD

SEQ ID NO: 3283480 - protein, 27 aa, Plasmodium falciparum
DSFVNPQYRGIYMPPRRQHFCTSNLEK

SEQ ID NO: 3283481 - protein, 17 aa, Plasmodium falciparum
DSIKCLLNNIISFSYDL

SEQ ID NO: 3283482 - protein, 20 aa, Plasmodium falciparum
DSILSLLNFFKSASNHMVVV

SEQ ID NO: 3283483 - protein, 24 aa, Plasmodium falciparum
DSIYSKNIILNISESGYNMEVQYP

SEQ ID NO: 3283484 - protein, 19 aa, Plasmodium falciparum
DSIYWRTEKLERCLKNGNP

SEQ ID NO: 3283485 - protein, 24 aa, Plasmodium falciparum
DSIYYYDYFEIIKDIYVKKSKNKK

SEQ ID NO: 3283486 - protein, 64 aa, Plasmodium falciparum
DSKGRVVIPWIVFGNSFNFYLYVFNNLALFEWFVFEVKSFLVYVSGLIKWLNIIEDKHVTIRYM

SEQ ID NO: 3283487 - protein, 32 aa, Plasmodium falciparum
DSKYYDNKFPFNILFHRWITDFIQYYNKSKEK

SEQ ID NO: 3283488 - protein, 30 aa, Plasmodium falciparum
DSLCLLYSFIFVIYKILISMIYKNKSYFGF

SEQ ID NO: 3283489 - protein, 21 aa, Plasmodium falciparum
DSLFNFFNDIFKFVQSYQTDK

SEQ ID NO: 3283490 - protein, 37 aa, Plasmodium falciparum
DSLKLLKQNGIRSLYLSLPITLLMNIPYQIIMICTNE

SEQ ID NO: 3283491 - protein, 17 aa, Plasmodium falciparum
DSLKRAIERQRNFFRLS

SEQ ID NO: 3283492 - protein, 24 aa, Plasmodium falciparum
DSLLDFLKMSKLKKTWRSSSNNFS

SEQ ID NO: 3283493 - protein, 29 aa, Plasmodium falciparum
DSLVFFKRFFNCLNGYIYFLNKCEKNYNK

SEQ ID NO: 3283494 - protein, 19 aa, Plasmodium falciparum
DSNILLSDTIYKLLNRIQV

SEQ ID NO: 3283495 - protein, 27 aa, Plasmodium falciparum
DSNKKGLWNLLKSTIGFLILVAAGSVY

SEQ ID NO: 3283496 - protein, 24 aa, Plasmodium falciparum
DSNKYLHIQYYMNEQYIISKKQAE

SEQ ID NO: 3283497 - protein, 39 aa, Plasmodium falciparum
DSSVLNPTAWWRRYGTRLWKTMIQPYAHLGCRKPDENEP

SEQ ID NO: 3283498 - protein, 31 aa, Plasmodium falciparum
DSTKEVKFFIKKIPIDIWLKQYKLMNEYDGE

SEQ ID NO: 3283499 - protein, 29 aa, Plasmodium falciparum
DSTSLDEIILFFYLLRNINNLRHFVFVLS

SEQ ID NO: 3283500 - protein, 40 aa, Plasmodium falciparum
DSVIMKYTIIISGLVLLFCISFIIYYFDIIQKVKMKLNKK

SEQ ID NO: 3283501 - protein, 25 aa, Plasmodium falciparum
DSYEQIILFIKNYKYIYKKDDIFLN

SEQ ID NO: 3283502 - protein, 21 aa, Plasmodium falciparum
DSYLMNIIFLLFKSINKDMCI

SEQ ID NO: 3283503 - protein, 21 aa, Plasmodium falciparum
DTCNYIYIYTFYSIMDNFCLK

SEQ ID NO: 3283504 - protein, 24 aa, Plasmodium falciparum
DTDNSLYFIYFSKLFFHISSDFTL

SEQ ID NO: 3283505 - protein, 21 aa, Plasmodium falciparum
DTEKILFYKISFHMLNIFIPI

SEQ ID NO: 3283506 - protein, 24 aa, Plasmodium falciparum
DTEKLNCIFIRPKKYISSNEEEIR

SEQ ID NO: 3283507 - protein, 24 aa, Plasmodium falciparum
DTENLILLILYNKKEIKLYIHIYV

SEQ ID NO: 3283508 - protein, 20 aa, Plasmodium falciparum
DTFIEAHRYILEKWKREEWF

SEQ ID NO: 3283509 - protein, 24 aa, Plasmodium falciparum
DTFKYIMKSKYFKNIPIILETPDI

SEQ ID NO: 3283510 - protein, 17 aa, Plasmodium falciparum
DTFLFLNKRMLCVYYNI

SEQ ID NO: 3283511 - protein, 17 aa, Plasmodium falciparum
DTFTFFKKIPRKVWRFI

SEQ ID NO: 3283512 - protein, 28 aa, Plasmodium falciparum
DTFYENFVKDNFPYIKINTTSTLPQTNK

SEQ ID NO: 3283513 - protein, 32 aa, Plasmodium falciparum
DTIEKFSLLLLLFLIFLVFIGTYISYNKRINK

SEQ ID NO: 3283514 - protein, 27 aa, Plasmodium falciparum
DTIGAIFFILSYWTFYPAYLSLYSFPS

SEQ ID NO: 3283515 - protein, 41 aa, Plasmodium falciparum
DTIKNIYIKNIPLFAILNCDILYLKGKIQSYLYDKLGRIKK

SEQ ID NO: 3283516 - protein, 19 aa, Plasmodium falciparum
DTINYFFKQVLPKSYMACN

SEQ ID NO: 3283517 - protein, 27 aa, Plasmodium falciparum
DTKNYYQLREDWWYANRRQVWKAITCD

SEQ ID NO: 3283518 - protein, 28 aa, Plasmodium falciparum
DTKYIKLFKNFILLLHNIISIIYSYNNE

SEQ ID NO: 3283519 - protein, 41 aa, Plasmodium falciparum
DTLIDKYRHILLYYILYTYPKFLYIFNIIKIKHFREEIKLA

SEQ ID NO: 3283520 - protein, 25 aa, Plasmodium falciparum
DTLVENFLFLLPYHEAYQGTNLYAL

SEQ ID NO: 3283521 - protein, 22 aa, Plasmodium falciparum
DTLYFDVLAADIYMLGILFIWI

SEQ ID NO: 3283522 - protein, 17 aa, Plasmodium falciparum
DTMILFNNILMNSIKVV

SEQ ID NO: 3283523 - protein, 27 aa, Plasmodium falciparum
DTNADFFIIIFSHFLNFIYQFWNKRIC

SEQ ID NO: 3283524 - protein, 26 aa, Plasmodium falciparum
DTNFKLIKILPVFSPISILFNSTNNH

SEQ ID NO: 3283525 - protein, 23 aa, Plasmodium falciparum
DTNIFIISWTKFKYAYTPIDIIK

SEQ ID NO: 3283526 - protein, 24 aa, Plasmodium falciparum
DTNNLIDLLYYTLTLTIRYYMNNI

SEQ ID NO: 3283527 - protein, 32 aa, Plasmodium falciparum
DTPPTLSQFISRPPYFRYLEEWGETFCRQRTR

SEQ ID NO: 3283528 - protein, 30 aa, Plasmodium falciparum
DTPTTLDSFIKRPPYFRYLEEWGQNFCKKR

SEQ ID NO: 3283529 - protein, 25 aa, Plasmodium falciparum
DTQKKNIYLLYETKLNAPILKLVIL

SEQ ID NO: 3283530 - protein, 22 aa, Plasmodium falciparum
DTTPNVNLKKKYNFGPSEGKEK

SEQ ID NO: 3283531 - protein, 29 aa, Plasmodium falciparum
DTYINVICLSILKNFYKKIIYKVKKGKFL

SEQ ID NO: 3283532 - protein, 22 aa, Plasmodium falciparum
DTYKIFFYNKLIYYLNSNNKHP

SEQ ID NO: 3283533 - protein, 18 aa, Plasmodium falciparum
DTYLIYYCRECKRYLHNR

SEQ ID NO: 3283534 - protein, 28 aa, Plasmodium falciparum
DTYLKHYIYHYYLFNYDFTFQNVYNYSN

SEQ ID NO: 3283535 - protein, 24 aa, Plasmodium falciparum
DTYTLFYTFFILIICVTWIQYVLK

SEQ ID NO: 3283536 - protein, 29 aa, Plasmodium falciparum
DVDDRILFKVLFERWLKYFIQDFNNVKDK

SEQ ID NO: 3283537 - protein, 17 aa, Plasmodium falciparum
DVDIINSLTLYVGTYIC

SEQ ID NO: 3283538 - protein, 17 aa, Plasmodium falciparum
DVECKRLFIDYEEWFRY

SEQ ID NO: 3283539 - protein, 35 aa, Plasmodium falciparum
DVEFAPIIPNLCIVLLIYFKASVVYCIIHCLIKKG

SEQ ID NO: 3283540 - protein, 23 aa, Plasmodium falciparum
DVEPNLYLPTYNYFENTNSKKLL

SEQ ID NO: 3283541 - protein, 32 aa, Plasmodium falciparum
DVFEYKMLIAANRLLWRKLSDKVQEESKVMIQ

SEQ ID NO: 3283542 - protein, 22 aa, Plasmodium falciparum
DVFNNLIRLLKLHKNESISTLH

SEQ ID NO: 3283543 - protein, 25 aa, Plasmodium falciparum
DVHNYPIYPLIEDISTFFYIISKFN

SEQ ID NO: 3283544 - protein, 20 aa, Plasmodium falciparum
DVIFVLYNKILKEIIIHFLK

SEQ ID NO: 3283545 - protein, 21 aa, Plasmodium falciparum
DVILQNSLHFVYTSTLIKCAE

SEQ ID NO: 3283546 - protein, 17 aa, Plasmodium falciparum
DVKDILKFISKDIWYIL

SEQ ID NO: 3283547 - protein, 19 aa, Plasmodium falciparum
DVKDIYLYYIFIGLHTNKK

SEQ ID NO: 3283548 - protein, 31 aa, Plasmodium falciparum
DVKILLNTFIYLFILRYFKNVEIFFNSYRVK

SEQ ID NO: 3283549 - protein, 23 aa, Plasmodium falciparum
DVKKILFKSLKLLIRLHDVGITH

SEQ ID NO: 3283550 - protein, 26 aa, Plasmodium falciparum
DVKKYKLTFYKNNLAHLFTLIKIVIP

SEQ ID NO: 3283551 - protein, 29 aa, Plasmodium falciparum
DVKNKFYTFMYHIFYKYKPKNQGGNIHNN

SEQ ID NO: 3283552 - protein, 24 aa, Plasmodium falciparum
DVKTDLILFKYDKDKLLSTIFIYV

SEQ ID NO: 3283553 - protein, 17 aa, Plasmodium falciparum
DVKYITIIYTATCCIYT

SEQ ID NO: 3283554 - protein, 32 aa, Plasmodium falciparum
DVLFNKNALLNFRNFIMKKKHIDYVKKSFNYK

SEQ ID NO: 3283555 - protein, 24 aa, Plasmodium falciparum
DVLIKYIDYFVYIIYGYKNIKSKD

SEQ ID NO: 3283556 - protein, 25 aa, Plasmodium falciparum
DVLLMLTCFPWLLSFCLLYALKYTY

SEQ ID NO: 3283557 - protein, 23 aa, Plasmodium falciparum
DVLMFEFFFSFFSANKWILTTKD

SEQ ID NO: 3283558 - protein, 19 aa, Plasmodium falciparum
DVLNFLLKLFKKINNDYYN

SEQ ID NO: 3283559 - protein, 24 aa, Plasmodium falciparum
DVLNKFLPFLYGALSKYIAIIFTY

SEQ ID NO: 3283560 - protein, 18 aa, Plasmodium falciparum
DVLNYFNIFQYLPRIHIN

SEQ ID NO: 3283561 - protein, 21 aa, Plasmodium falciparum
DVLVVLLISGISRAYNMINGE

SEQ ID NO: 3283562 - protein, 20 aa, Plasmodium falciparum
DVLYIYSYYLNYIKYVLLYN

SEQ ID NO: 3283563 - protein, 19 aa, Plasmodium falciparum
DVMIQLLKEYYPKIYNDFI

SEQ ID NO: 3283564 - protein, 27 aa, Plasmodium falciparum
DVNHNSYYIIPFIFKTTQTYHHHKHNI

SEQ ID NO: 3283565 - protein, 24 aa, Plasmodium falciparum
DVNNMCLSLPFYGLSTNPDLNMFK

SEQ ID NO: 3283566 - protein, 22 aa, Plasmodium falciparum
DVNNSSFLWGVWTIENNANEKT

SEQ ID NO: 3283567 - protein, 24 aa, Plasmodium falciparum
DVNNYYNIFNYVKSLWNIEKNDDQ

SEQ ID NO: 3283568 - protein, 30 aa, Plasmodium falciparum
DVNRERIINLLFFLYKKYIDKKDLELSTKS

SEQ ID NO: 3283569 - protein, 18 aa, Plasmodium falciparum
DVPFRYLQWLSYQTYSAS

SEQ ID NO: 3283570 - protein, 17 aa, Plasmodium falciparum
DVPILLEYWLFINILKF

SEQ ID NO: 3283571 - protein, 28 aa, Plasmodium falciparum
DVQDQIYFLLLVLSLCHSAMIRNVDIDE

SEQ ID NO: 3283572 - protein, 24 aa, Plasmodium falciparum
DVQEKNIIDLFKKLGLFDKGLKEH

SEQ ID NO: 3283573 - protein, 23 aa, Plasmodium falciparum
DVQFLILLDLCNIKISYKILKDY

SEQ ID NO: 3283574 - protein, 26 aa, Plasmodium falciparum
DVSFFYINLIYIYVLNNDKVDIIGDV

SEQ ID NO: 3283575 - protein, 26 aa, Plasmodium falciparum
DVSHYFFSDLFHILKKLYYSVKNVIH

SEQ ID NO: 3283576 - protein, 27 aa, Plasmodium falciparum
DVTDLRYITTFYVIKYFPGFSSDNDID

SEQ ID NO: 3283577 - protein, 35 aa, Plasmodium falciparum
DVTILNIIPIFLFFYFHVYVIKQIILDFAIYKNIL

SEQ ID NO: 3283578 - protein, 22 aa, Plasmodium falciparum
DVTIYRNTYHRIINRWKDGKKN

SEQ ID NO: 3283579 - protein, 24 aa, Plasmodium falciparum
DVTVSFICLLLLLNSGDFKIFFLE

SEQ ID NO: 3283580 - protein, 23 aa, Plasmodium falciparum
DVVDFLKQLLPRKSKNTPGVTAM

SEQ ID NO: 3283581 - protein, 17 aa, Plasmodium falciparum
DVVIYYLKGLGVEELIP

SEQ ID NO: 3283582 - protein, 24 aa, Plasmodium falciparum
DVVKFYLEHFIIFSSSTGVISFLY

SEQ ID NO: 3283583 - protein, 23 aa, Plasmodium falciparum
DVWNVISWVFKDKTVCKEDDIEN

SEQ ID NO: 3283584 - protein, 25 aa, Plasmodium falciparum
DVWYMHVEMPPFEWVRVIIPNTCKV

SEQ ID NO: 3283585 - protein, 21 aa, Plasmodium falciparum
DVYREFIYINKLYNFSKLQNV

SEQ ID NO: 3283586 - protein, 31 aa, Plasmodium falciparum
DWFVKSAAVETFFLWHRYKKQKEKKPQEGSL

SEQ ID NO: 3283587 - protein, 17 aa, Plasmodium falciparum
DWIVYLVTHLEILSLSF

SEQ ID NO: 3283588 - protein, 21 aa, Plasmodium falciparum
DWQAQLKYYWVYDKKINNYTC

SEQ ID NO: 3283589 - protein, 18 aa, Plasmodium falciparum
DYCKIKTSFFKMERIIST

SEQ ID NO: 3283590 - protein, 20 aa, Plasmodium falciparum
DYCMKFFNFNSSGYHSCMRK

SEQ ID NO: 3283591 - protein, 17 aa, Plasmodium falciparum
DYDYILTKKKKKRTSIE

SEQ ID NO: 3283592 - protein, 19 aa, Plasmodium falciparum
DYEMPTLKSKNRYISYRSG

SEQ ID NO: 3283593 - protein, 19 aa, Plasmodium falciparum
DYFDFTFDKLKSLKFNNFV

SEQ ID NO: 3283594 - protein, 25 aa, Plasmodium falciparum
DYFKVIDIFYKICFTNLDNINILSH

SEQ ID NO: 3283595 - protein, 27 aa, Plasmodium falciparum
DYFMLGVLFIWIWNCGHMWKTSFPSES

SEQ ID NO: 3283596 - protein, 25 aa, Plasmodium falciparum
DYGISQFRFLKNLLLVHGRLSYRRI

SEQ ID NO: 3283597 - protein, 21 aa, Plasmodium falciparum
DYHLPLILCILNVIDKNYSPH

SEQ ID NO: 3283598 - protein, 24 aa, Plasmodium falciparum
DYIDYYMFGIIHFLNNNFNKALLY

SEQ ID NO: 3283599 - protein, 27 aa, Plasmodium falciparum
DYIFQEKFLLFFHIQCLHFLYTKRNED

SEQ ID NO: 3283600 - protein, 25 aa, Plasmodium falciparum
DYIHLHPFYISTCDKYAFLNITKYY

SEQ ID NO: 3283601 - protein, 30 aa, Plasmodium falciparum
DYIILKLNEYLIWLLILHKNDSVIRYSLCG

SEQ ID NO: 3283602 - protein, 18 aa, Plasmodium falciparum
DYILQTYNIFKSKSNIIN

SEQ ID NO: 3283603 - protein, 19 aa, Plasmodium falciparum
DYILQTYNIFKSKSNIINN

SEQ ID NO: 3283604 - protein, 17 aa, Plasmodium falciparum
DYILTKKKKKRTSIEKN

SEQ ID NO: 3283605 - protein, 24 aa, Plasmodium falciparum
DYINHSIIPLKWIKSNYLKEYKNC

SEQ ID NO: 3283606 - protein, 26 aa, Plasmodium falciparum
DYIPQRLRWMTEWAEWYCKAQKEAYD

SEQ ID NO: 3283607 - protein, 25 aa, Plasmodium falciparum
DYIPQRLRWMTEWSEWYCKMQSQEY

SEQ ID NO: 3283608 - protein, 25 aa, Plasmodium falciparum
DYISKVEFLRIIGNIYFQIEKYKYS

SEQ ID NO: 3283609 - protein, 18 aa, Plasmodium falciparum
DYLDLYVNIALCQIKIYQ

SEQ ID NO: 3283610 - protein, 18 aa, Plasmodium falciparum
DYLIEIFHLFYHKKYNIK

SEQ ID NO: 3283611 - protein, 32 aa, Plasmodium falciparum
DYLKRICTTLKERLLYIIEMYISYYTKNINYN

SEQ ID NO: 3283612 - protein, 21 aa, Plasmodium falciparum
DYLLHPLQYNIYKLYTYLIFN

SEQ ID NO: 3283613 - protein, 26 aa, Plasmodium falciparum
DYLLTICVLIYLALLVLLIKICQLSC

SEQ ID NO: 3283614 - protein, 25 aa, Plasmodium falciparum
DYNDFYWVLLNKRTYEYFKSFILFS

SEQ ID NO: 3283615 - protein, 20 aa, Plasmodium falciparum
DYNHLFFIFSNNHMNICLKH

SEQ ID NO: 3283616 - protein, 19 aa, Plasmodium falciparum
DYNKFIFYHVRKIMKNIFF

SEQ ID NO: 3283617 - protein, 24 aa, Plasmodium falciparum
DYNLNPILSHPLFLELDEQTKKYL

SEQ ID NO: 3283618 - protein, 26 aa, Plasmodium falciparum
DYNNRYLYVLLHIVHKILLKKKEEIL

SEQ ID NO: 3283619 - protein, 19 aa, Plasmodium falciparum
DYNYFLNFVFERWKHKVKS

SEQ ID NO: 3283620 - protein, 23 aa, Plasmodium falciparum
DYSKFDSEDLIWKYYNNPSNNRN

SEQ ID NO: 3283621 - protein, 22 aa, Plasmodium falciparum
DYSLFLRIYSIYHTYNHRKNGY

SEQ ID NO: 3283622 - protein, 28 aa, Plasmodium falciparum
DYSQENGPNIFALRKRFPLGMNDEDEEG

SEQ ID NO: 3283623 - protein, 29 aa, Plasmodium falciparum
DYSTWNLSIIRVFNAWFLAGYGNKNVKVC

SEQ ID NO: 3283624 - protein, 33 aa, Plasmodium falciparum
DYSYNFMMNNFYANNFFFFYNNDYYENMTNNDS

SEQ ID NO: 3283625 - protein, 26 aa, Plasmodium falciparum
DYTQGCILLPRKINIINKIYKCSLGN

SEQ ID NO: 3283626 - protein, 18 aa, Plasmodium falciparum
DYVDIILVFFDSSGKSLS

SEQ ID NO: 3283627 - protein, 27 aa, Plasmodium falciparum
DYVEVQFHFPIYYTKFLYNYKSTYCVL

SEQ ID NO: 3283628 - protein, 18 aa, Plasmodium falciparum
DYVLYMIRVTSITNKYAN

SEQ ID NO: 3283629 - protein, 39 aa, Plasmodium falciparum
DYYIDCKIVDFLKYFFSMKPFFLYIIKEDINLILCVFEN

SEQ ID NO: 3283630 - protein, 18 aa, Plasmodium falciparum
DYYLSWIMEGLKDDTPTF

SEQ ID NO: 3283631 - protein, 24 aa, Plasmodium falciparum
DYYQLREDWWNNNRKMVWIAMTCE

SEQ ID NO: 3283632 - protein, 18 aa, Plasmodium falciparum
DYYYYYYSSMNILNDPDN

SEQ ID NO: 3283633 - protein, 27 aa, Plasmodium falciparum
EADWGTYFMVPFFLFENIDFSHNELMN

SEQ ID NO: 3283634 - protein, 17 aa, Plasmodium falciparum
EAEWLFNSFLEIKKLDE

SEQ ID NO: 3283635 - protein, 18 aa, Plasmodium falciparum
EAFIKCAAVETFFAWHEF

SEQ ID NO: 3283636 - protein, 28 aa, Plasmodium falciparum
EAFIKCAGAEIFLLWQKYKTDNNSDTKL

SEQ ID NO: 3283637 - protein, 38 aa, Plasmodium falciparum
EAFIQSAAIETFFLWDRYKKEWALQKLAELQRNGDLPF

SEQ ID NO: 3283638 - protein, 18 aa, Plasmodium falciparum
EAILKILYNKINLNNLDL

SEQ ID NO: 3283639 - protein, 18 aa, Plasmodium falciparum
EALFFSLMVTIGCICLTI

SEQ ID NO: 3283640 - protein, 30 aa, Plasmodium falciparum
EANANFRNLFLLYQLTIRGIHKLDLFPFNR

SEQ ID NO: 3283641 - protein, 19 aa, Plasmodium falciparum
EANNLFNLIKYYNVHKKEL

SEQ ID NO: 3283642 - protein, 29 aa, Plasmodium falciparum
EAPKIKRILYTLKFLFSFDLFPNVLPYNR

SEQ ID NO: 3283643 - protein, 25 aa, Plasmodium falciparum
EASEGIFYFYTKKVGIYTLTLKNNK

SEQ ID NO: 3283644 - protein, 26 aa, Plasmodium falciparum
EASIVYFILILMHNINYMYQYSLDSF

SEQ ID NO: 3283645 - protein, 18 aa, Plasmodium falciparum
EAWWDANRKDIWKAMTCA

SEQ ID NO: 3283646 - protein, 18 aa, Plasmodium falciparum
EAYIKLQQFLFNESYIFK

SEQ ID NO: 3283647 - protein, 19 aa, Plasmodium falciparum
EAYLHIIKDIYFHNYKNEY

SEQ ID NO: 3283648 - protein, 46 aa, Plasmodium falciparum
ECAKMIIPLYKLLVTRLKICLYYPHYFFLACLFNYKYDTNLSNTLL

SEQ ID NO: 3283649 - protein, 24 aa, Plasmodium falciparum
ECCKYYILLCLYEILKKSENYKYM

SEQ ID NO: 3283650 - protein, 18 aa, Plasmodium falciparum
ECFFVINFKDKKYRFDTF

SEQ ID NO: 3283651 - protein, 25 aa, Plasmodium falciparum
ECFKINPMIILINSYDQIKTVNSLL

SEQ ID NO: 3283652 - protein, 30 aa, Plasmodium falciparum
ECFLDNFEFFKLLKFEVIYIILISLKYDLD

SEQ ID NO: 3283653 - protein, 22 aa, Plasmodium falciparum
ECFNKCMISYRKDLLWYSENCF

SEQ ID NO: 3283654 - protein, 17 aa, Plasmodium falciparum
ECILFKNLVPEFYHLRD

SEQ ID NO: 3283655 - protein, 19 aa, Plasmodium falciparum
ECLIIFLRDSMIGEFPVRL

SEQ ID NO: 3283656 - protein, 22 aa, Plasmodium falciparum
ECLKILLRLNKIDKIKDLIFEC

SEQ ID NO: 3283657 - protein, 19 aa, Plasmodium falciparum
ECLTNYLSFIFKHFKNYIT

SEQ ID NO: 3283658 - protein, 41 aa, Plasmodium falciparum
ECLYFNNYTFNHIYGNRYFNLTILFNHLYHKKCSVCLFNFP

SEQ ID NO: 3283659 - protein, 24 aa, Plasmodium falciparum
ECNHTYCFLCFYRLLYMEKKENDN

SEQ ID NO: 3283660 - protein, 17 aa, Plasmodium falciparum
ECNILEFLIHFFNKYQL

SEQ ID NO: 3283661 - protein, 17 aa, Plasmodium falciparum
ECNILEFLIHYFNKYQL

SEQ ID NO: 3283662 - protein, 24 aa, Plasmodium falciparum
ECNIYFHHFFLISKEIMMKLIYID

SEQ ID NO: 3283663 - protein, 22 aa, Plasmodium falciparum
ECNSLLPCPLNIAEIKTYNIHA

SEQ ID NO: 3283664 - protein, 25 aa, Plasmodium falciparum
ECNYKLFFFIIQLQQKIKDLEKENE

SEQ ID NO: 3283665 - protein, 26 aa, Plasmodium falciparum
ECTKCSFWCGFYKKWLENQKQEFLKQ

SEQ ID NO: 3283666 - protein, 22 aa, Plasmodium falciparum
ECVVILNDKLCFNCISLLQQVE

SEQ ID NO: 3283667 - protein, 18 aa, Plasmodium falciparum
ECYWSSAFVQELVNRKLI

SEQ ID NO: 3283668 - protein, 25 aa, Plasmodium falciparum
EDAMNDFINKILLKEIKNVSFFIEP

SEQ ID NO: 3283669 - protein, 21 aa, Plasmodium falciparum
EDCDNIFSQKYNILPSFNCRD

SEQ ID NO: 3283670 - protein, 34 aa, Plasmodium falciparum
EDDGNLRIYSTNKTYPFITYKYNCPVNVCKYHYN

SEQ ID NO: 3283671 - protein, 28 aa, Plasmodium falciparum
EDDIENIPQFFRWFSEWGDDYCQDKTKM

SEQ ID NO: 3283672 - protein, 29 aa, Plasmodium falciparum
EDDVQIRRDVFFFNLLKSVIKKKTSEDML

SEQ ID NO: 3283673 - protein, 26 aa, Plasmodium falciparum
EDEKHKLVIELLKIIVTKKKIEHIRK

SEQ ID NO: 3283674 - protein, 28 aa, Plasmodium falciparum
EDEKLLIGTIFFNFMKYKGLFNKYETDI

SEQ ID NO: 3283675 - protein, 24 aa, Plasmodium falciparum
EDENMLFYILHIFELFVEIYEDKD

SEQ ID NO: 3283676 - protein, 28 aa, Plasmodium falciparum
EDETLFLNFLRFLGIQLYYKNDYMFLLC

SEQ ID NO: 3283677 - protein, 23 aa, Plasmodium falciparum
EDEYLLPFFFFLKNKRNGINSDY

SEQ ID NO: 3283678 - protein, 17 aa, Plasmodium falciparum
EDFFYKNKKLKDLSKRE

SEQ ID NO: 3283679 - protein, 25 aa, Plasmodium falciparum
EDFKRQMFYTFGDYRDFLFGTDISK

SEQ ID NO: 3283680 - protein, 33 aa, Plasmodium falciparum
EDFKRQMFYTFGDYRDLFLGRYIGNDLDKVNNN

SEQ ID NO: 3283681 - protein, 22 aa, Plasmodium falciparum
EDFYKYLFINKNNPIFFHILHD

SEQ ID NO: 3283682 - protein, 25 aa, Plasmodium falciparum
EDFYNKQINLLKYYMKKDNDEIHEN

SEQ ID NO: 3283683 - protein, 25 aa, Plasmodium falciparum
EDIDFKTFFYLFYKNKKGKKTSYST

SEQ ID NO: 3283684 - protein, 24 aa, Plasmodium falciparum
EDIDINNIYPYKSPKYKTLIDVVL

SEQ ID NO: 3283685 - protein, 22 aa, Plasmodium falciparum
EDIEYFLFNLQVEWLRILTLEL

SEQ ID NO: 3283686 - protein, 24 aa, Plasmodium falciparum
EDIFQFLHRAITFDPFLFKDDEDD

SEQ ID NO: 3283687 - protein, 25 aa, Plasmodium falciparum
EDIKIVQHIIMKYVQKLNSLKDIEQ

SEQ ID NO: 3283688 - protein, 25 aa, Plasmodium falciparum
EDIKKKLQLFINTHSPTMVNITEKW

SEQ ID NO: 3283689 - protein, 28 aa, Plasmodium falciparum
EDIQHIFYFLQYVLSSLIYSPSIFFFHI

SEQ ID NO: 3283690 - protein, 25 aa, Plasmodium falciparum
EDKAYEHLLFSNNYMRIIIYILNEK

SEQ ID NO: 3283691 - protein, 30 aa, Plasmodium falciparum
EDKLMLKNIILIIFTLLSMIVYIIINHYEN

SEQ ID NO: 3283692 - protein, 27 aa, Plasmodium falciparum
EDKPVVDFLYNLYLQNGGKKGPPPDTH

SEQ ID NO: 3283693 - protein, 32 aa, Plasmodium falciparum
EDKQKSIMAFFPFFYIMLMKNCNYVISHLTVV

SEQ ID NO: 3283694 - protein, 45 aa, Plasmodium falciparum
EDLERNYLYLFFQIIHNRSFILYYSFLFIYINQKGLNFEGSLSTM

SEQ ID NO: 3283695 - protein, 31 aa, Plasmodium falciparum
EDMKKHWGYPRRWKVILWDLHIQNYMNNDFN

SEQ ID NO: 3283696 - protein, 17 aa, Plasmodium falciparum
EDMKLYWNSIKNDVYNK

SEQ ID NO: 3283697 - protein, 26 aa, Plasmodium falciparum
EDMNTLYEYALIRFPIYNENKDMCSL

SEQ ID NO: 3283698 - protein, 30 aa, Plasmodium falciparum
EDMTRNVLILIILDIKLVIKKAVERVLCDK

SEQ ID NO: 3283699 - protein, 30 aa, Plasmodium falciparum
EDNIFELYKYFYYLNYPLNLNTHELLQEKL

SEQ ID NO: 3283700 - protein, 37 aa, Plasmodium falciparum
EDNMKVQFLSFFFLMTTILQMIYLSILKIYQYNTTNI

SEQ ID NO: 3283701 - protein, 23 aa, Plasmodium falciparum
EDNNILSNTFWYIPDKYKDSLSC

SEQ ID NO: 3283702 - protein, 23 aa, Plasmodium falciparum
EDQFLLWFQEWGENFCARQKELY

SEQ ID NO: 3283703 - protein, 29 aa, Plasmodium falciparum
EDQGNCAISWIFASKYYLETLKCMKGYEP

SEQ ID NO: 3283704 - protein, 22 aa, Plasmodium falciparum
EDQKYILHNYLLIDIFKHMNDN

SEQ ID NO: 3283705 - protein, 27 aa, Plasmodium falciparum
EDQRVVDFLKQLLLRNSAAARNRVIRA

SEQ ID NO: 3283706 - protein, 24 aa, Plasmodium falciparum
EDRLKIYEILPGLQVVFIKEIEIK

SEQ ID NO: 3283707 - protein, 35 aa, Plasmodium falciparum
EDSCIYFYQYNIGKRLYFFLYQSLLYGNNMKEYNM

SEQ ID NO: 3283708 - protein, 33 aa, Plasmodium falciparum
EDSEGYLKSWLIKQWIQWKNMKILECLMNEWRR

SEQ ID NO: 3283709 - protein, 26 aa, Plasmodium falciparum
EDTLYYKIIYILRKKNINKDTIYITY

SEQ ID NO: 3283710 - protein, 23 aa, Plasmodium falciparum
EDVNDICDYIILSNTYHLSNIYD

SEQ ID NO: 3283711 - protein, 26 aa, Plasmodium falciparum
EDVVKLKVLLLKKAIYFLPVCNKIFQ

SEQ ID NO: 3283712 - protein, 22 aa, Plasmodium falciparum
EDVYNFFLNKQYSKFFYNTENK

SEQ ID NO: 3283713 - protein, 17 aa, Plasmodium falciparum
EDWWTANRDQVWKAMTC

SEQ ID NO: 3283714 - protein, 27 aa, Plasmodium falciparum
EDYFSNFFFFCKTYEDFYIYLNTYYEE

SEQ ID NO: 3283715 - protein, 29 aa, Plasmodium falciparum
EDYILRYKRKFFFFINKSGNIVKIILFLF

SEQ ID NO: 3283716 - protein, 30 aa, Plasmodium falciparum
EDYVENKMFLFFQLFLIFYSSSSELIDYVI

SEQ ID NO: 3283717 - protein, 17 aa, Plasmodium falciparum
EEDYFYVNPLRKLNCIG

SEQ ID NO: 3283718 - protein, 23 aa, Plasmodium falciparum
EEDYKIILQEKTIIEDAAIKIQS

SEQ ID NO: 3283719 - protein, 28 aa, Plasmodium falciparum
EEEFDIIKYLFYIIRLVEYSLSSENGNL

SEQ ID NO: 3283720 - protein, 27 aa, Plasmodium falciparum
EEEINLHFIFCLTLPCLITNIYFLNYN

SEQ ID NO: 3283721 - protein, 25 aa, Plasmodium falciparum
EEEKEKIILFINELNSYINDLSLSL

SEQ ID NO: 3283722 - protein, 21 aa, Plasmodium falciparum
EEEKMILIIDHIKNYINRIIS

SEQ ID NO: 3283723 - protein, 19 aa, Plasmodium falciparum
EEELLLLDGISKFGFGNWE

SEQ ID NO: 3283724 - protein, 17 aa, Plasmodium falciparum
EEENFDILNIFSNDPKS

SEQ ID NO: 3283725 - protein, 26 aa, Plasmodium falciparum
EEENMINSFLLKKSSFNKYCDKSNNS

SEQ ID NO: 3283726 - protein, 19 aa, Plasmodium falciparum
EEESFLYDIDFLIKNSSFS

SEQ ID NO: 3283727 - protein, 24 aa, Plasmodium falciparum
EEETEIWFFPVKNDHKLSSNLTEI

SEQ ID NO: 3283728 - protein, 32 aa, Plasmodium falciparum
EEEVDKNTLFPYLFKMLSISKPLSIQIHPNEQ

SEQ ID NO: 3283729 - protein, 24 aa, Plasmodium falciparum
EEEWQLLKLWLEGEKNKWLEGKNK

SEQ ID NO: 3283730 - protein, 18 aa, Plasmodium falciparum
EEFIYRFFVLKSLNLFMN

SEQ ID NO: 3283731 - protein, 28 aa, Plasmodium falciparum
EEFKNMNFLYFDKAYIDLTLTNPIRYSY

SEQ ID NO: 3283732 - protein, 25 aa, Plasmodium falciparum
EEFKRQMFYTLGDYADIFFGKNDIL

SEQ ID NO: 3283733 - protein, 24 aa, Plasmodium falciparum
EEFKRQMFYTLGDYRDILFGKNDI

SEQ ID NO: 3283734 - protein, 17 aa, Plasmodium falciparum
EEFLYLYLCFLNKNMNT

SEQ ID NO: 3283735 - protein, 25 aa, Plasmodium falciparum
EEGKKLFYNFFASGDFFFVENYDYF

SEQ ID NO: 3283736 - protein, 32 aa, Plasmodium falciparum
EEGNQMYLILPTYFLYINVLNIITNILIQNED

SEQ ID NO: 3283737 - protein, 25 aa, Plasmodium falciparum
EEGSATDYFVGQGSIIEEVLEEEGL

SEQ ID NO: 3283738 - protein, 24 aa, Plasmodium falciparum
EEHETFIHFLQNNNYLYIKNKLWN

SEQ ID NO: 3283739 - protein, 24 aa, Plasmodium falciparum
EEIKILFLSIIKLLSFSLDHFPFF

SEQ ID NO: 3283740 - protein, 26 aa, Plasmodium falciparum
EEIKMLQILLLHINVPRLNNFFQLIL

SEQ ID NO: 3283741 - protein, 20 aa, Plasmodium falciparum
EEILLIIFLNIIEYICKINN

SEQ ID NO: 3283742 - protein, 21 aa, Plasmodium falciparum
EEILMLCQIFKILKIKNDILV

SEQ ID NO: 3283743 - protein, 21 aa, Plasmodium falciparum
EEIMFLYQYFFVRTCLFNELK

SEQ ID NO: 3283744 - protein, 23 aa, Plasmodium falciparum
EEIVEELIPEKLIGEVVPEKVVE

SEQ ID NO: 3283745 - protein, 17 aa, Plasmodium falciparum
EEIWYNGLTLEEIYKNS

SEQ ID NO: 3283746 - protein, 27 aa, Plasmodium falciparum
EEKASLRFYRLLAQSYVFNSRLDGFHN

SEQ ID NO: 3283747 - protein, 32 aa, Plasmodium falciparum
EEKCYNNMILCYYYLIYLFSNLSEKKEDSCIY

SEQ ID NO: 3283748 - protein, 26 aa, Plasmodium falciparum
EEKENIFIMLILVDDILYYGKNNNLE

SEQ ID NO: 3283749 - protein, 24 aa, Plasmodium falciparum
EEKEQIITILFTKDLYKLKLFYIK

SEQ ID NO: 3283750 - protein, 34 aa, Plasmodium falciparum
EEKGVIIACLFAEWYFIYKNYLNILKMSISNDMQ

SEQ ID NO: 3283751 - protein, 27 aa, Plasmodium falciparum
EEKGVLRIFVLKLNYILSVLNFVNQLK

SEQ ID NO: 3283752 - protein, 17 aa, Plasmodium falciparum
EEKKRILIYLDPFAGAG

SEQ ID NO: 3283753 - protein, 25 aa, Plasmodium falciparum
EEKKTNYIQILLIQKKKKLFINISN

SEQ ID NO: 3283754 - protein, 27 aa, Plasmodium falciparum
EEKLNISCRFFIQESNPYELDIRMLKE

SEQ ID NO: 3283755 - protein, 20 aa, Plasmodium falciparum
EEKMILIFKCDNKFYITKYG

SEQ ID NO: 3283756 - protein, 22 aa, Plasmodium falciparum
EEKNLIKYNTLMDIPVELLKNK

SEQ ID NO: 3283757 - protein, 38 aa, Plasmodium falciparum
EEKPRKYDNYFFYIFFILLLFFLLFVDSNGLYNEITQN

SEQ ID NO: 3283758 - protein, 25 aa, Plasmodium falciparum
EEKRNWFEKYINLIKKDWLDHNPWK

SEQ ID NO: 3283759 - protein, 37 aa, Plasmodium falciparum
EEKSMHYHPFFWKWVTEMLIDSMYWRKELKSCINNKR

SEQ ID NO: 3283760 - protein, 23 aa, Plasmodium falciparum
EELDINDIYPYKSPKYKTLIEVV

SEQ ID NO: 3283761 - protein, 22 aa, Plasmodium falciparum
EELDINEIYPYQSPKYKTLIEV

SEQ ID NO: 3283762 - protein, 21 aa, Plasmodium falciparum
EELILKNYLIKSVYQNFFVCI

SEQ ID NO: 3283763 - protein, 17 aa, Plasmodium falciparum
EELLLKQNKLMKLQDEQ

SEQ ID NO: 3283764 - protein, 24 aa, Plasmodium falciparum
EELNRLLNIQHLTIPEIATIYGVH

SEQ ID NO: 3283765 - protein, 21 aa, Plasmodium falciparum
EELYYRHVFIIKDITLEDRKN

SEQ ID NO: 3283766 - protein, 19 aa, Plasmodium falciparum
EEMLLHIKLILYSIYVITP

SEQ ID NO: 3283767 - protein, 40 aa, Plasmodium falciparum
EEMYLILLASYPKHFAWFKYFLFFILYSINFQFRDKKVFD

SEQ ID NO: 3283768 - protein, 21 aa, Plasmodium falciparum
EENCFFLKRKIWELLHDQTNL

SEQ ID NO: 3283769 - protein, 26 aa, Plasmodium falciparum
EENDAKFPLFYVEENKNRIKNKQNEN

SEQ ID NO: 3283770 - protein, 19 aa, Plasmodium falciparum
EENFLLRDLIYPLQGIDGE

SEQ ID NO: 3283771 - protein, 26 aa, Plasmodium falciparum
EENHSLLLFYFYRCYTHLNYLIKKKN

SEQ ID NO: 3283772 - protein, 29 aa, Plasmodium falciparum
EENIVIEFFIYFMNLLKICFEHPLYRDHL

SEQ ID NO: 3283773 - protein, 49 aa, Plasmodium falciparum
EENKKMFLKIIQDRIYLLNKFNIYFENCLPITSILFNKPVINLEEQGLR

SEQ ID NO: 3283774 - protein, 25 aa, Plasmodium falciparum
EENKNKFLYNIKKYQKKKKYYINKE

SEQ ID NO: 3283775 - protein, 17 aa, Plasmodium falciparum
EENLFFLKKIQLNTLEI

SEQ ID NO: 3283776 - protein, 19 aa, Plasmodium falciparum
EENLFSVPYFLLQKNYDTR

SEQ ID NO: 3283777 - protein, 24 aa, Plasmodium falciparum
EENSYFFNILKFKDYLIDFYEKNE

SEQ ID NO: 3283778 - protein, 25 aa, Plasmodium falciparum
EENVNKWMLFFKLHGTHVAYEIYLG

SEQ ID NO: 3283779 - protein, 18 aa, Plasmodium falciparum
EENYINDIFLFLNSNEQY

SEQ ID NO: 3283780 - protein, 32 aa, Plasmodium falciparum
EEPYNNIFEIIKPENLYSSLLLLSNEKENDFP

SEQ ID NO: 3283781 - protein, 34 aa, Plasmodium falciparum
EEQDMINGVLDEKGNYIYLSQEEINKLCFEIQSK

SEQ ID NO: 3283782 - protein, 23 aa, Plasmodium falciparum
EEQKKFCFYLNNILDILITPLNK

SEQ ID NO: 3283783 - protein, 25 aa, Plasmodium falciparum
EEQKLRQRLTKLQEWKALGLQNIEQ

SEQ ID NO: 3283784 - protein, 25 aa, Plasmodium falciparum
EEQNTFSLMLKQFKILLTCVDDELK

SEQ ID NO: 3283785 - protein, 36 aa, Plasmodium falciparum
EERKEKRRNWILRSLRRDKLREIEQLEKLNAQLESA

SEQ ID NO: 3283786 - protein, 29 aa, Plasmodium falciparum
EERKFSFLRYHLYNYYYSLKNRSRVSREY

SEQ ID NO: 3283787 - protein, 40 aa, Plasmodium falciparum
EERKKFYFDVLSADKYMLGILYIWIWNNNYIWKRADPSKD

SEQ ID NO: 3283788 - protein, 24 aa, Plasmodium falciparum
EERRKRLVILKRRKGQNDKIKCGT

SEQ ID NO: 3283789 - protein, 25 aa, Plasmodium falciparum
EERYEKKRYYLKEDGEGDLKDVEEK

SEQ ID NO: 3283790 - protein, 34 aa, Plasmodium falciparum
EESIIIKYIITILFYIHCDLFFKHISYLENMYIS

SEQ ID NO: 3283791 - protein, 24 aa, Plasmodium falciparum
EESKSYYIIKLLTPIHLEEKSDDN

SEQ ID NO: 3283792 - protein, 19 aa, Plasmodium falciparum
EESLYMYNIFLSYFSYLHY

SEQ ID NO: 3283793 - protein, 25 aa, Plasmodium falciparum
EESNYYTLSLFNTKYTYIIEKLLEH

SEQ ID NO: 3283794 - protein, 17 aa, Plasmodium falciparum
EETYKLILKYVEKIKKV

SEQ ID NO: 3283795 - protein, 23 aa, Plasmodium falciparum
EEVEVFSIWGSNSVLDHIDVLRD

SEQ ID NO: 3283796 - protein, 23 aa, Plasmodium falciparum
EEVIPELLVEEIVPIEVVGEIVP

SEQ ID NO: 3283797 - protein, 18 aa, Plasmodium falciparum
EEVIPKVLVEEVIPELLV

SEQ ID NO: 3283798 - protein, 25 aa, Plasmodium falciparum
EEVKISILWTLTKYQKYIDPLLLYD

SEQ ID NO: 3283799 - protein, 17 aa, Plasmodium falciparum
EEVLPEELIEELVPEEV

SEQ ID NO: 3283800 - protein, 25 aa, Plasmodium falciparum
EEVLQFRIFLYHHLDKYHKVYKNLL

SEQ ID NO: 3283801 - protein, 18 aa, Plasmodium falciparum
EEVPNLYLDVFRRNSGDE

SEQ ID NO: 3283802 - protein, 63 aa, Plasmodium falciparum
EEVYPPVYLHQWLLTLFIASLPIKSVIVIWDYLFSTSIKKIIIISVALLKILKSYLMKHKFEK

SEQ ID NO: 3283803 - protein, 17 aa, Plasmodium falciparum
EEWFKKLKYNWNDEVNR

SEQ ID NO: 3283804 - protein, 17 aa, Plasmodium falciparum
EEYIFYEKKLDDNTRNN

SEQ ID NO: 3283805 - protein, 24 aa, Plasmodium falciparum
EEYIHALVLFLKLVPYLSHDVLYH

SEQ ID NO: 3283806 - protein, 21 aa, Plasmodium falciparum
EEYKSIDLFLGKLKAGPCSKT

SEQ ID NO: 3283807 - protein, 24 aa, Plasmodium falciparum
EEYLFYPHIIINKLKKKPYYLYHY

SEQ ID NO: 3283808 - protein, 24 aa, Plasmodium falciparum
EEYLNILYYLDHSNKYFIDNLKIF

SEQ ID NO: 3283809 - protein, 42 aa, Plasmodium falciparum
EEYNKFNITKLFYYYISIYMNIVNFLYYNMLYKMKKKKKDLS

SEQ ID NO: 3283810 - protein, 34 aa, Plasmodium falciparum
EFALKKEDLLYLQHLNILGYLIIEPIENYYHSCI

SEQ ID NO: 3283811 - protein, 19 aa, Plasmodium falciparum
EFCYFILRFIQKNPVLCAE

SEQ ID NO: 3283812 - protein, 26 aa, Plasmodium falciparum
EFDNLLYEHTLAYKKKDFFKKIEKKK

SEQ ID NO: 3283813 - protein, 19 aa, Plasmodium falciparum
EFFATILSFSISLGLHNLL

SEQ ID NO: 3283814 - protein, 28 aa, Plasmodium falciparum
EFFDDLLELLIILITKKHPILNKYTIIY

SEQ ID NO: 3283815 - protein, 21 aa, Plasmodium falciparum
EFFHSFIFYIISLGNNIRLHM

SEQ ID NO: 3283816 - protein, 17 aa, Plasmodium falciparum
EFFIDLLSQLYSRRILF

SEQ ID NO: 3283817 - protein, 20 aa, Plasmodium falciparum
EFFIYYIIKHYKDISSSILI

SEQ ID NO: 3283818 - protein, 19 aa, Plasmodium falciparum
EFHILLSKLKINKKNFFFF

SEQ ID NO: 3283819 - protein, 17 aa, Plasmodium falciparum
EFIIIIKEYLNKIFRQN

SEQ ID NO: 3283820 - protein, 19 aa, Plasmodium falciparum
EFIILLCREIFHENFILFQ

SEQ ID NO: 3283821 - protein, 18 aa, Plasmodium falciparum
EFILKVYTDFYYKKRENI

SEQ ID NO: 3283822 - protein, 23 aa, Plasmodium falciparum
EFIRPSFILILIINELKNYDDMF

SEQ ID NO: 3283823 - protein, 33 aa, Plasmodium falciparum
EFKEGKNVMSYNAFFWKWVHDMLIDSMQWRNEH

SEQ ID NO: 3283824 - protein, 17 aa, Plasmodium falciparum
EFKPIVQYDNFQDEENI

SEQ ID NO: 3283825 - protein, 24 aa, Plasmodium falciparum
EFKRQMFYTLADYKDILFGDQEVI

SEQ ID NO: 3283826 - protein, 23 aa, Plasmodium falciparum
EFKSQMFYTLADYRDILFGNNIG

SEQ ID NO: 3283827 - protein, 32 aa, Plasmodium falciparum
EFLKDISGYIINILHYIPLSEFITISCCFGCQ

SEQ ID NO: 3283828 - protein, 22 aa, Plasmodium falciparum
EFLKRLHILVNSLNKFKLQNLF

SEQ ID NO: 3283829 - protein, 25 aa, Plasmodium falciparum
EFLYNRLMWHLFVKKDNVAQSILGC

SEQ ID NO: 3283830 - protein, 20 aa, Plasmodium falciparum
EFMMGLLANYGFKFVKKIEE

SEQ ID NO: 3283831 - protein, 25 aa, Plasmodium falciparum
EFNKNTLLFFLSLINKIIKYKYMHI

SEQ ID NO: 3283832 - protein, 22 aa, Plasmodium falciparum
EFNYFNFYFYNDTYLEFYNLCI

SEQ ID NO: 3283833 - protein, 40 aa, Plasmodium falciparum
EFPSHYIFNNLFYLKCFLCVRIFFNILKNFPFCNTIHQYC

SEQ ID NO: 3283834 - protein, 24 aa, Plasmodium falciparum
EFPVRLNLIYFIAIIFKNSSNMNE

SEQ ID NO: 3283835 - protein, 18 aa, Plasmodium falciparum
EFQFCVIDAPWTIKSDIV

SEQ ID NO: 3283836 - protein, 23 aa, Plasmodium falciparum
EFSCFYLFIYFRCCFENINFYLI

SEQ ID NO: 3283837 - protein, 23 aa, Plasmodium falciparum
EFSIVLLLQMELCKGYTLRKWLD

SEQ ID NO: 3283838 - protein, 24 aa, Plasmodium falciparum
EFSRFQIMIVRCLSFLLKKKNINK

SEQ ID NO: 3283839 - protein, 35 aa, Plasmodium falciparum
EFSSKNIFLISYIEYIYILLLIIKEKKNTEKDRAI

SEQ ID NO: 3283840 - protein, 21 aa, Plasmodium falciparum
EFTKFRIILIKFKKHIKYILK

SEQ ID NO: 3283841 - protein, 23 aa, Plasmodium falciparum
EFTLIEYINQLYNLEWFNKFNLH

SEQ ID NO: 3283842 - protein, 33 aa, Plasmodium falciparum
EFVFCKMLNLCRLYINGILPFVFTKINTVHYGI

SEQ ID NO: 3283843 - protein, 19 aa, Plasmodium falciparum
EFVSSIIIPLLIQKKIWTN

SEQ ID NO: 3283844 - protein, 18 aa, Plasmodium falciparum
EFYKFQFKISTYIGFIYT

SEQ ID NO: 3283845 - protein, 22 aa, Plasmodium falciparum
EFYMHTFDFVYINEKNLLLSLY

SEQ ID NO: 3283846 - protein, 18 aa, Plasmodium falciparum
EGAIYFYTLIYKKRKHTY

SEQ ID NO: 3283847 - protein, 25 aa, Plasmodium falciparum
EGALILMKILCYSIYTVNIKKGKKD

SEQ ID NO: 3283848 - protein, 36 aa, Plasmodium falciparum
EGDYYNYIYKFNIFNVLLYYLFNETYFYEHILVHLK

SEQ ID NO: 3283849 - protein, 31 aa, Plasmodium falciparum
EGEHFDLCFLFMKLYFYYYFYINNEKEENTT

SEQ ID NO: 3283850 - protein, 21 aa, Plasmodium falciparum
EGEPLPFYKKCFCALAAGGLG

SEQ ID NO: 3283851 - protein, 26 aa, Plasmodium falciparum
EGEVLIGYWYHGIPVGPFKCRDFKTG

SEQ ID NO: 3283852 - protein, 31 aa, Plasmodium falciparum
EGFIFSFLILFITLLFFILLKFSSNIKEEDT

SEQ ID NO: 3283853 - protein, 17 aa, Plasmodium falciparum
EGFSGFYKGYIPTLLTG

SEQ ID NO: 3283854 - protein, 28 aa, Plasmodium falciparum
EGHNIDISLYNFIIRNIQIKIGNDIKNI

SEQ ID NO: 3283855 - protein, 30 aa, Plasmodium falciparum
EGHRLIDYIKEKIFNLYIKCSEQQNIIDDS

SEQ ID NO: 3283856 - protein, 25 aa, Plasmodium falciparum
EGHRYMLEKWKKEKWFIVLKENWKN

SEQ ID NO: 3283857 - protein, 32 aa, Plasmodium falciparum
EGIDQIRGWFQSFFFVFFCLNWINQRKKTRSQ

SEQ ID NO: 3283858 - protein, 28 aa, Plasmodium falciparum
EGILSIVIHYLLWNLINYIFNVNNIEII

SEQ ID NO: 3283859 - protein, 27 aa, Plasmodium falciparum
EGINGFFKGMFFGLLSAIIIPVVSLGV

SEQ ID NO: 3283860 - protein, 28 aa, Plasmodium falciparum
EGKFVEIIFLYIRLGYFEEAIEICSYFF

SEQ ID NO: 3283861 - protein, 26 aa, Plasmodium falciparum
EGKIFLFNNLGIPFFFSTLKSKYLTY

SEQ ID NO: 3283862 - protein, 22 aa, Plasmodium falciparum
EGKKKFCVIYKNKIYMLNNHDY

SEQ ID NO: 3283863 - protein, 25 aa, Plasmodium falciparum
EGLEQYMLWNNYMVIPHMKQYPPVF

SEQ ID NO: 3283864 - protein, 26 aa, Plasmodium falciparum
EGLITCIIFIFKYKNSLLGSVLFIGL

SEQ ID NO: 3283865 - protein, 22 aa, Plasmodium falciparum
EGNFGIFFEAYFKMLENIKNRN

SEQ ID NO: 3283866 - protein, 27 aa, Plasmodium falciparum
EGNFIMLVKGWFLKVLNKIILYKNLLL

SEQ ID NO: 3283867 - protein, 23 aa, Plasmodium falciparum
EGPIMTWWYGKILANFIKSKPNT

SEQ ID NO: 3283868 - protein, 19 aa, Plasmodium falciparum
EGPKKYKIIYSIPGRKKSV

SEQ ID NO: 3283869 - protein, 27 aa, Plasmodium falciparum
EGQKTLCLYCLALLKFLENDILKCTNI

SEQ ID NO: 3283870 - protein, 20 aa, Plasmodium falciparum
EGRHYLFSSIANHLRYPNSH

SEQ ID NO: 3283871 - protein, 26 aa, Plasmodium falciparum
EGRNFYEILYLLSTIANLILFKKVKI

SEQ ID NO: 3283872 - protein, 34 aa, Plasmodium falciparum
EGRYIPRNIIPGLLSNCSIVVGFPKGINGNVPNE

SEQ ID NO: 3283873 - protein, 24 aa, Plasmodium falciparum
EGSCYLMEKLFKKLSEEKKETSFN

SEQ ID NO: 3283874 - protein, 21 aa, Plasmodium falciparum
EGTFYRSKYCQPCPYCGMKKK

SEQ ID NO: 3283875 - protein, 21 aa, Plasmodium falciparum
EGTFYRSKYCQPCPYCGVKKN

SEQ ID NO: 3283876 - protein, 22 aa, Plasmodium falciparum
EGTYIIQIRALVRRWVEYFLED

SEQ ID NO: 3283877 - protein, 22 aa, Plasmodium falciparum
EGVEFLVNLQNDLKKKLDLECI

SEQ ID NO: 3283878 - protein, 18 aa, Plasmodium falciparum
EGYMNKCFYFIKNDEYNI

SEQ ID NO: 3283879 - protein, 17 aa, Plasmodium falciparum
EHAFALFLHKPHKYVDI

SEQ ID NO: 3283880 - protein, 19 aa, Plasmodium falciparum
EHAWFEIYKYMEIPERIKI

SEQ ID NO: 3283881 - protein, 31 aa, Plasmodium falciparum
EHCSSHLMLIFLLLAFFLVVVYRLYNEVVNS

SEQ ID NO: 3283882 - protein, 27 aa, Plasmodium falciparum
EHDYAFLYVTSLVIVLCLMTVIMSVYF

SEQ ID NO: 3283883 - protein, 26 aa, Plasmodium falciparum
EHEITIILYYLFTMWINGDKNNSSFF

SEQ ID NO: 3283884 - protein, 32 aa, Plasmodium falciparum
EHEKIAELVATQRLYMILYDVKEQLIRENDFS

SEQ ID NO: 3283885 - protein, 41 aa, Plasmodium falciparum
EHFRNLNHVFFIYSNYFYNFHNLFLFFNKDNDLFNSLFKLR

SEQ ID NO: 3283886 - protein, 22 aa, Plasmodium falciparum
EHIAYAIKIFLQEGLFDSDYKR

SEQ ID NO: 3283887 - protein, 20 aa, Plasmodium falciparum
EHIHNLCIHFEEKFKQECIH

SEQ ID NO: 3283888 - protein, 30 aa, Plasmodium falciparum
EHIIPFYQNYIKYIPIFLLKIFQGDSFNDI

SEQ ID NO: 3283889 - protein, 18 aa, Plasmodium falciparum
EHIKILKHLKLRHFINFT

SEQ ID NO: 3283890 - protein, 18 aa, Plasmodium falciparum
EHIKLFKNMNLEEIKNVL

SEQ ID NO: 3283891 - protein, 18 aa, Plasmodium falciparum
EHILLYNAIINYYEYFIT

SEQ ID NO: 3283892 - protein, 26 aa, Plasmodium falciparum
EHINKFFYIYILKYINDKLKIAFLKR

SEQ ID NO: 3283893 - protein, 25 aa, Plasmodium falciparum
EHKHGEFFNLNNMKYPLYGKNKNIM

SEQ ID NO: 3283894 - protein, 31 aa, Plasmodium falciparum
EHKTLNMKLLSLFLFSNKYFKYEEFYHFFNN

SEQ ID NO: 3283895 - protein, 20 aa, Plasmodium falciparum
EHLFREWEIRFAENPFEKQK

SEQ ID NO: 3283896 - protein, 25 aa, Plasmodium falciparum
EHLQGGIIIYEFYEKRFKKLKLILK

SEQ ID NO: 3283897 - protein, 23 aa, Plasmodium falciparum
EHMFKWRLFYNFCKKSPSPCNYF

SEQ ID NO: 3283898 - protein, 33 aa, Plasmodium falciparum
EHNGIVIYSILLDFFEILKRELAPRWFNIYYNP

SEQ ID NO: 3283899 - protein, 17 aa, Plasmodium falciparum
EHNKFIDSHTFFGLTLP

SEQ ID NO: 3283900 - protein, 20 aa, Plasmodium falciparum
EHQWRLFEYNMSKWMIENKY

SEQ ID NO: 3283901 - protein, 25 aa, Plasmodium falciparum
EHTNVMIRLGMTNPPYILKHIKDIC

SEQ ID NO: 3283902 - protein, 25 aa, Plasmodium falciparum
EHVDIYSIPLYFLKDFFRNDDNIVS

SEQ ID NO: 3283903 - protein, 19 aa, Plasmodium falciparum
EHVLKVYTFFPQIIDNDYY

SEQ ID NO: 3283904 - protein, 17 aa, Plasmodium falciparum
EHYFIDINNINLETNLL

SEQ ID NO: 3283905 - protein, 34 aa, Plasmodium falciparum
EICEGILKYTIYNNDLVLTLKIVDTFLTISVYEN

SEQ ID NO: 3283906 - protein, 19 aa, Plasmodium falciparum
EICHIELIPIIYNKILQEK

SEQ ID NO: 3283907 - protein, 26 aa, Plasmodium falciparum
EICILKKLNYDLSIPTPYSLLDSLLK

SEQ ID NO: 3283908 - protein, 25 aa, Plasmodium falciparum
EICYDLMLFFQLLIIAKEINKKNYY

SEQ ID NO: 3283909 - protein, 27 aa, Plasmodium falciparum
EIDAIKINFLFFKSLIIYNVPLKNIEI

SEQ ID NO: 3283910 - protein, 47 aa, Plasmodium falciparum
EIDDTKRNFNFFYAFVSSNFFYNVKLTFPVQWNLPSIYLTNDEIVED

SEQ ID NO: 3283911 - protein, 27 aa, Plasmodium falciparum
EIDDVYIFFFLFVDIFYNDILKTYNKL

SEQ ID NO: 3283912 - protein, 24 aa, Plasmodium falciparum
EIDILVLKKILTCVIYFTYAMLSN

SEQ ID NO: 3283913 - protein, 23 aa, Plasmodium falciparum
EIDKDIMNLIKYIMDHLENMQVE

SEQ ID NO: 3283914 - protein, 49 aa, Plasmodium falciparum
EIDMSNNFIFTYYYIFYLLNYMDTYIQFLFYYLKNTYILFSVVKVAERN

SEQ ID NO: 3283915 - protein, 23 aa, Plasmodium falciparum
EIEEILPEELIEELVPEGVIEEV

SEQ ID NO: 3283916 - protein, 27 aa, Plasmodium falciparum
EIELKLKKWLHYLKNWFYKKKRMKKYI

SEQ ID NO: 3283917 - protein, 23 aa, Plasmodium falciparum
EIENTCHFILYDKIKKFIRETNG

SEQ ID NO: 3283918 - protein, 28 aa, Plasmodium falciparum
EIESFNSLFWHWINEMLKDSILWSKELD

SEQ ID NO: 3283919 - protein, 25 aa, Plasmodium falciparum
EIESIFSLFLLFKKYYISICGNQTT

SEQ ID NO: 3283920 - protein, 17 aa, Plasmodium falciparum
EIFISKYSLTLCINYDY

SEQ ID NO: 3283921 - protein, 24 aa, Plasmodium falciparum
EIFQHMYIFLFNIPSFLIKNFNFA

SEQ ID NO: 3283922 - protein, 33 aa, Plasmodium falciparum
EIHHTPIFLRILTLIFLINLFNILDSTYLSSIK

SEQ ID NO: 3283923 - protein, 17 aa, Plasmodium falciparum
EIHILLKDKEITNNLLN

SEQ ID NO: 3283924 - protein, 28 aa, Plasmodium falciparum
EIHRDIFINYFYLLLNKIIVEAVKELKL

SEQ ID NO: 3283925 - protein, 20 aa, Plasmodium falciparum
EIHYFFLCAKLFSLNRMNFL

SEQ ID NO: 3283926 - protein, 18 aa, Plasmodium falciparum
EIIIFYKTRTKNNNYIWK

SEQ ID NO: 3283927 - protein, 24 aa, Plasmodium falciparum
EIIIKNIVFFLNHTDLKIFSIVTR

SEQ ID NO: 3283928 - protein, 23 aa, Plasmodium falciparum
EIIKILSFSLSFYLICDEKILLL

SEQ ID NO: 3283929 - protein, 19 aa, Plasmodium falciparum
EIIKLNSLYSFLDNLHKCV

SEQ ID NO: 3283930 - protein, 27 aa, Plasmodium falciparum
EIIKNKIFYFFTFFKVEKNLINLFFKY

SEQ ID NO: 3283931 - protein, 18 aa, Plasmodium falciparum
EIIKREYGISLNSCTALG

SEQ ID NO: 3283932 - protein, 17 aa, Plasmodium falciparum
EIILLFKNLYFFNIHLI

SEQ ID NO: 3283933 - protein, 39 aa, Plasmodium falciparum
EIILQRSWLIHWSLIIIFHFFMYVIYVKNTYPKNNSFSM

SEQ ID NO: 3283934 - protein, 17 aa, Plasmodium falciparum
EIILVYNLSFSDKKKYD

SEQ ID NO: 3283935 - protein, 27 aa, Plasmodium falciparum
EIINIDYYLIYILSKLLTHNKCTYMHI

SEQ ID NO: 3283936 - protein, 17 aa, Plasmodium falciparum
EIISIILVFFIGMTYNA

SEQ ID NO: 3283937 - protein, 27 aa, Plasmodium falciparum
EIKERIFLFKNELYFLAFIKILNLSIC

SEQ ID NO: 3283938 - protein, 28 aa, Plasmodium falciparum
EIKGCCYPYIFLNTILYCSKIVIAVHMF

SEQ ID NO: 3283939 - protein, 17 aa, Plasmodium falciparum
EIKIIFFSLKYLSICYY

SEQ ID NO: 3283940 - protein, 30 aa, Plasmodium falciparum
EIKIPPVILNNFTFILIDYNIKKDINNYFL

SEQ ID NO: 3283941 - protein, 22 aa, Plasmodium falciparum
EIKIYKYKYSLWNNPYLNIFKS

SEQ ID NO: 3283942 - protein, 24 aa, Plasmodium falciparum
EIKKFYFIRNLKHGTPFICIHNYE

SEQ ID NO: 3283943 - protein, 33 aa, Plasmodium falciparum
EIKNQLYFLILQMFNYILYLYYKYVNHNRIYIC

SEQ ID NO: 3283944 - protein, 17 aa, Plasmodium falciparum
EIKQIFNISRYKDLYKL

SEQ ID NO: 3283945 - protein, 23 aa, Plasmodium falciparum
EIKTYIDLFFGKNTYEKVFVKNN

SEQ ID NO: 3283946 - protein, 17 aa, Plasmodium falciparum
EIKWLSNFLVTVSGWND

SEQ ID NO: 3283947 - protein, 23 aa, Plasmodium falciparum
EILALHNIFFPMYVDNPGHVKKS

SEQ ID NO: 3283948 - protein, 25 aa, Plasmodium falciparum
EILEIFIYHRLDGYCLKYIDKKILK

SEQ ID NO: 3283949 - protein, 26 aa, Plasmodium falciparum
EILKNSFFIIYIYTHLQYIIFNKKKK

SEQ ID NO: 3283950 - protein, 34 aa, Plasmodium falciparum
EILKSFNYYIKPKMLFFELLPSYINKFVYTMKGY

SEQ ID NO: 3283951 - protein, 17 aa, Plasmodium falciparum
EILLNNSIYFIDCIYMI

SEQ ID NO: 3283952 - protein, 30 aa, Plasmodium falciparum
EILNKIDILPFLMFFRTLPFFINNKNKEKD

SEQ ID NO: 3283953 - protein, 17 aa, Plasmodium falciparum
EILNQLWNFLSMNNFIA

SEQ ID NO: 3283954 - protein, 35 aa, Plasmodium falciparum
EILNTFDLRVTIFNVFWLREWTEFNYRLTGSIGRF

SEQ ID NO: 3283955 - protein, 20 aa, Plasmodium falciparum
EILNTILFIWAKKNPDISYK

SEQ ID NO: 3283956 - protein, 20 aa, Plasmodium falciparum
EILTKLPIINGKYPHYIFKK

SEQ ID NO: 3283957 - protein, 34 aa, Plasmodium falciparum
EILTTLFILFIPLILFVFFYFYFTIIKLICSCLV

SEQ ID NO: 3283958 - protein, 18 aa, Plasmodium falciparum
EILYCYEHQYMHGTYHNY

SEQ ID NO: 3283959 - protein, 24 aa, Plasmodium falciparum
EIMEIIIHMLMLFSSLNILSNNIS

SEQ ID NO: 3283960 - protein, 24 aa, Plasmodium falciparum
EIMKIRIHVYPYILQKYHVETTYV

SEQ ID NO: 3283961 - protein, 30 aa, Plasmodium falciparum
EINDEYIKYIYFNGYIPINIYLSTNLIKYN

SEQ ID NO: 3283962 - protein, 31 aa, Plasmodium falciparum
EINFHVFFTFFILIYCILNIYLFHYTYNIFL

SEQ ID NO: 3283963 - protein, 24 aa, Plasmodium falciparum
EINFIDIIIAYAYHFFPKAVNDFT

SEQ ID NO: 3283964 - protein, 19 aa, Plasmodium falciparum
EINILYYKNTYVLIKNIHI

SEQ ID NO: 3283965 - protein, 30 aa, Plasmodium falciparum
EINIMDIFRLYSFYDYYRKYKKRKVKKIKN

SEQ ID NO: 3283966 - protein, 23 aa, Plasmodium falciparum
EINIYLLKLRTKNYNDFLYNLNK

SEQ ID NO: 3283967 - protein, 29 aa, Plasmodium falciparum
EINKIILKRKKVCKIILLVILPENTKNTE

SEQ ID NO: 3283968 - protein, 25 aa, Plasmodium falciparum
EINKWNLCNKPLLEEVPNLYLDVFR

SEQ ID NO: 3283969 - protein, 26 aa, Plasmodium falciparum
EINKYKIYMFILSKIDKFIKIKRYNE

SEQ ID NO: 3283970 - protein, 29 aa, Plasmodium falciparum
EINSLSLIILYFLCTIYYEQKKYLFCAFL

SEQ ID NO: 3283971 - protein, 27 aa, Plasmodium falciparum
EINTVFSIIYIFIIMISYIGCQILEWL

SEQ ID NO: 3283972 - protein, 24 aa, Plasmodium falciparum
EINYLLNILNYCDYSIYSDVDSCA

SEQ ID NO: 3283973 - protein, 27 aa, Plasmodium falciparum
EIPDDFLRQMFYTLGDYRDILVRGVAD

SEQ ID NO: 3283974 - protein, 28 aa, Plasmodium falciparum
EIPDGFLRQMFYTLGDYRDILFSGDKDK

SEQ ID NO: 3283975 - protein, 26 aa, Plasmodium falciparum
EIPPDFLRQMFYTLGDYRDILVGNST

SEQ ID NO: 3283976 - protein, 27 aa, Plasmodium falciparum
EIPPDFLRQMFYTLGDYRDILYSGDTV

SEQ ID NO: 3283977 - protein, 26 aa, Plasmodium falciparum
EIPTDFLRQMFYTLGDYRDICIGGDR

SEQ ID NO: 3283978 - protein, 20 aa, Plasmodium falciparum
EIQFHILSFSPEEFLRKNKD

SEQ ID NO: 3283979 - protein, 39 aa, Plasmodium falciparum
EIQGDKNIFIKNLLVFINNLIILYFSKSDLIDVCINRRS

SEQ ID NO: 3283980 - protein, 31 aa, Plasmodium falciparum
EIQKTFNNFFYYWVAHMLKDSIYWRMKKLER

SEQ ID NO: 3283981 - protein, 30 aa, Plasmodium falciparum
EIQNVSDVHAFIQKDMKYLDDLIDEEQTIK

SEQ ID NO: 3283982 - protein, 28 aa, Plasmodium falciparum
EIQTKEILYLKKLLYHYLSSFTNQTVET

SEQ ID NO: 3283983 - protein, 38 aa, Plasmodium falciparum
EIRHKYTKTYLFQISKRLLVMKKPWRLPKNVELQINNV

SEQ ID NO: 3283984 - protein, 17 aa, Plasmodium falciparum
EIRKYEYIKIFIIGLVL

SEQ ID NO: 3283985 - protein, 27 aa, Plasmodium falciparum
EIRNPFIILYQLIFKNFRMNLNIRKIN

SEQ ID NO: 3283986 - protein, 19 aa, Plasmodium falciparum
EIRNSRFLYFDREHKLLVI

SEQ ID NO: 3283987 - protein, 20 aa, Plasmodium falciparum
EIRRLKKKMLKYIYSDKKSD

SEQ ID NO: 3283988 - protein, 17 aa, Plasmodium falciparum
EIRTNILNFLEASFSPQ

SEQ ID NO: 3283989 - protein, 26 aa, Plasmodium falciparum
EITDNLIKIIFIKCYYLKINISNLEY

SEQ ID NO: 3283990 - protein, 18 aa, Plasmodium falciparum
EITLYIYRDDIKKSYKLL

SEQ ID NO: 3283991 - protein, 25 aa, Plasmodium falciparum
EITSILWAISIILIKSFKNSTYIGN

SEQ ID NO: 3283992 - protein, 25 aa, Plasmodium falciparum
EIVEEVIPEELIAEFAPEELFEKVI

SEQ ID NO: 3283993 - protein, 17 aa, Plasmodium falciparum
EIVGNKLILRPIEKDKM

SEQ ID NO: 3283994 - protein, 20 aa, Plasmodium falciparum
EIVIKKIFKYSFLLPEREYS

SEQ ID NO: 3283995 - protein, 23 aa, Plasmodium falciparum
EIVKSFILPYYHSFRFFSQEVTR

SEQ ID NO: 3283996 - protein, 24 aa, Plasmodium falciparum
EIVKYNIIYLTKYLNKNIPTVKNF

SEQ ID NO: 3283997 - protein, 25 aa, Plasmodium falciparum
EIVMYGLFHIYNYKLNFKIVCDNGY

SEQ ID NO: 3283998 - protein, 25 aa, Plasmodium falciparum
EIVSKPLEWLLFHDLTKPDVTALPE

SEQ ID NO: 3283999 - protein, 42 aa, Plasmodium falciparum
EIVYIFAVNFFFLFVLVMDIFPFLNYFFSLVSFPNIRFKFFF

SEQ ID NO: 3284000 - protein, 18 aa, Plasmodium falciparum
EIWNYWYSAFHKLYSFKI

SEQ ID NO: 3284001 - protein, 46 aa, Plasmodium falciparum
EIYCFEKFYFFIFIFILTVLWISCAFIFLIIKIYKNWKGYRNYDIV

SEQ ID NO: 3284002 - protein, 21 aa, Plasmodium falciparum
EIYDKFLFLLNQKIYSNVLII

SEQ ID NO: 3284003 - protein, 37 aa, Plasmodium falciparum
EIYGCLYKLNYLKLDIIFLLFSILINNTINFFNLSGY

SEQ ID NO: 3284004 - protein, 23 aa, Plasmodium falciparum
EIYIILKYYFELYNFLKKNISNI

SEQ ID NO: 3284005 - protein, 23 aa, Plasmodium falciparum
EIYKFLEILLFSNSYKKPHILYS

SEQ ID NO: 3284006 - protein, 17 aa, Plasmodium falciparum
EIYKKSYEIEKKEKEIY

SEQ ID NO: 3284007 - protein, 23 aa, Plasmodium falciparum
EIYKNYLLNIDRIGKTILIHEYN

SEQ ID NO: 3284008 - protein, 30 aa, Plasmodium falciparum
EIYLCSNLCIYYFDLLHRYNIKKNNFIKLF

SEQ ID NO: 3284009 - protein, 28 aa, Plasmodium falciparum
EIYLYKHIFYLLFLNKYNYYIINGFFNS

SEQ ID NO: 3284010 - protein, 30 aa, Plasmodium falciparum
EIYNIYEKCFFYLYDIYMYIEKYETVLVNL

SEQ ID NO: 3284011 - protein, 35 aa, Plasmodium falciparum
EIYNSMKLIFQFIKQNFYYLCKYINEEKKRNKLSA

SEQ ID NO: 3284012 - protein, 24 aa, Plasmodium falciparum
EIYRKTHLLPFIKKDYNSISLFLS

SEQ ID NO: 3284013 - protein, 28 aa, Plasmodium falciparum
EIYTHSLHLLYLYILKSMSVLNGLINKR

SEQ ID NO: 3284014 - protein, 37 aa, Plasmodium falciparum
EIYYRSNRIFLYSLMKYCYLLEYFSCLRSLVFLEIND

SEQ ID NO: 3284015 - protein, 22 aa, Plasmodium falciparum
EKAHLFICYPYLLDCLNTENKN

SEQ ID NO: 3284016 - protein, 24 aa, Plasmodium falciparum
EKAKLIFIIFLCMNLKIVPCTIKR

SEQ ID NO: 3284017 - protein, 23 aa, Plasmodium falciparum
EKALYFIHYIYTNFIHHSFLTNV

SEQ ID NO: 3284018 - protein, 24 aa, Plasmodium falciparum
EKCENLMIFFHMYLIRKYCEKNYY

SEQ ID NO: 3284019 - protein, 25 aa, Plasmodium falciparum
EKCSLNIFYFSMNILLTIFNSDISI

SEQ ID NO: 3284020 - protein, 26 aa, Plasmodium falciparum
EKDCTYWIKILKKKLKIYDIQWHEEY

SEQ ID NO: 3284021 - protein, 24 aa, Plasmodium falciparum
EKDDLIILNYIYNKFVKENPQFIN

SEQ ID NO: 3284022 - protein, 23 aa, Plasmodium falciparum
EKDFNVNYYYTYDPRLLIFEYTN

SEQ ID NO: 3284023 - protein, 31 aa, Plasmodium falciparum
EKDIEWKIYQILTWKYWNLKEFPGVDIPDPS

SEQ ID NO: 3284024 - protein, 32 aa, Plasmodium falciparum
EKDIHSLFFYSFYENILFYFPYEHSYTYDWRS

SEQ ID NO: 3284025 - protein, 22 aa, Plasmodium falciparum
EKDIYSIFFFLNNLDKHDIQNI

SEQ ID NO: 3284026 - protein, 22 aa, Plasmodium falciparum
EKDMKYLLSNIIYVYDKNKRIP

SEQ ID NO: 3284027 - protein, 25 aa, Plasmodium falciparum
EKDYRLIFYIIMKYIHKHKIKYTYD

SEQ ID NO: 3284028 - protein, 24 aa, Plasmodium falciparum
EKEDDMLLNRYLKNLFPSMNRFNT

SEQ ID NO: 3284029 - protein, 37 aa, Plasmodium falciparum
EKEETYYIYIIYKIKKKYINILIQLLLKLLCEKNMRT

SEQ ID NO: 3284030 - protein, 28 aa, Plasmodium falciparum
EKEKFNSWYMYFNNNFYLLRKKYKTPFN

SEQ ID NO: 3284031 - protein, 22 aa, Plasmodium falciparum
EKEKLLFNIYETPNFVQELEAI

SEQ ID NO: 3284032 - protein, 19 aa, Plasmodium falciparum
EKEKRQIFIKKLKERSMLY

SEQ ID NO: 3284033 - protein, 24 aa, Plasmodium falciparum
EKENLIIMIYMEILKYINKNERIG

SEQ ID NO: 3284034 - protein, 20 aa, Plasmodium falciparum
EKENYFSPMLLFENIVNNGN

SEQ ID NO: 3284035 - protein, 39 aa, Plasmodium falciparum
EKEVEFCKNMKLPILFFLLIKRLLIMEVSNSNLNMLKDI

SEQ ID NO: 3284036 - protein, 37 aa, Plasmodium falciparum
EKEYPNLKYLLSVCSSILFWLNFNKKDNFAIINYHKI

SEQ ID NO: 3284037 - protein, 26 aa, Plasmodium falciparum
EKFAERPQFLRWFTEWSDEFCREREK

SEQ ID NO: 3284038 - protein, 19 aa, Plasmodium falciparum
EKFIYSYASSEARKLRTIH

SEQ ID NO: 3284039 - protein, 22 aa, Plasmodium falciparum
EKFVLYFISIISVLYINEYYYE

SEQ ID NO: 3284040 - protein, 26 aa, Plasmodium falciparum
EKFYYNHKIFLNTSLILLHCLSKDVK

SEQ ID NO: 3284041 - protein, 22 aa, Plasmodium falciparum
EKGKWYQFKDDLKKKFEPSEKN

SEQ ID NO: 3284042 - protein, 20 aa, Plasmodium falciparum
EKHFIKHVLAFFAASDGIVL

SEQ ID NO: 3284043 - protein, 41 aa, Plasmodium falciparum
EKHKFIKRKLYLVKRILYMFIRIVYPFLQTCHKIYLHGKCN

SEQ ID NO: 3284044 - protein, 58 aa, Plasmodium falciparum
EKHNIYLHPLYIDLYMRDIFEFLNLFDLKLLKNILFINIQILTFIYEIKYGYWVRNGP

SEQ ID NO: 3284045 - protein, 29 aa, Plasmodium falciparum
EKIDIKYILIFLYLLKYKNYQMNNFFIDS

SEQ ID NO: 3284046 - protein, 28 aa, Plasmodium falciparum
EKIDKTLTFIKEFYPPLLRGGKDSDPEN

SEQ ID NO: 3284047 - protein, 42 aa, Plasmodium falciparum
EKIEGRTTYYIWYENMFSFSLYFFLRPYIKKKHILIDIDNNF

SEQ ID NO: 3284048 - protein, 21 aa, Plasmodium falciparum
EKIIKHLFKKFPYPSNINSSN

SEQ ID NO: 3284049 - protein, 31 aa, Plasmodium falciparum
EKIISFDEFFYVWVRKLLIDSIKWENELNNC

SEQ ID NO: 3284050 - protein, 25 aa, Plasmodium falciparum
EKIKILFYIIYYILYINHFSCDKNQ

SEQ ID NO: 3284051 - protein, 40 aa, Plasmodium falciparum
EKIKKLFEYAFPFLIKYNEHFFFHFLKKKNILISPEEIIT

SEQ ID NO: 3284052 - protein, 36 aa, Plasmodium falciparum
EKIKYNFHNNFYFYQLIGLDILLDNNGKAWLLEVNS

SEQ ID NO: 3284053 - protein, 26 aa, Plasmodium falciparum
EKILLLYKYRIFLEPYLFISHKNNSN

SEQ ID NO: 3284054 - protein, 26 aa, Plasmodium falciparum
EKILQKCEWIINTYPFGLCPVSVKEN

SEQ ID NO: 3284055 - protein, 18 aa, Plasmodium falciparum
EKKDFLSTQYLSNKNRNI

SEQ ID NO: 3284056 - protein, 22 aa, Plasmodium falciparum
EKKDLLFLGFRQKSQDFYFKDE

SEQ ID NO: 3284057 - protein, 25 aa, Plasmodium falciparum
EKKHLIPLVYKCKMIESFDSFFLLL

SEQ ID NO: 3284058 - protein, 30 aa, Plasmodium falciparum
EKKIDQDKLFLFPLPYGNYTHYSNFVVNRK

SEQ ID NO: 3284059 - protein, 54 aa, Plasmodium falciparum
EKKILKISVLFLILTIFFLCLRIALIISRILYDIILFIYMKGFRLSIESKKKYL

SEQ ID NO: 3284060 - protein, 22 aa, Plasmodium falciparum
EKKKIEMMPKQKKLYTFFIKSA

SEQ ID NO: 3284061 - protein, 30 aa, Plasmodium falciparum
EKKKKNLLTKIWFQIHMMILEEYKKDECIH

SEQ ID NO: 3284062 - protein, 19 aa, Plasmodium falciparum
EKKKWCSLYISTMNGPMSN

SEQ ID NO: 3284063 - protein, 21 aa, Plasmodium falciparum
EKKLFVILQIPHNINSSSYYD

SEQ ID NO: 3284064 - protein, 23 aa, Plasmodium falciparum
EKKLIDLLKIVKPTKDIKLIKQN

SEQ ID NO: 3284065 - protein, 25 aa, Plasmodium falciparum
EKKNFFFFINFMYLQHKLCISPMFY

SEQ ID NO: 3284066 - protein, 23 aa, Plasmodium falciparum
EKKNFYFLLHFLMTNNNNGLIII

SEQ ID NO: 3284067 - protein, 22 aa, Plasmodium falciparum
EKKNLYLFIKNNLLLLNQDAVL

SEQ ID NO: 3284068 - protein, 23 aa, Plasmodium falciparum
EKKNQWFYFSASYVPNEYYTNEL

SEQ ID NO: 3284069 - protein, 17 aa, Plasmodium falciparum
EKKQIIYYYVHSLLRRS

SEQ ID NO: 3284070 - protein, 27 aa, Plasmodium falciparum
EKKSDSIFLRIYKYPTLGGDEYFITFQ

SEQ ID NO: 3284071 - protein, 26 aa, Plasmodium falciparum
EKKSFFKRALLLLKIFDNIFIQKTID

SEQ ID NO: 3284072 - protein, 24 aa, Plasmodium falciparum
EKKVNMGILLFSDKIREFIKYGQK

SEQ ID NO: 3284073 - protein, 25 aa, Plasmodium falciparum
EKKYIILKYLYYIMKSIFDYGIQQG

SEQ ID NO: 3284074 - protein, 22 aa, Plasmodium falciparum
EKKYLNILYTYIFQIITVHSFQ

SEQ ID NO: 3284075 - protein, 23 aa, Plasmodium falciparum
EKLKHMYDIIYINDIINNTVLEI

SEQ ID NO: 3284076 - protein, 24 aa, Plasmodium falciparum
EKLKMHNMLYGLRLLYKELINKYN

SEQ ID NO: 3284077 - protein, 22 aa, Plasmodium falciparum
EKLLNMIYYFIVLIISLCLKER

SEQ ID NO: 3284078 - protein, 19 aa, Plasmodium falciparum
EKLMSFSFLLCLDNILYDI

SEQ ID NO: 3284079 - protein, 22 aa, Plasmodium falciparum
EKLRTLVHFFFGKEYVKNKTYI

SEQ ID NO: 3284080 - protein, 28 aa, Plasmodium falciparum
EKLSFDHFSFFFINAIVCLSIYTKVIHK

SEQ ID NO: 3284081 - protein, 18 aa, Plasmodium falciparum
EKLSYSYAFAQSVKLSYF

SEQ ID NO: 3284082 - protein, 22 aa, Plasmodium falciparum
EKLVEEVVPVELLEEVIPEELI

SEQ ID NO: 3284083 - protein, 20 aa, Plasmodium falciparum
EKMKIKFWCLLFAYVISFVS

SEQ ID NO: 3284084 - protein, 40 aa, Plasmodium falciparum
EKMKKITNKAFLYCFIKLFVLIVLSLFTIYYIKKLVSNKR

SEQ ID NO: 3284085 - protein, 25 aa, Plasmodium falciparum
EKNALNRFFFYSYLNNIKNNNNLSS

SEQ ID NO: 3284086 - protein, 25 aa, Plasmodium falciparum
EKNDNFIYACLPFEFINKYEFLQCL

SEQ ID NO: 3284087 - protein, 22 aa, Plasmodium falciparum
EKNETYINFLKDQIKLLCNNID

SEQ ID NO: 3284088 - protein, 28 aa, Plasmodium falciparum
EKNIICHGLIFLKLLNCFYPYNNNYIRN

SEQ ID NO: 3284089 - protein, 28 aa, Plasmodium falciparum
EKNIKFYDTPIFPYITSLILDYENDNKK

SEQ ID NO: 3284090 - protein, 23 aa, Plasmodium falciparum
EKNKSLIILVNRMEDKYPIENNN

SEQ ID NO: 3284091 - protein, 26 aa, Plasmodium falciparum
EKNLEEYLLILFFANHFNFFQNMIKY

SEQ ID NO: 3284092 - protein, 27 aa, Plasmodium falciparum
EKNLKFFFLFLIYGFFTTSYISITVIP

SEQ ID NO: 3284093 - protein, 21 aa, Plasmodium falciparum
EKNLKKIFGIIYEGLTKANGK

SEQ ID NO: 3284094 - protein, 19 aa, Plasmodium falciparum
EKNLLLSLYLYMKKEIEDK

SEQ ID NO: 3284095 - protein, 28 aa, Plasmodium falciparum
EKNLSYFFKMFFTTLYIISFKKKGNENM

SEQ ID NO: 3284096 - protein, 25 aa, Plasmodium falciparum
EKNMCKLFFDIFKNYDIIDNNSIFS

SEQ ID NO: 3284097 - protein, 25 aa, Plasmodium falciparum
EKNVKYLNFIISSLLKRLDDSNLDI

SEQ ID NO: 3284098 - protein, 17 aa, Plasmodium falciparum
EKNYLLEKIGISNFNFL

SEQ ID NO: 3284099 - protein, 20 aa, Plasmodium falciparum
EKPCFKLKRDSPLSFQKCIE

SEQ ID NO: 3284100 - protein, 25 aa, Plasmodium falciparum
EKPKDIIKLLKDLIKYLHIVKFENN

SEQ ID NO: 3284101 - protein, 28 aa, Plasmodium falciparum
EKQLHFKFCLDIFFLKNMKLISLEASKP

SEQ ID NO: 3284102 - protein, 20 aa, Plasmodium falciparum
EKQNYFGLLGSYRKVRDTTN

SEQ ID NO: 3284103 - protein, 25 aa, Plasmodium falciparum
EKQSNWLVTFSFPDLLRGKTTQIYM

SEQ ID NO: 3284104 - protein, 25 aa, Plasmodium falciparum
EKRHLLKVIFLYGKLHSLQGLNTPF

SEQ ID NO: 3284105 - protein, 22 aa, Plasmodium falciparum
EKRKEMFIPHIYILMKYFEEAV

SEQ ID NO: 3284106 - protein, 22 aa, Plasmodium falciparum
EKRKRLFIITDMPGLGYAEGIG

SEQ ID NO: 3284107 - protein, 86 aa, Plasmodium falciparum
EKSFEDIYNKFILAFGYYLCILNPIRVPAFVFAWLELISHKLFLPEILKSSKGWYIYNKLLIYLLEFLYIFLKNNYLTDSIKILYR

SEQ ID NO: 3284108 - protein, 27 aa, Plasmodium falciparum
EKSFFIEHLLLYFLYNRINTIYELFYN

SEQ ID NO: 3284109 - protein, 25 aa, Plasmodium falciparum
EKSGPFLFLKLYKILSNILYTTCEN

SEQ ID NO: 3284110 - protein, 22 aa, Plasmodium falciparum
EKSIEFLFLEFLERYKNIYTFG

SEQ ID NO: 3284111 - protein, 35 aa, Plasmodium falciparum
EKSKNNPVFKFRLSKLFILKYIDLYTIVKNKEFTT

SEQ ID NO: 3284112 - protein, 23 aa, Plasmodium falciparum
EKSLFSNVLFFYKKSKRNIRRRS

SEQ ID NO: 3284113 - protein, 26 aa, Plasmodium falciparum
EKSNDFYIYKKIILSLKRVNEKFPFP

SEQ ID NO: 3284114 - protein, 17 aa, Plasmodium falciparum
EKSWNAYPYLKTVYESS

SEQ ID NO: 3284115 - protein, 34 aa, Plasmodium falciparum
EKTFKELIVTKYDYLLCVSLFSSYLINKEKSSKD

SEQ ID NO: 3284116 - protein, 35 aa, Plasmodium falciparum
EKTIPFGVALALGSIAFLFLKKKTQAPVDLFSVIN

SEQ ID NO: 3284117 - protein, 34 aa, Plasmodium falciparum
EKTIPFGVALALGSIAFLFLKKKTQTPVDLFSVI

SEQ ID NO: 3284118 - protein, 24 aa, Plasmodium falciparum
EKTKGDIYSLPFKIDKKNKNKNKK

SEQ ID NO: 3284119 - protein, 22 aa, Plasmodium falciparum
EKTKLILFQTIKSILISHIPIE

SEQ ID NO: 3284120 - protein, 29 aa, Plasmodium falciparum
EKTMNFLEIILFLYLRKYVPFVQKYNMTQ

SEQ ID NO: 3284121 - protein, 37 aa, Plasmodium falciparum
EKTQSILFLLICLLFMFFFLLFIYVIIRKKQNKKNVQ

SEQ ID NO: 3284122 - protein, 30 aa, Plasmodium falciparum
EKTTLVDFISRPPYFRYLEEWGQNFCKKRT

SEQ ID NO: 3284123 - protein, 27 aa, Plasmodium falciparum
EKVADFIFCLNLFYSISMMKDIISLKQ

SEQ ID NO: 3284124 - protein, 24 aa, Plasmodium falciparum
EKVKELLYELILLTNKLSIYRKKY

SEQ ID NO: 3284125 - protein, 28 aa, Plasmodium falciparum
EKWIFHHSIIYFHMFHFLFQYTDVNIEK

SEQ ID NO: 3284126 - protein, 31 aa, Plasmodium falciparum
EKYDNIALFVAFLCGLILGLVINYYKSMKKK

SEQ ID NO: 3284127 - protein, 30 aa, Plasmodium falciparum
EKYIEYIPNSRYIPVLPTRKSGFIMLNDIT

SEQ ID NO: 3284128 - protein, 29 aa, Plasmodium falciparum
EKYKCLCIIMFYIIYYNPFLDFINEHAFK

SEQ ID NO: 3284129 - protein, 17 aa, Plasmodium falciparum
EKYLFINNYLKEKFIKL

SEQ ID NO: 3284130 - protein, 25 aa, Plasmodium falciparum
EKYMLGIFFMWIWNEGHLWDCSDPS

SEQ ID NO: 3284131 - protein, 24 aa, Plasmodium falciparum
EKYNELILYSFFYNKNIKSTRDYK

SEQ ID NO: 3284132 - protein, 29 aa, Plasmodium falciparum
EKYVSNFLVNILLDILKKKNILSKQILIK

SEQ ID NO: 3284133 - protein, 20 aa, Plasmodium falciparum
EKYYIFPYNCGNTQIQLITG

SEQ ID NO: 3284134 - protein, 20 aa, Plasmodium falciparum
ELCFNLSYKLNVCPKYMVTS

SEQ ID NO: 3284135 - protein, 17 aa, Plasmodium falciparum
ELCLQLPVNYFLKDHFN

SEQ ID NO: 3284136 - protein, 27 aa, Plasmodium falciparum
ELDIIYLYAAFLPLESDLFHLNYLSQN

SEQ ID NO: 3284137 - protein, 19 aa, Plasmodium falciparum
ELDNILFWTDYKKKKKFFT

SEQ ID NO: 3284138 - protein, 24 aa, Plasmodium falciparum
ELEAFIFGCFLYSWNDILTNNIIY

SEQ ID NO: 3284139 - protein, 23 aa, Plasmodium falciparum
ELEAHYLYILYKNNIPITPINKN

SEQ ID NO: 3284140 - protein, 19 aa, Plasmodium falciparum
ELEIILNSFLHFGYNYYSK

SEQ ID NO: 3284141 - protein, 23 aa, Plasmodium falciparum
ELEKAVIHPYLKNSYKPLRVNSN

SEQ ID NO: 3284142 - protein, 30 aa, Plasmodium falciparum
ELELYLIKKLNFHFFNLTERILKCETALLI

SEQ ID NO: 3284143 - protein, 21 aa, Plasmodium falciparum
ELEQFCVLKFKRINLGFLYMH

SEQ ID NO: 3284144 - protein, 27 aa, Plasmodium falciparum
ELFIPQAHYTPYQQITPYGPSGQIVHY

SEQ ID NO: 3284145 - protein, 21 aa, Plasmodium falciparum
ELFYFHYMNEKLFWKDGSVLF

SEQ ID NO: 3284146 - protein, 24 aa, Plasmodium falciparum
ELGFLTPYAFLEQISKIFFKNFNN

SEQ ID NO: 3284147 - protein, 29 aa, Plasmodium falciparum
ELGLCKLMIYDHFLILYGTPYVCNVHMIG

SEQ ID NO: 3284148 - protein, 18 aa, Plasmodium falciparum
ELGLLNIKSLLYEDFKQE

SEQ ID NO: 3284149 - protein, 31 aa, Plasmodium falciparum
ELGSMLISYILLQFPFFYRKLKNTFMRARNI

SEQ ID NO: 3284150 - protein, 23 aa, Plasmodium falciparum
ELHEFSCDPLTIIKPIEESNRDY

SEQ ID NO: 3284151 - protein, 21 aa, Plasmodium falciparum
ELHFTWIAFWCATLSNFGSSI

SEQ ID NO: 3284152 - protein, 31 aa, Plasmodium falciparum
ELHILQTHYYFYYVFLTLLSGWVNEADWGTY

SEQ ID NO: 3284153 - protein, 19 aa, Plasmodium falciparum
ELHSTFYSKNVDKENYDDK

SEQ ID NO: 3284154 - protein, 18 aa, Plasmodium falciparum
ELIFLSFAKPCRNLYFYK

SEQ ID NO: 3284155 - protein, 23 aa, Plasmodium falciparum
ELIHFSLFVSLIIKKGVEELKNM

SEQ ID NO: 3284156 - protein, 21 aa, Plasmodium falciparum
ELINYIFIDMGLMNNPIMTEA

SEQ ID NO: 3284157 - protein, 26 aa, Plasmodium falciparum
ELKERKFMILLLKIKNGTPSIRRTAL

SEQ ID NO: 3284158 - protein, 34 aa, Plasmodium falciparum
ELKFYNIQYLFYPTQFFKALLIKYSFIYQKKIKD

SEQ ID NO: 3284159 - protein, 18 aa, Plasmodium falciparum
ELKIFLSKFYKYLNEYDD

SEQ ID NO: 3284160 - protein, 23 aa, Plasmodium falciparum
ELKIRPFPKFYFYKKEKSYYCSS

SEQ ID NO: 3284161 - protein, 26 aa, Plasmodium falciparum
ELKKYAMKLLYGDALIMITKIWKLSY

SEQ ID NO: 3284162 - protein, 17 aa, Plasmodium falciparum
ELKLLKRQARSLVIAEE

SEQ ID NO: 3284163 - protein, 25 aa, Plasmodium falciparum
ELKMYKSCLFLFNKTKIPANWVIND

SEQ ID NO: 3284164 - protein, 26 aa, Plasmodium falciparum
ELKNIMKINYYISCYPHHLNYFNWNL

SEQ ID NO: 3284165 - protein, 17 aa, Plasmodium falciparum
ELKYIFPDIPEGLYFHL

SEQ ID NO: 3284166 - protein, 29 aa, Plasmodium falciparum
ELLELFNNPLFLLSLKYVQNKKLAVNIMR

SEQ ID NO: 3284167 - protein, 35 aa, Plasmodium falciparum
ELLHNLLLEKNIYQLLLYTFYKYLYINWIEETYNY

SEQ ID NO: 3284168 - protein, 22 aa, Plasmodium falciparum
ELLKKNIVAIILLYTINDNTPN

SEQ ID NO: 3284169 - protein, 26 aa, Plasmodium falciparum
ELLNAFDFHVLEFIKKSIKNNEDYKS

SEQ ID NO: 3284170 - protein, 19 aa, Plasmodium falciparum
ELMVVWKYSISNLFHKKYI

SEQ ID NO: 3284171 - protein, 35 aa, Plasmodium falciparum
ELNDFVIIIYTIISHIPYFLFFKNKIKDPCKCQKD

SEQ ID NO: 3284172 - protein, 31 aa, Plasmodium falciparum
ELNEKDLLFYNYFALFLLDGSMFLKMTKFQM

SEQ ID NO: 3284173 - protein, 18 aa, Plasmodium falciparum
ELNLLFNKRNIYSNLYHL

SEQ ID NO: 3284174 - protein, 36 aa, Plasmodium falciparum
ELNMLEDFILIIINLYNIILYIYKNDLYKYYHNTLY

SEQ ID NO: 3284175 - protein, 21 aa, Plasmodium falciparum
ELNNILPIKKSLDNYVLPNII

SEQ ID NO: 3284176 - protein, 27 aa, Plasmodium falciparum
ELNNLFVLNIYFPVIKFAILFVKDHKD

SEQ ID NO: 3284177 - protein, 51 aa, Plasmodium falciparum
ELNRDNIMEEVLSKIPEPIIREAPKYVPKKPVPPQHIPRGDNVPRNIDVNG

SEQ ID NO: 3284178 - protein, 28 aa, Plasmodium falciparum
ELNSKYLFYVMLFFVLINEQSYLENIEL

SEQ ID NO: 3284179 - protein, 42 aa, Plasmodium falciparum
ELNTPIHIYYYFSWININWNFNFLDNILSLCCSIIFSMITQR

SEQ ID NO: 3284180 - protein, 26 aa, Plasmodium falciparum
ELNYFNYYVVLDLYILDVIIKNVDLL

SEQ ID NO: 3284181 - protein, 24 aa, Plasmodium falciparum
ELPLVLFDYAIIQICKICRILDFN

SEQ ID NO: 3284182 - protein, 17 aa, Plasmodium falciparum
ELPRMISEKSADGILDQ

SEQ ID NO: 3284183 - protein, 20 aa, Plasmodium falciparum
ELPRTFILSIYAYDKLTNKE

SEQ ID NO: 3284184 - protein, 21 aa, Plasmodium falciparum
ELQIRYVFYNLLVAGYKLDKI

SEQ ID NO: 3284185 - protein, 36 aa, Plasmodium falciparum
ELQRKNKKFFFLCGIYLIYILQFLNKNILYRFIDKI

SEQ ID NO: 3284186 - protein, 33 aa, Plasmodium falciparum
ELQSFRQKIYFLFPKIYFYIKLFICSNTDRYSE

SEQ ID NO: 3284187 - protein, 31 aa, Plasmodium falciparum
ELRESWWNTNKKYIWLAMKHGAGMNSTTCCG

SEQ ID NO: 3284188 - protein, 32 aa, Plasmodium falciparum
ELRKKNCLYYYRNALFYNGSSMIPCEENKHFT

SEQ ID NO: 3284189 - protein, 21 aa, Plasmodium falciparum
ELRRIISFFLIYSIVFSIVYE

SEQ ID NO: 3284190 - protein, 20 aa, Plasmodium falciparum
ELRYIWINIKSNEENKYFYM

SEQ ID NO: 3284191 - protein, 19 aa, Plasmodium falciparum
ELSPFSFFWGALLSQQILK

SEQ ID NO: 3284192 - protein, 23 aa, Plasmodium falciparum
ELTILIIIKIILNSSNLSIVICF

SEQ ID NO: 3284193 - protein, 17 aa, Plasmodium falciparum
ELTIRYAAEKVLFDEGV

SEQ ID NO: 3284194 - protein, 18 aa, Plasmodium falciparum
ELTKFKLLDLSYILDIIS

SEQ ID NO: 3284195 - protein, 23 aa, Plasmodium falciparum
ELVEFLYIVIYNDLYYLDISCNF

SEQ ID NO: 3284196 - protein, 25 aa, Plasmodium falciparum
ELVEKLIPEELVEEVIPELLVEEVV

SEQ ID NO: 3284197 - protein, 21 aa, Plasmodium falciparum
ELVEVVPVELLEEAIPEELVE

SEQ ID NO: 3284198 - protein, 20 aa, Plasmodium falciparum
ELVEVVPVELLEEVIPEELV

SEQ ID NO: 3284199 - protein, 18 aa, Plasmodium falciparum
ELVNNICMWMKSTYSNYV

SEQ ID NO: 3284200 - protein, 18 aa, Plasmodium falciparum
ELVYYYYCKYFSVNEFYT

SEQ ID NO: 3284201 - protein, 26 aa, Plasmodium falciparum
ELYGLKAYKYLMKNDLFYALFENEQI

SEQ ID NO: 3284202 - protein, 24 aa, Plasmodium falciparum
ELYKENLYNLYNQIFLIINNINNE

SEQ ID NO: 3284203 - protein, 35 aa, Plasmodium falciparum
ELYNNDLYRMYYYIKFLYLHNILRHTDLLLNFLIY

SEQ ID NO: 3284204 - protein, 25 aa, Plasmodium falciparum
ELYPKIHQIWIYLKINFYKNNYMND

SEQ ID NO: 3284205 - protein, 17 aa, Plasmodium falciparum
ELYSIYFYICTIMLSKG

SEQ ID NO: 3284206 - protein, 20 aa, Plasmodium falciparum
ELYVNIMKYITLVYTSHVDI

SEQ ID NO: 3284207 - protein, 25 aa, Plasmodium falciparum
ELYYNFYDLYKIFQIKNLSMLYDFI

SEQ ID NO: 3284208 - protein, 17 aa, Plasmodium falciparum
ELYYNNKKRRSMWDLLM

SEQ ID NO: 3284209 - protein, 23 aa, Plasmodium falciparum
EMDINDIYPYTSPKYKTLIEVVL

SEQ ID NO: 3284210 - protein, 25 aa, Plasmodium falciparum
EMDNLYAHVYYWKYLTELNIKCNNN

SEQ ID NO: 3284211 - protein, 27 aa, Plasmodium falciparum
EMDTQKIFFFYNIFSISIVPVHDDDMR

SEQ ID NO: 3284212 - protein, 17 aa, Plasmodium falciparum
EMELKEKEFIKQHLKDY

SEQ ID NO: 3284213 - protein, 19 aa, Plasmodium falciparum
EMFLSRKYKSLLLLQNKRN

SEQ ID NO: 3284214 - protein, 25 aa, Plasmodium falciparum
EMFQYKYFYNFLQSLKKKKKKRKKE

SEQ ID NO: 3284215 - protein, 19 aa, Plasmodium falciparum
EMIKDIRRIWIRNLYRDDR

SEQ ID NO: 3284216 - protein, 35 aa, Plasmodium falciparum
EMIPIDIVGNIRLYKLFYINMIKNNYSYYLKNNFF

SEQ ID NO: 3284217 - protein, 19 aa, Plasmodium falciparum
EMKKLLKVVLLKYKALKFG

SEQ ID NO: 3284218 - protein, 25 aa, Plasmodium falciparum
EMKQKNFLLYIYDLDIKKTKIYINV

SEQ ID NO: 3284219 - protein, 17 aa, Plasmodium falciparum
EMLDISVLPKKIFNYNI

SEQ ID NO: 3284220 - protein, 39 aa, Plasmodium falciparum
EMSRHFYMYDYPRYFKKWEIMKIWSPIWITLSKVDDQSC

SEQ ID NO: 3284221 - protein, 28 aa, Plasmodium falciparum
EMVGKLKDFGNLLLGKVGLSLDNFEVQK

SEQ ID NO: 3284222 - protein, 30 aa, Plasmodium falciparum
EMYILYEHFKLYYFLIGQNVLLYKKKRNEN

SEQ ID NO: 3284223 - protein, 32 aa, Plasmodium falciparum
EMYLEKYLFSIPFLFSSIFTFPHILKYSKRVD

SEQ ID NO: 3284224 - protein, 26 aa, Plasmodium falciparum
ENAISFFLHYIPLLLNKKKDFSSKRN

SEQ ID NO: 3284225 - protein, 25 aa, Plasmodium falciparum
ENCTIFYNILLKENYKFLISSRLEK

SEQ ID NO: 3284226 - protein, 24 aa, Plasmodium falciparum
ENDEFDFYLYDDILYYCIVKNDSI

SEQ ID NO: 3284227 - protein, 22 aa, Plasmodium falciparum
ENDEFFITYQNVLIKFIETLIT

SEQ ID NO: 3284228 - protein, 27 aa, Plasmodium falciparum
ENDHIFYPLSVLKIMKCFNYYYDYFSN

SEQ ID NO: 3284229 - protein, 26 aa, Plasmodium falciparum
ENDIRFIQIKFSTFEKFLYQCNIMKT

SEQ ID NO: 3284230 - protein, 22 aa, Plasmodium falciparum
ENDIVCVYYPNSSYNQCLCLSS

SEQ ID NO: 3284231 - protein, 19 aa, Plasmodium falciparum
ENDIYIFQIQVIKELLKNN

SEQ ID NO: 3284232 - protein, 29 aa, Plasmodium falciparum
ENDIYMSIFFLTYSFVFLKYTKMKDNKKD

SEQ ID NO: 3284233 - protein, 25 aa, Plasmodium falciparum
ENDKNFFFIIFHDLYNNINDKENKY

SEQ ID NO: 3284234 - protein, 23 aa, Plasmodium falciparum
ENDTFLPLLLQENRYYKSKLKRI

SEQ ID NO: 3284235 - protein, 18 aa, Plasmodium falciparum
ENDYISLNLKIFINNKKE

SEQ ID NO: 3284236 - protein, 18 aa, Plasmodium falciparum
ENEFVFFNRILFVNKIYS

SEQ ID NO: 3284237 - protein, 25 aa, Plasmodium falciparum
ENEKHYADLYSLKRKCYDDDDEKYR

SEQ ID NO: 3284238 - protein, 25 aa, Plasmodium falciparum
ENELKSYLLLVHHLINARNSPCRNY

SEQ ID NO: 3284239 - protein, 17 aa, Plasmodium falciparum
ENELLDMYIQKLEFNTL

SEQ ID NO: 3284240 - protein, 27 aa, Plasmodium falciparum
ENENNKLFFLQLLNSFNDYIMKLYNCI

SEQ ID NO: 3284241 - protein, 25 aa, Plasmodium falciparum
ENFDNFFYVLKKYINNYDYLKISAN

SEQ ID NO: 3284242 - protein, 24 aa, Plasmodium falciparum
ENFEQLFFLDLIEYSFLNYTSSNL

SEQ ID NO: 3284243 - protein, 21 aa, Plasmodium falciparum
ENFFFYKQFLMKYENMYKRHI

SEQ ID NO: 3284244 - protein, 25 aa, Plasmodium falciparum
ENFFILFCFVFVSIFFVSNVTIIKC

SEQ ID NO: 3284245 - protein, 29 aa, Plasmodium falciparum
ENFKYIIDLIFLHLNYNRCYYIYIPKRLL

SEQ ID NO: 3284246 - protein, 19 aa, Plasmodium falciparum
ENFLKYIYPLIVKLSNDDI

SEQ ID NO: 3284247 - protein, 18 aa, Plasmodium falciparum
ENFLPRAIPTSAEKIYSS

SEQ ID NO: 3284248 - protein, 18 aa, Plasmodium falciparum
ENFLVVRRLMNDEKGEGG

SEQ ID NO: 3284249 - protein, 25 aa, Plasmodium falciparum
ENFQAFRHFLLLVDGDLFETLFDNM

SEQ ID NO: 3284250 - protein, 33 aa, Plasmodium falciparum
ENFVCFIPSFQRGFKLSLYLNKLIIYDYNKINI

SEQ ID NO: 3284251 - protein, 22 aa, Plasmodium falciparum
ENFYRQLLLYEKMNYTLDGCTD

SEQ ID NO: 3284252 - protein, 39 aa, Plasmodium falciparum
ENGENQIIIIRALFKRWLEYFLEDYNKIRKKLKPCKKNG

SEQ ID NO: 3284253 - protein, 29 aa, Plasmodium falciparum
ENGKVKFFLIRFRLLNYIYDIPSNILNTE

SEQ ID NO: 3284254 - protein, 22 aa, Plasmodium falciparum
ENGPYIWKGMLCSLEKAWGKDT

SEQ ID NO: 3284255 - protein, 31 aa, Plasmodium falciparum
ENHPPSHYALLLYPKVIIYANLYANTNAQKN

SEQ ID NO: 3284256 - protein, 23 aa, Plasmodium falciparum
ENIELYLLSIFVFEKNKNICDIY

SEQ ID NO: 3284257 - protein, 25 aa, Plasmodium falciparum
ENIESLFILCLLYLNIHKYKESLKL

SEQ ID NO: 3284258 - protein, 41 aa, Plasmodium falciparum
ENIFNRIILFFHKFVFRKLPYIYFLNFWIYNKNDMIFQMND

SEQ ID NO: 3284259 - protein, 26 aa, Plasmodium falciparum
ENIFVNMFLFLFYNESFIIIEELLKE

SEQ ID NO: 3284260 - protein, 20 aa, Plasmodium falciparum
ENIIHVYPFIYLRIKHVKIT

SEQ ID NO: 3284261 - protein, 23 aa, Plasmodium falciparum
ENIISIPYFKIKKCLFLHDLIIC

SEQ ID NO: 3284262 - protein, 26 aa, Plasmodium falciparum
ENIKEYNFIFILWKHNNMNDLYERKQ

SEQ ID NO: 3284263 - protein, 25 aa, Plasmodium falciparum
ENIKQELHIIDRELKNILQKEENLQ

SEQ ID NO: 3284264 - protein, 24 aa, Plasmodium falciparum
ENIKSLLTYLFEKLNYLKYIINKE

SEQ ID NO: 3284265 - protein, 26 aa, Plasmodium falciparum
ENIKSMINAYLDKLDLETVRKIHSDI

SEQ ID NO: 3284266 - protein, 28 aa, Plasmodium falciparum
ENIKTLCDLFLKYKFDPSLKNNNNETYS

SEQ ID NO: 3284267 - protein, 24 aa, Plasmodium falciparum
ENINCIFVYLFNFMYESSNVIINN

SEQ ID NO: 3284268 - protein, 21 aa, Plasmodium falciparum
ENINSFASFPFLLSKNIIYFE

SEQ ID NO: 3284269 - protein, 80 aa, Plasmodium falciparum
ENITSTIHMKKIYKILFLLKEKIILFIFYIYKKIYKNAYINISYIKQFYTQIINIFINIPRYICSSYIFVKENEINYNMY

SEQ ID NO: 3284270 - protein, 23 aa, Plasmodium falciparum
ENIYIYIYLLLFEIIDIYKNNMK

SEQ ID NO: 3284271 - protein, 27 aa, Plasmodium falciparum
ENIYKELLLFLFLIYKDKMNTLVDRIL

SEQ ID NO: 3284272 - protein, 26 aa, Plasmodium falciparum
ENIYNIFILLYFIKPLFAFLTDSVYF

SEQ ID NO: 3284273 - protein, 22 aa, Plasmodium falciparum
ENKIFLKTYLNKYFNDRKIISH

SEQ ID NO: 3284274 - protein, 27 aa, Plasmodium falciparum
ENKNMKYFYLYCELLVILTQIIKILNN

SEQ ID NO: 3284275 - protein, 25 aa, Plasmodium falciparum
ENKRMNILHDILCNIILCIKNNYDN

SEQ ID NO: 3284276 - protein, 30 aa, Plasmodium falciparum
ENKSYLILCILFMKKKLFEEAFVIFSTNLV

SEQ ID NO: 3284277 - protein, 25 aa, Plasmodium falciparum
ENKYIKKMLFIKNDKYLLCISKRYI

SEQ ID NO: 3284278 - protein, 37 aa, Plasmodium falciparum
ENLKKKIFQVIAFLLFVVLIYLYLKLKKVNKNIKKDT

SEQ ID NO: 3284279 - protein, 20 aa, Plasmodium falciparum
ENLNRYIKEIRSKDVGIYFF

SEQ ID NO: 3284280 - protein, 34 aa, Plasmodium falciparum
ENLSYITLVFINNIFISFLKIIILDSIRDDLKQG

SEQ ID NO: 3284281 - protein, 21 aa, Plasmodium falciparum
ENNCIYYFLKHFYHSLLTIKE

SEQ ID NO: 3284282 - protein, 38 aa, Plasmodium falciparum
ENNCNVNLKYLSKYGFLYLIFLFFKIDKHTVQNVITFV

SEQ ID NO: 3284283 - protein, 24 aa, Plasmodium falciparum
ENNCSKWLLWIKRIKRDENLFFEN

SEQ ID NO: 3284284 - protein, 24 aa, Plasmodium falciparum
ENNEEDFYLLYNYMPIYNEMIKSN

SEQ ID NO: 3284285 - protein, 29 aa, Plasmodium falciparum
ENNFINIPYIFFFLLQSIMLNSNHTYVKP

SEQ ID NO: 3284286 - protein, 18 aa, Plasmodium falciparum
ENNKKYVWYVMLCGYKQG

SEQ ID NO: 3284287 - protein, 30 aa, Plasmodium falciparum
ENNKSFMIEILKIIWKKWIEKNVKYINESV

SEQ ID NO: 3284288 - protein, 36 aa, Plasmodium falciparum
ENNLDFLIKLISKSIIFLNMNIFKLALMNFNKFSGR

SEQ ID NO: 3284289 - protein, 37 aa, Plasmodium falciparum
ENNNYISTGFFLFLLLITFFVYLSAFTNIINQFYLSF

SEQ ID NO: 3284290 - protein, 28 aa, Plasmodium falciparum
ENNNYLLNFSYQLPLYKYKNIIDSNIEY

SEQ ID NO: 3284291 - protein, 17 aa, Plasmodium falciparum
ENNPDTIIYNKTNYYLI

SEQ ID NO: 3284292 - protein, 27 aa, Plasmodium falciparum
ENNRSFFLLYLYFELFTIWCSIKFISH

SEQ ID NO: 3284293 - protein, 32 aa, Plasmodium falciparum
ENNSCYYLCPYIFVYKFKGLCFLFVPVCNNFY

SEQ ID NO: 3284294 - protein, 32 aa, Plasmodium falciparum
ENNYKQNILIRALFKRWLEHFLEDYNKINDKI

SEQ ID NO: 3284295 - protein, 24 aa, Plasmodium falciparum
ENPDFSIIIFLLKHIQIKIQNHIK

SEQ ID NO: 3284296 - protein, 18 aa, Plasmodium falciparum
ENPILYIEKLFNAIKNKS

SEQ ID NO: 3284297 - protein, 26 aa, Plasmodium falciparum
ENPLIVQFKLLFLEGHIFKNCLIEMK

SEQ ID NO: 3284298 - protein, 22 aa, Plasmodium falciparum
ENQFFAKLLKSIYLKNKEEIVQ

SEQ ID NO: 3284299 - protein, 32 aa, Plasmodium falciparum
ENQIFTLTDFMYLIFRWLETYISFNDRDHCTF

SEQ ID NO: 3284300 - protein, 22 aa, Plasmodium falciparum
ENQYIYVYFFLLKKNTKEQFNI

SEQ ID NO: 3284301 - protein, 17 aa, Plasmodium falciparum
ENRITIIIAHRLSTIRY

SEQ ID NO: 3284302 - protein, 20 aa, Plasmodium falciparum
ENRKKWWEEISTHIWNAMIK

SEQ ID NO: 3284303 - protein, 33 aa, Plasmodium falciparum
ENRKRKLHKFPYLRDFIYYEKYFLKINKRSNKH

SEQ ID NO: 3284304 - protein, 30 aa, Plasmodium falciparum
ENSLYFIYEIYILLILSFRCIQNFEHVLHE

SEQ ID NO: 3284305 - protein, 25 aa, Plasmodium falciparum
ENTDYYILYMDILIHLLNKQDEKII

SEQ ID NO: 3284306 - protein, 25 aa, Plasmodium falciparum
ENTHSIHIINLLRTKAFSKLQELRK

SEQ ID NO: 3284307 - protein, 28 aa, Plasmodium falciparum
ENTLKRNFLKNIIWIDIFMGVLNACEEE

SEQ ID NO: 3284308 - protein, 29 aa, Plasmodium falciparum
ENTNDLYVFFLNILYDLSFIFNSNKNIQN

SEQ ID NO: 3284309 - protein, 25 aa, Plasmodium falciparum
ENVFSVICYFFFSNKKFPQINDDIN

SEQ ID NO: 3284310 - protein, 31 aa, Plasmodium falciparum
ENVKKNFFFFFYHTLIGGPTFFFFNKEKEKG

SEQ ID NO: 3284311 - protein, 24 aa, Plasmodium falciparum
ENVKLLLIGIGGPTIHKLRLLGGC

SEQ ID NO: 3284312 - protein, 26 aa, Plasmodium falciparum
ENYIKYLYIIYVMVILRKIYAKIKKE

SEQ ID NO: 3284313 - protein, 36 aa, Plasmodium falciparum
ENYKFCYNFSFDLLFYILFYCFKRLHIYCLPHHIKN

SEQ ID NO: 3284314 - protein, 33 aa, Plasmodium falciparum
ENYKIFNYFVLRWILIFFKNKNQFFLSQKKMSS

SEQ ID NO: 3284315 - protein, 23 aa, Plasmodium falciparum
ENYKNCMKLYKLSEFIIHNILNK

SEQ ID NO: 3284316 - protein, 27 aa, Plasmodium falciparum
ENYKYMNLFLLFIKLLSVFLNNVQKNV

SEQ ID NO: 3284317 - protein, 28 aa, Plasmodium falciparum
ENYLKEKILKIALLMNIFMAILDTSFNE

SEQ ID NO: 3284318 - protein, 19 aa, Plasmodium falciparum
ENYLLTCLTFFGTQCICLG

SEQ ID NO: 3284319 - protein, 25 aa, Plasmodium falciparum
ENYNELFFKNILISFDIIAVPYPNN

SEQ ID NO: 3284320 - protein, 26 aa, Plasmodium falciparum
ENYNQLFNLLYRAFQNKFYNIFKLHE

SEQ ID NO: 3284321 - protein, 28 aa, Plasmodium falciparum
ENYPNKRFFRILKFRCISYVIHILIFMN

SEQ ID NO: 3284322 - protein, 28 aa, Plasmodium falciparum
ENYYKWTQWIIIQLFLNNLSYKKRSYVN

SEQ ID NO: 3284323 - protein, 32 aa, Plasmodium falciparum
EPDEIQKTFNPFFYYWVVHMLKDSIHWRTKKL

SEQ ID NO: 3284324 - protein, 27 aa, Plasmodium falciparum
EPEQFYWFVEHFLSVKFRVPKHLKDKN

SEQ ID NO: 3284325 - protein, 29 aa, Plasmodium falciparum
EPHFKILEKLLFYDLYYNICTTLSISNSM

SEQ ID NO: 3284326 - protein, 31 aa, Plasmodium falciparum
EPLTSFAKLWWRLMFLFPSVISLIGILALVV

SEQ ID NO: 3284327 - protein, 26 aa, Plasmodium falciparum
EPNMNIPFFIRFLIGSSSGAIAALFI

SEQ ID NO: 3284328 - protein, 24 aa, Plasmodium falciparum
EPPHTPHYPFWFKSMFHSHDIPSV

SEQ ID NO: 3284329 - protein, 36 aa, Plasmodium falciparum
EPQINLWIKEWNENFLMEKKRLFLNIKDKCVENKKY

SEQ ID NO: 3284330 - protein, 31 aa, Plasmodium falciparum
EPTTLADFTRRPAYFRWLEEWGDGFCRERKK

SEQ ID NO: 3284331 - protein, 21 aa, Plasmodium falciparum
EPVPKLKLFDLDTYKNMSLDT

SEQ ID NO: 3284332 - protein, 19 aa, Plasmodium falciparum
EPYIYPLKKIKKFESFYNE

SEQ ID NO: 3284333 - protein, 25 aa, Plasmodium falciparum
EQAMLIIRHILIDYYFLKNDIDEEN

SEQ ID NO: 3284334 - protein, 33 aa, Plasmodium falciparum
EQDEYIFLLHFFFFLIFYFYSKPKKKHLKKIFF

SEQ ID NO: 3284335 - protein, 22 aa, Plasmodium falciparum
EQDILWMRFFSLIKEHNNEIIN

SEQ ID NO: 3284336 - protein, 17 aa, Plasmodium falciparum
EQDNLMMNVYINNTSYL

SEQ ID NO: 3284337 - protein, 23 aa, Plasmodium falciparum
EQFDILEKLILKGKVRHIAVSNE

SEQ ID NO: 3284338 - protein, 27 aa, Plasmodium falciparum
EQFDNDILFYLNICTKFYFSKDRNETC

SEQ ID NO: 3284339 - protein, 20 aa, Plasmodium falciparum
EQFHRIVIICFKPTVKHSHI

SEQ ID NO: 3284340 - protein, 35 aa, Plasmodium falciparum
EQFQKTFNDFFTYWVAHMLKDSIYWRTKKIKKCLE

SEQ ID NO: 3284341 - protein, 31 aa, Plasmodium falciparum
EQFQKTFNEFFYFWIGRFLNDSMYWRGKVNS

SEQ ID NO: 3284342 - protein, 32 aa, Plasmodium falciparum
EQFQKTFNEFFYFWIVRFLNDSMYWRGKIGGC

SEQ ID NO: 3284343 - protein, 25 aa, Plasmodium falciparum
EQFQTFITCIFIYSLIWSVGSNTYK

SEQ ID NO: 3284344 - protein, 23 aa, Plasmodium falciparum
EQIIIKHNFLKKCKDQILFNLKS

SEQ ID NO: 3284345 - protein, 24 aa, Plasmodium falciparum
EQISFLLFYQFVKIIMWKYLQYME

SEQ ID NO: 3284346 - protein, 27 aa, Plasmodium falciparum
EQKDKLFSLYPLYLNMLNLAFFNDNLM

SEQ ID NO: 3284347 - protein, 27 aa, Plasmodium falciparum
EQKKSKKFWIFLKKIQLDHLYIHPSII

SEQ ID NO: 3284348 - protein, 18 aa, Plasmodium falciparum
EQKKYFLKKLLFEDIEYK

SEQ ID NO: 3284349 - protein, 19 aa, Plasmodium falciparum
EQLKILEKYFAFASSNTKC

SEQ ID NO: 3284350 - protein, 28 aa, Plasmodium falciparum
EQLMFIIHLNIILLSYKIVKSIYNIFLS

SEQ ID NO: 3284351 - protein, 26 aa, Plasmodium falciparum
EQLNFYYYLKYFMIKINEINIHVNKN

SEQ ID NO: 3284352 - protein, 17 aa, Plasmodium falciparum
EQLTSLCRYLISRSLKS

SEQ ID NO: 3284353 - protein, 17 aa, Plasmodium falciparum
EQMDIGKVSFLYENNRE

SEQ ID NO: 3284354 - protein, 22 aa, Plasmodium falciparum
EQMFKLIIMSATMQSNLFYSYF

SEQ ID NO: 3284355 - protein, 29 aa, Plasmodium falciparum
EQMKYYISFFLNPFLYNKRNYIYINKQSL

SEQ ID NO: 3284356 - protein, 29 aa, Plasmodium falciparum
EQMQLLKQQREYLKLCYGDNWEKKIKELQ

SEQ ID NO: 3284357 - protein, 21 aa, Plasmodium falciparum
EQNLLFYIHINKLKDIICNKR

SEQ ID NO: 3284358 - protein, 29 aa, Plasmodium falciparum
EQNYDDFFPLFIIKILNKKKIKQIYIPQL

SEQ ID NO: 3284359 - protein, 18 aa, Plasmodium falciparum
EQQILKIRDLQVQLRHIQ

SEQ ID NO: 3284360 - protein, 28 aa, Plasmodium falciparum
EQRKTWWGDFAQYIWNGMICALTYTDSE

SEQ ID NO: 3284361 - protein, 26 aa, Plasmodium falciparum
EQTASYFVLFPLFVHSMDLLISTIGI

SEQ ID NO: 3284362 - protein, 23 aa, Plasmodium falciparum
EQTKLDEFLLPTNEGKSDDFVSE

SEQ ID NO: 3284363 - protein, 26 aa, Plasmodium falciparum
EQVNYHLFCFLDIMNYIYMKNKNKWT

SEQ ID NO: 3284364 - protein, 31 aa, Plasmodium falciparum
EQVYCRCLQFLKLIHALAINYFASLEKINEQ

SEQ ID NO: 3284365 - protein, 18 aa, Plasmodium falciparum
EQYKMDSDEYYYVRSCLE

SEQ ID NO: 3284366 - protein, 25 aa, Plasmodium falciparum
ERAIYIYEYLIYLLKDNKNFYMIND

SEQ ID NO: 3284367 - protein, 25 aa, Plasmodium falciparum
ERALVLFRYIPIPGDSRFKRIKNFL

SEQ ID NO: 3284368 - protein, 25 aa, Plasmodium falciparum
ERCPKYYLLFPFHLQIEGSSINEKS

SEQ ID NO: 3284369 - protein, 25 aa, Plasmodium falciparum
ERDVLFIHMYKLWKNEKLLKKRMDK

SEQ ID NO: 3284370 - protein, 26 aa, Plasmodium falciparum
EREKFNIMRPSDCNTLFLSTRKRERP

SEQ ID NO: 3284371 - protein, 18 aa, Plasmodium falciparum
ERGIGNDFAFIRRYYKSR

SEQ ID NO: 3284372 - protein, 30 aa, Plasmodium falciparum
ERHKLYLKKAINHLLFIQKNIHNLTFDIIS

SEQ ID NO: 3284373 - protein, 22 aa, Plasmodium falciparum
ERIEHLFNELLFICFKFINYPL

SEQ ID NO: 3284374 - protein, 23 aa, Plasmodium falciparum
ERIFFLIIFSGIVYFFLDFMTVY

SEQ ID NO: 3284375 - protein, 27 aa, Plasmodium falciparum
ERIMNINILFILHLFIMIVYCSEIVDY

SEQ ID NO: 3284376 - protein, 32 aa, Plasmodium falciparum
ERIQKKITFLLYLPLLILICSLLCTFVITLFY

SEQ ID NO: 3284377 - protein, 28 aa, Plasmodium falciparum
ERISYMLTLFLFPIIFHSINMINDKQII

SEQ ID NO: 3284378 - protein, 31 aa, Plasmodium falciparum
ERKIFQIKLIYLHKHFSLLYLLAESGLYIKE

SEQ ID NO: 3284379 - protein, 45 aa, Plasmodium falciparum
ERKKYYFDVHCVDKYMLGIFYIWIWNLNYIWKRADPPNDRTFNNF

SEQ ID NO: 3284380 - protein, 27 aa, Plasmodium falciparum
ERKNKVLSYFFILKKLKIHKLMDNEVI

SEQ ID NO: 3284381 - protein, 17 aa, Plasmodium falciparum
ERKNTIYDIYEKTLKKL

SEQ ID NO: 3284382 - protein, 29 aa, Plasmodium falciparum
ERKRYYDTPFKYLFLKISKVRRFYGSAKK

SEQ ID NO: 3284383 - protein, 23 aa, Plasmodium falciparum
ERKSLCCSISDFCLKYFDHNSNK

SEQ ID NO: 3284384 - protein, 33 aa, Plasmodium falciparum
ERNHFSFFYPKSKICLPLYCTWYYKNIEKLYSN

SEQ ID NO: 3284385 - protein, 22 aa, Plasmodium falciparum
ERQLSFCNFLSYPIILPNSIVN

SEQ ID NO: 3284386 - protein, 20 aa, Plasmodium falciparum
ERRKWYFDVLTAEKYMLGIF

SEQ ID NO: 3284387 - protein, 23 aa, Plasmodium falciparum
ERSKIILLIFYFIEDNITEHIPS

SEQ ID NO: 3284388 - protein, 42 aa, Plasmodium falciparum
ERTIKNIIILKIFIIIFSFIILFYFTCELNVLLFPIESILKK

SEQ ID NO: 3284389 - protein, 22 aa, Plasmodium falciparum
ERYASFFNYMDVIFTTQNMIDD

SEQ ID NO: 3284390 - protein, 28 aa, Plasmodium falciparum
ERYNKNPFLPLLSKADAKVFLILNIEYI

SEQ ID NO: 3284391 - protein, 25 aa, Plasmodium falciparum
ESAAVETFFLWHRYKEEKKKPQEGG

SEQ ID NO: 3284392 - protein, 26 aa, Plasmodium falciparum
ESASVETFFAWHKYKMEKKQPAQEGA

SEQ ID NO: 3284393 - protein, 35 aa, Plasmodium falciparum
ESDEHILIKELIKRWLEYFFQDYNRIQKKLKPCMN

SEQ ID NO: 3284394 - protein, 22 aa, Plasmodium falciparum
ESDIEIILPSEKKTRNISLEKQ

SEQ ID NO: 3284395 - protein, 31 aa, Plasmodium falciparum
ESDTFFYISLLFVIILTFLAATYLSQSDLQS

SEQ ID NO: 3284396 - protein, 26 aa, Plasmodium falciparum
ESEKQLLPLFFLYSKELITDVIILEL

SEQ ID NO: 3284397 - protein, 23 aa, Plasmodium falciparum
ESFDILIFLKNSKNIFFSLCIYL

SEQ ID NO: 3284398 - protein, 26 aa, Plasmodium falciparum
ESFLACIWFCFQIVNSALILTFGGKY

SEQ ID NO: 3284399 - protein, 20 aa, Plasmodium falciparum
ESFLLYQYLLDRSSFYNNLS

SEQ ID NO: 3284400 - protein, 26 aa, Plasmodium falciparum
ESFLRKYWFCLKNLHLFHKTYNNHVL

SEQ ID NO: 3284401 - protein, 34 aa, Plasmodium falciparum
ESFQPFITNYYEYFKNIFFEYLLKIKTTTEKIKY

SEQ ID NO: 3284402 - protein, 47 aa, Plasmodium falciparum
ESIDFRRFFSNLFFLLHNFIEQYYFKTILKFLLGYPFVVEFIKNNEH

SEQ ID NO: 3284403 - protein, 29 aa, Plasmodium falciparum
ESIKKMCRHFLNVMLPGLKIEKIHFYDWN

SEQ ID NO: 3284404 - protein, 30 aa, Plasmodium falciparum
ESIMDRIPKSFNKLFGYFSGSQEEEQKEND

SEQ ID NO: 3284405 - protein, 23 aa, Plasmodium falciparum
ESIYLLLLNIIKGNLTNLSLLFS

SEQ ID NO: 3284406 - protein, 26 aa, Plasmodium falciparum
ESKEKIFLLLYIISGKYNGLIQSSLS

SEQ ID NO: 3284407 - protein, 23 aa, Plasmodium falciparum
ESKILYPPIYTLNAKKSYEESNS

SEQ ID NO: 3284408 - protein, 17 aa, Plasmodium falciparum
ESKLIFVTGFLLTTLSA

SEQ ID NO: 3284409 - protein, 25 aa, Plasmodium falciparum
ESKPYWVYGLFFVLLILEFLNLKCH

SEQ ID NO: 3284410 - protein, 24 aa, Plasmodium falciparum
ESKRNSMFCFRPAKDISFQNYTYL

SEQ ID NO: 3284411 - protein, 19 aa, Plasmodium falciparum
ESKYTPYFDDYTSNHCLNK

SEQ ID NO: 3284412 - protein, 23 aa, Plasmodium falciparum
ESLIYIEQLYFYNFQHLKKPNNT

SEQ ID NO: 3284413 - protein, 25 aa, Plasmodium falciparum
ESLKKLYVDYFWPEMSNYILNMSHY

SEQ ID NO: 3284414 - protein, 18 aa, Plasmodium falciparum
ESLKSLLVVIKKFFIMIN

SEQ ID NO: 3284415 - protein, 25 aa, Plasmodium falciparum
ESLRLFLYFGIVTFLSLDLLINPLQ

SEQ ID NO: 3284416 - protein, 21 aa, Plasmodium falciparum
ESLTFWNNILIPDCIKKYNIN

SEQ ID NO: 3284417 - protein, 22 aa, Plasmodium falciparum
ESMKPLLDYSFLGYIKHAIQME

SEQ ID NO: 3284418 - protein, 24 aa, Plasmodium falciparum
ESNDDILIAKLLIKKSESIILSNE

SEQ ID NO: 3284419 - protein, 26 aa, Plasmodium falciparum
ESNKFMNLFFNIIFLDNIIHEENKNM

SEQ ID NO: 3284420 - protein, 22 aa, Plasmodium falciparum
ESNLLDILFLFNEEIVKESKKE

SEQ ID NO: 3284421 - protein, 17 aa, Plasmodium falciparum
ESNTTIELSRLEEVLLN

SEQ ID NO: 3284422 - protein, 40 aa, Plasmodium falciparum
ESPDFLFLEIYSKTISLCFDFIYFYTIQTYDVISLYCVYI

SEQ ID NO: 3284423 - protein, 20 aa, Plasmodium falciparum
ESQYAIRKKALFLFSEQELV

SEQ ID NO: 3284424 - protein, 26 aa, Plasmodium falciparum
ESREHYCTPCFSACSLYKIWVANQKK

SEQ ID NO: 3284425 - protein, 21 aa, Plasmodium falciparum
ESSILLEYYNIFKASTCLQLS

SEQ ID NO: 3284426 - protein, 24 aa, Plasmodium falciparum
ESSIWNLIFCNKNIEQFFKMKKNN

SEQ ID NO: 3284427 - protein, 29 aa, Plasmodium falciparum
ESSKYFYIGLDFSLYLLMLARKKMNTDLL

SEQ ID NO: 3284428 - protein, 43 aa, Plasmodium falciparum
ESSLFSVQNYGWMLLKLLHIIIIKFRSLTPLKTIMREIDEKNR

SEQ ID NO: 3284429 - protein, 24 aa, Plasmodium falciparum
ESSNYILYNFYLYKTLNKDYVCLL

SEQ ID NO: 3284430 - protein, 32 aa, Plasmodium falciparum
ESTHFNYACQWFLFSFIFSTISIFKFVQFKRW

SEQ ID NO: 3284431 - protein, 21 aa, Plasmodium falciparum
ESTHQFLRWLTEWGTQYCKEK

SEQ ID NO: 3284432 - protein, 44 aa, Plasmodium falciparum
ESTISSCFFWLNDVKIIIIGIIILALAILFTFSGIMYILEAPDI

SEQ ID NO: 3284433 - protein, 29 aa, Plasmodium falciparum
ESVENLLLILVLFNKYYPYFENNFYSNLC

SEQ ID NO: 3284434 - protein, 28 aa, Plasmodium falciparum
ESWKNPWYIFYIFVSIFLSFFTLIYLNH

SEQ ID NO: 3284435 - protein, 27 aa, Plasmodium falciparum
ESYERSVLYILQLNDCLFKKGILKDTE

SEQ ID NO: 3284436 - protein, 36 aa, Plasmodium falciparum
ESYFDYLIYVSFSNLFIFISSLYKLYIEYIIKKKFH

SEQ ID NO: 3284437 - protein, 19 aa, Plasmodium falciparum
ESYFPNMDSLIKSLNFVKW

SEQ ID NO: 3284438 - protein, 19 aa, Plasmodium falciparum
ESYHIYSIYDIYIYTHIKL

SEQ ID NO: 3284439 - protein, 24 aa, Plasmodium falciparum
ESYNLHYIIHFLFPYFESKNKNNI

SEQ ID NO: 3284440 - protein, 34 aa, Plasmodium falciparum
ESYRKILYEFPILYLFFPNKLLCKISKKSNLYHL

SEQ ID NO: 3284441 - protein, 28 aa, Plasmodium falciparum
ETANNLYILKKIYFADMYQISVADFFNN

SEQ ID NO: 3284442 - protein, 18 aa, Plasmodium falciparum
ETELALLLRDLLQPYVDG

SEQ ID NO: 3284443 - protein, 21 aa, Plasmodium falciparum
ETFCRQRTRMLAKIRGECVKS

SEQ ID NO: 3284444 - protein, 30 aa, Plasmodium falciparum
ETFKKNEIILLFLFLDLYELIIVEETTLFD

SEQ ID NO: 3284445 - protein, 25 aa, Plasmodium falciparum
ETFTHLPHFIYQYQKTLHLLNLLSN

SEQ ID NO: 3284446 - protein, 20 aa, Plasmodium falciparum
ETHIFLNQLLNKTKKKKYPF

SEQ ID NO: 3284447 - protein, 20 aa, Plasmodium falciparum
ETIFYIWIDSIYEKTKKLCS

SEQ ID NO: 3284448 - protein, 28 aa, Plasmodium falciparum
ETKFDICADFFLSINIDLLWEEFNKTMQ

SEQ ID NO: 3284449 - protein, 25 aa, Plasmodium falciparum
ETKGTFYRSKYCQPCPICGMKKKGG

SEQ ID NO: 3284450 - protein, 25 aa, Plasmodium falciparum
ETKKGGLLMGIMKRKRFMSRDPKKK

SEQ ID NO: 3284451 - protein, 26 aa, Plasmodium falciparum
ETKNLKYFFIYNIYEIHRDIFINYFY

SEQ ID NO: 3284452 - protein, 25 aa, Plasmodium falciparum
ETLMNYLDIDLFLAFSIFTMLSENH

SEQ ID NO: 3284453 - protein, 17 aa, Plasmodium falciparum
ETLNLILYILHNENLLL

SEQ ID NO: 3284454 - protein, 17 aa, Plasmodium falciparum
ETLNYFKSYFPNKIYKN

SEQ ID NO: 3284455 - protein, 23 aa, Plasmodium falciparum
ETLVCTKCDKWGEWSECKDGRMH

SEQ ID NO: 3284456 - protein, 18 aa, Plasmodium falciparum
ETMKNIWMERLTYKMRKY

SEQ ID NO: 3284457 - protein, 25 aa, Plasmodium falciparum
ETNEDIHNLFFYNLSLDDYKKEIKN

SEQ ID NO: 3284458 - protein, 24 aa, Plasmodium falciparum
ETNEYLYALNGPATLKGLCEYMAS

SEQ ID NO: 3284459 - protein, 38 aa, Plasmodium falciparum
ETNKNLLISVILLVKKSIHPWIRLNRVIRDIPNPSIIA

SEQ ID NO: 3284460 - protein, 44 aa, Plasmodium falciparum
ETNPLKWHQVVRNKYRKLHFGWKLFVNISPPAALAIIGTAVAIT

SEQ ID NO: 3284461 - protein, 43 aa, Plasmodium falciparum
ETNQIVNILWNQFNKWSLDFLIKNRLIFNVSTIVFFSSTFLFT

SEQ ID NO: 3284462 - protein, 29 aa, Plasmodium falciparum
ETNYSFLSLKFFPFILTSLLHTGINQIPR

SEQ ID NO: 3284463 - protein, 27 aa, Plasmodium falciparum
ETQTINKYFIGIIKLKHRNGKNVKYTC

SEQ ID NO: 3284464 - protein, 26 aa, Plasmodium falciparum
ETSDFYFMCHFFISIFQMFSLFYDLG

SEQ ID NO: 3284465 - protein, 41 aa, Plasmodium falciparum
ETSNNIFYNLSFTKLTLGRLLYLLFLKMNNLMIKKKLYFEQ

SEQ ID NO: 3284466 - protein, 33 aa, Plasmodium falciparum
ETVCINIKLIIFLFLFIKKKYMTIFLNSIQMVA

SEQ ID NO: 3284467 - protein, 21 aa, Plasmodium falciparum
ETVLIYVPSLLSLMFIHSIGK

SEQ ID NO: 3284468 - protein, 22 aa, Plasmodium falciparum
ETVNLFYIFLKENNKKYETSEE

SEQ ID NO: 3284469 - protein, 17 aa, Plasmodium falciparum
ETWWDLNKYHVWESMLC

SEQ ID NO: 3284470 - protein, 25 aa, Plasmodium falciparum
ETWWEEYGPHIWDGMICALSYNTKD

SEQ ID NO: 3284471 - protein, 21 aa, Plasmodium falciparum
ETYMPIILSMYLNNLLTMYNA

SEQ ID NO: 3284472 - protein, 24 aa, Plasmodium falciparum
EVDELFLHFWNINNMKNIFKYISY

SEQ ID NO: 3284473 - protein, 30 aa, Plasmodium falciparum
EVDFKNSLYLLVIIKLHKFINNLFEITKVR

SEQ ID NO: 3284474 - protein, 26 aa, Plasmodium falciparum
EVECAICMKLLIVPVTIPCGHNFCRD

SEQ ID NO: 3284475 - protein, 27 aa, Plasmodium falciparum
EVEKDLYFCGFLTFICPIKVTTPNYIL

SEQ ID NO: 3284476 - protein, 20 aa, Plasmodium falciparum
EVELALLLRDRLETYLEGDE

SEQ ID NO: 3284477 - protein, 23 aa, Plasmodium falciparum
EVELFFLLTCVLYYMERDMNLKV

SEQ ID NO: 3284478 - protein, 22 aa, Plasmodium falciparum
EVEVFSIWGSNSVLDHIDVLRD

SEQ ID NO: 3284479 - protein, 26 aa, Plasmodium falciparum
EVFEQVFNLYKCTLDWEWKNGKNTCK

SEQ ID NO: 3284480 - protein, 19 aa, Plasmodium falciparum
EVFINESDFFCNCNNMNVL

SEQ ID NO: 3284481 - protein, 25 aa, Plasmodium falciparum
EVFISLFPLPYLKLTALQLCHLSIL

SEQ ID NO: 3284482 - protein, 17 aa, Plasmodium falciparum
EVFKKIYEGFLDKGARE

SEQ ID NO: 3284483 - protein, 18 aa, Plasmodium falciparum
EVFPVFQGMFKIINNLFD

SEQ ID NO: 3284484 - protein, 28 aa, Plasmodium falciparum
EVHFKSFLKCVFISLWKYFIQMEMIDFY

SEQ ID NO: 3284485 - protein, 31 aa, Plasmodium falciparum
EVIKIVLFNKYVIKKILKILSLLHRMNSQVR

SEQ ID NO: 3284486 - protein, 23 aa, Plasmodium falciparum
EVIPELLVEEVVLEELIEEVIPE

SEQ ID NO: 3284487 - protein, 25 aa, Plasmodium falciparum
EVIWNYYLLKILYFLYHIHLKRIKK

SEQ ID NO: 3284488 - protein, 22 aa, Plasmodium falciparum
EVKELIYLFGFSDLHIVKSKIN

SEQ ID NO: 3284489 - protein, 21 aa, Plasmodium falciparum
EVKFLSFRIILQMVVNSRSIK

SEQ ID NO: 3284490 - protein, 24 aa, Plasmodium falciparum
EVKGVKGKLKKDVKAKHLKGSKVK

SEQ ID NO: 3284491 - protein, 23 aa, Plasmodium falciparum
EVKNIIRIYKKQKMFLKNMKQKS

SEQ ID NO: 3284492 - protein, 27 aa, Plasmodium falciparum
EVKYIDMLLILLFYCKNYVIQKNIYEF

SEQ ID NO: 3284493 - protein, 20 aa, Plasmodium falciparum
EVKYLRVPLPIWTEKEMSIS

SEQ ID NO: 3284494 - protein, 20 aa, Plasmodium falciparum
EVLAFLFFNLIGISQSIIPT

SEQ ID NO: 3284495 - protein, 17 aa, Plasmodium falciparum
EVLFEEEIPEELVEVVP

SEQ ID NO: 3284496 - protein, 32 aa, Plasmodium falciparum
EVLLTLLNLHHALYIFLSHILRFYNKMFHITK

SEQ ID NO: 3284497 - protein, 27 aa, Plasmodium falciparum
EVLNKFIFVFFLFYLTSIFLFIYVKKK

SEQ ID NO: 3284498 - protein, 22 aa, Plasmodium falciparum
EVLPEVFVEEIVPKELVEEVIP

SEQ ID NO: 3284499 - protein, 25 aa, Plasmodium falciparum
EVLQKYLCLVKPFSKLYIVLNFFFY

SEQ ID NO: 3284500 - protein, 29 aa, Plasmodium falciparum
EVLSMLSRIYIYIINYALKRGNGLSYDVI

SEQ ID NO: 3284501 - protein, 18 aa, Plasmodium falciparum
EVLVEEVIPEKLVKVVPE

SEQ ID NO: 3284502 - protein, 26 aa, Plasmodium falciparum
EVMKYYLFIFSYFNKHFFDIFISNFY

SEQ ID NO: 3284503 - protein, 30 aa, Plasmodium falciparum
EVNDAFFMDPLIFFMMLFTSEELFDYIGTL

SEQ ID NO: 3284504 - protein, 23 aa, Plasmodium falciparum
EVNISFCIYQLIILCNIMEIFEK

SEQ ID NO: 3284505 - protein, 24 aa, Plasmodium falciparum
EVNKKFFLHIYIIYEDMKLLVSTL

SEQ ID NO: 3284506 - protein, 26 aa, Plasmodium falciparum
EVNRAPWFYHLINVLGLTKDNFMEIK

SEQ ID NO: 3284507 - protein, 17 aa, Plasmodium falciparum
EVQVILPTNLNLAPDIS

SEQ ID NO: 3284508 - protein, 21 aa, Plasmodium falciparum
EVSVIMLYKKPLDLNKQTILY

SEQ ID NO: 3284509 - protein, 24 aa, Plasmodium falciparum
EVTEVLIKSLYLKETIQKFFTSNF

SEQ ID NO: 3284510 - protein, 43 aa, Plasmodium falciparum
EVTMGSLLCSFLWLTYGFTLKDGFIIIPNLCGFILSLLQVLLI

SEQ ID NO: 3284511 - protein, 18 aa, Plasmodium falciparum
EVYKLDLVLLINRKRKYE

SEQ ID NO: 3284512 - protein, 26 aa, Plasmodium falciparum
EVYKNPKLMYPLFNDFVSKLNESPYC

SEQ ID NO: 3284513 - protein, 27 aa, Plasmodium falciparum
EVYNHGLVVLGWRSPIPVRRDVISCSV

SEQ ID NO: 3284514 - protein, 25 aa, Plasmodium falciparum
EWHISPYCIYVFPKENKYFSVSTST

SEQ ID NO: 3284515 - protein, 17 aa, Plasmodium falciparum
EWKCDKFCGVQICGLKK

SEQ ID NO: 3284516 - protein, 17 aa, Plasmodium falciparum
EWKILLIRIINNTYKDV

SEQ ID NO: 3284517 - protein, 24 aa, Plasmodium falciparum
EWVFFIFVRLVHAFSCLLYGLAAY

SEQ ID NO: 3284518 - protein, 25 aa, Plasmodium falciparum
EYARDIFQGLFYNTPLSIKQFLNDK

SEQ ID NO: 3284519 - protein, 19 aa, Plasmodium falciparum
EYCIIIFLEFIEFLKKIIQ

SEQ ID NO: 3284520 - protein, 18 aa, Plasmodium falciparum
EYCQACPWCGMTCTFDGK

SEQ ID NO: 3284521 - protein, 36 aa, Plasmodium falciparum
EYDETNKMIIIDPLIFFNLIFTSDMMYEYTGNTQVS

SEQ ID NO: 3284522 - protein, 18 aa, Plasmodium falciparum
EYDKLKVYPFDKEQIIPP

SEQ ID NO: 3284523 - protein, 28 aa, Plasmodium falciparum
EYDLKKEYIYFLYDPELVGIRYILEILK

SEQ ID NO: 3284524 - protein, 26 aa, Plasmodium falciparum
EYDYGNLFYDCYYTEGLIDQGEENEE

SEQ ID NO: 3284525 - protein, 17 aa, Plasmodium falciparum
EYEEIILIIEKKNNELE

SEQ ID NO: 3284526 - protein, 23 aa, Plasmodium falciparum
EYEKYRPDIFDIYSLIKKDITYI

SEQ ID NO: 3284527 - protein, 23 aa, Plasmodium falciparum
EYELPNFDILEYDLPHFDPSEFK

SEQ ID NO: 3284528 - protein, 28 aa, Plasmodium falciparum
EYESLKLLELFSLQYPMFLKIQNKPQRC

SEQ ID NO: 3284529 - protein, 24 aa, Plasmodium falciparum
EYEYKYLKLIFNLYCFEHFSNVYD

SEQ ID NO: 3284530 - protein, 25 aa, Plasmodium falciparum
EYFHKFLTYCNNIFLDKIKHIRKKQ

SEQ ID NO: 3284531 - protein, 44 aa, Plasmodium falciparum
EYFKIELSINFSITFIFINILLVFFSTFLYRNIKKVNDPDSYKT

SEQ ID NO: 3284532 - protein, 22 aa, Plasmodium falciparum
EYFLDEYFFFTHKELLAKDIFL

SEQ ID NO: 3284533 - protein, 34 aa, Plasmodium falciparum
EYFLSNQLNTFINFLLLLWGINISFDHINHEEFL

SEQ ID NO: 3284534 - protein, 23 aa, Plasmodium falciparum
EYFPYYLLKLCIKVTFENVYNLK

SEQ ID NO: 3284535 - protein, 22 aa, Plasmodium falciparum
EYGDKFIGLLEIKNQRFRFLKI

SEQ ID NO: 3284536 - protein, 32 aa, Plasmodium falciparum
EYGIKIDIWSLGVLIFFIITGKVPFTGKNANE

SEQ ID NO: 3284537 - protein, 25 aa, Plasmodium falciparum
EYIIKYYTTFKYLQTLNKSLYDSIY

SEQ ID NO: 3284538 - protein, 27 aa, Plasmodium falciparum
EYIKEPYILFISFFKYNIYELFENTIN

SEQ ID NO: 3284539 - protein, 19 aa, Plasmodium falciparum
EYIPKLKKFIQIGNGYKSI

SEQ ID NO: 3284540 - protein, 29 aa, Plasmodium falciparum
EYIQELIHLLFVIFQLKKLALNKSTISNS

SEQ ID NO: 3284541 - protein, 19 aa, Plasmodium falciparum
EYISPLDILNISNLINYIG

SEQ ID NO: 3284542 - protein, 18 aa, Plasmodium falciparum
EYISTVCYFLGKKNIYFW

SEQ ID NO: 3284543 - protein, 23 aa, Plasmodium falciparum
EYKEFYFYVNLLRYNNKNKFNHF

SEQ ID NO: 3284544 - protein, 26 aa, Plasmodium falciparum
EYKELLNEYKFSLNLLNDTKNKLDTL

SEQ ID NO: 3284545 - protein, 17 aa, Plasmodium falciparum
EYKHLVPIYLDLKKELK

SEQ ID NO: 3284546 - protein, 22 aa, Plasmodium falciparum
EYKIIVKLYPQYFFTYQEYIIK

SEQ ID NO: 3284547 - protein, 26 aa, Plasmodium falciparum
EYKIYYILNCIYMLIKLIKQKDFPTT

SEQ ID NO: 3284548 - protein, 25 aa, Plasmodium falciparum
EYKKHYIFCIFSYEKALFFKEDISI

SEQ ID NO: 3284549 - protein, 27 aa, Plasmodium falciparum
EYKLSRYFFRALIYEGLHFPAKGYNAF

SEQ ID NO: 3284550 - protein, 35 aa, Plasmodium falciparum
EYKSPFFNYSLFNTYYQFYIYYKTIFMKCNNENVI

SEQ ID NO: 3284551 - protein, 26 aa, Plasmodium falciparum
EYKYDFNYILKNRDKIKKWLNCICKN

SEQ ID NO: 3284552 - protein, 20 aa, Plasmodium falciparum
EYLDFYLSTFGYKFHTFILE

SEQ ID NO: 3284553 - protein, 25 aa, Plasmodium falciparum
EYLDKNTYIFLVASKLLGIDAETFL

SEQ ID NO: 3284554 - protein, 24 aa, Plasmodium falciparum
EYLDTFLCYEKWVPGMNFFSLNMI

SEQ ID NO: 3284555 - protein, 24 aa, Plasmodium falciparum
EYLIDILNFLKILCNNYPRLVNKY

SEQ ID NO: 3284556 - protein, 24 aa, Plasmodium falciparum
EYLKFTPSYLYFENILLCSSEKYL

SEQ ID NO: 3284557 - protein, 18 aa, Plasmodium falciparum
EYLLKEKYYFKNNNQFII

SEQ ID NO: 3284558 - protein, 25 aa, Plasmodium falciparum
EYLNDPPINYYYRGLELYNKNVFAN

SEQ ID NO: 3284559 - protein, 22 aa, Plasmodium falciparum
EYLPNVLILWCKRVKYAINIYN

SEQ ID NO: 3284560 - protein, 29 aa, Plasmodium falciparum
EYMNIKHVIYIYIYINRYLTKEFKKQQKK

SEQ ID NO: 3284561 - protein, 29 aa, Plasmodium falciparum
EYMYKFHTLIPQFLLPINVSYNIPKTGML

SEQ ID NO: 3284562 - protein, 26 aa, Plasmodium falciparum
EYNKSYFVLLQTFSNIFKKYSDFTYF

SEQ ID NO: 3284563 - protein, 34 aa, Plasmodium falciparum
EYNLEYIYKLYYFIVNYFYLLQYMNKNNFSVYIP

SEQ ID NO: 3284564 - protein, 17 aa, Plasmodium falciparum
EYNLFQSMPTRNCRNEI

SEQ ID NO: 3284565 - protein, 17 aa, Plasmodium falciparum
EYNLYPNIFHYCSTYKI

SEQ ID NO: 3284566 - protein, 42 aa, Plasmodium falciparum
EYNMNKIIRSLLFILMLFILFCTEFLFVYNNLLKIKVDSKLV

SEQ ID NO: 3284567 - protein, 32 aa, Plasmodium falciparum
EYNNTYSIYFFLFLDFIFNTLKKKYIYISHND

SEQ ID NO: 3284568 - protein, 31 aa, Plasmodium falciparum
EYNNVEINIPWRVIEQLLLLLEEETGYRRPD

SEQ ID NO: 3284569 - protein, 36 aa, Plasmodium falciparum
EYNYKIDSYHFLKKLYYSVFNEPRICYTSINEQIKH

SEQ ID NO: 3284570 - protein, 24 aa, Plasmodium falciparum
EYPGYQCFFLQTSSDKIKPVHKLE

SEQ ID NO: 3284571 - protein, 27 aa, Plasmodium falciparum
EYQNIFKYYFNKFLKIKIELLSNLYGS

SEQ ID NO: 3284572 - protein, 27 aa, Plasmodium falciparum
EYRKKKLICIIWIKIYMMIIEEHKKEE

SEQ ID NO: 3284573 - protein, 34 aa, Plasmodium falciparum
EYRNKLHNMFLKIYILLIEKILINTKSFDFGCNI

SEQ ID NO: 3284574 - protein, 24 aa, Plasmodium falciparum
EYSCFYILEWLTPSKEEKLLKLKS

SEQ ID NO: 3284575 - protein, 22 aa, Plasmodium falciparum
EYSKIMYNIWNSLNINTPHDIY

SEQ ID NO: 3284576 - protein, 30 aa, Plasmodium falciparum
EYSRDINFHFFIFNLILYKCKNEFPCSIFE

SEQ ID NO: 3284577 - protein, 24 aa, Plasmodium falciparum
EYSSKFFFSLLKETKIIASQKENQ

SEQ ID NO: 3284578 - protein, 32 aa, Plasmodium falciparum
EYTNYILKKWKKKSFISFYFKQPVILSEIKEQ

SEQ ID NO: 3284579 - protein, 18 aa, Plasmodium falciparum
EYTTYFNEFKKRIKNLKN

SEQ ID NO: 3284580 - protein, 17 aa, Plasmodium falciparum
EYWRKWNLPIYYFVCRH

SEQ ID NO: 3284581 - protein, 17 aa, Plasmodium falciparum
EYYCLKKLLKKRINLQK

SEQ ID NO: 3284582 - protein, 25 aa, Plasmodium falciparum
EYYKLKHIFSIFQKLKIEHLYILLY

SEQ ID NO: 3284583 - protein, 18 aa, Plasmodium falciparum
EYYKLREAWWDANRAKVW

SEQ ID NO: 3284584 - protein, 22 aa, Plasmodium falciparum
EYYKSFYKKFAKSDYKKVHDFL

SEQ ID NO: 3284585 - protein, 30 aa, Plasmodium falciparum
EYYLTNYITWYITNMIFLLLNRKEKNWKVD

SEQ ID NO: 3284586 - protein, 24 aa, Plasmodium falciparum
EYYSKYLNIFFKSSFVRYININQV

SEQ ID NO: 3284587 - protein, 29 aa, Plasmodium falciparum
FADTKNISMVPFYSFYFSRCEIQKKNILN

SEQ ID NO: 3284588 - protein, 19 aa, Plasmodium falciparum
FAFFIFIKYGRCQGDQVIN

SEQ ID NO: 3284589 - protein, 21 aa, Plasmodium falciparum
FAFIILALFVCALNTYIYLKQ

SEQ ID NO: 3284590 - protein, 18 aa, Plasmodium falciparum
FAFLLRMCFMSLNKINNN

SEQ ID NO: 3284591 - protein, 21 aa, Plasmodium falciparum
FAFNLIVHYFIREKGKDTCEI

SEQ ID NO: 3284592 - protein, 22 aa, Plasmodium falciparum
FAHIFFIINILCQYICLNASKV

SEQ ID NO: 3284593 - protein, 20 aa, Plasmodium falciparum
FAHILFFRAINGLALGSIGP

SEQ ID NO: 3284594 - protein, 22 aa, Plasmodium falciparum
FAHILSPLFFNFYNDKHTYTNS

SEQ ID NO: 3284595 - protein, 21 aa, Plasmodium falciparum
FAIGLIICSSVGFIFRKEINN

SEQ ID NO: 3284596 - protein, 21 aa, Plasmodium falciparum
FAIKYILSYRFFFIYMARTTF

SEQ ID NO: 3284597 - protein, 26 aa, Plasmodium falciparum
FAKKPQFFRWFIEWSDEFCRERKKKE

SEQ ID NO: 3284598 - protein, 26 aa, Plasmodium falciparum
FAKQYFQYLFNIFNPYSNMKPHCVVI

SEQ ID NO: 3284599 - protein, 24 aa, Plasmodium falciparum
FAKTPQFLRWFTEWGDDFCQQQKE

SEQ ID NO: 3284600 - protein, 19 aa, Plasmodium falciparum
FAMMQYRLMKYIGHLTNTY

SEQ ID NO: 3284601 - protein, 25 aa, Plasmodium falciparum
FANDLFMWAYLFMDNFIYFFENCVV

SEQ ID NO: 3284602 - protein, 18 aa, Plasmodium falciparum
FANIQSFYPNFYKCIEND

SEQ ID NO: 3284603 - protein, 19 aa, Plasmodium falciparum
FANITLMLDLPQLPAIFFV

SEQ ID NO: 3284604 - protein, 19 aa, Plasmodium falciparum
FASILGETGGFYKTCDIIK

SEQ ID NO: 3284605 - protein, 23 aa, Plasmodium falciparum
FAYFACCILLNLYVLIGDYYTAL

SEQ ID NO: 3284606 - protein, 27 aa, Plasmodium falciparum
FAYKFLDPFYVNLLLTLYLTLAGVFSL

SEQ ID NO: 3284607 - protein, 22 aa, Plasmodium falciparum
FCDILMIKYYMRKYVRLEFVNI

SEQ ID NO: 3284608 - protein, 19 aa, Plasmodium falciparum
FCEIIYSFFIKNGGIIYSR

SEQ ID NO: 3284609 - protein, 21 aa, Plasmodium falciparum
FCFPIVINTFGWIKNIGLFLL

SEQ ID NO: 3284610 - protein, 17 aa, Plasmodium falciparum
FCIIIDYFLCFICRIID

SEQ ID NO: 3284611 - protein, 17 aa, Plasmodium falciparum
FCKGFPKYVSHEGFLFG

SEQ ID NO: 3284612 - protein, 18 aa, Plasmodium falciparum
FCKIYLMKFSFNIRMFIL

SEQ ID NO: 3284613 - protein, 25 aa, Plasmodium falciparum
FCLDTFKIISMFKYYLYEKYISYKN

SEQ ID NO: 3284614 - protein, 17 aa, Plasmodium falciparum
FCLNYRCKRKVSLSSIG

SEQ ID NO: 3284615 - protein, 18 aa, Plasmodium falciparum
FCLSSIICYLMYSSLNIN

SEQ ID NO: 3284616 - protein, 17 aa, Plasmodium falciparum
FCLYYNKNNKKYIHYNN

SEQ ID NO: 3284617 - protein, 19 aa, Plasmodium falciparum
FCMICWNNILFCKESLFKD

SEQ ID NO: 3284618 - protein, 20 aa, Plasmodium falciparum
FCNDLKLYREILILICIIII

SEQ ID NO: 3284619 - protein, 20 aa, Plasmodium falciparum
FCNFIKIILFVFNIWVFCFS

SEQ ID NO: 3284620 - protein, 17 aa, Plasmodium falciparum
FCNGCLVVFLGVSNNIC

SEQ ID NO: 3284621 - protein, 33 aa, Plasmodium falciparum
FCNIDTNIFKNILYLYPIYSPNISTYNKKNTTK

SEQ ID NO: 3284622 - protein, 19 aa, Plasmodium falciparum
FCNNIINKIQTYKFKYEHE

SEQ ID NO: 3284623 - protein, 18 aa, Plasmodium falciparum
FCNNILKDLSILKKNKCV

SEQ ID NO: 3284624 - protein, 29 aa, Plasmodium falciparum
FCPHICEEFWFYYLKRYKIKKRKKLCYFC

SEQ ID NO: 3284625 - protein, 17 aa, Plasmodium falciparum
FCSGIEFIKELGKTTFL

SEQ ID NO: 3284626 - protein, 29 aa, Plasmodium falciparum
FCSLYMNKLLYWSTLIKTLNFICNLTKST

SEQ ID NO: 3284627 - protein, 25 aa, Plasmodium falciparum
FCVCYDMFILYWRNSQILNNKYLEK

SEQ ID NO: 3284628 - protein, 17 aa, Plasmodium falciparum
FCVSLLAKEGIFKNKGE

SEQ ID NO: 3284629 - protein, 23 aa, Plasmodium falciparum
FCWIFLISFLYLINVIVCKQTIL

SEQ ID NO: 3284630 - protein, 24 aa, Plasmodium falciparum
FCWRSDTPLIYRAIPAWFVRVSNS

SEQ ID NO: 3284631 - protein, 19 aa, Plasmodium falciparum
FDCFSIFLIVRFKYYLEEF

SEQ ID NO: 3284632 - protein, 25 aa, Plasmodium falciparum
FDDKILLRLFFFKWKRYEIINIVKE

SEQ ID NO: 3284633 - protein, 38 aa, Plasmodium falciparum
FDDKSLRKWFIETAAIETFFLWDRYKKIKAKEKKEKED

SEQ ID NO: 3284634 - protein, 22 aa, Plasmodium falciparum
FDECRIFVLKIYFLIEKNLNNL

SEQ ID NO: 3284635 - protein, 20 aa, Plasmodium falciparum
FDEMDLNYDKIYTLAMINNE

SEQ ID NO: 3284636 - protein, 20 aa, Plasmodium falciparum
FDEQNLRYSFLLNPNNQQTS

SEQ ID NO: 3284637 - protein, 17 aa, Plasmodium falciparum
FDFFHLNNDVNVFFEYN

SEQ ID NO: 3284638 - protein, 23 aa, Plasmodium falciparum
FDHTIMPFYITLNSLIVNESRKV

SEQ ID NO: 3284639 - protein, 29 aa, Plasmodium falciparum
FDIFLFEKYFFDFFIYFTNSLYTWKKIDK

SEQ ID NO: 3284640 - protein, 18 aa, Plasmodium falciparum
FDIFLKNISLTCVSDTFF

SEQ ID NO: 3284641 - protein, 29 aa, Plasmodium falciparum
FDIIKNINMFLYYYHIYFPYDISTICIKY

SEQ ID NO: 3284642 - protein, 17 aa, Plasmodium falciparum
FDILIDDYKLLTNCIEE

SEQ ID NO: 3284643 - protein, 17 aa, Plasmodium falciparum
FDILINDAAIHDNDNEI

SEQ ID NO: 3284644 - protein, 18 aa, Plasmodium falciparum
FDILKNFDFLKSNILLAS

SEQ ID NO: 3284645 - protein, 25 aa, Plasmodium falciparum
FDINKMIIFNLYDEIFMKRKDVILY

SEQ ID NO: 3284646 - protein, 18 aa, Plasmodium falciparum
FDITFLYRREGKYGISIF

SEQ ID NO: 3284647 - protein, 45 aa, Plasmodium falciparum
FDIYINHSWKMYLYFFFYDFFCIAFNQLFYILYENSNKNLRYYSI

SEQ ID NO: 3284648 - protein, 28 aa, Plasmodium falciparum
FDKDTLIFLFICNFLVTSFQLFGLTNFA

SEQ ID NO: 3284649 - protein, 32 aa, Plasmodium falciparum
FDKIHLGHILLLFYSIFLTKNFFYIGLYNNKN

SEQ ID NO: 3284650 - protein, 24 aa, Plasmodium falciparum
FDKKEFLNFLTNFNKKFMKKNSLV

SEQ ID NO: 3284651 - protein, 30 aa, Plasmodium falciparum
FDKNISLKYVFFPICFFGYEKKLKVVVHMN

SEQ ID NO: 3284652 - protein, 17 aa, Plasmodium falciparum
FDLEYSKFYFSNKILRK

SEQ ID NO: 3284653 - protein, 18 aa, Plasmodium falciparum
FDLFHKWINGSIHELSEF

SEQ ID NO: 3284654 - protein, 28 aa, Plasmodium falciparum
FDLNDDILIVRLLLKPQTVILTVIQSFM

SEQ ID NO: 3284655 - protein, 27 aa, Plasmodium falciparum
FDNFMRHIYFNLAFTYILLEDYKNALK

SEQ ID NO: 3284656 - protein, 19 aa, Plasmodium falciparum
FDNFYRDNRFNYVNDYTFV

SEQ ID NO: 3284657 - protein, 26 aa, Plasmodium falciparum
FDNKKFCFDYIFVGSKLTFLKEYVRG

SEQ ID NO: 3284658 - protein, 18 aa, Plasmodium falciparum
FDNLYSCSPPYKSDYFRY

SEQ ID NO: 3284659 - protein, 40 aa, Plasmodium falciparum
FDPTILQTTIPFGVALALGSIAFLFLKKKTKSPVDLFSVI

SEQ ID NO: 3284660 - protein, 45 aa, Plasmodium falciparum
FDPTILQTTIPFGVALALGSIAFLFLKKKTLSPVDLFSVINIPKG

SEQ ID NO: 3284661 - protein, 39 aa, Plasmodium falciparum
FDPTILQTTIPLGIALALGSIAFLFLKKKTKASVGNLFQ

SEQ ID NO: 3284662 - protein, 40 aa, Plasmodium falciparum
FDPTILQTTIPLGIALALGSIAFLFLKKKTKHPVDLFSVI

SEQ ID NO: 3284663 - protein, 34 aa, Plasmodium falciparum
FDQCLLYMYNFKSIYIMYIQFLYIQRDVKKIRQI

SEQ ID NO: 3284664 - protein, 17 aa, Plasmodium falciparum
FDQFLQTLLNNYEIMHK

SEQ ID NO: 3284665 - protein, 17 aa, Plasmodium falciparum
FDQYIDLHFYNLQKLDN

SEQ ID NO: 3284666 - protein, 29 aa, Plasmodium falciparum
FDRNDMILKERIFEYAKHKTSIDMLKHPD

SEQ ID NO: 3284667 - protein, 24 aa, Plasmodium falciparum
FDRNHYTFCLLKKNTVIGGVCFRP

SEQ ID NO: 3284668 - protein, 28 aa, Plasmodium falciparum
FDSAMYETDLLWNKYGFRGFDDFCDDVK

SEQ ID NO: 3284669 - protein, 26 aa, Plasmodium falciparum
FDSKKLLLKLLKFLWNCIMALRKIQT

SEQ ID NO: 3284670 - protein, 41 aa, Plasmodium falciparum
FDSPLTNAINYLPWAFKIFLTCLIIELRIINEFVIPYKKVV

SEQ ID NO: 3284671 - protein, 35 aa, Plasmodium falciparum
FDSPVLNALLPFIFIAFVYCTITMLVGNVRYIIAL

SEQ ID NO: 3284672 - protein, 25 aa, Plasmodium falciparum
FDSSALLICIMKFGCEIENFLVSFS

SEQ ID NO: 3284673 - protein, 22 aa, Plasmodium falciparum
FDTSHFLLNLFPKNLYNMVEGY

SEQ ID NO: 3284674 - protein, 28 aa, Plasmodium falciparum
FDVFNKYDYIIIYLLNYYLQKNNDISKY

SEQ ID NO: 3284675 - protein, 38 aa, Plasmodium falciparum
FDWLPALGYLLPYEKIKFLRTFFPIVFFISICASAYSY

SEQ ID NO: 3284676 - protein, 33 aa, Plasmodium falciparum
FDYGFLKRIYKAFFIFFRCILSSLLIIYMIRDC

SEQ ID NO: 3284677 - protein, 17 aa, Plasmodium falciparum
FDYILNNTIFYNDYVYY

SEQ ID NO: 3284678 - protein, 31 aa, Plasmodium falciparum
FDYIYIYIYIYIYIYIYIYRLLNFESRKELN

SEQ ID NO: 3284679 - protein, 32 aa, Plasmodium falciparum
FDYNNIFLGTLISNILLYYYPSNNIGLNSSDI

SEQ ID NO: 3284680 - protein, 35 aa, Plasmodium falciparum
FDYSNQNIYLKFLFSLSFTPLFIHGSPNLPLRDLN

SEQ ID NO: 3284681 - protein, 23 aa, Plasmodium falciparum
FECNEIHMKCTFLINEVKNLEKS

SEQ ID NO: 3284682 - protein, 41 aa, Plasmodium falciparum
FEDYSKLYIASGVATLVLLGGSITFYFLRKEKTEKVVQEET

SEQ ID NO: 3284683 - protein, 25 aa, Plasmodium falciparum
FEEAKYFIRFIKSIDRYPLIYPNDI

SEQ ID NO: 3284684 - protein, 45 aa, Plasmodium falciparum
FEFFENILTSLLLKPSIFINVLNSLHFIFFVSPVSLQVKQKNDTS

SEQ ID NO: 3284685 - protein, 22 aa, Plasmodium falciparum
FEFLKNLFFGIATNGIFFCFDE

SEQ ID NO: 3284686 - protein, 18 aa, Plasmodium falciparum
FEGDIYMFPVVKEYYWEI

SEQ ID NO: 3284687 - protein, 20 aa, Plasmodium falciparum
FEGFKDEYFTQMEGGAYGIT

SEQ ID NO: 3284688 - protein, 18 aa, Plasmodium falciparum
FEIFKSNSFFIVLSLFIH

SEQ ID NO: 3284689 - protein, 21 aa, Plasmodium falciparum
FEIFLKIFQDVQFPSVLYSII

SEQ ID NO: 3284690 - protein, 22 aa, Plasmodium falciparum
FEIHMLLIVLLFVLSLVYYRKR

SEQ ID NO: 3284691 - protein, 18 aa, Plasmodium falciparum
FEIIKKSILIAYLNITFS

SEQ ID NO: 3284692 - protein, 34 aa, Plasmodium falciparum
FEIKKLIFPINIFVNLLIPLFLPYDDVLVDKNII

SEQ ID NO: 3284693 - protein, 23 aa, Plasmodium falciparum
FEIKYCIFYFTKIIKQLIKQRKK

SEQ ID NO: 3284694 - protein, 17 aa, Plasmodium falciparum
FEKAYIIKYISNNVQLF

SEQ ID NO: 3284695 - protein, 18 aa, Plasmodium falciparum
FEKFLYQCNIMKTCLLQF

SEQ ID NO: 3284696 - protein, 21 aa, Plasmodium falciparum
FEKFMKIMDSFFLLLNSKMNI

SEQ ID NO: 3284697 - protein, 23 aa, Plasmodium falciparum
FEKKIIFDLFEQFFSQIISLQMF

SEQ ID NO: 3284698 - protein, 23 aa, Plasmodium falciparum
FEKKPQFIRWFEEWTEDFCRKRT

SEQ ID NO: 3284699 - protein, 25 aa, Plasmodium falciparum
FEKKRKMFLEKFGLNYLTTSEGIIL

SEQ ID NO: 3284700 - protein, 24 aa, Plasmodium falciparum
FEKNDILLKYIPTPKIYKIKDDPT

SEQ ID NO: 3284701 - protein, 21 aa, Plasmodium falciparum
FEKNESFLLPLPPLTTKSNVQ

SEQ ID NO: 3284702 - protein, 25 aa, Plasmodium falciparum
FEKWNYLFFINLLYFFVGPALFGTY

SEQ ID NO: 3284703 - protein, 21 aa, Plasmodium falciparum
FELFTEGCYLFLLPNEKIKSN

SEQ ID NO: 3284704 - protein, 27 aa, Plasmodium falciparum
FELHISQYLYFFVKLNELNIKDAYIYY

SEQ ID NO: 3284705 - protein, 26 aa, Plasmodium falciparum
FELIKFFIELIKRPLIYSLHILCVNY

SEQ ID NO: 3284706 - protein, 19 aa, Plasmodium falciparum
FELSVWKPAALAAAKEFAE

SEQ ID NO: 3284707 - protein, 23 aa, Plasmodium falciparum
FELYEMDVLYERPKYPWIKGDTD

SEQ ID NO: 3284708 - protein, 33 aa, Plasmodium falciparum
FENIKYVLNKIFFLFHLLKIRIIYGHILAVKKS

SEQ ID NO: 3284709 - protein, 18 aa, Plasmodium falciparum
FENITLKNIYFPKQYREL

SEQ ID NO: 3284710 - protein, 57 aa, Plasmodium falciparum
FENIYHIKIYFIYIDFLVLKIICLFLLVSFVILYIVLPIPFILYIHNHIVYNYNFKK

SEQ ID NO: 3284711 - protein, 18 aa, Plasmodium falciparum
FENKIFLRNILGQIKENL

SEQ ID NO: 3284712 - protein, 38 aa, Plasmodium falciparum
FENKLNTPWMCMIFPYYFISYFNYKIFCILKCTKKKRV

SEQ ID NO: 3284713 - protein, 26 aa, Plasmodium falciparum
FENKNYKHFLILYISISFSLTNTDVT

SEQ ID NO: 3284714 - protein, 27 aa, Plasmodium falciparum
FENKRHYLRKKLKYLKSGIRSDPIRLS

SEQ ID NO: 3284715 - protein, 27 aa, Plasmodium falciparum
FENLETLFTLYINYNINKKKKKLFYFY

SEQ ID NO: 3284716 - protein, 17 aa, Plasmodium falciparum
FEQFCHCSTAGGLSGLD

SEQ ID NO: 3284717 - protein, 19 aa, Plasmodium falciparum
FERAQIAFVAVFLHLTGYK

SEQ ID NO: 3284718 - protein, 25 aa, Plasmodium falciparum
FESLLLLYEVLLSKLLLIHFILMIL

SEQ ID NO: 3284719 - protein, 17 aa, Plasmodium falciparum
FESLNIIELLNNKEYIS

SEQ ID NO: 3284720 - protein, 20 aa, Plasmodium falciparum
FESPLWLDSLSLPDPYYILP

SEQ ID NO: 3284721 - protein, 24 aa, Plasmodium falciparum
FESRPELNKAIKPCPNLNNFKTSC

SEQ ID NO: 3284722 - protein, 24 aa, Plasmodium falciparum
FETLIHLMYIYGIPSKILYNDFRE

SEQ ID NO: 3284723 - protein, 26 aa, Plasmodium falciparum
FEYKCPVEWIITPFLEFLNNFINDYC

SEQ ID NO: 3284724 - protein, 23 aa, Plasmodium falciparum
FEYRKLIKKFFFKKVYYSIKKKH

SEQ ID NO: 3284725 - protein, 25 aa, Plasmodium falciparum
FEYYLKIFFFVFLNVYQKYINNQKI

SEQ ID NO: 3284726 - protein, 17 aa, Plasmodium falciparum
FFAALLALNFIAPNYFN

SEQ ID NO: 3284727 - protein, 18 aa, Plasmodium falciparum
FFAALLALNFIAPRDYNS

SEQ ID NO: 3284728 - protein, 23 aa, Plasmodium falciparum
FFAFFIALKYFNRCLGDQLDMGS

SEQ ID NO: 3284729 - protein, 17 aa, Plasmodium falciparum
FFAFNMLSIFLFSLPII

SEQ ID NO: 3284730 - protein, 17 aa, Plasmodium falciparum
FFANLIPYHAYKKRPKR

SEQ ID NO: 3284731 - protein, 20 aa, Plasmodium falciparum
FFAPFICLLIFSSNHGLFQK

SEQ ID NO: 3284732 - protein, 23 aa, Plasmodium falciparum
FFASFFVLYFAKARNEYDIKENE

SEQ ID NO: 3284733 - protein, 17 aa, Plasmodium falciparum
FFCILIIIYIKISRLKN

SEQ ID NO: 3284734 - protein, 25 aa, Plasmodium falciparum
FFCLYSFFVFFIWSLLALSTKKLVS

SEQ ID NO: 3284735 - protein, 33 aa, Plasmodium falciparum
FFCYHYVYNNLYIHLLMLFYALQNIVFTINDAF

SEQ ID NO: 3284736 - protein, 39 aa, Plasmodium falciparum
FFDFSSLTKNILISLAIFGVIFLFIFSNKHRSLGMFNKK

SEQ ID NO: 3284737 - protein, 34 aa, Plasmodium falciparum
FFDNIYITFNDVLIKIPFLNQILEFQKIHEFLKR

SEQ ID NO: 3284738 - protein, 26 aa, Plasmodium falciparum
FFDPTQIFNYLWKKYINQYVIIKNMF

SEQ ID NO: 3284739 - protein, 19 aa, Plasmodium falciparum
FFDYVAYYIYIRYYFNKIN

SEQ ID NO: 3284740 - protein, 24 aa, Plasmodium falciparum
FFEETFLKMRKKLSYKWIPKWHMC

SEQ ID NO: 3284741 - protein, 25 aa, Plasmodium falciparum
FFETDNFLIILKNFLKFTKKFVKVL

SEQ ID NO: 3284742 - protein, 19 aa, Plasmodium falciparum
FFFAIIAVKLVYPGYVAAG

SEQ ID NO: 3284743 - protein, 19 aa, Plasmodium falciparum
FFFCFLRYNNLYKGKNKYV

SEQ ID NO: 3284744 - protein, 27 aa, Plasmodium falciparum
FFFFLVHIFYIFHIEGIYINKNSLTND

SEQ ID NO: 3284745 - protein, 18 aa, Plasmodium falciparum
FFFFSYNIEKFKYYLNSI

SEQ ID NO: 3284746 - protein, 19 aa, Plasmodium falciparum
FFFHDLSKRDFLNSKNFVL

SEQ ID NO: 3284747 - protein, 18 aa, Plasmodium falciparum
FFFHKFVKIPFLFEYFTL

SEQ ID NO: 3284748 - protein, 18 aa, Plasmodium falciparum
FFFIIEKMDHFGIFLMIS

SEQ ID NO: 3284749 - protein, 19 aa, Plasmodium falciparum
FFFITITINDLVINNTSKC

SEQ ID NO: 3284750 - protein, 18 aa, Plasmodium falciparum
FFFKFIKDNKIKIKIIGN

SEQ ID NO: 3284751 - protein, 31 aa, Plasmodium falciparum
FFFKYIYNIFILTCFYITLSSYYFIISFIFS

SEQ ID NO: 3284752 - protein, 23 aa, Plasmodium falciparum
FFFLCIFFFILCTLITYIYCFFK

SEQ ID NO: 3284753 - protein, 21 aa, Plasmodium falciparum
FFFLFFFFFFVYYKPKLSIQI

SEQ ID NO: 3284754 - protein, 23 aa, Plasmodium falciparum
FFFLFLVILYFNNVVEGENGTTN

SEQ ID NO: 3284755 - protein, 23 aa, Plasmodium falciparum
FFFLYFFFFLFLYKDVVLFFLFH

SEQ ID NO: 3284756 - protein, 20 aa, Plasmodium falciparum
FFFNESMKFPLYTESLRLYK

SEQ ID NO: 3284757 - protein, 33 aa, Plasmodium falciparum
FFFSFSVFYNILFLLIIMLMYIKKNNITRKRIQ

SEQ ID NO: 3284758 - protein, 22 aa, Plasmodium falciparum
FFFTKMYLHCDLKKLTMITDHN

SEQ ID NO: 3284759 - protein, 21 aa, Plasmodium falciparum
FFFVLLNCFLNIQPYVSNATS

SEQ ID NO: 3284760 - protein, 18 aa, Plasmodium falciparum
FFGATNMPIPSMSNISLA

SEQ ID NO: 3284761 - protein, 28 aa, Plasmodium falciparum
FFGFKDIYIFFFNFMVLIPLSALMGHVT

SEQ ID NO: 3284762 - protein, 21 aa, Plasmodium falciparum
FFHFLSCYLLYDINTLYKFCS

SEQ ID NO: 3284763 - protein, 20 aa, Plasmodium falciparum
FFHKIHISIINYISVYYKNE

SEQ ID NO: 3284764 - protein, 19 aa, Plasmodium falciparum
FFHKSFFKYDIFMIDFVHI

SEQ ID NO: 3284765 - protein, 17 aa, Plasmodium falciparum
FFHNLNEAPFGLPRAHP

SEQ ID NO: 3284766 - protein, 17 aa, Plasmodium falciparum
FFIKHDIYYLNKKFYKV

SEQ ID NO: 3284767 - protein, 18 aa, Plasmodium falciparum
FFILYLSQILWALYLIWA

SEQ ID NO: 3284768 - protein, 17 aa, Plasmodium falciparum
FFIMINLACHTRQLKMK

SEQ ID NO: 3284769 - protein, 20 aa, Plasmodium falciparum
FFINNLYYHLKCKLLCVFKF

SEQ ID NO: 3284770 - protein, 19 aa, Plasmodium falciparum
FFISLMTWTPLTLINFVFV

SEQ ID NO: 3284771 - protein, 22 aa, Plasmodium falciparum
FFITIFLILIFIDSAKGDERKN

SEQ ID NO: 3284772 - protein, 28 aa, Plasmodium falciparum
FFKCKKYLPCLLLSCLSFTNTMILFLKK

SEQ ID NO: 3284773 - protein, 24 aa, Plasmodium falciparum
FFKDDEYFIYYLGSLYISHYFLNI

SEQ ID NO: 3284774 - protein, 32 aa, Plasmodium falciparum
FFKLINIDIILIILWFFVLYSFSYNIVEVRNF

SEQ ID NO: 3284775 - protein, 18 aa, Plasmodium falciparum
FFKMERIISTDEPSLLLL

SEQ ID NO: 3284776 - protein, 27 aa, Plasmodium falciparum
FFKSEYNCRIAFLYPKSILYDQNDIPS

SEQ ID NO: 3284777 - protein, 18 aa, Plasmodium falciparum
FFKSIMPLFNLLNDNFNQ

SEQ ID NO: 3284778 - protein, 19 aa, Plasmodium falciparum
FFLCSFYLLYVTCSSNNNN

SEQ ID NO: 3284779 - protein, 37 aa, Plasmodium falciparum
FFLFEHFSIFYVYRLISFLTLFLFTPISIYLVKRRNI

SEQ ID NO: 3284780 - protein, 22 aa, Plasmodium falciparum
FFLFIFLICPIKTFILKNNNNL

SEQ ID NO: 3284781 - protein, 18 aa, Plasmodium falciparum
FFLFYQKYNKSKNIKFLP

SEQ ID NO: 3284782 - protein, 21 aa, Plasmodium falciparum
FFLIFFSFYNPVKGEGYICDF

SEQ ID NO: 3284783 - protein, 17 aa, Plasmodium falciparum
FFLLISYIIFVYSDLNL

SEQ ID NO: 3284784 - protein, 20 aa, Plasmodium falciparum
FFLLYLIKAHLDFFLRYRTG

SEQ ID NO: 3284785 - protein, 25 aa, Plasmodium falciparum
FFLSLVIILIFIYPVFRTISINPRN

SEQ ID NO: 3284786 - protein, 18 aa, Plasmodium falciparum
FFMLEKRYITERTKNDKQ

SEQ ID NO: 3284787 - protein, 19 aa, Plasmodium falciparum
FFMSEFLYILFLRYNDHIL

SEQ ID NO: 3284788 - protein, 20 aa, Plasmodium falciparum
FFNHKTGVLAPLAIYAEIKD

SEQ ID NO: 3284789 - protein, 19 aa, Plasmodium falciparum
FFNIKYNIAIIYAPYISLI

SEQ ID NO: 3284790 - protein, 18 aa, Plasmodium falciparum
FFNILKCVPYIINNGRMS

SEQ ID NO: 3284791 - protein, 24 aa, Plasmodium falciparum
FFNKIFIFLFLKASCFEFFYLGNE

SEQ ID NO: 3284792 - protein, 17 aa, Plasmodium falciparum
FFNPIIDLILSNLNNRN

SEQ ID NO: 3284793 - protein, 26 aa, Plasmodium falciparum
FFNSNLLFFEVLLRHSLFLIFNEETN

SEQ ID NO: 3284794 - protein, 47 aa, Plasmodium falciparum
FFNSRYIFENIFTWSSLIFSYACNFITPSIIYLIACKNIPFSEKNPL

SEQ ID NO: 3284795 - protein, 17 aa, Plasmodium falciparum
FFNYEKYINNDKSFFII

SEQ ID NO: 3284796 - protein, 33 aa, Plasmodium falciparum
FFNYTYDQILYVLKIFIQLNYFSQDFFNYLFKA

SEQ ID NO: 3284797 - protein, 17 aa, Plasmodium falciparum
FFPIYMPTTDTITTTKI

SEQ ID NO: 3284798 - protein, 27 aa, Plasmodium falciparum
FFQKNKYLIWNIFRQVLESLSYLHKQK

SEQ ID NO: 3284799 - protein, 19 aa, Plasmodium falciparum
FFQLNDIIIEIFYNFNKMN

SEQ ID NO: 3284800 - protein, 24 aa, Plasmodium falciparum
FFQLREDWWALNREDVWKALTCSA

SEQ ID NO: 3284801 - protein, 19 aa, Plasmodium falciparum
FFRNIFISHKFQNKIYLKF

SEQ ID NO: 3284802 - protein, 17 aa, Plasmodium falciparum
FFRPMALEECRCSMLNN

SEQ ID NO: 3284803 - protein, 19 aa, Plasmodium falciparum
FFSIFIYFLGPFLFRNEKS

SEQ ID NO: 3284804 - protein, 19 aa, Plasmodium falciparum
FFSLVSLFHIYIPKKKKKN

SEQ ID NO: 3284805 - protein, 18 aa, Plasmodium falciparum
FFSPFKLQQSPKVSINKT

SEQ ID NO: 3284806 - protein, 26 aa, Plasmodium falciparum
FFTCDHLCELIKILCYFKKCYHLNMC

SEQ ID NO: 3284807 - protein, 28 aa, Plasmodium falciparum
FFTDINFYQLIKLLYILCKEKYMYYFCT

SEQ ID NO: 3284808 - protein, 17 aa, Plasmodium falciparum
FFTIYQIFNPKNNENVL

SEQ ID NO: 3284809 - protein, 19 aa, Plasmodium falciparum
FFTNPIILSAIAILVIVII

SEQ ID NO: 3284810 - protein, 25 aa, Plasmodium falciparum
FFTPNYFKMCSILILNDLLNFEIFY

SEQ ID NO: 3284811 - protein, 19 aa, Plasmodium falciparum
FFVAIIAVKLFIPGYVLGG

SEQ ID NO: 3284812 - protein, 21 aa, Plasmodium falciparum
FFVYIILNILIVLVISKNVVY

SEQ ID NO: 3284813 - protein, 17 aa, Plasmodium falciparum
FFYFLKEQRYYSSDVGS

SEQ ID NO: 3284814 - protein, 20 aa, Plasmodium falciparum
FFYKEYIIDSIINTLFRCTM

SEQ ID NO: 3284815 - protein, 27 aa, Plasmodium falciparum
FFYLLILSFILYNKIINVLNFPINNGI

SEQ ID NO: 3284816 - protein, 19 aa, Plasmodium falciparum
FFYRKILIYEFLDNYFISF

SEQ ID NO: 3284817 - protein, 26 aa, Plasmodium falciparum
FGADCIYPYILYESLQFIKFADNEAR

SEQ ID NO: 3284818 - protein, 32 aa, Plasmodium falciparum
FGAIILLIILIIAIVFLLVTWLWFHKDVYYET

SEQ ID NO: 3284819 - protein, 20 aa, Plasmodium falciparum
FGALPSLKDEIITIGYPAGG

SEQ ID NO: 3284820 - protein, 18 aa, Plasmodium falciparum
FGETLKFMKYRELLRKYM

SEQ ID NO: 3284821 - protein, 24 aa, Plasmodium falciparum
FGFHEARKLAIKTIQTKEINYLCN

SEQ ID NO: 3284822 - protein, 33 aa, Plasmodium falciparum
FGHMQNLFNYIFYFVCLLLVIQIVLILLYIYIK

SEQ ID NO: 3284823 - protein, 36 aa, Plasmodium falciparum
FGIAALVLLILAVALIILYIWLYKRRKRSWKHECKK

SEQ ID NO: 3284824 - protein, 37 aa, Plasmodium falciparum
FGILSAHLKNFIFFSISLWLCLFTGSALVPVCVGMLL

SEQ ID NO: 3284825 - protein, 21 aa, Plasmodium falciparum
FGKLLLFVCNMNDAFSTTAKT

SEQ ID NO: 3284826 - protein, 17 aa, Plasmodium falciparum
FGKSYWFNIKELQIQKI

SEQ ID NO: 3284827 - protein, 34 aa, Plasmodium falciparum
FGLNFVYSKVQHWLYRIWVKLRNPDLPLDDVGFL

SEQ ID NO: 3284828 - protein, 23 aa, Plasmodium falciparum
FGLSFAFVPLYQLFCQSTGYGGT

SEQ ID NO: 3284829 - protein, 25 aa, Plasmodium falciparum
FGSFIPVDLLLIWEVVRLLQGYLIN

SEQ ID NO: 3284830 - protein, 27 aa, Plasmodium falciparum
FGYINRALQIFLKLNNYLKIFYIMIHH

SEQ ID NO: 3284831 - protein, 17 aa, Plasmodium falciparum
FHDLFLKKVIHNNIFET

SEQ ID NO: 3284832 - protein, 18 aa, Plasmodium falciparum
FHEEAIMEFHRYKDLLKL

SEQ ID NO: 3284833 - protein, 29 aa, Plasmodium falciparum
FHEFGHAYHLLLLSYKYKLYNFNNIPLDY

SEQ ID NO: 3284834 - protein, 27 aa, Plasmodium falciparum
FHEKKKIFYIILLIENLSFKKNIFEEI

SEQ ID NO: 3284835 - protein, 18 aa, Plasmodium falciparum
FHERICQLKFKWPINKDE

SEQ ID NO: 3284836 - protein, 35 aa, Plasmodium falciparum
FHFDENYIYDILYICIWIFSLSVSKYRKIRFTSSL

SEQ ID NO: 3284837 - protein, 38 aa, Plasmodium falciparum
FHGFGSYPLKKDILGLWWEALSIIKLGFEIITRDFKSY

SEQ ID NO: 3284838 - protein, 29 aa, Plasmodium falciparum
FHGSVVFLIPLYFLSYYNIPTSDGIPYDI

SEQ ID NO: 3284839 - protein, 17 aa, Plasmodium falciparum
FHHLLKQVNKIMYFSEL

SEQ ID NO: 3284840 - protein, 17 aa, Plasmodium falciparum
FHIAIFKRFTKWNGLSI

SEQ ID NO: 3284841 - protein, 18 aa, Plasmodium falciparum
FHIDGVTDLKWKTLITAQ

SEQ ID NO: 3284842 - protein, 26 aa, Plasmodium falciparum
FHIGVIILLIINYFSSHIKKIFPSFF

SEQ ID NO: 3284843 - protein, 19 aa, Plasmodium falciparum
FHIIPFNKALGRKLYENNN

SEQ ID NO: 3284844 - protein, 21 aa, Plasmodium falciparum
FHILIEIKLNYYFKIPYDIKN

SEQ ID NO: 3284845 - protein, 18 aa, Plasmodium falciparum
FHIMKFNLVCNIVSSFFF

SEQ ID NO: 3284846 - protein, 18 aa, Plasmodium falciparum
FHKDLYKILLERKIINPY

SEQ ID NO: 3284847 - protein, 38 aa, Plasmodium falciparum
FHKSRIILTYLYLLSPYPQFIFYVISPLVFIKPQKYCD

SEQ ID NO: 3284848 - protein, 23 aa, Plasmodium falciparum
FHLYTLLKILKYYCKSHISEVVI

SEQ ID NO: 3284849 - protein, 20 aa, Plasmodium falciparum
FHNFRDILILSYTCKYSSSM

SEQ ID NO: 3284850 - protein, 19 aa, Plasmodium falciparum
FHNFYNNILNLIQPVNAIV

SEQ ID NO: 3284851 - protein, 19 aa, Plasmodium falciparum
FHNILMKYKFKLKQNLIDA

SEQ ID NO: 3284852 - protein, 37 aa, Plasmodium falciparum
FHNLLFVITLLFGLVFLLYLLLILFNIFFKKSKANNV

SEQ ID NO: 3284853 - protein, 35 aa, Plasmodium falciparum
FHNLNDEMLHMLLYIYFIIWGEDLHFYELKKVHIE

SEQ ID NO: 3284854 - protein, 17 aa, Plasmodium falciparum
FHRTVTTCYWFPSPIKK

SEQ ID NO: 3284855 - protein, 25 aa, Plasmodium falciparum
FHSTKIYILLIFLHIPKKKEYLEPI

SEQ ID NO: 3284856 - protein, 25 aa, Plasmodium falciparum
FHSTRLMMIIYLKNYVYEFINTYLK

SEQ ID NO: 3284857 - protein, 23 aa, Plasmodium falciparum
FHSWAKNLLIDTIRWEHQLKNCI

SEQ ID NO: 3284858 - protein, 17 aa, Plasmodium falciparum
FHSYFMEFMLRLSIIDN

SEQ ID NO: 3284859 - protein, 17 aa, Plasmodium falciparum
FHTNYLKNIFIFMDLFK

SEQ ID NO: 3284860 - protein, 19 aa, Plasmodium falciparum
FHVFVLFILLFCTTIFPFN

SEQ ID NO: 3284861 - protein, 24 aa, Plasmodium falciparum
FHYKVKYVFLVINNFALYHKIGVI

SEQ ID NO: 3284862 - protein, 21 aa, Plasmodium falciparum
FIALMVFNAILFWVYNRGKKD

SEQ ID NO: 3284863 - protein, 39 aa, Plasmodium falciparum
FIATRLQLFIWYIDISLMILFIYIIIPISLIYTYVTYED

SEQ ID NO: 3284864 - protein, 18 aa, Plasmodium falciparum
FICENMLMSFGFIKANKL

SEQ ID NO: 3284865 - protein, 24 aa, Plasmodium falciparum
FICEYKDLIIIRKTNIILKSLGVN

SEQ ID NO: 3284866 - protein, 19 aa, Plasmodium falciparum
FICIINKFCKFFENINLEK

SEQ ID NO: 3284867 - protein, 17 aa, Plasmodium falciparum
FICLLQQILIKLNEFNI

SEQ ID NO: 3284868 - protein, 24 aa, Plasmodium falciparum
FICLVNTIFFLFYLVTNNFKISTN

SEQ ID NO: 3284869 - protein, 18 aa, Plasmodium falciparum
FICPLIVIIYLLFCKYGN

SEQ ID NO: 3284870 - protein, 19 aa, Plasmodium falciparum
FIDKLLLLLSSNSCSVVLM

SEQ ID NO: 3284871 - protein, 57 aa, Plasmodium falciparum
FIDKTRIDYFKIHMLLKLICTFTPCYNSRIVKISCFFMIFIIMNKKINRYKQDYTTD

SEQ ID NO: 3284872 - protein, 19 aa, Plasmodium falciparum
FIDNIFLEIDRIIKFLIKY

SEQ ID NO: 3284873 - protein, 26 aa, Plasmodium falciparum
FIDNSLVYMYQFFQQISKQIVFSCFM

SEQ ID NO: 3284874 - protein, 28 aa, Plasmodium falciparum
FIDTHRYFFKYFIMDLTFNIINYLNYMD

SEQ ID NO: 3284875 - protein, 18 aa, Plasmodium falciparum
FIEEVILVSQYKLRKFKD

SEQ ID NO: 3284876 - protein, 18 aa, Plasmodium falciparum
FIEIIIPFIIKEKGEEKN

SEQ ID NO: 3284877 - protein, 20 aa, Plasmodium falciparum
FIEKFLNQIASFLPSEEIYG

SEQ ID NO: 3284878 - protein, 23 aa, Plasmodium falciparum
FIELNSFYYFNAVNFYGTDNDDD

SEQ ID NO: 3284879 - protein, 28 aa, Plasmodium falciparum
FIFFCSVVIFIRFIGYFFCNRYMTEEPY

SEQ ID NO: 3284880 - protein, 18 aa, Plasmodium falciparum
FIFIDTWVLSSNFPYKKI

SEQ ID NO: 3284881 - protein, 18 aa, Plasmodium falciparum
FIFKKKYIFIVTCYFNDF

SEQ ID NO: 3284882 - protein, 18 aa, Plasmodium falciparum
FIFLILSIFLIILFSVVF

SEQ ID NO: 3284883 - protein, 17 aa, Plasmodium falciparum
FIFQFIDKEFKREDFYE

SEQ ID NO: 3284884 - protein, 19 aa, Plasmodium falciparum
FIFSIILGTLSLIYNNDYE

SEQ ID NO: 3284885 - protein, 30 aa, Plasmodium falciparum
FIFYHVRKIMKNIFFSVRKILQMKNRSNVI

SEQ ID NO: 3284886 - protein, 42 aa, Plasmodium falciparum
FIFYKNCFYFFQITPQIIYIYIYYYILLYYKKMARSSAVGTQ

SEQ ID NO: 3284887 - protein, 24 aa, Plasmodium falciparum
FIHFKNFILLNFGTHINFFQHLYD

SEQ ID NO: 3284888 - protein, 17 aa, Plasmodium falciparum
FIHFYDNTHYIIFTTST

SEQ ID NO: 3284889 - protein, 19 aa, Plasmodium falciparum
FIHIICSLLIIIFNSIVTI

SEQ ID NO: 3284890 - protein, 19 aa, Plasmodium falciparum
FIHIKYIRIEYIYSLLYSA

SEQ ID NO: 3284891 - protein, 29 aa, Plasmodium falciparum
FIHKRDFINLNILKLIKEKIIQVLQNNYK

SEQ ID NO: 3284892 - protein, 36 aa, Plasmodium falciparum
FIHLIKSVIFIIPYVYKVKFLFLFCSLFNIYQKEYE

SEQ ID NO: 3284893 - protein, 17 aa, Plasmodium falciparum
FIIADIIITLLLNILWL

SEQ ID NO: 3284894 - protein, 20 aa, Plasmodium falciparum
FIICVFYILIFYNNNVNCFY

SEQ ID NO: 3284895 - protein, 18 aa, Plasmodium falciparum
FIIELYRKRNKFGFIKGI

SEQ ID NO: 3284896 - protein, 18 aa, Plasmodium falciparum
FIIHAKTSLRMFQLFDCS

SEQ ID NO: 3284897 - protein, 19 aa, Plasmodium falciparum
FIIILLISLIFISSCSNTN

SEQ ID NO: 3284898 - protein, 19 aa, Plasmodium falciparum
FIILLLSFLTTCASLLYYF

SEQ ID NO: 3284899 - protein, 27 aa, Plasmodium falciparum
FIILNKQIYWLYYSQLSKNIYIPFIYK

SEQ ID NO: 3284900 - protein, 17 aa, Plasmodium falciparum
FIIMFTLSFFYRLFFNK

SEQ ID NO: 3284901 - protein, 34 aa, Plasmodium falciparum
FIITQMKKYIYLRPLVLLLKFFLHSRNLNETYIG

SEQ ID NO: 3284902 - protein, 20 aa, Plasmodium falciparum
FIIYIEVTVWWLSLGILSSI

SEQ ID NO: 3284903 - protein, 20 aa, Plasmodium falciparum
FIIYNYINEEWFKQVLKLYK

SEQ ID NO: 3284904 - protein, 46 aa, Plasmodium falciparum
FIKIKNFCALLFFNILFIMKRIFYNYYIMINFIITLLNKNMFIKRN

SEQ ID NO: 3284905 - protein, 17 aa, Plasmodium falciparum
FIKILNIIKIKEKVSEI

SEQ ID NO: 3284906 - protein, 18 aa, Plasmodium falciparum
FIKIYLTKIISELYDTKR

SEQ ID NO: 3284907 - protein, 22 aa, Plasmodium falciparum
FIKKCLLLIYIINTIIIPFIQT

SEQ ID NO: 3284908 - protein, 19 aa, Plasmodium falciparum
FIKKKFSFDLIKNNLKKKK

SEQ ID NO: 3284909 - protein, 19 aa, Plasmodium falciparum
FIKKKNLFCYTNHLSLLYF

SEQ ID NO: 3284910 - protein, 18 aa, Plasmodium falciparum
FIKLIKYITNISTLIYQS

SEQ ID NO: 3284911 - protein, 28 aa, Plasmodium falciparum
FIKLLRIQIVVILLFLIVKYNFKNKWED

SEQ ID NO: 3284912 - protein, 19 aa, Plasmodium falciparum
FIKLRMYLYHILIDVFENA

SEQ ID NO: 3284913 - protein, 18 aa, Plasmodium falciparum
FIKSPYYNLLYEFATEKI

SEQ ID NO: 3284914 - protein, 29 aa, Plasmodium falciparum
FIKYKKKLLVVILWIKIYMSMLEEYVKEE

SEQ ID NO: 3284915 - protein, 18 aa, Plasmodium falciparum
FILNINHFIFYTDNFLSI

SEQ ID NO: 3284916 - protein, 18 aa, Plasmodium falciparum
FILPISFICYNFGKKFNM

SEQ ID NO: 3284917 - protein, 20 aa, Plasmodium falciparum
FILTILYILLIFNYGNTIIQ

SEQ ID NO: 3284918 - protein, 19 aa, Plasmodium falciparum
FIMSFYMFYYKMGSAAVLN

SEQ ID NO: 3284919 - protein, 32 aa, Plasmodium falciparum
FINEYWPVFNFLQFIYIILHYTLFQTTKWIFS

SEQ ID NO: 3284920 - protein, 19 aa, Plasmodium falciparum
FINFFSYILNINYKGNEDD

SEQ ID NO: 3284921 - protein, 27 aa, Plasmodium falciparum
FINFLRYVCLMVYVIGFLNVFLDNSYE

SEQ ID NO: 3284922 - protein, 17 aa, Plasmodium falciparum
FINIFRKQTSYLQNKNV

SEQ ID NO: 3284923 - protein, 25 aa, Plasmodium falciparum
FINITEILYKCKLQKKYISLYPEQT

SEQ ID NO: 3284924 - protein, 18 aa, Plasmodium falciparum
FINKQNVLFYLSSKILLP

SEQ ID NO: 3284925 - protein, 17 aa, Plasmodium falciparum
FINKYGQMIIPFKNNIN

SEQ ID NO: 3284926 - protein, 31 aa, Plasmodium falciparum
FINLLKMYYKNYPFFTLKKNNILFLVHIILL

SEQ ID NO: 3284927 - protein, 34 aa, Plasmodium falciparum
FINMKYYNFYYSLYVYIFFNYTISRLALYSLLND

SEQ ID NO: 3284928 - protein, 20 aa, Plasmodium falciparum
FINNIKFIFENKLFYNIMGY

SEQ ID NO: 3284929 - protein, 26 aa, Plasmodium falciparum
FINNLTALIMHFFFFSSPSKNEKKQK

SEQ ID NO: 3284930 - protein, 30 aa, Plasmodium falciparum
FINPIHINFIYNLITLIKYIIIYNYDKEIL

SEQ ID NO: 3284931 - protein, 39 aa, Plasmodium falciparum
FINQHFIHFFNILCRFLYYDEEWCIHFLFNNYNKGSKKS

SEQ ID NO: 3284932 - protein, 17 aa, Plasmodium falciparum
FINVKLKDNIYYIHLLI

SEQ ID NO: 3284933 - protein, 25 aa, Plasmodium falciparum
FINYDNYFLKLTRLIKNVLKKFEPK

SEQ ID NO: 3284934 - protein, 19 aa, Plasmodium falciparum
FINYEILYNNSLFKLIQDI

SEQ ID NO: 3284935 - protein, 17 aa, Plasmodium falciparum
FIQFVYSYSKKKVCTSS

SEQ ID NO: 3284936 - protein, 17 aa, Plasmodium falciparum
FIQIKDKIMIKHKTTNI

SEQ ID NO: 3284937 - protein, 18 aa, Plasmodium falciparum
FIQLILKKKIKELEQQNI

SEQ ID NO: 3284938 - protein, 24 aa, Plasmodium falciparum
FIQNTAELLLFKNLPRNCTCCKIT

SEQ ID NO: 3284939 - protein, 17 aa, Plasmodium falciparum
FIQSIVLNLYKKTDSYL

SEQ ID NO: 3284940 - protein, 30 aa, Plasmodium falciparum
FIRTAAAETFLSWQYYKIKNGADAKQLDNG

SEQ ID NO: 3284941 - protein, 18 aa, Plasmodium falciparum
FIRYILPLYEKNIDKKFL

SEQ ID NO: 3284942 - protein, 18 aa, Plasmodium falciparum
FISCMLFKLNRIFGNHYK

SEQ ID NO: 3284943 - protein, 27 aa, Plasmodium falciparum
FISELKSFFFSILEKIRSSKLLLRFIV

SEQ ID NO: 3284944 - protein, 20 aa, Plasmodium falciparum
FISEPFFSIKSKYLEKILLQ

SEQ ID NO: 3284945 - protein, 24 aa, Plasmodium falciparum
FISKYILCESLYNVVRRFFNFQNR

SEQ ID NO: 3284946 - protein, 17 aa, Plasmodium falciparum
FISMNFLICYSIFIVSI

SEQ ID NO: 3284947 - protein, 26 aa, Plasmodium falciparum
FISQPEFLIIIFYISFYEHENNNYLT

SEQ ID NO: 3284948 - protein, 27 aa, Plasmodium falciparum
FISRKIKFFIQILFSLSPNTYANIYIT

SEQ ID NO: 3284949 - protein, 28 aa, Plasmodium falciparum
FISRNILLPDLFYKKFGFLSSQILSYFH

SEQ ID NO: 3284950 - protein, 33 aa, Plasmodium falciparum
FISSQISNDIKMFWFFMLNEIRPDLVPVDLDHK

SEQ ID NO: 3284951 - protein, 22 aa, Plasmodium falciparum
FISYEKYFAGFFTILVQTNPRD

SEQ ID NO: 3284952 - protein, 19 aa, Plasmodium falciparum
FITNLISKLQEKISECTSQ

SEQ ID NO: 3284953 - protein, 24 aa, Plasmodium falciparum
FITPPSIYFLTISTFIFILLSKNI

SEQ ID NO: 3284954 - protein, 25 aa, Plasmodium falciparum
FIVAKLHWLWWAYYLEFRGYNTFLQ

SEQ ID NO: 3284955 - protein, 18 aa, Plasmodium falciparum
FIVCLFDIAFFAVCVCIW

SEQ ID NO: 3284956 - protein, 27 aa, Plasmodium falciparum
FIVDNMFIFIYILKNIYVMLSSHMLTF

SEQ ID NO: 3284957 - protein, 17 aa, Plasmodium falciparum
FIVSIFITSWSIVGIYF

SEQ ID NO: 3284958 - protein, 19 aa, Plasmodium falciparum
FIYCCICGISVHYSCANIV

SEQ ID NO: 3284959 - protein, 28 aa, Plasmodium falciparum
FIYEDPLEIFSFFQGINWLPELKNRCTS

SEQ ID NO: 3284960 - protein, 27 aa, Plasmodium falciparum
FIYHNKNLLFYSYIYEHFLASFTSLAS

SEQ ID NO: 3284961 - protein, 17 aa, Plasmodium falciparum
FIYIKDNINININTNII

SEQ ID NO: 3284962 - protein, 30 aa, Plasmodium falciparum
FIYLNLKLKNMFTFFNPIKNNKFLFSYYTL

SEQ ID NO: 3284963 - protein, 19 aa, Plasmodium falciparum
FIYLRNFLKSMKLINFIKL

SEQ ID NO: 3284964 - protein, 18 aa, Plasmodium falciparum
FIYSAFTQNLYIDEIILQ

SEQ ID NO: 3284965 - protein, 19 aa, Plasmodium falciparum
FIYTLIGYKRIMVNFFILY

SEQ ID NO: 3284966 - protein, 24 aa, Plasmodium falciparum
FKDIRLFIKIFLRYYKKEQETFNL

SEQ ID NO: 3284967 - protein, 17 aa, Plasmodium falciparum
FKDSYLFKSVRDQNWEC

SEQ ID NO: 3284968 - protein, 23 aa, Plasmodium falciparum
FKDVFHHVIWMGDFNFRVHGIHI

SEQ ID NO: 3284969 - protein, 28 aa, Plasmodium falciparum
FKEIMNPFFIFQIFAMIVWSLDNYIEYT

SEQ ID NO: 3284970 - protein, 47 aa, Plasmodium falciparum
FKEQYVYIKLYINKKTFNLSLLLRIILLIIMILKFSLLYNKKNVVMY

SEQ ID NO: 3284971 - protein, 19 aa, Plasmodium falciparum
FKEYITNYIFQKIFVSIKY

SEQ ID NO: 3284972 - protein, 18 aa, Plasmodium falciparum
FKGSLARMALCIPASAVS

SEQ ID NO: 3284973 - protein, 23 aa, Plasmodium falciparum
FKHDKMYFYLGSIYELISLCIHH

SEQ ID NO: 3284974 - protein, 25 aa, Plasmodium falciparum
FKHSLWHIMLLLALTTYHTQIPDKN

SEQ ID NO: 3284975 - protein, 19 aa, Plasmodium falciparum
FKIEGFPTLLYFKNGKMYD

SEQ ID NO: 3284976 - protein, 28 aa, Plasmodium falciparum
FKIENMAKPFFLYKYGHSPLSFSECKYK

SEQ ID NO: 3284977 - protein, 29 aa, Plasmodium falciparum
FKIGQKWNYKYIYKIGKNLYIPPRRQHMC

SEQ ID NO: 3284978 - protein, 19 aa, Plasmodium falciparum
FKILYMGISVYLIIRFSVL

SEQ ID NO: 3284979 - protein, 31 aa, Plasmodium falciparum
FKINCNIYYIALYLLCILKKKDVFHLYTLLK

SEQ ID NO: 3284980 - protein, 25 aa, Plasmodium falciparum
FKIQNYFFLEDILTYYLNNLKEVKY

SEQ ID NO: 3284981 - protein, 25 aa, Plasmodium falciparum
FKIRDLFIYYIKLKSDIYSEYSFLG

SEQ ID NO: 3284982 - protein, 25 aa, Plasmodium falciparum
FKIRTKIIFYKLKKVNQIKNAPQLY

SEQ ID NO: 3284983 - protein, 20 aa, Plasmodium falciparum
FKIYSDLFILFGEKKKIEMM

SEQ ID NO: 3284984 - protein, 36 aa, Plasmodium falciparum
FKIYSNHMYFYKIFFYLLSFLNFYLEDMIKDGSLLY

SEQ ID NO: 3284985 - protein, 24 aa, Plasmodium falciparum
FKKDPSFIPVLYIYHNDDEFRFTF

SEQ ID NO: 3284986 - protein, 35 aa, Plasmodium falciparum
FKKFLELFDFLYMDDRLKYFLNIDLRKNLENSRNI

SEQ ID NO: 3284987 - protein, 18 aa, Plasmodium falciparum
FKKKIFLCNNLDQLIKAH

SEQ ID NO: 3284988 - protein, 20 aa, Plasmodium falciparum
FKKKYIALKIIRKIIKKYKN

SEQ ID NO: 3284989 - protein, 25 aa, Plasmodium falciparum
FKKQVFFSIYALWEILEHIVMPAVD

SEQ ID NO: 3284990 - protein, 17 aa, Plasmodium falciparum
FKLINWAPMVTPTIYNQ

SEQ ID NO: 3284991 - protein, 19 aa, Plasmodium falciparum
FKLNYYAFYVKKEKFYTFL

SEQ ID NO: 3284992 - protein, 19 aa, Plasmodium falciparum
FKLQNLFENAFIYPSYGLN

SEQ ID NO: 3284993 - protein, 20 aa, Plasmodium falciparum
FKNELFTHIPFLIKQYKQYI

SEQ ID NO: 3284994 - protein, 21 aa, Plasmodium falciparum
FKNIFFGKRKENISFWLDSNN

SEQ ID NO: 3284995 - protein, 24 aa, Plasmodium falciparum
FKNIFLRVCVINLSIFSFTLYNYL

SEQ ID NO: 3284996 - protein, 21 aa, Plasmodium falciparum
FKNIINLIIHEMKKINKKIKN

SEQ ID NO: 3284997 - protein, 22 aa, Plasmodium falciparum
FKNINLYFQLTNVIKKVSINKL

SEQ ID NO: 3284998 - protein, 43 aa, Plasmodium falciparum
FKNIYRPYGLLRIMPKYLFIPFIRELAYLNLLYVISEYVIKNQ

SEQ ID NO: 3284999 - protein, 19 aa, Plasmodium falciparum
FKNKLLRRLIVPNIHLDNV

SEQ ID NO: 3285000 - protein, 33 aa, Plasmodium falciparum
FKNNINDIFLFLKILKKFLLFYDTILITRKELI

SEQ ID NO: 3285001 - protein, 23 aa, Plasmodium falciparum
FKNRSYYILNYILNINLSDEKNV

SEQ ID NO: 3285002 - protein, 38 aa, Plasmodium falciparum
FKRKRSIFIVLTVSICFMFALMLFYFTRNENNKTLFTN

SEQ ID NO: 3285003 - protein, 21 aa, Plasmodium falciparum
FKRQMFYTFADYRDICLGKDI

SEQ ID NO: 3285004 - protein, 21 aa, Plasmodium falciparum
FKRQMFYTFGDFRDLCLGNDI

SEQ ID NO: 3285005 - protein, 21 aa, Plasmodium falciparum
FKRQMYYTFADYRDIFFGTDI

SEQ ID NO: 3285006 - protein, 27 aa, Plasmodium falciparum
FKSIDMYIYIICYYFMKRSNIQELLIN

SEQ ID NO: 3285007 - protein, 17 aa, Plasmodium falciparum
FKSIPTVGFSKDGDRLQ

SEQ ID NO: 3285008 - protein, 25 aa, Plasmodium falciparum
FKSNKINFILSYKYNFIVYLNVDKV

SEQ ID NO: 3285009 - protein, 25 aa, Plasmodium falciparum
FKSPYYVYVYIHMLIIQTSILLIVR

SEQ ID NO: 3285010 - protein, 25 aa, Plasmodium falciparum
FKTALLLMVALFLKGVNFALDLKAY

SEQ ID NO: 3285011 - protein, 29 aa, Plasmodium falciparum
FKTIKELKNVWWILNRNKVWESMRCGIDE

SEQ ID NO: 3285012 - protein, 25 aa, Plasmodium falciparum
FKTKSFFFKYINNLIIYLCIDYKDS

SEQ ID NO: 3285013 - protein, 23 aa, Plasmodium falciparum
FKTKYLYEYIGNSGKLVITPLTD

SEQ ID NO: 3285014 - protein, 22 aa, Plasmodium falciparum
FKTYELILIQIFFTYFEIKYNE

SEQ ID NO: 3285015 - protein, 38 aa, Plasmodium falciparum
FKVLKNFDFLIYNLRILPDRRFLLISGEKKVLVLDIWA

SEQ ID NO: 3285016 - protein, 20 aa, Plasmodium falciparum
FKYINYSNILLLKYKGDIYD

SEQ ID NO: 3285017 - protein, 18 aa, Plasmodium falciparum
FKYLISSIFQYFFFLNNN

SEQ ID NO: 3285018 - protein, 34 aa, Plasmodium falciparum
FKYNRNFCFFFLKFVLYYYYILISFFLYTSYFTS

SEQ ID NO: 3285019 - protein, 26 aa, Plasmodium falciparum
FKYTKIRIFFNILKLIIEKKINEILI

SEQ ID NO: 3285020 - protein, 20 aa, Plasmodium falciparum
FKYYLYEKYISYKNKCILNK

SEQ ID NO: 3285021 - protein, 20 aa, Plasmodium falciparum
FLAFNKLYLLYCYDKLLDYN

SEQ ID NO: 3285022 - protein, 29 aa, Plasmodium falciparum
FLAITLLRFGLFCPLLLSITILIRIILML

SEQ ID NO: 3285023 - protein, 18 aa, Plasmodium falciparum
FLCDKGLLAWFNISLSEA

SEQ ID NO: 3285024 - protein, 19 aa, Plasmodium falciparum
FLCILFCNDIIITKVKRLK

SEQ ID NO: 3285025 - protein, 19 aa, Plasmodium falciparum
FLCNILFNKRNKIINKIEN

SEQ ID NO: 3285026 - protein, 18 aa, Plasmodium falciparum
FLCYNLIVYIYCVSKNAY

SEQ ID NO: 3285027 - protein, 26 aa, Plasmodium falciparum
FLDDKQYYYFYINTLTFITLNKQICI

SEQ ID NO: 3285028 - protein, 29 aa, Plasmodium falciparum
FLDNYFISFFLFYFLKYKVTKNYNDIYAS

SEQ ID NO: 3285029 - protein, 18 aa, Plasmodium falciparum
FLDTIFKFDNSSFFLFNM

SEQ ID NO: 3285030 - protein, 18 aa, Plasmodium falciparum
FLEFCLNLSFSYLHSLTY

SEQ ID NO: 3285031 - protein, 17 aa, Plasmodium falciparum
FLEFKKPFCILNNYNIT

SEQ ID NO: 3285032 - protein, 19 aa, Plasmodium falciparum
FLEKNEILGFLSFSKKFPK

SEQ ID NO: 3285033 - protein, 31 aa, Plasmodium falciparum
FLELCENMIKPKCLTLLQACTFIISGIIPCL

SEQ ID NO: 3285034 - protein, 29 aa, Plasmodium falciparum
FLESYKLKKIIFSVFIKQLKKYVKGNILW

SEQ ID NO: 3285035 - protein, 20 aa, Plasmodium falciparum
FLEYASTMFLLYIFKNINIY

SEQ ID NO: 3285036 - protein, 18 aa, Plasmodium falciparum
FLFALPLNILVHNKRNHM

SEQ ID NO: 3285037 - protein, 18 aa, Plasmodium falciparum
FLFFFLQHKNTFNQIFEI

SEQ ID NO: 3285038 - protein, 20 aa, Plasmodium falciparum
FLFHNINCSYFIKLMDIYLI

SEQ ID NO: 3285039 - protein, 20 aa, Plasmodium falciparum
FLFIIYLSFHLIYTKKNDNI

SEQ ID NO: 3285040 - protein, 19 aa, Plasmodium falciparum
FLFIMLMIGLLGCGNVCNE

SEQ ID NO: 3285041 - protein, 17 aa, Plasmodium falciparum
FLFIQFKEKKKLPHLLC

SEQ ID NO: 3285042 - protein, 17 aa, Plasmodium falciparum
FLFKVFPYIISTLLYAT

SEQ ID NO: 3285043 - protein, 23 aa, Plasmodium falciparum
FLFLFIVYGIFFSSRPILMINTI

SEQ ID NO: 3285044 - protein, 17 aa, Plasmodium falciparum
FLFLLSNNFIWAKQDDE

SEQ ID NO: 3285045 - protein, 19 aa, Plasmodium falciparum
FLFLNKRMLCVYYNIHNKY

SEQ ID NO: 3285046 - protein, 20 aa, Plasmodium falciparum
FLFLVNILNIYGTPLFYNKN

SEQ ID NO: 3285047 - protein, 17 aa, Plasmodium falciparum
FLFQIFFIDLYLFQYMD

SEQ ID NO: 3285048 - protein, 19 aa, Plasmodium falciparum
FLFSLMFNILLNVNKNHYN

SEQ ID NO: 3285049 - protein, 19 aa, Plasmodium falciparum
FLFSLPLNIILLSSQVYNQ

SEQ ID NO: 3285050 - protein, 18 aa, Plasmodium falciparum
FLFVCCFVSSVIGMNVVI

SEQ ID NO: 3285051 - protein, 17 aa, Plasmodium falciparum
FLFYHYLVDVAARRYAL

SEQ ID NO: 3285052 - protein, 17 aa, Plasmodium falciparum
FLGCLVPWMTAQERETK

SEQ ID NO: 3285053 - protein, 18 aa, Plasmodium falciparum
FLGLYFDILFKNKNKKRL

SEQ ID NO: 3285054 - protein, 17 aa, Plasmodium falciparum
FLGYLEYSCFYILEWLT

SEQ ID NO: 3285055 - protein, 20 aa, Plasmodium falciparum
FLHDKFLGIVKKFVQKNYPK

SEQ ID NO: 3285056 - protein, 17 aa, Plasmodium falciparum
FLHFCNNDRYVITNTNE

SEQ ID NO: 3285057 - protein, 18 aa, Plasmodium falciparum
FLHKLKGLSTIKYINYVH

SEQ ID NO: 3285058 - protein, 20 aa, Plasmodium falciparum
FLHKPNKCFLYLEGVEFYCK

SEQ ID NO: 3285059 - protein, 20 aa, Plasmodium falciparum
FLHNCLYIRIPKPDKILFNN

SEQ ID NO: 3285060 - protein, 20 aa, Plasmodium falciparum
FLHNWNYFFIERFFNPTSKY

SEQ ID NO: 3285061 - protein, 26 aa, Plasmodium falciparum
FLHSFNYIYHIIDTYSLISNIYVLDD

SEQ ID NO: 3285062 - protein, 27 aa, Plasmodium falciparum
FLICYINTLFLRRVLFCYSYNLSQHFS

SEQ ID NO: 3285063 - protein, 18 aa, Plasmodium falciparum
FLIFIFKHRIINIGFLYY

SEQ ID NO: 3285064 - protein, 21 aa, Plasmodium falciparum
FLIIFIQDILCLKYEDYIKSL

SEQ ID NO: 3285065 - protein, 17 aa, Plasmodium falciparum
FLIINNENFIIKDKKDF

SEQ ID NO: 3285066 - protein, 18 aa, Plasmodium falciparum
FLILLKNKKIQTKKSIKN

SEQ ID NO: 3285067 - protein, 25 aa, Plasmodium falciparum
FLINDLCILYKKKLIFASALGIYGQ

SEQ ID NO: 3285068 - protein, 26 aa, Plasmodium falciparum
FLIPLIFLYNVIRINESIIGRTLYNR

SEQ ID NO: 3285069 - protein, 17 aa, Plasmodium falciparum
FLISKDSGKLFFKSLKE

SEQ ID NO: 3285070 - protein, 18 aa, Plasmodium falciparum
FLIVDILYNYDYYYTLTK

SEQ ID NO: 3285071 - protein, 18 aa, Plasmodium falciparum
FLKFWGTFILMLTIFTCF

SEQ ID NO: 3285072 - protein, 19 aa, Plasmodium falciparum
FLKILFNYNSSIFSYIFLN

SEQ ID NO: 3285073 - protein, 35 aa, Plasmodium falciparum
FLKILIVIFLFYTKYYICFFFFVNNTKWCWHKLEG

SEQ ID NO: 3285074 - protein, 18 aa, Plasmodium falciparum
FLKKLLFEDIEYKDTEII

SEQ ID NO: 3285075 - protein, 31 aa, Plasmodium falciparum
FLKNEIYRNVIFLKYKYLKSYKTAIHNLKQE

SEQ ID NO: 3285076 - protein, 19 aa, Plasmodium falciparum
FLKNFAYISSLYDIHFYGG

SEQ ID NO: 3285077 - protein, 30 aa, Plasmodium falciparum
FLKPYEKKKIVLYLLVNKYGYHKIDFKILF

SEQ ID NO: 3285078 - protein, 26 aa, Plasmodium falciparum
FLKSVKHIIIYLKDDFVKYISFFYIK

SEQ ID NO: 3285079 - protein, 19 aa, Plasmodium falciparum
FLKTLILDFFIYVHNIYKQ

SEQ ID NO: 3285080 - protein, 25 aa, Plasmodium falciparum
FLKTTSFPLNLFLIDIGRGIDMKNF

SEQ ID NO: 3285081 - protein, 28 aa, Plasmodium falciparum
FLKYRRKKLEVILWIKIYMSVLEEQKNE

SEQ ID NO: 3285082 - protein, 17 aa, Plasmodium falciparum
FLLFFNEEFYNFNDYIN

SEQ ID NO: 3285083 - protein, 23 aa, Plasmodium falciparum
FLLFHLFVVNTRMRILCNLLIVI

SEQ ID NO: 3285084 - protein, 20 aa, Plasmodium falciparum
FLLFLYVNNTSAINNPQEEF

SEQ ID NO: 3285085 - protein, 18 aa, Plasmodium falciparum
FLLFNMKNCIRMFILFRD

SEQ ID NO: 3285086 - protein, 19 aa, Plasmodium falciparum
FLLFVSLRHFISLYKDYNK

SEQ ID NO: 3285087 - protein, 23 aa, Plasmodium falciparum
FLLICILLNKQWILLNKAESIFA

SEQ ID NO: 3285088 - protein, 20 aa, Plasmodium falciparum
FLLIITFIYIFTIDYILFIM

SEQ ID NO: 3285089 - protein, 20 aa, Plasmodium falciparum
FLLLLFFINLFFVKSNFKND

SEQ ID NO: 3285090 - protein, 28 aa, Plasmodium falciparum
FLLLSVPYFFLFLWNEDIKCQSLLPVSY

SEQ ID NO: 3285091 - protein, 17 aa, Plasmodium falciparum
FLLLVDIILLICLTYFL

SEQ ID NO: 3285092 - protein, 17 aa, Plasmodium falciparum
FLLSKKSIRLNNVVNNK

SEQ ID NO: 3285093 - protein, 20 aa, Plasmodium falciparum
FLLSVFIFDCYIHRINQLTN

SEQ ID NO: 3285094 - protein, 17 aa, Plasmodium falciparum
FLLTSYPLYFFKKRNKN

SEQ ID NO: 3285095 - protein, 20 aa, Plasmodium falciparum
FLLVLLLLNLSIKSKILNRN

SEQ ID NO: 3285096 - protein, 18 aa, Plasmodium falciparum
FLLVWKYQKKEYSNKKMN

SEQ ID NO: 3285097 - protein, 20 aa, Plasmodium falciparum
FLLYIFLNKYFISCVKKDPY

SEQ ID NO: 3285098 - protein, 37 aa, Plasmodium falciparum
FLMDSTYIFYFMFFDIISFMLLFFDIFLFEKYFFDFF

SEQ ID NO: 3285099 - protein, 52 aa, Plasmodium falciparum
FLMDSTYIFYFMFFDIISFMLLFFDIFLFEKYFFDFFIYFTNSLYTWKKIDK

SEQ ID NO: 3285100 - protein, 37 aa, Plasmodium falciparum
FLMSIQPPLFFTLICYFILFIFILIALNIYLPKHCEF

SEQ ID NO: 3285101 - protein, 18 aa, Plasmodium falciparum
FLNFKNLSIIKGKKRKEK

SEQ ID NO: 3285102 - protein, 18 aa, Plasmodium falciparum
FLNFLTINYVKELVNFVF

SEQ ID NO: 3285103 - protein, 17 aa, Plasmodium falciparum
FLNIIKSTKLNELYSIY

SEQ ID NO: 3285104 - protein, 19 aa, Plasmodium falciparum
FLNINSCIFNYMYYHVILK

SEQ ID NO: 3285105 - protein, 29 aa, Plasmodium falciparum
FLNIYNNIFHFFFFLPTNYFTLNNFVDKY

SEQ ID NO: 3285106 - protein, 17 aa, Plasmodium falciparum
FLNKLFFNYNQQYDDII

SEQ ID NO: 3285107 - protein, 17 aa, Plasmodium falciparum
FLNKYYPGIAPKFYGIL

SEQ ID NO: 3285108 - protein, 19 aa, Plasmodium falciparum
FLNLFYLCVSLLQIIPIFN

SEQ ID NO: 3285109 - protein, 17 aa, Plasmodium falciparum
FLNLLYNIFKKKVSINT

SEQ ID NO: 3285110 - protein, 18 aa, Plasmodium falciparum
FLNMPKEGLPFNRDGYYT

SEQ ID NO: 3285111 - protein, 40 aa, Plasmodium falciparum
FLNNDIILQFILFIINIGVTEFFLLKKNYKFLMKKKKLKI

SEQ ID NO: 3285112 - protein, 39 aa, Plasmodium falciparum
FLNNGFNFQFWYWESIVFLRKILVLLISTVPIFKNAKIF

SEQ ID NO: 3285113 - protein, 45 aa, Plasmodium falciparum
FLNNIIVQFHFYLLPFFLNLNYSNVFLNFFIKYWNTISSEKKDMS

SEQ ID NO: 3285114 - protein, 27 aa, Plasmodium falciparum
FLNNKIKYIINIIYIYCMTALNNFLIK

SEQ ID NO: 3285115 - protein, 36 aa, Plasmodium falciparum
FLNPQDIHFFPIPPIFFFMKILPSNCIFFPNNKYNS

SEQ ID NO: 3285116 - protein, 25 aa, Plasmodium falciparum
FLNTYLHKHLIDHLLFNVTHKESKK

SEQ ID NO: 3285117 - protein, 20 aa, Plasmodium falciparum
FLNYLVPYYIKLYEKKKNKE

SEQ ID NO: 3285118 - protein, 38 aa, Plasmodium falciparum
FLNYYYFFKKYYIYHILFLYIFFLRITYTYAEITISQF

SEQ ID NO: 3285119 - protein, 17 aa, Plasmodium falciparum
FLPISKEEKKKKGFFFF

SEQ ID NO: 3285120 - protein, 18 aa, Plasmodium falciparum
FLPKFSTFLFFTIPIFVM

SEQ ID NO: 3285121 - protein, 23 aa, Plasmodium falciparum
FLPLLSCMFIMYKIIKVNSEMSK

SEQ ID NO: 3285122 - protein, 24 aa, Plasmodium falciparum
FLPSINKLYFIKNKTYIIIKKEKN

SEQ ID NO: 3285123 - protein, 28 aa, Plasmodium falciparum
FLQTFYIYFFYFFWNYIQNLIIIKIFLT

SEQ ID NO: 3285124 - protein, 24 aa, Plasmodium falciparum
FLRIKHWITILKIQDIIIELNQHT

SEQ ID NO: 3285125 - protein, 21 aa, Plasmodium falciparum
FLRLIFSGVVIQKVQCQKCLF

SEQ ID NO: 3285126 - protein, 19 aa, Plasmodium falciparum
FLRTFENISLIGQGGFGSV

SEQ ID NO: 3285127 - protein, 32 aa, Plasmodium falciparum
FLSEYQSNFLGGGYSAALKLVNSKKSGTNVNT

SEQ ID NO: 3285128 - protein, 28 aa, Plasmodium falciparum
FLSHDINWYTFLFLFRLTSFEEISKKSV

SEQ ID NO: 3285129 - protein, 29 aa, Plasmodium falciparum
FLSHDINWYTFLFLFRLTSFKEIANKNVA

SEQ ID NO: 3285130 - protein, 29 aa, Plasmodium falciparum
FLSHDVNWYTFLFLFRITSFQKIAQKNVV

SEQ ID NO: 3285131 - protein, 17 aa, Plasmodium falciparum
FLSIIEGTVRTSCKMVL

SEQ ID NO: 3285132 - protein, 23 aa, Plasmodium falciparum
FLSLIIYVILFLKGKKIGDLYIT

SEQ ID NO: 3285133 - protein, 24 aa, Plasmodium falciparum
FLSNRYIKIMPFKNLNINFTSFYN

SEQ ID NO: 3285134 - protein, 39 aa, Plasmodium falciparum
FLSQGKSLIKFLIGIAIFLVVLIFIKSSHPALKEKKKKV

SEQ ID NO: 3285135 - protein, 18 aa, Plasmodium falciparum
FLSSFTIIILFWSQVYYA

SEQ ID NO: 3285136 - protein, 19 aa, Plasmodium falciparum
FLSSLLLLFTFLYYEIEKS

SEQ ID NO: 3285137 - protein, 24 aa, Plasmodium falciparum
FLSTQVNCYFLYDIGSRNKINKYM

SEQ ID NO: 3285138 - protein, 27 aa, Plasmodium falciparum
FLSTVHILYIYIIKNIFFHYISCYRKC

SEQ ID NO: 3285139 - protein, 18 aa, Plasmodium falciparum
FLSVFEYLLKIIKGYNRD

SEQ ID NO: 3285140 - protein, 17 aa, Plasmodium falciparum
FLSYVFHCVNICGSSVI

SEQ ID NO: 3285141 - protein, 31 aa, Plasmodium falciparum
FLTDANIFDSLYYYLLTNKSISYTVFQDSTY

SEQ ID NO: 3285142 - protein, 34 aa, Plasmodium falciparum
FLTEWFNDPLLTPKVFNISLLFNPNSFFSAIKQI

SEQ ID NO: 3285143 - protein, 24 aa, Plasmodium falciparum
FLTHFIIVIFLKRDKTILKYVCEL

SEQ ID NO: 3285144 - protein, 19 aa, Plasmodium falciparum
FLTIIYCLHSYLFKYNSSN

SEQ ID NO: 3285145 - protein, 19 aa, Plasmodium falciparum
FLTNLFSFIYEKLFHIIKV

SEQ ID NO: 3285146 - protein, 21 aa, Plasmodium falciparum
FLVIIIYSLSIYYCNDNILEN

SEQ ID NO: 3285147 - protein, 42 aa, Plasmodium falciparum
FLVMYNLPITHIFIKPLMLIIITFFIIILSFVMKYISFNFNT

SEQ ID NO: 3285148 - protein, 18 aa, Plasmodium falciparum
FLVPDIIQFYYYNDIYKK

SEQ ID NO: 3285149 - protein, 18 aa, Plasmodium falciparum
FLVSKRKVYTFGRKSFES

SEQ ID NO: 3285150 - protein, 17 aa, Plasmodium falciparum
FLYDSYLMNIIFLLFKS

SEQ ID NO: 3285151 - protein, 21 aa, Plasmodium falciparum
FLYFPILLQKYEILTTLFILF

SEQ ID NO: 3285152 - protein, 25 aa, Plasmodium falciparum
FLYLFYLTYIFKVVIIYCDSSFNRK

SEQ ID NO: 3285153 - protein, 17 aa, Plasmodium falciparum
FLYLIFSIVIILPVFFL

SEQ ID NO: 3285154 - protein, 36 aa, Plasmodium falciparum
FLYMSFICLLIRCLILFYICRIIRKKYSVLRTCNVR

SEQ ID NO: 3285155 - protein, 17 aa, Plasmodium falciparum
FLYNFPCFSCNLFNKCN

SEQ ID NO: 3285156 - protein, 18 aa, Plasmodium falciparum
FLYSFYENSLQKIRATND

SEQ ID NO: 3285157 - protein, 17 aa, Plasmodium falciparum
FLYSIYIYIIIIISRFH

SEQ ID NO: 3285158 - protein, 25 aa, Plasmodium falciparum
FMCIEGIVVGFFTLVDNIKPEVFEL

SEQ ID NO: 3285159 - protein, 18 aa, Plasmodium falciparum
FMDKFEILKLLDSIGIYT

SEQ ID NO: 3285160 - protein, 24 aa, Plasmodium falciparum
FMDNLTNLLYFNNYYLLTYKKNNF

SEQ ID NO: 3285161 - protein, 26 aa, Plasmodium falciparum
FMDNYKYMWTYIYFLQKRIMMKKLSH

SEQ ID NO: 3285162 - protein, 31 aa, Plasmodium falciparum
FMDVHDILSKRFYYYYIYNDTFKELKNDVLL

SEQ ID NO: 3285163 - protein, 17 aa, Plasmodium falciparum
FMFGLIICVFQYSFFNS

SEQ ID NO: 3285164 - protein, 17 aa, Plasmodium falciparum
FMFHFFIHEYSDFVKKG

SEQ ID NO: 3285165 - protein, 18 aa, Plasmodium falciparum
FMFLPKKHILSYCRKDVL

SEQ ID NO: 3285166 - protein, 23 aa, Plasmodium falciparum
FMIFSIILIFIYNYFYTKYDSYY

SEQ ID NO: 3285167 - protein, 25 aa, Plasmodium falciparum
FMKFKKYYNILYYDFYKKLKNKFEK

SEQ ID NO: 3285168 - protein, 17 aa, Plasmodium falciparum
FMKPFHNNIENTNDFKS

SEQ ID NO: 3285169 - protein, 19 aa, Plasmodium falciparum
FMKWYNYWVKTVLFNYYKS

SEQ ID NO: 3285170 - protein, 27 aa, Plasmodium falciparum
FMNKFEASCPIHLLTKLRLLSDERIYS

SEQ ID NO: 3285171 - protein, 17 aa, Plasmodium falciparum
FMRLPYYDMWSIGIVFL

SEQ ID NO: 3285172 - protein, 17 aa, Plasmodium falciparum
FMSFVNLIFVILTSFFL

SEQ ID NO: 3285173 - protein, 17 aa, Plasmodium falciparum
FMSKLYTCMIYCCYILI

SEQ ID NO: 3285174 - protein, 17 aa, Plasmodium falciparum
FMVLNMIFFLLSTYLNY

SEQ ID NO: 3285175 - protein, 19 aa, Plasmodium falciparum
FMYIFVLRILVFFHKINAE

SEQ ID NO: 3285176 - protein, 18 aa, Plasmodium falciparum
FMYILYFLRDIVIMITIF

SEQ ID NO: 3285177 - protein, 17 aa, Plasmodium falciparum
FMYLKEYTNIIFKYMKF

SEQ ID NO: 3285178 - protein, 17 aa, Plasmodium falciparum
FMYSIGFNDIYKPFWNS

SEQ ID NO: 3285179 - protein, 19 aa, Plasmodium falciparum
FNCIRMVFILIKHVIIKIY

SEQ ID NO: 3285180 - protein, 26 aa, Plasmodium falciparum
FNCKKYYIFILNYYNGLLQLAIYIYQ

SEQ ID NO: 3285181 - protein, 18 aa, Plasmodium falciparum
FNDEYKYQISDEKTYFFI

SEQ ID NO: 3285182 - protein, 32 aa, Plasmodium falciparum
FNDLIKMRIYFLLLYKIKFVRKIKSYLFKKHF

SEQ ID NO: 3285183 - protein, 20 aa, Plasmodium falciparum
FNEFFPYRGIKGSYGFIAPE

SEQ ID NO: 3285184 - protein, 40 aa, Plasmodium falciparum
FNEFHIYDLLFQIIKPFNVFLNIIKILTIRYILHEHLQNC

SEQ ID NO: 3285185 - protein, 25 aa, Plasmodium falciparum
FNEHIQYCILWKSIQTYFNTLHINY

SEQ ID NO: 3285186 - protein, 28 aa, Plasmodium falciparum
FNEKNYYFYISLINRLLLINKNLGTVII

SEQ ID NO: 3285187 - protein, 18 aa, Plasmodium falciparum
FNELILTGILLLVILVVV

SEQ ID NO: 3285188 - protein, 26 aa, Plasmodium falciparum
FNELNILAIFIFYYQNRCLWDEQYIN

SEQ ID NO: 3285189 - protein, 24 aa, Plasmodium falciparum
FNENYIYRHYIQFIWDALICNKHI

SEQ ID NO: 3285190 - protein, 18 aa, Plasmodium falciparum
FNFEKCISYFSPEWGYYI

SEQ ID NO: 3285191 - protein, 20 aa, Plasmodium falciparum
FNFFFFMFVMGINNSCIYIL

SEQ ID NO: 3285192 - protein, 26 aa, Plasmodium falciparum
FNFFHNAFLIYVSSFIFSFLDIQIAI

SEQ ID NO: 3285193 - protein, 25 aa, Plasmodium falciparum
FNFINKELFSFVYNLPFFKNLNEDI

SEQ ID NO: 3285194 - protein, 25 aa, Plasmodium falciparum
FNFLKYALRSIFIYNLNKQKFNNCF

SEQ ID NO: 3285195 - protein, 22 aa, Plasmodium falciparum
FNFPLDELVLQDIFLNLKGQEE

SEQ ID NO: 3285196 - protein, 21 aa, Plasmodium falciparum
FNGFLFSKMARYKYFHKCLIR

SEQ ID NO: 3285197 - protein, 31 aa, Plasmodium falciparum
FNGYFYVQQYIIFFFLIYSTSHKKFFIYLVE

SEQ ID NO: 3285198 - protein, 17 aa, Plasmodium falciparum
FNHFNEILLMNLNKEYK

SEQ ID NO: 3285199 - protein, 25 aa, Plasmodium falciparum
FNHFRWPLLVDIQNIGLQWLKKSFT

SEQ ID NO: 3285200 - protein, 27 aa, Plasmodium falciparum
FNHIITDLYRFYRTLIKKYKVSGNFAF

SEQ ID NO: 3285201 - protein, 25 aa, Plasmodium falciparum
FNHNYNYTYLFWKNLSNKNINIILV

SEQ ID NO: 3285202 - protein, 28 aa, Plasmodium falciparum
FNHQDVKIIILYYFIENISKKIKTLKND

SEQ ID NO: 3285203 - protein, 24 aa, Plasmodium falciparum
FNILIVCYLFIYIGSFSICHDIKT

SEQ ID NO: 3285204 - protein, 20 aa, Plasmodium falciparum
FNIMYLYYILDKVSLNDKQK

SEQ ID NO: 3285205 - protein, 20 aa, Plasmodium falciparum
FNINYYLYVYLYEYKNNNTR

SEQ ID NO: 3285206 - protein, 26 aa, Plasmodium falciparum
FNIQSFVSVLIFSLLVIFVSGDKIFI

SEQ ID NO: 3285207 - protein, 26 aa, Plasmodium falciparum
FNISNFYFFNKLLLNILYFFYQNNMG

SEQ ID NO: 3285208 - protein, 25 aa, Plasmodium falciparum
FNITNKLLYMILDNFFYKNHMIGEK

SEQ ID NO: 3285209 - protein, 18 aa, Plasmodium falciparum
FNIYIYLKLLNDRSYNNI

SEQ ID NO: 3285210 - protein, 21 aa, Plasmodium falciparum
FNKILYKNFKSIKKQFTMFHR

SEQ ID NO: 3285211 - protein, 20 aa, Plasmodium falciparum
FNKIMKYNISSIWLNKSQIY

SEQ ID NO: 3285212 - protein, 32 aa, Plasmodium falciparum
FNKTAKSILFIIFIMGIVMLIITYICRNPKFK

SEQ ID NO: 3285213 - protein, 20 aa, Plasmodium falciparum
FNKYCLYGYLSSKVLKLLSS

SEQ ID NO: 3285214 - protein, 27 aa, Plasmodium falciparum
FNLDKNGMFLLFQMSLSNCFYIMNNIF

SEQ ID NO: 3285215 - protein, 54 aa, Plasmodium falciparum
FNLIFDIHLLYISLCFYYIYLLNDDIYYLQFSLLLFLMLFTHFKNKEIIHFIYF

SEQ ID NO: 3285216 - protein, 25 aa, Plasmodium falciparum
FNLLILACRLLWRRTLTKIKEEGKK

SEQ ID NO: 3285217 - protein, 17 aa, Plasmodium falciparum
FNLLIYPMSLYKNQHQC

SEQ ID NO: 3285218 - protein, 18 aa, Plasmodium falciparum
FNLNNFICDFCKYNIKHN

SEQ ID NO: 3285219 - protein, 28 aa, Plasmodium falciparum
FNLRESIFILCFFYLYNFLSFEILNKFI

SEQ ID NO: 3285220 - protein, 25 aa, Plasmodium falciparum
FNLTIDLIYVILSGDDNYFLRVIKN

SEQ ID NO: 3285221 - protein, 18 aa, Plasmodium falciparum
FNMFSYFQKIKVSEQELL

SEQ ID NO: 3285222 - protein, 23 aa, Plasmodium falciparum
FNMKKIYFLKRTSIKNFHFNHFN

SEQ ID NO: 3285223 - protein, 18 aa, Plasmodium falciparum
FNMTYEHIIKLLKYLQPI

SEQ ID NO: 3285224 - protein, 24 aa, Plasmodium falciparum
FNNEIYVFILYEKKLLFFNHNMEF

SEQ ID NO: 3285225 - protein, 18 aa, Plasmodium falciparum
FNNIKRIIIIKKKKKKNL

SEQ ID NO: 3285226 - protein, 18 aa, Plasmodium falciparum
FNNIYFLCKYSSGYLPLE

SEQ ID NO: 3285227 - protein, 25 aa, Plasmodium falciparum
FNNKDVMFYLKRIYFPYIMYEHDDN

SEQ ID NO: 3285228 - protein, 29 aa, Plasmodium falciparum
FNNKKNYFPNYIILNNLNILITDLNELYD

SEQ ID NO: 3285229 - protein, 27 aa, Plasmodium falciparum
FNNNIYLVPLNYLFINIKKLLKQCIQE

SEQ ID NO: 3285230 - protein, 32 aa, Plasmodium falciparum
FNNTFELFCLFVFVTWALFLNNNGILYPVHCL

SEQ ID NO: 3285231 - protein, 19 aa, Plasmodium falciparum
FNNTFICILKYMTKYDLLH

SEQ ID NO: 3285232 - protein, 25 aa, Plasmodium falciparum
FNNVKALFYFSFFNFINHKDSMIIF

SEQ ID NO: 3285233 - protein, 19 aa, Plasmodium falciparum
FNNVLLEDWWKEHGPEIWE

SEQ ID NO: 3285234 - protein, 22 aa, Plasmodium falciparum
FNNYCLVTYKKKQILLKCNIYD

SEQ ID NO: 3285235 - protein, 24 aa, Plasmodium falciparum
FNPTIRYLFLLKNLMNIFYKYFSI

SEQ ID NO: 3285236 - protein, 20 aa, Plasmodium falciparum
FNQNVLIEEILSKKYRTFSI

SEQ ID NO: 3285237 - protein, 25 aa, Plasmodium falciparum
FNQRPYFRLLHCLLIDINEQCIYSN

SEQ ID NO: 3285238 - protein, 20 aa, Plasmodium falciparum
FNRDILEKTIPFGVALALGS

SEQ ID NO: 3285239 - protein, 23 aa, Plasmodium falciparum
FNREIKFSSLFYNLPCAINYIHK

SEQ ID NO: 3285240 - protein, 20 aa, Plasmodium falciparum
FNRKKYLKKIKKKKLNYFPG

SEQ ID NO: 3285241 - protein, 18 aa, Plasmodium falciparum
FNRRFFIQLLFYGLVCLF

SEQ ID NO: 3285242 - protein, 28 aa, Plasmodium falciparum
FNSENIYILLFFVYYVNKQIDDLLTYNI

SEQ ID NO: 3285243 - protein, 25 aa, Plasmodium falciparum
FNSIILFLAGFLLTVLFISILAVQE

SEQ ID NO: 3285244 - protein, 19 aa, Plasmodium falciparum
FNSISLRGLLLYQNKLYIA

SEQ ID NO: 3285245 - protein, 38 aa, Plasmodium falciparum
FNSYIKEEKFWNLLKKIKIKKRKILYYKDKYFNKMNSK

SEQ ID NO: 3285246 - protein, 33 aa, Plasmodium falciparum
FNTHKNDMLWFLLRIFLLLKLPVHCLALILYCK

SEQ ID NO: 3285247 - protein, 28 aa, Plasmodium falciparum
FNTLLKKLPMYINYFFHNLYVYIEYEDM

SEQ ID NO: 3285248 - protein, 17 aa, Plasmodium falciparum
FNTMGMIARFVLNPPPF

SEQ ID NO: 3285249 - protein, 20 aa, Plasmodium falciparum
FNVLKSLYLPILDKLINVNE

SEQ ID NO: 3285250 - protein, 25 aa, Plasmodium falciparum
FNVSPVLLFLILPINLQYNSVPKEE

SEQ ID NO: 3285251 - protein, 17 aa, Plasmodium falciparum
FNYIQNVMLFRQLGISA

SEQ ID NO: 3285252 - protein, 20 aa, Plasmodium falciparum
FNYKYVFPFFFNSTNKIIKN

SEQ ID NO: 3285253 - protein, 28 aa, Plasmodium falciparum
FNYTFRYSKIIKLLYLNKKGKRLIYGDN

SEQ ID NO: 3285254 - protein, 26 aa, Plasmodium falciparum
FNYVSFDFLNYLLSNTLIFISDYFFI

SEQ ID NO: 3285255 - protein, 24 aa, Plasmodium falciparum
FNYYKYPHYAVIKNDLWKNIKNIK

SEQ ID NO: 3285256 - protein, 22 aa, Plasmodium falciparum
FPCNNKLFNYKFFKPVEGFEEY

SEQ ID NO: 3285257 - protein, 19 aa, Plasmodium falciparum
FPFILDRNINKKLNIAFVG

SEQ ID NO: 3285258 - protein, 25 aa, Plasmodium falciparum
FPFNIHDFKKYSINIYFLVYDNILS

SEQ ID NO: 3285259 - protein, 33 aa, Plasmodium falciparum
FPGYKDKIWLKLPYHFRLYLIKSWNKNFEKNMF

SEQ ID NO: 3285260 - protein, 32 aa, Plasmodium falciparum; identical to SEQ ID NO: 3259356

SEQ ID NO: 3285261 - protein, 25 aa, Plasmodium falciparum
FPKNCIRLLFSNLLAYDLTSFNSLN

SEQ ID NO: 3285262 - protein, 27 aa, Plasmodium falciparum
FPLDNFIIIYDFLYNILIHYFNDNKKI

SEQ ID NO: 3285263 - protein, 25 aa, Plasmodium falciparum
FPLEALQILFLNLMTDGCPAVALSR

SEQ ID NO: 3285264 - protein, 31 aa, Plasmodium falciparum
FPLVYDNHLLFFYLIFYFNNIMRNHFVLLFI

SEQ ID NO: 3285265 - protein, 22 aa, Plasmodium falciparum
FPMAFLFQIFFIDLYLFQYMDD

SEQ ID NO: 3285266 - protein, 19 aa, Plasmodium falciparum
FPMFIYDEIKKIWFYLLEK

SEQ ID NO: 3285267 - protein, 19 aa, Plasmodium falciparum
FPNLYKYTKLIKKKELKEM

SEQ ID NO: 3285268 - protein, 20 aa, Plasmodium falciparum
FPNRTFFYKQKKRKYIFFTS

SEQ ID NO: 3285269 - protein, 25 aa, Plasmodium falciparum
FPNSFILLCLFFMTCLPFIIPKHKL

SEQ ID NO: 3285270 - protein, 33 aa, Plasmodium falciparum
FPQLYILEPSKFDKISFLLYDKLFDEEKRLKLF

SEQ ID NO: 3285271 - protein, 26 aa, Plasmodium falciparum
FPQNFKILLFDFYYMTNGELYIAIFS

SEQ ID NO: 3285272 - protein, 30 aa, Plasmodium falciparum
FPRTIIYNFFLMVFIVLCKLLLNVFIGELR

SEQ ID NO: 3285273 - protein, 23 aa, Plasmodium falciparum
FPSFDYFRNKYLPNNSIDFTINN

SEQ ID NO: 3285274 - protein, 25 aa, Plasmodium falciparum
FPSILYFIFVLFYQLIYYNDHRILL

SEQ ID NO: 3285275 - protein, 31 aa, Plasmodium falciparum
FPSRTKYNWIIHLIFIFLNSSSIILVGSAKP

SEQ ID NO: 3285276 - protein, 20 aa, Plasmodium falciparum
FPVIVISISLLLSYYLGLKS

SEQ ID NO: 3285277 - protein, 20 aa, Plasmodium falciparum
FPVPTFILGDPFMRKYFTVF

SEQ ID NO: 3285278 - protein, 24 aa, Plasmodium falciparum
FQCTDLDCKWLKPKHIKYPYEGYD

SEQ ID NO: 3285279 - protein, 18 aa, Plasmodium falciparum
FQCYKLLEYSLKKDIHMT

SEQ ID NO: 3285280 - protein, 25 aa, Plasmodium falciparum
FQDIDVVPYYLINLTKYNIKLRQVG

SEQ ID NO: 3285281 - protein, 26 aa, Plasmodium falciparum
FQEKLLKLLLFPIVVMRLCFLSLTLI

SEQ ID NO: 3285282 - protein, 18 aa, Plasmodium falciparum
FQELFLSSFFFVYISTDD

SEQ ID NO: 3285283 - protein, 36 aa, Plasmodium falciparum
FQELFYKFIIALLSLFYFIKLIHIPSSFLKGKEDPE

SEQ ID NO: 3285284 - protein, 20 aa, Plasmodium falciparum
FQFKISTYIGFIYTSPKLSD

SEQ ID NO: 3285285 - protein, 17 aa, Plasmodium falciparum
FQFLKNKIYNIFYNCLS

SEQ ID NO: 3285286 - protein, 17 aa, Plasmodium falciparum
FQFNAYNILLNCKEKNS

SEQ ID NO: 3285287 - protein, 29 aa, Plasmodium falciparum
FQHVEEPFCILLFYKKKLFVSKKINIYHN

SEQ ID NO: 3285288 - protein, 32 aa, Plasmodium falciparum
FQIAFFNHFIPCYIFFIHNKFNLYPNYQLNII

SEQ ID NO: 3285289 - protein, 24 aa, Plasmodium falciparum
FQIEKFINIFFNLRNRFLPFSYNV

SEQ ID NO: 3285290 - protein, 32 aa, Plasmodium falciparum
FQIIPIIIEFILYLYILTYKIHYTVSLVTCFN

SEQ ID NO: 3285291 - protein, 25 aa, Plasmodium falciparum
FQKEPKFITCIFWMTFKSLSVFFKP

SEQ ID NO: 3285292 - protein, 28 aa, Plasmodium falciparum
FQKFKNSSWFFCIDIFRQHTNRIFNQRG

SEQ ID NO: 3285293 - protein, 17 aa, Plasmodium falciparum
FQKIKFLHNYYKPSLYI

SEQ ID NO: 3285294 - protein, 18 aa, Plasmodium falciparum
FQKIPKYCLPFNINCLFN

SEQ ID NO: 3285295 - protein, 19 aa, Plasmodium falciparum
FQKKKWLLKKSLDNLLDYN

SEQ ID NO: 3285296 - protein, 27 aa, Plasmodium falciparum
FQKKTKNLFIIFKKKFKNLNSFISSKK

SEQ ID NO: 3285297 - protein, 25 aa, Plasmodium falciparum
FQKNKMNYIHLDKIKMDKKTKCKPM

SEQ ID NO: 3285298 - protein, 22 aa, Plasmodium falciparum
FQKYIIKVKLPSTIYHFYHLMT

SEQ ID NO: 3285299 - protein, 25 aa, Plasmodium falciparum
FQLNDYFLDVFLRFIQYKQHNNNTF

SEQ ID NO: 3285300 - protein, 23 aa, Plasmodium falciparum
FQNMLFLLINIIYICIFCFLKNY

SEQ ID NO: 3285301 - protein, 31 aa, Plasmodium falciparum
FQNQQLNNLFNFDYFFACGDFNFRINKNLEE

SEQ ID NO: 3285302 - protein, 30 aa, Plasmodium falciparum
FQNYNVHHLLLFSFYYGFSDLIRTRRPYVN

SEQ ID NO: 3285303 - protein, 24 aa, Plasmodium falciparum
FQSNIKSFFLKKVSKDLLGSFNSA

SEQ ID NO: 3285304 - protein, 25 aa, Plasmodium falciparum
FQTKGFNFFRIVSNIYYREGMRSFF

SEQ ID NO: 3285305 - protein, 28 aa, Plasmodium falciparum
FQYNLELFLISRKLLRYLFINLNKLKRR

SEQ ID NO: 3285306 - protein, 35 aa, Plasmodium falciparum
FRASFIFIDTWALMVGFPIIRNYRAFREQFNWLSK

SEQ ID NO: 3285307 - protein, 19 aa, Plasmodium falciparum
FRCENDIIKLLFDETLFNN

SEQ ID NO: 3285308 - protein, 26 aa, Plasmodium falciparum
FRCISYVIHILIFMNKYKYAERIVKS

SEQ ID NO: 3285309 - protein, 21 aa, Plasmodium falciparum
FRDMNVIKVPFLPLYVTTCDN

SEQ ID NO: 3285310 - protein, 26 aa, Plasmodium falciparum
FRDVERKLIPFVYLDKCQSKIQICLF

SEQ ID NO: 3285311 - protein, 35 aa, Plasmodium falciparum
FRENKIIFLFFIKIFLFSLFIWELCCFNKEKFQDQ

SEQ ID NO: 3285312 - protein, 32 aa, Plasmodium falciparum
FRFIRKALVLTIVIVLLVIVASVFLILHFINS

SEQ ID NO: 3285313 - protein, 26 aa, Plasmodium falciparum
FRGIYFSEWIILTLNKIFNSLISEEE

SEQ ID NO: 3285314 - protein, 20 aa, Plasmodium falciparum
FRHPLSTFEAFSVAISSLLK

SEQ ID NO: 3285315 - protein, 25 aa, Plasmodium falciparum
FRKEDIIIAFFLRLSNIIFDLILYI

SEQ ID NO: 3285316 - protein, 23 aa, Plasmodium falciparum
FRKQLCNILFYINLSIYSQVRSY

SEQ ID NO: 3285317 - protein, 39 aa, Plasmodium falciparum
FRKQRFTSMHYIAGGGIIALLLFILGSASYRKNLDDEKG

SEQ ID NO: 3285318 - protein, 34 aa, Plasmodium falciparum
FRNKNNILSYFLILPSFFFMNNSFYFSCLNIDID

SEQ ID NO: 3285319 - protein, 46 aa, Plasmodium falciparum
FRNMIKMALSFYFLYKINVHLFIVSLFIVFIISNISIFFSNIFRKL

SEQ ID NO: 3285320 - protein, 19 aa, Plasmodium falciparum
FRNNLIYGRPLYPLNMKLS

SEQ ID NO: 3285321 - protein, 25 aa, Plasmodium falciparum
FRNSKFFLTSYINHGPFPLIIECVI

SEQ ID NO: 3285322 - protein, 23 aa, Plasmodium falciparum
FRRISFLLTKKRLNFFSFESYLG

SEQ ID NO: 3285323 - protein, 18 aa, Plasmodium falciparum
FRRPKFFNCIIEESFENY

SEQ ID NO: 3285324 - protein, 18 aa, Plasmodium falciparum
FRSFLSIIHLYKEYCRKV

SEQ ID NO: 3285325 - protein, 26 aa, Plasmodium falciparum
FRSVNDLLYFDYVNHFKSFRNIKKKK

SEQ ID NO: 3285326 - protein, 30 aa, Plasmodium falciparum
FRTSLIYPFILFLIFFLINLVLHYEHSNTA

SEQ ID NO: 3285327 - protein, 17 aa, Plasmodium falciparum
FRYLQWLSYQTYSASVL

SEQ ID NO: 3285328 - protein, 23 aa, Plasmodium falciparum
FRYNEILFILKIFCKRKYKNLLL

SEQ ID NO: 3285329 - protein, 25 aa, Plasmodium falciparum
FSADNSFNYILHEIKFKKIQEFVYL

SEQ ID NO: 3285330 - protein, 21 aa, Plasmodium falciparum
FSAKCKNVILSLTLLNYSSYS

SEQ ID NO: 3285331 - protein, 24 aa, Plasmodium falciparum
FSCFLLFLPLHIVRTHYAKNEETN

SEQ ID NO: 3285332 - protein, 25 aa, Plasmodium falciparum
FSCIYFLIIIWKFSYVYNESYSNIK

SEQ ID NO: 3285333 - protein, 24 aa, Plasmodium falciparum
FSCMKIFYVMGISELYFPVTFSSH

SEQ ID NO: 3285334 - protein, 27 aa, Plasmodium falciparum
FSCPNYMKYIKYFIQYYFELINTKNIV

SEQ ID NO: 3285335 - protein, 18 aa, Plasmodium falciparum
FSDDLLNRKVALSEFYFL

SEQ ID NO: 3285336 - protein, 26 aa, Plasmodium falciparum
FSDFIHYYILHYLGTLQGKIIEQEGE

SEQ ID NO: 3285337 - protein, 25 aa, Plasmodium falciparum
FSEFDSCVYFLFTYKSFCYYIINNE

SEQ ID NO: 3285338 - protein, 21 aa, Plasmodium falciparum
FSEFLSWLFVYRNEKFKKLNE

SEQ ID NO: 3285339 - protein, 17 aa, Plasmodium falciparum
FSEIKKFYFIRNLKHGT

SEQ ID NO: 3285340 - protein, 32 aa, Plasmodium falciparum
FSESQKFRFIYHFYSVRLLGVSPSDLYMKTNK

SEQ ID NO: 3285341 - protein, 26 aa, Plasmodium falciparum
FSFDEIFFFLIIFYGFFSFTSTILTL

SEQ ID NO: 3285342 - protein, 22 aa, Plasmodium falciparum
FSFIILFYIYLLANNNDLRKND

SEQ ID NO: 3285343 - protein, 24 aa, Plasmodium falciparum
FSFLTSYIHILFHLNKTQTIEPYL

SEQ ID NO: 3285344 - protein, 25 aa, Plasmodium falciparum
FSFPYEILCRIIIIQLKFFSNKILN

SEQ ID NO: 3285345 - protein, 17 aa, Plasmodium falciparum
FSFREILHGSNYYIPKE

SEQ ID NO: 3285346 - protein, 26 aa, Plasmodium falciparum
FSFRNIYMLICIISVMYVSFMNVHMN

SEQ ID NO: 3285347 - protein, 28 aa, Plasmodium falciparum
FSFSLTEEIIFLYKIYLIELKKKNILHS

SEQ ID NO: 3285348 - protein, 20 aa, Plasmodium falciparum
FSFTLLLCIIALSCNNNTDI

SEQ ID NO: 3285349 - protein, 33 aa, Plasmodium falciparum
FSGCNMSIYDYLKYLFFSLYKEYIHSNYCLTKN

SEQ ID NO: 3285350 - protein, 26 aa, Plasmodium falciparum
FSGFYKGYIPTLLTGVPYVTLQMLFF

SEQ ID NO: 3285351 - protein, 20 aa, Plasmodium falciparum
FSGILCFFFDRSWLFSLSPL

SEQ ID NO: 3285352 - protein, 17 aa, Plasmodium falciparum
FSGIRKPISKKIVFIIT

SEQ ID NO: 3285353 - protein, 26 aa, Plasmodium falciparum
FSGSTLEYFFLLLKERNINITIFSEK

SEQ ID NO: 3285354 - protein, 19 aa, Plasmodium falciparum
FSGVYIPDINILKRAICIM

SEQ ID NO: 3285355 - protein, 17 aa, Plasmodium falciparum
FSHVYINDWNKVLYYYN

SEQ ID NO: 3285356 - protein, 25 aa, Plasmodium falciparum
FSIDKYPTIIFQKPYINLDIKVKIP

SEQ ID NO: 3285357 - protein, 24 aa, Plasmodium falciparum
FSIHKAFMEFLFIIACVSFTIIYS

SEQ ID NO: 3285358 - protein, 18 aa, Plasmodium falciparum
FSIILLINLLIFFSFING

SEQ ID NO: 3285359 - protein, 24 aa, Plasmodium falciparum
FSIKNVFIRLWKRKSPMKNQNFKT

SEQ ID NO: 3285360 - protein, 17 aa, Plasmodium falciparum
FSILWVYSYFFICEILQ

SEQ ID NO: 3285361 - protein, 25 aa, Plasmodium falciparum
FSIYIKIYQIYIFSKKTKNIKYFVD

SEQ ID NO: 3285362 - protein, 24 aa, Plasmodium falciparum
FSKELTIIYINALIRFCLFELRMD

SEQ ID NO: 3285363 - protein, 29 aa, Plasmodium falciparum
FSKGLSQLIPIKWFKLFSAHELKTLISGK

SEQ ID NO: 3285364 - protein, 26 aa, Plasmodium falciparum
FSKHPYINDLIYYDKLRYQKWITGQF

SEQ ID NO: 3285365 - protein, 24 aa, Plasmodium falciparum
FSKKNFFFIIKNLFIQSIYVFEIL

SEQ ID NO: 3285366 - protein, 29 aa, Plasmodium falciparum
FSKKWFSEFSIMWPGQAFSLKIKKILYET

SEQ ID NO: 3285367 - protein, 28 aa, Plasmodium falciparum
FSKKYFLNYLINAFNFYILKIGMLICAS

SEQ ID NO: 3285368 - protein, 22 aa, Plasmodium falciparum
FSKMNLLKYNLLGYYFADYFVL

SEQ ID NO: 3285369 - protein, 39 aa, Plasmodium falciparum
FSKNDNYLNLFKPLIPNIKILLFSLNKILFNKHRCNEPI

SEQ ID NO: 3285370 - protein, 23 aa, Plasmodium falciparum
FSKNGRFLSYAGGYTNNLNLIDL

SEQ ID NO: 3285371 - protein, 22 aa, Plasmodium falciparum
FSKRPQFLRWMTEWGEEFCKKR

SEQ ID NO: 3285372 - protein, 26 aa, Plasmodium falciparum
FSKYFPKFFIYSKLYIIINIKKSFYE

SEQ ID NO: 3285373 - protein, 24 aa, Plasmodium falciparum
FSLCKINLFIKEAKLLFFNKNISI

SEQ ID NO: 3285374 - protein, 25 aa, Plasmodium falciparum
FSLDHFPFFFFILKNDKKENSNNEI

SEQ ID NO: 3285375 - protein, 21 aa, Plasmodium falciparum
FSLHKKYLLTGVTILSFIFMF

SEQ ID NO: 3285376 - protein, 23 aa, Plasmodium falciparum
FSLILMIIHFLQNVAEPKILPSL

SEQ ID NO: 3285377 - protein, 20 aa, Plasmodium falciparum
FSLKIFWRAYHNFKMKFNKE

SEQ ID NO: 3285378 - protein, 25 aa, Plasmodium falciparum
FSLKNHGFFFFVRKAQDFKSSFFDH

SEQ ID NO: 3285379 - protein, 23 aa, Plasmodium falciparum
FSLKQFILFFYTFNGNIYNRDYI

SEQ ID NO: 3285380 - protein, 25 aa, Plasmodium falciparum
FSLNTIEQFLLLHKINNETGGEGTN

SEQ ID NO: 3285381 - protein, 18 aa, Plasmodium falciparum
FSLQSLLLVGFYESFETP

SEQ ID NO: 3285382 - protein, 43 aa, Plasmodium falciparum
FSLSSTFFIYLIFKLYIMRIFLLNYFVLFFLSVLFCCVNIFYY

SEQ ID NO: 3285383 - protein, 28 aa, Plasmodium falciparum
FSLYSPRVLYPLLFEYVVNIKNSYKIIL

SEQ ID NO: 3285384 - protein, 19 aa, Plasmodium falciparum
FSMIKYCTILLELSKNILK

SEQ ID NO: 3285385 - protein, 17 aa, Plasmodium falciparum
FSMMHIMDFFKSKQKVI

SEQ ID NO: 3285386 - protein, 26 aa, Plasmodium falciparum
FSNNRIGHFLWGSKIRKNPLASISTS

SEQ ID NO: 3285387 - protein, 20 aa, Plasmodium falciparum
FSNSYKYIYSYPLLNYNITY

SEQ ID NO: 3285388 - protein, 25 aa, Plasmodium falciparum
FSNYNFFQFPFYYSIEKILHDLYIY

SEQ ID NO: 3285389 - protein, 24 aa, Plasmodium falciparum
FSPLIITCIICFPFFFTRFMWSVE

SEQ ID NO: 3285390 - protein, 18 aa, Plasmodium falciparum
FSREQLLLEHIYIDNIKT

SEQ ID NO: 3285391 - protein, 35 aa, Plasmodium falciparum
FSRSINYIFLLLKNNFNLFLFPYNHAKYLSFISFL

SEQ ID NO: 3285392 - protein, 23 aa, Plasmodium falciparum
FSRTNFFFYLTILNKKNVKKIVK

SEQ ID NO: 3285393 - protein, 22 aa, Plasmodium falciparum
FSSFFFLDYRFSKKEIFQNLPS

SEQ ID NO: 3285394 - protein, 29 aa, Plasmodium falciparum
FSSFLKCYYKCFLILNLKLYENNMFKKNI

SEQ ID NO: 3285395 - protein, 26 aa, Plasmodium falciparum
FSSKNCIYIRLFFGVLLEEINDMIYN

SEQ ID NO: 3285396 - protein, 29 aa, Plasmodium falciparum
FSSLDWFYCLFLGLSLFFSVIWGLLFEPI

SEQ ID NO: 3285397 - protein, 21 aa, Plasmodium falciparum
FSSSLFKLKYLKYRDTRISNM

SEQ ID NO: 3285398 - protein, 25 aa, Plasmodium falciparum
FSSTYFIYYFILQGLGGIFLGFFSD

SEQ ID NO: 3285399 - protein, 25 aa, Plasmodium falciparum
FSSVEEILYFFSLDPVYVHDKYKDY

SEQ ID NO: 3285400 - protein, 54 aa, Plasmodium falciparum
FSSWKKPLYSLFFVTYFFLSFFFSKYFISFLLLFLSLILFIIVSIIRECDRIQR

SEQ ID NO: 3285401 - protein, 17 aa, Plasmodium falciparum
FSSYKKLYNRNITKLIR

SEQ ID NO: 3285402 - protein, 28 aa, Plasmodium falciparum
FSTFSIFFFFYFFLYKNYFSFYSIGITS

SEQ ID NO: 3285403 - protein, 24 aa, Plasmodium falciparum
FSTLICHKRYFKKKLFNEFLIALA

SEQ ID NO: 3285404 - protein, 29 aa, Plasmodium falciparum
FSVELWNSFYSYLYVYTILPEVSSSSFCY

SEQ ID NO: 3285405 - protein, 51 aa, Plasmodium falciparum
FSVILTMYGIFYKIFCYIFAHYVLFMGLYILSIYYNIYIHRDILTHSYNFF

SEQ ID NO: 3285406 - protein, 18 aa, Plasmodium falciparum
FSVRKYSYDIAKAKCLEC

SEQ ID NO: 3285407 - protein, 51 aa, Plasmodium falciparum
FSVTKFFNIYIKNIYKIFFKLNNFFSSYFFLKEFIIYISSILYLPEMVHIY

SEQ ID NO: 3285408 - protein, 28 aa, Plasmodium falciparum
FSYAQFFVVFPIYYFLTLHRLKNVWYIY

SEQ ID NO: 3285409 - protein, 28 aa, Plasmodium falciparum
FSYDKTLYIFFFLKLYVELNKIFFVCRE

SEQ ID NO: 3285410 - protein, 25 aa, Plasmodium falciparum
FSYEMKEFLPFLKVSPIESKKIPKN

SEQ ID NO: 3285411 - protein, 27 aa, Plasmodium falciparum
FSYHDNFLSHYIIYKKNKFIKHNKNEH

SEQ ID NO: 3285412 - protein, 18 aa, Plasmodium falciparum
FSYPLTIKMPSYVKINFG

SEQ ID NO: 3285413 - protein, 20 aa, Plasmodium falciparum
FTCKGLMEHFKLSQALPNIA

SEQ ID NO: 3285414 - protein, 32 aa, Plasmodium falciparum
FTCTGQDILYPWILRSFILLNYFIENDYLNEL

SEQ ID NO: 3285415 - protein, 26 aa, Plasmodium falciparum
FTDKLLDLRIYDMLKYVYRNNIYRTS

SEQ ID NO: 3285416 - protein, 23 aa, Plasmodium falciparum
FTFFKKIPRKVWRFIKKIAKKCK

SEQ ID NO: 3285417 - protein, 20 aa, Plasmodium falciparum
FTFFLWIVLFFINEENIQGK

SEQ ID NO: 3285418 - protein, 24 aa, Plasmodium falciparum
FTFIYSIILLCEYLSFIKHCIAMN

SEQ ID NO: 3285419 - protein, 18 aa, Plasmodium falciparum
FTFLINTLVLPHYENCQN

SEQ ID NO: 3285420 - protein, 18 aa, Plasmodium falciparum
FTFLINTLVLQHYENYLN

SEQ ID NO: 3285421 - protein, 17 aa, Plasmodium falciparum
FTFNYLRYFVLTNLFFK

SEQ ID NO: 3285422 - protein, 28 aa, Plasmodium falciparum
FTHNILYHIPFLLFFNLLKNENVHFIYD

SEQ ID NO: 3285423 - protein, 21 aa, Plasmodium falciparum
FTIFKNIPIDMIMINNLIHTK

SEQ ID NO: 3285424 - protein, 29 aa, Plasmodium falciparum
FTINIPYFGIFCSKLENWIISALRDNILK

SEQ ID NO: 3285425 - protein, 19 aa, Plasmodium falciparum
FTINLICKDLYIYNNNNNN

SEQ ID NO: 3285426 - protein, 20 aa, Plasmodium falciparum
FTIVFFVWKLLYTDIVLCLL

SEQ ID NO: 3285427 - protein, 20 aa, Plasmodium falciparum
FTKALAGIYFFFSSSIENAG

SEQ ID NO: 3285428 - protein, 27 aa, Plasmodium falciparum
FTKNYDLYTPPLLLMLASAMLSENLKK

SEQ ID NO: 3285429 - protein, 22 aa, Plasmodium falciparum
FTLINPLYLLALITSVIQMLAL

SEQ ID NO: 3285430 - protein, 18 aa, Plasmodium falciparum
FTLPKIYNKKMYTLHKTI

SEQ ID NO: 3285431 - protein, 18 aa, Plasmodium falciparum
FTLRMTHDVVLDGVLKEE

SEQ ID NO: 3285432 - protein, 24 aa, Plasmodium falciparum
FTLSFLLSWVYFYRTIKIEEKNLL

SEQ ID NO: 3285433 - protein, 21 aa, Plasmodium falciparum
FTLYTHFFMKDNLIGWIRESK

SEQ ID NO: 3285434 - protein, 21 aa, Plasmodium falciparum
FTNICRSMLLYNSLKRIRENE

SEQ ID NO: 3285435 - protein, 31 aa, Plasmodium falciparum
FTNIINQFYLSFKEKICLFIKGKYKGTFDNV

SEQ ID NO: 3285436 - protein, 23 aa, Plasmodium falciparum
FTNIVVGPVIPPLTFIHKKIKNK

SEQ ID NO: 3285437 - protein, 18 aa, Plasmodium falciparum
FTREKCWFLKLFSFDLRY

SEQ ID NO: 3285438 - protein, 33 aa, Plasmodium falciparum
FTRQEILPMNTSEYWWPGLKNIFKVEYSHEEAI

SEQ ID NO: 3285439 - protein, 26 aa, Plasmodium falciparum
FTSLISTYFFFLKRVAIIQRRKTREP

SEQ ID NO: 3285440 - protein, 22 aa, Plasmodium falciparum
FTTFNDIRFEPGSYRYIFMNNY

SEQ ID NO: 3285441 - protein, 19 aa, Plasmodium falciparum
FTTLRRFLGTRMNNLYSKL

SEQ ID NO: 3285442 - protein, 18 aa, Plasmodium falciparum
FTTYIKPTLLLKLKKDLG

SEQ ID NO: 3285443 - protein, 25 aa, Plasmodium falciparum
FTVKNYIYNFLKSNKINVLFKNIFL

SEQ ID NO: 3285444 - protein, 17 aa, Plasmodium falciparum
FTVLRMLILRKKNSFEI

SEQ ID NO: 3285445 - protein, 29 aa, Plasmodium falciparum
FTYEKYFKFNYLRLFFKTLLKVIHIYPLY

SEQ ID NO: 3285446 - protein, 19 aa, Plasmodium falciparum
FVCVTFLYSFIIFKCSSYS

SEQ ID NO: 3285447 - protein, 30 aa, Plasmodium falciparum
FVDCISNIKIPWKLLSHFKNDNTFFIVVYW

SEQ ID NO: 3285448 - protein, 25 aa, Plasmodium falciparum
FVDKNLICLLIYMNNIQKKLSSICN

SEQ ID NO: 3285449 - protein, 30 aa, Plasmodium falciparum
FVDRNIIKTIIFYFPYFICGGIASYMRIYF

SEQ ID NO: 3285450 - protein, 29 aa, Plasmodium falciparum
FVEKEILNIFYLAYPKRILTLNLKDANEE

SEQ ID NO: 3285451 - protein, 28 aa, Plasmodium falciparum
FVESAAIETFFLWDRYKKIKDIEEKEIK

SEQ ID NO: 3285452 - protein, 28 aa, Plasmodium falciparum
FVESAAIETFFLWDRYKKIKEKEKQEEQ

SEQ ID NO: 3285453 - protein, 28 aa, Plasmodium falciparum
FVESAAVETFFLWDRYKKEWEHRNKKPQ

SEQ ID NO: 3285454 - protein, 29 aa, Plasmodium falciparum
FVESAAVETFFLWHKYKAENTKTQSESLL

SEQ ID NO: 3285455 - protein, 26 aa, Plasmodium falciparum
FVESAAVETFFLWHKYKEEKKTPATQ

SEQ ID NO: 3285456 - protein, 29 aa, Plasmodium falciparum
FVESAAVETFFLWHRYKKIKDKEKKEKEE

SEQ ID NO: 3285457 - protein, 17 aa, Plasmodium falciparum
FVEYKEQLLIKKRIIIN

SEQ ID NO: 3285458 - protein, 19 aa, Plasmodium falciparum
FVFFIFALNFIAPNNEHNG

SEQ ID NO: 3285459 - protein, 18 aa, Plasmodium falciparum
FVFIFCNGLLSVLGKEEK

SEQ ID NO: 3285460 - protein, 19 aa, Plasmodium falciparum
FVFLSMCILPICYYINLNY

SEQ ID NO: 3285461 - protein, 24 aa, Plasmodium falciparum
FVFYESIIILLKITYQMVLNSKNI

SEQ ID NO: 3285462 - protein, 19 aa, Plasmodium falciparum
FVFYFLNCSGGINVLMKYN

SEQ ID NO: 3285463 - protein, 51 aa, Plasmodium falciparum
FVGFLGTFFIYIDIYVCFVLYISICFMYISYIFNIWKKPKLRPTKLIRVID

SEQ ID NO: 3285464 - protein, 17 aa, Plasmodium falciparum
FVGYLENLIFLSKDNML

SEQ ID NO: 3285465 - protein, 20 aa, Plasmodium falciparum
FVHNFKMILGGDAVLHYFDN

SEQ ID NO: 3285466 - protein, 24 aa, Plasmodium falciparum
FVIDKGCINCLYACNPYVEWIEKQ

SEQ ID NO: 3285467 - protein, 36 aa, Plasmodium falciparum
FVIIFMICLLFLLFVMYLYIIFIYLQYNIKNIHTQY

SEQ ID NO: 3285468 - protein, 22 aa, Plasmodium falciparum
FVILDGVPLLNFFSHNILKKKN

SEQ ID NO: 3285469 - protein, 17 aa, Plasmodium falciparum
FVILITMFFYPIDKFNH

SEQ ID NO: 3285470 - protein, 32 aa, Plasmodium falciparum
FVINYVFICIFLIILLVLFYAWAVFILKRGNN

SEQ ID NO: 3285471 - protein, 17 aa, Plasmodium falciparum
FVIYIDYIILKLNEYLI

SEQ ID NO: 3285472 - protein, 25 aa, Plasmodium falciparum
FVKILWSIFFLYIYMIRITRCDEDV

SEQ ID NO: 3285473 - protein, 20 aa, Plasmodium falciparum
FVKNKYFHRLIESVVNNVSK

SEQ ID NO: 3285474 - protein, 25 aa, Plasmodium falciparum
FVKQIFLLCNDIYRKDIHTKDVHAS

SEQ ID NO: 3285475 - protein, 17 aa, Plasmodium falciparum
FVKRNFSWNFFKKQHTN

SEQ ID NO: 3285476 - protein, 24 aa, Plasmodium falciparum
FVKSTLYQIPLFSETLELSKIPFG

SEQ ID NO: 3285477 - protein, 26 aa, Plasmodium falciparum
FVLCASLFYFLLLSLNINLYKKLGTF

SEQ ID NO: 3285478 - protein, 18 aa, Plasmodium falciparum
FVLFFKDYIYYMNEQDIT

SEQ ID NO: 3285479 - protein, 19 aa, Plasmodium falciparum
FVLLITFYLTNGILNIGFV

SEQ ID NO: 3285480 - protein, 30 aa, Plasmodium falciparum
FVLLKCITVTLFLFIIFVDTFKGKRRNKPK

SEQ ID NO: 3285481 - protein, 29 aa, Plasmodium falciparum
FVLNFFFVLYYIFYFFHYVIDLQLNNIYN

SEQ ID NO: 3285482 - protein, 17 aa, Plasmodium falciparum
FVLPQYFEKIISKSLKI

SEQ ID NO: 3285483 - protein, 25 aa, Plasmodium falciparum
FVNDYIYMFISYLTLMDMKLSLLLV

SEQ ID NO: 3285484 - protein, 20 aa, Plasmodium falciparum
FVNFLFVLNLFSPCTCKKDY

SEQ ID NO: 3285485 - protein, 20 aa, Plasmodium falciparum
FVNIYYNSLFFIHLLTLCIL

SEQ ID NO: 3285486 - protein, 28 aa, Plasmodium falciparum
FVNKFYVMCLRYCLIGLICIAIILNNCL

SEQ ID NO: 3285487 - protein, 17 aa, Plasmodium falciparum
FVNTLVLMHSINLKLSL

SEQ ID NO: 3285488 - protein, 28 aa, Plasmodium falciparum
FVNYFGHFYLINLLYKRILACDTLVINM

SEQ ID NO: 3285489 - protein, 18 aa, Plasmodium falciparum
FVPEPHSFPYISAEPELR

SEQ ID NO: 3285490 - protein, 33 aa, Plasmodium falciparum
FVPVCNNFYLLFYHFFFHFLNCSDFFSFKKCFN

SEQ ID NO: 3285491 - protein, 18 aa, Plasmodium falciparum
FVQIFYFIFICCILRDIC

SEQ ID NO: 3285492 - protein, 17 aa, Plasmodium falciparum
FVQIMVENFIYILNNYP

SEQ ID NO: 3285493 - protein, 19 aa, Plasmodium falciparum
FVQLFLERNIAPENIVSFL

SEQ ID NO: 3285494 - protein, 17 aa, Plasmodium falciparum
FVRKIKSYLFKKHFVKY

SEQ ID NO: 3285495 - protein, 18 aa, Plasmodium falciparum
FVSIVYFLKKYYNNAFFV

SEQ ID NO: 3285496 - protein, 21 aa, Plasmodium falciparum
FVSLMFFLPIYFIHKHLYMIY

SEQ ID NO: 3285497 - protein, 27 aa, Plasmodium falciparum
FVSNYYNYYFFLKNMPKITTLIFMNDG

SEQ ID NO: 3285498 - protein, 23 aa, Plasmodium falciparum
FVSYEKIIRMFPNYDIRLILVDV

SEQ ID NO: 3285499 - protein, 17 aa, Plasmodium falciparum
FVTLFGYLFGSIIYRVG

SEQ ID NO: 3285500 - protein, 17 aa, Plasmodium falciparum
FVVFLIHGYINTNIFHV

SEQ ID NO: 3285501 - protein, 18 aa, Plasmodium falciparum
FVVYFFNYSFHFIKHFDK

SEQ ID NO: 3285502 - protein, 25 aa, Plasmodium falciparum
FVYLVYLFHMFSLSLRMQKNIFKYI

SEQ ID NO: 3285503 - protein, 20 aa, Plasmodium falciparum
FVYLYRIDTKLLPRDISKYL

SEQ ID NO: 3285504 - protein, 32 aa, Plasmodium falciparum
FVYNAGGVVCCVLFFASITFFSMDRSNKDECD

SEQ ID NO: 3285505 - protein, 40 aa, Plasmodium falciparum
FVYPVIQIIRVIYLFSLKYFPTLFLKTINYLNYIKVDENL

SEQ ID NO: 3285506 - protein, 17 aa, Plasmodium falciparum
FVYSFKEESIIKTIYGC

SEQ ID NO: 3285507 - protein, 24 aa, Plasmodium falciparum
FWIQIVHNIWIPLIINHFNSIKNN

SEQ ID NO: 3285508 - protein, 19 aa, Plasmodium falciparum
FWMMYNNYSSSFYEKYLKC

SEQ ID NO: 3285509 - protein, 21 aa, Plasmodium falciparum
FWNNIWINSINFFLIIIMIAC

SEQ ID NO: 3285510 - protein, 23 aa, Plasmodium falciparum
FWNNIWIVVITLLSIILLIAAMA

SEQ ID NO: 3285511 - protein, 17 aa, Plasmodium falciparum
FWRAYHNFKMKFNKEQF

SEQ ID NO: 3285512 - protein, 20 aa, Plasmodium falciparum
FYANLFSYIIILTSLLNFFF

SEQ ID NO: 3285513 - protein, 19 aa, Plasmodium falciparum
FYCYIDNYTFYSFSSSLKD

SEQ ID NO: 3285514 - protein, 28 aa, Plasmodium falciparum
FYDDINFMFRVLLIRGLKDMYSNIFLFC

SEQ ID NO: 3285515 - protein, 17 aa, Plasmodium falciparum
FYDNFFLNIQMINFIYP

SEQ ID NO: 3285516 - protein, 23 aa, Plasmodium falciparum
FYEKYLKCIPDINGIKIYIEASM

SEQ ID NO: 3285517 - protein, 21 aa, Plasmodium falciparum
FYETEFLKALYFYSAIQKNKR

SEQ ID NO: 3285518 - protein, 19 aa, Plasmodium falciparum
FYETITYLFIHLMDKNRRV

SEQ ID NO: 3285519 - protein, 24 aa, Plasmodium falciparum
FYETTVSFLIIPILKEYVKSNSGL

SEQ ID NO: 3285520 - protein, 17 aa, Plasmodium falciparum
FYFAFFNYIKYKNRIHH

SEQ ID NO: 3285521 - protein, 33 aa, Plasmodium falciparum
FYFDTIYNTQYLFNFLLHNFLFYSKDADEYSKK

SEQ ID NO: 3285522 - protein, 28 aa, Plasmodium falciparum
FYFILVNLLIFHINGKIIKNSEKDEIIK

SEQ ID NO: 3285523 - protein, 27 aa, Plasmodium falciparum
FYFNHFINIFLLYKINLAVCFFLNLLN

SEQ ID NO: 3285524 - protein, 20 aa, Plasmodium falciparum
FYFSKYSYCFERLLDYAFSL

SEQ ID NO: 3285525 - protein, 17 aa, Plasmodium falciparum
FYFWVPLVAPCVGSVVF

SEQ ID NO: 3285526 - protein, 20 aa, Plasmodium falciparum
FYHLKYSNIIVYIYALKNFI

SEQ ID NO: 3285527 - protein, 25 aa, Plasmodium falciparum
FYIFFLHIDIYVNIYSTCFVVNEGN

SEQ ID NO: 3285528 - protein, 18 aa, Plasmodium falciparum
FYIFISALHLFFSYKEIQ

SEQ ID NO: 3285529 - protein, 28 aa, Plasmodium falciparum
FYIHTKVVQIIYFLTLQNCKIYSSHNNN

SEQ ID NO: 3285530 - protein, 27 aa, Plasmodium falciparum
FYIKEKFKYFPILNIHFYTTSININIT

SEQ ID NO: 3285531 - protein, 17 aa, Plasmodium falciparum
FYILKKYYHTWFQLSYK

SEQ ID NO: 3285532 - protein, 26 aa, Plasmodium falciparum
FYIMSKYLFVLLDNGLLYYTKKNDDG

SEQ ID NO: 3285533 - protein, 22 aa, Plasmodium falciparum
FYISINTYVKILNKIYKKIINR

SEQ ID NO: 3285534 - protein, 36 aa, Plasmodium falciparum
FYKDFYYPYIRPFIERLLYIYQINIYPQILSNINMY

SEQ ID NO: 3285535 - protein, 22 aa, Plasmodium falciparum
FYKDYLYMGLFYENLDVRNLNV

SEQ ID NO: 3285536 - protein, 23 aa, Plasmodium falciparum
FYKNVINIFLCLYNILYRQNKIY

SEQ ID NO: 3285537 - protein, 17 aa, Plasmodium falciparum
FYKPFLQRKMLESPFAV

SEQ ID NO: 3285538 - protein, 17 aa, Plasmodium falciparum
FYLPKNQYIKTPIYCFR

SEQ ID NO: 3285539 - protein, 22 aa, Plasmodium falciparum
FYLYILFSIIMRIKCVITKNLK

SEQ ID NO: 3285540 - protein, 18 aa, Plasmodium falciparum
FYMFIKTNNKQYNSPNEM

SEQ ID NO: 3285541 - protein, 19 aa, Plasmodium falciparum
FYNLLCFRITYKNNSVLSE

SEQ ID NO: 3285542 - protein, 36 aa, Plasmodium falciparum
FYNNKNILLYYYTFQQYFYLYKFLEDKYYSECVLSE

SEQ ID NO: 3285543 - protein, 18 aa, Plasmodium falciparum
FYNVFIPLFLKHIKYLKN

SEQ ID NO: 3285544 - protein, 20 aa, Plasmodium falciparum
FYPSILMHERQCGLSSAYIV

SEQ ID NO: 3285545 - protein, 19 aa, Plasmodium falciparum
FYQFIITSILLHSIPDKST

SEQ ID NO: 3285546 - protein, 24 aa, Plasmodium falciparum
FYQNKHILYLLRNQYKNFNNYIYP

SEQ ID NO: 3285547 - protein, 37 aa, Plasmodium falciparum
FYSDIYAFGIILWEMLSNDIPYNYPFASHIMAVVGYA

SEQ ID NO: 3285548 - protein, 23 aa, Plasmodium falciparum
FYSFSKLYRFLNTFVIDKNKCFK

SEQ ID NO: 3285549 - protein, 31 aa, Plasmodium falciparum
FYSIMIYIFYLFLFLTIMNMFFYLSKYVKNE

SEQ ID NO: 3285550 - protein, 18 aa, Plasmodium falciparum
FYSLPTILTANSDNSFFM

SEQ ID NO: 3285551 - protein, 18 aa, Plasmodium falciparum
FYSVLGEKDYFYFPSEQI

SEQ ID NO: 3285552 - protein, 41 aa, Plasmodium falciparum
FYTEKKLYPYYFYRKPVCHSIIFKILAYNFLHYEQINKKKK

SEQ ID NO: 3285553 - protein, 20 aa, Plasmodium falciparum
FYTINKISYEYNIKISFDNF

SEQ ID NO: 3285554 - protein, 17 aa, Plasmodium falciparum
FYTLFGILGYFSFLNTA

SEQ ID NO: 3285555 - protein, 18 aa, Plasmodium falciparum
FYVKYSQDYLLPPNSLQV

SEQ ID NO: 3285556 - protein, 20 aa, Plasmodium falciparum
FYYMNIHAWKIFLYNTRFNQ

SEQ ID NO: 3285557 - protein, 25 aa, Plasmodium falciparum
FYYQYKIYLFYYYLNKHKIFEQFFQ

SEQ ID NO: 3285558 - protein, 26 aa, Plasmodium falciparum
FYYRTHELWKHRLSFLPKCLLQISTM

SEQ ID NO: 3285559 - protein, 17 aa, Plasmodium falciparum
FYYYIYCFNTSTNSTFL

SEQ ID NO: 3285560 - protein, 25 aa, Plasmodium falciparum
FYYYTKFVYFHLLKDYFDINLNFKD

SEQ ID NO: 3285561 - protein, 24 aa, Plasmodium falciparum
GACAPYRRLFLCNKNMEKMGRTST

SEQ ID NO: 3285562 - protein, 23 aa, Plasmodium falciparum
GACAPYRRLHLCDYNLEKMGKTS

SEQ ID NO: 3285563 - protein, 24 aa, Plasmodium falciparum
GACAPYRRLHLCDYNLEKMGKTST

SEQ ID NO: 3285564 - protein, 32 aa, Plasmodium falciparum
GAGDRLVLVGALRRIKSFLRGLFSVQSSTLYN

SEQ ID NO: 3285565 - protein, 24 aa, Plasmodium falciparum
GAICIPPRRRKLYIGKIKEWANSG

SEQ ID NO: 3285566 - protein, 25 aa, Plasmodium falciparum
GAICVPPRRRRLYVGGLTKLTSAGT

SEQ ID NO: 3285567 - protein, 39 aa, Plasmodium falciparum
GAIGYSILAILIIVLIMLIIYLILRYRRKKKMKKKLQYI

SEQ ID NO: 3285568 - protein, 23 aa, Plasmodium falciparum
GAISLLIVYPLDFARTRLASDIG

SEQ ID NO: 3285569 - protein, 17 aa, Plasmodium falciparum
GAKFVPTNVPPAPPPQP

SEQ ID NO: 3285570 - protein, 24 aa, Plasmodium falciparum
GALYPIYGYSFYLMSKSSMWIYTH

SEQ ID NO: 3285571 - protein, 23 aa, Plasmodium falciparum
GAPVILTLIIVGGFIWGVKGTKY

SEQ ID NO: 3285572 - protein, 35 aa, Plasmodium falciparum
GARNYKYFVYFVFNLYVLICITLSASIYKLVVCIN

SEQ ID NO: 3285573 - protein, 24 aa, Plasmodium falciparum
GASYYEQLQSAFKKHIKPSARRTN

SEQ ID NO: 3285574 - protein, 28 aa, Plasmodium falciparum
GATCKSYNEWSEWSGPCEFERRQRIIPL

SEQ ID NO: 3285575 - protein, 28 aa, Plasmodium falciparum
GATVFYFLENIFYKYFKGDNIKANEFLK

SEQ ID NO: 3285576 - protein, 31 aa, Plasmodium falciparum
GATVPTYFDYVPQYLRWFEEWAEDFCRKKKK

SEQ ID NO: 3285577 - protein, 25 aa, Plasmodium falciparum
GCDGGHPFYSFLYVLQNELCLGDEY

SEQ ID NO: 3285578 - protein, 18 aa, Plasmodium falciparum
GCDKKLIALTKIFGNVMD

SEQ ID NO: 3285579 - protein, 17 aa, Plasmodium falciparum
GCFIYVIFILLGAHINP

SEQ ID NO: 3285580 - protein, 31 aa, Plasmodium falciparum
GCILQSPLYSGLRLLLPLDYKKEMPWFDVFK

SEQ ID NO: 3285581 - protein, 19 aa, Plasmodium falciparum
GCILYNIPYNKNQLYFLLH

SEQ ID NO: 3285582 - protein, 32 aa, Plasmodium falciparum
GCKEYAYMVYPYLLLLSDFIKRMIHIYKEDYV

SEQ ID NO: 3285583 - protein, 18 aa, Plasmodium falciparum
GCNINRYSKWYNKSDIGF

SEQ ID NO: 3285584 - protein, 17 aa, Plasmodium falciparum
GCSYEFINFVFTSFHVI

SEQ ID NO: 3285585 - protein, 30 aa, Plasmodium falciparum
GCVGYFKINLPLLYFMKNPINIYMEDVIIV

SEQ ID NO: 3285586 - protein, 17 aa, Plasmodium falciparum
GCYFFVFNPNDTSNIIF

SEQ ID NO: 3285587 - protein, 27 aa, Plasmodium falciparum
GCYKSFYKFCFFPIRYIPYIQRYTEKI

SEQ ID NO: 3285588 - protein, 36 aa, Plasmodium falciparum
GDALLLTAFVETAAVETFFLWHKYKQEKKKPKNEVG

SEQ ID NO: 3285589 - protein, 23 aa, Plasmodium falciparum
GDCLFLSLQYLLQNNGIKKNNFV

SEQ ID NO: 3285590 - protein, 42 aa, Plasmodium falciparum
GDDNYFLRVIKNSYLIFYNNFLYPTNFFIDNYKQLPLCIGIQ

SEQ ID NO: 3285591 - protein, 33 aa, Plasmodium falciparum
GDDTLFKLICSGYMWLYSLINLYIQLLKSKTHD

SEQ ID NO: 3285592 - protein, 18 aa, Plasmodium falciparum
GDFAQDIWHGMICALTYT

SEQ ID NO: 3285593 - protein, 18 aa, Plasmodium falciparum
GDIELTIRYAAEKVLFDE

SEQ ID NO: 3285594 - protein, 29 aa, Plasmodium falciparum
GDIFFNYYLLLRLLLPLLFSASLDHYILL

SEQ ID NO: 3285595 - protein, 25 aa, Plasmodium falciparum
GDIHGQYYDLMRMFQLYKCPVEEDL

SEQ ID NO: 3285596 - protein, 22 aa, Plasmodium falciparum
GDILCMLVHFFSKIKEFDLNYK

SEQ ID NO: 3285597 - protein, 25 aa, Plasmodium falciparum
GDINYMALCITPCNLFMCYKIVHCG

SEQ ID NO: 3285598 - protein, 29 aa, Plasmodium falciparum
GDIPDGFLRQMFYTLGDYRDILYSGDKEN

SEQ ID NO: 3285599 - protein, 28 aa, Plasmodium falciparum
GDIPNDFLRLMFYTLGDYRDICIGVKED

SEQ ID NO: 3285600 - protein, 26 aa, Plasmodium falciparum
GDITLHPKRLYLKHFKLISVSNYDDV

SEQ ID NO: 3285601 - protein, 19 aa, Plasmodium falciparum
GDIYLLLGSPLDSLEIYMS

SEQ ID NO: 3285602 - protein, 27 aa, Plasmodium falciparum
GDIYSDVYVWYFLKNVYKKMEICSFNK

SEQ ID NO: 3285603 - protein, 25 aa, Plasmodium falciparum
GDKKDQFLYLIYNHFLILVEYYHYY

SEQ ID NO: 3285604 - protein, 25 aa, Plasmodium falciparum
GDLFSLIMYSLFCGSGIQGMMHAIG

SEQ ID NO: 3285605 - protein, 23 aa, Plasmodium falciparum
GDNILYMLLSNFFYISKNIYDEN

SEQ ID NO: 3285606 - protein, 27 aa, Plasmodium falciparum
GDNKIRSFFLFFPNHLFVHLKSKNIIL

SEQ ID NO: 3285607 - protein, 31 aa, Plasmodium falciparum
GDNTPLSHFISRPTYFRYLEEWGQNFCKERK

SEQ ID NO: 3285608 - protein, 32 aa, Plasmodium falciparum
GDNTPLSKFVLRPPYFRYLEEWGETFCRERTR

SEQ ID NO: 3285609 - protein, 32 aa, Plasmodium falciparum
GDNTPLTQFVLRPPYFRYLEEWGETFCRQRTR

SEQ ID NO: 3285610 - protein, 28 aa, Plasmodium falciparum
GDNYYKLREDWWALNRQEIWKAITCGHP

SEQ ID NO: 3285611 - protein, 21 aa, Plasmodium falciparum
GDPFFHFFKNKMKLINKVECA

SEQ ID NO: 3285612 - protein, 30 aa, Plasmodium falciparum
GDPPTYFDYVPQYLRWFEEWAEDFCRKRKH

SEQ ID NO: 3285613 - protein, 24 aa, Plasmodium falciparum
GDTFPVRSFLEELIPKIAVVNDQD

SEQ ID NO: 3285614 - protein, 30 aa, Plasmodium falciparum
GDTPLTNFISRPTYFRYLEEWGETFCRQRT

SEQ ID NO: 3285615 - protein, 30 aa, Plasmodium falciparum
GDVKNNICNLFLYNFPYQNNIKELNSYNMF

SEQ ID NO: 3285616 - protein, 23 aa, Plasmodium falciparum
GDYSVKMIYPYSSIYYTLRHNNE

SEQ ID NO: 3285617 - protein, 24 aa, Plasmodium falciparum
GEAMGVKTIIRIFEKIFSIDKLKG

SEQ ID NO: 3285618 - protein, 26 aa, Plasmodium falciparum
GEDPGKILEFYLKSIFLQDMKEAQGD

SEQ ID NO: 3285619 - protein, 24 aa, Plasmodium falciparum
GEDYDLVLCLLKKLEEKAKKCKED

SEQ ID NO: 3285620 - protein, 23 aa, Plasmodium falciparum
GEFYNNLILNNQFLIHSFKVEEG

SEQ ID NO: 3285621 - protein, 35 aa, Plasmodium falciparum
GEILWNDRAFVFFIFLLLCFIITYGILTVRKHMHS

SEQ ID NO: 3285622 - protein, 20 aa, Plasmodium falciparum
GEKCFFFNFPQIKEIIFVNE

SEQ ID NO: 3285623 - protein, 17 aa, Plasmodium falciparum
GEKDMLRLYYKYINKYA

SEQ ID NO: 3285624 - protein, 25 aa, Plasmodium falciparum
GEKDQRLFYFIIYTTIENDNDIIKS

SEQ ID NO: 3285625 - protein, 44 aa, Plasmodium falciparum
GEKIFKRKKKIVKENILLILRNLCYEIYTVLCETSKTTKHVYDM

SEQ ID NO: 3285626 - protein, 25 aa, Plasmodium falciparum
GEKLRGFWYHGYPVGPFISQEIGSG

SEQ ID NO: 3285627 - protein, 23 aa, Plasmodium falciparum
GEKSYCNYIVLLYAFKREDNSDQ

SEQ ID NO: 3285628 - protein, 31 aa, Plasmodium falciparum
GEKTYLSKFVLRPPYFRYLEEWGETFCRERT

SEQ ID NO: 3285629 - protein, 38 aa, Plasmodium falciparum
GELDGFPYIILLLSSFLWLVYGMLLNNSAIVFPNLVGL

SEQ ID NO: 3285630 - protein, 32 aa, Plasmodium falciparum
GELDYYIKKLLLSKKIYFFTSIKKKNMSRLSN

SEQ ID NO: 3285631 - protein, 28 aa, Plasmodium falciparum
GEMLGVLMKSPSYVLKFVLEKDVLLTSI

SEQ ID NO: 3285632 - protein, 32 aa, Plasmodium falciparum
GENEKLFYIKIGVFFVILIIVILNGVIGRKTN

SEQ ID NO: 3285633 - protein, 17 aa, Plasmodium falciparum
GENFLLKNNEQNINNNI

SEQ ID NO: 3285634 - protein, 18 aa, Plasmodium falciparum
GENKFLYMYSKNTNRDKI

SEQ ID NO: 3285635 - protein, 30 aa, Plasmodium falciparum
GENRSSLILLIVIFILTVHTYLEVKRICRF

SEQ ID NO: 3285636 - protein, 27 aa, Plasmodium falciparum
GEPLNTPEIHVIRPSDLMDKGENKSAG

SEQ ID NO: 3285637 - protein, 18 aa, Plasmodium falciparum
GESTDFDILINDAAIHDN

SEQ ID NO: 3285638 - protein, 26 aa, Plasmodium falciparum
GEVDDLRWNYLLYSPYELFTNSRKRL

SEQ ID NO: 3285639 - protein, 28 aa, Plasmodium falciparum
GEYSHVYVLLFFYLLTTRCIKIYEYTSD

SEQ ID NO: 3285640 - protein, 23 aa, Plasmodium falciparum
GFDQTFPPYYVLEDVLEESYFPI

SEQ ID NO: 3285641 - protein, 19 aa, Plasmodium falciparum
GFENDLLYELYLNKKKKKK

SEQ ID NO: 3285642 - protein, 18 aa, Plasmodium falciparum
GFEYEFHILLSKLKINKK

SEQ ID NO: 3285643 - protein, 29 aa, Plasmodium falciparum
GFFDISIDIFFKYKWNNLLHISVCDLLQT

SEQ ID NO: 3285644 - protein, 20 aa, Plasmodium falciparum
GFFHNLFSTFSGKKSRESSE

SEQ ID NO: 3285645 - protein, 46 aa, Plasmodium falciparum
GFFQRLKKYKTFFYLFFGFLMASLIIYAFYEYYFKKNGDFKLNCND

SEQ ID NO: 3285646 - protein, 25 aa, Plasmodium falciparum
GFIPMYIFNYILNKFKFIDNNITIF

SEQ ID NO: 3285647 - protein, 30 aa, Plasmodium falciparum
GFIYENWFDFTIRFAFVYISWIKKCNKKNN

SEQ ID NO: 3285648 - protein, 45 aa, Plasmodium falciparum
GFKKENRLFFLLFYKTIKMMKLYIRNLFMKYIKIYYKTKHFEKNI

SEQ ID NO: 3285649 - protein, 17 aa, Plasmodium falciparum
GFKLTPQTVLISTLIFM

SEQ ID NO: 3285650 - protein, 25 aa, Plasmodium falciparum
GFLATLVHDLIITPIDTLKQRIQLG

SEQ ID NO: 3285651 - protein, 24 aa, Plasmodium falciparum
GFLGQFGYDEVLKYVLNIDELFKD

SEQ ID NO: 3285652 - protein, 33 aa, Plasmodium falciparum
GFLLKNISIVLYLLTHFIIILLIGNEYCIKENG

SEQ ID NO: 3285653 - protein, 34 aa, Plasmodium falciparum
GFLNIQIKIIFKRNPLFLTFLSNIRKPLFYYKLP

SEQ ID NO: 3285654 - protein, 26 aa, Plasmodium falciparum
GFLNSKHVFILLLITKNIYSKKNDYS

SEQ ID NO: 3285655 - protein, 19 aa, Plasmodium falciparum
GFLSFYHNLPNYNIIICFT

SEQ ID NO: 3285656 - protein, 20 aa, Plasmodium falciparum
GFLSSFSLILMIIHFLQNVA

SEQ ID NO: 3285657 - protein, 19 aa, Plasmodium falciparum
GFMAEFFKFLDLRNGKVIL

SEQ ID NO: 3285658 - protein, 21 aa, Plasmodium falciparum
GFMYAFCFYSIMPLYAYFENV

SEQ ID NO: 3285659 - protein, 17 aa, Plasmodium falciparum
GFNLFKKSNHKIKDLTH

SEQ ID NO: 3285660 - protein, 24 aa, Plasmodium falciparum
GFSSVIPLGRLRLLYDFKDVEHMV

SEQ ID NO: 3285661 - protein, 42 aa, Plasmodium falciparum
GFVESKALSILFRKSFFFHLNKIHNFLKNILYNKNNISNTMI

SEQ ID NO: 3285662 - protein, 22 aa, Plasmodium falciparum
GFYDLSICISSGIFKGIRKDIW

SEQ ID NO: 3285663 - protein, 25 aa, Plasmodium falciparum
GGACAPFRRLFLCDQHLSHMKAEKI

SEQ ID NO: 3285664 - protein, 26 aa, Plasmodium falciparum
GGANKILPFYIWRSFLKNIQFNVKDQ

SEQ ID NO: 3285665 - protein, 18 aa, Plasmodium falciparum
GGCFIMKIKLSFDNFLLS

SEQ ID NO: 3285666 - protein, 31 aa, Plasmodium falciparum
GGDTPLTQFVLRPTYFRYLEEWGQNFCKKRT

SEQ ID NO: 3285667 - protein, 21 aa, Plasmodium falciparum
GGFMHILFNVICQIQILWMIE

SEQ ID NO: 3285668 - protein, 25 aa, Plasmodium falciparum
GGFSYIVEALKYGLYSYAKSTSSRL

SEQ ID NO: 3285669 - protein, 24 aa, Plasmodium falciparum
GGGLMFNMLGLMNKFFDKFKKDQE

SEQ ID NO: 3285670 - protein, 29 aa, Plasmodium falciparum
GGGVLNSYDIFLIISLLAVPTILNNKFGK

SEQ ID NO: 3285671 - protein, 35 aa, Plasmodium falciparum
GGIGLMLYFRYLTFLNFLSILFIVVSLFDVYLPFD

SEQ ID NO: 3285672 - protein, 23 aa, Plasmodium falciparum
GGINKEIYTPKIYVSEFKNNDDE

SEQ ID NO: 3285673 - protein, 24 aa, Plasmodium falciparum
GGIRGWRLCFIVVGILSVLLSIIV

SEQ ID NO: 3285674 - protein, 24 aa, Plasmodium falciparum
GGIYFFFIIFGYYQEKLPQLGRGS

SEQ ID NO: 3285675 - protein, 28 aa, Plasmodium falciparum
GGIYSSFLLYAFVKYLKNVKNRQSDLYI

SEQ ID NO: 3285676 - protein, 27 aa, Plasmodium falciparum
GGKKIPAPPPFLLKKMGDKSKCVLKKC

SEQ ID NO: 3285677 - protein, 28 aa, Plasmodium falciparum
GGKSLIYQVLPLIIEGISIVISPLISLI

SEQ ID NO: 3285678 - protein, 23 aa, Plasmodium falciparum
GGLRKYIILQYTNKNTKAFLKSL

SEQ ID NO: 3285679 - protein, 19 aa, Plasmodium falciparum
GGLRYKRLLAEPIFGFDVM

SEQ ID NO: 3285680 - protein, 20 aa, Plasmodium falciparum
GGLSFGVFLTSGVNFELEGD

SEQ ID NO: 3285681 - protein, 34 aa, Plasmodium falciparum
GGNALDHSLLLCSLFLGIPVLAFVCFGTLWDKQK

SEQ ID NO: 3285682 - protein, 22 aa, Plasmodium falciparum
GGNFFKLREDWWTANRHTVWEA

SEQ ID NO: 3285683 - protein, 25 aa, Plasmodium falciparum
GGNILFIQNFLWQKDYKEIYMNIKD

SEQ ID NO: 3285684 - protein, 41 aa, Plasmodium falciparum
GGNINYCVYVLKKLLFLINANLYLLSKKYIFQFFNVLQNII

SEQ ID NO: 3285685 - protein, 25 aa, Plasmodium falciparum
GGQRQRPLPLPPVQQPPVQQPPVQQ

SEQ ID NO: 3285686 - protein, 24 aa, Plasmodium falciparum
GGSLLYALNTWKPAAIIAAKEAAL

SEQ ID NO: 3285687 - protein, 17 aa, Plasmodium falciparum
GGSNLLMNSRSFQYHKS

SEQ ID NO: 3285688 - protein, 25 aa, Plasmodium falciparum
GGTCAPLRRLFLCDQHLSHMKEGNI

SEQ ID NO: 3285689 - protein, 24 aa, Plasmodium falciparum
GGTPFNKILLWSFKINKKDITKYW

SEQ ID NO: 3285690 - protein, 27 aa, Plasmodium falciparum
GGVCFRPYFEQKFAEIAFLAVTSTEQV

SEQ ID NO: 3285691 - protein, 28 aa, Plasmodium falciparum
GGVKIKKYLMLPINKFTFENMSKRNYPH

SEQ ID NO: 3285692 - protein, 19 aa, Plasmodium falciparum
GHAIIIILQLFFAGVVVIL

SEQ ID NO: 3285693 - protein, 24 aa, Plasmodium falciparum
GHALIGWFLEFADPVLKVSIIPRN

SEQ ID NO: 3285694 - protein, 30 aa, Plasmodium falciparum
GHDISNFVHVVLPLLFSYNIEKIYENPVRT

SEQ ID NO: 3285695 - protein, 27 aa, Plasmodium falciparum
GHFVSWKYFFVLYGPFVCMVLLFIFIV

SEQ ID NO: 3285696 - protein, 26 aa, Plasmodium falciparum
GHGAFESFVSIWRFKKRYSKSYTSTK

SEQ ID NO: 3285697 - protein, 25 aa, Plasmodium falciparum
GHGKFTYLILRALSKYKKYFKSMNL

SEQ ID NO: 3285698 - protein, 27 aa, Plasmodium falciparum
GHNIDISLYNFIIRNIQIKIGNDIKNI

SEQ ID NO: 3285699 - protein, 30 aa, Plasmodium falciparum
GHNKNLLREFFFLFNFIKKELYNSWPYMFK

SEQ ID NO: 3285700 - protein, 23 aa, Plasmodium falciparum
GHRNFVWVFIGIGCGYIYGTLEY

SEQ ID NO: 3285701 - protein, 35 aa, Plasmodium falciparum
GIAALVLILVAVALIILYIWLYRRRKNSWKHECKK

SEQ ID NO: 3285702 - protein, 21 aa, Plasmodium falciparum
GIAINIWKPTALDAAIEAAIA

SEQ ID NO: 3285703 - protein, 23 aa, Plasmodium falciparum
GIAPKLYRVLFQPDVHYIGGEFP

SEQ ID NO: 3285704 - protein, 18 aa, Plasmodium falciparum
GICLFKFINFLSYHKSSI

SEQ ID NO: 3285705 - protein, 19 aa, Plasmodium falciparum
GICNLNGYFYLFNIYKNEE

SEQ ID NO: 3285706 - protein, 32 aa, Plasmodium falciparum
GIENARIFLLWILLNIFFSFSIIYIYGWFIFN

SEQ ID NO: 3285707 - protein, 30 aa, Plasmodium falciparum
GIETIISKKLFLPCFFSEYFYSLYKENEND

SEQ ID NO: 3285708 - protein, 20 aa, Plasmodium falciparum
GIEYNFNLLKSKYPFAHPNE

SEQ ID NO: 3285709 - protein, 34 aa, Plasmodium falciparum
GIFKADLYIPLMSSITYILLYTLTITAQKQNATF

SEQ ID NO: 3285710 - protein, 21 aa, Plasmodium falciparum
GIFLSWAEIYDFFQPLNKYCV

SEQ ID NO: 3285711 - protein, 17 aa, Plasmodium falciparum
GIFSPEFVPIGVLSSMT

SEQ ID NO: 3285712 - protein, 27 aa, Plasmodium falciparum
GIGLLSFIILFYLLMRNMSYSITTLVI

SEQ ID NO: 3285713 - protein, 25 aa, Plasmodium falciparum
GIGMAMITFAWINLYRKHYYNQCLA

SEQ ID NO: 3285714 - protein, 25 aa, Plasmodium falciparum
GIGTKFITIFTYASSFLGLYIWSLI

SEQ ID NO: 3285715 - protein, 20 aa, Plasmodium falciparum
GIHKIFDYVYVYYYKTNIFD

SEQ ID NO: 3285716 - protein, 17 aa, Plasmodium falciparum
GIHWNFFLTLCTTFLIS

SEQ ID NO: 3285717 - protein, 24 aa, Plasmodium falciparum
GIISFLTEAYIQEIIITKSIRENI

SEQ ID NO: 3285718 - protein, 24 aa, Plasmodium falciparum
GIKGFYIGIFPRLVKIVPTCAILF

SEQ ID NO: 3285719 - protein, 26 aa, Plasmodium falciparum
GIKRKNYLFLILEKAKEIPPGVIVGL

SEQ ID NO: 3285720 - protein, 26 aa, Plasmodium falciparum
GILAILPFYWMWRSHKTSILTIVSVF

SEQ ID NO: 3285721 - protein, 26 aa, Plasmodium falciparum
GILKILFCVCIILLSIFIAKRKNKKK

SEQ ID NO: 3285722 - protein, 19 aa, Plasmodium falciparum
GILLFKVVSNILIIISNNL

SEQ ID NO: 3285723 - protein, 21 aa, Plasmodium falciparum
GILSLWLKKIKVVSSVIILCV

SEQ ID NO: 3285724 - protein, 27 aa, Plasmodium falciparum
GIPQKYRWKIWFHITNAKNLYNKFQKK

SEQ ID NO: 3285725 - protein, 17 aa, Plasmodium falciparum
GIPYDIWTVGCATYFLT

SEQ ID NO: 3285726 - protein, 25 aa, Plasmodium falciparum
GIRKKDMKIPPFASFISLELIHIKK

SEQ ID NO: 3285727 - protein, 25 aa, Plasmodium falciparum
GIRNDVWKCGKVCGLDVCGLKNANG

SEQ ID NO: 3285728 - protein, 22 aa, Plasmodium falciparum
GIRNFYYMLFSYIYNKGSIIYN

SEQ ID NO: 3285729 - protein, 18 aa, Plasmodium falciparum
GISILKRNYKHSLSYVIQ

SEQ ID NO: 3285730 - protein, 26 aa, Plasmodium falciparum
GISLVLFFFPFLMLNHLNIYSFLIFY

SEQ ID NO: 3285731 - protein, 31 aa, Plasmodium falciparum
GITIFVIVLVMVIIYFILRYRRKKKMKKKLQ

SEQ ID NO: 3285732 - protein, 27 aa, Plasmodium falciparum
GITLTGSFILLLPISTRYAKILTDVCL

SEQ ID NO: 3285733 - protein, 18 aa, Plasmodium falciparum
GIVICLYLIIYKNSDIKW

SEQ ID NO: 3285734 - protein, 18 aa, Plasmodium falciparum
GIVIIFCILTCKGQVENK

SEQ ID NO: 3285735 - protein, 19 aa, Plasmodium falciparum
GIVLICIMNLWIYKNKGTS

SEQ ID NO: 3285736 - protein, 17 aa, Plasmodium falciparum
GIVLKYWSKIRNINDRS

SEQ ID NO: 3285737 - protein, 26 aa, Plasmodium falciparum
GIVNYFPFKIFLKNMLYYHKYQNESQ

SEQ ID NO: 3285738 - protein, 21 aa, Plasmodium falciparum
GIYCSYSFFSSIHNFIFFFIL

SEQ ID NO: 3285739 - protein, 22 aa, Plasmodium falciparum
GIYLIYIMYHCLPLIYKDYKKV

SEQ ID NO: 3285740 - protein, 20 aa, Plasmodium falciparum
GIYPPVKYLLNTLKFYNKID

SEQ ID NO: 3285741 - protein, 19 aa, Plasmodium falciparum
GIYQILYKVNKIGKKKLYI

SEQ ID NO: 3285742 - protein, 25 aa, Plasmodium falciparum
GKAEFKDILLYLYTYMLDDCQRDEL

SEQ ID NO: 3285743 - protein, 23 aa, Plasmodium falciparum
GKAKNLLNFLKGKSYKTLTDLHR

SEQ ID NO: 3285744 - protein, 41 aa, Plasmodium falciparum
GKCQKICIKHFLIFNKILLLFILVWIFQYSNEEFTCKGSRS

SEQ ID NO: 3285745 - protein, 23 aa, Plasmodium falciparum
GKDPAIVLKPTNFPGDCFSFKGN

SEQ ID NO: 3285746 - protein, 31 aa, Plasmodium falciparum
GKDPPAYLYFHFFLNLYFDSGKYFPGGFSTS

SEQ ID NO: 3285747 - protein, 19 aa, Plasmodium falciparum
GKEFFLVSLIPARNLQILQ

SEQ ID NO: 3285748 - protein, 24 aa, Plasmodium falciparum
GKEIPYVCIIQILGLSLLGQRVCL

SEQ ID NO: 3285749 - protein, 17 aa, Plasmodium falciparum
GKELFNFLVYKKQVKEN

SEQ ID NO: 3285750 - protein, 33 aa, Plasmodium falciparum
GKFFFPYEQLRAVFWIWIQSLFSDISYLERDVE

SEQ ID NO: 3285751 - protein, 25 aa, Plasmodium falciparum
GKGCTDCFFACNPYIDWINNQRKQF

SEQ ID NO: 3285752 - protein, 24 aa, Plasmodium falciparum
GKGKSFFVINFINNLLNYYKGVIL

SEQ ID NO: 3285753 - protein, 29 aa, Plasmodium falciparum
GKGLTPYKTLEWVLDLSYFPIIKEAHPKE

SEQ ID NO: 3285754 - protein, 20 aa, Plasmodium falciparum
GKIFITMDGIYFISLFNSLF

SEQ ID NO: 3285755 - protein, 29 aa, Plasmodium falciparum
GKIGCILVHCFPPWSCTYGYIKKEHYIIN

SEQ ID NO: 3285756 - protein, 17 aa, Plasmodium falciparum
GKIILLLQNFFTNDPIK

SEQ ID NO: 3285757 - protein, 24 aa, Plasmodium falciparum
GKIKKYRTIRYIKSIIQRIKYEII

SEQ ID NO: 3285758 - protein, 26 aa, Plasmodium falciparum
GKIKVQWYILLFGGLSMSLGLSIMGY

SEQ ID NO: 3285759 - protein, 33 aa, Plasmodium falciparum
GKILKYQSIIKKILKYIINLFRDVLNNTDLNIN

SEQ ID NO: 3285760 - protein, 27 aa, Plasmodium falciparum
GKIPEVFLRQMFYTLGDYRDICVGNTP

SEQ ID NO: 3285761 - protein, 21 aa, Plasmodium falciparum
GKIREIILSIFKYLLDIINNE

SEQ ID NO: 3285762 - protein, 17 aa, Plasmodium falciparum
GKKKLCIHFIRTNNKNY

SEQ ID NO: 3285763 - protein, 33 aa, Plasmodium falciparum
GKKMKDWEEWFPTIYYNWLAYVNNLEEDFMHDK

SEQ ID NO: 3285764 - protein, 31 aa, Plasmodium falciparum
GKKNKIFLFIINIILFYTLEYVLIGSNYDKH

SEQ ID NO: 3285765 - protein, 31 aa, Plasmodium falciparum
GKKYYKYICPLTPYEIYIIEKFYKHGIKEEL

SEQ ID NO: 3285766 - protein, 19 aa, Plasmodium falciparum
GKLFSFPILISIYGQIIIQ

SEQ ID NO: 3285767 - protein, 17 aa, Plasmodium falciparum
GKLQIYIYTVNGSFIFV

SEQ ID NO: 3285768 - protein, 31 aa, Plasmodium falciparum
GKLYYEMYFILPHCIFFFSFVSIYKELIYYK

SEQ ID NO: 3285769 - protein, 25 aa, Plasmodium falciparum
GKMPIIWNLTFLPLDLIKDDFFIFY

SEQ ID NO: 3285770 - protein, 30 aa, Plasmodium falciparum
GKNATQNMFLIDGSFFFTLVFSSEKLCDYI

SEQ ID NO: 3285771 - protein, 24 aa, Plasmodium falciparum
GKNEYFINVPKRNLQKLWKGRNKN

SEQ ID NO: 3285772 - protein, 28 aa, Plasmodium falciparum
GKNNDKFLYYILLFYIHNVNIIEVNEKF

SEQ ID NO: 3285773 - protein, 21 aa, Plasmodium falciparum
GKPEYIVNFFFMLAEEVREYL

SEQ ID NO: 3285774 - protein, 30 aa, Plasmodium falciparum
GKRVYEFFKKFHLLDWFYNPNDETCYFYLF

SEQ ID NO: 3285775 - protein, 30 aa, Plasmodium falciparum
GKSIEWFPVISLYYWEINLLDIQLSHKNLF

SEQ ID NO: 3285776 - protein, 24 aa, Plasmodium falciparum
GKSLYFPYILYIYEPETYNNINSS

SEQ ID NO: 3285777 - protein, 27 aa, Plasmodium falciparum
GKSTTKNLFLLKKLLKTYKRNVCIREP

SEQ ID NO: 3285778 - protein, 29 aa, Plasmodium falciparum
GKSVKSYNGFFWKWVHDMLIDSMQWRDEH

SEQ ID NO: 3285779 - protein, 26 aa, Plasmodium falciparum
GKSVTAWMYFFKNFGTHVSTLLHLGG

SEQ ID NO: 3285780 - protein, 25 aa, Plasmodium falciparum
GKTISPLFIVRYICIHMKKIHQFNI

SEQ ID NO: 3285781 - protein, 25 aa, Plasmodium falciparum
GKTIVYIMFTIIIAMSIYGCTLMKK

SEQ ID NO: 3285782 - protein, 29 aa, Plasmodium falciparum
GKVLNLKVFHIYNIFSKIIELYYERKRKG

SEQ ID NO: 3285783 - protein, 20 aa, Plasmodium falciparum
GKYLDLRKDWWEANRYKVWK

SEQ ID NO: 3285784 - protein, 19 aa, Plasmodium falciparum
GKYLYLVQCSGRILKNDFF

SEQ ID NO: 3285785 - protein, 22 aa, Plasmodium falciparum
GKYRGKRYIYLEGDSGTDSGYT

SEQ ID NO: 3285786 - protein, 17 aa, Plasmodium falciparum
GLAASYYLNKCNAKFLV

SEQ ID NO: 3285787 - protein, 30 aa, Plasmodium falciparum
GLCIPPRRRKLYVTPLTKWATTAVSSEATP

SEQ ID NO: 3285788 - protein, 41 aa, Plasmodium falciparum
GLDVAKDMFIMDPSILFMLNYSLVQLFPYIGKYDITTIINF

SEQ ID NO: 3285789 - protein, 38 aa, Plasmodium falciparum
GLDVTKDMFIMDPSILFMLNYSLDQLFPYIGKYDITTI

SEQ ID NO: 3285790 - protein, 20 aa, Plasmodium falciparum
GLEIFDIYWITIEKDNKYEF

SEQ ID NO: 3285791 - protein, 25 aa, Plasmodium falciparum
GLEIFFDYIIQIDDLKLLDSSKRTY

SEQ ID NO: 3285792 - protein, 18 aa, Plasmodium falciparum
GLEWLLYYNLPFYNNELN

SEQ ID NO: 3285793 - protein, 19 aa, Plasmodium falciparum
GLFALWKGSVPTIARAMSL

SEQ ID NO: 3285794 - protein, 26 aa, Plasmodium falciparum
GLFDIPSLIDEVGWIPVIFGNVFVCS

SEQ ID NO: 3285795 - protein, 21 aa, Plasmodium falciparum
GLFGGLGIYGWKTAALATAIA

SEQ ID NO: 3285796 - protein, 19 aa, Plasmodium falciparum
GLFLKLLGENSYGFCLNMF

SEQ ID NO: 3285797 - protein, 38 aa, Plasmodium falciparum
GLFLNLKGFVMYLLVISLYFFFLFLTEIQNKCIAKGCV

SEQ ID NO: 3285798 - protein, 17 aa, Plasmodium falciparum
GLFQKFKNSSWFFCIDI

SEQ ID NO: 3285799 - protein, 24 aa, Plasmodium falciparum
GLFQSLRISYFRQLLRQSLPSAWL

SEQ ID NO: 3285800 - protein, 22 aa, Plasmodium falciparum
GLIAIIVLVVIISLAVIIKYRD

SEQ ID NO: 3285801 - protein, 30 aa, Plasmodium falciparum
GLIDSKIFIWLLIFFRIFNCLFVVTSFYPD

SEQ ID NO: 3285802 - protein, 20 aa, Plasmodium falciparum
GLIFDKLFYKLYESLGIILV

SEQ ID NO: 3285803 - protein, 21 aa, Plasmodium falciparum
GLIIYVCMLLSKFYSFKNEED

SEQ ID NO: 3285804 - protein, 23 aa, Plasmodium falciparum
GLISGIVYTGWKAAALAAAKELA

SEQ ID NO: 3285805 - protein, 23 aa, Plasmodium falciparum
GLISGIVYTGWKAAALAAAKKLA

SEQ ID NO: 3285806 - protein, 24 aa, Plasmodium falciparum
GLISGIVYTGWKAAALAAAKKLAA

SEQ ID NO: 3285807 - protein, 24 aa, Plasmodium falciparum
GLISILICYIIKNNLFYYFNKSCV

SEQ ID NO: 3285808 - protein, 33 aa, Plasmodium falciparum
GLKATEKMFLMEPGLLFMIMFSIDEMSDYVGDL

SEQ ID NO: 3285809 - protein, 23 aa, Plasmodium falciparum
GLKFNNFMFLQFEKIILKRFICL

SEQ ID NO: 3285810 - protein, 33 aa, Plasmodium falciparum
GLKKAVYIFLILILIFYDQWSFPLVYSFCINKR

SEQ ID NO: 3285811 - protein, 27 aa, Plasmodium falciparum
GLLKIMIFFVLIFFNFFMFTFDAIVQA

SEQ ID NO: 3285812 - protein, 26 aa, Plasmodium falciparum
GLNATKDMFLIDPSIFYVKMLSIEKF

SEQ ID NO: 3285813 - protein, 24 aa, Plasmodium falciparum
GLNLAHFKILLPLLIKYKYVNNNV

SEQ ID NO: 3285814 - protein, 24 aa, Plasmodium falciparum
GLNNGMIIIYQLDKKLKLLKKIHI

SEQ ID NO: 3285815 - protein, 27 aa, Plasmodium falciparum
GLNTPKNIPVNNRKLRKGCTVHEIGFM

SEQ ID NO: 3285816 - protein, 34 aa, Plasmodium falciparum
GLSKIYCLFPDLFSSFLIEGFIKYIKLFHERIDD

SEQ ID NO: 3285817 - protein, 26 aa, Plasmodium falciparum
GLTCNKIIGYPIYWNRGKGLCRLKRN

SEQ ID NO: 3285818 - protein, 18 aa, Plasmodium falciparum
GLTNFAFSAALVLLLIGF

SEQ ID NO: 3285819 - protein, 20 aa, Plasmodium falciparum
GLYYILFEYNKLILLLCLFD

SEQ ID NO: 3285820 - protein, 24 aa, Plasmodium falciparum
GMACSYLFVILTRYYTDYSYPKVK

SEQ ID NO: 3285821 - protein, 23 aa, Plasmodium falciparum
GMAMLIIPTFYFKNLIFDNFFNL

SEQ ID NO: 3285822 - protein, 26 aa, Plasmodium falciparum
GMEKHREPYFYDIYEDDITYFDIDDE

SEQ ID NO: 3285823 - protein, 19 aa, Plasmodium falciparum
GMGYITFYSFENIEFNLYT

SEQ ID NO: 3285824 - protein, 24 aa, Plasmodium falciparum
GMINKLFHEFLIELSINQGISEEE

SEQ ID NO: 3285825 - protein, 23 aa, Plasmodium falciparum
GMLNPLYTLGFLNIQIKIIFKRN

SEQ ID NO: 3285826 - protein, 23 aa, Plasmodium falciparum
GMMRSRVIYMKPNDINKLIYSFE

SEQ ID NO: 3285827 - protein, 25 aa, Plasmodium falciparum
GMNIPINFDNLGLFIRLMTKCKMNE

SEQ ID NO: 3285828 - protein, 23 aa, Plasmodium falciparum
GMQLTHFPLKYKNKHILKDNILL

SEQ ID NO: 3285829 - protein, 17 aa, Plasmodium falciparum
GMSLSQLSLSYVYSRPF

SEQ ID NO: 3285830 - protein, 30 aa, Plasmodium falciparum
GMSTVHTLYFIWFVLGTLYFFLSIFDKDGM

SEQ ID NO: 3285831 - protein, 25 aa, Plasmodium falciparum
GMVDIINSILLYVNNFVRNYKNGKL

SEQ ID NO: 3285832 - protein, 22 aa, Plasmodium falciparum
GMVKGRELLYKNIKMNENKNNQ

SEQ ID NO: 3285833 - protein, 27 aa, Plasmodium falciparum
GNAFHCILFPLLFVSFSVICSMITFYI

SEQ ID NO: 3285834 - protein, 26 aa, Plasmodium falciparum
GNAFNKYIYYLTRNKKDIYNMICILY

SEQ ID NO: 3285835 - protein, 31 aa, Plasmodium falciparum
GNDTAFPFLSYLHRNLLYYFQQTFAQVTNPA

SEQ ID NO: 3285836 - protein, 37 aa, Plasmodium falciparum
GNEDRRSFMYFISASYFFIMSSIMRSAICKSVHFFWI

SEQ ID NO: 3285837 - protein, 27 aa, Plasmodium falciparum
GNFFQLREDWWYANRATIWEALTCNAQ

SEQ ID NO: 3285838 - protein, 24 aa, Plasmodium falciparum
GNFFSLICVLLFTVMIHKKKSGCQ

SEQ ID NO: 3285839 - protein, 19 aa, Plasmodium falciparum
GNFYKLKYCYTCNIYRGIR

SEQ ID NO: 3285840 - protein, 35 aa, Plasmodium falciparum
GNGNQIIIIRALFKRWLEYFLQDYNKINAKISYCK

SEQ ID NO: 3285841 - protein, 25 aa, Plasmodium falciparum
GNHCIEFCFIILYLINIVYSNHNDV

SEQ ID NO: 3285842 - protein, 20 aa, Plasmodium falciparum
GNHVIVLIICQVFISLIVAI

SEQ ID NO: 3285843 - protein, 33 aa, Plasmodium falciparum
GNILFYVFYFLQQTKHIFLLKMNCLYYMLSKNI

SEQ ID NO: 3285844 - protein, 36 aa, Plasmodium falciparum
GNINSFFFRNYLDVFFILFLKIIYLNENISELNNSA

SEQ ID NO: 3285845 - protein, 20 aa, Plasmodium falciparum
GNIYILDFSNIFFKFNKNHL

SEQ ID NO: 3285846 - protein, 18 aa, Plasmodium falciparum
GNKAPAFCPPPEKPPKEE

SEQ ID NO: 3285847 - protein, 32 aa, Plasmodium falciparum
GNKKKYINIFPIMKVLVICLLLSLVNKSNDNT

SEQ ID NO: 3285848 - protein, 33 aa, Plasmodium falciparum
GNKKNFIYLSSTLFDLLIKCNFMRTYLSSTYRN

SEQ ID NO: 3285849 - protein, 33 aa, Plasmodium falciparum
GNKLKLRIIVILLFLIYIIIFSSQTIIDINTKS

SEQ ID NO: 3285850 - protein, 25 aa, Plasmodium falciparum
GNKYIQIRALMRRWVEHFLEDYNRI

SEQ ID NO: 3285851 - protein, 37 aa, Plasmodium falciparum
GNKYKGLLRTNHFPPYANFNFTIRRKLQTSNVLGHFM

SEQ ID NO: 3285852 - protein, 34 aa, Plasmodium falciparum
GNLDFLEIFLMTIKPYRIILTTLDLNIFRNVEIY

SEQ ID NO: 3285853 - protein, 23 aa, Plasmodium falciparum
GNLNYLDILSLLYFLSRNNLKIK

SEQ ID NO: 3285854 - protein, 24 aa, Plasmodium falciparum
GNNENLLLRIYRFIELIIKKKYNV

SEQ ID NO: 3285855 - protein, 39 aa, Plasmodium falciparum
GNNKQKMFCFKNDNIVLLNKIILYLIDKNRKDAIKKDKL

SEQ ID NO: 3285856 - protein, 24 aa, Plasmodium falciparum
GNNKYLFLDIRLNSHFKSFHLYNS

SEQ ID NO: 3285857 - protein, 25 aa, Plasmodium falciparum
GNNLIYKCYLPLDKALTGFQFSIKS

SEQ ID NO: 3285858 - protein, 30 aa, Plasmodium falciparum
GNNNVYLIQIISMSCTLFSLLDANYHGYLL

SEQ ID NO: 3285859 - protein, 27 aa, Plasmodium falciparum
GNQCTKCFFACYPYEKWIDKKKEEFLK

SEQ ID NO: 3285860 - protein, 25 aa, Plasmodium falciparum
GNQCTKCFFACYPYENWIEKQKEQF

SEQ ID NO: 3285861 - protein, 19 aa, Plasmodium falciparum
GNQCTKCLFACNPYVEWIE

SEQ ID NO: 3285862 - protein, 23 aa, Plasmodium falciparum
GNQIVTWQCYFDKEKPSKKNNNC

SEQ ID NO: 3285863 - protein, 19 aa, Plasmodium falciparum
GNRDILYVNAFLNIYNDEN

SEQ ID NO: 3285864 - protein, 40 aa, Plasmodium falciparum
GNSQGKYYYSYFYALPLYSLFFYFSKQKILSGDKLLRYFF

SEQ ID NO: 3285865 - protein, 44 aa, Plasmodium falciparum
GNTLSTILRLNPLELYLSPLLIKSILSFTFPLLDIINKSHKTAM

SEQ ID NO: 3285866 - protein, 23 aa, Plasmodium falciparum
GNVRYIIALYILAKILKMHYDYK

SEQ ID NO: 3285867 - protein, 21 aa, Plasmodium falciparum
GNYFKLREDWWTANRDQVWKA

SEQ ID NO: 3285868 - protein, 20 aa, Plasmodium falciparum
GNYFQLREDWWTANRATVWK

SEQ ID NO: 3285869 - protein, 27 aa, Plasmodium falciparum
GNYYFPTNFLHKFLDTFLLKKDNAYIM

SEQ ID NO: 3285870 - protein, 19 aa, Plasmodium falciparum
GNYYKLREAWWTANRDQVW

SEQ ID NO: 3285871 - protein, 20 aa, Plasmodium falciparum
GPELLTMWFGESEANVRDLF

SEQ ID NO: 3285872 - protein, 53 aa, Plasmodium falciparum
GPMSNFNYHLFKILCSNDEIYMYFFLFKKFIFSCYIYFNLVSIQIYSNFSNIE

SEQ ID NO: 3285873 - protein, 32 aa, Plasmodium falciparum
GPNIFILNYEYKEKLISFSSLLNKILQEKICD

SEQ ID NO: 3285874 - protein, 17 aa, Plasmodium falciparum
GPYYRPPHIIERSNYYK

SEQ ID NO: 3285875 - protein, 25 aa, Plasmodium falciparum
GQEFKSYYSFFYGSIIDMLKDSVDW

SEQ ID NO: 3285876 - protein, 24 aa, Plasmodium falciparum
GQEKRIYNFFKDDSLYYILNRIHN

SEQ ID NO: 3285877 - protein, 35 aa, Plasmodium falciparum
GQILNIMKFKLNKYFPFFLQIFLTIMHYINSYNYI

SEQ ID NO: 3285878 - protein, 36 aa, Plasmodium falciparum
GQIMIRFNLSINLCRLLLYGVLLDVTFDTIILIGIL

SEQ ID NO: 3285879 - protein, 34 aa, Plasmodium falciparum
GQIQKLRKVYWFEKFHWFISSENYLVIAGRDALQ

SEQ ID NO: 3285880 - protein, 24 aa, Plasmodium falciparum
GQLFNIICWILLSIDIKGVDTTLW

SEQ ID NO: 3285881 - protein, 29 aa, Plasmodium falciparum
GQLILPDTLKLLPLFTSCLLKHNVVKKDA

SEQ ID NO: 3285882 - protein, 26 aa, Plasmodium falciparum
GQNFLWNRWMEIQTYILDKYKEEEPF

SEQ ID NO: 3285883 - protein, 19 aa, Plasmodium falciparum
GQNKVYIYKYDKNIKKKFK

SEQ ID NO: 3285884 - protein, 24 aa, Plasmodium falciparum
GQRAQTNFLFLKKNHLNTTTENIT

SEQ ID NO: 3285885 - protein, 18 aa, Plasmodium falciparum
GQSFLWNRWMERQTYMLD

SEQ ID NO: 3285886 - protein, 21 aa, Plasmodium falciparum
GQYLIIKIFFYSFFNILNIYG

SEQ ID NO: 3285887 - protein, 23 aa, Plasmodium falciparum
GRAGRILYLLKKNKKNKKKMENE

SEQ ID NO: 3285888 - protein, 20 aa, Plasmodium falciparum
GRDKYLKHLKWRCTRAICFC

SEQ ID NO: 3285889 - protein, 25 aa, Plasmodium falciparum
GRIKYFFSYIFYKLFSHIYNKKNKK

SEQ ID NO: 3285890 - protein, 25 aa, Plasmodium falciparum
GRITLFEICLFINEYLNKIFNNDFQ

SEQ ID NO: 3285891 - protein, 24 aa, Plasmodium falciparum
GRKYFPLTTYYLSLRIRASYGWVH

SEQ ID NO: 3285892 - protein, 17 aa, Plasmodium falciparum
GRNIYLIDKNKLNKIFL

SEQ ID NO: 3285893 - protein, 31 aa, Plasmodium falciparum
GRNTYRIKYILYLFSYTYCNFISLISKLRKH

SEQ ID NO: 3285894 - protein, 17 aa, Plasmodium falciparum
GRPILIYKSFFSIKKKN

SEQ ID NO: 3285895 - protein, 25 aa, Plasmodium falciparum
GRRFGLTFFILGCMTICGFRGRMVK

SEQ ID NO: 3285896 - protein, 25 aa, Plasmodium falciparum
GRVESFHLFMMKSFPHLETVKKWHK

SEQ ID NO: 3285897 - protein, 20 aa, Plasmodium falciparum
GRVIMIYYIMKMMVLIFKII

SEQ ID NO: 3285898 - protein, 30 aa, Plasmodium falciparum
GRVYSFHFLVKIFACSLFIWTLYVSHNGNV

SEQ ID NO: 3285899 - protein, 29 aa, Plasmodium falciparum
GRYYATAVRNFVIFKVNYICEYSKCGPNS

SEQ ID NO: 3285900 - protein, 18 aa, Plasmodium falciparum
GSAFFLYPPLYISGCVTF

SEQ ID NO: 3285901 - protein, 17 aa, Plasmodium falciparum
GSALLTLIALIAAKKAA

SEQ ID NO: 3285902 - protein, 26 aa, Plasmodium falciparum
GSCEKREFLYFINSKRKGWADLTETM

SEQ ID NO: 3285903 - protein, 23 aa, Plasmodium falciparum
GSCPLGFYLTYFTYLEIETENEL

SEQ ID NO: 3285904 - protein, 25 aa, Plasmodium falciparum
GSCQKLFRHIPLNYAKYLLLTNKII

SEQ ID NO: 3285905 - protein, 32 aa, Plasmodium falciparum
GSEHAVLHLLYSRFFHKFLYDLKLTKHKEPFQ

SEQ ID NO: 3285906 - protein, 20 aa, Plasmodium falciparum
GSFLFVFFISIYMLNSNSNE

SEQ ID NO: 3285907 - protein, 24 aa, Plasmodium falciparum
GSFLYGCLYYFKISVALAVAAIPE

SEQ ID NO: 3285908 - protein, 26 aa, Plasmodium falciparum
GSFNDIIMIIYTWRQYIFYKTYMNKQ

SEQ ID NO: 3285909 - protein, 19 aa, Plasmodium falciparum
GSFYRTVNAYRINRYFMYR

SEQ ID NO: 3285910 - protein, 30 aa, Plasmodium falciparum
GSICIPPRRRKLYLGGFKRLTDGTSVSSEP

SEQ ID NO: 3285911 - protein, 30 aa, Plasmodium falciparum
GSICVPPRRRKLYLGGFKRLTDGTAVSSET

SEQ ID NO: 3285912 - protein, 19 aa, Plasmodium falciparum
GSIEYKNNFIYCCICGISV

SEQ ID NO: 3285913 - protein, 28 aa, Plasmodium falciparum
GSIKKYMKILFLKFTKNVFLRNYEICNS

SEQ ID NO: 3285914 - protein, 25 aa, Plasmodium falciparum
GSKHNFKIFLKNVKKFLLFNYKESF

SEQ ID NO: 3285915 - protein, 25 aa, Plasmodium falciparum
GSKMVNMMIQIATLFMGAFMIMAVF

SEQ ID NO: 3285916 - protein, 17 aa, Plasmodium falciparum
GSNVPLLGLINGVGIYA

SEQ ID NO: 3285917 - protein, 26 aa, Plasmodium falciparum
GSSDLPIQLSSYLFIKKLLKHDTCLK

SEQ ID NO: 3285918 - protein, 26 aa, Plasmodium falciparum
GSSVLLFQFFFYLTIGYKANTSQYAV

SEQ ID NO: 3285919 - protein, 21 aa, Plasmodium falciparum
GSSVMYLFDYLFSDIKKNDSK

SEQ ID NO: 3285920 - protein, 19 aa, Plasmodium falciparum
GSSYLIIWKVYYNDKKEQF

SEQ ID NO: 3285921 - protein, 25 aa, Plasmodium falciparum
GSTQKILLTFIFKYFVNTFGCITIK

SEQ ID NO: 3285922 - protein, 22 aa, Plasmodium falciparum
GSTWFLLINGGILFSYKYFKNF

SEQ ID NO: 3285923 - protein, 50 aa, Plasmodium falciparum
GSTYLYTYEDKIILFYMIFISLFLIFHLMYILFIFLSKENNFTKLFTERK

SEQ ID NO: 3285924 - protein, 30 aa, Plasmodium falciparum
GSVGPLWCRQIPYTMAKFYFFEKIVQLMYD

SEQ ID NO: 3285925 - protein, 31 aa, Plasmodium falciparum
GSYFNMAMLLFFSIIIPFLKLLMVSDNFYSF

SEQ ID NO: 3285926 - protein, 23 aa, Plasmodium falciparum
GTCSFIYFMFIKQISYSLNMMNE

SEQ ID NO: 3285927 - protein, 25 aa, Plasmodium falciparum
GTDLKQYIEIRALLKRWVDNFFDDY

SEQ ID NO: 3285928 - protein, 23 aa, Plasmodium falciparum
GTEKDVVICLLDKLQKQIETCQT

SEQ ID NO: 3285929 - protein, 29 aa, Plasmodium falciparum
GTFFGYIFLSKFMKLSISLLLLALIQNIL

SEQ ID NO: 3285930 - protein, 24 aa, Plasmodium falciparum
GTGKTFTFKLLKQLKKKFITQLSY

SEQ ID NO: 3285931 - protein, 21 aa, Plasmodium falciparum
GTHFLIPFFERSIIYDVRTKP

SEQ ID NO: 3285932 - protein, 31 aa, Plasmodium falciparum
GTIIWSLGIPLFSFYILYINRHNLFNENVRI

SEQ ID NO: 3285933 - protein, 21 aa, Plasmodium falciparum
GTIKIDHMFCTCSCGSTANSN

SEQ ID NO: 3285934 - protein, 26 aa, Plasmodium falciparum
GTILFTILIFLYPTIFVLVLVFGLIY

SEQ ID NO: 3285935 - protein, 24 aa, Plasmodium falciparum
GTINFLFIAFLKFSEKSKLFVFPD

SEQ ID NO: 3285936 - protein, 27 aa, Plasmodium falciparum
GTIPPDFLRQMFYTLGDYRDICIGVKE

SEQ ID NO: 3285937 - protein, 27 aa, Plasmodium falciparum
GTIPTDFLRQMFYTLGDYRDLCVGVKE

SEQ ID NO: 3285938 - protein, 32 aa, Plasmodium falciparum
GTIVFNVFFLLFFFSYIYLYIKTFSKEFQNYS

SEQ ID NO: 3285939 - protein, 24 aa, Plasmodium falciparum
GTKELPLTPRPRPGPQPKPPPQVE

SEQ ID NO: 3285940 - protein, 17 aa, Plasmodium falciparum
GTKIPYYDIARIANAII

SEQ ID NO: 3285941 - protein, 18 aa, Plasmodium falciparum
GTKSFYSLPTILTANSDN

SEQ ID NO: 3285942 - protein, 30 aa, Plasmodium falciparum
GTKSIYHFSFFFSLIDYFILNIYKCLKYNI

SEQ ID NO: 3285943 - protein, 26 aa, Plasmodium falciparum
GTLMECYIFPNINYLRLSEMLYEQKK

SEQ ID NO: 3285944 - protein, 40 aa, Plasmodium falciparum
GTNIKRKGFIFYRNFYFVLFLLVYIFQSFNECPFNHYCSY

SEQ ID NO: 3285945 - protein, 24 aa, Plasmodium falciparum
GTPFDKFLFYCFKQLLSSFFTEDK

SEQ ID NO: 3285946 - protein, 18 aa, Plasmodium falciparum
GTPGRLHKLIHEKKIIKL

SEQ ID NO: 3285947 - protein, 24 aa, Plasmodium falciparum
GTVPASAFFYCFYELSKKLLTDYN

SEQ ID NO: 3285948 - protein, 26 aa, Plasmodium falciparum
GTYFNNPLFKYFKKYCLYIYENKNCE

SEQ ID NO: 3285949 - protein, 23 aa, Plasmodium falciparum
GTYNIIFEIFVDSISNIIFQDVK

SEQ ID NO: 3285950 - protein, 22 aa, Plasmodium falciparum
GVEHKLISFALNLLCVSKKYEL

SEQ ID NO: 3285951 - protein, 22 aa, Plasmodium falciparum
GVFEYINPYIILNIIKKHKSIY

SEQ ID NO: 3285952 - protein, 17 aa, Plasmodium falciparum
GVFLTSGVNFELEGDAN

SEQ ID NO: 3285953 - protein, 24 aa, Plasmodium falciparum
GVGKRLPFFNFINKLYDEIIKLKD

SEQ ID NO: 3285954 - protein, 23 aa, Plasmodium falciparum
GVHKIYIYKLYINLTNEKCLLKL

SEQ ID NO: 3285955 - protein, 41 aa, Plasmodium falciparum
GVITYKYIYSKHFFSEIINYLFSFFYMNEFFFKNVHLWGKY

SEQ ID NO: 3285956 - protein, 24 aa, Plasmodium falciparum
GVIVWALLYALFSAIFRAGFMQKI

SEQ ID NO: 3285957 - protein, 27 aa, Plasmodium falciparum
GVLFLFYMTFLFFYFILISSNCSENMI

SEQ ID NO: 3285958 - protein, 20 aa, Plasmodium falciparum
GVMLMFTYELIFAFSMYAFS

SEQ ID NO: 3285959 - protein, 29 aa, Plasmodium falciparum
GVNFIHPTIYYMLASLEKFAFYTGSPQIV

SEQ ID NO: 3285960 - protein, 35 aa, Plasmodium falciparum
GVNTDSYILIWSYNNYINPLYALISPYQISSAIVN

SEQ ID NO: 3285961 - protein, 22 aa, Plasmodium falciparum
GVQSLYYLVWSISAYFGGWLSD

SEQ ID NO: 3285962 - protein, 17 aa, Plasmodium falciparum
GVSLTSAYSLKLTKIIF

SEQ ID NO: 3285963 - protein, 24 aa, Plasmodium falciparum
GVTALTPITLYSSAAGYIHQELGK

SEQ ID NO: 3285964 - protein, 35 aa, Plasmodium falciparum
GVTKNNKIIVKLKEPFFYFHQNVVLYFNNDKITHD

SEQ ID NO: 3285965 - protein, 19 aa, Plasmodium falciparum
GVVIIDYYLPNTSIKKKKK

SEQ ID NO: 3285966 - protein, 31 aa, Plasmodium falciparum
GVVVNFLYLIILLSLLIVIYKYYYTNFFYFY

SEQ ID NO: 3285967 - protein, 25 aa, Plasmodium falciparum
GVVYIFNLRRSIIVHKLFVNGTTEN

SEQ ID NO: 3285968 - protein, 29 aa, Plasmodium falciparum
GVYINKHLIFILLFFMNMKQKLLSILNND

SEQ ID NO: 3285969 - protein, 19 aa, Plasmodium falciparum
GWRVLKRPYADRFFKELSS

SEQ ID NO: 3285970 - protein, 26 aa, Plasmodium falciparum
GYAYYNLITLFFFSVAAGILIQYNLN

SEQ ID NO: 3285971 - protein, 33 aa, Plasmodium falciparum
GYDIRKCYNGIDLIFLFLSKIKGANVNFINGNN

SEQ ID NO: 3285972 - protein, 29 aa, Plasmodium falciparum
GYEEINELLYKLNFYFDLLRAKLNDVCAN

SEQ ID NO: 3285973 - protein, 21 aa, Plasmodium falciparum
GYESKFYKIFKGKCGTVDAFL

SEQ ID NO: 3285974 - protein, 20 aa, Plasmodium falciparum
GYHHLYYYDYYDYYDYYLYY

SEQ ID NO: 3285975 - protein, 22 aa, Plasmodium falciparum
GYIEKIIVYIGFPKINLTNKQL

SEQ ID NO: 3285976 - protein, 30 aa, Plasmodium falciparum
GYIRSLDLQIPLLYLFQKASLKVSDVVIVL

SEQ ID NO: 3285977 - protein, 19 aa, Plasmodium falciparum
GYIYFDFLDLFIIFNALDE

SEQ ID NO: 3285978 - protein, 22 aa, Plasmodium falciparum
GYKKYILFQLEKNFYDLYCFIH

SEQ ID NO: 3285979 - protein, 48 aa, Plasmodium falciparum
GYKNNSFFFLIDKKMVKTLLIKLTFMMPFIYKLKIPACVIRLYIRVIK

SEQ ID NO: 3285980 - protein, 29 aa, Plasmodium falciparum
GYKRIMVNFFILYNIFRFKEKCFQNENLL

SEQ ID NO: 3285981 - protein, 22 aa, Plasmodium falciparum
GYLIVLNSFLLYYYSKSLALSK

SEQ ID NO: 3285982 - protein, 25 aa, Plasmodium falciparum
GYLKYNYCLILKSLNKIELVSLNIF

SEQ ID NO: 3285983 - protein, 58 aa, Plasmodium falciparum
GYLQYFILYDMCIKLFLFFSSNYILSFWFLLNLLNTPFFYILVSYFNNIKYKKMHWLY

SEQ ID NO: 3285984 - protein, 20 aa, Plasmodium falciparum
GYNLLHLIFNKYKSANFLNY

SEQ ID NO: 3285985 - protein, 20 aa, Plasmodium falciparum
GYNNLFFVNSLHPLSIIYND

SEQ ID NO: 3285986 - protein, 45 aa, Plasmodium falciparum
GYNTENIFIHIWRFAPDSIILIIYTILTLWFVVGLLCYHIYTIVT

SEQ ID NO: 3285987 - protein, 25 aa, Plasmodium falciparum
GYNVANYFFYVKIDCAKTNDIIENE

SEQ ID NO: 3285988 - protein, 23 aa, Plasmodium falciparum
GYNVKKLIYTVFMRSKNILRNTK

SEQ ID NO: 3285989 - protein, 26 aa, Plasmodium falciparum
GYNYYSKVFLILKKIIYLKNYKDRDV

SEQ ID NO: 3285990 - protein, 35 aa, Plasmodium falciparum
GYQYLQYQILNLNKIFSPLLNLCLHRHFNIVAKVE

SEQ ID NO: 3285991 - protein, 35 aa, Plasmodium falciparum
GYSGIAILIILLVMIIIYLILRYRRKKKMNKKLQY

SEQ ID NO: 3285992 - protein, 19 aa, Plasmodium falciparum
GYSSLFMYLKEYTNIIFKY

SEQ ID NO: 3285993 - protein, 30 aa, Plasmodium falciparum
GYSVGARVIFYCLKYLYSKKLYNIVSNAIF

SEQ ID NO: 3285994 - protein, 19 aa, Plasmodium falciparum
GYYYSKIFSLYPLDQIHLN

SEQ ID NO: 3285995 - protein, 25 aa, Plasmodium falciparum
HADISIYIILLNSCVFFLCSKSYMT

SEQ ID NO: 3285996 - protein, 27 aa, Plasmodium falciparum
HAFIKKKGFYILCYILFHIQNNHIIYK

SEQ ID NO: 3285997 - protein, 29 aa, Plasmodium falciparum
HAYINKPYEYFYLNKYIPVHFELQNKGII

SEQ ID NO: 3285998 - protein, 27 aa, Plasmodium falciparum
HCFRIFLMFTLFYFIPKEATSFIYFVI

SEQ ID NO: 3285999 - protein, 24 aa, Plasmodium falciparum
HCLKRLFKYPPVENIKILIDLSFK

SEQ ID NO: 3286000 - protein, 17 aa, Plasmodium falciparum
HCRKWCRNFYFKSCSLV

SEQ ID NO: 3286001 - protein, 17 aa, Plasmodium falciparum
HCSILRKELYDRYIMIV

SEQ ID NO: 3286002 - protein, 25 aa, Plasmodium falciparum
HCSNNIYVHILFNDLYITLHKKIFI

SEQ ID NO: 3286003 - protein, 20 aa, Plasmodium falciparum
HCYRIVISIFIFLLNHSRCI

SEQ ID NO: 3286004 - protein, 33 aa, Plasmodium falciparum
HDEIQKTFNPFFYYWVAHMLKDSIHWKKKLEKC

SEQ ID NO: 3286005 - protein, 21 aa, Plasmodium falciparum
HDIFDFYFLRKLKYSLEHSDN

SEQ ID NO: 3286006 - protein, 33 aa, Plasmodium falciparum
HDIKYYIHNLYKICYFFILSKKLITNVEFINQI

SEQ ID NO: 3286007 - protein, 34 aa, Plasmodium falciparum
HDKKNVLIRTLFKRWLEYFFEDYNRIQKKLKPCI

SEQ ID NO: 3286008 - protein, 34 aa, Plasmodium falciparum
HDKKNVLIRTLFKRWLEYFLQDYIKINAKFSHCT

SEQ ID NO: 3286009 - protein, 17 aa, Plasmodium falciparum
HDLFLLLGKYNILPYDT

SEQ ID NO: 3286010 - protein, 21 aa, Plasmodium falciparum
HDLLLDYFFDLHFIKDELKCQ

SEQ ID NO: 3286011 - protein, 18 aa, Plasmodium falciparum
HDLNLQNIPLKVIIGRSG

SEQ ID NO: 3286012 - protein, 25 aa, Plasmodium falciparum
HDQNYILINYYLNIKKKYVKLSNLS

SEQ ID NO: 3286013 - protein, 30 aa, Plasmodium falciparum
HDRSILLDIVLLFIKLYLHNKQKDEQMFKL

SEQ ID NO: 3286014 - protein, 30 aa, Plasmodium falciparum
HDVPTYFDYVPQYLRWFEEWAEDFCRKRKK

SEQ ID NO: 3286015 - protein, 19 aa, Plasmodium falciparum
HDVSYLKFIINKIKNFKMS

SEQ ID NO: 3286016 - protein, 25 aa, Plasmodium falciparum
HDYMFIFLQHIIINKNYFPQIIENT

SEQ ID NO: 3286017 - protein, 26 aa, Plasmodium falciparum
HDYNNFIFLPFFVISINDDKKYFTYV

SEQ ID NO: 3286018 - protein, 38 aa, Plasmodium falciparum
HEAQSLKTILIFEIEILFNYFKINVFDYYNKCNIIKSR

SEQ ID NO: 3286019 - protein, 17 aa, Plasmodium falciparum
HEDIFVAIYIEVYEKVS

SEQ ID NO: 3286020 - protein, 18 aa, Plasmodium falciparum
HEDIYKNIFLLPNNIHNY

SEQ ID NO: 3286021 - protein, 23 aa, Plasmodium falciparum
HEDLEIFHFLKDDIFLCSNYKFH

SEQ ID NO: 3286022 - protein, 24 aa, Plasmodium falciparum
HEEYKHFIYIVYILNVFNMEDKAH

SEQ ID NO: 3286023 - protein, 17 aa, Plasmodium falciparum
HEFLKRFKIYLDEIICR

SEQ ID NO: 3286024 - protein, 24 aa, Plasmodium falciparum
HEFNKLYNMLSIKMKNKFDSENDM

SEQ ID NO: 3286025 - protein, 34 aa, Plasmodium falciparum
HEFYKNLIIYLNYNYICILFINAPNYKNCSSNYV

SEQ ID NO: 3286026 - protein, 27 aa, Plasmodium falciparum
HELRLKNIYIILLLKRKACDIIIDFCS

SEQ ID NO: 3286027 - protein, 18 aa, Plasmodium falciparum
HENAEGHFTPYESGKNKI

SEQ ID NO: 3286028 - protein, 26 aa, Plasmodium falciparum
HENDYTVFFYELLDKDPTLDEIKNYI

SEQ ID NO: 3286029 - protein, 30 aa, Plasmodium falciparum
HENFKYNNIFLLPKFYPINKEYAILSKYIL

SEQ ID NO: 3286030 - protein, 23 aa, Plasmodium falciparum
HENSDCIILIKKLIKIKNNYIDV

SEQ ID NO: 3286031 - protein, 33 aa, Plasmodium falciparum
HERMYFASGIVVSILFLFSFGFVINSKNNKQEY

SEQ ID NO: 3286032 - protein, 25 aa, Plasmodium falciparum
HESILLSAIFWVLSSISLINKKRET

SEQ ID NO: 3286033 - protein, 39 aa, Plasmodium falciparum
HESITKFLRAFKMIVMYLLIIILVLFITSRSYAYSRTTL

SEQ ID NO: 3286034 - protein, 25 aa, Plasmodium falciparum
HEYFLNYIIFYYICNLKKVCNKWLC

SEQ ID NO: 3286035 - protein, 22 aa, Plasmodium falciparum
HEYLISIPLKLGFTGYIFFAFI

SEQ ID NO: 3286036 - protein, 27 aa, Plasmodium falciparum
HFARNQFLFNFIFYSNILIYLEKLKKE

SEQ ID NO: 3286037 - protein, 29 aa, Plasmodium falciparum
HFFNFIHQHIFFLYNKYIMGKYAIPFFGF

SEQ ID NO: 3286038 - protein, 22 aa, Plasmodium falciparum
HFFVLYIICSCFILILSIKHDK

SEQ ID NO: 3286039 - protein, 19 aa, Plasmodium falciparum
HFFYLLKNYNESLLFLYNE

SEQ ID NO: 3286040 - protein, 24 aa, Plasmodium falciparum
HFGMYEICRYILQAYLYNNLKKEK

SEQ ID NO: 3286041 - protein, 19 aa, Plasmodium falciparum
HFGYIYKTIISFKKKYKQY

SEQ ID NO: 3286042 - protein, 17 aa, Plasmodium falciparum
HFHNVYFSSPYLNLFLS

SEQ ID NO: 3286043 - protein, 19 aa, Plasmodium falciparum
HFHTILFARLLSGFGIGLV

SEQ ID NO: 3286044 - protein, 22 aa, Plasmodium falciparum
HFIHFFQCNKNIFIQKYKEFQH

SEQ ID NO: 3286045 - protein, 20 aa, Plasmodium falciparum
HFIKTYIQILFLISQRKNLF

SEQ ID NO: 3286046 - protein, 21 aa, Plasmodium falciparum
HFIRRGIFFSHRDLDFLLNYY

SEQ ID NO: 3286047 - protein, 30 aa, Plasmodium falciparum
HFKNNFFFLDKIFIPKDAFFFVKDSEDIGL

SEQ ID NO: 3286048 - protein, 47 aa, Plasmodium falciparum
HFKRKMDFFFEFLPQLVMMLSMIGYLVFLIIYKWVTPVGYGGFQKQG

SEQ ID NO: 3286049 - protein, 35 aa, Plasmodium falciparum
HFKSLIWITIWFFQQFLWCMLYFKSPGFYKENHMF

SEQ ID NO: 3286050 - protein, 53 aa, Plasmodium falciparum
HFLKDNHILLSKYYTAKFIDILNKTYYYNLYKNKILLFNKYIIKLRNDLKEYA

SEQ ID NO: 3286051 - protein, 25 aa, Plasmodium falciparum
HFLKNKYILVPYQKYIKIMQSNLLY

SEQ ID NO: 3286052 - protein, 21 aa, Plasmodium falciparum
HFLKSLFYRITYIEIKTKDGR

SEQ ID NO: 3286053 - protein, 18 aa, Plasmodium falciparum
HFLVFYMSILNKQYKYKC

SEQ ID NO: 3286054 - protein, 17 aa, Plasmodium falciparum
HFLYMYKIIEINRHIEL

SEQ ID NO: 3286055 - protein, 34 aa, Plasmodium falciparum
HFNCFNLILCHWIFRLRRVCTDSGKEWVFPSELF

SEQ ID NO: 3286056 - protein, 32 aa, Plasmodium falciparum
HFNNTYLIKLLIEFFYFYSIDFKLHDACIVVR

SEQ ID NO: 3286057 - protein, 27 aa, Plasmodium falciparum
HFNSLTLPAVIYWSIQHIYDLLVIIVI

SEQ ID NO: 3286058 - protein, 19 aa, Plasmodium falciparum
HFNTYVINLLLLLYDNKNF

SEQ ID NO: 3286059 - protein, 25 aa, Plasmodium falciparum
HFQEEHIFLLIRSIYKICINNQHYF

SEQ ID NO: 3286060 - protein, 31 aa, Plasmodium falciparum
HFQQEDPLLNFLFKKSYFKNILHKNEKHNNY

SEQ ID NO: 3286061 - protein, 26 aa, Plasmodium falciparum
HFSIYSILILIKYKFFSFVNMKNKNK

SEQ ID NO: 3286062 - protein, 24 aa, Plasmodium falciparum
HFSKPYLEESILNSFYNIQLGSSV

SEQ ID NO: 3286063 - protein, 26 aa, Plasmodium falciparum
HFVLKYILVIILGVLCAEFCVMVIHI

SEQ ID NO: 3286064 - protein, 18 aa, Plasmodium falciparum
HFVYKDIEFLFKQIDQKR

SEQ ID NO: 3286065 - protein, 19 aa, Plasmodium falciparum
HFYIFLKIFFLYLNVYNLG

SEQ ID NO: 3286066 - protein, 23 aa, Plasmodium falciparum
HFYQLREDWWIANRHTVWEAITC

SEQ ID NO: 3286067 - protein, 23 aa, Plasmodium falciparum
HGDILIWKLVNFDLVKILKNCHL

SEQ ID NO: 3286068 - protein, 29 aa, Plasmodium falciparum
HGGLENDLPLYFYFLNKKKKRCKKSKPKE

SEQ ID NO: 3286069 - protein, 23 aa, Plasmodium falciparum
HGICIRMISKNFLNLLRDHKISE

SEQ ID NO: 3286070 - protein, 23 aa, Plasmodium falciparum
HGKIDIIMFRNAIKRAISCRKKF

SEQ ID NO: 3286071 - protein, 19 aa, Plasmodium falciparum
HGKITIHLPATIDITSISI

SEQ ID NO: 3286072 - protein, 22 aa, Plasmodium falciparum
HGMKIVIYYLKDWGIQQCCPEI

SEQ ID NO: 3286073 - protein, 28 aa, Plasmodium falciparum
HGRYEKNIFFTKMGPLLIYVNPMEKEKN

SEQ ID NO: 3286074 - protein, 36 aa, Plasmodium falciparum
HGSLSFMVNLNAICLFFLSLGGYYIYTPYSDNFQIV

SEQ ID NO: 3286075 - protein, 41 aa, Plasmodium falciparum
HHFMYNEFLKNCKFFSFVLKKKKKITIPEELVVLIPHIEYN

SEQ ID NO: 3286076 - protein, 26 aa, Plasmodium falciparum
HHIIKTMIFLFVLIFYNVHVDNNNTI

SEQ ID NO: 3286077 - protein, 24 aa, Plasmodium falciparum
HHLEKMTCILIFSLKNKISSARDD

SEQ ID NO: 3286078 - protein, 17 aa, Plasmodium falciparum
HHLEMKYIYLYYKNIEK

SEQ ID NO: 3286079 - protein, 23 aa, Plasmodium falciparum
HHLKNLYIILKKKNLKKKEPNKA

SEQ ID NO: 3286080 - protein, 17 aa, Plasmodium falciparum
HHLMLNFKDLPSTNMKD

SEQ ID NO: 3286081 - protein, 17 aa, Plasmodium falciparum
HHMNLTTPLVKYEEIQN

SEQ ID NO: 3286082 - protein, 18 aa, Plasmodium falciparum
HHNHLYFLINKRKKKYIL

SEQ ID NO: 3286083 - protein, 17 aa, Plasmodium falciparum
HICGDFLDFPIFEEYII

SEQ ID NO: 3286084 - protein, 37 aa, Plasmodium falciparum
HICSLHLLEYIFFKKITILLFLNKFSYISSKALKFSQ

SEQ ID NO: 3286085 - protein, 20 aa, Plasmodium falciparum
HICVYYFMRKNYSKCIYYIK

SEQ ID NO: 3286086 - protein, 19 aa, Plasmodium falciparum
HIDILWNSFISNLFKDEYI

SEQ ID NO: 3286087 - protein, 17 aa, Plasmodium falciparum
HIDVLRDNGTVVFSVQP

SEQ ID NO: 3286088 - protein, 24 aa, Plasmodium falciparum
HIEFINLFNNNIFFIKCIDTLPIY

SEQ ID NO: 3286089 - protein, 25 aa, Plasmodium falciparum
HIEMYIVISILLTFGLVFSICVYLP

SEQ ID NO: 3286090 - protein, 28 aa, Plasmodium falciparum
HIEYPVTLYFIYLFNKLNEYTNYINLKL

SEQ ID NO: 3286091 - protein, 23 aa, Plasmodium falciparum
HIFFFVLFFITIYEIKCQLRFAS

SEQ ID NO: 3286092 - protein, 24 aa, Plasmodium falciparum
HIFFIYKILYMLKNNDIFTLNIEN

SEQ ID NO: 3286093 - protein, 18 aa, Plasmodium falciparum
HIFKNVFPFLFMLTGIAT

SEQ ID NO: 3286094 - protein, 36 aa, Plasmodium falciparum
HIFKSSFIFLIYQLVFFILLMLIISRLRVLALPLIC

SEQ ID NO: 3286095 - protein, 19 aa, Plasmodium falciparum
HIFNHVWNYSKGSKFLLSQ

SEQ ID NO: 3286096 - protein, 27 aa, Plasmodium falciparum
HIGCELIKLIEICLDLSLVIFNNIDEI

SEQ ID NO: 3286097 - protein, 20 aa, Plasmodium falciparum
HIGSAVPLYMSYKLIICICI

SEQ ID NO: 3286098 - protein, 50 aa, Plasmodium falciparum
HIGSAVPLYMSYKLIICICIPKLIFYMLLWMKNLLLHQYKIDFLVVVINN

SEQ ID NO: 3286099 - protein, 34 aa, Plasmodium falciparum
HIHDYKCVKSIYYNKTYFLLYCPNNDEEDISKNP

SEQ ID NO: 3286100 - protein, 18 aa, Plasmodium falciparum
HIIIFLFTQAFFGLAIGC

SEQ ID NO: 3286101 - protein, 24 aa, Plasmodium falciparum
HIILHFLNFQIFIKNNYLKCNMLY

SEQ ID NO: 3286102 - protein, 28 aa, Plasmodium falciparum
HIIPENFISIYLYFIQSRVYNPILFHNI

SEQ ID NO: 3286103 - protein, 23 aa, Plasmodium falciparum
HIIQIFSLWFLLFHFIKREFESL

SEQ ID NO: 3286104 - protein, 24 aa, Plasmodium falciparum
HIIRYYCVYAIFYRNRKDHFELIL

SEQ ID NO: 3286105 - protein, 24 aa, Plasmodium falciparum
HIKEFFFYFYCILIICEINTPIII

SEQ ID NO: 3286106 - protein, 24 aa, Plasmodium falciparum
HIKEKKLLYFTPYNIIYLNNNKNI

SEQ ID NO: 3286107 - protein, 22 aa, Plasmodium falciparum
HIKIFKLNGYLNFLKKKKKKKK

SEQ ID NO: 3286108 - protein, 17 aa, Plasmodium falciparum
HIKIYKYEQIKLLELAI

SEQ ID NO: 3286109 - protein, 30 aa, Plasmodium falciparum
HIKKFFLYLSILFLISPFKPFYKFSHFLFF

SEQ ID NO: 3286110 - protein, 23 aa, Plasmodium falciparum
HIKKILLKKPTNKILRKLNYDDF

SEQ ID NO: 3286111 - protein, 35 aa, Plasmodium falciparum
HIKLVNILELSYYDYIFLKTHKIFFSKKGVKIYDH

SEQ ID NO: 3286112 - protein, 33 aa, Plasmodium falciparum
HIKLYKKLKITFKVIFIMITCVITSVICPTCPV

SEQ ID NO: 3286113 - protein, 28 aa, Plasmodium falciparum
HIKMFSRIMLFLFFVKKKYIILYEQCLY

SEQ ID NO: 3286114 - protein, 42 aa, Plasmodium falciparum
HIKNKITWNVLYALKLIYNNFSFFFSYNFYNLHNKILDNLIY

SEQ ID NO: 3286115 - protein, 23 aa, Plasmodium falciparum
HILFSLFYIFFGTLIIIIFILTY

SEQ ID NO: 3286116 - protein, 24 aa, Plasmodium falciparum
HILKIFSKFFVIPKLSYDQFKEII

SEQ ID NO: 3286117 - protein, 29 aa, Plasmodium falciparum
HILLGNFIPRLKLQNFYFFVIHKKKNIPK

SEQ ID NO: 3286118 - protein, 19 aa, Plasmodium falciparum
HILLKYIKSLDRLSKYYLS

SEQ ID NO: 3286119 - protein, 25 aa, Plasmodium falciparum
HILLLQFLLCLIRCYVHNDVIKFGE

SEQ ID NO: 3286120 - protein, 27 aa, Plasmodium falciparum
HILNKIHKIFKIIRLQIIKKYRIINIR

SEQ ID NO: 3286121 - protein, 26 aa, Plasmodium falciparum
HILTINTYLLLKRTNILFVNHQSVLI

SEQ ID NO: 3286122 - protein, 23 aa, Plasmodium falciparum
HIMIRIIYFFLFILCNIIMIKHY

SEQ ID NO: 3286123 - protein, 33 aa, Plasmodium falciparum
HIMNILHMIFVSIFILLFTVIMAYLNVFTGANR

SEQ ID NO: 3286124 - protein, 43 aa, Plasmodium falciparum
HIMNKCYLYHRWINFLMKKYNKIIIYLLNKKNIVKLILFNNRN

SEQ ID NO: 3286125 - protein, 25 aa, Plasmodium falciparum
HIMNNLFFHLLIECILTTSNMYQYN

SEQ ID NO: 3286126 - protein, 29 aa, Plasmodium falciparum
HIMYENLLPLHLYLHHIFNNIPEYFYIKK

SEQ ID NO: 3286127 - protein, 28 aa, Plasmodium falciparum
HINCKIIFYLFFFILNNKEYIYIYDSEK

SEQ ID NO: 3286128 - protein, 18 aa, Plasmodium falciparum
HINFFKYAMNNYKKVFKK

SEQ ID NO: 3286129 - protein, 26 aa, Plasmodium falciparum
HINIFTQLFNKLVQQYFPFFKEDFEK

SEQ ID NO: 3286130 - protein, 18 aa, Plasmodium falciparum
HINQFYMFIKTNNKQYNS

SEQ ID NO: 3286131 - protein, 18 aa, Plasmodium falciparum
HINSDFDLLKPFVKHTIK

SEQ ID NO: 3286132 - protein, 22 aa, Plasmodium falciparum
HIPAGIYLLFYSSLYGYFLTYD

SEQ ID NO: 3286133 - protein, 21 aa, Plasmodium falciparum
HIQYNILTFICSLLKEINYID

SEQ ID NO: 3286134 - protein, 18 aa, Plasmodium falciparum
HIRTLINFILCINHFSIY

SEQ ID NO: 3286135 - protein, 30 aa, Plasmodium falciparum
HISIYLSSFCFLLYYYLVVNMFNQLIDINK

SEQ ID NO: 3286136 - protein, 17 aa, Plasmodium falciparum
HITFTIVFFVWKLLYTD

SEQ ID NO: 3286137 - protein, 22 aa, Plasmodium falciparum
HITHYDLCLNIFRGQDIELIGN

SEQ ID NO: 3286138 - protein, 29 aa, Plasmodium falciparum
HITLLFYLILLFYLKNFTISFIDVPKKLF

SEQ ID NO: 3286139 - protein, 18 aa, Plasmodium falciparum
HIVKASAPLFAAFFSYFF

SEQ ID NO: 3286140 - protein, 32 aa, Plasmodium falciparum
HIVKLNVVTLIWLSYLFLLKPHGTLKNMMVCN

SEQ ID NO: 3286141 - protein, 19 aa, Plasmodium falciparum
HIWEGMICALTYKESENGD

SEQ ID NO: 3286142 - protein, 17 aa, Plasmodium falciparum
HIWEGMICALTYKETSG

SEQ ID NO: 3286143 - protein, 18 aa, Plasmodium falciparum
HIWNGMICALTYKENGID

SEQ ID NO: 3286144 - protein, 17 aa, Plasmodium falciparum
HIWRIFLNFLYVGKFSL

SEQ ID NO: 3286145 - protein, 34 aa, Plasmodium falciparum
HIYFKKIIYVLLNTKYILLLLIDNSCCPLLHEHI

SEQ ID NO: 3286146 - protein, 21 aa, Plasmodium falciparum
HIYFNFLFNIHYLHNLNDHMN

SEQ ID NO: 3286147 - protein, 31 aa, Plasmodium falciparum
HIYHKFKLGIVYLFDHYIIGGINLINPYNSM

SEQ ID NO: 3286148 - protein, 26 aa, Plasmodium falciparum
HIYIYDFFVNVFYYLDLYYSNMKKEK

SEQ ID NO: 3286149 - protein, 19 aa, Plasmodium falciparum
HIYIYLINIILTSGKERIE

SEQ ID NO: 3286150 - protein, 26 aa, Plasmodium falciparum
HIYKEYINYFLPRYKSLLIDYENYKF

SEQ ID NO: 3286151 - protein, 26 aa, Plasmodium falciparum
HIYNIFNWFSFINYRYGCSYEFINFV

SEQ ID NO: 3286152 - protein, 17 aa, Plasmodium falciparum
HIYNLNNFYYFRKRYDY

SEQ ID NO: 3286153 - protein, 23 aa, Plasmodium falciparum
HKARKNVFKYLLRNERLLFKRRR

SEQ ID NO: 3286154 - protein, 22 aa, Plasmodium falciparum
HKFIQFVFRLFKINSTNNIHIY

SEQ ID NO: 3286155 - protein, 24 aa, Plasmodium falciparum
HKFNNFLLHIFYNISLHDFELPSH

SEQ ID NO: 3286156 - protein, 38 aa, Plasmodium falciparum
HKFSWQIINLIIDSIWKILIYIFYNIKINIFSIKVKTF

SEQ ID NO: 3286157 - protein, 24 aa, Plasmodium falciparum
HKFTKTLYFYFSTNKSIPLMVLNF

SEQ ID NO: 3286158 - protein, 24 aa, Plasmodium falciparum
HKFVKIPFLFEYFTLFVITINLSE

SEQ ID NO: 3286159 - protein, 21 aa, Plasmodium falciparum
HKHKTYSFFRFKFSALQEQYD

SEQ ID NO: 3286160 - protein, 24 aa, Plasmodium falciparum
HKHPYLLCIFKYKDLKEDGNEKKN

SEQ ID NO: 3286161 - protein, 28 aa, Plasmodium falciparum
HKHRLVLMFFKKYIYKLLNKQNMFIINF

SEQ ID NO: 3286162 - protein, 34 aa, Plasmodium falciparum
HKILNEYIYIFNKDLFLFNYKFLYTLSYNIHYIY

SEQ ID NO: 3286163 - protein, 61 aa, Plasmodium falciparum
HKINFNQFISIWNIMCILFWDTDEINNFTFLQKNKYYYYDFMLIFLKTFYDYINVNRDMRE

SEQ ID NO: 3286164 - protein, 34 aa, Plasmodium falciparum
HKIVPSVSSFSVFDLYKLFFFDHKELDKINNEQD

SEQ ID NO: 3286165 - protein, 17 aa, Plasmodium falciparum
HKKKKCFLLPKKKLRKR

SEQ ID NO: 3286166 - protein, 43 aa, Plasmodium falciparum
HKKNKFYKTFTPWYRFIFLLLGVFFLYVWKLESSLSQLWNMPS

SEQ ID NO: 3286167 - protein, 18 aa, Plasmodium falciparum
HKKQRLEWAIQISCIVHE

SEQ ID NO: 3286168 - protein, 22 aa, Plasmodium falciparum
HKKSIFLFFKILISYPSVCVIT

SEQ ID NO: 3286169 - protein, 31 aa, Plasmodium falciparum
HKKSQMINLLKYVKFILKYWNIYNLINEKNL

SEQ ID NO: 3286170 - protein, 26 aa, Plasmodium falciparum
HKKTLLFLENLLLKCNMNENIINIVS

SEQ ID NO: 3286171 - protein, 25 aa, Plasmodium falciparum
HKKYNWKYLHNLEEYNRKSYCEEEK

SEQ ID NO: 3286172 - protein, 27 aa, Plasmodium falciparum
HKKYVPYLLFENFLTYSLNKIDNEKDK

SEQ ID NO: 3286173 - protein, 22 aa, Plasmodium falciparum
HKLHKLIDLLIPNKTIIYITHS

SEQ ID NO: 3286174 - protein, 17 aa, Plasmodium falciparum
HKNCIITLSYINFEIIK

SEQ ID NO: 3286175 - protein, 30 aa, Plasmodium falciparum
HKNDFILCTYIYLMFYIYDKEKKKSYIFSN

SEQ ID NO: 3286176 - protein, 24 aa, Plasmodium falciparum
HKNKFFFPFFHINLKTCELKEICY

SEQ ID NO: 3286177 - protein, 35 aa, Plasmodium falciparum
HKPTCIPTYIYTNTYILIFIYRKKPNITSGRTNLF

SEQ ID NO: 3286178 - protein, 43 aa, Plasmodium falciparum
HKSDIILEYVLKYNLFIFFKRLQLFYFMNTKKDLLFIYDILLN

SEQ ID NO: 3286179 - protein, 27 aa, Plasmodium falciparum
HKSDTKPPLPPPLPPAVDPPQAEEPFN

SEQ ID NO: 3286180 - protein, 26 aa, Plasmodium falciparum
HKSIEIPLKYILKHIGRYIYGVDYND

SEQ ID NO: 3286181 - protein, 24 aa, Plasmodium falciparum
HKTDPCFLFTLLKIVLSICKVRRY

SEQ ID NO: 3286182 - protein, 24 aa, Plasmodium falciparum
HKTTPFFEIYIYYEYISIKTQDHY

SEQ ID NO: 3286183 - protein, 38 aa, Plasmodium falciparum
HKVPKHGYIMSFFAFFDLWVKNLLIDTINWKNELTNCI

SEQ ID NO: 3286184 - protein, 30 aa, Plasmodium falciparum
HKWEQIQEFLYQTVKFFKALKDRVKRKFKY

SEQ ID NO: 3286185 - protein, 18 aa, Plasmodium falciparum
HLATYFYHEKNKEPGTWC

SEQ ID NO: 3286186 - protein, 19 aa, Plasmodium falciparum
HLDFYLQNLSLQINFYHVM

SEQ ID NO: 3286187 - protein, 27 aa, Plasmodium falciparum
HLDSYQYNFFLLPTIDYMKNNICLVCF

SEQ ID NO: 3286188 - protein, 17 aa, Plasmodium falciparum
HLEIMEGINFERLKIAQ

SEQ ID NO: 3286189 - protein, 17 aa, Plasmodium falciparum
HLFFNSNLLFFEVLLRH

SEQ ID NO: 3286190 - protein, 18 aa, Plasmodium falciparum
HLFLISFVSLMFFLPIYF

SEQ ID NO: 3286191 - protein, 22 aa, Plasmodium falciparum
HLFNFLPEIISLKTYYNILKEI

SEQ ID NO: 3286192 - protein, 23 aa, Plasmodium falciparum
HLFNVLYNLLNYYCTYKFSKKYS

SEQ ID NO: 3286193 - protein, 23 aa, Plasmodium falciparum
HLHGDHCLGLISVLTMLRNMNTI

SEQ ID NO: 3286194 - protein, 25 aa, Plasmodium falciparum
HLHNITHILHFCDEPYISSSCIQSS

SEQ ID NO: 3286195 - protein, 26 aa, Plasmodium falciparum
HLHYFKFYNSYIYFLKHYNMLHIPHA

SEQ ID NO: 3286196 - protein, 23 aa, Plasmodium falciparum
HLIALGHFMILKLALKYYDIYFE

SEQ ID NO: 3286197 - protein, 21 aa, Plasmodium falciparum
HLIALGHFVVLKLALKNYKNY

SEQ ID NO: 3286198 - protein, 26 aa, Plasmodium falciparum
HLKKLNDFILLLYNKQIFKRKRKELL

SEQ ID NO: 3286199 - protein, 27 aa, Plasmodium falciparum
HLKKRKYKFFFFYNMNFFHKDKNCILQ

SEQ ID NO: 3286200 - protein, 26 aa, Plasmodium falciparum
HLKLKMLNIYLWIMRFLNINCSNYIN

SEQ ID NO: 3286201 - protein, 34 aa, Plasmodium falciparum
HLKNVSFNIFLCDLPKLYKIKYPNMLKLSGIQTK

SEQ ID NO: 3286202 - protein, 23 aa, Plasmodium falciparum
HLKSIFLGYSLSNLFHFCNYQIK

SEQ ID NO: 3286203 - protein, 25 aa, Plasmodium falciparum
HLKTYEPINFILFYSENFVEKLINF

SEQ ID NO: 3286204 - protein, 33 aa, Plasmodium falciparum
HLKVNSILRIFFFFFLISFLFSNCKLNDYIRTK

SEQ ID NO: 3286205 - protein, 36 aa, Plasmodium falciparum
HLLGTIVYLVQSLRFWLVVILGLFTALLRDYVFKVY

SEQ ID NO: 3286206 - protein, 40 aa, Plasmodium falciparum
HLLNLAIYIYMITFNILYGNIIFFPSYNFLNDFYNFLNKE

SEQ ID NO: 3286207 - protein, 23 aa, Plasmodium falciparum
HLLNTLAECIILPYLRTEIKENI

SEQ ID NO: 3286208 - protein, 18 aa, Plasmodium falciparum
HLLSLKENIIKKLLNHIE

SEQ ID NO: 3286209 - protein, 25 aa, Plasmodium falciparum
HLNEIEFLYNLLINKIFQKDTYAVR

SEQ ID NO: 3286210 - protein, 29 aa, Plasmodium falciparum
HLNIFNLIPLFFLSFFWSYIYIYTDNILV

SEQ ID NO: 3286211 - protein, 24 aa, Plasmodium falciparum
HLNLLVHSFLYFMKKSFKNVKYII

SEQ ID NO: 3286212 - protein, 56 aa, Plasmodium falciparum
HLNNYILERNYLKKVHKFFLTLQKLLKYFNECLKYFISFLFPNKEFNIFIQFASYN

SEQ ID NO: 3286213 - protein, 29 aa, Plasmodium falciparum
HLNSYYDYLFKRLKYLLHFYRNKLIYLKE

SEQ ID NO: 3286214 - protein, 22 aa, Plasmodium falciparum
HLPNILYPFSTYIFDQNRIKLE

SEQ ID NO: 3286215 - protein, 19 aa, Plasmodium falciparum
HLQKFFLKNFAYISSLYDI

SEQ ID NO: 3286216 - protein, 19 aa, Plasmodium falciparum
HLRQMLKQAGVAIGLDAFV

SEQ ID NO: 3286217 - protein, 18 aa, Plasmodium falciparum
HLRQMLKQAGVAIGLDAL

SEQ ID NO: 3286218 - protein, 20 aa, Plasmodium falciparum
HLTISILMALYLLGTLYIAM

SEQ ID NO: 3286219 - protein, 17 aa, Plasmodium falciparum
HLTISLFIILIECFVFS

SEQ ID NO: 3286220 - protein, 17 aa, Plasmodium falciparum
HLVKRQNVTFLNFKKKI

SEQ ID NO: 3286221 - protein, 21 aa, Plasmodium falciparum
HLWDLVNSIIFFIEQEKKKLW

SEQ ID NO: 3286222 - protein, 38 aa, Plasmodium falciparum
HLYEEYSMLINFLHLYKILFQNFLFYYYNGITEYIKEI

SEQ ID NO: 3286223 - protein, 28 aa, Plasmodium falciparum
HLYHKKCSVCLFNFPSLKCSIYNCYNFI

SEQ ID NO: 3286224 - protein, 35 aa, Plasmodium falciparum
HLYKEEYFYINFNIFYIYIKSLIKLKKYELCLKYI

SEQ ID NO: 3286225 - protein, 33 aa, Plasmodium falciparum
HLYKEKIYIFRYSIYYIILSRCSNNIKINYFPR

SEQ ID NO: 3286226 - protein, 17 aa, Plasmodium falciparum
HLYYYLHMLLNYNMEHI

SEQ ID NO: 3286227 - protein, 22 aa, Plasmodium falciparum
HMDKIIFFCGKNIYVGSHKNLM

SEQ ID NO: 3286228 - protein, 33 aa, Plasmodium falciparum
HMEDMLMLERQKIIWLQWINRNKYMLEKWNKEE

SEQ ID NO: 3286229 - protein, 22 aa, Plasmodium falciparum
HMENVLYILYIIRKKQYEHVKS

SEQ ID NO: 3286230 - protein, 19 aa, Plasmodium falciparum
HMEQLLLLLNGYNKEKEYS

SEQ ID NO: 3286231 - protein, 26 aa, Plasmodium falciparum
HMFEYFFSYILIFLTLFCLSNQLIFL

SEQ ID NO: 3286232 - protein, 18 aa, Plasmodium falciparum
HMILYIDQYFKYYNFTHN

SEQ ID NO: 3286233 - protein, 18 aa, Plasmodium falciparum
HMKENIIYLTDEEATRNM

SEQ ID NO: 3286234 - protein, 24 aa, Plasmodium falciparum
HMKILRYDIFLQISYILKKNIFPL

SEQ ID NO: 3286235 - protein, 23 aa, Plasmodium falciparum
HMKNVCFMPRYSKKSIMYYIFSL

SEQ ID NO: 3286236 - protein, 18 aa, Plasmodium falciparum
HMLIAQIIFCTLITFFGG

SEQ ID NO: 3286237 - protein, 20 aa, Plasmodium falciparum
HMLKSWELLKNTYRYKMPVI

SEQ ID NO: 3286238 - protein, 22 aa, Plasmodium falciparum
HMLNVPFFFEKLMSFSFLLCLD

SEQ ID NO: 3286239 - protein, 29 aa, Plasmodium falciparum
HMLQFQDPLFESLIYKIYLNYYKIGDTPK

SEQ ID NO: 3286240 - protein, 26 aa, Plasmodium falciparum
HMNDHTFIILFFILGFQKNNDKSDIL

SEQ ID NO: 3286241 - protein, 21 aa, Plasmodium falciparum
HMNNFIYCKMKMLLYNSAYNI

SEQ ID NO: 3286242 - protein, 26 aa, Plasmodium falciparum
HMSQRQKIIWRKWIAKHPIRVREFVI

SEQ ID NO: 3286243 - protein, 26 aa, Plasmodium falciparum
HMSQRQKIIWRKWIAKHPYRIREFVI

SEQ ID NO: 3286244 - protein, 25 aa, Plasmodium falciparum
HMSQRQKIIWRKWIAKHPYRVREFV

SEQ ID NO: 3286245 - protein, 18 aa, Plasmodium falciparum
HMYNYLYFIDITNKFITI

SEQ ID NO: 3286246 - protein, 23 aa, Plasmodium falciparum
HNARNNILRLLTSQINRKDYSPN

SEQ ID NO: 3286247 - protein, 17 aa, Plasmodium falciparum
HNDIIKIHPFMNAKRIR

SEQ ID NO: 3286248 - protein, 45 aa, Plasmodium falciparum
HNEGFLILSYCFAISLFMYIVLKNLYYLYIFKRTRIKIIESLNND

SEQ ID NO: 3286249 - protein, 18 aa, Plasmodium falciparum
HNEKIQAEILIIDDAKRK

SEQ ID NO: 3286250 - protein, 19 aa, Plasmodium falciparum
HNEKIQAEILIIDDAKRKV

SEQ ID NO: 3286251 - protein, 29 aa, Plasmodium falciparum
HNELNIRMIYFFLNYIKFYQYENMNFLKE

SEQ ID NO: 3286252 - protein, 17 aa, Plasmodium falciparum
HNFFYLLIVKYIDPNRY

SEQ ID NO: 3286253 - protein, 35 aa, Plasmodium falciparum
HNFLNSPIYISTIIYFIAICYFILLNTCIPNNNEL

SEQ ID NO: 3286254 - protein, 19 aa, Plasmodium falciparum
HNFYLLKKNINLPKNIYYD

SEQ ID NO: 3286255 - protein, 17 aa, Plasmodium falciparum
HNFYPYKIPSCISNHFS

SEQ ID NO: 3286256 - protein, 30 aa, Plasmodium falciparum
HNHGFTCNLFLILYIPYKRSLCYDTLFNQM

SEQ ID NO: 3286257 - protein, 34 aa, Plasmodium falciparum
HNIDDTFFIRNISKVFLYIIQNINLYDVKQFKNI

SEQ ID NO: 3286258 - protein, 31 aa, Plasmodium falciparum
HNIIKICIDTLYFFKGYNSHLCLSILSIIEY

SEQ ID NO: 3286259 - protein, 31 aa, Plasmodium falciparum
HNIKKLNKSILLVNVLWSLCLIEVPCSEFLK

SEQ ID NO: 3286260 - protein, 18 aa, Plasmodium falciparum
HNINYYFSLSPVKYHVRK

SEQ ID NO: 3286261 - protein, 25 aa, Plasmodium falciparum
HNIPKKILFKLWNKAYNDLICTLHN

SEQ ID NO: 3286262 - protein, 27 aa, Plasmodium falciparum
HNIYDMYTFPFFLLSLTVMSCRTVQNK

SEQ ID NO: 3286263 - protein, 19 aa, Plasmodium falciparum
HNIYYYNKILKYYKINKQE

SEQ ID NO: 3286264 - protein, 54 aa, Plasmodium falciparum
HNKCTYMHIYVSYYLIYLMPINIHIKFFLSYTPNFLTIFFKKYIYYQNVYSSFS

SEQ ID NO: 3286265 - protein, 27 aa, Plasmodium falciparum
HNKKNRMIYLTKIFRKIITRKKIRQFI

SEQ ID NO: 3286266 - protein, 21 aa, Plasmodium falciparum
HNKLYYEDFSKAIILSICECV

SEQ ID NO: 3286267 - protein, 26 aa, Plasmodium falciparum
HNKNIDINLLIYLIGKIIYGGIIIDI

SEQ ID NO: 3286268 - protein, 19 aa, Plasmodium falciparum
HNLILNNLFVPQKNVYHIK

SEQ ID NO: 3286269 - protein, 25 aa, Plasmodium falciparum
HNLSFYFILHLFQTKFHVFNNNFFL

SEQ ID NO: 3286270 - protein, 20 aa, Plasmodium falciparum
HNLSLLYFYSSSLGNHPAST

SEQ ID NO: 3286271 - protein, 19 aa, Plasmodium falciparum
HNMDQKPFIMSIHDRNLFS

SEQ ID NO: 3286272 - protein, 20 aa, Plasmodium falciparum
HNMDQKPFIMSIHDRNLFSG

SEQ ID NO: 3286273 - protein, 26 aa, Plasmodium falciparum
HNNLFITILLLFIYFFGSSLCNVIGE

SEQ ID NO: 3286274 - protein, 28 aa, Plasmodium falciparum
HNNNFSKYTYPFIGAPTIIKDLKNERNK

SEQ ID NO: 3286275 - protein, 29 aa, Plasmodium falciparum
HNNNILLKLYIFNIIYGYVRIYITNNFIN

SEQ ID NO: 3286276 - protein, 23 aa, Plasmodium falciparum
HNQDNRLSFTYMKKMSLSNSSIN

SEQ ID NO: 3286277 - protein, 24 aa, Plasmodium falciparum
HNSKSDIFYIFDDIVYDITESVNM

SEQ ID NO: 3286278 - protein, 28 aa, Plasmodium falciparum
HNSSKKWYYEWLVLYYKELELHEKEINK

SEQ ID NO: 3286279 - protein, 30 aa, Plasmodium falciparum
HNTKKSIFLYYYKLLIKSISLKMIKFIYRK

SEQ ID NO: 3286280 - protein, 28 aa, Plasmodium falciparum
HNTKYVRKLYFDLIYKLNIKNVCIIEGG

SEQ ID NO: 3286281 - protein, 28 aa, Plasmodium falciparum
HNVYFSSPYLNLFLSFSIKLIYKYKNVV

SEQ ID NO: 3286282 - protein, 24 aa, Plasmodium falciparum
HNYINICHFILNIFELYTLSLNNI

SEQ ID NO: 3286283 - protein, 20 aa, Plasmodium falciparum
HNYWNYIYTLDLNKNVYLND

SEQ ID NO: 3286284 - protein, 17 aa, Plasmodium falciparum
HPEIRTNILNFLEASFS

SEQ ID NO: 3286285 - protein, 25 aa, Plasmodium falciparum
HPEYYSQIIIIPYLTCYNNKNVRND

SEQ ID NO: 3286286 - protein, 41 aa, Plasmodium falciparum
HPFKQFFKQIYSFFYFLCYIIIHHIILLHNFIIRELLINIC

SEQ ID NO: 3286287 - protein, 21 aa, Plasmodium falciparum
HPFKYQPTKGLKEYEESHVAK

SEQ ID NO: 3286288 - protein, 23 aa, Plasmodium falciparum
HPKDDFILNWLDVQYLKDEKYDE

SEQ ID NO: 3286289 - protein, 24 aa, Plasmodium falciparum
HPLCAYMCGLFIKCKNSNKKFLKF

SEQ ID NO: 3286290 - protein, 25 aa, Plasmodium falciparum
HPLCYKMILYFQKNTSFLIKKKLAL

SEQ ID NO: 3286291 - protein, 28 aa, Plasmodium falciparum
HQAEYIPIILFFLNNVKNDLYNCYKQMI

SEQ ID NO: 3286292 - protein, 32 aa, Plasmodium falciparum
HQAYVHKILTGRKLLFLSLRNKKGISGFLNIF

SEQ ID NO: 3286293 - protein, 25 aa, Plasmodium falciparum
HQIDIYFMMGFLRNIKIFLNVSYVR

SEQ ID NO: 3286294 - protein, 24 aa, Plasmodium falciparum
HQNDLFLFFSFFFNYYHNRNIDQM

SEQ ID NO: 3286295 - protein, 34 aa, Plasmodium falciparum
HQNNIILDSFLFFIIHIFYTFLHFHNVYFSSPYL

SEQ ID NO: 3286296 - protein, 27 aa, Plasmodium falciparum
HQTNQEHLLLVFKILKIALYECKHIYK

SEQ ID NO: 3286297 - protein, 23 aa, Plasmodium falciparum
HRDFYCSCCIYVSDNYFEMQNHF

SEQ ID NO: 3286298 - protein, 24 aa, Plasmodium falciparum
HREFTFHIFILNVFITTEKILLLS

SEQ ID NO: 3286299 - protein, 29 aa, Plasmodium falciparum
HRIHKMFSYFLMYVFMFFCYNDIFKTLNL

SEQ ID NO: 3286300 - protein, 34 aa, Plasmodium falciparum
HRITFNIIVFTLFLVIIYIFYHKIENIKTVFLIS

SEQ ID NO: 3286301 - protein, 22 aa, Plasmodium falciparum
HRKKIPCIFYKARGKNIIISMN

SEQ ID NO: 3286302 - protein, 25 aa, Plasmodium falciparum
HRKNRPIFFHYMPSPTNIKAYTENP

SEQ ID NO: 3286303 - protein, 17 aa, Plasmodium falciparum
HRLIDYIKEKIFNLYIK

SEQ ID NO: 3286304 - protein, 42 aa, Plasmodium falciparum
HRNNYDNILVDKFHRSSLLDKLDDRMFFDELNRDNIMEEVLS

SEQ ID NO: 3286305 - protein, 17 aa, Plasmodium falciparum
HRYYKEYLMFTNNIKRI

SEQ ID NO: 3286306 - protein, 24 aa, Plasmodium falciparum
HSCGSRLFFNGFRSCVEDNLFYNV

SEQ ID NO: 3286307 - protein, 26 aa, Plasmodium falciparum
HSCKNLPLVLVYLSKKIKLNFYKYSM

SEQ ID NO: 3286308 - protein, 26 aa, Plasmodium falciparum
HSEEKYLLYYIFIKNILLTEDLFMKT

SEQ ID NO: 3286309 - protein, 18 aa, Plasmodium falciparum
HSFFFYFVCVIPSIYLTL

SEQ ID NO: 3286310 - protein, 17 aa, Plasmodium falciparum
HSFFIKPSLLKDSDYVL

SEQ ID NO: 3286311 - protein, 17 aa, Plasmodium falciparum
HSHYFMYMCPSVSYMKK

SEQ ID NO: 3286312 - protein, 17 aa, Plasmodium falciparum
HSILACLGFIVGYSSLI

SEQ ID NO: 3286313 - protein, 19 aa, Plasmodium falciparum
HSILISCLIFLFNNFLNEH

SEQ ID NO: 3286314 - protein, 25 aa, Plasmodium falciparum
HSIPKLIFEKVLNFGPIRPNEKKEK

SEQ ID NO: 3286315 - protein, 17 aa, Plasmodium falciparum
HSLLINNEYKKHLIFDC

SEQ ID NO: 3286316 - protein, 21 aa, Plasmodium falciparum
HSLSLFFYSYSVYFINNCFYY

SEQ ID NO: 3286317 - protein, 31 aa, Plasmodium falciparum
HSLYMIFICFIYFVVLYFMLLKKIYTHPFIF

SEQ ID NO: 3286318 - protein, 32 aa, Plasmodium falciparum
HSNILIRLILTIYIYIVMFLTLSFSLICQLSS

SEQ ID NO: 3286319 - protein, 34 aa, Plasmodium falciparum
HSNKKSFNFFYLFSYIFKIFPFIGKINKEEKKNK

SEQ ID NO: 3286320 - protein, 22 aa, Plasmodium falciparum
HSNKYFIDNLKIFIFDEFYNIE

SEQ ID NO: 3286321 - protein, 23 aa, Plasmodium falciparum
HSNMVCEKYYFYKKLNIFQVNYY

SEQ ID NO: 3286322 - protein, 26 aa, Plasmodium falciparum
HSNNDIYKIVLLFSPLALTSIKNKQK

SEQ ID NO: 3286323 - protein, 25 aa, Plasmodium falciparum
HSRFFICICVLLHMMVFGVCIYKVE

SEQ ID NO: 3286324 - protein, 19 aa, Plasmodium falciparum
HSRIVCMLICVYGVQVNKK

SEQ ID NO: 3286325 - protein, 22 aa, Plasmodium falciparum
HSSGSLFFKIPIKGKRYMKINN

SEQ ID NO: 3286326 - protein, 26 aa, Plasmodium falciparum
HSSIDRLNIYRFFLRVAQSISMTKYK

SEQ ID NO: 3286327 - protein, 34 aa, Plasmodium falciparum
HSSIYILRYNIIYILRIFYLWFNKTSDNQSFLFR

SEQ ID NO: 3286328 - protein, 33 aa, Plasmodium falciparum
HSSKLFLNFRNLYSCFFFIVYKYLNKEHEEVIE

SEQ ID NO: 3286329 - protein, 17 aa, Plasmodium falciparum
HSSKYKLILILSKHHLS

SEQ ID NO: 3286330 - protein, 21 aa, Plasmodium falciparum
HSTINIIYQSPLIKAVFHEKD

SEQ ID NO: 3286331 - protein, 36 aa, Plasmodium falciparum
HSYKKYIDIIMLYTLRTFFFLIFQHYHSITLDKKCL

SEQ ID NO: 3286332 - protein, 24 aa, Plasmodium falciparum
HSYLRSYPHPLDIYYKMYIKKRRK

SEQ ID NO: 3286333 - protein, 22 aa, Plasmodium falciparum
HSYRLYVYNFFIKYLNINKEEI

SEQ ID NO: 3286334 - protein, 28 aa, Plasmodium falciparum
HTAFTTLLTFFWFFYERNIYVKTTIFLY

SEQ ID NO: 3286335 - protein, 17 aa, Plasmodium falciparum
HTCFPMISKILSEELCS

SEQ ID NO: 3286336 - protein, 28 aa, Plasmodium falciparum
HTHIYIYIYIYIYVYIYLFIYLFFLNVL

SEQ ID NO: 3286337 - protein, 25 aa, Plasmodium falciparum
HTLEDILKFIYSFLEHFKTLKKELQ

SEQ ID NO: 3286338 - protein, 24 aa, Plasmodium falciparum
HTPLHDYIPQRLRWMTEWAEWYCK

SEQ ID NO: 3286339 - protein, 28 aa, Plasmodium falciparum
HTPVTYAMWWIIYIISVLVLFLCCCNIC

SEQ ID NO: 3286340 - protein, 21 aa, Plasmodium falciparum
HTSLINEHYLYERKSNVDKMK

SEQ ID NO: 3286341 - protein, 17 aa, Plasmodium falciparum
HTSWVYKYTIYTFGGFS

SEQ ID NO: 3286342 - protein, 28 aa, Plasmodium falciparum
HTSYTMLNFLNFLEYFLKNNLQQLSPLH

SEQ ID NO: 3286343 - protein, 24 aa, Plasmodium falciparum
HTTNLFDQIIIPAVFIHLKNDDIS

SEQ ID NO: 3286344 - protein, 17 aa, Plasmodium falciparum
HVADKIEVLVLGGTWSC

SEQ ID NO: 3286345 - protein, 27 aa, Plasmodium falciparum
HVDIEINYFEFWISLDPIRIPQKRKRH

SEQ ID NO: 3286346 - protein, 22 aa, Plasmodium falciparum
HVEKNCDELLYKNSFNSEECNK

SEQ ID NO: 3286347 - protein, 27 aa, Plasmodium falciparum
HVHSVYIPLYFFKLSINNMSLLLNIMF

SEQ ID NO: 3286348 - protein, 22 aa, Plasmodium falciparum
HVIKEPYVNLLIKCLSQSKNKD

SEQ ID NO: 3286349 - protein, 25 aa, Plasmodium falciparum
HVKKFGIEYFLTYADNFAIGYFRKQ

SEQ ID NO: 3286350 - protein, 46 aa, Plasmodium falciparum
HVLDHPAVIPALMSSTIMWSIGIGFAAFTYFFLKKKTKSSVGNLFQ

SEQ ID NO: 3286351 - protein, 19 aa, Plasmodium falciparum
HVLIFLIRSCNNTILRYGT

SEQ ID NO: 3286352 - protein, 28 aa, Plasmodium falciparum
HVLMSGVWFYLYNQLSFISLNRLNHITH

SEQ ID NO: 3286353 - protein, 25 aa, Plasmodium falciparum
HVMNKKYFHLFKNYITNMQKKIKNN

SEQ ID NO: 3286354 - protein, 19 aa, Plasmodium falciparum
HVNEDIPLLLPQPLNIENT

SEQ ID NO: 3286355 - protein, 27 aa, Plasmodium falciparum
HVNEILWKMFLMPIVDKYLKEEELNGI

SEQ ID NO: 3286356 - protein, 17 aa, Plasmodium falciparum
HVNPWTTTLADLKNINN

SEQ ID NO: 3286357 - protein, 25 aa, Plasmodium falciparum
HVNSSLWIYAISILKILLKRIYKIV

SEQ ID NO: 3286358 - protein, 18 aa, Plasmodium falciparum
HVSIIQPILLVGMIFVFY

SEQ ID NO: 3286359 - protein, 31 aa, Plasmodium falciparum
HVSSQLYYFAFSPLIFIIYIVARYFPDMKIG

SEQ ID NO: 3286360 - protein, 18 aa, Plasmodium falciparum
HVVIKWRGKPVFVKHRTP

SEQ ID NO: 3286361 - protein, 20 aa, Plasmodium falciparum
HVVLIPSIYNRRGVLYNKNP

SEQ ID NO: 3286362 - protein, 23 aa, Plasmodium falciparum
HVYKMFLSQIYLYISLYNIMHAD

SEQ ID NO: 3286363 - protein, 17 aa, Plasmodium falciparum
HWNFFLTLCTTFLISNI

SEQ ID NO: 3286364 - protein, 27 aa, Plasmodium falciparum
HYDIRCLTLSGLFYYLGLKPVNRNVCN

SEQ ID NO: 3286365 - protein, 32 aa, Plasmodium falciparum
HYIGNILLCFLLYFHSFLDLLCGLRDGHFINM

SEQ ID NO: 3286366 - protein, 45 aa, Plasmodium falciparum
HYINNFRISYFFKWLINIWASLYIKIFILLLTTYIIMHPHLYASG

SEQ ID NO: 3286367 - protein, 25 aa, Plasmodium falciparum
HYINNYYHIFYYNPYKMRTIRFSNF

SEQ ID NO: 3286368 - protein, 20 aa, Plasmodium falciparum
HYISYAFHFLKQNKINLGNL

SEQ ID NO: 3286369 - protein, 19 aa, Plasmodium falciparum
HYKGYNSIKYYALKFVYNN

SEQ ID NO: 3286370 - protein, 17 aa, Plasmodium falciparum
HYKKIMDKIFILDNRYE

SEQ ID NO: 3286371 - protein, 21 aa, Plasmodium falciparum
HYLFVTIVNYLSKPVYKYMVH

SEQ ID NO: 3286372 - protein, 23 aa, Plasmodium falciparum
HYLHAGFYILLADFLTHFIIVIF

SEQ ID NO: 3286373 - protein, 18 aa, Plasmodium falciparum
HYLKFYSKSCNILIKCIF

SEQ ID NO: 3286374 - protein, 37 aa, Plasmodium falciparum
HYLSYEPIWIVAILIRIVLWCIVWIWAASYMERKPKN

SEQ ID NO: 3286375 - protein, 18 aa, Plasmodium falciparum
HYMLHVFEIYYYKLDNFF

SEQ ID NO: 3286376 - protein, 33 aa, Plasmodium falciparum
HYNKFSFYEYLFLLLFYKKGIHKIFDYVYVYYY

SEQ ID NO: 3286377 - protein, 25 aa, Plasmodium falciparum
HYNNTLVACGYYDNYVHLYDVRINS

SEQ ID NO: 3286378 - protein, 19 aa, Plasmodium falciparum
HYPIFLKERFNRNNNFCSN

SEQ ID NO: 3286379 - protein, 25 aa, Plasmodium falciparum
HYRNIKIIFITALSMMEFPVLPMLY

SEQ ID NO: 3286380 - protein, 23 aa, Plasmodium falciparum
HYSIYVFFSTFFKNALKEYNDIC

SEQ ID NO: 3286381 - protein, 25 aa, Plasmodium falciparum
HYSKFYLLMLLINKILKKYIPATSE

SEQ ID NO: 3286382 - protein, 18 aa, Plasmodium falciparum
HYSYLFNKDIFICGNYRN

SEQ ID NO: 3286383 - protein, 17 aa, Plasmodium falciparum
IAALVLLILAVVLIILY

SEQ ID NO: 3286384 - protein, 17 aa, Plasmodium falciparum
IAALVLLILVVVIIILY

SEQ ID NO: 3286385 - protein, 27 aa, Plasmodium falciparum
IADIIITLLLNILWLNVHKYIYRNNDD

SEQ ID NO: 3286386 - protein, 33 aa, Plasmodium falciparum
IAEDTFLKWKLANVCQLVYLLTKFKHIHKNIFN

SEQ ID NO: 3286387 - protein, 17 aa, Plasmodium falciparum
IAFLISAISPFYSICAF

SEQ ID NO: 3286388 - protein, 18 aa, Plasmodium falciparum
IAFSSFVGIILLSIIIVI

SEQ ID NO: 3286389 - protein, 30 aa, Plasmodium falciparum
IAFTTIVLIAIILLITYLILHYRKKKENEE

SEQ ID NO: 3286390 - protein, 24 aa, Plasmodium falciparum
IAGLMEHVFMYPLDTLKTYFQTNG

SEQ ID NO: 3286391 - protein, 24 aa, Plasmodium falciparum
IAHITYLIYILKNKVNNLSGIIFT

SEQ ID NO: 3286392 - protein, 27 aa, Plasmodium falciparum
IAIALTSIVFLFLKKKTKSTIDLLRVI

SEQ ID NO: 3286393 - protein, 25 aa, Plasmodium falciparum
IAIGCLLGMIPLLFIDNNKLEERKN

SEQ ID NO: 3286394 - protein, 24 aa, Plasmodium falciparum
IAIIDNYIILLQKNRLIIYERKCL

SEQ ID NO: 3286395 - protein, 31 aa, Plasmodium falciparum
IAILVIVLVMVIIFLILRYRRKKKMNKKAQY

SEQ ID NO: 3286396 - protein, 31 aa, Plasmodium falciparum
IAIMIIVAIVLIIYLILRYRRKQKIKKKIQY

SEQ ID NO: 3286397 - protein, 19 aa, Plasmodium falciparum
IAINIWKPTALDAAIEAAI

SEQ ID NO: 3286398 - protein, 17 aa, Plasmodium falciparum
IAISRLKKKFSISCLCP

SEQ ID NO: 3286399 - protein, 26 aa, Plasmodium falciparum
IAISTCVIMLFFGFIFKLTAKEQTRY

SEQ ID NO: 3286400 - protein, 30 aa, Plasmodium falciparum
IAIVVIILIMIIIYLVLRYLRKKKMKKKLE

SEQ ID NO: 3286401 - protein, 31 aa, Plasmodium falciparum
IAIVVIILIMVIIYLILRYRRKKKMKKKLQY

SEQ ID NO: 3286402 - protein, 31 aa, Plasmodium falciparum
IAIVVIILIMVIIYLILRYRRKKKNEEKTPV

SEQ ID NO: 3286403 - protein, 31 aa, Plasmodium falciparum
IAIVVIVLVMVIIYLILRYRRKKKMKKKLEY

SEQ ID NO: 3286404 - protein, 34 aa, Plasmodium falciparum
IAIVVIVLVMVIVYLILRYRRKEIIKKKLQYIKL

SEQ ID NO: 3286405 - protein, 36 aa, Plasmodium falciparum
IAKAKCLECYYCLLHKYKFKPLNISGVIDIVLESDI

SEQ ID NO: 3286406 - protein, 17 aa, Plasmodium falciparum
IALGHFMVLKLALKNYK

SEQ ID NO: 3286407 - protein, 17 aa, Plasmodium falciparum
IALKTFKFLVKEYKIEN

SEQ ID NO: 3286408 - protein, 18 aa, Plasmodium falciparum
IALQICLGVKPLNDSRYV

SEQ ID NO: 3286409 - protein, 19 aa, Plasmodium falciparum
IALSFLIYYVYFIDRDYRP

SEQ ID NO: 3286410 - protein, 31 aa, Plasmodium falciparum
IANDIFPFSYLILVNTLLFQLAMPLNMFGTI

SEQ ID NO: 3286411 - protein, 24 aa, Plasmodium falciparum
IANKTFLYTIYGYGINIPTHTSYI

SEQ ID NO: 3286412 - protein, 24 aa, Plasmodium falciparum
IANPSEFLSFYRKKIRQRDIYNNN

SEQ ID NO: 3286413 - protein, 29 aa, Plasmodium falciparum
IAPKKLYHLLIRLGITFLTIFIVSIFIKH

SEQ ID NO: 3286414 - protein, 27 aa, Plasmodium falciparum
IAQAAFIFLFFGWIILGTALSYSKYYV

SEQ ID NO: 3286415 - protein, 31 aa, Plasmodium falciparum
IAQNDSFDLWIYIMNLLICFNSQNKYSLSFP

SEQ ID NO: 3286416 - protein, 28 aa, Plasmodium falciparum
IASALNICFNPIIWKKICGVPLELQDLA

SEQ ID NO: 3286417 - protein, 36 aa, Plasmodium falciparum
IASIVAIFFFFFFLVMVVIYLILRYTRKQKIKKKII

SEQ ID NO: 3286418 - protein, 23 aa, Plasmodium falciparum
IASYFLFQCAKLIKLLKKQIYID

SEQ ID NO: 3286419 - protein, 32 aa, Plasmodium falciparum
IATLFMGAFMIMAVFYKRNIFIFGAKKKKKKK

SEQ ID NO: 3286420 - protein, 20 aa, Plasmodium falciparum
IAVKPIPSLFRGFSAPVYIE

SEQ ID NO: 3286421 - protein, 31 aa, Plasmodium falciparum
IAVVVIVLIMVIIYFILRYRRKKKMKKKLQY

SEQ ID NO: 3286422 - protein, 34 aa, Plasmodium falciparum
ICCIIRYIAFICKNINFFLFNSINTLPSTFMIKY

SEQ ID NO: 3286423 - protein, 34 aa, Plasmodium falciparum
ICCLLHMYNYIYFIIDILLYFLVISKGKYMHYKY

SEQ ID NO: 3286424 - protein, 30 aa, Plasmodium falciparum
ICCSNISYFCIFLKFFQIYQVIMFKKDAST

SEQ ID NO: 3286425 - protein, 18 aa, Plasmodium falciparum
ICDILPELKFLMFDKKLI

SEQ ID NO: 3286426 - protein, 29 aa, Plasmodium falciparum
ICDKAELIKLLFDIMIRYLNDMLDKKKRC

SEQ ID NO: 3286427 - protein, 17 aa, Plasmodium falciparum
ICDSIFIKLIKYITNIS

SEQ ID NO: 3286428 - protein, 19 aa, Plasmodium falciparum
ICELLILNIYNKKSIVLIG

SEQ ID NO: 3286429 - protein, 17 aa, Plasmodium falciparum
ICENALYNLYEYDSHYL

SEQ ID NO: 3286430 - protein, 26 aa, Plasmodium falciparum
ICENLELIPPLLVTNFIFTIGTCKYI

SEQ ID NO: 3286431 - protein, 17 aa, Plasmodium falciparum
ICESIVKYTLLYSNIIP

SEQ ID NO: 3286432 - protein, 19 aa, Plasmodium falciparum
ICEYILYNPYIIETSYIHI

SEQ ID NO: 3286433 - protein, 30 aa, Plasmodium falciparum
ICFEHYQIFRKYYLFHNLNIISNIESLPMH

SEQ ID NO: 3286434 - protein, 22 aa, Plasmodium falciparum
ICFFFCLFLTNVVYEYVHVLNS

SEQ ID NO: 3286435 - protein, 20 aa, Plasmodium falciparum
ICFIILKVCLSKNINLNDEG

SEQ ID NO: 3286436 - protein, 18 aa, Plasmodium falciparum
ICFINNNNKYIERCTLCF

SEQ ID NO: 3286437 - protein, 17 aa, Plasmodium falciparum
ICGRRLHRSLYEYQICN

SEQ ID NO: 3286438 - protein, 36 aa, Plasmodium falciparum
ICGWDNYKKLLIHLFTFLKCFLKKIQVSKAIESLYI

SEQ ID NO: 3286439 - protein, 27 aa, Plasmodium falciparum
ICHIIYEQFIFLLSKKKLYLYFELFFI

SEQ ID NO: 3286440 - protein, 24 aa, Plasmodium falciparum
ICIDKYICLFFKEVYYIISRTNME

SEQ ID NO: 3286441 - protein, 24 aa, Plasmodium falciparum
ICIFLLFILFNYFCCALRSYKKYK

SEQ ID NO: 3286442 - protein, 24 aa, Plasmodium falciparum
ICIISCIFIILFIPQINSCIDFHI

SEQ ID NO: 3286443 - protein, 17 aa, Plasmodium falciparum
ICILKYMTKYDLLHFNI

SEQ ID NO: 3286444 - protein, 31 aa, Plasmodium falciparum
ICINNNTYFFFDFINKEFIMELYKLENKNER

SEQ ID NO: 3286445 - protein, 22 aa, Plasmodium falciparum
ICIPPRRRRLYIQKLQEWAKTV

SEQ ID NO: 3286446 - protein, 19 aa, Plasmodium falciparum
ICKAMKYSFADLADIVRGI

SEQ ID NO: 3286447 - protein, 20 aa, Plasmodium falciparum
ICKAMKYSFADLGDIIRGRD

SEQ ID NO: 3286448 - protein, 26 aa, Plasmodium falciparum
ICKCEGIFGCIRFLNYPYLYVLIKKE

SEQ ID NO: 3286449 - protein, 18 aa, Plasmodium falciparum
ICKIIYRFLEYNFSVTIM

SEQ ID NO: 3286450 - protein, 28 aa, Plasmodium falciparum
ICKKCVKVFIIFFHYTRDLIIDIKNKIE

SEQ ID NO: 3286451 - protein, 28 aa, Plasmodium falciparum
ICKNLHMITCIFFLLMNNKVNNKKEKMG

SEQ ID NO: 3286452 - protein, 26 aa, Plasmodium falciparum
ICKQVLKPFLFLYVDIFDSFIQALKK

SEQ ID NO: 3286453 - protein, 26 aa, Plasmodium falciparum
ICKSGLYMKTFIFKSIINFYEFDYYN

SEQ ID NO: 3286454 - protein, 18 aa, Plasmodium falciparum
ICKYINILSLEKLNNILN

SEQ ID NO: 3286455 - protein, 19 aa, Plasmodium falciparum
ICLFLYFLSYNLYAKVNNE

SEQ ID NO: 3286456 - protein, 17 aa, Plasmodium falciparum
ICLISPNIKNDMLSYMN

SEQ ID NO: 3286457 - protein, 24 aa, Plasmodium falciparum
ICLNIFCYIFIIKISMLYTGAPIA

SEQ ID NO: 3286458 - protein, 28 aa, Plasmodium falciparum
ICLNISFFILLIIFILSFITVKTSFFLF

SEQ ID NO: 3286459 - protein, 26 aa, Plasmodium falciparum
ICLSDFVAKLYRYIFKFNLQESYNMK

SEQ ID NO: 3286460 - protein, 49 aa, Plasmodium falciparum
ICLTCAFKIYKLFKIIFENILLYILFILFFIKNWYTRLLILKDIEHMQI

SEQ ID NO: 3286461 - protein, 17 aa, Plasmodium falciparum
ICLVLFLSSFDDSTLSL

SEQ ID NO: 3286462 - protein, 17 aa, Plasmodium falciparum
ICMCYIMYIKKYNPNLI

SEQ ID NO: 3286463 - protein, 18 aa, Plasmodium falciparum
ICMSIFSLFIFELSSLIS

SEQ ID NO: 3286464 - protein, 26 aa, Plasmodium falciparum
ICNEGKTWMVIYKPAYYHCSAYTSHN

SEQ ID NO: 3286465 - protein, 24 aa, Plasmodium falciparum
ICNELKCHLPFLQPYSITVTLNYL

SEQ ID NO: 3286466 - protein, 36 aa, Plasmodium falciparum
ICNIYLNNFFFLLLQNLFYLLLLFNNNNNNNNYNYN

SEQ ID NO: 3286467 - protein, 26 aa, Plasmodium falciparum
ICNKKEIIIAFYYPKSNNYINTLIMK

SEQ ID NO: 3286468 - protein, 18 aa, Plasmodium falciparum
ICNRGFNIYIYLKLLNDR

SEQ ID NO: 3286469 - protein, 31 aa, Plasmodium falciparum
ICPSTYCILYKTPLYIFLHFIKKYRNKKLQI

SEQ ID NO: 3286470 - protein, 21 aa, Plasmodium falciparum
ICPWVMRNFFAAKDSPRNVVS

SEQ ID NO: 3286471 - protein, 24 aa, Plasmodium falciparum
ICQIQILWMIEPDWGSIRTGLLFF

SEQ ID NO: 3286472 - protein, 23 aa, Plasmodium falciparum
ICRNPKFKNLFYNYGFDTFENVK

SEQ ID NO: 3286473 - protein, 25 aa, Plasmodium falciparum
ICRNTNLLYLFKNKLFYENKYFFDI

SEQ ID NO: 3286474 - protein, 22 aa, Plasmodium falciparum
ICSCVLITQYIFIKCIDLINKY

SEQ ID NO: 3286475 - protein, 36 aa, Plasmodium falciparum
ICSDNLAFFFGCVAPFLFAWIFSNGLIFSDTFNYIS

SEQ ID NO: 3286476 - protein, 23 aa, Plasmodium falciparum
ICSIINLQQLMPVNTRLANPNLI

SEQ ID NO: 3286477 - protein, 19 aa, Plasmodium falciparum
ICSKLKICKTIYAFYFWFF

SEQ ID NO: 3286478 - protein, 32 aa, Plasmodium falciparum
ICSKRNNISFIYLYDYLLIMTLNEIKNKEYYI

SEQ ID NO: 3286479 - protein, 23 aa, Plasmodium falciparum
ICSYNLFQWVYDIKYTIVKYYSY

SEQ ID NO: 3286480 - protein, 19 aa, Plasmodium falciparum
ICTITVIINIFSILLCEYN

SEQ ID NO: 3286481 - protein, 36 aa, Plasmodium falciparum
ICTLKRIYFYTLYIWLIFSFFQFPIIYVPTLLCIIL

SEQ ID NO: 3286482 - protein, 18 aa, Plasmodium falciparum
ICTYIYHFKFLNKINNEQ

SEQ ID NO: 3286483 - protein, 27 aa, Plasmodium falciparum
ICVPPRRRKLYVTPLTKWAEETTKGSK

SEQ ID NO: 3286484 - protein, 26 aa, Plasmodium falciparum
ICVPPRRRRLYIQKLHDWATAVSPQA

SEQ ID NO: 3286485 - protein, 28 aa, Plasmodium falciparum
ICVPPRRRRLYVTPLTKWATNMEATEAQ

SEQ ID NO: 3286486 - protein, 26 aa, Plasmodium falciparum
ICVPPRRRRLYVTPLTRLAGGDKDTQ

SEQ ID NO: 3286487 - protein, 17 aa, Plasmodium falciparum
ICYCILLFIALSFLIYY

SEQ ID NO: 3286488 - protein, 17 aa, Plasmodium falciparum
ICYICRKTIFYKKCYVF

SEQ ID NO: 3286489 - protein, 52 aa, Plasmodium falciparum
ICYKVTLPIFLYLLSCLFIIIFRIFVILNIPIFFFILYIKFVLISDKSIITL

SEQ ID NO: 3286490 - protein, 37 aa, Plasmodium falciparum
ICYSFTFDLLFFILRIAIFSVYYLITVKNYILIDNIF

SEQ ID NO: 3286491 - protein, 27 aa, Plasmodium falciparum
IDCKYYIFRINLLLNKLYISAGNYDKQ

SEQ ID NO: 3286492 - protein, 40 aa, Plasmodium falciparum
IDDFDTFFFFLSLFYLEYFLIYCHFFEIIYFIHLSNHEKN

SEQ ID NO: 3286493 - protein, 35 aa, Plasmodium falciparum
IDDLLYLFNLSNMNYYHLLYSFHYIFQTSKGNPDM

SEQ ID NO: 3286494 - protein, 22 aa, Plasmodium falciparum
IDDNWFCSIIQGYISYTSIEIN

SEQ ID NO: 3286495 - protein, 23 aa, Plasmodium falciparum
IDEIKNYIYSSIKYYDILKNELY

SEQ ID NO: 3286496 - protein, 18 aa, Plasmodium falciparum
IDEKGIVSIYFSSNLFIN

SEQ ID NO: 3286497 - protein, 33 aa, Plasmodium falciparum
IDEKISEDVIINLTSLIYKEKRKIYKTKIDSML

SEQ ID NO: 3286498 - protein, 31 aa, Plasmodium falciparum
IDEKLNLITLFLFIILTLFSIYMCSVKLNNL

SEQ ID NO: 3286499 - protein, 37 aa, Plasmodium falciparum
IDELENMPQFFRWFSQWAHFFCKEKEYWELKLNDKCT

SEQ ID NO: 3286500 - protein, 33 aa, Plasmodium falciparum
IDESLWAVWSICKLLYFNISFDNYYIKLKKRIS

SEQ ID NO: 3286501 - protein, 19 aa, Plasmodium falciparum
IDEWEREEWFINLWNDWNE

SEQ ID NO: 3286502 - protein, 26 aa, Plasmodium falciparum
IDFTKIFDQLDKLFKERCSCMDTQVL

SEQ ID NO: 3286503 - protein, 24 aa, Plasmodium falciparum
IDIDFYCLQILKMLIHVIIYEHEL

SEQ ID NO: 3286504 - protein, 25 aa, Plasmodium falciparum
IDIFKLFRICYWFSILYIFMLTPVM

SEQ ID NO: 3286505 - protein, 28 aa, Plasmodium falciparum
IDIFNYVYFYQLIFMNFFSLLYNKNSST

SEQ ID NO: 3286506 - protein, 18 aa, Plasmodium falciparum
IDIIDIFKEYLLLIQQEI

SEQ ID NO: 3286507 - protein, 22 aa, Plasmodium falciparum
IDIIKIIYAFSKVRIRDIELLK

SEQ ID NO: 3286508 - protein, 17 aa, Plasmodium falciparum
IDIINIMMFFNNFLNKI

SEQ ID NO: 3286509 - protein, 33 aa, Plasmodium falciparum
IDILDYIHTKYYDNLKYIYFDLHLEKNSSKISS

SEQ ID NO: 3286510 - protein, 24 aa, Plasmodium falciparum
IDIYSLFLIIKYLKYHIYSNEKLF

SEQ ID NO: 3286511 - protein, 29 aa, Plasmodium falciparum
IDIYTKRYIFKFLKYFTIKKKFTDIVITK

SEQ ID NO: 3286512 - protein, 24 aa, Plasmodium falciparum
IDKELPLLVIFKDKLFCINSKYSI

SEQ ID NO: 3286513 - protein, 20 aa, Plasmodium falciparum
IDKGIPYRRCYLLHGPPGCG

SEQ ID NO: 3286514 - protein, 26 aa, Plasmodium falciparum
IDKKDICNILLYNLIFINKMNKKLNN

SEQ ID NO: 3286515 - protein, 23 aa, Plasmodium falciparum
IDKKRIAFLSCNIYGLCGYIFVD

SEQ ID NO: 3286516 - protein, 18 aa, Plasmodium falciparum
IDKYFPLSNEPLLPDFKD

SEQ ID NO: 3286517 - protein, 17 aa, Plasmodium falciparum
IDKYLIESINLPTNLPL

SEQ ID NO: 3286518 - protein, 24 aa, Plasmodium falciparum
IDKYTYLKLFLNKYHYVYPYENIK

SEQ ID NO: 3286519 - protein, 26 aa, Plasmodium falciparum
IDLFTQYCNFPRYDVFWNLLIKKEVE

SEQ ID NO: 3286520 - protein, 24 aa, Plasmodium falciparum
IDLIDIPCRLNFGCVGYFKINLPL

SEQ ID NO: 3286521 - protein, 33 aa, Plasmodium falciparum
IDLISNFIILPLITYNYYFPFICKNKYGGISSN

SEQ ID NO: 3286522 - protein, 19 aa, Plasmodium falciparum
IDLLPIYIHGAKTGRYLFE

SEQ ID NO: 3286523 - protein, 18 aa, Plasmodium falciparum
IDLNILSPSVLYPQEYLT

SEQ ID NO: 3286524 - protein, 35 aa, Plasmodium falciparum
IDLNQYTTFKVLLIYWLEDFIEGYYILKKRKVFEQ

SEQ ID NO: 3286525 - protein, 25 aa, Plasmodium falciparum
IDLSFLEYTILYAVAFQKKTPKEIS

SEQ ID NO: 3286526 - protein, 20 aa, Plasmodium falciparum
IDLSILYHFYVNCSGDYFEY

SEQ ID NO: 3286527 - protein, 34 aa, Plasmodium falciparum
IDLSLFRYKLCWILIDFFFYPICKKLTVPMNVHF

SEQ ID NO: 3286528 - protein, 33 aa, Plasmodium falciparum
IDLSSQCLVLPKMFWLSLMEYLPVNKDDDRCIR

SEQ ID NO: 3286529 - protein, 26 aa, Plasmodium falciparum
IDLTKKLIIIFIFTEIFLSLCNIIEL

SEQ ID NO: 3286530 - protein, 34 aa, Plasmodium falciparum
IDMIKIIFKYKFDFFNFYPYIVNIILDVLNSKNF

SEQ ID NO: 3286531 - protein, 25 aa, Plasmodium falciparum
IDMNNLFLNKMNIYKCSICCMLYHC

SEQ ID NO: 3286532 - protein, 24 aa, Plasmodium falciparum
IDNAFIIINLILTYIDFFIKNKNK

SEQ ID NO: 3286533 - protein, 24 aa, Plasmodium falciparum
IDNQLNLFHKWLDRHRDMCEQWNN

SEQ ID NO: 3286534 - protein, 18 aa, Plasmodium falciparum
IDNTILHPVILYNVNRLL

SEQ ID NO: 3286535 - protein, 19 aa, Plasmodium falciparum
IDNYYIGHIFYIIDSMLSL

SEQ ID NO: 3286536 - protein, 21 aa, Plasmodium falciparum
IDPLIFNIFLDYMKDVYMTDE

SEQ ID NO: 3286537 - protein, 24 aa, Plasmodium falciparum
IDPLLYNNFLFVYVPDLLYSQDNC

SEQ ID NO: 3286538 - protein, 23 aa, Plasmodium falciparum
IDQDNFLFISGRIKDIINRGGEK

SEQ ID NO: 3286539 - protein, 22 aa, Plasmodium falciparum
IDQLHTLGIYFVGGKPLESIIH

SEQ ID NO: 3286540 - protein, 20 aa, Plasmodium falciparum
IDSILEHTLYKGKNTYKHLL

SEQ ID NO: 3286541 - protein, 20 aa, Plasmodium falciparum
IDSILTLCNFKLYKKKFLNK

SEQ ID NO: 3286542 - protein, 25 aa, Plasmodium falciparum
IDSKQPYLIVHIFNIDKIITVDNIK

SEQ ID NO: 3286543 - protein, 27 aa, Plasmodium falciparum
IDSYFIIEMLKIFDEFLKIIEFDLSNY

SEQ ID NO: 3286544 - protein, 17 aa, Plasmodium falciparum
IDTAISLFFNIILLIVI

SEQ ID NO: 3286545 - protein, 17 aa, Plasmodium falciparum
IDTHYLLKNIFEKNLYP

SEQ ID NO: 3286546 - protein, 17 aa, Plasmodium falciparum
IDTKLLPRDISKYLLNK

SEQ ID NO: 3286547 - protein, 32 aa, Plasmodium falciparum
IDTLDSALLRPGRFDRIVYVPLPDINGRKKIL

SEQ ID NO: 3286548 - protein, 28 aa, Plasmodium falciparum
IDTSIFFTLIQMLFFKKEILINFAQCLI

SEQ ID NO: 3286549 - protein, 61 aa, Plasmodium falciparum
IDVPKKLFNYIKVYYSFLILLTILGFFSKLLVLIRIFITHNINKIFRLLLRNNVNFECIKN

SEQ ID NO: 3286550 - protein, 20 aa, Plasmodium falciparum
IDYNFYIRKKNLKNYWLFKG

SEQ ID NO: 3286551 - protein, 24 aa, Plasmodium falciparum
IDYNMKIFCLLSLFNVVNNLRNIY

SEQ ID NO: 3286552 - protein, 18 aa, Plasmodium falciparum
IDYNTEVFMYYEGKKKIY

SEQ ID NO: 3286553 - protein, 48 aa, Plasmodium falciparum
IEAFMEYVLIFLQYLGYFGYIYKSLLRRILRILFFYVNSVINSNDSKM

SEQ ID NO: 3286554 - protein, 18 aa, Plasmodium falciparum
IEAKKRLIYLNCIHFVYK

SEQ ID NO: 3286555 - protein, 36 aa, Plasmodium falciparum
IECIIFYVYLYIFLSIPIFIFPWNNIDNKLNNKILK

SEQ ID NO: 3286556 - protein, 26 aa, Plasmodium falciparum
IECSLCFELIKFICIQECNHTYCFLC

SEQ ID NO: 3286557 - protein, 25 aa, Plasmodium falciparum
IEDDERIFISLNNYLKNFKFSDDSD

SEQ ID NO: 3286558 - protein, 19 aa, Plasmodium falciparum
IEDIKTRLKSILYPNNLDS

SEQ ID NO: 3286559 - protein, 23 aa, Plasmodium falciparum
IEDLIHYLSILNKISIIQKNLYC

SEQ ID NO: 3286560 - protein, 24 aa, Plasmodium falciparum
IEDLRKIELFLKNAQLKDSIHVPN

SEQ ID NO: 3286561 - protein, 34 aa, Plasmodium falciparum
IEDLRKTAVKKKLKYFFLHLCLESGISINVALML

SEQ ID NO: 3286562 - protein, 30 aa, Plasmodium falciparum
IEECFIKLYKYKLCFLINNTVVQLNNFVRE

SEQ ID NO: 3286563 - protein, 24 aa, Plasmodium falciparum
IEEDKNFNLVYINNNLLFNENNNN

SEQ ID NO: 3286564 - protein, 20 aa, Plasmodium falciparum
IEEIIPEELIEEVIPEVLVE

SEQ ID NO: 3286565 - protein, 29 aa, Plasmodium falciparum
IEEKTILDVIFLALAYYITVSHNLNEYIQ

SEQ ID NO: 3286566 - protein, 26 aa, Plasmodium falciparum
IEELLYLIYCILINIYMIRDQHYEYY

SEQ ID NO: 3286567 - protein, 30 aa, Plasmodium falciparum
IEENKLITFLLCWICHLYFLNNICNNKLVQ

SEQ ID NO: 3286568 - protein, 17 aa, Plasmodium falciparum
IEEVIPEELIKEVVPEE

SEQ ID NO: 3286569 - protein, 17 aa, Plasmodium falciparum
IEEVVPVELLEEVIPEE

SEQ ID NO: 3286570 - protein, 21 aa, Plasmodium falciparum
IEEYKVCQLYFVAKASLEDAE

SEQ ID NO: 3286571 - protein, 28 aa, Plasmodium falciparum
IEFERRMNLIFIFQDPLTIVYEGPTFTM

SEQ ID NO: 3286572 - protein, 19 aa, Plasmodium falciparum
IEFRKSMFDVWKEKLASEF

SEQ ID NO: 3286573 - protein, 23 aa, Plasmodium falciparum
IEGLLIMAFMCSKLNFVNISTYI

SEQ ID NO: 3286574 - protein, 20 aa, Plasmodium falciparum
IEHIMKCFKLVDISFIESHI

SEQ ID NO: 3286575 - protein, 46 aa, Plasmodium falciparum
IEHTDKYLIFLYELCYIDLCINNYIFTMKLSDGLFFLFMSNLENEI

SEQ ID NO: 3286576 - protein, 42 aa, Plasmodium falciparum
IEICLYYCKSYILFLLLFYPYLHNYIRILKNNDLRLYKNFYK

SEQ ID NO: 3286577 - protein, 24 aa, Plasmodium falciparum
IEIKRKIMLMMKAILKKKNICDKE

SEQ ID NO: 3286578 - protein, 18 aa, Plasmodium falciparum
IEIMLCKLYQSYLTYNMF

SEQ ID NO: 3286579 - protein, 28 aa, Plasmodium falciparum
IEINKKCLELLLISRRSSILGGTRFNKR

SEQ ID NO: 3286580 - protein, 27 aa, Plasmodium falciparum
IEIVMSFYSFFIRWEKQRDKEKKNISD

SEQ ID NO: 3286581 - protein, 26 aa, Plasmodium falciparum
IEKCKLYTTILMFGSSIYSSIKYFFL

SEQ ID NO: 3286582 - protein, 21 aa, Plasmodium falciparum
IEKCLKVCYYIYNNIPSIGTI

SEQ ID NO: 3286583 - protein, 35 aa, Plasmodium falciparum
IEKDFNFNFYFYILLLYYYIYIYNTTRKIKIFDQG

SEQ ID NO: 3286584 - protein, 57 aa, Plasmodium falciparum
IEKIYFLLAILGTLSVVSLYLYIPNENINLSFHKYDSYIRILCEKHPDDNQFSGSLC

SEQ ID NO: 3286585 - protein, 18 aa, Plasmodium falciparum
IEKKKEKEKIRKPKKKVE

SEQ ID NO: 3286586 - protein, 23 aa, Plasmodium falciparum
IEKKYIYITPIIHSLSISIDKSN

SEQ ID NO: 3286587 - protein, 18 aa, Plasmodium falciparum
IEKNIFTFNLNLNDILNS

SEQ ID NO: 3286588 - protein, 23 aa, Plasmodium falciparum
IEKSFCHFIMCINTCRKKINTEM

SEQ ID NO: 3286589 - protein, 38 aa, Plasmodium falciparum
IEKTDYIFNDLYLNPTYKILRICFLPSSIHYVVYLAYV

SEQ ID NO: 3286590 - protein, 25 aa, Plasmodium falciparum
IELMKDIYFLGQVPFFDLVAKITPS

SEQ ID NO: 3286591 - protein, 34 aa, Plasmodium falciparum
IELNNLFIEEDWNNIFIKLNILENQFKNIINLII

SEQ ID NO: 3286592 - protein, 24 aa, Plasmodium falciparum
IELYEYVYIIDIILNIIITIINYN

SEQ ID NO: 3286593 - protein, 21 aa, Plasmodium falciparum
IEMIIYFICPNYMYINNIYNN

SEQ ID NO: 3286594 - protein, 26 aa, Plasmodium falciparum
IENARFYGFLFTWFKNHRKAQKVNEE

SEQ ID NO: 3286595 - protein, 27 aa, Plasmodium falciparum
IENIDDFLTYFRGLDKIFISKNIFDTL

SEQ ID NO: 3286596 - protein, 17 aa, Plasmodium falciparum
IENIYCLNIPGYKYKYK

SEQ ID NO: 3286597 - protein, 28 aa, Plasmodium falciparum
IENKIVFFVPLWLYKKLQGNNFLFMIKK

SEQ ID NO: 3286598 - protein, 26 aa, Plasmodium falciparum
IENKVFYLHDNLLLYALDNLTISNNA

SEQ ID NO: 3286599 - protein, 20 aa, Plasmodium falciparum
IENLLQNCIFYIDLYNNSKS

SEQ ID NO: 3286600 - protein, 27 aa, Plasmodium falciparum
IENLNENHFLILPGGFYLQKEKMLVKI

SEQ ID NO: 3286601 - protein, 25 aa, Plasmodium falciparum
IENLSLYYHLLKNNGYIYFITDVYT

SEQ ID NO: 3286602 - protein, 32 aa, Plasmodium falciparum
IENTISPILIPNYKKIKILKPTKIINPLSNDT

SEQ ID NO: 3286603 - protein, 17 aa, Plasmodium falciparum
IENYFFFHLNDINTIVG

SEQ ID NO: 3286604 - protein, 18 aa, Plasmodium falciparum
IENYILSINILYNTTYNI

SEQ ID NO: 3286605 - protein, 37 aa, Plasmodium falciparum
IEPLIKLYEELKLFLLYFFHKLLYNLLTEQDNLPRNI

SEQ ID NO: 3286606 - protein, 38 aa, Plasmodium falciparum
IEPLYIFAHTSMVFFCIIFTILILTIYNLMKTEKKNKV

SEQ ID NO: 3286607 - protein, 28 aa, Plasmodium falciparum
IEPNKYSYLGWVNPFIYVTRNVQIEIVL

SEQ ID NO: 3286608 - protein, 19 aa, Plasmodium falciparum
IEQGLDIFHLLDSTLFHNE

SEQ ID NO: 3286609 - protein, 28 aa, Plasmodium falciparum
IEQYNDSIFLFIFMYLRKLNEQYNEENM

SEQ ID NO: 3286610 - protein, 27 aa, Plasmodium falciparum
IERNEWLKAYYYMTDILLINENKFHNY

SEQ ID NO: 3286611 - protein, 24 aa, Plasmodium falciparum
IERNRYILEKWKKEKWFEKLKNQW

SEQ ID NO: 3286612 - protein, 18 aa, Plasmodium falciparum
IESFSFIKKMYPCKNFGG

SEQ ID NO: 3286613 - protein, 27 aa, Plasmodium falciparum
IESIYFTFFIMDLYLLNIIKLENYLDN

SEQ ID NO: 3286614 - protein, 36 aa, Plasmodium falciparum
IESKIHLIVVMYFSFCFYLYLFERGKYAINSTFSVT

SEQ ID NO: 3286615 - protein, 18 aa, Plasmodium falciparum
IETESFKIMILKKKKKKK

SEQ ID NO: 3286616 - protein, 49 aa, Plasmodium falciparum
IETLGIYKKIYFYDFFFIYLLRKLFWNIFSLYYIYLQKYNDRREEKRKN

SEQ ID NO: 3286617 - protein, 29 aa, Plasmodium falciparum
IETLKLFLYYIHMLTFLSLRKYIQIRNIV

SEQ ID NO: 3286618 - protein, 32 aa, Plasmodium falciparum
IETVPTYFDYVPQYLRWFEEWAEDFCRKKKHK

SEQ ID NO: 3286619 - protein, 42 aa, Plasmodium falciparum
IETYNYLIIFIIIHLLFIIIYIFILLLLHKYHFIYFNITIEI

SEQ ID NO: 3286620 - protein, 24 aa, Plasmodium falciparum
IETYYDEMLLKKKSINQLRLISEE

SEQ ID NO: 3286621 - protein, 27 aa, Plasmodium falciparum
IEVYKNFYISLYKTYIFIFPEELEKEN

SEQ ID NO: 3286622 - protein, 19 aa, Plasmodium falciparum
IEYEFDETFDFFDEDAKRN

SEQ ID NO: 3286623 - protein, 24 aa, Plasmodium falciparum
IEYNYFIPIQILYKVKSRYCISLI

SEQ ID NO: 3286624 - protein, 24 aa, Plasmodium falciparum
IEYTYDYFILYEKCFLPIERIVHV

SEQ ID NO: 3286625 - protein, 29 aa, Plasmodium falciparum
IFCFYVSFYILFITLFTKKNCLCIVLKER

SEQ ID NO: 3286626 - protein, 17 aa, Plasmodium falciparum
IFCKKMFYILKNQNYEI

SEQ ID NO: 3286627 - protein, 30 aa, Plasmodium falciparum
IFCVIFGMTFSLLWLPLVLISIYLAERHRK

SEQ ID NO: 3286628 - protein, 18 aa, Plasmodium falciparum
IFDGSAWVLLEKLSIRSI

SEQ ID NO: 3286629 - protein, 20 aa, Plasmodium falciparum
IFDKSFLFCFLKNLEKSSYD

SEQ ID NO: 3286630 - protein, 25 aa, Plasmodium falciparum
IFDNKDFLLKRYLLFTNKKNEIVKK

SEQ ID NO: 3286631 - protein, 25 aa, Plasmodium falciparum
IFDNKNIFHYYSDKCIFKIIFIDEH

SEQ ID NO: 3286632 - protein, 25 aa, Plasmodium falciparum
IFDSYHYYLIINNLSFKSCYELIKI

SEQ ID NO: 3286633 - protein, 17 aa, Plasmodium falciparum
IFDWSNKFCYYLSKHIF

SEQ ID NO: 3286634 - protein, 31 aa, Plasmodium falciparum
IFDYKFYNVSLILLNILIDLFYISNDIKCKC

SEQ ID NO: 3286635 - protein, 19 aa, Plasmodium falciparum
IFDYQWSIPTEPKGSFYRT

SEQ ID NO: 3286636 - protein, 35 aa, Plasmodium falciparum
IFEDIQKNCLYNFLLNILKKPYLTNFNLKEISIEK

SEQ ID NO: 3286637 - protein, 30 aa, Plasmodium falciparum
IFEELCKIFLNIKFPDMFKIIIKELFKYFI

SEQ ID NO: 3286638 - protein, 18 aa, Plasmodium falciparum
IFEFLTSSFGKNVSIQKN

SEQ ID NO: 3286639 - protein, 17 aa, Plasmodium falciparum
IFEFMLHCTINLKTIYF

SEQ ID NO: 3286640 - protein, 18 aa, Plasmodium falciparum
IFEIYVPKNIKIYRRPSM

SEQ ID NO: 3286641 - protein, 18 aa, Plasmodium falciparum
IFELGFLMNAHDLLGKYL

SEQ ID NO: 3286642 - protein, 19 aa, Plasmodium falciparum
IFELILNQFDDLLVKILLL

SEQ ID NO: 3286643 - protein, 27 aa, Plasmodium falciparum
IFENFHYFLLFFKIKNLLCSSTRNPFF

SEQ ID NO: 3286644 - protein, 18 aa, Plasmodium falciparum
IFENSISPLRRYASLNKS

SEQ ID NO: 3286645 - protein, 29 aa, Plasmodium falciparum
IFENYKIFFLFLFIMIIHICAIQYGSFFF

SEQ ID NO: 3286646 - protein, 19 aa, Plasmodium falciparum
IFEWIIYLIISLITSYNKK

SEQ ID NO: 3286647 - protein, 19 aa, Plasmodium falciparum
IFFADIFNLRKYLTATPLI

SEQ ID NO: 3286648 - protein, 18 aa, Plasmodium falciparum
IFFCDFHSHSRKYNCFIF

SEQ ID NO: 3286649 - protein, 19 aa, Plasmodium falciparum
IFFETFLHKVDLLKKVFIA

SEQ ID NO: 3286650 - protein, 23 aa, Plasmodium falciparum
IFFFMFIVKNPYLFVENFYLLKN

SEQ ID NO: 3286651 - protein, 18 aa, Plasmodium falciparum
IFFIKLLICISFICVFEC

SEQ ID NO: 3286652 - protein, 21 aa, Plasmodium falciparum
IFFILYFIPVNKICVAYNVEK

SEQ ID NO: 3286653 - protein, 17 aa, Plasmodium falciparum
IFFLFFLFTIICNVIYL

SEQ ID NO: 3286654 - protein, 17 aa, Plasmodium falciparum
IFFLSWAKWVCGSVNFT

SEQ ID NO: 3286655 - protein, 17 aa, Plasmodium falciparum
IFFSLKYLSICYYFTIY

SEQ ID NO: 3286656 - protein, 18 aa, Plasmodium falciparum
IFFTYKYGRNIPINFKNM

SEQ ID NO: 3286657 - protein, 23 aa, Plasmodium falciparum
IFGIIFIVYSIYNILKSLININD

SEQ ID NO: 3286658 - protein, 17 aa, Plasmodium falciparum
IFGKNLLDKLTSIMLKK

SEQ ID NO: 3286659 - protein, 19 aa, Plasmodium falciparum
IFGMCFFNHKTGVLAPLAI

SEQ ID NO: 3286660 - protein, 20 aa, Plasmodium falciparum
IFGPIHLTIFFFYNGILKNQ

SEQ ID NO: 3286661 - protein, 17 aa, Plasmodium falciparum
IFHLFYHKKYNIKKLNP

SEQ ID NO: 3286662 - protein, 17 aa, Plasmodium falciparum
IFHLSDILLYYMKKDYI

SEQ ID NO: 3286663 - protein, 26 aa, Plasmodium falciparum
IFHNNIIYLFILYIINDNKYGIKQHR

SEQ ID NO: 3286664 - protein, 25 aa, Plasmodium falciparum
IFHYNEYFILDSILVDIFIPHSKIV

SEQ ID NO: 3286665 - protein, 26 aa, Plasmodium falciparum
IFIADSFSYLLKKLSLHDLILCFNKI

SEQ ID NO: 3286666 - protein, 19 aa, Plasmodium falciparum
IFIAGFLSIFAILLTISAV

SEQ ID NO: 3286667 - protein, 18 aa, Plasmodium falciparum
IFIEKKEWILTENKMKGV

SEQ ID NO: 3286668 - protein, 21 aa, Plasmodium falciparum
IFILIIFLYLNEKVICSINEN

SEQ ID NO: 3286669 - protein, 19 aa, Plasmodium falciparum
IFILSYYYFLNINYEINTL

SEQ ID NO: 3286670 - protein, 20 aa, Plasmodium falciparum
IFINEYFIYKMFKKQMTKYK

SEQ ID NO: 3286671 - protein, 21 aa, Plasmodium falciparum
IFIVLVMVVIYLILCYRRKQK

SEQ ID NO: 3286672 - protein, 19 aa, Plasmodium falciparum
IFIWRNQRWELLPPNLLIK

SEQ ID NO: 3286673 - protein, 25 aa, Plasmodium falciparum
IFKCDNKFYITKYGKEFKWSDPKVI

SEQ ID NO: 3286674 - protein, 17 aa, Plasmodium falciparum
IFKCTINNKLFACKVQH

SEQ ID NO: 3286675 - protein, 28 aa, Plasmodium falciparum
IFKDYIYSILLLILLWRNNYSYSDNFYV

SEQ ID NO: 3286676 - protein, 36 aa, Plasmodium falciparum
IFKENEYSYLLYYILALTTFLPKCLRYFDAVRRCRN

SEQ ID NO: 3286677 - protein, 19 aa, Plasmodium falciparum
IFKGIRKDVWTCEKVCGYN

SEQ ID NO: 3286678 - protein, 25 aa, Plasmodium falciparum
IFKGLGAFMILLTSFLIVLDNITLN

SEQ ID NO: 3286679 - protein, 27 aa, Plasmodium falciparum
IFKISIVFTLLILSLYIIRGEDTKLPQ

SEQ ID NO: 3286680 - protein, 26 aa, Plasmodium falciparum
IFKNAEFYRLFTSLFLHSNFNHICAN

SEQ ID NO: 3286681 - protein, 24 aa, Plasmodium falciparum
IFKNFLHSIYFRTPALGGRTIMLL

SEQ ID NO: 3286682 - protein, 25 aa, Plasmodium falciparum
IFKNYAFNFSFYNPYKDPKLKVTLL

SEQ ID NO: 3286683 - protein, 31 aa, Plasmodium falciparum
IFKVKKIYRIFYFINIFYNLNIEITKYLYNI

SEQ ID NO: 3286684 - protein, 18 aa, Plasmodium falciparum
IFKYFLQKLKHNSLNECM

SEQ ID NO: 3286685 - protein, 24 aa, Plasmodium falciparum
IFLCYLFLIVELLVFLIALFSLYE

SEQ ID NO: 3286686 - protein, 32 aa, Plasmodium falciparum
IFLDVHLLSIYEYLLWVCFYIVKDVYRLCCCL

SEQ ID NO: 3286687 - protein, 17 aa, Plasmodium falciparum
IFLFCSFYNIFLKILLF

SEQ ID NO: 3286688 - protein, 19 aa, Plasmodium falciparum
IFLFFFFGVHIINLYEGKN

SEQ ID NO: 3286689 - protein, 17 aa, Plasmodium falciparum
IFLIFLYVFLSRMLYDL

SEQ ID NO: 3286690 - protein, 18 aa, Plasmodium falciparum
IFLKILHFLLFKPIKINI

SEQ ID NO: 3286691 - protein, 20 aa, Plasmodium falciparum
IFLKNLYYMISKIEGIKTYC

SEQ ID NO: 3286692 - protein, 24 aa, Plasmodium falciparum
IFLNKYLYNNYILFSLKKQTQKCI

SEQ ID NO: 3286693 - protein, 21 aa, Plasmodium falciparum
IFLNLLTISGILLLNIIICDK

SEQ ID NO: 3286694 - protein, 18 aa, Plasmodium falciparum
IFLNVYHKEYFYLFIYEE

SEQ ID NO: 3286695 - protein, 17 aa, Plasmodium falciparum
IFLNVYHNIICQFCFLK

SEQ ID NO: 3286696 - protein, 32 aa, Plasmodium falciparum
IFLPISSNFFLYSILFLLEYLKDSQKKKKKKK

SEQ ID NO: 3286697 - protein, 24 aa, Plasmodium falciparum
IFLYILIIILNTIYQNIFDNIDNV

SEQ ID NO: 3286698 - protein, 27 aa, Plasmodium falciparum
IFMYIYMFSLLMWIMKLSINYNFYEVY

SEQ ID NO: 3286699 - protein, 18 aa, Plasmodium falciparum
IFMYSICLIVAKINELFS

SEQ ID NO: 3286700 - protein, 20 aa, Plasmodium falciparum
IFNDLIYFGFSANLLMLFNN

SEQ ID NO: 3286701 - protein, 19 aa, Plasmodium falciparum
IFNFMFYEHIIQPTKLFYK

SEQ ID NO: 3286702 - protein, 37 aa, Plasmodium falciparum
IFNHEKNIFIIFGHSLWFLHFFKYFLKESHKAKTNKL

SEQ ID NO: 3286703 - protein, 17 aa, Plasmodium falciparum
IFNHNLLSIYRILKTLI

SEQ ID NO: 3286704 - protein, 18 aa, Plasmodium falciparum
IFNIILIINLISYYIFLI

SEQ ID NO: 3286705 - protein, 21 aa, Plasmodium falciparum
IFNLFENIFNYDFVMHIYSYV

SEQ ID NO: 3286706 - protein, 18 aa, Plasmodium falciparum
IFNLRKYLTATPLIKKTW

SEQ ID NO: 3286707 - protein, 17 aa, Plasmodium falciparum
IFNMCSFKRYYNNHLEK

SEQ ID NO: 3286708 - protein, 40 aa, Plasmodium falciparum
IFNNDLIFIEYLLVFVCEYIYFLVLPSIFLFPLCNEFIAH

SEQ ID NO: 3286709 - protein, 21 aa, Plasmodium falciparum
IFNPFIDIMNNLFCYGIGLID

SEQ ID NO: 3286710 - protein, 25 aa, Plasmodium falciparum
IFNRTIYENLIYGLVPLYIKNNNNN

SEQ ID NO: 3286711 - protein, 23 aa, Plasmodium falciparum
IFNSLLNFFSNERIFPLKKKFEI

SEQ ID NO: 3286712 - protein, 30 aa, Plasmodium falciparum
IFPKKSILIIFLILYLRNLTKRKYNILRGL

SEQ ID NO: 3286713 - protein, 20 aa, Plasmodium falciparum
IFQEVWFRLVQIITGFVEGD

SEQ ID NO: 3286714 - protein, 43 aa, Plasmodium falciparum
IFQKLKIEHLYILLYFSLSILSTLFHIYLTRIMLNRKNPFFIS

SEQ ID NO: 3286715 - protein, 20 aa, Plasmodium falciparum
IFQLLNFLLNVLITHLTNAG

SEQ ID NO: 3286716 - protein, 24 aa, Plasmodium falciparum
IFRVVVFLCVCLFIVNICFDINKE

SEQ ID NO: 3286717 - protein, 23 aa, Plasmodium falciparum
IFSFFHIIYVLFVYASLNIKTRN

SEQ ID NO: 3286718 - protein, 17 aa, Plasmodium falciparum
IFSFVFLLFFYIKNPYL

SEQ ID NO: 3286719 - protein, 17 aa, Plasmodium falciparum
IFSHTKYCQACPLCGLE

SEQ ID NO: 3286720 - protein, 17 aa, Plasmodium falciparum
IFSILLCEYNEDVFHFL

SEQ ID NO: 3286721 - protein, 31 aa, Plasmodium falciparum
IFSIYNILEYMFLFPSYPVHLCFTNYCSFVS

SEQ ID NO: 3286722 - protein, 29 aa, Plasmodium falciparum
IFSKSGFLDLLLKWTYYTLYGHKNNNEIL

SEQ ID NO: 3286723 - protein, 42 aa, Plasmodium falciparum
IFSNPIVISFIVLVIIVLILLIIYLILRYRRKRKMKKKLQYL

SEQ ID NO: 3286724 - protein, 26 aa, Plasmodium falciparum
IFSNTFLFIYFVLFLMMTSICIICSL

SEQ ID NO: 3286725 - protein, 26 aa, Plasmodium falciparum
IFSSKINYFYLFNNLKELTKGKLYYE

SEQ ID NO: 3286726 - protein, 20 aa, Plasmodium falciparum
IFTCAHFLCLWIYGPLNAIY

SEQ ID NO: 3286727 - protein, 19 aa, Plasmodium falciparum
IFTFCSLIGLLFKDLIKGK

SEQ ID NO: 3286728 - protein, 25 aa, Plasmodium falciparum
IFTNKELYFLKKISTFYIKDLYDKC

SEQ ID NO: 3286729 - protein, 21 aa, Plasmodium falciparum
IFTWDFFMNHFQNTFGFAFAF

SEQ ID NO: 3286730 - protein, 26 aa, Plasmodium falciparum
IFVKKNIFFSIWNYLYIDIFCKNKNV

SEQ ID NO: 3286731 - protein, 18 aa, Plasmodium falciparum
IFVPWYFQQQYKTEGYDD

SEQ ID NO: 3286732 - protein, 23 aa, Plasmodium falciparum
IFVTYCLFLLFQLYTHISLFQDK

SEQ ID NO: 3286733 - protein, 21 aa, Plasmodium falciparum
IFVVRLAQGLLYMGKGLLTIN

SEQ ID NO: 3286734 - protein, 25 aa, Plasmodium falciparum
IFVYKEENMFFLKRKSDMEEVGNNN

SEQ ID NO: 3286735 - protein, 18 aa, Plasmodium falciparum
IFVYLKLNYEKNVEFKQL

SEQ ID NO: 3286736 - protein, 20 aa, Plasmodium falciparum
IFWRNYYLFINQLTKKILVS

SEQ ID NO: 3286737 - protein, 26 aa, Plasmodium falciparum
IFYDNIESYWIRWNKLNFEHFIFEKT

SEQ ID NO: 3286738 - protein, 29 aa, Plasmodium falciparum
IFYGISLLVYVIIIFFLNRFEKQTIPYER

SEQ ID NO: 3286739 - protein, 18 aa, Plasmodium falciparum
IFYHHLFLRKDNNVFLPH

SEQ ID NO: 3286740 - protein, 19 aa, Plasmodium falciparum
IFYNFFKSSVDLFLLNVIR

SEQ ID NO: 3286741 - protein, 19 aa, Plasmodium falciparum
IGACAPYRRLHLCHHNLEN

SEQ ID NO: 3286742 - protein, 19 aa, Plasmodium falciparum
IGCKDLITYYPYISLKQNS

SEQ ID NO: 3286743 - protein, 27 aa, Plasmodium falciparum
IGDIILRILSIIFPDVSPGLWFFIHFI

SEQ ID NO: 3286744 - protein, 20 aa, Plasmodium falciparum
IGDILCFLDLYLHINISQEF

SEQ ID NO: 3286745 - protein, 18 aa, Plasmodium falciparum
IGEFIGCLIFKFYKYKDT

SEQ ID NO: 3286746 - protein, 28 aa, Plasmodium falciparum
IGETNISLVPYLPWIKNIDEVLYYLQAH

SEQ ID NO: 3286747 - protein, 37 aa, Plasmodium falciparum
IGFNDIYKPFWNSLKLAFICLLVIWVFVLSFVYPSLL

SEQ ID NO: 3286748 - protein, 23 aa, Plasmodium falciparum
IGGDIFRLYLLSKMLKQKTKRKN

SEQ ID NO: 3286749 - protein, 23 aa, Plasmodium falciparum
IGGSLLYALSKWQTTEIATAIAA

SEQ ID NO: 3286750 - protein, 24 aa, Plasmodium falciparum
IGIAKPQFIRWLEEWTNEFCEKYT

SEQ ID NO: 3286751 - protein, 21 aa, Plasmodium falciparum
IGILLIFYFLEKYNITFCKDC

SEQ ID NO: 3286752 - protein, 37 aa, Plasmodium falciparum
IGISLLLYNISILKLYKYYYLFSLFKNHIIKTKSHLN

SEQ ID NO: 3286753 - protein, 24 aa, Plasmodium falciparum
IGISYLLKYIFLDIIIINPEIIPI

SEQ ID NO: 3286754 - protein, 20 aa, Plasmodium falciparum
IGIYLSYAFITLLNALISSS

SEQ ID NO: 3286755 - protein, 17 aa, Plasmodium falciparum
IGKLDIGSLLAQNLELL

SEQ ID NO: 3286756 - protein, 31 aa, Plasmodium falciparum
IGKNNFPMYIYIMLICLIFSILQDDGNYDDI

SEQ ID NO: 3286757 - protein, 17 aa, Plasmodium falciparum
IGKSHYPIFLKERFNRN

SEQ ID NO: 3286758 - protein, 24 aa, Plasmodium falciparum
IGLFILHILLYIIYAIHAQILRYI

SEQ ID NO: 3286759 - protein, 17 aa, Plasmodium falciparum
IGLFLLNLNIYLSKCNF

SEQ ID NO: 3286760 - protein, 32 aa, Plasmodium falciparum
IGLGTDILCVYRIYKILLLKNKNKFLQKVLNS

SEQ ID NO: 3286761 - protein, 18 aa, Plasmodium falciparum
IGLLLKYLDIDVYNVFCL

SEQ ID NO: 3286762 - protein, 25 aa, Plasmodium falciparum
IGLNRRIFKYLYLYESNDEKNFKDK

SEQ ID NO: 3286763 - protein, 19 aa, Plasmodium falciparum
IGMKLIERMLIYKNEFYDV

SEQ ID NO: 3286764 - protein, 27 aa, Plasmodium falciparum
IGMNQKIFFLIPLCLVKLMNINTNLFN

SEQ ID NO: 3286765 - protein, 26 aa, Plasmodium falciparum
IGNDFAFIRRYYKSRLLSDVSYKNNS

SEQ ID NO: 3286766 - protein, 29 aa, Plasmodium falciparum
IGNIQFLSFNLLFYVPLKINFNEMNFINF

SEQ ID NO: 3286767 - protein, 24 aa, Plasmodium falciparum
IGNLYLQYILMFNYLNIYMSSVEI

SEQ ID NO: 3286768 - protein, 54 aa, Plasmodium falciparum
IGNVLNIFFPLIIWGSFYWTYENFFIFPIFVIYAYHIYMFYHIVKEFTLSIHFI

SEQ ID NO: 3286769 - protein, 35 aa, Plasmodium falciparum
IGPCLYKDFNNSCFLNLPILFNHQTKECVIIGTHE

SEQ ID NO: 3286770 - protein, 18 aa, Plasmodium falciparum
IGQEIIIEEIKKEVKKRV

SEQ ID NO: 3286771 - protein, 27 aa, Plasmodium falciparum
IGTAYITLNPLLPWLDNYEKNECVELF

SEQ ID NO: 3286772 - protein, 23 aa, Plasmodium falciparum
IGTFIRYIKIFILVFTRIRNNER

SEQ ID NO: 3286773 - protein, 25 aa, Plasmodium falciparum
IGTKSIMCCCIILRTLLEMNSDGYY

SEQ ID NO: 3286774 - protein, 18 aa, Plasmodium falciparum
IGTLIFHLFHMTFSFSFI

SEQ ID NO: 3286775 - protein, 18 aa, Plasmodium falciparum
IGYIPNDLFFSCIQNRII

SEQ ID NO: 3286776 - protein, 18 aa, Plasmodium falciparum
IHACNMIFIPTQIDHTYY

SEQ ID NO: 3286777 - protein, 20 aa, Plasmodium falciparum
IHAMFKWAILLRNMLMKSKQ

SEQ ID NO: 3286778 - protein, 25 aa, Plasmodium falciparum
IHAWKIFLYNTRFNQLLFKFLHLCM

SEQ ID NO: 3286779 - protein, 22 aa, Plasmodium falciparum
IHCRNIHLYLILSSHEGIERKK

SEQ ID NO: 3286780 - protein, 17 aa, Plasmodium falciparum
IHDLLFNKVYIIQNKQH

SEQ ID NO: 3286781 - protein, 23 aa, Plasmodium falciparum
IHDMDTYIFKYYNSLLKIASVES

SEQ ID NO: 3286782 - protein, 22 aa, Plasmodium falciparum
IHECSYIYMYKIGLYCIISGYY

SEQ ID NO: 3286783 - protein, 38 aa, Plasmodium falciparum
IHFKNKIILFFIFTQCKYIYIKFFRLLVQSIFSSSEFQ

SEQ ID NO: 3286784 - protein, 21 aa, Plasmodium falciparum
IHFLTYWILYSFYTYFESAFI

SEQ ID NO: 3286785 - protein, 17 aa, Plasmodium falciparum
IHFTILDANYIYKKIYV

SEQ ID NO: 3286786 - protein, 23 aa, Plasmodium falciparum
IHGDYIYLINLKSYNLDFQKYES

SEQ ID NO: 3286787 - protein, 50 aa, Plasmodium falciparum
IHGYDLIYDFIYRKKSFFYSYMCIYIFLKNGHIYLIRRNLMTKDKDERFI

SEQ ID NO: 3286788 - protein, 25 aa, Plasmodium falciparum
IHHICYYIFVDTKYFLEKNIKFNKF

SEQ ID NO: 3286789 - protein, 25 aa, Plasmodium falciparum
IHIFEDNLDFLISLNEFIKTNNFTY

SEQ ID NO: 3286790 - protein, 26 aa, Plasmodium falciparum
IHIKDLINIWFGINKIIFDNRNKLIR

SEQ ID NO: 3286791 - protein, 27 aa, Plasmodium falciparum
IHINILLFLILYEYICKYTNIHFVFYF

SEQ ID NO: 3286792 - protein, 24 aa, Plasmodium falciparum
IHITQTYFLFKMKSFLIIFMLRFF

SEQ ID NO: 3286793 - protein, 19 aa, Plasmodium falciparum
IHIVLLQFVEFLQSNIIPS

SEQ ID NO: 3286794 - protein, 24 aa, Plasmodium falciparum
IHKACVTIELFLKIIILCFKHIND

SEQ ID NO: 3286795 - protein, 31 aa, Plasmodium falciparum
IHKKGKFKRLFLFIGFQSIPIIALMYLFKYI

SEQ ID NO: 3286796 - protein, 26 aa, Plasmodium falciparum
IHKKRKTFILPPRLKKSFSYKPNKVI

SEQ ID NO: 3286797 - protein, 22 aa, Plasmodium falciparum
IHKYQKIFKILADNKNIWEKIN

SEQ ID NO: 3286798 - protein, 27 aa, Plasmodium falciparum
IHLKNIFFSFKTNPMYKYYHHCSILRK

SEQ ID NO: 3286799 - protein, 18 aa, Plasmodium falciparum
IHLLRNNLYIFKNYESIT

SEQ ID NO: 3286800 - protein, 18 aa, Plasmodium falciparum
IHLYKEYCRKVWIELFPQ

SEQ ID NO: 3286801 - protein, 24 aa, Plasmodium falciparum
IHMDVRKIFYFLDVIKKNATIQLY

SEQ ID NO: 3286802 - protein, 19 aa, Plasmodium falciparum
IHMKKIILENLYFCKDIRL

SEQ ID NO: 3286803 - protein, 28 aa, Plasmodium falciparum
IHMKNYFLNKYLIYLNDIYKKVIQNHRM

SEQ ID NO: 3286804 - protein, 18 aa, Plasmodium falciparum
IHMVILEDTLYYKIIYIL

SEQ ID NO: 3286805 - protein, 23 aa, Plasmodium falciparum
IHNNLYIKYFFENSLYFIYEIYI

SEQ ID NO: 3286806 - protein, 18 aa, Plasmodium falciparum
IHNPLFSQIFQKPDTQHN

SEQ ID NO: 3286807 - protein, 23 aa, Plasmodium falciparum
IHNQLELFHKWLDRHRDMCEKLK

SEQ ID NO: 3286808 - protein, 22 aa, Plasmodium falciparum
IHNQLELFHKWLDRHRDMCEKW

SEQ ID NO: 3286809 - protein, 23 aa, Plasmodium falciparum
IHNQLELFHKWLDRHRDMCEQWE

SEQ ID NO: 3286810 - protein, 23 aa, Plasmodium falciparum
IHNQLELFHKWLDRHRNMCEKWK

SEQ ID NO: 3286811 - protein, 24 aa, Plasmodium falciparum
IHNQLELFHTWLDRHRDMCEQWSN

SEQ ID NO: 3286812 - protein, 24 aa, Plasmodium falciparum
IHNQLNLFHTWLDRHRDMCEKWNT

SEQ ID NO: 3286813 - protein, 39 aa, Plasmodium falciparum
IHNRNYYFINYAHHVIFNTLYYCIVKGCNIYYKIKKSKE

SEQ ID NO: 3286814 - protein, 27 aa, Plasmodium falciparum
IHNYEIIFKIIDYLRPYTWDKSVENFS

SEQ ID NO: 3286815 - protein, 18 aa, Plasmodium falciparum
IHNYIYKKLMGYPIYMAF

SEQ ID NO: 3286816 - protein, 19 aa, Plasmodium falciparum
IHNYKVIWTIRNVQEKLFW

SEQ ID NO: 3286817 - protein, 18 aa, Plasmodium falciparum
IHNYLFKIMNNMFINRFI

SEQ ID NO: 3286818 - protein, 27 aa, Plasmodium falciparum
IHQHFKILIFIYYLFNGFIGYYHRNDQ

SEQ ID NO: 3286819 - protein, 30 aa, Plasmodium falciparum
IHQNNNILTHYVICLLKIIIRNIYENRRYE

SEQ ID NO: 3286820 - protein, 25 aa, Plasmodium falciparum
IHRKNPLINFCLRKNIYCDNINKHL

SEQ ID NO: 3286821 - protein, 17 aa, Plasmodium falciparum
IHSKYAFLFIPDHNNMN

SEQ ID NO: 3286822 - protein, 23 aa, Plasmodium falciparum
IHSRLHFNYLALPNINKIISVLF

SEQ ID NO: 3286823 - protein, 32 aa, Plasmodium falciparum
IHSYYNSNSIYVFFYLFVHINNIINSIIIQFN

SEQ ID NO: 3286824 - protein, 44 aa, Plasmodium falciparum
IHTQYIHYLFFISLMSIIFLFILYDLYYNILQICTIFLCTCTFF

SEQ ID NO: 3286825 - protein, 18 aa, Plasmodium falciparum
IHVQALFFLFDNLYCKKE

SEQ ID NO: 3286826 - protein, 18 aa, Plasmodium falciparum
IHYSFYNLTYKHSCNFQT

SEQ ID NO: 3286827 - protein, 23 aa, Plasmodium falciparum
IHYVVYLAYVLINNNHYLFVTIV

SEQ ID NO: 3286828 - protein, 25 aa, Plasmodium falciparum
IIAIILYLIFMLFSYVFVNYVLFYA

SEQ ID NO: 3286829 - protein, 32 aa, Plasmodium falciparum
IIAIVVIILIMVIIYLILRYRRKKKMKKKLQY

SEQ ID NO: 3286830 - protein, 29 aa, Plasmodium falciparum
IIAIVVIVLIMVIIYKILRYRRKKKMKKK

SEQ ID NO: 3286831 - protein, 24 aa, Plasmodium falciparum
IIALAYFTRFNTYLIFSLYERIAM

SEQ ID NO: 3286832 - protein, 28 aa, Plasmodium falciparum
IICFTLLLLVHIIICIAIHIALYILAKH

SEQ ID NO: 3286833 - protein, 18 aa, Plasmodium falciparum
IICFVWIYKIIKNIHFLV

SEQ ID NO: 3286834 - protein, 19 aa, Plasmodium falciparum
IICHFFKIYTLHAINTLHN

SEQ ID NO: 3286835 - protein, 20 aa, Plasmodium falciparum
IICKKLEYFYIISKFIYNNI

SEQ ID NO: 3286836 - protein, 32 aa, Plasmodium falciparum
IICKTYYIHIYLIIYIILLDLLTTYKLYTSNW

SEQ ID NO: 3286837 - protein, 22 aa, Plasmodium falciparum
IICLFNQYFNMFTYFYDEKKMS

SEQ ID NO: 3286838 - protein, 20 aa, Plasmodium falciparum
IICMLFFFLFAINLFHISEK

SEQ ID NO: 3286839 - protein, 24 aa, Plasmodium falciparum
IICNKYFVYFLAEIQYLLEVLQKY

SEQ ID NO: 3286840 - protein, 19 aa, Plasmodium falciparum
IICSIQCALIGFIILLIIA

SEQ ID NO: 3286841 - protein, 25 aa, Plasmodium falciparum
IICSSCLFLIFLSVIFCSEPDTNSF

SEQ ID NO: 3286842 - protein, 28 aa, Plasmodium falciparum
IIDFEIYIIIFILLVYFATKKIHKIIDS

SEQ ID NO: 3286843 - protein, 29 aa, Plasmodium falciparum
IIDFFIGVIIINVFFFEYVKCQGKFVNTK

SEQ ID NO: 3286844 - protein, 26 aa, Plasmodium falciparum
IIDIDLYLSYFYLLSKINMIDKHMVI

SEQ ID NO: 3286845 - protein, 24 aa, Plasmodium falciparum
IIDKKIIPLKIKYDKMIIHFKTYI

SEQ ID NO: 3286846 - protein, 31 aa, Plasmodium falciparum
IIDKQVCKFLKKIYFIILKYVIYMQNINMEE

SEQ ID NO: 3286847 - protein, 25 aa, Plasmodium falciparum
IIDLIKLIYSFFILLNQKVQINQAQ

SEQ ID NO: 3286848 - protein, 25 aa, Plasmodium falciparum
IIDLSLFHYLCNLFLVEKVYININN

SEQ ID NO: 3286849 - protein, 20 aa, Plasmodium falciparum
IIDMPLFLVEHIYIRKKKEL

SEQ ID NO: 3286850 - protein, 39 aa, Plasmodium falciparum
IIDVYLLNISYLCNYIIIVLDFFFIFGDSLFSINCYNHN

SEQ ID NO: 3286851 - protein, 25 aa, Plasmodium falciparum
IIEALVYIFFKVLCKITIDYIYMFN

SEQ ID NO: 3286852 - protein, 34 aa, Plasmodium falciparum
IIEDPYKIKLLERKKWLWKTIIEIHKLILEEQRK

SEQ ID NO: 3286853 - protein, 32 aa, Plasmodium falciparum
IIEDPYKIKLLERKKWLWKTIIEIHMLILEEQ

SEQ ID NO: 3286854 - protein, 19 aa, Plasmodium falciparum
IIEEKVEKIPKKKVIEKKK

SEQ ID NO: 3286855 - protein, 32 aa, Plasmodium falciparum
IIEEPYKIKLLERKKWLWKTIIEIHMLILEEQ

SEQ ID NO: 3286856 - protein, 31 aa, Plasmodium falciparum
IIEHFIYTYEKPIFKYLKCKKVDNVNIFFSY

SEQ ID NO: 3286857 - protein, 25 aa, Plasmodium falciparum
IIEMTNMFFFYKQYYYELREEEYNN

SEQ ID NO: 3286858 - protein, 31 aa, Plasmodium falciparum
IIFCLNRNSQFVLIIKNLFWSNLVELFLKYN

SEQ ID NO: 3286859 - protein, 19 aa, Plasmodium falciparum
IIFCTLITFFGGSKLFLNL

SEQ ID NO: 3286860 - protein, 17 aa, Plasmodium falciparum
IIFFCFEIILHTLNMLF

SEQ ID NO: 3286861 - protein, 18 aa, Plasmodium falciparum
IIFFEQIVILYNYLKYVI

SEQ ID NO: 3286862 - protein, 29 aa, Plasmodium falciparum
IIFFSMFVYFFVYFYFIPQNKYVFPIDFS

SEQ ID NO: 3286863 - protein, 17 aa, Plasmodium falciparum
IIFIIDHLLLNLVKLLK

SEQ ID NO: 3286864 - protein, 25 aa, Plasmodium falciparum
IIFKYKYICILLGKLRYFTNQDILK

SEQ ID NO: 3286865 - protein, 17 aa, Plasmodium falciparum
IIFLALTKLLNHDKIRN

SEQ ID NO: 3286866 - protein, 21 aa, Plasmodium falciparum
IIFLFFTFFNYCFSQDVIELN

SEQ ID NO: 3286867 - protein, 21 aa, Plasmodium falciparum
IIFLSFCFFLFIFVELIRKIC

SEQ ID NO: 3286868 - protein, 22 aa, Plasmodium falciparum
IIFLSFCFFLFIFVELIRKICE

SEQ ID NO: 3286869 - protein, 24 aa, Plasmodium falciparum
IIFMSTILSLIFKNIIIPKCDNVH

SEQ ID NO: 3286870 - protein, 25 aa, Plasmodium falciparum
IIFNINYLLYLFNKNNRIYFDLHVL

SEQ ID NO: 3286871 - protein, 23 aa, Plasmodium falciparum
IIFPLFITYLLLSTPLVLQEINS

SEQ ID NO: 3286872 - protein, 20 aa, Plasmodium falciparum
IIFSIILVTLSLIYNNDYER

SEQ ID NO: 3286873 - protein, 20 aa, Plasmodium falciparum
IIFSIILVTLTLIYNNDYER

SEQ ID NO: 3286874 - protein, 19 aa, Plasmodium falciparum
IIFSTIKIYCNLRLYNYRS

SEQ ID NO: 3286875 - protein, 26 aa, Plasmodium falciparum
IIGILQLLVPLIGWIWAVFWGILIVI

SEQ ID NO: 3286876 - protein, 19 aa, Plasmodium falciparum
IIGLISLFVYLYRIDTKLL

SEQ ID NO: 3286877 - protein, 26 aa, Plasmodium falciparum
IIGRKCFHWWNNLPITWKVGIACSVL

SEQ ID NO: 3286878 - protein, 40 aa, Plasmodium falciparum
IIGRYLYIQFVLFHKNKIIVFIIFFFQQVEYMTNEQKNIL

SEQ ID NO: 3286879 - protein, 18 aa, Plasmodium falciparum
IIHDFVFNYFLQSGNRIC

SEQ ID NO: 3286880 - protein, 18 aa, Plasmodium falciparum
IIHHVFKPPYDACKLKLL

SEQ ID NO: 3286881 - protein, 18 aa, Plasmodium falciparum
IIHKDKLYDYKKIGYLFA

SEQ ID NO: 3286882 - protein, 31 aa, Plasmodium falciparum
IIHMKNFFDYFFVLLVKLINIIIRRAQCSLN

SEQ ID NO: 3286883 - protein, 19 aa, Plasmodium falciparum
IIHNILNKKLIYDEQSRHI

SEQ ID NO: 3286884 - protein, 17 aa, Plasmodium falciparum
IIHSIFELLKNVSMYYA

SEQ ID NO: 3286885 - protein, 19 aa, Plasmodium falciparum
IIHYINYISFNKFKSFIDK

SEQ ID NO: 3286886 - protein, 17 aa, Plasmodium falciparum
IIIAPLTKWLIGSNRRW

SEQ ID NO: 3286887 - protein, 20 aa, Plasmodium falciparum
IIIFFFLLCLNEKVLCSINE

SEQ ID NO: 3286888 - protein, 21 aa, Plasmodium falciparum
IIIFLKWVSCKKYIFSVFVFL

SEQ ID NO: 3286889 - protein, 25 aa, Plasmodium falciparum
IIIGCILRCIFSPVFGLLNFSASIT

SEQ ID NO: 3286890 - protein, 27 aa, Plasmodium falciparum
IIIHKYMILLEYFICILDMCLYIHLLL

SEQ ID NO: 3286891 - protein, 19 aa, Plasmodium falciparum
IIIIFKYIQNYHDNMNFFY

SEQ ID NO: 3286892 - protein, 32 aa, Plasmodium falciparum
IIIIVILVIILIIYLCFLIKKSGILENEHVQK

SEQ ID NO: 3286893 - protein, 33 aa, Plasmodium falciparum
IIIIVNKFKIKEHNLLLFLNKTKLNKYIPKVEN

SEQ ID NO: 3286894 - protein, 24 aa, Plasmodium falciparum
IIIKKCFFMWNRLYNFLNKKKRNI

SEQ ID NO: 3286895 - protein, 17 aa, Plasmodium falciparum
IIIKYYLIKYDKDNLNF

SEQ ID NO: 3286896 - protein, 19 aa, Plasmodium falciparum
IIILDEFLYILYIPGNTED

SEQ ID NO: 3286897 - protein, 18 aa, Plasmodium falciparum
IIILTFKIFFLTEHMKKN

SEQ ID NO: 3286898 - protein, 24 aa, Plasmodium falciparum
IIIMYGLMFAFEFSSSLFKLKYLK

SEQ ID NO: 3286899 - protein, 25 aa, Plasmodium falciparum
IIINNFIDIFKSNILYFLKYKDEEY

SEQ ID NO: 3286900 - protein, 24 aa, Plasmodium falciparum
IIIYDNYFLLHFSKLALCVFSYFL

SEQ ID NO: 3286901 - protein, 18 aa, Plasmodium falciparum
IIIYLLVLSKYIPFSNMM

SEQ ID NO: 3286902 - protein, 23 aa, Plasmodium falciparum
IIKEILMILSLNCPIKFKNNFYM

SEQ ID NO: 3286903 - protein, 24 aa, Plasmodium falciparum
IIKFKNKIVYFTKLFFQQINISVD

SEQ ID NO: 3286904 - protein, 18 aa, Plasmodium falciparum
IIKIIKKSKSFKSIKKNI

SEQ ID NO: 3286905 - protein, 17 aa, Plasmodium falciparum
IIKIIKNNKLQNVFINI

SEQ ID NO: 3286906 - protein, 17 aa, Plasmodium falciparum
IIKIIQPLIQVLYCINK

SEQ ID NO: 3286907 - protein, 28 aa, Plasmodium falciparum
IIKKKKTYLILPIFIDIIKILDVYDEII

SEQ ID NO: 3286908 - protein, 18 aa, Plasmodium falciparum
IIKLIINSNIKKLINVIH

SEQ ID NO: 3286909 - protein, 26 aa, Plasmodium falciparum
IIKNDMYIYTLFFNPIKEDKNKSIVY

SEQ ID NO: 3286910 - protein, 17 aa, Plasmodium falciparum
IIKNINRLLLNKIIDNY

SEQ ID NO: 3286911 - protein, 17 aa, Plasmodium falciparum
IIKNSMNTLWIESVLRL

SEQ ID NO: 3286912 - protein, 24 aa, Plasmodium falciparum
IIKPLNLRIPFINLRNSESLFVNS

SEQ ID NO: 3286913 - protein, 31 aa, Plasmodium falciparum
IIKSIHLFHLLLKHFYNYFPILKITNNQTNN

SEQ ID NO: 3286914 - protein, 25 aa, Plasmodium falciparum
IIKSIKIDLLYILKNDYNKIIILDE

SEQ ID NO: 3286915 - protein, 36 aa, Plasmodium falciparum
IIKTILLRKHLIVFVIINILILFKLNVNTTYEFSSL

SEQ ID NO: 3286916 - protein, 32 aa, Plasmodium falciparum
IIKTVWLCNIFCCIIYYIFGYVLCTAYPNINN

SEQ ID NO: 3286917 - protein, 18 aa, Plasmodium falciparum
IIKVILFLLKMLSKYNMN

SEQ ID NO: 3286918 - protein, 18 aa, Plasmodium falciparum
IILALYLYDSEKTSWLLL

SEQ ID NO: 3286919 - protein, 18 aa, Plasmodium falciparum
IILDLLDYLIKLLDDSNI

SEQ ID NO: 3286920 - protein, 19 aa, Plasmodium falciparum
IILFIIKSNIFSELYTYNI

SEQ ID NO: 3286921 - protein, 26 aa, Plasmodium falciparum
IILHNYNFEYLIKPFDLVLPVEQSSN

SEQ ID NO: 3286922 - protein, 18 aa, Plasmodium falciparum
IILIKFKKHIKYILKKAF

SEQ ID NO: 3286923 - protein, 19 aa, Plasmodium falciparum
IILILKLFIVLADKSDNSI

SEQ ID NO: 3286924 - protein, 34 aa, Plasmodium falciparum
IILKNYFVYYHPLYLDFYLSFAWYNKGSNNEKAF

SEQ ID NO: 3286925 - protein, 25 aa, Plasmodium falciparum
IILLCSNLHDWKLFCGLPTIRFRKD

SEQ ID NO: 3286926 - protein, 26 aa, Plasmodium falciparum
IILLFLLFPLNIFLSFSFIRYNSISF

SEQ ID NO: 3286927 - protein, 36 aa, Plasmodium falciparum
IILNIKPILYLFQINILFFFKLLHVLDICNYKNIAL

SEQ ID NO: 3286928 - protein, 25 aa, Plasmodium falciparum
IILNLTNLIHIYTLGFNYINNDLSN

SEQ ID NO: 3286929 - protein, 26 aa, Plasmodium falciparum
IILNTNLFLCMYLTYLNIANDIFPFS

SEQ ID NO: 3286930 - protein, 26 aa, Plasmodium falciparum
IILPQYHLFDLFDNYVYIIICLKNEN

SEQ ID NO: 3286931 - protein, 17 aa, Plasmodium falciparum
IILSVDGFIYIFGEFIK

SEQ ID NO: 3286932 - protein, 47 aa, Plasmodium falciparum
IILTCNKKLLLYLSYSFLLTNYVCPMSWFFIIRRIVEDVKIFNKKQC

SEQ ID NO: 3286933 - protein, 17 aa, Plasmodium falciparum
IIMFFKIHRRNALLVTH

SEQ ID NO: 3286934 - protein, 22 aa, Plasmodium falciparum
IIMKLGFFFDKVMNISINQWLR

SEQ ID NO: 3286935 - protein, 23 aa, Plasmodium falciparum
IIMLIFQVLLDEIILVYNLSFSD

SEQ ID NO: 3286936 - protein, 32 aa, Plasmodium falciparum
IIMSNIFMRINIETILNLLKFFSDNNSLDSDM

SEQ ID NO: 3286937 - protein, 18 aa, Plasmodium falciparum
IIMWSNNFVFSFSLFNKC

SEQ ID NO: 3286938 - protein, 17 aa, Plasmodium falciparum
IINDIYLEVLFFDLDAL

SEQ ID NO: 3286939 - protein, 26 aa, Plasmodium falciparum
IINEEWIKMELYLCNIYGINEKWMGI

SEQ ID NO: 3286940 - protein, 24 aa, Plasmodium falciparum
IINFFIFVTFNIKNESKYSNTFIN

SEQ ID NO: 3286941 - protein, 28 aa, Plasmodium falciparum
IINHNIISKIYYILYLKNFCFDEKGMKI

SEQ ID NO: 3286942 - protein, 17 aa, Plasmodium falciparum
IINIIFEFFQIQDVYKL

SEQ ID NO: 3286943 - protein, 26 aa, Plasmodium falciparum
IINIILFYFFLWVKKSISELLSSTQY

SEQ ID NO: 3286944 - protein, 18 aa, Plasmodium falciparum
IININFIHKIYADFLFEK

SEQ ID NO: 3286945 - protein, 18 aa, Plasmodium falciparum
IINKLFETILYNIIHKEN

SEQ ID NO: 3286946 - protein, 17 aa, Plasmodium falciparum
IINKLICLLYSKNDLNS

SEQ ID NO: 3286947 - protein, 26 aa, Plasmodium falciparum
IINKTHFIYFFLNNSLHDILNIFNEL

SEQ ID NO: 3286948 - protein, 17 aa, Plasmodium falciparum
IINLLKTELSHLLSLKE

SEQ ID NO: 3286949 - protein, 17 aa, Plasmodium falciparum
IINLYNSILRVLKVFNG

SEQ ID NO: 3286950 - protein, 27 aa, Plasmodium falciparum
IINNFVDLPLLYFLKNSKDVKNKMLLR

SEQ ID NO: 3286951 - protein, 50 aa, Plasmodium falciparum
IINRIPSIYMYTKKKTLTFLLSHLSLIFPSLFNFYPNTFVLPENKNIIKY

SEQ ID NO: 3286952 - protein, 22 aa, Plasmodium falciparum
IINSFYIYNYIQLLLNEGSNKS

SEQ ID NO: 3286953 - protein, 18 aa, Plasmodium falciparum
IINSILMILKKYCWYNIK

SEQ ID NO: 3286954 - protein, 33 aa, Plasmodium falciparum
IINSNERYFLPLISFIPIIILYDYLKKKNEIEE

SEQ ID NO: 3286955 - protein, 18 aa, Plasmodium falciparum
IINTLIKALSIFVLSFIF

SEQ ID NO: 3286956 - protein, 17 aa, Plasmodium falciparum
IINVLNYCNFDIPLILA

SEQ ID NO: 3286957 - protein, 39 aa, Plasmodium falciparum
IIPKGWVFFSIFFWVFIMLLLFLFPFFTQTFEKYCAYDD

SEQ ID NO: 3286958 - protein, 23 aa, Plasmodium falciparum
IIPLIHKKYFLSSHIHLYFDSLK

SEQ ID NO: 3286959 - protein, 26 aa, Plasmodium falciparum
IIPPEFLRSMFYTFGDYRDICLDTDI

SEQ ID NO: 3286960 - protein, 25 aa, Plasmodium falciparum
IIQENLYNILVFKIQYLKVKAINDI

SEQ ID NO: 3286961 - protein, 45 aa, Plasmodium falciparum
IIQEQIIRVLLERILAHRPHPWGLLITFIELIKNTKFNFWECPFV

SEQ ID NO: 3286962 - protein, 19 aa, Plasmodium falciparum
IIQILGVDKLPLIMLDSLE

SEQ ID NO: 3286963 - protein, 30 aa, Plasmodium falciparum
IIQISSFFSFYFKLFSNMWILLISELMGLY

SEQ ID NO: 3286964 - protein, 19 aa, Plasmodium falciparum
IIQLFCFSKYILEKYMDKI

SEQ ID NO: 3286965 - protein, 34 aa, Plasmodium falciparum
IIQPILLVGMIFVFYIFYFRLFKRRYTSNESYRR

SEQ ID NO: 3286966 - protein, 17 aa, Plasmodium falciparum
IIRHEWYYNLLNNSPHD

SEQ ID NO: 3286967 - protein, 26 aa, Plasmodium falciparum
IIRKIKKIIYFNNSLYSMLYMKKLPC

SEQ ID NO: 3286968 - protein, 25 aa, Plasmodium falciparum
IIRKKYIHFFFLKKQKYKNMTYHKF

SEQ ID NO: 3286969 - protein, 17 aa, Plasmodium falciparum
IIRNFFLLNINSVIFEL

SEQ ID NO: 3286970 - protein, 35 aa, Plasmodium falciparum
IIRNSIVLRQCKSRFISIITNYYPFKEQNNPFIKQ

SEQ ID NO: 3286971 - protein, 23 aa, Plasmodium falciparum
IIRRISLILANRYILRKDLNLIY

SEQ ID NO: 3286972 - protein, 24 aa, Plasmodium falciparum
IIRTSFHWAITSFVLFFLFEHFSI

SEQ ID NO: 3286973 - protein, 17 aa, Plasmodium falciparum
IISFFFYFKEHKFSTIL

SEQ ID NO: 3286974 - protein, 17 aa, Plasmodium falciparum
IISFFYKFSSILTIFYT

SEQ ID NO: 3286975 - protein, 26 aa, Plasmodium falciparum
IISFINKMWINKFNVFYYITQHVNIH

SEQ ID NO: 3286976 - protein, 20 aa, Plasmodium falciparum
IISFLSFWFTKCMIIWCHIK

SEQ ID NO: 3286977 - protein, 23 aa, Plasmodium falciparum
IISHPFLPFFALIHINNNEKNMN

SEQ ID NO: 3286978 - protein, 30 aa, Plasmodium falciparum
IISIHYLFILYIIILPLSSSLLFTSSLSWT

SEQ ID NO: 3286979 - protein, 41 aa, Plasmodium falciparum
IISIKHNYIRLLLIFNKLFLFVLYIYIFRYTHNEHTFYNNV

SEQ ID NO: 3286980 - protein, 28 aa, Plasmodium falciparum
IISINKIIFSIIFINIYIKIKQCLKMNE

SEQ ID NO: 3286981 - protein, 20 aa, Plasmodium falciparum
IISLLFLCEQFFYIINTNII

SEQ ID NO: 3286982 - protein, 24 aa, Plasmodium falciparum
IISLLRIMNEFLLKDILLQKKTND

SEQ ID NO: 3286983 - protein, 21 aa, Plasmodium falciparum
IISLLYTCLIVLISKTSPLKN

SEQ ID NO: 3286984 - protein, 30 aa, Plasmodium falciparum
IISMNFILCLRLLYLIINTLNYFLKYENKI

SEQ ID NO: 3286985 - protein, 18 aa, Plasmodium falciparum
IISRNYMTILLYSISKNM

SEQ ID NO: 3286986 - protein, 23 aa, Plasmodium falciparum
IISSFIFYLLHIILNLYKNYSVR

SEQ ID NO: 3286987 - protein, 36 aa, Plasmodium falciparum
IISTSLLNLFLMQFLKLFPIPWLKKKKCHFKYIKQI

SEQ ID NO: 3286988 - protein, 31 aa, Plasmodium falciparum
IISYITYFLFLCIFTYFFKLYQQHKYNIKIT

SEQ ID NO: 3286989 - protein, 18 aa, Plasmodium falciparum
IISYIYLNDFRNAYMKFL

SEQ ID NO: 3286990 - protein, 19 aa, Plasmodium falciparum
IISYSYLICLKYFNKYMKQ

SEQ ID NO: 3286991 - protein, 19 aa, Plasmodium falciparum
IITFPLNSYYLQNIKNKFN

SEQ ID NO: 3286992 - protein, 23 aa, Plasmodium falciparum
IITFSPMPILHKHNVVIGTVLKG

SEQ ID NO: 3286993 - protein, 18 aa, Plasmodium falciparum
IITIFFNLQIYIGKCLNH

SEQ ID NO: 3286994 - protein, 21 aa, Plasmodium falciparum
IITIIYLILTIFMVYYIRSKI

SEQ ID NO: 3286995 - protein, 18 aa, Plasmodium falciparum
IITKLFLSSSLLILTLNV

SEQ ID NO: 3286996 - protein, 31 aa, Plasmodium falciparum
IITLFYFLLYIFILFHCLNSLIIKYNVKVEG

SEQ ID NO: 3286997 - protein, 20 aa, Plasmodium falciparum
IITLVNMLCNLFIYDSLIFY

SEQ ID NO: 3286998 - protein, 17 aa, Plasmodium falciparum
IITNLIKYDIILDNVYL

SEQ ID NO: 3286999 - protein, 22 aa, Plasmodium falciparum
IITYCIIFNLLIKKIKKFFRNN

SEQ ID NO: 3287000 - protein, 28 aa, Plasmodium falciparum
IIVFTYPNLKTIRRFLKKKIKSLKIQSD

SEQ ID NO: 3287001 - protein, 25 aa, Plasmodium falciparum
IIVINISFFFIKDDKKIKIFLDYIL

SEQ ID NO: 3287002 - protein, 17 aa, Plasmodium falciparum
IIVKTVILLNPDYPLDT

SEQ ID NO: 3287003 - protein, 18 aa, Plasmodium falciparum
IIVLFKICYKVTLPIFLY

SEQ ID NO: 3287004 - protein, 43 aa, Plasmodium falciparum
IIVLKQIMFIKILFFLYKHNNLLIIKLYILKTLSILSKHLIFE

SEQ ID NO: 3287005 - protein, 18 aa, Plasmodium falciparum
IIWAQIQGSERLKTYSMV

SEQ ID NO: 3287006 - protein, 19 aa, Plasmodium falciparum
IIYDLQFFDYFINDEKKKK

SEQ ID NO: 3287007 - protein, 18 aa, Plasmodium falciparum
IIYFILISIFLKYNNCNI

SEQ ID NO: 3287008 - protein, 22 aa, Plasmodium falciparum
IIYICYRFFGHHYIINCMIQIF

SEQ ID NO: 3287009 - protein, 19 aa, Plasmodium falciparum
IIYIIVYSIYININKGCLC

SEQ ID NO: 3287010 - protein, 20 aa, Plasmodium falciparum
IIYKLFLIIKNHLVEFINVG

SEQ ID NO: 3287011 - protein, 24 aa, Plasmodium falciparum
IIYKRNLFLNIFLRNILSSSYLLS

SEQ ID NO: 3287012 - protein, 17 aa, Plasmodium falciparum
IIYLRHKNKNRLNVKIN

SEQ ID NO: 3287013 - protein, 17 aa, Plasmodium falciparum
IIYLVHVMKPTLYEIYM

SEQ ID NO: 3287014 - protein, 33 aa, Plasmodium falciparum
IIYMITIFTIIIILLIMCIIPLYFQDIANMKYL

SEQ ID NO: 3287015 - protein, 19 aa, Plasmodium falciparum
IIYNYDYLYWIELLNDENE

SEQ ID NO: 3287016 - protein, 32 aa, Plasmodium falciparum
IIYQLNLLIKAYIPKLFYYFKRKKIKIDFFCV

SEQ ID NO: 3287017 - protein, 25 aa, Plasmodium falciparum
IIYSFIYSFIMTIMKYIKKGQPEDH

SEQ ID NO: 3287018 - protein, 18 aa, Plasmodium falciparum
IIYVCLIGHLTKVYIKEN

SEQ ID NO: 3287019 - protein, 19 aa, Plasmodium falciparum
IIYYVVISIFHIYNKIISK

SEQ ID NO: 3287020 - protein, 18 aa, Plasmodium falciparum
IIYYYVHSLLRRSSGIGK

SEQ ID NO: 3287021 - protein, 38 aa, Plasmodium falciparum
IKALHVLIHIFFIKKNKNWIPLFDYSIYLEHVLLSLDN

SEQ ID NO: 3287022 - protein, 18 aa, Plasmodium falciparum
IKALLYNYIFHNDEIIVE

SEQ ID NO: 3287023 - protein, 20 aa, Plasmodium falciparum
IKCAAAETYLLWQKYKEDNN

SEQ ID NO: 3287024 - protein, 18 aa, Plasmodium falciparum
IKCAAVETFFAWHEFTKE

SEQ ID NO: 3287025 - protein, 25 aa, Plasmodium falciparum
IKCEKTFEFILKNKNKKKIKNCIKS

SEQ ID NO: 3287026 - protein, 28 aa, Plasmodium falciparum
IKCLEHLYNYLYFVYLKKKEEKKNKKKK

SEQ ID NO: 3287027 - protein, 19 aa, Plasmodium falciparum
IKCSDIFDSFLNLKLIMET

SEQ ID NO: 3287028 - protein, 23 aa, Plasmodium falciparum
IKDEEFILYLLINKKHVIQYLDS

SEQ ID NO: 3287029 - protein, 19 aa, Plasmodium falciparum
IKDEFIIEGGRFIRTSIND

SEQ ID NO: 3287030 - protein, 22 aa, Plasmodium falciparum
IKDIMKLYIMNINKNKNKNILG

SEQ ID NO: 3287031 - protein, 27 aa, Plasmodium falciparum
IKDIQRKRLIIYFKQDNTILSSRNYKH

SEQ ID NO: 3287032 - protein, 30 aa, Plasmodium falciparum
IKDIYIDKVLLLDFYTLLIKRKYYIHNLRN

SEQ ID NO: 3287033 - protein, 22 aa, Plasmodium falciparum
IKDKLLLPKNKIYQSFIKYDVD

SEQ ID NO: 3287034 - protein, 19 aa, Plasmodium falciparum
IKDLKLEIHILLKDKEITN

SEQ ID NO: 3287035 - protein, 22 aa, Plasmodium falciparum
IKDLKYYALVESLAYILYQCTD

SEQ ID NO: 3287036 - protein, 24 aa, Plasmodium falciparum
IKDLSLLLLSYSRLYIKYDSFINR

SEQ ID NO: 3287037 - protein, 24 aa, Plasmodium falciparum
IKDSRVLFTLDTWQYNILNLVDRR

SEQ ID NO: 3287038 - protein, 20 aa, Plasmodium falciparum
IKDYIQLKYLIYDDEERTKK

SEQ ID NO: 3287039 - protein, 36 aa, Plasmodium falciparum
IKEFKDMFFLKLFFFTLYLFFISYNSANILWNVIKI

SEQ ID NO: 3287040 - protein, 20 aa, Plasmodium falciparum
IKEIVAIFIFDDLNITKARE

SEQ ID NO: 3287041 - protein, 33 aa, Plasmodium falciparum
IKEKAIDHYTSHDWFRLLRQGNKAQNSISQEVD

SEQ ID NO: 3287042 - protein, 40 aa, Plasmodium falciparum
IKENNNLVPNLFTFKYLVSYYSNDPNFLQKKKYLESKHGE

SEQ ID NO: 3287043 - protein, 25 aa, Plasmodium falciparum
IKEQIKYFLQIFHILQENITTFENQ

SEQ ID NO: 3287044 - protein, 26 aa, Plasmodium falciparum
IKEQYIIYNFIIKIILNYLYNGNNQY

SEQ ID NO: 3287045 - protein, 30 aa, Plasmodium falciparum
IKEYRILIIACRLIWRKLKKNTLQSLEHII

SEQ ID NO: 3287046 - protein, 17 aa, Plasmodium falciparum
IKFLLNILILCFKKDKS

SEQ ID NO: 3287047 - protein, 23 aa, Plasmodium falciparum
IKFLRIIYICDLSKYYDFSFKKI

SEQ ID NO: 3287048 - protein, 30 aa, Plasmodium falciparum
IKFSHIFNDKFVPLFPLKDIFKNYVFLMNK

SEQ ID NO: 3287049 - protein, 29 aa, Plasmodium falciparum
IKFTGKYMPIYQLLYLDFFECISLNEKVD

SEQ ID NO: 3287050 - protein, 33 aa, Plasmodium falciparum
IKFVFILSLCRLYLPIYIYLYPHNIFQLDNFSQ

SEQ ID NO: 3287051 - protein, 34 aa, Plasmodium falciparum
IKFVNVLANYLLRYVPFTLPFDDRLLIFYHFRNK

SEQ ID NO: 3287052 - protein, 24 aa, Plasmodium falciparum
IKGDPYFAEYATKLSFILNSSDAN

SEQ ID NO: 3287053 - protein, 26 aa, Plasmodium falciparum
IKGHYLLFFIIICTLVVLIVELWKKI

SEQ ID NO: 3287054 - protein, 22 aa, Plasmodium falciparum
IKGIRYTFVIIGIKVFISSIIT

SEQ ID NO: 3287055 - protein, 37 aa, Plasmodium falciparum
IKGKNINIFPLLKFTVFTLLIWIVTFINNYGNYMNDG

SEQ ID NO: 3287056 - protein, 35 aa, Plasmodium falciparum
IKGVKIKVIASILLLFYKLLHSFGPHIICVKTINK

SEQ ID NO: 3287057 - protein, 27 aa, Plasmodium falciparum
IKGYEFIYINLLLLLEYCIELLLCSWD

SEQ ID NO: 3287058 - protein, 21 aa, Plasmodium falciparum
IKGYGICQYILTFNIHLQRKG

SEQ ID NO: 3287059 - protein, 17 aa, Plasmodium falciparum
IKGYLLLHNKNFYVSPK

SEQ ID NO: 3287060 - protein, 18 aa, Plasmodium falciparum
IKHDIYYLNKKFYKVKNI

SEQ ID NO: 3287061 - protein, 46 aa, Plasmodium falciparum
IKHLIYLEHKFLKLITKIKYMKYLSDNFIFFLFKAPSTSKLEQKLD

SEQ ID NO: 3287062 - protein, 28 aa, Plasmodium falciparum
IKHTNTYLSLLLFIVHIFYYIINHKECS

SEQ ID NO: 3287063 - protein, 35 aa, Plasmodium falciparum
IKIANIWWNVLFFSIFGAFFFNLFISFLVNKKRKV

SEQ ID NO: 3287064 - protein, 26 aa, Plasmodium falciparum
IKICKDIYILYLYKIGLLLNISIYET

SEQ ID NO: 3287065 - protein, 25 aa, Plasmodium falciparum
IKIDNDFIFNDIKLSYIKNKIHSNI

SEQ ID NO: 3287066 - protein, 23 aa, Plasmodium falciparum
IKIDTFTVIAKLLGYICIHIHIN

SEQ ID NO: 3287067 - protein, 20 aa, Plasmodium falciparum
IKIFINEYISFNLKSAYSRN

SEQ ID NO: 3287068 - protein, 21 aa, Plasmodium falciparum
IKIFISLMYMSLYEINSMNLG

SEQ ID NO: 3287069 - protein, 34 aa, Plasmodium falciparum
IKIIRSHIYLSYFNIFLDYFRNNNLKCMYFICNN

SEQ ID NO: 3287070 - protein, 25 aa, Plasmodium falciparum
IKIISIKIIIDIFTFINSYYDTHDN

SEQ ID NO: 3287071 - protein, 25 aa, Plasmodium falciparum
IKIKILFFFFIIFDFIKQFVDMHLT

SEQ ID NO: 3287072 - protein, 27 aa, Plasmodium falciparum
IKILKKNIYFLLSYKSIIMKNVMKMLV

SEQ ID NO: 3287073 - protein, 20 aa, Plasmodium falciparum
IKILLSKLKEKIELCKKNDV

SEQ ID NO: 3287074 - protein, 24 aa, Plasmodium falciparum
IKIMKNFIIIADLFKGIFINMYNY

SEQ ID NO: 3287075 - protein, 43 aa, Plasmodium falciparum
IKIRKKKIYLYIIYLYYYIINHLRFFLYNQDIIKYIHTYIIKT

SEQ ID NO: 3287076 - protein, 17 aa, Plasmodium falciparum
IKISKHYFFLQKKIYNI

SEQ ID NO: 3287077 - protein, 20 aa, Plasmodium falciparum
IKIVNYYEFFRNILSMENSM

SEQ ID NO: 3287078 - protein, 29 aa, Plasmodium falciparum
IKKCIHPIFLINLLKWYSIITNSSLSYGL

SEQ ID NO: 3287079 - protein, 24 aa, Plasmodium falciparum
IKKDFLYPCSILLIVVFIYLCIVS

SEQ ID NO: 3287080 - protein, 22 aa, Plasmodium falciparum
IKKEFFNIWFLFVMKRKKERNT

SEQ ID NO: 3287081 - protein, 31 aa, Plasmodium falciparum
IKKEFILLFSIYLYDISFLRYYFRHKNINIE

SEQ ID NO: 3287082 - protein, 40 aa, Plasmodium falciparum
IKKENNMFFIYQTINFYYLYKSFFLYILPTQHKDGNITNE

SEQ ID NO: 3287083 - protein, 25 aa, Plasmodium falciparum
IKKHINVFLPPLFLSFFDYSKNVKQ

SEQ ID NO: 3287084 - protein, 29 aa, Plasmodium falciparum
IKKIKEIYFLLCLVWIFHNIKREGVSKIF

SEQ ID NO: 3287085 - protein, 27 aa, Plasmodium falciparum
IKKKKKMYLIFLILVKNSFTCIYYKNI

SEQ ID NO: 3287086 - protein, 23 aa, Plasmodium falciparum
IKKKNIFIYYFKDNYVNANMFNY

SEQ ID NO: 3287087 - protein, 24 aa, Plasmodium falciparum
IKKKNIFVELYFNINYPFSYMHLM

SEQ ID NO: 3287088 - protein, 23 aa, Plasmodium falciparum
IKKNFILHPLINSKYIGFKINCN

SEQ ID NO: 3287089 - protein, 26 aa, Plasmodium falciparum
IKKNFKFYFFYFYYNIFKNKQTSNRY

SEQ ID NO: 3287090 - protein, 23 aa, Plasmodium falciparum
IKKNILQDLFYKLENYDNEDFLC

SEQ ID NO: 3287091 - protein, 28 aa, Plasmodium falciparum
IKKNMVRKFFFKYINLEKECIIYIKYVF

SEQ ID NO: 3287092 - protein, 26 aa, Plasmodium falciparum
IKKNNKNIRYFYIKNLKLIEKNFNIN

SEQ ID NO: 3287093 - protein, 25 aa, Plasmodium falciparum
IKKNNYIINKYLCAYALIAAGKLDY

SEQ ID NO: 3287094 - protein, 21 aa, Plasmodium falciparum
IKKRILNILQLYQSKETKNNK

SEQ ID NO: 3287095 - protein, 25 aa, Plasmodium falciparum
IKKTINYCFFLLLDNLYHIRDYSKI

SEQ ID NO: 3287096 - protein, 30 aa, Plasmodium falciparum
IKKTNYLSTLLNIILKLLKSESALPVVVST

SEQ ID NO: 3287097 - protein, 28 aa, Plasmodium falciparum
IKKYFKDIFRQWGNTALFLSGGAILGLH

SEQ ID NO: 3287098 - protein, 23 aa, Plasmodium falciparum
IKKYFLKVKLFLYSFVTTTMEDQ

SEQ ID NO: 3287099 - protein, 21 aa, Plasmodium falciparum
IKKYHLFLNQVTCNKIIETQN

SEQ ID NO: 3287100 - protein, 29 aa, Plasmodium falciparum
IKKYNINLTIFIPLFLDNIDFLFMFIVKF

SEQ ID NO: 3287101 - protein, 35 aa, Plasmodium falciparum
IKLEQFIYIIQQQPVYLIILCLIHNYKNVKNVKQL

SEQ ID NO: 3287102 - protein, 28 aa, Plasmodium falciparum
IKLIKQNIFCLLSKLIKHILNSEINIYT

SEQ ID NO: 3287103 - protein, 23 aa, Plasmodium falciparum
IKLKHNFNLLIMKKKNILINQCE

SEQ ID NO: 3287104 - protein, 19 aa, Plasmodium falciparum
IKLLFLHFLNLLPIKCFIK

SEQ ID NO: 3287105 - protein, 17 aa, Plasmodium falciparum
IKLLKKQIYIDNLFFIL

SEQ ID NO: 3287106 - protein, 25 aa, Plasmodium falciparum
IKLNIHHFMFFPVIREENKTVYCEE

SEQ ID NO: 3287107 - protein, 32 aa, Plasmodium falciparum
IKLRHSLEQKWLKHLQNILSLKIDSLLNKNDE

SEQ ID NO: 3287108 - protein, 18 aa, Plasmodium falciparum
IKLSKFDNPCGCSFEANS

SEQ ID NO: 3287109 - protein, 25 aa, Plasmodium falciparum
IKLVDDNIFFILKTDIRFLNLFLYV

SEQ ID NO: 3287110 - protein, 19 aa, Plasmodium falciparum
IKMILFDDYTRELWKRSLA

SEQ ID NO: 3287111 - protein, 20 aa, Plasmodium falciparum
IKMKIIKNIPLIINTLKDEH

SEQ ID NO: 3287112 - protein, 24 aa, Plasmodium falciparum
IKMLHLDLLKILYNLQYHNGIFNG

SEQ ID NO: 3287113 - protein, 28 aa, Plasmodium falciparum
IKNAFLCIKLFNIIWIKIKTWYKKIDKK

SEQ ID NO: 3287114 - protein, 43 aa, Plasmodium falciparum
IKNELLFIGEVVFKFIYYYGLFKDKNKLFYFLQNHYHTTNLLN

SEQ ID NO: 3287115 - protein, 25 aa, Plasmodium falciparum
IKNFTLLDFIFQIKNYFNYYKILLS

SEQ ID NO: 3287116 - protein, 27 aa, Plasmodium falciparum
IKNIIYNDIFYYFPCKCLTNILNNYSN

SEQ ID NO: 3287117 - protein, 18 aa, Plasmodium falciparum
IKNILKKKTLRKSNINKL

SEQ ID NO: 3287118 - protein, 20 aa, Plasmodium falciparum
IKNISLHKLIIDKLGKKMKK

SEQ ID NO: 3287119 - protein, 28 aa, Plasmodium falciparum
IKNITSIYYKINILNILIICIKQTYNNN

SEQ ID NO: 3287120 - protein, 22 aa, Plasmodium falciparum
IKNKEKLIFSGKKKRALAQVFL

SEQ ID NO: 3287121 - protein, 25 aa, Plasmodium falciparum
IKNKENFVIGNYPYTNGVSYITNGE

SEQ ID NO: 3287122 - protein, 24 aa, Plasmodium falciparum
IKNKIYYFNMDLLNIIFNLDSTAL

SEQ ID NO: 3287123 - protein, 24 aa, Plasmodium falciparum
IKNKYLLERQKIIWLKCIKRNKYI

SEQ ID NO: 3287124 - protein, 35 aa, Plasmodium falciparum
IKNKYYLDFFCLYLLLKSYFFIDTIIINKYIVLPN

SEQ ID NO: 3287125 - protein, 36 aa, Plasmodium falciparum
IKNLQFCENSFFFLFKFIYIYMYKIIKNVNIYNSSE

SEQ ID NO: 3287126 - protein, 25 aa, Plasmodium falciparum
IKNNSKFLNIFHKDTYPYSSFTVQE

SEQ ID NO: 3287127 - protein, 25 aa, Plasmodium falciparum
IKNNYKIMCFQPTKISYKDFLKSKL

SEQ ID NO: 3287128 - protein, 22 aa, Plasmodium falciparum
IKNQLLPSCLLFDSIRALTNMK

SEQ ID NO: 3287129 - protein, 24 aa, Plasmodium falciparum
IKNSLYSIIFKGSNFWKGLGIYLC

SEQ ID NO: 3287130 - protein, 25 aa, Plasmodium falciparum
IKNSYKIILLLLKCLNIICISLCNY

SEQ ID NO: 3287131 - protein, 33 aa, Plasmodium falciparum
IKNTYIYYNTFFKYVKYFITKIKNYNVIYEPYI

SEQ ID NO: 3287132 - protein, 20 aa, Plasmodium falciparum
IKNYEIGISILKRNYKHSLS

SEQ ID NO: 3287133 - protein, 20 aa, Plasmodium falciparum
IKNYFLYNKYFYINDLFQLK

SEQ ID NO: 3287134 - protein, 43 aa, Plasmodium falciparum
IKNYITSFLEGFQNLIDFLFNKYKIIFLQTTTEIPIDGTIYDT

SEQ ID NO: 3287135 - protein, 30 aa, Plasmodium falciparum
IKNYKNLLGIIFYLCGYILLQHLNYNIQEQ

SEQ ID NO: 3287136 - protein, 27 aa, Plasmodium falciparum
IKQDLINLLHFMYLYKSIKNKNCKNNV

SEQ ID NO: 3287137 - protein, 17 aa, Plasmodium falciparum
IKQKIKTGFLYPPFKEE

SEQ ID NO: 3287138 - protein, 25 aa, Plasmodium falciparum
IKQNKYYHNYPFGLYKVNINDVIRI

SEQ ID NO: 3287139 - protein, 18 aa, Plasmodium falciparum
IKQNLCFYIFISALHLFF

SEQ ID NO: 3287140 - protein, 23 aa, Plasmodium falciparum
IKQNYWYYDNLLQIYEHKYLKNI

SEQ ID NO: 3287141 - protein, 17 aa, Plasmodium falciparum
IKQYLIHFIYKFFYCHH

SEQ ID NO: 3287142 - protein, 17 aa, Plasmodium falciparum
IKRALLVVSFVIFIIIF

SEQ ID NO: 3287143 - protein, 31 aa, Plasmodium falciparum
IKRFFPFEPYKIQLNFMRLFYQVLTSSNIKK

SEQ ID NO: 3287144 - protein, 18 aa, Plasmodium falciparum
IKRFKKYMKKLIKTKYDD

SEQ ID NO: 3287145 - protein, 17 aa, Plasmodium falciparum
IKRFYKNIYTCYKLMCK

SEQ ID NO: 3287146 - protein, 55 aa, Plasmodium falciparum
IKRIYKSFYTLFRFLFTLFLLIYMVKYTIVIFPFIMLIIYFFVFNKYSKGCKEAQ

SEQ ID NO: 3287147 - protein, 35 aa, Plasmodium falciparum
IKRKSTVKIIQMILWMIIIVLHLMNMKKLKVISEE

SEQ ID NO: 3287148 - protein, 20 aa, Plasmodium falciparum
IKRLIFFKNMNINSFCISIS

SEQ ID NO: 3287149 - protein, 21 aa, Plasmodium falciparum
IKRLLRSGFSRIPVINRNKAE

SEQ ID NO: 3287150 - protein, 31 aa, Plasmodium falciparum
IKSFFMNFDINVLIYILSVCYKYCRIIKGGI

SEQ ID NO: 3287151 - protein, 17 aa, Plasmodium falciparum
IKSIIIDTKICISTCLL

SEQ ID NO: 3287152 - protein, 17 aa, Plasmodium falciparum
IKSKYLEKILLQEGYYK

SEQ ID NO: 3287153 - protein, 25 aa, Plasmodium falciparum
IKSLLPISYFRIYYKDNYKIYSPNA

SEQ ID NO: 3287154 - protein, 25 aa, Plasmodium falciparum
IKSPLYIFILVEFFLITFSVCYFMF

SEQ ID NO: 3287155 - protein, 35 aa, Plasmodium falciparum
IKSSILYFNFHFNPILLFPIIYKGASIYVCLHNVK

SEQ ID NO: 3287156 - protein, 26 aa, Plasmodium falciparum
IKSSSLILIYFLSIRFGLKEFKLSLL

SEQ ID NO: 3287157 - protein, 32 aa, Plasmodium falciparum
IKSVNFLPILFFKFISLFKYFFKYEYVYKNYD

SEQ ID NO: 3287158 - protein, 27 aa, Plasmodium falciparum
IKTDKMEVIFLLNKYFKKLNKYKKRAR

SEQ ID NO: 3287159 - protein, 35 aa, Plasmodium falciparum
IKTFDNFLYMKYNLLLIWYIKYGKDVFFSMLENDI

SEQ ID NO: 3287160 - protein, 23 aa, Plasmodium falciparum
IKTFNSEPYWKRLEKKDIEEFKH

SEQ ID NO: 3287161 - protein, 28 aa, Plasmodium falciparum
IKTNMLYYFVLYILKYIKYKIKKRMDFN

SEQ ID NO: 3287162 - protein, 34 aa, Plasmodium falciparum
IKTVFLISLTLYSLYFLLFSLYMLSTILNDEYGD

SEQ ID NO: 3287163 - protein, 30 aa, Plasmodium falciparum
IKTYNRLGIALYKLINLLPNEKRNKLEDYL

SEQ ID NO: 3287164 - protein, 27 aa, Plasmodium falciparum
IKVFDNIIPLIFKKYDIKYIYGLYGIP

SEQ ID NO: 3287165 - protein, 26 aa, Plasmodium falciparum
IKVIKEIVLSVLFIIRIYPNVINNVG

SEQ ID NO: 3287166 - protein, 28 aa, Plasmodium falciparum
IKYAVFHSCLLLLSGIQIYFICPSKKKD

SEQ ID NO: 3287167 - protein, 22 aa, Plasmodium falciparum
IKYEQYFIIMKKLGLLDGDINK

SEQ ID NO: 3287168 - protein, 26 aa, Plasmodium falciparum
IKYESMLFMFLFFLSIQLEIIRLITY

SEQ ID NO: 3287169 - protein, 31 aa, Plasmodium falciparum
IKYICNSSLFINPFPYICFLKILNKPLSMNE

SEQ ID NO: 3287170 - protein, 24 aa, Plasmodium falciparum
IKYIDMLLIYKYYFKKVNNKDENN

SEQ ID NO: 3287171 - protein, 21 aa, Plasmodium falciparum
IKYINFFINLKKSFILVKCTT

SEQ ID NO: 3287172 - protein, 22 aa, Plasmodium falciparum
IKYKKLEFLLNQINLEIKNWVL

SEQ ID NO: 3287173 - protein, 25 aa, Plasmodium falciparum
IKYNTVVIVVPWGYEFHSLYASPEG

SEQ ID NO: 3287174 - protein, 17 aa, Plasmodium falciparum
IKYPPLFKEHILNILLS

SEQ ID NO: 3287175 - protein, 19 aa, Plasmodium falciparum
IKYQLNYGSMFFPFNIIFK

SEQ ID NO: 3287176 - protein, 17 aa, Plasmodium falciparum
IKYSIIWSFTNDEKIVV

SEQ ID NO: 3287177 - protein, 27 aa, Plasmodium falciparum
IKYSNPFKSLFLYRIINYFTMVDLYKV

SEQ ID NO: 3287178 - protein, 19 aa, Plasmodium falciparum
IKYSTFVDHKIVPSVSSFS

SEQ ID NO: 3287179 - protein, 17 aa, Plasmodium falciparum
IKYTILYSSPFYYIPEE

SEQ ID NO: 3287180 - protein, 25 aa, Plasmodium falciparum
IKYTPFFITFLFNYFFIINTIIKFY

SEQ ID NO: 3287181 - protein, 24 aa, Plasmodium falciparum
IKYVSLYLYILSNINFNISYYKFI

SEQ ID NO: 3287182 - protein, 34 aa, Plasmodium falciparum
IKYYQHNFNIPPLRLLFLYDVPYKFNKDIKKNMV

SEQ ID NO: 3287183 - protein, 20 aa, Plasmodium falciparum
ILACIIFCDPSIHTIEGLGS

SEQ ID NO: 3287184 - protein, 19 aa, Plasmodium falciparum
ILANIYDLFLMKIKILVEK

SEQ ID NO: 3287185 - protein, 25 aa, Plasmodium falciparum
ILAVALIILYIWLYKRRKNSWKHEC

SEQ ID NO: 3287186 - protein, 25 aa, Plasmodium falciparum
ILAVVLIILYIWLYRRRKNSWKHEC

SEQ ID NO: 3287187 - protein, 42 aa, Plasmodium falciparum
ILCADKCNIYLLKFKFTKITRNLFTTKFLPLSIQKIPKEEYE

SEQ ID NO: 3287188 - protein, 20 aa, Plasmodium falciparum
ILCIIVSSYFLLFFSITELS

SEQ ID NO: 3287189 - protein, 22 aa, Plasmodium falciparum
ILCKLRNKVSFMYNINFALDEF

SEQ ID NO: 3287190 - protein, 26 aa, Plasmodium falciparum
ILCNLNQIIIFLYKNNFIEMNPKNNG

SEQ ID NO: 3287191 - protein, 29 aa, Plasmodium falciparum
ILCNMKILLFENFYLLKNTIKIYNSIYSI

SEQ ID NO: 3287192 - protein, 19 aa, Plasmodium falciparum
ILCSINLKIIIYKYNILEN

SEQ ID NO: 3287193 - protein, 20 aa, Plasmodium falciparum
ILCYDLKWCFNMLKVNSGTT

SEQ ID NO: 3287194 - protein, 19 aa, Plasmodium falciparum
ILDEFFFDIYNDYNMFVDC

SEQ ID NO: 3287195 - protein, 18 aa, Plasmodium falciparum
ILDFKRFRGFKRRKKKTK

SEQ ID NO: 3287196 - protein, 31 aa, Plasmodium falciparum
ILDIFKELYLFFYLYLYKFACNINDFVGYLY

SEQ ID NO: 3287197 - protein, 17 aa, Plasmodium falciparum
ILDILSNINIKKLIFGK

SEQ ID NO: 3287198 - protein, 34 aa, Plasmodium falciparum
ILDKALTRPGRLDKLIYISLPDLKSRYSIFKAIL

SEQ ID NO: 3287199 - protein, 25 aa, Plasmodium falciparum
ILDKDLFFYISYYLYIHNNNINKIH

SEQ ID NO: 3287200 - protein, 23 aa, Plasmodium falciparum
ILDKYLFKILNTEYKIYLNAKLK

SEQ ID NO: 3287201 - protein, 18 aa, Plasmodium falciparum
ILDNICICIWDMCSILTN

SEQ ID NO: 3287202 - protein, 24 aa, Plasmodium falciparum
ILDNNLFKGLFIKDDIKLSKRTIQ

SEQ ID NO: 3287203 - protein, 17 aa, Plasmodium falciparum
ILDSIILGLDGLILDTF

SEQ ID NO: 3287204 - protein, 26 aa, Plasmodium falciparum
ILDTLNYYFFLYRTNHYKKLIGDNNI

SEQ ID NO: 3287205 - protein, 34 aa, Plasmodium falciparum
ILDVNNLLHFFKLTKLFFHFNLHSNIQTLWNSIF

SEQ ID NO: 3287206 - protein, 24 aa, Plasmodium falciparum
ILDYNEIDWALESLGAKIVYKMTS

SEQ ID NO: 3287207 - protein, 21 aa, Plasmodium falciparum
ILECIFYMPVKIGIYATILGI

SEQ ID NO: 3287208 - protein, 24 aa, Plasmodium falciparum
ILEDTKMYILLNRSIFKMMNRKKM

SEQ ID NO: 3287209 - protein, 26 aa, Plasmodium falciparum
ILEKLKDTFFLPVYKNKTLNIDNQVN

SEQ ID NO: 3287210 - protein, 23 aa, Plasmodium falciparum
ILEKYYMHILKLNMSKLYIVYKK

SEQ ID NO: 3287211 - protein, 18 aa, Plasmodium falciparum
ILENLYFCKDIRLFKKEY

SEQ ID NO: 3287212 - protein, 19 aa, Plasmodium falciparum
ILESIKRIRAILSPSILND

SEQ ID NO: 3287213 - protein, 23 aa, Plasmodium falciparum
ILEYLFYCFFRNDEYFMASLFEL

SEQ ID NO: 3287214 - protein, 26 aa, Plasmodium falciparum
ILEYRSIIILLYSSLLFYVHDFFVID

SEQ ID NO: 3287215 - protein, 19 aa, Plasmodium falciparum
ILFDYKNFQGFFYEESHNF

SEQ ID NO: 3287216 - protein, 24 aa, Plasmodium falciparum
ILFEKYCIGILLNSSLISSNKNRN

SEQ ID NO: 3287217 - protein, 24 aa, Plasmodium falciparum
ILFFALIHIKNIIALKLEIFKGRF

SEQ ID NO: 3287218 - protein, 19 aa, Plasmodium falciparum
ILFFLDILHDIMSLIIFLV

SEQ ID NO: 3287219 - protein, 17 aa, Plasmodium falciparum
ILFFVFYKKFNVNCIIQ

SEQ ID NO: 3287220 - protein, 21 aa, Plasmodium falciparum
ILFGCALGMLQLIFIDTTKSE

SEQ ID NO: 3287221 - protein, 17 aa, Plasmodium falciparum
ILFIGATNRYKQLDSAL

SEQ ID NO: 3287222 - protein, 22 aa, Plasmodium falciparum
ILFIIRFIVIRGSKYRYENNSE

SEQ ID NO: 3287223 - protein, 26 aa, Plasmodium falciparum
ILFISINILYFWYSEYLDRIQFLVKR

SEQ ID NO: 3287224 - protein, 30 aa, Plasmodium falciparum
ILFKENMRYILRLMALLDLSPTIRGLNAGS

SEQ ID NO: 3287225 - protein, 19 aa, Plasmodium falciparum
ILFKYGFLNNGFNFQFWYW

SEQ ID NO: 3287226 - protein, 18 aa, Plasmodium falciparum
ILFLDDILHFLSDEKKLK

SEQ ID NO: 3287227 - protein, 17 aa, Plasmodium falciparum
ILFLLSNSNIYFIFIEY

SEQ ID NO: 3287228 - protein, 17 aa, Plasmodium falciparum
ILFMKGHDHYSCSLSSA

SEQ ID NO: 3287229 - protein, 17 aa, Plasmodium falciparum
ILFMNRKKKKLIDHLLV

SEQ ID NO: 3287230 - protein, 22 aa, Plasmodium falciparum
ILFNCFINFLLRKSLKIASFDF

SEQ ID NO: 3287231 - protein, 20 aa, Plasmodium falciparum
ILFNFLINTLLLPHYENSQN

SEQ ID NO: 3287232 - protein, 21 aa, Plasmodium falciparum
ILFNILIGYYFFIVINNVVGN

SEQ ID NO: 3287233 - protein, 29 aa, Plasmodium falciparum
ILFQTLLLPLIFVIPILVFYSFLILLFTK

SEQ ID NO: 3287234 - protein, 26 aa, Plasmodium falciparum
ILFSGSFCAIFWFKKQNKLHGLTFSN

SEQ ID NO: 3287235 - protein, 36 aa, Plasmodium falciparum
ILFSIYEIIYIIYNSNEFLIFKYFKNIQNVNCLQEF

SEQ ID NO: 3287236 - protein, 18 aa, Plasmodium falciparum
ILFSLSLNILLLSSRVYN

SEQ ID NO: 3287237 - protein, 31 aa, Plasmodium falciparum
ILFSSLYFFFFFFFFFNMNFVKTYYKNCMDA

SEQ ID NO: 3287238 - protein, 19 aa, Plasmodium falciparum
ILFTFLINTLVLPHYENYL

SEQ ID NO: 3287239 - protein, 42 aa, Plasmodium falciparum
ILFYIYQKFILMKYLKKKSNVYMFYYIPSAEKQNCITYTLNS

SEQ ID NO: 3287240 - protein, 53 aa, Plasmodium falciparum
ILGDECIVWWLHDIDPIFSYHFQYFIWIISLFCFATYVLHKILKTCASRWDRT

SEQ ID NO: 3287241 - protein, 31 aa, Plasmodium falciparum
ILGISEYIYFFFFILFFKSNYDKTNDNNIDT

SEQ ID NO: 3287242 - protein, 21 aa, Plasmodium falciparum
ILGKFSMFKKFPLIKRSNTYN

SEQ ID NO: 3287243 - protein, 32 aa, Plasmodium falciparum
ILGLDGLILDTFYRPWVSLVTQPIISINKGNS

SEQ ID NO: 3287244 - protein, 28 aa, Plasmodium falciparum
ILGLIKTFFYFMFYNKIYLFEIGNIDIW

SEQ ID NO: 3287245 - protein, 36 aa, Plasmodium falciparum
ILGLRLHSGLFISIFKYYLNYFLSPYTLQKDICPLY

SEQ ID NO: 3287246 - protein, 17 aa, Plasmodium falciparum
ILGYFKCKQFYFQNIYD

SEQ ID NO: 3287247 - protein, 18 aa, Plasmodium falciparum
ILHKLLEINKLILREEKD

SEQ ID NO: 3287248 - protein, 18 aa, Plasmodium falciparum
ILHLIFSNIKYVPFNSIK

SEQ ID NO: 3287249 - protein, 19 aa, Plasmodium falciparum
ILHPVILYNVNRLLLDFFY

SEQ ID NO: 3287250 - protein, 18 aa, Plasmodium falciparum
ILHQCYLFHINMIQNNDT

SEQ ID NO: 3287251 - protein, 27 aa, Plasmodium falciparum
ILHYKDHIKLFYPSNFYMFVNEEDNIN

SEQ ID NO: 3287252 - protein, 27 aa, Plasmodium falciparum
ILIAKAFIPFNLLLKKNKTKISVPLFF

SEQ ID NO: 3287253 - protein, 20 aa, Plasmodium falciparum
ILIEPQKLLAAIQNFKNHKK

SEQ ID NO: 3287254 - protein, 17 aa, Plasmodium falciparum
ILIFTIFSVVNIVVLLI

SEQ ID NO: 3287255 - protein, 19 aa, Plasmodium falciparum
ILIFYVLIYHIKKDIISYK

SEQ ID NO: 3287256 - protein, 26 aa, Plasmodium falciparum
ILIGEYFIYLIIYFRNIKIKKNPLKV

SEQ ID NO: 3287257 - protein, 17 aa, Plasmodium falciparum
ILIKKLNFCLCSGDKIN

SEQ ID NO: 3287258 - protein, 25 aa, Plasmodium falciparum
ILIKKLYLTIINFLIPLGYKNKIQS

SEQ ID NO: 3287259 - protein, 30 aa, Plasmodium falciparum
ILIKSEYYKILSLFYLAIKNITELYNKYII

SEQ ID NO: 3287260 - protein, 18 aa, Plasmodium falciparum
ILINIFCYELFYSPNKKL

SEQ ID NO: 3287261 - protein, 24 aa, Plasmodium falciparum
ILISKIFHYFYELNYGYKYMIHFL

SEQ ID NO: 3287262 - protein, 31 aa, Plasmodium falciparum
ILITCFGCFLFVFFPSLLFICFAYLSNEYIR

SEQ ID NO: 3287263 - protein, 24 aa, Plasmodium falciparum
ILKDKYRRYLLEKMNIECTTLYNI

SEQ ID NO: 3287264 - protein, 22 aa, Plasmodium falciparum
ILKDNILLNKIQKIDVLLVLFI

SEQ ID NO: 3287265 - protein, 38 aa, Plasmodium falciparum
ILKEISLINTFYYLKLNKFFCFLICDFMERFSLYDIFY

SEQ ID NO: 3287266 - protein, 29 aa, Plasmodium falciparum
ILKENYNVPLVPYGLLAGGILTGKYLDPE

SEQ ID NO: 3287267 - protein, 18 aa, Plasmodium falciparum
ILKERCMVYQYNGDKGKD

SEQ ID NO: 3287268 - protein, 28 aa, Plasmodium falciparum
ILKFFSKNKFYITLFTTIVLCAQSIKIK

SEQ ID NO: 3287269 - protein, 27 aa, Plasmodium falciparum
ILKFSYVWYIFFFLLGVSADLSFIPLL

SEQ ID NO: 3287270 - protein, 18 aa, Plasmodium falciparum
ILKFVVELFIIFRIMYKK

SEQ ID NO: 3287271 - protein, 24 aa, Plasmodium falciparum
ILKISYALLYILINKNINTSNCGN

SEQ ID NO: 3287272 - protein, 24 aa, Plasmodium falciparum
ILKIYFLYIFFLAPIFGSLKCLEE

SEQ ID NO: 3287273 - protein, 33 aa, Plasmodium falciparum
ILKKIKKIYFYNYISIFFYLLKNIDISSEHTSY

SEQ ID NO: 3287274 - protein, 37 aa, Plasmodium falciparum
ILKKKYYLKFSYLFSIYFSLHMKFFLQYKLGEQQNRK

SEQ ID NO: 3287275 - protein, 25 aa, Plasmodium falciparum
ILKKNTLPILLSLRTIMFKTKSFFF

SEQ ID NO: 3287276 - protein, 25 aa, Plasmodium falciparum
ILKKRQLQISLIKWVIKAVDENTLK

SEQ ID NO: 3287277 - protein, 23 aa, Plasmodium falciparum
ILKKYLNTFLTLYIKRQSEDVNN

SEQ ID NO: 3287278 - protein, 23 aa, Plasmodium falciparum
ILKNKLYLLYFNKNLRDDIYVAY

SEQ ID NO: 3287279 - protein, 19 aa, Plasmodium falciparum
ILKNLLFIDISFNNPIDCI

SEQ ID NO: 3287280 - protein, 25 aa, Plasmodium falciparum
ILKNYYNLIMDSNLIFLCIKHTEIR

SEQ ID NO: 3287281 - protein, 24 aa, Plasmodium falciparum
ILKRDLFVIDYLQNYFNFSVIRKM

SEQ ID NO: 3287282 - protein, 25 aa, Plasmodium falciparum
ILKRERIFFFCFLYSLLESVTDVIS

SEQ ID NO: 3287283 - protein, 31 aa, Plasmodium falciparum
ILKRKNMWMYLFRKYYMSYIYYGDYIIKDTI

SEQ ID NO: 3287284 - protein, 19 aa, Plasmodium falciparum
ILKSFIIELLTVILYDIET

SEQ ID NO: 3287285 - protein, 21 aa, Plasmodium falciparum
ILKTNIILDGIFFQINPDAIS

SEQ ID NO: 3287286 - protein, 25 aa, Plasmodium falciparum
ILLDMLKLILCRYYILYLNDPEKIQ

SEQ ID NO: 3287287 - protein, 33 aa, Plasmodium falciparum
ILLENKIINLFSCKFYLILLKEVNKKFFLHIYI

SEQ ID NO: 3287288 - protein, 30 aa, Plasmodium falciparum
ILLFKNLYFFNIHLISLFFYILDCFFQKLK

SEQ ID NO: 3287289 - protein, 17 aa, Plasmodium falciparum
ILLFNKRGIFINSNRGE

SEQ ID NO: 3287290 - protein, 33 aa, Plasmodium falciparum
ILLFYNIMEHIYKFILYFVIKKLHISFMFYESP

SEQ ID NO: 3287291 - protein, 23 aa, Plasmodium falciparum
ILLHSIFSFFAFKNDMQFWYKNE

SEQ ID NO: 3287292 - protein, 18 aa, Plasmodium falciparum
ILLILCNEKMIHNIYKCA

SEQ ID NO: 3287293 - protein, 26 aa, Plasmodium falciparum
ILLKIDSFCCIFNSFKLQWKDNSHEE

SEQ ID NO: 3287294 - protein, 32 aa, Plasmodium falciparum
ILLKSEKIKFCKFLLFILYGLLCFSINLYVNQ

SEQ ID NO: 3287295 - protein, 25 aa, Plasmodium falciparum
ILLLSFFFFDYNFCSRGLVFYIGNK

SEQ ID NO: 3287296 - protein, 17 aa, Plasmodium falciparum
ILLLTICIIILSLKPDS

SEQ ID NO: 3287297 - protein, 40 aa, Plasmodium falciparum
ILLLYFVLIPLESNFFFFFFSFFFIYINNVSIARICSSNY

SEQ ID NO: 3287298 - protein, 46 aa, Plasmodium falciparum
ILLNNMYVIKKFLLLYKSYKIIKIWNKLYFLCFTNFCFNINRKDYF

SEQ ID NO: 3287299 - protein, 26 aa, Plasmodium falciparum
ILLNNPLLYETSPSTLWPFYSNRKME

SEQ ID NO: 3287300 - protein, 30 aa, Plasmodium falciparum
ILLSQYFLFIIFLLYVYISYINIPLLHIIK

SEQ ID NO: 3287301 - protein, 21 aa, Plasmodium falciparum
ILLTFLYLIYVGVFKYIINKI

SEQ ID NO: 3287302 - protein, 20 aa, Plasmodium falciparum
ILMGFSINLNFYKNKYLSST

SEQ ID NO: 3287303 - protein, 17 aa, Plasmodium falciparum
ILMLFNLKRNQNIFGNL

SEQ ID NO: 3287304 - protein, 28 aa, Plasmodium falciparum
ILMQTFFSYYVFLYIYTFETICNFNYDT

SEQ ID NO: 3287305 - protein, 29 aa, Plasmodium falciparum
ILMTTNIYMLIFSAIFILLHSIFSFFAFK

SEQ ID NO: 3287306 - protein, 19 aa, Plasmodium falciparum
ILNDVLIFNMKKTLENKKD

SEQ ID NO: 3287307 - protein, 26 aa, Plasmodium falciparum
ILNEYKNIFIFFAASGFDVLCVNYIG

SEQ ID NO: 3287308 - protein, 23 aa, Plasmodium falciparum
ILNFFMLSLTSSLGNGFLHSSIT

SEQ ID NO: 3287309 - protein, 30 aa, Plasmodium falciparum
ILNFINFSIEYMLIYCIIICDYYKNKSIIK

SEQ ID NO: 3287310 - protein, 26 aa, Plasmodium falciparum
ILNFSLSFYRQWIRFIKIKNEDFFKE

SEQ ID NO: 3287311 - protein, 19 aa, Plasmodium falciparum
ILNINNFLYNKIKKVSFIE

SEQ ID NO: 3287312 - protein, 17 aa, Plasmodium falciparum
ILNIYNKKSIVLIGNYG

SEQ ID NO: 3287313 - protein, 29 aa, Plasmodium falciparum
ILNIYSYDYFFYFYNMLISFFSYGNGQEI

SEQ ID NO: 3287314 - protein, 23 aa, Plasmodium falciparum
ILNKIHTYLYFNVSTNHYINNNN

SEQ ID NO: 3287315 - protein, 18 aa, Plasmodium falciparum
ILNKLNALYKMNAVYKMN

SEQ ID NO: 3287316 - protein, 28 aa, Plasmodium falciparum
ILNNFLEKFLNLFNYKNLNLTKIVIAIF

SEQ ID NO: 3287317 - protein, 17 aa, Plasmodium falciparum
ILNPKKLNKLQLYLYNN

SEQ ID NO: 3287318 - protein, 23 aa, Plasmodium falciparum
ILNQINLFHKWLDRHRDMCEKWK

SEQ ID NO: 3287319 - protein, 24 aa, Plasmodium falciparum
ILNQINLFHKWLDRHRNMCEQWDK

SEQ ID NO: 3287320 - protein, 24 aa, Plasmodium falciparum
ILNQLDLFHKWLDRHRNMCEQWNK

SEQ ID NO: 3287321 - protein, 17 aa, Plasmodium falciparum
ILNQRITLSLLINNFPL

SEQ ID NO: 3287322 - protein, 56 aa, Plasmodium falciparum
ILNSIILIFYIFLYFYLHRIILKILNLFGYLLITFVSFSLILFLYSTSYFHISLYD

SEQ ID NO: 3287323 - protein, 17 aa, Plasmodium falciparum
ILNYKYKYKYRFFYIII

SEQ ID NO: 3287324 - protein, 19 aa, Plasmodium falciparum
ILNYLFLNNINCSIITFLK

SEQ ID NO: 3287325 - protein, 21 aa, Plasmodium falciparum
ILNYSIYFNTFYKLKIINNQY

SEQ ID NO: 3287326 - protein, 22 aa, Plasmodium falciparum
ILPNIYVLILLKGLWVHVHVHL

SEQ ID NO: 3287327 - protein, 22 aa, Plasmodium falciparum
ILQIYIHDFIPYVFQILSIIVD

SEQ ID NO: 3287328 - protein, 35 aa, Plasmodium falciparum
ILQKTIPFGIALALGSIAFLFMKKKPKTPVDLLRV

SEQ ID NO: 3287329 - protein, 25 aa, Plasmodium falciparum
ILQMIYPFIIKYFYDKTVFFYVLVA

SEQ ID NO: 3287330 - protein, 18 aa, Plasmodium falciparum
ILQNSWSEWFKRHTYILD

SEQ ID NO: 3287331 - protein, 17 aa, Plasmodium falciparum
ILQVIFYTLFGILGYFS

SEQ ID NO: 3287332 - protein, 24 aa, Plasmodium falciparum
ILREKVIYHFYQIPKNLYMVFINK

SEQ ID NO: 3287333 - protein, 31 aa, Plasmodium falciparum
ILRHTDLLLNFLIYIYYKYFYYNSHAIDHNF

SEQ ID NO: 3287334 - protein, 17 aa, Plasmodium falciparum
ILRIIYLQYNIKKSEDT

SEQ ID NO: 3287335 - protein, 26 aa, Plasmodium falciparum
ILRKSVKFYASWLLKKYIIDMTCVMA

SEQ ID NO: 3287336 - protein, 20 aa, Plasmodium falciparum
ILRNMFINRLNSLNLDLLFL

SEQ ID NO: 3287337 - protein, 27 aa, Plasmodium falciparum
ILSCHHVFILLYYIYKNKTSISELLYE

SEQ ID NO: 3287338 - protein, 17 aa, Plasmodium falciparum
ILSFIYKSYISFKYLNY

SEQ ID NO: 3287339 - protein, 24 aa, Plasmodium falciparum
ILSFSIYLIICSCVMNNKWFLFCR

SEQ ID NO: 3287340 - protein, 18 aa, Plasmodium falciparum
ILSFSLYSSSYATMLIRE

SEQ ID NO: 3287341 - protein, 19 aa, Plasmodium falciparum
ILSFVVLISFKYLEEKYSI

SEQ ID NO: 3287342 - protein, 29 aa, Plasmodium falciparum
ILSGDKLLRYFFISIFKYELNKININNYL

SEQ ID NO: 3287343 - protein, 25 aa, Plasmodium falciparum
ILSGPRKNFFFGSCNTNNIINDLEE

SEQ ID NO: 3287344 - protein, 34 aa, Plasmodium falciparum
ILSIEDIYFLFNRFFYFLLMYIRKFCCFSNKKDT

SEQ ID NO: 3287345 - protein, 31 aa, Plasmodium falciparum
ILSIYICKNVYFISLPILASLLRSFSYLSFN

SEQ ID NO: 3287346 - protein, 18 aa, Plasmodium falciparum
ILSLFFNSLYYINSFQES

SEQ ID NO: 3287347 - protein, 24 aa, Plasmodium falciparum
ILSLLQVLLIILYSNKENTTFNHD

SEQ ID NO: 3287348 - protein, 27 aa, Plasmodium falciparum
ILSNKPFFYYFQDLDFFGCYKFINIDG

SEQ ID NO: 3287349 - protein, 41 aa, Plasmodium falciparum
ILSNPIIISFIVIVIVVIIFLIIYLILRYRRKKKTKKKLQY

SEQ ID NO: 3287350 - protein, 32 aa, Plasmodium falciparum
ILSQLMIVFLIFFFLFIGFYVLINISTPKIYE

SEQ ID NO: 3287351 - protein, 35 aa, Plasmodium falciparum
ILSVYNFHYALFNYYFFFFYKYIKILSKFSAKSVS

SEQ ID NO: 3287352 - protein, 25 aa, Plasmodium falciparum
ILSYSKFFLIIITLSRAINLHLKNK

SEQ ID NO: 3287353 - protein, 19 aa, Plasmodium falciparum
ILTFINSICDHFLFNIFFM

SEQ ID NO: 3287354 - protein, 18 aa, Plasmodium falciparum
ILTKKLFHNNAIQYFIKL

SEQ ID NO: 3287355 - protein, 17 aa, Plasmodium falciparum
ILTLQSFFLTISLAIHS

SEQ ID NO: 3287356 - protein, 19 aa, Plasmodium falciparum
ILTRGFIEMIKKSDNKYMQ

SEQ ID NO: 3287357 - protein, 18 aa, Plasmodium falciparum
ILTRKLELLKNKDITRTK

SEQ ID NO: 3287358 - protein, 26 aa, Plasmodium falciparum
ILTSSFFFVFLFFLHICFKIIMRDFM

SEQ ID NO: 3287359 - protein, 26 aa, Plasmodium falciparum
ILTYQLQAIYFFFKKRGRILIADEMG

SEQ ID NO: 3287360 - protein, 25 aa, Plasmodium falciparum
ILVIILHLWIIKKQKIISLILFIVN

SEQ ID NO: 3287361 - protein, 40 aa, Plasmodium falciparum
ILVISKIIDIFIIKLYGYTILFQIYPQIKITKCSLNLLDA

SEQ ID NO: 3287362 - protein, 20 aa, Plasmodium falciparum
ILVSLPPLTCVILHSSVFLV

SEQ ID NO: 3287363 - protein, 19 aa, Plasmodium falciparum
ILWPYMLISYFTSLLTYQI

SEQ ID NO: 3287364 - protein, 32 aa, Plasmodium falciparum
ILYDVKNIFLFFYGYGIPPCHIKRNPPIYKPH

SEQ ID NO: 3287365 - protein, 31 aa, Plasmodium falciparum
ILYELSLHLYFFIIFVYHLLNFLFTENKEYT

SEQ ID NO: 3287366 - protein, 26 aa, Plasmodium falciparum
ILYIFIIYIIFLLHLNNIILCEGAIW

SEQ ID NO: 3287367 - protein, 18 aa, Plasmodium falciparum
ILYIFTSNQIIPFFNLFH

SEQ ID NO: 3287368 - protein, 25 aa, Plasmodium falciparum
ILYILLVIIFNIKSSASNLIYQKKF

SEQ ID NO: 3287369 - protein, 25 aa, Plasmodium falciparum
ILYIQMHIYLFIYLGICGYRNIQAL

SEQ ID NO: 3287370 - protein, 18 aa, Plasmodium falciparum
ILYKILGNFIYGLNDEEL

SEQ ID NO: 3287371 - protein, 28 aa, Plasmodium falciparum
ILYREDFFKLLILINKKYKKKTGEDVIS

SEQ ID NO: 3287372 - protein, 17 aa, Plasmodium falciparum
ILYSLTWPDRIKTNLKP

SEQ ID NO: 3287373 - protein, 18 aa, Plasmodium falciparum
ILYVAFFVAYLSLLVHDN

SEQ ID NO: 3287374 - protein, 20 aa, Plasmodium falciparum
IMCYSLCKLLLNDYIYDPCV

SEQ ID NO: 3287375 - protein, 24 aa, Plasmodium falciparum
IMCYVFGFYKFFKIENLKIIKNNN

SEQ ID NO: 3287376 - protein, 19 aa, Plasmodium falciparum
IMDVEFITNLFLSLKDLEN

SEQ ID NO: 3287377 - protein, 20 aa, Plasmodium falciparum
IMEFHRYKDLLKLRKNNMQK

SEQ ID NO: 3287378 - protein, 24 aa, Plasmodium falciparum
IMEILNIFFFYFNDNNSYIRWCLS

SEQ ID NO: 3287379 - protein, 26 aa, Plasmodium falciparum
IMFIDTPFLIYFITALIELANMIIKF

SEQ ID NO: 3287380 - protein, 18 aa, Plasmodium falciparum
IMFYSDMNDFPFLANNQV

SEQ ID NO: 3287381 - protein, 20 aa, Plasmodium falciparum
IMHGLKWTGVWIVVGVIVIG

SEQ ID NO: 3287382 - protein, 17 aa, Plasmodium falciparum
IMIKQIIVYCNLLLESF

SEQ ID NO: 3287383 - protein, 26 aa, Plasmodium falciparum
IMINNKLYIYIKFSQDIDHLIPYFKR

SEQ ID NO: 3287384 - protein, 24 aa, Plasmodium falciparum
IMISGFTIGYLINAIICIHLSSKG

SEQ ID NO: 3287385 - protein, 29 aa, Plasmodium falciparum
IMISLIKLFNFLTFFLSLLSLYLLHFYKN

SEQ ID NO: 3287386 - protein, 25 aa, Plasmodium falciparum
IMITVFIHCFKWFSIPIVFFTFCPG

SEQ ID NO: 3287387 - protein, 33 aa, Plasmodium falciparum
IMKKRYITFYSIRALLYLIKKKKLFICMDYYIY

SEQ ID NO: 3287388 - protein, 18 aa, Plasmodium falciparum
IMKPCTELYHFLKSLGCT

SEQ ID NO: 3287389 - protein, 19 aa, Plasmodium falciparum
IMKPIYASRKYARINKLNI

SEQ ID NO: 3287390 - protein, 17 aa, Plasmodium falciparum
IMKYYLYVLNKKGLKGL

SEQ ID NO: 3287391 - protein, 19 aa, Plasmodium falciparum
IMLIQYIIQNHLFNVLYNL

SEQ ID NO: 3287392 - protein, 17 aa, Plasmodium falciparum
IMNFIYKNIVYDKNYTF

SEQ ID NO: 3287393 - protein, 18 aa, Plasmodium falciparum
IMNKMIPVFLCAYILDNN

SEQ ID NO: 3287394 - protein, 22 aa, Plasmodium falciparum
IMNMITVILSLFRYVSDKEKFE

SEQ ID NO: 3287395 - protein, 28 aa, Plasmodium falciparum
IMNNYYINYPILFLSNYKGKLYIHPLNK

SEQ ID NO: 3287396 - protein, 24 aa, Plasmodium falciparum
IMNQLDLLHKWLDRHRDMCDKWNT

SEQ ID NO: 3287397 - protein, 22 aa, Plasmodium falciparum
IMNQLDLLHKWLDRHRDMCEKW

SEQ ID NO: 3287398 - protein, 23 aa, Plasmodium falciparum
IMNQLDLLHKWLDRHRDMCEMWN

SEQ ID NO: 3287399 - protein, 23 aa, Plasmodium falciparum
IMNQLDLLHKWLDRRRNMCEKWE

SEQ ID NO: 3287400 - protein, 24 aa, Plasmodium falciparum
IMNQLDLLHTWLDRHRDMCEKWNK

SEQ ID NO: 3287401 - protein, 17 aa, Plasmodium falciparum
IMNSFVLFFKDYIYYMN

SEQ ID NO: 3287402 - protein, 18 aa, Plasmodium falciparum
IMQIIRMLKKKFLSSSYT

SEQ ID NO: 3287403 - protein, 17 aa, Plasmodium falciparum
IMRLKRSNMLKFTNFLK

SEQ ID NO: 3287404 - protein, 46 aa, Plasmodium falciparum
IMSCMYSFISLYLYFKIYFLSFFLLFFCICIIYIYISNHKPINHMY

SEQ ID NO: 3287405 - protein, 17 aa, Plasmodium falciparum
IMSIHDRNLFSGEEISY

SEQ ID NO: 3287406 - protein, 17 aa, Plasmodium falciparum
IMSIHDRNLLNGEEYSY

SEQ ID NO: 3287407 - protein, 18 aa, Plasmodium falciparum
IMSIHDRNLLNGEEYSYD

SEQ ID NO: 3287408 - protein, 17 aa, Plasmodium falciparum
IMSIHDRNLYSGEEYSY

SEQ ID NO: 3287409 - protein, 17 aa, Plasmodium falciparum
IMSIHDRNLYTGEEYSY

SEQ ID NO: 3287410 - protein, 35 aa, Plasmodium falciparum
IMSYVFKSLLLFFYPLIIPFRGAFAFAISAFCITQ

SEQ ID NO: 3287411 - protein, 26 aa, Plasmodium falciparum
IMTLGYLLYIKFNKYLRVIYEYDLGL

SEQ ID NO: 3287412 - protein, 17 aa, Plasmodium falciparum
IMTNVESMKIFLCIAMR

SEQ ID NO: 3287413 - protein, 40 aa, Plasmodium falciparum
IMVSVIFYLCYFFYFLTYSYEIIFLFQTKIDYIVFCLLFI

SEQ ID NO: 3287414 - protein, 24 aa, Plasmodium falciparum
IMYTQYVNFILNNKLIFDLDTNIV

SEQ ID NO: 3287415 - protein, 26 aa, Plasmodium falciparum
INADFAYSLLLKDISVFFIHKDKKYP

SEQ ID NO: 3287416 - protein, 25 aa, Plasmodium falciparum
INALFNIPKRLSSLIYPKIKKNFIA

SEQ ID NO: 3287417 - protein, 25 aa, Plasmodium falciparum
INALYDYLMYMNLSKNYFTFFQKIV

SEQ ID NO: 3287418 - protein, 17 aa, Plasmodium falciparum
INAPLHTSKKRSLTIAQ

SEQ ID NO: 3287419 - protein, 37 aa, Plasmodium falciparum
INASIIAILIIVLIMVIIYLILRYRRKKKMKKKLQYI

SEQ ID NO: 3287420 - protein, 25 aa, Plasmodium falciparum
INCCYIFIIHKLYSFILWTNNNNNI

SEQ ID NO: 3287421 - protein, 23 aa, Plasmodium falciparum
INCKYLTLINLKLILLSYMSIQE

SEQ ID NO: 3287422 - protein, 22 aa, Plasmodium falciparum
INCNLLFLKKILKYSFQQRRKK

SEQ ID NO: 3287423 - protein, 25 aa, Plasmodium falciparum
INDDYLELLLSYYLDYYDFTKCEQC

SEQ ID NO: 3287424 - protein, 28 aa, Plasmodium falciparum
INDIENKFRYLFLRDLSYYIDIPRDIKR

SEQ ID NO: 3287425 - protein, 29 aa, Plasmodium falciparum
INDIFQLAIYLKVLSKKISYFVFFHIYRN

SEQ ID NO: 3287426 - protein, 23 aa, Plasmodium falciparum
INDIRYYFLLFNKGYMDENVLKK

SEQ ID NO: 3287427 - protein, 17 aa, Plasmodium falciparum
INDIYIITLIYDYLKKK

SEQ ID NO: 3287428 - protein, 24 aa, Plasmodium falciparum
INDKLDLLINLELTNYYLEKDLMY

SEQ ID NO: 3287429 - protein, 43 aa, Plasmodium falciparum
INDLIYKFHLPITIQMYAIKFLNVVLFKYRFSKFLLNVYTNKY

SEQ ID NO: 3287430 - protein, 38 aa, Plasmodium falciparum
INDSYKFLIILIIYAFFSVFILLYITLSNNEYTNHIII

SEQ ID NO: 3287431 - protein, 29 aa, Plasmodium falciparum
INDTNIVNFIFLPSKFSPIQILKSLGYSK

SEQ ID NO: 3287432 - protein, 24 aa, Plasmodium falciparum
INDVFFNIFNKFKNLFTYQYKEEP

SEQ ID NO: 3287433 - protein, 19 aa, Plasmodium falciparum
INDYKYDLFISKDRKRFGS

SEQ ID NO: 3287434 - protein, 26 aa, Plasmodium falciparum
INDYMLPFFEFIFKENCFLIIDERNM

SEQ ID NO: 3287435 - protein, 25 aa, Plasmodium falciparum
INECYLNIFYSPYKDSIYYAEQKIK

SEQ ID NO: 3287436 - protein, 25 aa, Plasmodium falciparum
INEDIRYNIFFESLYIKCVEIEEEN

SEQ ID NO: 3287437 - protein, 28 aa, Plasmodium falciparum
INEEVEEFILNEIPLEEQVPKELPQEEI

SEQ ID NO: 3287438 - protein, 23 aa, Plasmodium falciparum
INEFKYFTLLNLLFDITLNINDQ

SEQ ID NO: 3287439 - protein, 25 aa, Plasmodium falciparum
INEIIISFFNALTFIYINIFNSYYN

SEQ ID NO: 3287440 - protein, 37 aa, Plasmodium falciparum
INEIILFTETFITPKFIALFFPSYLKYLKDGTKQKKY

SEQ ID NO: 3287441 - protein, 28 aa, Plasmodium falciparum
INEIKRKFYNLSLKYYPKMNKDKNLVMN

SEQ ID NO: 3287442 - protein, 26 aa, Plasmodium falciparum
INEKKMIIFKLLFKQSVILVDRFSVC

SEQ ID NO: 3287443 - protein, 24 aa, Plasmodium falciparum
INEKNKMFKLIKNIIIYLCSLMKK

SEQ ID NO: 3287444 - protein, 29 aa, Plasmodium falciparum
INELIKTFYYFHNFTFLFLKETNIRINLF

SEQ ID NO: 3287445 - protein, 33 aa, Plasmodium falciparum
INELKLKGYKVGQLYDFFLSFDINQKDEFLNNG

SEQ ID NO: 3287446 - protein, 17 aa, Plasmodium falciparum
INELYNFIMLRFYEYDK

SEQ ID NO: 3287447 - protein, 45 aa, Plasmodium falciparum
INENDYIFIGGLLYIHILNIKKYYSIMSFFLSEKLPIIKRKNFSK

SEQ ID NO: 3287448 - protein, 39 aa, Plasmodium falciparum
INENGFTIFYKNKKKMTYFWSVLELPIKMIGSIEQCFYF

SEQ ID NO: 3287449 - protein, 24 aa, Plasmodium falciparum
INENMRFYLYIKMLCLYMHSHSYS

SEQ ID NO: 3287450 - protein, 29 aa, Plasmodium falciparum
INFDFIEIIFYTLSWVLFHKFKDCCFYID

SEQ ID NO: 3287451 - protein, 26 aa, Plasmodium falciparum
INFDIIVYVLLFILFRTVEPIKFLKH

SEQ ID NO: 3287452 - protein, 19 aa, Plasmodium falciparum
INFFFIILTIYLIGAIQVK

SEQ ID NO: 3287453 - protein, 20 aa, Plasmodium falciparum
INFFYLNLFVDNSEFVRVVA

SEQ ID NO: 3287454 - protein, 38 aa, Plasmodium falciparum
INFIFQTLCFCFLIILSCWIFLLRVDNITWFQLYSYGS

SEQ ID NO: 3287455 - protein, 17 aa, Plasmodium falciparum
INFILKEMLYIKKNDER

SEQ ID NO: 3287456 - protein, 28 aa, Plasmodium falciparum
INFLKIKYFFYMFIKDFYDKKILSFLNI

SEQ ID NO: 3287457 - protein, 39 aa, Plasmodium falciparum
INFQHKYLFIHIFVYTLNLIIFFKLLKTNIFHSQNNQLL

SEQ ID NO: 3287458 - protein, 20 aa, Plasmodium falciparum
INFTNLMELLFIFNNMGMSC

SEQ ID NO: 3287459 - protein, 25 aa, Plasmodium falciparum
INFTSFYNFQYYLFSSNNNHSIINL

SEQ ID NO: 3287460 - protein, 23 aa, Plasmodium falciparum
INFYSYNYLLWNKQQNFFVVSFS

SEQ ID NO: 3287461 - protein, 23 aa, Plasmodium falciparum
INGNISLSYFIFNFDDICKKYNI

SEQ ID NO: 3287462 - protein, 18 aa, Plasmodium falciparum
INHFIDFIFSFIKKITQT

SEQ ID NO: 3287463 - protein, 23 aa, Plasmodium falciparum
INHIHIYIQPILNNLHTLKQVQN

SEQ ID NO: 3287464 - protein, 29 aa, Plasmodium falciparum
INHIKKYLMYYIIGVIVFFSLALVMQSSD

SEQ ID NO: 3287465 - protein, 21 aa, Plasmodium falciparum
INHIYPFIFLNKYLYNNYILF

SEQ ID NO: 3287466 - protein, 24 aa, Plasmodium falciparum
INHKDSMIIFRKKTLTFLNILNDI

SEQ ID NO: 3287467 - protein, 17 aa, Plasmodium falciparum
INHQEIISMLPKIDDQK

SEQ ID NO: 3287468 - protein, 23 aa, Plasmodium falciparum
INHSSYLHLLYISAFPFEVEQIY

SEQ ID NO: 3287469 - protein, 28 aa, Plasmodium falciparum
INICDYDMEFFFLIFSQIFDHYSQQELA

SEQ ID NO: 3287470 - protein, 28 aa, Plasmodium falciparum
INICNNISPFRLFIKNNASKKYLQLCNK

SEQ ID NO: 3287471 - protein, 31 aa, Plasmodium falciparum
INICYSVLFHNFLFIKSVYPFDMLTKEKGEE

SEQ ID NO: 3287472 - protein, 24 aa, Plasmodium falciparum
INIEDINYFIFHQANIRIIETVAK

SEQ ID NO: 3287473 - protein, 21 aa, Plasmodium falciparum
INIFIMKKLYHIIEKIILLFF

SEQ ID NO: 3287474 - protein, 27 aa, Plasmodium falciparum
INIFNSCLGVLLLIHLNVKNKGLSSIA

SEQ ID NO: 3287475 - protein, 26 aa, Plasmodium falciparum
INIGEIIYFLYLLNHFNNYELLNSMF

SEQ ID NO: 3287476 - protein, 29 aa, Plasmodium falciparum
INIIINSKCYLFLIQLLCIKNFSISSLYK

SEQ ID NO: 3287477 - protein, 18 aa, Plasmodium falciparum
INIIIYNRLLLDMVNNIY

SEQ ID NO: 3287478 - protein, 22 aa, Plasmodium falciparum
INIIKVSFIIIPFICQLYTKRN

SEQ ID NO: 3287479 - protein, 24 aa, Plasmodium falciparum
INIINIMYSFIYIDRFKCLNITEY

SEQ ID NO: 3287480 - protein, 24 aa, Plasmodium falciparum
INIITNYFYTLYSTNIRNIHNSIL

SEQ ID NO: 3287481 - protein, 27 aa, Plasmodium falciparum
INIKELHFFFLYLLVIDIIQGKNNLKH

SEQ ID NO: 3287482 - protein, 30 aa, Plasmodium falciparum
INIKKLVKLFFISFYKYLKNYFLQIYYHFF

SEQ ID NO: 3287483 - protein, 17 aa, Plasmodium falciparum
INIKTFNFHSFRISFIQ

SEQ ID NO: 3287484 - protein, 25 aa, Plasmodium falciparum
INILKLLCNIFINSELNYILYSRIF

SEQ ID NO: 3287485 - protein, 31 aa, Plasmodium falciparum
INILYNNYFYLKYFLFDAYIEYNLEYIYKLY

SEQ ID NO: 3287486 - protein, 23 aa, Plasmodium falciparum
INILYNYHILIILRQYDIVSVTK

SEQ ID NO: 3287487 - protein, 35 aa, Plasmodium falciparum
ININELLTTLLKIYYLLFKIKPFNFIDNSLVYMYQ

SEQ ID NO: 3287488 - protein, 24 aa, Plasmodium falciparum
ININFGFSIPFIFKSKTTNILNIS

SEQ ID NO: 3287489 - protein, 24 aa, Plasmodium falciparum
INIRMKIEPIGYLKSYYSFSYSNI

SEQ ID NO: 3287490 - protein, 35 aa, Plasmodium falciparum
INISELFDFSFNYNKKLYLIIDIIDSIDGTYYYNS

SEQ ID NO: 3287491 - protein, 17 aa, Plasmodium falciparum
INITFYLCYYNNELLEC

SEQ ID NO: 3287492 - protein, 27 aa, Plasmodium falciparum
INITTSFLYLYQYLFANLNFKKEFNEV

SEQ ID NO: 3287493 - protein, 21 aa, Plasmodium falciparum
INITYYMYCKNLQGKKCKLLC

SEQ ID NO: 3287494 - protein, 23 aa, Plasmodium falciparum
INIVNYFLFNSFMKNCDITYEYL

SEQ ID NO: 3287495 - protein, 20 aa, Plasmodium falciparum
INIYFVFIYILNEIYEYFKN

SEQ ID NO: 3287496 - protein, 24 aa, Plasmodium falciparum
INIYGPEGLYRFLKNNFNCTYSKR

SEQ ID NO: 3287497 - protein, 39 aa, Plasmodium falciparum
INKDLFIVQSVISFVYSFLLFIYMCVIRTIKSYKTKHIW

SEQ ID NO: 3287498 - protein, 29 aa, Plasmodium falciparum
INKDNYFVILFLLYLIRNKKIRAIENEVN

SEQ ID NO: 3287499 - protein, 17 aa, Plasmodium falciparum
INKEFNILFNILNKMNY

SEQ ID NO: 3287500 - protein, 17 aa, Plasmodium falciparum
INKENKNILLKKRDNKE

SEQ ID NO: 3287501 - protein, 30 aa, Plasmodium falciparum
INKFSVCLEYLFLVSPKDLYNSGRNNYWGI

SEQ ID NO: 3287502 - protein, 21 aa, Plasmodium falciparum
INKHIFLFSFEKVHIYIYDFF

SEQ ID NO: 3287503 - protein, 26 aa, Plasmodium falciparum
INKHLYRQYIYYKDKKIYKYELRNEF

SEQ ID NO: 3287504 - protein, 28 aa, Plasmodium falciparum
INKICYIFKYINFYLTQKCQSLLYLFFH

SEQ ID NO: 3287505 - protein, 29 aa, Plasmodium falciparum
INKINNIFLYPFSFFNLINHHIFVLHVYR

SEQ ID NO: 3287506 - protein, 17 aa, Plasmodium falciparum
INKIQTYKFKYEHEKSI

SEQ ID NO: 3287507 - protein, 28 aa, Plasmodium falciparum
INKKDTLFFLFIFYTSLIFEQQKLNSTQ

SEQ ID NO: 3287508 - protein, 19 aa, Plasmodium falciparum
INKKIIFCLNRNSQFVLII

SEQ ID NO: 3287509 - protein, 28 aa, Plasmodium falciparum
INKKIKNKFIFICLIAVGGFSCVYKIKK

SEQ ID NO: 3287510 - protein, 17 aa, Plasmodium falciparum
INKKKILNFLKIYLLIL

SEQ ID NO: 3287511 - protein, 23 aa, Plasmodium falciparum
INKLMKKKAIFILLNLKRSIERI

SEQ ID NO: 3287512 - protein, 23 aa, Plasmodium falciparum
INKLNNILFIFCFSYLLSITLTF

SEQ ID NO: 3287513 - protein, 23 aa, Plasmodium falciparum
INKLRRKLLRLLKDYHPDMYIKE

SEQ ID NO: 3287514 - protein, 19 aa, Plasmodium falciparum
INKMYLYSFMNIQIKEITA

SEQ ID NO: 3287515 - protein, 31 aa, Plasmodium falciparum
INKNKERPFYSFVFDIFKNLKHYLQQMKEKF

SEQ ID NO: 3287516 - protein, 25 aa, Plasmodium falciparum
INKNLFYGILCKYHYMYEGRRKEIH

SEQ ID NO: 3287517 - protein, 24 aa, Plasmodium falciparum
INKNNPIFFHILHDLQNCTFINIK

SEQ ID NO: 3287518 - protein, 30 aa, Plasmodium falciparum
INKNTILMFFVSILLFLNLIKNKFIENVYF

SEQ ID NO: 3287519 - protein, 32 aa, Plasmodium falciparum
INKNTYYYVLIINILVNLFLFINKRDYDDETC

SEQ ID NO: 3287520 - protein, 29 aa, Plasmodium falciparum
INKNVWIFKIFKFFYYRSFMCFYKNKSQE

SEQ ID NO: 3287521 - protein, 23 aa, Plasmodium falciparum
INKNYFNTFYYPYNIYYNQNIHS

SEQ ID NO: 3287522 - protein, 33 aa, Plasmodium falciparum
INKNYVLIKIFYKYFNYFIKQNWKTIFYYIPLN

SEQ ID NO: 3287523 - protein, 18 aa, Plasmodium falciparum
INKQPLLRRHSTAILNHN

SEQ ID NO: 3287524 - protein, 35 aa, Plasmodium falciparum
INKQSLLNIYIFSLIHDMLLYYKSKNVWNYDTINL

SEQ ID NO: 3287525 - protein, 28 aa, Plasmodium falciparum
INKSKLNYFYIFLRLTKNIKHEYIINPN

SEQ ID NO: 3287526 - protein, 35 aa, Plasmodium falciparum
INKVLKNNFLLYIKLFYYLLLVGNIYTTIVFLSCV

SEQ ID NO: 3287527 - protein, 32 aa, Plasmodium falciparum
INKVTINIILFFLLFFYDYYSNNYKIKENILI

SEQ ID NO: 3287528 - protein, 34 aa, Plasmodium falciparum
INKWEIIPFINDKLLLILMLENLQFLYSNNYKLV

SEQ ID NO: 3287529 - protein, 22 aa, Plasmodium falciparum
INKYFNFLYKSQDIFEIFYFYL

SEQ ID NO: 3287530 - protein, 19 aa, Plasmodium falciparum
INKYTLYYWYNYNTKRKIK

SEQ ID NO: 3287531 - protein, 24 aa, Plasmodium falciparum
INLAILLNDMFWKHKNRCKGVNYN

SEQ ID NO: 3287532 - protein, 17 aa, Plasmodium falciparum
INLEIYLGEKHTIMGRN

SEQ ID NO: 3287533 - protein, 22 aa, Plasmodium falciparum
INLFVLIITLSNYTIIVSCLKK

SEQ ID NO: 3287534 - protein, 59 aa, Plasmodium falciparum
INLKNKRKFSFFINFFLNIFNIINILLFGHIVFLLLCLLTMNNIFQKILTACIKLVYYQ

SEQ ID NO: 3287535 - protein, 33 aa, Plasmodium falciparum
INLLQKFSVQKFFYQILIDLDRTMYIITKNKEY

SEQ ID NO: 3287536 - protein, 27 aa, Plasmodium falciparum
INLNDYFTNKLLKLLYEILIENKNSII

SEQ ID NO: 3287537 - protein, 24 aa, Plasmodium falciparum
INLTIEIMFLINKFIKRIIQLINE

SEQ ID NO: 3287538 - protein, 30 aa, Plasmodium falciparum
INLTIIFVILLLLFYFNIIMKRRNKMHLPD

SEQ ID NO: 3287539 - protein, 17 aa, Plasmodium falciparum
INMCTLLFFKSPNDVCL

SEQ ID NO: 3287540 - protein, 21 aa, Plasmodium falciparum
INMCYDVVVFIKILRDLHFPI

SEQ ID NO: 3287541 - protein, 35 aa, Plasmodium falciparum
INNDGNIFYGKLHDFLFLFKNKIKIRKDIKCFFLM

SEQ ID NO: 3287542 - protein, 23 aa, Plasmodium falciparum
INNDVHIYFILSNNKFHIKRKLK

SEQ ID NO: 3287543 - protein, 27 aa, Plasmodium falciparum
INNFDIYNFFFYNYDNISNLNEINKDL

SEQ ID NO: 3287544 - protein, 28 aa, Plasmodium falciparum
INNFSYHMLYYFNYTIKTNKFIQPLFYD

SEQ ID NO: 3287545 - protein, 23 aa, Plasmodium falciparum
INNIILFLNLYINKYIHLKDKYN

SEQ ID NO: 3287546 - protein, 17 aa, Plasmodium falciparum
INNILIRKTTIPVDLSL

SEQ ID NO: 3287547 - protein, 20 aa, Plasmodium falciparum
INNILVLTNYKSILQDISQN

SEQ ID NO: 3287548 - protein, 26 aa, Plasmodium falciparum
INNINDELLLPIKIQYFKNRKIFMNA

SEQ ID NO: 3287549 - protein, 22 aa, Plasmodium falciparum
INNIVIISFIYTFTSFMNKEIR

SEQ ID NO: 3287550 - protein, 20 aa, Plasmodium falciparum
INNIYLNYTLYFNKNYEINM

SEQ ID NO: 3287551 - protein, 24 aa, Plasmodium falciparum
INNKKLVIQFLPPINKGTHILHNK

SEQ ID NO: 3287552 - protein, 25 aa, Plasmodium falciparum
INNKYVYLQYISIDKINILLNFQSE

SEQ ID NO: 3287553 - protein, 23 aa, Plasmodium falciparum
INNLIPIMNFIPKNNICLEIFLK

SEQ ID NO: 3287554 - protein, 24 aa, Plasmodium falciparum
INNLYLFDMLLHKFNEKRKRENNM

SEQ ID NO: 3287555 - protein, 27 aa, Plasmodium falciparum
INNLYRAYIILLHSRIYFDKKLWNVKN

SEQ ID NO: 3287556 - protein, 25 aa, Plasmodium falciparum
INNLYYENFLNKINKYYYLYDQMDD

SEQ ID NO: 3287557 - protein, 30 aa, Plasmodium falciparum
INNMQFIDSTFFFTLLFGSEKLDPYIGKLR

SEQ ID NO: 3287558 - protein, 22 aa, Plasmodium falciparum
INNMYLPYLSILIDIIHAQNLK

SEQ ID NO: 3287559 - protein, 25 aa, Plasmodium falciparum
INNNIFLFINLLNESLLDIIDIRIP

SEQ ID NO: 3287560 - protein, 38 aa, Plasmodium falciparum
INNNINILSSVHRKGRILYDSFLEINKLENDKKEKHEK

SEQ ID NO: 3287561 - protein, 18 aa, Plasmodium falciparum
INNNLLNLNFYFFDNVYT

SEQ ID NO: 3287562 - protein, 32 aa, Plasmodium falciparum
INNPTLKEFISRPPYFRYLEEWGETFCRQRAR

SEQ ID NO: 3287563 - protein, 23 aa, Plasmodium falciparum
INNQFYLYLCKYYQLNISFQNIY

SEQ ID NO: 3287564 - protein, 40 aa, Plasmodium falciparum
INNSHNIVFTPFLIFLFKRILPQFICLNYPSLRSPYSLNT

SEQ ID NO: 3287565 - protein, 28 aa, Plasmodium falciparum
INNSSIIPIFKAPLIFGPYFPGEVFDIN

SEQ ID NO: 3287566 - protein, 28 aa, Plasmodium falciparum
INNTILLYIFVNYLIYIYKNIRIKKKKG

SEQ ID NO: 3287567 - protein, 23 aa, Plasmodium falciparum
INNTLYFHFVKLILYLDTQNCCL

SEQ ID NO: 3287568 - protein, 26 aa, Plasmodium falciparum
INNTWNSIFNLFRKNNSRFINNVNYF

SEQ ID NO: 3287569 - protein, 23 aa, Plasmodium falciparum
INNVEIWYEKNIIEYFLRHMNDQ

SEQ ID NO: 3287570 - protein, 23 aa, Plasmodium falciparum
INNVLKFLKCIQIVFFYDNNTNE

SEQ ID NO: 3287571 - protein, 18 aa, Plasmodium falciparum
INNVNVVHLFILLNKRAN

SEQ ID NO: 3287572 - protein, 24 aa, Plasmodium falciparum
INNYFLKRNIIYLQKIHKKLIIKN

SEQ ID NO: 3287573 - protein, 22 aa, Plasmodium falciparum
INPTTINFYIKEKFKYFPILNI

SEQ ID NO: 3287574 - protein, 32 aa, Plasmodium falciparum
INQDKLESFKYLHFNFFYICSKLENKSISNIN

SEQ ID NO: 3287575 - protein, 27 aa, Plasmodium falciparum
INQINQLLYSFPLDYKLSSGEYFWVGQ

SEQ ID NO: 3287576 - protein, 24 aa, Plasmodium falciparum
INQKVIFIFIIIISSYVNSYIKLV

SEQ ID NO: 3287577 - protein, 22 aa, Plasmodium falciparum
INRDYMLYFVNDCYKKKEYFFK

SEQ ID NO: 3287578 - protein, 29 aa, Plasmodium falciparum
INREFILIWLMIFFNWQAISYTQVFWKIF

SEQ ID NO: 3287579 - protein, 17 aa, Plasmodium falciparum
INRESLENLGCDKKLIA

SEQ ID NO: 3287580 - protein, 52 aa, Plasmodium falciparum
INRKTKLLEKIFLQLRATYIFSITLREQNFFFSILLFPLINIDYFSESDATN

SEQ ID NO: 3287581 - protein, 24 aa, Plasmodium falciparum
INRNYEIIQMIILGLYSIHNNNIM

SEQ ID NO: 3287582 - protein, 17 aa, Plasmodium falciparum
INRSLSFFKDYISNSIN

SEQ ID NO: 3287583 - protein, 29 aa, Plasmodium falciparum
INSDIFELYSLYIFYFVCDKNLFIYEINK

SEQ ID NO: 3287584 - protein, 34 aa, Plasmodium falciparum
INSENIIFFQRFFPLFLLVGYANGNIILFLILYE

SEQ ID NO: 3287585 - protein, 25 aa, Plasmodium falciparum
INSFLFYIRSFFNNNFYYVYEIYPI

SEQ ID NO: 3287586 - protein, 29 aa, Plasmodium falciparum
INSICDHFLFNIFFMHIVKPTLFIKGDML

SEQ ID NO: 3287587 - protein, 25 aa, Plasmodium falciparum
INSINKKMFFLADECMYFMRYCIDK

SEQ ID NO: 3287588 - protein, 17 aa, Plasmodium falciparum
INSIYTLTLLMFLEIFF

SEQ ID NO: 3287589 - protein, 30 aa, Plasmodium falciparum
INSKEENILRYPFILNGEKLLNIETNVVVN

SEQ ID NO: 3287590 - protein, 28 aa, Plasmodium falciparum
INSKKECELIWILTLNYFDNIKENVFQR

SEQ ID NO: 3287591 - protein, 23 aa, Plasmodium falciparum
INSLFEEYKILVKLKNEILNDMQ

SEQ ID NO: 3287592 - protein, 28 aa, Plasmodium falciparum
INSLYFTYLHFFIYITNHPYIFFHIKKY

SEQ ID NO: 3287593 - protein, 31 aa, Plasmodium falciparum
INSNHNFMLAKEYSWYVWKKQLNVAKYNKDD

SEQ ID NO: 3287594 - protein, 24 aa, Plasmodium falciparum
INSPKYFFYNLSYDLTKQNFLTYQ

SEQ ID NO: 3287595 - protein, 25 aa, Plasmodium falciparum
INSRTTYLILLLKNFFRDNEMNKVI

SEQ ID NO: 3287596 - protein, 18 aa, Plasmodium falciparum
INSSLFFSEFDSCVYFLF

SEQ ID NO: 3287597 - protein, 39 aa, Plasmodium falciparum
INTFGNICFIGCLLISILRLFLEGSLWSPSILITCFGCF

SEQ ID NO: 3287598 - protein, 24 aa, Plasmodium falciparum
INTGYFFFCIIPVTIIYSIIYIWV

SEQ ID NO: 3287599 - protein, 32 aa, Plasmodium falciparum
INTIFHIEDIINSYYPLVYGHHFMYNEFLKNC

SEQ ID NO: 3287600 - protein, 26 aa, Plasmodium falciparum
INTLQYMYLMRFVDNHFIILLISKLC

SEQ ID NO: 3287601 - protein, 34 aa, Plasmodium falciparum
INTNYLMNICPLFYSFMIFFNQLNSRKKLMKIIN

SEQ ID NO: 3287602 - protein, 27 aa, Plasmodium falciparum
INTPHDIYNFFKIPKYLLYEEGPREVK

SEQ ID NO: 3287603 - protein, 27 aa, Plasmodium falciparum
INTQQIYLLKYLFKKLFEQFINQEIFL

SEQ ID NO: 3287604 - protein, 26 aa, Plasmodium falciparum
INTYIIPYMNLLLEKLLFYDEDNNVK

SEQ ID NO: 3287605 - protein, 27 aa, Plasmodium falciparum
INVDYDLLSILFNFIICSIIKNVIEFS

SEQ ID NO: 3287606 - protein, 18 aa, Plasmodium falciparum
INVFLDKILIIDPSSLNV

SEQ ID NO: 3287607 - protein, 39 aa, Plasmodium falciparum
INVFVNCVTFILLHFIMILSFSLFMDMYICSAPILYDTH

SEQ ID NO: 3287608 - protein, 33 aa, Plasmodium falciparum
INVFYNNIFNHLFFIFINYILSIFTFHMYINNP

SEQ ID NO: 3287609 - protein, 24 aa, Plasmodium falciparum
INVKTFFNIYFHKMGLSSAFQKEA

SEQ ID NO: 3287610 - protein, 32 aa, Plasmodium falciparum
INVLTKILIEAIYFKLFNLVKIIKKKICVLYS

SEQ ID NO: 3287611 - protein, 29 aa, Plasmodium falciparum
INVNMSKIIYILILISNKRIMKELIEEKY

SEQ ID NO: 3287612 - protein, 24 aa, Plasmodium falciparum
INVNVFMYIIRKINYVLKFYIYSK

SEQ ID NO: 3287613 - protein, 55 aa, Plasmodium falciparum
INWCDNNLIQIKLQLYNIAFCLLLEIYILLLTINYEYIENFKNQYLKKFSAYEPV

SEQ ID NO: 3287614 - protein, 32 aa, Plasmodium falciparum
INYAILLCIYIIIWILLTLYCLFNKLKSYIIS

SEQ ID NO: 3287615 - protein, 32 aa, Plasmodium falciparum
INYEKCINFPYLFLSILHIKIKLSYEIILYDL

SEQ ID NO: 3287616 - protein, 29 aa, Plasmodium falciparum
INYIATFLLFFLFSSFRLIIHSGASNILT

SEQ ID NO: 3287617 - protein, 42 aa, Plasmodium falciparum
INYIKFVFYLFPYIINLFINLIINFYILFSVFYYNNTIPLAS

SEQ ID NO: 3287618 - protein, 25 aa, Plasmodium falciparum
INYIVKYIHTFLKNLIINISNTNIN

SEQ ID NO: 3287619 - protein, 18 aa, Plasmodium falciparum
INYIYKKCRLLQKCLFYK

SEQ ID NO: 3287620 - protein, 38 aa, Plasmodium falciparum
INYKRGKWKKMFKFLNLFVFIFLFVYIGDYLGNELSYQ

SEQ ID NO: 3287621 - protein, 27 aa, Plasmodium falciparum
INYNLAKGIYKEFYKYSLKNRKGNNKC

SEQ ID NO: 3287622 - protein, 19 aa, Plasmodium falciparum
INYQLFYDLISGKVKRKKN

SEQ ID NO: 3287623 - protein, 17 aa, Plasmodium falciparum
INYSFPSLFSYFIKNMQ

SEQ ID NO: 3287624 - protein, 20 aa, Plasmodium falciparum
INYTLLYLTKFIFYINNITI

SEQ ID NO: 3287625 - protein, 35 aa, Plasmodium falciparum
INYTPIYNLFHFVIQRDYFFFDRFGDIAVSVGNII

SEQ ID NO: 3287626 - protein, 26 aa, Plasmodium falciparum
IPDDFKRLMFYTLGDYRDIVVRGVAD

SEQ ID NO: 3287627 - protein, 27 aa, Plasmodium falciparum
IPDDFLRQMFYTLADYKDILFSGDKDN

SEQ ID NO: 3287628 - protein, 25 aa, Plasmodium falciparum
IPDDFLRQMFYTLGDYRDICIGDEN

SEQ ID NO: 3287629 - protein, 26 aa, Plasmodium falciparum
IPDGFLRQMFYTLADYKDILYSGSND

SEQ ID NO: 3287630 - protein, 26 aa, Plasmodium falciparum
IPEEFLRQMFYTLGDYRDILVRGGDV

SEQ ID NO: 3287631 - protein, 20 aa, Plasmodium falciparum
IPEELIKEVLPEEVIEELKP

SEQ ID NO: 3287632 - protein, 23 aa, Plasmodium falciparum
IPEELVEEVIAEKLVKEIVPEQV

SEQ ID NO: 3287633 - protein, 26 aa, Plasmodium falciparum
IPEIATIYGVHRTTIARWCNIRNITS

SEQ ID NO: 3287634 - protein, 34 aa, Plasmodium falciparum
IPEVLVEEIIYKEGIPEVLIEEVIPEELVQEVIP

SEQ ID NO: 3287635 - protein, 26 aa, Plasmodium falciparum
IPFESLFIFFLFFAICIFYAIFFKYE

SEQ ID NO: 3287636 - protein, 18 aa, Plasmodium falciparum
IPHEDLIFIHPIENYYMD

SEQ ID NO: 3287637 - protein, 34 aa, Plasmodium falciparum
IPILKYIGLFFSSLLCFLFWQFSVFVSVTHIVSL

SEQ ID NO: 3287638 - protein, 17 aa, Plasmodium falciparum
IPILLGCNQLVLTFCKK

SEQ ID NO: 3287639 - protein, 24 aa, Plasmodium falciparum
IPINKIIYSFIKNNIYYISFRNEI

SEQ ID NO: 3287640 - protein, 25 aa, Plasmodium falciparum
IPINMFFCFLILRYRYHLYNYLGAV

SEQ ID NO: 3287641 - protein, 23 aa, Plasmodium falciparum
IPKELIEEIIPEELIKEVIPEEI

SEQ ID NO: 3287642 - protein, 22 aa, Plasmodium falciparum
IPKIRHDHTFAFLLNYSDISET

SEQ ID NO: 3287643 - protein, 19 aa, Plasmodium falciparum
IPKSPFVLKFAIYNYSQKT

SEQ ID NO: 3287644 - protein, 18 aa, Plasmodium falciparum
IPLFYIYIILHIFKNENI

SEQ ID NO: 3287645 - protein, 23 aa, Plasmodium falciparum
IPLKKEKWMWKTILEIEMKVVEK

SEQ ID NO: 3287646 - protein, 25 aa, Plasmodium falciparum
IPLKYIHLCVIADIFKYLNLDHIVK

SEQ ID NO: 3287647 - protein, 28 aa, Plasmodium falciparum
IPLNVQYLNLFKLIKKVRKYKFILAMCL

SEQ ID NO: 3287648 - protein, 29 aa, Plasmodium falciparum
IPMTNLKYLFYFHLFYFNMNYSLIRIEKC

SEQ ID NO: 3287649 - protein, 25 aa, Plasmodium falciparum
IPMWNHFFPIYYHNTILYKFCPKIK

SEQ ID NO: 3287650 - protein, 26 aa, Plasmodium falciparum
IPNDFLRQMFYTLADYKDILDGKNIV

SEQ ID NO: 3287651 - protein, 26 aa, Plasmodium falciparum
IPNDFLRQMFYTLGDYRDILVRGGHK

SEQ ID NO: 3287652 - protein, 17 aa, Plasmodium falciparum
IPNDIIHNPLFSQIFQK

SEQ ID NO: 3287653 - protein, 19 aa, Plasmodium falciparum
IPNIYYIYEETLYYDIKYL

SEQ ID NO: 3287654 - protein, 23 aa, Plasmodium falciparum
IPNKNLIQPFIKSYSKFIISNFI

SEQ ID NO: 3287655 - protein, 28 aa, Plasmodium falciparum
IPNLFFLTLFFFLLFFLMATQDIAVDGW

SEQ ID NO: 3287656 - protein, 23 aa, Plasmodium falciparum
IPNSHIIVIPYPLNNSNKWQIQL

SEQ ID NO: 3287657 - protein, 26 aa, Plasmodium falciparum
IPPQFLRSMFYTFGDYKDICLDTDIS

SEQ ID NO: 3287658 - protein, 20 aa, Plasmodium falciparum
IPPRRRQLCFRNIRKFHGRI

SEQ ID NO: 3287659 - protein, 21 aa, Plasmodium falciparum
IPPRRRRLYVGKLEQWASGGN

SEQ ID NO: 3287660 - protein, 25 aa, Plasmodium falciparum
IPQPRNHLFIYFRTSSRISHEEKQE

SEQ ID NO: 3287661 - protein, 21 aa, Plasmodium falciparum
IPRITFTWIHRQDVIIAIHLT

SEQ ID NO: 3287662 - protein, 29 aa, Plasmodium falciparum
IPRPCCVLIFMFLVVMFGIIVGMFGYTDN

SEQ ID NO: 3287663 - protein, 28 aa, Plasmodium falciparum
IPSINDILHIWWQLREVERHKFAMMQYR

SEQ ID NO: 3287664 - protein, 17 aa, Plasmodium falciparum
IPSLFRGFSAPVYIEDN

SEQ ID NO: 3287665 - protein, 19 aa, Plasmodium falciparum
IPSLLYYFQNIFFYISLAN

SEQ ID NO: 3287666 - protein, 23 aa, Plasmodium falciparum
IPTTRLLCECDLYTSIYDNDPEM

SEQ ID NO: 3287667 - protein, 21 aa, Plasmodium falciparum
IPTVFFPLLIVLTANAIKDAF

SEQ ID NO: 3287668 - protein, 19 aa, Plasmodium falciparum
IPTYILFNKKLNDYIRNKY

SEQ ID NO: 3287669 - protein, 26 aa, Plasmodium falciparum
IPVFWPLLLFYFICLFFATMKQQIKN

SEQ ID NO: 3287670 - protein, 18 aa, Plasmodium falciparum
IPYYCRYICIINKYAKDM

SEQ ID NO: 3287671 - protein, 36 aa, Plasmodium falciparum
IQALSKIYHIKFETLLIYIIIPKTTTKSLCYKDFFD

SEQ ID NO: 3287672 - protein, 31 aa, Plasmodium falciparum
IQAPYNDVLFFFIFHVLIYKSFQLVKKKEKK

SEQ ID NO: 3287673 - protein, 18 aa, Plasmodium falciparum
IQCLYIYFNSEINNLFIA

SEQ ID NO: 3287674 - protein, 19 aa, Plasmodium falciparum
IQCYLVYGAPILYALNIFP

SEQ ID NO: 3287675 - protein, 36 aa, Plasmodium falciparum
IQDGFSRMLPFDFVLRIYGIYLFEGQKTLCLYCLAL

SEQ ID NO: 3287676 - protein, 22 aa, Plasmodium falciparum
IQDIIRVWKFKNKSFKFLILHN

SEQ ID NO: 3287677 - protein, 17 aa, Plasmodium falciparum
IQDIIYKYFCLHYDFSN

SEQ ID NO: 3287678 - protein, 37 aa, Plasmodium falciparum
IQDVYKLIHRSLLLRIMDYFFYLINKNIHNFIYEKKK

SEQ ID NO: 3287679 - protein, 27 aa, Plasmodium falciparum
IQFNKYFYKLIINKLSYYKIKKDLYVN

SEQ ID NO: 3287680 - protein, 27 aa, Plasmodium falciparum
IQHESNLILFFHFFQNINICCNYYDDH

SEQ ID NO: 3287681 - protein, 34 aa, Plasmodium falciparum
IQHGYKLEWIVIYLICIEVLIDIVWTIIIKGVFK

SEQ ID NO: 3287682 - protein, 51 aa, Plasmodium falciparum
IQHIYDLLVIIVINYIFFLDLKKIFYFLIIFLIYLYIRAKLEFLNHIRKDC

SEQ ID NO: 3287683 - protein, 31 aa, Plasmodium falciparum
IQIHRNILHVVIFIYRMVSYSYDILFKMKEE

SEQ ID NO: 3287684 - protein, 20 aa, Plasmodium falciparum
IQIIIFYYKCELYVSNYDND

SEQ ID NO: 3287685 - protein, 27 aa, Plasmodium falciparum
IQILCIVYTYLYIYNILHKLNKNNLSL

SEQ ID NO: 3287686 - protein, 21 aa, Plasmodium falciparum
IQILFDLYHKCTFNILKYLEI

SEQ ID NO: 3287687 - protein, 36 aa, Plasmodium falciparum
IQILFLISQRKNLFAQFYFYKINLLTYFLYCINQII

SEQ ID NO: 3287688 - protein, 28 aa, Plasmodium falciparum
IQILYYIILYYILFNSPLYLWIYKFFFF

SEQ ID NO: 3287689 - protein, 19 aa, Plasmodium falciparum
IQIWILVCVFLYLIENICL

SEQ ID NO: 3287690 - protein, 41 aa, Plasmodium falciparum
IQKGTLYYISFKLLCLSLYIIGFYYVLLNNSLENGSLEISK

SEQ ID NO: 3287691 - protein, 24 aa, Plasmodium falciparum
IQKKAFINPLYIISQNKFQLSCAV

SEQ ID NO: 3287692 - protein, 25 aa, Plasmodium falciparum
IQKKYIYKIIMYNFFYINKCIKLTN

SEQ ID NO: 3287693 - protein, 29 aa, Plasmodium falciparum
IQKLSIYCHSIVSILLFLSSHPMLWECIS

SEQ ID NO: 3287694 - protein, 23 aa, Plasmodium falciparum
IQKRFFVVLSILIGFLLLMLVSI

SEQ ID NO: 3287695 - protein, 27 aa, Plasmodium falciparum
IQKTYNDFFYYWVAHMLKDSIHWRTKK

SEQ ID NO: 3287696 - protein, 18 aa, Plasmodium falciparum
IQMWMEIHMMILEDCKKD

SEQ ID NO: 3287697 - protein, 33 aa, Plasmodium falciparum
IQNILKLVNILLYNSYILFITNKNIHILNLNNL

SEQ ID NO: 3287698 - protein, 26 aa, Plasmodium falciparum
IQNINLLFLLVYFNNSFYVHFHNLLN

SEQ ID NO: 3287699 - protein, 28 aa, Plasmodium falciparum
IQNLSVEMFYRDNYFYFHCLNKYIKSKN

SEQ ID NO: 3287700 - protein, 26 aa, Plasmodium falciparum
IQNNTILISYLWPSINYHLLDKMIQD

SEQ ID NO: 3287701 - protein, 24 aa, Plasmodium falciparum
IQNVKYIFLLFKHKAKYKRQKRKL

SEQ ID NO: 3287702 - protein, 30 aa, Plasmodium falciparum
IQQKSRKFKEIFISFIKRDDSKKTEDMEKN

SEQ ID NO: 3287703 - protein, 23 aa, Plasmodium falciparum
IQQNLLTFFELNTFLFNNNRHVY

SEQ ID NO: 3287704 - protein, 23 aa, Plasmodium falciparum
IQTIYIFIHILNEYKLCYNLFPY

SEQ ID NO: 3287705 - protein, 24 aa, Plasmodium falciparum
IQTNRFFLDLIEYVFFSFSIDIEK

SEQ ID NO: 3287706 - protein, 26 aa, Plasmodium falciparum
IQVFKILNIFLIIDNINYIIISLIIL

SEQ ID NO: 3287707 - protein, 71 aa, Plasmodium falciparum
IQVSKAIESLYIGTLRILLILLHDFPEFLASYYVTLCSIFPINFIQLRNLVLSAFPRNIKLPDPFMSDVKI

SEQ ID NO: 3287708 - protein, 29 aa, Plasmodium falciparum
IQYLENILKTYYFFHSLNTYYEKKFKKIK

SEQ ID NO: 3287709 - protein, 38 aa, Plasmodium falciparum
IQYNKFFQAIIMNMFYMFIFFLYDLLTKENMWKYMHNL

SEQ ID NO: 3287710 - protein, 20 aa, Plasmodium falciparum
IRAGNVKAAILYLMKSLKNG

SEQ ID NO: 3287711 - protein, 24 aa, Plasmodium falciparum
IRDDILFLYIRYYKKYYVNYDYSI

SEQ ID NO: 3287712 - protein, 25 aa, Plasmodium falciparum
IRDDYFDLWLFLRGERHGKRTLINL

SEQ ID NO: 3287713 - protein, 58 aa, Plasmodium falciparum
IRDISRLSYIIYVVVLLIHIMMYIKCLYNLIRIISLVMFFFVFINTSLSYPNMKINNI

SEQ ID NO: 3287714 - protein, 28 aa, Plasmodium falciparum
IREMSLCFYFLLLNNILRDIKCVFFFNL

SEQ ID NO: 3287715 - protein, 46 aa, Plasmodium falciparum
IREVFRQTFLWAPLYVLLILWFSTCIISYIFINFTKSILFPNIYNV

SEQ ID NO: 3287716 - protein, 25 aa, Plasmodium falciparum
IRFKFKNEIIFIYNCLKSSLVSLIK

SEQ ID NO: 3287717 - protein, 31 aa, Plasmodium falciparum
IRFNGDKYIFLFDIFIKKYLLNVFVANILWE

SEQ ID NO: 3287718 - protein, 21 aa, Plasmodium falciparum
IRFVFFIYVHGKLNIDIFEKL

SEQ ID NO: 3287719 - protein, 17 aa, Plasmodium falciparum
IRFVLKNIYRKLYGIRK

SEQ ID NO: 3287720 - protein, 21 aa, Plasmodium falciparum
IRGLYYIFLNVYHKEYFYLFI

SEQ ID NO: 3287721 - protein, 77 aa, Plasmodium falciparum
IRGRKNILIFLLKIFLFSPLIWILIYSEYFTVVKNYNKIDNVYNIFEIRLKRSLAQVLGNTRLSSRGVRDPRTKEAL

SEQ ID NO: 3287722 - protein, 26 aa, Plasmodium falciparum
IRGTEEILPPFLLLNMDKENYITRLR

SEQ ID NO: 3287723 - protein, 31 aa, Plasmodium falciparum
IRHITYMNVLILFFLFKYEIFLRNYNIYKRC

SEQ ID NO: 3287724 - protein, 30 aa, Plasmodium falciparum
IRHIYDFNKLLLQKSFLFLSFSFYNYKNIL

SEQ ID NO: 3287725 - protein, 31 aa, Plasmodium falciparum
IRHPLNFQYIFIIVDVLIGLFLKIVFNEKKR

SEQ ID NO: 3287726 - protein, 18 aa, Plasmodium falciparum
IRIIYGHILAVKKSKKNR

SEQ ID NO: 3287727 - protein, 27 aa, Plasmodium falciparum
IRISLNILIFYMYDIILKLIKCLHYYD

SEQ ID NO: 3287728 - protein, 24 aa, Plasmodium falciparum
IRKDMILLRTGFLSCVIRYNELWL

SEQ ID NO: 3287729 - protein, 21 aa, Plasmodium falciparum
IRKEQWKCRNVCGYIVCGLKG

SEQ ID NO: 3287730 - protein, 31 aa, Plasmodium falciparum
IRKIQKKIDFSTLKVFLVCNVDINCLNNTIV

SEQ ID NO: 3287731 - protein, 17 aa, Plasmodium falciparum
IRKMLLISYADLLYRHP

SEQ ID NO: 3287732 - protein, 37 aa, Plasmodium falciparum
IRKNNLDYFYLLILLNFYSLFYILISDQKYILHEEEN

SEQ ID NO: 3287733 - protein, 18 aa, Plasmodium falciparum
IRLIQKIFYLILCNKQFN

SEQ ID NO: 3287734 - protein, 26 aa, Plasmodium falciparum
IRLKRAEAMLILGNLMLEISGISGID

SEQ ID NO: 3287735 - protein, 34 aa, Plasmodium falciparum
IRLVCKIIKFILITIYRLIKYIIVWIFNTADSVV

SEQ ID NO: 3287736 - protein, 19 aa, Plasmodium falciparum
IRMLKKKFLSSSYTPTLLA

SEQ ID NO: 3287737 - protein, 23 aa, Plasmodium falciparum
IRNGIFFNIFLLKDTYEEMFSQE

SEQ ID NO: 3287738 - protein, 19 aa, Plasmodium falciparum
IRNHSLNYAWNAYFDKNKV

SEQ ID NO: 3287739 - protein, 18 aa, Plasmodium falciparum
IRNIWFKVHCNERNKFHS

SEQ ID NO: 3287740 - protein, 22 aa, Plasmodium falciparum
IRNIYLFIKFISSKCILKMSTY

SEQ ID NO: 3287741 - protein, 27 aa, Plasmodium falciparum
IRNKDIFNIYLFKCLYLNNQWIHILNY

SEQ ID NO: 3287742 - protein, 38 aa, Plasmodium falciparum
IRNNGVCFFYIKDIVKYLFFSYFIIFNSMENLIELMNK

SEQ ID NO: 3287743 - protein, 32 aa, Plasmodium falciparum
IRNNYYLILLKIYICNILYYVINYLNFLFLNN

SEQ ID NO: 3287744 - protein, 20 aa, Plasmodium falciparum
IRNSFINILFSLPINYNHIL

SEQ ID NO: 3287745 - protein, 18 aa, Plasmodium falciparum
IRNYLYYIFDNICKIKLN

SEQ ID NO: 3287746 - protein, 27 aa, Plasmodium falciparum
IRPDYETKCPPRYPLKSKVFGTFDQKT

SEQ ID NO: 3287747 - protein, 17 aa, Plasmodium falciparum
IRPKSVNYWILAQKTIF

SEQ ID NO: 3287748 - protein, 17 aa, Plasmodium falciparum
IRQMLNTLQLLSKTYTR

SEQ ID NO: 3287749 - protein, 29 aa, Plasmodium falciparum
IRRICKVLFFYFYGYIFKYDKYQSLNNCQ

SEQ ID NO: 3287750 - protein, 20 aa, Plasmodium falciparum
IRRTPAWCDRVLMSGKLVHL

SEQ ID NO: 3287751 - protein, 25 aa, Plasmodium falciparum
IRSYDDMDFYILRNQNKLHIHDYKC

SEQ ID NO: 3287752 - protein, 21 aa, Plasmodium falciparum
IRTCSLFLYLDSVFLNIAAQF

SEQ ID NO: 3287753 - protein, 17 aa, Plasmodium falciparum
IRTGYHFKFNINKKSIH

SEQ ID NO: 3287754 - protein, 18 aa, Plasmodium falciparum
IRTKLLPFSFFMDDNDMI

SEQ ID NO: 3287755 - protein, 20 aa, Plasmodium falciparum
IRTKLYLFDMIPKSNIYKKM

SEQ ID NO: 3287756 - protein, 24 aa, Plasmodium falciparum
IRTNFIYIIITCAFGFISAIYIIH

SEQ ID NO: 3287757 - protein, 42 aa, Plasmodium falciparum
IRVNELFDMIIMFVIFLILLLSVYLIYKILFTKKMKVRRMKH

SEQ ID NO: 3287758 - protein, 26 aa, Plasmodium falciparum
IRYTNILAIFFSYDIFDELYLQIKLV

SEQ ID NO: 3287759 - protein, 18 aa, Plasmodium falciparum
ISACIFGILSAHLKNFIF

SEQ ID NO: 3287760 - protein, 27 aa, Plasmodium falciparum
ISCCFGCQKIILINKYWKNVKKTKEPN

SEQ ID NO: 3287761 - protein, 33 aa, Plasmodium falciparum
ISCVRYEFYNTFTLFIMLWYSHINDHFMKKEFT

SEQ ID NO: 3287762 - protein, 18 aa, Plasmodium falciparum
ISCYPHHLNYFNWNLNYL

SEQ ID NO: 3287763 - protein, 22 aa, Plasmodium falciparum
ISDDFFHILASRLYYSKITTYI

SEQ ID NO: 3287764 - protein, 24 aa, Plasmodium falciparum
ISDLIWRNEVIPFSLEIIKRINIS

SEQ ID NO: 3287765 - protein, 27 aa, Plasmodium falciparum
ISDMPVYVNFVYYKYSCVTNWVNLVNN

SEQ ID NO: 3287766 - protein, 26 aa, Plasmodium falciparum
ISDSLKHLIWLRSNDVNYFVINFPHF

SEQ ID NO: 3287767 - protein, 26 aa, Plasmodium falciparum
ISDSLLTKILNKFLYCLNLKTCLLKE

SEQ ID NO: 3287768 - protein, 34 aa, Plasmodium falciparum
ISDTDKYFSFYFLISIVIVFIGVSYFFYQSIVEE

SEQ ID NO: 3287769 - protein, 25 aa, Plasmodium falciparum
ISEGKNSFPYKYYTDTKSVHKIIYK

SEQ ID NO: 3287770 - protein, 21 aa, Plasmodium falciparum
ISEIWIHYLYNIISLSNEPQK

SEQ ID NO: 3287771 - protein, 24 aa, Plasmodium falciparum
ISEIYFKNIRWPSIKLVDIFYKQK

SEQ ID NO: 3287772 - protein, 24 aa, Plasmodium falciparum
ISFCNIIFFFLELSHEHFVGQSSN

SEQ ID NO: 3287773 - protein, 25 aa, Plasmodium falciparum
ISFCNIIFFFLELSHEHFVGQSSNT

SEQ ID NO: 3287774 - protein, 25 aa, Plasmodium falciparum
ISFDKIIKIRLCFKQAAFSMITLIL

SEQ ID NO: 3287775 - protein, 19 aa, Plasmodium falciparum
ISFFLPFKCLPAQHRKLLF

SEQ ID NO: 3287776 - protein, 21 aa, Plasmodium falciparum
ISFFSICCIMTLLGKLNNVCI

SEQ ID NO: 3287777 - protein, 17 aa, Plasmodium falciparum
ISFILFTLYVLPKKLVP

SEQ ID NO: 3287778 - protein, 22 aa, Plasmodium falciparum
ISFNSPYFLKDKIYYLLCIQYN

SEQ ID NO: 3287779 - protein, 24 aa, Plasmodium falciparum
ISFVSHIMLSFLYSLLNCSDDIYD

SEQ ID NO: 3287780 - protein, 18 aa, Plasmodium falciparum
ISGEGLIIYVCMLLSKFY

SEQ ID NO: 3287781 - protein, 18 aa, Plasmodium falciparum
ISGIIPCLGYVTTLFVDK

SEQ ID NO: 3287782 - protein, 22 aa, Plasmodium falciparum
ISGSVLLILTIQGLTFECLYRF

SEQ ID NO: 3287783 - protein, 35 aa, Plasmodium falciparum
ISGVTWHLFGLVKIYQSFYIHGFRKIQKKFNKMHA

SEQ ID NO: 3287784 - protein, 36 aa, Plasmodium falciparum
ISHINIYLLSLSLLFLCIFIYRLYYISINEHLFKKC

SEQ ID NO: 3287785 - protein, 26 aa, Plasmodium falciparum
ISIALFLFIFLFLNNGNFKNNFYRKD

SEQ ID NO: 3287786 - protein, 19 aa, Plasmodium falciparum
ISIFILFLSIFDYIWTIFI

SEQ ID NO: 3287787 - protein, 19 aa, Plasmodium falciparum
ISIFQMFSLFYDLGLYHMH

SEQ ID NO: 3287788 - protein, 17 aa, Plasmodium falciparum
ISIKKLYFDYLNKYMKH

SEQ ID NO: 3287789 - protein, 25 aa, Plasmodium falciparum
ISILIISLIIFIYFTGNKKKKNTNT

SEQ ID NO: 3287790 - protein, 29 aa, Plasmodium falciparum
ISIQNIFYFPYVSFNYLHILNKLLNSNYY

SEQ ID NO: 3287791 - protein, 31 aa, Plasmodium falciparum
ISISVHLFCFFLLLLFLKFSLNTVSINIYSH

SEQ ID NO: 3287792 - protein, 24 aa, Plasmodium falciparum
ISITSILLLCFIFTNLKTFMEKII

SEQ ID NO: 3287793 - protein, 17 aa, Plasmodium falciparum
ISIVHSLLKDLNPGRTC

SEQ ID NO: 3287794 - protein, 20 aa, Plasmodium falciparum
ISIVIVYYILYMDNNSNEQF

SEQ ID NO: 3287795 - protein, 23 aa, Plasmodium falciparum
ISIYINTYIRKIKKGFYFLYDVI

SEQ ID NO: 3287796 - protein, 34 aa, Plasmodium falciparum
ISKCRYFLLPIVGILYIILLNILAFEGNLSTNIQ

SEQ ID NO: 3287797 - protein, 26 aa, Plasmodium falciparum
ISKDIILQIRKCGFSSEYFKFDSSSD

SEQ ID NO: 3287798 - protein, 20 aa, Plasmodium falciparum
ISKELNFFCSNYNILLCFLL

SEQ ID NO: 3287799 - protein, 25 aa, Plasmodium falciparum
ISKKLRINWIPKKKGLRPLINLSTL

SEQ ID NO: 3287800 - protein, 41 aa, Plasmodium falciparum
ISKKVILDLLPYVQPKVDLVSFFYLFLSNYFSAYVKDENIN

SEQ ID NO: 3287801 - protein, 17 aa, Plasmodium falciparum
ISKLFKNNLLKKNFRTY

SEQ ID NO: 3287802 - protein, 24 aa, Plasmodium falciparum
ISKNKFRMFMLKSYCFKYVASLSQ

SEQ ID NO: 3287803 - protein, 29 aa, Plasmodium falciparum
ISKNLIIKRLKGYRLSYSEYKLLIRTMND

SEQ ID NO: 3287804 - protein, 26 aa, Plasmodium falciparum
ISKNNNIIYLLYKRGNEGLFLSGLKP

SEQ ID NO: 3287805 - protein, 20 aa, Plasmodium falciparum
ISKPYYLLEVISKDALRNLS

SEQ ID NO: 3287806 - protein, 21 aa, Plasmodium falciparum
ISKYIIYIILLFNHIKKENNT

SEQ ID NO: 3287807 - protein, 25 aa, Plasmodium falciparum
ISLDLLFYRTYAFLEYPNYVKLNLS

SEQ ID NO: 3287808 - protein, 29 aa, Plasmodium falciparum
ISLIIYNIYKYYYIQYIKNIFYRSDEINR

SEQ ID NO: 3287809 - protein, 24 aa, Plasmodium falciparum
ISLKMFIHNFIKTCVIPYISMLTN

SEQ ID NO: 3287810 - protein, 18 aa, Plasmodium falciparum
ISLLVTVCIIIILSIIYL

SEQ ID NO: 3287811 - protein, 38 aa, Plasmodium falciparum
ISLMIIFIWIYILMLIFYMIIWRKSPLLYLFKIEIYII

SEQ ID NO: 3287812 - protein, 26 aa, Plasmodium falciparum
ISLNILYHFFLLIPLHNHKNVIECVN

SEQ ID NO: 3287813 - protein, 17 aa, Plasmodium falciparum
ISLSIEPQIFLLRWIRL

SEQ ID NO: 3287814 - protein, 33 aa, Plasmodium falciparum
ISLSNTMVILFFFYKIYIILKKLEIRNVNLFDN

SEQ ID NO: 3287815 - protein, 20 aa, Plasmodium falciparum
ISLTHKIYYTLLGWSIIYNT

SEQ ID NO: 3287816 - protein, 29 aa, Plasmodium falciparum
ISLVHVYYNLVYYLLLYVSQNIKFYFACF

SEQ ID NO: 3287817 - protein, 27 aa, Plasmodium falciparum
ISLVQIRGSIPLFWKQHSMSSHVNIQR

SEQ ID NO: 3287818 - protein, 27 aa, Plasmodium falciparum
ISMKNSNIHLFWTSEKLKNFVENEEEE

SEQ ID NO: 3287819 - protein, 27 aa, Plasmodium falciparum
ISMLGYALLPLVILSLISIIINLRSKK

SEQ ID NO: 3287820 - protein, 25 aa, Plasmodium falciparum
ISMLLKSSFSSFILESIGWTYENVS

SEQ ID NO: 3287821 - protein, 33 aa, Plasmodium falciparum
ISMNILFYLHISFWIYFIYYRMLVNNKFNVFSK

SEQ ID NO: 3287822 - protein, 28 aa, Plasmodium falciparum
ISMQNLYQILFCIHLFILYIENELKMKK

SEQ ID NO: 3287823 - protein, 30 aa, Plasmodium falciparum
ISNILSHVFFYIFSCYYIDKFILLDDHYLL

SEQ ID NO: 3287824 - protein, 25 aa, Plasmodium falciparum
ISNKLFDTLLPRNVFKKPKPFKKNE

SEQ ID NO: 3287825 - protein, 41 aa, Plasmodium falciparum
ISNLYRDRLIKFPSFLSNFSFIYFLPWPYEALVNVSNKFLS

SEQ ID NO: 3287826 - protein, 23 aa, Plasmodium falciparum
ISNMYWFTFVMTLGLTFLFSAMP

SEQ ID NO: 3287827 - protein, 25 aa, Plasmodium falciparum
ISNVYFFFIGILQVIPQFTATNGIP

SEQ ID NO: 3287828 - protein, 36 aa, Plasmodium falciparum
ISNYNITNVCMFLLLPEIFCKYYKKGDKKKKKNKNV

SEQ ID NO: 3287829 - protein, 35 aa, Plasmodium falciparum
ISNYYFKKFYFNKYDYIYITYFKNIFLYNKKGFFD

SEQ ID NO: 3287830 - protein, 20 aa, Plasmodium falciparum
ISPKFIPKLRLMGFRILVER

SEQ ID NO: 3287831 - protein, 17 aa, Plasmodium falciparum
ISPKWVLKYLDDDLSNY

SEQ ID NO: 3287832 - protein, 23 aa, Plasmodium falciparum
ISPLWIFYMLYLSKTLTARIFTS

SEQ ID NO: 3287833 - protein, 29 aa, Plasmodium falciparum
ISPMSEYIWWSWLLLQGVIVFGTLFHSNY

SEQ ID NO: 3287834 - protein, 28 aa, Plasmodium falciparum
ISPNLIIHFIVHFFKHYTIFKNVIKNSN

SEQ ID NO: 3287835 - protein, 34 aa, Plasmodium falciparum
ISPSEFLEHFYPYDNFIFFLKVLNTKSNEEYMIY

SEQ ID NO: 3287836 - protein, 23 aa, Plasmodium falciparum
ISPSLFCQIFFLLKKLKCDARNQ

SEQ ID NO: 3287837 - protein, 26 aa, Plasmodium falciparum
ISQACAKCFFSCHRFVKWIDNQKLEL

SEQ ID NO: 3287838 - protein, 17 aa, Plasmodium falciparum
ISQFFDALLCYYDFRLR

SEQ ID NO: 3287839 - protein, 26 aa, Plasmodium falciparum
ISQLSLLLVILLIYSNQIFLHGFVNI

SEQ ID NO: 3287840 - protein, 19 aa, Plasmodium falciparum
ISQNMPIYINCISSIIVNI

SEQ ID NO: 3287841 - protein, 28 aa, Plasmodium falciparum
ISQYSKIIYIFIFIINHQEIISMLPKID

SEQ ID NO: 3287842 - protein, 36 aa, Plasmodium falciparum
ISRKKIKAFYEHMYKFLIYRILLVENDTLNECVTSI

SEQ ID NO: 3287843 - protein, 24 aa, Plasmodium falciparum
ISRNICSPYKWKIKIIKVVGIKNN

SEQ ID NO: 3287844 - protein, 25 aa, Plasmodium falciparum
ISRNRYWGTPIPIWCDEKMETVICV

SEQ ID NO: 3287845 - protein, 18 aa, Plasmodium falciparum
ISSAFTLIICILYMIYFY

SEQ ID NO: 3287846 - protein, 27 aa, Plasmodium falciparum
ISSEVFFFSPYFLPTVLYNLFEFLRTL

SEQ ID NO: 3287847 - protein, 20 aa, Plasmodium falciparum
ISSIFQYFFFLNNNDSNMLI

SEQ ID NO: 3287848 - protein, 22 aa, Plasmodium falciparum
ISSIISVLFLHPIWLIKTKIEC

SEQ ID NO: 3287849 - protein, 31 aa, Plasmodium falciparum
ISSISLPLPFENFFLFFKNFYSINNNYINNM

SEQ ID NO: 3287850 - protein, 18 aa, Plasmodium falciparum
ISSLYINILILYYIITQK

SEQ ID NO: 3287851 - protein, 23 aa, Plasmodium falciparum
ISSLYLAFYILTFDRNLSAPKDQ

SEQ ID NO: 3287852 - protein, 22 aa, Plasmodium falciparum
ISSQLSYLRINLQNYAKMNEQE

SEQ ID NO: 3287853 - protein, 29 aa, Plasmodium falciparum
ISSTEEFLFIIWSILLNHVYKYEIMCFSN

SEQ ID NO: 3287854 - protein, 24 aa, Plasmodium falciparum
ISSYDIEFNYIYGRKLYSTESLNR

SEQ ID NO: 3287855 - protein, 29 aa, Plasmodium falciparum
ISSYYQKYFLKIFIKLLYWDEQQTMNNLH

SEQ ID NO: 3287856 - protein, 24 aa, Plasmodium falciparum
ISTANMEYILKLTLEKNKAQEADV

SEQ ID NO: 3287857 - protein, 22 aa, Plasmodium falciparum
ISTFIETFSYVNRVSWKDQNGV

SEQ ID NO: 3287858 - protein, 31 aa, Plasmodium falciparum
ISTQKQLYYFEYIYIMNKNTLNLLSYNIQKT

SEQ ID NO: 3287859 - protein, 25 aa, Plasmodium falciparum
ISTTAILFWVFFAEMVFNYNTFNGR

SEQ ID NO: 3287860 - protein, 25 aa, Plasmodium falciparum
ISTYFIKYFAFFKNKVKKIIIDNER

SEQ ID NO: 3287861 - protein, 17 aa, Plasmodium falciparum
ISTYILYLLIKNYKIEY

SEQ ID NO: 3287862 - protein, 26 aa, Plasmodium falciparum
ISVAFFFLHFYLLSEHFLILFPYQLI

SEQ ID NO: 3287863 - protein, 24 aa, Plasmodium falciparum
ISVIINKLFLFNKIIYMMSQMCYP

SEQ ID NO: 3287864 - protein, 21 aa, Plasmodium falciparum
ISVLFMILSFFTLPMIVITPR

SEQ ID NO: 3287865 - protein, 27 aa, Plasmodium falciparum
ISWNSYDLFILFFKSLILFDSSNVSSL

SEQ ID NO: 3287866 - protein, 27 aa, Plasmodium falciparum
ISYEYVIMSILFYFYNITTINYEHINE

SEQ ID NO: 3287867 - protein, 27 aa, Plasmodium falciparum
ISYKENFFHVFLFLQIKKNIYQAIENL

SEQ ID NO: 3287868 - protein, 28 aa, Plasmodium falciparum
ISYLITTFLFFCVYITLIILLLYSEKTE

SEQ ID NO: 3287869 - protein, 33 aa, Plasmodium falciparum
ISYTWNIYQILFLYYQLKYDIHIYIKCMKQLLN

SEQ ID NO: 3287870 - protein, 18 aa, Plasmodium falciparum
ISYYLKYMKDIPLKYREV

SEQ ID NO: 3287871 - protein, 27 aa, Plasmodium falciparum
ITAEKLLNYPLIPVVIQRDIFKYFLQK

SEQ ID NO: 3287872 - protein, 29 aa, Plasmodium falciparum
ITAKAYKLLMYAFSLYNSLIQNGIKCECR

SEQ ID NO: 3287873 - protein, 20 aa, Plasmodium falciparum
ITAVIPYYGYARQDRKLSSR

SEQ ID NO: 3287874 - protein, 18 aa, Plasmodium falciparum
ITCAAIETHFAWHKYKKD

SEQ ID NO: 3287875 - protein, 28 aa, Plasmodium falciparum
ITCAAIETYFAWLRYKKINTEADKELKE

SEQ ID NO: 3287876 - protein, 32 aa, Plasmodium falciparum
ITCRSFIFMSLSLCVISLFYISLLNIHEGNIV

SEQ ID NO: 3287877 - protein, 18 aa, Plasmodium falciparum
ITDDIYLYDLTQNKWKKL

SEQ ID NO: 3287878 - protein, 26 aa, Plasmodium falciparum
ITDFYSGWLLIPKYYYENKGLILLGE

SEQ ID NO: 3287879 - protein, 26 aa, Plasmodium falciparum
ITDINIIFHLISLVFYYCLCYNKKNE

SEQ ID NO: 3287880 - protein, 25 aa, Plasmodium falciparum
ITDKMLYLLMLMFNHHIAKKKQRKN

SEQ ID NO: 3287881 - protein, 23 aa, Plasmodium falciparum
ITEPIRIVITILITPYIARAIKF

SEQ ID NO: 3287882 - protein, 25 aa, Plasmodium falciparum
ITFDNSITFYYYIKEFLLLSNSKNM

SEQ ID NO: 3287883 - protein, 25 aa, Plasmodium falciparum
ITFEEFWNFLVSNLPLNNYLYKEDI

SEQ ID NO: 3287884 - protein, 19 aa, Plasmodium falciparum
ITFFLMFIEVLRRSIWMCF

SEQ ID NO: 3287885 - protein, 18 aa, Plasmodium falciparum
ITFLVFIIKYIHCDIIIV

SEQ ID NO: 3287886 - protein, 17 aa, Plasmodium falciparum
ITFMYISRFVNGLCQAI

SEQ ID NO: 3287887 - protein, 25 aa, Plasmodium falciparum
ITFYDFYDRLLILNYFHISHKHRLV

SEQ ID NO: 3287888 - protein, 28 aa, Plasmodium falciparum
ITGNSYLFYFLLIAPLMFCFDDKILLRL

SEQ ID NO: 3287889 - protein, 28 aa, Plasmodium falciparum
ITGPCNVNLSIFLVPHIYIDVETKYNNI

SEQ ID NO: 3287890 - protein, 26 aa, Plasmodium falciparum
ITHDDIYLLYFHMCIYNSKKATNVCI

SEQ ID NO: 3287891 - protein, 26 aa, Plasmodium falciparum
ITHIKGFIPIVLSYLYMYPNNIIMYH

SEQ ID NO: 3287892 - protein, 33 aa, Plasmodium falciparum
ITIDAYSNNLILYCFLYLILKHINKMYLYSFMN

SEQ ID NO: 3287893 - protein, 23 aa, Plasmodium falciparum
ITILIRIILMLSFIYCIRSFFIY

SEQ ID NO: 3287894 - protein, 23 aa, Plasmodium falciparum
ITILPFFHRIFSELIYGYCSSLN

SEQ ID NO: 3287895 - protein, 17 aa, Plasmodium falciparum
ITILVYILLFYINDFYI

SEQ ID NO: 3287896 - protein, 27 aa, Plasmodium falciparum
ITIRKKLLYILYFLINDKNFEQIVYSI

SEQ ID NO: 3287897 - protein, 18 aa, Plasmodium falciparum
ITIYEIKCQLRFASLGDW

SEQ ID NO: 3287898 - protein, 35 aa, Plasmodium falciparum
ITKDSSTYRLLLKNLGAWIGIITIGRNKPLMSKYM

SEQ ID NO: 3287899 - protein, 19 aa, Plasmodium falciparum
ITKEYLDYYIRSFNTFNRF

SEQ ID NO: 3287900 - protein, 26 aa, Plasmodium falciparum
ITKGDYIFVSFQLINPLYTKIECQGT

SEQ ID NO: 3287901 - protein, 18 aa, Plasmodium falciparum
ITKNFDIRFCDFGKSAPV

SEQ ID NO: 3287902 - protein, 17 aa, Plasmodium falciparum
ITKYFFWKEWVLYIFFN

SEQ ID NO: 3287903 - protein, 27 aa, Plasmodium falciparum
ITLMEFYFAIYIIQFIESKKLSILINL

SEQ ID NO: 3287904 - protein, 26 aa, Plasmodium falciparum
ITLTFFPRYLLCTYFPYVLIAILITN

SEQ ID NO: 3287905 - protein, 23 aa, Plasmodium falciparum
ITLTIYNFLMFIQQKKKKQKAQD

SEQ ID NO: 3287906 - protein, 17 aa, Plasmodium falciparum
ITLTYCLCKFPIILIDQ

SEQ ID NO: 3287907 - protein, 20 aa, Plasmodium falciparum
ITMAYYDFLLNKKGKLKKRN

SEQ ID NO: 3287908 - protein, 18 aa, Plasmodium falciparum
ITMQYDYAYLEATKEVLY

SEQ ID NO: 3287909 - protein, 18 aa, Plasmodium falciparum
ITNFRFMLVILLDYILKC

SEQ ID NO: 3287910 - protein, 24 aa, Plasmodium falciparum
ITNKINLFHKWLDRHRDMCEKWEN

SEQ ID NO: 3287911 - protein, 25 aa, Plasmodium falciparum
ITNKINLFHKWLYRHRDMCEKWENH

SEQ ID NO: 3287912 - protein, 29 aa, Plasmodium falciparum
ITNKTIYIILLTFLFYNYSKFYYKKQKKK

SEQ ID NO: 3287913 - protein, 23 aa, Plasmodium falciparum
ITNMMIYLYIRKLLNINDLANMI

SEQ ID NO: 3287914 - protein, 24 aa, Plasmodium falciparum
ITNQLELFHKWLDRHRHMCDQWNK

SEQ ID NO: 3287915 - protein, 24 aa, Plasmodium falciparum
ITNQLNLFHKWLDRHRNMCEKWEN

SEQ ID NO: 3287916 - protein, 26 aa, Plasmodium falciparum
ITNVKIYYHILKKIPLSYIIAQLHIK

SEQ ID NO: 3287917 - protein, 36 aa, Plasmodium falciparum
ITNVLLTLHNIYFTLYMCHLMRVAIFSNKLNQFITT

SEQ ID NO: 3287918 - protein, 24 aa, Plasmodium falciparum
ITPFIYYVLFLFLKLINIDHPVCV

SEQ ID NO: 3287919 - protein, 19 aa, Plasmodium falciparum
ITPSTWWEKNKEKIWYVMM

SEQ ID NO: 3287920 - protein, 35 aa, Plasmodium falciparum
ITRSCGFLVLIFFLSFIFLFIYFYKNRDKINILLF

SEQ ID NO: 3287921 - protein, 40 aa, Plasmodium falciparum
ITSFTFFNFMFLMNILGLFLSFFLKWELYGFIYSNLICMI

SEQ ID NO: 3287922 - protein, 26 aa, Plasmodium falciparum
ITSLELFCFLNFTLATSILLIIDTDI

SEQ ID NO: 3287923 - protein, 18 aa, Plasmodium falciparum
ITSLLYNSKLMWTNKVTL

SEQ ID NO: 3287924 - protein, 32 aa, Plasmodium falciparum
ITSLSIFLLTLLGIWVYKTLIINKEKKKKKNQ

SEQ ID NO: 3287925 - protein, 24 aa, Plasmodium falciparum
ITTFFYLISLIIYAPLLWLVPVKE

SEQ ID NO: 3287926 - protein, 17 aa, Plasmodium falciparum
ITTIRNIQKIYYDNIYA

SEQ ID NO: 3287927 - protein, 34 aa, Plasmodium falciparum
ITTITFFKQIIYTQIYLLIYILTKIIIMWKKLMM

SEQ ID NO: 3287928 - protein, 19 aa, Plasmodium falciparum
ITTYFLVMRISWTHAFTTG

SEQ ID NO: 3287929 - protein, 20 aa, Plasmodium falciparum
ITTYFLVMRISWTHAFTTGQ

SEQ ID NO: 3287930 - protein, 24 aa, Plasmodium falciparum
ITVNQKYLNFINSFFLMITEFLYG

SEQ ID NO: 3287931 - protein, 28 aa, Plasmodium falciparum
ITVQMASRFFFLIKNFEQFLSFRSVDEE

SEQ ID NO: 3287932 - protein, 26 aa, Plasmodium falciparum
ITVVPQFIISNKLNFPLLIKQYQNDQ

SEQ ID NO: 3287933 - protein, 22 aa, Plasmodium falciparum
ITWAVTIYIFFGMINVSSYNEG

SEQ ID NO: 3287934 - protein, 32 aa, Plasmodium falciparum
ITYAVLKTFKYYLSLISFFHIIHTIFLIFVAV

SEQ ID NO: 3287935 - protein, 24 aa, Plasmodium falciparum
ITYEDIPIFLGLINDLFPNVNCNI

SEQ ID NO: 3287936 - protein, 20 aa, Plasmodium falciparum
ITYILKYLSKILFSLSLQKF

SEQ ID NO: 3287937 - protein, 32 aa, Plasmodium falciparum
ITYIWHIDICILLFLLYVIIPIEFINTIFDSN

SEQ ID NO: 3287938 - protein, 24 aa, Plasmodium falciparum
ITYKKFICKDCYRCIYCCESIYDY

SEQ ID NO: 3287939 - protein, 29 aa, Plasmodium falciparum
ITYSSIICLLLFLLLSGITYMHYFIKTKK

SEQ ID NO: 3287940 - protein, 33 aa, Plasmodium falciparum
IVAILVIVLVMIIIYLFLRYRKNKKMKKKLQYI

SEQ ID NO: 3287941 - protein, 29 aa, Plasmodium falciparum
IVAIVIIVLIMVIIYKILRYRRKKKMKKK

SEQ ID NO: 3287942 - protein, 33 aa, Plasmodium falciparum
IVAIVVIILIMVIIYLILRYRRKKKMKKKLQYI

SEQ ID NO: 3287943 - protein, 32 aa, Plasmodium falciparum
IVAIVVIILVMSIIYLILRYRRKKKIHKKLQY

SEQ ID NO: 3287944 - protein, 33 aa, Plasmodium falciparum
IVAIVVIVLIMVIIYLILRYRRKKKMKKKLQYI

SEQ ID NO: 3287945 - protein, 79 aa, Plasmodium falciparum
IVANTLYFVSQLAIPLTVLLLLNQLIFIFSLILSFFILKRKYNIHHIISVIIVLIGFLFFYIPFVYKDNIKIKKESCVN

SEQ ID NO: 3287946 - protein, 55 aa, Plasmodium falciparum
IVCYLGIAILIFIISLVVYFKKFHASFLFLIILALFMVFGYQQISIYGKTFFRHV

SEQ ID NO: 3287947 - protein, 32 aa, Plasmodium falciparum
IVDDFIKTLINDNINLLYLIIEQVAIEKSSIE

SEQ ID NO: 3287948 - protein, 34 aa, Plasmodium falciparum
IVDKRSDVFLDYLKIYNFKQICIIFNLINKKKER

SEQ ID NO: 3287949 - protein, 24 aa, Plasmodium falciparum
IVEEVIYEEFLEEIMPEELIEEMK

SEQ ID NO: 3287950 - protein, 27 aa, Plasmodium falciparum
IVEFQLFNQYIIYPPLKRLTKKELKYI

SEQ ID NO: 3287951 - protein, 24 aa, Plasmodium falciparum
IVEGAVKCQCSHLYFGDGVFCVKN

SEQ ID NO: 3287952 - protein, 26 aa, Plasmodium falciparum
IVFNAWLLIYIYLLKNPPFLQMDINT

SEQ ID NO: 3287953 - protein, 17 aa, Plasmodium falciparum
IVFRFNFNLKDIIFKNV

SEQ ID NO: 3287954 - protein, 18 aa, Plasmodium falciparum
IVGFLPLSFLTIIYDTIY

SEQ ID NO: 3287955 - protein, 47 aa, Plasmodium falciparum
IVGGLDIFLYNYYNYICNMYINPYFYINTYYFEKYILKKYYKRENNL

SEQ ID NO: 3287956 - protein, 19 aa, Plasmodium falciparum
IVGKYNLIYIFYSIEFICL

SEQ ID NO: 3287957 - protein, 29 aa, Plasmodium falciparum
IVGRLVAFIFFWFFGVDYWIFPNLFDEEC

SEQ ID NO: 3287958 - protein, 26 aa, Plasmodium falciparum
IVGTSFLFISPYLCAKAEGINGFFKG

SEQ ID NO: 3287959 - protein, 17 aa, Plasmodium falciparum
IVGVLLSLPIMIALACA

SEQ ID NO: 3287960 - protein, 17 aa, Plasmodium falciparum
IVHDYMFIFLQHIIINK

SEQ ID NO: 3287961 - protein, 20 aa, Plasmodium falciparum
IVHFFSLCPLLFVKNKIHAD

SEQ ID NO: 3287962 - protein, 52 aa, Plasmodium falciparum
IVIFITFFYILLNILHDNLFMIKLVNNYSYSYLWNIVKLKNRKILSELSDVQ

SEQ ID NO: 3287963 - protein, 30 aa, Plasmodium falciparum
IVIKTITLLKLKFVDLIKSIPVFKNVMRTV

SEQ ID NO: 3287964 - protein, 26 aa, Plasmodium falciparum
IVIMKKLIICKIFIDILKKFKRQKYR

SEQ ID NO: 3287965 - protein, 19 aa, Plasmodium falciparum
IVIYKYYYTNFFYFYNLCV

SEQ ID NO: 3287966 - protein, 27 aa, Plasmodium falciparum
IVKNDIYLFLQILKNIFYELYTYNQSL

SEQ ID NO: 3287967 - protein, 26 aa, Plasmodium falciparum
IVKNVSILYIHFLKLAYRNTVKKILK

SEQ ID NO: 3287968 - protein, 24 aa, Plasmodium falciparum
IVKYHCCIILSKICLLCIKNQLNR

SEQ ID NO: 3287969 - protein, 19 aa, Plasmodium falciparum
IVLCLLDMLEKKATPCLSS

SEQ ID NO: 3287970 - protein, 24 aa, Plasmodium falciparum
IVLCYIWILLYLFFIILSIYLEYQ

SEQ ID NO: 3287971 - protein, 22 aa, Plasmodium falciparum
IVLEYIQYGTLFDILHKYKINM

SEQ ID NO: 3287972 - protein, 18 aa, Plasmodium falciparum
IVLHILIYLAEFSHEQES

SEQ ID NO: 3287973 - protein, 31 aa, Plasmodium falciparum
IVLICIAVILLIIYLILRYRRKKQMNKKLKY

SEQ ID NO: 3287974 - protein, 32 aa, Plasmodium falciparum
IVLILVIVALIMLYIWFYRRRKSSWKYAYKNH

SEQ ID NO: 3287975 - protein, 17 aa, Plasmodium falciparum
IVLLDSLSSDMGPNISI

SEQ ID NO: 3287976 - protein, 25 aa, Plasmodium falciparum
IVLLVFIYLVYLFLADLYIFIYMLL

SEQ ID NO: 3287977 - protein, 39 aa, Plasmodium falciparum
IVLMDSFFFFHNYIVTMYPFGGYPLMVWCKEKEKFVLGN

SEQ ID NO: 3287978 - protein, 23 aa, Plasmodium falciparum
IVLNYIVIYIFFLNKYNNDSKRN

SEQ ID NO: 3287979 - protein, 24 aa, Plasmodium falciparum
IVLTNRLFFGWPNLSNLLFREDTY

SEQ ID NO: 3287980 - protein, 28 aa, Plasmodium falciparum
IVLVVVLIVLYIWLYRRRKKSWKHECKK

SEQ ID NO: 3287981 - protein, 20 aa, Plasmodium falciparum
IVMCMFMVIYFFKNKNDHKN

SEQ ID NO: 3287982 - protein, 31 aa, Plasmodium falciparum
IVNHKYPVALLYYIYPYLDSSTLVILMDNLN

SEQ ID NO: 3287983 - protein, 17 aa, Plasmodium falciparum
IVNIAIVFLFLTIIHYI

SEQ ID NO: 3287984 - protein, 32 aa, Plasmodium falciparum
IVNIEVFNVWIYCFHLLFINIKKKYIHVYNKL

SEQ ID NO: 3287985 - protein, 30 aa, Plasmodium falciparum
IVNLKVVKFLIYKFKYWKNIFKRYIINGLS

SEQ ID NO: 3287986 - protein, 24 aa, Plasmodium falciparum
IVNQINLFHKWLDRHKNMCEQWDK

SEQ ID NO: 3287987 - protein, 27 aa, Plasmodium falciparum
IVNSFPNYIPPWLPNILISVAKLSNSS

SEQ ID NO: 3287988 - protein, 23 aa, Plasmodium falciparum
IVQMIFFNFINSPNFFFSFSVFY

SEQ ID NO: 3287989 - protein, 31 aa, Plasmodium falciparum
IVSHECFHLWVQSLLIDTIKWETKLKKCINN

SEQ ID NO: 3287990 - protein, 29 aa, Plasmodium falciparum
IVSKKEELFFYFIKSLLKNNFICLSYEEE

SEQ ID NO: 3287991 - protein, 28 aa, Plasmodium falciparum
IVSLQRIFICMQLYSLVLCAKKKKDHFE

SEQ ID NO: 3287992 - protein, 38 aa, Plasmodium falciparum
IVSLYATYHKLIYPHLLKFYLDHFFLSSYSIVKKEIIH

SEQ ID NO: 3287993 - protein, 23 aa, Plasmodium falciparum
IVSRIDVQYYKHSNYKFLLTQID

SEQ ID NO: 3287994 - protein, 26 aa, Plasmodium falciparum
IVSTTLLLIIIMIACVYWLASTPPPG

SEQ ID NO: 3287995 - protein, 25 aa, Plasmodium falciparum
IVTCFLFFHIWLLINAMTTIEFCEK

SEQ ID NO: 3287996 - protein, 20 aa, Plasmodium falciparum
IVTCVLYYLNIYRKNERLII

SEQ ID NO: 3287997 - protein, 28 aa, Plasmodium falciparum
IVTIFCYYKYYHLYFLKGHIEEIKQEIK

SEQ ID NO: 3287998 - protein, 27 aa, Plasmodium falciparum
IVTLFEFLIMYIILRIVIFFTKMKCST

SEQ ID NO: 3287999 - protein, 26 aa, Plasmodium falciparum
IVVALIIIIVCVIALIGLICFLVENK

SEQ ID NO: 3288000 - protein, 28 aa, Plasmodium falciparum
IVVIALVMLIIYLILRYRRKKKNDEKTA

SEQ ID NO: 3288001 - protein, 30 aa, Plasmodium falciparum
IVVITILIVGVFVYMIIRTKKKKLKLDNMF

SEQ ID NO: 3288002 - protein, 29 aa, Plasmodium falciparum
IVVIVLVMIIIYLILRYRRKKKMKKKLQY

SEQ ID NO: 3288003 - protein, 28 aa, Plasmodium falciparum
IVVIVLVMLIIYFILHYRRKKKMKKKLQ

SEQ ID NO: 3288004 - protein, 29 aa, Plasmodium falciparum
IVVKNNLSYTLFLFLSKELDMEGRYLLLS

SEQ ID NO: 3288005 - protein, 27 aa, Plasmodium falciparum
IVVNPLIIFVMYLFSNLFNENYYKDVF

SEQ ID NO: 3288006 - protein, 18 aa, Plasmodium falciparum
IVYECNNFFVFQFEFKEK

SEQ ID NO: 3288007 - protein, 35 aa, Plasmodium falciparum
IVYGLLFSIYLYHSWLKRILFVFLSMCILPICYYI

SEQ ID NO: 3288008 - protein, 33 aa, Plasmodium falciparum
IWEKKYDTILDFLYDFMLIIHNAKMVHMPNTPI

SEQ ID NO: 3288009 - protein, 25 aa, Plasmodium falciparum
IWFKNIIHSILLEKIILILKEIDDN

SEQ ID NO: 3288010 - protein, 21 aa, Plasmodium falciparum
IWKGFNIFTFNLFNVDYNDKI

SEQ ID NO: 3288011 - protein, 19 aa, Plasmodium falciparum
IWLIGFLIVFHHWCNILAE

SEQ ID NO: 3288012 - protein, 25 aa, Plasmodium falciparum
IWNAKKMFFFIYLKMYINKSKFIFQ

SEQ ID NO: 3288013 - protein, 17 aa, Plasmodium falciparum
IWNAMTCNAPYDAKIYI

SEQ ID NO: 3288014 - protein, 37 aa, Plasmodium falciparum
IWNNIYNLLLIFQQKCPFFFLPFSKNYNKYFKHYQKK

SEQ ID NO: 3288015 - protein, 27 aa, Plasmodium falciparum
IWSAACCIVEIFSSKYPYYNLTKNVKI

SEQ ID NO: 3288016 - protein, 31 aa, Plasmodium falciparum
IWSVFVFLLIIIIVGTWFLATWLWPHRDTYN

SEQ ID NO: 3288017 - protein, 31 aa, Plasmodium falciparum
IYAHILREKFIFIIIPMLNIDGVILGNNRYC

SEQ ID NO: 3288018 - protein, 28 aa, Plasmodium falciparum
IYALCFLSLLLLDLFNKGKQKSSHRDQL

SEQ ID NO: 3288019 - protein, 25 aa, Plasmodium falciparum
IYCGKKYYFFEQYIQKKFYNSNTTN

SEQ ID NO: 3288020 - protein, 17 aa, Plasmodium falciparum
IYCLKIFANIQSFYPNF

SEQ ID NO: 3288021 - protein, 25 aa, Plasmodium falciparum
IYCSKYFYMFDLSKVMFINTHLYSS

SEQ ID NO: 3288022 - protein, 31 aa, Plasmodium falciparum
IYDEICTEAFVFFLCILNKKNMVFKKNILVN

SEQ ID NO: 3288023 - protein, 27 aa, Plasmodium falciparum
IYDEIKKIWFYLLEKNIENMNVYVPFG

SEQ ID NO: 3288024 - protein, 18 aa, Plasmodium falciparum
IYDIYIYTHIKLLKNIFK

SEQ ID NO: 3288025 - protein, 29 aa, Plasmodium falciparum
IYDLLHLCMYIYMLYMYNVTTSFKGIRGP

SEQ ID NO: 3288026 - protein, 20 aa, Plasmodium falciparum
IYDLLKYMKNKNFLKLCIFM

SEQ ID NO: 3288027 - protein, 24 aa, Plasmodium falciparum
IYDNKYHLYFFSLEFDLYSTQNKI

SEQ ID NO: 3288028 - protein, 23 aa, Plasmodium falciparum
IYDNLHIFVYTLRYMIKKIKQMI

SEQ ID NO: 3288029 - protein, 23 aa, Plasmodium falciparum
IYDNYYEIIIYMYNILKDMNTYI

SEQ ID NO: 3288030 - protein, 24 aa, Plasmodium falciparum
IYDTKYMNLFIKKIMILLKNDLTT

SEQ ID NO: 3288031 - protein, 41 aa, Plasmodium falciparum
IYEGNVIFCMILSIYLYIIQNWIHFYKLNKNKKYPFKFPEI

SEQ ID NO: 3288032 - protein, 26 aa, Plasmodium falciparum
IYEIKNLFRILILSKLHIGVYNLLYF

SEQ ID NO: 3288033 - protein, 18 aa, Plasmodium falciparum
IYEKIFLKDNLNKGLEEI

SEQ ID NO: 3288034 - protein, 18 aa, Plasmodium falciparum
IYELTPYPFLSKGRLHKG

SEQ ID NO: 3288035 - protein, 26 aa, Plasmodium falciparum
IYESEKYIILLLEKNPFDIKALHVLI

SEQ ID NO: 3288036 - protein, 31 aa, Plasmodium falciparum
IYEYDYIINPHFFFLCIFSLYSYNLSKTRFY

SEQ ID NO: 3288037 - protein, 27 aa, Plasmodium falciparum
IYFEILLLLFFLNYKIHISIYVNIAVV

SEQ ID NO: 3288038 - protein, 18 aa, Plasmodium falciparum
IYFILKIFNYNYINIYLN

SEQ ID NO: 3288039 - protein, 18 aa, Plasmodium falciparum
IYFLCFLSFLYGIRKFNN

SEQ ID NO: 3288040 - protein, 24 aa, Plasmodium falciparum
IYFNIINIIYFFSFFFMYVYINSR

SEQ ID NO: 3288041 - protein, 18 aa, Plasmodium falciparum
IYFNKILKRLQSLDDMYK

SEQ ID NO: 3288042 - protein, 32 aa, Plasmodium falciparum
IYFQIEKYKYSAITYMLLCNILNRIDYDEYKV

SEQ ID NO: 3288043 - protein, 27 aa, Plasmodium falciparum
IYFSRLMWGAIIFVIMFILVSIIGIYL

SEQ ID NO: 3288044 - protein, 19 aa, Plasmodium falciparum
IYFSYYYLNSLFNNNFDSL

SEQ ID NO: 3288045 - protein, 20 aa, Plasmodium falciparum
IYFTDLCLLKLKKLVNNKKI

SEQ ID NO: 3288046 - protein, 31 aa, Plasmodium falciparum
IYGKSKILFKNFLPSFNLLKLIILCDKKKEK

SEQ ID NO: 3288047 - protein, 18 aa, Plasmodium falciparum
IYGMNFYDYNFYNEKYKN

SEQ ID NO: 3288048 - protein, 27 aa, Plasmodium falciparum
IYGRAALLMFLQFYESWIVFIKTFLTS

SEQ ID NO: 3288049 - protein, 19 aa, Plasmodium falciparum
IYGSPFFPIIINMHEILNI

SEQ ID NO: 3288050 - protein, 19 aa, Plasmodium falciparum
IYHHMLLKKNYFLRKTKNV

SEQ ID NO: 3288051 - protein, 19 aa, Plasmodium falciparum
IYHICLLSVVLLMFLILRY

SEQ ID NO: 3288052 - protein, 25 aa, Plasmodium falciparum
IYHLYNSMILFHRLIEFIDRPIFDK

SEQ ID NO: 3288053 - protein, 21 aa, Plasmodium falciparum
IYICKYIININNLIPIMNFIP

SEQ ID NO: 3288054 - protein, 30 aa, Plasmodium falciparum
IYIDKIKNIIEYRKWRAKSKYRSPAKQPEE

SEQ ID NO: 3288055 - protein, 24 aa, Plasmodium falciparum
IYIDLLYHIIYKNRKYIYKKLNEK

SEQ ID NO: 3288056 - protein, 29 aa, Plasmodium falciparum
IYIEASMFYLTPDLFLTQINYSELNAVLN

SEQ ID NO: 3288057 - protein, 18 aa, Plasmodium falciparum
IYIFIILRTALTIPLMIY

SEQ ID NO: 3288058 - protein, 39 aa, Plasmodium falciparum
IYIIYENYIYHLCKKRYFFNFLYNIFLHKYKNDKIDGKK

SEQ ID NO: 3288059 - protein, 19 aa, Plasmodium falciparum
IYIKSFFFSTKVTYDDMFC

SEQ ID NO: 3288060 - protein, 21 aa, Plasmodium falciparum
IYINMFLNKYYTYINYKDMGL

SEQ ID NO: 3288061 - protein, 24 aa, Plasmodium falciparum
IYINNKYITYIYNIKKENITNCVL

SEQ ID NO: 3288062 - protein, 25 aa, Plasmodium falciparum
IYINRNNLLIYWKMLEDLKNVKTEN

SEQ ID NO: 3288063 - protein, 27 aa, Plasmodium falciparum
IYIQVITFFYLFHIIKCVHIISYNNAR

SEQ ID NO: 3288064 - protein, 33 aa, Plasmodium falciparum
IYIRNNNKLYAIKFLKIFSLKYMKKVKNMSEVN

SEQ ID NO: 3288065 - protein, 34 aa, Plasmodium falciparum
IYISFFSFFFLNFFFFFLFHFMSFTPVSYFYDYI

SEQ ID NO: 3288066 - protein, 26 aa, Plasmodium falciparum
IYISINYIFLYILLALIGLSNYHIKE

SEQ ID NO: 3288067 - protein, 22 aa, Plasmodium falciparum
IYITYIEYYYILLDYFCKYFYN

SEQ ID NO: 3288068 - protein, 28 aa, Plasmodium falciparum
IYKFIIKNKFFYIYFTDYYNTNIFVNKN

SEQ ID NO: 3288069 - protein, 17 aa, Plasmodium falciparum
IYKINIYCYRTYKSYLN

SEQ ID NO: 3288070 - protein, 26 aa, Plasmodium falciparum
IYKKKLIWLLGILLSVVIDPIFTIIA

SEQ ID NO: 3288071 - protein, 19 aa, Plasmodium falciparum
IYKKMYMDIILMNFNHLYV

SEQ ID NO: 3288072 - protein, 23 aa, Plasmodium falciparum
IYKKRFFLLITHLSSLIFMYSIC

SEQ ID NO: 3288073 - protein, 34 aa, Plasmodium falciparum
IYKKYRLIFFAVILKPILLIIYKVLCLSPSNIDL

SEQ ID NO: 3288074 - protein, 18 aa, Plasmodium falciparum
IYKNKILRWLYFKFRKRR

SEQ ID NO: 3288075 - protein, 22 aa, Plasmodium falciparum
IYKNLCNIIKLMCYLQDCNICH

SEQ ID NO: 3288076 - protein, 29 aa, Plasmodium falciparum
IYKPQNKPEPYYLIVLKKEVDKLKEFIPK

SEQ ID NO: 3288077 - protein, 24 aa, Plasmodium falciparum
IYKSVELVNFCDLNFLLKSMCQDK

SEQ ID NO: 3288078 - protein, 21 aa, Plasmodium falciparum
IYKSYISFKYLNYPSTPLLID

SEQ ID NO: 3288079 - protein, 17 aa, Plasmodium falciparum
IYKYKKNEIKQFLNRLF

SEQ ID NO: 3288080 - protein, 28 aa, Plasmodium falciparum
IYKYNFTPSYIILPKKIKKSLKIFCRCN

SEQ ID NO: 3288081 - protein, 26 aa, Plasmodium falciparum
IYKYPMNMFFFEIYLKLLTLINIQPY

SEQ ID NO: 3288082 - protein, 20 aa, Plasmodium falciparum
IYLFCELLCKYFYDIIFYLD

SEQ ID NO: 3288083 - protein, 17 aa, Plasmodium falciparum
IYLFNWKCDDCLKCNKC

SEQ ID NO: 3288084 - protein, 21 aa, Plasmodium falciparum
IYLLLDNILIQPSSYIIFICI

SEQ ID NO: 3288085 - protein, 20 aa, Plasmodium falciparum
IYLLSQNYIDPSPISSIRNL

SEQ ID NO: 3288086 - protein, 17 aa, Plasmodium falciparum
IYLMTKKGELKIIRNYK

SEQ ID NO: 3288087 - protein, 21 aa, Plasmodium falciparum
IYLREYYDLFCSTNCMNYNLG

SEQ ID NO: 3288088 - protein, 17 aa, Plasmodium falciparum
IYLTYLFECDIIKLFIF

SEQ ID NO: 3288089 - protein, 21 aa, Plasmodium falciparum
IYLYIKHILMIHIYSNYYIKI

SEQ ID NO: 3288090 - protein, 18 aa, Plasmodium falciparum
IYMKTFVKIKGGIYSYDL

SEQ ID NO: 3288091 - protein, 32 aa, Plasmodium falciparum
IYMLSKHIIYLLKDNFIFINNRLRNYYNLYRY

SEQ ID NO: 3288092 - protein, 24 aa, Plasmodium falciparum
IYMPQLVLLIFPSFILKIYFLYIF

SEQ ID NO: 3288093 - protein, 19 aa, Plasmodium falciparum
IYMTTLNLICRYKSSYLYE

SEQ ID NO: 3288094 - protein, 44 aa, Plasmodium falciparum
IYMYIYFYFILFYFIFILFCCDLIILMFVRIKKLILSFSIYLII

SEQ ID NO: 3288095 - protein, 18 aa, Plasmodium falciparum
IYMYSLLLNIYANFYFIK

SEQ ID NO: 3288096 - protein, 26 aa, Plasmodium falciparum
IYNCVYSISFLLYKKSILDYDKNIEL

SEQ ID NO: 3288097 - protein, 26 aa, Plasmodium falciparum
IYNCYNFIHLNCAYNYLSWPNYSKTS

SEQ ID NO: 3288098 - protein, 19 aa, Plasmodium falciparum
IYNFFFIPMIIVISTASTF

SEQ ID NO: 3288099 - protein, 27 aa, Plasmodium falciparum
IYNFQTYITTFFFTLLEMLKNIQSDKD

SEQ ID NO: 3288100 - protein, 26 aa, Plasmodium falciparum
IYNFSLYNFIRRLISFDAILVYSLFL

SEQ ID NO: 3288101 - protein, 20 aa, Plasmodium falciparum
IYNHFLILVEYYHYYKNSSY

SEQ ID NO: 3288102 - protein, 31 aa, Plasmodium falciparum
IYNIFTSFLCLFIVILILYASIDISINYGPV

SEQ ID NO: 3288103 - protein, 17 aa, Plasmodium falciparum
IYNIMFIDTPFLIYFIT

SEQ ID NO: 3288104 - protein, 18 aa, Plasmodium falciparum
IYNINRTDDILKRLMYLS

SEQ ID NO: 3288105 - protein, 36 aa, Plasmodium falciparum
IYNIQLKYILKHIKGIIPYKLIYNNSYFLYNKFRKR

SEQ ID NO: 3288106 - protein, 22 aa, Plasmodium falciparum
IYNKTIFFFFQKKHTCFNYYFN

SEQ ID NO: 3288107 - protein, 24 aa, Plasmodium falciparum
IYNLKRLFDFLNISYIQFICKNKK

SEQ ID NO: 3288108 - protein, 19 aa, Plasmodium falciparum
IYNLLKILKYKKNLGMKIL

SEQ ID NO: 3288109 - protein, 17 aa, Plasmodium falciparum
IYNLLKLICLTYEFHHN

SEQ ID NO: 3288110 - protein, 18 aa, Plasmodium falciparum
IYNMLFYDESINDYPYKN

SEQ ID NO: 3288111 - protein, 28 aa, Plasmodium falciparum
IYNNELLYFLKIFFFFYDNEVYNKYNDL

SEQ ID NO: 3288112 - protein, 27 aa, Plasmodium falciparum
IYNNFHNFKIIIFLPSIKKHFNIQYNK

SEQ ID NO: 3288113 - protein, 25 aa, Plasmodium falciparum
IYNNPDIYFIILTDSFNLLHKITHI

SEQ ID NO: 3288114 - protein, 30 aa, Plasmodium falciparum
IYNNVFNIYYIYIYIIKNTLKLIKENIRFV

SEQ ID NO: 3288115 - protein, 31 aa, Plasmodium falciparum
IYNRKKYSIWQFYLSIEILHLIFSNIKYVPF

SEQ ID NO: 3288116 - protein, 32 aa, Plasmodium falciparum
IYNVYSFLILLLSLFFIMCSLLTYYIVFFTEK

SEQ ID NO: 3288117 - protein, 33 aa, Plasmodium falciparum
IYNYKHNFYLRVFNFLLNFIKRTKNVINIVLCI

SEQ ID NO: 3288118 - protein, 30 aa, Plasmodium falciparum
IYNYMTYDIITYFQLKKTFLLDMCEHVHFS

SEQ ID NO: 3288119 - protein, 17 aa, Plasmodium falciparum
IYNYNIYDEICTEAFVF

SEQ ID NO: 3288120 - protein, 18 aa, Plasmodium falciparum
IYPFKLYFKKKWKHFNIY

SEQ ID NO: 3288121 - protein, 30 aa, Plasmodium falciparum
IYPLSYITIINICLNYFILDEIDALLDEQF

SEQ ID NO: 3288122 - protein, 17 aa, Plasmodium falciparum
IYPPNNILFYDNIGKLW

SEQ ID NO: 3288123 - protein, 23 aa, Plasmodium falciparum
IYQIYIAIRRIVYLDNIKLNYKS

SEQ ID NO: 3288124 - protein, 25 aa, Plasmodium falciparum
IYQSVVMFFMTLLPWWVPDVAYLEE

SEQ ID NO: 3288125 - protein, 17 aa, Plasmodium falciparum
IYQYKKMFLRFFPEHHE

SEQ ID NO: 3288126 - protein, 21 aa, Plasmodium falciparum
IYRCKYALVPLLFSQVIKDNY

SEQ ID NO: 3288127 - protein, 21 aa, Plasmodium falciparum
IYRKPYIVVINKCDVNFKEKI

SEQ ID NO: 3288128 - protein, 27 aa, Plasmodium falciparum
IYSAISYAFIYLLWRKIRPSKKKTKKF

SEQ ID NO: 3288129 - protein, 24 aa, Plasmodium falciparum
IYSAKLFLYTFIKLNYMMQNEQLI

SEQ ID NO: 3288130 - protein, 32 aa, Plasmodium falciparum
IYSDELSYLIWPFYLLYPIKRNANIYVFNYHS

SEQ ID NO: 3288131 - protein, 17 aa, Plasmodium falciparum
IYSFLKYDNIINTIIKT

SEQ ID NO: 3288132 - protein, 27 aa, Plasmodium falciparum
IYSFNIFIPIIIYLTIYFKTKKIPPFK

SEQ ID NO: 3288133 - protein, 34 aa, Plasmodium falciparum
IYSIGVTIYLILFKNFPYLFDEISIRKWEHFVIN

SEQ ID NO: 3288134 - protein, 23 aa, Plasmodium falciparum
IYSKNLMVILLNKDKIFSIIFKY

SEQ ID NO: 3288135 - protein, 23 aa, Plasmodium falciparum
IYSNKFLFNLLSEPILFEKDNNL

SEQ ID NO: 3288136 - protein, 25 aa, Plasmodium falciparum
IYSSFRCFIKLLALKHIRINKVIYE

SEQ ID NO: 3288137 - protein, 23 aa, Plasmodium falciparum
IYSTILYSFIYKSISKKNIFSLC

SEQ ID NO: 3288138 - protein, 17 aa, Plasmodium falciparum
IYTFYDVKILLNTFIYL

SEQ ID NO: 3288139 - protein, 18 aa, Plasmodium falciparum
IYTHIYTDILYYDYLYLF

SEQ ID NO: 3288140 - protein, 20 aa, Plasmodium falciparum
IYTLYNNVLLFLKKLDNMKK

SEQ ID NO: 3288141 - protein, 63 aa, Plasmodium falciparum
IYTNIYIIKYNNISKIYIIIIVKNIFFTKIIFINIYHIYYKNYYYIYIITINMKYLDRINKSP

SEQ ID NO: 3288142 - protein, 28 aa, Plasmodium falciparum
IYTNKYTYFIFSCFVYPVIQIIRVIYLF

SEQ ID NO: 3288143 - protein, 26 aa, Plasmodium falciparum
IYTYIAQFVIIYLLKVLLKYFSKYFN

SEQ ID NO: 3288144 - protein, 18 aa, Plasmodium falciparum
IYVDIYGPYILDILIKNT

SEQ ID NO: 3288145 - protein, 20 aa, Plasmodium falciparum
IYVETIILDRLLQFLNLKNI

SEQ ID NO: 3288146 - protein, 33 aa, Plasmodium falciparum
IYVGLICPKYRRKLFNLRYLILSGSLSINSIVS

SEQ ID NO: 3288147 - protein, 28 aa, Plasmodium falciparum
IYVLINNIIMFFIQSLKFICIHNIHKEE

SEQ ID NO: 3288148 - protein, 36 aa, Plasmodium falciparum
IYVNKFYHTFCKIIKYFFHIYNILIRKGDRCFKRES

SEQ ID NO: 3288149 - protein, 23 aa, Plasmodium falciparum
IYVPSFPKYKTFIELVLEPSKRD

SEQ ID NO: 3288150 - protein, 18 aa, Plasmodium falciparum
IYVYVKLRNLCINLLYIC

SEQ ID NO: 3288151 - protein, 17 aa, Plasmodium falciparum
IYYLHLHILAKRQMKWP

SEQ ID NO: 3288152 - protein, 21 aa, Plasmodium falciparum
IYYNMKKFMLRIKKMYSNIFL

SEQ ID NO: 3288153 - protein, 19 aa, Plasmodium falciparum
IYYYTYFYILRTDLYLRTL

SEQ ID NO: 3288154 - protein, 36 aa, Plasmodium falciparum
KAANNIHHFINETQPILLKSEIYKSLNKYQINMIVE

SEQ ID NO: 3288155 - protein, 28 aa, Plasmodium falciparum
KACETMCQWILAIYHYFIINKELEPKKE

SEQ ID NO: 3288156 - protein, 20 aa, Plasmodium falciparum
KACINYYNSLNYYGYNGYLF

SEQ ID NO: 3288157 - protein, 23 aa, Plasmodium falciparum
KADNFLIEYLNKEYYELYIYLKN

SEQ ID NO: 3288158 - protein, 22 aa, Plasmodium falciparum
KAEYVPFFFIIQNILLYNEFSL

SEQ ID NO: 3288159 - protein, 19 aa, Plasmodium falciparum
KAFFKHEPCLKNVLRNIFL

SEQ ID NO: 3288160 - protein, 22 aa, Plasmodium falciparum
KAFLVQLIKNRLYPTPNTLAIG

SEQ ID NO: 3288161 - protein, 40 aa, Plasmodium falciparum
KAFWNEEKYLLLKQYIYKYIFNMLINIMLTIPYNEISFMN

SEQ ID NO: 3288162 - protein, 25 aa, Plasmodium falciparum
KAGDVIYFGTILFVGSPNFSIIGKP

SEQ ID NO: 3288163 - protein, 29 aa, Plasmodium falciparum
KAILLYPLMLLFLYVYLNITYFLYARKYI

SEQ ID NO: 3288164 - protein, 23 aa, Plasmodium falciparum
KAKEIIFMLNKINFFSTVHFCKI

SEQ ID NO: 3288165 - protein, 27 aa, Plasmodium falciparum
KAKHIPFYNCLNICLLVFHEDVDILSF

SEQ ID NO: 3288166 - protein, 29 aa, Plasmodium falciparum
KAKLLYLYIICELCLILAIVFCVCNLDLT

SEQ ID NO: 3288167 - protein, 17 aa, Plasmodium falciparum
KALNYKYSFYDFSTLKK

SEQ ID NO: 3288168 - protein, 19 aa, Plasmodium falciparum
KALPTFEFYFNLNNEWVLV

SEQ ID NO: 3288169 - protein, 19 aa, Plasmodium falciparum
KAMMLPKYLFDLSGKTCNK

SEQ ID NO: 3288170 - protein, 47 aa, Plasmodium falciparum
KANFDIFIYIFYFHQILRILRWLRKWNKFILPLKYWSEIDYINVLIN

SEQ ID NO: 3288171 - protein, 41 aa, Plasmodium falciparum
KAPKKRNYFVYTKELFFYIQENKIVFLFRKNDMKKIDIIIH

SEQ ID NO: 3288172 - protein, 38 aa, Plasmodium falciparum
KAPNDKLIMILNCCRIVTSVLYAAKRNLKRKKKKREKA

SEQ ID NO: 3288173 - protein, 25 aa, Plasmodium falciparum
KAQVAFILYIVLVLRIISGNNDFCK

SEQ ID NO: 3288174 - protein, 21 aa, Plasmodium falciparum
KARAIIPPIYKYIIQNSSNVI

SEQ ID NO: 3288175 - protein, 23 aa, Plasmodium falciparum
KASHLIVELYIAGNIILTDENYK

SEQ ID NO: 3288176 - protein, 17 aa, Plasmodium falciparum
KAVILALQHFKLDNLFP

SEQ ID NO: 3288177 - protein, 29 aa, Plasmodium falciparum
KAVKKAIHFIKPQVIYKGINYFADNKGAA

SEQ ID NO: 3288178 - protein, 27 aa, Plasmodium falciparum
KAYEFKKPLYFFKKNKLQLSLHINEHY

SEQ ID NO: 3288179 - protein, 21 aa, Plasmodium falciparum
KAYKHLLKQINKKVTIKYDKN

SEQ ID NO: 3288180 - protein, 24 aa, Plasmodium falciparum
KAYLPYLEIKPFLQKIQKKYIYII

SEQ ID NO: 3288181 - protein, 23 aa, Plasmodium falciparum
KAYNLFIFFMNHKVIQNVVINMF

SEQ ID NO: 3288182 - protein, 18 aa, Plasmodium falciparum
KAYRKLAMKWHPDKHLND

SEQ ID NO: 3288183 - protein, 19 aa, Plasmodium falciparum
KAYRYLIRKFKKVAIECDL

SEQ ID NO: 3288184 - protein, 23 aa, Plasmodium falciparum
KCAPLKNYLYYNNNHRFELKNKF

SEQ ID NO: 3288185 - protein, 40 aa, Plasmodium falciparum
KCCSCIFLSYIIFFSLIFKNLEMYYMHFTKFSFNLKNMSD

SEQ ID NO: 3288186 - protein, 18 aa, Plasmodium falciparum
KCDKFCGVQICGLKKNND

SEQ ID NO: 3288187 - protein, 26 aa, Plasmodium falciparum
KCDLYPLQICDIYIKIYNKIVSIKNK

SEQ ID NO: 3288188 - protein, 23 aa, Plasmodium falciparum
KCECLFFFHIINQLNKEESCYVF

SEQ ID NO: 3288189 - protein, 17 aa, Plasmodium falciparum
KCECYERWVDKKKGEWK

SEQ ID NO: 3288190 - protein, 20 aa, Plasmodium falciparum
KCEDLLEQLLLLFEENYVLS

SEQ ID NO: 3288191 - protein, 18 aa, Plasmodium falciparum
KCEHIFPLLFLHMDDDYE

SEQ ID NO: 3288192 - protein, 26 aa, Plasmodium falciparum
KCEKNIFDLYKPFYLKTTDAPIKNLD

SEQ ID NO: 3288193 - protein, 39 aa, Plasmodium falciparum
KCESLSSRFYVFIIIILTLLILDIQSYYFYRKSVHVAKT

SEQ ID NO: 3288194 - protein, 23 aa, Plasmodium falciparum
KCFKYIKIKYLKKKHYLPISISI

SEQ ID NO: 3288195 - protein, 18 aa, Plasmodium falciparum
KCFLLPKKKLRKRKEKII

SEQ ID NO: 3288196 - protein, 17 aa, Plasmodium falciparum
KCFLYLEGVEFYCKKKT

SEQ ID NO: 3288197 - protein, 18 aa, Plasmodium falciparum
KCFVPFPCSIKELIDRNY

SEQ ID NO: 3288198 - protein, 24 aa, Plasmodium falciparum
KCGFKRLALFCYSNVLKKYEQKVF

SEQ ID NO: 3288199 - protein, 37 aa, Plasmodium falciparum
KCIGRNMFNNLYLYHTNPMRYLPHYNNFDSYMNMNNL

SEQ ID NO: 3288200 - protein, 25 aa, Plasmodium falciparum
KCILYNIFSVMFFINNYFNIYNKGQ

SEQ ID NO: 3288201 - protein, 44 aa, Plasmodium falciparum
KCKKPYLLHSFSIYSLFPGKVFFYITIYLHTYNTLLFHHEPILI

SEQ ID NO: 3288202 - protein, 26 aa, Plasmodium falciparum
KCKVKNPEMVFKSGFANVAECRNLNV

SEQ ID NO: 3288203 - protein, 35 aa, Plasmodium falciparum
KCLCTDHIFFFYRTIKALFLYNYKYYNNIYKKENI

SEQ ID NO: 3288204 - protein, 26 aa, Plasmodium falciparum
KCLGKRIFKLKLPLYKIHHYEDYLNI

SEQ ID NO: 3288205 - protein, 17 aa, Plasmodium falciparum
KCLLNNIISFSYDLYTN

SEQ ID NO: 3288206 - protein, 27 aa, Plasmodium falciparum
KCLPLTKLLYHFFMPKNCIQVCKELYP

SEQ ID NO: 3288207 - protein, 20 aa, Plasmodium falciparum
KCLRFLQIKEFFFLHNIDKN

SEQ ID NO: 3288208 - protein, 18 aa, Plasmodium falciparum
KCLSLMVYPFIQCAGEDD

SEQ ID NO: 3288209 - protein, 30 aa, Plasmodium falciparum
KCLVFSYYILLLWVLKYYMLTCQAINFKKT

SEQ ID NO: 3288210 - protein, 33 aa, Plasmodium falciparum
KCMYTNTYFLIPYFILPLYTLSIGRKLTPNFNR

SEQ ID NO: 3288211 - protein, 32 aa, Plasmodium falciparum
KCNKYYVNIFDKSFFYIYKYAPSIIDQKIKDF

SEQ ID NO: 3288212 - protein, 18 aa, Plasmodium falciparum
KCNMITALSKYIIKYIFT

SEQ ID NO: 3288213 - protein, 26 aa, Plasmodium falciparum
KCNVHFWISLFYLGIYNNFFSLIKYA

SEQ ID NO: 3288214 - protein, 24 aa, Plasmodium falciparum
KCPNKIISIFFKLLEEVPIPLGEE

SEQ ID NO: 3288215 - protein, 26 aa, Plasmodium falciparum
KCQSKIQICLFSLKYDKMINEINKDL

SEQ ID NO: 3288216 - protein, 31 aa, Plasmodium falciparum
KCRLLQKCLFYKIYISQLKNKKLKQLKEYIY

SEQ ID NO: 3288217 - protein, 21 aa, Plasmodium falciparum
KCSILNKIDFLSAFKKNLYVV

SEQ ID NO: 3288218 - protein, 39 aa, Plasmodium falciparum
KCSIRFGVFFFITLSNFLLCIIIYMKLIRNLGQGTYLKL

SEQ ID NO: 3288219 - protein, 23 aa, Plasmodium falciparum
KCSSVCIPFGPWIKNQKQEFEKQ

SEQ ID NO: 3288220 - protein, 22 aa, Plasmodium falciparum
KCSSYIFFLDNILSKNQKKKEE

SEQ ID NO: 3288221 - protein, 23 aa, Plasmodium falciparum
KCSVVCIPFGPWIDNQKQEFEKQ

SEQ ID NO: 3288222 - protein, 17 aa, Plasmodium falciparum
KCSYINEYLFYNNKREY

SEQ ID NO: 3288223 - protein, 29 aa, Plasmodium falciparum
KCTGCFLSCSHFRTWIDNQKLEFLKQKEK

SEQ ID NO: 3288224 - protein, 17 aa, Plasmodium falciparum
KCTLPNFIPIYFLNSDG

SEQ ID NO: 3288225 - protein, 17 aa, Plasmodium falciparum
KCVIRKIKKRNKVNPKR

SEQ ID NO: 3288226 - protein, 24 aa, Plasmodium falciparum
KCYFRKMISLLYLYTDELILYTIK

SEQ ID NO: 3288227 - protein, 17 aa, Plasmodium falciparum
KCYKDILANPKKFSIML

SEQ ID NO: 3288228 - protein, 28 aa, Plasmodium falciparum
KCYYLNNMFICCILNYYLSLIYDEHNES

SEQ ID NO: 3288229 - protein, 26 aa, Plasmodium falciparum
KDAENYLALHLFLLKDENITLFSMMH

SEQ ID NO: 3288230 - protein, 24 aa, Plasmodium falciparum
KDAKDNFLWFNTTKKKPLVFVKLA

SEQ ID NO: 3288231 - protein, 21 aa, Plasmodium falciparum
KDAYIYYFNNFKYQDMIIYFS

SEQ ID NO: 3288232 - protein, 23 aa, Plasmodium falciparum
KDCIMYYDMLPIHKIYGFYISHC

SEQ ID NO: 3288233 - protein, 23 aa, Plasmodium falciparum
KDCIRAIYLLKENGFKVDIHLMP

SEQ ID NO: 3288234 - protein, 23 aa, Plasmodium falciparum
KDDAKKKHKFLREANTEKNDNEK

SEQ ID NO: 3288235 - protein, 52 aa, Plasmodium falciparum
KDDETPFMFLKNIHWLITFPILLYIVFAVRLLFLSIISFIFELGFLMNAHDL

SEQ ID NO: 3288236 - protein, 32 aa, Plasmodium falciparum
KDDILLYKDKKFYPLYYYSYILYENEKWISGI

SEQ ID NO: 3288237 - protein, 28 aa, Plasmodium falciparum
KDDLHKKKNLFYLLKSEKKNNKNLSKIC

SEQ ID NO: 3288238 - protein, 24 aa, Plasmodium falciparum
KDDLLWNIFMFDRNISFFSVSFYV

SEQ ID NO: 3288239 - protein, 21 aa, Plasmodium falciparum
KDDPLMFFIPVINIKKNDMKL

SEQ ID NO: 3288240 - protein, 27 aa, Plasmodium falciparum
KDDPNYIIYQFLIYGLIKNSREIESYE

SEQ ID NO: 3288241 - protein, 36 aa, Plasmodium falciparum
KDDTNVFILIYIYIFYYIYSMYLKYKINNLNILSRN

SEQ ID NO: 3288242 - protein, 23 aa, Plasmodium falciparum
KDDVFYPYQYIPPMLIKADRCKL

SEQ ID NO: 3288243 - protein, 20 aa, Plasmodium falciparum
KDECIHIKNLLLDNYIDNLK

SEQ ID NO: 3288244 - protein, 26 aa, Plasmodium falciparum
KDEDEKLLNFIYDPSKHLCGNRINYC

SEQ ID NO: 3288245 - protein, 28 aa, Plasmodium falciparum
KDEEELYKILLSRFQYEFFLMSDSFYHL

SEQ ID NO: 3288246 - protein, 23 aa, Plasmodium falciparum
KDEIIYLFKKQKLEDILPGVIIF

SEQ ID NO: 3288247 - protein, 25 aa, Plasmodium falciparum
KDELYINIDLIYKNKNNKSFLSVME

SEQ ID NO: 3288248 - protein, 18 aa, Plasmodium falciparum
KDESLIFYFFYNLMNQEN

SEQ ID NO: 3288249 - protein, 17 aa, Plasmodium falciparum
KDEWKCDKFCGVQICGL

SEQ ID NO: 3288250 - protein, 21 aa, Plasmodium falciparum
KDFCFKFPTFINYKNEIRITE

SEQ ID NO: 3288251 - protein, 21 aa, Plasmodium falciparum
KDFDHFYKNYLIHKMKSTNQK

SEQ ID NO: 3288252 - protein, 21 aa, Plasmodium falciparum
KDFMVFSIYGIFNIYDNNIHI

SEQ ID NO: 3288253 - protein, 28 aa, Plasmodium falciparum
KDFNHNLFPLLYFILPYHYENDSAVLKI

SEQ ID NO: 3288254 - protein, 19 aa, Plasmodium falciparum
KDFNILLDDASITHLSFSN

SEQ ID NO: 3288255 - protein, 31 aa, Plasmodium falciparum
KDFPLSYIEQSLLGSLVYFGLIIGTIMASIL

SEQ ID NO: 3288256 - protein, 20 aa, Plasmodium falciparum
KDFQNFFYFLKEQRYYSSDV

SEQ ID NO: 3288257 - protein, 28 aa, Plasmodium falciparum
KDFTVIFFQTLSLVLFFSITFSSMFLPV

SEQ ID NO: 3288258 - protein, 23 aa, Plasmodium falciparum
KDFYSYYVFFEFLVNIQNTYFEE

SEQ ID NO: 3288259 - protein, 25 aa, Plasmodium falciparum
KDGKGIFNWRFVYNIKIPTNATNIK

SEQ ID NO: 3288260 - protein, 23 aa, Plasmodium falciparum
KDGSYYVGFWKKNKKWGYGKMTW

SEQ ID NO: 3288261 - protein, 17 aa, Plasmodium falciparum
KDHILLIKAILKFVKNQ

SEQ ID NO: 3288262 - protein, 26 aa, Plasmodium falciparum
KDHKGLQYYILYMNRKLNDYVNGNEG

SEQ ID NO: 3288263 - protein, 18 aa, Plasmodium falciparum
KDHLKYLYNYVIQPNVAK

SEQ ID NO: 3288264 - protein, 54 aa, Plasmodium falciparum
KDIFIDIRIITLEYFYLYLDVLTLYFTNRKFTKLLIWILYDKDNKIKICCLKIL

SEQ ID NO: 3288265 - protein, 22 aa, Plasmodium falciparum
KDIFNIITLLQKLSLYVKYSLE

SEQ ID NO: 3288266 - protein, 23 aa, Plasmodium falciparum
KDIFNIITLLQKLSLYVKYSLEK

SEQ ID NO: 3288267 - protein, 54 aa, Plasmodium falciparum
KDIFRNKYVNFLIYIKNILTLPYDKLLRVPIKNKYFFFYIKNKRIDIPFQKFFN

SEQ ID NO: 3288268 - protein, 20 aa, Plasmodium falciparum
KDIFYKQYDYKIFFDKAFLD

SEQ ID NO: 3288269 - protein, 25 aa, Plasmodium falciparum
KDIHKYIFPFFPKISTGLDHYACVA

SEQ ID NO: 3288270 - protein, 24 aa, Plasmodium falciparum
KDIIDIYMPYLKKWNIYSFYCSSN

SEQ ID NO: 3288271 - protein, 27 aa, Plasmodium falciparum
KDIIKLYFAFFNRFLYYLLHQERNIYI

SEQ ID NO: 3288272 - protein, 24 aa, Plasmodium falciparum
KDIIQFFTCNLIQLYIKDTKNCDL

SEQ ID NO: 3288273 - protein, 17 aa, Plasmodium falciparum
KDIIYLVHVMKPTLYEI

SEQ ID NO: 3288274 - protein, 35 aa, Plasmodium falciparum
KDIKMLLKYYRNYIYKFICLLLGENKFLYMYSKNT

SEQ ID NO: 3288275 - protein, 25 aa, Plasmodium falciparum
KDIKNNFLIFLYYIIHSLNNNTTND

SEQ ID NO: 3288276 - protein, 25 aa, Plasmodium falciparum
KDILHNFILFCKMNMFECSYYMNKI

SEQ ID NO: 3288277 - protein, 29 aa, Plasmodium falciparum
KDILILIKFSILHMYLLLLKNKSISKKSI

SEQ ID NO: 3288278 - protein, 29 aa, Plasmodium falciparum
KDILKFISKDIWYILFNKNSDKIQTQKKG

SEQ ID NO: 3288279 - protein, 22 aa, Plasmodium falciparum
KDILLLLEDIKIATSPRIKGIF

SEQ ID NO: 3288280 - protein, 26 aa, Plasmodium falciparum
KDILNFHAILYICLLKSLNLELPQKI

SEQ ID NO: 3288281 - protein, 26 aa, Plasmodium falciparum
KDILSSILYFFLYNPKNLVQKVSDQK

SEQ ID NO: 3288282 - protein, 25 aa, Plasmodium falciparum
KDINSKDIFLFRSLSTYLEEKSHNN

SEQ ID NO: 3288283 - protein, 19 aa, Plasmodium falciparum
KDIWHGMICALTYKETSGS

SEQ ID NO: 3288284 - protein, 17 aa, Plasmodium falciparum
KDIWNAMTCNAPYDAKI

SEQ ID NO: 3288285 - protein, 26 aa, Plasmodium falciparum
KDIYIKCYLFYYPHFHNFVLTYFHKF

SEQ ID NO: 3288286 - protein, 31 aa, Plasmodium falciparum
KDIYLKYFLFQNYFVLLIHGFDTHGLPIEYN

SEQ ID NO: 3288287 - protein, 33 aa, Plasmodium falciparum
KDIYLMIRINLFKYLHMIYLKDDLLLKINVLEI

SEQ ID NO: 3288288 - protein, 24 aa, Plasmodium falciparum
KDIYTLFIHLLYVMKNKHNINIVN

SEQ ID NO: 3288289 - protein, 45 aa, Plasmodium falciparum
KDKDYINILPFSKRAIPIFWLYDCTLPYIKILRKKEKKRHSKNLR

SEQ ID NO: 3288290 - protein, 26 aa, Plasmodium falciparum
KDKELEKIILYYKLNNPFYLNEKEKS

SEQ ID NO: 3288291 - protein, 27 aa, Plasmodium falciparum
KDKETVLDYYIDDIIKRIVEDTSHVNN

SEQ ID NO: 3288292 - protein, 18 aa, Plasmodium falciparum
KDKFFTVEFFFSNSTKSK

SEQ ID NO: 3288293 - protein, 22 aa, Plasmodium falciparum
KDKIFHSFFIQQNYNFFMLNVT

SEQ ID NO: 3288294 - protein, 45 aa, Plasmodium falciparum
KDKISVILLSFNVSLIQVIFLPLIIYFQMLFNKNKNISYLLFIKN

SEQ ID NO: 3288295 - protein, 22 aa, Plasmodium falciparum
KDKIYYLLCIQYNLILLNKKYK

SEQ ID NO: 3288296 - protein, 25 aa, Plasmodium falciparum
KDKLKVPFFFKEKGIYNFFNKTVEN

SEQ ID NO: 3288297 - protein, 26 aa, Plasmodium falciparum
KDKLLFLFLFFFYFTNWNLNNLINKK

SEQ ID NO: 3288298 - protein, 26 aa, Plasmodium falciparum
KDKLLFNCIFVFKLLEKKKIYDKDFN

SEQ ID NO: 3288299 - protein, 34 aa, Plasmodium falciparum
KDKNNITFFLIKFLLYFYHPYKLKYEKGKRKIIK

SEQ ID NO: 3288300 - protein, 29 aa, Plasmodium falciparum
KDKSKLHIFVFLLLNTLLKIEKNSWIKMY

SEQ ID NO: 3288301 - protein, 25 aa, Plasmodium falciparum
KDLENYVMLFLLNYNTKKKRKIIAN

SEQ ID NO: 3288302 - protein, 19 aa, Plasmodium falciparum
KDLFLSYISLYIKLNLFYS

SEQ ID NO: 3288303 - protein, 30 aa, Plasmodium falciparum
KDLFYVIYHIYFLQYVLKYNFLNFLTNFIT

SEQ ID NO: 3288304 - protein, 24 aa, Plasmodium falciparum
KDLLFIYDILLNRTIKKINTINIE

SEQ ID NO: 3288305 - protein, 32 aa, Plasmodium falciparum
KDLQKDIYLNKLFQILPKNFFSHIFKPTNNNE

SEQ ID NO: 3288306 - protein, 21 aa, Plasmodium falciparum
KDLRGFLRNNLISTYFIHILT

SEQ ID NO: 3288307 - protein, 34 aa, Plasmodium falciparum
KDLVFFMKKIFWKIYIFFLFYKNRRFLKRRKENT

SEQ ID NO: 3288308 - protein, 29 aa, Plasmodium falciparum
KDLYNILFDVPMLLLLMKKKGINFLVTNI

SEQ ID NO: 3288309 - protein, 21 aa, Plasmodium falciparum
KDMLRLYYKYINKYANTEFMK

SEQ ID NO: 3288310 - protein, 20 aa, Plasmodium falciparum
KDMYEFLETIDINKILKSIH

SEQ ID NO: 3288311 - protein, 28 aa, Plasmodium falciparum
KDNCSNDIIYILYLIDENELKIYSKNFI

SEQ ID NO: 3288312 - protein, 22 aa, Plasmodium falciparum
KDNFHFNEIPLLGGFLFKRNEE

SEQ ID NO: 3288313 - protein, 17 aa, Plasmodium falciparum
KDNFICSQYFPYTNKPL

SEQ ID NO: 3288314 - protein, 25 aa, Plasmodium falciparum
KDNGKKILLIRALVTHWVDNFLQDY

SEQ ID NO: 3288315 - protein, 24 aa, Plasmodium falciparum
KDNIFLWLDLIMNQKLFSEVMSFH

SEQ ID NO: 3288316 - protein, 30 aa, Plasmodium falciparum
KDNIKCEENVSFNILRRSNKKDQLPLEEKK

SEQ ID NO: 3288317 - protein, 27 aa, Plasmodium falciparum
KDNIKILDIFKLYLFPQNNYFHYKNVF

SEQ ID NO: 3288318 - protein, 27 aa, Plasmodium falciparum
KDNIKKLMYCFLIMVIEINHILNKKKR

SEQ ID NO: 3288319 - protein, 28 aa, Plasmodium falciparum
KDNIYYIHLLINYILYVLNLVIYIEKEN

SEQ ID NO: 3288320 - protein, 25 aa, Plasmodium falciparum
KDNLNYFLHCSSLYAFKFSDVQINS

SEQ ID NO: 3288321 - protein, 28 aa, Plasmodium falciparum
KDNMFKIYQFILYLIPNTIYYTIEFINN

SEQ ID NO: 3288322 - protein, 22 aa, Plasmodium falciparum
KDNRFVTFCALLLFEHFREYVK

SEQ ID NO: 3288323 - protein, 24 aa, Plasmodium falciparum
KDNVYYINFFFDELKMYKSCLFLF

SEQ ID NO: 3288324 - protein, 24 aa, Plasmodium falciparum
KDPSNNPFFRYLKCFNLVEFNKDT

SEQ ID NO: 3288325 - protein, 24 aa, Plasmodium falciparum
KDQFITYFPIYKKNTIFFNPSSIK

SEQ ID NO: 3288326 - protein, 26 aa, Plasmodium falciparum
KDQFLGILNEAGGLKEMFFNLEDVFK

SEQ ID NO: 3288327 - protein, 20 aa, Plasmodium falciparum
KDQHFLFTNKKKHLILLFIN

SEQ ID NO: 3288328 - protein, 20 aa, Plasmodium falciparum
KDQITFLKKICLLLNNFNNG

SEQ ID NO: 3288329 - protein, 21 aa, Plasmodium falciparum
KDQYVIYKKLLYFLDEYLKSH

SEQ ID NO: 3288330 - protein, 28 aa, Plasmodium falciparum
KDRKKLCPFYIYPRKFNLSYKSRKKIFI

SEQ ID NO: 3288331 - protein, 22 aa, Plasmodium falciparum
KDRYISILFLRGDSVILILRNP

SEQ ID NO: 3288332 - protein, 20 aa, Plasmodium falciparum
KDSIYWRTKKLVKCLKNGNT

SEQ ID NO: 3288333 - protein, 33 aa, Plasmodium falciparum
KDTINNLFNLIFKLLYFIKYLKSYIIQNRNLKN

SEQ ID NO: 3288334 - protein, 21 aa, Plasmodium falciparum
KDTTKFSLLKKLSLNKNSVIQ

SEQ ID NO: 3288335 - protein, 37 aa, Plasmodium falciparum
KDVCELLSSIFPYCKLDLQLKLQFKKVTFNNSLLYHH

SEQ ID NO: 3288336 - protein, 31 aa, Plasmodium falciparum
KDVDCIFIYNIFFHMNRFIKKLYYCSDIKKI

SEQ ID NO: 3288337 - protein, 39 aa, Plasmodium falciparum
KDVFLYLRVICSNYILLQMYLFYIILNNNIMNNKNNFPF

SEQ ID NO: 3288338 - protein, 25 aa, Plasmodium falciparum
KDVFRYFESLYIKYFKSYNYINYIT

SEQ ID NO: 3288339 - protein, 17 aa, Plasmodium falciparum
KDWWEANRYKVWKAMKC

SEQ ID NO: 3288340 - protein, 18 aa, Plasmodium falciparum
KDWWNENGPYIWKGMLCS

SEQ ID NO: 3288341 - protein, 17 aa, Plasmodium falciparum
KDYFYKNILYQMKKKKC

SEQ ID NO: 3288342 - protein, 33 aa, Plasmodium falciparum
KDYLKLKSSIFSAFLLYLMHLKEIYLLNISVII

SEQ ID NO: 3288343 - protein, 26 aa, Plasmodium falciparum
KDYLYNIDILLLILNTIKLNNLISRN

SEQ ID NO: 3288344 - protein, 26 aa, Plasmodium falciparum
KDYNNIDYFFKDLYHKIHEINLNEGS

SEQ ID NO: 3288345 - protein, 18 aa, Plasmodium falciparum
KEADLLFKTFFFKKNKIN

SEQ ID NO: 3288346 - protein, 24 aa, Plasmodium falciparum
KEAINDIINLPPILFNVNKEINLS

SEQ ID NO: 3288347 - protein, 34 aa, Plasmodium falciparum
KEAVTDRFVRLMSILIFIVVSVLITVIIISRKQT

SEQ ID NO: 3288348 - protein, 24 aa, Plasmodium falciparum
KECIDPCMKYRDWIIRSKFEWHTL

SEQ ID NO: 3288349 - protein, 25 aa, Plasmodium falciparum
KECKILLTSLLNYIRPFIKLIEDNK

SEQ ID NO: 3288350 - protein, 23 aa, Plasmodium falciparum
KECKPLFTFWDTVANYFHLENKY

SEQ ID NO: 3288351 - protein, 24 aa, Plasmodium falciparum
KECNEIICLSAHYLQRHLNNMFNE

SEQ ID NO: 3288352 - protein, 24 aa, Plasmodium falciparum
KEDDLFHIFLLLKNLCNDPSDTIK

SEQ ID NO: 3288353 - protein, 31 aa, Plasmodium falciparum
KEDIEEYFFFFFFLFYFLLLNNNKSCIVIYY

SEQ ID NO: 3288354 - protein, 21 aa, Plasmodium falciparum
KEDMDKCPPINLYKPIDDKGG

SEQ ID NO: 3288355 - protein, 27 aa, Plasmodium falciparum
KEDMYLFSMDIIIFIGFDKLVLCNINE

SEQ ID NO: 3288356 - protein, 23 aa, Plasmodium falciparum
KEDPIFHFLKRQRKYKKIEYNQN

SEQ ID NO: 3288357 - protein, 31 aa, Plasmodium falciparum
KEDQIFSVGVFLPFSFIDYINSDYINKLLKR

SEQ ID NO: 3288358 - protein, 26 aa, Plasmodium falciparum
KEDYSKFFFLGLTGTIIWSLGIPLFS

SEQ ID NO: 3288359 - protein, 17 aa, Plasmodium falciparum
KEECFFVINFKDKKYRF

SEQ ID NO: 3288360 - protein, 29 aa, Plasmodium falciparum
KEEEKSLFHIIMRFLLQEKNHFYNYYYSN

SEQ ID NO: 3288361 - protein, 21 aa, Plasmodium falciparum
KEEFNFIYLKEVELFFLLTCV

SEQ ID NO: 3288362 - protein, 25 aa, Plasmodium falciparum
KEEHLHILSHYLSEYNRKVFSQFLN

SEQ ID NO: 3288363 - protein, 23 aa, Plasmodium falciparum
KEEIKDKEYLRKVIPKEEKKEPI

SEQ ID NO: 3288364 - protein, 24 aa, Plasmodium falciparum
KEEIKIYIYTIKQILTKRNIEVYK

SEQ ID NO: 3288365 - protein, 32 aa, Plasmodium falciparum
KEEILNIFSIMYLFRICIYYLGRSKDFRKEDY

SEQ ID NO: 3288366 - protein, 73 aa, Plasmodium falciparum
KEELIPLNDFYLLDKNIYTKRFYCIPIYIKKNNILIRPNFFHIKWIVYTLQSFIFYNFFFKKINKYMCTYPFF

SEQ ID NO: 3288367 - protein, 23 aa, Plasmodium falciparum
KEENEWFLNMNNIYFMIKSREVK

SEQ ID NO: 3288368 - protein, 25 aa, Plasmodium falciparum
KEENFLKALPIKLINSLRIFAENIK

SEQ ID NO: 3288369 - protein, 46 aa, Plasmodium falciparum
KEEYIYQFISSILPYICFSFMLFFPHILICLYIPYIKKKNEKQKEL

SEQ ID NO: 3288370 - protein, 46 aa, Plasmodium falciparum
KEEYKYYHYFKANEIYFYRYDINKLLIRNNFLPIFFELFKRTNDYN

SEQ ID NO: 3288371 - protein, 28 aa, Plasmodium falciparum
KEFALIYVFYLLIESLKYINQQYYICNT

SEQ ID NO: 3288372 - protein, 25 aa, Plasmodium falciparum
KEFIGLFLTGFFIAIGSISHSIFYL

SEQ ID NO: 3288373 - protein, 28 aa, Plasmodium falciparum
KEFLGKDLSFNFYFRSIMYYNKDIIASN

SEQ ID NO: 3288374 - protein, 20 aa, Plasmodium falciparum
KEFLYILSKNRLQLYNNKMN

SEQ ID NO: 3288375 - protein, 19 aa, Plasmodium falciparum
KEFMNIINNDYFVKNKYFH

SEQ ID NO: 3288376 - protein, 25 aa, Plasmodium falciparum
KEFSRNFYHLLNKTANLEDITNFIY

SEQ ID NO: 3288377 - protein, 29 aa, Plasmodium falciparum
KEGFEDKIFLALYRRLFKKIEYQCYHVDT

SEQ ID NO: 3288378 - protein, 18 aa, Plasmodium falciparum
KEGFIQSSKISPSIFCLC

SEQ ID NO: 3288379 - protein, 17 aa, Plasmodium falciparum
KEHAPSIWEGMICALTY

SEQ ID NO: 3288380 - protein, 24 aa, Plasmodium falciparum
KEHEFQLYYMYYLLDRTTGNIKDS

SEQ ID NO: 3288381 - protein, 19 aa, Plasmodium falciparum
KEHIYILTFLKKYISSRNN

SEQ ID NO: 3288382 - protein, 23 aa, Plasmodium falciparum
KEIDIFLNFYRFMDKFNIYHSTK

SEQ ID NO: 3288383 - protein, 18 aa, Plasmodium falciparum
KEIDKIFYFVGNNIYRNK

SEQ ID NO: 3288384 - protein, 41 aa, Plasmodium falciparum
KEIISLFEFCMLSIKEYIKYIMTYVPLIPTKNTFNDYCKIK

SEQ ID NO: 3288385 - protein, 19 aa, Plasmodium falciparum
KEIKKLIKYITFYNNQNEN

SEQ ID NO: 3288386 - protein, 31 aa, Plasmodium falciparum
KEIKKLLLNKFIITLPLLKSLFHEEFFRILK

SEQ ID NO: 3288387 - protein, 27 aa, Plasmodium falciparum
KEIKLYIHIYVSFFFLFHSYCTHNNIL

SEQ ID NO: 3288388 - protein, 19 aa, Plasmodium falciparum
KEILSILYYFLINSEEEMN

SEQ ID NO: 3288389 - protein, 22 aa, Plasmodium falciparum
KEINCIFNLLNKLTYLKIRDIS

SEQ ID NO: 3288390 - protein, 25 aa, Plasmodium falciparum
KEINEPIIVPSYYPTTGPNPNTHGP

SEQ ID NO: 3288391 - protein, 28 aa, Plasmodium falciparum
KEINNLINIFFFFYYHQIKNKKYINRTC

SEQ ID NO: 3288392 - protein, 27 aa, Plasmodium falciparum
KEINQETYLFLPLADYKLSGYGDGAFL

SEQ ID NO: 3288393 - protein, 36 aa, Plasmodium falciparum
KEINYIDEYIFCNFLILLFLYKFLSKEKQKDILYTI

SEQ ID NO: 3288394 - protein, 27 aa, Plasmodium falciparum
KEINYLYFLHILPWKTSLHFCIKDSHL

SEQ ID NO: 3288395 - protein, 23 aa, Plasmodium falciparum
KEIQPQYIALLLINVMKFINNSQ

SEQ ID NO: 3288396 - protein, 21 aa, Plasmodium falciparum
KEIRKWKTIIEIQMAVIEEIH

SEQ ID NO: 3288397 - protein, 25 aa, Plasmodium falciparum
KEIYKNFFFYLTRMNLINKYLHDYY

SEQ ID NO: 3288398 - protein, 21 aa, Plasmodium falciparum
KEIYLKFIYNYLILIEFSYDH

SEQ ID NO: 3288399 - protein, 19 aa, Plasmodium falciparum
KEIYTPQIYVSEFKNNDDE

SEQ ID NO: 3288400 - protein, 23 aa, Plasmodium falciparum
KEKCSFFLNLFTKHVSNKIFPMR

SEQ ID NO: 3288401 - protein, 27 aa, Plasmodium falciparum
KEKDLENIYLKIFFSKLEEIEKSSEKY

SEQ ID NO: 3288402 - protein, 28 aa, Plasmodium falciparum
KEKEKFIKSLFHIFDGDNEILQIVDELS

SEQ ID NO: 3288403 - protein, 31 aa, Plasmodium falciparum
KEKFYISAFKVLPLFFYNVFNINFYLKTIKK

SEQ ID NO: 3288404 - protein, 32 aa, Plasmodium falciparum
KEKGKKYFFFINIIVYCILTVLYDIFPNITFP

SEQ ID NO: 3288405 - protein, 23 aa, Plasmodium falciparum
KEKGYIQYLLPQSCFKHFKNIEF

SEQ ID NO: 3288406 - protein, 25 aa, Plasmodium falciparum
KEKIKKIMFTFVKELLNYLDGFINS

SEQ ID NO: 3288407 - protein, 25 aa, Plasmodium falciparum
KEKILKLLILLKHEDIYLKKFSKKI

SEQ ID NO: 3288408 - protein, 24 aa, Plasmodium falciparum
KEKIYLRNIISILLLDLSYSISNL

SEQ ID NO: 3288409 - protein, 50 aa, Plasmodium falciparum
KEKKEKKYAYSNTFKYAGATVLAGLFVLLASVLVFKKVKGFTYKNNDYTN

SEQ ID NO: 3288410 - protein, 18 aa, Plasmodium falciparum
KEKKLYNTLLYLSNIKHK

SEQ ID NO: 3288411 - protein, 18 aa, Plasmodium falciparum
KEKKNELKLLKRQARSLV

SEQ ID NO: 3288412 - protein, 23 aa, Plasmodium falciparum
KEKKYFLIFNNFLSKQQNQKNVV

SEQ ID NO: 3288413 - protein, 22 aa, Plasmodium falciparum
KEKLFLYKYISPFMDLGKRFYS

SEQ ID NO: 3288414 - protein, 19 aa, Plasmodium falciparum
KEKLLWTAVSLFVFLICCQ

SEQ ID NO: 3288415 - protein, 25 aa, Plasmodium falciparum
KEKLNHLPLYYKDSSFYLFNNNNIK

SEQ ID NO: 3288416 - protein, 17 aa, Plasmodium falciparum
KEKLYFMSKLYTCMIYC

SEQ ID NO: 3288417 - protein, 49 aa, Plasmodium falciparum
KEKNIDILLLLYNKILKEYLYYNLLSCVYFYFYRIIKNFQIYIQDIVLY

SEQ ID NO: 3288418 - protein, 27 aa, Plasmodium falciparum
KEKNKMVFIFFINEILLKRLRRNNLRK

SEQ ID NO: 3288419 - protein, 25 aa, Plasmodium falciparum
KEKNLESFIKFLQQLMTLEKNEKEF

SEQ ID NO: 3288420 - protein, 41 aa, Plasmodium falciparum
KEKNSEQIFIFFNKKFLIKKDYVMNYLIYVINNIREKINKI

SEQ ID NO: 3288421 - protein, 24 aa, Plasmodium falciparum
KEKRKIFFILLKYKNIKKKKKFLL

SEQ ID NO: 3288422 - protein, 21 aa, Plasmodium falciparum
KEKYECLFPIDLSFLRDDINM

SEQ ID NO: 3288423 - protein, 24 aa, Plasmodium falciparum
KEKYIFKNVIFLNPNLYKSKWIYD

SEQ ID NO: 3288424 - protein, 17 aa, Plasmodium falciparum
KEKYIHNYLFKIMNNMF

SEQ ID NO: 3288425 - protein, 23 aa, Plasmodium falciparum
KEKYVHVFIIRYTSRLKMHSFIF

SEQ ID NO: 3288426 - protein, 39 aa, Plasmodium falciparum
KEKYVNWILFLFILSIIVFITYFFFKALHNYFKTKEEKE

SEQ ID NO: 3288427 - protein, 26 aa, Plasmodium falciparum
KEKYYIYIPFIIFESQTLMLNNSILL

SEQ ID NO: 3288428 - protein, 25 aa, Plasmodium falciparum
KELDIYLYIFFLIIKPIYKKEEKKD

SEQ ID NO: 3288429 - protein, 17 aa, Plasmodium falciparum
KELFPIFTAKQLVIFTE

SEQ ID NO: 3288430 - protein, 34 aa, Plasmodium falciparum
KELIKYKEFYFSQLGNLVPFYDTKHPYILELEKL

SEQ ID NO: 3288431 - protein, 22 aa, Plasmodium falciparum
KELILNIMKYILFFSCTKKYTN

SEQ ID NO: 3288432 - protein, 29 aa, Plasmodium falciparum
KELKRKIFCSLFFLLCSKMAIIYTPILLS

SEQ ID NO: 3288433 - protein, 19 aa, Plasmodium falciparum
KELLKFYNFSKMKMKPKTN

SEQ ID NO: 3288434 - protein, 19 aa, Plasmodium falciparum
KELMNFFYLIINKELNSLI

SEQ ID NO: 3288435 - protein, 25 aa, Plasmodium falciparum
KELSNMFSFLLDIIKICFFNNYKNN

SEQ ID NO: 3288436 - protein, 43 aa, Plasmodium falciparum
KELYDNILIKILFFYIFFYFGDHYFCIILLLNFKYIIEEENKH

SEQ ID NO: 3288437 - protein, 22 aa, Plasmodium falciparum
KELYDRYIMIVIRKLTNECIND

SEQ ID NO: 3288438 - protein, 26 aa, Plasmodium falciparum
KEMELFYIKLRILLSEKKFITFLNTC

SEQ ID NO: 3288439 - protein, 21 aa, Plasmodium falciparum
KEMLKKLIKMKNYYAYNFLNL

SEQ ID NO: 3288440 - protein, 24 aa, Plasmodium falciparum
KEMYNFLFLFFNIPSVETRNKFFC

SEQ ID NO: 3288441 - protein, 28 aa, Plasmodium falciparum
KENANSKLPALLWNKIIGKGNDNEVNFE

SEQ ID NO: 3288442 - protein, 20 aa, Plasmodium falciparum
KENDIKMFNFGITALEQFEE

SEQ ID NO: 3288443 - protein, 23 aa, Plasmodium falciparum
KENELLLQYLYMNFSKELANLLR

SEQ ID NO: 3288444 - protein, 33 aa, Plasmodium falciparum
KENFTNLIEFVILLFKNILIDFHIYRYNDFQNI

SEQ ID NO: 3288445 - protein, 21 aa, Plasmodium falciparum
KENHFSFTILTANSFNLNQNI

SEQ ID NO: 3288446 - protein, 26 aa, Plasmodium falciparum
KENIKNLLIYLFLKKMNLLNDEKLSS

SEQ ID NO: 3288447 - protein, 23 aa, Plasmodium falciparum
KENILNYILVHTYIDGKLGIRSA

SEQ ID NO: 3288448 - protein, 26 aa, Plasmodium falciparum
KENKKLSCFVLSLLYILMCLLLKVKI

SEQ ID NO: 3288449 - protein, 31 aa, Plasmodium falciparum
KENKKNYYYYYYYYYYTLFKNKHVLKRDYNH

SEQ ID NO: 3288450 - protein, 32 aa, Plasmodium falciparum
KENLFTITPYDPYFVNFLYQHFIKEFDELKFY

SEQ ID NO: 3288451 - protein, 24 aa, Plasmodium falciparum
KENLKLCFVRFKKTNRCIIIKEKN

SEQ ID NO: 3288452 - protein, 22 aa, Plasmodium falciparum
KENLLLNETYDKIIFNQKSEIN

SEQ ID NO: 3288453 - protein, 28 aa, Plasmodium falciparum
KENMNYIQLCLFLLPLKNHFLYIKNGKT

SEQ ID NO: 3288454 - protein, 22 aa, Plasmodium falciparum
KENNFYYILNNIKTLILNPDDA

SEQ ID NO: 3288455 - protein, 17 aa, Plasmodium falciparum
KENNYIFFNINLMLCEC

SEQ ID NO: 3288456 - protein, 25 aa, Plasmodium falciparum
KENNYIFLYILYTIVKPILKECYYL

SEQ ID NO: 3288457 - protein, 23 aa, Plasmodium falciparum
KENRLLFLLDFYEKNSNCNNIIF

SEQ ID NO: 3288458 - protein, 27 aa, Plasmodium falciparum
KENSTIHFFFYLVNIMFRCGNYVGLIQ

SEQ ID NO: 3288459 - protein, 26 aa, Plasmodium falciparum
KENVKLLFYILIQENLNYSPLGEMEK

SEQ ID NO: 3288460 - protein, 23 aa, Plasmodium falciparum
KENVYIFAYALLLSLFNVVDSDN

SEQ ID NO: 3288461 - protein, 22 aa, Plasmodium falciparum
KENYEIILDLELLQMQNNILKE

SEQ ID NO: 3288462 - protein, 25 aa, Plasmodium falciparum
KENYFFHINKYFLKSLRKYNFQISK

SEQ ID NO: 3288463 - protein, 37 aa, Plasmodium falciparum
KENYFKLNRFLSCVFFSVHFSLSILCVACPCAVGLAS

SEQ ID NO: 3288464 - protein, 24 aa, Plasmodium falciparum
KEPNEYICFIVDTIFIYMEILYEH

SEQ ID NO: 3288465 - protein, 22 aa, Plasmodium falciparum
KEQLQNKLKYIFKKIHEKLDSE

SEQ ID NO: 3288466 - protein, 35 aa, Plasmodium falciparum
KEREFRSYIKYIYNIWFKWLKKRKGELTGEQKPWM

SEQ ID NO: 3288467 - protein, 26 aa, Plasmodium falciparum
KERISQIIWCFFFCLHLALLKIAEVF

SEQ ID NO: 3288468 - protein, 25 aa, Plasmodium falciparum
KERKKNFVSLLIPLYANIIEPNINI

SEQ ID NO: 3288469 - protein, 29 aa, Plasmodium falciparum
KERKRLIYDILFCIKIFISKYLYNLHILK

SEQ ID NO: 3288470 - protein, 36 aa, Plasmodium falciparum
KERLFLCLICLLVIIWLIYFCYKNHIFLSYLQNEKE

SEQ ID NO: 3288471 - protein, 33 aa, Plasmodium falciparum
KESDKKYIIMKELLKRWLEYFLEDYNKIKHKIS

SEQ ID NO: 3288472 - protein, 27 aa, Plasmodium falciparum
KESDRFTLYPILYPDVWDFYKKAEASF

SEQ ID NO: 3288473 - protein, 22 aa, Plasmodium falciparum
KESTIILCFLNNKNIKHKENTT

SEQ ID NO: 3288474 - protein, 31 aa, Plasmodium falciparum
KESTRIYHVVFILKLFFHNLLFISCTNNSIY

SEQ ID NO: 3288475 - protein, 26 aa, Plasmodium falciparum
KETKKIYYSFLKFIKEMQNAIFYIQK

SEQ ID NO: 3288476 - protein, 32 aa, Plasmodium falciparum
KETNKLFKKKFRYLSLKLKNILMSHCAGGLKT

SEQ ID NO: 3288477 - protein, 27 aa, Plasmodium falciparum
KETSDSFFFFFWYLLSLNQTSTKWNES

SEQ ID NO: 3288478 - protein, 24 aa, Plasmodium falciparum
KETSFNCVWISYKHELRSYDDENE

SEQ ID NO: 3288479 - protein, 37 aa, Plasmodium falciparum
KETSLITIFFLVIFSFLYFGFIIYFFNIPIKKNYIQR

SEQ ID NO: 3288480 - protein, 32 aa, Plasmodium falciparum
KEVKKLFHNKLYIIITLGMSNLYFVVTGIQFW

SEQ ID NO: 3288481 - protein, 24 aa, Plasmodium falciparum
KEVKNLLRRGISDSLKHLIWLRSN

SEQ ID NO: 3288482 - protein, 28 aa, Plasmodium falciparum
KEVKNYYLTVFFLDLLYIIKMEDQKKKK

SEQ ID NO: 3288483 - protein, 23 aa, Plasmodium falciparum
KEVLYTLYFTIYSCLHFVYVNYD

SEQ ID NO: 3288484 - protein, 22 aa, Plasmodium falciparum
KEVPKFFYLNITFRKKTDHSNN

SEQ ID NO: 3288485 - protein, 45 aa, Plasmodium falciparum
KEVSFKMNSLQKLLLLLYKLSIKLYKSYYYHASILHYHTSQQIFE

SEQ ID NO: 3288486 - protein, 25 aa, Plasmodium falciparum
KEVSKFYEFILLPIVLENIDKNKKL

SEQ ID NO: 3288487 - protein, 33 aa, Plasmodium falciparum
KEYCRKVWIELFPQLFYFFNKEEIKILNMCLIR

SEQ ID NO: 3288488 - protein, 25 aa, Plasmodium falciparum
KEYDAILLATGYKIPRKLDIPGANL

SEQ ID NO: 3288489 - protein, 30 aa, Plasmodium falciparum
KEYDPKTRLFMYYGLYGLGGRLGANIKRDK

SEQ ID NO: 3288490 - protein, 23 aa, Plasmodium falciparum
KEYKLIHNIKWYKGGKQETRIPS

SEQ ID NO: 3288491 - protein, 24 aa, Plasmodium falciparum
KEYLLYLCVVYDYYKFYKKDNNMD

SEQ ID NO: 3288492 - protein, 37 aa, Plasmodium falciparum
KEYLNFSFRKVQNLLFYTFKNSCLVSILLIVFIINDE

SEQ ID NO: 3288493 - protein, 22 aa, Plasmodium falciparum
KEYLYILITSFILFSLRSMNTS

SEQ ID NO: 3288494 - protein, 61 aa, Plasmodium falciparum
KEYNFSSYYFFLNTLIYIYSFENYLKKSFLQYIFILKNGIYSLIPSLFYLSANNINEFCLK

SEQ ID NO: 3288495 - protein, 35 aa, Plasmodium falciparum
KEYSRILFKYDSIKYVLYYIKKHTLLFQTFNCHFK

SEQ ID NO: 3288496 - protein, 18 aa, Plasmodium falciparum
KEYYFFHKSFFKYDIFMI

SEQ ID NO: 3288497 - protein, 19 aa, Plasmodium falciparum
KFDLGFSPFYFISYPLYNI

SEQ ID NO: 3288498 - protein, 19 aa, Plasmodium falciparum
KFDSQDIFVPWYFQQQYKT

SEQ ID NO: 3288499 - protein, 29 aa, Plasmodium falciparum
KFDVKPRYPLLGGWKFHFFNTFYHFSNLY

SEQ ID NO: 3288500 - protein, 35 aa, Plasmodium falciparum
KFDYISYFFLNMENFMLWLYKHKISKKIYHSRNKM

SEQ ID NO: 3288501 - protein, 25 aa, Plasmodium falciparum
KFEDDLIFLFDSIVFTIVLGSTKDN

SEQ ID NO: 3288502 - protein, 30 aa, Plasmodium falciparum
KFEGYLNNLIIKWCYTDLIIILIRDMLSLN

SEQ ID NO: 3288503 - protein, 42 aa, Plasmodium falciparum
KFEYMKILNLYYRQIIHHLLFLYYYFTVKKYYVLQLQLVHFI

SEQ ID NO: 3288504 - protein, 23 aa, Plasmodium falciparum
KFFFNNLHFIFTTLKCSTLSEIT

SEQ ID NO: 3288505 - protein, 24 aa, Plasmodium falciparum
KFFKYSKWKYDFISDIFISILLFG

SEQ ID NO: 3288506 - protein, 19 aa, Plasmodium falciparum
KFFSNLLSKTYLGYLKFFV

SEQ ID NO: 3288507 - protein, 23 aa, Plasmodium falciparum
KFGKQLFCFGDNKYFQCGRHLGK

SEQ ID NO: 3288508 - protein, 24 aa, Plasmodium falciparum
KFGMKSFIYFYEEKSIILTNMYGP

SEQ ID NO: 3288509 - protein, 19 aa, Plasmodium falciparum
KFHSLIYSIRKIHDKYFSD

SEQ ID NO: 3288510 - protein, 26 aa, Plasmodium falciparum
KFIALLIYIYYILLILNIFKELSKVS

SEQ ID NO: 3288511 - protein, 31 aa, Plasmodium falciparum
KFIDAHVNLLLQYLNFNPPKHRFNYFNELYL

SEQ ID NO: 3288512 - protein, 29 aa, Plasmodium falciparum
KFIFFKCLKLKPHNITPYLIYSSVVLGIY

SEQ ID NO: 3288513 - protein, 17 aa, Plasmodium falciparum
KFIILNYNKQLGSKSLN

SEQ ID NO: 3288514 - protein, 30 aa, Plasmodium falciparum
KFIIYTITLVYFILLLKTGKIQFNTIPYAE

SEQ ID NO: 3288515 - protein, 24 aa, Plasmodium falciparum
KFINDPVHYLRIDSTHKFINQNKP

SEQ ID NO: 3288516 - protein, 28 aa, Plasmodium falciparum
KFINNFFLKMIIIFLIINAYLHPNFERE

SEQ ID NO: 3288517 - protein, 24 aa, Plasmodium falciparum
KFINYKYFPFNYYKYYYSCEDLMD

SEQ ID NO: 3288518 - protein, 27 aa, Plasmodium falciparum
KFIQLSFIFFIIIFKYFIFTDKLSWNH

SEQ ID NO: 3288519 - protein, 21 aa, Plasmodium falciparum
KFIRPFLYYGFTPMIFGYGLY

SEQ ID NO: 3288520 - protein, 18 aa, Plasmodium falciparum
KFISLNNLFLPLIQSHKQ

SEQ ID NO: 3288521 - protein, 29 aa, Plasmodium falciparum
KFISNLLNKNIILLWSCKNIGYIFLNTDN

SEQ ID NO: 3288522 - protein, 26 aa, Plasmodium falciparum
KFITITQYFFLINKFNISFESSLSYD

SEQ ID NO: 3288523 - protein, 18 aa, Plasmodium falciparum
KFITNLNVMLRGIKISLF

SEQ ID NO: 3288524 - protein, 32 aa, Plasmodium falciparum
KFKHLRSLHSPLVRFFIMILNFDVIKKCLDDV

SEQ ID NO: 3288525 - protein, 17 aa, Plasmodium falciparum
KFKKHILNLYKLDVLNG

SEQ ID NO: 3288526 - protein, 29 aa, Plasmodium falciparum
KFKKIIYHILYMLGSALTTYLFLGALGPE

SEQ ID NO: 3288527 - protein, 39 aa, Plasmodium falciparum
KFKNYPFYFYIYLSLIYFILFILIILFDNSYLGSNKEQH

SEQ ID NO: 3288528 - protein, 20 aa, Plasmodium falciparum
KFKRLFIYSYRDDAKSNLYK

SEQ ID NO: 3288529 - protein, 17 aa, Plasmodium falciparum
KFKTIIRVFRIIYEFQD

SEQ ID NO: 3288530 - protein, 30 aa, Plasmodium falciparum
KFKYATYILILSFLLYKGIPWKRENYYTYL

SEQ ID NO: 3288531 - protein, 43 aa, Plasmodium falciparum
KFKYNICMFIQKNLFHYFKTNLVHYFFLLSNEHLSRCIINYFC

SEQ ID NO: 3288532 - protein, 19 aa, Plasmodium falciparum
KFLCIIKYYGEKLNYLLLL

SEQ ID NO: 3288533 - protein, 21 aa, Plasmodium falciparum
KFLDDIIVKIKDELYINIDLI

SEQ ID NO: 3288534 - protein, 18 aa, Plasmodium falciparum
KFLDLLNKEEVCTKFSED

SEQ ID NO: 3288535 - protein, 17 aa, Plasmodium falciparum
KFLDLRSDWWEANRHQV

SEQ ID NO: 3288536 - protein, 20 aa, Plasmodium falciparum
KFLEEFFSYIDFYFYIYSGE

SEQ ID NO: 3288537 - protein, 17 aa, Plasmodium falciparum
KFLINKKFCPIYLIEKL

SEQ ID NO: 3288538 - protein, 22 aa, Plasmodium falciparum
KFLQDFFVNFVHFFENYNKYID

SEQ ID NO: 3288539 - protein, 17 aa, Plasmodium falciparum
KFLQWLMEWARKYCSEK

SEQ ID NO: 3288540 - protein, 23 aa, Plasmodium falciparum
KFLRAYFFSFFCGIIMNIICEFQ

SEQ ID NO: 3288541 - protein, 25 aa, Plasmodium falciparum
KFLTVDKIFYLLKKIDTFSDYYYSV

SEQ ID NO: 3288542 - protein, 18 aa, Plasmodium falciparum
KFLWNCIMALRKIQTTKD

SEQ ID NO: 3288543 - protein, 20 aa, Plasmodium falciparum
KFLYCLNLKTCLLKENKINY

SEQ ID NO: 3288544 - protein, 23 aa, Plasmodium falciparum
KFLYNVIQLYLSVIVKIIELGNF

SEQ ID NO: 3288545 - protein, 18 aa, Plasmodium falciparum
KFMLLINYLFMFGSLLTI

SEQ ID NO: 3288546 - protein, 31 aa, Plasmodium falciparum
KFMSSFTFVFFFFIFIYAFLLSIIHIFINYF

SEQ ID NO: 3288547 - protein, 25 aa, Plasmodium falciparum
KFNIPVSVIWFLYGMCTYVIAKNFN

SEQ ID NO: 3288548 - protein, 27 aa, Plasmodium falciparum
KFNKFKLFHFIHLLSLSFSITWDLHIL

SEQ ID NO: 3288549 - protein, 31 aa, Plasmodium falciparum
KFNKIKWALILFFIPAWLIINIVYIILVQKM

SEQ ID NO: 3288550 - protein, 33 aa, Plasmodium falciparum
KFNLVCNIVSSFFFYSFILKKKKIRHKRFKCLN

SEQ ID NO: 3288551 - protein, 25 aa, Plasmodium falciparum
KFQNKIYLKFPYYSYYDKKGVLKYM

SEQ ID NO: 3288552 - protein, 20 aa, Plasmodium falciparum
KFREYFFRKIQNNYNFEERK

SEQ ID NO: 3288553 - protein, 32 aa, Plasmodium falciparum
KFRGKNKIPLYLKIRVYVLRGIGLYGINNEYT

SEQ ID NO: 3288554 - protein, 19 aa, Plasmodium falciparum
KFSFIYIHFFNSISKKTYN

SEQ ID NO: 3288555 - protein, 25 aa, Plasmodium falciparum
KFSHLYFFFFFNIKSSFNFSSNIIF

SEQ ID NO: 3288556 - protein, 33 aa, Plasmodium falciparum
KFSLEHLYIILSSFKKMNLFFERCIILVCKKFK

SEQ ID NO: 3288557 - protein, 25 aa, Plasmodium falciparum
KFSVDLLRVLNIPKGDYEMPTLKSK

SEQ ID NO: 3288558 - protein, 18 aa, Plasmodium falciparum
KFTHNCFLFILNSINKKD

SEQ ID NO: 3288559 - protein, 36 aa, Plasmodium falciparum
KFTNKMHLALIKRYFMSLIFIMLSYIMIEIIYISKE

SEQ ID NO: 3288560 - protein, 23 aa, Plasmodium falciparum
KFTSIIMPLYVYKILISNVANFP

SEQ ID NO: 3288561 - protein, 32 aa, Plasmodium falciparum
KFTTRLICGILFSYVTLILEVIIFIIINEKIE

SEQ ID NO: 3288562 - protein, 18 aa, Plasmodium falciparum
KFVPPYYKKKNLFYNFRP

SEQ ID NO: 3288563 - protein, 18 aa, Plasmodium falciparum
KFVPTNVPPAPPPQPPPP

SEQ ID NO: 3288564 - protein, 55 aa, Plasmodium falciparum
KFVQKNYPKILYIIWNIVLLIKQYLVIILWFNDIKPFFPLFNYPNDDNKQNKFLQ

SEQ ID NO: 3288565 - protein, 21 aa, Plasmodium falciparum
KFVQLLRLNFGYLVNYMEKES

SEQ ID NO: 3288566 - protein, 28 aa, Plasmodium falciparum
KFVRLLPVFFIFIVLLGIYLIYIMYHCL

SEQ ID NO: 3288567 - protein, 18 aa, Plasmodium falciparum
KFWCLLFAYVISFVSTTY

SEQ ID NO: 3288568 - protein, 19 aa, Plasmodium falciparum
KFYKILKEKNNYGTVGEFL

SEQ ID NO: 3288569 - protein, 18 aa, Plasmodium falciparum
KFYMLYKNKKQIPSTIRL

SEQ ID NO: 3288570 - protein, 19 aa, Plasmodium falciparum
KFYNILKGIPEGGLDKFLD

SEQ ID NO: 3288571 - protein, 25 aa, Plasmodium falciparum
KFYRIKICSYPFFNSCKTYGMKIEA

SEQ ID NO: 3288572 - protein, 23 aa, Plasmodium falciparum
KFYTFHILEFLRLKILEIKEDVD

SEQ ID NO: 3288573 - protein, 20 aa, Plasmodium falciparum
KFYVYTWMLLFCISTILSII

SEQ ID NO: 3288574 - protein, 25 aa, Plasmodium falciparum
KGCLKSVLFILLYNRQEINNEVDNT

SEQ ID NO: 3288575 - protein, 25 aa, Plasmodium falciparum
KGCTDCFFACYPYEKWIDNKKKEFL

SEQ ID NO: 3288576 - protein, 29 aa, Plasmodium falciparum
KGCVSILLNIFNQFVLFIGCHMPAKDQEI

SEQ ID NO: 3288577 - protein, 24 aa, Plasmodium falciparum
KGDIYYVSLLFYILQVYMDICLNE

SEQ ID NO: 3288578 - protein, 23 aa, Plasmodium falciparum
KGDSNFCILLLYEKKMNNVTSRV

SEQ ID NO: 3288579 - protein, 23 aa, Plasmodium falciparum
KGEKLAFSIFFYVDNISNPYNIT

SEQ ID NO: 3288580 - protein, 26 aa, Plasmodium falciparum
KGEPRTLFYYEIYKKLFVYYECAINE

SEQ ID NO: 3288581 - protein, 24 aa, Plasmodium falciparum
KGETETKYNLIYEKINEEVEKAKF

SEQ ID NO: 3288582 - protein, 18 aa, Plasmodium falciparum
KGEYINFKPILCSSQFNL

SEQ ID NO: 3288583 - protein, 48 aa, Plasmodium falciparum
KGFNYSILSDMWSIGIIFYILMTGITPLPMCLMINYKNTKDILLKKEK

SEQ ID NO: 3288584 - protein, 28 aa, Plasmodium falciparum
KGFYFKDSFFLYKKIKTSFLYFACITES

SEQ ID NO: 3288585 - protein, 19 aa, Plasmodium falciparum
KGGFFYSKGYCLECLEGAL

SEQ ID NO: 3288586 - protein, 40 aa, Plasmodium falciparum
KGIEHYIKYVPVALAVFGVLFVFILFNKEWIDKESHDILP

SEQ ID NO: 3288587 - protein, 29 aa, Plasmodium falciparum
KGIETINITYFLSLYYIYINQNKNNIQLR

SEQ ID NO: 3288588 - protein, 17 aa, Plasmodium falciparum
KGIKEIVAIFIFDDLNI

SEQ ID NO: 3288589 - protein, 24 aa, Plasmodium falciparum
KGILDKIHVLWFYEKKNEVHYLHL

SEQ ID NO: 3288590 - protein, 36 aa, Plasmodium falciparum
KGILHYISFKFLCLCLYMIGFYYVFLNNSSENSSSE

SEQ ID NO: 3288591 - protein, 25 aa, Plasmodium falciparum
KGIQENLLTGMFRSIETSIVIQSEE

SEQ ID NO: 3288592 - protein, 17 aa, Plasmodium falciparum
KGKELFPIFTAKQLVIF

SEQ ID NO: 3288593 - protein, 25 aa, Plasmodium falciparum
KGKINFPHFMILPKDIHDIFVKENK

SEQ ID NO: 3288594 - protein, 22 aa, Plasmodium falciparum
KGKKFFIFERLIKERKYICVNK

SEQ ID NO: 3288595 - protein, 39 aa, Plasmodium falciparum
KGKKKNFVFLALLKVPIILFSLLIYFKKNDYWSSNMYGY

SEQ ID NO: 3288596 - protein, 26 aa, Plasmodium falciparum
KGKKKYFLLFIKYYKEIFNTNDIFII

SEQ ID NO: 3288597 - protein, 36 aa, Plasmodium falciparum
KGKLHYISFKFLCLCLYMIGFYYVFLNNSSENSSSE

SEQ ID NO: 3288598 - protein, 39 aa, Plasmodium falciparum
KGKLNFISFKFLCLCLYMIGFLYIFLNISLENKSLEKVE

SEQ ID NO: 3288599 - protein, 35 aa, Plasmodium falciparum
KGKTNLFLMLYRSYGKTFIYFYKCSLYFYEDLTSY

SEQ ID NO: 3288600 - protein, 18 aa, Plasmodium falciparum
KGLKDIINKLLSLESRMK

SEQ ID NO: 3288601 - protein, 30 aa, Plasmodium falciparum
KGLNYNYVCALYITFFSKVICLSEGYKKYM

SEQ ID NO: 3288602 - protein, 18 aa, Plasmodium falciparum
KGLREVFKKIYEGLKNNG

SEQ ID NO: 3288603 - protein, 25 aa, Plasmodium falciparum
KGLTSIFIFLILRLIIFSKDKDDSH

SEQ ID NO: 3288604 - protein, 19 aa, Plasmodium falciparum
KGMFYWIGYNINDFDHYNY

SEQ ID NO: 3288605 - protein, 17 aa, Plasmodium falciparum
KGNMYYTNLWIENKKMD

SEQ ID NO: 3288606 - protein, 25 aa, Plasmodium falciparum
KGNPLLLNFLKYLITLEKFKEYITN

SEQ ID NO: 3288607 - protein, 36 aa, Plasmodium falciparum
KGNYTTYVFCLAFALLIILTLMLIYKKIRDVEKKHI

SEQ ID NO: 3288608 - protein, 17 aa, Plasmodium falciparum
KGPFYFSYYYNLTISLQ

SEQ ID NO: 3288609 - protein, 29 aa, Plasmodium falciparum
KGQEVMVYHPFFWKWVTEMLDDSIKWRKE

SEQ ID NO: 3288610 - protein, 21 aa, Plasmodium falciparum
KGRIYNIPDAIKKDLLLKIQL

SEQ ID NO: 3288611 - protein, 38 aa, Plasmodium falciparum
KGRRKLWRISIFKIILIILFLCLFKKNDVLILKDECFD

SEQ ID NO: 3288612 - protein, 20 aa, Plasmodium falciparum
KGSIYYIKKGSPRNSIKRED

SEQ ID NO: 3288613 - protein, 24 aa, Plasmodium falciparum
KGTKLNILKYMKLYMQKPVKHRIT

SEQ ID NO: 3288614 - protein, 35 aa, Plasmodium falciparum
KGTMIPFLLRLINCYYPYTLSLYFTSFDRLYLLIL

SEQ ID NO: 3288615 - protein, 18 aa, Plasmodium falciparum
KGVNFLDTIKRNDSSYKF

SEQ ID NO: 3288616 - protein, 41 aa, Plasmodium falciparum
KGVYYIVFIFFINFSFFLYCLFLYKINTIYFFLRQIYKQCK

SEQ ID NO: 3288617 - protein, 31 aa, Plasmodium falciparum
KGYDNDYVYIPFLITEIRLYVSSRSADLVMK

SEQ ID NO: 3288618 - protein, 38 aa, Plasmodium falciparum
KGYIYPFFVMLPFIFPVIISMCFFLSVFFLNMYYESFS

SEQ ID NO: 3288619 - protein, 21 aa, Plasmodium falciparum
KGYLFFFHNMFNNINLMINNK

SEQ ID NO: 3288620 - protein, 20 aa, Plasmodium falciparum
KGYWIMIKHLHYSTPSLLDR

SEQ ID NO: 3288621 - protein, 20 aa, Plasmodium falciparum
KHAFLFISMGSIVTIILSVF

SEQ ID NO: 3288622 - protein, 20 aa, Plasmodium falciparum
KHAFRLLLFYDENITKSKNF

SEQ ID NO: 3288623 - protein, 35 aa, Plasmodium falciparum
KHCIGQIIHMLYFICLIFILYNRNTCLRRIAKCGR

SEQ ID NO: 3288624 - protein, 32 aa, Plasmodium falciparum
KHDLLRVNYLRYVMSKLLLSLTLSFNRQEIEQ

SEQ ID NO: 3288625 - protein, 25 aa, Plasmodium falciparum
KHDNSFLRYLSFYVLSKLLSEDYIK

SEQ ID NO: 3288626 - protein, 18 aa, Plasmodium falciparum
KHEILEYFYFISNKEIKE

SEQ ID NO: 3288627 - protein, 24 aa, Plasmodium falciparum
KHEKEILDFLLKNLMNYINKYSFC

SEQ ID NO: 3288628 - protein, 20 aa, Plasmodium falciparum
KHEQLFLLWGNGPSLINFIF

SEQ ID NO: 3288629 - protein, 24 aa, Plasmodium falciparum
KHFEDKYIIFLEKITLLILKIMMN

SEQ ID NO: 3288630 - protein, 18 aa, Plasmodium falciparum
KHFFNASGCYRKIVVKPY

SEQ ID NO: 3288631 - protein, 19 aa, Plasmodium falciparum
KHFKILCITIRPGEVINYV

SEQ ID NO: 3288632 - protein, 35 aa, Plasmodium falciparum
KHFKNIEFIFKSQSSYLFMLYLICISKYGLDDKSI

SEQ ID NO: 3288633 - protein, 24 aa, Plasmodium falciparum
KHFNLLSYFILNLTKNLLPKTKNL

SEQ ID NO: 3288634 - protein, 26 aa, Plasmodium falciparum
KHFNTKLYCFFIFKQRNNNEIVDGVH

SEQ ID NO: 3288635 - protein, 18 aa, Plasmodium falciparum
KHFSLFMRILFNIKYIYY

SEQ ID NO: 3288636 - protein, 20 aa, Plasmodium falciparum
KHFVFKNMSVFMLNFCSLYI

SEQ ID NO: 3288637 - protein, 18 aa, Plasmodium falciparum
KHFYLITQGYIKASNYIN

SEQ ID NO: 3288638 - protein, 19 aa, Plasmodium falciparum
KHFYSFFEYIFINDNINIK

SEQ ID NO: 3288639 - protein, 39 aa, Plasmodium falciparum
KHGLAIGGFFAPLIYVLKFLLYLFAKPTSLLLDHFVGKN

SEQ ID NO: 3288640 - protein, 29 aa, Plasmodium falciparum
KHHEEIMSYLLLDVYHNNIVYKNNYGFLY

SEQ ID NO: 3288641 - protein, 29 aa, Plasmodium falciparum
KHHIKKNIPFLFFIYELMITFFNTAENIN

SEQ ID NO: 3288642 - protein, 22 aa, Plasmodium falciparum
KHIFTSFFFYINNIYSYIDILD

SEQ ID NO: 3288643 - protein, 21 aa, Plasmodium falciparum
KHIITIRALVTHWVQNFLDDY

SEQ ID NO: 3288644 - protein, 21 aa, Plasmodium falciparum
KHIITIRALVTHWVQNFLEDY

SEQ ID NO: 3288645 - protein, 25 aa, Plasmodium falciparum
KHILSSIFFILTYYNFSAETNYSDL

SEQ ID NO: 3288646 - protein, 22 aa, Plasmodium falciparum
KHISMMLQLLTLYHTCIMEPCP

SEQ ID NO: 3288647 - protein, 24 aa, Plasmodium falciparum
KHKFINFHFIKLFDILNIHTYIID

SEQ ID NO: 3288648 - protein, 26 aa, Plasmodium falciparum
KHKLDDILKFIYSFLEHFKILKKELY

SEQ ID NO: 3288649 - protein, 22 aa, Plasmodium falciparum
KHKMYNYFLKNKYINIFINIYH

SEQ ID NO: 3288650 - protein, 45 aa, Plasmodium falciparum
KHKNKYPSLYYYTLLLFHILNIPLYYYPSFYFISRLLSFTAHINE

SEQ ID NO: 3288651 - protein, 24 aa, Plasmodium falciparum
KHKSFNYHVLSSSVPRQIAKNEKF

SEQ ID NO: 3288652 - protein, 19 aa, Plasmodium falciparum
KHKYAYNYLFKFIISLGNI

SEQ ID NO: 3288653 - protein, 34 aa, Plasmodium falciparum
KHKYSLLIGLFITFLIFCGFFRYMTELYHTHFYN

SEQ ID NO: 3288654 - protein, 30 aa, Plasmodium falciparum
KHLDMCIIYGKILIIQYFNFQNLYIYDKKY

SEQ ID NO: 3288655 - protein, 25 aa, Plasmodium falciparum
KHLELRKDWWFANRDKVWEAMKCEQ

SEQ ID NO: 3288656 - protein, 43 aa, Plasmodium falciparum
KHLLNYDQFIYNKMYNILPFCLFHEHPITFNPTYKYKKHSNMY

SEQ ID NO: 3288657 - protein, 23 aa, Plasmodium falciparum
KHLLVEHFFKYVLYDFIINYEGI

SEQ ID NO: 3288658 - protein, 19 aa, Plasmodium falciparum
KHLLVFLLMFNLVGIYLFY

SEQ ID NO: 3288659 - protein, 40 aa, Plasmodium falciparum
KHMNKYLYIQFLFHFNLATLKLMNFLNLKIINIIKKYSHV

SEQ ID NO: 3288660 - protein, 43 aa, Plasmodium falciparum
KHMTFPYIYNQYFISFFFFFKIHYLFFLIKFKCENEIFLKAYW

SEQ ID NO: 3288661 - protein, 28 aa, Plasmodium falciparum
KHNERRRTLRWRGYKDAKLNSPFVDDLF

SEQ ID NO: 3288662 - protein, 27 aa, Plasmodium falciparum
KHNWNICLLWIRVILSSSLLISLIFYN

SEQ ID NO: 3288663 - protein, 20 aa, Plasmodium falciparum
KHNYFFIISSYINLKKNYDI

SEQ ID NO: 3288664 - protein, 17 aa, Plasmodium falciparum
KHNYLWKLQKRLEKKSK

SEQ ID NO: 3288665 - protein, 25 aa, Plasmodium falciparum
KHPVGPILLVVFIFVVIGSVIVQML

SEQ ID NO: 3288666 - protein, 26 aa, Plasmodium falciparum
KHRVRNYLFTIKELKYPELFDLTNHM

SEQ ID NO: 3288667 - protein, 48 aa, Plasmodium falciparum
KHTLLFQTFNCHFKKLLINYLFVTLNPLNVLIFVYLKLYQNNDKTNVV

SEQ ID NO: 3288668 - protein, 23 aa, Plasmodium falciparum
KHVSNYLSIKKLMYKLKCCGESM

SEQ ID NO: 3288669 - protein, 26 aa, Plasmodium falciparum
KHYDKKKVILLKKSNIKYIRVFNNEV

SEQ ID NO: 3288670 - protein, 35 aa, Plasmodium falciparum
KIAEPIFDCILFTLIFFIIYVLYISWNNEKIQIAQ

SEQ ID NO: 3288671 - protein, 20 aa, Plasmodium falciparum
KIAFIFFLSLMNLMVSLLIY

SEQ ID NO: 3288672 - protein, 22 aa, Plasmodium falciparum
KICFFIMNCLVLLYIMSVCSNS

SEQ ID NO: 3288673 - protein, 19 aa, Plasmodium falciparum
KICILINIHKYLIPSSDMK

SEQ ID NO: 3288674 - protein, 31 aa, Plasmodium falciparum
KICKTIYAFYFWFFAILNLIVYFNIAHSFSI

SEQ ID NO: 3288675 - protein, 17 aa, Plasmodium falciparum
KICLFFNIKYNIAIIYA

SEQ ID NO: 3288676 - protein, 21 aa, Plasmodium falciparum
KICLYLLLVNTLILLTKCSLR

SEQ ID NO: 3288677 - protein, 18 aa, Plasmodium falciparum
KICNMLCLYILKNNYKMK

SEQ ID NO: 3288678 - protein, 18 aa, Plasmodium falciparum
KICYLNDYLKYVLIHLSI

SEQ ID NO: 3288679 - protein, 21 aa, Plasmodium falciparum
KIDHKILLSNYLNLFKHTNYS

SEQ ID NO: 3288680 - protein, 22 aa, Plasmodium falciparum
KIDIFFLKNILCMLHVFFTRGI

SEQ ID NO: 3288681 - protein, 38 aa, Plasmodium falciparum
KIDLILSFKQFYYILDIVNYYFIYSCLVNGLCIEEWLN

SEQ ID NO: 3288682 - protein, 31 aa, Plasmodium falciparum
KIDLIYDSLFYIIISHFIYFFLNMNIELDEE

SEQ ID NO: 3288683 - protein, 36 aa, Plasmodium falciparum
KIDLNQYTTFKVLLIYWLEDFIEGYYILKKRKVFEQ

SEQ ID NO: 3288684 - protein, 24 aa, Plasmodium falciparum
KIDNDIYFFYKQKKYIFNYETFIF

SEQ ID NO: 3288685 - protein, 33 aa, Plasmodium falciparum
KIDNLTRLLLLIGVLLIFMYALFNNVTSVLYRS

SEQ ID NO: 3288686 - protein, 25 aa, Plasmodium falciparum
KIDTKPLYIFPVLRENYIKKEDIIM

SEQ ID NO: 3288687 - protein, 25 aa, Plasmodium falciparum
KIEDNYLFPISYKINLNNFDFSLLK

SEQ ID NO: 3288688 - protein, 25 aa, Plasmodium falciparum
KIEEMYFIHTLIISTKLEALCSSIS

SEQ ID NO: 3288689 - protein, 32 aa, Plasmodium falciparum
KIEHIFIDNYFFYLYFLQFTSASIFIDELMYH

SEQ ID NO: 3288690 - protein, 37 aa, Plasmodium falciparum
KIEMLVNYIFSKKKIKIVESLLINLFKSIPQSDQFEK

SEQ ID NO: 3288691 - protein, 24 aa, Plasmodium falciparum
KIENKLFNFLYNVNKYFLINKKSY

SEQ ID NO: 3288692 - protein, 29 aa, Plasmodium falciparum
KIERHSNVLYINPTKFDPIKINDINKKGE

SEQ ID NO: 3288693 - protein, 32 aa, Plasmodium falciparum
KIETKLYKLILFLLFLLILSLSKNISNYMVIT

SEQ ID NO: 3288694 - protein, 32 aa, Plasmodium falciparum
KIETYHIYKKHLLLTFLRYIKNFLLNICSCVL

SEQ ID NO: 3288695 - protein, 17 aa, Plasmodium falciparum
KIEVLVLGGTWSCYDIA

SEQ ID NO: 3288696 - protein, 23 aa, Plasmodium falciparum
KIFDYYTFVKRYFTFLRKNETID

SEQ ID NO: 3288697 - protein, 25 aa, Plasmodium falciparum
KIFEKLLIIFNYYYNKNVEINCLHA

SEQ ID NO: 3288698 - protein, 25 aa, Plasmodium falciparum
KIFGTTMWLFTIISSIFLTLQVILQ

SEQ ID NO: 3288699 - protein, 17 aa, Plasmodium falciparum
KIFIFSIFTINLKLTNR

SEQ ID NO: 3288700 - protein, 20 aa, Plasmodium falciparum
KIFIKYILRLCKDEEYSIIH

SEQ ID NO: 3288701 - protein, 31 aa, Plasmodium falciparum
KIFITGIIISMWCVFAIYLTIRIMSPDNFDW

SEQ ID NO: 3288702 - protein, 21 aa, Plasmodium falciparum
KIFRHKFSFYNINKILYDKDD

SEQ ID NO: 3288703 - protein, 17 aa, Plasmodium falciparum
KIFWEVVDEFLSWIINT

SEQ ID NO: 3288704 - protein, 21 aa, Plasmodium falciparum
KIFYSLFKLDIYDEGIIYHIN

SEQ ID NO: 3288705 - protein, 25 aa, Plasmodium falciparum
KIGRPLIIVIIIFMLLSIFTDEIKN

SEQ ID NO: 3288706 - protein, 28 aa, Plasmodium falciparum
KIGYVIFLFVLLCLCIYLITGVECSLFG

SEQ ID NO: 3288707 - protein, 21 aa, Plasmodium falciparum
KIHDFKNLFYLLCYKNNNIQD

SEQ ID NO: 3288708 - protein, 23 aa, Plasmodium falciparum
KIHDSFFYEDTLNYKAYFDKLKD

SEQ ID NO: 3288709 - protein, 26 aa, Plasmodium falciparum
KIHIKKEEEYILLKNELKSLRENLNE

SEQ ID NO: 3288710 - protein, 35 aa, Plasmodium falciparum
KIHNYIISYLEYKQFFNLFLYILKEFEIHIKNSLF

SEQ ID NO: 3288711 - protein, 17 aa, Plasmodium falciparum
KIHNYLITIYFDDNHFS

SEQ ID NO: 3288712 - protein, 29 aa, Plasmodium falciparum
KIHYNIIRILFNLLLYMKIYMNIVTNNIK

SEQ ID NO: 3288713 - protein, 29 aa, Plasmodium falciparum
KIIELKKMYIFLLTCFVLSLACSFSSKRT

SEQ ID NO: 3288714 - protein, 22 aa, Plasmodium falciparum
KIIEMYIFFKRFKKVVISWKMY

SEQ ID NO: 3288715 - protein, 20 aa, Plasmodium falciparum
KIIEYLKKYSNIWYIDIEKY

SEQ ID NO: 3288716 - protein, 19 aa, Plasmodium falciparum
KIIFFDNHIHTKPFTLEFF

SEQ ID NO: 3288717 - protein, 17 aa, Plasmodium falciparum
KIIFFSLKYLSICYYFT

SEQ ID NO: 3288718 - protein, 20 aa, Plasmodium falciparum
KIIHVILNNLPLYELNKLCL

SEQ ID NO: 3288719 - protein, 25 aa, Plasmodium falciparum
KIIKILFIFIHIFHITIESFVTNYL

SEQ ID NO: 3288720 - protein, 18 aa, Plasmodium falciparum
KIIKLDLRKAFLSNGLII

SEQ ID NO: 3288721 - protein, 18 aa, Plasmodium falciparum
KIIKLKIKKILNLFHIKY

SEQ ID NO: 3288722 - protein, 25 aa, Plasmodium falciparum
KIIKLLIVSLFKMSYNRNIFFGPFS

SEQ ID NO: 3288723 - protein, 23 aa, Plasmodium falciparum
KIIKNIKIYLSLMTKIYYNNRKV

SEQ ID NO: 3288724 - protein, 20 aa, Plasmodium falciparum
KIIKNKIPPPKKKTVQNIRT

SEQ ID NO: 3288725 - protein, 18 aa, Plasmodium falciparum
KIIKTCYIIYMIEIHYKF

SEQ ID NO: 3288726 - protein, 22 aa, Plasmodium falciparum
KIILFIVFLLQELLLSWNININ

SEQ ID NO: 3288727 - protein, 20 aa, Plasmodium falciparum
KIILYISISKILFFSKKMYM

SEQ ID NO: 3288728 - protein, 20 aa, Plasmodium falciparum
KIINHFILNKIFENISINCT

SEQ ID NO: 3288729 - protein, 20 aa, Plasmodium falciparum
KIINIIKKKSSWIYIGVLYT

SEQ ID NO: 3288730 - protein, 28 aa, Plasmodium falciparum
KIINSSMLLFLYDFLLRVKCVDVCSIFS

SEQ ID NO: 3288731 - protein, 29 aa, Plasmodium falciparum
KIIQCTTYMFLLFFIFSTDFLFDECINIY

SEQ ID NO: 3288732 - protein, 18 aa, Plasmodium falciparum
KIIQFFMNNKNEKKVIIC

SEQ ID NO: 3288733 - protein, 21 aa, Plasmodium falciparum
KIIRNIYFFLCALSGRQFIAY

SEQ ID NO: 3288734 - protein, 25 aa, Plasmodium falciparum
KIISNIYLLYLTKNIFKYIIFARYN

SEQ ID NO: 3288735 - protein, 19 aa, Plasmodium falciparum
KIITIRGLVAHWVQYFLED

SEQ ID NO: 3288736 - protein, 25 aa, Plasmodium falciparum
KIITSAWWVYYNQVSKSAPSGEYLK

SEQ ID NO: 3288737 - protein, 25 aa, Plasmodium falciparum
KIIVSLMSFYYSLINKYYTSVKEDI

SEQ ID NO: 3288738 - protein, 18 aa, Plasmodium falciparum
KIIYKIPRNLRKRRRNKC

SEQ ID NO: 3288739 - protein, 24 aa, Plasmodium falciparum
KIKAFIHIYNMFSIYPYINNNFIQ

SEQ ID NO: 3288740 - protein, 54 aa, Plasmodium falciparum
KIKCAIYLIFLFIFYLFIYLFVYFLFIFYSFYIYIFIYYFKPWAYNKYTYVHIY

SEQ ID NO: 3288741 - protein, 19 aa, Plasmodium falciparum
KIKDLPAFLKLYGCNCADN

SEQ ID NO: 3288742 - protein, 23 aa, Plasmodium falciparum
KIKELYLKSIWKKTQRKKINKYK

SEQ ID NO: 3288743 - protein, 29 aa, Plasmodium falciparum
KIKEWLKLLNLLIFLNIKDVYIFGELFSL

SEQ ID NO: 3288744 - protein, 21 aa, Plasmodium falciparum
KIKFSYIQLYNYRTLSCLEKL

SEQ ID NO: 3288745 - protein, 22 aa, Plasmodium falciparum
KIKICCLKILIYLCNYYNNSNK

SEQ ID NO: 3288746 - protein, 26 aa, Plasmodium falciparum
KIKISFTYLLFLKIKKYILIQKFNNL

SEQ ID NO: 3288747 - protein, 17 aa, Plasmodium falciparum
KIKKAFLESYKLKKIIF

SEQ ID NO: 3288748 - protein, 33 aa, Plasmodium falciparum
KIKKHFFFFRGILFLTFIWVILGGLRNMIYKKN

SEQ ID NO: 3288749 - protein, 27 aa, Plasmodium falciparum
KIKKKNYKLIAWIQIHMMILERLKEDE

SEQ ID NO: 3288750 - protein, 18 aa, Plasmodium falciparum
KIKKKTFFKIAPFNFFRE

SEQ ID NO: 3288751 - protein, 24 aa, Plasmodium falciparum
KIKKMIIYTFYIIKNSKQLIKLHQ

SEQ ID NO: 3288752 - protein, 24 aa, Plasmodium falciparum
KIKKWLNCICKNKKNIKEFMNIIN

SEQ ID NO: 3288753 - protein, 26 aa, Plasmodium falciparum
KIKLHRIYKHFVFIKKIFYHDNLANV

SEQ ID NO: 3288754 - protein, 18 aa, Plasmodium falciparum
KIKNIWPFKEGKGDLTFL

SEQ ID NO: 3288755 - protein, 24 aa, Plasmodium falciparum
KIKNKIIHLIALKIINFIKTHTSI

SEQ ID NO: 3288756 - protein, 22 aa, Plasmodium falciparum
KIKNLEIYIQTLSVEIGNIKTQ

SEQ ID NO: 3288757 - protein, 19 aa, Plasmodium falciparum
KIKNLFTPQPFRQLSDFKP

SEQ ID NO: 3288758 - protein, 18 aa, Plasmodium falciparum
KIKNNFFQKILFDDMVCS

SEQ ID NO: 3288759 - protein, 29 aa, Plasmodium falciparum
KIKNYVYNKALHIFFFIVEYTNIYENINL

SEQ ID NO: 3288760 - protein, 18 aa, Plasmodium falciparum
KIKPFFRSLNFMTVDTRK

SEQ ID NO: 3288761 - protein, 23 aa, Plasmodium falciparum
KIKRLRKFNYFILNKCLIEKYNN

SEQ ID NO: 3288762 - protein, 22 aa, Plasmodium falciparum
KIKSIIFTDYAPCSVSIEIYEI

SEQ ID NO: 3288763 - protein, 24 aa, Plasmodium falciparum
KIKSNCIYPLFYGNIFNPDNIIFT

SEQ ID NO: 3288764 - protein, 25 aa, Plasmodium falciparum
KIKTFRDLFYFLSKKNIITIGLYRK

SEQ ID NO: 3288765 - protein, 27 aa, Plasmodium falciparum
KIKVLDLFIYFLDLNKIVTPFFFTYLT

SEQ ID NO: 3288766 - protein, 62 aa, Plasmodium falciparum
KIKYAFNWEFSFYTLVNILILFLICYSISFIIYMFSYIPFVFFRFLFFVTCSYFIIRSYELT

SEQ ID NO: 3288767 - protein, 27 aa, Plasmodium falciparum
KIKYYLNIYLIPFFHKIHISIINYISV

SEQ ID NO: 3288768 - protein, 23 aa, Plasmodium falciparum
KILDIITRFINITTSLVSLICEH

SEQ ID NO: 3288769 - protein, 24 aa, Plasmodium falciparum
KILDNLIYTLRNTSVYKIKILSSL

SEQ ID NO: 3288770 - protein, 52 aa, Plasmodium falciparum
KILEKNASAFFYLLINLLFNLSIDRFRLVINRKYIFFKKKKRIDLVFNITKK

SEQ ID NO: 3288771 - protein, 21 aa, Plasmodium falciparum
KILHPCGLIARSIFNDTFSVY

SEQ ID NO: 3288772 - protein, 30 aa, Plasmodium falciparum
KILKDFMQPDYFNWLAFYIVKSRASKEVNL

SEQ ID NO: 3288773 - protein, 17 aa, Plasmodium falciparum
KILKISCFLLRYISIDN

SEQ ID NO: 3288774 - protein, 31 aa, Plasmodium falciparum
KILKSYLMKHKFEKILKLLKSLKYNESNDDI

SEQ ID NO: 3288775 - protein, 27 aa, Plasmodium falciparum
KILLCTIFIWICQCFYNKSYYVYKKDG

SEQ ID NO: 3288776 - protein, 18 aa, Plasmodium falciparum
KILLLKDDKIYFYNSEYS

SEQ ID NO: 3288777 - protein, 24 aa, Plasmodium falciparum
KILMTFTNLPCFPPNYIHIFEYHP

SEQ ID NO: 3288778 - protein, 26 aa, Plasmodium falciparum
KILNYLILIYYVIIMFLHFFSTSEVR

SEQ ID NO: 3288779 - protein, 19 aa, Plasmodium falciparum
KILSNFFLFYNEKSNINFD

SEQ ID NO: 3288780 - protein, 20 aa, Plasmodium falciparum
KILSSILFYYIKYSEDDLYL

SEQ ID NO: 3288781 - protein, 17 aa, Plasmodium falciparum
KILTACIKLVYYQRNKN

SEQ ID NO: 3288782 - protein, 19 aa, Plasmodium falciparum
KILTFYLDLFFDDNEQIRE

SEQ ID NO: 3288783 - protein, 35 aa, Plasmodium falciparum
KIMLHFFYGFFCSSLIYLKYYFKIEFKLIKIEHMN

SEQ ID NO: 3288784 - protein, 40 aa, Plasmodium falciparum
KIMNILNIIIEIIPQLFIKYVNFFYPYIYNNDVSKDVCEL

SEQ ID NO: 3288785 - protein, 28 aa, Plasmodium falciparum
KIMVKVLIYFTFVVVFFFHIKTLGFKKN

SEQ ID NO: 3288786 - protein, 21 aa, Plasmodium falciparum
KIMYPFWHMALARWWAKFSSY

SEQ ID NO: 3288787 - protein, 36 aa, Plasmodium falciparum
KINDDSFIFTLFYSFQFLFIPTYILQNIKVGINEGL

SEQ ID NO: 3288788 - protein, 26 aa, Plasmodium falciparum
KINDLDFFFFLRNDPFSKFLLKNITN

SEQ ID NO: 3288789 - protein, 26 aa, Plasmodium falciparum
KINDLSYIFLKLLKNGFIQNINEHNI

SEQ ID NO: 3288790 - protein, 37 aa, Plasmodium falciparum
KINDVYTLPYPLQLKSHVLWGYYLYIIQDTVESRYSE

SEQ ID NO: 3288791 - protein, 33 aa, Plasmodium falciparum
KINEYMYIFFCNNLYFFVIFINGEVTQISNIND

SEQ ID NO: 3288792 - protein, 18 aa, Plasmodium falciparum
KINFIFNTIIQRIKQEYN

SEQ ID NO: 3288793 - protein, 20 aa, Plasmodium falciparum
KINFIIFHQIINYFKKNIDN

SEQ ID NO: 3288794 - protein, 20 aa, Plasmodium falciparum
KINFSWKYLKKININVYNSV

SEQ ID NO: 3288795 - protein, 21 aa, Plasmodium falciparum
KINHSFLGDVLLAAKYEAEFI

SEQ ID NO: 3288796 - protein, 21 aa, Plasmodium falciparum
KINHSFLGEVLLAAKYEAEFI

SEQ ID NO: 3288797 - protein, 25 aa, Plasmodium falciparum
KINIIFCFFAYVPIFYLITIIPCRI

SEQ ID NO: 3288798 - protein, 20 aa, Plasmodium falciparum
KINILLFKLAYQYRTLSKFR

SEQ ID NO: 3288799 - protein, 22 aa, Plasmodium falciparum
KINKFIHSIFPKKSILIIFLIL

SEQ ID NO: 3288800 - protein, 35 aa, Plasmodium falciparum
KINKIKIIYDDTKKCYFIFYKNKCTSCLITHNILN

SEQ ID NO: 3288801 - protein, 24 aa, Plasmodium falciparum
KINKINIFLPIDSFLKFISNTFNF

SEQ ID NO: 3288802 - protein, 25 aa, Plasmodium falciparum
KINKKKVTIYLKLNEGLENIKQELH

SEQ ID NO: 3288803 - protein, 26 aa, Plasmodium falciparum
KINKKNFFFFSPKVVNIFLVYEHCMK

SEQ ID NO: 3288804 - protein, 26 aa, Plasmodium falciparum
KINKKRMIFNLIPLNWKNVCTKKKYD

SEQ ID NO: 3288805 - protein, 23 aa, Plasmodium falciparum
KINKYMCTYPFFNYKYTHFKNYI

SEQ ID NO: 3288806 - protein, 23 aa, Plasmodium falciparum
KINLKQLYILLANKKFIELFINI

SEQ ID NO: 3288807 - protein, 28 aa, Plasmodium falciparum
KINLNEFMYFLFNIYLNICTLTKRIINH

SEQ ID NO: 3288808 - protein, 33 aa, Plasmodium falciparum
KINMDHVVQLFYILTIIILKYVFKSVNKDIKKR

SEQ ID NO: 3288809 - protein, 20 aa, Plasmodium falciparum
KINMPYPMNTCNYYPYGFAY

SEQ ID NO: 3288810 - protein, 38 aa, Plasmodium falciparum
KINRKNIFIITIKIMTVFLFVLSLLNQFSKNPYNCQAT

SEQ ID NO: 3288811 - protein, 25 aa, Plasmodium falciparum
KINSHLLNIFIFSNIFIIYIEKVMT

SEQ ID NO: 3288812 - protein, 29 aa, Plasmodium falciparum
KINSKFILNIIYKLLIKSIYFFKGDINYD

SEQ ID NO: 3288813 - protein, 26 aa, Plasmodium falciparum
KINSTLWFSMYLIMKRMLIDECEIKI

SEQ ID NO: 3288814 - protein, 30 aa, Plasmodium falciparum
KINTNNFYYFYIFQIFLSIIQLHSLGIYHG

SEQ ID NO: 3288815 - protein, 22 aa, Plasmodium falciparum
KINTSTLWWEANKEKIWNAMMC

SEQ ID NO: 3288816 - protein, 33 aa, Plasmodium falciparum
KINYIILCLLFYRYCYFFYTYNSFIFSYLFTNI

SEQ ID NO: 3288817 - protein, 31 aa, Plasmodium falciparum
KIPCSIVTPLDDYIPQRLRWMTEWSEWFCKE

SEQ ID NO: 3288818 - protein, 27 aa, Plasmodium falciparum
KIPDGFLRQMFYTLADYKDILEGKNIV

SEQ ID NO: 3288819 - protein, 29 aa, Plasmodium falciparum
KIPDGFLRQMFYTLADYKDILFSGDKDKK

SEQ ID NO: 3288820 - protein, 20 aa, Plasmodium falciparum
KIPKKKVIEKKKEKEKIRKP

SEQ ID NO: 3288821 - protein, 19 aa, Plasmodium falciparum
KIPLNLLLLETDAPWCGVK

SEQ ID NO: 3288822 - protein, 18 aa, Plasmodium falciparum
KIPNAVILFLIFVCISLR

SEQ ID NO: 3288823 - protein, 19 aa, Plasmodium falciparum
KIPNIRLLCECELYAAPNY

SEQ ID NO: 3288824 - protein, 28 aa, Plasmodium falciparum
KIPPDFLRQMFYTLGDYRDILFSGSKDE

SEQ ID NO: 3288825 - protein, 22 aa, Plasmodium falciparum
KIQILLKLKESLIPQIDGNFIG

SEQ ID NO: 3288826 - protein, 25 aa, Plasmodium falciparum
KIQIQKLLFFFFETQMRDIIQNYKD

SEQ ID NO: 3288827 - protein, 29 aa, Plasmodium falciparum
KIQKIDVLLVLFILFNQTKNYHISYGISA

SEQ ID NO: 3288828 - protein, 56 aa, Plasmodium falciparum
KIQRYHMLLRKNGLGRLFFYNLRKMYNYVYNLYDFIPLYLIQNILIHYYDIYQHVN

SEQ ID NO: 3288829 - protein, 17 aa, Plasmodium falciparum
KIRIKLGMILPDDKIAP

SEQ ID NO: 3288830 - protein, 17 aa, Plasmodium falciparum
KIRNKYNYLLKDYYMKV

SEQ ID NO: 3288831 - protein, 24 aa, Plasmodium falciparum
KIRNVGFLLRWFNYNKTPSKNINF

SEQ ID NO: 3288832 - protein, 18 aa, Plasmodium falciparum
KIRVEVLIHFLSMIYTKK

SEQ ID NO: 3288833 - protein, 28 aa, Plasmodium falciparum
KIRYCTKCFLWLHIFPCNNKLFNYKFFK

SEQ ID NO: 3288834 - protein, 17 aa, Plasmodium falciparum
KISIYMKVPYYTLTIFN

SEQ ID NO: 3288835 - protein, 26 aa, Plasmodium falciparum
KISMPKERWFGYIKDYDGGTLMECYI

SEQ ID NO: 3288836 - protein, 34 aa, Plasmodium falciparum
KISNKKYFIFKSFAVFLFIWFLNNLKECKTAEYL

SEQ ID NO: 3288837 - protein, 26 aa, Plasmodium falciparum
KISTLFMFFVLLKSTLLLFPPVLCVL

SEQ ID NO: 3288838 - protein, 24 aa, Plasmodium falciparum
KISVPLFFSPFFTKGVNKNEVEVI

SEQ ID NO: 3288839 - protein, 21 aa, Plasmodium falciparum
KISYEYNIKISFDNFWNIADP

SEQ ID NO: 3288840 - protein, 24 aa, Plasmodium falciparum
KISYVFICLKWKEAFCLLLNIFKN

SEQ ID NO: 3288841 - protein, 24 aa, Plasmodium falciparum
KITKKPLDIFFKKFLSKPRIKHAI

SEQ ID NO: 3288842 - protein, 25 aa, Plasmodium falciparum
KITKLAMRLFYLSSVLFFKSMPSGL

SEQ ID NO: 3288843 - protein, 26 aa, Plasmodium falciparum
KITTYIYFLVIILNLIILIYTIFTNV

SEQ ID NO: 3288844 - protein, 51 aa, Plasmodium falciparum
KIVELKKKIRIKKFVQLTLLLLLISIIVFISTYGFSYILEISQKKLQINAE

SEQ ID NO: 3288845 - protein, 19 aa, Plasmodium falciparum
KIVTFVNSYIFINRLPFDI

SEQ ID NO: 3288846 - protein, 35 aa, Plasmodium falciparum
KIYCSHIRLSFFFPLLFYKTYYINDILSSSLFIYS

SEQ ID NO: 3288847 - protein, 17 aa, Plasmodium falciparum
KIYDKIYYYILIVSICY

SEQ ID NO: 3288848 - protein, 26 aa, Plasmodium falciparum
KIYDRYKYFFMLYSEMYLEKYLFSIP

SEQ ID NO: 3288849 - protein, 20 aa, Plasmodium falciparum
KIYEILFDVFNKYDYIIIYL

SEQ ID NO: 3288850 - protein, 23 aa, Plasmodium falciparum
KIYFFFDCRKISHTLLNLSSIFY

SEQ ID NO: 3288851 - protein, 19 aa, Plasmodium falciparum
KIYFLKFSKELYEHLSVLD

SEQ ID NO: 3288852 - protein, 26 aa, Plasmodium falciparum
KIYHHKYFFLSHIYCFFFYDNEIIKI

SEQ ID NO: 3288853 - protein, 27 aa, Plasmodium falciparum
KIYINVNYILKLFLTKNFLMNVSAITI

SEQ ID NO: 3288854 - protein, 21 aa, Plasmodium falciparum
KIYITVTILQALVLLLFNKKN

SEQ ID NO: 3288855 - protein, 23 aa, Plasmodium falciparum
KIYKKLFMLYHKIVIYKHIMDLK

SEQ ID NO: 3288856 - protein, 17 aa, Plasmodium falciparum
KIYKSLSLIIIKGLCTY

SEQ ID NO: 3288857 - protein, 20 aa, Plasmodium falciparum
KIYMKDLILLLDSIRINKAY

SEQ ID NO: 3288858 - protein, 30 aa, Plasmodium falciparum
KIYMKIRMHRFSICSNFRINLKKYKHAYKE

SEQ ID NO: 3288859 - protein, 28 aa, Plasmodium falciparum
KIYNFIESIFFQLFTIYVIIKNLKEKQH

SEQ ID NO: 3288860 - protein, 31 aa, Plasmodium falciparum
KIYNIEEWYYIYPIIIILSLNYSKYIQSFFF

SEQ ID NO: 3288861 - protein, 28 aa, Plasmodium falciparum
KIYNKINYFYKQKFYYTFYNISSSICFS

SEQ ID NO: 3288862 - protein, 29 aa, Plasmodium falciparum
KIYNNLQLFCKMFWKFGNSKVIENLSYEL

SEQ ID NO: 3288863 - protein, 18 aa, Plasmodium falciparum
KIYSFKILNPFLCCMNSR

SEQ ID NO: 3288864 - protein, 27 aa, Plasmodium falciparum
KIYSLKNVFAVSILFLYGSYECINVLQ

SEQ ID NO: 3288865 - protein, 25 aa, Plasmodium falciparum
KIYSNWPTFPQLYVNQKFIGGIDKL

SEQ ID NO: 3288866 - protein, 21 aa, Plasmodium falciparum
KIYTFHASLLLVVNPYKEIKG

SEQ ID NO: 3288867 - protein, 17 aa, Plasmodium falciparum
KIYTLYIIDGISGKLLF

SEQ ID NO: 3288868 - protein, 28 aa, Plasmodium falciparum
KIYVLLNILINIVFLHNWNYFFIERFFN

SEQ ID NO: 3288869 - protein, 23 aa, Plasmodium falciparum
KIYYIYIILIILCFEKKVCTDDN

SEQ ID NO: 3288870 - protein, 20 aa, Plasmodium falciparum
KIYYLKNYFYIINNIQKHLK

SEQ ID NO: 3288871 - protein, 24 aa, Plasmodium falciparum
KKAKIFYFMLYLKIKSNYDNICVL

SEQ ID NO: 3288872 - protein, 25 aa, Plasmodium falciparum
KKCDIQFLSFYDILKTFKGEYDYLI

SEQ ID NO: 3288873 - protein, 43 aa, Plasmodium falciparum
KKCHMREKINKYFFLIKILTCTILIWAVQYANNSDINKSWKKN

SEQ ID NO: 3288874 - protein, 19 aa, Plasmodium falciparum
KKCIFCDSGYYIKKKKCIS

SEQ ID NO: 3288875 - protein, 27 aa, Plasmodium falciparum
KKCINIYPCFFMYISYDKYKRRIMNSS

SEQ ID NO: 3288876 - protein, 17 aa, Plasmodium falciparum
KKCISFFYLHKDNIIQH

SEQ ID NO: 3288877 - protein, 23 aa, Plasmodium falciparum
KKCKLLFHIIRNIQKHIISKKKK

SEQ ID NO: 3288878 - protein, 29 aa, Plasmodium falciparum
KKCLDDVYWYKYLYLRRVYEKKRIYKNRK

SEQ ID NO: 3288879 - protein, 22 aa, Plasmodium falciparum
KKCPLNILLLLQEISDKDLEMY

SEQ ID NO: 3288880 - protein, 28 aa, Plasmodium falciparum
KKCTHLIIDILIFILENHFYYADFCLNA

SEQ ID NO: 3288881 - protein, 20 aa, Plasmodium falciparum
KKCTLIIPPKYHNSNIKESK

SEQ ID NO: 3288882 - protein, 26 aa, Plasmodium falciparum
KKCTLSFFCMSLENLILMKKANFLKT

SEQ ID NO: 3288883 - protein, 19 aa, Plasmodium falciparum
KKCVLFIYNLELTTKNIQY

SEQ ID NO: 3288884 - protein, 24 aa, Plasmodium falciparum
KKDARFEKILYEEIYMNKNIKAMS

SEQ ID NO: 3288885 - protein, 23 aa, Plasmodium falciparum
KKDFLYDTLTLYYLSSIECICKV

SEQ ID NO: 3288886 - protein, 24 aa, Plasmodium falciparum
KKDHMYLALLWIKEKLSLFNKYNL

SEQ ID NO: 3288887 - protein, 25 aa, Plasmodium falciparum
KKDKSLNVWKYGLKVSLEIIEYVSN

SEQ ID NO: 3288888 - protein, 25 aa, Plasmodium falciparum
KKDLYNKYMDVLKSLKSEEMDASVN

SEQ ID NO: 3288889 - protein, 32 aa, Plasmodium falciparum
KKDLYPNVFFHKLMLYYFLKKSDYSSNLVITK

SEQ ID NO: 3288890 - protein, 22 aa, Plasmodium falciparum
KKDMVTLLLSRLQNEIKTCQNP

SEQ ID NO: 3288891 - protein, 24 aa, Plasmodium falciparum
KKDNLLIMNILYNKINYICYILKS

SEQ ID NO: 3288892 - protein, 24 aa, Plasmodium falciparum
KKDQSYFFLYSNPFVNFFIDSIKK

SEQ ID NO: 3288893 - protein, 31 aa, Plasmodium falciparum
KKDRKKLSFFILLHKFYLDNYNIVINKLKNM

SEQ ID NO: 3288894 - protein, 36 aa, Plasmodium falciparum
KKDVTIIFFSILVAGGLYPVFALLYARYVSTLFDFA

SEQ ID NO: 3288895 - protein, 23 aa, Plasmodium falciparum
KKEDFLVFTLYIQKKYNINNDIQ

SEQ ID NO: 3288896 - protein, 29 aa, Plasmodium falciparum
KKEENIGIFILLNCQWLSDSFVNNVNQIE

SEQ ID NO: 3288897 - protein, 26 aa, Plasmodium falciparum
KKEEYIYFWLVFVNEGYSLSKHLFDT

SEQ ID NO: 3288898 - protein, 34 aa, Plasmodium falciparum
KKEGCYLFMRLMNVIPLIKLKIYSPLSIIHNDKY

SEQ ID NO: 3288899 - protein, 22 aa, Plasmodium falciparum
KKEHIKIYYIISNFVFFFSKMH

SEQ ID NO: 3288900 - protein, 26 aa, Plasmodium falciparum
KKEIKLYLEKIFFNTLYTKVIYEDSI

SEQ ID NO: 3288901 - protein, 33 aa, Plasmodium falciparum
KKEKEKLIKMYLLLSLLLMPFGYIYMYCIENDI

SEQ ID NO: 3288902 - protein, 30 aa, Plasmodium falciparum
KKEKKNFFIHFFIILFCFGKNILQNIKYLM

SEQ ID NO: 3288903 - protein, 36 aa, Plasmodium falciparum
KKEKRTFVLSIYAFITFIIFCIGILYFTNKSSAHNN

SEQ ID NO: 3288904 - protein, 44 aa, Plasmodium falciparum
KKEMKLLINYIIYYYNELIFNYYIYYILPYEKRLLFYKKNEQTN

SEQ ID NO: 3288905 - protein, 23 aa, Plasmodium falciparum
KKEMTAYQWLLIKDLINLSNIKN

SEQ ID NO: 3288906 - protein, 27 aa, Plasmodium falciparum
KKENFYNKVFYSFIKREAVTKHALECF

SEQ ID NO: 3288907 - protein, 31 aa, Plasmodium falciparum
KKENIDIYMYCNIYPILKRTFESFVSYLSNL

SEQ ID NO: 3288908 - protein, 22 aa, Plasmodium falciparum
KKENILFPYFHMEILKDNEMNI

SEQ ID NO: 3288909 - protein, 24 aa, Plasmodium falciparum
KKESKFLPFLTNIETLYNNLVNKI

SEQ ID NO: 3288910 - protein, 23 aa, Plasmodium falciparum
KKESYDMALLFYNNLYGIDNENF

SEQ ID NO: 3288911 - protein, 29 aa, Plasmodium falciparum
KKETKNILKTSIDLDKNLLREYKKEKNII

SEQ ID NO: 3288912 - protein, 17 aa, Plasmodium falciparum
KKEVSVPRLSVSEFKNN

SEQ ID NO: 3288913 - protein, 28 aa, Plasmodium falciparum
KKEYKYFHLVMKILFLHNYLLEKMNMLN

SEQ ID NO: 3288914 - protein, 25 aa, Plasmodium falciparum
KKEYSFHIFLYIIRTYINELISYYK

SEQ ID NO: 3288915 - protein, 19 aa, Plasmodium falciparum
KKFCPIYLIEKLGIKNHCV

SEQ ID NO: 3288916 - protein, 20 aa, Plasmodium falciparum
KKFFNEIKEYLNKKYIKDDD

SEQ ID NO: 3288917 - protein, 27 aa, Plasmodium falciparum
KKFGDLLNYIIKLKKIFNISFSMNLEK

SEQ ID NO: 3288918 - protein, 23 aa, Plasmodium falciparum
KKFHLYNVPHFIYNKIKINNIKN

SEQ ID NO: 3288919 - protein, 21 aa, Plasmodium falciparum
KKFICKIFADCSFTINFENEY

SEQ ID NO: 3288920 - protein, 33 aa, Plasmodium falciparum
KKFIIYIIIIYFFASLLNIFFFTSYISYWFNYN

SEQ ID NO: 3288921 - protein, 24 aa, Plasmodium falciparum
KKFKKIPLWIMRQAGRYLPEYVEI

SEQ ID NO: 3288922 - protein, 21 aa, Plasmodium falciparum
KKFLPIIIHIYFTNKAKSVIF

SEQ ID NO: 3288923 - protein, 26 aa, Plasmodium falciparum
KKFLYYSKLYFNSFFHMYFKSILKET

SEQ ID NO: 3288924 - protein, 31 aa, Plasmodium falciparum
KKFNIILYDISYLYYIYTKTLLNFQKEIEIK

SEQ ID NO: 3288925 - protein, 17 aa, Plasmodium falciparum
KKFNMFSYFQKIKVSEQ

SEQ ID NO: 3288926 - protein, 24 aa, Plasmodium falciparum
KKFNNDFYYLLSADSNKLKGFLKS

SEQ ID NO: 3288927 - protein, 24 aa, Plasmodium falciparum
KKFSVKTFGFLQARKLAIEYRERW

SEQ ID NO: 3288928 - protein, 25 aa, Plasmodium falciparum
KKFYAYLCYLLIKENNFTFVNKFVQ

SEQ ID NO: 3288929 - protein, 20 aa, Plasmodium falciparum
KKFYYDTPYILIKIKKNKES

SEQ ID NO: 3288930 - protein, 27 aa, Plasmodium falciparum
KKGEIWRLFTPYLYIGNLYLQYILMFN

SEQ ID NO: 3288931 - protein, 35 aa, Plasmodium falciparum
KKGENQIIIIRALFKIWLEYFLEDYNKIKKKLNPC

SEQ ID NO: 3288932 - protein, 39 aa, Plasmodium falciparum
KKGGFIFSTLFKIFFPLVIFALYNILIQINFKLNQNVNI

SEQ ID NO: 3288933 - protein, 40 aa, Plasmodium falciparum
KKGILKALKFTWRSISFFIKLIFFGLISLLFWTCRCISCL

SEQ ID NO: 3288934 - protein, 26 aa, Plasmodium falciparum
KKGINFNLLSFHNYPIAKDLCEQLLQ

SEQ ID NO: 3288935 - protein, 32 aa, Plasmodium falciparum
KKGQHFLKINYLKNMYFLLLSKRMKECLYNLK

SEQ ID NO: 3288936 - protein, 20 aa, Plasmodium falciparum
KKGTLLLCDNSRDNKMNTYN

SEQ ID NO: 3288937 - protein, 25 aa, Plasmodium falciparum
KKGTYIFLNRLFVKEKIHFRKLKEA

SEQ ID NO: 3288938 - protein, 23 aa, Plasmodium falciparum
KKGYFIYMFKSINIDYLRYKFDI

SEQ ID NO: 3288939 - protein, 37 aa, Plasmodium falciparum
KKGYNYIYIKDGEWKYFFCVLFYLQNNIGLKNDIICK

SEQ ID NO: 3288940 - protein, 30 aa, Plasmodium falciparum
KKHLIFDCYIYIFIFFKYIKHLRNTMKCKI

SEQ ID NO: 3288941 - protein, 31 aa, Plasmodium falciparum
KKHLRLDVLLFFVYLIFLNLILQNKKFEAQP

SEQ ID NO: 3288942 - protein, 24 aa, Plasmodium falciparum
KKHLTDYIHNLLNKLSACNEKMNE

SEQ ID NO: 3288943 - protein, 39 aa, Plasmodium falciparum
KKHLTKLCKFLFLKMIKPFLHFLFTYVYMGINKDYSFEY

SEQ ID NO: 3288944 - protein, 21 aa, Plasmodium falciparum
KKHNIVIKPLIFAAAKIELLK

SEQ ID NO: 3288945 - protein, 31 aa, Plasmodium falciparum
KKHSPLLYLLLLTLFDLYYLYHPFKLIIPVY

SEQ ID NO: 3288946 - protein, 36 aa, Plasmodium falciparum
KKHSQVTWCCRITLVIIFLMLVVLTSNIISNKFLKK

SEQ ID NO: 3288947 - protein, 25 aa, Plasmodium falciparum
KKIAMKNIFFYIRKKNVTINNNNNN

SEQ ID NO: 3288948 - protein, 31 aa, Plasmodium falciparum
KKIDNIVFNIYILISLLLLSSIHIKDIQNFF

SEQ ID NO: 3288949 - protein, 25 aa, Plasmodium falciparum
KKIFGLWHFIFTKNDNWFKNMGTFL

SEQ ID NO: 3288950 - protein, 30 aa, Plasmodium falciparum
KKIGDKWNFVFLIFYIFHKFNELNKNYITS

SEQ ID NO: 3288951 - protein, 28 aa, Plasmodium falciparum
KKIHKIFFDPVFYLFTSLWNNHHFQISL

SEQ ID NO: 3288952 - protein, 19 aa, Plasmodium falciparum
KKIHLKKKKVKPIPIFCCE

SEQ ID NO: 3288953 - protein, 25 aa, Plasmodium falciparum
KKIHTYSILIFFKTQIYADMFYKKF

SEQ ID NO: 3288954 - protein, 17 aa, Plasmodium falciparum
KKIHVLLKEKCSIFKNE

SEQ ID NO: 3288955 - protein, 17 aa, Plasmodium falciparum
KKIIKIIKKSKSFKSIK

SEQ ID NO: 3288956 - protein, 26 aa, Plasmodium falciparum
KKIINNFDPILLFSQYIIRLTNDDDD

SEQ ID NO: 3288957 - protein, 19 aa, Plasmodium falciparum
KKIIPITLFFLLSSICFLY

SEQ ID NO: 3288958 - protein, 36 aa, Plasmodium falciparum
KKIKEWEKQWHKIQVQYLMLYYEANTTARYGIHAYA

SEQ ID NO: 3288959 - protein, 23 aa, Plasmodium falciparum
KKIKKPILIFKTNTYITSSNEYK

SEQ ID NO: 3288960 - protein, 21 aa, Plasmodium falciparum
KKILAKYFLPKGEELKIDYEN

SEQ ID NO: 3288961 - protein, 25 aa, Plasmodium falciparum
KKILNKLIYIPFIYHSLFDKNKNFT

SEQ ID NO: 3288962 - protein, 22 aa, Plasmodium falciparum
KKILSFHNSFNEFPIINNNNKI

SEQ ID NO: 3288963 - protein, 23 aa, Plasmodium falciparum
KKILSLLLNYTFLEYFYIYYKEV

SEQ ID NO: 3288964 - protein, 25 aa, Plasmodium falciparum
KKIMKECLKLLIKLHNAGLAHLDIS

SEQ ID NO: 3288965 - protein, 24 aa, Plasmodium falciparum
KKINKFFSFFKYIFSYIYDDVVKK

SEQ ID NO: 3288966 - protein, 27 aa, Plasmodium falciparum
KKINKLIIFMKFGLFLKKKIYTDEEIC

SEQ ID NO: 3288967 - protein, 24 aa, Plasmodium falciparum
KKIPPFKLIYLISLLSYNNIMLLP

SEQ ID NO: 3288968 - protein, 39 aa, Plasmodium falciparum
KKIQCELSNMWYLFTHLFKIINIIYYNSLFNFCNIIRNE

SEQ ID NO: 3288969 - protein, 34 aa, Plasmodium falciparum
KKIQKGFQILYVLLFCSVMCGLFYYVYENVWLQR

SEQ ID NO: 3288970 - protein, 32 aa, Plasmodium falciparum
KKIQKNLVKILYFLYYVFHFIYNYNKKIENMN

SEQ ID NO: 3288971 - protein, 24 aa, Plasmodium falciparum
KKISIFICFLVKRDIYILDEPFIA

SEQ ID NO: 3288972 - protein, 25 aa, Plasmodium falciparum
KKISYFVFFHIYRNYEKLSKDRINY

SEQ ID NO: 3288973 - protein, 24 aa, Plasmodium falciparum
KKITELYHILLFDLYFCEQVLDKN

SEQ ID NO: 3288974 - protein, 20 aa, Plasmodium falciparum
KKITFINLLFNNQIKYQTKN

SEQ ID NO: 3288975 - protein, 40 aa, Plasmodium falciparum
KKIVHMNIQIKLVTFIYFLYIPVLPFYENSIRHNEQYYHV

SEQ ID NO: 3288976 - protein, 21 aa, Plasmodium falciparum
KKIVNLLKPFDKEIFGWTDVC

SEQ ID NO: 3288977 - protein, 18 aa, Plasmodium falciparum
KKIYCDHLLLYESDVSLN

SEQ ID NO: 3288978 - protein, 23 aa, Plasmodium falciparum
KKIYIDIIFHVLIPKKINRKSFK

SEQ ID NO: 3288979 - protein, 32 aa, Plasmodium falciparum
KKIYKYELRNEFFRVIKKLRYSYEHLFNMKHI

SEQ ID NO: 3288980 - protein, 20 aa, Plasmodium falciparum
KKIYVNFILLIKGIYYRGMS

SEQ ID NO: 3288981 - protein, 17 aa, Plasmodium falciparum
KKKCFLLPKKKLRKRKE

SEQ ID NO: 3288982 - protein, 30 aa, Plasmodium falciparum
KKKEEDLIEAFFPFILKKLDNESLSLDNKY

SEQ ID NO: 3288983 - protein, 37 aa, Plasmodium falciparum
KKKEEIIAYPLYESLKPFLFINYFQHLVKLNYIQTHT

SEQ ID NO: 3288984 - protein, 29 aa, Plasmodium falciparum
KKKEKIRLFYILNKISLINLKKSIRYKNN

SEQ ID NO: 3288985 - protein, 28 aa, Plasmodium falciparum
KKKFRKIFFQFLYLFLKSNSYTENLLIL

SEQ ID NO: 3288986 - protein, 26 aa, Plasmodium falciparum
KKKFSFFISEIFLKENIKKINIKEII

SEQ ID NO: 3288987 - protein, 21 aa, Plasmodium falciparum
KKKFYILDMFPYPSSEGLHVG

SEQ ID NO: 3288988 - protein, 25 aa, Plasmodium falciparum
KKKGFLFLTPLLLNKKRFEGRTYVK

SEQ ID NO: 3288989 - protein, 31 aa, Plasmodium falciparum
KKKIENLIMIRSNLYKYMNCLNVLGIRYINN

SEQ ID NO: 3288990 - protein, 22 aa, Plasmodium falciparum
KKKIHAIFEKYFKVSINVLNIW

SEQ ID NO: 3288991 - protein, 30 aa, Plasmodium falciparum
KKKIKLNFYYFLLIIQYFKNTYTQEKKRSF

SEQ ID NO: 3288992 - protein, 51 aa, Plasmodium falciparum
KKKIKVLYNLKTFINLFLNKYPKWFHKIKADLLILFILKGNDYLPKIREGN

SEQ ID NO: 3288993 - protein, 31 aa, Plasmodium falciparum
KKKILNFLKIYLLILNKINYPTPPRFLSSRA

SEQ ID NO: 3288994 - protein, 35 aa, Plasmodium falciparum
KKKILTPYYFSLNDLTPLFFLKLSNIHIYDINIQL

SEQ ID NO: 3288995 - protein, 32 aa, Plasmodium falciparum
KKKINIYEYIILLSYLFYKKSKYLGINKVYMY

SEQ ID NO: 3288996 - protein, 21 aa, Plasmodium falciparum
KKKINKFYWSPTLGYNSIGFF

SEQ ID NO: 3288997 - protein, 17 aa, Plasmodium falciparum
KKKIYIISILNDVPLSF

SEQ ID NO: 3288998 - protein, 24 aa, Plasmodium falciparum
KKKKAFIIYMLVKHVDIMFDIINM

SEQ ID NO: 3288999 - protein, 41 aa, Plasmodium falciparum
KKKKEIFYHLYYIYIYYRDILFLLKFVFTLNFCENTKYKFL

SEQ ID NO: 3289000 - protein, 35 aa, Plasmodium falciparum
KKKKEYIVYLLCERFLLFYMIDYLTLSLDISIKNT

SEQ ID NO: 3289001 - protein, 21 aa, Plasmodium falciparum
KKKKGFFFFKGGNNNNKICTS

SEQ ID NO: 3289002 - protein, 45 aa, Plasmodium falciparum
KKKKIFKMEKYIIKNIPFNIHICTCSYVNLKYKKILIKKDESNKK

SEQ ID NO: 3289003 - protein, 24 aa, Plasmodium falciparum
KKKKIFLTDIWLLGLLLYEMITKK

SEQ ID NO: 3289004 - protein, 21 aa, Plasmodium falciparum
KKKKIIINYPLKLLLNNLNFS

SEQ ID NO: 3289005 - protein, 37 aa, Plasmodium falciparum
KKKKIIQIHLNFLLNFFPVHLPIYHIKSNKTFLLIFV

SEQ ID NO: 3289006 - protein, 22 aa, Plasmodium falciparum
KKKKIPLPIKKNEKLNLSSLQS

SEQ ID NO: 3289007 - protein, 24 aa, Plasmodium falciparum
KKKKIYICTSLLLKIFKRIIKKKS

SEQ ID NO: 3289008 - protein, 18 aa, Plasmodium falciparum
KKKKKIIKIIKKSKSFKS

SEQ ID NO: 3289009 - protein, 45 aa, Plasmodium falciparum
KKKKKIKIYYYYTALNKYKIILTHLFFYFFHLYMKNYNEEYIMFL

SEQ ID NO: 3289010 - protein, 24 aa, Plasmodium falciparum
KKKKKKFYTLKYTNSSLNVWGKFK

SEQ ID NO: 3289011 - protein, 34 aa, Plasmodium falciparum
KKKKKKILFNILYFKLFRLIFDKIETYHIYKKHL

SEQ ID NO: 3289012 - protein, 30 aa, Plasmodium falciparum
KKKKKKLLFFFNYIFEQIILFVININSYNH

SEQ ID NO: 3289013 - protein, 43 aa, Plasmodium falciparum
KKKKKKYFFQVLKLIYFIMYYHPYFISLLIFRLKQIKEQDNNN

SEQ ID NO: 3289014 - protein, 24 aa, Plasmodium falciparum
KKKKKLFSFFRRKNKKNKSKNEGD

SEQ ID NO: 3289015 - protein, 17 aa, Plasmodium falciparum
KKKKKLPIFLSIYTKYI

SEQ ID NO: 3289016 - protein, 24 aa, Plasmodium falciparum
KKKKKNFLLLKKRDNENLCIDIYT

SEQ ID NO: 3289017 - protein, 25 aa, Plasmodium falciparum
KKKKKNFWNIFELIKNDTYNNDNNN

SEQ ID NO: 3289018 - protein, 27 aa, Plasmodium falciparum
KKKKKTIIIYKPFVAFGSLIMTKREVL

SEQ ID NO: 3289019 - protein, 27 aa, Plasmodium falciparum
KKKKKYILYTKPLFKLNLQYLCINDYI

SEQ ID NO: 3289020 - protein, 38 aa, Plasmodium falciparum
KKKKKYLQFFLHLSLGIFIYIYIYKYIKQNYKSIEFFI

SEQ ID NO: 3289021 - protein, 17 aa, Plasmodium falciparum
KKKKLYQWLIKYANLNK

SEQ ID NO: 3289022 - protein, 27 aa, Plasmodium falciparum
KKKKNEKLLLISSIATGLAVLVGGIIG

SEQ ID NO: 3289023 - protein, 34 aa, Plasmodium falciparum
KKKKNFLFKNFILQKLFWVYKINKHNIQIKQNNN

SEQ ID NO: 3289024 - protein, 27 aa, Plasmodium falciparum
KKKKNHLYLISPALKYLAVCLGNFYSF

SEQ ID NO: 3289025 - protein, 30 aa, Plasmodium falciparum
KKKKNIFFIMKFCQFLIEIFKLIYRDEMKN

SEQ ID NO: 3289026 - protein, 20 aa, Plasmodium falciparum
KKKKNILRIIYLQYNIKKSE

SEQ ID NO: 3289027 - protein, 23 aa, Plasmodium falciparum
KKKKNLLKLLYNSSKLKTTGCQR

SEQ ID NO: 3289028 - protein, 32 aa, Plasmodium falciparum
KKKKTIDHYFFLLLLFNILSNLPYSIIPIQKF

SEQ ID NO: 3289029 - protein, 17 aa, Plasmodium falciparum
KKKKYHFFSKNYKLHKK

SEQ ID NO: 3289030 - protein, 21 aa, Plasmodium falciparum
KKKLECIISLDYYKPLKKALQ

SEQ ID NO: 3289031 - protein, 23 aa, Plasmodium falciparum
KKKLKFTFSHLQKFFLKNFAYIS

SEQ ID NO: 3289032 - protein, 17 aa, Plasmodium falciparum
KKKLKRALLLTNKTLID

SEQ ID NO: 3289033 - protein, 25 aa, Plasmodium falciparum
KKKLLIVRTLKTIKLMLIPLNAYKE

SEQ ID NO: 3289034 - protein, 25 aa, Plasmodium falciparum
KKKLLIVRTLKTIKLMLIPLNSYKE

SEQ ID NO: 3289035 - protein, 20 aa, Plasmodium falciparum
KKKLPIFLSIYTKYIENKAI

SEQ ID NO: 3289036 - protein, 24 aa, Plasmodium falciparum
KKKLYLYFELFFILNSKRYNKKEE

SEQ ID NO: 3289037 - protein, 37 aa, Plasmodium falciparum
KKKLYTSPLFFNAVSYIIQYILNSKLFHYLREKKELT

SEQ ID NO: 3289038 - protein, 21 aa, Plasmodium falciparum
KKKMNILSIMKFNYIHDDLYK

SEQ ID NO: 3289039 - protein, 17 aa, Plasmodium falciparum
KKKMTNLRYGNTFNFIC

SEQ ID NO: 3289040 - protein, 30 aa, Plasmodium falciparum
KKKNHDKFILMLFYYHSNMLKDNKLYNIIF

SEQ ID NO: 3289041 - protein, 17 aa, Plasmodium falciparum
KKKNKFIYYTNKYLRIQ

SEQ ID NO: 3289042 - protein, 24 aa, Plasmodium falciparum
KKKNKFLNYYLKKKNHYPEMNDKI

SEQ ID NO: 3289043 - protein, 26 aa, Plasmodium falciparum
KKKNKKQMHLLKNKNFYLISCEESNY

SEQ ID NO: 3289044 - protein, 26 aa, Plasmodium falciparum
KKKNLLQKIFPFFKKKRTNISEDLSK

SEQ ID NO: 3289045 - protein, 33 aa, Plasmodium falciparum
KKKNNFHFYPDEQLLPYLYFKPTNLNKNYVYRF

SEQ ID NO: 3289046 - protein, 30 aa, Plasmodium falciparum
KKKNNFLHLKGYFILLCFVNDTIIPYVCSE

SEQ ID NO: 3289047 - protein, 29 aa, Plasmodium falciparum
KKKNRKFLIKLLKIIYKNLLEIDLYIVDY

SEQ ID NO: 3289048 - protein, 39 aa, Plasmodium falciparum
KKKNRMFFLFVIIFFSLFILYYFYLGYIRGYLSVNEFHI

SEQ ID NO: 3289049 - protein, 29 aa, Plasmodium falciparum
KKKNSAFLFIILFTLFFSLIIQNIVYFIE

SEQ ID NO: 3289050 - protein, 25 aa, Plasmodium falciparum
KKKNYIDIYYGLMKNILLNLNMNNE

SEQ ID NO: 3289051 - protein, 23 aa, Plasmodium falciparum
KKKNYKLIAWIQIHMMILERLKE

SEQ ID NO: 3289052 - protein, 53 aa, Plasmodium falciparum
KKKNYNKLRRKLKNLNYTEYLCVLCTPLVQIIFDDLIQAIHNFQKLSDKYEEL

SEQ ID NO: 3289053 - protein, 40 aa, Plasmodium falciparum
KKKRETFFTFRKILIYIIFIYILYFIDYKYLLNNHSHEQY

SEQ ID NO: 3289054 - protein, 31 aa, Plasmodium falciparum
KKKRKKKFVILFLYIILSSVIQICLTYRLGR

SEQ ID NO: 3289055 - protein, 30 aa, Plasmodium falciparum
KKKRKLFLRNIFISEILYRYKIIKKTEIIF

SEQ ID NO: 3289056 - protein, 27 aa, Plasmodium falciparum
KKKRMEELYKNYLIFYDISILSDIVQF

SEQ ID NO: 3289057 - protein, 18 aa, Plasmodium falciparum
KKKRNLWLKKINLSELPH

SEQ ID NO: 3289058 - protein, 27 aa, Plasmodium falciparum
KKKRSKIKLLFYSFNIIFGGYVIYKIY

SEQ ID NO: 3289059 - protein, 34 aa, Plasmodium falciparum
KKKRVPKRFWLYIQKLFLYKCYLINKTVNYKCEN

SEQ ID NO: 3289060 - protein, 27 aa, Plasmodium falciparum
KKKSLQIFYFLIYLVHDHSLFIIYFNS

SEQ ID NO: 3289061 - protein, 24 aa, Plasmodium falciparum
KKKSLYDTFFNITEKLESIKKGKE

SEQ ID NO: 3289062 - protein, 24 aa, Plasmodium falciparum
KKKSSEHILTLTLSLMICISILCN

SEQ ID NO: 3289063 - protein, 24 aa, Plasmodium falciparum
KKKTSIYRRFLNLHFYKNCNKERK

SEQ ID NO: 3289064 - protein, 24 aa, Plasmodium falciparum
KKKTSYFYYLIQQRIQYYNHNDSA

SEQ ID NO: 3289065 - protein, 26 aa, Plasmodium falciparum
KKKVKKFYDFFRFWVTHMLDDSMEWK

SEQ ID NO: 3289066 - protein, 23 aa, Plasmodium falciparum
KKKVKLFIKKVPLNSWIELYNKM

SEQ ID NO: 3289067 - protein, 23 aa, Plasmodium falciparum
KKKVLDLWSLFRNRFDVDIQTIF

SEQ ID NO: 3289068 - protein, 30 aa, Plasmodium falciparum
KKKYLSKYIWSVSTLYLLEIILGDECIVWW

SEQ ID NO: 3289069 - protein, 23 aa, Plasmodium falciparum
KKKYNYYLHVIRYISSIQNKYDS

SEQ ID NO: 3289070 - protein, 25 aa, Plasmodium falciparum
KKKYSIFEFYYLLYGLNKINEYEKY

SEQ ID NO: 3289071 - protein, 31 aa, Plasmodium falciparum
KKLDTYPFLPLHLLYYYMNLCSNVNYFDNIY

SEQ ID NO: 3289072 - protein, 21 aa, Plasmodium falciparum
KKLELLKIIDTKIIFLTYIKD

SEQ ID NO: 3289073 - protein, 18 aa, Plasmodium falciparum
KKLFLNILNIFDIKQRVD

SEQ ID NO: 3289074 - protein, 26 aa, Plasmodium falciparum
KKLFLQNYIFFKLYKDIFNQNYTDII

SEQ ID NO: 3289075 - protein, 23 aa, Plasmodium falciparum
KKLHFLSKWYTSFIINVKFKEVE

SEQ ID NO: 3289076 - protein, 17 aa, Plasmodium falciparum
KKLIALTKIFGNVMDDS

SEQ ID NO: 3289077 - protein, 20 aa, Plasmodium falciparum
KKLKINFMNNMNIGFFTYIC

SEQ ID NO: 3289078 - protein, 37 aa, Plasmodium falciparum
KKLKKQYLPLLAHELKIFLFFIVNITGGHFSSVLSSL

SEQ ID NO: 3289079 - protein, 26 aa, Plasmodium falciparum
KKLKKSYFPTFYYLNIKTLNDMINRD

SEQ ID NO: 3289080 - protein, 36 aa, Plasmodium falciparum
KKLKKYLTKHKSLLFCLFELCEYIYLFLDKKEKIIE

SEQ ID NO: 3289081 - protein, 29 aa, Plasmodium falciparum
KKLKSYKILFYYYLLGKKYCKELYMASDK

SEQ ID NO: 3289082 - protein, 21 aa, Plasmodium falciparum
KKLLVILIGMFLKILIGLLIS

SEQ ID NO: 3289083 - protein, 25 aa, Plasmodium falciparum
KKLNRNYISLFYFSYDTDIYEKIES

SEQ ID NO: 3289084 - protein, 26 aa, Plasmodium falciparum
KKLPHVIPLSLLFYNFNEKYFMEKNK

SEQ ID NO: 3289085 - protein, 24 aa, Plasmodium falciparum
KKLQYFMLISLISIVLICCMFPVW

SEQ ID NO: 3289086 - protein, 19 aa, Plasmodium falciparum
KKLRNLILYIHGGPYSIIL

SEQ ID NO: 3289087 - protein, 25 aa, Plasmodium falciparum
KKLSCSWLWMLPKKLALSTTSDEVL

SEQ ID NO: 3289088 - protein, 25 aa, Plasmodium falciparum
KKLSLGLLIFFISVIVLICIYCYIN

SEQ ID NO: 3289089 - protein, 22 aa, Plasmodium falciparum
KKLSYKWIPKWHMCNDIFLSRL

SEQ ID NO: 3289090 - protein, 28 aa, Plasmodium falciparum
KKLTNPFFPLLLIKLYTTDKFIINIIIK

SEQ ID NO: 3289091 - protein, 19 aa, Plasmodium falciparum
KKLYRISQLLKRRKKKWEF

SEQ ID NO: 3289092 - protein, 30 aa, Plasmodium falciparum
KKLYSDPIYLFLFIKNYFELTIDRKAWIIG

SEQ ID NO: 3289093 - protein, 21 aa, Plasmodium falciparum
KKLYTFFIKSAHIGEFIGCLI

SEQ ID NO: 3289094 - protein, 19 aa, Plasmodium falciparum
KKLYYSNTVLWRGNFFQIK

SEQ ID NO: 3289095 - protein, 31 aa, Plasmodium falciparum
KKMCEVFPEIYSHTLPWFALVDTVYKADNEN

SEQ ID NO: 3289096 - protein, 24 aa, Plasmodium falciparum
KKMENIKFLTSRAAMWYQVEKNDD

SEQ ID NO: 3289097 - protein, 28 aa, Plasmodium falciparum
KKMEYSQKFPFFLNFTNNITSNKDNKEQ

SEQ ID NO: 3289098 - protein, 19 aa, Plasmodium falciparum
KKMFNLSHTYNKKINGHNK

SEQ ID NO: 3289099 - protein, 34 aa, Plasmodium falciparum
KKMFSNYPIIKEFILLLIFLFQRIRAENEYKNVD

SEQ ID NO: 3289100 - protein, 19 aa, Plasmodium falciparum
KKMFTYSSSKPKILSFLGI

SEQ ID NO: 3289101 - protein, 25 aa, Plasmodium falciparum
KKMILYIYETLIIYILKKIDNKNIY

SEQ ID NO: 3289102 - protein, 46 aa, Plasmodium falciparum
KKMKKITIKLFYINLFICIIENFRNFLYFLPYNLYDIFNYIIHVKE

SEQ ID NO: 3289103 - protein, 18 aa, Plasmodium falciparum
KKMLIFDVLFLLGKTYFK

SEQ ID NO: 3289104 - protein, 21 aa, Plasmodium falciparum
KKMNELKLKREYKESYLLDNK

SEQ ID NO: 3289105 - protein, 24 aa, Plasmodium falciparum
KKMNKYARCFLIIQNLLEEQTCAV

SEQ ID NO: 3289106 - protein, 19 aa, Plasmodium falciparum
KKMNNIISNILYLSKLIST

SEQ ID NO: 3289107 - protein, 30 aa, Plasmodium falciparum
KKMNSYFIKILYYYINLVFLKIKNIFCDDC

SEQ ID NO: 3289108 - protein, 22 aa, Plasmodium falciparum
KKMYSNIFLRRCNVPLNLFDSN

SEQ ID NO: 3289109 - protein, 29 aa, Plasmodium falciparum
KKNAEAQFLLLLISNNPFVFSFSPNTKND

SEQ ID NO: 3289110 - protein, 23 aa, Plasmodium falciparum
KKNALKFLGIFNKKKNEKLHIKN

SEQ ID NO: 3289111 - protein, 31 aa, Plasmodium falciparum
KKNDLRNILFFPSLFWFNGQFCPPIPVVKYY

SEQ ID NO: 3289112 - protein, 25 aa, Plasmodium falciparum
KKNEKLLIFLLKMIKIFYSEWYNLC

SEQ ID NO: 3289113 - protein, 18 aa, Plasmodium falciparum
KKNFIYAYKILYKANEIN

SEQ ID NO: 3289114 - protein, 23 aa, Plasmodium falciparum
KKNFLINKLINLYIPIYNYSEYS

SEQ ID NO: 3289115 - protein, 24 aa, Plasmodium falciparum
KKNFNLLFINYFNLKRMKNSLLNK

SEQ ID NO: 3289116 - protein, 23 aa, Plasmodium falciparum
KKNFVYIKYEYFYKIKLSSYSTD

SEQ ID NO: 3289117 - protein, 23 aa, Plasmodium falciparum
KKNGHFVLPNKYDYILKKKSDIF

SEQ ID NO: 3289118 - protein, 24 aa, Plasmodium falciparum
KKNGTMYILLKKILSSRFNQMIFV

SEQ ID NO: 3289119 - protein, 26 aa, Plasmodium falciparum
KKNHLLKLAILAFPIFMEHVSNIFKR

SEQ ID NO: 3289120 - protein, 26 aa, Plasmodium falciparum
KKNIKCEIFFKLYLNISTEYILKISR

SEQ ID NO: 3289121 - protein, 31 aa, Plasmodium falciparum
KKNIKKNLLINIWIRLIGIHMIYKEYRKKIK

SEQ ID NO: 3289122 - protein, 27 aa, Plasmodium falciparum
KKNITYILEVWIYNLICLFIKTRRNSL

SEQ ID NO: 3289123 - protein, 32 aa, Plasmodium falciparum
KKNIYFLKFFFSIHFLIFLCEYTYIFSSLKEI

SEQ ID NO: 3289124 - protein, 39 aa, Plasmodium falciparum
KKNIYKINNSCFHLLLFFLPLSVPPFKSKINIYEHLLTY

SEQ ID NO: 3289125 - protein, 23 aa, Plasmodium falciparum
KKNIYMRLIIPHNDIIKKKKENV

SEQ ID NO: 3289126 - protein, 32 aa, Plasmodium falciparum
KKNKDIFYILKRIKFIIYFTSLLNQLIFDMCE

SEQ ID NO: 3289127 - protein, 25 aa, Plasmodium falciparum
KKNKKFIKLFFDINYLYFFCDNMFC

SEQ ID NO: 3289128 - protein, 25 aa, Plasmodium falciparum
KKNKKYIYMNFLRKHKTSLSFNHFT

SEQ ID NO: 3289129 - protein, 32 aa, Plasmodium falciparum
KKNKNVYPHSLGYIFLPLYNKLSRSNTNNNVS

SEQ ID NO: 3289130 - protein, 30 aa, Plasmodium falciparum
KKNKQLMVHIFLRLLLLHFIRTMMPKHMKG

SEQ ID NO: 3289131 - protein, 22 aa, Plasmodium falciparum
KKNLHVILFPLHKNNKTNDLKL

SEQ ID NO: 3289132 - protein, 24 aa, Plasmodium falciparum
KKNLIPYFIFNNWYNDENYNIYLI

SEQ ID NO: 3289133 - protein, 26 aa, Plasmodium falciparum
KKNLSKYFFSLYKGNILKQLVTEGED

SEQ ID NO: 3289134 - protein, 41 aa, Plasmodium falciparum
KKNLYKQINLILLIIFIISYYDILLFKNILKKNFEFSSIAF

SEQ ID NO: 3289135 - protein, 26 aa, Plasmodium falciparum
KKNMLKSYLYYYNKLKEPYYPYNNIK

SEQ ID NO: 3289136 - protein, 24 aa, Plasmodium falciparum
KKNNKYKLYGLLKNNYIKGKEKDT

SEQ ID NO: 3289137 - protein, 24 aa, Plasmodium falciparum
KKNNMFQFIFLNKISDNTITSSIK

SEQ ID NO: 3289138 - protein, 25 aa, Plasmodium falciparum
KKNNMYIYFLFCNATLLLHFREIDK

SEQ ID NO: 3289139 - protein, 22 aa, Plasmodium falciparum
KKNNYLSLKYLGLGYDIIMGNP

SEQ ID NO: 3289140 - protein, 24 aa, Plasmodium falciparum
KKNQYKLMHYLDISKFISIFEIIL

SEQ ID NO: 3289141 - protein, 27 aa, Plasmodium falciparum
KKNRKRNLILYSLGSAALIAALVVTGI

SEQ ID NO: 3289142 - protein, 35 aa, Plasmodium falciparum
KKNSFEIIKKMYWFLIFLITLPFSVFLIFHNPIVI

SEQ ID NO: 3289143 - protein, 57 aa, Plasmodium falciparum
KKNVSLMIFFFYFYYSYLSFLVFIISMFFLPPFISVIDYLLFILLIIPMLSICLLRN

SEQ ID NO: 3289144 - protein, 35 aa, Plasmodium falciparum
KKNYENFLLLIYNKVLHLYFKLLKEILLKEQTNIY

SEQ ID NO: 3289145 - protein, 20 aa, Plasmodium falciparum
KKNYMFGRPPFLIPQNVADS

SEQ ID NO: 3289146 - protein, 25 aa, Plasmodium falciparum
KKNYNYSIMKHRYSEFLPISKKQSF

SEQ ID NO: 3289147 - protein, 18 aa, Plasmodium falciparum
KKPKTPVDLLRVLDIPKG

SEQ ID NO: 3289148 - protein, 17 aa, Plasmodium falciparum
KKPLKLIDTHDFLTSKN

SEQ ID NO: 3289149 - protein, 38 aa, Plasmodium falciparum
KKQFPIYLTQHRIITVFLIFIYFINLKDCFHINNSRIL

SEQ ID NO: 3289150 - protein, 28 aa, Plasmodium falciparum
KKQGINYYILILLSKFKNKLIINNFYTS

SEQ ID NO: 3289151 - protein, 22 aa, Plasmodium falciparum
KKQIICIFMLQIFLNNLDKNLN

SEQ ID NO: 3289152 - protein, 37 aa, Plasmodium falciparum
KKQKKPLFLFENLKKGFSFLGFWRNQYDQKYIDDVIS

SEQ ID NO: 3289153 - protein, 27 aa, Plasmodium falciparum
KKQKKYQKYIKRFLLKKLKKDEKILKE

SEQ ID NO: 3289154 - protein, 23 aa, Plasmodium falciparum
KKQKNYNFLINEKKMKDIQNINE

SEQ ID NO: 3289155 - protein, 32 aa, Plasmodium falciparum
KKQKTFNDFFHFWVRHLLNDSIEWRDKLKKCI

SEQ ID NO: 3289156 - protein, 31 aa, Plasmodium falciparum
KKQKTFNDFFHFWVRHLLNDSIEWREGLKKC

SEQ ID NO: 3289157 - protein, 31 aa, Plasmodium falciparum
KKQKTFNDFFHFWVRHLLNDSIEWREKLDKC

SEQ ID NO: 3289158 - protein, 25 aa, Plasmodium falciparum
KKQSDILFVPFYFNKNTKDNILTSI

SEQ ID NO: 3289159 - protein, 21 aa, Plasmodium falciparum
KKREEWYIVKKRFNGQYTKEN

SEQ ID NO: 3289160 - protein, 20 aa, Plasmodium falciparum
KKREHIVLSVIITLTIYNFL

SEQ ID NO: 3289161 - protein, 19 aa, Plasmodium falciparum
KKRKFFFRRNSKDSNYLNL

SEQ ID NO: 3289162 - protein, 23 aa, Plasmodium falciparum
KKRKFLIKILKNTNIYNKIPLKY

SEQ ID NO: 3289163 - protein, 32 aa, Plasmodium falciparum
KKRKKLCYFCNSNLLYYGKWPSLFEIKQNKLV

SEQ ID NO: 3289164 - protein, 19 aa, Plasmodium falciparum
KKRKLRILCLDGGGIRGLL

SEQ ID NO: 3289165 - protein, 23 aa, Plasmodium falciparum
KKRKNIYLLLPNNNTKFPIIKNG

SEQ ID NO: 3289166 - protein, 26 aa, Plasmodium falciparum
KKRKNNFLFFFSPLSSGIMGSLVTIF

SEQ ID NO: 3289167 - protein, 34 aa, Plasmodium falciparum
KKRKNWYKISIFTYLLIFIISISFINLMTLYENR

SEQ ID NO: 3289168 - protein, 18 aa, Plasmodium falciparum
KKRKYLCLSLLLNYFKNS

SEQ ID NO: 3289169 - protein, 54 aa, Plasmodium falciparum
KKRLIHIYIKYMYLYEYLYHMILNRILYISTIKFYPFLQNIILKELNYYFHDFK

SEQ ID NO: 3289170 - protein, 21 aa, Plasmodium falciparum
KKRLIYLNCIHFVYKDIEFLF

SEQ ID NO: 3289171 - protein, 28 aa, Plasmodium falciparum
KKRNGTFFSLYFFILNILMNKCESLKEE

SEQ ID NO: 3289172 - protein, 24 aa, Plasmodium falciparum
KKRNYFFYMILHYINDRNAFISLK

SEQ ID NO: 3289173 - protein, 22 aa, Plasmodium falciparum
KKRRKFIFTAKKQSSYSNTIIC

SEQ ID NO: 3289174 - protein, 36 aa, Plasmodium falciparum
KKRSINMIIILLYLTYISFGIYFLNTYNIYIRLYYL

SEQ ID NO: 3289175 - protein, 24 aa, Plasmodium falciparum
KKRTFPFFDIFNKAISYILCNYFK

SEQ ID NO: 3289176 - protein, 19 aa, Plasmodium falciparum
KKSDWIFVVGHHPLISSGR

SEQ ID NO: 3289177 - protein, 17 aa, Plasmodium falciparum
KKSFFELWSLFYEIMEE

SEQ ID NO: 3289178 - protein, 20 aa, Plasmodium falciparum
KKSFKLLQKKSLKINLYPLD

SEQ ID NO: 3289179 - protein, 25 aa, Plasmodium falciparum
KKSFYYICYLYYNSYIFNKSIYYCS

SEQ ID NO: 3289180 - protein, 23 aa, Plasmodium falciparum
KKSKILFYIWSNNLQKIRVNEIM

SEQ ID NO: 3289181 - protein, 27 aa, Plasmodium falciparum
KKSKINNYHFLFHSFYISRCNNKTKCN

SEQ ID NO: 3289182 - protein, 31 aa, Plasmodium falciparum
KKSKKKKKSFFQMLGCNFLCNKNIETDDEEE

SEQ ID NO: 3289183 - protein, 31 aa, Plasmodium falciparum
KKSLIIDKDILSFPIKRLLFAGEHTYHSDCN

SEQ ID NO: 3289184 - protein, 17 aa, Plasmodium falciparum
KKSLYFFNHIYLNYLRI

SEQ ID NO: 3289185 - protein, 24 aa, Plasmodium falciparum
KKSSWIYIGVLYTDDLYSRAYKIP

SEQ ID NO: 3289186 - protein, 21 aa, Plasmodium falciparum
KKSTHAYQYLSKKLKKICQNG

SEQ ID NO: 3289187 - protein, 25 aa, Plasmodium falciparum
KKSVDRIYFFFLEKINNIKNKNTDI

SEQ ID NO: 3289188 - protein, 22 aa, Plasmodium falciparum
KKSYEFIFEITKYKTPDIIHNF

SEQ ID NO: 3289189 - protein, 24 aa, Plasmodium falciparum
KKSYLLINLLLRYMSEMDTQKIFF

SEQ ID NO: 3289190 - protein, 30 aa, Plasmodium falciparum
KKSYPYGINLIIGIFLTFLGGYYGSLILGY

SEQ ID NO: 3289191 - protein, 26 aa, Plasmodium falciparum
KKSYYYFYFGIILTSAVAPAFNIFSN

SEQ ID NO: 3289192 - protein, 26 aa, Plasmodium falciparum
KKTEHGRINIIYAKKFYDILKEQYGK

SEQ ID NO: 3289193 - protein, 22 aa, Plasmodium falciparum
KKTEIEIRIIIWRCTMLTNKDN

SEQ ID NO: 3289194 - protein, 40 aa, Plasmodium falciparum
KKTEMINLLIHKFLFYIIIFFIMYLNYYCYIKKNYLFISI

SEQ ID NO: 3289195 - protein, 23 aa, Plasmodium falciparum
KKTKGYFHLYKNSLVDIITHYIN

SEQ ID NO: 3289196 - protein, 27 aa, Plasmodium falciparum
KKTSLFYIYMILLRNIEERYNFNMDKM

SEQ ID NO: 3289197 - protein, 17 aa, Plasmodium falciparum
KKTYFEKLYLYSIKMKN

SEQ ID NO: 3289198 - protein, 28 aa, Plasmodium falciparum
KKVKCAYAYLLYIIYYYELTKYEKESSD

SEQ ID NO: 3289199 - protein, 26 aa, Plasmodium falciparum
KKVKKILQFCILLTFHIYKQMYLNNY

SEQ ID NO: 3289200 - protein, 22 aa, Plasmodium falciparum
KKVKLYIENITNLLGRINTFIK

SEQ ID NO: 3289201 - protein, 21 aa, Plasmodium falciparum
KKVKVIPGKWEGNGLLGIHIS

SEQ ID NO: 3289202 - protein, 26 aa, Plasmodium falciparum
KKVLFNTILYVYNYKHENIRKVQIQL

SEQ ID NO: 3289203 - protein, 33 aa, Plasmodium falciparum
KKVNKFYFIYTIITIIHFLIYVNRGIIPGSYDY

SEQ ID NO: 3289204 - protein, 25 aa, Plasmodium falciparum
KKVNLNLLLLLKKIANMFYIKQNNI

SEQ ID NO: 3289205 - protein, 31 aa, Plasmodium falciparum
KKWEQQWDAISYKYLMLYAKARITAINGGPG

SEQ ID NO: 3289206 - protein, 26 aa, Plasmodium falciparum
KKYAQFWEMFFHILLNFCNIYELNHI

SEQ ID NO: 3289207 - protein, 30 aa, Plasmodium falciparum
KKYCDIKFFLYICSYIIYYICKVLQIDDYN

SEQ ID NO: 3289208 - protein, 45 aa, Plasmodium falciparum
KKYEDNITLPMKNPSLIKNLFDCSIYSYCLGPCLENSFGNKCFRN

SEQ ID NO: 3289209 - protein, 17 aa, Plasmodium falciparum
KKYHFFSKNYKLHKKYH

SEQ ID NO: 3289210 - protein, 22 aa, Plasmodium falciparum
KKYHHAYMIPSHKYKSCLVGIQ

SEQ ID NO: 3289211 - protein, 37 aa, Plasmodium falciparum
KKYHKKIFRILLLILFYFSLPTFPFSKKFFITYHNWR

SEQ ID NO: 3289212 - protein, 37 aa, Plasmodium falciparum
KKYIHKVLFRKSIIHSLFFYNKLIYLRIVFQNQLSLD

SEQ ID NO: 3289213 - protein, 23 aa, Plasmodium falciparum
KKYIKFMYLIFNKSTYYRNVYEK

SEQ ID NO: 3289214 - protein, 18 aa, Plasmodium falciparum
KKYILNEQYLLDLHLKSL

SEQ ID NO: 3289215 - protein, 22 aa, Plasmodium falciparum
KKYINLLNIMTFFVEFIKHMNK

SEQ ID NO: 3289216 - protein, 24 aa, Plasmodium falciparum
KKYIPFFWVIFFKYINSSMLIVII

SEQ ID NO: 3289217 - protein, 26 aa, Plasmodium falciparum
KKYIWKLIYCHILGYGISLSYLDIIK

SEQ ID NO: 3289218 - protein, 19 aa, Plasmodium falciparum
KKYKKFIKKFLFINTCDEQ

SEQ ID NO: 3289219 - protein, 26 aa, Plasmodium falciparum
KKYKSFHFYIFMIRYLWNSLQNKSIS

SEQ ID NO: 3289220 - protein, 27 aa, Plasmodium falciparum
KKYKYNLFFEFIGSFLFVFFISIYMLN

SEQ ID NO: 3289221 - protein, 18 aa, Plasmodium falciparum
KKYLHASFPIFKTTAIYI

SEQ ID NO: 3289222 - protein, 26 aa, Plasmodium falciparum
KKYNQIIYDLYMYLEFLRRKNKVPHE

SEQ ID NO: 3289223 - protein, 25 aa, Plasmodium falciparum
KKYRPNIYIILFIKNNFHDDIKNLK

SEQ ID NO: 3289224 - protein, 17 aa, Plasmodium falciparum
KKYYHPLCAYLEGYYMD

SEQ ID NO: 3289225 - protein, 21 aa, Plasmodium falciparum
KKYYIFFNITYNMNIINNIIN

SEQ ID NO: 3289226 - protein, 19 aa, Plasmodium falciparum
KKYYINKEYYYVKNYYHDI

SEQ ID NO: 3289227 - protein, 26 aa, Plasmodium falciparum
KKYYKLYHLFLNVYVKYEYKFEESNF

SEQ ID NO: 3289228 - protein, 21 aa, Plasmodium falciparum
KKYYTILTFKNDVAYTYAAID

SEQ ID NO: 3289229 - protein, 31 aa, Plasmodium falciparum
KLANIKSFRFSLFFDIFFELKVNFNHFFNSH

SEQ ID NO: 3289230 - protein, 30 aa, Plasmodium falciparum
KLANKKFILLLAFSILAITLDVRYASCSGT

SEQ ID NO: 3289231 - protein, 44 aa, Plasmodium falciparum
KLANQNIICRILYYIFFKLLLYWFIKIFFKFYYIKIEQVHVNIY

SEQ ID NO: 3289232 - protein, 26 aa, Plasmodium falciparum
KLASYDLYMMLYYYQFFTFQSICNPN

SEQ ID NO: 3289233 - protein, 17 aa, Plasmodium falciparum
KLAYVYPQYVIAEILRQ

SEQ ID NO: 3289234 - protein, 42 aa, Plasmodium falciparum
KLCFEMNLLRFLLNKTSFVILLFLYIFFVQRFHILTETGGKE

SEQ ID NO: 3289235 - protein, 17 aa, Plasmodium falciparum
KLCIPVEVRKRYIYDFL

SEQ ID NO: 3289236 - protein, 38 aa, Plasmodium falciparum
KLCISPMFYFFYYIELIRYVYCLFVWRVRKMSNINNDN

SEQ ID NO: 3289237 - protein, 24 aa, Plasmodium falciparum
KLCKPYLITLSSLPFILFFCGYTS

SEQ ID NO: 3289238 - protein, 20 aa, Plasmodium falciparum
KLCTAAYWGIPWHVIVYYEN

SEQ ID NO: 3289239 - protein, 33 aa, Plasmodium falciparum
KLDDKQIILIRALIKRWLEYFLEDYNKIKHKIS

SEQ ID NO: 3289240 - protein, 40 aa, Plasmodium falciparum
KLDDKQIILIRALIKRWLEYFLEDYNKIRKKLKSCTEKGE

SEQ ID NO: 3289241 - protein, 21 aa, Plasmodium falciparum
KLDHYNFISGLHKSIRAGNVK

SEQ ID NO: 3289242 - protein, 54 aa, Plasmodium falciparum
KLDIGSLLAQNLELLKGFALNFQTLSLFFLVFVGQFYPKHFQKAAIFIGMVNVF

SEQ ID NO: 3289243 - protein, 20 aa, Plasmodium falciparum
KLDKLIIWAQIQGSERLKTY

SEQ ID NO: 3289244 - protein, 25 aa, Plasmodium falciparum
KLDLKSFFIIVWISIFQGTVVMLGA

SEQ ID NO: 3289245 - protein, 26 aa, Plasmodium falciparum
KLDRWFTHDMLFNLVLPQINFTYIPL

SEQ ID NO: 3289246 - protein, 24 aa, Plasmodium falciparum
KLDSKLFFNGLYYYPFNKNMNNNM

SEQ ID NO: 3289247 - protein, 43 aa, Plasmodium falciparum
KLDVENICILLFKYGYKFIKYYPQLTIYLLKKIIKKYNINLTI

SEQ ID NO: 3289248 - protein, 20 aa, Plasmodium falciparum
KLDYLNFDQTIKSFLYSCLQ

SEQ ID NO: 3289249 - protein, 49 aa, Plasmodium falciparum
KLEDMQSPFDYKRFFRKYTIFAPFILVYFTLMFFVNSTVQNGTMLLNSI

SEQ ID NO: 3289250 - protein, 32 aa, Plasmodium falciparum
KLEETGYGFREKFPTTRILVKRKRNKEQKKLK

SEQ ID NO: 3289251 - protein, 20 aa, Plasmodium falciparum
KLEFLLFLNLFISRKKNVST

SEQ ID NO: 3289252 - protein, 28 aa, Plasmodium falciparum
KLEGDIPYRVFIKNKFYPGLAMSRAIGD

SEQ ID NO: 3289253 - protein, 28 aa, Plasmodium falciparum
KLEKFASRPPFFRWLEEWADEFCRKRTH

SEQ ID NO: 3289254 - protein, 28 aa, Plasmodium falciparum
KLEKHLNDYKSYYYLSKATLMDKIGESQ

SEQ ID NO: 3289255 - protein, 31 aa, Plasmodium falciparum
KLENIRLDILFFTLLSLRDSILNKKGKLQIY

SEQ ID NO: 3289256 - protein, 20 aa, Plasmodium falciparum
KLEYEEFLKLQLLHINSNIN

SEQ ID NO: 3289257 - protein, 17 aa, Plasmodium falciparum
KLFCLYYNKNNKKYIHY

SEQ ID NO: 3289258 - protein, 19 aa, Plasmodium falciparum
KLFEEIISYIVNISLSDIE

SEQ ID NO: 3289259 - protein, 54 aa, Plasmodium falciparum
KLFEQYVLNIRIILANLLYSFYEHLYNNFIFFIHILNLLPCNFSLLSNKHNEDN

SEQ ID NO: 3289260 - protein, 45 aa, Plasmodium falciparum
KLFHNNAIQYFIKLFYYLSFYNPIFSILFLNLIRTPLFHKNIENK

SEQ ID NO: 3289261 - protein, 24 aa, Plasmodium falciparum
KLFKKYHIIGKYIMNMITVILSLF

SEQ ID NO: 3289262 - protein, 24 aa, Plasmodium falciparum
KLFMDFYVFKIYKRLYKNKIFNMC

SEQ ID NO: 3289263 - protein, 17 aa, Plasmodium falciparum
KLFMKYLNVYIKKKKCI

SEQ ID NO: 3289264 - protein, 24 aa, Plasmodium falciparum
KLFSTWVFLWNKYINFRTNFEKFD

SEQ ID NO: 3289265 - protein, 20 aa, Plasmodium falciparum
KLGFEIITRDFKSYMKTYLD

SEQ ID NO: 3289266 - protein, 20 aa, Plasmodium falciparum
KLGGYLYFRGTCGDNEKSVT

SEQ ID NO: 3289267 - protein, 22 aa, Plasmodium falciparum
KLGILFERVILSHPAFFEFCET

SEQ ID NO: 3289268 - protein, 19 aa, Plasmodium falciparum
KLGIPFFLNKYLIFDNENE

SEQ ID NO: 3289269 - protein, 38 aa, Plasmodium falciparum
KLGKKSLLQYLSVYEGIPLYNIITTKIKIIEIDDTKRN

SEQ ID NO: 3289270 - protein, 25 aa, Plasmodium falciparum
KLGLDKSLLERFVMAKIAPVHLLNT

SEQ ID NO: 3289271 - protein, 24 aa, Plasmodium falciparum
KLHALGNILIFLEDYKHINFIGFR

SEQ ID NO: 3289272 - protein, 35 aa, Plasmodium falciparum
KLHIGVYNLLYFLKKKNIFMLFYSSNKNLTNLLFK

SEQ ID NO: 3289273 - protein, 20 aa, Plasmodium falciparum
KLHILNILDETRKCIREKES

SEQ ID NO: 3289274 - protein, 25 aa, Plasmodium falciparum
KLICILCYPFFNIILELLYFTFHNN

SEQ ID NO: 3289275 - protein, 34 aa, Plasmodium falciparum
KLIDHLLVPIKYILWLLLQFLTLCKLKICNYRMK

SEQ ID NO: 3289276 - protein, 30 aa, Plasmodium falciparum
KLIFGHYNILLYLLLLHFDVFKNKNMNIDN

SEQ ID NO: 3289277 - protein, 19 aa, Plasmodium falciparum
KLIFIPYEIIFYCSKHFGM

SEQ ID NO: 3289278 - protein, 21 aa, Plasmodium falciparum
KLIFVTGFLLTTLSAIVDSYI

SEQ ID NO: 3289279 - protein, 24 aa, Plasmodium falciparum
KLIIASIICIIFMVIEIVAAIVSN

SEQ ID NO: 3289280 - protein, 32 aa, Plasmodium falciparum
KLIIDNIYRVDILIFFLLFIQNKKTKNKISFQ

SEQ ID NO: 3289281 - protein, 19 aa, Plasmodium falciparum
KLIIFPPQFGLMKQSEQTN

SEQ ID NO: 3289282 - protein, 22 aa, Plasmodium falciparum
KLIKCISKIFYPLKNQNIYNIH

SEQ ID NO: 3289283 - protein, 19 aa, Plasmodium falciparum
KLIKFVYINRRVINSLIKQ

SEQ ID NO: 3289284 - protein, 20 aa, Plasmodium falciparum
KLIKIWDTYLFFKEKKQLEE

SEQ ID NO: 3289285 - protein, 35 aa, Plasmodium falciparum
KLIKNDLKYNLKSKGLVFLYAMIDKYGSILNKSQK

SEQ ID NO: 3289286 - protein, 27 aa, Plasmodium falciparum
KLIKNMIDIFIYTYKLNYTNSKSISKL

SEQ ID NO: 3289287 - protein, 29 aa, Plasmodium falciparum
KLIKTIFIQYYHKGYIKKPILFQTKIIPI

SEQ ID NO: 3289288 - protein, 26 aa, Plasmodium falciparum
KLIKYVYILYIIIHSNFIFPKVILTQ

SEQ ID NO: 3289289 - protein, 18 aa, Plasmodium falciparum
KLILILSKHHLSTASEIM

SEQ ID NO: 3289290 - protein, 19 aa, Plasmodium falciparum
KLINLYFKKYKKKILYNNF

SEQ ID NO: 3289291 - protein, 18 aa, Plasmodium falciparum
KLINNIYINTYSSLLYII

SEQ ID NO: 3289292 - protein, 20 aa, Plasmodium falciparum
KLIPIEKILSYKPSLDFSYI

SEQ ID NO: 3289293 - protein, 19 aa, Plasmodium falciparum
KLITKLFIEIHMMVIEDFK

SEQ ID NO: 3289294 - protein, 19 aa, Plasmodium falciparum
KLITKLFIEIHMMVIENSK

SEQ ID NO: 3289295 - protein, 20 aa, Plasmodium falciparum
KLIYTSLGEAINYEIKKMKK

SEQ ID NO: 3289296 - protein, 28 aa, Plasmodium falciparum
KLKEFVEIPTFFRYLHEWGQNFCKERKK

SEQ ID NO: 3289297 - protein, 27 aa, Plasmodium falciparum
KLKFTFIFLHIFVVINILFILMLHYTH

SEQ ID NO: 3289298 - protein, 34 aa, Plasmodium falciparum
KLKGAFYKILKLLCLYLFLYEEEYVLFYGKVKSL

SEQ ID NO: 3289299 - protein, 19 aa, Plasmodium falciparum
KLKIFLYKEFIIKKVLMLK

SEQ ID NO: 3289300 - protein, 17 aa, Plasmodium falciparum
KLKIFWEVVDEFLSWII

SEQ ID NO: 3289301 - protein, 24 aa, Plasmodium falciparum
KLKIKNFFTKLKQKVLPKKQKLHI

SEQ ID NO: 3289302 - protein, 46 aa, Plasmodium falciparum
KLKKAGSFHLILLYAILVFLFISISLLLHILLKYKTVKKVQQIKYA

SEQ ID NO: 3289303 - protein, 21 aa, Plasmodium falciparum
KLKKDYYCGGGTKILGALKYS

SEQ ID NO: 3289304 - protein, 17 aa, Plasmodium falciparum
KLKLIKYSSKFLYSLCF

SEQ ID NO: 3289305 - protein, 17 aa, Plasmodium falciparum
KLKMKKWYKDLKKEWII

SEQ ID NO: 3289306 - protein, 18 aa, Plasmodium falciparum
KLKNAIVFYVPILEIEKS

SEQ ID NO: 3289307 - protein, 25 aa, Plasmodium falciparum
KLKNFFFFFFFLYIIILHRNTLTGF

SEQ ID NO: 3289308 - protein, 25 aa, Plasmodium falciparum
KLKNYTDFINWNIISVALVSYNKIS

SEQ ID NO: 3289309 - protein, 23 aa, Plasmodium falciparum
KLKPQITEILDLSFKIIHGNIGR

SEQ ID NO: 3289310 - protein, 22 aa, Plasmodium falciparum
KLKQLNFKNIKLKKITITNILA

SEQ ID NO: 3289311 - protein, 27 aa, Plasmodium falciparum
KLKTEEWLHLYGLFKQATIGNMILSNE

SEQ ID NO: 3289312 - protein, 25 aa, Plasmodium falciparum
KLKTKLIYMYLSLNPRDVPNVLINI

SEQ ID NO: 3289313 - protein, 17 aa, Plasmodium falciparum
KLKVYPFDKEQIIPPLN

SEQ ID NO: 3289314 - protein, 36 aa, Plasmodium falciparum
KLLAEFIYFFMIIAFWILVTHLILYGTLKIGIYLSY

SEQ ID NO: 3289315 - protein, 28 aa, Plasmodium falciparum
KLLFSYFSVVLLGIIYEIPVDLSVYDET

SEQ ID NO: 3289316 - protein, 17 aa, Plasmodium falciparum
KLLLFHENSKHVYGYYI

SEQ ID NO: 3289317 - protein, 23 aa, Plasmodium falciparum
KLLLKSFMIGHFIKVKLSKNTFI

SEQ ID NO: 3289318 - protein, 17 aa, Plasmodium falciparum
KLLLNKYHFLIIDNQVV

SEQ ID NO: 3289319 - protein, 29 aa, Plasmodium falciparum
KLLSIKKIFMIFYNYLRKCHFIDKKNSCK

SEQ ID NO: 3289320 - protein, 23 aa, Plasmodium falciparum
KLLSKVFIDIYMMVLEDFKEEEC

SEQ ID NO: 3289321 - protein, 19 aa, Plasmodium falciparum
KLLTCMCRNLGISKYINHI

SEQ ID NO: 3289322 - protein, 27 aa, Plasmodium falciparum
KLLTILKNNFFLGPSSMYYYLSNYFWT

SEQ ID NO: 3289323 - protein, 19 aa, Plasmodium falciparum
KLLWFFGVMLIICGLIFIL

SEQ ID NO: 3289324 - protein, 20 aa, Plasmodium falciparum
KLLYFVKINFCLNNKDFNIF

SEQ ID NO: 3289325 - protein, 25 aa, Plasmodium falciparum
KLLYPTLYYHRNAFIKSFVVEFFNN

SEQ ID NO: 3289326 - protein, 20 aa, Plasmodium falciparum
KLMDDFYKWFEYFFDESEND

SEQ ID NO: 3289327 - protein, 31 aa, Plasmodium falciparum
KLMIYLCDMIYIYFYILKIKGKDMKCNNIMD

SEQ ID NO: 3289328 - protein, 25 aa, Plasmodium falciparum
KLMNHNYFLNFFNKKKKKSKEYKTS

SEQ ID NO: 3289329 - protein, 30 aa, Plasmodium falciparum
KLMNLTYMSHIFIVKFLIQLLKEIKSVHPN

SEQ ID NO: 3289330 - protein, 18 aa, Plasmodium falciparum
KLMRKSCDFLFPSNKWTV

SEQ ID NO: 3289331 - protein, 21 aa, Plasmodium falciparum
KLMRLKYISYLITYMDITYKQ

SEQ ID NO: 3289332 - protein, 19 aa, Plasmodium falciparum
KLMVSILQNIRFYSNKVYN

SEQ ID NO: 3289333 - protein, 19 aa, Plasmodium falciparum
KLNALYKMNAVYKMNALNK

SEQ ID NO: 3289334 - protein, 26 aa, Plasmodium falciparum
KLNDLFKGYFFHVMYELNNEEAKWNK

SEQ ID NO: 3289335 - protein, 23 aa, Plasmodium falciparum
KLNDNFFNFLTDLNIKYFINHFV

SEQ ID NO: 3289336 - protein, 25 aa, Plasmodium falciparum
KLNEFLLYYISKETVIALLRDNINY

SEQ ID NO: 3289337 - protein, 23 aa, Plasmodium falciparum
KLNFELWIIYMNSLYLIGSYVKP

SEQ ID NO: 3289338 - protein, 19 aa, Plasmodium falciparum
KLNILLPTLYIKEIKNKSP

SEQ ID NO: 3289339 - protein, 24 aa, Plasmodium falciparum
KLNKCFTIKGYKFAYNKIKAVKRR

SEQ ID NO: 3289340 - protein, 19 aa, Plasmodium falciparum
KLNKHILSAFPMLKNVIEA

SEQ ID NO: 3289341 - protein, 29 aa, Plasmodium falciparum
KLNKSIFGTFFLKSIGWIYTNLTQCYRED

SEQ ID NO: 3289342 - protein, 40 aa, Plasmodium falciparum
KLNMYNYIFLYKMNFMFLHRLYSLSIYQLYKILSCYLKIY

SEQ ID NO: 3289343 - protein, 24 aa, Plasmodium falciparum
KLNNILYFINIYFHLNEYIQIYLE

SEQ ID NO: 3289344 - protein, 23 aa, Plasmodium falciparum
KLNNLNVFLVGSGALGCEYAKLF

SEQ ID NO: 3289345 - protein, 26 aa, Plasmodium falciparum
KLNNVFINLFIILLNHIIRQKIKRFF

SEQ ID NO: 3289346 - protein, 26 aa, Plasmodium falciparum
KLNPFHFFMQYISSFLFLYKVVHPFE

SEQ ID NO: 3289347 - protein, 35 aa, Plasmodium falciparum
KLNPSYILYYNIFFIYNLLPIFIKNLLYSQNVMSI

SEQ ID NO: 3289348 - protein, 27 aa, Plasmodium falciparum
KLNSIHLIELLYTLSILHIDKSKIVKV

SEQ ID NO: 3289349 - protein, 22 aa, Plasmodium falciparum
KLNSINHFISKKLRINWIPKKK

SEQ ID NO: 3289350 - protein, 17 aa, Plasmodium falciparum
KLNYLLLLDQINNDGDI

SEQ ID NO: 3289351 - protein, 22 aa, Plasmodium falciparum
KLPDRFELFFNYLLTYSEKNVI

SEQ ID NO: 3289352 - protein, 20 aa, Plasmodium falciparum
KLPHYMVLEIVLEEEFLKEV

SEQ ID NO: 3289353 - protein, 45 aa, Plasmodium falciparum
KLPVHCLALILYCKNYILLNILFNWFPYLYHIFNYILNMNSTHFL

SEQ ID NO: 3289354 - protein, 34 aa, Plasmodium falciparum
KLQGNNFLFMIKKLKSFFFFTTKFSYLHMFHDTT

SEQ ID NO: 3289355 - protein, 23 aa, Plasmodium falciparum
KLQHDIKGLYYLNPLTKNIQNCM

SEQ ID NO: 3289356 - protein, 33 aa, Plasmodium falciparum
KLQKSGDIPPPFLRQMFYTIADYKDILYSGSND

SEQ ID NO: 3289357 - protein, 24 aa, Plasmodium falciparum
KLQKYLFNVLLHKNINYFKKKGKG

SEQ ID NO: 3289358 - protein, 20 aa, Plasmodium falciparum
KLQNVFINIFRKQTSYLQNK

SEQ ID NO: 3289359 - protein, 19 aa, Plasmodium falciparum
KLRGIFKRKKAMKKKIIEN

SEQ ID NO: 3289360 - protein, 19 aa, Plasmodium falciparum
KLRKIFKKASEKTPCIIFI

SEQ ID NO: 3289361 - protein, 23 aa, Plasmodium falciparum
KLRNLCINLLYICSKLMSSNFLS

SEQ ID NO: 3289362 - protein, 23 aa, Plasmodium falciparum
KLRNVFFYCIDAFSNAALQKSFL

SEQ ID NO: 3289363 - protein, 28 aa, Plasmodium falciparum
KLSFKFYDLIKLFFLYDLEVIGIIGLKN

SEQ ID NO: 3289364 - protein, 20 aa, Plasmodium falciparum
KLSIQRFFDTFIQKEKIYGN

SEQ ID NO: 3289365 - protein, 18 aa, Plasmodium falciparum
KLSKLYKYYYGSIFLLIL

SEQ ID NO: 3289366 - protein, 26 aa, Plasmodium falciparum
KLSKSIFINPLYLYKCSFTMKNKNNF

SEQ ID NO: 3289367 - protein, 24 aa, Plasmodium falciparum
KLSNFELHLIFRKLKDQSMVKSIP

SEQ ID NO: 3289368 - protein, 26 aa, Plasmodium falciparum
KLSSDLFFDLYYTYFNNFLENFLYYQ

SEQ ID NO: 3289369 - protein, 44 aa, Plasmodium falciparum
KLSSIELILTKHILLKQLFCNILYICNWLNKPRKYEWFEWNMVV

SEQ ID NO: 3289370 - protein, 23 aa, Plasmodium falciparum
KLSYTNMFPLNRKNTLLQNDKNE

SEQ ID NO: 3289371 - protein, 18 aa, Plasmodium falciparum
KLTDEIFQFIKDENLKAI

SEQ ID NO: 3289372 - protein, 38 aa, Plasmodium falciparum
KLTECNNMIIQLIKLWFKLYVTYMNILKELFKYSESLG

SEQ ID NO: 3289373 - protein, 18 aa, Plasmodium falciparum
KLTIIGNLPFYITSQILF

SEQ ID NO: 3289374 - protein, 26 aa, Plasmodium falciparum
KLTNMFKYFFFYHKMNYHKNIINKQI

SEQ ID NO: 3289375 - protein, 36 aa, Plasmodium falciparum
KLTNRKIILELLNTYIKIIIITPQLIRNIIYGDINQ

SEQ ID NO: 3289376 - protein, 24 aa, Plasmodium falciparum
KLTPMWCFLLKYFITTIFIFLLIS

SEQ ID NO: 3289377 - protein, 25 aa, Plasmodium falciparum
KLTTKAIRLHFIICVDFLIENMNII

SEQ ID NO: 3289378 - protein, 32 aa, Plasmodium falciparum
KLVCTFLQKCYFNFSLLSFLWLKNERKNLFLF

SEQ ID NO: 3289379 - protein, 26 aa, Plasmodium falciparum
KLVEKDPMLILKKKSIKYMLMHIDFY

SEQ ID NO: 3289380 - protein, 24 aa, Plasmodium falciparum
KLVHRGYYLIVLSLLKYAHQYNMN

SEQ ID NO: 3289381 - protein, 25 aa, Plasmodium falciparum
KLVMIKKAVIYLMKKYNIKIEELYI

SEQ ID NO: 3289382 - protein, 17 aa, Plasmodium falciparum
KLWESIRIDVWKAMICG

SEQ ID NO: 3289383 - protein, 26 aa, Plasmodium falciparum
KLYDIYKNILLLPDAIKKYYYKDRCI

SEQ ID NO: 3289384 - protein, 22 aa, Plasmodium falciparum
KLYDKILVYFLNNYCFSYPTKN

SEQ ID NO: 3289385 - protein, 20 aa, Plasmodium falciparum
KLYIKLYINYKYNQLIKKKT

SEQ ID NO: 3289386 - protein, 27 aa, Plasmodium falciparum
KLYKTDDFIIFLNRKLLKEKDEIFQKC

SEQ ID NO: 3289387 - protein, 17 aa, Plasmodium falciparum
KLYLNSRNNDLITMLTI

SEQ ID NO: 3289388 - protein, 17 aa, Plasmodium falciparum
KLYMGYNIELSLMNDNK

SEQ ID NO: 3289389 - protein, 26 aa, Plasmodium falciparum
KLYNSFNVFHFNSFNILYTTYPTDNK

SEQ ID NO: 3289390 - protein, 23 aa, Plasmodium falciparum
KLYPVLIYIIYHYSLTGLLIIPP

SEQ ID NO: 3289391 - protein, 17 aa, Plasmodium falciparum
KLYQWLIKYANLNKNYQ

SEQ ID NO: 3289392 - protein, 18 aa, Plasmodium falciparum
KMCISFLNTFKSVCMKFC

SEQ ID NO: 3289393 - protein, 33 aa, Plasmodium falciparum
KMDIIQWLHYGFVIYWYVLLKENFFNIPCHGQN

SEQ ID NO: 3289394 - protein, 23 aa, Plasmodium falciparum
KMDKGCLHFPFPSSDSLIKNDDN

SEQ ID NO: 3289395 - protein, 33 aa, Plasmodium falciparum
KMDMKDILKYFIDFYFENGSYYILDNILYSVNH

SEQ ID NO: 3289396 - protein, 25 aa, Plasmodium falciparum
KMDSFIYQIYMMKSEFDKNLNYMNA

SEQ ID NO: 3289397 - protein, 18 aa, Plasmodium falciparum
KMEIKNFLNLAISDDFFT

SEQ ID NO: 3289398 - protein, 27 aa, Plasmodium falciparum
KMEKCSSVFNVVNSSIGLIMVLSFLFL

SEQ ID NO: 3289399 - protein, 24 aa, Plasmodium falciparum
KMEKNFIILRHTYIYIKKRICDEI

SEQ ID NO: 3289400 - protein, 18 aa, Plasmodium falciparum
KMERCTNILGLDKRETVI

SEQ ID NO: 3289401 - protein, 30 aa, Plasmodium falciparum
KMFLEKCLNLYYLLLSNIKLKKAHFLKKRI

SEQ ID NO: 3289402 - protein, 18 aa, Plasmodium falciparum
KMFNFGITALEQFEEYLL

SEQ ID NO: 3289403 - protein, 23 aa, Plasmodium falciparum
KMFYILTFLLAMPKKKYIDLIIF

SEQ ID NO: 3289404 - protein, 34 aa, Plasmodium falciparum
KMGNHNKIILRFYPYNFTWPFDSLQINCIDQKFQ

SEQ ID NO: 3289405 - protein, 26 aa, Plasmodium falciparum
KMGVPIIFPFLLFNSLSMLYFTYFFS

SEQ ID NO: 3289406 - protein, 20 aa, Plasmodium falciparum
KMIESFDSFFLLLCIDKNKE

SEQ ID NO: 3289407 - protein, 17 aa, Plasmodium falciparum
KMIICFFCTYNYDGFLS

SEQ ID NO: 3289408 - protein, 25 aa, Plasmodium falciparum
KMIKKWFNLLSYFNNKSEFIIIIKE

SEQ ID NO: 3289409 - protein, 18 aa, Plasmodium falciparum
KMILGGDAVLHYFDNLLP

SEQ ID NO: 3289410 - protein, 32 aa, Plasmodium falciparum
KMIQKYYIITIVFFLCLLGIYVLPYTNNLPNK

SEQ ID NO: 3289411 - protein, 57 aa, Plasmodium falciparum
KMIRTECIIGKRKILYYMSVNVLFFLCFIFIFSRFNSGQFYEKWKNKPNIKSICGRR

SEQ ID NO: 3289412 - protein, 17 aa, Plasmodium falciparum
KMIYLEDYRRLTVACII

SEQ ID NO: 3289413 - protein, 19 aa, Plasmodium falciparum
KMKCPPFWDYSVLGSGPLH

SEQ ID NO: 3289414 - protein, 17 aa, Plasmodium falciparum
KMKIIISIYINPNQYIM

SEQ ID NO: 3289415 - protein, 19 aa, Plasmodium falciparum
KMKKGLVNSFFFTKMYLHC

SEQ ID NO: 3289416 - protein, 22 aa, Plasmodium falciparum
KMKKLLYILTGKVTGNLYIEFL

SEQ ID NO: 3289417 - protein, 23 aa, Plasmodium falciparum
KMKKVHAFYTLDSFKKYIQLNNL

SEQ ID NO: 3289418 - protein, 19 aa, Plasmodium falciparum
KMKYYKKRKNIKLFLNIIN

SEQ ID NO: 3289419 - protein, 17 aa, Plasmodium falciparum
KMLIKNKKLKFVKLFLI

SEQ ID NO: 3289420 - protein, 23 aa, Plasmodium falciparum
KMLVKILYIIHKKNNLYSFAVLN

SEQ ID NO: 3289421 - protein, 27 aa, Plasmodium falciparum
KMMSYESLLLVYYFLSTQVNCYFLYDI

SEQ ID NO: 3289422 - protein, 25 aa, Plasmodium falciparum
KMNASLLVHYFACAAYYIKRADVYN

SEQ ID NO: 3289423 - protein, 24 aa, Plasmodium falciparum
KMNDVIYFFIPFNVTDFLLKKITK

SEQ ID NO: 3289424 - protein, 25 aa, Plasmodium falciparum
KMNEKLQFFNSYVSLLISLRKPSIK

SEQ ID NO: 3289425 - protein, 25 aa, Plasmodium falciparum
KMNHPLEFDLFKQLIKGLKDIHATC

SEQ ID NO: 3289426 - protein, 28 aa, Plasmodium falciparum
KMNIYDLEYLFNRQVFFSKYINKNQGLT

SEQ ID NO: 3289427 - protein, 17 aa, Plasmodium falciparum
KMNNEIFLFFVWQRMNN

SEQ ID NO: 3289428 - protein, 26 aa, Plasmodium falciparum
KMNYCEMYIINIFINYLYHNFFQDED

SEQ ID NO: 3289429 - protein, 20 aa, Plasmodium falciparum
KMNYHYLIKNIYRKNFIKNH

SEQ ID NO: 3289430 - protein, 18 aa, Plasmodium falciparum
KMQLNRWKYKNIKGIIVI

SEQ ID NO: 3289431 - protein, 21 aa, Plasmodium falciparum
KMRNMLFFKSIGNKNHLFLVF

SEQ ID NO: 3289432 - protein, 24 aa, Plasmodium falciparum
KMSLPDFFILNYYLDKNRKNNLDL

SEQ ID NO: 3289433 - protein, 34 aa, Plasmodium falciparum
KMSSLYELLIQYIKFLYYLEYIQKPIFLKSNKSI

SEQ ID NO: 3289434 - protein, 17 aa, Plasmodium falciparum
KMTNLRYGNTFNFICNK

SEQ ID NO: 3289435 - protein, 29 aa, Plasmodium falciparum
KMVNKKFMSYLTLIKKKKLFKKTRRGEQK

SEQ ID NO: 3289436 - protein, 28 aa, Plasmodium falciparum
KMVYTKIAMPWIIRDRYLLMDVWICEDF

SEQ ID NO: 3289437 - protein, 35 aa, Plasmodium falciparum
KMYASCKRLLNFIKLFFFIDIGISDVLIKYFAEKN

SEQ ID NO: 3289438 - protein, 19 aa, Plasmodium falciparum
KMYNMHPINPIQTSNLRTF

SEQ ID NO: 3289439 - protein, 24 aa, Plasmodium falciparum
KMYRLHILFILLNKNYCEYKIYYI

SEQ ID NO: 3289440 - protein, 27 aa, Plasmodium falciparum
KMYRYLYIYKVFVLKQFYRIVYYNQGI

SEQ ID NO: 3289441 - protein, 25 aa, Plasmodium falciparum
KNAEYKIKYYLEIYKKDILNEITES

SEQ ID NO: 3289442 - protein, 27 aa, Plasmodium falciparum
KNAFINSALPLFLFSEPMPPLRMMDKE

SEQ ID NO: 3289443 - protein, 25 aa, Plasmodium falciparum
KNAFKNFCIALSDIFFTNLSFKSEE

SEQ ID NO: 3289444 - protein, 25 aa, Plasmodium falciparum
KNAIILISLILYHLPVRLSYHIPTI

SEQ ID NO: 3289445 - protein, 20 aa, Plasmodium falciparum
KNALHYSLIYNDKKNNICYN

SEQ ID NO: 3289446 - protein, 39 aa, Plasmodium falciparum
KNAMLSSTIMWSIGIGFATFTYFFLKKKTKASVGNLFQI

SEQ ID NO: 3289447 - protein, 38 aa, Plasmodium falciparum
KNAMLSSTIMWSIGIGFATFTYFYLKKKTKSSVANLFQ

SEQ ID NO: 3289448 - protein, 26 aa, Plasmodium falciparum
KNASMIKSAFLPTGAFKADRYKSHGK

SEQ ID NO: 3289449 - protein, 27 aa, Plasmodium falciparum
KNCFTYIIPLFFYYIKSMNLKKCIPQH

SEQ ID NO: 3289450 - protein, 38 aa, Plasmodium falciparum
KNCHQFLIFIYLFIFIFLLLLVYFLVCGEFPLYYYKKN

SEQ ID NO: 3289451 - protein, 24 aa, Plasmodium falciparum
KNCIRMFILFRDLYVKEENGYNII

SEQ ID NO: 3289452 - protein, 22 aa, Plasmodium falciparum
KNCLYFSILIFYDIYETSIINK

SEQ ID NO: 3289453 - protein, 26 aa, Plasmodium falciparum
KNDCLKLLYICNLCTIKYDYVLKIIT

SEQ ID NO: 3289454 - protein, 32 aa, Plasmodium falciparum
KNDEEIDMLVLLNKYFFDFYINVRRMNEEYNE

SEQ ID NO: 3289455 - protein, 25 aa, Plasmodium falciparum
KNDELYNIFFKYLKLDLKNINNLYR

SEQ ID NO: 3289456 - protein, 18 aa, Plasmodium falciparum
KNDHFFCDIYKFLYSLKN

SEQ ID NO: 3289457 - protein, 27 aa, Plasmodium falciparum
KNDIYIYKIIYLPYIPNYFYNVETSSC

SEQ ID NO: 3289458 - protein, 25 aa, Plasmodium falciparum
KNDIYLNLFLNKILNDISLLQIQAI

SEQ ID NO: 3289459 - protein, 17 aa, Plasmodium falciparum
KNDIYMHLLYIYYYKYI

SEQ ID NO: 3289460 - protein, 34 aa, Plasmodium falciparum
KNDKLYPLYLNIFSYLSFPLINISNKIKLLFKLI

SEQ ID NO: 3289461 - protein, 25 aa, Plasmodium falciparum
KNDKRLKNIPLLPLFIMHGKNDRDI

SEQ ID NO: 3289462 - protein, 22 aa, Plasmodium falciparum
KNDLNTLIYLKTYLYEILCHAL

SEQ ID NO: 3289463 - protein, 27 aa, Plasmodium falciparum
KNDLYIFFCYFVLLRYLKKFHIYQKFK

SEQ ID NO: 3289464 - protein, 26 aa, Plasmodium falciparum
KNDLYNTFYWLFSQKGLQYIIKNYNV

SEQ ID NO: 3289465 - protein, 35 aa, Plasmodium falciparum
KNDMSVCIIHFLNLILFILIYLNDLARKNKKKGQM

SEQ ID NO: 3289466 - protein, 35 aa, Plasmodium falciparum
KNDNDYPILNYPLDSLILYLLSFNIKNVENFPFIN

SEQ ID NO: 3289467 - protein, 27 aa, Plasmodium falciparum
KNDNFINKILLFLNSFSDELLPVYLEQ

SEQ ID NO: 3289468 - protein, 28 aa, Plasmodium falciparum
KNDNFLNGIYKLQNIWRNTTLGELDLKK

SEQ ID NO: 3289469 - protein, 25 aa, Plasmodium falciparum
KNDNLWFNFIFLSPKQMKRIHNQNK

SEQ ID NO: 3289470 - protein, 22 aa, Plasmodium falciparum
KNDSLYMRLQNIISFSSGHNNT

SEQ ID NO: 3289471 - protein, 24 aa, Plasmodium falciparum
KNDVKHIITIRALVTHWVEYFLDD

SEQ ID NO: 3289472 - protein, 28 aa, Plasmodium falciparum
KNDVLLLRYKIYLRALLFPKKMYSDVQI

SEQ ID NO: 3289473 - protein, 21 aa, Plasmodium falciparum
KNDYMYTNLFLNTSKITKLIN

SEQ ID NO: 3289474 - protein, 26 aa, Plasmodium falciparum
KNEFLKLYIFYGQKNLPSMPYTPLFF

SEQ ID NO: 3289475 - protein, 19 aa, Plasmodium falciparum
KNEIKQFLNRLFVNKKKKK

SEQ ID NO: 3289476 - protein, 26 aa, Plasmodium falciparum
KNEKDVIILLLWKSFLNSFVLLEKMN

SEQ ID NO: 3289477 - protein, 21 aa, Plasmodium falciparum
KNEKEYYMYISQQYLDMVVNF

SEQ ID NO: 3289478 - protein, 30 aa, Plasmodium falciparum
KNEKIENLLNIWITLIIKNKKKHEGRYIPR

SEQ ID NO: 3289479 - protein, 25 aa, Plasmodium falciparum
KNEKKNFFFLTKNLFNKFLVFLLYS

SEQ ID NO: 3289480 - protein, 26 aa, Plasmodium falciparum
KNEKMIHTFLYILISYIYIYLNDLYN

SEQ ID NO: 3289481 - protein, 20 aa, Plasmodium falciparum
KNELCILYKGYFYVNFIFNT

SEQ ID NO: 3289482 - protein, 26 aa, Plasmodium falciparum
KNELEKILFNLKDSLKLLREGYIQSK

SEQ ID NO: 3289483 - protein, 22 aa, Plasmodium falciparum
KNENFFKILSLLSNIRYLLTCN

SEQ ID NO: 3289484 - protein, 23 aa, Plasmodium falciparum
KNENFLKSYLYPIKTLPFYNDES

SEQ ID NO: 3289485 - protein, 18 aa, Plasmodium falciparum
KNENLINAPLHTSKKRSL

SEQ ID NO: 3289486 - protein, 25 aa, Plasmodium falciparum
KNENRFFFDIIIDILKYMKYEKCLN

SEQ ID NO: 3289487 - protein, 17 aa, Plasmodium falciparum
KNEQDILLFFKNKFNYI

SEQ ID NO: 3289488 - protein, 28 aa, Plasmodium falciparum
KNEVSKRLFRLANLYLYTTKFVEDNNNN

SEQ ID NO: 3289489 - protein, 25 aa, Plasmodium falciparum
KNEYIYMLQNDLCKRYWKDLDKMWL

SEQ ID NO: 3289490 - protein, 24 aa, Plasmodium falciparum
KNEYLKYIIPFIRKIENSYISYKN

SEQ ID NO: 3289491 - protein, 25 aa, Plasmodium falciparum
KNFDELGNFFFIYGKKIYVNFILLI

SEQ ID NO: 3289492 - protein, 26 aa, Plasmodium falciparum
KNFDILKNIIFLGLNKVLEKKENKKL

SEQ ID NO: 3289493 - protein, 25 aa, Plasmodium falciparum
KNFEHIFYLLKMSMHNSPYVHFFLI

SEQ ID NO: 3289494 - protein, 20 aa, Plasmodium falciparum
KNFGESFIRIGFLLKKETSI

SEQ ID NO: 3289495 - protein, 20 aa, Plasmodium falciparum
KNFHLLYYDNNYIDDFSIFD

SEQ ID NO: 3289496 - protein, 19 aa, Plasmodium falciparum
KNFHYLIEALENVSLILAH

SEQ ID NO: 3289497 - protein, 21 aa, Plasmodium falciparum
KNFIELFLLSREDILNWCSKN

SEQ ID NO: 3289498 - protein, 28 aa, Plasmodium falciparum
KNFKKLHQILYNLYNLRHSNLVLIMGVS

SEQ ID NO: 3289499 - protein, 23 aa, Plasmodium falciparum
KNFKLLLDGLTYIKYDSFIINQF

SEQ ID NO: 3289500 - protein, 17 aa, Plasmodium falciparum
KNFLLQQFKNRFIFKPH

SEQ ID NO: 3289501 - protein, 20 aa, Plasmodium falciparum
KNFMYRFFDIKIYEYIQKTK

SEQ ID NO: 3289502 - protein, 21 aa, Plasmodium falciparum
KNFNLIYYKNTSYLYFIQCLR

SEQ ID NO: 3289503 - protein, 34 aa, Plasmodium falciparum
KNFQIYIQDIVLYGIYCCFFIYNKIKAVKKKDNL

SEQ ID NO: 3289504 - protein, 20 aa, Plasmodium falciparum
KNFQLFHMFYNYKYNYNVEY

SEQ ID NO: 3289505 - protein, 25 aa, Plasmodium falciparum
KNFSKTFPLLFDFYSNMSMNINEKK

SEQ ID NO: 3289506 - protein, 24 aa, Plasmodium falciparum
KNFSSILDLYLIYIKNESVQYKTM

SEQ ID NO: 3289507 - protein, 27 aa, Plasmodium falciparum
KNFVPVVLYILLIIYINLNGMNNKNQI

SEQ ID NO: 3289508 - protein, 24 aa, Plasmodium falciparum
KNFYTKFMLKRKKYAQFWEMFFHI

SEQ ID NO: 3289509 - protein, 24 aa, Plasmodium falciparum
KNGEDPIYICRRLIRIASEDIGLA

SEQ ID NO: 3289510 - protein, 49 aa, Plasmodium falciparum
KNGLNKLAIIPFSKMSINNLLHALIFGFLKFLFNLRKKYHKQPNGNCAC

SEQ ID NO: 3289511 - protein, 22 aa, Plasmodium falciparum
KNGRIILQHFILDLIKCCDNPR

SEQ ID NO: 3289512 - protein, 23 aa, Plasmodium falciparum
KNGYIFYGYFTPDFKRHGIGILI

SEQ ID NO: 3289513 - protein, 20 aa, Plasmodium falciparum
KNHCFYISIIIIFQTKQING

SEQ ID NO: 3289514 - protein, 35 aa, Plasmodium falciparum
KNHDYKKWISNCTTLFVLGLPFQMNEYNLLHNLID

SEQ ID NO: 3289515 - protein, 25 aa, Plasmodium falciparum
KNHEFYINFLIEAILIPIKTSHEEL

SEQ ID NO: 3289516 - protein, 22 aa, Plasmodium falciparum
KNHIILPTIYLLHDINDKLFPI

SEQ ID NO: 3289517 - protein, 23 aa, Plasmodium falciparum
KNHKNLLHFINTQKIKRLSEYVF

SEQ ID NO: 3289518 - protein, 37 aa, Plasmodium falciparum
KNICFCYFCVKYNFVILNYIYLYNIFHILYNKQINSS

SEQ ID NO: 3289519 - protein, 26 aa, Plasmodium falciparum
KNICSCIYFFFYKYNTFTHLERISIL

SEQ ID NO: 3289520 - protein, 36 aa, Plasmodium falciparum
KNIDKKFYIILLSLKYFLITLLHLYLNPHITNTKFL

SEQ ID NO: 3289521 - protein, 23 aa, Plasmodium falciparum
KNIFKWILLFYQIQTNQNSFPYE

SEQ ID NO: 3289522 - protein, 21 aa, Plasmodium falciparum
KNIFLKIRRKDKINILHACLK

SEQ ID NO: 3289523 - protein, 18 aa, Plasmodium falciparum
KNIFLKKQKKYQKYIKRF

SEQ ID NO: 3289524 - protein, 26 aa, Plasmodium falciparum
KNIHKNYYPFYKIMSPIIYKKKITHV

SEQ ID NO: 3289525 - protein, 21 aa, Plasmodium falciparum
KNIIFVNPLLDIFNNLSDRNN

SEQ ID NO: 3289526 - protein, 35 aa, Plasmodium falciparum
KNIIILKIFIIIFSFIILFYFTCELNVLLFPIESI

SEQ ID NO: 3289527 - protein, 36 aa, Plasmodium falciparum
KNIIILKIFIIIFSFIILFYFTCELNVLLFPIESIL

SEQ ID NO: 3289528 - protein, 32 aa, Plasmodium falciparum
KNIIQTRMLYLRAILFIPDSIYLNILYFHFEC

SEQ ID NO: 3289529 - protein, 25 aa, Plasmodium falciparum
KNIISIITIVLIDYNFLYSLKTDGK

SEQ ID NO: 3289530 - protein, 21 aa, Plasmodium falciparum
KNIIVKILKPNIKYGNKTKYD

SEQ ID NO: 3289531 - protein, 31 aa, Plasmodium falciparum
KNIKHTIVWVKTGILLFLTNMKISKNLIIKR

SEQ ID NO: 3289532 - protein, 24 aa, Plasmodium falciparum
KNIKKYILYDFFFEYDRKLILKEE

SEQ ID NO: 3289533 - protein, 33 aa, Plasmodium falciparum
KNILINFLEPILNKNFYYFSSSYYNNLDITKNK

SEQ ID NO: 3289534 - protein, 28 aa, Plasmodium falciparum
KNILIQIYFILFYFKNNCYFSYCCCCCY

SEQ ID NO: 3289535 - protein, 18 aa, Plasmodium falciparum
KNILLPYQTLHIHWSFIP

SEQ ID NO: 3289536 - protein, 33 aa, Plasmodium falciparum
KNILNYSLQKTLYYVVYLFIITIHLNTNSHIQY

SEQ ID NO: 3289537 - protein, 27 aa, Plasmodium falciparum
KNILVIINLFVCNLFYHLKNIGKNIHN

SEQ ID NO: 3289538 - protein, 26 aa, Plasmodium falciparum
KNINDVYIKLFFTEDFLIQKTNIPEK

SEQ ID NO: 3289539 - protein, 30 aa, Plasmodium falciparum
KNINGIMYNLGFLNLHCLLENKNKHFYLIT

SEQ ID NO: 3289540 - protein, 33 aa, Plasmodium falciparum
KNINKFKTFCIKLLYIMTLFNISFTNISISATS

SEQ ID NO: 3289541 - protein, 25 aa, Plasmodium falciparum
KNINSLIFFFLICTSIFLFIIDFFK

SEQ ID NO: 3289542 - protein, 17 aa, Plasmodium falciparum
KNIPLIKVLNEDIIKFM

SEQ ID NO: 3289543 - protein, 30 aa, Plasmodium falciparum
KNIQCFRNLIICSYKYRRMLRTTANKFDEI

SEQ ID NO: 3289544 - protein, 33 aa, Plasmodium falciparum
KNIQKNYLTNSLFWLCLYRLYIFPNADNVDILY

SEQ ID NO: 3289545 - protein, 39 aa, Plasmodium falciparum
KNISSYLYVPLGVLFIIISFIWFFLNRTKHLNMLIKEKE

SEQ ID NO: 3289546 - protein, 27 aa, Plasmodium falciparum
KNITIPFIVSLLHSLKIMISSNLFLTN

SEQ ID NO: 3289547 - protein, 47 aa, Plasmodium falciparum
KNIYDYFFLLCVLVSKLFFVFILMSEKIRVFFYHFRLLYTYQKEEIF

SEQ ID NO: 3289548 - protein, 30 aa, Plasmodium falciparum
KNIYLLLCICALLLYFFIFCLSIKEYKDIF

SEQ ID NO: 3289549 - protein, 27 aa, Plasmodium falciparum
KNIYYKKYLLVLYFFLMISSICSCYIK

SEQ ID NO: 3289550 - protein, 24 aa, Plasmodium falciparum
KNIYYLFICFNDINNIILFLNLYI

SEQ ID NO: 3289551 - protein, 27 aa, Plasmodium falciparum
KNKCIQLLYVLIFSLKENTHIYADILF

SEQ ID NO: 3289552 - protein, 43 aa, Plasmodium falciparum
KNKDDKICLLCNFSNYIYKGRLIPFYDIYIHSECLKWSLNCTQ

SEQ ID NO: 3289553 - protein, 34 aa, Plasmodium falciparum
KNKEFVIENFYKSKYNFFFFKNEKIIKMSVNKYH

SEQ ID NO: 3289554 - protein, 27 aa, Plasmodium falciparum
KNKETKLFPLYFSDNRLNIIYNDRAEK

SEQ ID NO: 3289555 - protein, 24 aa, Plasmodium falciparum
KNKEWYNIFLNKTIQYIYKEKKIF

SEQ ID NO: 3289556 - protein, 56 aa, Plasmodium falciparum
KNKEYSNLSKDLGLIEKQKIIWKSWIVKNVNNIENWFDEMWFKNVVNELKEKNDVS

SEQ ID NO: 3289557 - protein, 23 aa, Plasmodium falciparum
KNKFCLIYFGFTYCPDICPQELE

SEQ ID NO: 3289558 - protein, 21 aa, Plasmodium falciparum
KNKFIYYTNKYLRIQYYNNKE

SEQ ID NO: 3289559 - protein, 18 aa, Plasmodium falciparum
KNKFKTHLRKYLLKKIKH

SEQ ID NO: 3289560 - protein, 24 aa, Plasmodium falciparum
KNKFLEHYILTLNNFFLHKTKMTI

SEQ ID NO: 3289561 - protein, 41 aa, Plasmodium falciparum
KNKGFYCYDKFLNSLKIFIVYYYYILIYLNKDKINEEIDKD

SEQ ID NO: 3289562 - protein, 32 aa, Plasmodium falciparum
KNKGGYYISLAHFEFFFLARELIYSKNSTTYE

SEQ ID NO: 3289563 - protein, 17 aa, Plasmodium falciparum
KNKGIMFYSDMNDFPFL

SEQ ID NO: 3289564 - protein, 23 aa, Plasmodium falciparum
KNKHSENPALYNKLFYGQDIHNN

SEQ ID NO: 3289565 - protein, 18 aa, Plasmodium falciparum
KNKHWFEKLKKEWNIREN

SEQ ID NO: 3289566 - protein, 59 aa, Plasmodium falciparum
KNKIHFISVSLMNCLSVIMFIILYIISLHIFFYKTNSFHLSLREPVPYANRTYNRILYS

SEQ ID NO: 3289567 - protein, 17 aa, Plasmodium falciparum
KNKIMLCELIYQSLDYI

SEQ ID NO: 3289568 - protein, 23 aa, Plasmodium falciparum
KNKINKKYILKPLKIYIDEITYN

SEQ ID NO: 3289569 - protein, 24 aa, Plasmodium falciparum
KNKINYKYLIINKFEFHTAGINIS

SEQ ID NO: 3289570 - protein, 24 aa, Plasmodium falciparum
KNKIRFFCKVILLYLNNYLELSKH

SEQ ID NO: 3289571 - protein, 26 aa, Plasmodium falciparum
KNKIRKFLITLLEYSRDINFHFFIFN

SEQ ID NO: 3289572 - protein, 31 aa, Plasmodium falciparum
KNKIRKILLCLYFELLFLKICNNKNLFLYMF

SEQ ID NO: 3289573 - protein, 28 aa, Plasmodium falciparum
KNKISFPPFSPIYSYPFILHHFDYETKQ

SEQ ID NO: 3289574 - protein, 24 aa, Plasmodium falciparum
KNKKEILLKLYNKILNKIKIIHDG

SEQ ID NO: 3289575 - protein, 26 aa, Plasmodium falciparum
KNKKGYNYILNKYGFIKLKSSKKHIE

SEQ ID NO: 3289576 - protein, 25 aa, Plasmodium falciparum
KNKKIKVLLKYLSKINIQLKTFITI

SEQ ID NO: 3289577 - protein, 27 aa, Plasmodium falciparum
KNKKISFFMWIINNKKLSLGLLIFFIS

SEQ ID NO: 3289578 - protein, 23 aa, Plasmodium falciparum
KNKKKNVIYPTYDIKHIHNTNCI

SEQ ID NO: 3289579 - protein, 24 aa, Plasmodium falciparum
KNKKLFLLKDILIEQLRNILELYK

SEQ ID NO: 3289580 - protein, 28 aa, Plasmodium falciparum
KNKKLIQKIFFHLLNYYYTTKKHISYKY

SEQ ID NO: 3289581 - protein, 31 aa, Plasmodium falciparum
KNKKRYILFYIYFLIYKFMKLKGLDVLCMIE

SEQ ID NO: 3289582 - protein, 27 aa, Plasmodium falciparum
KNKKYHNFYLFLLNIFEYHLVKNTHTN

SEQ ID NO: 3289583 - protein, 22 aa, Plasmodium falciparum
KNKLCIIEILYICISFMINEYM

SEQ ID NO: 3289584 - protein, 39 aa, Plasmodium falciparum
KNKLKGKVCYYTNKSFLFLVRNIYRIRKMWIREKMKKRN

SEQ ID NO: 3289585 - protein, 26 aa, Plasmodium falciparum
KNKLNKIFLLAIQYINITKFNYFTSN

SEQ ID NO: 3289586 - protein, 45 aa, Plasmodium falciparum
KNKNESYSFIKLLFRKCIIFFIIYFLFIIPLNEVIYNKYDYSSKS

SEQ ID NO: 3289587 - protein, 17 aa, Plasmodium falciparum
KNKNFMYRFFDIKIYEY

SEQ ID NO: 3289588 - protein, 24 aa, Plasmodium falciparum
KNKNILIPFSFLFHNINCSYFIKL

SEQ ID NO: 3289589 - protein, 26 aa, Plasmodium falciparum
KNKNILISFRLFLVRSIHYKKSNPFL

SEQ ID NO: 3289590 - protein, 32 aa, Plasmodium falciparum
KNKNINSLIYNLVSKLKMDFYKNYIICDKDIF

SEQ ID NO: 3289591 - protein, 23 aa, Plasmodium falciparum
KNKNLNFHFYYYDTPEVDNISND

SEQ ID NO: 3289592 - protein, 30 aa, Plasmodium falciparum
KNKNSAIFLRYARLLIYKKNYDIGNVDINV

SEQ ID NO: 3289593 - protein, 24 aa, Plasmodium falciparum
KNKNTFINILLRYFSHIFCEYDIN

SEQ ID NO: 3289594 - protein, 17 aa, Plasmodium falciparum
KNKPPLLPTPKNESYKL

SEQ ID NO: 3289595 - protein, 28 aa, Plasmodium falciparum
KNKSIYLSPLFFFLNKYHNKKNGHDVIN

SEQ ID NO: 3289596 - protein, 26 aa, Plasmodium falciparum
KNKSPHLCLLWNVKLIEKYQPKNLSM

SEQ ID NO: 3289597 - protein, 24 aa, Plasmodium falciparum
KNKTLNLFAYLFYLCYEDDKDEKV

SEQ ID NO: 3289598 - protein, 31 aa, Plasmodium falciparum
KNKTQYVHRDIWIYLILKALKKKNDSTIFNE

SEQ ID NO: 3289599 - protein, 35 aa, Plasmodium falciparum
KNKYECIPFHLLLILLTILLYIDFLVIKQIGKEIY

SEQ ID NO: 3289600 - protein, 24 aa, Plasmodium falciparum
KNKYFRFNCFINNIKLDETSPEII

SEQ ID NO: 3289601 - protein, 24 aa, Plasmodium falciparum
KNKYKILYSFVKNLIKIALSDIEY

SEQ ID NO: 3289602 - protein, 33 aa, Plasmodium falciparum
KNKYNLLSEKLGILKFDLLFGSEYHLAKNEMLN

SEQ ID NO: 3289603 - protein, 18 aa, Plasmodium falciparum
KNKYSLCFHFIKKNNKKK

SEQ ID NO: 3289604 - protein, 43 aa, Plasmodium falciparum
KNLFCYTNHLSLLYFTYIYSLNKFYYCTLYYNISKCFYYKINI

SEQ ID NO: 3289605 - protein, 20 aa, Plasmodium falciparum
KNLFEPFNIFKNIIVNSISS

SEQ ID NO: 3289606 - protein, 26 aa, Plasmodium falciparum
KNLFLNVCILLFKKQNFLLYTHDIKK

SEQ ID NO: 3289607 - protein, 37 aa, Plasmodium falciparum
KNLFLRSILIKFIIISFLGILYLFFYNVEVLEDKETN

SEQ ID NO: 3289608 - protein, 26 aa, Plasmodium falciparum
KNLFNKFLVFLLYSNVYEFKKIFESS

SEQ ID NO: 3289609 - protein, 17 aa, Plasmodium falciparum
KNLGSWLGFITLGRNRP

SEQ ID NO: 3289610 - protein, 21 aa, Plasmodium falciparum
KNLHFINFFFQCFEYEHLLSM

SEQ ID NO: 3289611 - protein, 38 aa, Plasmodium falciparum
KNLIISPNIQLIKIHPKFKALIYLAFDSSIKEVITSIV

SEQ ID NO: 3289612 - protein, 26 aa, Plasmodium falciparum
KNLIKIYHLFYRNYYCNLNMSEILHI

SEQ ID NO: 3289613 - protein, 28 aa, Plasmodium falciparum
KNLKKYVNFLFISTNLLYRGINCMGFTT

SEQ ID NO: 3289614 - protein, 22 aa, Plasmodium falciparum
KNLLFNNYIFNDNFLDNVFVLK

SEQ ID NO: 3289615 - protein, 29 aa, Plasmodium falciparum
KNLLLFHTHFFFYYYFCILQQNNYDIIHE

SEQ ID NO: 3289616 - protein, 26 aa, Plasmodium falciparum
KNLLLIYISNCLLYINNKHLLSIMHY

SEQ ID NO: 3289617 - protein, 17 aa, Plasmodium falciparum
KNLLREYKKEKNIINQS

SEQ ID NO: 3289618 - protein, 18 aa, Plasmodium falciparum
KNLLRYRNGNFLLNYSNN

SEQ ID NO: 3289619 - protein, 30 aa, Plasmodium falciparum
KNLLTSFEKLIIYKIFRFDILKLNMNNYID

SEQ ID NO: 3289620 - protein, 45 aa, Plasmodium falciparum
KNLNKKQLFNKYRLYIIFIFIILTFLLILSIKYNRYVKKYPYIKT

SEQ ID NO: 3289621 - protein, 24 aa, Plasmodium falciparum
KNLNKYFVFYLPSSVIWSSSKRSV

SEQ ID NO: 3289622 - protein, 62 aa, Plasmodium falciparum
KNLNLTKIVIAIFAYFAIILFPIKFHHLVILKLLHWYYKGYLRRYYKNVILYSILENIKNIK

SEQ ID NO: 3289623 - protein, 42 aa, Plasmodium falciparum
KNLRMDILYPIFNASLVFLFDDFYFFIIQNIKLVIEEKEKFY

SEQ ID NO: 3289624 - protein, 34 aa, Plasmodium falciparum
KNLSVAIYTAGSVALCVLIFSSIGLLLIKTNSGD

SEQ ID NO: 3289625 - protein, 24 aa, Plasmodium falciparum
KNLSVHLIFYLKDLTDMLGIDIYY

SEQ ID NO: 3289626 - protein, 25 aa, Plasmodium falciparum
KNLTILNNFLLCTYNILYKNKIKDI

SEQ ID NO: 3289627 - protein, 25 aa, Plasmodium falciparum
KNMERHKFFFNDNKIKLIFDKLLAN

SEQ ID NO: 3289628 - protein, 24 aa, Plasmodium falciparum
KNMIKKLSLVFLLGGFQGVVGWWM

SEQ ID NO: 3289629 - protein, 23 aa, Plasmodium falciparum
KNMIYFVCRFLISKTFCDNSTIF

SEQ ID NO: 3289630 - protein, 25 aa, Plasmodium falciparum
KNMIYGYDILLKLFDFLYMEHISME

SEQ ID NO: 3289631 - protein, 19 aa, Plasmodium falciparum
KNMKEPFFYFSKENKIKED

SEQ ID NO: 3289632 - protein, 20 aa, Plasmodium falciparum
KNMLDCSIQLYKKGGISIFY

SEQ ID NO: 3289633 - protein, 20 aa, Plasmodium falciparum
KNMMFHIVVLNVSFFLINFE

SEQ ID NO: 3289634 - protein, 27 aa, Plasmodium falciparum
KNMMSFHFFYLFLTTLLNNSPNSFIYN

SEQ ID NO: 3289635 - protein, 26 aa, Plasmodium falciparum
KNMNKYFYIYKYIQILTKENQILTFI

SEQ ID NO: 3289636 - protein, 25 aa, Plasmodium falciparum
KNMRKKFIVFDTHLYLLLSVAYYDL

SEQ ID NO: 3289637 - protein, 25 aa, Plasmodium falciparum
KNMYAILQSIKLDAVTKYILDNSYK

SEQ ID NO: 3289638 - protein, 30 aa, Plasmodium falciparum
KNNDYLNAIYYYNKALKKCKDKNIKSILYS

SEQ ID NO: 3289639 - protein, 17 aa, Plasmodium falciparum
KNNELIIAKDYIDKIKE

SEQ ID NO: 3289640 - protein, 28 aa, Plasmodium falciparum
KNNEQICIFVYIYSKLKFLHNMNLIHIK

SEQ ID NO: 3289641 - protein, 27 aa, Plasmodium falciparum
KNNFDGCLKKEVSVPRLSVSEFKNNFD

SEQ ID NO: 3289642 - protein, 21 aa, Plasmodium falciparum
KNNFHHMNIKDFQIFLRKEKN

SEQ ID NO: 3289643 - protein, 21 aa, Plasmodium falciparum
KNNFSLLKSSILKFICCIKTL

SEQ ID NO: 3289644 - protein, 23 aa, Plasmodium falciparum
KNNIKIYFRLAKGYFMLGEYDKS

SEQ ID NO: 3289645 - protein, 30 aa, Plasmodium falciparum
KNNIKRICRYIKYYALMERLNIINVCYIRL

SEQ ID NO: 3289646 - protein, 26 aa, Plasmodium falciparum
KNNILFLVHIILLSIAHYKLMRKSCD

SEQ ID NO: 3289647 - protein, 21 aa, Plasmodium falciparum
KNNINMPLNINYPYGISKDEM

SEQ ID NO: 3289648 - protein, 43 aa, Plasmodium falciparum
KNNIRAILEYSFSFSIMNFVGWLYEYFSKLYMGYNIELSLMND

SEQ ID NO: 3289649 - protein, 25 aa, Plasmodium falciparum
KNNKKIPIIYIPFNDIKNSPYIRGK

SEQ ID NO: 3289650 - protein, 17 aa, Plasmodium falciparum
KNNLLFAFAKDIKKYFL

SEQ ID NO: 3289651 - protein, 22 aa, Plasmodium falciparum
KNNLLLFQYYDGQQKAFKISQN

SEQ ID NO: 3289652 - protein, 24 aa, Plasmodium falciparum
KNNLSLFLLFIQNCNYVNSFYISQ

SEQ ID NO: 3289653 - protein, 24 aa, Plasmodium falciparum
KNNLVNIPFTWDKTTLDFSKCLPD

SEQ ID NO: 3289654 - protein, 17 aa, Plasmodium falciparum
KNNMLLFKFFFSHTKEE

SEQ ID NO: 3289655 - protein, 27 aa, Plasmodium falciparum
KNNNGHGYIFLILLNKNFFVDEFMKSS

SEQ ID NO: 3289656 - protein, 42 aa, Plasmodium falciparum
KNNNKYWFIISCTVIPFLLIILFILLYKRWFPDNLICFPFLS

SEQ ID NO: 3289657 - protein, 23 aa, Plasmodium falciparum
KNNNNIFLFPNDYFPSLQKRKIK

SEQ ID NO: 3289658 - protein, 23 aa, Plasmodium falciparum
KNNNQFIILMVKLLSNVYEIVKK

SEQ ID NO: 3289659 - protein, 27 aa, Plasmodium falciparum
KNNRTQIIGYWPLRGDFDIEYDNDAEL

SEQ ID NO: 3289660 - protein, 24 aa, Plasmodium falciparum
KNNSFLFINLSYFVKYIFDCVTNI

SEQ ID NO: 3289661 - protein, 22 aa, Plasmodium falciparum
KNPILHLWKIYSFQKCPHNYYC

SEQ ID NO: 3289662 - protein, 31 aa, Plasmodium falciparum
KNPPKLSDFVLRPPYFRYLEEWGETFCRQRA

SEQ ID NO: 3289663 - protein, 19 aa, Plasmodium falciparum
KNPQLLRRGLGLLRNHLNN

SEQ ID NO: 3289664 - protein, 17 aa, Plasmodium falciparum
KNPYFYPQRKYEIHVKE

SEQ ID NO: 3289665 - protein, 24 aa, Plasmodium falciparum
KNPYLFVENFYLLKNSKHFPFYIN

SEQ ID NO: 3289666 - protein, 48 aa, Plasmodium falciparum
KNQGLTLIDFFLLMQEISLLIFPYISHLCIYNTIYPYRKDFFDKLNDQ

SEQ ID NO: 3289667 - protein, 25 aa, Plasmodium falciparum
KNQILYKRKIIYSKWKAPVQIKKKE

SEQ ID NO: 3289668 - protein, 29 aa, Plasmodium falciparum
KNQYKVLVTANRFLWRKSLLDVQEECNVI

SEQ ID NO: 3289669 - protein, 22 aa, Plasmodium falciparum
KNRFEYLLPTQKKTNLLCNDDH

SEQ ID NO: 3289670 - protein, 23 aa, Plasmodium falciparum
KNRFIIFLNILFLKPEIYRHIVF

SEQ ID NO: 3289671 - protein, 22 aa, Plasmodium falciparum
KNRINILVLHQNRYIRNAYGNN

SEQ ID NO: 3289672 - protein, 26 aa, Plasmodium falciparum
KNRLKKFCFTLFFSVTLKNLIKCYIC

SEQ ID NO: 3289673 - protein, 28 aa, Plasmodium falciparum
KNRNPLYYVSLLFNKPNSFPYLIKKNIL

SEQ ID NO: 3289674 - protein, 32 aa, Plasmodium falciparum
KNRTQLEIVSFNSLFWRWVTEMLKDSIDWRKE

SEQ ID NO: 3289675 - protein, 21 aa, Plasmodium falciparum
KNRYSKRGNYLWLLEKKEKND

SEQ ID NO: 3289676 - protein, 26 aa, Plasmodium falciparum
KNSDFFILLLHFNLPFILFHLDLFSN

SEQ ID NO: 3289677 - protein, 38 aa, Plasmodium falciparum
KNSFKIVKKMWFFDYPFNIHFHIFNWKKYIIDAQIHVF

SEQ ID NO: 3289678 - protein, 28 aa, Plasmodium falciparum
KNSKIFRPPNPWTVSILNLLGELHEAQS

SEQ ID NO: 3289679 - protein, 23 aa, Plasmodium falciparum
KNSKIYIKMFYINGNIPSNFEVF

SEQ ID NO: 3289680 - protein, 27 aa, Plasmodium falciparum
KNSKRLFYNFFFNHKYVFDISLQQFVY

SEQ ID NO: 3289681 - protein, 22 aa, Plasmodium falciparum
KNSLIIIYHRIVSGLITIEYVC

SEQ ID NO: 3289682 - protein, 21 aa, Plasmodium falciparum
KNSMNTLWIESVLRLIALQIC

SEQ ID NO: 3289683 - protein, 31 aa, Plasmodium falciparum
KNSRNTYYIYILFILCVIQIKILLSKEGSYG

SEQ ID NO: 3289684 - protein, 28 aa, Plasmodium falciparum
KNSSNFLFVDKLPYYLSPLLHTLVIQGK

SEQ ID NO: 3289685 - protein, 26 aa, Plasmodium falciparum
KNSTIKIVQLLLKLGADLTIKNKKGI

SEQ ID NO: 3289686 - protein, 26 aa, Plasmodium falciparum
KNSYMNYQIFYQIFIKRNSKKITNIK

SEQ ID NO: 3289687 - protein, 22 aa, Plasmodium falciparum
KNTENEMYYLKSATYKYDINLK

SEQ ID NO: 3289688 - protein, 20 aa, Plasmodium falciparum
KNTFDPFFEKHSNNSLMDSG

SEQ ID NO: 3289689 - protein, 45 aa, Plasmodium falciparum
KNTLLYLKKKNETMLTYIIYITYYVFLKVMNSYTPTHPVLDKLIY

SEQ ID NO: 3289690 - protein, 27 aa, Plasmodium falciparum
KNTLNNTLYFIFKVLSIRIICYEFQKE

SEQ ID NO: 3289691 - protein, 20 aa, Plasmodium falciparum
KNTMKLLLPPVFEAKNIIKS

SEQ ID NO: 3289692 - protein, 18 aa, Plasmodium falciparum
KNTNYLFNLFKKSFKEEG

SEQ ID NO: 3289693 - protein, 24 aa, Plasmodium falciparum
KNTSFYLFKVLLYAKLHRHYESLQ

SEQ ID NO: 3289694 - protein, 26 aa, Plasmodium falciparum
KNTSTPLFLIINNLNKILTEKKLKHI

SEQ ID NO: 3289695 - protein, 21 aa, Plasmodium falciparum
KNTYLLYYLFVQGTTLNNIIN

SEQ ID NO: 3289696 - protein, 26 aa, Plasmodium falciparum
KNTYRQTYNYLYKHYNYREPLKRSIS

SEQ ID NO: 3289697 - protein, 29 aa, Plasmodium falciparum
KNVEFKQLYIIPYLLKDYNVIIDPLPTTP

SEQ ID NO: 3289698 - protein, 25 aa, Plasmodium falciparum
KNVFEPFLELLCICKDLSCTNTMCY

SEQ ID NO: 3289699 - protein, 27 aa, Plasmodium falciparum
KNVHKRFGYLLLIDNFDFVYEDLLKNI

SEQ ID NO: 3289700 - protein, 25 aa, Plasmodium falciparum
KNVLNEFIYIFYSNNFRNNYLQKGH

SEQ ID NO: 3289701 - protein, 22 aa, Plasmodium falciparum
KNVMIHIYPINQIYSYIINTYI

SEQ ID NO: 3289702 - protein, 21 aa, Plasmodium falciparum
KNVMKMLVSVPLGLIRYLCVC

SEQ ID NO: 3289703 - protein, 29 aa, Plasmodium falciparum
KNVMLKNKWMYFLQKLLNQYIHMKCFKKV

SEQ ID NO: 3289704 - protein, 25 aa, Plasmodium falciparum
KNVWYIYIIFIFSIYIIYWHYIGTF

SEQ ID NO: 3289705 - protein, 26 aa, Plasmodium falciparum
KNVYINILLVFIKKIKDYIVGIGILK

SEQ ID NO: 3289706 - protein, 21 aa, Plasmodium falciparum
KNVYKFIPYINIKDIIIILKS

SEQ ID NO: 3289707 - protein, 26 aa, Plasmodium falciparum
KNVYKIFTLSLWIYHIICFDNNIIFS

SEQ ID NO: 3289708 - protein, 26 aa, Plasmodium falciparum
KNVYYNILIVLYYLFNQHIKKELYHF

SEQ ID NO: 3289709 - protein, 23 aa, Plasmodium falciparum
KNWKNHVIPFTDKIIKDLTISKN

SEQ ID NO: 3289710 - protein, 21 aa, Plasmodium falciparum
KNWNLFLLSLIKYKKNERTNK

SEQ ID NO: 3289711 - protein, 30 aa, Plasmodium falciparum
KNYDNLLIYDYFYYNYIFNNKFTTYDSFKC

SEQ ID NO: 3289712 - protein, 42 aa, Plasmodium falciparum
KNYFEKIFEIYKTLYIIIVEKTFLSIFVNNILYTIDLIIFLT

SEQ ID NO: 3289713 - protein, 21 aa, Plasmodium falciparum
KNYIISFICYYILKDEDSAIN

SEQ ID NO: 3289714 - protein, 21 aa, Plasmodium falciparum
KNYIKLYKLCNPEYSKLTIEK

SEQ ID NO: 3289715 - protein, 21 aa, Plasmodium falciparum
KNYILNYLKICKNIFVVPNEY

SEQ ID NO: 3289716 - protein, 23 aa, Plasmodium falciparum
KNYKILYLTIFIKSINIHRDMQN

SEQ ID NO: 3289717 - protein, 20 aa, Plasmodium falciparum
KNYKNFLHFCNNDRYVITNT

SEQ ID NO: 3289718 - protein, 21 aa, Plasmodium falciparum
KNYLLIFAWIIITISYLIYIN

SEQ ID NO: 3289719 - protein, 22 aa, Plasmodium falciparum
KNYLLIFAWIIITISYLIYINS

SEQ ID NO: 3289720 - protein, 19 aa, Plasmodium falciparum
KNYLLLFEYNIKTLINLCL

SEQ ID NO: 3289721 - protein, 17 aa, Plasmodium falciparum
KNYMLYTKQLNKLKEER

SEQ ID NO: 3289722 - protein, 34 aa, Plasmodium falciparum
KNYNEEYIMFLLINYIISIQFLYITDVVNILLNF

SEQ ID NO: 3289723 - protein, 29 aa, Plasmodium falciparum
KNYQSYFQLYIILPMRFIAHYFKLNCFFN

SEQ ID NO: 3289724 - protein, 26 aa, Plasmodium falciparum
KNYRLEKMEYWKKYLSSKFKKYKRNA

SEQ ID NO: 3289725 - protein, 35 aa, Plasmodium falciparum
KNYSILSILFHLFTYPYLLFKIPSKAFYPVPKVQA

SEQ ID NO: 3289726 - protein, 24 aa, Plasmodium falciparum
KNYTSLFFNIPLNIYDMNSKYMDE

SEQ ID NO: 3289727 - protein, 37 aa, Plasmodium falciparum
KNYVKYVGGHTPIWSIDTAFLGYFFATAEDDGNLRIY

SEQ ID NO: 3289728 - protein, 26 aa, Plasmodium falciparum
KPEDFLIFLTFGYISNLLFTIWANMY

SEQ ID NO: 3289729 - protein, 18 aa, Plasmodium falciparum
KPFFQNLRINMDPISYDK

SEQ ID NO: 3289730 - protein, 20 aa, Plasmodium falciparum
KPFIIKDISVLSYSLSEQYD

SEQ ID NO: 3289731 - protein, 20 aa, Plasmodium falciparum
KPFIMSIHDRNLFSGEEYNY

SEQ ID NO: 3289732 - protein, 31 aa, Plasmodium falciparum
KPFVSFGNPFFLFTLFICIFQNFQKYPFYQY

SEQ ID NO: 3289733 - protein, 26 aa, Plasmodium falciparum
KPHHICNILLYLTIYKDVYLMGVHKN

SEQ ID NO: 3289734 - protein, 19 aa, Plasmodium falciparum
KPHIINRSLSFFKDYISNS

SEQ ID NO: 3289735 - protein, 20 aa, Plasmodium falciparum
KPHKILLDYNRCGVPLVEIV

SEQ ID NO: 3289736 - protein, 20 aa, Plasmodium falciparum
KPICHTVYTLDFVQGKVHVP

SEQ ID NO: 3289737 - protein, 35 aa, Plasmodium falciparum
KPISKKIVFIITIFCLILISWKYFNISYENNKFSF

SEQ ID NO: 3289738 - protein, 20 aa, Plasmodium falciparum
KPIVQYDNFQDEENIGIYKE

SEQ ID NO: 3289739 - protein, 25 aa, Plasmodium falciparum
KPKNLYHFTFFYLYNTLKCTLTGKV

SEQ ID NO: 3289740 - protein, 24 aa, Plasmodium falciparum
KPMDKMNSYFNRQAKNKLKGKVCY

SEQ ID NO: 3289741 - protein, 25 aa, Plasmodium falciparum
KPNIFLTYQIVLNNYDFINKHDIFP

SEQ ID NO: 3289742 - protein, 18 aa, Plasmodium falciparum
KPNTLYNNFLESLKHESC

SEQ ID NO: 3289743 - protein, 20 aa, Plasmodium falciparum
KPPILLGSCIISLKSVTEYP

SEQ ID NO: 3289744 - protein, 20 aa, Plasmodium falciparum
KPRHRFLHFLLKHNIRLCLR

SEQ ID NO: 3289745 - protein, 28 aa, Plasmodium falciparum
KPSLRFCKLFRRYYIRKFLKNKIKEDLI

SEQ ID NO: 3289746 - protein, 27 aa, Plasmodium falciparum
KPTDTLIFSHWIQPYYDIYVICLQESI

SEQ ID NO: 3289747 - protein, 17 aa, Plasmodium falciparum
KPTTLDSFVKRPTYFRY

SEQ ID NO: 3289748 - protein, 21 aa, Plasmodium falciparum
KPYIVGIISFFSWVVITGNFV

SEQ ID NO: 3289749 - protein, 48 aa, Plasmodium falciparum
KQAVHVAKQNYLYVVIFLFFVINILLFINFYNLGKRKGYYLAKKQKKE

SEQ ID NO: 3289750 - protein, 21 aa, Plasmodium falciparum
KQCISCLYACNPYVEWIDNQR

SEQ ID NO: 3289751 - protein, 21 aa, Plasmodium falciparum
KQCISCLYGCNPYVDWIEKQK

SEQ ID NO: 3289752 - protein, 33 aa, Plasmodium falciparum
KQDKKCALIIYKNLYYLLIEKLYYEQNDNINSE

SEQ ID NO: 3289753 - protein, 26 aa, Plasmodium falciparum
KQDNSLLPFFFFHLSKEDKMNLLSIC

SEQ ID NO: 3289754 - protein, 21 aa, Plasmodium falciparum
KQEGKLLWKKHGTILDNQNAC

SEQ ID NO: 3289755 - protein, 27 aa, Plasmodium falciparum
KQGLNEVLALFFYLKGKHFNMVDVYFC

SEQ ID NO: 3289756 - protein, 29 aa, Plasmodium falciparum
KQGSWSILLFILLFTFLSPLFMSVEIMCV

SEQ ID NO: 3289757 - protein, 42 aa, Plasmodium falciparum
KQHYVYNISFAQLIYFMLIFLYKIFFQPIKTTDTMLSDVPNN

SEQ ID NO: 3289758 - protein, 18 aa, Plasmodium falciparum
KQIFYLAKRKRSMNDEVL

SEQ ID NO: 3289759 - protein, 26 aa, Plasmodium falciparum
KQIKRNGFALWILKDPFVIKEAGSNV

SEQ ID NO: 3289760 - protein, 17 aa, Plasmodium falciparum
KQILIKPKDLCFLINYA

SEQ ID NO: 3289761 - protein, 26 aa, Plasmodium falciparum
KQIYNFEKLLYILYKKDVHKSFNKLL

SEQ ID NO: 3289762 - protein, 21 aa, Plasmodium falciparum
KQKFKYLMEENFFFSKRQNNM

SEQ ID NO: 3289763 - protein, 26 aa, Plasmodium falciparum
KQKGIPFGCYFTTLEGVLQLEFLNEN

SEQ ID NO: 3289764 - protein, 23 aa, Plasmodium falciparum
KQKLHIEAFFNNIIVKSCKNSLK

SEQ ID NO: 3289765 - protein, 17 aa, Plasmodium falciparum
KQKLPLCKFIHSCVSCA

SEQ ID NO: 3289766 - protein, 30 aa, Plasmodium falciparum
KQKTYNDFFYYWVAHMLKDSIHWKKKLEKC

SEQ ID NO: 3289767 - protein, 31 aa, Plasmodium falciparum
KQKTYNDFFYYWVAHMLKDSIHWKKKLEKCL

SEQ ID NO: 3289768 - protein, 24 aa, Plasmodium falciparum
KQKYFYVICPLFLKNGNCILVNRG

SEQ ID NO: 3289769 - protein, 23 aa, Plasmodium falciparum
KQLDLCVRIFDILNKSILLIDEV

SEQ ID NO: 3289770 - protein, 46 aa, Plasmodium falciparum
KQLHKNYLFTVTFIKNFLLFILIDIFFMLSYIIKTHYYKCIFDYIY

SEQ ID NO: 3289771 - protein, 21 aa, Plasmodium falciparum
KQLNYAFKLIIIGSTSIIASL

SEQ ID NO: 3289772 - protein, 33 aa, Plasmodium falciparum
KQLQTGTIPPDFLRLMFYTLGDYRDILDGKNME

SEQ ID NO: 3289773 - protein, 24 aa, Plasmodium falciparum
KQLSPNIYTLKKYLYPSDNYDVSN

SEQ ID NO: 3289774 - protein, 22 aa, Plasmodium falciparum
KQMKLYFIFQIKEIALRKHGSL

SEQ ID NO: 3289775 - protein, 26 aa, Plasmodium falciparum
KQMLIKTLDYLFYILNNHHNIKWNNN

SEQ ID NO: 3289776 - protein, 30 aa, Plasmodium falciparum
KQNDKLFRDEWWKVIKKDVWNVISWVFKDK

SEQ ID NO: 3289777 - protein, 26 aa, Plasmodium falciparum
KQNNNFFMYIFSKIKNVYLFVDEINK

SEQ ID NO: 3289778 - protein, 37 aa, Plasmodium falciparum
KQNNSTFLFVLISFACVILLFCNVYEAPFINNDHFLI

SEQ ID NO: 3289779 - protein, 23 aa, Plasmodium falciparum
KQNNYYMQYINELIIYNNIFTYC

SEQ ID NO: 3289780 - protein, 25 aa, Plasmodium falciparum
KQNRKYIYFSSHGLGGRLGANIEEP

SEQ ID NO: 3289781 - protein, 20 aa, Plasmodium falciparum
KQNVLFYLSSKILLPYQVEK

SEQ ID NO: 3289782 - protein, 29 aa, Plasmodium falciparum
KQRETQIMCLPLYISIVGGLDIFLYNYYN

SEQ ID NO: 3289783 - protein, 18 aa, Plasmodium falciparum
KQRFLINSSLFFSEFDSC

SEQ ID NO: 3289784 - protein, 29 aa, Plasmodium falciparum
KQRILYFSIFLLIVAFIILFPVFFNYTIF

SEQ ID NO: 3289785 - protein, 26 aa, Plasmodium falciparum
KQSKAKRPPPPLPAALLKSVNVAKEK

SEQ ID NO: 3289786 - protein, 24 aa, Plasmodium falciparum
KQSKRIFLYLRLSNGMYLTCVYEK

SEQ ID NO: 3289787 - protein, 23 aa, Plasmodium falciparum
KQSPFYVITLNPKSIMNPPQNRY

SEQ ID NO: 3289788 - protein, 33 aa, Plasmodium falciparum
KQTAFRRFFNKILSLGNMLLRKPSFRVEHALWF

SEQ ID NO: 3289789 - protein, 20 aa, Plasmodium falciparum
KQTLYILFIVILLVFQNFFI

SEQ ID NO: 3289790 - protein, 27 aa, Plasmodium falciparum
KQVQIIICQILYALYYLHIKGIIHCDI

SEQ ID NO: 3289791 - protein, 24 aa, Plasmodium falciparum
KQVRYLEYFVILPIISLVTSGICF

SEQ ID NO: 3289792 - protein, 22 aa, Plasmodium falciparum
KQVYVILICGYLMPIELCIMEI

SEQ ID NO: 3289793 - protein, 19 aa, Plasmodium falciparum
KQYFFFPSKDENIRKDFFL

SEQ ID NO: 3289794 - protein, 19 aa, Plasmodium falciparum
KQYGLYMKKLYDKNIIIDD

SEQ ID NO: 3289795 - protein, 33 aa, Plasmodium falciparum
KQYKNTNIFFLILFFNIFLPYTNNDILIYLNTI

SEQ ID NO: 3289796 - protein, 42 aa, Plasmodium falciparum
KRATKFTIKWGSLIIRHIYYFIFFFLTIPVRPCMRKRAGKGR

SEQ ID NO: 3289797 - protein, 32 aa, Plasmodium falciparum
KRCFILESFYSFLKYYCFYAMSLNEIYFVKNE

SEQ ID NO: 3289798 - protein, 25 aa, Plasmodium falciparum
KRDKHVLIIFYYTYTSHIYNTLFPN

SEQ ID NO: 3289799 - protein, 23 aa, Plasmodium falciparum
KRDKKLLFLYTINSFRVIQIYNN

SEQ ID NO: 3289800 - protein, 24 aa, Plasmodium falciparum
KRDPKLFKDFIYSSAISEVERLKK

SEQ ID NO: 3289801 - protein, 18 aa, Plasmodium falciparum
KREAYRIIERLNKVIYMD

SEQ ID NO: 3289802 - protein, 29 aa, Plasmodium falciparum
KREIKSMLFFVLYSKMFNEPFSCDTILFS

SEQ ID NO: 3289803 - protein, 20 aa, Plasmodium falciparum
KREKSISPHSYQKVSTKVQN

SEQ ID NO: 3289804 - protein, 20 aa, Plasmodium falciparum
KRENGELPFLARSTSVEMKA

SEQ ID NO: 3289805 - protein, 17 aa, Plasmodium falciparum
KRFFNIFINCEVKVYIN

SEQ ID NO: 3289806 - protein, 23 aa, Plasmodium falciparum
KRFSLLNYLWFITGTVVMVVTRK

SEQ ID NO: 3289807 - protein, 33 aa, Plasmodium falciparum
KRGMTYIATFMIVLSIIITFISGFITLYNNNNN

SEQ ID NO: 3289808 - protein, 18 aa, Plasmodium falciparum
KRHPYHILIYNFLCIENI

SEQ ID NO: 3289809 - protein, 19 aa, Plasmodium falciparum
KRIISPINNVLKFLKCIQI

SEQ ID NO: 3289810 - protein, 21 aa, Plasmodium falciparum
KRIKLPFLRIFFEKMSKIAEE

SEQ ID NO: 3289811 - protein, 20 aa, Plasmodium falciparum
KRILKVTKLLIQLNSFKLSP

SEQ ID NO: 3289812 - protein, 19 aa, Plasmodium falciparum
KRILLLQFVLIRFYSNTYM

SEQ ID NO: 3289813 - protein, 29 aa, Plasmodium falciparum
KRINDSFFFLMSSYKYFYKSSLYLSKQIN

SEQ ID NO: 3289814 - protein, 24 aa, Plasmodium falciparum
KRKDILHSFFDDVYFYVYNKDKNI

SEQ ID NO: 3289815 - protein, 18 aa, Plasmodium falciparum
KRKEMYKILYKLKHINEF

SEQ ID NO: 3289816 - protein, 28 aa, Plasmodium falciparum
KRKFSIVHKFFYSLNIFFNSFSTLIKQR

SEQ ID NO: 3289817 - protein, 21 aa, Plasmodium falciparum
KRKGLYYVIVDTINNLYNTTF

SEQ ID NO: 3289818 - protein, 19 aa, Plasmodium falciparum
KRKHLILSNLQNNLFNYHD

SEQ ID NO: 3289819 - protein, 19 aa, Plasmodium falciparum
KRKIERCRIAWKALSNKIQ

SEQ ID NO: 3289820 - protein, 19 aa, Plasmodium falciparum
KRKKEFTDVLLTKKRTPKR

SEQ ID NO: 3289821 - protein, 26 aa, Plasmodium falciparum
KRKKKKFKINPIKGYLLLHNKNFYVS

SEQ ID NO: 3289822 - protein, 27 aa, Plasmodium falciparum
KRKKYYYHICQILIKFIVSSLSDNTID

SEQ ID NO: 3289823 - protein, 30 aa, Plasmodium falciparum
KRKLEDELILSIKINLLYSIHNLIKMFSHV

SEQ ID NO: 3289824 - protein, 26 aa, Plasmodium falciparum
KRKNEKFLIIYKTPQSNILYLEMNND

SEQ ID NO: 3289825 - protein, 20 aa, Plasmodium falciparum
KRKNLWNNIWIVSTTLLLII

SEQ ID NO: 3289826 - protein, 27 aa, Plasmodium falciparum
KRKNNYVFIFVPYMSYLCKQEILKYNV

SEQ ID NO: 3289827 - protein, 24 aa, Plasmodium falciparum
KRKTSFPFFFFRRNESYSLNTCKI

SEQ ID NO: 3289828 - protein, 18 aa, Plasmodium falciparum
KRKWLRRRKRKRLYQIHV

SEQ ID NO: 3289829 - protein, 25 aa, Plasmodium falciparum
KRLCKLFIYFLNMTNINYINNMSDD

SEQ ID NO: 3289830 - protein, 32 aa, Plasmodium falciparum
KRLFIDYEEWFRYRYNQWKGLSEKYIKIKKSK

SEQ ID NO: 3289831 - protein, 17 aa, Plasmodium falciparum
KRLKLFLNKYNMQWLHF

SEQ ID NO: 3289832 - protein, 25 aa, Plasmodium falciparum
KRLPYLYIGMFFIGGLLEVVFCSTN

SEQ ID NO: 3289833 - protein, 42 aa, Plasmodium falciparum
KRMFCNICGYILKQNFLNDFFFFKIFIVTKRAIFSNHSTINI

SEQ ID NO: 3289834 - protein, 39 aa, Plasmodium falciparum
KRMINYYWNVYTKKPLKKFYKIIFFKAGKMFVSKFSLFN

SEQ ID NO: 3289835 - protein, 36 aa, Plasmodium falciparum
KRNALKWNEIISPPCHLILILNRYNWSFSSNEKKKI

SEQ ID NO: 3289836 - protein, 24 aa, Plasmodium falciparum
KRNEILQMLILKPTFCILDETDSG

SEQ ID NO: 3289837 - protein, 23 aa, Plasmodium falciparum
KRNEKLLFYKKKTNKCKNNKKPK

SEQ ID NO: 3289838 - protein, 18 aa, Plasmodium falciparum
KRNFLEVDTPILQLIPGG

SEQ ID NO: 3289839 - protein, 25 aa, Plasmodium falciparum
KRNIILLLSILFFISSFFISNSDSK

SEQ ID NO: 3289840 - protein, 23 aa, Plasmodium falciparum
KRNKYIFYYSNEKALYFIHYIYT

SEQ ID NO: 3289841 - protein, 26 aa, Plasmodium falciparum
KRNLYNLYIIIKCYYYLLTHSIKHEK

SEQ ID NO: 3289842 - protein, 28 aa, Plasmodium falciparum
KRNMNFHLLLFYSLSYSSSLYLNFECLK

SEQ ID NO: 3289843 - protein, 24 aa, Plasmodium falciparum
KRNNINNQLILYNKKRNISNRFFN

SEQ ID NO: 3289844 - protein, 19 aa, Plasmodium falciparum
KRNSLYKYKLKGSKGKSVK

SEQ ID NO: 3289845 - protein, 25 aa, Plasmodium falciparum
KRNVSFINFYSWIFFKDISIKKNRL

SEQ ID NO: 3289846 - protein, 24 aa, Plasmodium falciparum
KRNVYKEYILLCHGRIKKKKGFIN

SEQ ID NO: 3289847 - protein, 35 aa, Plasmodium falciparum
KRNYHKMYHILIAYKYILYALQVCIKYNIYYIYIY

SEQ ID NO: 3289848 - protein, 21 aa, Plasmodium falciparum
KRNYLLFKILISFLCYHIRQY

SEQ ID NO: 3289849 - protein, 18 aa, Plasmodium falciparum
KRQMFYTFGDYRDIFFGT

SEQ ID NO: 3289850 - protein, 18 aa, Plasmodium falciparum
KRQMYYTFGDYRDIFFGT

SEQ ID NO: 3289851 - protein, 32 aa, Plasmodium falciparum
KRRIIVYEYLYNIWYKTSKIEKVWLLPKKKNI

SEQ ID NO: 3289852 - protein, 28 aa, Plasmodium falciparum
KRRKKKWEFYNPSKLYYLDSRKIYKCKY

SEQ ID NO: 3289853 - protein, 34 aa, Plasmodium falciparum
KRRRMSFFLICTFFNLIFLVSLLVLYKETDTKGY

SEQ ID NO: 3289854 - protein, 18 aa, Plasmodium falciparum
KRRYELQKAILLNVDENL

SEQ ID NO: 3289855 - protein, 26 aa, Plasmodium falciparum
KRSKIMFLLLFCKVKHILNFKKIILD

SEQ ID NO: 3289856 - protein, 18 aa, Plasmodium falciparum
KRSLSLFSFKSLPIRRRK

SEQ ID NO: 3289857 - protein, 24 aa, Plasmodium falciparum
KRTHLFACGIKRKSIKWICRENSE

SEQ ID NO: 3289858 - protein, 41 aa, Plasmodium falciparum
KRTNLLLNSLFSRKAMIPLLGILYVILLNVLVSNNNDNRAV

SEQ ID NO: 3289859 - protein, 28 aa, Plasmodium falciparum
KRVCNSFYFFYTFFKISDTFLLHLLKEF

SEQ ID NO: 3289860 - protein, 25 aa, Plasmodium falciparum
KRVFLILTSYFIFGTKFSFLGGLGS

SEQ ID NO: 3289861 - protein, 24 aa, Plasmodium falciparum
KRVLYKYVFLFNNYKFKFKIVSTY

SEQ ID NO: 3289862 - protein, 26 aa, Plasmodium falciparum
KRYDKRFIYFKNIYNILFSNNIIIIR

SEQ ID NO: 3289863 - protein, 21 aa, Plasmodium falciparum
KRYFMSLIFIMLSYIMIEIIY

SEQ ID NO: 3289864 - protein, 22 aa, Plasmodium falciparum
KRYFMSLIFIMLSYIMIEIIYI

SEQ ID NO: 3289865 - protein, 18 aa, Plasmodium falciparum
KRYLKINDFYITFMKKLK

SEQ ID NO: 3289866 - protein, 20 aa, Plasmodium falciparum
KRYMVFTLFCFYIISCVGIF

SEQ ID NO: 3289867 - protein, 28 aa, Plasmodium falciparum
KRYRKKLFKLNFLEKSYILQFFINIYSS

SEQ ID NO: 3289868 - protein, 18 aa, Plasmodium falciparum
KRYSIFLNLLYNIFKKKV

SEQ ID NO: 3289869 - protein, 18 aa, Plasmodium falciparum
KSAFEQFCHCSTAGGLSG

SEQ ID NO: 3289870 - protein, 17 aa, Plasmodium falciparum
KSAVNFSVSFKKGSEYS

SEQ ID NO: 3289871 - protein, 33 aa, Plasmodium falciparum
KSCFKSLLSKPIVMIIAGILYIVILNVCMRERN

SEQ ID NO: 3289872 - protein, 57 aa, Plasmodium falciparum
KSCLQQFHYFLNHKRLGLKIFKYSHIILVYFIPFFKKYYFLWKFIEHEIDKDIMNLI

SEQ ID NO: 3289873 - protein, 20 aa, Plasmodium falciparum
KSCLYGYISDHNYMHNKHLN

SEQ ID NO: 3289874 - protein, 35 aa, Plasmodium falciparum
KSCNDLICLYLFKHFSYILDYLLLLNGNNISEWYR

SEQ ID NO: 3289875 - protein, 56 aa, Plasmodium falciparum
KSDFNTVIYFYVNLLIPSNFIYIIASLIEATLFKSWIPFYTFPFKFGITDCKLLKE

SEQ ID NO: 3289876 - protein, 26 aa, Plasmodium falciparum
KSDILNIKYIYKLIDNYSKIDSYIKH

SEQ ID NO: 3289877 - protein, 22 aa, Plasmodium falciparum
KSDWKLIFLGTGSMYPSTSRGT

SEQ ID NO: 3289878 - protein, 23 aa, Plasmodium falciparum
KSDYLLYNLFGCTRSLYCYSVNN

SEQ ID NO: 3289879 - protein, 17 aa, Plasmodium falciparum
KSEKFKYPNLSLCEELF

SEQ ID NO: 3289880 - protein, 24 aa, Plasmodium falciparum
KSELKLFIKKIPIDIWLKQFEMMQ

SEQ ID NO: 3289881 - protein, 44 aa, Plasmodium falciparum
KSELYLYSINLFDAGLYNLSFVFYFLFFYYIKAYNLNKIYDRYK

SEQ ID NO: 3289882 - protein, 25 aa, Plasmodium falciparum
KSESKFAFVNYLKDFFQNSPYVKNF

SEQ ID NO: 3289883 - protein, 21 aa, Plasmodium falciparum
KSEVKYFYYIQRKNNLGVYKE

SEQ ID NO: 3289884 - protein, 28 aa, Plasmodium falciparum
KSFCFNYIYSFRPFFLRCILHLNRKQEV

SEQ ID NO: 3289885 - protein, 26 aa, Plasmodium falciparum
KSFHILNLVYIFYKYVKSEKPLHFDN

SEQ ID NO: 3289886 - protein, 24 aa, Plasmodium falciparum
KSFHQYMLYLNKKCQDRIACDVIE

SEQ ID NO: 3289887 - protein, 32 aa, Plasmodium falciparum
KSFLFLLELMVFSLFIWILKSAKHNVSSKSIY

SEQ ID NO: 3289888 - protein, 22 aa, Plasmodium falciparum
KSFLLWASFMLIYFTNISIYVS

SEQ ID NO: 3289889 - protein, 28 aa, Plasmodium falciparum
KSFRNEYFKLLVNLYLSLSEEELKTEYI

SEQ ID NO: 3289890 - protein, 23 aa, Plasmodium falciparum
KSFRNYAWFCKGFPKYVSHEGFL

SEQ ID NO: 3289891 - protein, 25 aa, Plasmodium falciparum
KSFYALLKDKYSHSILACLGFIVGY

SEQ ID NO: 3289892 - protein, 25 aa, Plasmodium falciparum
KSGINKVFDIIKRTMDSYNIYNLSK

SEQ ID NO: 3289893 - protein, 29 aa, Plasmodium falciparum
KSHVIKINVPLLNFLKKITNLSNIKIQLS

SEQ ID NO: 3289894 - protein, 31 aa, Plasmodium falciparum
KSIDRNIRLYIFLYALLFVNNKRKEDMVHGL

SEQ ID NO: 3289895 - protein, 24 aa, Plasmodium falciparum
KSIFFLTIFVMINSAIISIIIPRY

SEQ ID NO: 3289896 - protein, 18 aa, Plasmodium falciparum
KSIFYLKESLRKFKHNRH

SEQ ID NO: 3289897 - protein, 33 aa, Plasmodium falciparum
KSIILMAFFQTPLFFIFYFSMKRIASYPDIFKD

SEQ ID NO: 3289898 - protein, 23 aa, Plasmodium falciparum
KSIILQVLLIICTYNILLNFVNI

SEQ ID NO: 3289899 - protein, 27 aa, Plasmodium falciparum
KSIKIKYLFKIYLGVTTPLEIVMREKG

SEQ ID NO: 3289900 - protein, 32 aa, Plasmodium falciparum
KSIKKQFTMFHRPNMLNLSYDWDSFQKDIMVL

SEQ ID NO: 3289901 - protein, 31 aa, Plasmodium falciparum
KSIKYLDTIPKYIKLFYVLNNDNYIFNFFSK

SEQ ID NO: 3289902 - protein, 35 aa, Plasmodium falciparum
KSINFYKYMFIMNSLVVILILCGLFVFTGDIINKY

SEQ ID NO: 3289903 - protein, 26 aa, Plasmodium falciparum
KSINTFLDFFISLINIGKFNMILFCS

SEQ ID NO: 3289904 - protein, 19 aa, Plasmodium falciparum
KSIRFPIWENLGEIYFRGT

SEQ ID NO: 3289905 - protein, 42 aa, Plasmodium falciparum
KSISDNLLSLKFHFLIISYKEKIYIYNILKGVLYEMCSNILL

SEQ ID NO: 3289906 - protein, 20 aa, Plasmodium falciparum
KSISYFIYFSTFQNFILCLT

SEQ ID NO: 3289907 - protein, 25 aa, Plasmodium falciparum
KSITHFARYLFFIAKKIAYSKDSPN

SEQ ID NO: 3289908 - protein, 19 aa, Plasmodium falciparum
KSIWFFTGYARNIFQPNSL

SEQ ID NO: 3289909 - protein, 18 aa, Plasmodium falciparum
KSIYFYLNEIRKIINPYV

SEQ ID NO: 3289910 - protein, 43 aa, Plasmodium falciparum
KSIYMKFIILIQNIIRYYIYNMLWFELYYFITNLKIDVLSFFS

SEQ ID NO: 3289911 - protein, 17 aa, Plasmodium falciparum
KSKFSLDTLFGTTLDKF

SEQ ID NO: 3289912 - protein, 27 aa, Plasmodium falciparum
KSKHKKIIFLLFVSLFGLYGFFESYNP

SEQ ID NO: 3289913 - protein, 25 aa, Plasmodium falciparum
KSKISILFPFYSVVLKFTIQYIFVL

SEQ ID NO: 3289914 - protein, 23 aa, Plasmodium falciparum
KSKKKNIFLTWKCLGINLSLTIP

SEQ ID NO: 3289915 - protein, 17 aa, Plasmodium falciparum
KSKKLLFPNLSIDRIKN

SEQ ID NO: 3289916 - protein, 26 aa, Plasmodium falciparum
KSKKYKLMHFIYYNNLYKKVDVNDRE

SEQ ID NO: 3289917 - protein, 17 aa, Plasmodium falciparum
KSKLFYKSINYTNFQTR

SEQ ID NO: 3289918 - protein, 30 aa, Plasmodium falciparum
KSKNKIEGLIICKLLTYLDLLRSYNTHGLN

SEQ ID NO: 3289919 - protein, 31 aa, Plasmodium falciparum
KSKNNIFRLLKKVLLPITLYNNITLNQLRLI

SEQ ID NO: 3289920 - protein, 22 aa, Plasmodium falciparum
KSKNRYIPYKSGPYKGKTYIYM

SEQ ID NO: 3289921 - protein, 23 aa, Plasmodium falciparum
KSKNRYIPYRSGQYKGKTYLYVE

SEQ ID NO: 3289922 - protein, 35 aa, Plasmodium falciparum
KSKQKLLKYYLSNDEYMFFQFLTSNLFEKNNRYKN

SEQ ID NO: 3289923 - protein, 25 aa, Plasmodium falciparum
KSKRGFFKNIFKKVFKRKKGKEGDE

SEQ ID NO: 3289924 - protein, 26 aa, Plasmodium falciparum
KSKRNIYHLVWILKKKKKNSYLGTNW

SEQ ID NO: 3289925 - protein, 21 aa, Plasmodium falciparum
KSKSIFSCRPVKYVCLSVAVA

SEQ ID NO: 3289926 - protein, 25 aa, Plasmodium falciparum
KSKSWFKGILFPILHRECTKKQMII

SEQ ID NO: 3289927 - protein, 23 aa, Plasmodium falciparum
KSKYLSLIHRLHKYYYNIKVKYK

SEQ ID NO: 3289928 - protein, 31 aa, Plasmodium falciparum
KSLDSCSFPLLFCILFLNTLGKFGKSVLSGI

SEQ ID NO: 3289929 - protein, 25 aa, Plasmodium falciparum
KSLFNYKIFWFYFKYAVACISNDLN

SEQ ID NO: 3289930 - protein, 26 aa, Plasmodium falciparum
KSLKNQLKFMWRKTKLNFTSSDAATF

SEQ ID NO: 3289931 - protein, 22 aa, Plasmodium falciparum
KSLKYFRVDVFFPKIFNSIGNA

SEQ ID NO: 3289932 - protein, 21 aa, Plasmodium falciparum
KSLLSRPSLVAPFVGIIYIVL

SEQ ID NO: 3289933 - protein, 21 aa, Plasmodium falciparum
KSLLVVIKKFFIMINLACHTR

SEQ ID NO: 3289934 - protein, 25 aa, Plasmodium falciparum
KSLNSLIHLFYSFSFMNIFDKKKID

SEQ ID NO: 3289935 - protein, 23 aa, Plasmodium falciparum
KSLPFYYLINIVESYSSCLIHDY

SEQ ID NO: 3289936 - protein, 29 aa, Plasmodium falciparum
KSLTLLTSLIYWLWKHKMNLFFIKENIEL

SEQ ID NO: 3289937 - protein, 34 aa, Plasmodium falciparum
KSLVALHIAFLQIILFRLTMSNFFVYYNEKRKKE

SEQ ID NO: 3289938 - protein, 18 aa, Plasmodium falciparum
KSLVIPIAVQFIRKNLNK

SEQ ID NO: 3289939 - protein, 21 aa, Plasmodium falciparum
KSLYYLLYSLVVLSKKVKMIS

SEQ ID NO: 3289940 - protein, 26 aa, Plasmodium falciparum
KSNEEYMIYFLTFHIYVKQIMKRSRT

SEQ ID NO: 3289941 - protein, 29 aa, Plasmodium falciparum
KSNFNQRPYYRLFLSILIEINKYEKSFED

SEQ ID NO: 3289942 - protein, 25 aa, Plasmodium falciparum
KSNHLLLDSFLFYKTQRTIIKVYDE

SEQ ID NO: 3289943 - protein, 26 aa, Plasmodium falciparum
KSNIFNKPFYFIKNLIIMCANISFSK

SEQ ID NO: 3289944 - protein, 32 aa, Plasmodium falciparum
KSNKLYLTYNGFLLFFFSIFAYCITKLLIMFF

SEQ ID NO: 3289945 - protein, 39 aa, Plasmodium falciparum
KSNLYHLHTFLHIFLLNRFPYFFQYLYKNHKCKCLYFFA

SEQ ID NO: 3289946 - protein, 24 aa, Plasmodium falciparum
KSNTYSYMNKNPYSHKKYVGVLKN

SEQ ID NO: 3289947 - protein, 27 aa, Plasmodium falciparum
KSPNTIFYQSYIILDIHSNTLTLEDEY

SEQ ID NO: 3289948 - protein, 23 aa, Plasmodium falciparum
KSPVDLLRVLDIHKGDYDIPTKL

SEQ ID NO: 3289949 - protein, 25 aa, Plasmodium falciparum
KSQDIFEIFYFYLSHFEPIYMSYFE

SEQ ID NO: 3289950 - protein, 28 aa, Plasmodium falciparum
KSQICLLWLSHMIQFKWLEYDLPKFCVL

SEQ ID NO: 3289951 - protein, 45 aa, Plasmodium falciparum
KSQISNFLIYYIFKGLIKFLYPFIPHICEILYIQIFFKEKEKKQI

SEQ ID NO: 3289952 - protein, 19 aa, Plasmodium falciparum
KSRHIFKKGLLNYSSYSIT

SEQ ID NO: 3289953 - protein, 17 aa, Plasmodium falciparum
KSRLLCECDVYTSIYDN

SEQ ID NO: 3289954 - protein, 17 aa, Plasmodium falciparum
KSRRNLLLKLKKDYTYN

SEQ ID NO: 3289955 - protein, 26 aa, Plasmodium falciparum
KSRSLSIFYFNAFPVFIQFLNIVKSF

SEQ ID NO: 3289956 - protein, 23 aa, Plasmodium falciparum
KSSFRSFLETLITQIAAIIDKGN

SEQ ID NO: 3289957 - protein, 30 aa, Plasmodium falciparum
KSSINFFPLLVFDFQSLYPSILIAFNICYS

SEQ ID NO: 3289958 - protein, 53 aa, Plasmodium falciparum
KSSLIFFCITLLYLFYTYVSLFLFIFNNALFYLFVNILLFYVCFHFVVRALTY

SEQ ID NO: 3289959 - protein, 27 aa, Plasmodium falciparum
KSSSSYIFFDVFFNFDLFFDELEKEDD

SEQ ID NO: 3289960 - protein, 30 aa, Plasmodium falciparum
KSSTPITLIVLYFYNIPFISDTDKYFSFYF

SEQ ID NO: 3289961 - protein, 28 aa, Plasmodium falciparum
KSTASKIFYFFTSFALIINCIHIPPNND

SEQ ID NO: 3289962 - protein, 24 aa, Plasmodium falciparum
KSTIDLLRVIDIPKGEYGIPTSKS

SEQ ID NO: 3289963 - protein, 25 aa, Plasmodium falciparum
KSTIDLLRVINIPKGDYGIPTMKSK

SEQ ID NO: 3289964 - protein, 25 aa, Plasmodium falciparum
KSTIDLLRVINIPKSDYDIPTKLSP

SEQ ID NO: 3289965 - protein, 25 aa, Plasmodium falciparum
KSTIDLLRVINIPKSDYDIPTKRSP

SEQ ID NO: 3289966 - protein, 24 aa, Plasmodium falciparum
KSTIDLLRVINIPKSDYGMPTKLS

SEQ ID NO: 3289967 - protein, 25 aa, Plasmodium falciparum
KSTIDLLRVINIPKSDYNIPTKLSP

SEQ ID NO: 3289968 - protein, 26 aa, Plasmodium falciparum
KSTIDLLRVINIPKSDYNIPTKLSPN

SEQ ID NO: 3289969 - protein, 17 aa, Plasmodium falciparum
KSTLWKLLTCNFSYEGN

SEQ ID NO: 3289970 - protein, 27 aa, Plasmodium falciparum
KSTSVQHFFYYKKFDYPYIYNVDNNYC

SEQ ID NO: 3289971 - protein, 17 aa, Plasmodium falciparum
KSTYLIRSSIILLIFSN

SEQ ID NO: 3289972 - protein, 26 aa, Plasmodium falciparum
KSVENLIKGYFILKNFLHIGNNNITL

SEQ ID NO: 3289973 - protein, 28 aa, Plasmodium falciparum
KSVFTNIAFIIWMSFLLLMNTCITFFSS

SEQ ID NO: 3289974 - protein, 26 aa, Plasmodium falciparum
KSVHNKMFYCYIVEIIILVVITVYSI

SEQ ID NO: 3289975 - protein, 20 aa, Plasmodium falciparum
KSVINYKISKKKSILCIKDI

SEQ ID NO: 3289976 - protein, 23 aa, Plasmodium falciparum
KSVLIIFIKDYLKLKSSIFSAFL

SEQ ID NO: 3289977 - protein, 18 aa, Plasmodium falciparum
KSVMVKLYKVKYLLNQHN

SEQ ID NO: 3289978 - protein, 29 aa, Plasmodium falciparum
KSVNCKGLFFLIINFFYKPKAVKSLKKYI

SEQ ID NO: 3289979 - protein, 28 aa, Plasmodium falciparum
KSVRPYIKKFYYKIKKKYFALKKMYIHM

SEQ ID NO: 3289980 - protein, 24 aa, Plasmodium falciparum
KSVYQNFFVCIFNFLKEPDTNIYV

SEQ ID NO: 3289981 - protein, 19 aa, Plasmodium falciparum
KSWWSQNGEYIWKGMVCAL

SEQ ID NO: 3289982 - protein, 26 aa, Plasmodium falciparum
KSYDTFLRWDVLLKQIVYSITNTELT

SEQ ID NO: 3289983 - protein, 24 aa, Plasmodium falciparum
KSYILQFFINIYSSIDKKFLFKLC

SEQ ID NO: 3289984 - protein, 24 aa, Plasmodium falciparum
KSYKIIFKELLINITIDNIKELYK

SEQ ID NO: 3289985 - protein, 88 aa, Plasmodium falciparum
KSYKTKHIWIYNNIIHMFNFFDVFMIFSFSILAFFFIFICLNSISFIITSTILFVSSLCTYFLHKYSNVIIVIFQTITLLANCIMSYI

SEQ ID NO: 3289986 - protein, 21 aa, Plasmodium falciparum
KSYLRAGANIIITYFAKQYGL

SEQ ID NO: 3289987 - protein, 32 aa, Plasmodium falciparum
KSYNFTYDLILRPLNKQFLKSIYYILCKLNNS

SEQ ID NO: 3289988 - protein, 24 aa, Plasmodium falciparum
KSYSKFFILGLTGLIVWGIGIPLM

SEQ ID NO: 3289989 - protein, 25 aa, Plasmodium falciparum
KSYSVDYLWNSFYMTKKDILFDKSP

SEQ ID NO: 3289990 - protein, 27 aa, Plasmodium falciparum
KSYVPNQLLLLLLLKNCQQKLQKRTSI

SEQ ID NO: 3289991 - protein, 26 aa, Plasmodium falciparum
KSYVQYFYDHIINLILQKKNYLENTL

SEQ ID NO: 3289992 - protein, 37 aa, Plasmodium falciparum
KSYVYNMIKLLTHSFLYIPFRRYTATPFIFISFCSLF

SEQ ID NO: 3289993 - protein, 29 aa, Plasmodium falciparum
KTAFLFGTIFPFFISCFFNSRYIFENIFT

SEQ ID NO: 3289994 - protein, 36 aa, Plasmodium falciparum
KTALMSSTIMWSIGIGFAAFTYFYLKKKTKSTIDLL

SEQ ID NO: 3289995 - protein, 23 aa, Plasmodium falciparum
KTCLKFEPELHPLKLRALQNYKM

SEQ ID NO: 3289996 - protein, 30 aa, Plasmodium falciparum
KTCLNIFKSFFHEYFYLSFINKMEIKKKKK

SEQ ID NO: 3289997 - protein, 44 aa, Plasmodium falciparum
KTDCDWKKYYLSNVISFLNCKYVDLNNYLLSMKYKSVKNIDILD

SEQ ID NO: 3289998 - protein, 23 aa, Plasmodium falciparum
KTEFIFSFYLIHFMLQNMIYKHI

SEQ ID NO: 3289999 - protein, 25 aa, Plasmodium falciparum
KTEFYYLFNIFYSQNIDMLRKQCKF

SEQ ID NO: 3290000 - protein, 27 aa, Plasmodium falciparum
KTEGFLISLFLIPLLIGFIFLKDDDII

SEQ ID NO: 3290001 - protein, 26 aa, Plasmodium falciparum
KTELYKIFNVWYYKKALYMNEYRKLV

SEQ ID NO: 3290002 - protein, 29 aa, Plasmodium falciparum
KTENCKFLFKYFHYIFFHKNGGTHNDNNN

SEQ ID NO: 3290003 - protein, 32 aa, Plasmodium falciparum
KTENIQFVLPYKPIRMFYSNNFLFFVNIINKS

SEQ ID NO: 3290004 - protein, 20 aa, Plasmodium falciparum
KTESLFFSKFSFFQCYKLLE

SEQ ID NO: 3290005 - protein, 19 aa, Plasmodium falciparum
KTFFFLKKENNITLYNCYG

SEQ ID NO: 3290006 - protein, 20 aa, Plasmodium falciparum
KTFFKNGNIIKFRYTHELWA

SEQ ID NO: 3290007 - protein, 18 aa, Plasmodium falciparum
KTFYEYFSFYHIKKNCIR

SEQ ID NO: 3290008 - protein, 21 aa, Plasmodium falciparum
KTGLKLYVYINFESLKIKTAF

SEQ ID NO: 3290009 - protein, 19 aa, Plasmodium falciparum
KTHDYILNYMLIDNLIVFI

SEQ ID NO: 3290010 - protein, 21 aa, Plasmodium falciparum
KTHLLIKHVHFILPGAIKIYG

SEQ ID NO: 3290011 - protein, 26 aa, Plasmodium falciparum
KTHVILCNFMYFIKKKNTNKNKNTNK

SEQ ID NO: 3290012 - protein, 21 aa, Plasmodium falciparum
KTICKMIPNNILKNYFFSIHN

SEQ ID NO: 3290013 - protein, 25 aa, Plasmodium falciparum
KTIECFYNFIKSLLKYGFSEDELLN

SEQ ID NO: 3290014 - protein, 20 aa, Plasmodium falciparum
KTIFIIAATNRPDILDKALT

SEQ ID NO: 3290015 - protein, 19 aa, Plasmodium falciparum
KTIKRYFYSIKSKIKSISQ

SEQ ID NO: 3290016 - protein, 30 aa, Plasmodium falciparum
KTILFRFQPQMGSFLPFYIPCKIKNKRKTD

SEQ ID NO: 3290017 - protein, 19 aa, Plasmodium falciparum
KTINYFITLLKKNIQYNNS

SEQ ID NO: 3290018 - protein, 20 aa, Plasmodium falciparum
KTIVTNYWYPSPIKKYYTLY

SEQ ID NO: 3290019 - protein, 26 aa, Plasmodium falciparum
KTKGFLILQLFLYGYLNRISSFRSNK

SEQ ID NO: 3290020 - protein, 28 aa, Plasmodium falciparum
KTKNVPLLPFFFTLPYTKRIKRSDLQSK

SEQ ID NO: 3290021 - protein, 25 aa, Plasmodium falciparum
KTKYYEYIKIILKVFMNTCFYFINI

SEQ ID NO: 3290022 - protein, 20 aa, Plasmodium falciparum
KTKYYFLHKKNFPNYYYYIL

SEQ ID NO: 3290023 - protein, 23 aa, Plasmodium falciparum
KTLFYNFPHIIISTPGRLKHVLN

SEQ ID NO: 3290024 - protein, 21 aa, Plasmodium falciparum
KTLLDCNFALYYNFKGNGPDA

SEQ ID NO: 3290025 - protein, 17 aa, Plasmodium falciparum
KTLLKYCNIFLYEINWE

SEQ ID NO: 3290026 - protein, 22 aa, Plasmodium falciparum
KTLNLYQKYSLYNLYDLSKLDE

SEQ ID NO: 3290027 - protein, 23 aa, Plasmodium falciparum
KTLSIYLYNLLPFTKQTIVKKNR

SEQ ID NO: 3290028 - protein, 19 aa, Plasmodium falciparum
KTMTVYFLDIIESIVRVVA

SEQ ID NO: 3290029 - protein, 25 aa, Plasmodium falciparum
KTNKYKLLRIIILEAFDSLNEYYRK

SEQ ID NO: 3290030 - protein, 49 aa, Plasmodium falciparum
KTNLQLYADKIASIFIPFILILCIVVFFIWFILTFFDIVNIKKENYFKL

SEQ ID NO: 3290031 - protein, 21 aa, Plasmodium falciparum
KTNMDHLCSVFLFGNPLERNE

SEQ ID NO: 3290032 - protein, 27 aa, Plasmodium falciparum
KTNNNCLLWCLIYLKGYLKKITKNLHH

SEQ ID NO: 3290033 - protein, 31 aa, Plasmodium falciparum
KTNPPEIISNIIYIQNFRHPSRFISEEAYSF

SEQ ID NO: 3290034 - protein, 25 aa, Plasmodium falciparum
KTNSYIYINNCYLFLNTYNENLNDI

SEQ ID NO: 3290035 - protein, 21 aa, Plasmodium falciparum
KTNYSFVNIPIAHGVPYTNTP

SEQ ID NO: 3290036 - protein, 23 aa, Plasmodium falciparum
KTPVDLLRVLDIPKGDYGIPTPK

SEQ ID NO: 3290037 - protein, 17 aa, Plasmodium falciparum
KTQVFREARPGGGFKAY

SEQ ID NO: 3290038 - protein, 17 aa, Plasmodium falciparum
KTRNLKYIKPHIYILCI

SEQ ID NO: 3290039 - protein, 19 aa, Plasmodium falciparum
KTRYSLIIYFKRLLIEYNE

SEQ ID NO: 3290040 - protein, 23 aa, Plasmodium falciparum
KTSCILFYYMVRVFQTFQNHINA

SEQ ID NO: 3290041 - protein, 26 aa, Plasmodium falciparum
KTSEDMLIYMNFLNKIKMEKIFDNII

SEQ ID NO: 3290042 - protein, 31 aa, Plasmodium falciparum
KTSKEFLYINRIQFFFTTENPILYIEKLFNA

SEQ ID NO: 3290043 - protein, 22 aa, Plasmodium falciparum
KTSWLLLFEMFIGVALSAWKVT

SEQ ID NO: 3290044 - protein, 22 aa, Plasmodium falciparum
KTSWYLLGICRNNILKNSMVNR

SEQ ID NO: 3290045 - protein, 24 aa, Plasmodium falciparum
KTTKCFIPRIILYLTHQSSILSFQ

SEQ ID NO: 3290046 - protein, 23 aa, Plasmodium falciparum
KTTNIPILTPYISQQSILKKYNK

SEQ ID NO: 3290047 - protein, 20 aa, Plasmodium falciparum
KTTNIPYIISRIITVVPQFI

SEQ ID NO: 3290048 - protein, 35 aa, Plasmodium falciparum
KTTRESWWNAHAPSIWKGMICALTYKDGEEGKSPQ

SEQ ID NO: 3290049 - protein, 34 aa, Plasmodium falciparum
KTTSDYYICCSLFLKLPFGILPGIYITCLTNMRD

SEQ ID NO: 3290050 - protein, 25 aa, Plasmodium falciparum
KTTSPFFYQNLYYPIRLVDKKELTN

SEQ ID NO: 3290051 - protein, 37 aa, Plasmodium falciparum
KTTVLSPLYFLIFSNYFLIFNMCPHPLIHFTMNSFRS

SEQ ID NO: 3290052 - protein, 20 aa, Plasmodium falciparum
KTVFYFQIVVFYLIINTNNV

SEQ ID NO: 3290053 - protein, 17 aa, Plasmodium falciparum
KTVILLNPDYPLDTFLE

SEQ ID NO: 3290054 - protein, 41 aa, Plasmodium falciparum
KTWKIQKRFQILYVFFFLLITGALFYYLIDNVLFPKNKKIN

SEQ ID NO: 3290055 - protein, 20 aa, Plasmodium falciparum
KTYFYLTYLITQKCSLSSKL

SEQ ID NO: 3290056 - protein, 17 aa, Plasmodium falciparum
KTYGICLLILFGLLPIL

SEQ ID NO: 3290057 - protein, 25 aa, Plasmodium falciparum
KTYKKLHFLLKHLFIFKNEMKNVEY

SEQ ID NO: 3290058 - protein, 24 aa, Plasmodium falciparum
KTYKTYLILIRFFNNLNYENNSEN

SEQ ID NO: 3290059 - protein, 29 aa, Plasmodium falciparum
KTYLYEILCHALYELGKHRPIYPGLTIQL

SEQ ID NO: 3290060 - protein, 29 aa, Plasmodium falciparum
KTYNDFFNFWVAHMLKDSIYWKKKLQRCL

SEQ ID NO: 3290061 - protein, 24 aa, Plasmodium falciparum
KTYNDFFNFWVAHVLKDSIHWRTK

SEQ ID NO: 3290062 - protein, 26 aa, Plasmodium falciparum
KTYNPPLIAVWDFYKDFYYPYIRPFI

SEQ ID NO: 3290063 - protein, 29 aa, Plasmodium falciparum
KTYYLIAILIWFILISVVLSRGEIINKHV

SEQ ID NO: 3290064 - protein, 18 aa, Plasmodium falciparum
KVAYDVILKKITSATLIG

SEQ ID NO: 3290065 - protein, 38 aa, Plasmodium falciparum
KVCETLFCKYINVLIWYILLYIIILNVCLWNSISSYDI

SEQ ID NO: 3290066 - protein, 25 aa, Plasmodium falciparum
KVCVKKILLKLKNISLLELDQMTKW

SEQ ID NO: 3290067 - protein, 20 aa, Plasmodium falciparum
KVDKFYFYEQLKLKLHSKLD

SEQ ID NO: 3290068 - protein, 25 aa, Plasmodium falciparum
KVDQFLGRKFFPLTTTFLIKRISTS

SEQ ID NO: 3290069 - protein, 18 aa, Plasmodium falciparum
KVDQKPFIMSIHDRNLYI

SEQ ID NO: 3290070 - protein, 36 aa, Plasmodium falciparum
KVEILYKYCKNNINILLYIYVMHIYINKLCKNIIVK

SEQ ID NO: 3290071 - protein, 20 aa, Plasmodium falciparum
KVEKNLINLFFKYIHNYKDH

SEQ ID NO: 3290072 - protein, 23 aa, Plasmodium falciparum
KVEQNFLPKFINYNKDKIKLCKN

SEQ ID NO: 3290073 - protein, 24 aa, Plasmodium falciparum
KVEYFKIMLRICKVLIPQFDIKEI

SEQ ID NO: 3290074 - protein, 33 aa, Plasmodium falciparum
KVFFFKISLILKLIWFLYFPYPKCELFQNKKHI

SEQ ID NO: 3290075 - protein, 20 aa, Plasmodium falciparum
KVFHSLYRLIEVSQIQSFIN

SEQ ID NO: 3290076 - protein, 21 aa, Plasmodium falciparum
KVFIPQFFYSEYNSVIYISII

SEQ ID NO: 3290077 - protein, 18 aa, Plasmodium falciparum
KVFNRNMWMHLACSISAT

SEQ ID NO: 3290078 - protein, 54 aa, Plasmodium falciparum
KVFSIKEFRWLINKLEIIYFYFFCHLLLLCIFQNIFLLTYMSKEYFLKNIHDYM

SEQ ID NO: 3290079 - protein, 19 aa, Plasmodium falciparum
KVFSLFNFSNTLKSYPVLL

SEQ ID NO: 3290080 - protein, 18 aa, Plasmodium falciparum
KVFSQFLNILYEMYKLKN

SEQ ID NO: 3290081 - protein, 28 aa, Plasmodium falciparum
KVIHAEEIYLFEWYCLGINYNLIENNNQ

SEQ ID NO: 3290082 - protein, 32 aa, Plasmodium falciparum
KVIIRYNFLINDLCLLYFFEFTRRFKPSYNDY

SEQ ID NO: 3290083 - protein, 39 aa, Plasmodium falciparum
KVIKKKKRRTLIYTFFTNFFLLYYILYHADQCFDNKLEY

SEQ ID NO: 3290084 - protein, 17 aa, Plasmodium falciparum
KVIPEVLVEEIIYKEGI

SEQ ID NO: 3290085 - protein, 24 aa, Plasmodium falciparum
KVISKIFVFLLNKKYKKGNHNPSN

SEQ ID NO: 3290086 - protein, 23 aa, Plasmodium falciparum
KVKMFLETLIPLMDLVNNKGKHE

SEQ ID NO: 3290087 - protein, 30 aa, Plasmodium falciparum
KVKNYVDFMMFWINHMLKDSIDWRKYIKRC

SEQ ID NO: 3290088 - protein, 24 aa, Plasmodium falciparum
KVKQEFLYHLPWDEGDQKYLSRTD

SEQ ID NO: 3290089 - protein, 19 aa, Plasmodium falciparum
KVLAGVYFFFSSSIENAAV

SEQ ID NO: 3290090 - protein, 20 aa, Plasmodium falciparum
KVLLIKKIEDLRKIELFLKN

SEQ ID NO: 3290091 - protein, 21 aa, Plasmodium falciparum
KVLLLFSLPLNILVTLHHVDK

SEQ ID NO: 3290092 - protein, 21 aa, Plasmodium falciparum
KVLSFINKYLYKGLKIDTKNE

SEQ ID NO: 3290093 - protein, 26 aa, Plasmodium falciparum
KVLSKRKRALLKLKKISAAYNINTHH

SEQ ID NO: 3290094 - protein, 20 aa, Plasmodium falciparum
KVLYPIKNMFLLQYTYEEIY

SEQ ID NO: 3290095 - protein, 25 aa, Plasmodium falciparum
KVMFDLFIFIDILKNKNIQLGKNNL

SEQ ID NO: 3290096 - protein, 20 aa, Plasmodium falciparum
KVPAKIKYIEDEPLNFFRSG

SEQ ID NO: 3290097 - protein, 26 aa, Plasmodium falciparum
KVQILYARYYFLKEKYIKVISILSLL

SEQ ID NO: 3290098 - protein, 19 aa, Plasmodium falciparum
KVRRNLLKLLYSIYYKHNL

SEQ ID NO: 3290099 - protein, 17 aa, Plasmodium falciparum
KVRSPFLVSLFKGDNFK

SEQ ID NO: 3290100 - protein, 27 aa, Plasmodium falciparum
KVRSQWTFILILLYFIILAAGHFYCSI

SEQ ID NO: 3290101 - protein, 25 aa, Plasmodium falciparum
KVSFLKTCAFYLKNYIKLYLLSKGD

SEQ ID NO: 3290102 - protein, 26 aa, Plasmodium falciparum
KVSLFFLLIFKYSYKNIVKKGRQDNF

SEQ ID NO: 3290103 - protein, 23 aa, Plasmodium falciparum
KVSLLMATSISSSLVLVSCKKPL

SEQ ID NO: 3290104 - protein, 37 aa, Plasmodium falciparum
KVSYINLYCLWLLLALTILLSLILYVRKMFYMDYFPL

SEQ ID NO: 3290105 - protein, 19 aa, Plasmodium falciparum
KVTINIFAPIKIKYAYYNM

SEQ ID NO: 3290106 - protein, 23 aa, Plasmodium falciparum
KVTRLLELPVGLGGGPFLEKEAQ

SEQ ID NO: 3290107 - protein, 26 aa, Plasmodium falciparum
KVTSYNAFFWKWVSEMLDDSIKWRAE

SEQ ID NO: 3290108 - protein, 29 aa, Plasmodium falciparum
KVVSLSNFLFFSCWEEYIQKYFNGDWSKI

SEQ ID NO: 3290109 - protein, 23 aa, Plasmodium falciparum
KVYDYCIVTVPIGVLKDSVRFFN

SEQ ID NO: 3290110 - protein, 18 aa, Plasmodium falciparum
KVYPFDKEQIIPPLNSYE

SEQ ID NO: 3290111 - protein, 32 aa, Plasmodium falciparum
KVYSKTIIKILFPDDYILELSFSSGTLLRDVN

SEQ ID NO: 3290112 - protein, 20 aa, Plasmodium falciparum
KVYSLWWQIMRNERVKYVMI

SEQ ID NO: 3290113 - protein, 30 aa, Plasmodium falciparum
KWDFTGWYVFLFMAFLILIVMGIIGIFVRS

SEQ ID NO: 3290114 - protein, 20 aa, Plasmodium falciparum
KWHDFNQWKYLAPRNLLNII

SEQ ID NO: 3290115 - protein, 17 aa, Plasmodium falciparum
KWHFNKFSSIDIIKIIY

SEQ ID NO: 3290116 - protein, 33 aa, Plasmodium falciparum
KWILRMSMYFLNFKDVMFFKKKAIQFGSKSKNV

SEQ ID NO: 3290117 - protein, 19 aa, Plasmodium falciparum
KWILSCLIAWAIIDIIRYL

SEQ ID NO: 3290118 - protein, 17 aa, Plasmodium falciparum
KWITQKKTEWDKIVQHF

SEQ ID NO: 3290119 - protein, 21 aa, Plasmodium falciparum
KWLCLYLERIMKNPNVKCFNF

SEQ ID NO: 3290120 - protein, 19 aa, Plasmodium falciparum
KWLGIYRKFKTLIWGNRKK

SEQ ID NO: 3290121 - protein, 17 aa, Plasmodium falciparum
KWLHFYNFEYLNKYIKM

SEQ ID NO: 3290122 - protein, 25 aa, Plasmodium falciparum
KWNNKKIFYIKKRDLLIGDCIIVSS

SEQ ID NO: 3290123 - protein, 20 aa, Plasmodium falciparum
KWSLFILTLSFLMRCVYMKR

SEQ ID NO: 3290124 - protein, 18 aa, Plasmodium falciparum
KWVKIYILPYLLTNIYKS

SEQ ID NO: 3290125 - protein, 22 aa, Plasmodium falciparum
KWWKNHGPSIWNGMLCGLSYDT

SEQ ID NO: 3290126 - protein, 37 aa, Plasmodium falciparum
KYACVEFFKMLFLVSLFLITSYYSFIYIYNNFMGQNH

SEQ ID NO: 3290127 - protein, 17 aa, Plasmodium falciparum
KYAEPIWNGMICALTYR

SEQ ID NO: 3290128 - protein, 20 aa, Plasmodium falciparum
KYAFRVPEYVIYLGCTSPKK

SEQ ID NO: 3290129 - protein, 26 aa, Plasmodium falciparum
KYAKKYFMLLIYYYEIYINRTNSNIL

SEQ ID NO: 3290130 - protein, 19 aa, Plasmodium falciparum
KYCFHIIPKKKKKMYYVGM

SEQ ID NO: 3290131 - protein, 19 aa, Plasmodium falciparum
KYCIKFLYLSFFSERFLFK

SEQ ID NO: 3290132 - protein, 19 aa, Plasmodium falciparum
KYCRGVYNDVPRYCSRNGY

SEQ ID NO: 3290133 - protein, 19 aa, Plasmodium falciparum
KYCVYFFNVLQYDYRNMLQ

SEQ ID NO: 3290134 - protein, 30 aa, Plasmodium falciparum
KYDDMLNKKMLYSIYLQSLLNNLNNEIYND

SEQ ID NO: 3290135 - protein, 26 aa, Plasmodium falciparum
KYDHKDFILSPLIGYSYSKFYGLKFN

SEQ ID NO: 3290136 - protein, 17 aa, Plasmodium falciparum
KYDKIIEFLKNNGYLKI

SEQ ID NO: 3290137 - protein, 23 aa, Plasmodium falciparum
KYDKTIINNLYYSKWNVGVENDE

SEQ ID NO: 3290138 - protein, 30 aa, Plasmodium falciparum
KYDLYTCSFHLFYYLKFLLKKNEKEKIIKK

SEQ ID NO: 3290139 - protein, 21 aa, Plasmodium falciparum
KYDNIFLGFTFSFDNKFEQVK

SEQ ID NO: 3290140 - protein, 26 aa, Plasmodium falciparum
KYDVFEYIIIILKLYDKIYPDAKYIE

SEQ ID NO: 3290141 - protein, 22 aa, Plasmodium falciparum
KYEACFGGCRLPCSSYTSFMKK

SEQ ID NO: 3290142 - protein, 25 aa, Plasmodium falciparum
KYEHVFYLNLLKKIIIMNKCFVKNV

SEQ ID NO: 3290143 - protein, 23 aa, Plasmodium falciparum
KYEIYRNIVINNFFPIQMNNKNG

SEQ ID NO: 3290144 - protein, 30 aa, Plasmodium falciparum
KYEKHIIRYPKIIKYFLKNNILIKNISCAS

SEQ ID NO: 3290145 - protein, 17 aa, Plasmodium falciparum
KYEKWQVPSLIKNIIYS

SEQ ID NO: 3290146 - protein, 24 aa, Plasmodium falciparum
KYENIWIRNIFTLINLKKMDTLDN

SEQ ID NO: 3290147 - protein, 26 aa, Plasmodium falciparum
KYFGSMFHILRFQGYHINPFSFLGSI

SEQ ID NO: 3290148 - protein, 20 aa, Plasmodium falciparum
KYFHLRCLIKNSYKKKKIIK

SEQ ID NO: 3290149 - protein, 18 aa, Plasmodium falciparum
KYFLYNKYNIYDENLFDL

SEQ ID NO: 3290150 - protein, 19 aa, Plasmodium falciparum
KYFNADDLVYLFNEKIDFR

SEQ ID NO: 3290151 - protein, 35 aa, Plasmodium falciparum
KYFSYNLFNLILRYYNNFYLYKKYYISSTISCDLK

SEQ ID NO: 3290152 - protein, 36 aa, Plasmodium falciparum
KYGIKNVFYLCIHVSIFIILINPFSSANHVYVSPER

SEQ ID NO: 3290153 - protein, 24 aa, Plasmodium falciparum
KYGLPQRHWGWKCIPSGSGSTATR

SEQ ID NO: 3290154 - protein, 27 aa, Plasmodium falciparum
KYGYQAKILILFVLNKKYLQLENMKTI

SEQ ID NO: 3290155 - protein, 26 aa, Plasmodium falciparum
KYHCRNFFFLFQKYLKKGRIIIGIYR

SEQ ID NO: 3290156 - protein, 20 aa, Plasmodium falciparum
KYHFDFVYVISLFISLILLK

SEQ ID NO: 3290157 - protein, 18 aa, Plasmodium falciparum
KYHLEGFLNYLISKNALS

SEQ ID NO: 3290158 - protein, 21 aa, Plasmodium falciparum
KYHYIILLITAIVPSLIIFII

SEQ ID NO: 3290159 - protein, 33 aa, Plasmodium falciparum
KYIFIFTCFITFIFSYYLIIKNYGLLIKKYNNV

SEQ ID NO: 3290160 - protein, 44 aa, Plasmodium falciparum
KYIHYFIYCFTKFSQILFFILRKFGYFLVILTLLTCGLSIYFYP

SEQ ID NO: 3290161 - protein, 24 aa, Plasmodium falciparum
KYIIKFSIELLYIIVKKIKYVHHT

SEQ ID NO: 3290162 - protein, 18 aa, Plasmodium falciparum
KYIINLLMLIVNLKCDIH

SEQ ID NO: 3290163 - protein, 26 aa, Plasmodium falciparum
KYILKYKYLHFLNYYLDSLILMTYIN

SEQ ID NO: 3290164 - protein, 19 aa, Plasmodium falciparum
KYILNHSIYFFKSCDNNII

SEQ ID NO: 3290165 - protein, 29 aa, Plasmodium falciparum
KYINEIIMEILFFTNIWKHYLSLEEHPRI

SEQ ID NO: 3290166 - protein, 25 aa, Plasmodium falciparum
KYINKYIHFILNVLYLILDENLKID

SEQ ID NO: 3290167 - protein, 20 aa, Plasmodium falciparum
KYINSLFILTLFFINIILST

SEQ ID NO: 3290168 - protein, 25 aa, Plasmodium falciparum
KYINVLFYISIIFLKSNSLKIYNDL

SEQ ID NO: 3290169 - protein, 35 aa, Plasmodium falciparum
KYISFFSIDLIDIWKKFFFLLNHFVNNLNLENIYD

SEQ ID NO: 3290170 - protein, 26 aa, Plasmodium falciparum
KYISLFFEKFFIFYQRMIELDKKNKN

SEQ ID NO: 3290171 - protein, 22 aa, Plasmodium falciparum
KYISLYSKPPCFYAPLFMCLYK

SEQ ID NO: 3290172 - protein, 23 aa, Plasmodium falciparum
KYISPEIFFYLNKKIAIVDTKGK

SEQ ID NO: 3290173 - protein, 24 aa, Plasmodium falciparum
KYIYEDFIIFQYLTTKKPQKFCIE

SEQ ID NO: 3290174 - protein, 18 aa, Plasmodium falciparum
KYIYIINKIINNYKYIIS

SEQ ID NO: 3290175 - protein, 20 aa, Plasmodium falciparum
KYIYVLYTLSCILSVYNFHY

SEQ ID NO: 3290176 - protein, 33 aa, Plasmodium falciparum
KYKFLSQFFIWRARIFFHLAKFHKYVLSDCCKA

SEQ ID NO: 3290177 - protein, 23 aa, Plasmodium falciparum
KYKHLFKFFKKNCFLNQGMTYIV

SEQ ID NO: 3290178 - protein, 35 aa, Plasmodium falciparum
KYKHTIKKIILITNLFFVFVFISNDFSLHHVKNIN

SEQ ID NO: 3290179 - protein, 18 aa, Plasmodium falciparum
KYKIILIDEIPIFNLNNS

SEQ ID NO: 3290180 - protein, 27 aa, Plasmodium falciparum
KYKINIFDIYKYFMKWIKNTKDIINTN

SEQ ID NO: 3290181 - protein, 26 aa, Plasmodium falciparum
KYKIPPFEYSVFLKYKIYKKNKTSTK

SEQ ID NO: 3290182 - protein, 31 aa, Plasmodium falciparum
KYKKDIMNFLKESIYFKYIDPQLLNQYIQRK

SEQ ID NO: 3290183 - protein, 27 aa, Plasmodium falciparum
KYKKMHWLYLSCPLRFLNFLRIEDLFG

SEQ ID NO: 3290184 - protein, 37 aa, Plasmodium falciparum
KYKNEPFFTIKRKKVIDLIYFFFVTKEKKAEVSNMNK

SEQ ID NO: 3290185 - protein, 23 aa, Plasmodium falciparum
KYKSTIIHFFKKKILRIKKKKKE

SEQ ID NO: 3290186 - protein, 25 aa, Plasmodium falciparum
KYKTFFLFNYPIFSFKRLFKGSKNN

SEQ ID NO: 3290187 - protein, 17 aa, Plasmodium falciparum
KYKTLIEVVLEPSKRDT

SEQ ID NO: 3290188 - protein, 17 aa, Plasmodium falciparum
KYKTLMVNIDDNDLGKR

SEQ ID NO: 3290189 - protein, 18 aa, Plasmodium falciparum
KYKVFYYLYDMSMSSIKK

SEQ ID NO: 3290190 - protein, 18 aa, Plasmodium falciparum
KYKYFYNCFFCCGSYISL

SEQ ID NO: 3290191 - protein, 19 aa, Plasmodium falciparum
KYLFCYYIYPLFISNYCHF

SEQ ID NO: 3290192 - protein, 29 aa, Plasmodium falciparum
KYLIEIDPLFFLFFQNFKYFNELNNLLLM

SEQ ID NO: 3290193 - protein, 26 aa, Plasmodium falciparum
KYLIKYLIIILYFGNDMFCLDKENSV

SEQ ID NO: 3290194 - protein, 21 aa, Plasmodium falciparum
KYLKRKFYFAFFNYIKYKNRI

SEQ ID NO: 3290195 - protein, 41 aa, Plasmodium falciparum
KYLKSFHLVSYYKLNELIYVSFLIRKYYNHYYEKELYDIVD

SEQ ID NO: 3290196 - protein, 30 aa, Plasmodium falciparum
KYLLKYLKGYIYYRYIFNIIYPNLSPEHFT

SEQ ID NO: 3290197 - protein, 18 aa, Plasmodium falciparum
KYLLLLSTVLQSLAILAI

SEQ ID NO: 3290198 - protein, 24 aa, Plasmodium falciparum
KYLMDSFIFDNIYKKVLYISDKKR

SEQ ID NO: 3290199 - protein, 22 aa, Plasmodium falciparum
KYLNNILFFHLNNQSDFLYEYL

SEQ ID NO: 3290200 - protein, 27 aa, Plasmodium falciparum
KYLSFSLLVYFIYNAYVYNTIKLQKCF

SEQ ID NO: 3290201 - protein, 20 aa, Plasmodium falciparum
KYLVTIIILLYNKLNCKTQL

SEQ ID NO: 3290202 - protein, 17 aa, Plasmodium falciparum
KYLYKKSLLKYVNYYIY

SEQ ID NO: 3290203 - protein, 27 aa, Plasmodium falciparum
KYLYLKKEKIIWKEWLLKNFKNIEECD

SEQ ID NO: 3290204 - protein, 20 aa, Plasmodium falciparum
KYLYPFLHDYFLNLDYFKLY

SEQ ID NO: 3290205 - protein, 41 aa, Plasmodium falciparum
KYMDKILNIRKYTLWNKWKGKKLTQWLMQDWKLIEDDEWEK

SEQ ID NO: 3290206 - protein, 25 aa, Plasmodium falciparum
KYMDSLADFLFYLYKYMRKADVKRT

SEQ ID NO: 3290207 - protein, 29 aa, Plasmodium falciparum
KYMIHTNFILLILFMNKISYYNNKKLNKC

SEQ ID NO: 3290208 - protein, 20 aa, Plasmodium falciparum
KYMKNMEYILLLTTHKEELI

SEQ ID NO: 3290209 - protein, 24 aa, Plasmodium falciparum
KYMNEYTFLYWSEVLDLNRVSMIY

SEQ ID NO: 3290210 - protein, 53 aa, Plasmodium falciparum
KYMQNVLFPNPLLFKYDSQLPIVFIFTIMFSFVCLYFQIRYLGLNMTSIFYTI

SEQ ID NO: 3290211 - protein, 20 aa, Plasmodium falciparum
KYMQSLICGLYLLTLIRKKK

SEQ ID NO: 3290212 - protein, 34 aa, Plasmodium falciparum
KYMRLFQKHLLEEIKFINFFEFLVQKKLGVILEK

SEQ ID NO: 3290213 - protein, 19 aa, Plasmodium falciparum
KYMTIFLNSIQMVANVSCG

SEQ ID NO: 3290214 - protein, 33 aa, Plasmodium falciparum
KYNDKVTTLRIYYFLILVTLEITYISMKNSNIH

SEQ ID NO: 3290215 - protein, 31 aa, Plasmodium falciparum
KYNEKPFHIFKKISLLLLLILSFLILYLYIF

SEQ ID NO: 3290216 - protein, 18 aa, Plasmodium falciparum
KYNFDKNFILPHGSYLIN

SEQ ID NO: 3290217 - protein, 17 aa, Plasmodium falciparum
KYNIIQNMLLYNDKHFN

SEQ ID NO: 3290218 - protein, 29 aa, Plasmodium falciparum
KYNIKWLTLFFHSLIQYFVYLNNSSHILI

SEQ ID NO: 3290219 - protein, 22 aa, Plasmodium falciparum
KYNKILILALLIILILFKIRYK

SEQ ID NO: 3290220 - protein, 23 aa, Plasmodium falciparum
KYNKYISPNFFSNSTNISSACIN

SEQ ID NO: 3290221 - protein, 20 aa, Plasmodium falciparum
KYNLSLLLHLKIYLTYLFEC

SEQ ID NO: 3290222 - protein, 21 aa, Plasmodium falciparum
KYNMQWLHFNECLFISSQLQC

SEQ ID NO: 3290223 - protein, 20 aa, Plasmodium falciparum
KYNNQFFFGVLYLLADKNEI

SEQ ID NO: 3290224 - protein, 32 aa, Plasmodium falciparum
KYNQDLYLWRTYFDEYIFHIFHNMLIKTNNKS

SEQ ID NO: 3290225 - protein, 74 aa, Plasmodium falciparum
KYNVHNNYLFIYFNTLIVASILNLLYIFYYVCINKFCIYLYRDCIISFFLLYIFILYLYKYYNHIIKIRDISRL

SEQ ID NO: 3290226 - protein, 35 aa, Plasmodium falciparum
KYNVLDIPLKIILFPLYFFPLYNDVYSLEIKNLFK

SEQ ID NO: 3290227 - protein, 31 aa, Plasmodium falciparum
KYNYIFFQDYQLFSYLNFFSDLAFFVDGYNI

SEQ ID NO: 3290228 - protein, 19 aa, Plasmodium falciparum
KYNYLLTIIYNDLTNIIYF

SEQ ID NO: 3290229 - protein, 18 aa, Plasmodium falciparum
KYPDNVNLYNALRKKIRK

SEQ ID NO: 3290230 - protein, 24 aa, Plasmodium falciparum
KYPNYFYVISLYRKNVRFKNNNVL

SEQ ID NO: 3290231 - protein, 38 aa, Plasmodium falciparum
KYPREFFYINLIFKLFPLFVVPFLFLFVVYKQYILKSH

SEQ ID NO: 3290232 - protein, 17 aa, Plasmodium falciparum
KYQCVLQWISRKEEEWK

SEQ ID NO: 3290233 - protein, 23 aa, Plasmodium falciparum
KYQDMIIYFSRKAFYPWETNVEQ

SEQ ID NO: 3290234 - protein, 25 aa, Plasmodium falciparum
KYQIRHIYCHLCNIYLYDFDTYMKH

SEQ ID NO: 3290235 - protein, 17 aa, Plasmodium falciparum
KYQISDEKTYFFIYTLI

SEQ ID NO: 3290236 - protein, 26 aa, Plasmodium falciparum
KYQSISFNIFFSLLSNYKKNILMLNV

SEQ ID NO: 3290237 - protein, 22 aa, Plasmodium falciparum
KYRCSLLKFPSYVDYIMFIAIF

SEQ ID NO: 3290238 - protein, 20 aa, Plasmodium falciparum
KYRGKRYIYIEGDSGTDSGY

SEQ ID NO: 3290239 - protein, 20 aa, Plasmodium falciparum
KYRGKRYIYLEGDSGTDSGY

SEQ ID NO: 3290240 - protein, 21 aa, Plasmodium falciparum
KYRGKTYIYLEGDSGTDSGYT

SEQ ID NO: 3290241 - protein, 25 aa, Plasmodium falciparum
KYRMLGKIYFLKAYEPIICFIGTPC

SEQ ID NO: 3290242 - protein, 18 aa, Plasmodium falciparum
KYRRTFFVKDKSSDEISG

SEQ ID NO: 3290243 - protein, 49 aa, Plasmodium falciparum
KYSDKLFYILGEFQFAFILFHLGYNYQSFIQWRKLFELMTNSSYLVTNS

SEQ ID NO: 3290244 - protein, 25 aa, Plasmodium falciparum
KYSEIYLLIHIIKYIYETYKNVNEH

SEQ ID NO: 3290245 - protein, 31 aa, Plasmodium falciparum
KYSIRYFFIIFFFFIFIAIKITILVITYTFH

SEQ ID NO: 3290246 - protein, 17 aa, Plasmodium falciparum
KYSKCECLFFFHIINQL

SEQ ID NO: 3290247 - protein, 21 aa, Plasmodium falciparum
KYSLIEFINKSGVFSDIIKGH

SEQ ID NO: 3290248 - protein, 24 aa, Plasmodium falciparum
KYSRKWMLVFGTALWGVATILLAN

SEQ ID NO: 3290249 - protein, 22 aa, Plasmodium falciparum
KYSSLPFSLIPKNVPSNFQIEL

SEQ ID NO: 3290250 - protein, 29 aa, Plasmodium falciparum
KYSSMIYFLMFLFILNLSVGILILILSSK

SEQ ID NO: 3290251 - protein, 21 aa, Plasmodium falciparum
KYTFYNIIIIVFIIINLFFCA

SEQ ID NO: 3290252 - protein, 42 aa, Plasmodium falciparum
KYTNIILLTNIILLLPPFLILLGIIIFMIFILMGYIQKNNNF

SEQ ID NO: 3290253 - protein, 24 aa, Plasmodium falciparum
KYTNILFHFLIILQTNPNFCSHSQ

SEQ ID NO: 3290254 - protein, 30 aa, Plasmodium falciparum
KYTNIVIDIYPLIFMSLVKLLNGTIKINDN

SEQ ID NO: 3290255 - protein, 22 aa, Plasmodium falciparum
KYTQYILKMLYNFSLHTIGFFY

SEQ ID NO: 3290256 - protein, 29 aa, Plasmodium falciparum
KYTRKVRKYPYLPYLISNKVLVNHNVYFK

SEQ ID NO: 3290257 - protein, 19 aa, Plasmodium falciparum
KYTRVRILHELFKEIEHKC

SEQ ID NO: 3290258 - protein, 20 aa, Plasmodium falciparum
KYVCIFRDKIKNKKYNVAIP

SEQ ID NO: 3290259 - protein, 19 aa, Plasmodium falciparum
KYVCNIGLLKNVLKLLSCF

SEQ ID NO: 3290260 - protein, 24 aa, Plasmodium falciparum
KYVEDIITFLIKKKKFVFKQGEDK

SEQ ID NO: 3290261 - protein, 22 aa, Plasmodium falciparum
KYVNAPFYYSYINKLLNVIGEK

SEQ ID NO: 3290262 - protein, 17 aa, Plasmodium falciparum
KYVPYYISSPRIIDPYK

SEQ ID NO: 3290263 - protein, 19 aa, Plasmodium falciparum
KYVQYKKKYLKILMNPKHL

SEQ ID NO: 3290264 - protein, 37 aa, Plasmodium falciparum
KYVYDIFKREYIFYDKILIMIQHILDINIRTNIFLFV

SEQ ID NO: 3290265 - protein, 27 aa, Plasmodium falciparum
KYYDHLKFNFPYLKKNMSYSVKFFGKI

SEQ ID NO: 3290266 - protein, 17 aa, Plasmodium falciparum
KYYGCVKRTFYSYKNIK

SEQ ID NO: 3290267 - protein, 17 aa, Plasmodium falciparum
KYYKLNKNIYWSSVIYP

SEQ ID NO: 3290268 - protein, 28 aa, Plasmodium falciparum
KYYKYNLYLLLIHFFTKQFLYNSHVNTN

SEQ ID NO: 3290269 - protein, 27 aa, Plasmodium falciparum
KYYKYRTNYYLILTKLLFMEQNLVSST

SEQ ID NO: 3290270 - protein, 46 aa, Plasmodium falciparum
KYYYGSIFLLILLFYYVFPFFPYILLILYLCWLPQILLDIWRGQRN

SEQ ID NO: 3290271 - protein, 18 aa, Plasmodium falciparum
LAAFPEPCGLIKDKGDEL

SEQ ID NO: 3290272 - protein, 17 aa, Plasmodium falciparum
LACAYFYKDEHTYPQCF

SEQ ID NO: 3290273 - protein, 25 aa, Plasmodium falciparum
LACKKKNIIFLKNKINSISHLNDKY

SEQ ID NO: 3290274 - protein, 25 aa, Plasmodium falciparum
LACLSALTRRLTLVQGPPGTGKTHV

SEQ ID NO: 3290275 - protein, 25 aa, Plasmodium falciparum
LAECLQYLLFYIIENNYMYNNRESN

SEQ ID NO: 3290276 - protein, 18 aa, Plasmodium falciparum
LAFEYKIPQSTLANEWKK

SEQ ID NO: 3290277 - protein, 26 aa, Plasmodium falciparum
LAFFEMYKIVFFLLNKNKKSKNRSTS

SEQ ID NO: 3290278 - protein, 18 aa, Plasmodium falciparum
LAFTGIAIIMMGKLSLHG

SEQ ID NO: 3290279 - protein, 22 aa, Plasmodium falciparum
LALFFIIFNKESLAEKTNKGTG

SEQ ID NO: 3290280 - protein, 17 aa, Plasmodium falciparum
LANIACHFFLKKLNKEK

SEQ ID NO: 3290281 - protein, 17 aa, Plasmodium falciparum
LANLSTHILKRCSKKIF

SEQ ID NO: 3290282 - protein, 25 aa, Plasmodium falciparum
LAQIITFIIKAFYFLVLKNMRHHLD

SEQ ID NO: 3290283 - protein, 35 aa, Plasmodium falciparum
LAQKSCFEFVYLILYILNNLFLIDEYNLYFSNIKI

SEQ ID NO: 3290284 - protein, 22 aa, Plasmodium falciparum
LARIFIILFNIKNQIYLINCGL

SEQ ID NO: 3290285 - protein, 23 aa, Plasmodium falciparum
LARIFTPSFIQNDIFLNCIYKYR

SEQ ID NO: 3290286 - protein, 32 aa, Plasmodium falciparum
LARWWAKFSSYLWWWIWPFAITNLILYKMFYD

SEQ ID NO: 3290287 - protein, 18 aa, Plasmodium falciparum
LASLLYQLAKYKPQFVIH

SEQ ID NO: 3290288 - protein, 23 aa, Plasmodium falciparum
LATILVFLIVIYLQGFRVDLSVK

SEQ ID NO: 3290289 - protein, 20 aa, Plasmodium falciparum
LAVALPLMKISIAQYFLISG

SEQ ID NO: 3290290 - protein, 23 aa, Plasmodium falciparum
LAVCLVIFCIGFLIGNHISSKSS

SEQ ID NO: 3290291 - protein, 26 aa, Plasmodium falciparum
LAVVLIILYIWLYRRRKHSWKHECKK

SEQ ID NO: 3290292 - protein, 29 aa, Plasmodium falciparum
LAWSVGIGFAAFTYFYLKKKTKSPVDLLR

SEQ ID NO: 3290293 - protein, 28 aa, Plasmodium falciparum
LAYDDPLYIPITLLCDVYLVTGILSKNI

SEQ ID NO: 3290294 - protein, 20 aa, Plasmodium falciparum
LAYVTIYLTLCILYTNSRHI

SEQ ID NO: 3290295 - protein, 18 aa, Plasmodium falciparum
LCCKFICTIRKYVKYFLY

SEQ ID NO: 3290296 - protein, 18 aa, Plasmodium falciparum
LCDDNFYNKYYSRSNIPF

SEQ ID NO: 3290297 - protein, 23 aa, Plasmodium falciparum
LCDEELIYFLFNKIIQDIENYDN

SEQ ID NO: 3290298 - protein, 24 aa, Plasmodium falciparum
LCDISFYPIYNPTLGKRIIEWLTK

SEQ ID NO: 3290299 - protein, 25 aa, Plasmodium falciparum
LCDLAKCAPMYTHNLRHIKGNGNDL

SEQ ID NO: 3290300 - protein, 28 aa, Plasmodium falciparum
LCDSMIFTIPIFSYLLKRINFFHNSSYI

SEQ ID NO: 3290301 - protein, 24 aa, Plasmodium falciparum
LCDVKTFRFYRFIEFLFTVIGRSL

SEQ ID NO: 3290302 - protein, 19 aa, Plasmodium falciparum
LCECDLFISIHKYRNMLLK

SEQ ID NO: 3290303 - protein, 18 aa, Plasmodium falciparum
LCECELYTPIYDDDPEMK

SEQ ID NO: 3290304 - protein, 19 aa, Plasmodium falciparum
LCECIGLLIPYMKDKQKII

SEQ ID NO: 3290305 - protein, 18 aa, Plasmodium falciparum
LCEHIFNHIIINYDYYHK

SEQ ID NO: 3290306 - protein, 26 aa, Plasmodium falciparum
LCELRILYELNIIDLIYLLEVEEIMR

SEQ ID NO: 3290307 - protein, 22 aa, Plasmodium falciparum
LCFFMSNDSYFPWTYKKRNTHL

SEQ ID NO: 3290308 - protein, 18 aa, Plasmodium falciparum
LCFHFIKKNNKKKKNHCD

SEQ ID NO: 3290309 - protein, 19 aa, Plasmodium falciparum
LCFLFVPVCNNFYLLFYHF

SEQ ID NO: 3290310 - protein, 20 aa, Plasmodium falciparum
LCGCVFPLCTYQLIVRYFIY

SEQ ID NO: 3290311 - protein, 18 aa, Plasmodium falciparum
LCIHFEEKFKQECIHNNV

SEQ ID NO: 3290312 - protein, 29 aa, Plasmodium falciparum
LCIIKKIYIKPLYQNFLKYLQNIFQQDKN

SEQ ID NO: 3290313 - protein, 17 aa, Plasmodium falciparum
LCIINTCIFLKRILQNI

SEQ ID NO: 3290314 - protein, 18 aa, Plasmodium falciparum
LCILDMLCKKNKILKKLI

SEQ ID NO: 3290315 - protein, 18 aa, Plasmodium falciparum
LCILFMGRIFKSYIISMF

SEQ ID NO: 3290316 - protein, 30 aa, Plasmodium falciparum
LCILNFLFNFLYISFFIIYNIFIYDIKSSQ

SEQ ID NO: 3290317 - protein, 26 aa, Plasmodium falciparum
LCITFSLYYFLKMNLNYKHLSYKTYC

SEQ ID NO: 3290318 - protein, 25 aa, Plasmodium falciparum
LCITKFDDILLKFSIDKYPTIIFQK

SEQ ID NO: 3290319 - protein, 33 aa, Plasmodium falciparum
LCKITIDYIYMFNPPIKLIVKLLKTLIDNVNGH

SEQ ID NO: 3290320 - protein, 25 aa, Plasmodium falciparum
LCKKQIVIFLISLLSFTLICLSMKY

SEQ ID NO: 3290321 - protein, 17 aa, Plasmodium falciparum
LCKNIIVKILKPNIKYG

SEQ ID NO: 3290322 - protein, 32 aa, Plasmodium falciparum
LCKRYSAPIIGLVYVIVLTVGIFYQGDYYSFN

SEQ ID NO: 3290323 - protein, 19 aa, Plasmodium falciparum
LCLDLTVFQLAFLLDIINE

SEQ ID NO: 3290324 - protein, 24 aa, Plasmodium falciparum
LCLGWGLAVFFGILVSAKLSGAHL

SEQ ID NO: 3290325 - protein, 20 aa, Plasmodium falciparum
LCLHFIFQPFDKRNYFTLNK

SEQ ID NO: 3290326 - protein, 38 aa, Plasmodium falciparum
LCLNNFINLLLMIIIDNYIFFDIKNLHFINFFFQCFEY

SEQ ID NO: 3290327 - protein, 17 aa, Plasmodium falciparum
LCLRNNFFYIFNEYIEE

SEQ ID NO: 3290328 - protein, 26 aa, Plasmodium falciparum
LCLSLAVCLYSLPGNFISCYIYIITC

SEQ ID NO: 3290329 - protein, 29 aa, Plasmodium falciparum
LCNIKKYFHYNYFLTFTKILHTNDIWNDI

SEQ ID NO: 3290330 - protein, 28 aa, Plasmodium falciparum
LCNITIYFVFILFFLINHTIKKYNFSKK

SEQ ID NO: 3290331 - protein, 17 aa, Plasmodium falciparum
LCNLHIITLIYIISNNK

SEQ ID NO: 3290332 - protein, 31 aa, Plasmodium falciparum
LCNMSTYFIIFFFAIFIFVISIFIAMCINNE

SEQ ID NO: 3290333 - protein, 26 aa, Plasmodium falciparum
LCPRRILSILLFFYEQNIESEKQLLP

SEQ ID NO: 3290334 - protein, 23 aa, Plasmodium falciparum
LCQAIPVVYLPVWVDEFSPDEKA

SEQ ID NO: 3290335 - protein, 20 aa, Plasmodium falciparum
LCRRDIRTVIHVKALDVLFI

SEQ ID NO: 3290336 - protein, 21 aa, Plasmodium falciparum
LCSFVNKNILKRIPLKKKVIS

SEQ ID NO: 3290337 - protein, 32 aa, Plasmodium falciparum
LCTAVPGWSIICSIGFYAFLNTNAMEAVVKAD

SEQ ID NO: 3290338 - protein, 25 aa, Plasmodium falciparum
LCTINYTLFHFLFNKNIISVDILNY

SEQ ID NO: 3290339 - protein, 25 aa, Plasmodium falciparum
LCTNNLTFLLSFFSDLFRQKGNKIK

SEQ ID NO: 3290340 - protein, 23 aa, Plasmodium falciparum
LCTSGFFSFIFNKIKYYCKTGIF

SEQ ID NO: 3290341 - protein, 32 aa, Plasmodium falciparum
LCTSINQYIMYLPLFLINPSLFSLTTYTLLDH

SEQ ID NO: 3290342 - protein, 47 aa, Plasmodium falciparum
LCTYQLIVRYFIYKLFHTCFIYQIPNFIFYFFRYYYRINNNINKHKM

SEQ ID NO: 3290343 - protein, 28 aa, Plasmodium falciparum
LCVDLCNPFIWIYINDTYLNTFLFKTNE

SEQ ID NO: 3290344 - protein, 29 aa, Plasmodium falciparum
LCVHRIIYCLLYIFNFISLSHINILYNNY

SEQ ID NO: 3290345 - protein, 36 aa, Plasmodium falciparum
LCVYYNYIILKYYFYSLFWAFIISIPLHHVKVKLKE

SEQ ID NO: 3290346 - protein, 19 aa, Plasmodium falciparum
LCYFYNFFLILKEKQFEYM

SEQ ID NO: 3290347 - protein, 26 aa, Plasmodium falciparum
LCYHQMCIQIFLRRVLILFKKEKNEE

SEQ ID NO: 3290348 - protein, 18 aa, Plasmodium falciparum
LCYLILIERVNINAFPLV

SEQ ID NO: 3290349 - protein, 23 aa, Plasmodium falciparum
LDCLKCILSPSIFKKLKGTYKKS

SEQ ID NO: 3290350 - protein, 17 aa, Plasmodium falciparum
LDDIFTIVLCDIELTVR

SEQ ID NO: 3290351 - protein, 36 aa, Plasmodium falciparum
LDDKQIILVRALIKRWLEYFLEDYNKIKKKLKSCTE

SEQ ID NO: 3290352 - protein, 23 aa, Plasmodium falciparum
LDDRKHVLTLTNYIVPIVESFHD

SEQ ID NO: 3290353 - protein, 31 aa, Plasmodium falciparum
LDEFKIVVLGTKLIYRQLLNNIKKENKEIII

SEQ ID NO: 3290354 - protein, 23 aa, Plasmodium falciparum
LDEFRCSFILYEVLNALNTYLNE

SEQ ID NO: 3290355 - protein, 20 aa, Plasmodium falciparum
LDEFTKFYESIKPAIDKIVE

SEQ ID NO: 3290356 - protein, 35 aa, Plasmodium falciparum
LDEIFSFSWNSIISYILILLFNKKYAFTKQCIDNC

SEQ ID NO: 3290357 - protein, 25 aa, Plasmodium falciparum
LDEMKELVIIFLKKISDTYTEDQTK

SEQ ID NO: 3290358 - protein, 25 aa, Plasmodium falciparum
LDENHFFIYYQFKYVLNKNKEEILV

SEQ ID NO: 3290359 - protein, 35 aa, Plasmodium falciparum
LDFENIQYLEFCRFIYLFLLICVDNLKMYKKMEKY

SEQ ID NO: 3290360 - protein, 25 aa, Plasmodium falciparum
LDFLLNYYEQHKCFYIYTGRGPSSL

SEQ ID NO: 3290361 - protein, 20 aa, Plasmodium falciparum
LDFYNKLRKKVYIGYNLRNN

SEQ ID NO: 3290362 - protein, 21 aa, Plasmodium falciparum
LDGDMGYTFSQRIRRFFLNNN

SEQ ID NO: 3290363 - protein, 24 aa, Plasmodium falciparum
LDGYLNIYYILYPSFHKKIKIEHI

SEQ ID NO: 3290364 - protein, 29 aa, Plasmodium falciparum
LDIADIIQNKIFKYNFLLEQLEEHINQLF

SEQ ID NO: 3290365 - protein, 20 aa, Plasmodium falciparum
LDIFKNFILNLLTMGDSSIT

SEQ ID NO: 3290366 - protein, 26 aa, Plasmodium falciparum
LDIHTKIIMIFLSLNKIPPKWSMYFN

SEQ ID NO: 3290367 - protein, 33 aa, Plasmodium falciparum
LDIIYSSTYYLLRLYKNYLLYIHQNYLGMKKLK

SEQ ID NO: 3290368 - protein, 19 aa, Plasmodium falciparum
LDILIKHLDILLGNYYIYN

SEQ ID NO: 3290369 - protein, 20 aa, Plasmodium falciparum
LDILNKKNITYILEVWIYNL

SEQ ID NO: 3290370 - protein, 31 aa, Plasmodium falciparum
LDINEYIFFICGIKLVWMKLFSSLEISCKDI

SEQ ID NO: 3290371 - protein, 24 aa, Plasmodium falciparum
LDISLNLIFLLCRNNFYVMLNKIC

SEQ ID NO: 3290372 - protein, 21 aa, Plasmodium falciparum
LDIYDPFLFSNNMCYNFGVHN

SEQ ID NO: 3290373 - protein, 27 aa, Plasmodium falciparum
LDIYKTPLCLIFTPKEILITCILKAYI

SEQ ID NO: 3290374 - protein, 36 aa, Plasmodium falciparum
LDKEIFYNYINSDLYFLLYSYIQTFAYIILKNEKQN

SEQ ID NO: 3290375 - protein, 25 aa, Plasmodium falciparum
LDKKNFFFIIDIVNLFKNIQTLSYL

SEQ ID NO: 3290376 - protein, 21 aa, Plasmodium falciparum
LDKYRRVIRILSGQHDNPFID

SEQ ID NO: 3290377 - protein, 28 aa, Plasmodium falciparum
LDLEERILQNFYTMLYRGSMSKSKFIQL

SEQ ID NO: 3290378 - protein, 29 aa, Plasmodium falciparum
LDLESTFYYNFYSFINRTYVIDKQDFILK

SEQ ID NO: 3290379 - protein, 22 aa, Plasmodium falciparum
LDLPKYILVPYEYKNINKFKTF

SEQ ID NO: 3290380 - protein, 22 aa, Plasmodium falciparum
LDLSYQMYHKCYYLNNMFICCI

SEQ ID NO: 3290381 - protein, 19 aa, Plasmodium falciparum
LDLVLLYDIGFVDDSENDH

SEQ ID NO: 3290382 - protein, 35 aa, Plasmodium falciparum
LDNFFFPFLCFLFFSFLFIFKIIMSLYYEYVYEKK

SEQ ID NO: 3290383 - protein, 29 aa, Plasmodium falciparum
LDNHFLLIVNNIYFCKYINDDIFLNIIKF

SEQ ID NO: 3290384 - protein, 44 aa, Plasmodium falciparum
LDNIFKTYVKLFIYSWITIFLDIIFKKIFSFINITSLYNSRGTK

SEQ ID NO: 3290385 - protein, 17 aa, Plasmodium falciparum
LDNIFYSQIYLYKNQEV

SEQ ID NO: 3290386 - protein, 51 aa, Plasmodium falciparum
LDNKSDMDVIRNDKFSYFTLYKNNLFPNSNNYFLHMLKTYDEENKGIDENT

SEQ ID NO: 3290387 - protein, 24 aa, Plasmodium falciparum
LDNLNYIPFDNFFFSLLNMPEQVM

SEQ ID NO: 3290388 - protein, 26 aa, Plasmodium falciparum
LDPTILQTTIPFGIAIALTSIVFLFL

SEQ ID NO: 3290389 - protein, 18 aa, Plasmodium falciparum
LDPYNKIKYHNIWKGFNI

SEQ ID NO: 3290390 - protein, 48 aa, Plasmodium falciparum
LDQHEFQILIWLYNVNSTKLNFIPFKSFYYLLLSETNLNYSKVLIGGS

SEQ ID NO: 3290391 - protein, 27 aa, Plasmodium falciparum
LDQKKKAFPRFYFLSNIALLDILSNGK

SEQ ID NO: 3290392 - protein, 23 aa, Plasmodium falciparum
LDRKCLELFFCNLVDIICMDVFL

SEQ ID NO: 3290393 - protein, 27 aa, Plasmodium falciparum
LDTGSLEYYFILNFFKDYESPDFLFLE

SEQ ID NO: 3290394 - protein, 21 aa, Plasmodium falciparum
LDTLMLLEKIKTKTISFINKS

SEQ ID NO: 3290395 - protein, 27 aa, Plasmodium falciparum
LDTYIFGELILEKLLRNYQYSCQYPGD

SEQ ID NO: 3290396 - protein, 24 aa, Plasmodium falciparum
LDVKMPLFEIFLQASIHTQIKIFY

SEQ ID NO: 3290397 - protein, 24 aa, Plasmodium falciparum
LDVLKKLVFGYRKPLDNIKDNVGK

SEQ ID NO: 3290398 - protein, 18 aa, Plasmodium falciparum
LDYFYFSIISISTVGYGD

SEQ ID NO: 3290399 - protein, 25 aa, Plasmodium falciparum
LDYHEKIWKKYYIVKLILEYCEGGN

SEQ ID NO: 3290400 - protein, 19 aa, Plasmodium falciparum
LDYLFKNLYSFFYSILDCE

SEQ ID NO: 3290401 - protein, 23 aa, Plasmodium falciparum
LDYNYLFYFYKNVVNPLLNDKNI

SEQ ID NO: 3290402 - protein, 27 aa, Plasmodium falciparum
LDYTKIYRNPLLLARYRIKKFLKRRCK

SEQ ID NO: 3290403 - protein, 28 aa, Plasmodium falciparum
LEASKPWIFYWCIHSIHILYNTFEIEEK

SEQ ID NO: 3290404 - protein, 26 aa, Plasmodium falciparum
LECFSNFFLIINPKLNIIRSDVIEYF

SEQ ID NO: 3290405 - protein, 29 aa, Plasmodium falciparum
LECIDVVYLNNFFPLESFYNSVKNYYLML

SEQ ID NO: 3290406 - protein, 20 aa, Plasmodium falciparum
LECKFLEKLKKAGSFHLILL

SEQ ID NO: 3290407 - protein, 25 aa, Plasmodium falciparum
LECLKHIYLYILPNEYLLNIEDNNQ

SEQ ID NO: 3290408 - protein, 17 aa, Plasmodium falciparum
LECLKVFYLKRKEKKFS

SEQ ID NO: 3290409 - protein, 32 aa, Plasmodium falciparum
LECLPQVLFLYVIFLLLCTGIFMHNKNKEHHH

SEQ ID NO: 3290410 - protein, 23 aa, Plasmodium falciparum
LEDDVLITKWFDKNILMKEYKKF

SEQ ID NO: 3290411 - protein, 19 aa, Plasmodium falciparum
LEDEWVTDAFMGQEGSVIE

SEQ ID NO: 3290412 - protein, 27 aa, Plasmodium falciparum
LEDIKFTYMLIYLLNYKKKQDKKCALI

SEQ ID NO: 3290413 - protein, 24 aa, Plasmodium falciparum
LEDLFLSIIFHLIDKIFINIKLIV

SEQ ID NO: 3290414 - protein, 30 aa, Plasmodium falciparum
LEDMIPMYVTLLFFIHTKTTYYMLTLLDCK

SEQ ID NO: 3290415 - protein, 25 aa, Plasmodium falciparum
LEDNDLLNLQLYFERKHEITSTLEN

SEQ ID NO: 3290416 - protein, 26 aa, Plasmodium falciparum
LEDNDLLNLQLYFERKHEITSTLEND

SEQ ID NO: 3290417 - protein, 24 aa, Plasmodium falciparum
LEDRNIILYILKNYGKHISICNKL

SEQ ID NO: 3290418 - protein, 30 aa, Plasmodium falciparum
LEEILYFSMEYILIIYKQMIDRDLFHINIG

SEQ ID NO: 3290419 - protein, 18 aa, Plasmodium falciparum
LEEIMPEELIEEMKPEEL

SEQ ID NO: 3290420 - protein, 28 aa, Plasmodium falciparum
LEEIPPKRVLINLWYQSLNIAKDMKELL

SEQ ID NO: 3290421 - protein, 19 aa, Plasmodium falciparum
LEEIVPVELLEEVIPEELV

SEQ ID NO: 3290422 - protein, 23 aa, Plasmodium falciparum
LEEKKVYFEILKKSFLKAEFFEK

SEQ ID NO: 3290423 - protein, 24 aa, Plasmodium falciparum
LEEKWTYDFIIYTKEFYRLFEYSD

SEQ ID NO: 3290424 - protein, 27 aa, Plasmodium falciparum
LEENIIRKKFIYIPKNDSNNIKIQSNI

SEQ ID NO: 3290425 - protein, 27 aa, Plasmodium falciparum
LEEYKNFLLRIRIFSRLTPNNKIEVIR

SEQ ID NO: 3290426 - protein, 33 aa, Plasmodium falciparum
LEEYYMLFNYVILSYIPLYVYELDINNLYLFDM

SEQ ID NO: 3290427 - protein, 18 aa, Plasmodium falciparum
LEFSYKLAKRLYLKSDLF

SEQ ID NO: 3290428 - protein, 36 aa, Plasmodium falciparum
LEHFSLFNYSLSSPFLWLLLLIKNRNLKTFCILDIC

SEQ ID NO: 3290429 - protein, 27 aa, Plasmodium falciparum
LEIENPYLRLLAHTLITKYFDSIFCIS

SEQ ID NO: 3290430 - protein, 19 aa, Plasmodium falciparum
LEILSNFYFLINNKKYVNQ

SEQ ID NO: 3290431 - protein, 21 aa, Plasmodium falciparum
LEINLFNYYFNYQKNVFSHLN

SEQ ID NO: 3290432 - protein, 24 aa, Plasmodium falciparum
LEISFNFFIKYFLLTHSIIMNEQD

SEQ ID NO: 3290433 - protein, 18 aa, Plasmodium falciparum
LEISSIIYIYLIELIKKL

SEQ ID NO: 3290434 - protein, 17 aa, Plasmodium falciparum
LEKFRVLSKIDGKLNDN

SEQ ID NO: 3290435 - protein, 25 aa, Plasmodium falciparum
LEKHREPYFYDIYDDDITYFDTDDV

SEQ ID NO: 3290436 - protein, 24 aa, Plasmodium falciparum
LEKKKFYLYLLGHQLYNILYEFFN

SEQ ID NO: 3290437 - protein, 43 aa, Plasmodium falciparum
LEKKPFPLKILKLFPCLINLSSFFMLPCFFSKRKFKKKGDAQN

SEQ ID NO: 3290438 - protein, 20 aa, Plasmodium falciparum
LEKLKYKCPLLKDHITNIIM

SEQ ID NO: 3290439 - protein, 20 aa, Plasmodium falciparum
LEKMLIMFQHYFLKMDNNTF

SEQ ID NO: 3290440 - protein, 25 aa, Plasmodium falciparum
LEKQKIIWRRWVARYVQHIDDDIIE

SEQ ID NO: 3290441 - protein, 28 aa, Plasmodium falciparum
LEKQSNMFYFLFDALPTLKRKSSIKNIL

SEQ ID NO: 3290442 - protein, 30 aa, Plasmodium falciparum
LEKRKIHFEPIINYLLNIYNKYNKKRKALN

SEQ ID NO: 3290443 - protein, 23 aa, Plasmodium falciparum
LEKSYNLFYSYNLIVSNNKEHDP

SEQ ID NO: 3290444 - protein, 17 aa, Plasmodium falciparum
LEKWKEEAWFLRLKESW

SEQ ID NO: 3290445 - protein, 17 aa, Plasmodium falciparum
LEKWNKENWFVQLKNDW

SEQ ID NO: 3290446 - protein, 17 aa, Plasmodium falciparum
LELCHKFFFTKISYCNK

SEQ ID NO: 3290447 - protein, 31 aa, Plasmodium falciparum
LELGFFVGSFFFIWYITGEKIFKRKKKIVKE

SEQ ID NO: 3290448 - protein, 24 aa, Plasmodium falciparum
LELIKIRLKKYYRIKQFLIDNNKN

SEQ ID NO: 3290449 - protein, 62 aa, Plasmodium falciparum
LELQMKYSIYIMNKKAFLNYLYIYFKFLVEYLDISRIHQTFLYFIHTTLNHCQKYFSNFDIY

SEQ ID NO: 3290450 - protein, 17 aa, Plasmodium falciparum
LEMKLSNNPYLCFECFI

SEQ ID NO: 3290451 - protein, 31 aa, Plasmodium falciparum
LENEKIEDYFFIKRFLPICEEFLLKNEDNVF

SEQ ID NO: 3290452 - protein, 29 aa, Plasmodium falciparum
LENFAERHPFFRWFIEWTDEFCQEQKKEY

SEQ ID NO: 3290453 - protein, 26 aa, Plasmodium falciparum
LENINKYIYLKLYNTFKFIMNNIYDL

SEQ ID NO: 3290454 - protein, 32 aa, Plasmodium falciparum
LENKKIILRIIMLMLFYFNIKHMYVICLDNES

SEQ ID NO: 3290455 - protein, 20 aa, Plasmodium falciparum
LENKLHFFIVMELCEGIDLV

SEQ ID NO: 3290456 - protein, 19 aa, Plasmodium falciparum
LENLWDLYIDIKNIYKDID

SEQ ID NO: 3290457 - protein, 26 aa, Plasmodium falciparum
LENSKILRMLNMKIAFFDITVLGYWY

SEQ ID NO: 3290458 - protein, 21 aa, Plasmodium falciparum
LENWIISALRDNILKYHRKAF

SEQ ID NO: 3290459 - protein, 29 aa, Plasmodium falciparum
LENYLKDKILKIALLMDIFMAILDTSFYE

SEQ ID NO: 3290460 - protein, 17 aa, Plasmodium falciparum
LEPSFYFQYTRCINKKK

SEQ ID NO: 3290461 - protein, 28 aa, Plasmodium falciparum
LEQFEEYLLCYPSFLSSLLTMNNLRKYN

SEQ ID NO: 3290462 - protein, 29 aa, Plasmodium falciparum
LEQKLIAFYRVITILFNAPTLIDSITNKN

SEQ ID NO: 3290463 - protein, 26 aa, Plasmodium falciparum
LEQNIRLFNDLLLFYIRNDKIYDHII

SEQ ID NO: 3290464 - protein, 17 aa, Plasmodium falciparum
LESIGWTYENVSNIFLE

SEQ ID NO: 3290465 - protein, 28 aa, Plasmodium falciparum
LESKHGEKMIKILKIKTSKKKKKRAHKE

SEQ ID NO: 3290466 - protein, 27 aa, Plasmodium falciparum
LESSFALAFIPFFFLNKNVFSNYNEFK

SEQ ID NO: 3290467 - protein, 22 aa, Plasmodium falciparum
LESVCIINIPYFLGGIKIWKDD

SEQ ID NO: 3290468 - protein, 28 aa, Plasmodium falciparum
LETFAKRPQFLRWFTEWGDEFCREQKKQ

SEQ ID NO: 3290469 - protein, 22 aa, Plasmodium falciparum
LEVICLLFALKCKYPKQIHLIR

SEQ ID NO: 3290470 - protein, 28 aa, Plasmodium falciparum
LEVKEKIFYDALLLDLYSYNISVDISII

SEQ ID NO: 3290471 - protein, 29 aa, Plasmodium falciparum
LEVNEYLYSYLFILAIKKMFYDIIAQKKM

SEQ ID NO: 3290472 - protein, 18 aa, Plasmodium falciparum
LEVTKKYIPSNTPIVLIC

SEQ ID NO: 3290473 - protein, 18 aa, Plasmodium falciparum
LEVYIIYLKYNYLNYSQV

SEQ ID NO: 3290474 - protein, 26 aa, Plasmodium falciparum
LEYNPSFFYLSFKILNTLLYNHITSI

SEQ ID NO: 3290475 - protein, 18 aa, Plasmodium falciparum
LFACPYLDKKGGKRVYEF

SEQ ID NO: 3290476 - protein, 35 aa, Plasmodium falciparum
LFASIGPYLFAPMAGLAVWNILKSEFKVLQRIDMA

SEQ ID NO: 3290477 - protein, 27 aa, Plasmodium falciparum
LFCGVPSIYRLLMRLHTYKYIELRINK

SEQ ID NO: 3290478 - protein, 20 aa, Plasmodium falciparum
LFCLPFIVLIFIIYIVARYF

SEQ ID NO: 3290479 - protein, 28 aa, Plasmodium falciparum
LFDELYTYTYIYLLINYKRNNFFDFIKM

SEQ ID NO: 3290480 - protein, 18 aa, Plasmodium falciparum
LFDIYIFIHFFFNNSQSF

SEQ ID NO: 3290481 - protein, 25 aa, Plasmodium falciparum
LFDSRFCMITLNYSLQKLIINFLYD

SEQ ID NO: 3290482 - protein, 26 aa, Plasmodium falciparum
LFDTFFYNLWILSIPVQYFLMKSFSL

SEQ ID NO: 3290483 - protein, 21 aa, Plasmodium falciparum
LFDYKLFKYHDILYKGILNKE

SEQ ID NO: 3290484 - protein, 33 aa, Plasmodium falciparum
LFECDIIKLFIFILHILIVLFWLALCININRIS

SEQ ID NO: 3290485 - protein, 45 aa, Plasmodium falciparum
LFEIKDPFYFHDNKNYIFFILVNFLILLQILFCIIIEIRGLFVTK

SEQ ID NO: 3290486 - protein, 35 aa, Plasmodium falciparum
LFEKEIYYVSIVNVFFFILTIYTFLRTSFMDPGII

SEQ ID NO: 3290487 - protein, 37 aa, Plasmodium falciparum
LFENPNILILILYYYFKLNLIPIQIFYKLHFKIKKNI

SEQ ID NO: 3290488 - protein, 23 aa, Plasmodium falciparum
LFERKLYYIFNNLFPLNKKKETN

SEQ ID NO: 3290489 - protein, 19 aa, Plasmodium falciparum
LFETILYNIIHKENHMIDV

SEQ ID NO: 3290490 - protein, 18 aa, Plasmodium falciparum
LFEYNKLILLLCLFDIYI

SEQ ID NO: 3290491 - protein, 20 aa, Plasmodium falciparum
LFFALFLDTFISSHALINIP

SEQ ID NO: 3290492 - protein, 19 aa, Plasmodium falciparum
LFFCLPLNILEISSYEINK

SEQ ID NO: 3290493 - protein, 21 aa, Plasmodium falciparum
LFFFDELYYYYSVNHTYIACF

SEQ ID NO: 3290494 - protein, 26 aa, Plasmodium falciparum
LFFFYSILYVVLCTYVLGISEEYLKE

SEQ ID NO: 3290495 - protein, 39 aa, Plasmodium falciparum
LFFKMDKKRTFYYLFFFFTFLVYVLYFDNIKSVLRSSTK

SEQ ID NO: 3290496 - protein, 23 aa, Plasmodium falciparum
LFFLFYFSSYNIYFVLTRNKNGQ

SEQ ID NO: 3290497 - protein, 21 aa, Plasmodium falciparum
LFFLTLFRYFISSHTNIPRTN

SEQ ID NO: 3290498 - protein, 22 aa, Plasmodium falciparum
LFFLVFFLSKISVVLSKDDGQR

SEQ ID NO: 3290499 - protein, 17 aa, Plasmodium falciparum
LFFQTFFKIVDFKKFFS

SEQ ID NO: 3290500 - protein, 18 aa, Plasmodium falciparum
LFFSLLLDTFISSHTKNK

SEQ ID NO: 3290501 - protein, 18 aa, Plasmodium falciparum
LFFSLLLDTFISSHTNIP

SEQ ID NO: 3290502 - protein, 17 aa, Plasmodium falciparum
LFFSLSLNILITSSYAH

SEQ ID NO: 3290503 - protein, 18 aa, Plasmodium falciparum
LFFSLSLNILITSSYAHN

SEQ ID NO: 3290504 - protein, 17 aa, Plasmodium falciparum
LFFSTNLDIRNISLFLW

SEQ ID NO: 3290505 - protein, 19 aa, Plasmodium falciparum
LFFVNYDTVPLYDYNRRCV

SEQ ID NO: 3290506 - protein, 19 aa, Plasmodium falciparum
LFFYILDCFFQKLKKKIMS

SEQ ID NO: 3290507 - protein, 23 aa, Plasmodium falciparum
LFGGFGIYGWKTAALAASKNAAV

SEQ ID NO: 3290508 - protein, 24 aa, Plasmodium falciparum
LFGGLGIYAWRSAALVTAIQKGIE

SEQ ID NO: 3290509 - protein, 18 aa, Plasmodium falciparum
LFGGLGIYVSKSAALATA

SEQ ID NO: 3290510 - protein, 30 aa, Plasmodium falciparum
LFGHFSAYFGLLTIIILSFGILFLSTSVIG

SEQ ID NO: 3290511 - protein, 43 aa, Plasmodium falciparum
LFGSIDVFRLILIKLNIPLDVLSIWFTLLLKNLNYITENCIIQ

SEQ ID NO: 3290512 - protein, 17 aa, Plasmodium falciparum
LFHFYICKVHTMDNIQK

SEQ ID NO: 3290513 - protein, 21 aa, Plasmodium falciparum
LFHYNHMVILFQFFSEQFITF

SEQ ID NO: 3290514 - protein, 20 aa, Plasmodium falciparum
LFIIFFYVIFLIHICKGIRL

SEQ ID NO: 3290515 - protein, 19 aa, Plasmodium falciparum
LFIILIIYETLNKNWGAKN

SEQ ID NO: 3290516 - protein, 20 aa, Plasmodium falciparum
LFIITFLSFSTVKVWGKDVF

SEQ ID NO: 3290517 - protein, 22 aa, Plasmodium falciparum
LFIKPFIDILNKKRVLYKYVFL

SEQ ID NO: 3290518 - protein, 25 aa, Plasmodium falciparum
LFILFPFFFIWNIIGTIWIYQIIKY

SEQ ID NO: 3290519 - protein, 19 aa, Plasmodium falciparum
LFILGLFKSQFTNQKPITC

SEQ ID NO: 3290520 - protein, 17 aa, Plasmodium falciparum
LFILILNTIIINPCTCV

SEQ ID NO: 3290521 - protein, 18 aa, Plasmodium falciparum
LFILINFTNKYYDYFYSL

SEQ ID NO: 3290522 - protein, 19 aa, Plasmodium falciparum
LFILNYMYQLLLLSYTIYK

SEQ ID NO: 3290523 - protein, 25 aa, Plasmodium falciparum
LFILTLFFINIILSTLYLIFSKINR

SEQ ID NO: 3290524 - protein, 30 aa, Plasmodium falciparum
LFINKNAFFYNLINYFLLVLNYVERNNFDE

SEQ ID NO: 3290525 - protein, 17 aa, Plasmodium falciparum
LFIWAKKNPDISYKQGM

SEQ ID NO: 3290526 - protein, 17 aa, Plasmodium falciparum
LFIYLFITRDIFVLVHL

SEQ ID NO: 3290527 - protein, 36 aa, Plasmodium falciparum
LFKDDNILNIYWYESFIFICTPLSVFVINFFNKTKI

SEQ ID NO: 3290528 - protein, 20 aa, Plasmodium falciparum
LFKDIKNLIYFLDDIGCFDI

SEQ ID NO: 3290529 - protein, 20 aa, Plasmodium falciparum
LFKDSYLFKSVRDQNWECKF

SEQ ID NO: 3290530 - protein, 18 aa, Plasmodium falciparum
LFKFINFLSYHKSSICRR

SEQ ID NO: 3290531 - protein, 19 aa, Plasmodium falciparum
LFKFQYFYTTLIKINNKKK

SEQ ID NO: 3290532 - protein, 17 aa, Plasmodium falciparum
LFKIIELLKPNKKLLYL

SEQ ID NO: 3290533 - protein, 38 aa, Plasmodium falciparum
LFKIQNVFILIIYIKLFYIYYYLKYYKNKKNKEISLLN

SEQ ID NO: 3290534 - protein, 29 aa, Plasmodium falciparum
LFKLFMGFIYTFLFLFSILIAYILIEDFN

SEQ ID NO: 3290535 - protein, 21 aa, Plasmodium falciparum
LFKNLVPEFYHLRDMLFIFKS

SEQ ID NO: 3290536 - protein, 27 aa, Plasmodium falciparum
LFKNNHTFKFILNKTKLKIFWEVVDEF

SEQ ID NO: 3290537 - protein, 38 aa, Plasmodium falciparum
LFKNNLLKKNFRTYFTNYIYTLFNYGKTYNFLTPYNKD

SEQ ID NO: 3290538 - protein, 20 aa, Plasmodium falciparum
LFKRIKRKFLKTTKKRINKM

SEQ ID NO: 3290539 - protein, 19 aa, Plasmodium falciparum
LFKTSRLFKGIRKQEWTCK

SEQ ID NO: 3290540 - protein, 19 aa, Plasmodium falciparum
LFLFIQLSIKYNNAKVTVD

SEQ ID NO: 3290541 - protein, 19 aa, Plasmodium falciparum
LFLFITFWILYLKNKASEF

SEQ ID NO: 3290542 - protein, 18 aa, Plasmodium falciparum
LFLILKKKKLTFLHSYHH

SEQ ID NO: 3290543 - protein, 19 aa, Plasmodium falciparum
LFLIQIFDMFEFQSLKKIS

SEQ ID NO: 3290544 - protein, 22 aa, Plasmodium falciparum
LFLLIFFIFHLNSTKNYKKTYR

SEQ ID NO: 3290545 - protein, 23 aa, Plasmodium falciparum
LFLLIFFLYLKKNVICSINDNVN

SEQ ID NO: 3290546 - protein, 17 aa, Plasmodium falciparum
LFLLLGKYNILPYDTSN

SEQ ID NO: 3290547 - protein, 17 aa, Plasmodium falciparum
LFLLSYISMYPYDKSIR

SEQ ID NO: 3290548 - protein, 18 aa, Plasmodium falciparum
LFLPFSKDISDLDGDKFS

SEQ ID NO: 3290549 - protein, 17 aa, Plasmodium falciparum
LFLSFIIIIIHGKDISS

SEQ ID NO: 3290550 - protein, 23 aa, Plasmodium falciparum
LFLYLIIFLEAYFCVSLFSTNIF

SEQ ID NO: 3290551 - protein, 22 aa, Plasmodium falciparum
LFLYLNFFILIIEILSKDIIKT

SEQ ID NO: 3290552 - protein, 19 aa, Plasmodium falciparum
LFMEKYKHIFSKYNKIYKI

SEQ ID NO: 3290553 - protein, 18 aa, Plasmodium falciparum
LFMHTYYYSYYDTYIDRI

SEQ ID NO: 3290554 - protein, 19 aa, Plasmodium falciparum
LFMLIIIILKKYTIKHFII

SEQ ID NO: 3290555 - protein, 20 aa, Plasmodium falciparum
LFMPLFHFFNIFSYTFVLIT

SEQ ID NO: 3290556 - protein, 23 aa, Plasmodium falciparum
LFNDNISLYPLIDKKKLNSYIDL

SEQ ID NO: 3290557 - protein, 23 aa, Plasmodium falciparum
LFNENFLKLYLYLCSQNSKGGMK

SEQ ID NO: 3290558 - protein, 22 aa, Plasmodium falciparum
LFNHYYCINMKTKKIWNYILDT

SEQ ID NO: 3290559 - protein, 18 aa, Plasmodium falciparum
LFNLIICCNVTSIYGYIH

SEQ ID NO: 3290560 - protein, 26 aa, Plasmodium falciparum
LFNMNIFSYKIIIAEGLLSLCLQNYT

SEQ ID NO: 3290561 - protein, 28 aa, Plasmodium falciparum
LFNPILFKYIAIFTFFFFISFAFSCFYC

SEQ ID NO: 3290562 - protein, 26 aa, Plasmodium falciparum
LFNVEIFVFLFFMSPWNYTKNDNIQS

SEQ ID NO: 3290563 - protein, 17 aa, Plasmodium falciparum
LFPIFTAKQLVIFTEGM

SEQ ID NO: 3290564 - protein, 35 aa, Plasmodium falciparum
LFQAQNYIYWNIFELNLFFFLVGIPKEILEIFIYH

SEQ ID NO: 3290565 - protein, 20 aa, Plasmodium falciparum
LFRDIVLKDGYFLSLVSADY

SEQ ID NO: 3290566 - protein, 25 aa, Plasmodium falciparum
LFRHNRYIIIPYFNDIYINRNNLLI

SEQ ID NO: 3290567 - protein, 17 aa, Plasmodium falciparum
LFRLIKKNDFKNTYNIE

SEQ ID NO: 3290568 - protein, 27 aa, Plasmodium falciparum
LFSCINFYIIFLYILKKNINEQKEYFI

SEQ ID NO: 3290569 - protein, 19 aa, Plasmodium falciparum
LFSFDKIKETILPPVTKKV

SEQ ID NO: 3290570 - protein, 18 aa, Plasmodium falciparum
LFSLLFVIPISILHNLKT

SEQ ID NO: 3290571 - protein, 29 aa, Plasmodium falciparum
LFSSIFPSYILLIINYWNGQYINECNIPK

SEQ ID NO: 3290572 - protein, 35 aa, Plasmodium falciparum
LFSSLYLHSYILFLFFNFIFCGIISIVIYVLVILS

SEQ ID NO: 3290573 - protein, 26 aa, Plasmodium falciparum
LFSVIFNLYAFLKKKIKLYYKHNKHL

SEQ ID NO: 3290574 - protein, 24 aa, Plasmodium falciparum
LFTCNSFYLYNIVDLLLLLKREEE

SEQ ID NO: 3290575 - protein, 94 aa, Plasmodium falciparum
LFTPNMGISYMQDILSLFLFYNYICLYLTKILLYKSGGALITILLVKIIPYVKEFDRNLIICFLYSVLHSIFYIMCNIFLYNLEKEKKIFQGSE

SEQ ID NO: 3290576 - protein, 27 aa, Plasmodium falciparum
LFVCFLLFFLILSFRYSCEKKKLQTVD

SEQ ID NO: 3290577 - protein, 18 aa, Plasmodium falciparum
LFVNNEFLICNFQYVRKC

SEQ ID NO: 3290578 - protein, 33 aa, Plasmodium falciparum
LFVTKNSCIYFFKFIIFYILEILKNSYFKIHLL

SEQ ID NO: 3290579 - protein, 17 aa, Plasmodium falciparum
LFYFSYDIILYTLSAKI

SEQ ID NO: 3290580 - protein, 21 aa, Plasmodium falciparum
LFYINWMFVFLLLDFCNGHLD

SEQ ID NO: 3290581 - protein, 20 aa, Plasmodium falciparum
LFYKCKIFRKNGLNRIIRRN

SEQ ID NO: 3290582 - protein, 21 aa, Plasmodium falciparum
LFYLHSKYIKLEHLFNPCFNN

SEQ ID NO: 3290583 - protein, 29 aa, Plasmodium falciparum
LFYLSLIFLFFILLITLYIYLIPGLNIEG

SEQ ID NO: 3290584 - protein, 19 aa, Plasmodium falciparum
LFYNYIPFDINNLYNIYEN

SEQ ID NO: 3290585 - protein, 20 aa, Plasmodium falciparum
LGALILFLSSLLLLFTFLYY

SEQ ID NO: 3290586 - protein, 26 aa, Plasmodium falciparum
LGAYKYVIMIALLDIVANTLYFVSQL

SEQ ID NO: 3290587 - protein, 30 aa, Plasmodium falciparum
LGDRIKSPYFVLELVLELEYFPLIKEAYGD

SEQ ID NO: 3290588 - protein, 39 aa, Plasmodium falciparum
LGENDVIVKRIKLYYPLRNKNVFTNISKIIFMTNTNICS

SEQ ID NO: 3290589 - protein, 33 aa, Plasmodium falciparum
LGFQSNYLFIILSLLFIFFYININLSTFVTYTK

SEQ ID NO: 3290590 - protein, 37 aa, Plasmodium falciparum
LGFQTYVPFVLIKLLMNIIIYIFYVFISYKNINQLHY

SEQ ID NO: 3290591 - protein, 25 aa, Plasmodium falciparum
LGGFLIGIILKRNQLKYFLRNNFLI

SEQ ID NO: 3290592 - protein, 22 aa, Plasmodium falciparum
LGGLWMQMDCYFVKFNLEKGKK

SEQ ID NO: 3290593 - protein, 18 aa, Plasmodium falciparum
LGIALSLFLSIMGAAWGI

SEQ ID NO: 3290594 - protein, 17 aa, Plasmodium falciparum
LGIDIYYIRKSIFEIFK

SEQ ID NO: 3290595 - protein, 20 aa, Plasmodium falciparum
LGIFELPFADIFNYGTEDFR

SEQ ID NO: 3290596 - protein, 18 aa, Plasmodium falciparum
LGIIFLTFLLLSASKRID

SEQ ID NO: 3290597 - protein, 17 aa, Plasmodium falciparum
LGIILISFMASVVFIVG

SEQ ID NO: 3290598 - protein, 25 aa, Plasmodium falciparum
LGILLFNMNIYLNFKLHGNNFLPSL

SEQ ID NO: 3290599 - protein, 18 aa, Plasmodium falciparum
LGIVKKFVQKNYPKILYI

SEQ ID NO: 3290600 - protein, 24 aa, Plasmodium falciparum
LGKELSYYKNLCKEFKIELELLKN

SEQ ID NO: 3290601 - protein, 27 aa, Plasmodium falciparum
LGKKVMPLIFFIINNPKEFFNECIIND

SEQ ID NO: 3290602 - protein, 36 aa, Plasmodium falciparum
LGKTLQAISIFYFYHLYPVLIITPASLKINWFSEIE

SEQ ID NO: 3290603 - protein, 22 aa, Plasmodium falciparum
LGKYTLLLYPSNLKSIKIIGSL

SEQ ID NO: 3290604 - protein, 17 aa, Plasmodium falciparum
LGLILLDAQGYFKIQEQ

SEQ ID NO: 3290605 - protein, 22 aa, Plasmodium falciparum
LGLLIMYISIYLLKYIYHCNRC

SEQ ID NO: 3290606 - protein, 17 aa, Plasmodium falciparum
LGLLYTYIHTINMINII

SEQ ID NO: 3290607 - protein, 38 aa, Plasmodium falciparum
LGNENNFFGIIYLFLYLYKIHYYIYKITDMNYLKSQIV

SEQ ID NO: 3290608 - protein, 19 aa, Plasmodium falciparum
LGNFRIVSILLKGFSSTVC

SEQ ID NO: 3290609 - protein, 28 aa, Plasmodium falciparum
LGNILFNTFLFFSNYLNFVCYLLKEIKQ

SEQ ID NO: 3290610 - protein, 25 aa, Plasmodium falciparum
LGNKQLYIFSLPRCFIDRTGLGIKA

SEQ ID NO: 3290611 - protein, 17 aa, Plasmodium falciparum
LGNTCYLNSLLQALYST

SEQ ID NO: 3290612 - protein, 19 aa, Plasmodium falciparum
LGPETLFNLILPLMMQNTL

SEQ ID NO: 3290613 - protein, 19 aa, Plasmodium falciparum
LGQLILAGILQFGTFSVMN

SEQ ID NO: 3290614 - protein, 30 aa, Plasmodium falciparum
LGSSSFYWYKFIVPLFLLSFGLLIIKCVSL

SEQ ID NO: 3290615 - protein, 24 aa, Plasmodium falciparum
LGSVLFIGLTLYIYSTIKITKWRK

SEQ ID NO: 3290616 - protein, 25 aa, Plasmodium falciparum
LGTLKILYNFYVNLFDKLKEDVENI

SEQ ID NO: 3290617 - protein, 24 aa, Plasmodium falciparum
LGTNFDLLIYNKINKLPNCTMIFI

SEQ ID NO: 3290618 - protein, 19 aa, Plasmodium falciparum
LGTYGWKIAAITTATELAK

SEQ ID NO: 3290619 - protein, 17 aa, Plasmodium falciparum
LGVLYVVLLNVCLHNGS

SEQ ID NO: 3290620 - protein, 19 aa, Plasmodium falciparum
LGYIYIMQKPILPEQINYY

SEQ ID NO: 3290621 - protein, 17 aa, Plasmodium falciparum
LGYKLLSVLKIQGVPSI

SEQ ID NO: 3290622 - protein, 17 aa, Plasmodium falciparum
LGYMAWTRYIAAKVLEE

SEQ ID NO: 3290623 - protein, 23 aa, Plasmodium falciparum
LHANINNLFYNYCCICKKSGGAL

SEQ ID NO: 3290624 - protein, 18 aa, Plasmodium falciparum
LHDYFLNLDYFKLYDNLE

SEQ ID NO: 3290625 - protein, 28 aa, Plasmodium falciparum
LHDYPIKFYLKKIISTYFIKYFAFFKNK

SEQ ID NO: 3290626 - protein, 26 aa, Plasmodium falciparum
LHEFLFHYIYKNMINYTLLYLTKFIF

SEQ ID NO: 3290627 - protein, 20 aa, Plasmodium falciparum
LHELCQYFFVSKKKRKKKKK

SEQ ID NO: 3290628 - protein, 23 aa, Plasmodium falciparum
LHFDDWLKLINLFVEINYIYKYI

SEQ ID NO: 3290629 - protein, 18 aa, Plasmodium falciparum
LHFISIFNDFYSLFPRRV

SEQ ID NO: 3290630 - protein, 17 aa, Plasmodium falciparum
LHFISLSNTIISFAINL

SEQ ID NO: 3290631 - protein, 18 aa, Plasmodium falciparum
LHFLLFKPIKINIDVLIK

SEQ ID NO: 3290632 - protein, 17 aa, Plasmodium falciparum
LHFLLKHNIRLCLRVAK

SEQ ID NO: 3290633 - protein, 17 aa, Plasmodium falciparum
LHFTNLIFDLYISRFNS

SEQ ID NO: 3290634 - protein, 43 aa, Plasmodium falciparum
LHIDKNIPYLYILSYIYNSFYSFYDFFYQYWKKNHLNNFNKMK

SEQ ID NO: 3290635 - protein, 24 aa, Plasmodium falciparum
LHIHMDLFIFTPIFPKNNSTCINE

SEQ ID NO: 3290636 - protein, 29 aa, Plasmodium falciparum
LHIKGIWGFLFFFLFQFVTSFVLYNKKIH

SEQ ID NO: 3290637 - protein, 19 aa, Plasmodium falciparum
LHILMCIADYLLYIFKIII

SEQ ID NO: 3290638 - protein, 44 aa, Plasmodium falciparum
LHINSFMFRYLRKFGRFIIYFLLLFFISIILLDSFNVGYDLRIS

SEQ ID NO: 3290639 - protein, 18 aa, Plasmodium falciparum
LHIYLYIDSIYSSELSKH

SEQ ID NO: 3290640 - protein, 20 aa, Plasmodium falciparum
LHKCTYIFHKLLKNSDKLLY

SEQ ID NO: 3290641 - protein, 22 aa, Plasmodium falciparum
LHKEFIFHLLSLNMLKKMNSFL

SEQ ID NO: 3290642 - protein, 26 aa, Plasmodium falciparum
LHKQYNYYFSYLYAKKMLTYDNVCYR

SEQ ID NO: 3290643 - protein, 18 aa, Plasmodium falciparum
LHKVLLINYFFLRNYIEK

SEQ ID NO: 3290644 - protein, 18 aa, Plasmodium falciparum
LHLLRRKNIYYKYVLNIN

SEQ ID NO: 3290645 - protein, 17 aa, Plasmodium falciparum
LHLYIKFKKEIYTNLLI

SEQ ID NO: 3290646 - protein, 25 aa, Plasmodium falciparum
LHLYMNILCYIIFKKFSYEYKKEQK

SEQ ID NO: 3290647 - protein, 32 aa, Plasmodium falciparum
LHNEKKISMFFYTFLILYISHVRIFYDCLNLK

SEQ ID NO: 3290648 - protein, 24 aa, Plasmodium falciparum
LHNIKIIHLFKLLKNIKKLNISYE

SEQ ID NO: 3290649 - protein, 18 aa, Plasmodium falciparum
LHNKLFLLNLQKICSKKK

SEQ ID NO: 3290650 - protein, 25 aa, Plasmodium falciparum
LHNQLNLFHTWLDRHRNMCEKWKND

SEQ ID NO: 3290651 - protein, 18 aa, Plasmodium falciparum
LHNYCLSYLFYNVSSLST

SEQ ID NO: 3290652 - protein, 18 aa, Plasmodium falciparum
LHNYYKPSLYIKEDIYSD

SEQ ID NO: 3290653 - protein, 21 aa, Plasmodium falciparum
LHPLQNIQFYRYKKNIRTNNQ

SEQ ID NO: 3290654 - protein, 20 aa, Plasmodium falciparum
LHQCYTYIYSIFIVTKKMKD

SEQ ID NO: 3290655 - protein, 28 aa, Plasmodium falciparum
LHQSQLYQAAFSYCLYLLNNQKHINKLL

SEQ ID NO: 3290656 - protein, 30 aa, Plasmodium falciparum
LHREIYCFKPFDFPIFKIFITTNMCTKLLI

SEQ ID NO: 3290657 - protein, 18 aa, Plasmodium falciparum
LHRSLYEYQICNNSKYFN

SEQ ID NO: 3290658 - protein, 25 aa, Plasmodium falciparum
LHSLFSCIPFNYRIYKYILKKTSKE

SEQ ID NO: 3290659 - protein, 43 aa, Plasmodium falciparum
LHSYMFSYLRLCTVPLYIYLYFDIPLSHTLILTSLSSLYHLIT

SEQ ID NO: 3290660 - protein, 25 aa, Plasmodium falciparum
LHTPSSRLLLLCIDQIYIIYENYIY

SEQ ID NO: 3290661 - protein, 34 aa, Plasmodium falciparum
LHTTIPFGVALALGSIAFLFLKKKTKSTIDLLRV

SEQ ID NO: 3290662 - protein, 18 aa, Plasmodium falciparum
LHVHELFPVIFDSFVKTR

SEQ ID NO: 3290663 - protein, 22 aa, Plasmodium falciparum
LHVRCYLLKIFYELIENNFIPL

SEQ ID NO: 3290664 - protein, 56 aa, Plasmodium falciparum
LHVSGILMRIWLNCSFTFIAYGFFIPNMNSFISKYWYLYKTAFSYHMKIFAYYLRV

SEQ ID NO: 3290665 - protein, 26 aa, Plasmodium falciparum
LHYDIKKYYFSTLLLCLCKLIISLLD

SEQ ID NO: 3290666 - protein, 19 aa, Plasmodium falciparum
LHYNKYESLNLLFLHSHIF

SEQ ID NO: 3290667 - protein, 19 aa, Plasmodium falciparum
LIALGHFTVLKLALKNYKN

SEQ ID NO: 3290668 - protein, 24 aa, Plasmodium falciparum
LIALTIIVIILYVWLRKRRKKLME

SEQ ID NO: 3290669 - protein, 20 aa, Plasmodium falciparum
LICFFYIFMGLLIFCSLFII

SEQ ID NO: 3290670 - protein, 23 aa, Plasmodium falciparum
LICGLFCNFLSPAFAYISACESN

SEQ ID NO: 3290671 - protein, 21 aa, Plasmodium falciparum
LICILNYIIYYKRKKMNMLNT

SEQ ID NO: 3290672 - protein, 29 aa, Plasmodium falciparum
LICKFFKVYSIWNWKYPVLLQNIKKYNIE

SEQ ID NO: 3290673 - protein, 35 aa, Plasmodium falciparum
LICKKKIKCLICVYISILIIYYLRNEEIKIMLIQY

SEQ ID NO: 3290674 - protein, 18 aa, Plasmodium falciparum
LICNYKTNFLWINNMNNT

SEQ ID NO: 3290675 - protein, 19 aa, Plasmodium falciparum
LICSQSMNSPIYPDVSIEA

SEQ ID NO: 3290676 - protein, 24 aa, Plasmodium falciparum
LICVYLLTFFSLSSTFFIYLIFKL

SEQ ID NO: 3290677 - protein, 18 aa, Plasmodium falciparum
LIDECVVILNDKLCFNCI

SEQ ID NO: 3290678 - protein, 36 aa, Plasmodium falciparum
LIDEKYQLLILSIFFLIFLVFIPATFIIYYQKQKQY

SEQ ID NO: 3290679 - protein, 23 aa, Plasmodium falciparum
LIDICRLLFLKKEINKKIMFTLF

SEQ ID NO: 3290680 - protein, 33 aa, Plasmodium falciparum
LIDIELLAYLPFHCNFFLMIKKKMKEKINGDKK

SEQ ID NO: 3290681 - protein, 24 aa, Plasmodium falciparum
LIDLLCIAFYCLKNYDYINCYYIS

SEQ ID NO: 3290682 - protein, 21 aa, Plasmodium falciparum
LIDMFIINIFNILLTKNNYNK

SEQ ID NO: 3290683 - protein, 26 aa, Plasmodium falciparum
LIDYIKEKIFNLYIKCSEQQNIIDDS

SEQ ID NO: 3290684 - protein, 20 aa, Plasmodium falciparum
LIDYMCYWVYEFFDKILYFI

SEQ ID NO: 3290685 - protein, 24 aa, Plasmodium falciparum
LIDYQQWLSIILKKNINIGNLREC

SEQ ID NO: 3290686 - protein, 17 aa, Plasmodium falciparum
LIEEILSKKYRTFSINE

SEQ ID NO: 3290687 - protein, 18 aa, Plasmodium falciparum
LIEEMMILTNFLVANVIS

SEQ ID NO: 3290688 - protein, 19 aa, Plasmodium falciparum
LIEEVIPEELIKEVVPEEV

SEQ ID NO: 3290689 - protein, 25 aa, Plasmodium falciparum
LIEGEKVLWKKWLRNQKGLLDKYNE

SEQ ID NO: 3290690 - protein, 22 aa, Plasmodium falciparum
LIEKFNNLFFNTLKLINYNFVI

SEQ ID NO: 3290691 - protein, 32 aa, Plasmodium falciparum
LIERGIIYHKTLRYVLEKLKLYPNKKIPWEYG

SEQ ID NO: 3290692 - protein, 20 aa, Plasmodium falciparum
LIEYINIYILSLINSRVNCD

SEQ ID NO: 3290693 - protein, 22 aa, Plasmodium falciparum
LIFHLFHMTFSFSFIKNYKTTD

SEQ ID NO: 3290694 - protein, 20 aa, Plasmodium falciparum
LIFIYCILNFITGNSYLFYF

SEQ ID NO: 3290695 - protein, 18 aa, Plasmodium falciparum
LIFKIYDPVIWRSLMCPN

SEQ ID NO: 3290696 - protein, 21 aa, Plasmodium falciparum
LIFMFLINALVLPHYENCQND

SEQ ID NO: 3290697 - protein, 21 aa, Plasmodium falciparum
LIFMFLINILVSLYNENYLNN

SEQ ID NO: 3290698 - protein, 18 aa, Plasmodium falciparum
LIFNFLINILVSPHNENY

SEQ ID NO: 3290699 - protein, 19 aa, Plasmodium falciparum
LIFTFLVNTLILSHNENCQ

SEQ ID NO: 3290700 - protein, 19 aa, Plasmodium falciparum
LIGFIILLIIAIINWNNEQ

SEQ ID NO: 3290701 - protein, 26 aa, Plasmodium falciparum
LIGHNIFFTYPLWFELNRSYEIIQEG

SEQ ID NO: 3290702 - protein, 19 aa, Plasmodium falciparum
LIGQMFLVIICIFSFIFSI

SEQ ID NO: 3290703 - protein, 18 aa, Plasmodium falciparum
LIGRLTVCISTTAILFWV

SEQ ID NO: 3290704 - protein, 26 aa, Plasmodium falciparum
LIGYAIYALFYFKYKSWYSYIISVLA

SEQ ID NO: 3290705 - protein, 22 aa, Plasmodium falciparum
LIHERMHLFGYLTMWMTESKMI

SEQ ID NO: 3290706 - protein, 19 aa, Plasmodium falciparum
LIHFIKCYHIILRNFMNYK

SEQ ID NO: 3290707 - protein, 29 aa, Plasmodium falciparum
LIHKKLNYKIFFFFVCNYLCTLSLDAMSS

SEQ ID NO: 3290708 - protein, 29 aa, Plasmodium falciparum
LIHLKNVKDIFWYLYIKSKFVKKQNMKEF

SEQ ID NO: 3290709 - protein, 27 aa, Plasmodium falciparum
LIHLNKLYIYDIFIKRNLVGCHGFTLF

SEQ ID NO: 3290710 - protein, 19 aa, Plasmodium falciparum
LIHLQVCYKYMPIVGFSRS

SEQ ID NO: 3290711 - protein, 19 aa, Plasmodium falciparum
LIHLYYTFEKIYKMKYLSM

SEQ ID NO: 3290712 - protein, 18 aa, Plasmodium falciparum
LIHPLMIHIHILHQFYLS

SEQ ID NO: 3290713 - protein, 24 aa, Plasmodium falciparum
LIHPYYIHKMIFFFNNMFSSHTFT

SEQ ID NO: 3290714 - protein, 19 aa, Plasmodium falciparum
LIHYDNIKISSYLSKGGFG

SEQ ID NO: 3290715 - protein, 19 aa, Plasmodium falciparum
LIICDGVCIDSFYHLVQTN

SEQ ID NO: 3290716 - protein, 29 aa, Plasmodium falciparum
LIIDIFLGFLIFLLLYFNVINLHYISEKA

SEQ ID NO: 3290717 - protein, 17 aa, Plasmodium falciparum
LIILTAMFILFKPSDRL

SEQ ID NO: 3290718 - protein, 25 aa, Plasmodium falciparum
LIILTIIIVWLLVTWLWSHKDEYYK

SEQ ID NO: 3290719 - protein, 28 aa, Plasmodium falciparum
LIILVVALIVLYIWLYKRRKKSWKHECK

SEQ ID NO: 3290720 - protein, 41 aa, Plasmodium falciparum
LIIQTSILLIVRYPTHYLLYFLYIISFTSLYWSFSIHKAFM

SEQ ID NO: 3290721 - protein, 17 aa, Plasmodium falciparum
LIIRFSVLFLPYTKSYF

SEQ ID NO: 3290722 - protein, 38 aa, Plasmodium falciparum
LIIYMIRDCIFIFPFVIILIYFFVFKRFSRGCKEAQRL

SEQ ID NO: 3290723 - protein, 33 aa, Plasmodium falciparum
LIKDCSYSVFFYNLFIKGLYLNKQNLEHATEKE

SEQ ID NO: 3290724 - protein, 26 aa, Plasmodium falciparum
LIKDSLPFEILILEAIFVDISEELKN

SEQ ID NO: 3290725 - protein, 27 aa, Plasmodium falciparum
LIKEKKDCILIYPYTYTKIWNTLTTYI

SEQ ID NO: 3290726 - protein, 18 aa, Plasmodium falciparum
LIKFIKFINKLVKYEYRI

SEQ ID NO: 3290727 - protein, 24 aa, Plasmodium falciparum
LIKGYNIIAIPFYTWRNMSYEEKE

SEQ ID NO: 3290728 - protein, 33 aa, Plasmodium falciparum
LIKILFLWFIIIQPYIKWLFIKLKKSYMKLDYQ

SEQ ID NO: 3290729 - protein, 17 aa, Plasmodium falciparum
LIKINIIDDFFLYHKYN

SEQ ID NO: 3290730 - protein, 28 aa, Plasmodium falciparum
LIKKEVENFLYLPQFRKSYDYKYNKYIY

SEQ ID NO: 3290731 - protein, 17 aa, Plasmodium falciparum
LIKKIKNILKKKTLRKS

SEQ ID NO: 3290732 - protein, 26 aa, Plasmodium falciparum
LIKKMVHFIILNFTKTFLKFVQSDEH

SEQ ID NO: 3290733 - protein, 17 aa, Plasmodium falciparum
LIKLLIINYGEVFTLYK

SEQ ID NO: 3290734 - protein, 30 aa, Plasmodium falciparum
LIKLNIHIPIYIYNIFKYYIKKKLSTFTDL

SEQ ID NO: 3290735 - protein, 29 aa, Plasmodium falciparum
LIKLNKNSWYLYDAFWPLSAFKDFQTANE

SEQ ID NO: 3290736 - protein, 29 aa, Plasmodium falciparum
LIKNKFIENVYFLISFIFELFVEDSICTK

SEQ ID NO: 3290737 - protein, 20 aa, Plasmodium falciparum
LIKNNLLMDYGNSLNIALMC

SEQ ID NO: 3290738 - protein, 25 aa, Plasmodium falciparum
LIKSKNLFTFIFYKNLKNIGRKNNF

SEQ ID NO: 3290739 - protein, 24 aa, Plasmodium falciparum
LIKWKDIFLFFKTFTNQNKEKCII

SEQ ID NO: 3290740 - protein, 28 aa, Plasmodium falciparum
LIKYNLNDLIPFFYKNNYIYVDDAFINI

SEQ ID NO: 3290741 - protein, 28 aa, Plasmodium falciparum
LILAVVLIILYIWLYRRRKKSWKHECKK

SEQ ID NO: 3290742 - protein, 28 aa, Plasmodium falciparum
LILCSDFMKNIYIFFKNSKKSSLKNCVI

SEQ ID NO: 3290743 - protein, 17 aa, Plasmodium falciparum
LILFHLNFMECFRKYDK

SEQ ID NO: 3290744 - protein, 19 aa, Plasmodium falciparum
LILFYINFNFFWLSGIKET

SEQ ID NO: 3290745 - protein, 17 aa, Plasmodium falciparum
LILIAISNTMDLPDRLI

SEQ ID NO: 3290746 - protein, 17 aa, Plasmodium falciparum
LILLFVINIFKACCKEA

SEQ ID NO: 3290747 - protein, 21 aa, Plasmodium falciparum
LILNLLKKCISFFYLHKDNII

SEQ ID NO: 3290748 - protein, 17 aa, Plasmodium falciparum
LILQYMKLYNLNKSIIL

SEQ ID NO: 3290749 - protein, 18 aa, Plasmodium falciparum
LILRKLHFSIKDKNIITF

SEQ ID NO: 3290750 - protein, 27 aa, Plasmodium falciparum
LILTVVLIILYIWLYRRRKNSWKHECK

SEQ ID NO: 3290751 - protein, 17 aa, Plasmodium falciparum
LILYFISLLISLRYKYI

SEQ ID NO: 3290752 - protein, 24 aa, Plasmodium falciparum
LILYKIILSYCYLLKRNKVLYGHI

SEQ ID NO: 3290753 - protein, 17 aa, Plasmodium falciparum
LIMLINEVPLCKFYYIN

SEQ ID NO: 3290754 - protein, 17 aa, Plasmodium falciparum
LINDLHKKFFIYESFCS

SEQ ID NO: 3290755 - protein, 37 aa, Plasmodium falciparum
LINDNTIIKFKLTLPFPHLFLCKPNSLYLNNFIKSIS

SEQ ID NO: 3290756 - protein, 21 aa, Plasmodium falciparum
LINFLKCCLLNISLSSYLCVK

SEQ ID NO: 3290757 - protein, 19 aa, Plasmodium falciparum
LINGSSLCFCLYFDKNVIN

SEQ ID NO: 3290758 - protein, 24 aa, Plasmodium falciparum
LINKKLYSFLIIRDNGSRAIVITE

SEQ ID NO: 3290759 - protein, 37 aa, Plasmodium falciparum
LINKYNKALNRYYKICSNIIYYKKYLEKELSSKNNGT

SEQ ID NO: 3290760 - protein, 19 aa, Plasmodium falciparum
LINLLIFFSFINGYFYARQ

SEQ ID NO: 3290761 - protein, 25 aa, Plasmodium falciparum
LINMYNILIYFYIKDKKKVIFEIKK

SEQ ID NO: 3290762 - protein, 21 aa, Plasmodium falciparum
LINNGFCLFACPYLDKKGGKR

SEQ ID NO: 3290763 - protein, 24 aa, Plasmodium falciparum
LINNKSFPFYSIKRKMKDLIKEEK

SEQ ID NO: 3290764 - protein, 26 aa, Plasmodium falciparum
LINNLIHILFFSYISIFPYFLVQANW

SEQ ID NO: 3290765 - protein, 18 aa, Plasmodium falciparum
LINRILVYLISLSSYYLI

SEQ ID NO: 3290766 - protein, 17 aa, Plasmodium falciparum
LINYIDKNDLLLYNINR

SEQ ID NO: 3290767 - protein, 17 aa, Plasmodium falciparum
LINYYISNIPKKKVDFI

SEQ ID NO: 3290768 - protein, 27 aa, Plasmodium falciparum
LIPLSLIIVYSFYLWKKYKKCKYISDS

SEQ ID NO: 3290769 - protein, 24 aa, Plasmodium falciparum
LIQAPVRFFLYFLLRKYKSENERM

SEQ ID NO: 3290770 - protein, 36 aa, Plasmodium falciparum
LIQATCTPMLYIINNFFLIILNHIRTLINFILCINH

SEQ ID NO: 3290771 - protein, 24 aa, Plasmodium falciparum
LIQIKYTIILLSSYINLFSEIICT

SEQ ID NO: 3290772 - protein, 28 aa, Plasmodium falciparum
LIQKIHILLLIFILLISSISMYVFALIK

SEQ ID NO: 3290773 - protein, 23 aa, Plasmodium falciparum
LIQVLVEFIIIFSTAICTSPVQN

SEQ ID NO: 3290774 - protein, 18 aa, Plasmodium falciparum
LIRAYTLIQYNKRYVHIQ

SEQ ID NO: 3290775 - protein, 23 aa, Plasmodium falciparum
LIRLKMYNIWLELMQNEQMKYYG

SEQ ID NO: 3290776 - protein, 24 aa, Plasmodium falciparum
LIRQEPFILNFFVKNMFILIERLI

SEQ ID NO: 3290777 - protein, 21 aa, Plasmodium falciparum
LIRVLNIFFCGLRNYIFMITS

SEQ ID NO: 3290778 - protein, 41 aa, Plasmodium falciparum
LISAEEIDSKFFLNKMLLLILGGSSYMRYSKENYFSVSIYD

SEQ ID NO: 3290779 - protein, 20 aa, Plasmodium falciparum
LISCLVWINDSLFLTINKEY

SEQ ID NO: 3290780 - protein, 22 aa, Plasmodium falciparum
LISFLFLAGGGTYYIYKYKKNE

SEQ ID NO: 3290781 - protein, 19 aa, Plasmodium falciparum
LISFVYLFELYLKKKKIEN

SEQ ID NO: 3290782 - protein, 47 aa, Plasmodium falciparum
LISISSSFSYFYSLLLLLFCLIFSIDLNGIPLYFDSSALLICIMKFG

SEQ ID NO: 3290783 - protein, 30 aa, Plasmodium falciparum
LISIYGQIIIQLFFVMISLVLLMNLSFYKY

SEQ ID NO: 3290784 - protein, 17 aa, Plasmodium falciparum
LISMIYKNKSYFGFMNK

SEQ ID NO: 3290785 - protein, 19 aa, Plasmodium falciparum
LISSIFSYWIKLSDGCIVK

SEQ ID NO: 3290786 - protein, 30 aa, Plasmodium falciparum
LISYENILNIFLYTFYYLRRNDDLFVHYTN

SEQ ID NO: 3290787 - protein, 19 aa, Plasmodium falciparum
LITFSPILFMHTYYYSYYD

SEQ ID NO: 3290788 - protein, 17 aa, Plasmodium falciparum
LITGYIRCFKKYSLYKE

SEQ ID NO: 3290789 - protein, 17 aa, Plasmodium falciparum
LITLEKFKEYITNYIFQ

SEQ ID NO: 3290790 - protein, 19 aa, Plasmodium falciparum
LITPLFVYKSLISGVSNFP

SEQ ID NO: 3290791 - protein, 21 aa, Plasmodium falciparum
LITVHKFPMFIYDEIKKIWFY

SEQ ID NO: 3290792 - protein, 19 aa, Plasmodium falciparum
LITYLKNENLINKDKIFLS

SEQ ID NO: 3290793 - protein, 24 aa, Plasmodium falciparum
LIVIAFIIMFLPLSILYVRKYERS

SEQ ID NO: 3290794 - protein, 18 aa, Plasmodium falciparum
LIVLSICIIYYFNLNFFS

SEQ ID NO: 3290795 - protein, 29 aa, Plasmodium falciparum
LIVSTCYRWPLLIDPQLQGLKWLKAKGGN

SEQ ID NO: 3290796 - protein, 23 aa, Plasmodium falciparum
LIYFILLVNINLFKKKKFNTSTR

SEQ ID NO: 3290797 - protein, 18 aa, Plasmodium falciparum
LIYFNYIDIIPIYIKTKN

SEQ ID NO: 3290798 - protein, 36 aa, Plasmodium falciparum
LIYICKKYRFDKLDTLLFFLLPFRNINGKIYDTYRN

SEQ ID NO: 3290799 - protein, 20 aa, Plasmodium falciparum
LIYIFLYSLCYQHVNNVFAL

SEQ ID NO: 3290800 - protein, 26 aa, Plasmodium falciparum
LIYKNIHFIIYKYNKILNSLVIVLRH

SEQ ID NO: 3290801 - protein, 24 aa, Plasmodium falciparum
LIYLCQSIFIILFHISNIKEISYE

SEQ ID NO: 3290802 - protein, 30 aa, Plasmodium falciparum
LIYMNELLYYLIHKVPFYYYTKFVYFHLLK

SEQ ID NO: 3290803 - protein, 19 aa, Plasmodium falciparum
LIYMNIYYFIFQNTHSLFS

SEQ ID NO: 3290804 - protein, 18 aa, Plasmodium falciparum
LIYNAFTNYSYNNSFYII

SEQ ID NO: 3290805 - protein, 24 aa, Plasmodium falciparum
LIYTNLHIGYILRNFLDISKEDFP

SEQ ID NO: 3290806 - protein, 19 aa, Plasmodium falciparum
LIYVGKSLRHLLFENYMDV

SEQ ID NO: 3290807 - protein, 17 aa, Plasmodium falciparum
LIYYCRECKRYLHNRWV

SEQ ID NO: 3290808 - protein, 19 aa, Plasmodium falciparum
LKAFFNILILLCLNNEHIL

SEQ ID NO: 3290809 - protein, 35 aa, Plasmodium falciparum
LKAIIIKALIIEEVIKYIKCILYKIELIKYNNNNN

SEQ ID NO: 3290810 - protein, 18 aa, Plasmodium falciparum
LKAIIKFLNPIKDKLDPQ

SEQ ID NO: 3290811 - protein, 22 aa, Plasmodium falciparum
LKAMLKAYFFTCSLGVVGFSFL

SEQ ID NO: 3290812 - protein, 26 aa, Plasmodium falciparum
LKAQYAPLIPIFSKNYDKIYTYLCVH

SEQ ID NO: 3290813 - protein, 26 aa, Plasmodium falciparum
LKCGITFFFIFILLRSHIFIQNKDVI

SEQ ID NO: 3290814 - protein, 23 aa, Plasmodium falciparum
LKCMYFICNNILYDLMIEMDTRS

SEQ ID NO: 3290815 - protein, 25 aa, Plasmodium falciparum
LKCMYYNILLFLYTSANNVITYLEE

SEQ ID NO: 3290816 - protein, 28 aa, Plasmodium falciparum
LKCRKKKLEVILWIKIYMSVLEEQKNEE

SEQ ID NO: 3290817 - protein, 27 aa, Plasmodium falciparum
LKCTYQFFYPFLMLPDLAKWTTSHFDD

SEQ ID NO: 3290818 - protein, 21 aa, Plasmodium falciparum
LKCVLPYILFLDDILHFLSDE

SEQ ID NO: 3290819 - protein, 18 aa, Plasmodium falciparum
LKDDFIYNMLQNEPNDIP

SEQ ID NO: 3290820 - protein, 24 aa, Plasmodium falciparum
LKDIKCIFFYIVYNIFKMCMKCFC

SEQ ID NO: 3290821 - protein, 25 aa, Plasmodium falciparum
LKDKYIYEWLNRNICLFQFPDNYVD

SEQ ID NO: 3290822 - protein, 22 aa, Plasmodium falciparum
LKDMYEFLETIDINKILKSIHN

SEQ ID NO: 3290823 - protein, 29 aa, Plasmodium falciparum
LKEFKFMFFFYIFIYIISIYIFNKMGVPI

SEQ ID NO: 3290824 - protein, 37 aa, Plasmodium falciparum
LKEFYYDDEFFFLQISFYLFKILIKYHDPVLSEILEN

SEQ ID NO: 3290825 - protein, 23 aa, Plasmodium falciparum
LKEKNFPLFLFTSGEVYFSANFF

SEQ ID NO: 3290826 - protein, 24 aa, Plasmodium falciparum
LKEKRNLFFKYNILERGYSKITSV

SEQ ID NO: 3290827 - protein, 27 aa, Plasmodium falciparum
LKELNYKHFLLFNSFVNPLKNFDIYIK

SEQ ID NO: 3290828 - protein, 18 aa, Plasmodium falciparum
LKEMMWMSIDYYEEKRWK

SEQ ID NO: 3290829 - protein, 18 aa, Plasmodium falciparum
LKENFLYLNIPKSIKRYL

SEQ ID NO: 3290830 - protein, 22 aa, Plasmodium falciparum
LKENIIFSGIWVYGISKRNDLY

SEQ ID NO: 3290831 - protein, 22 aa, Plasmodium falciparum
LKENYLYFYNNLSDIAKLFTNL

SEQ ID NO: 3290832 - protein, 26 aa, Plasmodium falciparum
LKEQLKFFFLSLYIIKINSFNIYQEN

SEQ ID NO: 3290833 - protein, 20 aa, Plasmodium falciparum
LKFFFSCTHFIKKLRYLLSI

SEQ ID NO: 3290834 - protein, 30 aa, Plasmodium falciparum
LKFTNYIYSIKFLYRPILTHVYYNNKTMDN

SEQ ID NO: 3290835 - protein, 20 aa, Plasmodium falciparum
LKFYQIRSYDDMDFYILRNQ

SEQ ID NO: 3290836 - protein, 22 aa, Plasmodium falciparum
LKGALKIEFPFSTPINNEKKNF

SEQ ID NO: 3290837 - protein, 31 aa, Plasmodium falciparum
LKGRDRNITLKYYLDILFKEKIKEAYGDERE

SEQ ID NO: 3290838 - protein, 20 aa, Plasmodium falciparum
LKHELNYLSFLTKNYITAKE

SEQ ID NO: 3290839 - protein, 19 aa, Plasmodium falciparum
LKHIIFEDIEFNNISINCV

SEQ ID NO: 3290840 - protein, 20 aa, Plasmodium falciparum
LKHIVIFAKRDIAAHEEITY

SEQ ID NO: 3290841 - protein, 21 aa, Plasmodium falciparum
LKHLYGMNMLLFLLLKDRNSN

SEQ ID NO: 3290842 - protein, 28 aa, Plasmodium falciparum
LKHNKKVHLLICPFSFFFSVYKEKKNKK

SEQ ID NO: 3290843 - protein, 64 aa, Plasmodium falciparum
LKHTEFFLNILTRFPNLKNVMRLLKFFLKVRTLPSMKQGGLPTIFWMMLCVKYCRISRERSEKN

SEQ ID NO: 3290844 - protein, 25 aa, Plasmodium falciparum
LKICVDLLKKRTFYYINIWEKNKAF

SEQ ID NO: 3290845 - protein, 25 aa, Plasmodium falciparum
LKIFEIPIIYFNTLPCNFYFYHFEA

SEQ ID NO: 3290846 - protein, 30 aa, Plasmodium falciparum
LKIFNYFHILVISLIFYLNLHSMYTLFIDL

SEQ ID NO: 3290847 - protein, 18 aa, Plasmodium falciparum
LKIFSNIPMRSVSLILNS

SEQ ID NO: 3290848 - protein, 20 aa, Plasmodium falciparum
LKIIFAIFITLLLSGSLASL

SEQ ID NO: 3290849 - protein, 35 aa, Plasmodium falciparum
LKIIITFMKCVNYLLYMIGIKRKFNMSLSRIWYFF

SEQ ID NO: 3290850 - protein, 23 aa, Plasmodium falciparum
LKIILIILFIKYNVVNGLLKTPC

SEQ ID NO: 3290851 - protein, 33 aa, Plasmodium falciparum
LKIKLYDTLNFLLNFLYIFKMYKSKNEKLQSLH

SEQ ID NO: 3290852 - protein, 35 aa, Plasmodium falciparum
LKILCSKRFLVPILGILYIILNYNFTYSGNSTCRL

SEQ ID NO: 3290853 - protein, 17 aa, Plasmodium falciparum
LKINYSISKIPYITINK

SEQ ID NO: 3290854 - protein, 41 aa, Plasmodium falciparum
LKIQKKLQFLYLILFVLITGVFFFFLIGNFYSHRKLYQVIK

SEQ ID NO: 3290855 - protein, 30 aa, Plasmodium falciparum
LKIQNELNLYYTFWLIYKSIKSMDERFEKK

SEQ ID NO: 3290856 - protein, 40 aa, Plasmodium falciparum
LKKAMLSSTIMWSIGIGFATFTYFFLKKKTKSTIDLLRVI

SEQ ID NO: 3290857 - protein, 25 aa, Plasmodium falciparum
LKKDHIYNFLKYNNFIILACQKKKK

SEQ ID NO: 3290858 - protein, 33 aa, Plasmodium falciparum
LKKEFYLKKMNIPCPSLILSPHLYSKGYVNIKC

SEQ ID NO: 3290859 - protein, 23 aa, Plasmodium falciparum
LKKHKLLFLSSGIYLCHLITNSI

SEQ ID NO: 3290860 - protein, 20 aa, Plasmodium falciparum
LKKILILVSLFTLPCSFFCF

SEQ ID NO: 3290861 - protein, 22 aa, Plasmodium falciparum
LKKKHLFYELYRISNSSSFKAH

SEQ ID NO: 3290862 - protein, 38 aa, Plasmodium falciparum
LKKKININKYTYLFYRLPLFLFGDKYINDIDDVKSIYM

SEQ ID NO: 3290863 - protein, 26 aa, Plasmodium falciparum
LKKLMKLFHFRGFTEKIPNEECSKKK

SEQ ID NO: 3290864 - protein, 24 aa, Plasmodium falciparum
LKKNHILLFKWLRCYEPIYKKLNE

SEQ ID NO: 3290865 - protein, 25 aa, Plasmodium falciparum
LKKNIKLLNSFLILRDIHVIEVELI

SEQ ID NO: 3290866 - protein, 25 aa, Plasmodium falciparum
LKKNKQTYYDYYPLKRFASEEELEN

SEQ ID NO: 3290867 - protein, 22 aa, Plasmodium falciparum
LKKRKYFLDVLESDLMQFKHIS

SEQ ID NO: 3290868 - protein, 24 aa, Plasmodium falciparum
LKKVKLYIENITNLLGRINTFIKE

SEQ ID NO: 3290869 - protein, 23 aa, Plasmodium falciparum
LKLAKIFLHLAYIHFEHGYIEKC

SEQ ID NO: 3290870 - protein, 19 aa, Plasmodium falciparum
LKLALLFLTWYTLNVLYNV

SEQ ID NO: 3290871 - protein, 30 aa, Plasmodium falciparum
LKLDDKSIYLIFLFLGNIFTVLYNSLLPYC

SEQ ID NO: 3290872 - protein, 20 aa, Plasmodium falciparum
LKLFLNKYNMQWLHFNECLF

SEQ ID NO: 3290873 - protein, 37 aa, Plasmodium falciparum
LKLININIPYLFPNVLAYKKLILTLKQDLNKFYHLKT

SEQ ID NO: 3290874 - protein, 24 aa, Plasmodium falciparum
LKLKSLIKLELLVKSLFPKSKIEV

SEQ ID NO: 3290875 - protein, 21 aa, Plasmodium falciparum
LKLNIVPVFVFLPGPVEYKEY

SEQ ID NO: 3290876 - protein, 40 aa, Plasmodium falciparum
LKNAMLSSTIMWSIGIGFATFTYFYLKKKTKRLVDLFSVI

SEQ ID NO: 3290877 - protein, 26 aa, Plasmodium falciparum
LKNCFILSFHILIIFGISTFLNLLPT

SEQ ID NO: 3290878 - protein, 30 aa, Plasmodium falciparum
LKNDNFYFMINSLLFIFNMKYDKATFYKLI

SEQ ID NO: 3290879 - protein, 22 aa, Plasmodium falciparum
LKNFEYFFDKDICKYIKNVCLL

SEQ ID NO: 3290880 - protein, 19 aa, Plasmodium falciparum
LKNHFVNFFLLKRKQYEKK

SEQ ID NO: 3290881 - protein, 21 aa, Plasmodium falciparum
LKNIFIFMDLFKMNKYIYNQK

SEQ ID NO: 3290882 - protein, 20 aa, Plasmodium falciparum
LKNILLKLFTILYNLLDTTE

SEQ ID NO: 3290883 - protein, 37 aa, Plasmodium falciparum
LKNITISNIVLLYFFSAFSFLNSYFIYKLHSLEKKSI

SEQ ID NO: 3290884 - protein, 38 aa, Plasmodium falciparum
LKNIYPFVFSSFSFFLFVYLFSFLLYIIVSYRNPGYVT

SEQ ID NO: 3290885 - protein, 24 aa, Plasmodium falciparum
LKNKENYGILDDKGKIKIYEENNE

SEQ ID NO: 3290886 - protein, 18 aa, Plasmodium falciparum
LKNKLSFDYLLGASYKGI

SEQ ID NO: 3290887 - protein, 36 aa, Plasmodium falciparum
LKNLKIVYFFNYSLMFKFFIYVLYPFIPATIYENII

SEQ ID NO: 3290888 - protein, 25 aa, Plasmodium falciparum
LKNMFIIKELIFNSPIITTTWIDNY

SEQ ID NO: 3290889 - protein, 28 aa, Plasmodium falciparum
LKNNFINSFLFSLSFFHTILICRCNYNN

SEQ ID NO: 3290890 - protein, 30 aa, Plasmodium falciparum
LKNNIYKLFLYFLFFYKNDFNHLILFLYSY

SEQ ID NO: 3290891 - protein, 27 aa, Plasmodium falciparum
LKNQNSFLKYILPYAQKLSLSEYQLNY

SEQ ID NO: 3290892 - protein, 23 aa, Plasmodium falciparum
LKNRALIQLWGKDSFKFLQSLTT

SEQ ID NO: 3290893 - protein, 17 aa, Plasmodium falciparum
LKNTLLLTIFHIEKYNY

SEQ ID NO: 3290894 - protein, 28 aa, Plasmodium falciparum
LKNVFKNMWNKFLSLKGISKLRGIFKRK

SEQ ID NO: 3290895 - protein, 52 aa, Plasmodium falciparum
LKNVPVVFWIILLLFGWNEILFFIRMFFKLNVILPLFFAAAFIVSTFVYNGN

SEQ ID NO: 3290896 - protein, 33 aa, Plasmodium falciparum
LKNWLACHYVVNTPPLLFLLNNSIALTNKNSIR

SEQ ID NO: 3290897 - protein, 34 aa, Plasmodium falciparum
LKNYDKLLTFFPYHIKLILISYLYNVIDYKILNY

SEQ ID NO: 3290898 - protein, 21 aa, Plasmodium falciparum
LKNYLFGLNLLPEDNFKRNNF

SEQ ID NO: 3290899 - protein, 27 aa, Plasmodium falciparum
LKQKQFKRWSIWKSNKWNGLNGWKKRE

SEQ ID NO: 3290900 - protein, 17 aa, Plasmodium falciparum
LKQNLIWANEKFLEAFK

SEQ ID NO: 3290901 - protein, 37 aa, Plasmodium falciparum
LKRAIERQRNFFRLSKFFFNKYKNKAYKHLLKQINKK

SEQ ID NO: 3290902 - protein, 22 aa, Plasmodium falciparum
LKREIFNRFYFLSTDDLINLIS

SEQ ID NO: 3290903 - protein, 50 aa, Plasmodium falciparum
LKRELLDGIYMFQLFISYKNFFWKEIITSLIWMIISILSVIKKIFKNQKN

SEQ ID NO: 3290904 - protein, 30 aa, Plasmodium falciparum
LKRFAYLNNAYYLYKLYYNMFVWDNKNHFD

SEQ ID NO: 3290905 - protein, 17 aa, Plasmodium falciparum
LKRGLQLSIFYEIYRMY

SEQ ID NO: 3290906 - protein, 22 aa, Plasmodium falciparum
LKRKNLWNNIWIVSTTLLLIII

SEQ ID NO: 3290907 - protein, 23 aa, Plasmodium falciparum
LKRKNLWNNIWIVSTTLSLIIIC

SEQ ID NO: 3290908 - protein, 23 aa, Plasmodium falciparum
LKRQPFFVFLGYGACEYNLDESA

SEQ ID NO: 3290909 - protein, 22 aa, Plasmodium falciparum
LKSIFQNIYKNLKKPAQKHYSD

SEQ ID NO: 3290910 - protein, 20 aa, Plasmodium falciparum
LKSILYFMEPLECVNIYESV

SEQ ID NO: 3290911 - protein, 17 aa, Plasmodium falciparum
LKSLIDISFYYFPIEFI

SEQ ID NO: 3290912 - protein, 18 aa, Plasmodium falciparum
LKSLIKYVNKKKIVHVLK

SEQ ID NO: 3290913 - protein, 36 aa, Plasmodium falciparum
LKSNLFIKRLFLFCHFLICSKIVTFRFIQDLFLKIE

SEQ ID NO: 3290914 - protein, 24 aa, Plasmodium falciparum
LKSSNRYIPYASDRYKGKTYIYME

SEQ ID NO: 3290915 - protein, 19 aa, Plasmodium falciparum
LKTLNFLYREKYSFLIYLF

SEQ ID NO: 3290916 - protein, 31 aa, Plasmodium falciparum
LKTNFFWKEFISFLDFFNSRKSVFTYPLQNV

SEQ ID NO: 3290917 - protein, 27 aa, Plasmodium falciparum
LKTNVRNITICKILLMINEYKHYRYIE

SEQ ID NO: 3290918 - protein, 23 aa, Plasmodium falciparum
LKTYFYHIVNKFKSDVFSLGLSL

SEQ ID NO: 3290919 - protein, 27 aa, Plasmodium falciparum
LKVDSLIFLTYLMKNIFSLIRQEPFIL

SEQ ID NO: 3290920 - protein, 30 aa, Plasmodium falciparum
LKVFMNTCFYFINIIKYENFHMLKSVSMAM

SEQ ID NO: 3290921 - protein, 26 aa, Plasmodium falciparum
LKVFYFLFFYLSFEDIYYHCINIGKP

SEQ ID NO: 3290922 - protein, 18 aa, Plasmodium falciparum
LKVKSFCFNYIYSFRPFF

SEQ ID NO: 3290923 - protein, 32 aa, Plasmodium falciparum
LKVKSFCFNYIYSFRPFFLRCILHLNRKQEVI

SEQ ID NO: 3290924 - protein, 22 aa, Plasmodium falciparum
LKVLDLRWNNFTYKSLLTLSFS

SEQ ID NO: 3290925 - protein, 17 aa, Plasmodium falciparum
LKVLFMVYSMISSIYYY

SEQ ID NO: 3290926 - protein, 30 aa, Plasmodium falciparum
LKVLNLSIYNILFPFKKYLNLKLQRISLQM

SEQ ID NO: 3290927 - protein, 28 aa, Plasmodium falciparum
LKVQNNVIFLMKIYCLRYYTGIPITTTS

SEQ ID NO: 3290928 - protein, 23 aa, Plasmodium falciparum
LKWRYKVILPFFASLPLLLSYSG

SEQ ID NO: 3290929 - protein, 33 aa, Plasmodium falciparum
LKYHIKNELIWLIYLFYFYNIKKNIIQTRMLYL

SEQ ID NO: 3290930 - protein, 19 aa, Plasmodium falciparum
LKYIFRCIQYYWSDKLKEE

SEQ ID NO: 3290931 - protein, 17 aa, Plasmodium falciparum
LKYMFDYLSIYYDELVI

SEQ ID NO: 3290932 - protein, 33 aa, Plasmodium falciparum
LKYSMILFLNFPLYPHIILKLFSFSILCLREEM

SEQ ID NO: 3290933 - protein, 39 aa, Plasmodium falciparum
LKYSTLYFFVIILPHLIFIRFLFIYTLFAPILSSYIIIK

SEQ ID NO: 3290934 - protein, 18 aa, Plasmodium falciparum
LKYTNIILIIKNISYIIA

SEQ ID NO: 3290935 - protein, 38 aa, Plasmodium falciparum
LKYYEKELLYFFPSKKYMYKILFKSFKKLKLEKFIQID

SEQ ID NO: 3290936 - protein, 17 aa, Plasmodium falciparum
LLALITSVIQMLALISF

SEQ ID NO: 3290937 - protein, 28 aa, Plasmodium falciparum
LLANCIMSYIYFYNISKKGTLYEIKSDH

SEQ ID NO: 3290938 - protein, 18 aa, Plasmodium falciparum
LLCFLETLKIIILNIRIK

SEQ ID NO: 3290939 - protein, 39 aa, Plasmodium falciparum
LLCISKRYIHIYKINKYPIKRIIYLDLLYLCCGIETIIS

SEQ ID NO: 3290940 - protein, 23 aa, Plasmodium falciparum
LLCLHLYNYVFHSTFFIINWKHG

SEQ ID NO: 3290941 - protein, 24 aa, Plasmodium falciparum
LLCPFCNDIFFLKNDLLNHIANIH

SEQ ID NO: 3290942 - protein, 18 aa, Plasmodium falciparum
LLCSFINPFWKLVIIRKS

SEQ ID NO: 3290943 - protein, 21 aa, Plasmodium falciparum
LLCSLPLNILLTPSYEINMKS

SEQ ID NO: 3290944 - protein, 22 aa, Plasmodium falciparum
LLDIYILIMLLKHESVFYEKIM

SEQ ID NO: 3290945 - protein, 26 aa, Plasmodium falciparum
LLDKYNEEFWFKKLFEDYEKEVENDD

SEQ ID NO: 3290946 - protein, 17 aa, Plasmodium falciparum
LLDLSYILDIISILIDN

SEQ ID NO: 3290947 - protein, 18 aa, Plasmodium falciparum
LLDVLFYNTTLLSFTNIF

SEQ ID NO: 3290948 - protein, 23 aa, Plasmodium falciparum
LLEDFAKDLWVAYSKYIATKLEK

SEQ ID NO: 3290949 - protein, 27 aa, Plasmodium falciparum
LLEEEVFLFFLFLINCSFLSEWDNIQN

SEQ ID NO: 3290950 - protein, 19 aa, Plasmodium falciparum
LLEELLIQIKEEDKIISEL

SEQ ID NO: 3290951 - protein, 20 aa, Plasmodium falciparum
LLEIKNQRFRFLKINLETVR

SEQ ID NO: 3290952 - protein, 18 aa, Plasmodium falciparum
LLEMGLTYRRERVKLLVL

SEQ ID NO: 3290953 - protein, 20 aa, Plasmodium falciparum
LLFAFLINTLVLPHYENYLN

SEQ ID NO: 3290954 - protein, 19 aa, Plasmodium falciparum
LLFAFPLNILVNTHKKPSI

SEQ ID NO: 3290955 - protein, 21 aa, Plasmodium falciparum
LLFAFPLNILVTLYHEYNQRN

SEQ ID NO: 3290956 - protein, 21 aa, Plasmodium falciparum
LLFAFPLNILVTLYHVNTHKK

SEQ ID NO: 3290957 - protein, 20 aa, Plasmodium falciparum
LLFAFPLNILVYNQWNHKST

SEQ ID NO: 3290958 - protein, 18 aa, Plasmodium falciparum
LLFAIPLNILIYNQRNHK

SEQ ID NO: 3290959 - protein, 19 aa, Plasmodium falciparum
LLFALALNILLTSYYAHNK

SEQ ID NO: 3290960 - protein, 19 aa, Plasmodium falciparum
LLFALPLDILEHNKNEPHT

SEQ ID NO: 3290961 - protein, 18 aa, Plasmodium falciparum
LLFALPLNILEHNERDHN

SEQ ID NO: 3290962 - protein, 19 aa, Plasmodium falciparum
LLFALPLNILIYNQRNHYI

SEQ ID NO: 3290963 - protein, 19 aa, Plasmodium falciparum
LLFALPLNILVGSPQKNPS

SEQ ID NO: 3290964 - protein, 18 aa, Plasmodium falciparum
LLFALPLNILVHNQRNHK

SEQ ID NO: 3290965 - protein, 18 aa, Plasmodium falciparum
LLFALPLNILVINQRNHN

SEQ ID NO: 3290966 - protein, 19 aa, Plasmodium falciparum
LLFALPLNILVKLCRVHYQ

SEQ ID NO: 3290967 - protein, 18 aa, Plasmodium falciparum
LLFALPLNILVNNQRNHN

SEQ ID NO: 3290968 - protein, 18 aa, Plasmodium falciparum
LLFALPLNILVNTHKKPH

SEQ ID NO: 3290969 - protein, 19 aa, Plasmodium falciparum
LLFALPLNILVNTHKKTSI

SEQ ID NO: 3290970 - protein, 20 aa, Plasmodium falciparum
LLFALPLNILVRLCNVGSPH

SEQ ID NO: 3290971 - protein, 19 aa, Plasmodium falciparum
LLFALPLNILVRNQRNHRK

SEQ ID NO: 3290972 - protein, 20 aa, Plasmodium falciparum
LLFALPLNILVSSKKNTYIK

SEQ ID NO: 3290973 - protein, 20 aa, Plasmodium falciparum
LLFALPLNILVSSPKKNPSI

SEQ ID NO: 3290974 - protein, 19 aa, Plasmodium falciparum
LLFALPLNILVYNQRNYYI

SEQ ID NO: 3290975 - protein, 18 aa, Plasmodium falciparum
LLFALPLNILVYNQRSYY

SEQ ID NO: 3290976 - protein, 20 aa, Plasmodium falciparum
LLFALPLYILDHKQRNHNST

SEQ ID NO: 3290977 - protein, 17 aa, Plasmodium falciparum
LLFALPRNILVNTHKKL

SEQ ID NO: 3290978 - protein, 17 aa, Plasmodium falciparum
LLFAVPLNILVTLCHAN

SEQ ID NO: 3290979 - protein, 20 aa, Plasmodium falciparum
LLFCLPLNILAHSKNKLYMK

SEQ ID NO: 3290980 - protein, 20 aa, Plasmodium falciparum
LLFEAVPLTIQLTTISKRIK

SEQ ID NO: 3290981 - protein, 20 aa, Plasmodium falciparum
LLFELPLNILIYNQRNHNST

SEQ ID NO: 3290982 - protein, 20 aa, Plasmodium falciparum
LLFELPLNILIYNQRNHYIT

SEQ ID NO: 3290983 - protein, 19 aa, Plasmodium falciparum
LLFELPLNILIYNQRNYYI

SEQ ID NO: 3290984 - protein, 23 aa, Plasmodium falciparum
LLFFFLLNILLTSYYAHNKNKPS

SEQ ID NO: 3290985 - protein, 19 aa, Plasmodium falciparum
LLFFFPLNILANNNKNKPS

SEQ ID NO: 3290986 - protein, 21 aa, Plasmodium falciparum
LLFFFPLNILLTSPSNSHNNN

SEQ ID NO: 3290987 - protein, 22 aa, Plasmodium falciparum
LLFFFPLNILLTSYHAHNKNKP

SEQ ID NO: 3290988 - protein, 22 aa, Plasmodium falciparum
LLFFFPLNILLTSYHEHNKNKP

SEQ ID NO: 3290989 - protein, 22 aa, Plasmodium falciparum
LLFFFPLNILLTSYHVHSKNKP

SEQ ID NO: 3290990 - protein, 22 aa, Plasmodium falciparum
LLFFFPLNILVTSYHAYNKNKP

SEQ ID NO: 3290991 - protein, 22 aa, Plasmodium falciparum
LLFFFPLNILVTSYHGNNNNKT

SEQ ID NO: 3290992 - protein, 21 aa, Plasmodium falciparum
LLFFFPLNILVTSYHVYNKNK

SEQ ID NO: 3290993 - protein, 22 aa, Plasmodium falciparum
LLFFFPLNILVTSYHVYSKNKP

SEQ ID NO: 3290994 - protein, 20 aa, Plasmodium falciparum
LLFFFPLNVLLTSYHAHNKN

SEQ ID NO: 3290995 - protein, 22 aa, Plasmodium falciparum
LLFFFPLYILEHNQNKPYITQH

SEQ ID NO: 3290996 - protein, 25 aa, Plasmodium falciparum
LLFFFPLYILVYSKNKPSITPHHTQ

SEQ ID NO: 3290997 - protein, 20 aa, Plasmodium falciparum
LLFIIEYIKENYKFVKILYG

SEQ ID NO: 3290998 - protein, 19 aa, Plasmodium falciparum
LLFILLYSSDIIISINPST

SEQ ID NO: 3290999 - protein, 20 aa, Plasmodium falciparum
LLFLIPLNTLVTSSSYVHNK

SEQ ID NO: 3291000 - protein, 21 aa, Plasmodium falciparum
LLFLLPLNILLTLHQVHSKNK

SEQ ID NO: 3291001 - protein, 21 aa, Plasmodium falciparum
LLFLLPLNILVTSLSNVHNNN

SEQ ID NO: 3291002 - protein, 22 aa, Plasmodium falciparum
LLFLLPLNILVTSLSNVHSKNK

SEQ ID NO: 3291003 - protein, 23 aa, Plasmodium falciparum
LLFLLPLNILVTSLSNVYSKNKS

SEQ ID NO: 3291004 - protein, 26 aa, Plasmodium falciparum
LLFNFLINILVLPYYENYLNNFYNIS

SEQ ID NO: 3291005 - protein, 19 aa, Plasmodium falciparum
LLFNFLINVLVLPHYENYQ

SEQ ID NO: 3291006 - protein, 20 aa, Plasmodium falciparum
LLFNILINTLVLPHYENYLN

SEQ ID NO: 3291007 - protein, 18 aa, Plasmodium falciparum
LLFNYLINTLVLPHYENY

SEQ ID NO: 3291008 - protein, 19 aa, Plasmodium falciparum
LLFPFSLNIMLLSSQVYNQ

SEQ ID NO: 3291009 - protein, 19 aa, Plasmodium falciparum
LLFPLKLNILIYNQRNHKS

SEQ ID NO: 3291010 - protein, 18 aa, Plasmodium falciparum
LLFPLKLNILVNTHQKPH

SEQ ID NO: 3291011 - protein, 19 aa, Plasmodium falciparum
LLFPLKLNILVNTQQIPSI

SEQ ID NO: 3291012 - protein, 18 aa, Plasmodium falciparum
LLFPLKLNILVYNQRNYY

SEQ ID NO: 3291013 - protein, 19 aa, Plasmodium falciparum
LLFPLLLNILSHNKNKPYI

SEQ ID NO: 3291014 - protein, 22 aa, Plasmodium falciparum
LLFPLPLNILEYSKNKPYITPN

SEQ ID NO: 3291015 - protein, 34 aa, Plasmodium falciparum
LLFSFCKYIYYKWKGIMNYLFMYFDKIKNRKIFL

SEQ ID NO: 3291016 - protein, 20 aa, Plasmodium falciparum
LLFSFLINILVLPQYENCEK

SEQ ID NO: 3291017 - protein, 24 aa, Plasmodium falciparum
LLFSFTLIILLLSPSQVNNQMNHY

SEQ ID NO: 3291018 - protein, 22 aa, Plasmodium falciparum
LLFSFTLIILLLSSSQVNNQMN

SEQ ID NO: 3291019 - protein, 24 aa, Plasmodium falciparum
LLFSFTLIILLLSSSQVNNQMNHY

SEQ ID NO: 3291020 - protein, 18 aa, Plasmodium falciparum
LLFSHPLNILLTSSQVYN

SEQ ID NO: 3291021 - protein, 17 aa, Plasmodium falciparum
LLFSIPLNILINDHSKY

SEQ ID NO: 3291022 - protein, 18 aa, Plasmodium falciparum
LLFSIPLNILINDQRNHK

SEQ ID NO: 3291023 - protein, 18 aa, Plasmodium falciparum
LLFSISLSIFFSSSYAHN

SEQ ID NO: 3291024 - protein, 20 aa, Plasmodium falciparum
LLFSLILNILVPSSYAHNKN

SEQ ID NO: 3291025 - protein, 20 aa, Plasmodium falciparum
LLFSLILNTLKHYSIALHTS

SEQ ID NO: 3291026 - protein, 22 aa, Plasmodium falciparum
LLFSLLLHRLLLSSSKVNIEMN

SEQ ID NO: 3291027 - protein, 19 aa, Plasmodium falciparum
LLFSLLLNILAHNKNKSYI

SEQ ID NO: 3291028 - protein, 20 aa, Plasmodium falciparum
LLFSLLLNILAHNKNKSYTT

SEQ ID NO: 3291029 - protein, 18 aa, Plasmodium falciparum
LLFSLPLNIFVTSSHLNN

SEQ ID NO: 3291030 - protein, 24 aa, Plasmodium falciparum
LLFSLPLNILLLSSSQVYVHRNHY

SEQ ID NO: 3291031 - protein, 19 aa, Plasmodium falciparum
LLFSLPLNILVASSSSNVN

SEQ ID NO: 3291032 - protein, 20 aa, Plasmodium falciparum
LLFSLPLNILVSSSYAHNKN

SEQ ID NO: 3291033 - protein, 19 aa, Plasmodium falciparum
LLFSLPLNILVTSSSNAHS

SEQ ID NO: 3291034 - protein, 20 aa, Plasmodium falciparum
LLFSLPLNILVTSSYAHNKN

SEQ ID NO: 3291035 - protein, 18 aa, Plasmodium falciparum
LLFSLQLNILITSSYVNN

SEQ ID NO: 3291036 - protein, 18 aa, Plasmodium falciparum
LLFSLQLNILMLSSYAHI

SEQ ID NO: 3291037 - protein, 18 aa, Plasmodium falciparum
LLFSLSLNIFLLSSQVYN

SEQ ID NO: 3291038 - protein, 24 aa, Plasmodium falciparum
LLFSLSLNILFLSSGVYNQGNHNL

SEQ ID NO: 3291039 - protein, 19 aa, Plasmodium falciparum
LLFSVPLNLLISSSYEHNN

SEQ ID NO: 3291040 - protein, 19 aa, Plasmodium falciparum
LLFTFFINTLVLAHYENYL

SEQ ID NO: 3291041 - protein, 20 aa, Plasmodium falciparum
LLFTFLINILGSPHNENYLN

SEQ ID NO: 3291042 - protein, 20 aa, Plasmodium falciparum
LLFTFLINILVLPHNVCTKI

SEQ ID NO: 3291043 - protein, 20 aa, Plasmodium falciparum
LLFTFLINTLILPHYENYLN

SEQ ID NO: 3291044 - protein, 21 aa, Plasmodium falciparum
LLFTFLINTLILPHYENYLNN

SEQ ID NO: 3291045 - protein, 20 aa, Plasmodium falciparum
LLFTFLINTLLLPHYENYLN

SEQ ID NO: 3291046 - protein, 20 aa, Plasmodium falciparum
LLFTFLINTLLLPQYENFIN

SEQ ID NO: 3291047 - protein, 17 aa, Plasmodium falciparum
LLFTFLINTLVARHYEN

SEQ ID NO: 3291048 - protein, 20 aa, Plasmodium falciparum
LLFTFLINTLVLPHYENHKN

SEQ ID NO: 3291049 - protein, 18 aa, Plasmodium falciparum
LLFTLPLNILEHNQRNHK

SEQ ID NO: 3291050 - protein, 18 aa, Plasmodium falciparum
LLFTLPLNILVNGQGHYS

SEQ ID NO: 3291051 - protein, 18 aa, Plasmodium falciparum
LLFTVPLNILVTLCHVYN

SEQ ID NO: 3291052 - protein, 18 aa, Plasmodium falciparum
LLFVILLNILINDQRNHK

SEQ ID NO: 3291053 - protein, 18 aa, Plasmodium falciparum
LLFVIPLNILINDQRNHK

SEQ ID NO: 3291054 - protein, 19 aa, Plasmodium falciparum
LLFVIPLNILIYNQRNHNS

SEQ ID NO: 3291055 - protein, 19 aa, Plasmodium falciparum
LLFYILFFDECEVLRNISY

SEQ ID NO: 3291056 - protein, 22 aa, Plasmodium falciparum
LLFYLPLNILLTLYHDHYENVN

SEQ ID NO: 3291057 - protein, 37 aa, Plasmodium falciparum
LLFYLPLNILLTLYHQIIIYLYNYLHIIWFIDKCPNG

SEQ ID NO: 3291058 - protein, 22 aa, Plasmodium falciparum
LLFYLPLNVLFISYKCPNEPFH

SEQ ID NO: 3291059 - protein, 17 aa, Plasmodium falciparum
LLFYLSLNILSSSSEVY

SEQ ID NO: 3291060 - protein, 18 aa, Plasmodium falciparum
LLFYLSLNILSSSSEVYN

SEQ ID NO: 3291061 - protein, 18 aa, Plasmodium falciparum
LLGFIISLPVISYILSPY

SEQ ID NO: 3291062 - protein, 23 aa, Plasmodium falciparum
LLGIYIIIFVFLVIALFAANNMP

SEQ ID NO: 3291063 - protein, 37 aa, Plasmodium falciparum
LLHDDLQILFNLIRKQKILIYFRYDQNKKIKCKNKTQ

SEQ ID NO: 3291064 - protein, 18 aa, Plasmodium falciparum
LLHFILYLEFEMNLENLR

SEQ ID NO: 3291065 - protein, 18 aa, Plasmodium falciparum
LLHFYRNKLIYLKEKKKK

SEQ ID NO: 3291066 - protein, 24 aa, Plasmodium falciparum
LLHIKCLIPVWLYKQYKIYISLII

SEQ ID NO: 3291067 - protein, 24 aa, Plasmodium falciparum
LLHILEIFSFIKYNKAMFTYIINT

SEQ ID NO: 3291068 - protein, 23 aa, Plasmodium falciparum
LLHLYNLIKYIKNLKLDKFSHIE

SEQ ID NO: 3291069 - protein, 27 aa, Plasmodium falciparum
LLHMIINKFFVMMTYILILLKGNVLLK

SEQ ID NO: 3291070 - protein, 17 aa, Plasmodium falciparum
LLICIILGWFYNTEYQF

SEQ ID NO: 3291071 - protein, 29 aa, Plasmodium falciparum
LLICILTIKILCFINLKKLRFNIIKTETI

SEQ ID NO: 3291072 - protein, 20 aa, Plasmodium falciparum
LLICLPLNILVLSSYVHNKN

SEQ ID NO: 3291073 - protein, 18 aa, Plasmodium falciparum
LLIFIIYIVASYFPDMKI

SEQ ID NO: 3291074 - protein, 20 aa, Plasmodium falciparum
LLIFILYLKRCCKGYVLNVN

SEQ ID NO: 3291075 - protein, 19 aa, Plasmodium falciparum
LLIIIMIVCLFSVDITSSS

SEQ ID NO: 3291076 - protein, 24 aa, Plasmodium falciparum
LLIIINILIKRNVSFINFYSWIFF

SEQ ID NO: 3291077 - protein, 24 aa, Plasmodium falciparum
LLIKLMFALLFLLIALIIQGFFMI

SEQ ID NO: 3291078 - protein, 29 aa, Plasmodium falciparum
LLILAVALIILYIWLYRRRKNSWKHECKK

SEQ ID NO: 3291079 - protein, 28 aa, Plasmodium falciparum
LLILAVLLIILYIWLYRRRKNSWKHECK

SEQ ID NO: 3291080 - protein, 17 aa, Plasmodium falciparum
LLILKKKGKFNVLYEHI

SEQ ID NO: 3291081 - protein, 17 aa, Plasmodium falciparum
LLILLSTSYIDLVMVII

SEQ ID NO: 3291082 - protein, 22 aa, Plasmodium falciparum
LLILNDLIKLFFFILNEHEYME

SEQ ID NO: 3291083 - protein, 19 aa, Plasmodium falciparum
LLINKYMESIPYLSKLYKN

SEQ ID NO: 3291084 - protein, 17 aa, Plasmodium falciparum
LLIPYMKDKQKIISFFS

SEQ ID NO: 3291085 - protein, 18 aa, Plasmodium falciparum
LLISLFLTKYLKINMSRS

SEQ ID NO: 3291086 - protein, 18 aa, Plasmodium falciparum
LLIYYILTTQVTCDDNYL

SEQ ID NO: 3291087 - protein, 42 aa, Plasmodium falciparum
LLKENGNYIFKNLNLFIILLKGANYALRYLFRENFESDLNST

SEQ ID NO: 3291088 - protein, 18 aa, Plasmodium falciparum
LLKEWIIAAFHEGKNLKP

SEQ ID NO: 3291089 - protein, 27 aa, Plasmodium falciparum
LLKGSVDILLPPIYYNSNNNFKLSYTY

SEQ ID NO: 3291090 - protein, 22 aa, Plasmodium falciparum
LLKIAFFYLFNFGNNEFYILCV

SEQ ID NO: 3291091 - protein, 19 aa, Plasmodium falciparum
LLKIFKRIIKKKSNSYFLF

SEQ ID NO: 3291092 - protein, 21 aa, Plasmodium falciparum
LLKIIIFKNTLYIFDNVCTSI

SEQ ID NO: 3291093 - protein, 20 aa, Plasmodium falciparum
LLKIILNINLCDIEETIREC

SEQ ID NO: 3291094 - protein, 18 aa, Plasmodium falciparum
LLKIIYERSCIILANQYS

SEQ ID NO: 3291095 - protein, 17 aa, Plasmodium falciparum
LLKKILYIWLEKSDEMK

SEQ ID NO: 3291096 - protein, 17 aa, Plasmodium falciparum
LLKMSIKYNYVLYSPSN

SEQ ID NO: 3291097 - protein, 19 aa, Plasmodium falciparum
LLKNKELKRKIFCSLFFLL

SEQ ID NO: 3291098 - protein, 25 aa, Plasmodium falciparum
LLKQKVVNFIYWYNSSSIGHRNFVW

SEQ ID NO: 3291099 - protein, 32 aa, Plasmodium falciparum
LLKSLCSKRLVLPILGILYIILNGNFGYNGSS

SEQ ID NO: 3291100 - protein, 22 aa, Plasmodium falciparum
LLKTIKYIFLLILHQETLHKLN

SEQ ID NO: 3291101 - protein, 25 aa, Plasmodium falciparum
LLKYKELIILLYSYSYVNFRNFYFY

SEQ ID NO: 3291102 - protein, 22 aa, Plasmodium falciparum
LLKYKGLLHMPFEKGPLLNNNT

SEQ ID NO: 3291103 - protein, 19 aa, Plasmodium falciparum
LLLECFNTYIWAGYYNLNI

SEQ ID NO: 3291104 - protein, 24 aa, Plasmodium falciparum
LLLENIHFLFFDKIKLFINIFLYF

SEQ ID NO: 3291105 - protein, 20 aa, Plasmodium falciparum
LLLFAHPLNILLLSSSHVHN

SEQ ID NO: 3291106 - protein, 17 aa, Plasmodium falciparum
LLLLEKGLDDSLYTFKS

SEQ ID NO: 3291107 - protein, 20 aa, Plasmodium falciparum
LLLNIPLNILIFSSHVNDQK

SEQ ID NO: 3291108 - protein, 37 aa, Plasmodium falciparum
LLLSKTWHIYFFIMAVLIIGILLIYVNIFTLVDCIKN

SEQ ID NO: 3291109 - protein, 22 aa, Plasmodium falciparum
LLLVLSFLLLEKTFYGSDTFRV

SEQ ID NO: 3291110 - protein, 26 aa, Plasmodium falciparum
LLLVNKILNIFIYKKKFISLNNSIII

SEQ ID NO: 3291111 - protein, 17 aa, Plasmodium falciparum
LLLVYNIVIKVYGCIQN

SEQ ID NO: 3291112 - protein, 17 aa, Plasmodium falciparum
LLLWCIMGNNLPSYMTW

SEQ ID NO: 3291113 - protein, 19 aa, Plasmodium falciparum
LLLYAVNLSILLISSHINI

SEQ ID NO: 3291114 - protein, 19 aa, Plasmodium falciparum
LLLYAVNLSILLITCRINI

SEQ ID NO: 3291115 - protein, 17 aa, Plasmodium falciparum
LLMNSRSFQYHKSRNYT

SEQ ID NO: 3291116 - protein, 17 aa, Plasmodium falciparum
LLNFLFNTDKRLCRKAE

SEQ ID NO: 3291117 - protein, 21 aa, Plasmodium falciparum
LLNHRLTWTFDYLNSFLDYVN

SEQ ID NO: 3291118 - protein, 29 aa, Plasmodium falciparum
LLNIINIIFILFIFYFISKKFISKNKYLN

SEQ ID NO: 3291119 - protein, 22 aa, Plasmodium falciparum
LLNILVVCHFIISCLCRNGQTT

SEQ ID NO: 3291120 - protein, 18 aa, Plasmodium falciparum
LLNIYIIDHLKFLNISME

SEQ ID NO: 3291121 - protein, 23 aa, Plasmodium falciparum
LLNKDNFFYCKEKKLSFLHKAYK

SEQ ID NO: 3291122 - protein, 25 aa, Plasmodium falciparum
LLNKKKAYLLPYTKLYIFEQHPCVS

SEQ ID NO: 3291123 - protein, 25 aa, Plasmodium falciparum
LLNMKQIILLLYGLKFNNFMFLQFE

SEQ ID NO: 3291124 - protein, 27 aa, Plasmodium falciparum
LLNNGKILYDCFIYNIKYSYEKNLFFS

SEQ ID NO: 3291125 - protein, 21 aa, Plasmodium falciparum
LLNNILIRLYSHSFIGYGWID

SEQ ID NO: 3291126 - protein, 25 aa, Plasmodium falciparum
LLNPDYPLDTFLEKDFFMLRSHCNH

SEQ ID NO: 3291127 - protein, 23 aa, Plasmodium falciparum
LLNRYPIYLRELIKIIKTSKKRE

SEQ ID NO: 3291128 - protein, 17 aa, Plasmodium falciparum
LLNSILDLLLKDKILKY

SEQ ID NO: 3291129 - protein, 20 aa, Plasmodium falciparum
LLNSITFLRLYLTIFMLTEK

SEQ ID NO: 3291130 - protein, 17 aa, Plasmodium falciparum
LLNSMFCIFYNLWSNHM

SEQ ID NO: 3291131 - protein, 18 aa, Plasmodium falciparum
LLNTSYYHYKMKLLNNQY

SEQ ID NO: 3291132 - protein, 32 aa, Plasmodium falciparum
LLNTYGFTHVFMMYIILTYIGKNVYFITSNKS

SEQ ID NO: 3291133 - protein, 29 aa, Plasmodium falciparum
LLNVSWGYLFGSTFWLCFFSEVGLLRSLK

SEQ ID NO: 3291134 - protein, 20 aa, Plasmodium falciparum
LLNYIFFENNFYFINGKNLL

SEQ ID NO: 3291135 - protein, 24 aa, Plasmodium falciparum
LLNYLLMYDYYDMYYFCLHIKKHF

SEQ ID NO: 3291136 - protein, 18 aa, Plasmodium falciparum
LLNYYEILDKKLKDNTYI

SEQ ID NO: 3291137 - protein, 18 aa, Plasmodium falciparum
LLPLLIKYKYVNNNVFKL

SEQ ID NO: 3291138 - protein, 20 aa, Plasmodium falciparum
LLPMFHTHYHYYYDYSIYSE

SEQ ID NO: 3291139 - protein, 17 aa, Plasmodium falciparum
LLPTPKNESYKLVNSIN

SEQ ID NO: 3291140 - protein, 20 aa, Plasmodium falciparum
LLPYIYIHIFILLKHKQVEE

SEQ ID NO: 3291141 - protein, 17 aa, Plasmodium falciparum
LLQIVLVLVLCCHRIRC

SEQ ID NO: 3291142 - protein, 17 aa, Plasmodium falciparum
LLQKRNLIFFKNDKNDI

SEQ ID NO: 3291143 - protein, 45 aa, Plasmodium falciparum
LLQMKGIFCILYILIVQIYIFFINNYFYFFLKKNIKNNISDMDKI

SEQ ID NO: 3291144 - protein, 23 aa, Plasmodium falciparum
LLQNLLDYFYMICSTRNMSFYDN

SEQ ID NO: 3291145 - protein, 19 aa, Plasmodium falciparum
LLQNNILIQFKKLLQEEYN

SEQ ID NO: 3291146 - protein, 18 aa, Plasmodium falciparum
LLRDPRIKMKFLKILERH

SEQ ID NO: 3291147 - protein, 18 aa, Plasmodium falciparum
LLREIIKYIYELYTSNKN

SEQ ID NO: 3291148 - protein, 17 aa, Plasmodium falciparum
LLRRLIVPNIHLDNVIQ

SEQ ID NO: 3291149 - protein, 17 aa, Plasmodium falciparum
LLRYLFINLNKLKRRIN

SEQ ID NO: 3291150 - protein, 25 aa, Plasmodium falciparum
LLSERSLIYIYFLSLNNIDEYKNEK

SEQ ID NO: 3291151 - protein, 23 aa, Plasmodium falciparum
LLSFLLLFFLFGIIQCTHFNIGP

SEQ ID NO: 3291152 - protein, 29 aa, Plasmodium falciparum
LLSIIIVICLLVWLWPSRGKLMGKDKTEN

SEQ ID NO: 3291153 - protein, 20 aa, Plasmodium falciparum
LLSISLYIFSHANCITFMYI

SEQ ID NO: 3291154 - protein, 20 aa, Plasmodium falciparum
LLSISYFLKDSFYQSFLYLL

SEQ ID NO: 3291155 - protein, 31 aa, Plasmodium falciparum
LLSKLLLIHFILMILLKFLLFTIMEVRYVLI

SEQ ID NO: 3291156 - protein, 26 aa, Plasmodium falciparum
LLSLCLLLPLLIKYKSKYLKDILYVM

SEQ ID NO: 3291157 - protein, 17 aa, Plasmodium falciparum
LLSLKEIYKLMVDIQNK

SEQ ID NO: 3291158 - protein, 24 aa, Plasmodium falciparum
LLSLLKCINLLLLLIYNSTKKNNK

SEQ ID NO: 3291159 - protein, 18 aa, Plasmodium falciparum
LLSLYLYMKKEIEDKERT

SEQ ID NO: 3291160 - protein, 29 aa, Plasmodium falciparum
LLSMSIYHYFYFFHIFRNINYAHLTQKDK

SEQ ID NO: 3291161 - protein, 19 aa, Plasmodium falciparum
LLSRYNVSFNFVSCKSLNI

SEQ ID NO: 3291162 - protein, 31 aa, Plasmodium falciparum
LLSTDQLMFLIRYINIYLKNLYLYNVIKHRN

SEQ ID NO: 3291163 - protein, 18 aa, Plasmodium falciparum
LLSYHYYINNIPLKSYSS

SEQ ID NO: 3291164 - protein, 18 aa, Plasmodium falciparum
LLSYIPIIFSKLINRNYE

SEQ ID NO: 3291165 - protein, 19 aa, Plasmodium falciparum
LLTAAFLLPLKPFKALDYY

SEQ ID NO: 3291166 - protein, 20 aa, Plasmodium falciparum
LLTFHILLLLLIWSFYKTYK

SEQ ID NO: 3291167 - protein, 52 aa, Plasmodium falciparum
LLTIGIIIFAKFQTRLSLHWPIYASYIFIICAVILLLFFENDKLDKNSRGEH

SEQ ID NO: 3291168 - protein, 18 aa, Plasmodium falciparum
LLTKFYTLILVNIEHISK

SEQ ID NO: 3291169 - protein, 17 aa, Plasmodium falciparum
LLTLFSLLQFTGSIFFG

SEQ ID NO: 3291170 - protein, 30 aa, Plasmodium falciparum
LLTNITHLFNILYFLISAYTDAKGLYGNEE

SEQ ID NO: 3291171 - protein, 26 aa, Plasmodium falciparum
LLTNKTLIDLFPPDFDFILNFLNNSL

SEQ ID NO: 3291172 - protein, 17 aa, Plasmodium falciparum
LLTNYIVQDIFYNLINN

SEQ ID NO: 3291173 - protein, 23 aa, Plasmodium falciparum
LLTSFIIFYSYLLKHKNMEETKE

SEQ ID NO: 3291174 - protein, 23 aa, Plasmodium falciparum
LLTSIKIFIPFFSLHQINMCSVY

SEQ ID NO: 3291175 - protein, 20 aa, Plasmodium falciparum
LLVMIILPFFFNFIMYFFID

SEQ ID NO: 3291176 - protein, 19 aa, Plasmodium falciparum
LLYALNTWKPVALKAAIAA

SEQ ID NO: 3291177 - protein, 24 aa, Plasmodium falciparum
LLYEDKLYYMLNNNSLENLNYTVI

SEQ ID NO: 3291178 - protein, 30 aa, Plasmodium falciparum
LLYEEIQKWTILPVYVNYKSPEIPLAINIQ

SEQ ID NO: 3291179 - protein, 17 aa, Plasmodium falciparum
LLYFPFPSKYWAAVIPC

SEQ ID NO: 3291180 - protein, 25 aa, Plasmodium falciparum
LLYFSYLIYCIFVSSYSTSKSKENG

SEQ ID NO: 3291181 - protein, 21 aa, Plasmodium falciparum
LLYLKKWYLKNVYILNSKGYD

SEQ ID NO: 3291182 - protein, 23 aa, Plasmodium falciparum
LLYNAIINYYEYFITFIDERSDT

SEQ ID NO: 3291183 - protein, 19 aa, Plasmodium falciparum
LLYRSFYFILLLLSFILFH

SEQ ID NO: 3291184 - protein, 28 aa, Plasmodium falciparum
LLYSKNIFFYFFVPLYNHFLRNENIYVF

SEQ ID NO: 3291185 - protein, 21 aa, Plasmodium falciparum
LMDVWICEDFEYSRGIFLYAT

SEQ ID NO: 3291186 - protein, 19 aa, Plasmodium falciparum
LMENEISMLLKSSFSSFIL

SEQ ID NO: 3291187 - protein, 25 aa, Plasmodium falciparum
LMFNLFNTFTLSLSIYRCKYALVPL

SEQ ID NO: 3291188 - protein, 20 aa, Plasmodium falciparum
LMHLIICSIVSFVLLICILN

SEQ ID NO: 3291189 - protein, 26 aa, Plasmodium falciparum
LMIGTLTGLQWWIYDTFKSVMGLGTS

SEQ ID NO: 3291190 - protein, 17 aa, Plasmodium falciparum
LMIITKKHIYYISKNTR

SEQ ID NO: 3291191 - protein, 21 aa, Plasmodium falciparum
LMINFYINMLIEKFLEKKKYM

SEQ ID NO: 3291192 - protein, 38 aa, Plasmodium falciparum
LMKISIAQYFLISGFVFFLFFMCFYLFDENLLKTYEDE

SEQ ID NO: 3291193 - protein, 28 aa, Plasmodium falciparum
LMLERQKIRWLQWINRNKYMLEKWNKEE

SEQ ID NO: 3291194 - protein, 23 aa, Plasmodium falciparum
LMNKHFVMFLKKFNSFYFKHHIN

SEQ ID NO: 3291195 - protein, 18 aa, Plasmodium falciparum
LMNKLNFSLCFFHALIQE

SEQ ID NO: 3291196 - protein, 17 aa, Plasmodium falciparum
LMNYKNINANIIDLFSV

SEQ ID NO: 3291197 - protein, 25 aa, Plasmodium falciparum
LMRKNIIEILSVLLKKKYKNEPFFT

SEQ ID NO: 3291198 - protein, 24 aa, Plasmodium falciparum
LMTIEKYVLFFKKTNLNYFNNKDV

SEQ ID NO: 3291199 - protein, 41 aa, Plasmodium falciparum
LMTNTWFFISHVVLWIELIATFFFWFIISNTKFFLDIIGAD

SEQ ID NO: 3291200 - protein, 20 aa, Plasmodium falciparum
LMVRLLLIFSPFSCILSSIG

SEQ ID NO: 3291201 - protein, 17 aa, Plasmodium falciparum
LMYYYRDKIYNIETSAD

SEQ ID NO: 3291202 - protein, 40 aa, Plasmodium falciparum
LNAEKIINILFFKLNKDYFLIIFLTGRPILIYKSFFSIKK

SEQ ID NO: 3291203 - protein, 29 aa, Plasmodium falciparum
LNCDKKNYFFLYLFINDILLFYEEEKNFF

SEQ ID NO: 3291204 - protein, 19 aa, Plasmodium falciparum
LNCKCLNTILYYLKEFFKD

SEQ ID NO: 3291205 - protein, 27 aa, Plasmodium falciparum
LNCKYSFMVYTLYIIVNALFNISVSSF

SEQ ID NO: 3291206 - protein, 25 aa, Plasmodium falciparum
LNCLMHIVVLIKMYFFTSESVYTKG

SEQ ID NO: 3291207 - protein, 53 aa, Plasmodium falciparum
LNCYDYICILIFWLFFFDLVVLSPFSLIFVHLFFCIFFISLSYKYGKFVPPYY

SEQ ID NO: 3291208 - protein, 19 aa, Plasmodium falciparum
LNDGSFYFINITKHKILLY

SEQ ID NO: 3291209 - protein, 29 aa, Plasmodium falciparum
LNDHIKIMKWLFEKYLLSEYISGNIFSGS

SEQ ID NO: 3291210 - protein, 17 aa, Plasmodium falciparum
LNDIYNFIILYIDYIYN

SEQ ID NO: 3291211 - protein, 25 aa, Plasmodium falciparum
LNDKNLIFLIKYMNKLKLFYINLNL

SEQ ID NO: 3291212 - protein, 38 aa, Plasmodium falciparum
LNDKNYYFLAFVNNNLLFFLYFYSKYKTILDYVSNENV

SEQ ID NO: 3291213 - protein, 18 aa, Plasmodium falciparum
LNDLISCLVWINDSLFLT

SEQ ID NO: 3291214 - protein, 21 aa, Plasmodium falciparum
LNDLLQDNYFKKLYDRNIKKM

SEQ ID NO: 3291215 - protein, 23 aa, Plasmodium falciparum
LNDNIIIQLYLDILRDFKNTIYF

SEQ ID NO: 3291216 - protein, 33 aa, Plasmodium falciparum
LNDTLPCYVLIMILSIPYILLELVQLTYCTPIK

SEQ ID NO: 3291217 - protein, 38 aa, Plasmodium falciparum
LNDYTTFKVFLEYWLDDFLYGYYLLKKRKIIEKCTQKE

SEQ ID NO: 3291218 - protein, 34 aa, Plasmodium falciparum
LNDYTTFKVLLIYWLEDFIEGYYILKKRKVFEQC

SEQ ID NO: 3291219 - protein, 23 aa, Plasmodium falciparum
LNECMDFLALLYIAKNEKSKLML

SEQ ID NO: 3291220 - protein, 21 aa, Plasmodium falciparum
LNECMNVLNILLYNNKDLSFP

SEQ ID NO: 3291221 - protein, 20 aa, Plasmodium falciparum
LNEEIIMLKSIKIKNNNFIK

SEQ ID NO: 3291222 - protein, 28 aa, Plasmodium falciparum
LNEFASRPSFLRWMTEWGDQFCRERITQ

SEQ ID NO: 3291223 - protein, 23 aa, Plasmodium falciparum
LNELYVMIYMRLLFECSLKLISI

SEQ ID NO: 3291224 - protein, 31 aa, Plasmodium falciparum
LNETIINFYISYFKIIKLLFSKIDMNKFEKK

SEQ ID NO: 3291225 - protein, 32 aa, Plasmodium falciparum
LNEVTKLIYVYTWCILYIFGHSYSYVKYAKYF

SEQ ID NO: 3291226 - protein, 38 aa, Plasmodium falciparum
LNEYTTFKVLIVYWLEDFLYSYYILKKKIELCTQNKEQ

SEQ ID NO: 3291227 - protein, 26 aa, Plasmodium falciparum
LNEYVQFVFLNSYINSIFLIEQIHID

SEQ ID NO: 3291228 - protein, 29 aa, Plasmodium falciparum
LNFCSDDFFFILKFSYNYVFLLNIQKKKN

SEQ ID NO: 3291229 - protein, 19 aa, Plasmodium falciparum
LNFDVILLQIWDSNTAYNR

SEQ ID NO: 3291230 - protein, 27 aa, Plasmodium falciparum
LNFLHIPHYDFLFDGYRRRSLSLTYGR

SEQ ID NO: 3291231 - protein, 28 aa, Plasmodium falciparum
LNFLKSIYFNLFVSLSFVLQYIPLNVQY

SEQ ID NO: 3291232 - protein, 23 aa, Plasmodium falciparum
LNFNTVYTFLFWPENEYLEDEYD

SEQ ID NO: 3291233 - protein, 18 aa, Plasmodium falciparum
LNFPLNKKLFYVTQTTLS

SEQ ID NO: 3291234 - protein, 31 aa, Plasmodium falciparum
LNFTLDDKIIFKLIFFYYHYKDYVDHIFEKF

SEQ ID NO: 3291235 - protein, 19 aa, Plasmodium falciparum
LNGFIKSNLDLLKPFNIND

SEQ ID NO: 3291236 - protein, 18 aa, Plasmodium falciparum
LNHKPYVSFLNMSYYNED

SEQ ID NO: 3291237 - protein, 17 aa, Plasmodium falciparum
LNHMMLTHNLYVSGVDN

SEQ ID NO: 3291238 - protein, 32 aa, Plasmodium falciparum
LNHSVLLYIIRTIIILFLLIDYNHINKHNIII

SEQ ID NO: 3291239 - protein, 25 aa, Plasmodium falciparum
LNHVREYWWALNRDQVWKAITCDAD

SEQ ID NO: 3291240 - protein, 19 aa, Plasmodium falciparum
LNIALVITFIIIFSNIHIN

SEQ ID NO: 3291241 - protein, 19 aa, Plasmodium falciparum
LNIDINLFIHILNNNIKLK

SEQ ID NO: 3291242 - protein, 17 aa, Plasmodium falciparum
LNIIFSLTKYYLTSSFF

SEQ ID NO: 3291243 - protein, 35 aa, Plasmodium falciparum
LNIIKKHKSIYTKIQKIYYFYNNYIKYMNSTKYYL

SEQ ID NO: 3291244 - protein, 27 aa, Plasmodium falciparum
LNIIKRNPMVYLWIKSSNPFKKKRFDK

SEQ ID NO: 3291245 - protein, 22 aa, Plasmodium falciparum
LNIIMDFIKFNMLINCVNYLFL

SEQ ID NO: 3291246 - protein, 24 aa, Plasmodium falciparum
LNILFFIWFVLLYELFFDNLSKPE

SEQ ID NO: 3291247 - protein, 28 aa, Plasmodium falciparum
LNILKNRWFLILLKYFMHKYATYANVFE

SEQ ID NO: 3291248 - protein, 26 aa, Plasmodium falciparum
LNILTDVYLFLPLEYHPYIYNNTEDI

SEQ ID NO: 3291249 - protein, 25 aa, Plasmodium falciparum
LNINITLKDLLYLINKFKEINYFIT

SEQ ID NO: 3291250 - protein, 27 aa, Plasmodium falciparum
LNINSNNLFFFLRSKIRKTQNYILNNN

SEQ ID NO: 3291251 - protein, 27 aa, Plasmodium falciparum
LNIPEGLFLNIKYLYYSFDINNDMLLN

SEQ ID NO: 3291252 - protein, 25 aa, Plasmodium falciparum
LNIQDYYTICLYIKKIILINSISVK

SEQ ID NO: 3291253 - protein, 26 aa, Plasmodium falciparum
LNIQENFFKYLTKLLFILFEYCKENN

SEQ ID NO: 3291254 - protein, 28 aa, Plasmodium falciparum
LNIREIMDLFFVDYELIPYFISENYTNV

SEQ ID NO: 3291255 - protein, 24 aa, Plasmodium falciparum
LNIRFHPFFYIYDKDYENVKNIFD

SEQ ID NO: 3291256 - protein, 45 aa, Plasmodium falciparum
LNIRKILRIMRELYIGFIGLQLIYFITYILFGNNNVYLIQIISMS

SEQ ID NO: 3291257 - protein, 23 aa, Plasmodium falciparum
LNIYLPLYIIVEINKIIKASKII

SEQ ID NO: 3291258 - protein, 17 aa, Plasmodium falciparum
LNIYLYNENPRTNGQYV

SEQ ID NO: 3291259 - protein, 35 aa, Plasmodium falciparum
LNKFKIYCVLGLKVLRTFLIKYLRSIKLCIPVEVR

SEQ ID NO: 3291260 - protein, 24 aa, Plasmodium falciparum
LNKIKYNLIFILKSFSQNNNLHHL

SEQ ID NO: 3291261 - protein, 26 aa, Plasmodium falciparum
LNKKKKYIYFPPFITLIMDERRKKKQ

SEQ ID NO: 3291262 - protein, 22 aa, Plasmodium falciparum
LNKKYSFLKYYSSYKTYNVYEG

SEQ ID NO: 3291263 - protein, 23 aa, Plasmodium falciparum
LNKRLICVFVYSFDNDLKKNIKL

SEQ ID NO: 3291264 - protein, 23 aa, Plasmodium falciparum
LNKSCFYFLKNILNNCTCENKNK

SEQ ID NO: 3291265 - protein, 28 aa, Plasmodium falciparum
LNKSLNFIVCTWGINILKKKSPAKYSSS

SEQ ID NO: 3291266 - protein, 24 aa, Plasmodium falciparum
LNKYDIYYKDYLYDYYKECNNNIN

SEQ ID NO: 3291267 - protein, 26 aa, Plasmodium falciparum
LNKYTIIYIYECLYTLLNIYHYNNNN

SEQ ID NO: 3291268 - protein, 35 aa, Plasmodium falciparum
LNKYTTFKVFLLYWLEDFLYGYYISKKRKIVEKCT

SEQ ID NO: 3291269 - protein, 18 aa, Plasmodium falciparum
LNLFTYIIAIFLALQIYD

SEQ ID NO: 3291270 - protein, 25 aa, Plasmodium falciparum
LNLHIMLYDYFLPKMFYLFAIHLIF

SEQ ID NO: 3291271 - protein, 20 aa, Plasmodium falciparum
LNLIISIIVRLVLDINSFFF

SEQ ID NO: 3291272 - protein, 19 aa, Plasmodium falciparum
LNLISVFISILIISLIIFI

SEQ ID NO: 3291273 - protein, 21 aa, Plasmodium falciparum
LNLLINVIFILCNIKRKNKFL

SEQ ID NO: 3291274 - protein, 19 aa, Plasmodium falciparum
LNLLPLQVFFKCRDKIQTI

SEQ ID NO: 3291275 - protein, 23 aa, Plasmodium falciparum
LNLNYIFLIFSTLCRPTIFQCKK

SEQ ID NO: 3291276 - protein, 26 aa, Plasmodium falciparum
LNLTEYFVQILIKNTNFIQAYVYTNN

SEQ ID NO: 3291277 - protein, 18 aa, Plasmodium falciparum
LNMAFYEYGINFFDICEY

SEQ ID NO: 3291278 - protein, 18 aa, Plasmodium falciparum
LNMFEYFFVITNKKDHID

SEQ ID NO: 3291279 - protein, 24 aa, Plasmodium falciparum
LNMGRPYMFTPRQYPQMNNVNMNV

SEQ ID NO: 3291280 - protein, 28 aa, Plasmodium falciparum
LNNEIKFFILNIFLHHLTYTKTSENLLN

SEQ ID NO: 3291281 - protein, 24 aa, Plasmodium falciparum
LNNFFQLILYCMLNAFYYNMDYVC

SEQ ID NO: 3291282 - protein, 25 aa, Plasmodium falciparum
LNNFSAYYKTYIHNDIFGDPNNGLR

SEQ ID NO: 3291283 - protein, 25 aa, Plasmodium falciparum
LNNHDYMIEFLKHPKFYASKKVKES

SEQ ID NO: 3291284 - protein, 28 aa, Plasmodium falciparum
LNNIFCNILITFIFLINDFKKGDTFLNM

SEQ ID NO: 3291285 - protein, 17 aa, Plasmodium falciparum
LNNILNSFFKNIKMFHY

SEQ ID NO: 3291286 - protein, 25 aa, Plasmodium falciparum
LNNINELIVCNIYFFLNIYENSKIK

SEQ ID NO: 3291287 - protein, 60 aa, Plasmodium falciparum
LNNITYIQNNLFIYISLFKSVLFIISEILFFIDPTNNLYFEILTLLKLKAQNQSYVEFDT

SEQ ID NO: 3291288 - protein, 24 aa, Plasmodium falciparum
LNNIYFAMDFLTSCQISLTKSDMT

SEQ ID NO: 3291289 - protein, 37 aa, Plasmodium falciparum
LNNKDIFHSYFFSFVLYFSFIYKHDTEFLLLYINMYN

SEQ ID NO: 3291290 - protein, 23 aa, Plasmodium falciparum
LNNKNICFYIFKKYIKFMYLIFN

SEQ ID NO: 3291291 - protein, 25 aa, Plasmodium falciparum
LNNLFNNIFNIFKKKYETYVDMKTI

SEQ ID NO: 3291292 - protein, 26 aa, Plasmodium falciparum
LNNLFNNIFNIFKKKYETYVDMKTIE

SEQ ID NO: 3291293 - protein, 29 aa, Plasmodium falciparum
LNNLLIILRTYFFIFQELNIYIYNFVTLH

SEQ ID NO: 3291294 - protein, 19 aa, Plasmodium falciparum
LNNNILKNFEYFFDKDICK

SEQ ID NO: 3291295 - protein, 17 aa, Plasmodium falciparum
LNNSYILKKDLSFNNEI

SEQ ID NO: 3291296 - protein, 36 aa, Plasmodium falciparum
LNPNDFFYFIIIHVIIILSIIFLLYLHTYKKNKQNI

SEQ ID NO: 3291297 - protein, 22 aa, Plasmodium falciparum
LNPSKIILLVKLYLENNNFHNY

SEQ ID NO: 3291298 - protein, 19 aa, Plasmodium falciparum
LNPTWLNLYGFHKKEFDLE

SEQ ID NO: 3291299 - protein, 31 aa, Plasmodium falciparum
LNQFDDLLVKILLLAAFISFVLTLLDMKHKK

SEQ ID NO: 3291300 - protein, 23 aa, Plasmodium falciparum
LNQINLFHTWLDRHRDMCEKLKN

SEQ ID NO: 3291301 - protein, 23 aa, Plasmodium falciparum
LNQINLFHTWLDRHRDMCEQWDT

SEQ ID NO: 3291302 - protein, 27 aa, Plasmodium falciparum
LNQRNIFFDRNYFFVKKLYNDQKKNIQ

SEQ ID NO: 3291303 - protein, 32 aa, Plasmodium falciparum
LNRFSLCKVFLWIIYLKITVVSFYFFHNFDNY

SEQ ID NO: 3291304 - protein, 18 aa, Plasmodium falciparum
LNRKDQITFLKKICLLLN

SEQ ID NO: 3291305 - protein, 25 aa, Plasmodium falciparum
LNRMNFLFVIKYVSTFILMFAYSLY

SEQ ID NO: 3291306 - protein, 24 aa, Plasmodium falciparum
LNRNKYFFLEYKLNNDYYGKKSYV

SEQ ID NO: 3291307 - protein, 26 aa, Plasmodium falciparum
LNRQDALIHLLNYVWPNIFETSPHLI

SEQ ID NO: 3291308 - protein, 21 aa, Plasmodium falciparum
LNSFIKLFYIKKKKLKKNFYD

SEQ ID NO: 3291309 - protein, 24 aa, Plasmodium falciparum
LNSIKFKIHYLYTSKMLIHTMNIL

SEQ ID NO: 3291310 - protein, 22 aa, Plasmodium falciparum
LNSIMFLTVVYKIIMSTLNIIF

SEQ ID NO: 3291311 - protein, 27 aa, Plasmodium falciparum
LNSKIIMKFYKFSYNFFYLLYEMERDF

SEQ ID NO: 3291312 - protein, 22 aa, Plasmodium falciparum
LNSLILMQILRVLRLLRKNTNT

SEQ ID NO: 3291313 - protein, 17 aa, Plasmodium falciparum
LNSLKYHIKNELIWLIY

SEQ ID NO: 3291314 - protein, 27 aa, Plasmodium falciparum
LNSQNRYIQILFYKVLCNFIKCKVQTL

SEQ ID NO: 3291315 - protein, 17 aa, Plasmodium falciparum
LNSQYFKYIYIIDNIKK

SEQ ID NO: 3291316 - protein, 32 aa, Plasmodium falciparum
LNSSSYLILKPQINGPWYQIYKNRITQLKQAT

SEQ ID NO: 3291317 - protein, 25 aa, Plasmodium falciparum
LNSTNVLDLLYYLISLTDINICYMH

SEQ ID NO: 3291318 - protein, 30 aa, Plasmodium falciparum
LNSYNMFGKILLYNNKYNYFNFDKYNNYDI

SEQ ID NO: 3291319 - protein, 29 aa, Plasmodium falciparum
LNTEFSILFIILILMFLTATCILHVVYGI

SEQ ID NO: 3291320 - protein, 24 aa, Plasmodium falciparum
LNTEPNILYFDKPEEKPFITSIHD

SEQ ID NO: 3291321 - protein, 35 aa, Plasmodium falciparum
LNTLEIILFIYIMRKDRLFYYIYSQLKNYLDLTET

SEQ ID NO: 3291322 - protein, 33 aa, Plasmodium falciparum
LNTLVFYYSFFYFFYIFFFNKKLYMNNYLYEYY

SEQ ID NO: 3291323 - protein, 23 aa, Plasmodium falciparum
LNTNFMFFHYLSQNEYSFRNSIL

SEQ ID NO: 3291324 - protein, 29 aa, Plasmodium falciparum
LNTQYKFYHIFINYKLLILTMITLFTTIT

SEQ ID NO: 3291325 - protein, 26 aa, Plasmodium falciparum
LNTYDNLLFCNFLNLYQKIYEQVYDI

SEQ ID NO: 3291326 - protein, 19 aa, Plasmodium falciparum
LNVINKYIYPFTCPNQNTK

SEQ ID NO: 3291327 - protein, 21 aa, Plasmodium falciparum
LNVIRIIYTVILFRLHKKLTE

SEQ ID NO: 3291328 - protein, 18 aa, Plasmodium falciparum
LNVLYMFFVMYNQSTYYV

SEQ ID NO: 3291329 - protein, 25 aa, Plasmodium falciparum
LNVMSFYQFIFQSILKYENYYYPYF

SEQ ID NO: 3291330 - protein, 17 aa, Plasmodium falciparum
LNWKKYIDNINKGMFYW

SEQ ID NO: 3291331 - protein, 40 aa, Plasmodium falciparum
LNYDEKIVFFSNLLLKNLIKSFRIVLLLKSLIKENRWNIG

SEQ ID NO: 3291332 - protein, 32 aa, Plasmodium falciparum
LNYENLIISHLFLYFCFSFLYNFKYNEFIIDI

SEQ ID NO: 3291333 - protein, 65 aa, Plasmodium falciparum
LNYENWSAHYFLKLPIFVILMIVFSLNAFIYLLIRFFIYFFENTSFWMITKYKDFHFFVRKKRNG

SEQ ID NO: 3291334 - protein, 32 aa, Plasmodium falciparum
LNYGSMFFPFNIIFKKLIFTNLIKLPYEDYIE

SEQ ID NO: 3291335 - protein, 27 aa, Plasmodium falciparum
LNYIYDDVLILYLKLLPILEKELLEKR

SEQ ID NO: 3291336 - protein, 25 aa, Plasmodium falciparum
LNYIYVDLFNIHKSKYKFKILEKIF

SEQ ID NO: 3291337 - protein, 17 aa, Plasmodium falciparum
LNYKAYFDKLKDLYENI

SEQ ID NO: 3291338 - protein, 18 aa, Plasmodium falciparum
LNYKILHDKLIKKNIKKY

SEQ ID NO: 3291339 - protein, 18 aa, Plasmodium falciparum
LNYLFFDNLNGVRSNNIS

SEQ ID NO: 3291340 - protein, 34 aa, Plasmodium falciparum
LNYMDIYDKLFIYKYLIILNYKNEYIINIIHDHL

SEQ ID NO: 3291341 - protein, 25 aa, Plasmodium falciparum
LNYNFEYFFLLFLNIHYFISFIKHF

SEQ ID NO: 3291342 - protein, 28 aa, Plasmodium falciparum
LNYNKNKLELLYNLYLQHNRLKEQLHAD

SEQ ID NO: 3291343 - protein, 26 aa, Plasmodium falciparum
LNYSLQKLIINFLYDCIYFTMKYEKK

SEQ ID NO: 3291344 - protein, 24 aa, Plasmodium falciparum
LNYYNINNLLFLKLLNMCELLLIK

SEQ ID NO: 3291345 - protein, 18 aa, Plasmodium falciparum
LPDNKRLLIKPDGNPYEI

SEQ ID NO: 3291346 - protein, 30 aa, Plasmodium falciparum
LPEIFYIRWYWFFLTIMTLGIPWVIPKLKH

SEQ ID NO: 3291347 - protein, 26 aa, Plasmodium falciparum
LPELFEFYIHICGPILHFDNLTNGIV

SEQ ID NO: 3291348 - protein, 30 aa, Plasmodium falciparum
LPHESIPELIYRIFWKYFSQNFNIINETFF

SEQ ID NO: 3291349 - protein, 30 aa, Plasmodium falciparum
LPIKCNINLFYYYIENDIFYFIPLSKRKNV

SEQ ID NO: 3291350 - protein, 23 aa, Plasmodium falciparum
LPISNFSFLFDKIKDLDFDFFTC

SEQ ID NO: 3291351 - protein, 21 aa, Plasmodium falciparum
LPKMFYLFAIHLIFIIFCLLV

SEQ ID NO: 3291352 - protein, 18 aa, Plasmodium falciparum
LPLENYFKLINDYKIRKR

SEQ ID NO: 3291353 - protein, 25 aa, Plasmodium falciparum
LPNINKIISVLFMYGLHPNFAVSFL

SEQ ID NO: 3291354 - protein, 28 aa, Plasmodium falciparum
LPSTFMIKYYLYLNNVIHNIDMSNFFVA

SEQ ID NO: 3291355 - protein, 17 aa, Plasmodium falciparum
LPTFYITDILELLHKIF

SEQ ID NO: 3291356 - protein, 18 aa, Plasmodium falciparum
LPTIFAHLILFNEKEAKD

SEQ ID NO: 3291357 - protein, 31 aa, Plasmodium falciparum
LPTVLYNLFEFLRTLGVWLTLLGRLKNDYTD

SEQ ID NO: 3291358 - protein, 28 aa, Plasmodium falciparum
LPVVVSTLKLLHILIEKFDKDIYNTVKN

SEQ ID NO: 3291359 - protein, 27 aa, Plasmodium falciparum
LPYIYSPFYFNTKIIKFLLFVYSTYCC

SEQ ID NO: 3291360 - protein, 26 aa, Plasmodium falciparum
LPYQTLHIHWSFIPLTYGLITLPNVL

SEQ ID NO: 3291361 - protein, 21 aa, Plasmodium falciparum
LQDIALLYRKENVKLLVVGVS

SEQ ID NO: 3291362 - protein, 33 aa, Plasmodium falciparum
LQEKICDYFVIVIKIYLLQKRHKPIYKKYNKVK

SEQ ID NO: 3291363 - protein, 27 aa, Plasmodium falciparum
LQEKNHFYNYYYSNELSLFIFNAIMSL

SEQ ID NO: 3291364 - protein, 21 aa, Plasmodium falciparum
LQGEMQYLYEELQIVYDENQA

SEQ ID NO: 3291365 - protein, 18 aa, Plasmodium falciparum
LQHDNLFNKINPLSSDNT

SEQ ID NO: 3291366 - protein, 20 aa, Plasmodium falciparum
LQHKINNLMIISFDKNKSSD

SEQ ID NO: 3291367 - protein, 27 aa, Plasmodium falciparum
LQIINKDNFYLAEELMILIFQKEEKLY

SEQ ID NO: 3291368 - protein, 26 aa, Plasmodium falciparum
LQIKIKNVFFFFYTCNMNMYIGIFIT

SEQ ID NO: 3291369 - protein, 26 aa, Plasmodium falciparum
LQILYYLINIFVYKNWKIYKYKEKKN

SEQ ID NO: 3291370 - protein, 18 aa, Plasmodium falciparum
LQKDSLLSNLSKFKFNEE

SEQ ID NO: 3291371 - protein, 23 aa, Plasmodium falciparum
LQKFDYLPFHNQKFVITGVFKNF

SEQ ID NO: 3291372 - protein, 18 aa, Plasmodium falciparum
LQKLYIFPKVRMKNYVKY

SEQ ID NO: 3291373 - protein, 24 aa, Plasmodium falciparum
LQKMLYLCVYNIIYLLKKIKINFM

SEQ ID NO: 3291374 - protein, 32 aa, Plasmodium falciparum
LQKQQNDLFSENWLYFLPSSSDYLLNEKKKNL

SEQ ID NO: 3291375 - protein, 32 aa, Plasmodium falciparum
LQKSGTIPLDFLRLMFYTLGDYRDILVRGVAD

SEQ ID NO: 3291376 - protein, 23 aa, Plasmodium falciparum
LQKTFIMLIIVLVSLILFGFYFP

SEQ ID NO: 3291377 - protein, 25 aa, Plasmodium falciparum
LQKVKIFYLFNFIKQLKILDLYQKV

SEQ ID NO: 3291378 - protein, 37 aa, Plasmodium falciparum
LQLFEYLKVDLGNRIFFFIIFFSFHSFQFLYQFFMNM

SEQ ID NO: 3291379 - protein, 25 aa, Plasmodium falciparum
LQLFNRYFIELMNLSKLYPNMTLCF

SEQ ID NO: 3291380 - protein, 27 aa, Plasmodium falciparum
LQLTYFEYVILNLFKYLYKKKPWLNHK

SEQ ID NO: 3291381 - protein, 39 aa, Plasmodium falciparum
LQNALLSSTIMWSIGIGFAAFTYFFLKKKTKSSVGNLFQ

SEQ ID NO: 3291382 - protein, 17 aa, Plasmodium falciparum
LQNFYYNQTIVNLSNLL

SEQ ID NO: 3291383 - protein, 17 aa, Plasmodium falciparum
LQNIFILPKQKKVILCC

SEQ ID NO: 3291384 - protein, 20 aa, Plasmodium falciparum
LQNIIYINCILKKGYYDLKI

SEQ ID NO: 3291385 - protein, 36 aa, Plasmodium falciparum
LQNIKYLMNYIFIKIVYFFHIHKLYTFPIYKDERKK

SEQ ID NO: 3291386 - protein, 27 aa, Plasmodium falciparum
LQNNKIYVPIYNYSISQYKYYNSLKGT

SEQ ID NO: 3291387 - protein, 26 aa, Plasmodium falciparum
LQNVNVYVFILFYLLCLKNHTKEYDI

SEQ ID NO: 3291388 - protein, 25 aa, Plasmodium falciparum
LQNYSFLIHNLFNENMYTLVLIRFI

SEQ ID NO: 3291389 - protein, 18 aa, Plasmodium falciparum
LQRGDIPDGFLRQMFYTL

SEQ ID NO: 3291390 - protein, 60 aa, Plasmodium falciparum
LQRNKYVDIFFYLSKNLFYFVKYVFLYFADIYIGFSNISLYFLKVLKILYTKGLCRDVDH

SEQ ID NO: 3291391 - protein, 24 aa, Plasmodium falciparum
LQRQKIIWRKWIAKNLYHIESNVM

SEQ ID NO: 3291392 - protein, 27 aa, Plasmodium falciparum
LQSLFKNFTLFFLMFSKNYVINNSIFF

SEQ ID NO: 3291393 - protein, 17 aa, Plasmodium falciparum
LQTMGIVLKYWSKIRNI

SEQ ID NO: 3291394 - protein, 34 aa, Plasmodium falciparum
LQVKDLYNYLYKKTLFFFFIKRMNNVILEIKTKF

SEQ ID NO: 3291395 - protein, 19 aa, Plasmodium falciparum
LQVQKVLLIKKIEDLRKIE

SEQ ID NO: 3291396 - protein, 17 aa, Plasmodium falciparum
LQYIVLSIHSSKLFLNF

SEQ ID NO: 3291397 - protein, 18 aa, Plasmodium falciparum
LQYSYYDKIIYEKEMNLF

SEQ ID NO: 3291398 - protein, 26 aa, Plasmodium falciparum
LRDDKKEFNFIPFFNTNIFGKNFRYS

SEQ ID NO: 3291399 - protein, 25 aa, Plasmodium falciparum
LRDVEILLQYLTVPYIRIPLILEFF

SEQ ID NO: 3291400 - protein, 33 aa, Plasmodium falciparum
LREAFINCAAIETFWLWYKYKKDKNVDAEKKLE

SEQ ID NO: 3291401 - protein, 23 aa, Plasmodium falciparum
LREDFELLKKSRKLYDIPKVIFK

SEQ ID NO: 3291402 - protein, 17 aa, Plasmodium falciparum
LREDWWTANRETVWKAI

SEQ ID NO: 3291403 - protein, 17 aa, Plasmodium falciparum
LRERPYKKWIDHYSIHM

SEQ ID NO: 3291404 - protein, 34 aa, Plasmodium falciparum
LRFCFSFYFYVQLFIIYLFIWTENKYNEYGGDKN

SEQ ID NO: 3291405 - protein, 18 aa, Plasmodium falciparum
LRFLINKFGQKYIKIIKN

SEQ ID NO: 3291406 - protein, 24 aa, Plasmodium falciparum
LRFSVYFCVFLFLYMFSLCIESYK

SEQ ID NO: 3291407 - protein, 24 aa, Plasmodium falciparum
LRGNIVLFIVYMIRYENMFCYVVN

SEQ ID NO: 3291408 - protein, 22 aa, Plasmodium falciparum
LRGVVLMLTTYILTIATEYEST

SEQ ID NO: 3291409 - protein, 23 aa, Plasmodium falciparum
LRINKKHRIIRNKKLNFSSLRKK

SEQ ID NO: 3291410 - protein, 18 aa, Plasmodium falciparum
LRISFNFTYFFSAEFFFF

SEQ ID NO: 3291411 - protein, 28 aa, Plasmodium falciparum
LRIVRCIRFCGFFNFFLEKSIFNVLKNE

SEQ ID NO: 3291412 - protein, 22 aa, Plasmodium falciparum
LRKFNIEWFMFVADKQENIRTL

SEQ ID NO: 3291413 - protein, 17 aa, Plasmodium falciparum
LRKIMKIVYLPIKKGSI

SEQ ID NO: 3291414 - protein, 28 aa, Plasmodium falciparum
LRKNEYFFNNIILIIAYKNKYLNTKNNV

SEQ ID NO: 3291415 - protein, 23 aa, Plasmodium falciparum
LRKNKFFSKFLSKKNRKIFKKKL

SEQ ID NO: 3291416 - protein, 25 aa, Plasmodium falciparum
LRLLASRLDFNLYYVRLSKGSDRKI

SEQ ID NO: 3291417 - protein, 22 aa, Plasmodium falciparum
LRLLFIPWFILNACVDHPFFKN

SEQ ID NO: 3291418 - protein, 19 aa, Plasmodium falciparum
LRNFIRYLLKINENKDIKV

SEQ ID NO: 3291419 - protein, 17 aa, Plasmodium falciparum
LRNFWANSITDAVLCNM

SEQ ID NO: 3291420 - protein, 24 aa, Plasmodium falciparum
LRNIRIDNIFLLKNHFNLIYGLRN

SEQ ID NO: 3291421 - protein, 23 aa, Plasmodium falciparum
LRNISMDYILRQKLNGYAVGGLC

SEQ ID NO: 3291422 - protein, 18 aa, Plasmodium falciparum
LRNLAKCLPRVSGVWYDL

SEQ ID NO: 3291423 - protein, 19 aa, Plasmodium falciparum
LRNVYFFMNFLKNNKNTLK

SEQ ID NO: 3291424 - protein, 23 aa, Plasmodium falciparum
LRNYSTFFFYKNYEHYIQYIVNK

SEQ ID NO: 3291425 - protein, 23 aa, Plasmodium falciparum
LRNYYNLYRYTLYYRYKTKKTYN

SEQ ID NO: 3291426 - protein, 20 aa, Plasmodium falciparum
LRQIHFLFTPIYISIFNKYM

SEQ ID NO: 3291427 - protein, 35 aa, Plasmodium falciparum
LRSALDLRFIRKYKLYKYFFFLKNMIKSTKFKNKK

SEQ ID NO: 3291428 - protein, 17 aa, Plasmodium falciparum
LRSDAIQLLLELNIKEE

SEQ ID NO: 3291429 - protein, 19 aa, Plasmodium falciparum
LRSFIKRNSVRPKNAYSSN

SEQ ID NO: 3291430 - protein, 25 aa, Plasmodium falciparum
LRSIFMRILYFLTSNISSIIIFCVS

SEQ ID NO: 3291431 - protein, 20 aa, Plasmodium falciparum
LRSWEFHYFLNKIVMIRRTI

SEQ ID NO: 3291432 - protein, 29 aa, Plasmodium falciparum
LRTDIYDFIILQLRILSISYRLPTQKIGF

SEQ ID NO: 3291433 - protein, 20 aa, Plasmodium falciparum
LRTITYIVLLLLHYDTFKKL

SEQ ID NO: 3291434 - protein, 42 aa, Plasmodium falciparum
LRYNDSIVIIWLIRSIYLFIITYIWIILKTKLKEYKNNSSKM

SEQ ID NO: 3291435 - protein, 26 aa, Plasmodium falciparum
LRYVHLVYYFIIISFCIHNNISCFNV

SEQ ID NO: 3291436 - protein, 19 aa, Plasmodium falciparum
LSCLCFFPNLKYIKKSETN

SEQ ID NO: 3291437 - protein, 31 aa, Plasmodium falciparum
LSCTLFVYFLYIHFFLLKQNNFCDVKVRERI

SEQ ID NO: 3291438 - protein, 23 aa, Plasmodium falciparum
LSCYIILNILLLSSQINIQWNLY

SEQ ID NO: 3291439 - protein, 30 aa, Plasmodium falciparum
LSCYSESFLFLYRIFKIKKAFLESYKLKKI

SEQ ID NO: 3291440 - protein, 27 aa, Plasmodium falciparum
LSDFKPSYYIRILYKSLYKNKKEKRKT

SEQ ID NO: 3291441 - protein, 34 aa, Plasmodium falciparum
LSDFSLSNIPYPTIHIPFFPRSPRIYKGLYGGIS

SEQ ID NO: 3291442 - protein, 23 aa, Plasmodium falciparum
LSDIFEMNIINIIKALLYNYIFH

SEQ ID NO: 3291443 - protein, 17 aa, Plasmodium falciparum
LSDILKKKYIYLDVKMG

SEQ ID NO: 3291444 - protein, 35 aa, Plasmodium falciparum
LSDLSCVYIIILYIYFPFIIINLLELVWCQPIQYK

SEQ ID NO: 3291445 - protein, 23 aa, Plasmodium falciparum
LSEASLCFHFGIKGVLINSNINN

SEQ ID NO: 3291446 - protein, 24 aa, Plasmodium falciparum
LSEEIYSIPFYPIYGNLGLKNVIT

SEQ ID NO: 3291447 - protein, 18 aa, Plasmodium falciparum
LSEKFISNLLNKNIILLW

SEQ ID NO: 3291448 - protein, 27 aa, Plasmodium falciparum
LSEQKYILLMLASMRKFDIKKYALNLS

SEQ ID NO: 3291449 - protein, 25 aa, Plasmodium falciparum
LSEYLDEDILFLQKLKWKTSEMENE

SEQ ID NO: 3291450 - protein, 31 aa, Plasmodium falciparum
LSFDFFVFLFFCFFFLYFPSEEIKVEKKTFS

SEQ ID NO: 3291451 - protein, 18 aa, Plasmodium falciparum
LSFDLSINTFLLFNFDHT

SEQ ID NO: 3291452 - protein, 23 aa, Plasmodium falciparum
LSFFFLFLFNFITSSTLWYIMKI

SEQ ID NO: 3291453 - protein, 23 aa, Plasmodium falciparum
LSFFLYITILDITLTSLIQKNIL

SEQ ID NO: 3291454 - protein, 21 aa, Plasmodium falciparum
LSFISLFIYSFILLYYMFFMI

SEQ ID NO: 3291455 - protein, 21 aa, Plasmodium falciparum
LSFTNTMILFLKKKNFINSTT

SEQ ID NO: 3291456 - protein, 25 aa, Plasmodium falciparum
LSGCIPFICFGFVDNSFMIISGDLF

SEQ ID NO: 3291457 - protein, 32 aa, Plasmodium falciparum
LSGVLYSCFFLIIYIILFSIYIYDTSKSIKAI

SEQ ID NO: 3291458 - protein, 20 aa, Plasmodium falciparum
LSICIIICSDLFNFPNKIKK

SEQ ID NO: 3291459 - protein, 33 aa, Plasmodium falciparum
LSICVCILVFFFILKYIIYYNVMVTKTGYLIDT

SEQ ID NO: 3291460 - protein, 19 aa, Plasmodium falciparum
LSICVFPNFHFYDNKLKTA

SEQ ID NO: 3291461 - protein, 25 aa, Plasmodium falciparum
LSIEILVFLLLLLHIDKPKNVNLVK

SEQ ID NO: 3291462 - protein, 28 aa, Plasmodium falciparum
LSIFFQLIENSFFLYKIRKKLLSFKKKI

SEQ ID NO: 3291463 - protein, 18 aa, Plasmodium falciparum
LSIFSFVLLVTAFSFMCV

SEQ ID NO: 3291464 - protein, 17 aa, Plasmodium falciparum
LSIIEYLTTTYNNVVFF

SEQ ID NO: 3291465 - protein, 23 aa, Plasmodium falciparum
LSIIFLKYYHVCCISTREILRDK

SEQ ID NO: 3291466 - protein, 26 aa, Plasmodium falciparum
LSIIIVICLLVWLWPSRGKLMGKDKT

SEQ ID NO: 3291467 - protein, 17 aa, Plasmodium falciparum
LSIIYILSFVNSYLIDE

SEQ ID NO: 3291468 - protein, 29 aa, Plasmodium falciparum
LSILCAEILNIYYLFIKKTKKNETKINEI

SEQ ID NO: 3291469 - protein, 19 aa, Plasmodium falciparum
LSILFCILNSYLSFATLQH

SEQ ID NO: 3291470 - protein, 25 aa, Plasmodium falciparum
LSILTNIFFLFFRKKKVNHFNIAWS

SEQ ID NO: 3291471 - protein, 19 aa, Plasmodium falciparum
LSILYDHWSPVLSVNSICL

SEQ ID NO: 3291472 - protein, 25 aa, Plasmodium falciparum
LSINLFKLFFFFKKNYHTNDNRNYY

SEQ ID NO: 3291473 - protein, 27 aa, Plasmodium falciparum
LSIYRSSLEGIYFYRNIRSILNKQLFD

SEQ ID NO: 3291474 - protein, 26 aa, Plasmodium falciparum
LSKEEFFFFVYIFPQHVKYSSKVLSY

SEQ ID NO: 3291475 - protein, 29 aa, Plasmodium falciparum
LSKFTERPPFFRWFQEWGEEFCRKKKIKI

SEQ ID NO: 3291476 - protein, 26 aa, Plasmodium falciparum
LSKITILLVVFLFGHLFIPENKWIFI

SEQ ID NO: 3291477 - protein, 17 aa, Plasmodium falciparum
LSKNVMIHIYPINQIYS

SEQ ID NO: 3291478 - protein, 23 aa, Plasmodium falciparum
LSKSKFDFIITERLKRICELLIL

SEQ ID NO: 3291479 - protein, 21 aa, Plasmodium falciparum
LSKVNIFKKILFSIYEIIYII

SEQ ID NO: 3291480 - protein, 31 aa, Plasmodium falciparum
LSKVVCIIFIFWTFIWVPIQFNDLIISIFSK

SEQ ID NO: 3291481 - protein, 30 aa, Plasmodium falciparum
LSKWLTNYIYFLIFLHMYKKNLFINNGLTF

SEQ ID NO: 3291482 - protein, 42 aa, Plasmodium falciparum
LSLETLLFKYFSLSNFIKFSLKLKISYLDYLCFFLNEKPSIK

SEQ ID NO: 3291483 - protein, 22 aa, Plasmodium falciparum
LSLFFLSILFVHSSYKRYYIKC

SEQ ID NO: 3291484 - protein, 17 aa, Plasmodium falciparum
LSLFSFDKIKETILPPV

SEQ ID NO: 3291485 - protein, 30 aa, Plasmodium falciparum
LSLIHLNYLIINYLFMWDNLYDFVNVILSY

SEQ ID NO: 3291486 - protein, 25 aa, Plasmodium falciparum
LSLIIIMIALLFLLPGSQPYYIFYS

SEQ ID NO: 3291487 - protein, 20 aa, Plasmodium falciparum
LSLILFKLFANKITQVVFYL

SEQ ID NO: 3291488 - protein, 17 aa, Plasmodium falciparum
LSLILICIYIFSFVDTS

SEQ ID NO: 3291489 - protein, 17 aa, Plasmodium falciparum
LSLLHRIPSKYIDKMLN

SEQ ID NO: 3291490 - protein, 36 aa, Plasmodium falciparum
LSLNILAHILYLIPKKMFMASFIPSILNKIINVKCL

SEQ ID NO: 3291491 - protein, 24 aa, Plasmodium falciparum
LSLNMLLFLYLSSYLFDMHFSYYI

SEQ ID NO: 3291492 - protein, 27 aa, Plasmodium falciparum
LSLNNKYIFYGIRKHILIYLNLINYVE

SEQ ID NO: 3291493 - protein, 18 aa, Plasmodium falciparum
LSLPVRPQFEIINATKFI

SEQ ID NO: 3291494 - protein, 26 aa, Plasmodium falciparum
LSLTYLHLYYRYVNVTNILFLEDYNK

SEQ ID NO: 3291495 - protein, 24 aa, Plasmodium falciparum
LSLYYLVIIFIYIKNNLYNKEKIH

SEQ ID NO: 3291496 - protein, 44 aa, Plasmodium falciparum
LSMNLSKLINFIILFTLFILNLLFFIKLLFCLFFECLDNIRRSK

SEQ ID NO: 3291497 - protein, 22 aa, Plasmodium falciparum
LSNENLLPWKIKVEAINLLCDK

SEQ ID NO: 3291498 - protein, 18 aa, Plasmodium falciparum
LSNEPLLPDFKDLNYPEN

SEQ ID NO: 3291499 - protein, 17 aa, Plasmodium falciparum
LSNFLIGFLLLSGLFVY

SEQ ID NO: 3291500 - protein, 38 aa, Plasmodium falciparum
LSNHHILILINIYIYYYQKFLHSPFLYKCLQYLSKKND

SEQ ID NO: 3291501 - protein, 18 aa, Plasmodium falciparum
LSNIIFDLILYISIKVKK

SEQ ID NO: 3291502 - protein, 26 aa, Plasmodium falciparum
LSNIRKPLFYYKLPVQFEPLYCQYYS

SEQ ID NO: 3291503 - protein, 22 aa, Plasmodium falciparum
LSNLLISFNIIGSPTSLIAHVK

SEQ ID NO: 3291504 - protein, 25 aa, Plasmodium falciparum
LSNMNEIYYFFLKSMYFKTDNKITY

SEQ ID NO: 3291505 - protein, 25 aa, Plasmodium falciparum
LSNPEHFFIYNIIDITYEEFIYHLD

SEQ ID NO: 3291506 - protein, 17 aa, Plasmodium falciparum
LSNRFNLTKIRKLKLFR

SEQ ID NO: 3291507 - protein, 37 aa, Plasmodium falciparum
LSNYDNIFLKTIMRFYLLLNFSIELLTILYEDIDLYS

SEQ ID NO: 3291508 - protein, 17 aa, Plasmodium falciparum
LSPGYIKELLKFYNFSK

SEQ ID NO: 3291509 - protein, 37 aa, Plasmodium falciparum
LSPLHMYIDLFLKVLNNLYFWLFGRINRYKTVLYEKY

SEQ ID NO: 3291510 - protein, 32 aa, Plasmodium falciparum
LSPNIKQIISFRFFLFCLNFKGIINIYNIKNQ

SEQ ID NO: 3291511 - protein, 18 aa, Plasmodium falciparum
LSPYIIYLRHKNKNRLNV

SEQ ID NO: 3291512 - protein, 32 aa, Plasmodium falciparum
LSQDVQIFFYPFFYFLNNMIIITIYKMKHKLS

SEQ ID NO: 3291513 - protein, 24 aa, Plasmodium falciparum
LSQIIIHFSILIYGWKLACVYREI

SEQ ID NO: 3291514 - protein, 23 aa, Plasmodium falciparum
LSRLLLFFMLQTVSCSLLFMIKN

SEQ ID NO: 3291515 - protein, 17 aa, Plasmodium falciparum
LSSHPMLWECISSHIPL

SEQ ID NO: 3291516 - protein, 24 aa, Plasmodium falciparum
LSSISYHYLYEKNGIYKFINIFGS

SEQ ID NO: 3291517 - protein, 54 aa, Plasmodium falciparum
LSSKLFITGLIVTITMFALYIFLWILLLYLYSKRKRLNLFDLLTTNLLSGFRKG

SEQ ID NO: 3291518 - protein, 23 aa, Plasmodium falciparum
LSSLIWRLSIINPNLPRTIERVN

SEQ ID NO: 3291519 - protein, 28 aa, Plasmodium falciparum
LSSSFINRLLFLYKLYYDIYKGLDFTHV

SEQ ID NO: 3291520 - protein, 23 aa, Plasmodium falciparum
LSSSVYYLGLYVTFFFISKFLKE

SEQ ID NO: 3291521 - protein, 18 aa, Plasmodium falciparum
LSSVLFFKSMPSGLFIYF

SEQ ID NO: 3291522 - protein, 18 aa, Plasmodium falciparum
LSSYFISYTFLGDEFLPN

SEQ ID NO: 3291523 - protein, 23 aa, Plasmodium falciparum
LSTEWSPCSVTCGNGIQVRIKPG

SEQ ID NO: 3291524 - protein, 20 aa, Plasmodium falciparum
LSTFVPSILLKNYNFWYNNN

SEQ ID NO: 3291525 - protein, 22 aa, Plasmodium falciparum
LSTIICFIFIGLFIQLCIKENG

SEQ ID NO: 3291526 - protein, 32 aa, Plasmodium falciparum
LSTKNNFFVFIYYFFIKGYISLVLVNINRALK

SEQ ID NO: 3291527 - protein, 17 aa, Plasmodium falciparum
LSTQYLSNKNRNIIRPK

SEQ ID NO: 3291528 - protein, 22 aa, Plasmodium falciparum
LSTWFVISTLFFSNKDFTVIFF

SEQ ID NO: 3291529 - protein, 25 aa, Plasmodium falciparum
LSTYVIKHNRFLSEYQSNFLGGGYS

SEQ ID NO: 3291530 - protein, 27 aa, Plasmodium falciparum
LSVDNYMLVRLFKISSIFSFVPEMEVY

SEQ ID NO: 3291531 - protein, 23 aa, Plasmodium falciparum
LSVFAVICMLSLNLSIFENNNNN

SEQ ID NO: 3291532 - protein, 18 aa, Plasmodium falciparum
LSVFGYNRGKFFVSIKKD

SEQ ID NO: 3291533 - protein, 29 aa, Plasmodium falciparum
LSVGIAFAALSYFLLKKKSKFSVDLLRVL

SEQ ID NO: 3291534 - protein, 30 aa, Plasmodium falciparum
LSVGIGFAALSYFLLKVNGCIYMCMLCMCG

SEQ ID NO: 3291535 - protein, 17 aa, Plasmodium falciparum
LSVIQKIVLYILCLIDN

SEQ ID NO: 3291536 - protein, 19 aa, Plasmodium falciparum
LSVIYSFILCSLLGQYIYQ

SEQ ID NO: 3291537 - protein, 33 aa, Plasmodium falciparum
LSVLKFLFDIIFFLSFILYPLFLRLKRIDKIIY

SEQ ID NO: 3291538 - protein, 38 aa, Plasmodium falciparum
LSVLPVYRLLYVLNFFFLFIFGAFLFMQFYGVNFTYIL

SEQ ID NO: 3291539 - protein, 29 aa, Plasmodium falciparum
LSVNEFHILLFILYIFCIVVYFNNIFTEK

SEQ ID NO: 3291540 - protein, 24 aa, Plasmodium falciparum
LSWTKLIYFTYILSLVTSIHIRKL

SEQ ID NO: 3291541 - protein, 24 aa, Plasmodium falciparum
LSYIFFFVHLIVINIKCKEINNNL

SEQ ID NO: 3291542 - protein, 24 aa, Plasmodium falciparum
LSYLGRIAYLRRGIFKYNLNCYEK

SEQ ID NO: 3291543 - protein, 25 aa, Plasmodium falciparum
LSYLNVFLSFYRKYYMKNVRLVFME

SEQ ID NO: 3291544 - protein, 18 aa, Plasmodium falciparum
LSYNTNTFLSLFILCMLY

SEQ ID NO: 3291545 - protein, 28 aa, Plasmodium falciparum
LSYTINLYNFIFYYINKLSPCKKIHMTY

SEQ ID NO: 3291546 - protein, 19 aa, Plasmodium falciparum
LTCDFVAYDLGMNDWKSLK

SEQ ID NO: 3291547 - protein, 26 aa, Plasmodium falciparum
LTDDQIREYWWTANRNDVWKAITCSA

SEQ ID NO: 3291548 - protein, 24 aa, Plasmodium falciparum
LTDNILCFVSMPVYFHKKMYNCEL

SEQ ID NO: 3291549 - protein, 37 aa, Plasmodium falciparum
LTEAYDIENLIFLGICIKIVICRISNLLNAKSCLQQF

SEQ ID NO: 3291550 - protein, 29 aa, Plasmodium falciparum
LTECVFSFLILFPIRSFRLVGGSLIFIYC

SEQ ID NO: 3291551 - protein, 26 aa, Plasmodium falciparum
LTFHCYGSIIQLKYNNEIFLRKKKYK

SEQ ID NO: 3291552 - protein, 17 aa, Plasmodium falciparum
LTFILNKLNIRFHPFFY

SEQ ID NO: 3291553 - protein, 19 aa, Plasmodium falciparum
LTFKFYKLFKNILSINVKR

SEQ ID NO: 3291554 - protein, 20 aa, Plasmodium falciparum
LTFSNVFYKFKYSLLRYTTS

SEQ ID NO: 3291555 - protein, 46 aa, Plasmodium falciparum
LTHINFINVLFNFIFYENIYLINLYLYYIYLIYNIQTQKKHQLFCN

SEQ ID NO: 3291556 - protein, 22 aa, Plasmodium falciparum
LTIEIFFDLNNIIKFSLILTKD

SEQ ID NO: 3291557 - protein, 25 aa, Plasmodium falciparum
LTIGNIIFILFKLFPKIITNSFQIL

SEQ ID NO: 3291558 - protein, 19 aa, Plasmodium falciparum
LTIITFLVNIFKTLCLSKN

SEQ ID NO: 3291559 - protein, 22 aa, Plasmodium falciparum
LTIQNFVIHPLLFLCIQEVLTF

SEQ ID NO: 3291560 - protein, 23 aa, Plasmodium falciparum
LTISPILLFTLYMQKFEPLEVTI

SEQ ID NO: 3291561 - protein, 26 aa, Plasmodium falciparum
LTITPLKVGLINFPPISYFLNINNNW

SEQ ID NO: 3291562 - protein, 25 aa, Plasmodium falciparum
LTITSLIICAYLFLKSKFSYYSFEQ

SEQ ID NO: 3291563 - protein, 18 aa, Plasmodium falciparum
LTIVTPFISPKFWKKVEY

SEQ ID NO: 3291564 - protein, 17 aa, Plasmodium falciparum
LTIYSLLFMRYALAIKP

SEQ ID NO: 3291565 - protein, 21 aa, Plasmodium falciparum
LTKKYGSINLFLDTLKEGSHC

SEQ ID NO: 3291566 - protein, 22 aa, Plasmodium falciparum
LTKLNLLSMFWSVGSINFQNGN

SEQ ID NO: 3291567 - protein, 26 aa, Plasmodium falciparum
LTKYQKYIDPLLLYDISRILLKSFHT

SEQ ID NO: 3291568 - protein, 28 aa, Plasmodium falciparum
LTLDYNYFLNILPLYYEHFRKKIHYYNL

SEQ ID NO: 3291569 - protein, 17 aa, Plasmodium falciparum
LTLIALIAAKKAALSAV

SEQ ID NO: 3291570 - protein, 19 aa, Plasmodium falciparum
LTLKKLIYNYLILYAEGNE

SEQ ID NO: 3291571 - protein, 19 aa, Plasmodium falciparum
LTLKYIYENIGYNQLLFSV

SEQ ID NO: 3291572 - protein, 25 aa, Plasmodium falciparum
LTLTKFIFLCGHLGLYTYIYAEKIQ

SEQ ID NO: 3291573 - protein, 18 aa, Plasmodium falciparum
LTMFGLAVAKKAAVDAIL

SEQ ID NO: 3291574 - protein, 30 aa, Plasmodium falciparum
LTMYRKYILLLFILKILKIIKIYSFQSAHP

SEQ ID NO: 3291575 - protein, 33 aa, Plasmodium falciparum
LTNDKIYMNIYVKSILYNILYIKSDLSENKMDH

SEQ ID NO: 3291576 - protein, 36 aa, Plasmodium falciparum
LTNKIKKFLNKKTLIKFIKKYSLYSSSPSSSLKTDK

SEQ ID NO: 3291577 - protein, 30 aa, Plasmodium falciparum
LTNLDYVPQFLRWFEEWAEEFCRIKKIKLE

SEQ ID NO: 3291578 - protein, 30 aa, Plasmodium falciparum
LTNLDYVPQFLRWFTEWAEEFCRIRKIKLG

SEQ ID NO: 3291579 - protein, 19 aa, Plasmodium falciparum
LTNSYIFTYGFYSKKGKYH

SEQ ID NO: 3291580 - protein, 25 aa, Plasmodium falciparum
LTPHKLLIRLINLTLNINTLESLTF

SEQ ID NO: 3291581 - protein, 18 aa, Plasmodium falciparum
LTQAEKDALAKKESEAPK

SEQ ID NO: 3291582 - protein, 30 aa, Plasmodium falciparum
LTQKCQSLLYLFFHFIKKCYNSFRNCWSIY

SEQ ID NO: 3291583 - protein, 24 aa, Plasmodium falciparum
LTRAKRGVILFGDQFTLANDPANW

SEQ ID NO: 3291584 - protein, 21 aa, Plasmodium falciparum
LTRETLWKEHAPSIWEGMICA

SEQ ID NO: 3291585 - protein, 26 aa, Plasmodium falciparum
LTSILPNLFIFYKFQKIIQKPSRANI

SEQ ID NO: 3291586 - protein, 18 aa, Plasmodium falciparum
LTSSPSTKNIFFSNNTFL

SEQ ID NO: 3291587 - protein, 17 aa, Plasmodium falciparum
LTVGFLLEYLYGTYVVF

SEQ ID NO: 3291588 - protein, 24 aa, Plasmodium falciparum
LTVKANIFPYYSDIRFFYHNENID

SEQ ID NO: 3291589 - protein, 36 aa, Plasmodium falciparum
LTVVSSFLMIFIPVAIFHIFTSTWLFEKEIYYVSIV

SEQ ID NO: 3291590 - protein, 17 aa, Plasmodium falciparum
LTWGIFSVILFVISHGH

SEQ ID NO: 3291591 - protein, 21 aa, Plasmodium falciparum
LTYFLIINFILCTNIQSISRK

SEQ ID NO: 3291592 - protein, 40 aa, Plasmodium falciparum
LTYKLIFPVIFNNYFLNLLHMKLYLFFNYNIFDKLQECHK

SEQ ID NO: 3291593 - protein, 22 aa, Plasmodium falciparum
LVCIYIVIIFLFQDVRCIKTKK

SEQ ID NO: 3291594 - protein, 35 aa, Plasmodium falciparum
LVCPKEKLLFLINNYYYIIYILKQNKLQEKICTFE

SEQ ID NO: 3291595 - protein, 18 aa, Plasmodium falciparum
LVCRIIINVYLHIYLKLK

SEQ ID NO: 3291596 - protein, 30 aa, Plasmodium falciparum
LVCSYNNIFYIYKIIYLLKDKIYIENTNVR

SEQ ID NO: 3291597 - protein, 27 aa, Plasmodium falciparum
LVDESFVNIFFYENYFKNLFNLNDVSN

SEQ ID NO: 3291598 - protein, 27 aa, Plasmodium falciparum
LVDLRKAFIKCAAIETFFAWHEFKKEK

SEQ ID NO: 3291599 - protein, 24 aa, Plasmodium falciparum
LVEEVIPELLVAEVIPEELVAEVI

SEQ ID NO: 3291600 - protein, 19 aa, Plasmodium falciparum
LVEEVVPVELLEEVIPEEL

SEQ ID NO: 3291601 - protein, 25 aa, Plasmodium falciparum
LVEIINDLIFFLFEDNFYNASISKE

SEQ ID NO: 3291602 - protein, 19 aa, Plasmodium falciparum
LVFLWFVINIFLKSSNTYK

SEQ ID NO: 3291603 - protein, 19 aa, Plasmodium falciparum
LVFYSFLILLFTKCLPPSI

SEQ ID NO: 3291604 - protein, 29 aa, Plasmodium falciparum
LVIAGCSNGLLVIWKLPPNFNGISVLNSK

SEQ ID NO: 3291605 - protein, 17 aa, Plasmodium falciparum
LVIICIFSFIFSITSIY

SEQ ID NO: 3291606 - protein, 17 aa, Plasmodium falciparum
LVIISLSVLSVVGFILF

SEQ ID NO: 3291607 - protein, 32 aa, Plasmodium falciparum
LVIISLSVLSVVGFVLFYFTPNSRKSDLFKNS

SEQ ID NO: 3291608 - protein, 28 aa, Plasmodium falciparum
LVKASFPYFLKLFFLEVLRKKNEKAYNL

SEQ ID NO: 3291609 - protein, 18 aa, Plasmodium falciparum
LVKLFKYYMEIYIDNFSG

SEQ ID NO: 3291610 - protein, 23 aa, Plasmodium falciparum
LVKNMYFIIYNRCLSLRDKNNNQ

SEQ ID NO: 3291611 - protein, 44 aa, Plasmodium falciparum
LVKNSFTCIYYKNIFLVFISFIKKIFIYFLQLNIQHFYVTVMRQ

SEQ ID NO: 3291612 - protein, 20 aa, Plasmodium falciparum
LVKNVFIHFYDNTHYIIFTT

SEQ ID NO: 3291613 - protein, 26 aa, Plasmodium falciparum
LVKVIDRILFKLDDLVRPYVHKILVV

SEQ ID NO: 3291614 - protein, 17 aa, Plasmodium falciparum
LVLFNPVHISKIKKNIL

SEQ ID NO: 3291615 - protein, 44 aa, Plasmodium falciparum
LVLIMGVSIHYPFVFIIYEYMKNKCLFSYLHCIKYKHVYISTFL

SEQ ID NO: 3291616 - protein, 27 aa, Plasmodium falciparum
LVLLILSFLCFFYSSLSYDEDYDEEYN

SEQ ID NO: 3291617 - protein, 31 aa, Plasmodium falciparum
LVLLILVVVIIILYIWLYRRRKNSLKHQCKK

SEQ ID NO: 3291618 - protein, 18 aa, Plasmodium falciparum
LVLLLIGFLSITQFATMF

SEQ ID NO: 3291619 - protein, 18 aa, Plasmodium falciparum
LVLMHSINLKLSLGRLRK

SEQ ID NO: 3291620 - protein, 21 aa, Plasmodium falciparum
LVMKSLFFLFEDKLGSYILQN

SEQ ID NO: 3291621 - protein, 18 aa, Plasmodium falciparum
LVMLLIGHNIFFTYPLWF

SEQ ID NO: 3291622 - protein, 29 aa, Plasmodium falciparum
LVMSEQQEYLILLKELSLNIEKVFNEIKE

SEQ ID NO: 3291623 - protein, 17 aa, Plasmodium falciparum
LVMSFLLNVLLLSDNVN

SEQ ID NO: 3291624 - protein, 22 aa, Plasmodium falciparum
LVMSILLIVLFLSYNVNNHNKK

SEQ ID NO: 3291625 - protein, 24 aa, Plasmodium falciparum
LVNGFMYAFCFFAISQMYAYFENI

SEQ ID NO: 3291626 - protein, 25 aa, Plasmodium falciparum
LVNGFMYAFCFFAISQMYAYFENIN

SEQ ID NO: 3291627 - protein, 19 aa, Plasmodium falciparum
LVNHNVYFKALISDMFFGV

SEQ ID NO: 3291628 - protein, 19 aa, Plasmodium falciparum
LVRSFMETLIPLMDLTNGK

SEQ ID NO: 3291629 - protein, 17 aa, Plasmodium falciparum
LVSAPFSWFLSNETKEL

SEQ ID NO: 3291630 - protein, 45 aa, Plasmodium falciparum
LVSFPNIRFKFFFFFLMLVDIFLPYLVTNLFKSLRFYIFHKYQIN

SEQ ID NO: 3291631 - protein, 26 aa, Plasmodium falciparum
LVSFYSCYILLNKIDVVPLLIKNNKG

SEQ ID NO: 3291632 - protein, 19 aa, Plasmodium falciparum
LVSLFYYLLLGSENKQCIK

SEQ ID NO: 3291633 - protein, 19 aa, Plasmodium falciparum
LVSLPPLTCVILHSSVFLV

SEQ ID NO: 3291634 - protein, 25 aa, Plasmodium falciparum
LVTCFNMFLYVLFTTLITKRRTIIR

SEQ ID NO: 3291635 - protein, 25 aa, Plasmodium falciparum
LVTDPKFCNLFLKKFVPIGSGLDRN

SEQ ID NO: 3291636 - protein, 17 aa, Plasmodium falciparum
LVTIFGKIKDKIRDEAT

SEQ ID NO: 3291637 - protein, 24 aa, Plasmodium falciparum
LVTRYLLFFVFFVDKIIEKNEDEN

SEQ ID NO: 3291638 - protein, 18 aa, Plasmodium falciparum
LVTSINCYKYMLLYGFMI

SEQ ID NO: 3291639 - protein, 27 aa, Plasmodium falciparum
LVTSTFLPYGIVAIVLILVIVALIMLY

SEQ ID NO: 3291640 - protein, 30 aa, Plasmodium falciparum
LVTVCIIIILSIIYLILRYRRKKKMKKKLQ

SEQ ID NO: 3291641 - protein, 19 aa, Plasmodium falciparum
LVVDMTFYNDWNLFKDTDG

SEQ ID NO: 3291642 - protein, 31 aa, Plasmodium falciparum
LVVLFEDTCFLCFLYKPFINTLHKLFKENNI

SEQ ID NO: 3291643 - protein, 24 aa, Plasmodium falciparum
LVVQNIVTYLEQIKNGISGHYTED

SEQ ID NO: 3291644 - protein, 47 aa, Plasmodium falciparum
LVVVMIMFFHLFFEALLHFYFHLFTINLKVSLMYFLYKINLCSNNNH

SEQ ID NO: 3291645 - protein, 19 aa, Plasmodium falciparum
LVVYFYVYKCLMNYFILFF

SEQ ID NO: 3291646 - protein, 29 aa, Plasmodium falciparum
LVWIIIFGNFFVVHFFLCFKIPNNKITNV

SEQ ID NO: 3291647 - protein, 25 aa, Plasmodium falciparum
LVYDEKVYYLSNLYHAFIFSKNIKY

SEQ ID NO: 3291648 - protein, 18 aa, Plasmodium falciparum
LWCLSYYHKTEFIFSFYL

SEQ ID NO: 3291649 - protein, 19 aa, Plasmodium falciparum
LWECISSHIPLITQMAFIP

SEQ ID NO: 3291650 - protein, 26 aa, Plasmodium falciparum
LWHKNICSNIYNLYEYIQMCINPNVK

SEQ ID NO: 3291651 - protein, 19 aa, Plasmodium falciparum
LWIEKDYLFLIENLKDILE

SEQ ID NO: 3291652 - protein, 19 aa, Plasmodium falciparum
LWLDILLNSDRRDLDIKYW

SEQ ID NO: 3291653 - protein, 26 aa, Plasmodium falciparum
LWTAVSLFVFLICCQIPLYGIVTSKS

SEQ ID NO: 3291654 - protein, 32 aa, Plasmodium falciparum
LYASFKSLYNQFLYPLYNFTNFIMYTQYVNFI

SEQ ID NO: 3291655 - protein, 17 aa, Plasmodium falciparum
LYDHIISFLLNTQDKEL

SEQ ID NO: 3291656 - protein, 24 aa, Plasmodium falciparum
LYDKNFFSPYNNSLIKYVHFIVEY

SEQ ID NO: 3291657 - protein, 25 aa, Plasmodium falciparum
LYDKSKIIALLALLYNENESNGDEY

SEQ ID NO: 3291658 - protein, 24 aa, Plasmodium falciparum
LYDKWYEHMLYIYEEKFKEYIPKL

SEQ ID NO: 3291659 - protein, 17 aa, Plasmodium falciparum
LYDPFANIENRDLETVQ

SEQ ID NO: 3291660 - protein, 19 aa, Plasmodium falciparum
LYDPWQCYQIGELTKDNKA

SEQ ID NO: 3291661 - protein, 17 aa, Plasmodium falciparum
LYDTMILFNNILMNSIK

SEQ ID NO: 3291662 - protein, 25 aa, Plasmodium falciparum
LYDYLKTNVIFLKSLNSRDLFSYPL

SEQ ID NO: 3291663 - protein, 18 aa, Plasmodium falciparum
LYEFFNNLKLRNINIDLD

SEQ ID NO: 3291664 - protein, 18 aa, Plasmodium falciparum
LYELIKFFSFSEGGFQNN

SEQ ID NO: 3291665 - protein, 18 aa, Plasmodium falciparum
LYEYLNIYMYYQSYMKIK

SEQ ID NO: 3291666 - protein, 20 aa, Plasmodium falciparum
LYFAFVFFSFFINYNNSHIF

SEQ ID NO: 3291667 - protein, 19 aa, Plasmodium falciparum
LYFIELYLSYIYKTNYYKE

SEQ ID NO: 3291668 - protein, 17 aa, Plasmodium falciparum
LYFISLLISLRYKYINS

SEQ ID NO: 3291669 - protein, 17 aa, Plasmodium falciparum
LYFKALLYSLDKTFEKV

SEQ ID NO: 3291670 - protein, 20 aa, Plasmodium falciparum
LYFLKWPSVAIEENFSGSFK

SEQ ID NO: 3291671 - protein, 17 aa, Plasmodium falciparum
LYFSSLMVRLLLIFSPF

SEQ ID NO: 3291672 - protein, 19 aa, Plasmodium falciparum
LYFSVPMYYLMNKHFVMFL

SEQ ID NO: 3291673 - protein, 29 aa, Plasmodium falciparum
LYGANIMFACIFLLLNLSKVPVITIIVTS

SEQ ID NO: 3291674 - protein, 17 aa, Plasmodium falciparum
LYGPPGCGKTLLAKAIA

SEQ ID NO: 3291675 - protein, 18 aa, Plasmodium falciparum
LYHTLILCENCKGFYVDM

SEQ ID NO: 3291676 - protein, 21 aa, Plasmodium falciparum
LYHTYHIIGIKKISSIGYIFN

SEQ ID NO: 3291677 - protein, 26 aa, Plasmodium falciparum
LYHVKNYFFHISLYFIKSLLCSRNNF

SEQ ID NO: 3291678 - protein, 18 aa, Plasmodium falciparum
LYIEFKQHILRTIKIKTL

SEQ ID NO: 3291679 - protein, 18 aa, Plasmodium falciparum
LYIEKFLPKYYLLKNQDI

SEQ ID NO: 3291680 - protein, 17 aa, Plasmodium falciparum
LYIFFDINFDIIVYVLL

SEQ ID NO: 3291681 - protein, 17 aa, Plasmodium falciparum
LYIFLGSVVHLKVPIEN

SEQ ID NO: 3291682 - protein, 24 aa, Plasmodium falciparum
LYIFYQSFPIFLWWMTGTASIITI

SEQ ID NO: 3291683 - protein, 42 aa, Plasmodium falciparum
LYIHDLMYVYLIVYFILFYCFISFYFIFFHSPISDDKLEIEL

SEQ ID NO: 3291684 - protein, 19 aa, Plasmodium falciparum
LYIIELARIFIHCLLLDVS

SEQ ID NO: 3291685 - protein, 23 aa, Plasmodium falciparum
LYILAKHIFYIKRKPLRALDNIE

SEQ ID NO: 3291686 - protein, 25 aa, Plasmodium falciparum
LYILMKARFNLIIQNLLYIKNVNET

SEQ ID NO: 3291687 - protein, 18 aa, Plasmodium falciparum
LYILRKNKITYVPISNIL

SEQ ID NO: 3291688 - protein, 17 aa, Plasmodium falciparum
LYILYIPGNTEDIIKKL

SEQ ID NO: 3291689 - protein, 18 aa, Plasmodium falciparum
LYINSLINNYFFFDSYKN

SEQ ID NO: 3291690 - protein, 26 aa, Plasmodium falciparum
LYISGNFFFINLKYFQNNIYEPIFLI

SEQ ID NO: 3291691 - protein, 19 aa, Plasmodium falciparum
LYKCLRLLVRLHSAGLSHL

SEQ ID NO: 3291692 - protein, 26 aa, Plasmodium falciparum
LYKDSFIFVIHILYKVFYLNNILDDY

SEQ ID NO: 3291693 - protein, 29 aa, Plasmodium falciparum
LYKFEYIKNMYIIPPYNKGILINIEKEHE

SEQ ID NO: 3291694 - protein, 25 aa, Plasmodium falciparum
LYKGYFYVNFIFNTWKNMVHYFVHN

SEQ ID NO: 3291695 - protein, 20 aa, Plasmodium falciparum
LYKHLILKTFLFLLKEKKKI

SEQ ID NO: 3291696 - protein, 27 aa, Plasmodium falciparum
LYKIKNKYLFLLYQTYMICISYINMSL

SEQ ID NO: 3291697 - protein, 25 aa, Plasmodium falciparum
LYKISQFYAILAYFANQRKNYIISF

SEQ ID NO: 3291698 - protein, 17 aa, Plasmodium falciparum
LYKLFLKKKKKIQNIKY

SEQ ID NO: 3291699 - protein, 27 aa, Plasmodium falciparum
LYKNNDVMYFYVIKGKEVGLYEITKFP

SEQ ID NO: 3291700 - protein, 28 aa, Plasmodium falciparum
LYKYFSLYMFLIYYKYRYVRGTLKNIIT

SEQ ID NO: 3291701 - protein, 30 aa, Plasmodium falciparum
LYKYYHNTLYFINIFLEIFYMLSHYENKNK

SEQ ID NO: 3291702 - protein, 25 aa, Plasmodium falciparum
LYLDLFHPFLFVIYYFVVTSNPGYL

SEQ ID NO: 3291703 - protein, 20 aa, Plasmodium falciparum
LYLIVIFCLQWESVVSISIS

SEQ ID NO: 3291704 - protein, 18 aa, Plasmodium falciparum
LYLKFLKLVCRLAIWVFG

SEQ ID NO: 3291705 - protein, 17 aa, Plasmodium falciparum
LYLLIKLNNDNINETYP

SEQ ID NO: 3291706 - protein, 22 aa, Plasmodium falciparum
LYLLYNLHANLLKILKSKYYNP

SEQ ID NO: 3291707 - protein, 18 aa, Plasmodium falciparum
LYLTLIISIIYIITSINQ

SEQ ID NO: 3291708 - protein, 26 aa, Plasmodium falciparum
LYMSIYNTNVLLYMGKKKYILYAITI

SEQ ID NO: 3291709 - protein, 18 aa, Plasmodium falciparum
LYMSYFVKDFHSIFSFLS

SEQ ID NO: 3291710 - protein, 43 aa, Plasmodium falciparum
LYMSYKLIICICIPKLIFYMLLWMKNLLLHQYKIDFLVVVINN

SEQ ID NO: 3291711 - protein, 18 aa, Plasmodium falciparum
LYNCDYSLFLRIYSIYHT

SEQ ID NO: 3291712 - protein, 21 aa, Plasmodium falciparum
LYNCLNLLRKLHNAGLSHLDF

SEQ ID NO: 3291713 - protein, 27 aa, Plasmodium falciparum
LYNDIIQYWIWFFLKDEKENKNDSVHL

SEQ ID NO: 3291714 - protein, 25 aa, Plasmodium falciparum
LYNEILLFLQYFYKYMDCSILSKCL

SEQ ID NO: 3291715 - protein, 23 aa, Plasmodium falciparum
LYNGLHFLIMFLNNYLDNTKHFK

SEQ ID NO: 3291716 - protein, 34 aa, Plasmodium falciparum
LYNIIENFPFFNSSMLPLYSSFKFLIYNCAIHYY

SEQ ID NO: 3291717 - protein, 28 aa, Plasmodium falciparum
LYNKYRRHMFITTLYYENNFLIGGTNHG

SEQ ID NO: 3291718 - protein, 17 aa, Plasmodium falciparum
LYNLLKEIQFHLIIVDE

SEQ ID NO: 3291719 - protein, 19 aa, Plasmodium falciparum
LYNLNKFYEVILSMINSYY

SEQ ID NO: 3291720 - protein, 24 aa, Plasmodium falciparum
LYNNLFFTNMYYKENVIKCIDMNN

SEQ ID NO: 3291721 - protein, 17 aa, Plasmodium falciparum
LYNNNFFRFLEKNNFIY

SEQ ID NO: 3291722 - protein, 23 aa, Plasmodium falciparum
LYNPKYILHNIYNYINQIKETHN

SEQ ID NO: 3291723 - protein, 24 aa, Plasmodium falciparum
LYNQKYFILLNFYTLLLCCNIAFI

SEQ ID NO: 3291724 - protein, 17 aa, Plasmodium falciparum
LYNSSSMFSNDDCFSLC

SEQ ID NO: 3291725 - protein, 18 aa, Plasmodium falciparum
LYNTLKMILLNKNFNNNN

SEQ ID NO: 3291726 - protein, 24 aa, Plasmodium falciparum
LYNTSNLIKLLYSNTLLMLPSKIK

SEQ ID NO: 3291727 - protein, 19 aa, Plasmodium falciparum
LYNYIILNYLYDKKEDMLI

SEQ ID NO: 3291728 - protein, 32 aa, Plasmodium falciparum
LYNYIKKIISSIFLFCFIYSEFDIYQNVIYFP

SEQ ID NO: 3291729 - protein, 17 aa, Plasmodium falciparum
LYPDLYNNILTYEYKKK

SEQ ID NO: 3291730 - protein, 27 aa, Plasmodium falciparum
LYPMEEFLLLFLNYNKNKIKLFSSDYI

SEQ ID NO: 3291731 - protein, 18 aa, Plasmodium falciparum
LYPNLIYSSNLGLDETDM

SEQ ID NO: 3291732 - protein, 23 aa, Plasmodium falciparum
LYPYNCLKMLEKCLLFLSSVNNN

SEQ ID NO: 3291733 - protein, 19 aa, Plasmodium falciparum
LYQDPKEYNLMLSVECFHS

SEQ ID NO: 3291734 - protein, 27 aa, Plasmodium falciparum
LYREKYSFLIYLFNLFDEATLHKEIEK

SEQ ID NO: 3291735 - protein, 17 aa, Plasmodium falciparum
LYRFFINYNMKSSKSSN

SEQ ID NO: 3291736 - protein, 37 aa, Plasmodium falciparum
LYSFSCLIYTTILLFYYTFLCYVHIKNFIKIITIISI

SEQ ID NO: 3291737 - protein, 18 aa, Plasmodium falciparum
LYSHSFIGYGWIDSLFRV

SEQ ID NO: 3291738 - protein, 19 aa, Plasmodium falciparum
LYSLYCQCSDNGVISFWKI

SEQ ID NO: 3291739 - protein, 17 aa, Plasmodium falciparum
LYSMRNSYYTFLKKYME

SEQ ID NO: 3291740 - protein, 18 aa, Plasmodium falciparum
LYSSWLYEYYKIKKIKNV

SEQ ID NO: 3291741 - protein, 31 aa, Plasmodium falciparum
LYSYYSYMICLYFNYIYLLNNIIKLNSFYLP

SEQ ID NO: 3291742 - protein, 18 aa, Plasmodium falciparum
LYTIFLSQPYIHKSPKKY

SEQ ID NO: 3291743 - protein, 23 aa, Plasmodium falciparum
LYTLYKIHFLLPTLFSLISVLLF

SEQ ID NO: 3291744 - protein, 29 aa, Plasmodium falciparum
LYTNKFFNDFFFIINDILSIYIIENTHIP

SEQ ID NO: 3291745 - protein, 18 aa, Plasmodium falciparum
LYTYFQKCDEKKLIDILE

SEQ ID NO: 3291746 - protein, 39 aa, Plasmodium falciparum
LYVKTSFTIMLYILNFIIWNIITLLSMIKPSLLVYYYII

SEQ ID NO: 3291747 - protein, 30 aa, Plasmodium falciparum
LYVNYNPIKCMFFYFLSIISHKPSMNRDTI

SEQ ID NO: 3291748 - protein, 21 aa, Plasmodium falciparum
LYVSEGFFPIYMPTTDTITTT

SEQ ID NO: 3291749 - protein, 25 aa, Plasmodium falciparum
LYVSNYIVYLNYLVLFNPVHISKIK

SEQ ID NO: 3291750 - protein, 34 aa, Plasmodium falciparum
LYVYAKNIPLWIYKFFYIFHYKRLEMISLNCYDY

SEQ ID NO: 3291751 - protein, 18 aa, Plasmodium falciparum
LYWNSIKNDVYNKLVYYI

SEQ ID NO: 3291752 - protein, 26 aa, Plasmodium falciparum
LYYIKKKFPWIFYLKNIIKNKDTSFI

SEQ ID NO: 3291753 - protein, 25 aa, Plasmodium falciparum
MAELKKIFLKSKNYAFLIIDILQKN

SEQ ID NO: 3291754 - protein, 25 aa, Plasmodium falciparum
MAHSKFKIDILTLNFFMGSKRSNPN

SEQ ID NO: 3291755 - protein, 25 aa, Plasmodium falciparum
MAINTLILIFFIIIGSTELCKYSEC

SEQ ID NO: 3291756 - protein, 43 aa, Plasmodium falciparum
MALDSWWFISTAEMPTYLKKLPKFLRFKFPLSERDWIIHSSYN

SEQ ID NO: 3291757 - protein, 26 aa, Plasmodium falciparum
MAMKKLTNIIYFLLNNLTIKEKANDN

SEQ ID NO: 3291758 - protein, 17 aa, Plasmodium falciparum
MARYKYFHKCLIRLLKE

SEQ ID NO: 3291759 - protein, 17 aa, Plasmodium falciparum
MCCNFFDPTQIFNYLWK

SEQ ID NO: 3291760 - protein, 17 aa, Plasmodium falciparum
MCEHVHFSYHVIGHMIK

SEQ ID NO: 3291761 - protein, 26 aa, Plasmodium falciparum
MCINQSYIFLLLEEKLIIISNVKFKK

SEQ ID NO: 3291762 - protein, 21 aa, Plasmodium falciparum
MCMLCMCGCMFGNMYKKPKST

SEQ ID NO: 3291763 - protein, 24 aa, Plasmodium falciparum
MCNNVEVFLIFFKNNIHYNKYLNK

SEQ ID NO: 3291764 - protein, 21 aa, Plasmodium falciparum
MCTMLARSFADIGDIIRGRDL

SEQ ID NO: 3291765 - protein, 26 aa, Plasmodium falciparum
MCTQFRLLYNFIPVLYIDRLDWQFNT

SEQ ID NO: 3291766 - protein, 24 aa, Plasmodium falciparum
MCTSKFFCLYIFNEKHVYKEETSL

SEQ ID NO: 3291767 - protein, 17 aa, Plasmodium falciparum
MCVCIASALNICFNPII

SEQ ID NO: 3291768 - protein, 21 aa, Plasmodium falciparum
MDEIIKCSIILNRNAYYVCTL

SEQ ID NO: 3291769 - protein, 30 aa, Plasmodium falciparum
MDENRDMYSWKPPSFYWKILRNQYVVKEIL

SEQ ID NO: 3291770 - protein, 28 aa, Plasmodium falciparum
MDIELYPLTLLLIINNLDNKYIKPEINV

SEQ ID NO: 3291771 - protein, 28 aa, Plasmodium falciparum
MDINSVLYCLYISVIISYIYLNDFRNAY

SEQ ID NO: 3291772 - protein, 20 aa, Plasmodium falciparum
MDISNFVSIVYFLKKYYNNA

SEQ ID NO: 3291773 - protein, 33 aa, Plasmodium falciparum
MDKIWIFFEDMIPVYVTFLFIIHAKTSLRMFQL

SEQ ID NO: 3291774 - protein, 25 aa, Plasmodium falciparum
MDKYKLNLVLYFMDKQNFNGVYRRL

SEQ ID NO: 3291775 - protein, 18 aa, Plasmodium falciparum
MDLINFSVELWNSFYSYL

SEQ ID NO: 3291776 - protein, 18 aa, Plasmodium falciparum
MDLLKQALLILHNDLHEY

SEQ ID NO: 3291777 - protein, 19 aa, Plasmodium falciparum
MDLYMKTYIMHIKIIVFTF

SEQ ID NO: 3291778 - protein, 22 aa, Plasmodium falciparum
MDMKYFKMLKKIYKYNLNKIFS

SEQ ID NO: 3291779 - protein, 29 aa, Plasmodium falciparum
MDNRILELIIMQSYIYILSKSFKILNLDL

SEQ ID NO: 3291780 - protein, 50 aa, Plasmodium falciparum
MDPRNPNIPYVRFPHHQWGQGMMYGRPYYPWVPFMGDGRGYNFYNPHQHM

SEQ ID NO: 3291781 - protein, 24 aa, Plasmodium falciparum
MDQINFLIIIKIFLIMCDMTTFEN

SEQ ID NO: 3291782 - protein, 29 aa, Plasmodium falciparum
MDRNILDYCIFFIQKFNISYIKCIENNVN

SEQ ID NO: 3291783 - protein, 31 aa, Plasmodium falciparum
MDSISFLYDFILNFLIELFRIIKINEINSLS

SEQ ID NO: 3291784 - protein, 26 aa, Plasmodium falciparum
MDSPEKISLFIYHAFDMEKIKKKLPS

SEQ ID NO: 3291785 - protein, 37 aa, Plasmodium falciparum
MDTQLKWNTYLWGYGFKYYPIFYPKNLHTLLHSHEKQ

SEQ ID NO: 3291786 - protein, 27 aa, Plasmodium falciparum
MDVDKDLIFCVMYLFEYCNIIEIKECE

SEQ ID NO: 3291787 - protein, 27 aa, Plasmodium falciparum
MDVYKSLFIFFIYPNNNIFFNPYLINM

SEQ ID NO: 3291788 - protein, 18 aa, Plasmodium falciparum
MEEILFKRYNFNFSNISV

SEQ ID NO: 3291789 - protein, 30 aa, Plasmodium falciparum
MEELDLDGSLWLLRRNVFQILLDADKIIMS

SEQ ID NO: 3291790 - protein, 24 aa, Plasmodium falciparum
MEELYVIYFYIHEIERKKYLNMEC

SEQ ID NO: 3291791 - protein, 21 aa, Plasmodium falciparum
MEFFLHIKALVYLKFGYINRA

SEQ ID NO: 3291792 - protein, 34 aa, Plasmodium falciparum
MEIEQLWICDPSNKQPIFFTLTKDINSKDIFLFR

SEQ ID NO: 3291793 - protein, 18 aa, Plasmodium falciparum
MEKFYYYIIKNSWGSDWG

SEQ ID NO: 3291794 - protein, 18 aa, Plasmodium falciparum
MELLYKPSILFFQKIILL

SEQ ID NO: 3291795 - protein, 16 aa, Plasmodium falciparum
MENNIKKHKNETSKNK

SEQ ID NO: 3291796 - protein, 29 aa, Plasmodium falciparum
MERFSLYDIFYRYQYLLTMKNKIYLRRTK

SEQ ID NO: 3291797 - protein, 23 aa, Plasmodium falciparum
MERYIKTTYLFNDIKRLVGKSKY

SEQ ID NO: 3291798 - protein, 26 aa, Plasmodium falciparum
METMKFPNKYYPWDNKNVFEPFLELL

SEQ ID NO: 3291799 - protein, 24 aa, Plasmodium falciparum
MEVLEIISLIFYGMKIRDLAKYKR

SEQ ID NO: 3291800 - protein, 18 aa, Plasmodium falciparum
MEYILLLTTHKEELIPLN

SEQ ID NO: 3291801 - protein, 23 aa, Plasmodium falciparum
MEYLDLYNYIRNINKVSYSCFIN

SEQ ID NO: 3291802 - protein, 17 aa, Plasmodium falciparum
MFCLIASSLGQMIFPMC

SEQ ID NO: 3291803 - protein, 17 aa, Plasmodium falciparum
MFCTCSCGSTANSNMEN

SEQ ID NO: 3291804 - protein, 35 aa, Plasmodium falciparum
MFDNCRLYNAPTTIYFKYANELQTLIWPKYEAITD

SEQ ID NO: 3291805 - protein, 25 aa, Plasmodium falciparum
MFELMTRLFRFYTKPIDLIITMNTH

SEQ ID NO: 3291806 - protein, 20 aa, Plasmodium falciparum
MFFNLFYFSLMSIFGFVVLR

SEQ ID NO: 3291807 - protein, 17 aa, Plasmodium falciparum
MFFVMYNQSTYYVELAK

SEQ ID NO: 3291808 - protein, 18 aa, Plasmodium falciparum
MFHFYIFSDDILLQPLNT

SEQ ID NO: 3291809 - protein, 22 aa, Plasmodium falciparum
MFIYKKIILYKSSYNKVTLYDT

SEQ ID NO: 3291810 - protein, 23 aa, Plasmodium falciparum
MFKIIIKELFKYFIIYEKNLNDE

SEQ ID NO: 3291811 - protein, 32 aa, Plasmodium falciparum
MFLDNLNFVLIFYYFLSYLINRLHSFLDVAYS

SEQ ID NO: 3291812 - protein, 19 aa, Plasmodium falciparum
MFLFIHIIKYVSCEEYKIN

SEQ ID NO: 3291813 - protein, 17 aa, Plasmodium falciparum
MFLIKCATSIYDDNFIF

SEQ ID NO: 3291814 - protein, 18 aa, Plasmodium falciparum
MFLSFAVFGIIPLSAYVA

SEQ ID NO: 3291815 - protein, 38 aa, Plasmodium falciparum
MFMKNYLLFIFIINEIFYIYIWLLYVCLHKYTYDTKKI

SEQ ID NO: 3291816 - protein, 17 aa, Plasmodium falciparum
MFNGYYYTSTGGYERIM

SEQ ID NO: 3291817 - protein, 26 aa, Plasmodium falciparum
MFNNPLLFFYSIYFTYAINMNTSLSN

SEQ ID NO: 3291818 - protein, 22 aa, Plasmodium falciparum
MFSILIIFIVFIQCIYMLLQRI

SEQ ID NO: 3291819 - protein, 18 aa, Plasmodium falciparum
MFSSWDKIPILKKNSSKE

SEQ ID NO: 3291820 - protein, 41 aa, Plasmodium falciparum
MGALYPWGIAALVLLILAIILIILYIWLYRRRKNSWKHECK

SEQ ID NO: 3291821 - protein, 19 aa, Plasmodium falciparum
MGEKPFIMSIHDRNLYTGE

SEQ ID NO: 3291822 - protein, 20 aa, Plasmodium falciparum
MGEKPFIMSIHDRNLYTGEE

SEQ ID NO: 3291823 - protein, 24 aa, Plasmodium falciparum
MGENFMGIFFFDSIFKRIKERIIL

SEQ ID NO: 3291824 - protein, 18 aa, Plasmodium falciparum
MGIDYIYDIFRLCKESNV

SEQ ID NO: 3291825 - protein, 18 aa, Plasmodium falciparum
MGIFYPCGIAALVLLILA

SEQ ID NO: 3291826 - protein, 42 aa, Plasmodium falciparum
MGIFYPCGIAALVLLILAVVLIILYIWLYRRRKNSWKHECKK

SEQ ID NO: 3291827 - protein, 18 aa, Plasmodium falciparum
MGKFKNKLFFFTCSEDSM

SEQ ID NO: 3291828 - protein, 18 aa, Plasmodium falciparum
MGLGLIYYYFFIKRGRLL

SEQ ID NO: 3291829 - protein, 18 aa, Plasmodium falciparum
MGTFYNYSSLKCASYIII

SEQ ID NO: 3291830 - protein, 17 aa, Plasmodium falciparum
MGYFSQAVVIMLCSLKR

SEQ ID NO: 3291831 - protein, 22 aa, Plasmodium falciparum
MHAKFTYPFLLNIFKHMNTNTD

SEQ ID NO: 3291832 - protein, 27 aa, Plasmodium falciparum
MHLVCLVFYVYIFKVIVNHLLTNKEDR

SEQ ID NO: 3291833 - protein, 19 aa, Plasmodium falciparum
MHMKLLYIYPAFQNIFNSN

SEQ ID NO: 3291834 - protein, 19 aa, Plasmodium falciparum
MHPFVKYELIWDVKNDIAR

SEQ ID NO: 3291835 - protein, 33 aa, Plasmodium falciparum
MHTCKMHDTFFFNFLYFFYNKYSKNCKNNYIKK

SEQ ID NO: 3291836 - protein, 25 aa, Plasmodium falciparum
MHTELKLRLSRIEELELIQKNTENE

SEQ ID NO: 3291837 - protein, 18 aa, Plasmodium falciparum
MHWKNIYEKWLHDEYKYV

SEQ ID NO: 3291838 - protein, 27 aa, Plasmodium falciparum
MIDQKGRIILLFKKHIYSFIISKILLN

SEQ ID NO: 3291839 - protein, 24 aa, Plasmodium falciparum
MIDYKFIHFIKKYKYELFYEYDKI

SEQ ID NO: 3291840 - protein, 29 aa, Plasmodium falciparum
MIEKRKKLKLILWIKIYMYVWEEVEKDKW

SEQ ID NO: 3291841 - protein, 17 aa, Plasmodium falciparum
MIENIIYFATYLFEMFS

SEQ ID NO: 3291842 - protein, 26 aa, Plasmodium falciparum
MIERQKIIWRKWIAKHVYNIDIMENE

SEQ ID NO: 3291843 - protein, 17 aa, Plasmodium falciparum
MIFFFEKIFHLNILDEH

SEQ ID NO: 3291844 - protein, 18 aa, Plasmodium falciparum
MIFIYLSVKKKKGNGIFI

SEQ ID NO: 3291845 - protein, 24 aa, Plasmodium falciparum
MIFYKSNTLFKKRLLRALGYTVIS

SEQ ID NO: 3291846 - protein, 25 aa, Plasmodium falciparum
MIGDVYYKIAYYLKKNRKYMQRILK

SEQ ID NO: 3291847 - protein, 20 aa, Plasmodium falciparum
MIHWFSIINSIILVILLSFL

SEQ ID NO: 3291848 - protein, 24 aa, Plasmodium falciparum
MIIYSIYLFIWSYLLIRNKNYVIK

SEQ ID NO: 3291849 - protein, 31 aa, Plasmodium falciparum
MIKKINLYRLVFYLTQYFLGNLNIFKYNLLN

SEQ ID NO: 3291850 - protein, 19 aa, Plasmodium falciparum
MIKMCNEAFFLFYQKYNKS

SEQ ID NO: 3291851 - protein, 19 aa, Plasmodium falciparum
MIKPFNMKKKYNLDSSFIE

SEQ ID NO: 3291852 - protein, 27 aa, Plasmodium falciparum
MIKQSQIFFFFYFSLFFFVSSLSNSDK

SEQ ID NO: 3291853 - protein, 18 aa, Plasmodium falciparum
MILFLKKKNFINSTTNNN

SEQ ID NO: 3291854 - protein, 29 aa, Plasmodium falciparum
MINDIYNTYYIFLHISNSIILLSSSPLRN

SEQ ID NO: 3291855 - protein, 21 aa, Plasmodium falciparum
MINKKKDNFLPFPNVKLKNVD

SEQ ID NO: 3291856 - protein, 33 aa, Plasmodium falciparum
MINSEFIVDYLYFIYLFKWINKLYRKYEKIKQL

SEQ ID NO: 3291857 - protein, 18 aa, Plasmodium falciparum
MIPFFFKNNNISNYFLLS

SEQ ID NO: 3291858 - protein, 24 aa, Plasmodium falciparum
MIRDMLYYLYNQSSDILFEYFLDD

SEQ ID NO: 3291859 - protein, 24 aa, Plasmodium falciparum
MISLIIIFYYFYYGKYSRILYGIN

SEQ ID NO: 3291860 - protein, 43 aa, Plasmodium falciparum
MITDHLCFIFEVLCYFTPYVLIYPLILLFTKRTIMSIKSDTNN

SEQ ID NO: 3291861 - protein, 20 aa, Plasmodium falciparum
MIVIFSDILIIFVAMGIDIK

SEQ ID NO: 3291862 - protein, 17 aa, Plasmodium falciparum
MIYFFQYCNISDFKSGF

SEQ ID NO: 3291863 - protein, 17 aa, Plasmodium falciparum
MIYIIKNLPLYKYTEED

SEQ ID NO: 3291864 - protein, 17 aa, Plasmodium falciparum
MIYIKNPLKYVRSYNLF

SEQ ID NO: 3291865 - protein, 17 aa, Plasmodium falciparum
MIYLLFSYILNVENYLK

SEQ ID NO: 3291866 - protein, 19 aa, Plasmodium falciparum
MIYNYLHFHIKKSLYNIMN

SEQ ID NO: 3291867 - protein, 34 aa, Plasmodium falciparum
MIYVLTYIYGFLPLVIIDIFFPSRTKYNWIIHLI

SEQ ID NO: 3291868 - protein, 25 aa, Plasmodium falciparum
MKATENMFFIDAATFFTMIYSSEKL

SEQ ID NO: 3291869 - protein, 23 aa, Plasmodium falciparum
MKEFIYSFIKYYDTLKNELFNEK

SEQ ID NO: 3291870 - protein, 25 aa, Plasmodium falciparum
MKEILYVHNVILNKNFHLNNSYTLF

SEQ ID NO: 3291871 - protein, 30 aa, Plasmodium falciparum
MKEQKFCYNTFWYLAFILNVHVKYLNKIKK

SEQ ID NO: 3291872 - protein, 18 aa, Plasmodium falciparum
MKFSFNIRMFILIKQIVE

SEQ ID NO: 3291873 - protein, 25 aa, Plasmodium falciparum
MKGDFFYYYEYFIKKIVINRQNNIF

SEQ ID NO: 3291874 - protein, 25 aa, Plasmodium falciparum
MKGKICSSYVKYICLTICVIGMLCI

SEQ ID NO: 3291875 - protein, 23 aa, Plasmodium falciparum
MKIIKMIIKALNLALKGYSPTDT

SEQ ID NO: 3291876 - protein, 26 aa, Plasmodium falciparum
MKIYKIVLFCLFINVLFINKYNQYFS

SEQ ID NO: 3291877 - protein, 29 aa, Plasmodium falciparum
MKKDFFFREGVHKNFFIKILNIIKIKEKV

SEQ ID NO: 3291878 - protein, 59 aa, Plasmodium falciparum
MKKDNNFKYIYLQLYMYFIETYLGIDIYSVSIQYIFYNISFLDIYKNICCPLELNQIIK

SEQ ID NO: 3291879 - protein, 25 aa, Plasmodium falciparum
MKKDVKLFFFKKRIIYLTDEINKKT

SEQ ID NO: 3291880 - protein, 23 aa, Plasmodium falciparum
MKKILFVKYMYNKIELKIYSDLT

SEQ ID NO: 3291881 - protein, 19 aa, Plasmodium falciparum
MKKIYKELLISLRGDTYYM

SEQ ID NO: 3291882 - protein, 22 aa, Plasmodium falciparum
MKKKFNNFLLNLRIIYGETEEK

SEQ ID NO: 3291883 - protein, 32 aa, Plasmodium falciparum
MKKRKLIIPFKELFYLYFFMKKLKYSVDPLTY

SEQ ID NO: 3291884 - protein, 29 aa, Plasmodium falciparum
MKKVENMYLFFYYEKYVKWKKKRIKYLVT

SEQ ID NO: 3291885 - protein, 30 aa, Plasmodium falciparum
MKLENNFFLFYIYNIYSYIYYQLILYVSQK

SEQ ID NO: 3291886 - protein, 28 aa, Plasmodium falciparum
MKLHPNFEKLFIKYFFFVIINDNDDDDD

SEQ ID NO: 3291887 - protein, 20 aa, Plasmodium falciparum
MKLSIPFFYLVSQNYFTLYT

SEQ ID NO: 3291888 - protein, 18 aa, Plasmodium falciparum
MKNFLIDSKFKYSNKEKT

SEQ ID NO: 3291889 - protein, 31 aa, Plasmodium falciparum
MKNFNECLYFIDIFFNILLVDYPYKWDNLLE

SEQ ID NO: 3291890 - protein, 32 aa, Plasmodium falciparum
MKNIFLLVIHFLFYIILVHIYYTYNNENLLQC

SEQ ID NO: 3291891 - protein, 19 aa, Plasmodium falciparum
MKNILLYDRFDNIGKVRKS

SEQ ID NO: 3291892 - protein, 26 aa, Plasmodium falciparum
MKNKKYIIDFYSALLLLYTYSEINIL

SEQ ID NO: 3291893 - protein, 28 aa, Plasmodium falciparum
MKNKNNFYINYFFPLVLNYSDNSSRDKK

SEQ ID NO: 3291894 - protein, 30 aa, Plasmodium falciparum
MKQLNTIPLAALLVSCLYLESIFSYDYKLK

SEQ ID NO: 3291895 - protein, 18 aa, Plasmodium falciparum
MKQTNSCSPLLLINELIS

SEQ ID NO: 3291896 - protein, 38 aa, Plasmodium falciparum
MKRGSFLFKYPQIKKCLPPYFIFVIECSYNSIYSNITH

SEQ ID NO: 3291897 - protein, 31 aa, Plasmodium falciparum
MKRKKKKCITKVKFLPLFSSNNVNKLIGMFN

SEQ ID NO: 3291898 - protein, 25 aa, Plasmodium falciparum
MKSFLIIFMLRFFLSLVIILIFIYP

SEQ ID NO: 3291899 - protein, 31 aa, Plasmodium falciparum
MKSSKVYIWMYLYVNFVFDFFYVNIKKNYRK

SEQ ID NO: 3291900 - protein, 20 aa, Plasmodium falciparum
MKSVFLFYKIDHTLFENSDL

SEQ ID NO: 3291901 - protein, 23 aa, Plasmodium falciparum
MKSWSFLNMLPYYFPRYNFSKNN

SEQ ID NO: 3291902 - protein, 32 aa, Plasmodium falciparum
MKSYDFSYSLIILLRFLILNHNLFNKIIDYAI

SEQ ID NO: 3291903 - protein, 18 aa, Plasmodium falciparum
MKSYLYFSYIFLAFSQDV

SEQ ID NO: 3291904 - protein, 24 aa, Plasmodium falciparum
MKTRLYFFNMFLNYLEEKRFEKNM

SEQ ID NO: 3291905 - protein, 36 aa, Plasmodium falciparum
MKVDEYIYINYFLFLYLQILINLISYLNFSTYNEIA

SEQ ID NO: 3291906 - protein, 23 aa, Plasmodium falciparum
MKVINFLFFFNIVKNINRYFLFP

SEQ ID NO: 3291907 - protein, 25 aa, Plasmodium falciparum
MKYNIPSFHFSFYKAFDTFFFNNIL

SEQ ID NO: 3291908 - protein, 27 aa, Plasmodium falciparum
MKYVFYLFIIYMLLNIMIIFFSMFVYF

SEQ ID NO: 3291909 - protein, 18 aa, Plasmodium falciparum
MLCAFFISTMLAIKRIYI

SEQ ID NO: 3291910 - protein, 26 aa, Plasmodium falciparum
MLCFQLFSDHYLYLLKNILSILLIHI

SEQ ID NO: 3291911 - protein, 32 aa, Plasmodium falciparum
MLCIHICLNLYISYKLLMQVQVSKSLKSIESK

SEQ ID NO: 3291912 - protein, 18 aa, Plasmodium falciparum
MLCIKLRDKYEGYAASGI

SEQ ID NO: 3291913 - protein, 26 aa, Plasmodium falciparum
MLCNLFIYDSLIFYNYLNNLKEADKE

SEQ ID NO: 3291914 - protein, 17 aa, Plasmodium falciparum
MLDLPQLPAIFFVNVRN

SEQ ID NO: 3291915 - protein, 18 aa, Plasmodium falciparum
MLDYDKIFKIIKEKLINK

SEQ ID NO: 3291916 - protein, 18 aa, Plasmodium falciparum
MLEKYMLKSFLSNRYIIT

SEQ ID NO: 3291917 - protein, 20 aa, Plasmodium falciparum
MLELFYVFIQIYNNYFVSFC

SEQ ID NO: 3291918 - protein, 17 aa, Plasmodium falciparum
MLFNLKRNQNIFGNLIF

SEQ ID NO: 3291919 - protein, 23 aa, Plasmodium falciparum
MLGGLMSCPDFVLKTVLKLEDLF

SEQ ID NO: 3291920 - protein, 19 aa, Plasmodium falciparum
MLHYLINYIDKNDLLLYNI

SEQ ID NO: 3291921 - protein, 31 aa, Plasmodium falciparum
MLKDNKLYNIIFDVIRFFLYNNIITKRNAHN

SEQ ID NO: 3291922 - protein, 29 aa, Plasmodium falciparum
MLKFVTYKWLYNIISYEIFIRCVKKFIYR

SEQ ID NO: 3291923 - protein, 18 aa, Plasmodium falciparum
MLKSFKNIILSTKNNFFV

SEQ ID NO: 3291924 - protein, 25 aa, Plasmodium falciparum
MLKSFLSNRYIITDLDIFTIDPTKA

SEQ ID NO: 3291925 - protein, 21 aa, Plasmodium falciparum
MLMHIDFYNVNIQKKIFFCII

SEQ ID NO: 3291926 - protein, 26 aa, Plasmodium falciparum
MLNEKDWWLLNNWNYWHLNCDKKNYF

SEQ ID NO: 3291927 - protein, 21 aa, Plasmodium falciparum
MLNFFNYIFNFYLKEIYKNFF

SEQ ID NO: 3291928 - protein, 28 aa, Plasmodium falciparum
MLNFFYICKNILWKKSIFFLTIFVMINS

SEQ ID NO: 3291929 - protein, 23 aa, Plasmodium falciparum
MLNNLYIGILYILNDLLKYVISL

SEQ ID NO: 3291930 - protein, 18 aa, Plasmodium falciparum
MLNYLQKYFYTLIKKHYL

SEQ ID NO: 3291931 - protein, 22 aa, Plasmodium falciparum
MLQKFYIYLTEGLRIQKVSFLM

SEQ ID NO: 3291932 - protein, 17 aa, Plasmodium falciparum
MLQMFITVYGAKYKSYS

SEQ ID NO: 3291933 - protein, 20 aa, Plasmodium falciparum
MLRYYIIIGVLQAMSLKFLS

SEQ ID NO: 3291934 - protein, 24 aa, Plasmodium falciparum
MLSGSLHYFLDILKNFIFINDNFV

SEQ ID NO: 3291935 - protein, 17 aa, Plasmodium falciparum
MLSTDIPILLGCNQLVL

SEQ ID NO: 3291936 - protein, 24 aa, Plasmodium falciparum
MLSVVLLPYINFHIPFVYMKINKN

SEQ ID NO: 3291937 - protein, 34 aa, Plasmodium falciparum
MLTIPYNEISFMNLYLSFLIIDIDKKTVKLFLDQ

SEQ ID NO: 3291938 - protein, 17 aa, Plasmodium falciparum
MLVFSIILSCYYLQLIN

SEQ ID NO: 3291939 - protein, 19 aa, Plasmodium falciparum
MMALDMYKNNIYLISLEPE

SEQ ID NO: 3291940 - protein, 25 aa, Plasmodium falciparum
MMEERNRLLFFFIKDMMFDNYKKWY

SEQ ID NO: 3291941 - protein, 50 aa, Plasmodium falciparum
MMENVFKDNLYFFLYIALTYVYLLLARSVMILIFTPFLSKIGYEVNCKEI

SEQ ID NO: 3291942 - protein, 23 aa, Plasmodium falciparum
MMLDTLQLNLLILVSEKNKKEIN

SEQ ID NO: 3291943 - protein, 26 aa, Plasmodium falciparum
MMNIYNMIFSIFYLRLNAFSDFSTNK

SEQ ID NO: 3291944 - protein, 17 aa, Plasmodium falciparum
MMNVYINNTSYLTNNTR

SEQ ID NO: 3291945 - protein, 32 aa, Plasmodium falciparum
MMSVYYQFFEFLLKYYITFLCTNNLTFLLSFF

SEQ ID NO: 3291946 - protein, 17 aa, Plasmodium falciparum
MMVFGVCIYKVEGSVHV

SEQ ID NO: 3291947 - protein, 20 aa, Plasmodium falciparum
MNANKLLKSLIKYVNKKKIV

SEQ ID NO: 3291948 - protein, 17 aa, Plasmodium falciparum
MNDFVFYFLNCSGGINV

SEQ ID NO: 3291949 - protein, 21 aa, Plasmodium falciparum
MNDGILIPPRRRQLCFRNIRK

SEQ ID NO: 3291950 - protein, 22 aa, Plasmodium falciparum
MNDLEFLIKILNIINVYINDKD

SEQ ID NO: 3291951 - protein, 17 aa, Plasmodium falciparum
MNDLRFFMNSSFDNMLD

SEQ ID NO: 3291952 - protein, 44 aa, Plasmodium falciparum
MNDYFVYIDYIYNVKLQNLLLIKRLISIFRNKLYLNSRNNDLIT

SEQ ID NO: 3291953 - protein, 20 aa, Plasmodium falciparum
MNECQFFKYTLFDKNDNVFD

SEQ ID NO: 3291954 - protein, 18 aa, Plasmodium falciparum
MNEDFIIPFKAKGVLYTN

SEQ ID NO: 3291955 - protein, 20 aa, Plasmodium falciparum
MNEKIPLEKSSFVDDESFKG

SEQ ID NO: 3291956 - protein, 24 aa, Plasmodium falciparum
MNEQLFLLYVSHFKYYIFSFFLYS

SEQ ID NO: 3291957 - protein, 18 aa, Plasmodium falciparum
MNFFDKNIFSLLTRKINK

SEQ ID NO: 3291958 - protein, 24 aa, Plasmodium falciparum
MNFNEFFISFITKVFIKSCITHFI

SEQ ID NO: 3291959 - protein, 19 aa, Plasmodium falciparum
MNHIPLYNILYKSLDVDTT

SEQ ID NO: 3291960 - protein, 26 aa, Plasmodium falciparum
MNHRLTYKEMFIIIKHLYDMHKITKG

SEQ ID NO: 3291961 - protein, 25 aa, Plasmodium falciparum
MNIFQLCVLFSFFKKFHINNTILIS

SEQ ID NO: 3291962 - protein, 35 aa, Plasmodium falciparum
MNIHFMHNIYFNIIINKKYNLLFKMKKGLVNSFFF

SEQ ID NO: 3291963 - protein, 24 aa, Plasmodium falciparum
MNIKYEYIIIDEPLMKVKKDIPQM

SEQ ID NO: 3291964 - protein, 22 aa, Plasmodium falciparum
MNILFILLQFISYNMIFIDNKN

SEQ ID NO: 3291965 - protein, 20 aa, Plasmodium falciparum
MNISLYMPIYYLYDEEDFIK

SEQ ID NO: 3291966 - protein, 17 aa, Plasmodium falciparum
MNIYKFIIKNKFFYIYF

SEQ ID NO: 3291967 - protein, 25 aa, Plasmodium falciparum
MNIYNKWKKWIKWKKNKLANFNEWS

SEQ ID NO: 3291968 - protein, 30 aa, Plasmodium falciparum
MNKENYFAIYFYNLANLIKFLFERRGYFLY

SEQ ID NO: 3291969 - protein, 23 aa, Plasmodium falciparum
MNKFSFIKLCLCLNYFVNLNIKN

SEQ ID NO: 3291970 - protein, 30 aa, Plasmodium falciparum
MNKLKKKKILKFFPLFNYKSDLESIMEEDE

SEQ ID NO: 3291971 - protein, 34 aa, Plasmodium falciparum
MNKLKLFYINLNLYNMFFLILSKSFALCSANSFV

SEQ ID NO: 3291972 - protein, 37 aa, Plasmodium falciparum
MNKNGMLFYRSYLFFLTWYFIGIFYISLKCTYQNKGE

SEQ ID NO: 3291973 - protein, 31 aa, Plasmodium falciparum
MNKYFKRVCKLLILSLWYILKNSINCIYNEL

SEQ ID NO: 3291974 - protein, 29 aa, Plasmodium falciparum
MNLGEFFMEILKIILHRFYNNLDYNDIQI

SEQ ID NO: 3291975 - protein, 21 aa, Plasmodium falciparum
MNLNINILQTLNIGINACNTN

SEQ ID NO: 3291976 - protein, 24 aa, Plasmodium falciparum
MNLPERPFVYVFTDIAKDNITYCM

SEQ ID NO: 3291977 - protein, 19 aa, Plasmodium falciparum
MNMRNWSNIFWSCANIGLG

SEQ ID NO: 3291978 - protein, 17 aa, Plasmodium falciparum
MNNFFIDSLIQKVLYKL

SEQ ID NO: 3291979 - protein, 32 aa, Plasmodium falciparum
MNNIQKYNAFSLPWFNTYFKTSWTYTHLFNNS

SEQ ID NO: 3291980 - protein, 27 aa, Plasmodium falciparum
MNNIYDNIYIILKQKFLNKLNEIIQNH

SEQ ID NO: 3291981 - protein, 38 aa, Plasmodium falciparum
MNNKNNFPFLFKRIQLYISKFFLYIQNDFLSISDVLVD

SEQ ID NO: 3291982 - protein, 25 aa, Plasmodium falciparum
MNNLMIKKKLYFEQIYFGMKNINYE

SEQ ID NO: 3291983 - protein, 33 aa, Plasmodium falciparum
MNNNGMYIFFDLYKCIYIYLYNNIINKEIKKLN

SEQ ID NO: 3291984 - protein, 17 aa, Plasmodium falciparum
MNNPFYRNRSSVYFDEF

SEQ ID NO: 3291985 - protein, 25 aa, Plasmodium falciparum
MNNTQFFLMDNLFSHSLNSPNNIIN

SEQ ID NO: 3291986 - protein, 29 aa, Plasmodium falciparum
MNNYINKLYWIWTDNFFRYLRIKTYIYEN

SEQ ID NO: 3291987 - protein, 17 aa, Plasmodium falciparum
MNNYVFILKIYDNKHIF

SEQ ID NO: 3291988 - protein, 37 aa, Plasmodium falciparum
MNNYYLKDFYKEKFPLLNRFIYLFERIMQNEIPDLVD

SEQ ID NO: 3291989 - protein, 37 aa, Plasmodium falciparum
MNPILFYEIIKFQNLYFIIYVYFFKHSYNITFVSKYN

SEQ ID NO: 3291990 - protein, 18 aa, Plasmodium falciparum
MNPLLYKDKIFKTEMCVC

SEQ ID NO: 3291991 - protein, 23 aa, Plasmodium falciparum
MNQDLLNYYEILDKKLKDNTYIK

SEQ ID NO: 3291992 - protein, 22 aa, Plasmodium falciparum
MNQLNLFHKWLDRHRYICEKWK

SEQ ID NO: 3291993 - protein, 24 aa, Plasmodium falciparum
MNREYLYIIDTYNITLYILNMFKN

SEQ ID NO: 3291994 - protein, 35 aa, Plasmodium falciparum
MNRFIKKIYYVLLKLYFYNLCFHINIYLYTYFQKC

SEQ ID NO: 3291995 - protein, 17 aa, Plasmodium falciparum
MNSIYEYILSDKILCIS

SEQ ID NO: 3291996 - protein, 25 aa, Plasmodium falciparum
MNSKLILWLEIQIILLVVLTLVHIY

SEQ ID NO: 3291997 - protein, 26 aa, Plasmodium falciparum
MNSTHKFFFLQYFLNKDIKNKMIKRK

SEQ ID NO: 3291998 - protein, 28 aa, Plasmodium falciparum
MNYHNIINFLLMFYYNYDYIIQFINKSC

SEQ ID NO: 3291999 - protein, 22 aa, Plasmodium falciparum
MNYLTWKKCLYYIYKIKKYTRK

SEQ ID NO: 3292000 - protein, 31 aa, Plasmodium falciparum
MNYLYNRYTLDIYNYSLYWSPQLVKSYFGNV

SEQ ID NO: 3292001 - protein, 26 aa, Plasmodium falciparum
MPARSCPTSFWNPKMKLLHNMKAFYM

SEQ ID NO: 3292002 - protein, 17 aa, Plasmodium falciparum
MPEKSIHYFLLKEVDYD

SEQ ID NO: 3292003 - protein, 19 aa, Plasmodium falciparum
MPILFSYLQKLYIFPKVRM

SEQ ID NO: 3292004 - protein, 18 aa, Plasmodium falciparum
MPIYINCISSIIVNICRT

SEQ ID NO: 3292005 - protein, 26 aa, Plasmodium falciparum
MPKQLSIFINYLGRNIYLIDKNKLNK

SEQ ID NO: 3292006 - protein, 17 aa, Plasmodium falciparum
MPLFYSNITLKNIINVR

SEQ ID NO: 3292007 - protein, 18 aa, Plasmodium falciparum
MPLLLVEPIDDITDEMKK

SEQ ID NO: 3292008 - protein, 18 aa, Plasmodium falciparum
MPLTIEEYKVCQLYFVAK

SEQ ID NO: 3292009 - protein, 26 aa, Plasmodium falciparum
MPPRRQKLCVYFFANPSQIGSINKQD

SEQ ID NO: 3292010 - protein, 23 aa, Plasmodium falciparum
MPSGLFIYFITNTFFQLFITQIC

SEQ ID NO: 3292011 - protein, 20 aa, Plasmodium falciparum
MPYIYDLTFILNKLNIRFHP

SEQ ID NO: 3292012 - protein, 30 aa, Plasmodium falciparum
MQEILHVIYFLFLFYIKLPSNVQLNSSKYF

SEQ ID NO: 3292013 - protein, 29 aa, Plasmodium falciparum
MQIDKFTLIVWCSFLLDKMHMMSDLLRIG

SEQ ID NO: 3292014 - protein, 41 aa, Plasmodium falciparum
MQIISLIDIYKIVWCLCVLKKNEIFIDLLRILYKEIEYMDV

SEQ ID NO: 3292015 - protein, 18 aa, Plasmodium falciparum
MQIISNDYFLHLYHNIRN

SEQ ID NO: 3292016 - protein, 17 aa, Plasmodium falciparum
MQKWLCLYLERIMKNPN

SEQ ID NO: 3292017 - protein, 35 aa, Plasmodium falciparum
MQLKGNFYMCYVYMLYIFLSFLTKNRKKNYKKFIF

SEQ ID NO: 3292018 - protein, 24 aa, Plasmodium falciparum
MQNHFFLQQFNIKDINFPLYVHTL

SEQ ID NO: 3292019 - protein, 23 aa, Plasmodium falciparum
MQNLIICISLFYSIYICLEKLCK

SEQ ID NO: 3292020 - protein, 17 aa, Plasmodium falciparum
MQPFYFKVLKNIYLDYD

SEQ ID NO: 3292021 - protein, 44 aa, Plasmodium falciparum
MQRDEWKKNKRDFLYICLKEINKLSEDTLMKFYGSDSNKSANDN

SEQ ID NO: 3292022 - protein, 39 aa, Plasmodium falciparum
MRFIFFIGLLVILKNILYFFFWLFNYVKSKIVLKNLKSY

SEQ ID NO: 3292023 - protein, 19 aa, Plasmodium falciparum
MRFYIRSNMIFKLGVLKKV

SEQ ID NO: 3292024 - protein, 29 aa, Plasmodium falciparum
MRIIAQFYLDFIFFFIENIKNNLIILDII

SEQ ID NO: 3292025 - protein, 18 aa, Plasmodium falciparum
MRKNYSKCIYYIKIFINK

SEQ ID NO: 3292026 - protein, 23 aa, Plasmodium falciparum
MRNFQWDIFYSIYNRLIIESSSD

SEQ ID NO: 3292027 - protein, 20 aa, Plasmodium falciparum
MRRFLILYNNIYPSIYTSII

SEQ ID NO: 3292028 - protein, 26 aa, Plasmodium falciparum
MRRKPYLFLFSLFQSLNFLALAFLNL

SEQ ID NO: 3292029 - protein, 27 aa, Plasmodium falciparum
MRRLSQYLCLYILYKDINIYNICNNYF

SEQ ID NO: 3292030 - protein, 24 aa, Plasmodium falciparum
MRSFQNIFLMPEVLKRMINTKHVN

SEQ ID NO: 3292031 - protein, 24 aa, Plasmodium falciparum
MRSTARHILSPSSVLSPTNVLSSN

SEQ ID NO: 3292032 - protein, 27 aa, Plasmodium falciparum
MRTHKMCLFLLNYLYNYSIFNTKEKIM

SEQ ID NO: 3292033 - protein, 17 aa, Plasmodium falciparum
MRYSFYVENICSKKMRH

SEQ ID NO: 3292034 - protein, 24 aa, Plasmodium falciparum
MSEQDFFINVFSQKLKKHNIDLIM

SEQ ID NO: 3292035 - protein, 22 aa, Plasmodium falciparum
MSFYFKLRYYNIIKTYITHLFN

SEQ ID NO: 3292036 - protein, 22 aa, Plasmodium falciparum
MSHIYAHRNFLYINAKLNSHEK

SEQ ID NO: 3292037 - protein, 25 aa, Plasmodium falciparum
MSKNNFICILFSRIYIKKYHKKIFR

SEQ ID NO: 3292038 - protein, 23 aa, Plasmodium falciparum
MSKSRYFLAVPYIGKDTPSSMSE

SEQ ID NO: 3292039 - protein, 29 aa, Plasmodium falciparum
MSKYEYPINILFKLLNSSLYLTSKKLMSH

SEQ ID NO: 3292040 - protein, 19 aa, Plasmodium falciparum
MSLEEIMRTFDEDHLYSIR

SEQ ID NO: 3292041 - protein, 29 aa, Plasmodium falciparum
MSLELFNGMKFLLDKYNFFLSRMHKNSIF

SEQ ID NO: 3292042 - protein, 20 aa, Plasmodium falciparum
MSLLYSYVNLHFYDYSLYYI

SEQ ID NO: 3292043 - protein, 33 aa, Plasmodium falciparum
MSLVSFFCFLSFFLFFFLFHNNNNTILYVNCFN

SEQ ID NO: 3292044 - protein, 21 aa, Plasmodium falciparum
MSMLNYLLKNMPLYNMKKVHE

SEQ ID NO: 3292045 - protein, 28 aa, Plasmodium falciparum
MSNEHFFKLFMFINKYLNFFNINNKMEE

SEQ ID NO: 3292046 - protein, 22 aa, Plasmodium falciparum
MSNLFHLINIPNPLRRERMKAL

SEQ ID NO: 3292047 - protein, 23 aa, Plasmodium falciparum
MSNLYFVVTGIQFWITEYMSVVL

SEQ ID NO: 3292048 - protein, 25 aa, Plasmodium falciparum
MSQKQKIIWRRWVAKHPYRIREKRI

SEQ ID NO: 3292049 - protein, 20 aa, Plasmodium falciparum
MSQPLLGLILLDAQGYFKIQ

SEQ ID NO: 3292050 - protein, 25 aa, Plasmodium falciparum
MSQRQKIIWRKWIAKHPYKINEEII

SEQ ID NO: 3292051 - protein, 43 aa, Plasmodium falciparum
MSRMKLGLLYIIEKFFIRLIDMMTFILTLILSKKTLMYNLNTD

SEQ ID NO: 3292052 - protein, 35 aa, Plasmodium falciparum
MSSLPVALVTFVFLFMFLVFNKMNPFGTTIVQGKK

SEQ ID NO: 3292053 - protein, 25 aa, Plasmodium falciparum
MSSSNIPYYKNTKFYFEPKNHIQHN

SEQ ID NO: 3292054 - protein, 35 aa, Plasmodium falciparum
MSTKQFLKMFMVILYELVFLFSKKSALIDSPLSNT

SEQ ID NO: 3292055 - protein, 39 aa, Plasmodium falciparum
MSYKLIICICIPKLIFYMLLWMKNLLLHQYKIDFLVVVI

SEQ ID NO: 3292056 - protein, 22 aa, Plasmodium falciparum
MTDLFTILYTFVQNDIFIELKK

SEQ ID NO: 3292057 - protein, 41 aa, Plasmodium falciparum
MTKYKDILSIIMKIFFFYLLKYVIYFNHGDVFYSCIHKMLH

SEQ ID NO: 3292058 - protein, 18 aa, Plasmodium falciparum
MTLTHDYVLEGVLELEFL

SEQ ID NO: 3292059 - protein, 33 aa, Plasmodium falciparum
MTNHCNFFNIFLFHFFNYTFNFPMDNFFQLDNK

SEQ ID NO: 3292060 - protein, 26 aa, Plasmodium falciparum
MTNKIKIPYFIFCLNKCDLVSTCKFS

SEQ ID NO: 3292061 - protein, 25 aa, Plasmodium falciparum
MTNPNMMMFNIMLGNNLDGIIPNYM

SEQ ID NO: 3292062 - protein, 39 aa, Plasmodium falciparum
MTNSYGLILIEGKLIFVKFLYICIDKEKFWDESFLCRRD

SEQ ID NO: 3292063 - protein, 23 aa, Plasmodium falciparum
MTNTNICSLYISDSLLIHYDNIK

SEQ ID NO: 3292064 - protein, 17 aa, Plasmodium falciparum
MTRHVMLLYLHKCNKKK

SEQ ID NO: 3292065 - protein, 24 aa, Plasmodium falciparum
MTRKRWWGKYRKVIWKGMLCGIQN

SEQ ID NO: 3292066 - protein, 17 aa, Plasmodium falciparum
MTRNYDEFLKLYNLKDS

SEQ ID NO: 3292067 - protein, 17 aa, Plasmodium falciparum
MTTYLLTSVIGLNYPFL

SEQ ID NO: 3292068 - protein, 23 aa, Plasmodium falciparum
MTYKIDNILLYISLLISSHYVTI

SEQ ID NO: 3292069 - protein, 20 aa, Plasmodium falciparum
MVALWGLWNIAIGLTLEYNP

SEQ ID NO: 3292070 - protein, 59 aa, Plasmodium falciparum
MVCVTFLSIHKFGREKYPDIYGFFLIILILYILKYVFKKMMYKLYYNKYGMGKKYSLKN

SEQ ID NO: 3292071 - protein, 25 aa, Plasmodium falciparum
MVDYFAISMILFIRSFLLESDENHC

SEQ ID NO: 3292072 - protein, 18 aa, Plasmodium falciparum
MVEKPKIYLSYNNKIFYN

SEQ ID NO: 3292073 - protein, 17 aa, Plasmodium falciparum
MVFLIINAYTNINYPRI

SEQ ID NO: 3292074 - protein, 39 aa, Plasmodium falciparum
MVHINMMNLFYSYNYFNFKNIFFYITINREDLYLNKCLM

SEQ ID NO: 3292075 - protein, 19 aa, Plasmodium falciparum
MVILNFYLVVMNTYFFDFS

SEQ ID NO: 3292076 - protein, 35 aa, Plasmodium falciparum
MVISYSYFYILKHIHLYSYIFIKRSVLKIVKKNEM

SEQ ID NO: 3292077 - protein, 18 aa, Plasmodium falciparum
MVKLPWFISSMQLYVGWI

SEQ ID NO: 3292078 - protein, 18 aa, Plasmodium falciparum
MVKSFLRKTIQKMKDNEN

SEQ ID NO: 3292079 - protein, 26 aa, Plasmodium falciparum
MVKYNYLFMLFVLSNYPLVIYFILKI

SEQ ID NO: 3292080 - protein, 17 aa, Plasmodium falciparum
MVLVNKFFFFTNKGDER

SEQ ID NO: 3292081 - protein, 19 aa, Plasmodium falciparum
MVLYNSSSLYRFAINLFNP

SEQ ID NO: 3292082 - protein, 17 aa, Plasmodium falciparum
MVNHRFLNISNISFYDP

SEQ ID NO: 3292083 - protein, 17 aa, Plasmodium falciparum
MVYIFFCNLYISNMFKE

SEQ ID NO: 3292084 - protein, 26 aa, Plasmodium falciparum
MWALGIVTFILLGGYRPFYPCSKFQE

SEQ ID NO: 3292085 - protein, 17 aa, Plasmodium falciparum
MWEAILINMSFFDEHVI

SEQ ID NO: 3292086 - protein, 18 aa, Plasmodium falciparum
MWNSYHSKYFIKQNIFLC

SEQ ID NO: 3292087 - protein, 29 aa, Plasmodium falciparum
MWSVGIGFAAFTYFYLKKKTKASVGNLFQ

SEQ ID NO: 3292088 - protein, 26 aa, Plasmodium falciparum
MWSVGIGFAAFTYFYLKKKTKSSVGN

SEQ ID NO: 3292089 - protein, 18 aa, Plasmodium falciparum
MYDIRRTPAWCDRVLMSG

SEQ ID NO: 3292090 - protein, 24 aa, Plasmodium falciparum
MYDNDDVPIFFLSAKYGIGINEFV

SEQ ID NO: 3292091 - protein, 43 aa, Plasmodium falciparum
MYDNFLSVFMWNENLCLLYIKLNLYKKSYILYSNINKLFMKYL

SEQ ID NO: 3292092 - protein, 27 aa, Plasmodium falciparum
MYDNNVYFHLYELARKKLYDYSEKSQK

SEQ ID NO: 3292093 - protein, 19 aa, Plasmodium falciparum
MYHKFYMSLLFKIINAFYS

SEQ ID NO: 3292094 - protein, 18 aa, Plasmodium falciparum
MYHKPYYKNLKNASLYLF

SEQ ID NO: 3292095 - protein, 18 aa, Plasmodium falciparum
MYHPYNIICYYMHGKKYI

SEQ ID NO: 3292096 - protein, 26 aa, Plasmodium falciparum
MYIKHKCLLIFLDNPSKYKIKKINKH

SEQ ID NO: 3292097 - protein, 17 aa, Plasmodium falciparum
MYIKRGVYFISSNVLLI

SEQ ID NO: 3292098 - protein, 17 aa, Plasmodium falciparum
MYKLFCLYYNKNNKKYI

SEQ ID NO: 3292099 - protein, 30 aa, Plasmodium falciparum
MYKNKLRYILDNIIIISIILSFVVLISFKY

SEQ ID NO: 3292100 - protein, 18 aa, Plasmodium falciparum
MYLKICFLSIKRKYMAYT

SEQ ID NO: 3292101 - protein, 17 aa, Plasmodium falciparum
MYNNALNLSFKKNNDQI

SEQ ID NO: 3292102 - protein, 19 aa, Plasmodium falciparum
MYNVLFVLNLNNLSFEFIL

SEQ ID NO: 3292103 - protein, 28 aa, Plasmodium falciparum
MYNYKYILLIIMFIITIIYLILTIFMVY

SEQ ID NO: 3292104 - protein, 27 aa, Plasmodium falciparum
MYPPYYFDIHFISRILFLLNKRKANSK

SEQ ID NO: 3292105 - protein, 31 aa, Plasmodium falciparum
MYQKDIYNYYLLNILLLVGVKIYIRQHNKLN

SEQ ID NO: 3292106 - protein, 18 aa, Plasmodium falciparum
MYSEFFNIHLLKYNLRNI

SEQ ID NO: 3292107 - protein, 17 aa, Plasmodium falciparum
MYSLLNKLLKIKGKIKK

SEQ ID NO: 3292108 - protein, 40 aa, Plasmodium falciparum
MYSTNLIIHYVFSKFYRLHTIKFKKFLRKFKKVSMTKKST

SEQ ID NO: 3292109 - protein, 25 aa, Plasmodium falciparum
MYTDFFLFTLDFYLYYLSKNSNMLN

SEQ ID NO: 3292110 - protein, 17 aa, Plasmodium falciparum
MYTKLICSQSMNSPIYP

SEQ ID NO: 3292111 - protein, 25 aa, Plasmodium falciparum
MYVHFDDFLLIFTTKIRNMLHFVLN

SEQ ID NO: 3292112 - protein, 18 aa, Plasmodium falciparum
MYYDIALISFVYLFELYL

SEQ ID NO: 3292113 - protein, 28 aa, Plasmodium falciparum
MYYSKHSSFFLLLFFICVSIIKNIYEDS

SEQ ID NO: 3292114 - protein, 25 aa, Plasmodium falciparum
NAAYNEAYFLWTVYNKDSTTAFEAI

SEQ ID NO: 3292115 - protein, 22 aa, Plasmodium falciparum
NACVLFLNIFKPRRLNVKNKCD

SEQ ID NO: 3292116 - protein, 29 aa, Plasmodium falciparum
NADINSITILFYFYKTFYNFHTKKNEQGQ

SEQ ID NO: 3292117 - protein, 31 aa, Plasmodium falciparum
NAEKKILLDILLYIFFHFDIINFKDINCFFK

SEQ ID NO: 3292118 - protein, 31 aa, Plasmodium falciparum
NAFIQSAAVETFFLWHKYKAENTKTQGGVGS

SEQ ID NO: 3292119 - protein, 25 aa, Plasmodium falciparum
NAFNKYFINFFKTKLKKYTTDVFIK

SEQ ID NO: 3292120 - protein, 23 aa, Plasmodium falciparum
NAGALLFIRRDLTVIPKLIYPAK

SEQ ID NO: 3292121 - protein, 24 aa, Plasmodium falciparum
NAGVKKYFLVNDRNSLMINEAKNK

SEQ ID NO: 3292122 - protein, 24 aa, Plasmodium falciparum
NAIDKLFLFIKKAFMFGLIICVFQ

SEQ ID NO: 3292123 - protein, 23 aa, Plasmodium falciparum
NAIKYIELFINSIFLKDTFNEKE

SEQ ID NO: 3292124 - protein, 17 aa, Plasmodium falciparum
NAKILNELIIKNQGTQD

SEQ ID NO: 3292125 - protein, 25 aa, Plasmodium falciparum
NAKNMIQWFIFKKDKIIDNTVDLNE

SEQ ID NO: 3292126 - protein, 26 aa, Plasmodium falciparum
NAKRKYLEYINFFFRNPHIKSNMDIK

SEQ ID NO: 3292127 - protein, 20 aa, Plasmodium falciparum
NALMIWKLLVVFTGCESPVV

SEQ ID NO: 3292128 - protein, 27 aa, Plasmodium falciparum
NALNMFKQMFYLKKIILLICGGDGTIS

SEQ ID NO: 3292129 - protein, 26 aa, Plasmodium falciparum
NALTPFFLLKFHINSPRFTFLHFIKS

SEQ ID NO: 3292130 - protein, 35 aa, Plasmodium falciparum
NAMLSSTIMWSIGIGFATFTYFYLKKKSKSSVGNL

SEQ ID NO: 3292131 - protein, 37 aa, Plasmodium falciparum
NAMLSSTIMWSIGIGFATFTYFYLKKKTKSTIDLLRV

SEQ ID NO: 3292132 - protein, 17 aa, Plasmodium falciparum
NAMTCNAPYDAKIYITK

SEQ ID NO: 3292133 - protein, 28 aa, Plasmodium falciparum
NANQKYILYFYKIIFYIITCLSGLFIKG

SEQ ID NO: 3292134 - protein, 23 aa, Plasmodium falciparum
NAQNAYYLFLFSNKFHNGHYNID

SEQ ID NO: 3292135 - protein, 24 aa, Plasmodium falciparum
NARSKWWNEIKYQVWHAMLCGYRT

SEQ ID NO: 3292136 - protein, 24 aa, Plasmodium falciparum
NASDIFFRQIIMSLKIYYQEKNDT

SEQ ID NO: 3292137 - protein, 27 aa, Plasmodium falciparum
NASFFSDYFFWYRLNIVVQLNEPMKIL

SEQ ID NO: 3292138 - protein, 35 aa, Plasmodium falciparum
NASIIAIIVIVLILVIIYLILRYRRKKKMKKKLQY

SEQ ID NO: 3292139 - protein, 36 aa, Plasmodium falciparum
NASIIAIIVIVLIMVIIYLILRYRRKKKMKKKLQYI

SEQ ID NO: 3292140 - protein, 43 aa, Plasmodium falciparum
NASKKLFLFSYDMKDIWIKKIYKLFYNMIICLILYHHSFCYIT

SEQ ID NO: 3292141 - protein, 24 aa, Plasmodium falciparum
NASSPPMLLYENYKFFPNQKFSLE

SEQ ID NO: 3292142 - protein, 22 aa, Plasmodium falciparum
NASTYFINCHLIIFKNASHLVL

SEQ ID NO: 3292143 - protein, 25 aa, Plasmodium falciparum
NATSNFLRVLFSNPLNKNVLVFCNT

SEQ ID NO: 3292144 - protein, 27 aa, Plasmodium falciparum
NAYKLMQIKRYYLATAFFILSGDIKDA

SEQ ID NO: 3292145 - protein, 26 aa, Plasmodium falciparum
NAYMKFLEYIYFKRKLKKIRKNYNET

SEQ ID NO: 3292146 - protein, 28 aa, Plasmodium falciparum
NCDITYEYLYYYLKIINSIYLNYNNKNI

SEQ ID NO: 3292147 - protein, 24 aa, Plasmodium falciparum
NCEILGIAEIPFIPIPNLELPIKE

SEQ ID NO: 3292148 - protein, 18 aa, Plasmodium falciparum
NCFFLPTKYILAPFVFTF

SEQ ID NO: 3292149 - protein, 22 aa, Plasmodium falciparum
NCFFMNSYMWVINNLIIDDKIM

SEQ ID NO: 3292150 - protein, 18 aa, Plasmodium falciparum
NCFLCPSLYLFKFDIINS

SEQ ID NO: 3292151 - protein, 31 aa, Plasmodium falciparum
NCFSRDFLHTILLCNYVTIIEDLRKTAVKKK

SEQ ID NO: 3292152 - protein, 23 aa, Plasmodium falciparum
NCFTHNYIYIYLLDKSNNNNNNK

SEQ ID NO: 3292153 - protein, 24 aa, Plasmodium falciparum
NCIIYLSIVFYKLLQIIPSKERTD

SEQ ID NO: 3292154 - protein, 25 aa, Plasmodium falciparum
NCIYDKIKLMYQFKPQPYITHIEKN

SEQ ID NO: 3292155 - protein, 17 aa, Plasmodium falciparum
NCIYFSGVYIPDINILK

SEQ ID NO: 3292156 - protein, 22 aa, Plasmodium falciparum
NCIYHIYVEHFFFNHYNEDYFV

SEQ ID NO: 3292157 - protein, 21 aa, Plasmodium falciparum
NCKEDVGCVPPRRQNLNMERL

SEQ ID NO: 3292158 - protein, 28 aa, Plasmodium falciparum
NCKGFYVDMFLINIFNEYINYYNIIMNN

SEQ ID NO: 3292159 - protein, 17 aa, Plasmodium falciparum
NCKSSLSLIKLFVIFEI

SEQ ID NO: 3292160 - protein, 18 aa, Plasmodium falciparum
NCLLKNKLPLYISSLNNI

SEQ ID NO: 3292161 - protein, 24 aa, Plasmodium falciparum
NCLNVFIFYCGNIIKWSVFETYVE

SEQ ID NO: 3292162 - protein, 17 aa, Plasmodium falciparum
NCLYYEKYKWYDIKNVI

SEQ ID NO: 3292163 - protein, 33 aa, Plasmodium falciparum
NCMIQIFENSFLYNYYNFFKRKINNIKLILENC

SEQ ID NO: 3292164 - protein, 25 aa, Plasmodium falciparum
NCNFQFFFKLLFTDKFHNIEEIILL

SEQ ID NO: 3292165 - protein, 23 aa, Plasmodium falciparum
NCNKKIYFLYKIFEDGNISFKNL

SEQ ID NO: 3292166 - protein, 23 aa, Plasmodium falciparum
NCNYFKISFYLKKAFSLLTQEGF

SEQ ID NO: 3292167 - protein, 25 aa, Plasmodium falciparum
NCQKILYKILRDLIILLGPIVPHLS

SEQ ID NO: 3292168 - protein, 22 aa, Plasmodium falciparum
NCQVDLLCSYDLHKGVEHKLIS

SEQ ID NO: 3292169 - protein, 35 aa, Plasmodium falciparum
NCRFSIFCILFIFLYYYLFFSLDFYRIIHLPLDNF

SEQ ID NO: 3292170 - protein, 17 aa, Plasmodium falciparum
NCRIFFKNIKKQLKINY

SEQ ID NO: 3292171 - protein, 24 aa, Plasmodium falciparum
NCSFKCFPYEIWLGNQREAFRKQK

SEQ ID NO: 3292172 - protein, 27 aa, Plasmodium falciparum
NCSYFIKLMDIYLINNNIYFSKNSYLL

SEQ ID NO: 3292173 - protein, 32 aa, Plasmodium falciparum
NCTNLFCDEIYWFICFFGDYIIKYNIIRCYGE

SEQ ID NO: 3292174 - protein, 24 aa, Plasmodium falciparum
NCVPYLNFILKSVSLFEPMMLYYI

SEQ ID NO: 3292175 - protein, 26 aa, Plasmodium falciparum
NCVSIRMIYIYLYFKDIKKSIHHIYT

SEQ ID NO: 3292176 - protein, 25 aa, Plasmodium falciparum
NDADNFLFIPLNELVPKLNDTSSLL

SEQ ID NO: 3292177 - protein, 31 aa, Plasmodium falciparum
NDCCSNIFFLLYVRLLYNLKIPKDILHEICS

SEQ ID NO: 3292178 - protein, 19 aa, Plasmodium falciparum
NDCFIFPYKDNKYIKKHLK

SEQ ID NO: 3292179 - protein, 24 aa, Plasmodium falciparum
NDCKRFHKIYFSVKLDQLYMSNEL

SEQ ID NO: 3292180 - protein, 29 aa, Plasmodium falciparum
NDCYKKKEYFFKHLKRRIQGFNKAFIELF

SEQ ID NO: 3292181 - protein, 23 aa, Plasmodium falciparum
NDDEHQFLRWFQEWTENFCTKRN

SEQ ID NO: 3292182 - protein, 18 aa, Plasmodium falciparum
NDDLLSYIKSLTEIQLRS

SEQ ID NO: 3292183 - protein, 24 aa, Plasmodium falciparum
NDDNYIFIYVSEKKILKISVLFLI

SEQ ID NO: 3292184 - protein, 23 aa, Plasmodium falciparum
NDEDEIFLIFGKNSKDYFTLDFR

SEQ ID NO: 3292185 - protein, 26 aa, Plasmodium falciparum
NDEILYALLILCKYPLFPKSTKIEKS

SEQ ID NO: 3292186 - protein, 25 aa, Plasmodium falciparum
NDELNYLYLFIKNNFQSDIFIIDQY

SEQ ID NO: 3292187 - protein, 25 aa, Plasmodium falciparum
NDESSLIYWCYKNDIPIFCPGLTDG

SEQ ID NO: 3292188 - protein, 24 aa, Plasmodium falciparum
NDEYPYFFNKILNVFRHNIKKLNK

SEQ ID NO: 3292189 - protein, 26 aa, Plasmodium falciparum
NDFLRKYFNLIFYSRDYWSCRNIIKI

SEQ ID NO: 3292190 - protein, 28 aa, Plasmodium falciparum
NDFREVLIFLFFQLLILFIKKESDSIDS

SEQ ID NO: 3292191 - protein, 33 aa, Plasmodium falciparum
NDFSNLIFCSFSLMFLQFLFNGVFKNIKSIGNL

SEQ ID NO: 3292192 - protein, 23 aa, Plasmodium falciparum
NDFVSLLKKFYPFTETVNPYLRR

SEQ ID NO: 3292193 - protein, 18 aa, Plasmodium falciparum
NDGALRMAITMKLKKSNP

SEQ ID NO: 3292194 - protein, 24 aa, Plasmodium falciparum
NDGNFFVYFILKMLWKYQTIDNKT

SEQ ID NO: 3292195 - protein, 25 aa, Plasmodium falciparum
NDHINGDILIYNKKYMNIPFNNNNI

SEQ ID NO: 3292196 - protein, 32 aa, Plasmodium falciparum
NDHKLVYINTIRWSFNGLFLASCDSGGTLVCY

SEQ ID NO: 3292197 - protein, 21 aa, Plasmodium falciparum
NDHLLDKPKFTVLKEDVFRTK

SEQ ID NO: 3292198 - protein, 25 aa, Plasmodium falciparum
NDIDILIQRLYLYKYHKIHVMVLSK

SEQ ID NO: 3292199 - protein, 19 aa, Plasmodium falciparum
NDIFFISIENILFIRQVHP

SEQ ID NO: 3292200 - protein, 30 aa, Plasmodium falciparum
NDIFFLVNSIFKYFLILLNGSHLLKLLYSS

SEQ ID NO: 3292201 - protein, 21 aa, Plasmodium falciparum
NDIFYFIPLSKRKNVYLHPLR

SEQ ID NO: 3292202 - protein, 31 aa, Plasmodium falciparum
NDIIIECLYIQLLLFFFKYMIQTLSYEISKE

SEQ ID NO: 3292203 - protein, 19 aa, Plasmodium falciparum
NDIKYLIFKGKSSIFDSVS

SEQ ID NO: 3292204 - protein, 18 aa, Plasmodium falciparum
NDILRWWIVINSILQLIQ

SEQ ID NO: 3292205 - protein, 25 aa, Plasmodium falciparum
NDIQKYVIIYFYDYLKILKQNKHNK

SEQ ID NO: 3292206 - protein, 33 aa, Plasmodium falciparum
NDIRDVDIIVVFLFSLFLYFNANNIVDMLDRNK

SEQ ID NO: 3292207 - protein, 42 aa, Plasmodium falciparum
NDITIKKTLLLYLYKHNFYVPKIIKRLIFKKLLLQNENNENN

SEQ ID NO: 3292208 - protein, 22 aa, Plasmodium falciparum
NDIYFATQCGAYILMINEYDFY

SEQ ID NO: 3292209 - protein, 19 aa, Plasmodium falciparum
NDIYLEVLFFDLDALSNVI

SEQ ID NO: 3292210 - protein, 17 aa, Plasmodium falciparum
NDIYLLFDELCNYFHEN

SEQ ID NO: 3292211 - protein, 25 aa, Plasmodium falciparum
NDKDLNKMMSYIKNILIYVIDECDT

SEQ ID NO: 3292212 - protein, 23 aa, Plasmodium falciparum
NDKETCLLMFYINKKKKKTKSKE

SEQ ID NO: 3292213 - protein, 25 aa, Plasmodium falciparum
NDKHLNFYIIFYIGELDKKGRPHGF

SEQ ID NO: 3292214 - protein, 24 aa, Plasmodium falciparum
NDKKCIFFLKRNYFINSKFLKNNF

SEQ ID NO: 3292215 - protein, 27 aa, Plasmodium falciparum
NDKLLGLVNKYRYAYFKALEVINHYEE

SEQ ID NO: 3292216 - protein, 17 aa, Plasmodium falciparum
NDKLMDDFYKWFEYFFD

SEQ ID NO: 3292217 - protein, 17 aa, Plasmodium falciparum
NDKLYMNTYTNNINPFD

SEQ ID NO: 3292218 - protein, 24 aa, Plasmodium falciparum
NDKRYKNFFFFKTATICDTIKNEE

SEQ ID NO: 3292219 - protein, 33 aa, Plasmodium falciparum
NDKYTGLIEFIPKLPEWKINSIKRLGVTKNNKI

SEQ ID NO: 3292220 - protein, 26 aa, Plasmodium falciparum
NDLCSILNMLQIILNLNLTGLTSNFL

SEQ ID NO: 3292221 - protein, 22 aa, Plasmodium falciparum
NDLFFSYFKKKIGSLFLKKVHS

SEQ ID NO: 3292222 - protein, 25 aa, Plasmodium falciparum
NDLFIIFLRMPKVHKYYLFADDFIL

SEQ ID NO: 3292223 - protein, 18 aa, Plasmodium falciparum
NDLHSEIIIFYKTRTKNN

SEQ ID NO: 3292224 - protein, 24 aa, Plasmodium falciparum
NDLLKIYRRLEIYPDFIFNNNNVG

SEQ ID NO: 3292225 - protein, 26 aa, Plasmodium falciparum
NDLLTFLHFLYFFKQSQYNDLLIKIL

SEQ ID NO: 3292226 - protein, 26 aa, Plasmodium falciparum
NDLLYKKGKLNFLYEYGMELLHINKV

SEQ ID NO: 3292227 - protein, 23 aa, Plasmodium falciparum
NDLNILYFFKYFFCNNKDNLKGS

SEQ ID NO: 3292228 - protein, 29 aa, Plasmodium falciparum
NDLNLLSINLLIFLLNKIGLYEIDIKIDE

SEQ ID NO: 3292229 - protein, 25 aa, Plasmodium falciparum
NDLYNFTFTIFIKKLSMKLNDYNIS

SEQ ID NO: 3292230 - protein, 23 aa, Plasmodium falciparum
NDMKYWTFLKKNMLNFFLSGNYE

SEQ ID NO: 3292231 - protein, 26 aa, Plasmodium falciparum
NDNDYPLITFKYLTSTYELICIGIIL

SEQ ID NO: 3292232 - protein, 22 aa, Plasmodium falciparum
NDNIVFLCEQIFYFLNKKNIYK

SEQ ID NO: 3292233 - protein, 29 aa, Plasmodium falciparum
NDNKHDWFTPFPMKIVFPKKNTKIKFISC

SEQ ID NO: 3292234 - protein, 34 aa, Plasmodium falciparum
NDNKIKIKLIYLLKLIYYVYENIQYIIRKNKANE

SEQ ID NO: 3292235 - protein, 23 aa, Plasmodium falciparum
NDNKNLFYFFNANYEKLKEKSKV

SEQ ID NO: 3292236 - protein, 25 aa, Plasmodium falciparum
NDNKSKHLNYLKEGMNKCKVKNPEM

SEQ ID NO: 3292237 - protein, 25 aa, Plasmodium falciparum
NDNMFYANLFVLTALSRRDPVKDYY

SEQ ID NO: 3292238 - protein, 25 aa, Plasmodium falciparum
NDNMLWSHLYFLKKKKKKKFDNFHY

SEQ ID NO: 3292239 - protein, 18 aa, Plasmodium falciparum
NDNQTFIQLILKKKIKEL

SEQ ID NO: 3292240 - protein, 26 aa, Plasmodium falciparum
NDNQYLHWFREWKNDFCIDKLKWNDV

SEQ ID NO: 3292241 - protein, 40 aa, Plasmodium falciparum
NDNRLALKAGFTMILYSSSIGFLLLFYANFLDLSEKKEND

SEQ ID NO: 3292242 - protein, 22 aa, Plasmodium falciparum
NDNYNPFYFLNEYARILSGEEE

SEQ ID NO: 3292243 - protein, 20 aa, Plasmodium falciparum
NDPAIISPRSSFLFFVEYDK

SEQ ID NO: 3292244 - protein, 19 aa, Plasmodium falciparum
NDPYFISRKKIKAFYEHMY

SEQ ID NO: 3292245 - protein, 25 aa, Plasmodium falciparum
NDQIIYILNILITFIHNLDIQTVLK

SEQ ID NO: 3292246 - protein, 24 aa, Plasmodium falciparum
NDQKFYQFFLFFFKNNNVQDTSSI

SEQ ID NO: 3292247 - protein, 27 aa, Plasmodium falciparum
NDQQQIHIFYIITILKNILPNFIDTNI

SEQ ID NO: 3292248 - protein, 33 aa, Plasmodium falciparum
NDQVPTYFDYVPQYLRWFEEWAEDFCRKKKIYV

SEQ ID NO: 3292249 - protein, 32 aa, Plasmodium falciparum
NDQVPTYFDYVPQYLRWFEEWAEDFCRKKNKK

SEQ ID NO: 3292250 - protein, 29 aa, Plasmodium falciparum
NDREPDHLIKLITLKNIFSRQLPKMPREY

SEQ ID NO: 3292251 - protein, 30 aa, Plasmodium falciparum
NDRKKNSYLLYLYDTLLEKTKYIFTTTTNK

SEQ ID NO: 3292252 - protein, 26 aa, Plasmodium falciparum
NDRLNNLFYCPVLISASLNNGDIICW

SEQ ID NO: 3292253 - protein, 35 aa, Plasmodium falciparum
NDRTFNNFLKYNLNINVFQLAKQWPKGLKDIINKL

SEQ ID NO: 3292254 - protein, 26 aa, Plasmodium falciparum
NDRYELKYVILKLLFLISESSKNENI

SEQ ID NO: 3292255 - protein, 26 aa, Plasmodium falciparum
NDSIISKNWFLYETPGIRKFDPQKSL

SEQ ID NO: 3292256 - protein, 28 aa, Plasmodium falciparum
NDSIKNEWKIPLFSNSFKMSSFITSEKE

SEQ ID NO: 3292257 - protein, 25 aa, Plasmodium falciparum
NDSKRKLMFCCEGILSIVIHYLLWN

SEQ ID NO: 3292258 - protein, 21 aa, Plasmodium falciparum
NDSLKVLKFILISTINYDTNE

SEQ ID NO: 3292259 - protein, 39 aa, Plasmodium falciparum
NDVEKKRFLFLFKMNKWLLYFFLYLMNIYFSKDNFYTTT

SEQ ID NO: 3292260 - protein, 21 aa, Plasmodium falciparum
NDVKKLIKLSEFYKSCGCSAK

SEQ ID NO: 3292261 - protein, 21 aa, Plasmodium falciparum
NDVLIFNYLKNVNYNLPCCIH

SEQ ID NO: 3292262 - protein, 23 aa, Plasmodium falciparum
NDVNVFFEYNILTNIYNKFVTTV

SEQ ID NO: 3292263 - protein, 30 aa, Plasmodium falciparum
NDVPTYFDYVPQYLRWFEEWAEDFCRKRKH

SEQ ID NO: 3292264 - protein, 31 aa, Plasmodium falciparum
NDVPTYFDYVPQYLRWFEEWAEDFCRKRKYK

SEQ ID NO: 3292265 - protein, 23 aa, Plasmodium falciparum
NDVYKCMLLVLFNECKFFPKYPP

SEQ ID NO: 3292266 - protein, 20 aa, Plasmodium falciparum
NDYIFRIYNLFKLQSYYDIK

SEQ ID NO: 3292267 - protein, 18 aa, Plasmodium falciparum
NDYKKYSFAYPYNYNMNK

SEQ ID NO: 3292268 - protein, 23 aa, Plasmodium falciparum
NDYLKYVLIHLSISKNILDEQIM

SEQ ID NO: 3292269 - protein, 32 aa, Plasmodium falciparum
NDYNMYLMEFFFKIVLRIVPFFKVKNKKKPVN

SEQ ID NO: 3292270 - protein, 28 aa, Plasmodium falciparum
NDYNVRSFLQDLIPRIALTNDKKHFKTL

SEQ ID NO: 3292271 - protein, 25 aa, Plasmodium falciparum
NDYSCYIKYYDILLSFIKEERKRTH

SEQ ID NO: 3292272 - protein, 25 aa, Plasmodium falciparum
NDYSIFFLHLYKITSLNYKYICTKN

SEQ ID NO: 3292273 - protein, 19 aa, Plasmodium falciparum
NDYSYLKRENILYNVNTHN

SEQ ID NO: 3292274 - protein, 32 aa, Plasmodium falciparum
NEAPPKLSDFVLRPTYFRYLEEWGETFCSERM

SEQ ID NO: 3292275 - protein, 25 aa, Plasmodium falciparum
NECKEKFLSLIKDDIYKITKLQNLY

SEQ ID NO: 3292276 - protein, 25 aa, Plasmodium falciparum
NECLTLFSFLSYLIVFPNILNIIEK

SEQ ID NO: 3292277 - protein, 17 aa, Plasmodium falciparum
NEDAFINNLLINIEKIK

SEQ ID NO: 3292278 - protein, 20 aa, Plasmodium falciparum
NEDFYGIWNLVLDTVNTICV

SEQ ID NO: 3292279 - protein, 23 aa, Plasmodium falciparum
NEDIYNFYLRKDIIQFFTCNLIQ

SEQ ID NO: 3292280 - protein, 23 aa, Plasmodium falciparum
NEDMLLKICLRLLESRRINVEND

SEQ ID NO: 3292281 - protein, 22 aa, Plasmodium falciparum
NEDQFLRWMTEWAEYFCKEKKK

SEQ ID NO: 3292282 - protein, 24 aa, Plasmodium falciparum
NEDRKRLDLLSLKNNSLLNEICEE

SEQ ID NO: 3292283 - protein, 25 aa, Plasmodium falciparum
NEEFKFNIFIFYYNNIDSICTEHIL

SEQ ID NO: 3292284 - protein, 23 aa, Plasmodium falciparum
NEEFNIFIIINPFYKGRSELPNN

SEQ ID NO: 3292285 - protein, 41 aa, Plasmodium falciparum
NEEHVLFYPSNFLLLPLKEAFFFFFFFFSHAESVHLELGVK

SEQ ID NO: 3292286 - protein, 20 aa, Plasmodium falciparum
NEEIKIMLIQYIIQNHLFNV

SEQ ID NO: 3292287 - protein, 35 aa, Plasmodium falciparum
NEEKNIFLDNMFNFLIYKFLYLLCKHFKMCDVGTF

SEQ ID NO: 3292288 - protein, 17 aa, Plasmodium falciparum
NEELITFDYYFINKYLN

SEQ ID NO: 3292289 - protein, 26 aa, Plasmodium falciparum
NEENKYFYMITKIYKMLMHMKIKYKE

SEQ ID NO: 3292290 - protein, 32 aa, Plasmodium falciparum
NEERKKYRYLNLKYYILFALGFTIVHNTIQSR

SEQ ID NO: 3292291 - protein, 26 aa, Plasmodium falciparum
NEEWKYFFESPFTLYKKLTPEEIAIR

SEQ ID NO: 3292292 - protein, 25 aa, Plasmodium falciparum
NEEYIMTYKLFAIVLLCIHSPIEIC

SEQ ID NO: 3292293 - protein, 17 aa, Plasmodium falciparum
NEFFGNKKFRSNNFLII

SEQ ID NO: 3292294 - protein, 19 aa, Plasmodium falciparum
NEFLLIYKYERMIKMFKEF

SEQ ID NO: 3292295 - protein, 17 aa, Plasmodium falciparum
NEFREKLWEAMLSEHKN

SEQ ID NO: 3292296 - protein, 29 aa, Plasmodium falciparum
NEFTKVDALKYSPKWLRLLSDVCFQNQHD

SEQ ID NO: 3292297 - protein, 27 aa, Plasmodium falciparum
NEFVSLKDMFIIFNHVKRIERKKFLCM

SEQ ID NO: 3292298 - protein, 22 aa, Plasmodium falciparum
NEGFTFEMWIGINESFFDRKGE

SEQ ID NO: 3292299 - protein, 24 aa, Plasmodium falciparum
NEGKIKSLFLRPFPKFKNYKQVNL

SEQ ID NO: 3292300 - protein, 26 aa, Plasmodium falciparum
NEGNFYAYSLPLKFSSLFLSFQSNIK

SEQ ID NO: 3292301 - protein, 22 aa, Plasmodium falciparum
NEHHGIGIILYNSGESFYGSFI

SEQ ID NO: 3292302 - protein, 26 aa, Plasmodium falciparum
NEHKKFMRIFYTKNNKGLIFQNNLMK

SEQ ID NO: 3292303 - protein, 29 aa, Plasmodium falciparum
NEHVKKNYFWKWITIIEIHLLIIEDIRKE

SEQ ID NO: 3292304 - protein, 29 aa, Plasmodium falciparum
NEHYEYVFFFLIIFYKYMQINLLHFISIF

SEQ ID NO: 3292305 - protein, 23 aa, Plasmodium falciparum
NEHYHLLQELLKIILNINLCDIE

SEQ ID NO: 3292306 - protein, 18 aa, Plasmodium falciparum
NEIFEKYFNADDLVYLFN

SEQ ID NO: 3292307 - protein, 23 aa, Plasmodium falciparum
NEIKDILIYLINKVIDHLIEKKI

SEQ ID NO: 3292308 - protein, 29 aa, Plasmodium falciparum
NEIKLIYFTVWYRIYSFIICMLNLGYFEK

SEQ ID NO: 3292309 - protein, 34 aa, Plasmodium falciparum
NEIKTWDIVPLKIFIIFVKLLYPFCPHICEEFWF

SEQ ID NO: 3292310 - protein, 25 aa, Plasmodium falciparum
NEILEEILRNILKIILCDVETTVRR

SEQ ID NO: 3292311 - protein, 36 aa, Plasmodium falciparum
NEIMENYWKRRIYIYKIKFFLSRTRKIRKRLDLLKA

SEQ ID NO: 3292312 - protein, 36 aa, Plasmodium falciparum
NEINMFNIFAYLNLLYVIILIFQKYESMYYYIKKEE

SEQ ID NO: 3292313 - protein, 33 aa, Plasmodium falciparum
NEISFGFLNKKYKLPIEIPLNKSGLSMYQGLFK

SEQ ID NO: 3292314 - protein, 22 aa, Plasmodium falciparum
NEIYKIIKNKYLNFAPKKYHKD

SEQ ID NO: 3292315 - protein, 23 aa, Plasmodium falciparum
NEKAFLHFLREFILLQINVCSKR

SEQ ID NO: 3292316 - protein, 24 aa, Plasmodium falciparum
NEKEKYMNSLLPSSDFIIINQDKN

SEQ ID NO: 3292317 - protein, 23 aa, Plasmodium falciparum
NEKEKYYLLKGRLYKYNNKFKME

SEQ ID NO: 3292318 - protein, 24 aa, Plasmodium falciparum
NEKFNKKLPLLSKKRFNIAYLKKK

SEQ ID NO: 3292319 - protein, 21 aa, Plasmodium falciparum
NEKFPFPKCYYYTAKLGSKKR

SEQ ID NO: 3292320 - protein, 26 aa, Plasmodium falciparum
NEKHVFLFYNYTLFKKTYECKTLNFK

SEQ ID NO: 3292321 - protein, 34 aa, Plasmodium falciparum
NEKIDFRYAEWFLKTYLFYKYKYSDNTHTKGSIY

SEQ ID NO: 3292322 - protein, 38 aa, Plasmodium falciparum
NEKIIKISLSNFYFFYSSTLFILFSNVVINYILTYIQE

SEQ ID NO: 3292323 - protein, 29 aa, Plasmodium falciparum
NEKIIYEVIICIFTYFNKYHPTDNVDIII

SEQ ID NO: 3292324 - protein, 36 aa, Plasmodium falciparum
NEKIMEILHFLPLKYLLDLLILYDLKDYIKFKTIIR

SEQ ID NO: 3292325 - protein, 30 aa, Plasmodium falciparum
NEKIQSLGILYLVIGIISLGIVACLIYNQM

SEQ ID NO: 3292326 - protein, 42 aa, Plasmodium falciparum
NEKKCTFPFFKQNRFYRIINKKFLLCVKIFKKINNILSVLHN

SEQ ID NO: 3292327 - protein, 34 aa, Plasmodium falciparum
NEKKENIFLKIFRYVKNWFPIKSSNNLKKTNINY

SEQ ID NO: 3292328 - protein, 25 aa, Plasmodium falciparum
NEKKLFIYPIYYLEDKNYFLNVVNN

SEQ ID NO: 3292329 - protein, 36 aa, Plasmodium falciparum
NEKKNLLFLFSSIMKIKFLYNLIIIKQKNIKNVSFK

SEQ ID NO: 3292330 - protein, 37 aa, Plasmodium falciparum
NEKLIYQNIYPFYFNIYLFLLFKVPKDSKMKFEYIRS

SEQ ID NO: 3292331 - protein, 37 aa, Plasmodium falciparum
NEKLNKNKFPRLLVSYFYVLSIVGIIYCLLFNIHTHG

SEQ ID NO: 3292332 - protein, 24 aa, Plasmodium falciparum
NEKLRIRVWEYKQFTLNKLEGIYE

SEQ ID NO: 3292333 - protein, 31 aa, Plasmodium falciparum
NEKMKHFRLFFFSSIIIFKYYDKKIIHNILM

SEQ ID NO: 3292334 - protein, 27 aa, Plasmodium falciparum
NEKNILYLINFYYNVIMLMDYGQLVYS

SEQ ID NO: 3292335 - protein, 24 aa, Plasmodium falciparum
NEKSKLMLFYKIKKQNKIYDFLSN

SEQ ID NO: 3292336 - protein, 22 aa, Plasmodium falciparum
NEKSLFLMFVTSCSRSPLLGFQ

SEQ ID NO: 3292337 - protein, 23 aa, Plasmodium falciparum
NEKTLFLNLLHKCLLLNNLQCNS

SEQ ID NO: 3292338 - protein, 23 aa, Plasmodium falciparum
NEKYLKFLKIYTRKSFCIDKNYN

SEQ ID NO: 3292339 - protein, 17 aa, Plasmodium falciparum
NEKYNVKYYGSSKTKIF

SEQ ID NO: 3292340 - protein, 21 aa, Plasmodium falciparum
NEKYRILICLYIALNFCMELI

SEQ ID NO: 3292341 - protein, 26 aa, Plasmodium falciparum
NELENFYYEFLPFSNLTQIKKKELQD

SEQ ID NO: 3292342 - protein, 50 aa, Plasmodium falciparum
NELEYKVMYPFALTADNMLFIINLLLKTYKHLIVYLIKIPASFNQKIIKS

SEQ ID NO: 3292343 - protein, 18 aa, Plasmodium falciparum
NELFHHINVIKYKCLFFY

SEQ ID NO: 3292344 - protein, 17 aa, Plasmodium falciparum
NELIIAKDYIDKIKEAA

SEQ ID NO: 3292345 - protein, 34 aa, Plasmodium falciparum
NELKKIVNIFIFLKNVITFLKGKKSKYVKEENYG

SEQ ID NO: 3292346 - protein, 20 aa, Plasmodium falciparum
NELKQDFISQYLPNTEPNNN

SEQ ID NO: 3292347 - protein, 27 aa, Plasmodium falciparum
NELKTNEYFTFIKDIFISIHQNYMKEE

SEQ ID NO: 3292348 - protein, 22 aa, Plasmodium falciparum
NELLFICFKFINYPLKHVQLCC

SEQ ID NO: 3292349 - protein, 25 aa, Plasmodium falciparum
NELMIYFFCIILTNLYDNISIYNNI

SEQ ID NO: 3292350 - protein, 25 aa, Plasmodium falciparum
NELYKTFLILFCSSNFFEKHINYLK

SEQ ID NO: 3292351 - protein, 25 aa, Plasmodium falciparum
NEMDQFFRWYIEWTEQYCDQKLLKM

SEQ ID NO: 3292352 - protein, 27 aa, Plasmodium falciparum
NEMENKIPIYYFLKKDIKIDTFTVIAK

SEQ ID NO: 3292353 - protein, 41 aa, Plasmodium falciparum
NEMFPIYIPMYIFNNFYQTHFFLYYLYCVIFKKQFSIHMDT

SEQ ID NO: 3292354 - protein, 25 aa, Plasmodium falciparum
NEMKYYEIFIFYNNKFYEDIIYNSI

SEQ ID NO: 3292355 - protein, 25 aa, Plasmodium falciparum
NEMNKVIIYFILQIFIRDCKTTINI

SEQ ID NO: 3292356 - protein, 23 aa, Plasmodium falciparum
NEMYIIWNYVNSKEKFKYLNMQQ

SEQ ID NO: 3292357 - protein, 17 aa, Plasmodium falciparum
NENAFVPPAYHTSNIIQ

SEQ ID NO: 3292358 - protein, 24 aa, Plasmodium falciparum
NENDRMFENLPSFNLKDENVDHTL

SEQ ID NO: 3292359 - protein, 32 aa, Plasmodium falciparum
NENEDSVPDFMKKTFYLAAAGEGKKLREKHDE

SEQ ID NO: 3292360 - protein, 18 aa, Plasmodium falciparum
NENFLINNVIKDDYKLGE

SEQ ID NO: 3292361 - protein, 26 aa, Plasmodium falciparum
NENFNYNIYLLLSYLKNPNIIEATQK

SEQ ID NO: 3292362 - protein, 19 aa, Plasmodium falciparum
NENILFIDKISILSKLHLL

SEQ ID NO: 3292363 - protein, 24 aa, Plasmodium falciparum
NENINYHPLIKFKSCLMNCFKEIN

SEQ ID NO: 3292364 - protein, 24 aa, Plasmodium falciparum
NENKDNINMIIRDTINMSNLNNNI

SEQ ID NO: 3292365 - protein, 24 aa, Plasmodium falciparum
NENKLHKWIVLHKPKGLLCTSNDE

SEQ ID NO: 3292366 - protein, 34 aa, Plasmodium falciparum
NENKNQILLFNALFKRWLEYFLEDYKKIKHKISH

SEQ ID NO: 3292367 - protein, 27 aa, Plasmodium falciparum
NENKRKLLLYIFPFMKEKKHEKVLIQK

SEQ ID NO: 3292368 - protein, 19 aa, Plasmodium falciparum
NENKWIFLGYENLEHLNDV

SEQ ID NO: 3292369 - protein, 26 aa, Plasmodium falciparum
NENLLKKYKFFLNKLIYHDIQNMNQM

SEQ ID NO: 3292370 - protein, 18 aa, Plasmodium falciparum
NENQLYLNKPYLNSTKDI

SEQ ID NO: 3292371 - protein, 33 aa, Plasmodium falciparum
NENSLNFDFHNLKLLFFFISKFEKFDSSLLENI

SEQ ID NO: 3292372 - protein, 22 aa, Plasmodium falciparum
NENYDRPLKWNLTSDFLEITRD

SEQ ID NO: 3292373 - protein, 18 aa, Plasmodium falciparum
NENYFFNYTFNKLNKNKN

SEQ ID NO: 3292374 - protein, 24 aa, Plasmodium falciparum
NENYYNYIYLLTLCLHCLENITSN

SEQ ID NO: 3292375 - protein, 41 aa, Plasmodium falciparum
NEQEKDKFKRLYVLAALGLIAKLKLILFFSTYVNSRNETNN

SEQ ID NO: 3292376 - protein, 19 aa, Plasmodium falciparum
NEQFGVITYKYIYSKHFFS

SEQ ID NO: 3292377 - protein, 24 aa, Plasmodium falciparum
NEQITGILIERLIVHRPHPWGLLI

SEQ ID NO: 3292378 - protein, 28 aa, Plasmodium falciparum
NEQLFNYFLFLFFNKSISIIPLFDNKPI

SEQ ID NO: 3292379 - protein, 24 aa, Plasmodium falciparum
NERGYYIPHQSSLPQDNRGNSRDS

SEQ ID NO: 3292380 - protein, 25 aa, Plasmodium falciparum
NERIENYFFLLPLINRNINNEKDYT

SEQ ID NO: 3292381 - protein, 19 aa, Plasmodium falciparum
NERIIYIYNSNKYMCSYDI

SEQ ID NO: 3292382 - protein, 37 aa, Plasmodium falciparum
NERIMSNVFFYVYNYMYIYLPLIRKKIRMSKNYFDLQ

SEQ ID NO: 3292383 - protein, 23 aa, Plasmodium falciparum
NERMFMRNYMNDGLFKSQAYNES

SEQ ID NO: 3292384 - protein, 33 aa, Plasmodium falciparum
NERRIKDMHLFLDNKMKYMIDKQHKLIEQLQKD

SEQ ID NO: 3292385 - protein, 23 aa, Plasmodium falciparum
NERSILYVLYENSDLYVKLLSNR

SEQ ID NO: 3292386 - protein, 22 aa, Plasmodium falciparum
NERTLLQWLNTSVLLSTISITL

SEQ ID NO: 3292387 - protein, 26 aa, Plasmodium falciparum
NERVRTIFTIFLIKLGIEEIKNSLNV

SEQ ID NO: 3292388 - protein, 27 aa, Plasmodium falciparum
NESFYLFMELCLCMLTFFSYEHKLLKS

SEQ ID NO: 3292389 - protein, 17 aa, Plasmodium falciparum
NESIPYLVKSYFDQIYF

SEQ ID NO: 3292390 - protein, 22 aa, Plasmodium falciparum
NESKIHFLFSYKENIKSSHTFN

SEQ ID NO: 3292391 - protein, 24 aa, Plasmodium falciparum
NETYGCLFIFLNNISYHVKYLTIC

SEQ ID NO: 3292392 - protein, 29 aa, Plasmodium falciparum
NEVIFKMIKNILYILVPYAHHTKQKKNSD

SEQ ID NO: 3292393 - protein, 28 aa, Plasmodium falciparum
NEVIKIFCNFFQYIYINEYLIRNIFDVS

SEQ ID NO: 3292394 - protein, 34 aa, Plasmodium falciparum
NEVKGYIPSILFFLLLIFLFQKITLKNVTNSGMD

SEQ ID NO: 3292395 - protein, 26 aa, Plasmodium falciparum
NEVKRIMILFFVSYNSKILDLACGHG

SEQ ID NO: 3292396 - protein, 26 aa, Plasmodium falciparum
NEVLFNKIIYKLVKLFKRKLKEKIED

SEQ ID NO: 3292397 - protein, 21 aa, Plasmodium falciparum
NEVLWLIYEHDFLYYFREELN

SEQ ID NO: 3292398 - protein, 30 aa, Plasmodium falciparum
NEVPTYFDYVPQYLRWFEEWAEDFCRKKKK

SEQ ID NO: 3292399 - protein, 23 aa, Plasmodium falciparum
NEVRKILFYSSSDEKKYIMNEIL

SEQ ID NO: 3292400 - protein, 25 aa, Plasmodium falciparum
NEWKLILQHFKKQGGFSIFGNDYNY

SEQ ID NO: 3292401 - protein, 17 aa, Plasmodium falciparum
NEWKNETWFNQWKDDWI

SEQ ID NO: 3292402 - protein, 19 aa, Plasmodium falciparum
NEYDRENSFYILNNKVEKE

SEQ ID NO: 3292403 - protein, 21 aa, Plasmodium falciparum
NEYDVIYLKPLAGVYRSLKKQ

SEQ ID NO: 3292404 - protein, 21 aa, Plasmodium falciparum
NEYFIIFLINANCRHQNNICY

SEQ ID NO: 3292405 - protein, 31 aa, Plasmodium falciparum
NEYFKSYYNSYLFFNIPKYKLNIHNILLNFS

SEQ ID NO: 3292406 - protein, 24 aa, Plasmodium falciparum
NEYKYICNYIPLEKIPNLLNNSTF

SEQ ID NO: 3292407 - protein, 20 aa, Plasmodium falciparum
NEYLMNMYKYSYNKIIIGDS

SEQ ID NO: 3292408 - protein, 18 aa, Plasmodium falciparum
NEYLTYKNKVKRSINIIN

SEQ ID NO: 3292409 - protein, 22 aa, Plasmodium falciparum
NEYLYIYDDGIIYVFVSIVGVN

SEQ ID NO: 3292410 - protein, 36 aa, Plasmodium falciparum
NEYNILWQDELLGRMINYIFDNYYIYIITNNNTCHT

SEQ ID NO: 3292411 - protein, 26 aa, Plasmodium falciparum
NEYPYYFLFSLIYNFFFIPMIIVIST

SEQ ID NO: 3292412 - protein, 51 aa, Plasmodium falciparum
NEYTGIILSLLLLSISIQLKYTKSYMSLLNSLLSLILISIISIIVSSNIKT

SEQ ID NO: 3292413 - protein, 26 aa, Plasmodium falciparum
NFAAYSFLYFFLISLDKYNSFALIKT

SEQ ID NO: 3292414 - protein, 20 aa, Plasmodium falciparum
NFAIGYFRKQGFSQKISMPK

SEQ ID NO: 3292415 - protein, 20 aa, Plasmodium falciparum
NFAKIGFLYSFYENSLQKIR

SEQ ID NO: 3292416 - protein, 19 aa, Plasmodium falciparum
NFCLFLCNIIIKIFNLDQN

SEQ ID NO: 3292417 - protein, 19 aa, Plasmodium falciparum
NFCMELILRFSPESTVFLS

SEQ ID NO: 3292418 - protein, 29 aa, Plasmodium falciparum
NFCRNQLRYILLLYVKRLIMVLEGLKKNE

SEQ ID NO: 3292419 - protein, 21 aa, Plasmodium falciparum
NFCYKGYFPMCFICDKDVSLD

SEQ ID NO: 3292420 - protein, 26 aa, Plasmodium falciparum
NFDDSNMIFPTFNFDFDILKAEEEVL

SEQ ID NO: 3292421 - protein, 17 aa, Plasmodium falciparum
NFDFLKSNILLASSLHY

SEQ ID NO: 3292422 - protein, 33 aa, Plasmodium falciparum
NFDIIHKHILLNLFLVFFYKSVLFICINNLFVY

SEQ ID NO: 3292423 - protein, 32 aa, Plasmodium falciparum
NFDIQTKLFTFYWIYQVYVYGSIFLKDKEIPH

SEQ ID NO: 3292424 - protein, 17 aa, Plasmodium falciparum
NFDYILNRKLEPGKDDT

SEQ ID NO: 3292425 - protein, 19 aa, Plasmodium falciparum
NFDYKLYGAIIHGGISASS

SEQ ID NO: 3292426 - protein, 23 aa, Plasmodium falciparum
NFEETIYLFLYKKLPNIKELKEK

SEQ ID NO: 3292427 - protein, 31 aa, Plasmodium falciparum
NFEILHRRVEWFYHWFIESASNIEYDYRWSV

SEQ ID NO: 3292428 - protein, 28 aa, Plasmodium falciparum
NFERQLLHIMYLFPCASKLLIKYKDVEG

SEQ ID NO: 3292429 - protein, 18 aa, Plasmodium falciparum
NFEYLHENKSLLLKLKSI

SEQ ID NO: 3292430 - protein, 24 aa, Plasmodium falciparum
NFFAEFIPILIFLSNIIIFNNDDY

SEQ ID NO: 3292431 - protein, 34 aa, Plasmodium falciparum
NFFCSNYNILLCFLLYVICFGFVISSLCYDSWKM

SEQ ID NO: 3292432 - protein, 22 aa, Plasmodium falciparum
NFFFFFFFFFVLFLNTNECFQQ

SEQ ID NO: 3292433 - protein, 21 aa, Plasmodium falciparum
NFFIYISNIFKKCSNFFVLNK

SEQ ID NO: 3292434 - protein, 24 aa, Plasmodium falciparum
NFFKTLYEYIYIESIYDFNTPIEI

SEQ ID NO: 3292435 - protein, 25 aa, Plasmodium falciparum
NFFLNIQMINFIYPVQLNVFHFYYM

SEQ ID NO: 3292436 - protein, 17 aa, Plasmodium falciparum
NFFLSALCGIIFFHEKR

SEQ ID NO: 3292437 - protein, 32 aa, Plasmodium falciparum
NFFNLDFWDIFCNLNYIFLFNSNNINMYINNK

SEQ ID NO: 3292438 - protein, 21 aa, Plasmodium falciparum
NFFQNMIKYKIILKLFIHNNL

SEQ ID NO: 3292439 - protein, 18 aa, Plasmodium falciparum
NFFRVYDFDFLNNDTLIV

SEQ ID NO: 3292440 - protein, 18 aa, Plasmodium falciparum
NFFSHIMLLLIKDEDKYE

SEQ ID NO: 3292441 - protein, 27 aa, Plasmodium falciparum
NFFSSLYILYTLYVTYFLYINLEENVD

SEQ ID NO: 3292442 - protein, 19 aa, Plasmodium falciparum
NFFYIINNLIWRKNKRKVK

SEQ ID NO: 3292443 - protein, 23 aa, Plasmodium falciparum
NFGKINFCECLISAPYIDEDNSD

SEQ ID NO: 3292444 - protein, 35 aa, Plasmodium falciparum
NFHFSPFFQGTYYCFLLFYVLCTKTKLLLSTCKIN

SEQ ID NO: 3292445 - protein, 21 aa, Plasmodium falciparum
NFHIRWLALILNSYAKINFVN

SEQ ID NO: 3292446 - protein, 22 aa, Plasmodium falciparum
NFHISYILKVLNFNIKIMNDII

SEQ ID NO: 3292447 - protein, 21 aa, Plasmodium falciparum
NFICMIMFFIVYSLFGNKKGN

SEQ ID NO: 3292448 - protein, 21 aa, Plasmodium falciparum
NFICSQYFPYTNKPLNNFLNI

SEQ ID NO: 3292449 - protein, 40 aa, Plasmodium falciparum
NFIDLVFIFHIHIKRKYYNFLFLYILINKLHFYINNNIVN

SEQ ID NO: 3292450 - protein, 19 aa, Plasmodium falciparum
NFIDTNILNYLFLNNINCS

SEQ ID NO: 3292451 - protein, 23 aa, Plasmodium falciparum
NFIFCRICCIFLFFQNMCFHKYD

SEQ ID NO: 3292452 - protein, 24 aa, Plasmodium falciparum
NFIFNIVIRTIIIKKNMISIGAGG

SEQ ID NO: 3292453 - protein, 17 aa, Plasmodium falciparum
NFIHFYNDSNQKKENYF

SEQ ID NO: 3292454 - protein, 17 aa, Plasmodium falciparum
NFIILYIDYIYNEEFVK

SEQ ID NO: 3292455 - protein, 29 aa, Plasmodium falciparum
NFIKESFIPKFIDLVIWGHEHFSKPYLEE

SEQ ID NO: 3292456 - protein, 18 aa, Plasmodium falciparum
NFILFQKSIKLFLKQIRN

SEQ ID NO: 3292457 - protein, 19 aa, Plasmodium falciparum
NFILLIKGIYYRGMSLLFL

SEQ ID NO: 3292458 - protein, 30 aa, Plasmodium falciparum
NFINNLKKIFPQELIRFIIKISSTIFHGYA

SEQ ID NO: 3292459 - protein, 24 aa, Plasmodium falciparum
NFINYNCVTFCPFTLIPNCNNVVN

SEQ ID NO: 3292460 - protein, 20 aa, Plasmodium falciparum
NFISTNQNVYLLLKSQYDKN

SEQ ID NO: 3292461 - protein, 48 aa, Plasmodium falciparum
NFKDKKYRFDTFPIFHLKSILINKHYWINISIIFNLTIDLIYVILSGD

SEQ ID NO: 3292462 - protein, 30 aa, Plasmodium falciparum
NFKITNYINIILLKFIKLYSSIYSYSTKMY

SEQ ID NO: 3292463 - protein, 22 aa, Plasmodium falciparum
NFKLYDLNYFSIAVSGFLATLV

SEQ ID NO: 3292464 - protein, 28 aa, Plasmodium falciparum
NFKNFHYLYKWKIAVSILLILSITFFLI

SEQ ID NO: 3292465 - protein, 32 aa, Plasmodium falciparum
NFKVSFFLNKLLYFFFLPIKPSINKNLSDKYI

SEQ ID NO: 3292466 - protein, 47 aa, Plasmodium falciparum
NFLCCLKINKYYYYYSWLLFYFIILFFYNIIFTLVVYFYVYKCLMNY

SEQ ID NO: 3292467 - protein, 25 aa, Plasmodium falciparum
NFLEKYLFKYIYKEYKIFINNLIFK

SEQ ID NO: 3292468 - protein, 24 aa, Plasmodium falciparum
NFLFLLFTILYFKSDYIYTFFKKK

SEQ ID NO: 3292469 - protein, 24 aa, Plasmodium falciparum
NFLKKCKLPYFKKLLKYIKYMEEQ

SEQ ID NO: 3292470 - protein, 19 aa, Plasmodium falciparum
NFLKKYNFHLFKNDGIYQK

SEQ ID NO: 3292471 - protein, 22 aa, Plasmodium falciparum
NFLKNFFTLKNMKYIVSSKYIN

SEQ ID NO: 3292472 - protein, 17 aa, Plasmodium falciparum
NFLLFIIEYIKENYKFV

SEQ ID NO: 3292473 - protein, 21 aa, Plasmodium falciparum
NFLNAFINKIIYYLKFINNNS

SEQ ID NO: 3292474 - protein, 24 aa, Plasmodium falciparum
NFMDKLNYIFFTAINNTSSTMKNN

SEQ ID NO: 3292475 - protein, 26 aa, Plasmodium falciparum
NFMNNMNIGFFTYICSTKFFDIKNII

SEQ ID NO: 3292476 - protein, 27 aa, Plasmodium falciparum
NFMVNSTPILFILTPGSDFIKYVEILG

SEQ ID NO: 3292477 - protein, 17 aa, Plasmodium falciparum
NFNFKLFSYLKVCYHND

SEQ ID NO: 3292478 - protein, 26 aa, Plasmodium falciparum
NFNIHSLFVLFKRNKKFLINKKFCPI

SEQ ID NO: 3292479 - protein, 19 aa, Plasmodium falciparum
NFNNIDKFKFKYSKRDYEN

SEQ ID NO: 3292480 - protein, 27 aa, Plasmodium falciparum
NFNNNHILFFYLFPEVKSPYFTLREKT

SEQ ID NO: 3292481 - protein, 28 aa, Plasmodium falciparum
NFNNYILLNILQFLHKMNFFDKNIFSLL

SEQ ID NO: 3292482 - protein, 19 aa, Plasmodium falciparum
NFNRTICYRKYIKCVNKYK

SEQ ID NO: 3292483 - protein, 26 aa, Plasmodium falciparum
NFPHSYIIYFKMDSISFLYDFILNFL

SEQ ID NO: 3292484 - protein, 23 aa, Plasmodium falciparum
NFQNAIEVFFNKYDQRILESTVF

SEQ ID NO: 3292485 - protein, 34 aa, Plasmodium falciparum
NFQVRKYILNYLFNIYYEKYIGLKNLYKTFDLHK

SEQ ID NO: 3292486 - protein, 33 aa, Plasmodium falciparum
NFQYVRKCETLFFKYFLLSLKPIVINADINSIT

SEQ ID NO: 3292487 - protein, 21 aa, Plasmodium falciparum
NFRFFEFFLILFYGSLYYDDD

SEQ ID NO: 3292488 - protein, 22 aa, Plasmodium falciparum
NFRFFEFFLILFYGSLYYDDDE

SEQ ID NO: 3292489 - protein, 17 aa, Plasmodium falciparum
NFRIFKRRYLNKNNYLL

SEQ ID NO: 3292490 - protein, 23 aa, Plasmodium falciparum
NFRKFYDCWYFDYYIDCKIVDFL

SEQ ID NO: 3292491 - protein, 17 aa, Plasmodium falciparum
NFRLFACMNPPIIPNIR

SEQ ID NO: 3292492 - protein, 20 aa, Plasmodium falciparum
NFRMISLTKLIKKYSLNTYD

SEQ ID NO: 3292493 - protein, 25 aa, Plasmodium falciparum
NFRNIVINDFFFFINKYVCASKIIN

SEQ ID NO: 3292494 - protein, 20 aa, Plasmodium falciparum
NFRPQLWLTSIVESYLFLLN

SEQ ID NO: 3292495 - protein, 38 aa, Plasmodium falciparum
NFSISFIFFQKVNINIFFLLFFWIDYLPSSHKNILQNM

SEQ ID NO: 3292496 - protein, 20 aa, Plasmodium falciparum
NFSKSVLYLTKGYRPTIIQS

SEQ ID NO: 3292497 - protein, 17 aa, Plasmodium falciparum
NFSLKCPIKIAARFRDV

SEQ ID NO: 3292498 - protein, 23 aa, Plasmodium falciparum
NFSLSNFNLFNKKKLRNLILYIH

SEQ ID NO: 3292499 - protein, 34 aa, Plasmodium falciparum
NFSNIFYICLLLIIPTFERIFLNYKIKNITLDLH

SEQ ID NO: 3292500 - protein, 24 aa, Plasmodium falciparum
NFSNTYMLIIYKSLCIYNIQKKVF

SEQ ID NO: 3292501 - protein, 22 aa, Plasmodium falciparum
NFSSIFDQLNAKYYNKCICQNN

SEQ ID NO: 3292502 - protein, 17 aa, Plasmodium falciparum
NFTIPFLEKNEILGFLS

SEQ ID NO: 3292503 - protein, 28 aa, Plasmodium falciparum
NFTISSERKSWKLPPPPPNIPPSYDRSS

SEQ ID NO: 3292504 - protein, 24 aa, Plasmodium falciparum
NFVKSILNILLLISKYKMKKQYML

SEQ ID NO: 3292505 - protein, 17 aa, Plasmodium falciparum
NFVKYINEFLLIPIYCT

SEQ ID NO: 3292506 - protein, 20 aa, Plasmodium falciparum
NFWKGLGIYLCTLSGAALGQ

SEQ ID NO: 3292507 - protein, 51 aa, Plasmodium falciparum
NFYDNPWCHIKFSSIVNILLYIFMKVIKRFIKSFVILIYSDVYTVFHKTLP

SEQ ID NO: 3292508 - protein, 26 aa, Plasmodium falciparum
NFYEFDYYNYLLLDFTKQLCYHNFVK

SEQ ID NO: 3292509 - protein, 27 aa, Plasmodium falciparum
NFYFNKEPYFILLYKNNTITILNNNLN

SEQ ID NO: 3292510 - protein, 19 aa, Plasmodium falciparum
NFYFSFAVFFSYLGSAFLH

SEQ ID NO: 3292511 - protein, 17 aa, Plasmodium falciparum
NFYFYHFEASRGDLYKY

SEQ ID NO: 3292512 - protein, 22 aa, Plasmodium falciparum
NFYGYFVKFTFNNSVPLKLKKN

SEQ ID NO: 3292513 - protein, 21 aa, Plasmodium falciparum
NFYIISNFRFLERYFNIFNKY

SEQ ID NO: 3292514 - protein, 28 aa, Plasmodium falciparum
NFYINRNTIIPIYFYNNIYKFIDYNTEV

SEQ ID NO: 3292515 - protein, 23 aa, Plasmodium falciparum
NFYKKNICLSGCKKRIFLKIYCF

SEQ ID NO: 3292516 - protein, 22 aa, Plasmodium falciparum
NFYLFLFISIIEFTLLYTREVN

SEQ ID NO: 3292517 - protein, 20 aa, Plasmodium falciparum
NFYLVSFGNKKLKLYGSLKN

SEQ ID NO: 3292518 - protein, 21 aa, Plasmodium falciparum
NFYMAYFDLFLKWCTHVKNGK

SEQ ID NO: 3292519 - protein, 23 aa, Plasmodium falciparum
NGADDFFFTSNKYGDIIQSDTES

SEQ ID NO: 3292520 - protein, 25 aa, Plasmodium falciparum
NGAHERYFLFLSKRKIYSIEYKIWL

SEQ ID NO: 3292521 - protein, 26 aa, Plasmodium falciparum
NGDHTLYADVILNSLLSESSIQQIRD

SEQ ID NO: 3292522 - protein, 25 aa, Plasmodium falciparum
NGDIFHFNVDNKFLWNLDKPININM

SEQ ID NO: 3292523 - protein, 31 aa, Plasmodium falciparum
NGDVPTYFDYVPQYLRWFEEWAEDFCRKKKK

SEQ ID NO: 3292524 - protein, 18 aa, Plasmodium falciparum
NGFFYPRKIQNKKRQILL

SEQ ID NO: 3292525 - protein, 25 aa, Plasmodium falciparum
NGFLSYYVSLPLSFIKEIQYFMIKN

SEQ ID NO: 3292526 - protein, 26 aa, Plasmodium falciparum
NGHLFENIILFIYKEYERIYKKRFVE

SEQ ID NO: 3292527 - protein, 23 aa, Plasmodium falciparum
NGHNFFLSLKILNRLLLKNRKMN

SEQ ID NO: 3292528 - protein, 23 aa, Plasmodium falciparum
NGILKIFVDLYDIYLSFLSKKTT

SEQ ID NO: 3292529 - protein, 27 aa, Plasmodium falciparum
NGININFYLTYWRLSISDIYVPHKQYQ

SEQ ID NO: 3292530 - protein, 21 aa, Plasmodium falciparum
NGIYKFINIFGSNIIRSNLRD

SEQ ID NO: 3292531 - protein, 25 aa, Plasmodium falciparum
NGKARTLFLFVHPRNYLINKKNEIE

SEQ ID NO: 3292532 - protein, 28 aa, Plasmodium falciparum
NGKGKLLFKYFNIWYLYEGNFCNDEIVD

SEQ ID NO: 3292533 - protein, 23 aa, Plasmodium falciparum
NGKINHSFLGDVLLAAKYQAQHT

SEQ ID NO: 3292534 - protein, 23 aa, Plasmodium falciparum
NGKYEHVFFLTYDNKLFGIGNNK

SEQ ID NO: 3292535 - protein, 26 aa, Plasmodium falciparum
NGLILVSYAFGFWYGTRIIINSATNQ

SEQ ID NO: 3292536 - protein, 27 aa, Plasmodium falciparum
NGLQQDMFQLPFLSPYSQRPLNIQNHT

SEQ ID NO: 3292537 - protein, 29 aa, Plasmodium falciparum
NGLVYENLSLYVVLWDIFTNNISKYTVHF

SEQ ID NO: 3292538 - protein, 31 aa, Plasmodium falciparum
NGMFPKMLIALQIIWIFLNAPQKINIMEYIL

SEQ ID NO: 3292539 - protein, 28 aa, Plasmodium falciparum
NGNNNIINPFFLYNKMFCMNNNANNFNN

SEQ ID NO: 3292540 - protein, 26 aa, Plasmodium falciparum
NGQHIWNGMIYALTYNTDTPSGDKPT

SEQ ID NO: 3292541 - protein, 23 aa, Plasmodium falciparum
NGRKKILEIYIKKIKSDLKLEDI

SEQ ID NO: 3292542 - protein, 40 aa, Plasmodium falciparum
NGSDYIMYKMVILKALLFYGYFTLYERLSYEFKIYEHQIF

SEQ ID NO: 3292543 - protein, 22 aa, Plasmodium falciparum
NGSFILYFFNNPLTSFLGVFNI

SEQ ID NO: 3292544 - protein, 35 aa, Plasmodium falciparum
NGSINVKFIFFYILKIFFYLKNNPYSTIFDIYKSV

SEQ ID NO: 3292545 - protein, 23 aa, Plasmodium falciparum
NGSMFFNNDKINFILSNSRSPIG

SEQ ID NO: 3292546 - protein, 54 aa, Plasmodium falciparum
NGTDLKDTKKDRIRFHFYFYFFIVKIILLSLLIWTVIYSNNCSNGKYKSTLYIV

SEQ ID NO: 3292547 - protein, 20 aa, Plasmodium falciparum
NGTLFFTLLCVIYMIVKEGS

SEQ ID NO: 3292548 - protein, 19 aa, Plasmodium falciparum
NGTVVFSVQPYYLDIYTCK

SEQ ID NO: 3292549 - protein, 18 aa, Plasmodium falciparum
NGVYYENWILKNINFRNS

SEQ ID NO: 3292550 - protein, 43 aa, Plasmodium falciparum
NGYLKIDRYIYFYPKLKTDIILFFFKEIFLNDNILKIDRKFLK

SEQ ID NO: 3292551 - protein, 48 aa, Plasmodium falciparum
NGYNSYIIQKYIDNPLLMYKKKFDFRIYILLLPGKNYPKIYLSKVGFA

SEQ ID NO: 3292552 - protein, 29 aa, Plasmodium falciparum
NHDISYFQKYLPRLKYRIQNMIQKGTLLL

SEQ ID NO: 3292553 - protein, 24 aa, Plasmodium falciparum
NHDKENIYFIDYSKILSIDNKNKE

SEQ ID NO: 3292554 - protein, 32 aa, Plasmodium falciparum
NHEDYYIRIYSIKILIILLSDTNIRDSLDKKN

SEQ ID NO: 3292555 - protein, 20 aa, Plasmodium falciparum
NHFSIQVLFPPFSNYNFFQF

SEQ ID NO: 3292556 - protein, 18 aa, Plasmodium falciparum
NHFYTIIYSLLNYQLEQP

SEQ ID NO: 3292557 - protein, 17 aa, Plasmodium falciparum
NHIFNKIMKYNISSIWL

SEQ ID NO: 3292558 - protein, 36 aa, Plasmodium falciparum
NHIFVKYINILNIFIDRIFISLNKKFIFFKSVYKNK

SEQ ID NO: 3292559 - protein, 18 aa, Plasmodium falciparum
NHIKLFSIDLDVLKTFHL

SEQ ID NO: 3292560 - protein, 23 aa, Plasmodium falciparum
NHILAFFYLLYLNIAITHKDYNN

SEQ ID NO: 3292561 - protein, 30 aa, Plasmodium falciparum
NHILIKNFYYLIFFLLIRYHTIIGNISHSG

SEQ ID NO: 3292562 - protein, 24 aa, Plasmodium falciparum
NHILLIFINFFTRLSLLLFIYVHY

SEQ ID NO: 3292563 - protein, 25 aa, Plasmodium falciparum
NHIQLSKFIFPLSLYTKKDVKKYMN

SEQ ID NO: 3292564 - protein, 18 aa, Plasmodium falciparum
NHIYIPKTNIKILIQANY

SEQ ID NO: 3292565 - protein, 27 aa, Plasmodium falciparum
NHKALYWKVTLCHLSIFYNIAFSYMML

SEQ ID NO: 3292566 - protein, 25 aa, Plasmodium falciparum
NHKNNYFFFFNFMKNLLTYMSVTGM

SEQ ID NO: 3292567 - protein, 18 aa, Plasmodium falciparum
NHLKLQDKDFYLIGFSMG

SEQ ID NO: 3292568 - protein, 35 aa, Plasmodium falciparum
NHLNIYSFLIFYIICCLFYFFFSTNLKTTLSLNLQ

SEQ ID NO: 3292569 - protein, 25 aa, Plasmodium falciparum
NHNIGFFFIYNKKQGINYYILILLS

SEQ ID NO: 3292570 - protein, 29 aa, Plasmodium falciparum
NHNIYKLLFLWLLFLYVTSFFTFYFRKYY

SEQ ID NO: 3292571 - protein, 23 aa, Plasmodium falciparum
NHNLLILNNTSFLKPTKLTIYNY

SEQ ID NO: 3292572 - protein, 39 aa, Plasmodium falciparum
NHRELKYICLFYIILLFCFFLWCIFKKYHENRINRKHKR

SEQ ID NO: 3292573 - protein, 17 aa, Plasmodium falciparum
NHRFLNISNISFYDPHV

SEQ ID NO: 3292574 - protein, 18 aa, Plasmodium falciparum
NHRNCISPLIPPLKKKKK

SEQ ID NO: 3292575 - protein, 20 aa, Plasmodium falciparum
NHSFYIYGLVFSNCSIYFDD

SEQ ID NO: 3292576 - protein, 19 aa, Plasmodium falciparum
NHSIGYLQYILLNTLQNKN

SEQ ID NO: 3292577 - protein, 32 aa, Plasmodium falciparum
NHTFMAYYVLINSFLFYLTVGGPNRLTCLFRM

SEQ ID NO: 3292578 - protein, 26 aa, Plasmodium falciparum
NHTLTSILIFDGPLKPLDIYCYMELD

SEQ ID NO: 3292579 - protein, 21 aa, Plasmodium falciparum
NHTMFGYFNYSTGKCETYYMN

SEQ ID NO: 3292580 - protein, 26 aa, Plasmodium falciparum
NHVLLILYSFLIYKIKWEHIKKINEH

SEQ ID NO: 3292581 - protein, 26 aa, Plasmodium falciparum
NHYYYTFYDLIYEPPFYYLKSHKTVQ

SEQ ID NO: 3292582 - protein, 23 aa, Plasmodium falciparum
NIAIQFTKNWKLLFKNIRNNIIT

SEQ ID NO: 3292583 - protein, 20 aa, Plasmodium falciparum
NIAIVFLFLTIIHYIRAYNK

SEQ ID NO: 3292584 - protein, 31 aa, Plasmodium falciparum
NICDISNQLVYIKIFVWDINDTYPEGKIVEI

SEQ ID NO: 3292585 - protein, 32 aa, Plasmodium falciparum
NICENICIYIKSLCYFFQRNYIYYYINMCILL

SEQ ID NO: 3292586 - protein, 20 aa, Plasmodium falciparum
NICNNICGILVISKIIDIFI

SEQ ID NO: 3292587 - protein, 41 aa, Plasmodium falciparum
NICTPIFDSIFITILLFAVIHIYKFFFYKKNIDIFEQLLCT

SEQ ID NO: 3292588 - protein, 22 aa, Plasmodium falciparum
NIDILGKKFNYPIPFNKLNNID

SEQ ID NO: 3292589 - protein, 25 aa, Plasmodium falciparum
NIDKDQFMFLRKILLDLINDQDVVV

SEQ ID NO: 3292590 - protein, 27 aa, Plasmodium falciparum
NIDKKFEQLFKESYLFKSVREQNWECK

SEQ ID NO: 3292591 - protein, 25 aa, Plasmodium falciparum
NIDLCLFIYKLLYISVNTNILKNII

SEQ ID NO: 3292592 - protein, 22 aa, Plasmodium falciparum
NIDMGFLFDLLEKKVLEKNVMK

SEQ ID NO: 3292593 - protein, 34 aa, Plasmodium falciparum
NIDNYLYDFVILLIRILLLIYNKKNTMNIFENMK

SEQ ID NO: 3292594 - protein, 32 aa, Plasmodium falciparum
NIDPPTYFDYVPQYLRWFEEWAEDFCRKKKHK

SEQ ID NO: 3292595 - protein, 26 aa, Plasmodium falciparum
NIDRLFLKILLKSKKWCLKILNIFLY

SEQ ID NO: 3292596 - protein, 29 aa, Plasmodium falciparum
NIDSSVLYFVLLPILLYEATQDINYYAFK

SEQ ID NO: 3292597 - protein, 25 aa, Plasmodium falciparum
NIDTPTIRHIYFDTFGKYASITHIP

SEQ ID NO: 3292598 - protein, 36 aa, Plasmodium falciparum
NIDTVEACIIYLLQTMWKFYISYILSIPNELEQYYE

SEQ ID NO: 3292599 - protein, 18 aa, Plasmodium falciparum
NIDYKYCPYLKPLEIKGI

SEQ ID NO: 3292600 - protein, 29 aa, Plasmodium falciparum
NIEEHLFDNMYFILSSISYKNVFHMNIMH

SEQ ID NO: 3292601 - protein, 18 aa, Plasmodium falciparum
NIEHNLLLIIKYVYTVHK

SEQ ID NO: 3292602 - protein, 37 aa, Plasmodium falciparum
NIEINNLINMLLFRSFNLFYYFINYMKNVQNVQWVKK

SEQ ID NO: 3292603 - protein, 30 aa, Plasmodium falciparum
NIEIRKILFHFYFIKRFLSLIFNKHANEDD

SEQ ID NO: 3292604 - protein, 24 aa, Plasmodium falciparum
NIEKDYLQFLKNNLSKYIRDNKNY

SEQ ID NO: 3292605 - protein, 30 aa, Plasmodium falciparum
NIEKKFISYIKYYITKFLNNLLPFSTDIST

SEQ ID NO: 3292606 - protein, 34 aa, Plasmodium falciparum
NIELDDAYICFFFLIFIDIYKFLTTGFNLSTLHL

SEQ ID NO: 3292607 - protein, 27 aa, Plasmodium falciparum
NIELILILIIFIVSFFLLFKNIFTDNY

SEQ ID NO: 3292608 - protein, 27 aa, Plasmodium falciparum
NIENILLLFLIYMVKVFYRINKFILFI

SEQ ID NO: 3292609 - protein, 30 aa, Plasmodium falciparum
NIETIWFLMSTWHGVIFIVPYILCYFFVCH

SEQ ID NO: 3292610 - protein, 21 aa, Plasmodium falciparum
NIFEKFQIVSLLKENYLYFYN

SEQ ID NO: 3292611 - protein, 19 aa, Plasmodium falciparum
NIFFLCGKFTNIYKKEFSI

SEQ ID NO: 3292612 - protein, 25 aa, Plasmodium falciparum
NIFFSLCIYLYNIAKIMMLKHPYDM

SEQ ID NO: 3292613 - protein, 18 aa, Plasmodium falciparum
NIFHLFQVQIGMSKAIKL

SEQ ID NO: 3292614 - protein, 21 aa, Plasmodium falciparum
NIFILHFIVITNFINLFKECE

SEQ ID NO: 3292615 - protein, 18 aa, Plasmodium falciparum
NIFILLSNCLINFTNLME

SEQ ID NO: 3292616 - protein, 31 aa, Plasmodium falciparum
NIFKKYSDFTYFIQKELFLKIQAMKHILFND

SEQ ID NO: 3292617 - protein, 20 aa, Plasmodium falciparum
NIFKWNKLKIYKGAYTKLSE

SEQ ID NO: 3292618 - protein, 23 aa, Plasmodium falciparum
NIFLLNTIIFILNQYIKRKDYGS

SEQ ID NO: 3292619 - protein, 17 aa, Plasmodium falciparum
NIFLSMNITLNGNIYNT

SEQ ID NO: 3292620 - protein, 24 aa, Plasmodium falciparum
NIFNDKWRFNYYFKFSFNQVDYEL

SEQ ID NO: 3292621 - protein, 20 aa, Plasmodium falciparum
NIFNKYFVELFRRKLKEYTS

SEQ ID NO: 3292622 - protein, 28 aa, Plasmodium falciparum
NIFNNIIKTLFFFININIPYKIHKNNLI

SEQ ID NO: 3292623 - protein, 27 aa, Plasmodium falciparum
NIFSNKWLCSFISFYLKNVNALKYISF

SEQ ID NO: 3292624 - protein, 31 aa, Plasmodium falciparum
NIFSRQLPKMPREYIVRLVFDRNHYTFCLLK

SEQ ID NO: 3292625 - protein, 29 aa, Plasmodium falciparum
NIFTLWNNIILYFILIVTFTFYNKDLFNK

SEQ ID NO: 3292626 - protein, 26 aa, Plasmodium falciparum
NIFTYLFEWIVFIIKYKEHHKDMSNI

SEQ ID NO: 3292627 - protein, 19 aa, Plasmodium falciparum
NIFVHFLNNFLYKNFFLKI

SEQ ID NO: 3292628 - protein, 19 aa, Plasmodium falciparum
NIFVKIINLILAKILSVIK

SEQ ID NO: 3292629 - protein, 17 aa, Plasmodium falciparum
NIFYFNFSRYNNITTDL

SEQ ID NO: 3292630 - protein, 20 aa, Plasmodium falciparum
NIGDAFLLVWKYQKKEYSNK

SEQ ID NO: 3292631 - protein, 30 aa, Plasmodium falciparum
NIGDSVGLLIKKHFYLPLNRIHNASEFNEK

SEQ ID NO: 3292632 - protein, 32 aa, Plasmodium falciparum
NIGEFKMLVMINRFLWRKIKKDLYDTNKKNIS

SEQ ID NO: 3292633 - protein, 29 aa, Plasmodium falciparum
NIGIFFNDFFSYIYLLCEDIKYFQNVSNK

SEQ ID NO: 3292634 - protein, 19 aa, Plasmodium falciparum
NIGIMKKFYKFCGKGLILV

SEQ ID NO: 3292635 - protein, 25 aa, Plasmodium falciparum
NIGKFNMILFCSKMLHPLTKIHNHF

SEQ ID NO: 3292636 - protein, 22 aa, Plasmodium falciparum
NIGLCLLFPIFKKGINNIRLEI

SEQ ID NO: 3292637 - protein, 18 aa, Plasmodium falciparum
NIGPFIVDFLLLNKNHHA

SEQ ID NO: 3292638 - protein, 24 aa, Plasmodium falciparum
NIGRINIQIPWSSLGKNPVCVLIK

SEQ ID NO: 3292639 - protein, 34 aa, Plasmodium falciparum
NIGRPFVYVLKDTKFSFLNFFLFFSNLSNKQNGI

SEQ ID NO: 3292640 - protein, 17 aa, Plasmodium falciparum
NIHDLLLDYFFDLHFIK

SEQ ID NO: 3292641 - protein, 25 aa, Plasmodium falciparum
NIHIFQFMIIIISFSIYVLIIHICV

SEQ ID NO: 3292642 - protein, 25 aa, Plasmodium falciparum
NIHIPDIIIYFLFNHVQKIEDISSY

SEQ ID NO: 3292643 - protein, 21 aa, Plasmodium falciparum
NIHLDHFIIPIFNILKKYDNI

SEQ ID NO: 3292644 - protein, 21 aa, Plasmodium falciparum
NIHLFNFPVVFIFSSDSKNFN

SEQ ID NO: 3292645 - protein, 33 aa, Plasmodium falciparum
NIHVNIKKYMVLYKICIFMLTCLIQTIYINNKY

SEQ ID NO: 3292646 - protein, 30 aa, Plasmodium falciparum
NIHVYTYILHLYIPIYPYMHKPTCIHTYIY

SEQ ID NO: 3292647 - protein, 31 aa, Plasmodium falciparum
NIHVYTYILHLYIPIYPYMHKPTCIPTYIYT

SEQ ID NO: 3292648 - protein, 29 aa, Plasmodium falciparum
NIHYITMFYIIYFVLACVLLIYIRIRNKA

SEQ ID NO: 3292649 - protein, 24 aa, Plasmodium falciparum
NIIDLNEPLYNYYRFMNKINANIK

SEQ ID NO: 3292650 - protein, 25 aa, Plasmodium falciparum
NIIDRLFYKNIALSNKLYIVKKMIK

SEQ ID NO: 3292651 - protein, 24 aa, Plasmodium falciparum
NIIERYKIIYGMNKEVDYNMLEED

SEQ ID NO: 3292652 - protein, 19 aa, Plasmodium falciparum
NIIEYFLNCKLNLSFIKLI

SEQ ID NO: 3292653 - protein, 18 aa, Plasmodium falciparum
NIIGMKIITGLGLELKED

SEQ ID NO: 3292654 - protein, 27 aa, Plasmodium falciparum
NIIHFQNYLFIKKSLYFLLENMKNEYL

SEQ ID NO: 3292655 - protein, 30 aa, Plasmodium falciparum
NIIHIINTLPLLHYTFSTSLIFPKKNEKIE

SEQ ID NO: 3292656 - protein, 18 aa, Plasmodium falciparum
NIIHMIPSKFLLITKKRR

SEQ ID NO: 3292657 - protein, 25 aa, Plasmodium falciparum
NIIKECVDNLLFINRYLVEEMLEDD

SEQ ID NO: 3292658 - protein, 28 aa, Plasmodium falciparum
NIIKEVIIIHMLLIINIKDIIIINMNIV

SEQ ID NO: 3292659 - protein, 24 aa, Plasmodium falciparum
NIIKFNEKIIFLKTIKFLLSNEKI

SEQ ID NO: 3292660 - protein, 19 aa, Plasmodium falciparum
NIIKFRYTHELWAKKKGVG

SEQ ID NO: 3292661 - protein, 25 aa, Plasmodium falciparum
NIIKKYFFLLIFSINKIKIEKKNFD

SEQ ID NO: 3292662 - protein, 17 aa, Plasmodium falciparum
NIILNIYINLFNIKNME

SEQ ID NO: 3292663 - protein, 19 aa, Plasmodium falciparum
NIILNIYNFVRMKYILENI

SEQ ID NO: 3292664 - protein, 24 aa, Plasmodium falciparum
NIIMYIYEYNQLLCALLESQRNNF

SEQ ID NO: 3292665 - protein, 26 aa, Plasmodium falciparum
NIINILTFISKHVWKYLFQHSSDLLK

SEQ ID NO: 3292666 - protein, 22 aa, Plasmodium falciparum
NIINKIIFLYNICTIHCLIYEN

SEQ ID NO: 3292667 - protein, 24 aa, Plasmodium falciparum
NIINLIILLYIIFNKTSSIRKNIM

SEQ ID NO: 3292668 - protein, 30 aa, Plasmodium falciparum
NIINLRDDYFLLSFFQFIEMLRTHLQLSNI

SEQ ID NO: 3292669 - protein, 20 aa, Plasmodium falciparum
NIINVVYLFKSKIYNINIYL

SEQ ID NO: 3292670 - protein, 29 aa, Plasmodium falciparum
NIIQFCTELIYNLIIQKKYLKCEHLKKSI

SEQ ID NO: 3292671 - protein, 19 aa, Plasmodium falciparum
NIISFIISFYPYLIKNIFS

SEQ ID NO: 3292672 - protein, 33 aa, Plasmodium falciparum
NIISINKLLYFITRPEFLFIDNLYSIFKDYIKN

SEQ ID NO: 3292673 - protein, 28 aa, Plasmodium falciparum
NIISYLDTLYLIICKYDILKFVDNMTLV

SEQ ID NO: 3292674 - protein, 18 aa, Plasmodium falciparum
NIITTCVFIFFHIKQFND

SEQ ID NO: 3292675 - protein, 19 aa, Plasmodium falciparum
NIIVKLINLYFKKYKKKIL

SEQ ID NO: 3292676 - protein, 41 aa, Plasmodium falciparum
NIIYDIYDYLFIYKMSDISFKCACKFLYTLGLLNIRNENYI

SEQ ID NO: 3292677 - protein, 21 aa, Plasmodium falciparum
NIIYKLIHKFILHQPLYEVMY

SEQ ID NO: 3292678 - protein, 25 aa, Plasmodium falciparum
NIKALLKWRICIYGIFNINQWVKLF

SEQ ID NO: 3292679 - protein, 25 aa, Plasmodium falciparum
NIKCPFVYRKVFFGKYGIINYDIKG

SEQ ID NO: 3292680 - protein, 25 aa, Plasmodium falciparum
NIKEYLNEILNKYNKFNFYENNYDI

SEQ ID NO: 3292681 - protein, 27 aa, Plasmodium falciparum
NIKINYKIWRYMPCPFKIISYNKNKLD

SEQ ID NO: 3292682 - protein, 23 aa, Plasmodium falciparum
NIKIYYNYVYKYKNLISPHILNV

SEQ ID NO: 3292683 - protein, 17 aa, Plasmodium falciparum
NIKKFFKILKSSNSKNS

SEQ ID NO: 3292684 - protein, 24 aa, Plasmodium falciparum
NIKKIICELAKLTKIHHKYLARYH

SEQ ID NO: 3292685 - protein, 24 aa, Plasmodium falciparum
NIKKKLRFIINKLFLEKSKEKKTN

SEQ ID NO: 3292686 - protein, 25 aa, Plasmodium falciparum
NIKKKLWYEFFFLSSSQKKKTKIYN

SEQ ID NO: 3292687 - protein, 24 aa, Plasmodium falciparum
NIKKKYIIVFNLSGLIDFINKKNN

SEQ ID NO: 3292688 - protein, 27 aa, Plasmodium falciparum
NIKKSKNIIIIVKKFTSDDLSEYHENL

SEQ ID NO: 3292689 - protein, 24 aa, Plasmodium falciparum
NIKKTYDFILKKVLIVKNVWENNT

SEQ ID NO: 3292690 - protein, 26 aa, Plasmodium falciparum
NIKLETFWWYLKKIGRPLIIVIIIFM

SEQ ID NO: 3292691 - protein, 22 aa, Plasmodium falciparum
NIKLVCGYISLLLNYSLNKKTN

SEQ ID NO: 3292692 - protein, 17 aa, Plasmodium falciparum
NIKLYKPRDDKGGTPIE

SEQ ID NO: 3292693 - protein, 25 aa, Plasmodium falciparum
NIKLYQNVFYIFLKLLQNVLKSNNL

SEQ ID NO: 3292694 - protein, 27 aa, Plasmodium falciparum
NIKMKNFFIFILYNLMKLCLDERIEVR

SEQ ID NO: 3292695 - protein, 31 aa, Plasmodium falciparum
NIKNTLLTFLSFPFFFSKLKVKPNYIKCEHF

SEQ ID NO: 3292696 - protein, 17 aa, Plasmodium falciparum
NIKNYMLYTKQLNKLKE

SEQ ID NO: 3292697 - protein, 26 aa, Plasmodium falciparum
NIKPSNISYILLLKRTQKIITQYNND

SEQ ID NO: 3292698 - protein, 35 aa, Plasmodium falciparum
NIKRQIYFYYCVLFLEVYYPLLYLRIIKGKGNIFS

SEQ ID NO: 3292699 - protein, 30 aa, Plasmodium falciparum
NIKSCNFLNSIWIYYYYNNIKTLTKKIKEL

SEQ ID NO: 3292700 - protein, 26 aa, Plasmodium falciparum
NIKSDSFIILLFKEIMNPFFIFQIFA

SEQ ID NO: 3292701 - protein, 36 aa, Plasmodium falciparum
NIKSEGFIFFVLVFFICIIFGCIYESLHEGPYKKTL

SEQ ID NO: 3292702 - protein, 34 aa, Plasmodium falciparum
NIKSILYSNRAACNIFLKKWNTVIEDCNKSIHLN

SEQ ID NO: 3292703 - protein, 24 aa, Plasmodium falciparum
NIKSNFKHLLLCNDISYIKKSTNN

SEQ ID NO: 3292704 - protein, 31 aa, Plasmodium falciparum
NIKSNFSYIHKFLHNMIPVYKYTIINGKLYK

SEQ ID NO: 3292705 - protein, 21 aa, Plasmodium falciparum
NIKTFEFIMLNGNISKSLSVC

SEQ ID NO: 3292706 - protein, 28 aa, Plasmodium falciparum
NIKVLNPVLYMFKYFKPSYFNVKKIQCS

SEQ ID NO: 3292707 - protein, 45 aa, Plasmodium falciparum
NIKYLGYRFHTIYKILLLLSQLKSIYYFNFNYLLNILNNLIKNIN

SEQ ID NO: 3292708 - protein, 21 aa, Plasmodium falciparum
NIKYPGFITLILNLFTAYNYD

SEQ ID NO: 3292709 - protein, 24 aa, Plasmodium falciparum
NIKYYYFFNRIVSTSLYLLHEILQ

SEQ ID NO: 3292710 - protein, 48 aa, Plasmodium falciparum
NILAHSHFFNFLMNPYYYNLTFKQIKNLIFSNFILNNNTLYSNYQSLS

SEQ ID NO: 3292711 - protein, 22 aa, Plasmodium falciparum
NILCHYFAYHVFIIFCNIMQND

SEQ ID NO: 3292712 - protein, 35 aa, Plasmodium falciparum
NILDQNIFLIYIKYFFLLLFHLPNINCCYIFIIHK

SEQ ID NO: 3292713 - protein, 24 aa, Plasmodium falciparum
NILEKICMKCKIKTKFMCITCKDM

SEQ ID NO: 3292714 - protein, 27 aa, Plasmodium falciparum
NILENFLVYTIYFRLYKFKEIKNIRKK

SEQ ID NO: 3292715 - protein, 24 aa, Plasmodium falciparum
NILEPFCLNFFFLKDDYSYDKNAK

SEQ ID NO: 3292716 - protein, 24 aa, Plasmodium falciparum
NILFRSFEYVKVHKLLLFINILIK

SEQ ID NO: 3292717 - protein, 32 aa, Plasmodium falciparum
NILIARDILLFIIDLLCLFKLHSIYIKKKYCE

SEQ ID NO: 3292718 - protein, 21 aa, Plasmodium falciparum
NILIELQYIYLNKLEHPKNIM

SEQ ID NO: 3292719 - protein, 20 aa, Plasmodium falciparum
NILIQIPMDIILKVLCPNVF

SEQ ID NO: 3292720 - protein, 24 aa, Plasmodium falciparum
NILMKYFIMIQEFLNWDFFNLDNI

SEQ ID NO: 3292721 - protein, 29 aa, Plasmodium falciparum
NILMNLTKYVDLVFIFIDSTKLSINKRLL

SEQ ID NO: 3292722 - protein, 33 aa, Plasmodium falciparum
NILNCFPIDNYKEFILLFDEYKLLEILNTLSIS

SEQ ID NO: 3292723 - protein, 30 aa, Plasmodium falciparum
NILNCLYLHIFIMYIYYYNKLYTKDTPFFM

SEQ ID NO: 3292724 - protein, 26 aa, Plasmodium falciparum
NILNKKYILTLSNYIPYFVLSYPSFP

SEQ ID NO: 3292725 - protein, 30 aa, Plasmodium falciparum
NILNKNTLILFLFILISLMKNYNMKNNYLV

SEQ ID NO: 3292726 - protein, 25 aa, Plasmodium falciparum
NILNNLIILIYYMIINFGSSCNKFV

SEQ ID NO: 3292727 - protein, 24 aa, Plasmodium falciparum
NILNSLKNQLYLNLKRELNEIIKE

SEQ ID NO: 3292728 - protein, 27 aa, Plasmodium falciparum
NILNSLLIFIYILTQNYILTPFPSIFL

SEQ ID NO: 3292729 - protein, 20 aa, Plasmodium falciparum
NILQKLYLTIEKYELFVNVS

SEQ ID NO: 3292730 - protein, 19 aa, Plasmodium falciparum
NILQLKYVKGKAVFAFVLL

SEQ ID NO: 3292731 - protein, 25 aa, Plasmodium falciparum
NILSKGLYYFINYYTLLISSNYKAE

SEQ ID NO: 3292732 - protein, 31 aa, Plasmodium falciparum
NILSKKGILFLFILIGFVLKKPDEIKPLLKN

SEQ ID NO: 3292733 - protein, 25 aa, Plasmodium falciparum
NILSLDYFFYFMRNKELEKIWASSN

SEQ ID NO: 3292734 - protein, 31 aa, Plasmodium falciparum
NILSTGLKIKFLLLNFINIAVNIFISKYILC

SEQ ID NO: 3292735 - protein, 29 aa, Plasmodium falciparum
NILTEIEKILWRNWLRNQKSVMGKYKDQK

SEQ ID NO: 3292736 - protein, 25 aa, Plasmodium falciparum
NILTILYFITLIYSAISYAFIYLLW

SEQ ID NO: 3292737 - protein, 25 aa, Plasmodium falciparum
NILVIMNLKCFVLMFEILNLMDMQS

SEQ ID NO: 3292738 - protein, 26 aa, Plasmodium falciparum
NILYNQKINYLYNIKKKKNFLFKNFI

SEQ ID NO: 3292739 - protein, 21 aa, Plasmodium falciparum
NILYSILNAPLYIFYNNNLGN

SEQ ID NO: 3292740 - protein, 28 aa, Plasmodium falciparum
NILYTSKQLFIIFVLKTLTSLQCMKKDS

SEQ ID NO: 3292741 - protein, 19 aa, Plasmodium falciparum
NIMLNYFLEKIYKKKKNKT

SEQ ID NO: 3292742 - protein, 30 aa, Plasmodium falciparum
NIMNIYSYIMKLIRLYYIILDVILLEMRDD

SEQ ID NO: 3292743 - protein, 33 aa, Plasmodium falciparum
NIMNKIYWKFLENTVLYTFIFSFVLHNLKSKEY

SEQ ID NO: 3292744 - protein, 17 aa, Plasmodium falciparum
NIMPPYNLSNNIGHNSY

SEQ ID NO: 3292745 - protein, 34 aa, Plasmodium falciparum
NIMVPAGIGVALTLGLLLFKMRRKAKRQVDMIRI

SEQ ID NO: 3292746 - protein, 29 aa, Plasmodium falciparum
NIMWKNYLKFLNNIIIDKLIHLTNFLFNN

SEQ ID NO: 3292747 - protein, 25 aa, Plasmodium falciparum
NINDLFALFIFYVHIKRFYFDFFFT

SEQ ID NO: 3292748 - protein, 25 aa, Plasmodium falciparum
NINDLWFNACLLDKCLFFKNNMVSI

SEQ ID NO: 3292749 - protein, 24 aa, Plasmodium falciparum
NINEFRMIIDANKFAWKKLNENVK

SEQ ID NO: 3292750 - protein, 23 aa, Plasmodium falciparum
NINEVYMKFLSLFNSQNYICDDM

SEQ ID NO: 3292751 - protein, 21 aa, Plasmodium falciparum
NINFLSVLLLSIYNYNKGLIY

SEQ ID NO: 3292752 - protein, 19 aa, Plasmodium falciparum
NINFLVNNFSPLVSISLQL

SEQ ID NO: 3292753 - protein, 27 aa, Plasmodium falciparum
NINGDYFIKFFFEKAFYIKNEDMHSMV

SEQ ID NO: 3292754 - protein, 17 aa, Plasmodium falciparum
NINGYGKIILLLQNFFT

SEQ ID NO: 3292755 - protein, 30 aa, Plasmodium falciparum
NINIFDEFLDIYLLFRLRGGKGGFGANLRN

SEQ ID NO: 3292756 - protein, 27 aa, Plasmodium falciparum
NININYLMMMFYYFSFLKVSNGTLDNI

SEQ ID NO: 3292757 - protein, 23 aa, Plasmodium falciparum
NINIPFRKFFKRLILSSSVWIFF

SEQ ID NO: 3292758 - protein, 21 aa, Plasmodium falciparum
NINITKVLFIFVTYSSRLLSN

SEQ ID NO: 3292759 - protein, 25 aa, Plasmodium falciparum
NINIYFIFCDYLKKLFRYGNYFVQV

SEQ ID NO: 3292760 - protein, 23 aa, Plasmodium falciparum
NINIYKIIFNYIIDLIGCIHMIQ

SEQ ID NO: 3292761 - protein, 34 aa, Plasmodium falciparum
NINKKKKKLFYFYDPWLYGYDSFLSFIQLDDKKN

SEQ ID NO: 3292762 - protein, 33 aa, Plasmodium falciparum
NINKKNYLYFHKIFYILMRNFPQDIFYDLRTIH

SEQ ID NO: 3292763 - protein, 23 aa, Plasmodium falciparum
NINLLIIILKSMLNLINSFFQII

SEQ ID NO: 3292764 - protein, 21 aa, Plasmodium falciparum
NINLTLNFFISKKKKKRLLNI

SEQ ID NO: 3292765 - protein, 18 aa, Plasmodium falciparum
NINMLFYKYFYTDNSNIH

SEQ ID NO: 3292766 - protein, 22 aa, Plasmodium falciparum
NINNILYYYFYSNQEYLMNIKN

SEQ ID NO: 3292767 - protein, 32 aa, Plasmodium falciparum
NINNINNRLSLKRLGILLGLDEIGDENELDFH

SEQ ID NO: 3292768 - protein, 25 aa, Plasmodium falciparum
NINNIYIYIYLLYKILREQYSKKLF

SEQ ID NO: 3292769 - protein, 24 aa, Plasmodium falciparum
NINNLFLFNKIESSFFKTLLDIYE

SEQ ID NO: 3292770 - protein, 20 aa, Plasmodium falciparum
NINPNFIYGAAAAAATSAAN

SEQ ID NO: 3292771 - protein, 26 aa, Plasmodium falciparum
NINRFTEYLLYLKTLGLKKEKILLNI

SEQ ID NO: 3292772 - protein, 26 aa, Plasmodium falciparum
NINSSNILFLLTYKTKVLYEDKYNIF

SEQ ID NO: 3292773 - protein, 32 aa, Plasmodium falciparum
NINTAVDFFKIYWILYNEILINIFYKNINYIS

SEQ ID NO: 3292774 - protein, 29 aa, Plasmodium falciparum
NINTNIINFLLLFKYHFLHNYFIYNEYKL

SEQ ID NO: 3292775 - protein, 19 aa, Plasmodium falciparum
NINVYFFNDKFGMKSFIYF

SEQ ID NO: 3292776 - protein, 23 aa, Plasmodium falciparum
NINYERVYSWELGKEALTKLLGC

SEQ ID NO: 3292777 - protein, 20 aa, Plasmodium falciparum
NINYFIYRNIYRPIKYHYDI

SEQ ID NO: 3292778 - protein, 23 aa, Plasmodium falciparum
NINYGYFLLDIAKKLVKQLKIIC

SEQ ID NO: 3292779 - protein, 25 aa, Plasmodium falciparum
NINYKNWLLVYKTYIEKITYLIDIV

SEQ ID NO: 3292780 - protein, 32 aa, Plasmodium falciparum
NINYNGFMYCMRYIPYVIPDFPLSTSHFEISY

SEQ ID NO: 3292781 - protein, 18 aa, Plasmodium falciparum
NINYVYIINYLNKNQKYI

SEQ ID NO: 3292782 - protein, 21 aa, Plasmodium falciparum
NIPIDKWIEYLDNSSFIDICF

SEQ ID NO: 3292783 - protein, 18 aa, Plasmodium falciparum
NIPIYPYGVIQKLNIFNS

SEQ ID NO: 3292784 - protein, 24 aa, Plasmodium falciparum
NIPLKFIVDIIYFINKYGQMIIPF

SEQ ID NO: 3292785 - protein, 20 aa, Plasmodium falciparum
NIPMTLFHAQGKRLYSSYLN

SEQ ID NO: 3292786 - protein, 23 aa, Plasmodium falciparum
NIPNSSSIPFYFTHMRLSRNDNM

SEQ ID NO: 3292787 - protein, 20 aa, Plasmodium falciparum
NIPSRYNLYDKKLDLDLYEN

SEQ ID NO: 3292788 - protein, 31 aa, Plasmodium falciparum
NIPSSKPKRSFIKLIFNWINNKKDDLHKKKN

SEQ ID NO: 3292789 - protein, 29 aa, Plasmodium falciparum
NIPTDFLRQMFYTLGDYRDILFSGSKDAK

SEQ ID NO: 3292790 - protein, 27 aa, Plasmodium falciparum
NIPYNKNQLYFLLHNAKKKKYVPHLIF

SEQ ID NO: 3292791 - protein, 31 aa, Plasmodium falciparum
NIQFNNFNFNHLCSYIFLTIIYCLHSYLFKY

SEQ ID NO: 3292792 - protein, 26 aa, Plasmodium falciparum
NIQIYCINIFLYLQLRLNILSQSNIK

SEQ ID NO: 3292793 - protein, 24 aa, Plasmodium falciparum
NIQKIKLLQWYLKITKYANRLIKD

SEQ ID NO: 3292794 - protein, 42 aa, Plasmodium falciparum
NIQMFQYIYISFFVNIYKFVNFIYHLAMLSLYNYFKYYYECD

SEQ ID NO: 3292795 - protein, 20 aa, Plasmodium falciparum
NIQPPLYIQNLPSVDVIMIQ

SEQ ID NO: 3292796 - protein, 32 aa, Plasmodium falciparum
NIQQYFKFLKYLLFFHLLLFTYIYNKHNTNKY

SEQ ID NO: 3292797 - protein, 24 aa, Plasmodium falciparum
NIQRKYFRILLLFVHFRAIKKKKF

SEQ ID NO: 3292798 - protein, 21 aa, Plasmodium falciparum
NIQTYLLLSYHYYINNIPLKS

SEQ ID NO: 3292799 - protein, 20 aa, Plasmodium falciparum
NIQWDIYYNMKKFMLRIKKM

SEQ ID NO: 3292800 - protein, 26 aa, Plasmodium falciparum
NIQYGMPLYTIILSDIFFVAKVEKNN

SEQ ID NO: 3292801 - protein, 24 aa, Plasmodium falciparum
NIRHKYVLEFLSWVKLSTRIYQNT

SEQ ID NO: 3292802 - protein, 25 aa, Plasmodium falciparum
NIRIPDVARKYLWDNQIEGNLKKLI

SEQ ID NO: 3292803 - protein, 27 aa, Plasmodium falciparum
NIRKDFFLYKTLVDHILTINTYLLLKR

SEQ ID NO: 3292804 - protein, 28 aa, Plasmodium falciparum
NISEIYYRFIKFITMIEIYLCVIEEIKR

SEQ ID NO: 3292805 - protein, 33 aa, Plasmodium falciparum
NISFLKILINIGRLEPFLFLKTLHYISGNIHKK

SEQ ID NO: 3292806 - protein, 33 aa, Plasmodium falciparum
NISFVWKILSLFVILILLYFLLKIETMSLNQSL

SEQ ID NO: 3292807 - protein, 23 aa, Plasmodium falciparum
NISHKILLLKEKILFFAKDLAEN

SEQ ID NO: 3292808 - protein, 27 aa, Plasmodium falciparum
NISICTLTLILFSFLHIYDLSSHFIIH

SEQ ID NO: 3292809 - protein, 19 aa, Plasmodium falciparum
NISIFHIMNANLLPYMINE

SEQ ID NO: 3292810 - protein, 26 aa, Plasmodium falciparum
NISILDIYLHFFLNIYTLNQENTTIF

SEQ ID NO: 3292811 - protein, 21 aa, Plasmodium falciparum
NISILIYIQTLKCVMLIRKNR

SEQ ID NO: 3292812 - protein, 17 aa, Plasmodium falciparum
NISIPVGEIFFFKSEYN

SEQ ID NO: 3292813 - protein, 24 aa, Plasmodium falciparum
NISKENIYLFYKNMLLLLDHNEKQ

SEQ ID NO: 3292814 - protein, 23 aa, Plasmodium falciparum
NISKFLLEIIKFYDKNFSIFTEE

SEQ ID NO: 3292815 - protein, 24 aa, Plasmodium falciparum
NISKHNLLLLLPLSKRVDILDYSK

SEQ ID NO: 3292816 - protein, 26 aa, Plasmodium falciparum
NISKKKILPFLKYLICSIFLRQSYYC

SEQ ID NO: 3292817 - protein, 23 aa, Plasmodium falciparum
NISKLLFPFFGYTTSEESVMSFS

SEQ ID NO: 3292818 - protein, 24 aa, Plasmodium falciparum
NISRFKKIFFLTYFVHEKGPVEKA

SEQ ID NO: 3292819 - protein, 23 aa, Plasmodium falciparum
NISRLLLEIIPPHTSRKSYIYDD

SEQ ID NO: 3292820 - protein, 17 aa, Plasmodium falciparum
NISSYIIDILLLSEIKE

SEQ ID NO: 3292821 - protein, 26 aa, Plasmodium falciparum
NISTLWCNILLMQYYYDKANATENEG

SEQ ID NO: 3292822 - protein, 31 aa, Plasmodium falciparum
NISTYIYKNVYLYFYFIFEKYQKKNKKKPFH

SEQ ID NO: 3292823 - protein, 22 aa, Plasmodium falciparum
NISVLLFFIISKYNPHNDHNNK

SEQ ID NO: 3292824 - protein, 24 aa, Plasmodium falciparum
NISVLLFLQYVFLLNLNIDTTHFL

SEQ ID NO: 3292825 - protein, 18 aa, Plasmodium falciparum
NISYFQIIKILNLCLNPT

SEQ ID NO: 3292826 - protein, 19 aa, Plasmodium falciparum
NISYLIKQINILNVTIICG

SEQ ID NO: 3292827 - protein, 20 aa, Plasmodium falciparum
NISYLKEKYYIYIPFIIFES

SEQ ID NO: 3292828 - protein, 19 aa, Plasmodium falciparum
NISYLYLFDDLFTSLDPCI

SEQ ID NO: 3292829 - protein, 20 aa, Plasmodium falciparum
NITINFLSQGFIICWCGKDN

SEQ ID NO: 3292830 - protein, 30 aa, Plasmodium falciparum
NITIRERFYKYILVHILDLSFEKNYASQRM

SEQ ID NO: 3292831 - protein, 28 aa, Plasmodium falciparum
NITLESWNKYIIPFVRKFITHFNINNNQ

SEQ ID NO: 3292832 - protein, 17 aa, Plasmodium falciparum
NITLHELCLFLNPVENR

SEQ ID NO: 3292833 - protein, 33 aa, Plasmodium falciparum
NITNMILLFLIYIIFCFIIIIISYLNITSGFYR

SEQ ID NO: 3292834 - protein, 28 aa, Plasmodium falciparum
NITNNLYFILLHNFIPYKNKHIYNKCNF

SEQ ID NO: 3292835 - protein, 20 aa, Plasmodium falciparum
NITPYFNIFDWSNKFCYYLS

SEQ ID NO: 3292836 - protein, 28 aa, Plasmodium falciparum
NITYTEFKKILLPYLWPSKRIDMKGNSS

SEQ ID NO: 3292837 - protein, 20 aa, Plasmodium falciparum
NIVDLGYILLKIDSFCCIFN

SEQ ID NO: 3292838 - protein, 24 aa, Plasmodium falciparum
NIVFKLIVHFCKNKKYYIAAKIFI

SEQ ID NO: 3292839 - protein, 39 aa, Plasmodium falciparum
NIVIFSHFIMLFLVSMVMSFYFCPIVAAVLTFIYFINMR

SEQ ID NO: 3292840 - protein, 24 aa, Plasmodium falciparum
NIVKDWRISLYDKSKIIALLALLY

SEQ ID NO: 3292841 - protein, 27 aa, Plasmodium falciparum
NIVLTGKAFIFLKKKFYSFHLPYYEEC

SEQ ID NO: 3292842 - protein, 29 aa, Plasmodium falciparum
NIVPTYFDYVPQYIRWFEEWAEDFCRKKK

SEQ ID NO: 3292843 - protein, 30 aa, Plasmodium falciparum
NIVRILLILFSIPFFICYYWSFAKCSIVNP

SEQ ID NO: 3292844 - protein, 26 aa, Plasmodium falciparum
NIVSYSYLYILLKKSIYLNSDVVFVL

SEQ ID NO: 3292845 - protein, 25 aa, Plasmodium falciparum
NIVVKPILLNKYKSKISIYAVGWMK

SEQ ID NO: 3292846 - protein, 25 aa, Plasmodium falciparum
NIVYPHEYWIEIYKPFYKQKKIKSD

SEQ ID NO: 3292847 - protein, 26 aa, Plasmodium falciparum
NIVYYLIFMYFVFVVLSIVIKTIFFH

SEQ ID NO: 3292848 - protein, 21 aa, Plasmodium falciparum
NIWCNIYHTTLPLKLFMIKQT

SEQ ID NO: 3292849 - protein, 19 aa, Plasmodium falciparum
NIYASLMLLILLNGIIKNN

SEQ ID NO: 3292850 - protein, 30 aa, Plasmodium falciparum
NIYENYYNIWIWVERIFSENFYEINSMLYN

SEQ ID NO: 3292851 - protein, 21 aa, Plasmodium falciparum
NIYIFNIIPKYWNISEISQFI

SEQ ID NO: 3292852 - protein, 22 aa, Plasmodium falciparum
NIYIILMRQLYLLKENIKQFII

SEQ ID NO: 3292853 - protein, 26 aa, Plasmodium falciparum
NIYIYIYIYIYIYIYTSEIYNSLFNL

SEQ ID NO: 3292854 - protein, 21 aa, Plasmodium falciparum
NIYKILLGKKLANKKFILLLA

SEQ ID NO: 3292855 - protein, 25 aa, Plasmodium falciparum
NIYKKIFTYLFPNNFFHSVYEINVL

SEQ ID NO: 3292856 - protein, 26 aa, Plasmodium falciparum
NIYKKILFCLNIYKKIKKPILIFKTN

SEQ ID NO: 3292857 - protein, 18 aa, Plasmodium falciparum
NIYKKLYNLLKEIQFHLI

SEQ ID NO: 3292858 - protein, 17 aa, Plasmodium falciparum
NIYLNMLQLITPNNILY

SEQ ID NO: 3292859 - protein, 25 aa, Plasmodium falciparum
NIYNIRALGLFRYIHPYNINIWDKM

SEQ ID NO: 3292860 - protein, 27 aa, Plasmodium falciparum
NIYNRFDLNILLVPISSQIVLSKFNGN

SEQ ID NO: 3292861 - protein, 19 aa, Plasmodium falciparum
NIYNYNFWFTPIEISDKNN

SEQ ID NO: 3292862 - protein, 32 aa, Plasmodium falciparum
NIYSGKIPPDFLRLMFYTLGDYRDICIGDDTM

SEQ ID NO: 3292863 - protein, 41 aa, Plasmodium falciparum
NIYSIISNNFLYVIRIIFLPFEKIYFSLKSLIMIKKMNMSS

SEQ ID NO: 3292864 - protein, 28 aa, Plasmodium falciparum
NIYTLENLILIIWSLSLKHIYSAKLFLY

SEQ ID NO: 3292865 - protein, 32 aa, Plasmodium falciparum
NIYVFYYSLINLFYFICIFEDINLIHPYYIHK

SEQ ID NO: 3292866 - protein, 25 aa, Plasmodium falciparum
NIYVKSLLICLKSKNLHIISVALKC

SEQ ID NO: 3292867 - protein, 17 aa, Plasmodium falciparum
NIYVLKHVSIPIFEKEI

SEQ ID NO: 3292868 - protein, 25 aa, Plasmodium falciparum
NIYVYNSLFFMIAEKMVYYYTQYLT

SEQ ID NO: 3292869 - protein, 21 aa, Plasmodium falciparum
NKACAYYFFKNLNFSISFIFF

SEQ ID NO: 3292870 - protein, 17 aa, Plasmodium falciparum
NKAFHSRFFICICVLLH

SEQ ID NO: 3292871 - protein, 20 aa, Plasmodium falciparum
NKCFNFVKDIYISRKQNMCI

SEQ ID NO: 3292872 - protein, 17 aa, Plasmodium falciparum
NKCRLDRVLISINVLLY

SEQ ID NO: 3292873 - protein, 23 aa, Plasmodium falciparum
NKCSFIKLYLYSDNINIYKDIIS

SEQ ID NO: 3292874 - protein, 28 aa, Plasmodium falciparum
NKCYELLRFLFFFIKQNDLITINIYKYI

SEQ ID NO: 3292875 - protein, 19 aa, Plasmodium falciparum
NKCYFLIENIISNVYKHGC

SEQ ID NO: 3292876 - protein, 27 aa, Plasmodium falciparum
NKDDFLLYSFKYFTTPFVFLSLVDCTN

SEQ ID NO: 3292877 - protein, 19 aa, Plasmodium falciparum
NKDDFLWHKNICSNIYNLY

SEQ ID NO: 3292878 - protein, 25 aa, Plasmodium falciparum
NKDDFSFYKIFLSNNSQLKRISMNE

SEQ ID NO: 3292879 - protein, 20 aa, Plasmodium falciparum
NKDDYVLQFLNKLLTQNKGN

SEQ ID NO: 3292880 - protein, 25 aa, Plasmodium falciparum
NKDELLRLRYYGCTRVQLGIQHIDD

SEQ ID NO: 3292881 - protein, 32 aa, Plasmodium falciparum
NKDHIIFCSLIVFIIKLLYVFVKNFKHKNVNF

SEQ ID NO: 3292882 - protein, 22 aa, Plasmodium falciparum
NKDHLLFLINNISEDIKNLEPQ

SEQ ID NO: 3292883 - protein, 27 aa, Plasmodium falciparum
NKDILYIYKWIYIQIYLIIYHEFYLIN

SEQ ID NO: 3292884 - protein, 22 aa, Plasmodium falciparum
NKDLIILFKIFSNILKKNHILL

SEQ ID NO: 3292885 - protein, 30 aa, Plasmodium falciparum
NKDLLSRIFYIFYIINIKFKYDVIQAHKLN

SEQ ID NO: 3292886 - protein, 24 aa, Plasmodium falciparum
NKDMLYIFNFINSFERKKYLIMQE

SEQ ID NO: 3292887 - protein, 24 aa, Plasmodium falciparum
NKDNLYFLSFHKYIIDEQLMLNYS

SEQ ID NO: 3292888 - protein, 42 aa, Plasmodium falciparum
NKDNLYIPCIKYGKYISWIQKMCYLYFLIQIMKKNKMEQNKK

SEQ ID NO: 3292889 - protein, 22 aa, Plasmodium falciparum
NKDVILPSLISFNRCDIMKLSD

SEQ ID NO: 3292890 - protein, 20 aa, Plasmodium falciparum
NKDWYNLINLITLALLGCVT

SEQ ID NO: 3292891 - protein, 48 aa, Plasmodium falciparum
NKDYDKYFLNLRKFKYVKLKSVSMIGLFIIIFIDEALVDHIREIEVCK

SEQ ID NO: 3292892 - protein, 25 aa, Plasmodium falciparum
NKEDNVEGLFSIRPSRSLTERKQRN

SEQ ID NO: 3292893 - protein, 26 aa, Plasmodium falciparum
NKEDSLFNHLYLYSYINQPKNKYNLL

SEQ ID NO: 3292894 - protein, 21 aa, Plasmodium falciparum
NKEEFFLFFEDIGTIFVDSNI

SEQ ID NO: 3292895 - protein, 52 aa, Plasmodium falciparum
NKEFNIFIQFASYNIPAFYLNYIIINCYTLLFGIILYFFKNNIKRICRYIKY

SEQ ID NO: 3292896 - protein, 17 aa, Plasmodium falciparum
NKEIFLNSFIKEIKKEK

SEQ ID NO: 3292897 - protein, 23 aa, Plasmodium falciparum
NKEKINFYLFFNSPKNYNFQINN

SEQ ID NO: 3292898 - protein, 20 aa, Plasmodium falciparum
NKEKSFFLNIKHGKLKYINE

SEQ ID NO: 3292899 - protein, 29 aa, Plasmodium falciparum
NKEKYFFDISFFKRSCLFMFLDEHANKKN

SEQ ID NO: 3292900 - protein, 22 aa, Plasmodium falciparum
NKEMCMFLVIKFIESLEILNNG

SEQ ID NO: 3292901 - protein, 27 aa, Plasmodium falciparum
NKENVKLYRRIYWPLLLGIYKAENLED

SEQ ID NO: 3292902 - protein, 29 aa, Plasmodium falciparum
NKESCIMCIYFLYPLYMNLEDIDFKTFFY

SEQ ID NO: 3292903 - protein, 24 aa, Plasmodium falciparum
NKESFGLLLLLLAPSNIIEFLHLM

SEQ ID NO: 3292904 - protein, 33 aa, Plasmodium falciparum
NKETKDIFYTIYKYLFKIISYPSLKKRMEFIDN

SEQ ID NO: 3292905 - protein, 25 aa, Plasmodium falciparum
NKEYKYYLTHYKNKKYICIEKKTDY

SEQ ID NO: 3292906 - protein, 22 aa, Plasmodium falciparum
NKEYYELYIYLKNFNNIVEEGK

SEQ ID NO: 3292907 - protein, 22 aa, Plasmodium falciparum
NKEYYYVKNYYHDIKKNIKLDK

SEQ ID NO: 3292908 - protein, 17 aa, Plasmodium falciparum
NKFENILLYFNIFEVQY

SEQ ID NO: 3292909 - protein, 22 aa, Plasmodium falciparum
NKFFYIYNGLDLLKKSYLVHIK

SEQ ID NO: 3292910 - protein, 42 aa, Plasmodium falciparum
NKFIDSHTFFGLTLPCVVYQIKYKLFKYMYKHLSEKIKTYIK

SEQ ID NO: 3292911 - protein, 21 aa, Plasmodium falciparum
NKFNLILLSMSNVDLPFDHFV

SEQ ID NO: 3292912 - protein, 27 aa, Plasmodium falciparum
NKFVLKLFFHIFFIYINIYYDEQNISN

SEQ ID NO: 3292913 - protein, 27 aa, Plasmodium falciparum
NKFYDIIYKYYIFEISYVNMYISRDNM

SEQ ID NO: 3292914 - protein, 21 aa, Plasmodium falciparum
NKFYMYFYNILKEKKEYCLNI

SEQ ID NO: 3292915 - protein, 34 aa, Plasmodium falciparum
NKFYSSFHFMCLVVYIISLFFITLTNIYENNTSL

SEQ ID NO: 3292916 - protein, 31 aa, Plasmodium falciparum
NKFYVLVLNLYLYPFFRYSLNNIKLNIFIHN

SEQ ID NO: 3292917 - protein, 23 aa, Plasmodium falciparum
NKGDTYTYSFPKYSFLKEEERIQ

SEQ ID NO: 3292918 - protein, 25 aa, Plasmodium falciparum
NKGFLKKNSIILKSLYNLNEDYVNN

SEQ ID NO: 3292919 - protein, 20 aa, Plasmodium falciparum
NKGILLYGPPGCGKTLLAKA

SEQ ID NO: 3292920 - protein, 27 aa, Plasmodium falciparum
NKGKYKLYSFLFSPILFLKNLFNDEKI

SEQ ID NO: 3292921 - protein, 32 aa, Plasmodium falciparum
NKGLLIHFLDILFRYYYIDLYIKKQMCINILC

SEQ ID NO: 3292922 - protein, 46 aa, Plasmodium falciparum
NKGNNYDQFFTLLRKNYLNSINKNLYKYMINKYKNTYPIYDYHKDI

SEQ ID NO: 3292923 - protein, 25 aa, Plasmodium falciparum
NKGVLVPPRRQSLCLRITLQDFRTK

SEQ ID NO: 3292924 - protein, 30 aa, Plasmodium falciparum
NKHISMNGLYLLMYYILKEHFDIESIKLLM

SEQ ID NO: 3292925 - protein, 20 aa, Plasmodium falciparum
NKIFIYFVQKCMYTNTYFLI

SEQ ID NO: 3292926 - protein, 17 aa, Plasmodium falciparum
NKIFNMCSFKRYYNNHL

SEQ ID NO: 3292927 - protein, 24 aa, Plasmodium falciparum
NKIIKLFEDLIIEALNFFNKQKMM

SEQ ID NO: 3292928 - protein, 18 aa, Plasmodium falciparum
NKIILYKNLLLLKYRSQS

SEQ ID NO: 3292929 - protein, 31 aa, Plasmodium falciparum
NKIINNICILFKYVWVLGLLLCHKDIWIVHS

SEQ ID NO: 3292930 - protein, 18 aa, Plasmodium falciparum
NKIIPIKLLLHMKCSKNR

SEQ ID NO: 3292931 - protein, 23 aa, Plasmodium falciparum
NKIKAYSWMNSLSEASLCFHFGI

SEQ ID NO: 3292932 - protein, 32 aa, Plasmodium falciparum
NKIKIRKDIKCFFLMYYILYKQNVSNNILLKT

SEQ ID NO: 3292933 - protein, 30 aa, Plasmodium falciparum
NKIKKSIIPYFFKLMVIIYCIIKHIKETYI

SEQ ID NO: 3292934 - protein, 33 aa, Plasmodium falciparum
NKIKKYIMNYIISTYFIILCFYFNEYNIEEHNL

SEQ ID NO: 3292935 - protein, 28 aa, Plasmodium falciparum
NKIKLNIYKLNLFISIVIMTLYQIMENL

SEQ ID NO: 3292936 - protein, 28 aa, Plasmodium falciparum
NKIKLSQKLLIYFIPLINSTVKRIEANF

SEQ ID NO: 3292937 - protein, 18 aa, Plasmodium falciparum
NKIKNLYRFFINYNMKSS

SEQ ID NO: 3292938 - protein, 28 aa, Plasmodium falciparum
NKIKSMLYIIFCLIKYYHNIKNFIAQEK

SEQ ID NO: 3292939 - protein, 23 aa, Plasmodium falciparum
NKILFLIFVAYFFVFVKISNGQL

SEQ ID NO: 3292940 - protein, 34 aa, Plasmodium falciparum
NKILNEYILITILRIFLIFTYKISDFYVMVLLMI

SEQ ID NO: 3292941 - protein, 19 aa, Plasmodium falciparum
NKILQLKINFNLALSFLSA

SEQ ID NO: 3292942 - protein, 26 aa, Plasmodium falciparum
NKINKNYLLLLNNDELKWIRGKNNYS

SEQ ID NO: 3292943 - protein, 23 aa, Plasmodium falciparum
NKIPPKWSMYFNKKIKYVNNFIT

SEQ ID NO: 3292944 - protein, 22 aa, Plasmodium falciparum
NKIRIPLYAPFQLKKRINRNRK

SEQ ID NO: 3292945 - protein, 26 aa, Plasmodium falciparum
NKIRKFKEYILYYYEFHSVQDFFDLL

SEQ ID NO: 3292946 - protein, 23 aa, Plasmodium falciparum
NKISKFLVNFLKHLLSFEKYEHV

SEQ ID NO: 3292947 - protein, 19 aa, Plasmodium falciparum
NKISKSMKQYWLNKNKYTK

SEQ ID NO: 3292948 - protein, 22 aa, Plasmodium falciparum
NKIYKYAIYSFFGELLVISIIV

SEQ ID NO: 3292949 - protein, 33 aa, Plasmodium falciparum
NKKDIYNMICILYPLVIYNILRKMNNPTYIYKS

SEQ ID NO: 3292950 - protein, 36 aa, Plasmodium falciparum
NKKDNFAIINYHKISSFILLIFSCAMLAIDNSLTFD

SEQ ID NO: 3292951 - protein, 29 aa, Plasmodium falciparum
NKKDTLFLIIFIILFHKKFWITINPSLYY

SEQ ID NO: 3292952 - protein, 34 aa, Plasmodium falciparum
NKKELLYIYFKLYSKIYFFFQSESIYFFHFITRV

SEQ ID NO: 3292953 - protein, 24 aa, Plasmodium falciparum
NKKEYDMWFNNIRCIFCNETQTIN

SEQ ID NO: 3292954 - protein, 25 aa, Plasmodium falciparum
NKKFFHGLNKCRFAGIFEGIRKDEW

SEQ ID NO: 3292955 - protein, 17 aa, Plasmodium falciparum
NKKFLINKKFCPIYLIE

SEQ ID NO: 3292956 - protein, 35 aa, Plasmodium falciparum
NKKFRSNNFLIIYILFTLYSFLPMCTYNGKLIYEY

SEQ ID NO: 3292957 - protein, 21 aa, Plasmodium falciparum
NKKHSSLCLFLYCIGKMKHRD

SEQ ID NO: 3292958 - protein, 21 aa, Plasmodium falciparum
NKKHYGLFSDNYFITASISAE

SEQ ID NO: 3292959 - protein, 26 aa, Plasmodium falciparum
NKKKELFFPLMEHLYMYKKKLLINKM

SEQ ID NO: 3292960 - protein, 23 aa, Plasmodium falciparum
NKKKFICVNTCGLFGRVFIDYGD

SEQ ID NO: 3292961 - protein, 22 aa, Plasmodium falciparum
NKKKFYVRRILVFCTCILLSII

SEQ ID NO: 3292962 - protein, 24 aa, Plasmodium falciparum
NKKKIFFITNVIKSEPYFSTDRNT

SEQ ID NO: 3292963 - protein, 31 aa, Plasmodium falciparum
NKKKIVHVLKCTYLYLYNIYEQLNKTSIDEK

SEQ ID NO: 3292964 - protein, 22 aa, Plasmodium falciparum
NKKKIYIYYYIKYLLQKKNNSY

SEQ ID NO: 3292965 - protein, 24 aa, Plasmodium falciparum
NKKKKIILNILKKVYYRYEHNLSN

SEQ ID NO: 3292966 - protein, 24 aa, Plasmodium falciparum
NKKKKKLIPPYLNFNFNLMEEGDK

SEQ ID NO: 3292967 - protein, 25 aa, Plasmodium falciparum
NKKKKLQLFLLLINSMYFPNPYHNA

SEQ ID NO: 3292968 - protein, 26 aa, Plasmodium falciparum
NKKKKYYFYKLFHKFRMSYNHFIKYT

SEQ ID NO: 3292969 - protein, 29 aa, Plasmodium falciparum
NKKKNKHLYLFYFIFNIISIMSCMYSFIS

SEQ ID NO: 3292970 - protein, 27 aa, Plasmodium falciparum
NKKKSILYMFKIYKIIILYTHHYKDNN

SEQ ID NO: 3292971 - protein, 87 aa, Plasmodium falciparum
NKKKTYLNVTLNINYVFLQIIYNIILYFVYLYIYYTKYIYYILRTYLFLLLYNSFHIIRENCYYPNIFLYNYYRNRIKKNILQQWKM

SEQ ID NO: 3292972 - protein, 24 aa, Plasmodium falciparum
NKKLDAFLYKALIKALYKSKSWFK

SEQ ID NO: 3292973 - protein, 26 aa, Plasmodium falciparum
NKKLKFVKLFLIQTAIEAFRYARIFN

SEQ ID NO: 3292974 - protein, 27 aa, Plasmodium falciparum
NKKLLNRLYNMLFRKKKKYRIKNMDAH

SEQ ID NO: 3292975 - protein, 24 aa, Plasmodium falciparum
NKKNDLPLFFSLNNKSFENSNNKY

SEQ ID NO: 3292976 - protein, 22 aa, Plasmodium falciparum
NKKNDYYIYLYICNFLLFIIYN

SEQ ID NO: 3292977 - protein, 21 aa, Plasmodium falciparum
NKKNLLFNYYNKESIGHKKKK

SEQ ID NO: 3292978 - protein, 25 aa, Plasmodium falciparum
NKKNTLVFFFCNHLYHLKCLHNGEF

SEQ ID NO: 3292979 - protein, 31 aa, Plasmodium falciparum
NKKPEAPPPPPPPQPPPPPPQPARPAEDQIE

SEQ ID NO: 3292980 - protein, 24 aa, Plasmodium falciparum
NKKQKYVYLLLNKILCKNKNKRNN

SEQ ID NO: 3292981 - protein, 19 aa, Plasmodium falciparum
NKKRVLFSSYKKLYNRNIT

SEQ ID NO: 3292982 - protein, 41 aa, Plasmodium falciparum
NKKSGLINIIRFPLLYEINLKKLMKIFCFYEHIKKEEKINT

SEQ ID NO: 3292983 - protein, 24 aa, Plasmodium falciparum
NKKTPHIPNFLPNSIKKCLQKCFS

SEQ ID NO: 3292984 - protein, 23 aa, Plasmodium falciparum
NKKWTLLINYLPTLNNKTIETLT

SEQ ID NO: 3292985 - protein, 24 aa, Plasmodium falciparum
NKKYKLIWNYFKINKEIYIDNFID

SEQ ID NO: 3292986 - protein, 35 aa, Plasmodium falciparum
NKKYLEDNLFLHLINFYINFSCSVYFHYLTHYEKN

SEQ ID NO: 3292987 - protein, 17 aa, Plasmodium falciparum
NKKYNVAIPFKKNIPLI

SEQ ID NO: 3292988 - protein, 25 aa, Plasmodium falciparum
NKKYTFLRIFKWKSALDIFNISTLM

SEQ ID NO: 3292989 - protein, 27 aa, Plasmodium falciparum
NKLEVSIVWFLWSFVIFYCGMCMFGSN

SEQ ID NO: 3292990 - protein, 36 aa, Plasmodium falciparum
NKLFEKNFFNDIFYPYILIIPRFFHCKKKNSVIIPK

SEQ ID NO: 3292991 - protein, 40 aa, Plasmodium falciparum
NKLHIPFLSIQNFTLFIFDIFLYPLIFSICNIIQFENIYH

SEQ ID NO: 3292992 - protein, 21 aa, Plasmodium falciparum
NKLIGMFNKYMNEKLKKYELK

SEQ ID NO: 3292993 - protein, 29 aa, Plasmodium falciparum
NKLINQLIIQWFFKIFSVFLEKHFHYFRE

SEQ ID NO: 3292994 - protein, 26 aa, Plasmodium falciparum
NKLKKLKILDAKFLYTEPHSKRLKVH

SEQ ID NO: 3292995 - protein, 25 aa, Plasmodium falciparum
NKLKRKHILLFPMKLDTLIDVVDEY

SEQ ID NO: 3292996 - protein, 21 aa, Plasmodium falciparum
NKLKYPVFFLVHKNKIKRYHV

SEQ ID NO: 3292997 - protein, 24 aa, Plasmodium falciparum
NKLLLLLLLLPLLLSCKNFQSNGY

SEQ ID NO: 3292998 - protein, 25 aa, Plasmodium falciparum
NKLLLLLLLLPLLLSCNFQSNGYIS

SEQ ID NO: 3292999 - protein, 23 aa, Plasmodium falciparum
NKLNDEIILLKNKNKTLLHKRDT

SEQ ID NO: 3293000 - protein, 22 aa, Plasmodium falciparum
NKLNGLFKGFFFEVMDKLNKDE

SEQ ID NO: 3293001 - protein, 20 aa, Plasmodium falciparum
NKLNQILIGMLKFIDYTNNS

SEQ ID NO: 3293002 - protein, 20 aa, Plasmodium falciparum
NKLQNILIKYYKHLKEHTNQ

SEQ ID NO: 3293003 - protein, 27 aa, Plasmodium falciparum
NKLRGSKLYFIIGISLLKQINTNPYYD

SEQ ID NO: 3293004 - protein, 23 aa, Plasmodium falciparum
NKLYYYNIVFFLKKLFVTKSVDL

SEQ ID NO: 3293005 - protein, 18 aa, Plasmodium falciparum
NKMDYDYILTKKKKKRTS

SEQ ID NO: 3293006 - protein, 29 aa, Plasmodium falciparum
NKMFEICSSFLIYLHSLFTVYKMTSKRIP

SEQ ID NO: 3293007 - protein, 26 aa, Plasmodium falciparum
NKMRYSFFELFYNTTIKILKFIKTDK

SEQ ID NO: 3293008 - protein, 18 aa, Plasmodium falciparum
NKMSILRDIYKTKEILTF

SEQ ID NO: 3293009 - protein, 28 aa, Plasmodium falciparum
NKMWPQTLDMYILHIYDLISSYMDSPEK

SEQ ID NO: 3293010 - protein, 23 aa, Plasmodium falciparum
NKNDYMLLKKKQSIYFYNILNCK

SEQ ID NO: 3293011 - protein, 25 aa, Plasmodium falciparum
NKNEKKVIICFYQLTIKNLNSVVQL

SEQ ID NO: 3293012 - protein, 24 aa, Plasmodium falciparum
NKNIDPLLFIRKKNIFFDSQKEYY

SEQ ID NO: 3293013 - protein, 26 aa, Plasmodium falciparum
NKNIILIYSLFILIKMYLVCKENNRN

SEQ ID NO: 3293014 - protein, 28 aa, Plasmodium falciparum
NKNIILNMNIFAHLIFKGIGISISNHNL

SEQ ID NO: 3293015 - protein, 17 aa, Plasmodium falciparum
NKNIKNYMLYTKQLNKL

SEQ ID NO: 3293016 - protein, 24 aa, Plasmodium falciparum
NKNILILCLFILDNFFNKKCFYKN

SEQ ID NO: 3293017 - protein, 30 aa, Plasmodium falciparum
NKNILINIISACKFFFISLLDETQCPHLLL

SEQ ID NO: 3293018 - protein, 22 aa, Plasmodium falciparum
NKNIMYDLWFKVMNNEKMKYYS

SEQ ID NO: 3293019 - protein, 45 aa, Plasmodium falciparum
NKNKMDFMNTFLFFIQLLFYGIKKNNPLILLAYINHELISKYHDN

SEQ ID NO: 3293020 - protein, 25 aa, Plasmodium falciparum
NKNKNISYLLFIKNSLRCFYGDTIE

SEQ ID NO: 3293021 - protein, 27 aa, Plasmodium falciparum
NKNKSYLLNIPIIIDITLFVNKSDDEK

SEQ ID NO: 3293022 - protein, 34 aa, Plasmodium falciparum
NKNKYSLYYFILYLYSDFLMTYFIYLSYTNKDSN

SEQ ID NO: 3293023 - protein, 29 aa, Plasmodium falciparum
NKNLFFYEHEWINIILQIINKDNFYLAEE

SEQ ID NO: 3293024 - protein, 21 aa, Plasmodium falciparum
NKNLFFYFIFIFPFLYVILLL

SEQ ID NO: 3293025 - protein, 24 aa, Plasmodium falciparum
NKNLWVFFEFNLFDSLLSSIEEIE

SEQ ID NO: 3293026 - protein, 24 aa, Plasmodium falciparum
NKNNKFITYLYFKSDKHKSFIYIN

SEQ ID NO: 3293027 - protein, 25 aa, Plasmodium falciparum
NKNSIIYNLYYYTILKDENIKKVTH

SEQ ID NO: 3293028 - protein, 26 aa, Plasmodium falciparum
NKNTCKYLYVQYFNKLFPDALEKLNN

SEQ ID NO: 3293029 - protein, 25 aa, Plasmodium falciparum
NKNTPLLLCLLIERGYIFCTYIIIT

SEQ ID NO: 3293030 - protein, 24 aa, Plasmodium falciparum
NKNVKICLFCCFIGCSINYEEQSK

SEQ ID NO: 3293031 - protein, 22 aa, Plasmodium falciparum
NKNVLDLIIVIFYGCLGTNLKK

SEQ ID NO: 3293032 - protein, 38 aa, Plasmodium falciparum
NKNYCKYFLNCSFFFNYLFIHLYLKNKLLLKNEIHKLH

SEQ ID NO: 3293033 - protein, 18 aa, Plasmodium falciparum
NKNYPLYLLIKLNNDNIN

SEQ ID NO: 3293034 - protein, 26 aa, Plasmodium falciparum
NKNYSLVYLFIGILIEYISFCFDDKI

SEQ ID NO: 3293035 - protein, 18 aa, Plasmodium falciparum
NKNYYIWRELQKNVLEYM

SEQ ID NO: 3293036 - protein, 26 aa, Plasmodium falciparum
NKPNDNFLILQFYKEANVHNPNEVIK

SEQ ID NO: 3293037 - protein, 29 aa, Plasmodium falciparum
NKPRKYEWFEWNMVVKKLRKLYGYSENGR

SEQ ID NO: 3293038 - protein, 29 aa, Plasmodium falciparum
NKPRYHFLKNMFFIFYTKRFIRNGNNKNM

SEQ ID NO: 3293039 - protein, 32 aa, Plasmodium falciparum
NKPTTLDSFIKRPPYFRYLEEWGETFCRERAK

SEQ ID NO: 3293040 - protein, 32 aa, Plasmodium falciparum
NKPTTLVDFISRPPYFRYLEEWGENFCKERKK

SEQ ID NO: 3293041 - protein, 32 aa, Plasmodium falciparum
NKQAEIYILNYFYFYIISLIYNKDILTVNFIL

SEQ ID NO: 3293042 - protein, 37 aa, Plasmodium falciparum
NKQKLYKFIFGCIFLLPIIWFTFYKISMLTLKNNKDI

SEQ ID NO: 3293043 - protein, 26 aa, Plasmodium falciparum
NKQLSFYYIINFNPNFFKTLYEYIYI

SEQ ID NO: 3293044 - protein, 32 aa, Plasmodium falciparum
NKQMTNLFYELRYRDFFHIEKIDYYKLFTMQK

SEQ ID NO: 3293045 - protein, 24 aa, Plasmodium falciparum
NKQWEDWKVYLEKQWSVWLEISEN

SEQ ID NO: 3293046 - protein, 34 aa, Plasmodium falciparum
NKQYELITNISFLFYIILIKFPNVSITIFHILNE

SEQ ID NO: 3293047 - protein, 32 aa, Plasmodium falciparum
NKRGNLNLLILLLLFTSFTSLISTYFFFLKRV

SEQ ID NO: 3293048 - protein, 23 aa, Plasmodium falciparum
NKRKEFFSFYLLNDENFLNIYLN

SEQ ID NO: 3293049 - protein, 24 aa, Plasmodium falciparum
NKRKKLIYYSLIASGAIASVAAIL

SEQ ID NO: 3293050 - protein, 28 aa, Plasmodium falciparum
NKRKKSILFLKEEYLRYLMILNKEEKNK

SEQ ID NO: 3293051 - protein, 23 aa, Plasmodium falciparum
NKRNVIFLNIFNRYNKIWKELIN

SEQ ID NO: 3293052 - protein, 35 aa, Plasmodium falciparum
NKRPFFIDCGFISLYMLYLYALKKKDKKKKCCPRK

SEQ ID NO: 3293053 - protein, 26 aa, Plasmodium falciparum
NKRSYHSLSYFPFPILSYKNVHAFYK

SEQ ID NO: 3293054 - protein, 19 aa, Plasmodium falciparum
NKRVLYKPNFLLYSEKKNK

SEQ ID NO: 3293055 - protein, 23 aa, Plasmodium falciparum
NKSCIVIYYDILLHLYDYFSFIS

SEQ ID NO: 3293056 - protein, 21 aa, Plasmodium falciparum
NKSFFKKIKLIMNILDDTHSD

SEQ ID NO: 3293057 - protein, 27 aa, Plasmodium falciparum
NKSFLQYMLYFLYNIYDKYKNILFFYY

SEQ ID NO: 3293058 - protein, 26 aa, Plasmodium falciparum
NKSGLSMYQGLFKRCPYNKKHYSMIK

SEQ ID NO: 3293059 - protein, 29 aa, Plasmodium falciparum
NKSILLIIYVYIFILFYIDLLISNNIKYD

SEQ ID NO: 3293060 - protein, 29 aa, Plasmodium falciparum
NKSIYYCSLIFYLLQKYNLHYTYLYQILL

SEQ ID NO: 3293061 - protein, 30 aa, Plasmodium falciparum
NKSKLELFSSYYFPLLHALPTSIQKHIDHI

SEQ ID NO: 3293062 - protein, 31 aa, Plasmodium falciparum
NKSLWYENYMYWMNKISLYNNLFFTNMYYKE

SEQ ID NO: 3293063 - protein, 26 aa, Plasmodium falciparum
NKSNILLHIIIIPPTSKQFYIKEIIN

SEQ ID NO: 3293064 - protein, 35 aa, Plasmodium falciparum
NKSQQENLLLILKKGYFYLLATCLFNPMNILNASL

SEQ ID NO: 3293065 - protein, 23 aa, Plasmodium falciparum
NKSTYFKTFLWGYPIYDDSPHKL

SEQ ID NO: 3293066 - protein, 23 aa, Plasmodium falciparum
NKTFYRSKYCQPCPLCGVKKNDN

SEQ ID NO: 3293067 - protein, 27 aa, Plasmodium falciparum
NKTHHQYILYKYRLAMLSLIIIKTNHL

SEQ ID NO: 3293068 - protein, 30 aa, Plasmodium falciparum
NKTKHLRIKYRWKKLLELRYIQPIIKKNEP

SEQ ID NO: 3293069 - protein, 27 aa, Plasmodium falciparum
NKTKNYICTIWYPKPLNYIALNCPTNR

SEQ ID NO: 3293070 - protein, 25 aa, Plasmodium falciparum
NKTLKAILLLTFVFASPLGIVLGHM

SEQ ID NO: 3293071 - protein, 41 aa, Plasmodium falciparum
NKTYCINFNFFYKYMSSPSLLSLYYYLLINRDDIYNNMKSM

SEQ ID NO: 3293072 - protein, 36 aa, Plasmodium falciparum
NKVDKKMIFYLLKEKKNIIFIVNKIDLILTNFEKKR

SEQ ID NO: 3293073 - protein, 26 aa, Plasmodium falciparum
NKVELILIQFLQDIFIYILDNFNYSL

SEQ ID NO: 3293074 - protein, 21 aa, Plasmodium falciparum
NKVIFYKRRFIKKKISICIQN

SEQ ID NO: 3293075 - protein, 46 aa, Plasmodium falciparum
NKVKKVYNNSSLKKYMKFCLCTIICVFLLDIYTNCESPTYSYSSIK

SEQ ID NO: 3293076 - protein, 36 aa, Plasmodium falciparum
NKVNNNICNIFLYFFVMIFFHLYIQNSDDKRKEDIC

SEQ ID NO: 3293077 - protein, 25 aa, Plasmodium falciparum
NKVPKHIYIVFKISDLIILNSEKLI

SEQ ID NO: 3293078 - protein, 23 aa, Plasmodium falciparum
NKVSYCNILLKSLNIINNLMNLD

SEQ ID NO: 3293079 - protein, 20 aa, Plasmodium falciparum
NKWVHGILTKKILEINTTYN

SEQ ID NO: 3293080 - protein, 32 aa, Plasmodium falciparum
NKWYWEIIVFSRKICVLFIMTVIIFPSDESNA

SEQ ID NO: 3293081 - protein, 21 aa, Plasmodium falciparum
NKYDISLLFSIHKFINNTKGK

SEQ ID NO: 3293082 - protein, 23 aa, Plasmodium falciparum
NKYETIISYTNKIYTFLLEITLP

SEQ ID NO: 3293083 - protein, 18 aa, Plasmodium falciparum
NKYFYINDLFQLKINTNY

SEQ ID NO: 3293084 - protein, 27 aa, Plasmodium falciparum
NKYFYKFENLIIFNYDFTLISKIEDFY

SEQ ID NO: 3293085 - protein, 39 aa, Plasmodium falciparum
NKYGNFLKLIICLPFILITVLWIFLTISIFNVCTYDPTL

SEQ ID NO: 3293086 - protein, 24 aa, Plasmodium falciparum
NKYIFLCCYKLRNMFLWDKEKIKI

SEQ ID NO: 3293087 - protein, 20 aa, Plasmodium falciparum
NKYIFLELYIKNHSGYVNYC

SEQ ID NO: 3293088 - protein, 25 aa, Plasmodium falciparum
NKYIKKFYFYLNSLTFYLKECKKLD

SEQ ID NO: 3293089 - protein, 33 aa, Plasmodium falciparum
NKYINIHNIIKFKLNFKIAIKKINILQDKIFIN

SEQ ID NO: 3293090 - protein, 19 aa, Plasmodium falciparum
NKYIPYASQRYKGKTYIYM

SEQ ID NO: 3293091 - protein, 25 aa, Plasmodium falciparum
NKYKIKCIQIIDICFNQDFNIIDIR

SEQ ID NO: 3293092 - protein, 21 aa, Plasmodium falciparum
NKYLIICDYIYDITIIFINTR

SEQ ID NO: 3293093 - protein, 17 aa, Plasmodium falciparum
NKYLILCADKCNIYLLK

SEQ ID NO: 3293094 - protein, 23 aa, Plasmodium falciparum
NKYLNICDLYLFLNFLNVTITDS

SEQ ID NO: 3293095 - protein, 20 aa, Plasmodium falciparum
NKYLYISKLVKCENKEVALH

SEQ ID NO: 3293096 - protein, 24 aa, Plasmodium falciparum
NKYTILLLYLYYKIYEHFLELYKK

SEQ ID NO: 3293097 - protein, 38 aa, Plasmodium falciparum
NKYTLYVFEILFISLLLYILIIYIKKFYMQDTPNFTTN

SEQ ID NO: 3293098 - protein, 34 aa, Plasmodium falciparum
NKYTTFKVFLENWLQDFLEGYYISKRKIEICTEN

SEQ ID NO: 3293099 - protein, 22 aa, Plasmodium falciparum
NKYVIFFLTNILSKVSPFELNK

SEQ ID NO: 3293100 - protein, 39 aa, Plasmodium falciparum
NKYVRNNLSRFILSVSLILFFFHFVLCSTIENVEILKND

SEQ ID NO: 3293101 - protein, 28 aa, Plasmodium falciparum
NKYYDYFYSLIYKTFPPLLFEKKELFQM

SEQ ID NO: 3293102 - protein, 32 aa, Plasmodium falciparum
NKYYERIKLLYLLNCIPLIYLDPHMNVILINE

SEQ ID NO: 3293103 - protein, 20 aa, Plasmodium falciparum
NKYYIFTGKFPFDVITYKLR

SEQ ID NO: 3293104 - protein, 29 aa, Plasmodium falciparum
NKYYNKILYIYLYFLLTLKCYMNIYKMDQ

SEQ ID NO: 3293105 - protein, 17 aa, Plasmodium falciparum
NLALITLISSIFSINRE

SEQ ID NO: 3293106 - protein, 25 aa, Plasmodium falciparum
NLANNIYIYYLFYSLSSILKSLSIL

SEQ ID NO: 3293107 - protein, 59 aa, Plasmodium falciparum
NLCNKIDPINLLITTRYYFFKKSKIMNFPKGLVYLSGYFLWLVAFLNNEKQEIIISFSV

SEQ ID NO: 3293108 - protein, 27 aa, Plasmodium falciparum
NLCNYFIISYLYYILEIFKCICRFIMS

SEQ ID NO: 3293109 - protein, 24 aa, Plasmodium falciparum
NLDTQTFVYPYKGYEDICKSTVKP

SEQ ID NO: 3293110 - protein, 24 aa, Plasmodium falciparum
NLDYVPQFVRWFEEWADDFCRIRK

SEQ ID NO: 3293111 - protein, 23 aa, Plasmodium falciparum
NLEAQLIGLDYFTKKDLYKPVIV

SEQ ID NO: 3293112 - protein, 40 aa, Plasmodium falciparum
NLEKECIIYIKYVFIYLLKYIFLFKIYKYDYKKKTNIDIK

SEQ ID NO: 3293113 - protein, 31 aa, Plasmodium falciparum
NLEKIVPLNLLYKFFQLFNFNINNVQLIYLL

SEQ ID NO: 3293114 - protein, 40 aa, Plasmodium falciparum
NLEKVYRSTIYLIFPFLQHIFVHIFYYYIEKKKEYLNNLI

SEQ ID NO: 3293115 - protein, 35 aa, Plasmodium falciparum
NLELCRICVSSIFKIFGDLFRYKYYFFEESKKVNE

SEQ ID NO: 3293116 - protein, 24 aa, Plasmodium falciparum
NLEMYMYKLFMLKMKNYRKHLPTE

SEQ ID NO: 3293117 - protein, 22 aa, Plasmodium falciparum
NLENIFIILSSIVDSFTKCYKD

SEQ ID NO: 3293118 - protein, 34 aa, Plasmodium falciparum
NLERFNIKILKKILSKLFYFLQQNKSLINGFDKL

SEQ ID NO: 3293119 - protein, 24 aa, Plasmodium falciparum
NLETHNMLIPYWNLADVDSSVSLT

SEQ ID NO: 3293120 - protein, 17 aa, Plasmodium falciparum
NLEYYLYNIIIENVHLL

SEQ ID NO: 3293121 - protein, 17 aa, Plasmodium falciparum
NLFDYFFSNGYGISKYT

SEQ ID NO: 3293122 - protein, 19 aa, Plasmodium falciparum
NLFFHLYEEYSMLINFLHL

SEQ ID NO: 3293123 - protein, 25 aa, Plasmodium falciparum
NLFFKNNFMYFNFLHNYLKEKKDEH

SEQ ID NO: 3293124 - protein, 26 aa, Plasmodium falciparum
NLFIDICWIYFRYMKFLTYIKRERNM

SEQ ID NO: 3293125 - protein, 19 aa, Plasmodium falciparum
NLFIKKVKVLLFYIKKRVI

SEQ ID NO: 3293126 - protein, 24 aa, Plasmodium falciparum
NLFKDIYIYRIYECFLKPYNIVNM

SEQ ID NO: 3293127 - protein, 24 aa, Plasmodium falciparum
NLFKTIFFIILFNSAIDSKLSILQ

SEQ ID NO: 3293128 - protein, 21 aa, Plasmodium falciparum
NLFLLCNGLIFITWRISEVLI

SEQ ID NO: 3293129 - protein, 19 aa, Plasmodium falciparum
NLFLYILKNIHSLYYDINC

SEQ ID NO: 3293130 - protein, 25 aa, Plasmodium falciparum
NLFNVLIFTLLFSVIAFIIDIVVML

SEQ ID NO: 3293131 - protein, 26 aa, Plasmodium falciparum
NLFSKYELPYLLYLKEIVYSLKKNQG

SEQ ID NO: 3293132 - protein, 33 aa, Plasmodium falciparum
NLFSNNMYKVYGKVLIFLTTYSPYEYVYNQYYS

SEQ ID NO: 3293133 - protein, 17 aa, Plasmodium falciparum
NLFTIIQSKTRLAKLSG

SEQ ID NO: 3293134 - protein, 25 aa, Plasmodium falciparum
NLFYFKNRIFMLTLKEKYQLNMRFS

SEQ ID NO: 3293135 - protein, 21 aa, Plasmodium falciparum
NLFYHYIGRIIDRGRYIIFED

SEQ ID NO: 3293136 - protein, 18 aa, Plasmodium falciparum
NLFYLIIISFHLSEFFLS

SEQ ID NO: 3293137 - protein, 26 aa, Plasmodium falciparum
NLGLRASFGVWVNPFSFGLSYTNMSE

SEQ ID NO: 3293138 - protein, 19 aa, Plasmodium falciparum
NLGNFFYDNVHFLEIIILN

SEQ ID NO: 3293139 - protein, 24 aa, Plasmodium falciparum
NLHLFLKEIYSDYCMIIFGSCNND

SEQ ID NO: 3293140 - protein, 22 aa, Plasmodium falciparum
NLHYLPKMKSIILNLYNVNYFK

SEQ ID NO: 3293141 - protein, 24 aa, Plasmodium falciparum
NLIDYNILYVKLNGKIYFNTFYDK

SEQ ID NO: 3293142 - protein, 27 aa, Plasmodium falciparum
NLIERKWLMYYFTKVVSKYFLNPRKDN

SEQ ID NO: 3293143 - protein, 20 aa, Plasmodium falciparum
NLIFQRYIKNVPLKHKTYVK

SEQ ID NO: 3293144 - protein, 20 aa, Plasmodium falciparum
NLIHIPLTRYMRIPTDWLVE

SEQ ID NO: 3293145 - protein, 19 aa, Plasmodium falciparum
NLIHTIIIIFITNQNVFFT

SEQ ID NO: 3293146 - protein, 43 aa, Plasmodium falciparum
NLIIVREYVFYKLLLKILSYFSYFYIFFLSCLQPVQMMNPIQM

SEQ ID NO: 3293147 - protein, 21 aa, Plasmodium falciparum
NLIKFLFERRGYFLYQEGYMK

SEQ ID NO: 3293148 - protein, 18 aa, Plasmodium falciparum
NLIKPFFIGVHDIFVPFD

SEQ ID NO: 3293149 - protein, 18 aa, Plasmodium falciparum
NLILFKKVKIDLSFLEYT

SEQ ID NO: 3293150 - protein, 18 aa, Plasmodium falciparum
NLILFLASTILKSGDKKD

SEQ ID NO: 3293151 - protein, 24 aa, Plasmodium falciparum
NLILLFYINKFICYFCFTHNSFGS

SEQ ID NO: 3293152 - protein, 18 aa, Plasmodium falciparum
NLILYIHGGPYSIILNEY

SEQ ID NO: 3293153 - protein, 25 aa, Plasmodium falciparum
NLINGLTLLRYIIIGTYVGIATVSI

SEQ ID NO: 3293154 - protein, 32 aa, Plasmodium falciparum
NLINNKLYLIKILITLLFINLNNIFLPSINKL

SEQ ID NO: 3293155 - protein, 23 aa, Plasmodium falciparum
NLINQLYYILLISQYYDLDLNML

SEQ ID NO: 3293156 - protein, 25 aa, Plasmodium falciparum
NLINRIIILIINIYLFFNKQNIILH

SEQ ID NO: 3293157 - protein, 25 aa, Plasmodium falciparum
NLIPLGHYCNNLVLIGDHKQLPPTI

SEQ ID NO: 3293158 - protein, 18 aa, Plasmodium falciparum
NLIQYYTNLFYINNKKKW

SEQ ID NO: 3293159 - protein, 18 aa, Plasmodium falciparum
NLIYFLDDIGCFDIKFIL

SEQ ID NO: 3293160 - protein, 22 aa, Plasmodium falciparum
NLIYIASLKFINNIKFIFENKL

SEQ ID NO: 3293161 - protein, 20 aa, Plasmodium falciparum
NLKDWLFSRQRYWGEPFPFL

SEQ ID NO: 3293162 - protein, 31 aa, Plasmodium falciparum
NLKINLPYNIISLYKLRYYKNLFFKNYSTIT

SEQ ID NO: 3293163 - protein, 25 aa, Plasmodium falciparum
NLKKKFLYDSIYKQQSWWSWVTGNK

SEQ ID NO: 3293164 - protein, 24 aa, Plasmodium falciparum
NLKKKKLFLKKVPANLWIEQYKLM

SEQ ID NO: 3293165 - protein, 24 aa, Plasmodium falciparum
NLKKLYIFIIYYIEGLRKKENILY

SEQ ID NO: 3293166 - protein, 44 aa, Plasmodium falciparum
NLKKNDICLLYTLCFKKSYLNHMLIFLNMDCLINDNTIIKFKLT

SEQ ID NO: 3293167 - protein, 25 aa, Plasmodium falciparum
NLKLNTYTTFYFYDVKSLKCNFDFL

SEQ ID NO: 3293168 - protein, 17 aa, Plasmodium falciparum
NLKLSLGRLRKILNKSI

SEQ ID NO: 3293169 - protein, 34 aa, Plasmodium falciparum
NLKNAMISINIYKLIILLYKADYYRCTSTLICLF

SEQ ID NO: 3293170 - protein, 24 aa, Plasmodium falciparum
NLKNFIFLIDSLFLKKKYVEILEL

SEQ ID NO: 3293171 - protein, 24 aa, Plasmodium falciparum
NLKNIPNYIIINSFRIILQSCLNK

SEQ ID NO: 3293172 - protein, 27 aa, Plasmodium falciparum
NLKNNKIYIIRILTGIFIIVLEEYMKD

SEQ ID NO: 3293173 - protein, 25 aa, Plasmodium falciparum
NLKSKWYWFDLGYPTLMCLYEILKS

SEQ ID NO: 3293174 - protein, 23 aa, Plasmodium falciparum
NLKTFCILDICLSHLLCALTFLE

SEQ ID NO: 3293175 - protein, 33 aa, Plasmodium falciparum
NLKTIQIYYIIRSFYEHFYLKQVDSFLTLVVNE

SEQ ID NO: 3293176 - protein, 33 aa, Plasmodium falciparum
NLKTWLSRCLIIAQTIILVYTYLFHLNVLSCNI

SEQ ID NO: 3293177 - protein, 18 aa, Plasmodium falciparum
NLKYIIIYSDLIKDEKKN

SEQ ID NO: 3293178 - protein, 25 aa, Plasmodium falciparum
NLLEKKYIYYLYREDIIYLENNINQ

SEQ ID NO: 3293179 - protein, 17 aa, Plasmodium falciparum
NLLHFISIFNDFYSLFP

SEQ ID NO: 3293180 - protein, 27 aa, Plasmodium falciparum
NLLIDFHILYFVFHLKKLNLSLHFFDP

SEQ ID NO: 3293181 - protein, 32 aa, Plasmodium falciparum
NLLKNGYIKSLYQYFLLYSHYEDAYNKYNITK

SEQ ID NO: 3293182 - protein, 24 aa, Plasmodium falciparum
NLLKNILSVLFNLTITWLNEMDSK

SEQ ID NO: 3293183 - protein, 31 aa, Plasmodium falciparum
NLLKRYVRLFDFCNLSLLSSLRLFLRCFKLP

SEQ ID NO: 3293184 - protein, 18 aa, Plasmodium falciparum
NLLLYLFRCNTKVNFTYP

SEQ ID NO: 3293185 - protein, 21 aa, Plasmodium falciparum
NLLSVGFFLNEKKKYYKLYHL

SEQ ID NO: 3293186 - protein, 20 aa, Plasmodium falciparum
NLLWFERYFLEHLCNSQLGV

SEQ ID NO: 3293187 - protein, 19 aa, Plasmodium falciparum
NLLYMYLEILKKKEIRTFY

SEQ ID NO: 3293188 - protein, 19 aa, Plasmodium falciparum
NLMNSFLIGIKKNSKEYKK

SEQ ID NO: 3293189 - protein, 18 aa, Plasmodium falciparum
NLMRNILILRINNILYKY

SEQ ID NO: 3293190 - protein, 32 aa, Plasmodium falciparum
NLNEGSYKILKDIYFSMLYNMNNMKNCGIQYL

SEQ ID NO: 3293191 - protein, 29 aa, Plasmodium falciparum
NLNETICVYIFFPLQFHYLRKLLCDKEED

SEQ ID NO: 3293192 - protein, 28 aa, Plasmodium falciparum
NLNFLQNYFLILLLIPHFELSIYKNVLK

SEQ ID NO: 3293193 - protein, 25 aa, Plasmodium falciparum
NLNFMPEEILIYIHGYNVKLNHGCS

SEQ ID NO: 3293194 - protein, 27 aa, Plasmodium falciparum
NLNGNIQVFMWPFSYFSNKKKKKKKNI

SEQ ID NO: 3293195 - protein, 28 aa, Plasmodium falciparum
NLNISSLIYLIKILIIKCSIKKENEIHN

SEQ ID NO: 3293196 - protein, 31 aa, Plasmodium falciparum
NLNKANTTLLLRIFYIMCFQKSFYINTAMHY

SEQ ID NO: 3293197 - protein, 30 aa, Plasmodium falciparum
NLNKIFSNNYKFFIIKKKKKLKKLCYIMKS

SEQ ID NO: 3293198 - protein, 32 aa, Plasmodium falciparum
NLNLFDYLIIVINKYFHLVQKYKLTNTYGNIK

SEQ ID NO: 3293199 - protein, 22 aa, Plasmodium falciparum
NLNLIFERNFGYKVGRNKLFKT

SEQ ID NO: 3293200 - protein, 17 aa, Plasmodium falciparum
NLNLQYLSIYLYNLCHM

SEQ ID NO: 3293201 - protein, 23 aa, Plasmodium falciparum
NLNLYFIIYKYMKKNRMLTCVRK

SEQ ID NO: 3293202 - protein, 21 aa, Plasmodium falciparum
NLNMYYYLEGLKYNIYRFQFP

SEQ ID NO: 3293203 - protein, 18 aa, Plasmodium falciparum
NLNNIFLPSINKLYFIKN

SEQ ID NO: 3293204 - protein, 24 aa, Plasmodium falciparum
NLNNNFIVYKFVNTKELIKNYLTT

SEQ ID NO: 3293205 - protein, 36 aa, Plasmodium falciparum
NLNPYTTFKVLLHYWLEDFLYGYYISKKKIEKCTQK

SEQ ID NO: 3293206 - protein, 29 aa, Plasmodium falciparum
NLNYIKYMWLHHSLVIFKLLIDTNLKVDI

SEQ ID NO: 3293207 - protein, 50 aa, Plasmodium falciparum
NLPLHRSHILLILSLPTYYTFYEFFLLIQGFMNFIVHIKIFKLNGYLNFL

SEQ ID NO: 3293208 - protein, 21 aa, Plasmodium falciparum
NLQYLSIYLYNLCHMNNYYIK

SEQ ID NO: 3293209 - protein, 21 aa, Plasmodium falciparum
NLRDPFLIKKGIRIKLDENTK

SEQ ID NO: 3293210 - protein, 25 aa, Plasmodium falciparum
NLREDINFIPKNIPLLFVHSKDDSV

SEQ ID NO: 3293211 - protein, 30 aa, Plasmodium falciparum
NLRGIKFLTYYKNCLLYRPFIKLNKLHLYR

SEQ ID NO: 3293212 - protein, 20 aa, Plasmodium falciparum
NLRHSNLVLIMGVSIHYPFV

SEQ ID NO: 3293213 - protein, 25 aa, Plasmodium falciparum
NLRKYKHYFELYKKYKKIFLDKKKD

SEQ ID NO: 3293214 - protein, 17 aa, Plasmodium falciparum
NLSCDFNLYLRICKVVL

SEQ ID NO: 3293215 - protein, 27 aa, Plasmodium falciparum
NLSCNVCTLIFFYDISSKLFNSDFCDI

SEQ ID NO: 3293216 - protein, 24 aa, Plasmodium falciparum
NLSFSFFYHIPLKNSISNYELLAL

SEQ ID NO: 3293217 - protein, 18 aa, Plasmodium falciparum
NLSIFPKFYETTVSFLII

SEQ ID NO: 3293218 - protein, 26 aa, Plasmodium falciparum
NLSIIFLKMFMLSFQLVDVFINGLVS

SEQ ID NO: 3293219 - protein, 25 aa, Plasmodium falciparum
NLSIQKNFLLIKFFNPNKLQDINDL

SEQ ID NO: 3293220 - protein, 17 aa, Plasmodium falciparum
NLSIRYDTYNEYDLKCY

SEQ ID NO: 3293221 - protein, 27 aa, Plasmodium falciparum
NLSKKINYIFFDMITRNRKSKDEVAIL

SEQ ID NO: 3293222 - protein, 19 aa, Plasmodium falciparum
NLSNYMYYSKHSSFFLLLF

SEQ ID NO: 3293223 - protein, 20 aa, Plasmodium falciparum
NLSPTLRSFIKRNSVRPKNA

SEQ ID NO: 3293224 - protein, 20 aa, Plasmodium falciparum
NLSQIMLCAFFISTMLAIKR

SEQ ID NO: 3293225 - protein, 17 aa, Plasmodium falciparum
NLSTLHLYPKPSPYIVS

SEQ ID NO: 3293226 - protein, 17 aa, Plasmodium falciparum
NLTKYVYIWAKNSTYNY

SEQ ID NO: 3293227 - protein, 21 aa, Plasmodium falciparum
NLTMWSWWLEKVNLKRLGVDK

SEQ ID NO: 3293228 - protein, 24 aa, Plasmodium falciparum
NLTNIHIPLYFEKIHFVEIVLFLL

SEQ ID NO: 3293229 - protein, 25 aa, Plasmodium falciparum
NLTSEYFYAFLMPESKIEEIMKRKK

SEQ ID NO: 3293230 - protein, 24 aa, Plasmodium falciparum
NLTYLRHIVNFIQLIFDIHNANYD

SEQ ID NO: 3293231 - protein, 21 aa, Plasmodium falciparum
NLVFYLPRNVCMKELYYLYGY

SEQ ID NO: 3293232 - protein, 18 aa, Plasmodium falciparum
NLVIKCYVHFILFYKKRK

SEQ ID NO: 3293233 - protein, 19 aa, Plasmodium falciparum
NLVLPQINFTYIPLNLNHY

SEQ ID NO: 3293234 - protein, 25 aa, Plasmodium falciparum
NLWNNIWINYITLSLIIIMIALLFL

SEQ ID NO: 3293235 - protein, 17 aa, Plasmodium falciparum
NLWYHSLGNFTASNYGL

SEQ ID NO: 3293236 - protein, 24 aa, Plasmodium falciparum
NLYEDLFCLIPLNNEKRITFYFLS

SEQ ID NO: 3293237 - protein, 42 aa, Plasmodium falciparum
NLYEYDSHYLLASVILFFLALLSIFVGMIYMKSRKHSDKKCS

SEQ ID NO: 3293238 - protein, 18 aa, Plasmodium falciparum
NLYINLHILNIKPNDEKK

SEQ ID NO: 3293239 - protein, 29 aa, Plasmodium falciparum
NLYITLFTIIYIYLIIFVGVMITPAISHT

SEQ ID NO: 3293240 - protein, 21 aa, Plasmodium falciparum
NLYKILEPLSKYMHEVKSNCL

SEQ ID NO: 3293241 - protein, 23 aa, Plasmodium falciparum
NLYKYWYSVIFAVEKILFVNCSN

SEQ ID NO: 3293242 - protein, 24 aa, Plasmodium falciparum
NLYNKIILTFLSALCFEKLNKLKL

SEQ ID NO: 3293243 - protein, 17 aa, Plasmodium falciparum
NLYPNIFHYCSTYKIKN

SEQ ID NO: 3293244 - protein, 17 aa, Plasmodium falciparum
NLYPNYQLNIIYSIVLC

SEQ ID NO: 3293245 - protein, 22 aa, Plasmodium falciparum
NLYQELLMYFNPIQIINIKNEK

SEQ ID NO: 3293246 - protein, 39 aa, Plasmodium falciparum
NLYTSEILNYIYYNSLYLLIHLLLNIRFYYNIFHSTYKK

SEQ ID NO: 3293247 - protein, 18 aa, Plasmodium falciparum
NLYVLRRILFFDSNINIY

SEQ ID NO: 3293248 - protein, 50 aa, Plasmodium falciparum
NLYVTINYLLYFKILNSCKLYLYLYSYFYYEFYIYSFKKYIKKYNVYFYF

SEQ ID NO: 3293249 - protein, 27 aa, Plasmodium falciparum
NMACEYIYKIYLIYKTMMNVKKSFSYN

SEQ ID NO: 3293250 - protein, 53 aa, Plasmodium falciparum
NMCHKSFSYIYDLVLLLYFLKICFFYLNEHIHFVLHLSLYTLYKSIKIFVIYL

SEQ ID NO: 3293251 - protein, 42 aa, Plasmodium falciparum
NMDDFINLWKIYKNELIHFYTTLIYIISITISEFYVILNNIK

SEQ ID NO: 3293252 - protein, 24 aa, Plasmodium falciparum
NMDDSMYYYYYYYHSFVGNGVGNN

SEQ ID NO: 3293253 - protein, 18 aa, Plasmodium falciparum
NMDQKPFIMSIHDRNLFS

SEQ ID NO: 3293254 - protein, 18 aa, Plasmodium falciparum
NMDYLNFFLKPPRGKGVT

SEQ ID NO: 3293255 - protein, 37 aa, Plasmodium falciparum
NMDYWKYINIKYWYDYDIILYFFLNLLKNCNNGHLFE

SEQ ID NO: 3293256 - protein, 23 aa, Plasmodium falciparum
NMDYYLNFDSFVSNPFTNNIYKN

SEQ ID NO: 3293257 - protein, 32 aa, Plasmodium falciparum
NMEDNIWKYIIIYLNLFIKNNVFIQNLVHPSS

SEQ ID NO: 3293258 - protein, 24 aa, Plasmodium falciparum
NMEKVLPYLYLHNYCRNPEGLSYI

SEQ ID NO: 3293259 - protein, 22 aa, Plasmodium falciparum
NMENLNAACTLKYGPKAPTSWK

SEQ ID NO: 3293260 - protein, 25 aa, Plasmodium falciparum
NMEVQYPIAHFVSESYRANDLFGVK

SEQ ID NO: 3293261 - protein, 23 aa, Plasmodium falciparum
NMEYISIIPDLLKSYNSIYDIIN

SEQ ID NO: 3293262 - protein, 19 aa, Plasmodium falciparum
NMFFIKLFKDKYQSQLQII

SEQ ID NO: 3293263 - protein, 31 aa, Plasmodium falciparum
NMFILAFVGFVWFILSLRKFSLKYQFSQIGI

SEQ ID NO: 3293264 - protein, 18 aa, Plasmodium falciparum
NMFLLLITLIIYALFIVI

SEQ ID NO: 3293265 - protein, 17 aa, Plasmodium falciparum
NMFLLQYTYEEIYDAIE

SEQ ID NO: 3293266 - protein, 19 aa, Plasmodium falciparum
NMFNEWFKKGFVSIGEFQN

SEQ ID NO: 3293267 - protein, 24 aa, Plasmodium falciparum
NMGIKFRIIYIFKKILSACFFKRN

SEQ ID NO: 3293268 - protein, 24 aa, Plasmodium falciparum
NMIDMNNYNFYYSCGKNEIRNMNT

SEQ ID NO: 3293269 - protein, 24 aa, Plasmodium falciparum
NMILFRTYLFLKAKNLEKQISDCL

SEQ ID NO: 3293270 - protein, 18 aa, Plasmodium falciparum
NMINFLLINNVHTYKIII

SEQ ID NO: 3293271 - protein, 23 aa, Plasmodium falciparum
NMKCNYILFLLNFVSHIKVRPFI

SEQ ID NO: 3293272 - protein, 18 aa, Plasmodium falciparum
NMKINLLETWFIQDDLFM

SEQ ID NO: 3293273 - protein, 23 aa, Plasmodium falciparum
NMKLIIYLPHWFNDYDLLKQVNT

SEQ ID NO: 3293274 - protein, 22 aa, Plasmodium falciparum
NMKNINYIYIIKKEFYDFYIHK

SEQ ID NO: 3293275 - protein, 22 aa, Plasmodium falciparum
NMKNNIFWLQQKKKKKIKKINN

SEQ ID NO: 3293276 - protein, 26 aa, Plasmodium falciparum
NMKQNYFHYLIKYPYINYNYSILKEK

SEQ ID NO: 3293277 - protein, 26 aa, Plasmodium falciparum
NMKRLKVFRFRPYLPISFGIITSCSF

SEQ ID NO: 3293278 - protein, 24 aa, Plasmodium falciparum
NMKTKLIQLQKLQKNKLLNALNND

SEQ ID NO: 3293279 - protein, 35 aa, Plasmodium falciparum
NMKYLDFLFIILRYITYFWFYLSEDNKLILISYYY

SEQ ID NO: 3293280 - protein, 20 aa, Plasmodium falciparum
NMKYLKKMNFLYSKKLNINR

SEQ ID NO: 3293281 - protein, 18 aa, Plasmodium falciparum
NMLLNYIRREKLNVYVIV

SEQ ID NO: 3293282 - protein, 23 aa, Plasmodium falciparum
NMLNEYYILFNNIILDTIKKKMS

SEQ ID NO: 3293283 - protein, 18 aa, Plasmodium falciparum
NMLSSKFINLPLDVHHKV

SEQ ID NO: 3293284 - protein, 53 aa, Plasmodium falciparum
NMLSSYGFIFVFLYFGLNNLVLCNAWFLSKTIPFFSVFYMLGSYFYKDIQKYI

SEQ ID NO: 3293285 - protein, 41 aa, Plasmodium falciparum
NMLTYGIPIRIGFLLGSAAFLFFYLKIAKIYMYIYGCYIYV

SEQ ID NO: 3293286 - protein, 25 aa, Plasmodium falciparum
NMNLYYIFILVLVSVTFLNITDILY

SEQ ID NO: 3293287 - protein, 24 aa, Plasmodium falciparum
NMNNIFLLLIKTERKIFSYIIFSH

SEQ ID NO: 3293288 - protein, 30 aa, Plasmodium falciparum
NMNNLHCFYDPLSYYMLYEHNKMNLKRYRE

SEQ ID NO: 3293289 - protein, 24 aa, Plasmodium falciparum
NMNNLLLLNVYFKDIMSKNNFICI

SEQ ID NO: 3293290 - protein, 26 aa, Plasmodium falciparum
NMNNSTLCYILYSYSTLFTISNSYLL

SEQ ID NO: 3293291 - protein, 17 aa, Plasmodium falciparum
NMNRHFVVCKYFGSIPK

SEQ ID NO: 3293292 - protein, 35 aa, Plasmodium falciparum
NMNTSFLTYYFLYINKSLFNFLGGIYSHTLRKGET

SEQ ID NO: 3293293 - protein, 24 aa, Plasmodium falciparum
NMNVRVYLCDALRKGLDVWYDPIK

SEQ ID NO: 3293294 - protein, 23 aa, Plasmodium falciparum
NMNYYLVNIFLKKKKKTLEQNIL

SEQ ID NO: 3293295 - protein, 26 aa, Plasmodium falciparum
NMPIDFLYELIHSITYFYKNMHVKKT

SEQ ID NO: 3293296 - protein, 27 aa, Plasmodium falciparum
NMQNKIVFVLAMKIFQIKKLYPNNIHF

SEQ ID NO: 3293297 - protein, 24 aa, Plasmodium falciparum
NMQNMMQRFFFLKRKKLKNKTEFN

SEQ ID NO: 3293298 - protein, 19 aa, Plasmodium falciparum
NMRQIRKILFLQKYSNILQ

SEQ ID NO: 3293299 - protein, 18 aa, Plasmodium falciparum
NMRTLRNTLLSLLSKAQY

SEQ ID NO: 3293300 - protein, 23 aa, Plasmodium falciparum
NMSKKEFELIKINDMFYQNNRSN

SEQ ID NO: 3293301 - protein, 23 aa, Plasmodium falciparum
NMSNGRVLPFFPKEYFLHSSTHE

SEQ ID NO: 3293302 - protein, 25 aa, Plasmodium falciparum
NMSNKLLYICIYNNKIYVLLNILIN

SEQ ID NO: 3293303 - protein, 27 aa, Plasmodium falciparum
NMSSSYYYYYVNMFSLYKKNYNKYEEI

SEQ ID NO: 3293304 - protein, 32 aa, Plasmodium falciparum
NMSTYHYALSFLLYTHFTSPIRRYPDILVHRV

SEQ ID NO: 3293305 - protein, 21 aa, Plasmodium falciparum
NMSVFTYVALINRSYNKLYTS

SEQ ID NO: 3293306 - protein, 35 aa, Plasmodium falciparum
NMTESNIIFIISNLTKLIIMTYLENNKNGLHSSID

SEQ ID NO: 3293307 - protein, 23 aa, Plasmodium falciparum
NMTHFFILQNCDLILKFLNIIYT

SEQ ID NO: 3293308 - protein, 37 aa, Plasmodium falciparum
NMVFKKNILVNYWYAFYTLIFHNFIFQYKENEIQFAD

SEQ ID NO: 3293309 - protein, 19 aa, Plasmodium falciparum
NMVILIIFSCSICILFIFI

SEQ ID NO: 3293310 - protein, 36 aa, Plasmodium falciparum
NMVINFYFNPFLYNHPYKFILIKNLMLIITKEVNFY

SEQ ID NO: 3293311 - protein, 28 aa, Plasmodium falciparum
NMVQPKHLNLLKMLKKYMYEIIEESCFD

SEQ ID NO: 3293312 - protein, 42 aa, Plasmodium falciparum
NMWLKQKLHSYYKICGFICFLLYAFLYILSYEQYEVFVGFVA

SEQ ID NO: 3293313 - protein, 18 aa, Plasmodium falciparum
NMYEILLSNFKSLNYEKI

SEQ ID NO: 3293314 - protein, 20 aa, Plasmodium falciparum
NMYHFNLFYNLYIKDNITNF

SEQ ID NO: 3293315 - protein, 18 aa, Plasmodium falciparum
NMYIFIDYMFIYNHHKNK

SEQ ID NO: 3293316 - protein, 39 aa, Plasmodium falciparum
NMYIRRMYRSLISLKPRGFIIGIIYILYINVLCIHEKNS

SEQ ID NO: 3293317 - protein, 28 aa, Plasmodium falciparum
NMYTLVLIRFIIVVFVIYINLCISHINI

SEQ ID NO: 3293318 - protein, 24 aa, Plasmodium falciparum
NNAIYDIFYEFIDIAYQYNLKNNT

SEQ ID NO: 3293319 - protein, 27 aa, Plasmodium falciparum
NNALDIFLFLHFLLYNEKIMIHNYACL

SEQ ID NO: 3293320 - protein, 23 aa, Plasmodium falciparum
NNARIHLFFQKFAKCLKINELLI

SEQ ID NO: 3293321 - protein, 18 aa, Plasmodium falciparum
NNCFISLFHLNNLNNELR

SEQ ID NO: 3293322 - protein, 26 aa, Plasmodium falciparum
NNCFYYYYYFHSFFNIITKFINIINK

SEQ ID NO: 3293323 - protein, 26 aa, Plasmodium falciparum
NNCHFFFLTYVLVCIVGVLYVILQNL

SEQ ID NO: 3293324 - protein, 20 aa, Plasmodium falciparum
NNCIYILKENILFKDLDNAT

SEQ ID NO: 3293325 - protein, 32 aa, Plasmodium falciparum
NNCKDPVFLFNILWSLILKYSKYCRKKLIKKR

SEQ ID NO: 3293326 - protein, 31 aa, Plasmodium falciparum
NNCNKMLSHIKYLFVKLLRNQIKDIIGIYIN

SEQ ID NO: 3293327 - protein, 40 aa, Plasmodium falciparum
NNCSNGKYKSTLYIVGNHLRFRGFRILAENEYEMKTKYKT

SEQ ID NO: 3293328 - protein, 25 aa, Plasmodium falciparum
NNDAYYYYKHILKTQATNRLRVTKK

SEQ ID NO: 3293329 - protein, 28 aa, Plasmodium falciparum
NNDDMFYLHALILSIQIQYTLSICIIIC

SEQ ID NO: 3293330 - protein, 17 aa, Plasmodium falciparum
NNDFRNFFFSSLSYENI

SEQ ID NO: 3293331 - protein, 22 aa, Plasmodium falciparum
NNDIYIKLIWKYNMNELERLTN

SEQ ID NO: 3293332 - protein, 23 aa, Plasmodium falciparum
NNDKLFFHNYLLEIFEVLFKRKK

SEQ ID NO: 3293333 - protein, 26 aa, Plasmodium falciparum
NNDLQHLFFELYQKEMIYYLHKLKEE

SEQ ID NO: 3293334 - protein, 23 aa, Plasmodium falciparum
NNDNGWFPIIKYFEGDNKEGKNY

SEQ ID NO: 3293335 - protein, 24 aa, Plasmodium falciparum
NNDNIYILLINFLCKNFPSYIGLF

SEQ ID NO: 3293336 - protein, 31 aa, Plasmodium falciparum
NNDNLYIFEKTFFFFILDLNNNMDDFINLWK

SEQ ID NO: 3293337 - protein, 25 aa, Plasmodium falciparum
NNDVIFLQVLFYGITKNYFILNNMY

SEQ ID NO: 3293338 - protein, 31 aa, Plasmodium falciparum
NNEELYFLLDNLYFILLHKISDLHRQKKNCL

SEQ ID NO: 3293339 - protein, 30 aa, Plasmodium falciparum
NNEENYILPLYIYLHVIDYNKAAINLYNKL

SEQ ID NO: 3293340 - protein, 27 aa, Plasmodium falciparum
NNEESYFLNRYYYFDSFIALVISKVHN

SEQ ID NO: 3293341 - protein, 26 aa, Plasmodium falciparum
NNEKIYPNIFLICNYLLQEETINVMN

SEQ ID NO: 3293342 - protein, 48 aa, Plasmodium falciparum
NNEKYSYIRQLLSVLLPQPPIYPPFEIWFFMSKKCASQLHKLHLTIYM

SEQ ID NO: 3293343 - protein, 17 aa, Plasmodium falciparum
NNELYVNIMKYITLVYT

SEQ ID NO: 3293344 - protein, 27 aa, Plasmodium falciparum
NNENMCMYLHLLYICSLYNEHILYNKY

SEQ ID NO: 3293345 - protein, 43 aa, Plasmodium falciparum
NNEPFLFTNILYDSSIKYICNKLLFIYFCLKNYHHYNDSFDIM

SEQ ID NO: 3293346 - protein, 27 aa, Plasmodium falciparum
NNEQIYDIFLYIYIKSNLAVTNWINNR

SEQ ID NO: 3293347 - protein, 29 aa, Plasmodium falciparum
NNEQSMYSFFLNLLLSECLPINHLGFCNR

SEQ ID NO: 3293348 - protein, 36 aa, Plasmodium falciparum
NNESVKIFLLKIGKSLIRFLIFIGNVEYIHKNILTL

SEQ ID NO: 3293349 - protein, 27 aa, Plasmodium falciparum
NNETVLLQFFRGVFLKNLRGIKFLTYY

SEQ ID NO: 3293350 - protein, 37 aa, Plasmodium falciparum
NNEYIYMFLVLSSYCHFTLYLNWWADTTIYFKLKKKK

SEQ ID NO: 3293351 - protein, 19 aa, Plasmodium falciparum
NNFFIFHKINYYMNKQLFE

SEQ ID NO: 3293352 - protein, 20 aa, Plasmodium falciparum
NNFFRFLEKNNFIYDIKNCN

SEQ ID NO: 3293353 - protein, 19 aa, Plasmodium falciparum
NNFFVFQFEFKEKKYFLIF

SEQ ID NO: 3293354 - protein, 28 aa, Plasmodium falciparum
NNFINQIILIHPYFILINNTNFNLVMCT

SEQ ID NO: 3293355 - protein, 28 aa, Plasmodium falciparum
NNFKTFFKIFFIPFFQCLLKKNNSLEYF

SEQ ID NO: 3293356 - protein, 17 aa, Plasmodium falciparum
NNFLFDLLNYLNKNINV

SEQ ID NO: 3293357 - protein, 17 aa, Plasmodium falciparum
NNFLFKVFPYIISTLLY

SEQ ID NO: 3293358 - protein, 27 aa, Plasmodium falciparum
NNFLIKNNLLLKSKFMRITPNTYLCRN

SEQ ID NO: 3293359 - protein, 24 aa, Plasmodium falciparum
NNFLKSFHYLLNTSYYHYKMKLLN

SEQ ID NO: 3293360 - protein, 31 aa, Plasmodium falciparum
NNFNIENIILSLLPYLLYFNNKKEEINSHIA

SEQ ID NO: 3293361 - protein, 35 aa, Plasmodium falciparum
NNFRYNIYFASFYKNYFSFFKNIYIHPFKNKNQSL

SEQ ID NO: 3293362 - protein, 26 aa, Plasmodium falciparum
NNFSDIAFNKIWWKLYPELISEFREK

SEQ ID NO: 3293363 - protein, 28 aa, Plasmodium falciparum
NNFSHEIKKYFFFKQLFHTKNKLETNTN

SEQ ID NO: 3293364 - protein, 25 aa, Plasmodium falciparum
NNFTTYDLFFLVKYIIQNQNNYVLS

SEQ ID NO: 3293365 - protein, 20 aa, Plasmodium falciparum
NNFTYKSLLTLSFSLTNIII

SEQ ID NO: 3293366 - protein, 21 aa, Plasmodium falciparum
NNFVFSFSLFNKCIVFRKIYA

SEQ ID NO: 3293367 - protein, 20 aa, Plasmodium falciparum
NNFWLYPGYFCFIGTYQQLA

SEQ ID NO: 3293368 - protein, 22 aa, Plasmodium falciparum
NNFYYVIYIYNINNVLKFTNYI

SEQ ID NO: 3293369 - protein, 23 aa, Plasmodium falciparum
NNGELFFSLFFLEAENSSSIFLI

SEQ ID NO: 3293370 - protein, 28 aa, Plasmodium falciparum
NNGFIKIMLFIILTFHSILFFFVIRIKK

SEQ ID NO: 3293371 - protein, 23 aa, Plasmodium falciparum
NNGGCFFFHVDKDLFFCTKKNIF

SEQ ID NO: 3293372 - protein, 27 aa, Plasmodium falciparum
NNGYLEPAFLWNQWVERKRYIMEKWKY

SEQ ID NO: 3293373 - protein, 24 aa, Plasmodium falciparum
NNGYLYKNLSFSIPLYKNLFQQKT

SEQ ID NO: 3293374 - protein, 18 aa, Plasmodium falciparum
NNHDILLEKLLIKNKNKL

SEQ ID NO: 3293375 - protein, 24 aa, Plasmodium falciparum
NNHLYNMPIFLSLFLRCVTIHLHY

SEQ ID NO: 3293376 - protein, 25 aa, Plasmodium falciparum
NNHPWFIVLWIVLCYIWILLYLFFI

SEQ ID NO: 3293377 - protein, 27 aa, Plasmodium falciparum
NNHTDIYIEFLYVLLINSQLFNRFLFL

SEQ ID NO: 3293378 - protein, 20 aa, Plasmodium falciparum
NNHYNIHPFFSINNLNKKEE

SEQ ID NO: 3293379 - protein, 30 aa, Plasmodium falciparum
NNICDLKNYNLIVELYLFHINELPEKAYQN

SEQ ID NO: 3293380 - protein, 23 aa, Plasmodium falciparum
NNICTNCFIYIYDDEMVGLNKKE

SEQ ID NO: 3293381 - protein, 22 aa, Plasmodium falciparum
NNIDAYYLNKMNSYLFNTLYKK

SEQ ID NO: 3293382 - protein, 28 aa, Plasmodium falciparum
NNIDKMRFFPCIFYLDYNDDDLLKMKIK

SEQ ID NO: 3293383 - protein, 21 aa, Plasmodium falciparum
NNIEMLPYKKLNIYIYNNQII

SEQ ID NO: 3293384 - protein, 17 aa, Plasmodium falciparum
NNIFFIKCIDTLPIYIK

SEQ ID NO: 3293385 - protein, 21 aa, Plasmodium falciparum
NNIFNWFFICTKTEYLTPVLF

SEQ ID NO: 3293386 - protein, 22 aa, Plasmodium falciparum
NNIHANISTLLKYYKNKNKGNN

SEQ ID NO: 3293387 - protein, 20 aa, Plasmodium falciparum
NNIIFLFNKCYSSYVVAICL

SEQ ID NO: 3293388 - protein, 34 aa, Plasmodium falciparum
NNIIHKYPLFLLQYIYFFLKYSPIISFEKYRSIY

SEQ ID NO: 3293389 - protein, 20 aa, Plasmodium falciparum
NNIILKGINKRPLIGLLTDF

SEQ ID NO: 3293390 - protein, 23 aa, Plasmodium falciparum
NNIINNFLKYVKFFKTLKKKKDV

SEQ ID NO: 3293391 - protein, 23 aa, Plasmodium falciparum
NNIIPDNFILYKNDIRNGIFFNI

SEQ ID NO: 3293392 - protein, 23 aa, Plasmodium falciparum
NNIISSIWKYVSNKNNLLYWRKF

SEQ ID NO: 3293393 - protein, 32 aa, Plasmodium falciparum
NNIIYFTQILRTTIYLILKGDIRVFQIFYISK

SEQ ID NO: 3293394 - protein, 20 aa, Plasmodium falciparum
NNIIYIYKKKGEYLIDILNF

SEQ ID NO: 3293395 - protein, 25 aa, Plasmodium falciparum
NNIKEKIYFLLIEKTNISINNRNEG

SEQ ID NO: 3293396 - protein, 25 aa, Plasmodium falciparum
NNIKENIYLLKKGKISSFYKSTNSK

SEQ ID NO: 3293397 - protein, 36 aa, Plasmodium falciparum
NNIKETCLYLLRYIFKYIFNIYNYINNFSYHMLYYF

SEQ ID NO: 3293398 - protein, 28 aa, Plasmodium falciparum
NNIKIVVQFFFFNVIKNILYNCYSSNFF

SEQ ID NO: 3293399 - protein, 26 aa, Plasmodium falciparum
NNIKRLAMFLILQLLVHRYPKIREFT

SEQ ID NO: 3293400 - protein, 23 aa, Plasmodium falciparum
NNIKSWIYYITTPLFVGVQDENE

SEQ ID NO: 3293401 - protein, 26 aa, Plasmodium falciparum
NNILFILLIFFMYLFCIRILYDGYRI

SEQ ID NO: 3293402 - protein, 34 aa, Plasmodium falciparum
NNILIQNIPLLWNLNFLFFFKIYIHNVLSNVHIC

SEQ ID NO: 3293403 - protein, 34 aa, Plasmodium falciparum
NNILPLPMYLNFEKIYCPSLLLTKKRYFGFSFKN

SEQ ID NO: 3293404 - protein, 34 aa, Plasmodium falciparum
NNILSLIYFSSLITYIFIFFFDLSKKNYIINIFY

SEQ ID NO: 3293405 - protein, 25 aa, Plasmodium falciparum
NNIMLLPIIFIYKIIIINTSINLVL

SEQ ID NO: 3293406 - protein, 20 aa, Plasmodium falciparum
NNIMLNFLDKHKKSIFLKSR

SEQ ID NO: 3293407 - protein, 25 aa, Plasmodium falciparum
NNINIFLTLFIFFMRNNISTIVYDP

SEQ ID NO: 3293408 - protein, 22 aa, Plasmodium falciparum
NNINKCIYLYDLKSAKKLKIFQ

SEQ ID NO: 3293409 - protein, 28 aa, Plasmodium falciparum
NNINLLRLFIEFIFIYNSQSHMLELFLS

SEQ ID NO: 3293410 - protein, 25 aa, Plasmodium falciparum
NNINRKNIFLSNKINPFSNAQGVHS

SEQ ID NO: 3293411 - protein, 50 aa, Plasmodium falciparum
NNINTNIDHMFDFDLDDILKIPEAQRKLNKLRTLVDVHLDVIEKMQRDEW

SEQ ID NO: 3293412 - protein, 24 aa, Plasmodium falciparum
NNIPPYFIINNIKTNWLYIKKVMV

SEQ ID NO: 3293413 - protein, 27 aa, Plasmodium falciparum
NNISLNHLFLFYYIYNIIDIMDTGENI

SEQ ID NO: 3293414 - protein, 25 aa, Plasmodium falciparum
NNISYLKPLPIFHSLIDSQFVNIIS

SEQ ID NO: 3293415 - protein, 24 aa, Plasmodium falciparum
NNITNFLFNLKKINILNCLSHEDS

SEQ ID NO: 3293416 - protein, 28 aa, Plasmodium falciparum
NNIYKNIMHPIFFPGYYNTIHFRYYNYF

SEQ ID NO: 3293417 - protein, 18 aa, Plasmodium falciparum
NNIYLIFEILNNIYDVYY

SEQ ID NO: 3293418 - protein, 19 aa, Plasmodium falciparum
NNIYLIQILKKSLSLEINE

SEQ ID NO: 3293419 - protein, 17 aa, Plasmodium falciparum
NNIYPFKLYFKKKWKHF

SEQ ID NO: 3293420 - protein, 25 aa, Plasmodium falciparum
NNIYRNVYYIWNILKSPFSFHSKYI

SEQ ID NO: 3293421 - protein, 22 aa, Plasmodium falciparum
NNKCFLFFQSKKNLILLFVINI

SEQ ID NO: 3293422 - protein, 20 aa, Plasmodium falciparum
NNKFFIFDKKKKNILRIIYL

SEQ ID NO: 3293423 - protein, 30 aa, Plasmodium falciparum
NNKFKDHHFWIPFDYWKASHKRYFYYMYDL

SEQ ID NO: 3293424 - protein, 21 aa, Plasmodium falciparum
NNKGYLFLNNIYRNIINNCKD

SEQ ID NO: 3293425 - protein, 34 aa, Plasmodium falciparum
NNKHGCTYMLYIIAMYLLFQMNIIYNIYKKKLMN

SEQ ID NO: 3293426 - protein, 17 aa, Plasmodium falciparum
NNKIFDNKFVAHKKREK

SEQ ID NO: 3293427 - protein, 21 aa, Plasmodium falciparum
NNKIIYRLISKKEYPDYLKKR

SEQ ID NO: 3293428 - protein, 26 aa, Plasmodium falciparum
NNKIKFYEINLLKKFKKHILNLYKLD

SEQ ID NO: 3293429 - protein, 26 aa, Plasmodium falciparum
NNKKDIYILWTYFESSKCVGYNECKT

SEQ ID NO: 3293430 - protein, 23 aa, Plasmodium falciparum
NNKKIKIMLYHYDILKYNSNHEY

SEQ ID NO: 3293431 - protein, 25 aa, Plasmodium falciparum
NNKKLKLFLLQILDIFASLICYMNI

SEQ ID NO: 3293432 - protein, 26 aa, Plasmodium falciparum
NNKKRNYFIVYYKRYIKRGYANSGNN

SEQ ID NO: 3293433 - protein, 28 aa, Plasmodium falciparum
NNKLKYYFDLFLDSFNFFHNAFLIYVSS

SEQ ID NO: 3293434 - protein, 22 aa, Plasmodium falciparum
NNKLQIVPYLHDFPFPYFVVVD

SEQ ID NO: 3293435 - protein, 27 aa, Plasmodium falciparum
NNKLRQKVWLLLLGFNINISKEKNYNE

SEQ ID NO: 3293436 - protein, 20 aa, Plasmodium falciparum
NNKLYILRYIKYLQINDDIN

SEQ ID NO: 3293437 - protein, 34 aa, Plasmodium falciparum
NNKMKKKIFGLLLFIKVLRIIPPYWIEYNIYEMI

SEQ ID NO: 3293438 - protein, 30 aa, Plasmodium falciparum
NNKMLTLIPWIIFQLFFIKNHMKKIIQCTT

SEQ ID NO: 3293439 - protein, 23 aa, Plasmodium falciparum
NNKNENFLVVRRLMNDEKGEGGF

SEQ ID NO: 3293440 - protein, 30 aa, Plasmodium falciparum
NNKNLSKICFNYFLNYLIKYKDNCSNDIIY

SEQ ID NO: 3293441 - protein, 23 aa, Plasmodium falciparum
NNKNYIYLIIISTLFLIFCYFLL

SEQ ID NO: 3293442 - protein, 25 aa, Plasmodium falciparum
NNKNYIYYDYLFICFDKQDVTTYSF

SEQ ID NO: 3293443 - protein, 21 aa, Plasmodium falciparum
NNKQILTPNPFFGFKKNYNNP

SEQ ID NO: 3293444 - protein, 17 aa, Plasmodium falciparum
NNKQLFMKPFHNNIENT

SEQ ID NO: 3293445 - protein, 26 aa, Plasmodium falciparum
NNKQLLSDVFIYLKKNGYDIDDIWKQ

SEQ ID NO: 3293446 - protein, 27 aa, Plasmodium falciparum
NNKSKNKFFFLFRKKGSIASSSHDKEN

SEQ ID NO: 3293447 - protein, 23 aa, Plasmodium falciparum
NNKSYLMLTFYLGDLKLMIGHNS

SEQ ID NO: 3293448 - protein, 24 aa, Plasmodium falciparum
NNKTFYRSKYCQPCPLCGMKRTKN

SEQ ID NO: 3293449 - protein, 39 aa, Plasmodium falciparum
NNKTIINMFFFFGHFNIMIIIYYVIYKLKMFDKDLFIHE

SEQ ID NO: 3293450 - protein, 23 aa, Plasmodium falciparum
NNKWNILFSFSDCCIRSFIHDKD

SEQ ID NO: 3293451 - protein, 25 aa, Plasmodium falciparum
NNKYFHLSSFFLLKSMDSSIHKDVE

SEQ ID NO: 3293452 - protein, 23 aa, Plasmodium falciparum
NNKYRMYIIKYLKRSLGDMFPSK

SEQ ID NO: 3293453 - protein, 31 aa, Plasmodium falciparum
NNKYSFLNKFLNIEPLILFAKKLNSKRSNIE

SEQ ID NO: 3293454 - protein, 28 aa, Plasmodium falciparum
NNLAHLFTLIKIVIPNIYYIYEETLYYD

SEQ ID NO: 3293455 - protein, 22 aa, Plasmodium falciparum
NNLEIIILFIDCLFKKCWNESF

SEQ ID NO: 3293456 - protein, 19 aa, Plasmodium falciparum
NNLFYYLSLHYLVKNEKIM

SEQ ID NO: 3293457 - protein, 28 aa, Plasmodium falciparum
NNLILPFNFCLDLLYIFLNNYECFLDNF

SEQ ID NO: 3293458 - protein, 17 aa, Plasmodium falciparum
NNLLNYYKGVILIDIDV

SEQ ID NO: 3293459 - protein, 27 aa, Plasmodium falciparum
NNLSFRFICPYLYKLKNFKLIIETNLS

SEQ ID NO: 3293460 - protein, 26 aa, Plasmodium falciparum
NNLSNILSLLFHFLKFRNIHVRNYGQ

SEQ ID NO: 3293461 - protein, 19 aa, Plasmodium falciparum
NNLSPSISFLTFPTNFLLN

SEQ ID NO: 3293462 - protein, 31 aa, Plasmodium falciparum
NNLSSCLLFFFRFYINCLMLLNINIDIDYEY

SEQ ID NO: 3293463 - protein, 26 aa, Plasmodium falciparum
NNLVKKYFPYILKSSFFIFNILKKKR

SEQ ID NO: 3293464 - protein, 17 aa, Plasmodium falciparum
NNLYFSYDARFAELLEG

SEQ ID NO: 3293465 - protein, 27 aa, Plasmodium falciparum
NNLYILLLYIFCIYSRCLCNISLHPSL

SEQ ID NO: 3293466 - protein, 25 aa, Plasmodium falciparum
NNLYYNFKFIIYDILFSPYSNKKII

SEQ ID NO: 3293467 - protein, 18 aa, Plasmodium falciparum
NNLYYTFNDYNVLQFLIN

SEQ ID NO: 3293468 - protein, 25 aa, Plasmodium falciparum
NNMDSIIVYWDIFKDIVFYINNLLY

SEQ ID NO: 3293469 - protein, 18 aa, Plasmodium falciparum
NNMDSMIKPFNMKKKYNL

SEQ ID NO: 3293470 - protein, 25 aa, Plasmodium falciparum
NNMEKFIYCIKNFPGPFSRKSNKVD

SEQ ID NO: 3293471 - protein, 17 aa, Plasmodium falciparum
NNMLLLCKSKNVKNQNR

SEQ ID NO: 3293472 - protein, 22 aa, Plasmodium falciparum
NNMMIDTIFIKSLIYLCQSIFI

SEQ ID NO: 3293473 - protein, 42 aa, Plasmodium falciparum
NNMMRYNLLDYIIYTCFYIIFCKIKLIKLMKIIYKINKNDCE

SEQ ID NO: 3293474 - protein, 32 aa, Plasmodium falciparum
NNMNQCFYIFIYPFIIYFNKYKYVLSNIIPNL

SEQ ID NO: 3293475 - protein, 25 aa, Plasmodium falciparum
NNMSLLLNIMFSFKKNLWTLNNILF

SEQ ID NO: 3293476 - protein, 22 aa, Plasmodium falciparum
NNMVYYIPFGYYKFGKLKNKML

SEQ ID NO: 3293477 - protein, 24 aa, Plasmodium falciparum
NNMWYHFFIILFQNVKKKDTFLYS

SEQ ID NO: 3293478 - protein, 23 aa, Plasmodium falciparum
NNMYDLFLIKKKNFLLLRNNIKE

SEQ ID NO: 3293479 - protein, 18 aa, Plasmodium falciparum
NNMYYLLGKEDMDEPRLC

SEQ ID NO: 3293480 - protein, 24 aa, Plasmodium falciparum
NNNDRYVRILSETEPPMSLEEIMR

SEQ ID NO: 3293481 - protein, 32 aa, Plasmodium falciparum
NNNEANFIFFLWLIYLLILLDSLQALDSNVSS

SEQ ID NO: 3293482 - protein, 39 aa, Plasmodium falciparum
NNNEVVAWGIIWFLIFSIILFYMLKNSSLVTFLFRQHKL

SEQ ID NO: 3293483 - protein, 33 aa, Plasmodium falciparum
NNNFCLNVEMLFSFLFCKKKNYFYNIKNKYFNE

SEQ ID NO: 3293484 - protein, 31 aa, Plasmodium falciparum
NNNFNLYHRYWSLFYKYCPVSYINDNKIIEG

SEQ ID NO: 3293485 - protein, 26 aa, Plasmodium falciparum
NNNFRYFPLNIYFLCSDIFNNKFKNV

SEQ ID NO: 3293486 - protein, 35 aa, Plasmodium falciparum
NNNFYNFFHHIIYLFYYFIYLEKIYEHNWKKNNKK

SEQ ID NO: 3293487 - protein, 26 aa, Plasmodium falciparum
NNNGKIELYIPNFWRSIKSVNEIKSL

SEQ ID NO: 3293488 - protein, 18 aa, Plasmodium falciparum
NNNHMLSFKIVIDAESFS

SEQ ID NO: 3293489 - protein, 30 aa, Plasmodium falciparum
NNNIFKIYIKWLYYTLYAHKYLIISLCILN

SEQ ID NO: 3293490 - protein, 33 aa, Plasmodium falciparum
NNNIKPYWYQLLIQILYLIKIKNLYSFDLLCFK

SEQ ID NO: 3293491 - protein, 26 aa, Plasmodium falciparum
NNNIPLFIYDLLNYIFKSDQTYFYHN

SEQ ID NO: 3293492 - protein, 27 aa, Plasmodium falciparum
NNNITLLKLNYKNSLIYILCTKRTYNG

SEQ ID NO: 3293493 - protein, 27 aa, Plasmodium falciparum
NNNIYSFPMKIFLRKNSTKIKGCSFQI

SEQ ID NO: 3293494 - protein, 37 aa, Plasmodium falciparum
NNNKKEYLFLFLYLYLYLYKFVYIKDMPFYLYNKKKK

SEQ ID NO: 3293495 - protein, 43 aa, Plasmodium falciparum
NNNKKKEIIIIIIIIIIITFLIVIMMILYITIDMMDFLPNNYN

SEQ ID NO: 3293496 - protein, 25 aa, Plasmodium falciparum
NNNKLVCLFFYVLSNIFYPISPSRF

SEQ ID NO: 3293497 - protein, 44 aa, Plasmodium falciparum
NNNKNILKIFNYWSYYIFPSTYKYIFFPLSILQLHPLFKNSDFF

SEQ ID NO: 3293498 - protein, 37 aa, Plasmodium falciparum
NNNKVIVLNLIWLKFLNVIFYLLYVKNYLCAKLVHEI

SEQ ID NO: 3293499 - protein, 34 aa, Plasmodium falciparum
NNNKYNLLFNIIVLLPQNILLDVLIEHAFALFLH

SEQ ID NO: 3293500 - protein, 23 aa, Plasmodium falciparum
NNNLFDLYSLRKVSTNTKQVTKE

SEQ ID NO: 3293501 - protein, 25 aa, Plasmodium falciparum
NNNLFKIKNLFFLKSFFSHIHNNVD

SEQ ID NO: 3293502 - protein, 27 aa, Plasmodium falciparum
NNNLSFLLLVRFLWGISLTNLISEPII

SEQ ID NO: 3293503 - protein, 29 aa, Plasmodium falciparum
NNNMSPYPYYPFYPIIPQPINYNNSGNPN

SEQ ID NO: 3293504 - protein, 22 aa, Plasmodium falciparum
NNNNIMISFQPLFDVILCDNNN

SEQ ID NO: 3293505 - protein, 24 aa, Plasmodium falciparum
NNNNLLFLIPIYHKYVKDKIKIIK

SEQ ID NO: 3293506 - protein, 23 aa, Plasmodium falciparum
NNNNNKHSILWWKQKRTSNNEND

SEQ ID NO: 3293507 - protein, 27 aa, Plasmodium falciparum
NNNTRLVTLDFLLKTFQYIDKKSISSL

SEQ ID NO: 3293508 - protein, 22 aa, Plasmodium falciparum
NNNYDFLLNSYERILFTNLIED

SEQ ID NO: 3293509 - protein, 24 aa, Plasmodium falciparum
NNNYIYQHNFLNLSNPGNVSLLLH

SEQ ID NO: 3293510 - protein, 27 aa, Plasmodium falciparum
NNNYNIVIVLVLILVGRRNRTIQIEDR

SEQ ID NO: 3293511 - protein, 29 aa, Plasmodium falciparum
NNNYNKKDLFLLFYKTEKKLIDLLKIVKP

SEQ ID NO: 3293512 - protein, 28 aa, Plasmodium falciparum
NNNYQWTNYFNYIQLYNKCKKINNKYRK

SEQ ID NO: 3293513 - protein, 24 aa, Plasmodium falciparum
NNNYYYPNQFFRNSTYHNSTSNMN

SEQ ID NO: 3293514 - protein, 37 aa, Plasmodium falciparum
NNPEKLLKVGKIPPDFLRLMFYTLGDYRDILFSSSNT

SEQ ID NO: 3293515 - protein, 32 aa, Plasmodium falciparum
NNPKLTQFVERPPYFRYLHEWGQNFCKKRKGM

SEQ ID NO: 3293516 - protein, 34 aa, Plasmodium falciparum
NNPPSQIMPYFVFIPIGLVIVLISIILNIMQKVN

SEQ ID NO: 3293517 - protein, 31 aa, Plasmodium falciparum
NNPTLKDFVLRPPYFRYLEEWGETFCRQRTR

SEQ ID NO: 3293518 - protein, 24 aa, Plasmodium falciparum
NNQHLLGVLILPVLILLSGELSVF

SEQ ID NO: 3293519 - protein, 22 aa, Plasmodium falciparum
NNQLLLLLALYLCPENYKKNIL

SEQ ID NO: 3293520 - protein, 28 aa, Plasmodium falciparum
NNQNTHFFYYHIYTLLLCIDNLSIHMNN

SEQ ID NO: 3293521 - protein, 23 aa, Plasmodium falciparum
NNQRKYFSSFFKSFKSLYTKKRN

SEQ ID NO: 3293522 - protein, 42 aa, Plasmodium falciparum
NNQSLLNIRYKLYSTNIYTSLYIYLIDISLSYLFTPNMGISY

SEQ ID NO: 3293523 - protein, 22 aa, Plasmodium falciparum
NNQVITFFLPLPKNKPNHLTYK

SEQ ID NO: 3293524 - protein, 32 aa, Plasmodium falciparum
NNQVPTYFDYVPQYLRWFEEWAEDFCRKKKKY

SEQ ID NO: 3293525 - protein, 25 aa, Plasmodium falciparum
NNRHFTTLEWFLEGQFLKTIEKAYG

SEQ ID NO: 3293526 - protein, 24 aa, Plasmodium falciparum
NNRITYIFEFLDIRYVYIKKKNIF

SEQ ID NO: 3293527 - protein, 26 aa, Plasmodium falciparum
NNRIVNIITYIIYRIFKLGNTQNDIL

SEQ ID NO: 3293528 - protein, 18 aa, Plasmodium falciparum
NNRKTMLNEIEKGIKDET

SEQ ID NO: 3293529 - protein, 28 aa, Plasmodium falciparum
NNSFEFYISYLFLILLNEEKENYINEIY

SEQ ID NO: 3293530 - protein, 19 aa, Plasmodium falciparum
NNSFENNMLLLCKSKNVKN

SEQ ID NO: 3293531 - protein, 19 aa, Plasmodium falciparum
NNSFLLYKGKRKKSNFLYS

SEQ ID NO: 3293532 - protein, 54 aa, Plasmodium falciparum
NNSIFKIFNHIFQPFFINQLFPYFFNSFFYTYPLNLISYLFKFNKNKFLYNNYS

SEQ ID NO: 3293533 - protein, 36 aa, Plasmodium falciparum
NNSKMDIHKYLKTIQKLLSVHMYYSYDYDLTQCIQK

SEQ ID NO: 3293534 - protein, 26 aa, Plasmodium falciparum
NNSKYFAFLKNFFNFDFSYIHNGKYV

SEQ ID NO: 3293535 - protein, 20 aa, Plasmodium falciparum
NNSLCVCNLYISSLSLLCCK

SEQ ID NO: 3293536 - protein, 23 aa, Plasmodium falciparum
NNSPLNFCYIFKGTFRIYDRYIK

SEQ ID NO: 3293537 - protein, 17 aa, Plasmodium falciparum
NNSQFIFKAIFTKYRGS

SEQ ID NO: 3293538 - protein, 25 aa, Plasmodium falciparum
NNSQYKYYYPHFYLSKHSDKNDMGI

SEQ ID NO: 3293539 - protein, 17 aa, Plasmodium falciparum
NNSVLLNIVISLLIENL

SEQ ID NO: 3293540 - protein, 29 aa, Plasmodium falciparum
NNSWVFSYILIIWLSFCLYIPFKLKDVDK

SEQ ID NO: 3293541 - protein, 22 aa, Plasmodium falciparum
NNSYINVYCPYVLKKHNWLYKS

SEQ ID NO: 3293542 - protein, 24 aa, Plasmodium falciparum
NNTFFFDIITLNFKKQIVLYTLQN

SEQ ID NO: 3293543 - protein, 19 aa, Plasmodium falciparum
NNTFFYTCQINILSKGLYY

SEQ ID NO: 3293544 - protein, 31 aa, Plasmodium falciparum
NNTKLVFYHPILLLNYIKMGLFSHVHLSLKL

SEQ ID NO: 3293545 - protein, 29 aa, Plasmodium falciparum
NNTKQIFAFPIKKLKFYCLRSFYHSGCLI

SEQ ID NO: 3293546 - protein, 29 aa, Plasmodium falciparum
NNTKSNLYGYFLRFIKRLSSSSNICFNRK

SEQ ID NO: 3293547 - protein, 25 aa, Plasmodium falciparum
NNTNYDIIFLYKNYKTLLYSKKNNY

SEQ ID NO: 3293548 - protein, 26 aa, Plasmodium falciparum
NNTSFYKMLNILISLYIEKVTDKKGN

SEQ ID NO: 3293549 - protein, 22 aa, Plasmodium falciparum
NNTSVPPFCSFSIFVNQKLVPP

SEQ ID NO: 3293550 - protein, 27 aa, Plasmodium falciparum
NNTVRIFHFIFPPLQFYEKLTTEQMEN

SEQ ID NO: 3293551 - protein, 49 aa, Plasmodium falciparum
NNTYNSICKFYLLYIPTIFNMYKYSSLLICIYFIHTINVFVNCVTFILL

SEQ ID NO: 3293552 - protein, 25 aa, Plasmodium falciparum
NNVKIIFLNFIIYQIYIAIRRIVYL

SEQ ID NO: 3293553 - protein, 29 aa, Plasmodium falciparum
NNVKNIFLNLFPHVFFQNQVNIFEFNPLN

SEQ ID NO: 3293554 - protein, 19 aa, Plasmodium falciparum
NNVLLHYPLNNLDNSYHSD

SEQ ID NO: 3293555 - protein, 18 aa, Plasmodium falciparum
NNVLLYIPSIYNNNNKFL

SEQ ID NO: 3293556 - protein, 26 aa, Plasmodium falciparum
NNVNPLFIFMSLTYSYYFIKKDKIYI

SEQ ID NO: 3293557 - protein, 27 aa, Plasmodium falciparum
NNVNPLFIFMSLTYSYYFIKKDKIYIA

SEQ ID NO: 3293558 - protein, 35 aa, Plasmodium falciparum
NNVQKNINLIIIPYIIELIIYLMNVRKEIVHHTMG

SEQ ID NO: 3293559 - protein, 34 aa, Plasmodium falciparum
NNVYIYFYSNYFLCELFINFYVYHLFLKLQQHVE

SEQ ID NO: 3293560 - protein, 28 aa, Plasmodium falciparum
NNVYLKIYFKELFIKFKIIQHNNTCSYI

SEQ ID NO: 3293561 - protein, 32 aa, Plasmodium falciparum
NNYDNEIYKKCKTFIWIHKLLHCLNNMIDYKF

SEQ ID NO: 3293562 - protein, 24 aa, Plasmodium falciparum
NNYDNIHNVFLLFNDDITKSDILN

SEQ ID NO: 3293563 - protein, 17 aa, Plasmodium falciparum
NNYDNIINEYKKIKDIN

SEQ ID NO: 3293564 - protein, 21 aa, Plasmodium falciparum
NNYDYLNAFSDKPIDISLSPN

SEQ ID NO: 3293565 - protein, 21 aa, Plasmodium falciparum
NNYFDMLIYLYKKKKMKNIKD

SEQ ID NO: 3293566 - protein, 23 aa, Plasmodium falciparum
NNYFHLCFPILECKILTKDALLT

SEQ ID NO: 3293567 - protein, 22 aa, Plasmodium falciparum
NNYFPLLKKFCTINQFLRPICI

SEQ ID NO: 3293568 - protein, 20 aa, Plasmodium falciparum
NNYIGLDLFFTKLNNITSNH

SEQ ID NO: 3293569 - protein, 30 aa, Plasmodium falciparum
NNYKMITIHNVKFLFLQNLFTFHKKIKNDS

SEQ ID NO: 3293570 - protein, 29 aa, Plasmodium falciparum
NNYKNSIIYFRFVYLTSLLYSNDIETISK

SEQ ID NO: 3293571 - protein, 30 aa, Plasmodium falciparum
NNYKYIISEILLYSFFLNYSSSFNYKYRSY

SEQ ID NO: 3293572 - protein, 45 aa, Plasmodium falciparum
NNYLTDSIKILYRGTLRTLLILLHDFPEFLCVYNFSFCNVIPLNC

SEQ ID NO: 3293573 - protein, 23 aa, Plasmodium falciparum
NNYMGLVKILYLYIKKNNDKSYI

SEQ ID NO: 3293574 - protein, 26 aa, Plasmodium falciparum
NNYNILKFFYILPEQVRKKYISYFIL

SEQ ID NO: 3293575 - protein, 20 aa, Plasmodium falciparum
NNYQLAFYYEFMMTYLKESS

SEQ ID NO: 3293576 - protein, 27 aa, Plasmodium falciparum
NNYRFFYKMKYLLNNLLIILRTYFFIF

SEQ ID NO: 3293577 - protein, 26 aa, Plasmodium falciparum
NNYSYIPFCFFYKYFEHFVFQQSLSY

SEQ ID NO: 3293578 - protein, 17 aa, Plasmodium falciparum
NNYVYKGVNFLDTIKRN

SEQ ID NO: 3293579 - protein, 25 aa, Plasmodium falciparum
NNYVYSYILLLYNNFVHEQIKKDNE

SEQ ID NO: 3293580 - protein, 21 aa, Plasmodium falciparum
NNYYLVLLNSQNRYIQILFYK

SEQ ID NO: 3293581 - protein, 18 aa, Plasmodium falciparum
NNYYYYNNYAYFNIVNQN

SEQ ID NO: 3293582 - protein, 26 aa, Plasmodium falciparum
NPEIIPIFLILLFAIFIVAYLVKSKK

SEQ ID NO: 3293583 - protein, 20 aa, Plasmodium falciparum
NPFLLYLIGHICNISCMITN

SEQ ID NO: 3293584 - protein, 17 aa, Plasmodium falciparum
NPFYRNRSSVYFDEFDK

SEQ ID NO: 3293585 - protein, 57 aa, Plasmodium falciparum
NPHVRGIIPPSLSDKIILLIFFTVVNIIHLYILFCLLFILYEFLKRATKFTIKWGSL

SEQ ID NO: 3293586 - protein, 21 aa, Plasmodium falciparum
NPIEGCYFYKNSAKYNYLKKS

SEQ ID NO: 3293587 - protein, 18 aa, Plasmodium falciparum
NPIGYIHPTIYSAKLLMK

SEQ ID NO: 3293588 - protein, 36 aa, Plasmodium falciparum
NPIKNNKFLFSYYTLSFQNIILFVTNHNLILKDKGN

SEQ ID NO: 3293589 - protein, 18 aa, Plasmodium falciparum
NPIMKKKLIRWLCERYDN

SEQ ID NO: 3293590 - protein, 25 aa, Plasmodium falciparum
NPKILSLICYLSLISLVLFFILIVS

SEQ ID NO: 3293591 - protein, 32 aa, Plasmodium falciparum
NPKLSNVFVEDIKRILPISNNNLENSITTIKN

SEQ ID NO: 3293592 - protein, 32 aa, Plasmodium falciparum
NPKLTEFVEIPPFFRWLHEWGSDFCDKRARML

SEQ ID NO: 3293593 - protein, 17 aa, Plasmodium falciparum
NPKMKLLHNMKAFYMSS

SEQ ID NO: 3293594 - protein, 20 aa, Plasmodium falciparum
NPLHIYLRIKKYGECIEFLN

SEQ ID NO: 3293595 - protein, 18 aa, Plasmodium falciparum
NPMVFFYIHLGRLSNHFY

SEQ ID NO: 3293596 - protein, 32 aa, Plasmodium falciparum
NPNSPYQFYNDLWTFPLEMLDKYIFKNKNHDY

SEQ ID NO: 3293597 - protein, 30 aa, Plasmodium falciparum
NPPNPFEHPAVIPALMSSTIMWSVGIGFAA

SEQ ID NO: 3293598 - protein, 18 aa, Plasmodium falciparum
NPQKIYRRLLSKFNDKQI

SEQ ID NO: 3293599 - protein, 26 aa, Plasmodium falciparum
NPREIYEIIIILFELARKKNFYHLVE

SEQ ID NO: 3293600 - protein, 22 aa, Plasmodium falciparum
NPRSCMYLNFYLNLEVTNVYVC

SEQ ID NO: 3293601 - protein, 25 aa, Plasmodium falciparum
NPRTHIRFLNLFEKLKKIKNTKNLT

SEQ ID NO: 3293602 - protein, 27 aa, Plasmodium falciparum
NPSKKFFEWIFNYPLFNEFRNSSVSNH

SEQ ID NO: 3293603 - protein, 17 aa, Plasmodium falciparum
NPWLEVFPNCYCDLYCL

SEQ ID NO: 3293604 - protein, 19 aa, Plasmodium falciparum
NPYILICIGMKRLCKLFIY

SEQ ID NO: 3293605 - protein, 22 aa, Plasmodium falciparum
NPYMNYDIFSIVLNLYSCLCVK

SEQ ID NO: 3293606 - protein, 22 aa, Plasmodium falciparum
NPYNRWLYLYRRNIGVLSNIKK

SEQ ID NO: 3293607 - protein, 27 aa, Plasmodium falciparum
NPYVLKRFLLYLYEYLLKISMTDYEKQ

SEQ ID NO: 3293608 - protein, 22 aa, Plasmodium falciparum
NQCISCLYACNPYVDWINNQKE

SEQ ID NO: 3293609 - protein, 23 aa, Plasmodium falciparum
NQCISCLYACNPYVDWINNQKEQ

SEQ ID NO: 3293610 - protein, 30 aa, Plasmodium falciparum
NQDAYLINEILLLFLLFSENSTEIKNIITY

SEQ ID NO: 3293611 - protein, 18 aa, Plasmodium falciparum
NQDLLNYYEILDKKLKDN

SEQ ID NO: 3293612 - protein, 24 aa, Plasmodium falciparum
NQEHLNLIPFLDIIKNCILKNICI

SEQ ID NO: 3293613 - protein, 17 aa, Plasmodium falciparum
NQEILILNDIKKNKDHI

SEQ ID NO: 3293614 - protein, 17 aa, Plasmodium falciparum
NQFFLKHKKTFPSKTNP

SEQ ID NO: 3293615 - protein, 26 aa, Plasmodium falciparum
NQFLCLQYNLLKYYKEAIYIPTVEGQ

SEQ ID NO: 3293616 - protein, 24 aa, Plasmodium falciparum
NQFNSVSLKFPYKGSSPQPLNSIN

SEQ ID NO: 3293617 - protein, 39 aa, Plasmodium falciparum
NQFYPYQSIIQILLLSLFVLCIPFMFICKPAIRTYHIMK

SEQ ID NO: 3293618 - protein, 26 aa, Plasmodium falciparum
NQGLNKLNMRIYYSHILNLCNNESYI

SEQ ID NO: 3293619 - protein, 18 aa, Plasmodium falciparum
NQIIGVRLLFDEIIKNKK

SEQ ID NO: 3293620 - protein, 21 aa, Plasmodium falciparum
NQIIPFFNLFHIFNKEGIEQI

SEQ ID NO: 3293621 - protein, 25 aa, Plasmodium falciparum
NQILRNNYLYSFLRNYNKNLKRNTH

SEQ ID NO: 3293622 - protein, 21 aa, Plasmodium falciparum
NQINLFHKWLDRHRDMCEKWD

SEQ ID NO: 3293623 - protein, 25 aa, Plasmodium falciparum
NQINNLFLHFLQYKKFPIKSYKMTY

SEQ ID NO: 3293624 - protein, 25 aa, Plasmodium falciparum
NQITLIIIAYIITSIFKLSMGRKLI

SEQ ID NO: 3293625 - protein, 19 aa, Plasmodium falciparum
NQKEEYFLLLYINEYIEKK

SEQ ID NO: 3293626 - protein, 27 aa, Plasmodium falciparum
NQKHNTYVFYFLLQKGLGSDHKTWNRF

SEQ ID NO: 3293627 - protein, 25 aa, Plasmodium falciparum
NQKKCLHAFYIALSLLRNKKNRTPK

SEQ ID NO: 3293628 - protein, 25 aa, Plasmodium falciparum
NQKKFKGLSRIYPMFLKSNKSDEFN

SEQ ID NO: 3293629 - protein, 29 aa, Plasmodium falciparum
NQKKRWIYILKHFLTKKLNIPILNDLSNI

SEQ ID NO: 3293630 - protein, 23 aa, Plasmodium falciparum
NQKLLLLLTYDFVHYCIYDNFSD

SEQ ID NO: 3293631 - protein, 29 aa, Plasmodium falciparum
NQKNNFIHYFLILIIGIIKGILKRFKIKA

SEQ ID NO: 3293632 - protein, 19 aa, Plasmodium falciparum
NQKNNHIYIPKTNIKILIQ

SEQ ID NO: 3293633 - protein, 27 aa, Plasmodium falciparum
NQKSYIKHCYILAFSFISHVLNNVIPS

SEQ ID NO: 3293634 - protein, 26 aa, Plasmodium falciparum
NQLKLLIYNFLYLYMFDEYIYMHTHK

SEQ ID NO: 3293635 - protein, 25 aa, Plasmodium falciparum
NQLKNMIYYMFLQSKINIYSFINMD

SEQ ID NO: 3293636 - protein, 19 aa, Plasmodium falciparum
NQLKYFLRNNFLIQILCFV

SEQ ID NO: 3293637 - protein, 18 aa, Plasmodium falciparum
NQLLSGKIPPDFLRQMFY

SEQ ID NO: 3293638 - protein, 28 aa, Plasmodium falciparum
NQMIFVSSIFISFYLINKHWQRALKISQ

SEQ ID NO: 3293639 - protein, 33 aa, Plasmodium falciparum
NQMNNFIIILNKNGMLYLLCDDIYISSIYLYNN

SEQ ID NO: 3293640 - protein, 23 aa, Plasmodium falciparum
NQNHIILLNFIYDNKYNIEFRTD

SEQ ID NO: 3293641 - protein, 20 aa, Plasmodium falciparum
NQNMLWNKWIERHRYMLEKW

SEQ ID NO: 3293642 - protein, 20 aa, Plasmodium falciparum
NQNVYLLLKSQYDKNYKRDK

SEQ ID NO: 3293643 - protein, 22 aa, Plasmodium falciparum
NQPYMFYSVIPKYSSKKKKDKK

SEQ ID NO: 3293644 - protein, 26 aa, Plasmodium falciparum
NQQKYYLINFLIIKILTYFIGCNENI

SEQ ID NO: 3293645 - protein, 27 aa, Plasmodium falciparum
NQQLVYLNYFILLPSISLLTTLISFML

SEQ ID NO: 3293646 - protein, 19 aa, Plasmodium falciparum
NQQPFTFILDTGSANLWVP

SEQ ID NO: 3293647 - protein, 21 aa, Plasmodium falciparum
NQQYYICNTFFLKIVKSFSRH

SEQ ID NO: 3293648 - protein, 20 aa, Plasmodium falciparum
NQRWELLPPNLLIKQDIFLL

SEQ ID NO: 3293649 - protein, 28 aa, Plasmodium falciparum
NQSFKLYKIIKLTPTVKIFIFSYPDEYE

SEQ ID NO: 3293650 - protein, 17 aa, Plasmodium falciparum
NQTYYLYKNFNLTFHKK

SEQ ID NO: 3293651 - protein, 19 aa, Plasmodium falciparum
NQYEPSSCIFYLSGTRSGP

SEQ ID NO: 3293652 - protein, 23 aa, Plasmodium falciparum
NQYIKTPIYCFRKYIFSHKNYMN

SEQ ID NO: 3293653 - protein, 34 aa, Plasmodium falciparum
NQYTTFKVFLEYWLQDFIEGYYILKKRKIIEQCK

SEQ ID NO: 3293654 - protein, 28 aa, Plasmodium falciparum
NRCQPNPDILFLYLVEIFLFPDKDCSYF

SEQ ID NO: 3293655 - protein, 19 aa, Plasmodium falciparum
NRCSLRKPHLLFPLLECHE

SEQ ID NO: 3293656 - protein, 22 aa, Plasmodium falciparum
NRDIYTGILLKKSKYKIDNDKK

SEQ ID NO: 3293657 - protein, 28 aa, Plasmodium falciparum
NRDQLIYCIIYLIYIIQIYIKNKKKNKN

SEQ ID NO: 3293658 - protein, 29 aa, Plasmodium falciparum
NRDQVWRAITCYIPYYVNYFKKTSDDTIV

SEQ ID NO: 3293659 - protein, 19 aa, Plasmodium falciparum
NREYLIIQMWMEIHMMILE

SEQ ID NO: 3293660 - protein, 20 aa, Plasmodium falciparum
NRFMWQAFVKKNISHSILGC

SEQ ID NO: 3293661 - protein, 18 aa, Plasmodium falciparum
NRHFVVCKYFGSIPKTNI

SEQ ID NO: 3293662 - protein, 25 aa, Plasmodium falciparum
NRIDDIFFVFLDMSVRKLCVLFHLY

SEQ ID NO: 3293663 - protein, 24 aa, Plasmodium falciparum
NRIHLIICDFFAIMLIFFLTRKIL

SEQ ID NO: 3293664 - protein, 18 aa, Plasmodium falciparum
NRINLLPYNILLNNSNNT

SEQ ID NO: 3293665 - protein, 18 aa, Plasmodium falciparum
NRITLLSLLPFDYELKTL

SEQ ID NO: 3293666 - protein, 24 aa, Plasmodium falciparum
NRKDYLRYYFEPFNYEGYDQEFIE

SEQ ID NO: 3293667 - protein, 32 aa, Plasmodium falciparum
NRKSKDEVAILFYVTLHLANLGYIYIMQKPIL

SEQ ID NO: 3293668 - protein, 20 aa, Plasmodium falciparum
NRLFDFTKKFKDVLQIRSEH

SEQ ID NO: 3293669 - protein, 26 aa, Plasmodium falciparum
NRLLFKNDIYNIWFSDLSNIYVDTTY

SEQ ID NO: 3293670 - protein, 49 aa, Plasmodium falciparum
NRMLKYMIVYNFSLLFYMFFVFIIIHFFLLILLFYSNKHYIQCTIPFDD

SEQ ID NO: 3293671 - protein, 21 aa, Plasmodium falciparum
NRNAYYVCTLFNDVYLKIEKS

SEQ ID NO: 3293672 - protein, 33 aa, Plasmodium falciparum
NRNELIVHSFLRFFNYPFFKKPLIGDIITNYKI

SEQ ID NO: 3293673 - protein, 22 aa, Plasmodium falciparum
NRNKLCLYFKPLQNYFCSMYYQ

SEQ ID NO: 3293674 - protein, 34 aa, Plasmodium falciparum
NRNMKNFIYFNFPNVPIIYKFNIPRITFTWIHRQ

SEQ ID NO: 3293675 - protein, 23 aa, Plasmodium falciparum
NRNPFFYFIQKLFNLKRGNNVDE

SEQ ID NO: 3293676 - protein, 17 aa, Plasmodium falciparum
NRNRIFLDGHGSCIRLA

SEQ ID NO: 3293677 - protein, 47 aa, Plasmodium falciparum
NRNVPLIVVSLFNLKFFLQKDIISIYNFLNFYLNIDIYDSYKILYDT

SEQ ID NO: 3293678 - protein, 39 aa, Plasmodium falciparum
NRQRYEVSILGKKYIKVVRYTIFRRKIVQPDNALDFLKL

SEQ ID NO: 3293679 - protein, 29 aa, Plasmodium falciparum
NRSHYLNSYLLIYPPPNLSGNLHAGHFFN

SEQ ID NO: 3293680 - protein, 25 aa, Plasmodium falciparum
NRTDDILKRLMYLSNNYYNNMIEYD

SEQ ID NO: 3293681 - protein, 20 aa, Plasmodium falciparum
NRVIKWYNYILPQLKKYMNI

SEQ ID NO: 3293682 - protein, 36 aa, Plasmodium falciparum
NRVYILSTIFYFLLYHERFRFGFFSSTSLLVNLIKL

SEQ ID NO: 3293683 - protein, 30 aa, Plasmodium falciparum
NRYFNNKIFLSKLLLYILNLNMKNIVHIQI

SEQ ID NO: 3293684 - protein, 19 aa, Plasmodium falciparum
NRYGSVETFLVLLNNEKAC

SEQ ID NO: 3293685 - protein, 28 aa, Plasmodium falciparum
NRYVPTLIDPGYFFLYDFEKLQIHTSYK

SEQ ID NO: 3293686 - protein, 26 aa, Plasmodium falciparum
NSAMSYRYLMNISSNLRLYVKKSSIH

SEQ ID NO: 3293687 - protein, 27 aa, Plasmodium falciparum
NSCKFEQPFLYYYFFIETCVNSCYFDF

SEQ ID NO: 3293688 - protein, 22 aa, Plasmodium falciparum
NSDIFINTGFLPYSLNKKKNNK

SEQ ID NO: 3293689 - protein, 38 aa, Plasmodium falciparum
NSDITIKNPFSHIIFYSSHPVIALYLKSNIVSRKKRKI

SEQ ID NO: 3293690 - protein, 42 aa, Plasmodium falciparum
NSDIYFYVLPKKTFSFIFNFSKYFLTYIFLRKNENFLKSYLY

SEQ ID NO: 3293691 - protein, 26 aa, Plasmodium falciparum
NSDKYLLPEHNFWLEPKTLSTPNFAF

SEQ ID NO: 3293692 - protein, 22 aa, Plasmodium falciparum
NSDLLLYIFDNHNNKMCWKLGK

SEQ ID NO: 3293693 - protein, 31 aa, Plasmodium falciparum
NSEKTRYIIVIINFLFTLMKTKFYDAIHENT

SEQ ID NO: 3293694 - protein, 17 aa, Plasmodium falciparum
NSELFYFHYMNEKLFWK

SEQ ID NO: 3293695 - protein, 31 aa, Plasmodium falciparum
NSELNYILYSRIFYAFYILQFNDNIIYKLIH

SEQ ID NO: 3293696 - protein, 17 aa, Plasmodium falciparum
NSFFFNESINYTRCNNI

SEQ ID NO: 3293697 - protein, 22 aa, Plasmodium falciparum
NSFFIVLSLFIHSFIEGLLMGS

SEQ ID NO: 3293698 - protein, 42 aa, Plasmodium falciparum
NSFFYSSVLFFFIPIFLIITLTIILFIILKIYQCVQKKQIAN

SEQ ID NO: 3293699 - protein, 24 aa, Plasmodium falciparum
NSFIDNVVILPYRIYGDNLLSRKT

SEQ ID NO: 3293700 - protein, 21 aa, Plasmodium falciparum
NSFIFIFLFVFTTIVLCFLYL

SEQ ID NO: 3293701 - protein, 24 aa, Plasmodium falciparum
NSFLDYLGIFKDINFIRIHDTKYL

SEQ ID NO: 3293702 - protein, 29 aa, Plasmodium falciparum
NSFLINMNLLIYFYLLKCILFDDMDDNYN

SEQ ID NO: 3293703 - protein, 26 aa, Plasmodium falciparum
NSFLLFTERIIYIFNFSYSHDIKLTL

SEQ ID NO: 3293704 - protein, 23 aa, Plasmodium falciparum
NSFNFPIYTSYKYNYKKTKYLFL

SEQ ID NO: 3293705 - protein, 34 aa, Plasmodium falciparum
NSFNLYVHFFVDSVFILCLPALSFFLSVLFMMMF

SEQ ID NO: 3293706 - protein, 29 aa, Plasmodium falciparum
NSFQKINTSILYIFNFVAVAPKVITGSIS

SEQ ID NO: 3293707 - protein, 17 aa, Plasmodium falciparum
NSFSTLIKQRYFFRCTS

SEQ ID NO: 3293708 - protein, 42 aa, Plasmodium falciparum
NSFVMKVSYYLSYICSYIFSNKYHMLLPYYDDVSLTNEKKKK

SEQ ID NO: 3293709 - protein, 18 aa, Plasmodium falciparum
NSFYIIFLNILKKDNNPY

SEQ ID NO: 3293710 - protein, 20 aa, Plasmodium falciparum
NSGISREKWWDKHAPSIWDG

SEQ ID NO: 3293711 - protein, 25 aa, Plasmodium falciparum
NSHFVIHLYILILKSTRLVTNIIEH

SEQ ID NO: 3293712 - protein, 21 aa, Plasmodium falciparum
NSHIFFCLCNPGYYLHEQMCK

SEQ ID NO: 3293713 - protein, 26 aa, Plasmodium falciparum
NSIENGFFIFQLPPYLKKNQTIEFAC

SEQ ID NO: 3293714 - protein, 29 aa, Plasmodium falciparum
NSILLLNKILYLILKNDVLLSLFSFDKIK

SEQ ID NO: 3293715 - protein, 23 aa, Plasmodium falciparum
NSINFFLIIIMIACVVVGLIDNF

SEQ ID NO: 3293716 - protein, 67 aa, Plasmodium falciparum
NSINNKVIYYLNNPLFIFSEKLPSWVYKIFYLFNFVIDIDIRLLFFELIYFGNYRGLYNYKQKIKEL

SEQ ID NO: 3293717 - protein, 41 aa, Plasmodium falciparum
NSIPYDVQIFKNIFLVFQKTLKYYLFCYMHCWKDVKDLLEY

SEQ ID NO: 3293718 - protein, 24 aa, Plasmodium falciparum
NSIYKYYYNIIKTKWNSLGAYKYV

SEQ ID NO: 3293719 - protein, 22 aa, Plasmodium falciparum
NSKFICFLNNMSSYLPCVVNMN

SEQ ID NO: 3293720 - protein, 29 aa, Plasmodium falciparum
NSKINLIYPKFILLKYIVDKYPQKRYLTL

SEQ ID NO: 3293721 - protein, 26 aa, Plasmodium falciparum
NSKIYKCFINYIYQPLIPHNIRSNNI

SEQ ID NO: 3293722 - protein, 24 aa, Plasmodium falciparum
NSKPYINLIFSDKNFMIKKKSYFK

SEQ ID NO: 3293723 - protein, 23 aa, Plasmodium falciparum
NSKSAFFLCFYMTPSIFANIFYY

SEQ ID NO: 3293724 - protein, 17 aa, Plasmodium falciparum
NSKYFFDIFLNMSNKIK

SEQ ID NO: 3293725 - protein, 88 aa, Plasmodium falciparum
NSLEYIMNLYIFHNLLKLQVYIIIQISQMLIQFILKIITLWIINMMNNIIMYLSIIFRMITILKMFYSTFIINIFVLHKDIILCDQYE

SEQ ID NO: 3293726 - protein, 19 aa, Plasmodium falciparum
NSLFFYPRGNELLNYIYIY

SEQ ID NO: 3293727 - protein, 24 aa, Plasmodium falciparum
NSLFHKMMCAFKKKLFKNEQVIEK

SEQ ID NO: 3293728 - protein, 17 aa, Plasmodium falciparum
NSLFHLATYFYHEKNKE

SEQ ID NO: 3293729 - protein, 32 aa, Plasmodium falciparum
NSLFITINVILIIAYFSLYIRYNKRNYFKSLD

SEQ ID NO: 3293730 - protein, 35 aa, Plasmodium falciparum
NSLILAYSLCNIILHHLIYLKKYKYYINCKQYEND

SEQ ID NO: 3293731 - protein, 47 aa, Plasmodium falciparum
NSLLCLHPYYYKLCSYLLIIHPYHQTYLIDLLLRYCKMFYKDPLSNK

SEQ ID NO: 3293732 - protein, 21 aa, Plasmodium falciparum
NSLLSYCYFPKYFSLKHENNL

SEQ ID NO: 3293733 - protein, 43 aa, Plasmodium falciparum
NSLLTMNVHFFFIVLFAYYNFLVPLYILLCRKETKKIYYSFLK

SEQ ID NO: 3293734 - protein, 44 aa, Plasmodium falciparum
NSLLYHHNIFISRSYIQLLCTLHTYIFCNFVYFKTYIEECFIKL

SEQ ID NO: 3293735 - protein, 27 aa, Plasmodium falciparum
NSLQFFDHIFFKDYLSDYVYISLPPGE

SEQ ID NO: 3293736 - protein, 48 aa, Plasmodium falciparum
NSLTIKTFSFLLIGVCNIYKKKVYFIGQDYDFLKRKILSLYKNKEDNL

SEQ ID NO: 3293737 - protein, 18 aa, Plasmodium falciparum
NSMFCIFYNLWSNHMKTI

SEQ ID NO: 3293738 - protein, 25 aa, Plasmodium falciparum
NSMQSYFYFNFFTKTFDIYLQNYME

SEQ ID NO: 3293739 - protein, 28 aa, Plasmodium falciparum
NSNAYKSCVYLLYLLRGGSDINYNMGNN

SEQ ID NO: 3293740 - protein, 21 aa, Plasmodium falciparum
NSNIINLLKTELSHLLSLKEN

SEQ ID NO: 3293741 - protein, 25 aa, Plasmodium falciparum
NSNIYFIFIEYLLINLLNKKFNVLK

SEQ ID NO: 3293742 - protein, 27 aa, Plasmodium falciparum
NSNIYKLLFNYFLFLSQYLNISFFNMN

SEQ ID NO: 3293743 - protein, 27 aa, Plasmodium falciparum
NSNIYLIDFISLYIRKNFFDLKHLSIY

SEQ ID NO: 3293744 - protein, 37 aa, Plasmodium falciparum
NSNKKFLKFQNKIDYCFPRIFFYVKCILHSIKKYGVV

SEQ ID NO: 3293745 - protein, 23 aa, Plasmodium falciparum
NSNKYLHFLEHFDYLFFIKKKEY

SEQ ID NO: 3293746 - protein, 25 aa, Plasmodium falciparum
NSNKYSIYILLIAIAMFISETLKNY

SEQ ID NO: 3293747 - protein, 23 aa, Plasmodium falciparum
NSNNIFNYIYYPCQKYYIEKYIQ

SEQ ID NO: 3293748 - protein, 40 aa, Plasmodium falciparum
NSNSLIKYLPFFNNDYYFVYFLEKNIKLIKTIFIQYYHKG

SEQ ID NO: 3293749 - protein, 26 aa, Plasmodium falciparum
NSNTIFKQRKYFFENLRKEKSSNNII

SEQ ID NO: 3293750 - protein, 25 aa, Plasmodium falciparum
NSPICCAFIYYLLLYENSSDVILSN

SEQ ID NO: 3293751 - protein, 22 aa, Plasmodium falciparum
NSPKTILLFTVRDWFEEFAPIE

SEQ ID NO: 3293752 - protein, 24 aa, Plasmodium falciparum
NSQKLNHFVFPKKCILILGDEKEG

SEQ ID NO: 3293753 - protein, 51 aa, Plasmodium falciparum
NSRGEHILMLYGIVQLSLIIIVKIIIFSGPLLAIYGFFCPCTEHCRILKKK

SEQ ID NO: 3293754 - protein, 25 aa, Plasmodium falciparum
NSRNSFLHILKYRGNRNDIILLRNK

SEQ ID NO: 3293755 - protein, 26 aa, Plasmodium falciparum
NSSFIDICFFSYIKDIMKLYIMNINK

SEQ ID NO: 3293756 - protein, 41 aa, Plasmodium falciparum
NSSFKLAYAFFLLSLLYFIMIIFILVLVKCKYYKLGKTLTY

SEQ ID NO: 3293757 - protein, 34 aa, Plasmodium falciparum
NSSKMMWTIFILNIFLCSWGIILIDLSCIHYSML

SEQ ID NO: 3293758 - protein, 21 aa, Plasmodium falciparum
NSSLCFYKLYRFFFEIHKCNS

SEQ ID NO: 3293759 - protein, 29 aa, Plasmodium falciparum
NSSNIMMYYIKLIYLFKKQIEAQKGVFYF

SEQ ID NO: 3293760 - protein, 25 aa, Plasmodium falciparum
NSSSIYLKYWDIKLTLVVTYIHFIS

SEQ ID NO: 3293761 - protein, 21 aa, Plasmodium falciparum
NSSVSIIYSTIRKNIHYMKEG

SEQ ID NO: 3293762 - protein, 27 aa, Plasmodium falciparum
NSTDNYIIFFLYDLIFNHNFDIYKYMY

SEQ ID NO: 3293763 - protein, 27 aa, Plasmodium falciparum
NSTSSIRYYLYLNKVIFKSAKTYLDIM

SEQ ID NO: 3293764 - protein, 30 aa, Plasmodium falciparum
NSTYNTKFILFLISYMNKMLIKNKKLKFVK

SEQ ID NO: 3293765 - protein, 23 aa, Plasmodium falciparum
NSVEWYFIALGVDKYYLVYIPDN

SEQ ID NO: 3293766 - protein, 26 aa, Plasmodium falciparum
NSVIKICIYILLILSLKKYVEFEIIY

SEQ ID NO: 3293767 - protein, 26 aa, Plasmodium falciparum
NSVKNYYLMLITENSFYFFNIHLYFN

SEQ ID NO: 3293768 - protein, 19 aa, Plasmodium falciparum
NSVKTPQQTWWKKYGEDIW

SEQ ID NO: 3293769 - protein, 27 aa, Plasmodium falciparum
NSVLNENFLCTFVNLFDMCVTNNTLPS

SEQ ID NO: 3293770 - protein, 21 aa, Plasmodium falciparum
NSVTPWFIKIYLTKIISELYD

SEQ ID NO: 3293771 - protein, 17 aa, Plasmodium falciparum
NSWSEWFKRHTYILDKW

SEQ ID NO: 3293772 - protein, 19 aa, Plasmodium falciparum
NSWVIIGLLIGAMLPYLFS

SEQ ID NO: 3293773 - protein, 25 aa, Plasmodium falciparum
NSYDKLFDDVELRDIIHNEKFFENL

SEQ ID NO: 3293774 - protein, 23 aa, Plasmodium falciparum
NSYESPIHILSFSFKNIYNKISS

SEQ ID NO: 3293775 - protein, 25 aa, Plasmodium falciparum
NSYLYKFLFHLNKLKDYMKFNDGFQ

SEQ ID NO: 3293776 - protein, 24 aa, Plasmodium falciparum
NSYMPYQLILLLRAFAYCNLQDIY

SEQ ID NO: 3293777 - protein, 39 aa, Plasmodium falciparum
NSYNVSYIILIFILINYQKKIFYIINIYYKDINCQYKKK

SEQ ID NO: 3293778 - protein, 32 aa, Plasmodium falciparum
NSYPKYFFNCFIKSASLAFWKKKKIFSRIQVS

SEQ ID NO: 3293779 - protein, 23 aa, Plasmodium falciparum
NSYSCHPFFSILIYITLFLLLFV

SEQ ID NO: 3293780 - protein, 27 aa, Plasmodium falciparum
NTCELIFYTYYNYNSFFFNESINYTRC

SEQ ID NO: 3293781 - protein, 33 aa, Plasmodium falciparum
NTCSFRRIFLNLLSIVGILLLVGLNNIIICDKS

SEQ ID NO: 3293782 - protein, 25 aa, Plasmodium falciparum
NTCSIYIMITISWFFNQINIGMYNK

SEQ ID NO: 3293783 - protein, 39 aa, Plasmodium falciparum
NTCYLNSLLQALYSTVSFIVNLFLFKINETNNKVRTVPN

SEQ ID NO: 3293784 - protein, 28 aa, Plasmodium falciparum
NTDKIYMDKIYMDKIYMDKRYMDKRYMD

SEQ ID NO: 3293785 - protein, 24 aa, Plasmodium falciparum
NTDKKSLLMYIENRARTGSSSINK

SEQ ID NO: 3293786 - protein, 23 aa, Plasmodium falciparum
NTDNYLNIIYFDCYLHSLWIENL

SEQ ID NO: 3293787 - protein, 20 aa, Plasmodium falciparum
NTEVFMYYEGKKKIYNTTTA

SEQ ID NO: 3293788 - protein, 18 aa, Plasmodium falciparum
NTFFQLFITQICKIKIIE

SEQ ID NO: 3293789 - protein, 24 aa, Plasmodium falciparum
NTFGYFFVFFFIGHILVSLNLSLL

SEQ ID NO: 3293790 - protein, 44 aa, Plasmodium falciparum
NTFIIPIMIIKITMSILILFFLILLWSIIFYGPYAIYALHHASI

SEQ ID NO: 3293791 - protein, 21 aa, Plasmodium falciparum
NTFLKSFIFQFIDKEFKREDF

SEQ ID NO: 3293792 - protein, 20 aa, Plasmodium falciparum
NTFLSLFILCMLYAIIFLIL

SEQ ID NO: 3293793 - protein, 21 aa, Plasmodium falciparum
NTFLYILLLINFITLVLYLLP

SEQ ID NO: 3293794 - protein, 29 aa, Plasmodium falciparum
NTFMNIDTFIYFLKGFINLKINNIDALYF

SEQ ID NO: 3293795 - protein, 20 aa, Plasmodium falciparum
NTFNYFTLPKIYNKKMYTLH

SEQ ID NO: 3293796 - protein, 24 aa, Plasmodium falciparum
NTFYSRLPSLISDNWKFFCVCSKD

SEQ ID NO: 3293797 - protein, 25 aa, Plasmodium falciparum
NTGGLFFLLIKVYLDKYYNEEMNLM

SEQ ID NO: 3293798 - protein, 22 aa, Plasmodium falciparum
NTGSCYFLKKKPTCVLKKENHF

SEQ ID NO: 3293799 - protein, 26 aa, Plasmodium falciparum
NTHKRKSFLFWSEYFDFLYNVTDIPK

SEQ ID NO: 3293800 - protein, 28 aa, Plasmodium falciparum
NTHNFTNLFFIVKLFFDYVVEKVEYLLY

SEQ ID NO: 3293801 - protein, 22 aa, Plasmodium falciparum
NTIDYACLLKRKSAEHKETMEI

SEQ ID NO: 3293802 - protein, 46 aa, Plasmodium falciparum
NTIEKFFKQLPKIYFKSILTVFIELFIKMWMLVIIEKGFSNYHFSD

SEQ ID NO: 3293803 - protein, 32 aa, Plasmodium falciparum
NTIKLNFDMIWLPFFCIISNFSSWKKPLYSLF

SEQ ID NO: 3293804 - protein, 34 aa, Plasmodium falciparum
NTIKSIIFVTKSNHIYFLLLKYMSIFFPRNNQER

SEQ ID NO: 3293805 - protein, 26 aa, Plasmodium falciparum
NTINIQFYIFYLFNDVYLQNNYAMRK

SEQ ID NO: 3293806 - protein, 23 aa, Plasmodium falciparum
NTIRKMDPYITAILIYCIGNYIP

SEQ ID NO: 3293807 - protein, 20 aa, Plasmodium falciparum
NTIYDIYEKTLKKLSIQEEN

SEQ ID NO: 3293808 - protein, 25 aa, Plasmodium falciparum
NTKELLYMLRIILSINIVYNKIKNE

SEQ ID NO: 3293809 - protein, 25 aa, Plasmodium falciparum
NTKHLVMSLLYFFLNRISVSSHIYV

SEQ ID NO: 3293810 - protein, 26 aa, Plasmodium falciparum
NTKITLFPFHFYLSSLKNKIIYILEK

SEQ ID NO: 3293811 - protein, 24 aa, Plasmodium falciparum
NTKKSMFYFKNKYVSLIYKHLLND

SEQ ID NO: 3293812 - protein, 25 aa, Plasmodium falciparum
NTKLWAYFTVVFLHLNMKMQADKSL

SEQ ID NO: 3293813 - protein, 32 aa, Plasmodium falciparum
NTKVVIQLLCDYIYYLIFCKHDILCYKCMNGG

SEQ ID NO: 3293814 - protein, 18 aa, Plasmodium falciparum
NTLDYIIPINIHLDVILQ

SEQ ID NO: 3293815 - protein, 29 aa, Plasmodium falciparum
NTLFFVDHTIFYYFINYIMESIRTSFLRI

SEQ ID NO: 3293816 - protein, 28 aa, Plasmodium falciparum
NTLGNNYPIPLILINSAKYIRIESKKNK

SEQ ID NO: 3293817 - protein, 25 aa, Plasmodium falciparum
NTLKDIFFLLQYFKQITILKDQKEI

SEQ ID NO: 3293818 - protein, 20 aa, Plasmodium falciparum
NTLKHDFISQYLPNTQNTEP

SEQ ID NO: 3293819 - protein, 25 aa, Plasmodium falciparum
NTLKKKWITTWVDVGSIFMTDVHRK

SEQ ID NO: 3293820 - protein, 34 aa, Plasmodium falciparum
NTLNTFPNMALNEDFRREFHNILSIHEDTDLMEL

SEQ ID NO: 3293821 - protein, 29 aa, Plasmodium falciparum
NTLYKPKFIPNLILLFNIQCYIIIHDFVF

SEQ ID NO: 3293822 - protein, 27 aa, Plasmodium falciparum
NTMMIYMNIFYFILVALLSSLYNWSYS

SEQ ID NO: 3293823 - protein, 25 aa, Plasmodium falciparum
NTNEFILVSIRYLLNIIYNLIFYDD

SEQ ID NO: 3293824 - protein, 75 aa, Plasmodium falciparum
NTNFSYHNILIKSLYIFNLIFFLTFLLLLDVYILDHTLLSGLIYILCILLFLLTSLFRSIVYLINIPLNKKIIPQ

SEQ ID NO: 3293825 - protein, 26 aa, Plasmodium falciparum
NTNKRINFFIKSLNIIMDFIKFNMLI

SEQ ID NO: 3293826 - protein, 28 aa, Plasmodium falciparum
NTNKYNVLIKTASLSSPLPSYMNTINLL

SEQ ID NO: 3293827 - protein, 23 aa, Plasmodium falciparum
NTNLIKDKILTSKLKGVNFIKYK

SEQ ID NO: 3293828 - protein, 22 aa, Plasmodium falciparum
NTNLLHIYYLYNFIINNKFIDE

SEQ ID NO: 3293829 - protein, 30 aa, Plasmodium falciparum
NTNVRQLIISWLFFLQNIPTINIFEYFHFF

SEQ ID NO: 3293830 - protein, 24 aa, Plasmodium falciparum
NTPSNYHLLIYALAGCSCVYYDNN

SEQ ID NO: 3293831 - protein, 31 aa, Plasmodium falciparum
NTPTTLTDFISRPPYFRYLEEWGQNFCKERK

SEQ ID NO: 3293832 - protein, 31 aa, Plasmodium falciparum
NTPTTLTDFISRPTYFRYLEEWGQNFCKERK

SEQ ID NO: 3293833 - protein, 31 aa, Plasmodium falciparum
NTPTTLTNFISRPPYFRYLEEWGETFCRERK

SEQ ID NO: 3293834 - protein, 31 aa, Plasmodium falciparum
NTPTTLTQFVLRPTYFRYLEEWGQNFCKERK

SEQ ID NO: 3293835 - protein, 24 aa, Plasmodium falciparum
NTQNIMCIFYILYINNLDKNKNFI

SEQ ID NO: 3293836 - protein, 25 aa, Plasmodium falciparum
NTQNNILHIFINKLRYHINNSIDIL

SEQ ID NO: 3293837 - protein, 32 aa, Plasmodium falciparum
NTQSVYDILYQFTYKMPFLYKNYDNDNKIINI

SEQ ID NO: 3293838 - protein, 24 aa, Plasmodium falciparum
NTRKVNFVKTYALLLQCIHYHNQI

SEQ ID NO: 3293839 - protein, 22 aa, Plasmodium falciparum
NTRMRILCNLLIVICEYMFPFY

SEQ ID NO: 3293840 - protein, 28 aa, Plasmodium falciparum
NTSDKIVVDGWKWLINYLSEEVQNKIFL

SEQ ID NO: 3293841 - protein, 17 aa, Plasmodium falciparum
NTSFTYVLLFLSYLFIK

SEQ ID NO: 3293842 - protein, 36 aa, Plasmodium falciparum
NTSINLVLYLYAILRFLIFIFYINTSIFYIYKYTNN

SEQ ID NO: 3293843 - protein, 17 aa, Plasmodium falciparum
NTSKILMLFNLKRNQNI

SEQ ID NO: 3293844 - protein, 24 aa, Plasmodium falciparum
NTSLFKYIYSFFFFKKEENHIYDL

SEQ ID NO: 3293845 - protein, 25 aa, Plasmodium falciparum
NTSNYVLRVPRVLFLASRKSFSSSF

SEQ ID NO: 3293846 - protein, 35 aa, Plasmodium falciparum
NTSVYKIKILSSLALIHIPLYYNIQKNKLKDMWEA

SEQ ID NO: 3293847 - protein, 44 aa, Plasmodium falciparum
NTTDSIILIFLIIFIVVFLPLIFSLTYLCVLFKMNILKVKMQKL

SEQ ID NO: 3293848 - protein, 30 aa, Plasmodium falciparum
NTTDSRFVYKILNILFMNLNKYDMYLCKME

SEQ ID NO: 3293849 - protein, 32 aa, Plasmodium falciparum
NTTFQYNLLYMIKNYYDKWFLNFDLEQFINNI

SEQ ID NO: 3293850 - protein, 43 aa, Plasmodium falciparum
NTTIKILKFIKTDKGFLFLLNILKFIYTKFISLPFNPIDIHTN

SEQ ID NO: 3293851 - protein, 31 aa, Plasmodium falciparum
NTVIKHKSLLWIYHFINILNIHFYNIFDSSP

SEQ ID NO: 3293852 - protein, 27 aa, Plasmodium falciparum
NTVKDEDFYFLEFYDKLFVKREPLMQE

SEQ ID NO: 3293853 - protein, 30 aa, Plasmodium falciparum
NTVMEIFIEIFFMNIFKTIKMKNIYSHFKN

SEQ ID NO: 3293854 - protein, 31 aa, Plasmodium falciparum
NTWKLIELSICIIISIIIIVLNKYQMNMGSM

SEQ ID NO: 3293855 - protein, 39 aa, Plasmodium falciparum
NTYKFTLSIFLFIIAPIAWTLTFLLKCFYNLWVEYFTKG

SEQ ID NO: 3293856 - protein, 26 aa, Plasmodium falciparum
NTYKNFLVLFLYHMYNYLYFIDITNK

SEQ ID NO: 3293857 - protein, 23 aa, Plasmodium falciparum
NTYLFKIFNSIYKLVIVNGYIVS

SEQ ID NO: 3293858 - protein, 18 aa, Plasmodium falciparum
NTYLLKKIANYFKSILNL

SEQ ID NO: 3293859 - protein, 25 aa, Plasmodium falciparum
NTYNIYIRLYYLYKEFQIFKKTNND

SEQ ID NO: 3293860 - protein, 25 aa, Plasmodium falciparum
NTYVDKKLNKLFNRSLGESQVNGEL

SEQ ID NO: 3293861 - protein, 18 aa, Plasmodium falciparum
NTYYLYILFSNMEKFKEN

SEQ ID NO: 3293862 - protein, 25 aa, Plasmodium falciparum
NVAYEPLVYLLLNSLGFLLYHENIK

SEQ ID NO: 3293863 - protein, 26 aa, Plasmodium falciparum
NVCIKYLRFLYYLKKIKFRKEWNRYY

SEQ ID NO: 3293864 - protein, 19 aa, Plasmodium falciparum
NVCIKYMITYIFQNMYHGK

SEQ ID NO: 3293865 - protein, 24 aa, Plasmodium falciparum
NVCKKFIHLQSVSAALYSSACTAS

SEQ ID NO: 3293866 - protein, 24 aa, Plasmodium falciparum
NVDENTMFLLEKLSYENKIVDSEE

SEQ ID NO: 3293867 - protein, 20 aa, Plasmodium falciparum
NVDIIYLIRFFSLCDYYKYN

SEQ ID NO: 3293868 - protein, 35 aa, Plasmodium falciparum
NVDKYKRYIFLGIHSFLFAFELYFVKGKHQGKEIE

SEQ ID NO: 3293869 - protein, 19 aa, Plasmodium falciparum
NVDLLKEKILFYNEEYCIY

SEQ ID NO: 3293870 - protein, 24 aa, Plasmodium falciparum
NVDMLIYSYYQLMDPLRDYERKLF

SEQ ID NO: 3293871 - protein, 24 aa, Plasmodium falciparum
NVENSVLFIENPIVNVLPSSFVQS

SEQ ID NO: 3293872 - protein, 36 aa, Plasmodium falciparum
NVETVLSSCWFLDRILIHLFLYYYSSCMIDKNSKEK

SEQ ID NO: 3293873 - protein, 18 aa, Plasmodium falciparum
NVFFIDTHRYFFKYFIMD

SEQ ID NO: 3293874 - protein, 41 aa, Plasmodium falciparum
NVFFTSPLLQYLLQFFFLLIFPFSFYFLSSIFKADFGSSTE

SEQ ID NO: 3293875 - protein, 17 aa, Plasmodium falciparum
NVFHGFGSYPLKKDILG

SEQ ID NO: 3293876 - protein, 18 aa, Plasmodium falciparum
NVFRHNIKKLNKSILLVN

SEQ ID NO: 3293877 - protein, 23 aa, Plasmodium falciparum
NVFSDLYFFSFLNLINTLHITQK

SEQ ID NO: 3293878 - protein, 17 aa, Plasmodium falciparum
NVFVANILWEEENNICF

SEQ ID NO: 3293879 - protein, 34 aa, Plasmodium falciparum
NVGKKIKINFIQILIIFLVYVNLDFFKSNINVKA

SEQ ID NO: 3293880 - protein, 29 aa, Plasmodium falciparum
NVGVMIASLFIWYDPKYSIADPICSIIFC

SEQ ID NO: 3293881 - protein, 23 aa, Plasmodium falciparum
NVGWHPFFVFFCGVSGLYVKELQ

SEQ ID NO: 3293882 - protein, 38 aa, Plasmodium falciparum
NVHIFKVLVYDENFLRVLFFNILVVLNYLNRELQICVK

SEQ ID NO: 3293883 - protein, 25 aa, Plasmodium falciparum
NVHLKHLLSIVIFLCYKYEEKGKHE

SEQ ID NO: 3293884 - protein, 22 aa, Plasmodium falciparum
NVHLLLFSIICLFEGGEIENVT

SEQ ID NO: 3293885 - protein, 17 aa, Plasmodium falciparum
NVHNIFIYTYQIFNVEI

SEQ ID NO: 3293886 - protein, 35 aa, Plasmodium falciparum
NVHRFETVLVVFIIMFCILGIIWSMEREHLKELFC

SEQ ID NO: 3293887 - protein, 22 aa, Plasmodium falciparum
NVIFLMLVTIYIILFHPIQNGS

SEQ ID NO: 3293888 - protein, 19 aa, Plasmodium falciparum
NVIILKYMVSLFSNNKDEI

SEQ ID NO: 3293889 - protein, 25 aa, Plasmodium falciparum
NVIKCIHKILYVLILYESRENICKN

SEQ ID NO: 3293890 - protein, 24 aa, Plasmodium falciparum
NVIQSLDMLFLIVRDYELNTSLTN

SEQ ID NO: 3293891 - protein, 23 aa, Plasmodium falciparum
NVIRYFPTQAFNFAFKDYFKNIF

SEQ ID NO: 3293892 - protein, 38 aa, Plasmodium falciparum
NVITYSVIVIILIVLVMLIIYLVLRYRRKKKMNKKQQY

SEQ ID NO: 3293893 - protein, 24 aa, Plasmodium falciparum
NVIVEPVLLNLLFLNNRMTHEIYS

SEQ ID NO: 3293894 - protein, 28 aa, Plasmodium falciparum
NVKCTFYYIYIYFFFMNKNKSGGIRNEQ

SEQ ID NO: 3293895 - protein, 18 aa, Plasmodium falciparum
NVKIFLYDTLWNETRALF

SEQ ID NO: 3293896 - protein, 33 aa, Plasmodium falciparum
NVKIKKFFCDFIYLPYTIKYGYIRSLDLQIPLL

SEQ ID NO: 3293897 - protein, 24 aa, Plasmodium falciparum
NVKINLLLYLLWKCCHIEGKGTDI

SEQ ID NO: 3293898 - protein, 33 aa, Plasmodium falciparum
NVKNFYDNWYIYCAFVNLIYYILNYKENIENVG

SEQ ID NO: 3293899 - protein, 24 aa, Plasmodium falciparum
NVKNYPYIKILTSKYILNVHIPPR

SEQ ID NO: 3293900 - protein, 20 aa, Plasmodium falciparum
NVKVPTFLTALGGIILLVTL

SEQ ID NO: 3293901 - protein, 27 aa, Plasmodium falciparum
NVKYNKYRLYLLLNIVTHERMLQALRS

SEQ ID NO: 3293902 - protein, 44 aa, Plasmodium falciparum
NVLEHPAVIPALMSSTIMWSIGIGFAAFTYFYLKKKTKSTIDLL

SEQ ID NO: 3293903 - protein, 42 aa, Plasmodium falciparum
NVLIQFNYVHIFIFLSSLYIILPNYIPNYYLILDDFSSYKND

SEQ ID NO: 3293904 - protein, 17 aa, Plasmodium falciparum
NVLLFYIGGISYAEIAS

SEQ ID NO: 3293905 - protein, 26 aa, Plasmodium falciparum
NVLLLNYEYILYNINLKYIYNAYVYL

SEQ ID NO: 3293906 - protein, 26 aa, Plasmodium falciparum
NVLLNQYIFDYIFKNYCYKKKYWKVR

SEQ ID NO: 3293907 - protein, 18 aa, Plasmodium falciparum
NVLLYNEKISRCPIWIPL

SEQ ID NO: 3293908 - protein, 20 aa, Plasmodium falciparum
NVLMLFYIIATFHKIPSEGA

SEQ ID NO: 3293909 - protein, 24 aa, Plasmodium falciparum
NVLSKILFVYCFFEINNKKMNEML

SEQ ID NO: 3293910 - protein, 29 aa, Plasmodium falciparum
NVLYSNDFLNIIDPILFENYDNINLDEYI

SEQ ID NO: 3293911 - protein, 22 aa, Plasmodium falciparum
NVMDIFTYAISSLLYKMVNEEQ

SEQ ID NO: 3293912 - protein, 25 aa, Plasmodium falciparum
NVMKEILLKIYYKYNEDDYRKHYLR

SEQ ID NO: 3293913 - protein, 57 aa, Plasmodium falciparum
NVMSINKIILFLLNKFIIIPQKILSLIFFKLLIVYNPYYFIQVRKALRIFNCILNSL

SEQ ID NO: 3293914 - protein, 23 aa, Plasmodium falciparum
NVNCLTFLLFGITSSFIAQIVSY

SEQ ID NO: 3293915 - protein, 38 aa, Plasmodium falciparum
NVNKQKTFYDFFYYWVAHMLKDSIHWRTRRLRKCINDG

SEQ ID NO: 3293916 - protein, 28 aa, Plasmodium falciparum
NVNLLSLYSCVIYSLFFLWNKNDNMDTN

SEQ ID NO: 3293917 - protein, 26 aa, Plasmodium falciparum
NVNNFLLLLKILSPSFFIWTATNTKF

SEQ ID NO: 3293918 - protein, 24 aa, Plasmodium falciparum
NVNRLLLDFFYDKISKASIQTLII

SEQ ID NO: 3293919 - protein, 24 aa, Plasmodium falciparum
NVNSKYFICCCIVLVLITEVACIL

SEQ ID NO: 3293920 - protein, 29 aa, Plasmodium falciparum
NVNYVLKIFKYTFSFFSFQKNLYLKRDNR

SEQ ID NO: 3293921 - protein, 26 aa, Plasmodium falciparum
NVPRFNIKFLKLFNSFYEFSTKKYNN

SEQ ID NO: 3293922 - protein, 25 aa, Plasmodium falciparum
NVQEKLFWRFREMGNIPLTTSAFTF

SEQ ID NO: 3293923 - protein, 27 aa, Plasmodium falciparum
NVQIIKQYLIYPQIIHFNYILLNKEFE

SEQ ID NO: 3293924 - protein, 28 aa, Plasmodium falciparum
NVQKRNCFVLKYYWSIFGIKEGYTENNR

SEQ ID NO: 3293925 - protein, 24 aa, Plasmodium falciparum
NVQNLILVFFMWKYHKIYSKSVQI

SEQ ID NO: 3293926 - protein, 29 aa, Plasmodium falciparum
NVRINFEFLFKNIYFKDELKYVLNYFVEP

SEQ ID NO: 3293927 - protein, 17 aa, Plasmodium falciparum
NVRISIVIVYYILYMDN

SEQ ID NO: 3293928 - protein, 23 aa, Plasmodium falciparum
NVRKGMILFIAPSVMVTISNLYA

SEQ ID NO: 3293929 - protein, 24 aa, Plasmodium falciparum
NVSHISLFIRYDIVHYTNLDKSMS

SEQ ID NO: 3293930 - protein, 29 aa, Plasmodium falciparum
NVSIINKFFLAILLYENKFYKKSLKLINK

SEQ ID NO: 3293931 - protein, 28 aa, Plasmodium falciparum
NVSILLCKFLLSLTFFFSVPLNFMGSYQ

SEQ ID NO: 3293932 - protein, 33 aa, Plasmodium falciparum
NVSIVPTYFDYVPQYLRWFEEWAEDFCRKKKKK

SEQ ID NO: 3293933 - protein, 19 aa, Plasmodium falciparum
NVSIYKSFYNIFVKYVLRC

SEQ ID NO: 3293934 - protein, 40 aa, Plasmodium falciparum
NVSKAIWFSSIFTSIFYFIFGLIFCLNNSFQKINTSILYI

SEQ ID NO: 3293935 - protein, 27 aa, Plasmodium falciparum
NVSKKLNFIFSLLEEILKIMLSVGLRV

SEQ ID NO: 3293936 - protein, 29 aa, Plasmodium falciparum
NVSKYKLNFFQFLKNMYLSKAPKGFERFE

SEQ ID NO: 3293937 - protein, 17 aa, Plasmodium falciparum
NVSLFLFSINYFHTIHK

SEQ ID NO: 3293938 - protein, 29 aa, Plasmodium falciparum
NVSQTNFKSLLRNLGVSENIFLKENKLNK

SEQ ID NO: 3293939 - protein, 31 aa, Plasmodium falciparum
NVTIDKHLMIKIFFFFCKKNFLLSSFFHSEE

SEQ ID NO: 3293940 - protein, 26 aa, Plasmodium falciparum
NVTIKNFWKFYLYAHTLIDINNSKII

SEQ ID NO: 3293941 - protein, 19 aa, Plasmodium falciparum
NVTMCRAIKYSFADLGDII

SEQ ID NO: 3293942 - protein, 31 aa, Plasmodium falciparum
NVTYLFKSPLFLIFLFFLILLSVLPKMQKIS

SEQ ID NO: 3293943 - protein, 25 aa, Plasmodium falciparum
NVTYYMLFYLFYIILEETNKMNNEI

SEQ ID NO: 3293944 - protein, 25 aa, Plasmodium falciparum
NVVFLSFFENFYFFNTFTNNGQASS

SEQ ID NO: 3293945 - protein, 26 aa, Plasmodium falciparum
NVVICLCRIFFKYVDNILLCKKNMLK

SEQ ID NO: 3293946 - protein, 20 aa, Plasmodium falciparum
NVVIPYKYKNSFFYNFITLN

SEQ ID NO: 3293947 - protein, 22 aa, Plasmodium falciparum
NVVKIFIRLFDNNTYQQIGVQQ

SEQ ID NO: 3293948 - protein, 24 aa, Plasmodium falciparum
NVVLIILTFFILLTKEEKNIKNNI

SEQ ID NO: 3293949 - protein, 25 aa, Plasmodium falciparum
NVVVIEPYIRTLLPCEFSMRRNKVV

SEQ ID NO: 3293950 - protein, 25 aa, Plasmodium falciparum
NVVVNFYFLLNRLINRTHNILWCYK

SEQ ID NO: 3293951 - protein, 21 aa, Plasmodium falciparum
NVVYRYSLLELIELDFYVYYK

SEQ ID NO: 3293952 - protein, 27 aa, Plasmodium falciparum
NVWSNFLYIIILKLFNKEIKNYVDFMI

SEQ ID NO: 3293953 - protein, 26 aa, Plasmodium falciparum
NVYGIFSLILLPTRELVFQIIEQFHL

SEQ ID NO: 3293954 - protein, 29 aa, Plasmodium falciparum
NVYILRSICIYIIESQCFKFFHLNNYILE

SEQ ID NO: 3293955 - protein, 24 aa, Plasmodium falciparum
NVYLQFIAYIIFSIYDYNSLAKKY

SEQ ID NO: 3293956 - protein, 34 aa, Plasmodium falciparum
NVYNIFQLYMKYILNEFSKFFKLFKFLNKNVENI

SEQ ID NO: 3293957 - protein, 25 aa, Plasmodium falciparum
NVYNKPLHFFNYFNNSNINTDDNNN

SEQ ID NO: 3293958 - protein, 26 aa, Plasmodium falciparum
NWIVQYSCSFLKRYDSIQLPIIDKDI

SEQ ID NO: 3293959 - protein, 23 aa, Plasmodium falciparum
NWNKYDNLFKRIPLERNYEGFIL

SEQ ID NO: 3293960 - protein, 23 aa, Plasmodium falciparum
NWNLKQLFVYVLVTYETPKKIKN

SEQ ID NO: 3293961 - protein, 18 aa, Plasmodium falciparum
NWVFLGCLVPWMTAQERE

SEQ ID NO: 3293962 - protein, 18 aa, Plasmodium falciparum
NWYNKRLIYFIRKKIEIY

SEQ ID NO: 3293963 - protein, 20 aa, Plasmodium falciparum
NYAVQIPSLLRQMKILLKVI

SEQ ID NO: 3293964 - protein, 26 aa, Plasmodium falciparum
NYDDNIQYLFRNNLQKMLYAKNINNS

SEQ ID NO: 3293965 - protein, 28 aa, Plasmodium falciparum
NYDDNYFMPLYIFYMKKINYKELIKNYF

SEQ ID NO: 3293966 - protein, 29 aa, Plasmodium falciparum
NYDEQKKLFFFNYVNYINTLYYCNHNDHN

SEQ ID NO: 3293967 - protein, 19 aa, Plasmodium falciparum
NYDIFLPISKEEKKKKGFF

SEQ ID NO: 3293968 - protein, 22 aa, Plasmodium falciparum
NYDKNFYLTLTKKYGSINLFLD

SEQ ID NO: 3293969 - protein, 43 aa, Plasmodium falciparum
NYDLLHIEKKWILYLIYKTILKYYDMLIFKKKVQKLMLLMCEI

SEQ ID NO: 3293970 - protein, 35 aa, Plasmodium falciparum
NYDQWKLWFQHIQKCLTILCTFFRHIHKFSDVPDD

SEQ ID NO: 3293971 - protein, 29 aa, Plasmodium falciparum
NYDYYIQNLIIPPLKRMLDLLPFCSLNLD

SEQ ID NO: 3293972 - protein, 21 aa, Plasmodium falciparum
NYEDYYKYIKEFVNYIPITIK

SEQ ID NO: 3293973 - protein, 28 aa, Plasmodium falciparum
NYEINFNMFFWVLYDNYINIYKKYSVHA

SEQ ID NO: 3293974 - protein, 29 aa, Plasmodium falciparum
NYEIRLLNKFLFKSFLMFSLFPNFNENIC

SEQ ID NO: 3293975 - protein, 18 aa, Plasmodium falciparum
NYEKNIIMPFFSGYNKFH

SEQ ID NO: 3293976 - protein, 28 aa, Plasmodium falciparum
NYENIYYFQIILIYTSLLLYNTHMKSLV

SEQ ID NO: 3293977 - protein, 30 aa, Plasmodium falciparum
NYENKESILFIFLIEFCLFIYSNFNIKICL

SEQ ID NO: 3293978 - protein, 24 aa, Plasmodium falciparum
NYEQSLYKRFLRLDLPSIYLNEQG

SEQ ID NO: 3293979 - protein, 35 aa, Plasmodium falciparum
NYEVKNIMIFFICCIFYLNELYIKYNNSLVTNIKP

SEQ ID NO: 3293980 - protein, 17 aa, Plasmodium falciparum
NYFCSDKIMYMIRNNSN

SEQ ID NO: 3293981 - protein, 24 aa, Plasmodium falciparum
NYFDFPFFHIILLNMNKFIIPIIS

SEQ ID NO: 3293982 - protein, 26 aa, Plasmodium falciparum
NYFELTIDRKAWIIGDKILSKYFKGS

SEQ ID NO: 3293983 - protein, 17 aa, Plasmodium falciparum
NYFILNKCLIEKYNNNN

SEQ ID NO: 3293984 - protein, 17 aa, Plasmodium falciparum
NYFINYEILYNNSLFKL

SEQ ID NO: 3293985 - protein, 18 aa, Plasmodium falciparum
NYFKLREDWWTANRDQVW

SEQ ID NO: 3293986 - protein, 20 aa, Plasmodium falciparum
NYFMYSCIFYKNKIIYVDML

SEQ ID NO: 3293987 - protein, 19 aa, Plasmodium falciparum
NYFQLREDWWTANRATVWK

SEQ ID NO: 3293988 - protein, 18 aa, Plasmodium falciparum
NYFVFIKNAIFKKCKIIK

SEQ ID NO: 3293989 - protein, 39 aa, Plasmodium falciparum
NYGFVMKDFLIFHVKLLKNLLIKGLKLGYWKSIDYDYIE

SEQ ID NO: 3293990 - protein, 42 aa, Plasmodium falciparum
NYGKYSFIFKGLYEQFLRLPNIWFLLISLLEFIPQYQNLSNY

SEQ ID NO: 3293991 - protein, 23 aa, Plasmodium falciparum
NYGSFYMIFGARNTDYPWACSCD

SEQ ID NO: 3293992 - protein, 19 aa, Plasmodium falciparum
NYHFKYFLSILLCVIKSII

SEQ ID NO: 3293993 - protein, 18 aa, Plasmodium falciparum
NYHIIIKISTWLSKNSAS

SEQ ID NO: 3293994 - protein, 19 aa, Plasmodium falciparum
NYHIINIKKFLYYSKLYFN

SEQ ID NO: 3293995 - protein, 19 aa, Plasmodium falciparum
NYHIKVRRNLLKLLYSIYY

SEQ ID NO: 3293996 - protein, 27 aa, Plasmodium falciparum
NYHKESLEWFYKTLSDIYFILNEFELS

SEQ ID NO: 3293997 - protein, 24 aa, Plasmodium falciparum
NYHLSYEYVFISQLFNIYDNFHIC

SEQ ID NO: 3293998 - protein, 31 aa, Plasmodium falciparum
NYIELIHCHLFMLRLLYKCYMNKLKNKYVYE

SEQ ID NO: 3293999 - protein, 19 aa, Plasmodium falciparum
NYIFFNINLMLCECKSKSD

SEQ ID NO: 3294000 - protein, 39 aa, Plasmodium falciparum
NYIHNTLYNFRYISSIYLKELLKFCLSFITNILYSKHLT

SEQ ID NO: 3294001 - protein, 22 aa, Plasmodium falciparum
NYIICITTCTILFLIIITFYMF

SEQ ID NO: 3294002 - protein, 21 aa, Plasmodium falciparum
NYIILYLHYYMEKSKLHPFHK

SEQ ID NO: 3294003 - protein, 20 aa, Plasmodium falciparum
NYIKNLYLFDQLSNNTYIFS

SEQ ID NO: 3294004 - protein, 19 aa, Plasmodium falciparum
NYIKYFDVLRIKHALEYYK

SEQ ID NO: 3294005 - protein, 26 aa, Plasmodium falciparum
NYILSFPLIPLFYPHHKPPLFLKNEQ

SEQ ID NO: 3294006 - protein, 18 aa, Plasmodium falciparum
NYILYHIILINDKDMRNI

SEQ ID NO: 3294007 - protein, 19 aa, Plasmodium falciparum
NYIMFFQTTQNKYLLNRRL

SEQ ID NO: 3294008 - protein, 23 aa, Plasmodium falciparum
NYINKLSLIILAGNRNFYLCHLP

SEQ ID NO: 3294009 - protein, 24 aa, Plasmodium falciparum
NYINNMCLFLIYKIIIMNEDDAEY

SEQ ID NO: 3294010 - protein, 30 aa, Plasmodium falciparum
NYINPYIKNSLWLYIITLYVKNSYSLNKNQ

SEQ ID NO: 3294011 - protein, 28 aa, Plasmodium falciparum
NYIQNKLLFIYELLSLWINTQDIWLRLE

SEQ ID NO: 3294012 - protein, 39 aa, Plasmodium falciparum
NYISVKIIKYILRFPHKFGLCLYGYILGFIYEHIYEDPT

SEQ ID NO: 3294013 - protein, 26 aa, Plasmodium falciparum
NYIYKYMPILYVPQFNWISLGTIRSM

SEQ ID NO: 3294014 - protein, 20 aa, Plasmodium falciparum
NYIYLLIIKCRSRKVFDTLM

SEQ ID NO: 3294015 - protein, 30 aa, Plasmodium falciparum
NYIYNFFSFFHYLFEFIYNTNLLVIIGSNG

SEQ ID NO: 3294016 - protein, 28 aa, Plasmodium falciparum
NYKCIYIVLFYFTIKLIIILGNNKNSNL

SEQ ID NO: 3294017 - protein, 21 aa, Plasmodium falciparum
NYKHIIFRLKCEVQIKNSYLE

SEQ ID NO: 3294018 - protein, 29 aa, Plasmodium falciparum
NYKKLKLISWNLIQTILWGILVSGENVQM

SEQ ID NO: 3294019 - protein, 23 aa, Plasmodium falciparum
NYKKRKLLVGLNPNFNYIQNVML

SEQ ID NO: 3294020 - protein, 19 aa, Plasmodium falciparum
NYKKSFFRRFFYHQPKEIN

SEQ ID NO: 3294021 - protein, 33 aa, Plasmodium falciparum
NYKKTYRYIISFLLYFINILYAQKIWGNGKKQI

SEQ ID NO: 3294022 - protein, 18 aa, Plasmodium falciparum
NYKNLYHMLAYNSKNRYN

SEQ ID NO: 3294023 - protein, 21 aa, Plasmodium falciparum
NYKRLCRYLNYKLDDIKDVFM

SEQ ID NO: 3294024 - protein, 25 aa, Plasmodium falciparum
NYKYRSYLINLWISIIKNNYIIIKD

SEQ ID NO: 3294025 - protein, 17 aa, Plasmodium falciparum
NYLIAHKFINTGDLFSL

SEQ ID NO: 3294026 - protein, 24 aa, Plasmodium falciparum
NYLKGKFLRGYLMKEVIIKNDSEE

SEQ ID NO: 3294027 - protein, 24 aa, Plasmodium falciparum
NYLKKFLSFVPFIYNILNERLSII

SEQ ID NO: 3294028 - protein, 20 aa, Plasmodium falciparum
NYLLEKIGISNFNFLLNVCD

SEQ ID NO: 3294029 - protein, 25 aa, Plasmodium falciparum
NYLLIFIIIILLLFINILGTSSVLL

SEQ ID NO: 3294030 - protein, 26 aa, Plasmodium falciparum
NYLNYLFNFIINYADYHLPLILCILN

SEQ ID NO: 3294031 - protein, 32 aa, Plasmodium falciparum
NYLSLKMALNIWPMFLKITLQGLLTSRHLSSE

SEQ ID NO: 3294032 - protein, 24 aa, Plasmodium falciparum
NYLTCIAYVKMIYIIIVCIARVHT

SEQ ID NO: 3294033 - protein, 33 aa, Plasmodium falciparum
NYLTNSVGIIWGIYRWLWKSNGKFICPLRLPLC

SEQ ID NO: 3294034 - protein, 18 aa, Plasmodium falciparum
NYLVIYNPFNITIQMKLK

SEQ ID NO: 3294035 - protein, 28 aa, Plasmodium falciparum
NYLVLSMRLYFLFFSYNDILNILNEGSK

SEQ ID NO: 3294036 - protein, 25 aa, Plasmodium falciparum
NYLVQIIQKIRLLIVFPNNHIVILT

SEQ ID NO: 3294037 - protein, 17 aa, Plasmodium falciparum
NYLYPFFLENKKFIEHI

SEQ ID NO: 3294038 - protein, 20 aa, Plasmodium falciparum
NYMLEIQRSLLKKYWQDVEI

SEQ ID NO: 3294039 - protein, 24 aa, Plasmodium falciparum
NYMPIKKYFYLNNGIISFLTEAYI

SEQ ID NO: 3294040 - protein, 20 aa, Plasmodium falciparum
NYMRIIIYILNEKCLVIKKN

SEQ ID NO: 3294041 - protein, 20 aa, Plasmodium falciparum
NYNALILSFSLYSSSYATML

SEQ ID NO: 3294042 - protein, 34 aa, Plasmodium falciparum
NYNEMYDVFFNSLKWKYFFYFKKNVNSENFYDNE

SEQ ID NO: 3294043 - protein, 19 aa, Plasmodium falciparum
NYNEWKQEKWFKNLKKEWK

SEQ ID NO: 3294044 - protein, 52 aa, Plasmodium falciparum
NYNFIESTFYMLCKCLLLFNKNILFRTIFDILFLFFINKIRVEVLIHFLSMI

SEQ ID NO: 3294045 - protein, 17 aa, Plasmodium falciparum
NYNFLCNILFNKRNKII

SEQ ID NO: 3294046 - protein, 29 aa, Plasmodium falciparum
NYNFNFQFTPIFYYLIDNLQIVKDHKISC

SEQ ID NO: 3294047 - protein, 18 aa, Plasmodium falciparum
NYNIDILRTLFPFFKEFI

SEQ ID NO: 3294048 - protein, 19 aa, Plasmodium falciparum
NYNIIICFTLLLLVHIIIC

SEQ ID NO: 3294049 - protein, 39 aa, Plasmodium falciparum
NYNIIPFITLFPTLFSFFGIYILPFLYKSMLILFCSNTT

SEQ ID NO: 3294050 - protein, 22 aa, Plasmodium falciparum
NYNILNFILSYYLKKKIFNDVH

SEQ ID NO: 3294051 - protein, 25 aa, Plasmodium falciparum
NYNILQHLDYFLHKLKGLSTIKYIN

SEQ ID NO: 3294052 - protein, 25 aa, Plasmodium falciparum
NYNITYLQYITIYNFLKLFKNEINE

SEQ ID NO: 3294053 - protein, 36 aa, Plasmodium falciparum
NYNKHNVILFKGKYTRQLICDYLKFLLNSIQNEHTI

SEQ ID NO: 3294054 - protein, 30 aa, Plasmodium falciparum
NYNKKYLLNSFFYLLNYYKQIIKLEQFTHN

SEQ ID NO: 3294055 - protein, 25 aa, Plasmodium falciparum
NYNLKNLVYYLYIDKIVKSYDFNLY

SEQ ID NO: 3294056 - protein, 28 aa, Plasmodium falciparum
NYNNCNFIILIYWPQSLNTFLKILFQKR

SEQ ID NO: 3294057 - protein, 18 aa, Plasmodium falciparum
NYNRSYFKVPYYNMKYYL

SEQ ID NO: 3294058 - protein, 23 aa, Plasmodium falciparum
NYNSLFILFQLVNTEFPPLLMKY

SEQ ID NO: 3294059 - protein, 25 aa, Plasmodium falciparum
NYNSSIFSYIFLNKNMFSFLCSIAC

SEQ ID NO: 3294060 - protein, 18 aa, Plasmodium falciparum
NYNWFFYSTKKIINNNKE

SEQ ID NO: 3294061 - protein, 20 aa, Plasmodium falciparum
NYPHIILRNLLHGHMNFSFA

SEQ ID NO: 3294062 - protein, 19 aa, Plasmodium falciparum
NYPLVIYFILKIFNYNYIN

SEQ ID NO: 3294063 - protein, 27 aa, Plasmodium falciparum
NYQEEAPFDFFIKKYPSMSKKNNIKRN

SEQ ID NO: 3294064 - protein, 24 aa, Plasmodium falciparum
NYRSRLCKMLVLSAPLVVTGIWHM

SEQ ID NO: 3294065 - protein, 20 aa, Plasmodium falciparum
NYRTQHFILFIGATNRYKQL

SEQ ID NO: 3294066 - protein, 30 aa, Plasmodium falciparum
NYSCLCIYKFIIIYSSLYYLSNIDNLSFPI

SEQ ID NO: 3294067 - protein, 31 aa, Plasmodium falciparum
NYSICNMIDYFYFYHYSYKNNSSYFQQFMQE

SEQ ID NO: 3294068 - protein, 30 aa, Plasmodium falciparum
NYSIDVLYKLLFQYPQIFYIFHVLASLKHT

SEQ ID NO: 3294069 - protein, 21 aa, Plasmodium falciparum
NYSIYGNLIVKLLYKEIKNDF

SEQ ID NO: 3294070 - protein, 31 aa, Plasmodium falciparum
NYSLVHPYNYNYFYYIFHLNSSFYCADTNSI

SEQ ID NO: 3294071 - protein, 29 aa, Plasmodium falciparum
NYSSEFVKIPLYTPPFLSSSSVSSSCVSS

SEQ ID NO: 3294072 - protein, 26 aa, Plasmodium falciparum
NYTANSIQIIWLWDVLQEFDENKKAS

SEQ ID NO: 3294073 - protein, 21 aa, Plasmodium falciparum
NYTFLFSTPFSFFSDNYNDLN

SEQ ID NO: 3294074 - protein, 18 aa, Plasmodium falciparum
NYTFNECFKIPIATPILD

SEQ ID NO: 3294075 - protein, 44 aa, Plasmodium falciparum
NYTIFKWSITIWASLYVQLIVLALTFFYIIYPHFFFKHAKQDHE

SEQ ID NO: 3294076 - protein, 28 aa, Plasmodium falciparum
NYTIIYNCFLFLLEIIKLSIHTGVQKFA

SEQ ID NO: 3294077 - protein, 24 aa, Plasmodium falciparum
NYTSSIIYLITYFLDMVEYTISMK

SEQ ID NO: 3294078 - protein, 23 aa, Plasmodium falciparum
NYVDELIYELRKFSLDKSEKKLN

SEQ ID NO: 3294079 - protein, 29 aa, Plasmodium falciparum
NYVDIFPVHIIYKIKKIWCNKCWNKKKIY

SEQ ID NO: 3294080 - protein, 21 aa, Plasmodium falciparum
NYVDIYKLWSSKMIYSCLYNK

SEQ ID NO: 3294081 - protein, 25 aa, Plasmodium falciparum
NYVDLKYDILLKTSSKLFTLHTLGL

SEQ ID NO: 3294082 - protein, 19 aa, Plasmodium falciparum
NYVILLKITLFKYKKKKKK

SEQ ID NO: 3294083 - protein, 34 aa, Plasmodium falciparum
NYVLPNIITQKVLPPVILPLNKQMTNLFYELRYR

SEQ ID NO: 3294084 - protein, 23 aa, Plasmodium falciparum
NYVMEFLVLSFLDTYHPNICPKL

SEQ ID NO: 3294085 - protein, 25 aa, Plasmodium falciparum
NYVNTCLNLLYIIDLYMEFKSNIFN

SEQ ID NO: 3294086 - protein, 18 aa, Plasmodium falciparum
NYVTVLPNKYFLTFFLSS

SEQ ID NO: 3294087 - protein, 21 aa, Plasmodium falciparum
NYVYYFYILQISYWFSCLFYL

SEQ ID NO: 3294088 - protein, 37 aa, Plasmodium falciparum
NYYDNLFYYLFHSIENLLFILLFYNNNNIINEDLFSN

SEQ ID NO: 3294089 - protein, 23 aa, Plasmodium falciparum
NYYDNMFFTYLKKKYYKRCMSTT

SEQ ID NO: 3294090 - protein, 25 aa, Plasmodium falciparum
NYYELREDWWALNRDQVWKAITCKA

SEQ ID NO: 3294091 - protein, 26 aa, Plasmodium falciparum
NYYELREDWWALNRDQVWKAITCNAG

SEQ ID NO: 3294092 - protein, 19 aa, Plasmodium falciparum
NYYFSLSPVKYHVRKYREY

SEQ ID NO: 3294093 - protein, 29 aa, Plasmodium falciparum
NYYIQNYEFFFFFPDYYEYSHLYIRLDKL

SEQ ID NO: 3294094 - protein, 25 aa, Plasmodium falciparum
NYYLLECFFFKTKKILFLQKNQMFS

SEQ ID NO: 3294095 - protein, 17 aa, Plasmodium falciparum
NYYLLTYKKNNFNSFVY

SEQ ID NO: 3294096 - protein, 21 aa, Plasmodium falciparum
NYYNMLLNVWPEQVKNIVRKH

SEQ ID NO: 3294097 - protein, 18 aa, Plasmodium falciparum
NYYPLPYDIRNSANRTNL

SEQ ID NO: 3294098 - protein, 29 aa, Plasmodium falciparum
NYYQLREDWWDANRAKVWYAITCGAGTSD

SEQ ID NO: 3294099 - protein, 18 aa, Plasmodium falciparum
NYYQLREDWWKVNRDQVW

SEQ ID NO: 3294100 - protein, 29 aa, Plasmodium falciparum
NYYQLREDWWNINRKKVWDAITCGAAGGT

SEQ ID NO: 3294101 - protein, 19 aa, Plasmodium falciparum
NYYYVYLYFHLFQATINYA

SEQ ID NO: 3294102 - protein, 20 aa, Plasmodium falciparum
NYYYYYDDDILYFKDLENNI

SEQ ID NO: 3294103 - protein, 26 aa, Plasmodium falciparum
PAAPPSPPIPPLATSTLAWSVGIGFA

SEQ ID NO: 3294104 - protein, 34 aa, Plasmodium falciparum
PAEFQKTFNDFFYFWIRRFLNDSMYWRGKVERCL

SEQ ID NO: 3294105 - protein, 34 aa, Plasmodium falciparum
PAEFQKTYNDFFYFWIRRFLNDSMYWRGKIGGCL

SEQ ID NO: 3294106 - protein, 24 aa, Plasmodium falciparum
PAETNITIFWLFVQNGYREKRKKK

SEQ ID NO: 3294107 - protein, 18 aa, Plasmodium falciparum
PAIDLFECNKLVFELSAS

SEQ ID NO: 3294108 - protein, 36 aa, Plasmodium falciparum
PAIKIYYIFLEHFGFLYFIYDVIYAYSMYITAVGSY

SEQ ID NO: 3294109 - protein, 43 aa, Plasmodium falciparum
PAMAAFYPWGIAALVLLILVVVLIILYIWLYRRRKNSWKHECK

SEQ ID NO: 3294110 - protein, 33 aa, Plasmodium falciparum
PAMAAFYPYGIAALVLLILAVVLIILYIWLYRR

SEQ ID NO: 3294111 - protein, 25 aa, Plasmodium falciparum
PAPKKEKVPVPKKEKVPAPKKEKVP

SEQ ID NO: 3294112 - protein, 24 aa, Plasmodium falciparum
PAQHRKLLFISFVCAVLSGGTLPF

SEQ ID NO: 3294113 - protein, 19 aa, Plasmodium falciparum
PAREPFDPTILQTTIPFGV

SEQ ID NO: 3294114 - protein, 18 aa, Plasmodium falciparum
PATSITWFAYEYAMRKLQ

SEQ ID NO: 3294115 - protein, 17 aa, Plasmodium falciparum
PAYILNKLTIKAKHFQH

SEQ ID NO: 3294116 - protein, 28 aa, Plasmodium falciparum
PCEFERRQRIIPLKITNIESTNFRSHYD

SEQ ID NO: 3294117 - protein, 37 aa, Plasmodium falciparum
PCGIAALVLLILAVVLIILYIWLYRRRKNSWKHECKK

SEQ ID NO: 3294118 - protein, 17 aa, Plasmodium falciparum
PCGIAALVLLILTVVLI

SEQ ID NO: 3294119 - protein, 37 aa, Plasmodium falciparum
PCGITALVLLILAVLLIILYIWLYRRRKRSWKHECKK

SEQ ID NO: 3294120 - protein, 25 aa, Plasmodium falciparum
PCNSDIWWIYSFSDIIHIEKIGLVS

SEQ ID NO: 3294121 - protein, 26 aa, Plasmodium falciparum
PDDFKRQMFYTFGDYRDFLFGTDISK

SEQ ID NO: 3294122 - protein, 25 aa, Plasmodium falciparum
PDDFKRQMFYTYGDYRDFLFGTDIS

SEQ ID NO: 3294123 - protein, 25 aa, Plasmodium falciparum
PDDFLHQMFYTFGDYKDILFGKDMG

SEQ ID NO: 3294124 - protein, 26 aa, Plasmodium falciparum
PDDIELLSFFIRKKLVRHNDMYFCSF

SEQ ID NO: 3294125 - protein, 33 aa, Plasmodium falciparum
PDEIQKTFYDFFYYWVAHMLKDSIYWRTKKLDK

SEQ ID NO: 3294126 - protein, 22 aa, Plasmodium falciparum
PDGFFRFIWINTRNGFKSFLWK

SEQ ID NO: 3294127 - protein, 20 aa, Plasmodium falciparum
PDIKKIIKLIINSNIKKLIN

SEQ ID NO: 3294128 - protein, 25 aa, Plasmodium falciparum
PDINILKRAICIMCPYLSFDIYVSK

SEQ ID NO: 3294129 - protein, 33 aa, Plasmodium falciparum
PDIYSFVWLNLFISFLVFFLFNIKNVFFNDINN

SEQ ID NO: 3294130 - protein, 23 aa, Plasmodium falciparum
PDLRSHFITLLVSRKQLIYIEYI

SEQ ID NO: 3294131 - protein, 19 aa, Plasmodium falciparum
PDRLFKICNLLLKMNWMIS

SEQ ID NO: 3294132 - protein, 29 aa, Plasmodium falciparum
PDVSPGLWFFIHFIMNLIVLCVSLSSLSE

SEQ ID NO: 3294133 - protein, 30 aa, Plasmodium falciparum
PDYVKIHLNPWYILMLQMSKPNPADRPSAA

SEQ ID NO: 3294134 - protein, 25 aa, Plasmodium falciparum
PDYYKLREDWWIANRDQVWKAITCN

SEQ ID NO: 3294135 - protein, 25 aa, Plasmodium falciparum
PEDFKRQMFYTLGDYRDILFGKDIS

SEQ ID NO: 3294136 - protein, 18 aa, Plasmodium falciparum
PEDLFRNFFGLNFATCNN

SEQ ID NO: 3294137 - protein, 24 aa, Plasmodium falciparum
PEEEAPLPPPPPAAPPRESKEKAK

SEQ ID NO: 3294138 - protein, 24 aa, Plasmodium falciparum
PEEFKRQMFYTLGDYRDILVRGGN

SEQ ID NO: 3294139 - protein, 27 aa, Plasmodium falciparum
PEFYHLRDMLFIFKSYMCPYIEKLPQV

SEQ ID NO: 3294140 - protein, 24 aa, Plasmodium falciparum
PEIAYTLVINNFLNDLLKLIENLC

SEQ ID NO: 3294141 - protein, 19 aa, Plasmodium falciparum
PEICYFPNNYFYNGLIKNA

SEQ ID NO: 3294142 - protein, 23 aa, Plasmodium falciparum
PEIIDGIFICKNHRLIYNMKEIF

SEQ ID NO: 3294143 - protein, 27 aa, Plasmodium falciparum
PEIILKNVPFPEKFFELADLPLEIIYS

SEQ ID NO: 3294144 - protein, 33 aa, Plasmodium falciparum
PELGYVQGMSYIALVFLLYSNLEKAFVHFANFM

SEQ ID NO: 3294145 - protein, 19 aa, Plasmodium falciparum
PENIFFPTRDFYSFLKLFE

SEQ ID NO: 3294146 - protein, 25 aa, Plasmodium falciparum
PENPLYQYYYIYLSKGNTFFDQYID

SEQ ID NO: 3294147 - protein, 23 aa, Plasmodium falciparum
PEPKVLPKPPKLPKRQPKERDFP

SEQ ID NO: 3294148 - protein, 17 aa, Plasmodium falciparum
PEPVLINYWRNNGARYW

SEQ ID NO: 3294149 - protein, 32 aa, Plasmodium falciparum
PEQFQKTFHDFFYFWIGRFLNDSMYWRGKVNS

SEQ ID NO: 3294150 - protein, 32 aa, Plasmodium falciparum
PEQFQKTFHDLFYYWVAHMLKDSIYWETQKLD

SEQ ID NO: 3294151 - protein, 31 aa, Plasmodium falciparum
PEQFQKTFYDFFTYWVAHMLKDSIHWRTEKL

SEQ ID NO: 3294152 - protein, 25 aa, Plasmodium falciparum
PETKKEKVPVPKKEKVPAPKKEKVP

SEQ ID NO: 3294153 - protein, 19 aa, Plasmodium falciparum
PEYVIYLGCTSPKKLLDRM

SEQ ID NO: 3294154 - protein, 18 aa, Plasmodium falciparum
PFDCIQYFLWESLKEKGK

SEQ ID NO: 3294155 - protein, 20 aa, Plasmodium falciparum
PFDIAIIDSIGWTLQYVSMS

SEQ ID NO: 3294156 - protein, 40 aa, Plasmodium falciparum
PFDPTILQTTIPFGIALALGSIAFLFLKKKTKSTIDLLRV

SEQ ID NO: 3294157 - protein, 41 aa, Plasmodium falciparum
PFDPTILQTTIPFGIALALGSIAFLFLKKKTKSTIDLLRVI

SEQ ID NO: 3294158 - protein, 19 aa, Plasmodium falciparum
PFEFIIFSTIKIYCNLRLY

SEQ ID NO: 3294159 - protein, 27 aa, Plasmodium falciparum
PFEKFLFIFILVVWLAFQTNKRPSYIT

SEQ ID NO: 3294160 - protein, 19 aa, Plasmodium falciparum
PFFFNFIMYFFIDTMIQRK

SEQ ID NO: 3294161 - protein, 17 aa, Plasmodium falciparum
PFHLYYPYVTLESDKKI

SEQ ID NO: 3294162 - protein, 24 aa, Plasmodium falciparum
PFIEDLILLIYENIRFLYIQLLQK

SEQ ID NO: 3294163 - protein, 19 aa, Plasmodium falciparum
PFIFISFCSLFRNSSRTFM

SEQ ID NO: 3294164 - protein, 20 aa, Plasmodium falciparum
PFIVDFLLLNKNHHAQYMHT

SEQ ID NO: 3294165 - protein, 20 aa, Plasmodium falciparum
PFKPIFPFTLLTRTGLQSKN

SEQ ID NO: 3294166 - protein, 36 aa, Plasmodium falciparum
PFKTFMLWYMCISVSFFFLLTIFLFPKNRYYRQYEF

SEQ ID NO: 3294167 - protein, 22 aa, Plasmodium falciparum
PFLSSLLFFNFELSIYNITDNY

SEQ ID NO: 3294168 - protein, 27 aa, Plasmodium falciparum
PFMILRFYFLAFFFSNIHFQPLLIKNI

SEQ ID NO: 3294169 - protein, 32 aa, Plasmodium falciparum
PFNEHIKNVILFKFYLRLVVSRIMLASKTLTL

SEQ ID NO: 3294170 - protein, 23 aa, Plasmodium falciparum
PFNFFFSYFFFKQIKFNLLMIIS

SEQ ID NO: 3294171 - protein, 40 aa, Plasmodium falciparum
PFNRDILEKTIPFGIALALGSIAFLFIKKKPKSPVDLIRV

SEQ ID NO: 3294172 - protein, 21 aa, Plasmodium falciparum
PFNRDILEKTIPFGVALALGS

SEQ ID NO: 3294173 - protein, 41 aa, Plasmodium falciparum
PFNRDILEKTIPFGVALALGSIAFLFLKKKTKSSVGNLFQI

SEQ ID NO: 3294174 - protein, 25 aa, Plasmodium falciparum
PFNSIKLILDIFLNKIYISICTHDI

SEQ ID NO: 3294175 - protein, 31 aa, Plasmodium falciparum
PFSKLYIVLNFFFYLFDNTSTFFYLYKYFYY

SEQ ID NO: 3294176 - protein, 26 aa, Plasmodium falciparum
PFSNNNIIILPENYKIYFKSFGCAHN

SEQ ID NO: 3294177 - protein, 17 aa, Plasmodium falciparum
PFTNKALITSAFSKNED

SEQ ID NO: 3294178 - protein, 28 aa, Plasmodium falciparum
PFVADTLKLFKPYLIKLKNHLLKEDNLF

SEQ ID NO: 3294179 - protein, 25 aa, Plasmodium falciparum
PFVEYWNEFLLYIFDIHNKVNQKNI

SEQ ID NO: 3294180 - protein, 21 aa, Plasmodium falciparum
PFVLKFAIYNYSQKTYYINYY

SEQ ID NO: 3294181 - protein, 21 aa, Plasmodium falciparum
PGELVILFGFALMKGIGSSSA

SEQ ID NO: 3294182 - protein, 18 aa, Plasmodium falciparum
PGIAPKFYGILYESPDKP

SEQ ID NO: 3294183 - protein, 19 aa, Plasmodium falciparum
PGIYVWKIAALAAAKEFAE

SEQ ID NO: 3294184 - protein, 36 aa, Plasmodium falciparum
PGKFFFNWKSDAPIYLYFYFFSNLYLDSAKYFPGGF

SEQ ID NO: 3294185 - protein, 29 aa, Plasmodium falciparum
PGLKIEKIHFYDWNNNYFSRGNVSYLKKK

SEQ ID NO: 3294186 - protein, 17 aa, Plasmodium falciparum
PGNFISCYIYIITCVKI

SEQ ID NO: 3294187 - protein, 24 aa, Plasmodium falciparum
PGTKPLERLYYNSLALGELVEPIR

SEQ ID NO: 3294188 - protein, 19 aa, Plasmodium falciparum
PHCTFSVLSILFIETIILN

SEQ ID NO: 3294189 - protein, 18 aa, Plasmodium falciparum
PHFIQYYHYFLKNQYEHF

SEQ ID NO: 3294190 - protein, 34 aa, Plasmodium falciparum
PHFSIIPTFFLSDIFEILYLLYELDLFKSPNNET

SEQ ID NO: 3294191 - protein, 20 aa, Plasmodium falciparum
PHGAGYSAPYGVPHGAAHGS

SEQ ID NO: 3294192 - protein, 24 aa, Plasmodium falciparum
PHGTLKNMMVCNAVLLPFNEKNKG

SEQ ID NO: 3294193 - protein, 19 aa, Plasmodium falciparum
PHGVKPIDIIVLYSGNEEG

SEQ ID NO: 3294194 - protein, 17 aa, Plasmodium falciparum
PHLLLNDYVLDISDFIQ

SEQ ID NO: 3294195 - protein, 31 aa, Plasmodium falciparum
PHLPHQCYFLLYYNYEPFLEKNLHGLEGVVS

SEQ ID NO: 3294196 - protein, 17 aa, Plasmodium falciparum
PHNILQLKYVKGKAVFA

SEQ ID NO: 3294197 - protein, 24 aa, Plasmodium falciparum
PHNMSQFWLALHNNNLIFYDNMKF

SEQ ID NO: 3294198 - protein, 29 aa, Plasmodium falciparum
PHSSFCLSLDFIFILIKNNIKIDYKQLFI

SEQ ID NO: 3294199 - protein, 41 aa, Plasmodium falciparum
PHYVNIINFIEILCDFGHIIPIHYISHFIHFFQCNKNIFIQ

SEQ ID NO: 3294200 - protein, 26 aa, Plasmodium falciparum
PIAKLYAVALGLLFLCSREKCEATLS

SEQ ID NO: 3294201 - protein, 18 aa, Plasmodium falciparum
PICGKIRVFFFDKTGTLT

SEQ ID NO: 3294202 - protein, 22 aa, Plasmodium falciparum
PICRCLFTSFIKFPLKNVERVD

SEQ ID NO: 3294203 - protein, 34 aa, Plasmodium falciparum
PIDDIREYWWALNRNDVWEALTCSAPYYADYFKK

SEQ ID NO: 3294204 - protein, 32 aa, Plasmodium falciparum
PIDINLSVRCPLNYHGIFRKGNKLYKSIENKS

SEQ ID NO: 3294205 - protein, 17 aa, Plasmodium falciparum
PIDIWLKQFEMMQMYNG

SEQ ID NO: 3294206 - protein, 25 aa, Plasmodium falciparum
PIECQLNLFHKWLDRHRDMCEKFSN

SEQ ID NO: 3294207 - protein, 25 aa, Plasmodium falciparum
PIEILNIYYFKKKLYRYLYELNEII

SEQ ID NO: 3294208 - protein, 20 aa, Plasmodium falciparum
PIERATFIVPPQRKTKKLDP

SEQ ID NO: 3294209 - protein, 18 aa, Plasmodium falciparum
PIFNWHLGKISVLKMLDN

SEQ ID NO: 3294210 - protein, 25 aa, Plasmodium falciparum
PIHKQLDLLHTWLDRHRHMCEKWNN

SEQ ID NO: 3294211 - protein, 24 aa, Plasmodium falciparum
PIHNQLELFHKWLDRHRDMCEKWN

SEQ ID NO: 3294212 - protein, 23 aa, Plasmodium falciparum
PIHNQLELFHKWLDRHRHMCEKW

SEQ ID NO: 3294213 - protein, 24 aa, Plasmodium falciparum
PIHNQLELFHKWLDRHRNMCEKWE

SEQ ID NO: 3294214 - protein, 26 aa, Plasmodium falciparum
PIHNQLNLFHTWLDRQRDMCQQWNNK

SEQ ID NO: 3294215 - protein, 18 aa, Plasmodium falciparum
PIIAGGTLLYIESLLWES

SEQ ID NO: 3294216 - protein, 18 aa, Plasmodium falciparum
PIIIAFEKKKDFLYYLYN

SEQ ID NO: 3294217 - protein, 20 aa, Plasmodium falciparum
PIINGKYPHYIFKKKNYDIK

SEQ ID NO: 3294218 - protein, 26 aa, Plasmodium falciparum
PIKKVKYNYYYDSKLFELLKKEDNLE

SEQ ID NO: 3294219 - protein, 17 aa, Plasmodium falciparum
PIKLFYTSNIPIILQTA

SEQ ID NO: 3294220 - protein, 21 aa, Plasmodium falciparum
PILFHIPLIFTFNKKKYKVLL

SEQ ID NO: 3294221 - protein, 24 aa, Plasmodium falciparum
PILIDDIKLDNDISWIACITLFAD

SEQ ID NO: 3294222 - protein, 22 aa, Plasmodium falciparum
PILLEYWLFINILKFLKTAFFF

SEQ ID NO: 3294223 - protein, 25 aa, Plasmodium falciparum
PILNQINLFHKWLDRHRDMCETLKN

SEQ ID NO: 3294224 - protein, 27 aa, Plasmodium falciparum
PILNQINLFHKWLDRHRYMCAKLKNKE

SEQ ID NO: 3294225 - protein, 31 aa, Plasmodium falciparum
PINITYIKYKICLMKSLLKISLKYIQEKKYT

SEQ ID NO: 3294226 - protein, 20 aa, Plasmodium falciparum
PINLYSFLHLKKNTIFKYLE

SEQ ID NO: 3294227 - protein, 18 aa, Plasmodium falciparum
PINNKPIYNLSLNNNYIS

SEQ ID NO: 3294228 - protein, 17 aa, Plasmodium falciparum
PINNRYLRNLGEKSEEG

SEQ ID NO: 3294229 - protein, 18 aa, Plasmodium falciparum
PIQKVIYKYSLKEKLYLN

SEQ ID NO: 3294230 - protein, 26 aa, Plasmodium falciparum
PIQMIQILTFININYSFPSLFSYFIK

SEQ ID NO: 3294231 - protein, 19 aa, Plasmodium falciparum
PIQQIFISCMLFKLNRIFG

SEQ ID NO: 3294232 - protein, 22 aa, Plasmodium falciparum
PIRRYIDIVIHRILQSLIDQDN

SEQ ID NO: 3294233 - protein, 22 aa, Plasmodium falciparum
PIRRYPDILVHRVIKKIISDEQ

SEQ ID NO: 3294234 - protein, 55 aa, Plasmodium falciparum
PISVSDPLNLLYFLISRKIWKAVKYFFFFYYLFKYTLLKLFFERSRKRPTQQIII

SEQ ID NO: 3294235 - protein, 17 aa, Plasmodium falciparum
PISYIYDMKNLIYEYQK

SEQ ID NO: 3294236 - protein, 19 aa, Plasmodium falciparum
PITRLLCECDIYTSIYDND

SEQ ID NO: 3294237 - protein, 28 aa, Plasmodium falciparum
PIVTLEYVLEEFYFPLIQEAYGDAQAIE

SEQ ID NO: 3294238 - protein, 25 aa, Plasmodium falciparum
PIYHNDYIYLNYKFNNLYYTFNDYN

SEQ ID NO: 3294239 - protein, 18 aa, Plasmodium falciparum
PIYLIEKLGIKNHCVYNE

SEQ ID NO: 3294240 - protein, 34 aa, Plasmodium falciparum
PKDIFSLFIHAIQSIVFNLLVSIRMKKFGLQIAL

SEQ ID NO: 3294241 - protein, 23 aa, Plasmodium falciparum
PKDNMLYILNLIEEFLYIIRNKY

SEQ ID NO: 3294242 - protein, 20 aa, Plasmodium falciparum
PKDWILNRQIWYGHTIPLFK

SEQ ID NO: 3294243 - protein, 20 aa, Plasmodium falciparum
PKEHIPMNKPTYQPYINILN

SEQ ID NO: 3294244 - protein, 34 aa, Plasmodium falciparum
PKEIQKTFHDFFYFWIRRFLNDSMYWRGKVNSCI

SEQ ID NO: 3294245 - protein, 18 aa, Plasmodium falciparum
PKFYDITSFFKPSSKKLE

SEQ ID NO: 3294246 - protein, 31 aa, Plasmodium falciparum
PKGTFKEYPMHFLIYYYSGIHFEPGVHVTLN

SEQ ID NO: 3294247 - protein, 23 aa, Plasmodium falciparum
PKHRFNYFNELYLIRRLMKENQN

SEQ ID NO: 3294248 - protein, 30 aa, Plasmodium falciparum
PKLKDFVEIPPFFRWLHEWGSDFCGKRARM

SEQ ID NO: 3294249 - protein, 29 aa, Plasmodium falciparum
PKLKNFVEIPTYFRYLHEWGQNFCKERKK

SEQ ID NO: 3294250 - protein, 22 aa, Plasmodium falciparum
PKLLSLLIRRHNILLHTIQTDI

SEQ ID NO: 3294251 - protein, 28 aa, Plasmodium falciparum
PKLSFSFFIYLIIWLHNIQVHVDFKGYI

SEQ ID NO: 3294252 - protein, 18 aa, Plasmodium falciparum
PKMNSLMHFLKPFTLKLE

SEQ ID NO: 3294253 - protein, 21 aa, Plasmodium falciparum
PKRILKKLKIMKYIEYRKYCE

SEQ ID NO: 3294254 - protein, 26 aa, Plasmodium falciparum
PKRMEYFLLNLLKNNEKKRKTCVLCY

SEQ ID NO: 3294255 - protein, 18 aa, Plasmodium falciparum
PKTWWQKNGEHIWNGMIC

SEQ ID NO: 3294256 - protein, 25 aa, Plasmodium falciparum
PKVPYPNGIVYPLPLTDIHNSLAAD

SEQ ID NO: 3294257 - protein, 17 aa, Plasmodium falciparum
PKWVLKYLDDDLSNYSS

SEQ ID NO: 3294258 - protein, 19 aa, Plasmodium falciparum
PKYKTLIEVVLEPSKRDTM

SEQ ID NO: 3294259 - protein, 19 aa, Plasmodium falciparum
PKYKTLIKVLLKSSSKTYN

SEQ ID NO: 3294260 - protein, 32 aa, Plasmodium falciparum
PKYNRKFIYGSMYCSFLILGINIASFSILMSL

SEQ ID NO: 3294261 - protein, 24 aa, Plasmodium falciparum
PLCIGIITAPYWISSLKNLYWSHR

SEQ ID NO: 3294262 - protein, 20 aa, Plasmodium falciparum
PLDIIFTKKIKNIYKSINIL

SEQ ID NO: 3294263 - protein, 24 aa, Plasmodium falciparum
PLDNEFIKMIRKIMEYDKKRKLKS

SEQ ID NO: 3294264 - protein, 37 aa, Plasmodium falciparum
PLFSFTEYLSCYIILYFFVFLPNYSYAININNYHNKN

SEQ ID NO: 3294265 - protein, 21 aa, Plasmodium falciparum
PLHDYIPQRLRWMTEWAEWYC

SEQ ID NO: 3294266 - protein, 25 aa, Plasmodium falciparum
PLHNQLELFHTWLDRHRNMCEKWNN

SEQ ID NO: 3294267 - protein, 26 aa, Plasmodium falciparum
PLHNQLNLFHTWLDRHRDMCEQWNNK

SEQ ID NO: 3294268 - protein, 27 aa, Plasmodium falciparum
PLIGTVTLPYIARTINFMTKYKGEKIY

SEQ ID NO: 3294269 - protein, 19 aa, Plasmodium falciparum
PLIILPKIYHYKNSLKYLH

SEQ ID NO: 3294270 - protein, 19 aa, Plasmodium falciparum
PLIKVLNEDIIKFMNKYNI

SEQ ID NO: 3294271 - protein, 17 aa, Plasmodium falciparum
PLILNKSSSEFSPSHSY

SEQ ID NO: 3294272 - protein, 17 aa, Plasmodium falciparum
PLIPLKESKRFTCSDGD

SEQ ID NO: 3294273 - protein, 29 aa, Plasmodium falciparum
PLISLLIISCALFFLFKRSEGIFQTKGLE

SEQ ID NO: 3294274 - protein, 28 aa, Plasmodium falciparum
PLKDKYMLLFIIYCLKYNIINIVMFIYE

SEQ ID NO: 3294275 - protein, 43 aa, Plasmodium falciparum
PLKEDTYLIFLKITNMQILFIILNIYFTYIMDIFIKNVQKNKY

SEQ ID NO: 3294276 - protein, 17 aa, Plasmodium falciparum
PLKLLLNNLNFSNIFYI

SEQ ID NO: 3294277 - protein, 26 aa, Plasmodium falciparum
PLKYKVHLIFLALYPNLKYYGYCVIY

SEQ ID NO: 3294278 - protein, 24 aa, Plasmodium falciparum
PLLNQLELFHKWLDRHRDMCEKWE

SEQ ID NO: 3294279 - protein, 33 aa, Plasmodium falciparum
PLLTAFVESAAIETFFLWHKYKVDKIREEKEQQ

SEQ ID NO: 3294280 - protein, 31 aa, Plasmodium falciparum
PLNDSRYVVPFLYHMFTICQPLLREVHISGD

SEQ ID NO: 3294281 - protein, 26 aa, Plasmodium falciparum
PLNIKQLFFLFHHLQKFNLNYEIILL

SEQ ID NO: 3294282 - protein, 24 aa, Plasmodium falciparum
PLNLKTLEVLLKKNYYRLKENKDY

SEQ ID NO: 3294283 - protein, 31 aa, Plasmodium falciparum
PLNNFLNIFEKYSLFELFKLSFLNIQRKDEK

SEQ ID NO: 3294284 - protein, 23 aa, Plasmodium falciparum
PLQAHIFIGVIYYQRLRHMAYDK

SEQ ID NO: 3294285 - protein, 22 aa, Plasmodium falciparum
PLRHIWAIFFYIDIFILYILVF

SEQ ID NO: 3294286 - protein, 20 aa, Plasmodium falciparum
PLRNPHFSEIKKFYFIRNLK

SEQ ID NO: 3294287 - protein, 20 aa, Plasmodium falciparum
PLRWKSIVFLLAAFIIGCFD

SEQ ID NO: 3294288 - protein, 19 aa, Plasmodium falciparum
PLSKMILEILLHKGKDKKI

SEQ ID NO: 3294289 - protein, 33 aa, Plasmodium falciparum
PLSRFHSPQHHEYFIQLLLEEQKLRQRLTKLQE

SEQ ID NO: 3294290 - protein, 23 aa, Plasmodium falciparum
PLTSNFFSLLYNTSPCILDDVFE

SEQ ID NO: 3294291 - protein, 29 aa, Plasmodium falciparum
PLTVGVAFAALSYFLLKKKSKSTIDLLRV

SEQ ID NO: 3294292 - protein, 18 aa, Plasmodium falciparum
PMAFLFQIFFIDLYLFQY

SEQ ID NO: 3294293 - protein, 23 aa, Plasmodium falciparum
PMDLKRDIVLLLKNIRSMDLCLN

SEQ ID NO: 3294294 - protein, 20 aa, Plasmodium falciparum
PMIRKIILKIFDRIKYLIND

SEQ ID NO: 3294295 - protein, 27 aa, Plasmodium falciparum
PMNKLNNIVFILLLSLLHYMEEKNKKF

SEQ ID NO: 3294296 - protein, 36 aa, Plasmodium falciparum
PMVISFIVVVIIVIILLITYLILRYRRKKKMKRKLQ

SEQ ID NO: 3294297 - protein, 37 aa, Plasmodium falciparum
PMVISFIVVVIIVIILLITYLILRYRRKKKNEEKTPI

SEQ ID NO: 3294298 - protein, 19 aa, Plasmodium falciparum
PNCIYLLSILKYLLNNRNI

SEQ ID NO: 3294299 - protein, 36 aa, Plasmodium falciparum
PNCLITTYLCISIIFILIGCIFIILSTRRKECKISY

SEQ ID NO: 3294300 - protein, 28 aa, Plasmodium falciparum
PNDDKPLNYLLLLDVLKLFIQKQQNDKY

SEQ ID NO: 3294301 - protein, 25 aa, Plasmodium falciparum
PNDLQEMIKFYMYLQNILNSKNETS

SEQ ID NO: 3294302 - protein, 17 aa, Plasmodium falciparum
PNDLYLCTLNEADLKIS

SEQ ID NO: 3294303 - protein, 40 aa, Plasmodium falciparum
PNGENQIIIIRALFKRWLEYFLEDYNKIRKKLKPCMNNSD

SEQ ID NO: 3294304 - protein, 25 aa, Plasmodium falciparum
PNICPKFYRLLYEPHYYFNLKSISC

SEQ ID NO: 3294305 - protein, 21 aa, Plasmodium falciparum
PNICPKLYKILYEPPNKEYIK

SEQ ID NO: 3294306 - protein, 21 aa, Plasmodium falciparum
PNIFFLLFTYIIIIISVLPIY

SEQ ID NO: 3294307 - protein, 19 aa, Plasmodium falciparum
PNIIGYIRVILALLGFIIS

SEQ ID NO: 3294308 - protein, 30 aa, Plasmodium falciparum
PNIKSICGRRLHRSLYEFQISNNSKSFNNV

SEQ ID NO: 3294309 - protein, 35 aa, Plasmodium falciparum
PNIMVPAGIGVALTLGLLLFKMRRKAKRQVDMIRI

SEQ ID NO: 3294310 - protein, 34 aa, Plasmodium falciparum
PNIMVPAGIGVALTLGLLLFKMRTKPKHEVDMIR

SEQ ID NO: 3294311 - protein, 26 aa, Plasmodium falciparum
PNKSSFYHFLVKLHNLFYSYKQKYKI

SEQ ID NO: 3294312 - protein, 28 aa, Plasmodium falciparum
PNLIFNHRLYFSLYRKKYCPYKNTCLSK

SEQ ID NO: 3294313 - protein, 32 aa, Plasmodium falciparum
PNLIYDPNYETIYSKWKTFLRKEQSSGNLISN

SEQ ID NO: 3294314 - protein, 17 aa, Plasmodium falciparum
PNNIMPPYNLSNNIGHN

SEQ ID NO: 3294315 - protein, 27 aa, Plasmodium falciparum
PNNKRNMIFYIQYYLKSLRKNTFNSYE

SEQ ID NO: 3294316 - protein, 26 aa, Plasmodium falciparum
PNNLYTNIITIPLPKENQNKTEEKTK

SEQ ID NO: 3294317 - protein, 18 aa, Plasmodium falciparum
PNSFPYLIKKNILRIEKN

SEQ ID NO: 3294318 - protein, 29 aa, Plasmodium falciparum
PNSHTHYFSCLLLWIFKVSNTEIINEQIT

SEQ ID NO: 3294319 - protein, 17 aa, Plasmodium falciparum
PNSIKGYFWEMCIKNKL

SEQ ID NO: 3294320 - protein, 32 aa, Plasmodium falciparum
PNSILNYYYLCIIYLYNLKINKCLYICKNFLI

SEQ ID NO: 3294321 - protein, 21 aa, Plasmodium falciparum
PNTRLLCECDIYTSIYDNDPQ

SEQ ID NO: 3294322 - protein, 21 aa, Plasmodium falciparum
PNYIKMNLTFKIGLRTYDNMY

SEQ ID NO: 3294323 - protein, 39 aa, Plasmodium falciparum
PNYLNYILITFLTYFKINIPIFIFSFFYQSQYIHNKNIL

SEQ ID NO: 3294324 - protein, 27 aa, Plasmodium falciparum
PPCFYAPLFMCLYKIIINYSLYNFNDK

SEQ ID NO: 3294325 - protein, 27 aa, Plasmodium falciparum
PPDYDYIPQPFRWLSEWSETYCLAQKD

SEQ ID NO: 3294326 - protein, 25 aa, Plasmodium falciparum
PPDYDYIPQPLRWISEWGEQFCLYQ

SEQ ID NO: 3294327 - protein, 36 aa, Plasmodium falciparum
PPHHYWSLPICSQAFYMKIFYHGLQIEKMNFICDYM

SEQ ID NO: 3294328 - protein, 17 aa, Plasmodium falciparum
PPHIIERSNYYKNPKKA

SEQ ID NO: 3294329 - protein, 24 aa, Plasmodium falciparum
PPITYLCDFLNKKQILQPLNNKTK

SEQ ID NO: 3294330 - protein, 25 aa, Plasmodium falciparum
PPKKKSIFWSLFKNKIHSDHFSQDA

SEQ ID NO: 3294331 - protein, 20 aa, Plasmodium falciparum
PPLKFNSIWHLKLWSYFWSI

SEQ ID NO: 3294332 - protein, 19 aa, Plasmodium falciparum
PPMDWEKLIIFGNFSDGVT

SEQ ID NO: 3294333 - protein, 23 aa, Plasmodium falciparum
PPNQKKHIFFLEDLNITAKDNCD

SEQ ID NO: 3294334 - protein, 20 aa, Plasmodium falciparum
PPPPPAPAPAPAPAPEKSQP

SEQ ID NO: 3294335 - protein, 26 aa, Plasmodium falciparum
PPQEPQPYLPPALKNAMLSSTIMWSI

SEQ ID NO: 3294336 - protein, 25 aa, Plasmodium falciparum
PPRRQKLCLYFLAHKIETPNLNTQE

SEQ ID NO: 3294337 - protein, 30 aa, Plasmodium falciparum
PPTNMDYVPQFLRWFEEWAEDFCRLRKHKL

SEQ ID NO: 3294338 - protein, 48 aa, Plasmodium falciparum
PPTPQLLDDPLLKTALMSSTILWMVGIGFAALTYFLLKKKSKSSVDLL

SEQ ID NO: 3294339 - protein, 20 aa, Plasmodium falciparum
PQDWWQTYGKDIWKGMICAL

SEQ ID NO: 3294340 - protein, 26 aa, Plasmodium falciparum
PQIFLLRWIRLFYCREFPIDDTVILW

SEQ ID NO: 3294341 - protein, 20 aa, Plasmodium falciparum
PQIQKILKKIKYYSFKRVII

SEQ ID NO: 3294342 - protein, 29 aa, Plasmodium falciparum
PQKSLSFYNLMPHALLRFKLDQQDENFVF

SEQ ID NO: 3294343 - protein, 31 aa, Plasmodium falciparum
PQLSDFVEIPTYFRWLHEWGSDFCGTRKRML

SEQ ID NO: 3294344 - protein, 21 aa, Plasmodium falciparum
PQLVALFHSFVGLAALFVGFS

SEQ ID NO: 3294345 - protein, 18 aa, Plasmodium falciparum
PQRHWGWKCISDTTTGKS

SEQ ID NO: 3294346 - protein, 18 aa, Plasmodium falciparum
PQRHWGWRCVAPSDTTKT

SEQ ID NO: 3294347 - protein, 22 aa, Plasmodium falciparum
PQRLRWMTEWAEWYCKYQAEAY

SEQ ID NO: 3294348 - protein, 18 aa, Plasmodium falciparum
PQTWWKDNAKHIWHGMIC

SEQ ID NO: 3294349 - protein, 30 aa, Plasmodium falciparum
PQYIYVPASFLLIFIIYIVARYFPDMKIGF

SEQ ID NO: 3294350 - protein, 18 aa, Plasmodium falciparum
PRGNELLNYIYIYYNLFV

SEQ ID NO: 3294351 - protein, 27 aa, Plasmodium falciparum
PRISNKFRYSFFKIRNRFKHNFNACDN

SEQ ID NO: 3294352 - protein, 24 aa, Plasmodium falciparum
PRLIEECFCLLLSSLFIGYVGDMN

SEQ ID NO: 3294353 - protein, 22 aa, Plasmodium falciparum
PRNILILFDIIYLLCNAYISPL

SEQ ID NO: 3294354 - protein, 17 aa, Plasmodium falciparum
PRNLRKRRRNKCKNIIY

SEQ ID NO: 3294355 - protein, 26 aa, Plasmodium falciparum
PRNVCMKELYYLYGYYKELVKNKKCK

SEQ ID NO: 3294356 - protein, 21 aa, Plasmodium falciparum
PRRIKLCIYYLENHTQKGNIK

SEQ ID NO: 3294357 - protein, 20 aa, Plasmodium falciparum
PRRRHLCLRNIIIKKNYRKG

SEQ ID NO: 3294358 - protein, 19 aa, Plasmodium falciparum
PRSIYTINLGFNKCPTEEI

SEQ ID NO: 3294359 - protein, 23 aa, Plasmodium falciparum
PSAYILLDILYNMQLDKLNEITI

SEQ ID NO: 3294360 - protein, 20 aa, Plasmodium falciparum
PSDLYMKTNKFLSMYDAYVR

SEQ ID NO: 3294361 - protein, 36 aa, Plasmodium falciparum
PSDNDPKSWWKLHAPYIWNGMIYALTYDTNTASGEK

SEQ ID NO: 3294362 - protein, 18 aa, Plasmodium falciparum
PSIILWIFVILTTKIITL

SEQ ID NO: 3294363 - protein, 20 aa, Plasmodium falciparum
PSIINDHTLSLGKELSYYKN

SEQ ID NO: 3294364 - protein, 22 aa, Plasmodium falciparum
PSILFIVFSVMSILTFFFIFFF

SEQ ID NO: 3294365 - protein, 18 aa, Plasmodium falciparum
PSILLKNYNFWYNNNDNS

SEQ ID NO: 3294366 - protein, 19 aa, Plasmodium falciparum
PSIWEGMICALTYKENDEK

SEQ ID NO: 3294367 - protein, 19 aa, Plasmodium falciparum
PSIWNGMLCGLSYDTKTKH

SEQ ID NO: 3294368 - protein, 26 aa, Plasmodium falciparum
PSIYNNYLLYPFYPDELYNIKYDTLE

SEQ ID NO: 3294369 - protein, 21 aa, Plasmodium falciparum
PSMFRRFINFLSFSGNENETE

SEQ ID NO: 3294370 - protein, 24 aa, Plasmodium falciparum
PSMPYTPLFFTCRTIIKIEVLRDV

SEQ ID NO: 3294371 - protein, 20 aa, Plasmodium falciparum
PSNFLFFYKTPQNPTYFPSI

SEQ ID NO: 3294372 - protein, 17 aa, Plasmodium falciparum
PSNIRIWIVQYVGLENT

SEQ ID NO: 3294373 - protein, 31 aa, Plasmodium falciparum
PSNVLDHPLMKPALMSSTIMWSVGIGFAAFT

SEQ ID NO: 3294374 - protein, 25 aa, Plasmodium falciparum
PSNYTYIIMNVFLKNKEFDHITELK

SEQ ID NO: 3294375 - protein, 18 aa, Plasmodium falciparum
PSPYLMNVKLKTFYRPRL

SEQ ID NO: 3294376 - protein, 30 aa, Plasmodium falciparum
PSRLSSFHHFITYHFIPFYEQLSENQNFHN

SEQ ID NO: 3294377 - protein, 26 aa, Plasmodium falciparum
PSTFRKFLFVLTYKEKKILVFNYETF

SEQ ID NO: 3294378 - protein, 43 aa, Plasmodium falciparum
PSTQLKNAMLFSTILWMVGIGFAAFTYFFLKKKPKSPVDLLRV

SEQ ID NO: 3294379 - protein, 34 aa, Plasmodium falciparum
PSTYLFAGRLTILFMLLFVIQIPIMIYANFLFSK

SEQ ID NO: 3294380 - protein, 20 aa, Plasmodium falciparum
PSVLPIILYKYIQIIMYLME

SEQ ID NO: 3294381 - protein, 24 aa, Plasmodium falciparum
PSVLYRRNIYIPETFLSLYLGLSN

SEQ ID NO: 3294382 - protein, 24 aa, Plasmodium falciparum
PSVNFYPLVISIFKRIFSELHTSD

SEQ ID NO: 3294383 - protein, 17 aa, Plasmodium falciparum
PSVSSYCFFFLNEVYKK

SEQ ID NO: 3294384 - protein, 23 aa, Plasmodium falciparum
PSYIGLFAHLWFECKILLAEKLI

SEQ ID NO: 3294385 - protein, 22 aa, Plasmodium falciparum
PTDLPQCFIPFINPKKMTKYNM

SEQ ID NO: 3294386 - protein, 19 aa, Plasmodium falciparum
PTDSRLPCFIYDSSNNITN

SEQ ID NO: 3294387 - protein, 17 aa, Plasmodium falciparum
PTEIKVLLLGRKGEVRN

SEQ ID NO: 3294388 - protein, 26 aa, Plasmodium falciparum
PTEINKILLLIIKIVFKNYMEYIRKC

SEQ ID NO: 3294389 - protein, 32 aa, Plasmodium falciparum
PTFCWKSIWSYSLLFYGFKFKETTKLLIINDN

SEQ ID NO: 3294390 - protein, 17 aa, Plasmodium falciparum
PTFLLVQNKCLLAECLK

SEQ ID NO: 3294391 - protein, 33 aa, Plasmodium falciparum
PTFYLKQLKPNPSFVLPFIFVYSCIEIENLHNE

SEQ ID NO: 3294392 - protein, 29 aa, Plasmodium falciparum
PTHLTDFISRPPYFRYLEEWGQNFCKKRT

SEQ ID NO: 3294393 - protein, 29 aa, Plasmodium falciparum
PTINIFEYFHFFIKDLFLMLSDENKDIQK

SEQ ID NO: 3294394 - protein, 28 aa, Plasmodium falciparum
PTKLDYVPQFLRWLTEWIEDFYREKQNL

SEQ ID NO: 3294395 - protein, 17 aa, Plasmodium falciparum
PTKLPEYEKGHVSREYQ

SEQ ID NO: 3294396 - protein, 22 aa, Plasmodium falciparum
PTKLSPNRYIPYTSGKYRGKRY

SEQ ID NO: 3294397 - protein, 25 aa, Plasmodium falciparum
PTKLSPNRYIPYTSGKYRGKRYIYL

SEQ ID NO: 3294398 - protein, 25 aa, Plasmodium falciparum
PTKLSPNRYIPYTSGKYRGKTYIYL

SEQ ID NO: 3294399 - protein, 30 aa, Plasmodium falciparum
PTLEEFSKRPTYFRWLHEWGESFCRERKKR

SEQ ID NO: 3294400 - protein, 30 aa, Plasmodium falciparum
PTLKNFVEIPTFFRWLHEWGSDFCRQRKRM

SEQ ID NO: 3294401 - protein, 23 aa, Plasmodium falciparum
PTLLAQYMSIFLSLWVFEGENNI

SEQ ID NO: 3294402 - protein, 38 aa, Plasmodium falciparum
PTNISLKIILIFFYYYICKKICMQFFTLCIYECRNNKM

SEQ ID NO: 3294403 - protein, 52 aa, Plasmodium falciparum
PTNPPPNLFNNPAVIPALMSSTIMWSIGIGFAAFTYFLLKKKTKSSVGNLFQ

SEQ ID NO: 3294404 - protein, 22 aa, Plasmodium falciparum
PTNRFLCECDLYTSIYDNDPEM

SEQ ID NO: 3294405 - protein, 24 aa, Plasmodium falciparum
PTNSSYVSLIPDKKYYLLGEKIEF

SEQ ID NO: 3294406 - protein, 32 aa, Plasmodium falciparum
PTNVPPAPPPQPPPPPAIPAPATTPGVNPCEI

SEQ ID NO: 3294407 - protein, 26 aa, Plasmodium falciparum
PTNYNIKFYDIFKIILKGIYSIKCEN

SEQ ID NO: 3294408 - protein, 25 aa, Plasmodium falciparum
PTPFAYFVIGLLLSTFPLLYIIYKR

SEQ ID NO: 3294409 - protein, 33 aa, Plasmodium falciparum
PTQYQSPYVFTPEIRFLLLHSYNKYSKYIAQNG

SEQ ID NO: 3294410 - protein, 27 aa, Plasmodium falciparum
PTTDDEYSFLRWFVEWGQNFCIRHEKE

SEQ ID NO: 3294411 - protein, 42 aa, Plasmodium falciparum
PTVKILQFFYVIYKHYIFKGYIFLLYLKLKKIKWKHPQDIKS

SEQ ID NO: 3294412 - protein, 24 aa, Plasmodium falciparum
PTYAVKFIYLKVSSLDNVSSRRYF

SEQ ID NO: 3294413 - protein, 21 aa, Plasmodium falciparum
PTYIPLNISSYLYIGKTKNYF

SEQ ID NO: 3294414 - protein, 22 aa, Plasmodium falciparum
PTYIYNMLLILLSTSYIDLVMV

SEQ ID NO: 3294415 - protein, 44 aa, Plasmodium falciparum
PVAIITFQYISMSFRLVLLDFYYVYFFDLHGNSLYIDDARKNSI

SEQ ID NO: 3294416 - protein, 19 aa, Plasmodium falciparum
PVDLIRVLDIHKGDYGMPT

SEQ ID NO: 3294417 - protein, 24 aa, Plasmodium falciparum
PVENTLHRYPVSSFLNIKKYGRKG

SEQ ID NO: 3294418 - protein, 41 aa, Plasmodium falciparum
PVFSKQRIHLIYPKNYPFLIKSLMILSLMLPLNTSNNILQK

SEQ ID NO: 3294419 - protein, 22 aa, Plasmodium falciparum
PVGPILLVVFIFVVIGSVIVQM

SEQ ID NO: 3294420 - protein, 17 aa, Plasmodium falciparum
PVKFLYTRSFFFFEELL

SEQ ID NO: 3294421 - protein, 20 aa, Plasmodium falciparum
PVKPTPAPAPAAPPAAPAQP

SEQ ID NO: 3294422 - protein, 25 aa, Plasmodium falciparum
PVQLNVFHFYYMKLYKKFNHQRHVY

SEQ ID NO: 3294423 - protein, 27 aa, Plasmodium falciparum
PVSTETILNFYYLLKKHTPNYSGSDND

SEQ ID NO: 3294424 - protein, 20 aa, Plasmodium falciparum
PVTYPKKLAFLFLNDICKQF

SEQ ID NO: 3294425 - protein, 30 aa, Plasmodium falciparum
PVVDYIPQRLRWMSEWSEYFCNVLNKEIDE

SEQ ID NO: 3294426 - protein, 26 aa, Plasmodium falciparum
PVVTNLFLFIALSYSFCIFVFFSFFF

SEQ ID NO: 3294427 - protein, 36 aa, Plasmodium falciparum
PVYKYAASFTLAAILFLGLSLYFINNRKGNKIVDAK

SEQ ID NO: 3294428 - protein, 18 aa, Plasmodium falciparum
PYCKHAFNFFTRTCNICQ

SEQ ID NO: 3294429 - protein, 25 aa, Plasmodium falciparum
PYDEHTFVNPFFPKNKIDDIIYVES

SEQ ID NO: 3294430 - protein, 20 aa, Plasmodium falciparum
PYDIWTVGCATYFLTVLIVN

SEQ ID NO: 3294431 - protein, 18 aa, Plasmodium falciparum
PYEDIFVYLKLNYEKNVE

SEQ ID NO: 3294432 - protein, 17 aa, Plasmodium falciparum
PYEFITFFLKFVQKIKK

SEQ ID NO: 3294433 - protein, 25 aa, Plasmodium falciparum
PYENYMILYVIYRLKANNIYHFEFI

SEQ ID NO: 3294434 - protein, 21 aa, Plasmodium falciparum
PYFNFFFCFIIPGIYSYFMYN

SEQ ID NO: 3294435 - protein, 18 aa, Plasmodium falciparum
PYFTNRFLKYYIYTDYAG

SEQ ID NO: 3294436 - protein, 23 aa, Plasmodium falciparum
PYGIAALVLLILAVLLIILYIWL

SEQ ID NO: 3294437 - protein, 26 aa, Plasmodium falciparum
PYGILEGNLQIYYLPMIQEAHPKDEA

SEQ ID NO: 3294438 - protein, 17 aa, Plasmodium falciparum
PYGVPHGAAHGSRYSSF

SEQ ID NO: 3294439 - protein, 18 aa, Plasmodium falciparum
PYILLLNDHELIQKHIIQ

SEQ ID NO: 3294440 - protein, 24 aa, Plasmodium falciparum
PYIRQNFFLLIRGLKKIITDEITI

SEQ ID NO: 3294441 - protein, 26 aa, Plasmodium falciparum
PYIYDDLMTFFFNPLKYKVIHMRIIP

SEQ ID NO: 3294442 - protein, 21 aa, Plasmodium falciparum
PYNNILLQPFRANFQFELKLP

SEQ ID NO: 3294443 - protein, 32 aa, Plasmodium falciparum
PYNNNYIRNLLYYLFVFSKYNKFAYYLCNIKK

SEQ ID NO: 3294444 - protein, 25 aa, Plasmodium falciparum
PYNSNRVYYFYYKNYMIEKCIYFDN

SEQ ID NO: 3294445 - protein, 18 aa, Plasmodium falciparum
PYPSNWLTSLSVSAYFDK

SEQ ID NO: 3294446 - protein, 20 aa, Plasmodium falciparum
PYRRCYLLHGPPGCGKSSLI

SEQ ID NO: 3294447 - protein, 20 aa, Plasmodium falciparum
PYVHFVKLKKIHPAYFEKIL

SEQ ID NO: 3294448 - protein, 27 aa, Plasmodium falciparum
PYVSHFKDNFLIRIYDTYINKYLINNG

SEQ ID NO: 3294449 - protein, 36 aa, Plasmodium falciparum
QAAAGFCLFSQLWYWFPLIHMISLTFMPTCLIGLTE

SEQ ID NO: 3294450 - protein, 28 aa, Plasmodium falciparum
QAAQTKYFLFNFTFMDPIVIIPEDKNMI

SEQ ID NO: 3294451 - protein, 21 aa, Plasmodium falciparum
QAFIEKWKGYYDKQSKKYFYD

SEQ ID NO: 3294452 - protein, 20 aa, Plasmodium falciparum
QAFSINLYYEALNHYICILN

SEQ ID NO: 3294453 - protein, 25 aa, Plasmodium falciparum
QAIKSLYYVLRFLYDKKKYNYNGED

SEQ ID NO: 3294454 - protein, 28 aa, Plasmodium falciparum
QAKIKAFLYKKSFIFLFCSFYNIFLKIL

SEQ ID NO: 3294455 - protein, 17 aa, Plasmodium falciparum
QAKKKTFFFFNKDKMDS

SEQ ID NO: 3294456 - protein, 35 aa, Plasmodium falciparum
QALSKTLFYLTIIPWILSFIFYSLLHFTYGKEYLK

SEQ ID NO: 3294457 - protein, 17 aa, Plasmodium falciparum
QALWDKISPSIWEGMLC

SEQ ID NO: 3294458 - protein, 21 aa, Plasmodium falciparum
QANYILLKNILFFIVKYNNVQ

SEQ ID NO: 3294459 - protein, 21 aa, Plasmodium falciparum
QAQRYVEILYYYIDVIKNDRK

SEQ ID NO: 3294460 - protein, 17 aa, Plasmodium falciparum
QATAKCICYILSELWEI

SEQ ID NO: 3294461 - protein, 27 aa, Plasmodium falciparum
QATNQFYYQLLNILYYLQEKQKIRKSN

SEQ ID NO: 3294462 - protein, 23 aa, Plasmodium falciparum
QAVIFFTALYYLISSKKSVLNYL

SEQ ID NO: 3294463 - protein, 20 aa, Plasmodium falciparum
QAVVIMLCSLKRQNEYKSLK

SEQ ID NO: 3294464 - protein, 26 aa, Plasmodium falciparum
QAYKDALIFYGLTYGLQLFGQEKYNH

SEQ ID NO: 3294465 - protein, 17 aa, Plasmodium falciparum
QAYYPKNNKLKYYFDLF

SEQ ID NO: 3294466 - protein, 19 aa, Plasmodium falciparum
QCAMDFWMMYNNYSSSFYE

SEQ ID NO: 3294467 - protein, 23 aa, Plasmodium falciparum
QCELIYEILKCTVLFNYIDLNNF

SEQ ID NO: 3294468 - protein, 24 aa, Plasmodium falciparum
QCIFNFLPIYINLISQAFKKTQSP

SEQ ID NO: 3294469 - protein, 21 aa, Plasmodium falciparum
QCIYMLLQRIYGPRYFVNIDL

SEQ ID NO: 3294470 - protein, 17 aa, Plasmodium falciparum
QCKIYKSLSLIIIKGLC

SEQ ID NO: 3294471 - protein, 28 aa, Plasmodium falciparum
QCKNEKLMLYLSFLLKHIHKLNCEQNNM

SEQ ID NO: 3294472 - protein, 30 aa, Plasmodium falciparum
QCSDNGVISFWKIFLKRLKRKSSSYMKDIN

SEQ ID NO: 3294473 - protein, 26 aa, Plasmodium falciparum
QCVSLVLMFVFYWAFGGTGIFIFDLY

SEQ ID NO: 3294474 - protein, 18 aa, Plasmodium falciparum
QCYIIIHDFVFNYFLQSG

SEQ ID NO: 3294475 - protein, 31 aa, Plasmodium falciparum
QDCYIIIRNNLYGDFIYFMKGMYVVKKKIKE

SEQ ID NO: 3294476 - protein, 21 aa, Plasmodium falciparum
QDDFTIIQTNDWILIMVFDGH

SEQ ID NO: 3294477 - protein, 23 aa, Plasmodium falciparum
QDDTFYFKLLNKNKYYMNNVNGN

SEQ ID NO: 3294478 - protein, 20 aa, Plasmodium falciparum
QDESWLINEAFIEIVDHVVD

SEQ ID NO: 3294479 - protein, 35 aa, Plasmodium falciparum
QDFFSKVKNFVKKYKVFAAPFISAVAAFASYVVGF

SEQ ID NO: 3294480 - protein, 17 aa, Plasmodium falciparum
QDFYNLLNKYGLEAKCE

SEQ ID NO: 3294481 - protein, 35 aa, Plasmodium falciparum
QDHQNTVHLIKNFQFPILNISQFYPRRGTVAYNMK

SEQ ID NO: 3294482 - protein, 39 aa, Plasmodium falciparum
QDIDHLIPYFKREFFFKTLIGNNIILLLAKKYEVTEVLI

SEQ ID NO: 3294483 - protein, 17 aa, Plasmodium falciparum
QDIFLYCKSYLVLGRQN

SEQ ID NO: 3294484 - protein, 22 aa, Plasmodium falciparum
QDISIVIQIVLFFLKNLKNVFK

SEQ ID NO: 3294485 - protein, 34 aa, Plasmodium falciparum
QDIYIIDILFNRLSLYLFLLYKTCEPSANITNFI

SEQ ID NO: 3294486 - protein, 19 aa, Plasmodium falciparum
QDIYLNYKEKSIKLLIIGI

SEQ ID NO: 3294487 - protein, 24 aa, Plasmodium falciparum
QDKIKLLIILYENASLVFTNENYK

SEQ ID NO: 3294488 - protein, 30 aa, Plasmodium falciparum
QDLGYRLYELIFIKLISLSKNKLKLNELMK

SEQ ID NO: 3294489 - protein, 24 aa, Plasmodium falciparum
QDLIKSIDFWITLKENIKNIDIPT

SEQ ID NO: 3294490 - protein, 25 aa, Plasmodium falciparum
QDMKLLHIYISTLLNIINIIFILFI

SEQ ID NO: 3294491 - protein, 42 aa, Plasmodium falciparum
QDNMYKYLKYFFFSNFYFYNPIFLFYYFSFISCTEKNLYEIY

SEQ ID NO: 3294492 - protein, 46 aa, Plasmodium falciparum
QDNSTEIPTMVLVPGVLTVFLLTIIWVLVYKHSLIDRVHGTGKTKK

SEQ ID NO: 3294493 - protein, 26 aa, Plasmodium falciparum
QDTLENRLFKYFKLLGQLCAKILTDN

SEQ ID NO: 3294494 - protein, 26 aa, Plasmodium falciparum
QDTYVELYYNFLKYLFARCILCSNNR

SEQ ID NO: 3294495 - protein, 37 aa, Plasmodium falciparum
QDVLQLVEGYWLLTLKNKYMFSFLKKKKKIIFSVSSG

SEQ ID NO: 3294496 - protein, 27 aa, Plasmodium falciparum
QDVTEVFRYIFDKLGGSEKEFLRLIFS

SEQ ID NO: 3294497 - protein, 35 aa, Plasmodium falciparum
QEDLLKWFIETAAIETFFLWHRYKKIKEKEIEEKR

SEQ ID NO: 3294498 - protein, 25 aa, Plasmodium falciparum
QEEKNKWLDIFWKYFHKNEEEIEKK

SEQ ID NO: 3294499 - protein, 23 aa, Plasmodium falciparum
QEHIYLFLHLIDYYINVLENNFS

SEQ ID NO: 3294500 - protein, 38 aa, Plasmodium falciparum
QEIKNLLLCIGFVEIYIFYVMIKVDTLLLLCIYESLKN

SEQ ID NO: 3294501 - protein, 30 aa, Plasmodium falciparum
QEINTLSDVFKKPFFFIQLNTDSSQHEKDI

SEQ ID NO: 3294502 - protein, 24 aa, Plasmodium falciparum
QEKKIKFVLIDNKWKHILGLGKIE

SEQ ID NO: 3294503 - protein, 21 aa, Plasmodium falciparum
QEKLYLYIDKLDNLKTIQIYY

SEQ ID NO: 3294504 - protein, 25 aa, Plasmodium falciparum
QEKQKLNILLFQYDNFRSAISSKYT

SEQ ID NO: 3294505 - protein, 33 aa, Plasmodium falciparum
QEMMEEFIYAYKRLKILKILNISLKACEKNNKS

SEQ ID NO: 3294506 - protein, 23 aa, Plasmodium falciparum
QENKGILIFYIKNISKAALNLSS

SEQ ID NO: 3294507 - protein, 22 aa, Plasmodium falciparum
QENLFTQLLNKFLQIYKNNQKC

SEQ ID NO: 3294508 - protein, 24 aa, Plasmodium falciparum
QEQSSYILKPYFTKKYQLIKMIRN

SEQ ID NO: 3294509 - protein, 28 aa, Plasmodium falciparum
QESENMYMQNLLKRILYNVEKKKVLSNY

SEQ ID NO: 3294510 - protein, 37 aa, Plasmodium falciparum
QESFNFLLKHIFKKNFIYYINYIYTILGDIFVSKNVD

SEQ ID NO: 3294511 - protein, 25 aa, Plasmodium falciparum
QEWEDMFIIDWLLGDDIFCVIKLEF

SEQ ID NO: 3294512 - protein, 40 aa, Plasmodium falciparum
QEYFCDYFLCYIKYLLILKKKNMIYFKVSKYSYIVEKFDY

SEQ ID NO: 3294513 - protein, 22 aa, Plasmodium falciparum
QEYFYKWIYIYEKKQIYIHFCN

SEQ ID NO: 3294514 - protein, 17 aa, Plasmodium falciparum
QEYYDLMIITKKHIYYI

SEQ ID NO: 3294515 - protein, 22 aa, Plasmodium falciparum
QFAFNLIVHYFIREKGKDTCEI

SEQ ID NO: 3294516 - protein, 27 aa, Plasmodium falciparum
QFASFSKLCLKLCILGIIVIVNVCCSF

SEQ ID NO: 3294517 - protein, 20 aa, Plasmodium falciparum
QFCLFICRIKNVHKRFGYLL

SEQ ID NO: 3294518 - protein, 23 aa, Plasmodium falciparum
QFDKLKLIFFFKQISQHSYIIKD

SEQ ID NO: 3294519 - protein, 24 aa, Plasmodium falciparum
QFDLYYFYVYPLMNFSFKASFLFC

SEQ ID NO: 3294520 - protein, 35 aa, Plasmodium falciparum
QFELVPYINHLYYLYNIYPLLFKLKEIKNIHDMKE

SEQ ID NO: 3294521 - protein, 17 aa, Plasmodium falciparum
QFFGIPKNQTSIYFYKK

SEQ ID NO: 3294522 - protein, 37 aa, Plasmodium falciparum
QFFNSLMKCSLLLNFLILLLYTFFNSFLSIKFMTNYK

SEQ ID NO: 3294523 - protein, 25 aa, Plasmodium falciparum
QFFSEQFITFFPLLKKKKKKREKTN

SEQ ID NO: 3294524 - protein, 20 aa, Plasmodium falciparum
QFGFKFDTFYNYRNLKNTFL

SEQ ID NO: 3294525 - protein, 23 aa, Plasmodium falciparum
QFIKNIIHIFFDIINKKYDNNIK

SEQ ID NO: 3294526 - protein, 25 aa, Plasmodium falciparum
QFIQKNDILIFYEGSTLLIDGIKIN

SEQ ID NO: 3294527 - protein, 30 aa, Plasmodium falciparum
QFKDEYFPHMFSFFEFVQIFKCLKNYKKIN

SEQ ID NO: 3294528 - protein, 24 aa, Plasmodium falciparum
QFKIDFLIVVVKRLLIILTGMFRK

SEQ ID NO: 3294529 - protein, 18 aa, Plasmodium falciparum
QFLGEKYSLFGISGKYYK

SEQ ID NO: 3294530 - protein, 17 aa, Plasmodium falciparum
QFLLILGFIIQFLSGSI

SEQ ID NO: 3294531 - protein, 21 aa, Plasmodium falciparum
QFLLKRHRVKFILTLKGREYT

SEQ ID NO: 3294532 - protein, 28 aa, Plasmodium falciparum
QFLTKKMIFFLIKWIPMLVFSIILSCYY

SEQ ID NO: 3294533 - protein, 19 aa, Plasmodium falciparum
QFMQFLKKNVFFSYNKYYV

SEQ ID NO: 3294534 - protein, 28 aa, Plasmodium falciparum
QFNCNSFYLYLYNLLENTIKYITVKDVT

SEQ ID NO: 3294535 - protein, 20 aa, Plasmodium falciparum
QFNYWNVSFFDNIRFLLPTE

SEQ ID NO: 3294536 - protein, 30 aa, Plasmodium falciparum
QFPPVFYHIIFIIFFSLLITYVFYKIFIKY

SEQ ID NO: 3294537 - protein, 33 aa, Plasmodium falciparum
QFQKTFNNFFNFWVAHMLKDSIYWRTKKLVKCL

SEQ ID NO: 3294538 - protein, 38 aa, Plasmodium falciparum
QFVCFLYCFIILVPFFFILIIFLPWRHINYHTSKEKEE

SEQ ID NO: 3294539 - protein, 25 aa, Plasmodium falciparum
QGDIKLLQMQFFPEYYVVNKTYDIL

SEQ ID NO: 3294540 - protein, 25 aa, Plasmodium falciparum
QGEENHFWYYSPGIIARINKEWIKC

SEQ ID NO: 3294541 - protein, 30 aa, Plasmodium falciparum
QGEVYLFVKKIPIEVWIRQYNLMNDNDGEY

SEQ ID NO: 3294542 - protein, 20 aa, Plasmodium falciparum
QGFLFVLLLVPFHFKKRIVK

SEQ ID NO: 3294543 - protein, 24 aa, Plasmodium falciparum
QGFNKAFIELFENIEMKDINRFIE

SEQ ID NO: 3294544 - protein, 25 aa, Plasmodium falciparum
QGIKMRLFRMAMNKSFYLFRAISEN

SEQ ID NO: 3294545 - protein, 21 aa, Plasmodium falciparum
QGKIFITMDGIYFISLFNSLF

SEQ ID NO: 3294546 - protein, 18 aa, Plasmodium falciparum
QGLCKFIHLIKSVIFIIP

SEQ ID NO: 3294547 - protein, 18 aa, Plasmodium falciparum
QGLNYIYNNLRGDYLMLM

SEQ ID NO: 3294548 - protein, 25 aa, Plasmodium falciparum
QGMNFLVGLLLIISNFNELETFCVL

SEQ ID NO: 3294549 - protein, 18 aa, Plasmodium falciparum
QGMRYVDFMLSLKNILYN

SEQ ID NO: 3294550 - protein, 29 aa, Plasmodium falciparum
QGNMLPYNFFLFIKALHLMSIYDIIKNFY

SEQ ID NO: 3294551 - protein, 19 aa, Plasmodium falciparum
QGQYYFLNGKFKGYHTFCS

SEQ ID NO: 3294552 - protein, 23 aa, Plasmodium falciparum
QGRRKCYSWLYFSSYRSNNIIYK

SEQ ID NO: 3294553 - protein, 17 aa, Plasmodium falciparum
QGTYPIKLFYTSNIPII

SEQ ID NO: 3294554 - protein, 24 aa, Plasmodium falciparum
QHDNPFIDSLLINPEKIEKDDLDV

SEQ ID NO: 3294555 - protein, 27 aa, Plasmodium falciparum
QHDTFLRYFLFYTFQKKSTLFNIYPLL

SEQ ID NO: 3294556 - protein, 28 aa, Plasmodium falciparum
QHDYYKSFLFLFEQNFKILEHNIILLTS

SEQ ID NO: 3294557 - protein, 19 aa, Plasmodium falciparum
QHILNQFISTLFIDSYKNF

SEQ ID NO: 3294558 - protein, 26 aa, Plasmodium falciparum
QHISCLMFMFFFKDIFFLKKERDEKN

SEQ ID NO: 3294559 - protein, 20 aa, Plasmodium falciparum
QHIWNGMICALTYKEIEVKN

SEQ ID NO: 3294560 - protein, 37 aa, Plasmodium falciparum
QHKNNSIWLFYFVVENFLFIVTLNNSIFIYTIDFNMK

SEQ ID NO: 3294561 - protein, 33 aa, Plasmodium falciparum
QHMYEIFLDINFFSTSTFFILRTIELHLQLLKN

SEQ ID NO: 3294562 - protein, 22 aa, Plasmodium falciparum
QHNNEWIQVIKLHLHLIDECKK

SEQ ID NO: 3294563 - protein, 35 aa, Plasmodium falciparum
QHSSPLNIWYDYWKFDFWFPFSSIEYNLQPSFTIK

SEQ ID NO: 3294564 - protein, 18 aa, Plasmodium falciparum
QICALSILKLYLKNNLDV

SEQ ID NO: 3294565 - protein, 26 aa, Plasmodium falciparum
QIDEYVYILKHLFKKMWVENGDIIST

SEQ ID NO: 3294566 - protein, 17 aa, Plasmodium falciparum
QIDFMGMRIIAEPLIPL

SEQ ID NO: 3294567 - protein, 35 aa, Plasmodium falciparum
QIDYIGTCFGLTKGLLIFWQKNKFIPVFLKQQKNE

SEQ ID NO: 3294568 - protein, 17 aa, Plasmodium falciparum
QIFGYTGIYGWANYAAL

SEQ ID NO: 3294569 - protein, 53 aa, Plasmodium falciparum
QIFKKHFLCNNLFGCIYFLFNNEYYKYIIDKYFISLWINVLFSFFKKNIDVYV

SEQ ID NO: 3294570 - protein, 17 aa, Plasmodium falciparum
QIFNSFILILISNNFIL

SEQ ID NO: 3294571 - protein, 20 aa, Plasmodium falciparum
QIFYIFHVLASLKHTSVIFS

SEQ ID NO: 3294572 - protein, 25 aa, Plasmodium falciparum
QIGLKKLLPLIKNLQFCENSFFFLF

SEQ ID NO: 3294573 - protein, 19 aa, Plasmodium falciparum
QIIFQNNYIFFLSDFLFIN

SEQ ID NO: 3294574 - protein, 23 aa, Plasmodium falciparum
QIIIKLLKCIYFIPFTDYSLIEL

SEQ ID NO: 3294575 - protein, 23 aa, Plasmodium falciparum
QIINIAFTSLPVIFFVALDKQLP

SEQ ID NO: 3294576 - protein, 18 aa, Plasmodium falciparum
QIITIRGLVTHWVQNFLD

SEQ ID NO: 3294577 - protein, 24 aa, Plasmodium falciparum
QIITLYFPFIIKKNNKVTYITNLN

SEQ ID NO: 3294578 - protein, 19 aa, Plasmodium falciparum
QIKFSFIVKSIFQNSKLQL

SEQ ID NO: 3294579 - protein, 42 aa, Plasmodium falciparum
QIKKIINILCIVLIIILGYYFVTLKLLYLKSICLYISLIIDS

SEQ ID NO: 3294580 - protein, 25 aa, Plasmodium falciparum
QIKLLELAIFLIRSCTCKEYKIIVK

SEQ ID NO: 3294581 - protein, 24 aa, Plasmodium falciparum
QIKRELNHLLYQRGYYNLKEAIGR

SEQ ID NO: 3294582 - protein, 25 aa, Plasmodium falciparum
QILIKDLFLLFKKIFFIEVDENLIY

SEQ ID NO: 3294583 - protein, 42 aa, Plasmodium falciparum
QILSIICLYNEPIYFRYLLNFLIFFVCEYINRIILYKSKENN

SEQ ID NO: 3294584 - protein, 26 aa, Plasmodium falciparum
QILTKLNYLLILKRLLNNIIPNDRTI

SEQ ID NO: 3294585 - protein, 29 aa, Plasmodium falciparum
QILWIETCLFLLYQNGIILVYTPVLTKRC

SEQ ID NO: 3294586 - protein, 17 aa, Plasmodium falciparum
QILWNIYKFRKYLQYLT

SEQ ID NO: 3294587 - protein, 21 aa, Plasmodium falciparum
QIMFMILVCALILLIGVYKYK

SEQ ID NO: 3294588 - protein, 17 aa, Plasmodium falciparum
QINCKFYRLITECIKKA

SEQ ID NO: 3294589 - protein, 25 aa, Plasmodium falciparum
QINEKIINYPIFKKSFHFYVSIQTL

SEQ ID NO: 3294590 - protein, 29 aa, Plasmodium falciparum
QINIFFDLVFLFYLYDYSVNLFFISLFIY

SEQ ID NO: 3294591 - protein, 29 aa, Plasmodium falciparum
QINISILFNFLFFLLSKYTKNKKKKKNYI

SEQ ID NO: 3294592 - protein, 27 aa, Plasmodium falciparum
QINKILTNILFFLFNELDHNLRLNNIY

SEQ ID NO: 3294593 - protein, 30 aa, Plasmodium falciparum
QINKKQFFLFLICFYINQALYYWSNDGDAI

SEQ ID NO: 3294594 - protein, 20 aa, Plasmodium falciparum
QINRWILEWGKYNCRLMKEK

SEQ ID NO: 3294595 - protein, 29 aa, Plasmodium falciparum
QINTNPITFLIFTNLYRKVPNNYLTFFKK

SEQ ID NO: 3294596 - protein, 20 aa, Plasmodium falciparum
QIPSFLEDTAYRYKGLNPEC

SEQ ID NO: 3294597 - protein, 24 aa, Plasmodium falciparum
QIQCLQFYIHKYPSFLKDKIKAFI

SEQ ID NO: 3294598 - protein, 17 aa, Plasmodium falciparum
QIQLNDSWGGKGLLGCN

SEQ ID NO: 3294599 - protein, 20 aa, Plasmodium falciparum
QIRALVTHWVQYFLEDYNRI

SEQ ID NO: 3294600 - protein, 19 aa, Plasmodium falciparum
QIREYWWEANRETVWKAIT

SEQ ID NO: 3294601 - protein, 23 aa, Plasmodium falciparum
QIRIYALLPIFVIVVLVCIIKSN

SEQ ID NO: 3294602 - protein, 33 aa, Plasmodium falciparum
QIRKKYPTIYNYPYFPFFINKSNIIKIKYDIDQ

SEQ ID NO: 3294603 - protein, 25 aa, Plasmodium falciparum
QISAFNLYLNYYYFMKRYSSYGTKK

SEQ ID NO: 3294604 - protein, 25 aa, Plasmodium falciparum
QISAFNLYLNYYYFMKRYSSYGVKK

SEQ ID NO: 3294605 - protein, 28 aa, Plasmodium falciparum
QISYFYYHYFVYILLPKLNYLNSSEKNE

SEQ ID NO: 3294606 - protein, 18 aa, Plasmodium falciparum
QISYILKKNIFPLSLVHI

SEQ ID NO: 3294607 - protein, 19 aa, Plasmodium falciparum
QITFLKFVVMPLFEELSHI

SEQ ID NO: 3294608 - protein, 23 aa, Plasmodium falciparum
QITPLQYFLFQECTLMNSLTSVM

SEQ ID NO: 3294609 - protein, 26 aa, Plasmodium falciparum
QIVNHLFTKFPFLKEEEKSLFHIIMR

SEQ ID NO: 3294610 - protein, 25 aa, Plasmodium falciparum
QIVNINYYLYYKMNLCIHTLKYVHV

SEQ ID NO: 3294611 - protein, 21 aa, Plasmodium falciparum
QIYIDFFMRFPLSQKEKKKKF

SEQ ID NO: 3294612 - protein, 20 aa, Plasmodium falciparum
QIYIDNLFFILIGFSQNELI

SEQ ID NO: 3294613 - protein, 17 aa, Plasmodium falciparum
QIYINIILKNILLYNCE

SEQ ID NO: 3294614 - protein, 36 aa, Plasmodium falciparum
QIYIYTVNGSFIFVSPLFRVPRNFTLFKKVMLNLLK

SEQ ID NO: 3294615 - protein, 21 aa, Plasmodium falciparum
QIYKFKLYNYIMKLLHKERIN

SEQ ID NO: 3294616 - protein, 21 aa, Plasmodium falciparum
QKALQILLRLSHRGGVQGNNG

SEQ ID NO: 3294617 - protein, 31 aa, Plasmodium falciparum
QKALYSFYLSLFVHPYFKQRFAFKLAKHYKL

SEQ ID NO: 3294618 - protein, 35 aa, Plasmodium falciparum
QKAMKLLTYNILLKQWYFFYFKKFQKKNHLFNIIF

SEQ ID NO: 3294619 - protein, 23 aa, Plasmodium falciparum
QKCEKPCDCFQRWVQQKETEWGK

SEQ ID NO: 3294620 - protein, 29 aa, Plasmodium falciparum
QKDTKILKNYLFKGVLYISPFDTNKCFVI

SEQ ID NO: 3294621 - protein, 26 aa, Plasmodium falciparum
QKEAKVMKALLFLEAVKKYNVVIATC

SEQ ID NO: 3294622 - protein, 41 aa, Plasmodium falciparum
QKELNELFNFFFFHIYTLIQGSIYRIFKNINLLIINSASCN

SEQ ID NO: 3294623 - protein, 30 aa, Plasmodium falciparum
QKENIHFLYYVLCSMLITTIPLLYPFMDIL

SEQ ID NO: 3294624 - protein, 20 aa, Plasmodium falciparum
QKFDHIFISILYKFHMLKEE

SEQ ID NO: 3294625 - protein, 19 aa, Plasmodium falciparum
QKGLLLYNNILRNYISMCK

SEQ ID NO: 3294626 - protein, 46 aa, Plasmodium falciparum
QKHEKILTLDIFYKNISYSLYFLIFINLLTQLWEKLSFDIKKMNAN

SEQ ID NO: 3294627 - protein, 23 aa, Plasmodium falciparum
QKHILCIIRCITKCMMNVPLVSK

SEQ ID NO: 3294628 - protein, 28 aa, Plasmodium falciparum
QKHKGKLRHFFSILLKSLVIPIAVQFIR

SEQ ID NO: 3294629 - protein, 23 aa, Plasmodium falciparum
QKIDYFIKMYPLFIENVDHLKKI

SEQ ID NO: 3294630 - protein, 25 aa, Plasmodium falciparum
QKIKGYYYYPFMKNIKKFIYEDRNC

SEQ ID NO: 3294631 - protein, 23 aa, Plasmodium falciparum
QKINIFETYIFSNILLVGGCSNI

SEQ ID NO: 3294632 - protein, 25 aa, Plasmodium falciparum
QKINNKYFYYLLSKQYQNANSKDNK

SEQ ID NO: 3294633 - protein, 25 aa, Plasmodium falciparum
QKINYPIYYNLYYTKDYFIDTTYIY

SEQ ID NO: 3294634 - protein, 26 aa, Plasmodium falciparum
QKIRTNAILCLKYLFECKQIKYIFML

SEQ ID NO: 3294635 - protein, 35 aa, Plasmodium falciparum
QKIRYNYVIPKTFLEYIYFYKNLLNVKNFEIEKSV

SEQ ID NO: 3294636 - protein, 27 aa, Plasmodium falciparum
QKISTFVSKLFFYKIHNLNLTYILSKK

SEQ ID NO: 3294637 - protein, 28 aa, Plasmodium falciparum
QKIYFYYSIHFFISILLLPIMIYPYYYN

SEQ ID NO: 3294638 - protein, 24 aa, Plasmodium falciparum
QKKDFYMHFIKTSPPFHFQNYNVH

SEQ ID NO: 3294639 - protein, 21 aa, Plasmodium falciparum
QKKDIVECLLDRLKKKATSCP

SEQ ID NO: 3294640 - protein, 17 aa, Plasmodium falciparum
QKKFLSLSLKRHLNRNM

SEQ ID NO: 3294641 - protein, 23 aa, Plasmodium falciparum
QKKHYTYSVPRWVNSYLTHQHFS

SEQ ID NO: 3294642 - protein, 20 aa, Plasmodium falciparum
QKKIIYLLETYEKLIHIDIG

SEQ ID NO: 3294643 - protein, 25 aa, Plasmodium falciparum
QKKKKKFFLLWKNNFFIKKMKKKKK

SEQ ID NO: 3294644 - protein, 24 aa, Plasmodium falciparum
QKKKLYFNLIFTQEGIYNINKFHV

SEQ ID NO: 3294645 - protein, 32 aa, Plasmodium falciparum
QKKKNIYIFTLIRFYYIFKTFYRNKKLLYNII

SEQ ID NO: 3294646 - protein, 23 aa, Plasmodium falciparum
QKKMKCNLNFRSVLGFLSMCPFN

SEQ ID NO: 3294647 - protein, 32 aa, Plasmodium falciparum
QKKNDLLFYTNYLCFIYKFIIILNNMNSTHKF

SEQ ID NO: 3294648 - protein, 42 aa, Plasmodium falciparum
QKKNHLFNIIFNLKLYKNISYYYLLPWAYKINAILKMIHMKQ

SEQ ID NO: 3294649 - protein, 24 aa, Plasmodium falciparum
QKKQYFIFSYIQLVVKGYLLLREK

SEQ ID NO: 3294650 - protein, 22 aa, Plasmodium falciparum
QKKRKYIFFTSNKYFVHNHTKI

SEQ ID NO: 3294651 - protein, 18 aa, Plasmodium falciparum
QKKRVIGTGFKFVKTLIK

SEQ ID NO: 3294652 - protein, 24 aa, Plasmodium falciparum
QKLLKKINYILFMSRNNTLKSAEC

SEQ ID NO: 3294653 - protein, 35 aa, Plasmodium falciparum
QKNEEKLFELYYIYIYIILHIINFYNDSFVDLKYY

SEQ ID NO: 3294654 - protein, 17 aa, Plasmodium falciparum
QKNFYLVSFGNKKLKLY

SEQ ID NO: 3294655 - protein, 26 aa, Plasmodium falciparum
QKNKNLLLFLKKLFPFEFHNFEKKYN

SEQ ID NO: 3294656 - protein, 30 aa, Plasmodium falciparum
QKNLPMDHVLILKFVLKLEDLFNNIKSGYG

SEQ ID NO: 3294657 - protein, 30 aa, Plasmodium falciparum
QKNNNILKLLNYPFVIPNNCEILGIAEIPF

SEQ ID NO: 3294658 - protein, 28 aa, Plasmodium falciparum
QKNRKSFLFFFFLYNKYFFGKQEQIRKM

SEQ ID NO: 3294659 - protein, 37 aa, Plasmodium falciparum
QKPFDEIINMCLYLLYLYYLCNVLYKCVRINNVLKGD

SEQ ID NO: 3294660 - protein, 25 aa, Plasmodium falciparum
QKQKIIWRQWISKHLYYINEDMVTK

SEQ ID NO: 3294661 - protein, 25 aa, Plasmodium falciparum
QKQSLGIYYEKLENLFKSNFFQVMK

SEQ ID NO: 3294662 - protein, 24 aa, Plasmodium falciparum
QKRFNTIILFRASGGFRLLSINES

SEQ ID NO: 3294663 - protein, 38 aa, Plasmodium falciparum
QKRHLMNRLIYFLFNYFIMPLIRRFFFLTKSEQTLHKT

SEQ ID NO: 3294664 - protein, 41 aa, Plasmodium falciparum
QKRKKKYLNFFVILLSLFLKKYLYKQMSKFFFIVGSLRQKY

SEQ ID NO: 3294665 - protein, 36 aa, Plasmodium falciparum
QKRQLPTHTSILPEMLSISSFPLTVGVAFAALSYFL

SEQ ID NO: 3294666 - protein, 19 aa, Plasmodium falciparum
QKRVFYKLNVETVLSSCWF

SEQ ID NO: 3294667 - protein, 23 aa, Plasmodium falciparum
QKSKLLFYVFYKKKRKKSIYPFN

SEQ ID NO: 3294668 - protein, 29 aa, Plasmodium falciparum
QKSQSAHFPLQLPYVLFGLGRTSNYVEEF

SEQ ID NO: 3294669 - protein, 27 aa, Plasmodium falciparum
QKTDKKIFTFIENKLDILNNSKFNKRW

SEQ ID NO: 3294670 - protein, 50 aa, Plasmodium falciparum
QKVNDYFIQVYFLVLKYYNNLKHLIIIKITYFLDLLERCTKIIRGQESNH

SEQ ID NO: 3294671 - protein, 28 aa, Plasmodium falciparum
QKVTSYNAFFWKWVHDMLHDSVEWRERL

SEQ ID NO: 3294672 - protein, 20 aa, Plasmodium falciparum
QKWINTFPFYIIYQNDHFKL

SEQ ID NO: 3294673 - protein, 20 aa, Plasmodium falciparum
QKWKSYPFYFQATGGMRNLK

SEQ ID NO: 3294674 - protein, 19 aa, Plasmodium falciparum
QKWLFDGLSYLKFFKEIEK

SEQ ID NO: 3294675 - protein, 19 aa, Plasmodium falciparum
QKYAFMQPPKGYEKACSCE

SEQ ID NO: 3294676 - protein, 29 aa, Plasmodium falciparum
QKYFSCFNFLGIFEWPYLLKCVLKSQDEY

SEQ ID NO: 3294677 - protein, 19 aa, Plasmodium falciparum
QKYFYYIFNIKEKYFLILS

SEQ ID NO: 3294678 - protein, 34 aa, Plasmodium falciparum
QKYLNSIKKMYNEALLGLQPKLPSIDEKISEDVI

SEQ ID NO: 3294679 - protein, 21 aa, Plasmodium falciparum
QKYLNYYFPFLNDPDVIIDTI

SEQ ID NO: 3294680 - protein, 17 aa, Plasmodium falciparum
QLAFTYDLFETFDPQYL

SEQ ID NO: 3294681 - protein, 26 aa, Plasmodium falciparum
QLEKEVLLLKKKITLIQLNDVLIEEG

SEQ ID NO: 3294682 - protein, 19 aa, Plasmodium falciparum
QLFGSLFINSIANPSEFLS

SEQ ID NO: 3294683 - protein, 36 aa, Plasmodium falciparum
QLFLFNKFHIVLSYIFRILYYIYVYINNQLIITKKK

SEQ ID NO: 3294684 - protein, 22 aa, Plasmodium falciparum
QLFNYIIIYILRNCTTFHIYHD

SEQ ID NO: 3294685 - protein, 23 aa, Plasmodium falciparum
QLGLGFLINLFFSGYLVAKIPFP

SEQ ID NO: 3294686 - protein, 28 aa, Plasmodium falciparum
QLIYKNFYSIFLHYYYRYSEVKMIKLNK

SEQ ID NO: 3294687 - protein, 19 aa, Plasmodium falciparum
QLKDDFISQYLPNTEPNNN

SEQ ID NO: 3294688 - protein, 32 aa, Plasmodium falciparum
QLKEGTIPHGFLRQMFYTLGDYRDILVGKYVD

SEQ ID NO: 3294689 - protein, 22 aa, Plasmodium falciparum
QLKIIYNYIVNPKIQILCYSST

SEQ ID NO: 3294690 - protein, 38 aa, Plasmodium falciparum
QLKLFQVCHIFNLFFRFQNYLMLSFNDPALDIVNFFYT

SEQ ID NO: 3294691 - protein, 21 aa, Plasmodium falciparum
QLKLNMQIPCMTHFDKYGIIE

SEQ ID NO: 3294692 - protein, 33 aa, Plasmodium falciparum
QLKSGIIPNDFLRLMFYTLADYKDILFSGSKDD

SEQ ID NO: 3294693 - protein, 33 aa, Plasmodium falciparum
QLKYSTYMSIAPMPFFRTTVMEILPYIVIINNT

SEQ ID NO: 3294694 - protein, 19 aa, Plasmodium falciparum
QLLDIMLLYSLHKNVYMLD

SEQ ID NO: 3294695 - protein, 20 aa, Plasmodium falciparum
QLLQIKSRKKLLPSFNVFEI

SEQ ID NO: 3294696 - protein, 34 aa, Plasmodium falciparum
QLLRDAFIQSAAIETFFLWHKYKAENTRDNKSPL

SEQ ID NO: 3294697 - protein, 33 aa, Plasmodium falciparum
QLLRQAFIESAAVETFFLWHKYKVDKEKEDKEK

SEQ ID NO: 3294698 - protein, 32 aa, Plasmodium falciparum
QLMDPLRDYERKLFWLFLYNRKRCINDVSYEN

SEQ ID NO: 3294699 - protein, 25 aa, Plasmodium falciparum
QLNNLELAILIKKKSYEFIFEITKY

SEQ ID NO: 3294700 - protein, 34 aa, Plasmodium falciparum
QLQFSHFFLYPLMDIYNLFLFLNDIKLCNSHNKF

SEQ ID NO: 3294701 - protein, 19 aa, Plasmodium falciparum
QLQLVHFIRYILPLYEKNI

SEQ ID NO: 3294702 - protein, 19 aa, Plasmodium falciparum
QLRKLLLSGNNINSSLYSS

SEQ ID NO: 3294703 - protein, 25 aa, Plasmodium falciparum
QLSENVWKIFKLALSPKWMNNEDFK

SEQ ID NO: 3294704 - protein, 24 aa, Plasmodium falciparum
QLSHLIHFLFILTSISQLFLFNKF

SEQ ID NO: 3294705 - protein, 24 aa, Plasmodium falciparum
QLSKIIFVICVTVWIINFKHFSDP

SEQ ID NO: 3294706 - protein, 26 aa, Plasmodium falciparum
QLSKNIYIPFIYKTYKILLQIFDRKC

SEQ ID NO: 3294707 - protein, 43 aa, Plasmodium falciparum
QLSKRNYIYLQKKLYTIKNILISKILLIYIMKYIFGHIDNNIL

SEQ ID NO: 3294708 - protein, 18 aa, Plasmodium falciparum
QLSLSYVYSRPFVGSSII

SEQ ID NO: 3294709 - protein, 25 aa, Plasmodium falciparum
QLYEEIFLIIEKFLDISHLKYHNNF

SEQ ID NO: 3294710 - protein, 32 aa, Plasmodium falciparum
QLYFIGSYSILKWFKNIDFPLLYSGNIGLSYL

SEQ ID NO: 3294711 - protein, 18 aa, Plasmodium falciparum
QLYNLEWFNKFNLHHLYN

SEQ ID NO: 3294712 - protein, 26 aa, Plasmodium falciparum
QLYVGWIFIFIYWISGMKKIPKIYSY

SEQ ID NO: 3294713 - protein, 29 aa, Plasmodium falciparum
QMDKDKIKHIYMKKFLFDKERLINRRSDE

SEQ ID NO: 3294714 - protein, 35 aa, Plasmodium falciparum
QMENIYFWTSLFPILYINFIFDKLMKYIKNRIYPD

SEQ ID NO: 3294715 - protein, 33 aa, Plasmodium falciparum
QMFFHIMCYKINYTYILYNILCKLKLKSYRTRN

SEQ ID NO: 3294716 - protein, 21 aa, Plasmodium falciparum
QMKYYGIRHSLNKFYKNLNQK

SEQ ID NO: 3294717 - protein, 22 aa, Plasmodium falciparum
QMNYIIYHFFITLHVVHYIKNN

SEQ ID NO: 3294718 - protein, 29 aa, Plasmodium falciparum
QMVYKVLLLLNIYLIFSIKGILIYMNIYY

SEQ ID NO: 3294719 - protein, 27 aa, Plasmodium falciparum
QNAKCLKKIFFLKKELFDMAKNINNIK

SEQ ID NO: 3294720 - protein, 35 aa, Plasmodium falciparum
QNAMLSNTIMWTIGIGFAAISYFFLKKKTKSTIDL

SEQ ID NO: 3294721 - protein, 18 aa, Plasmodium falciparum
QNCKDKFYALKKIKFHAN

SEQ ID NO: 3294722 - protein, 24 aa, Plasmodium falciparum
QNCNHPLIYTLINNIKHICNYEYV

SEQ ID NO: 3294723 - protein, 20 aa, Plasmodium falciparum
QNCNTHFFYLLKNYNESLLF

SEQ ID NO: 3294724 - protein, 21 aa, Plasmodium falciparum
QNCNYLNLIDLFIFEHINYDD

SEQ ID NO: 3294725 - protein, 30 aa, Plasmodium falciparum
QNDDQFLYKVLYYFNLFIYLEINITTYNMR

SEQ ID NO: 3294726 - protein, 26 aa, Plasmodium falciparum
QNDEKKMVFYDLYKPEENESYYEKKQ

SEQ ID NO: 3294727 - protein, 21 aa, Plasmodium falciparum
QNDFILFEKLFNTINNLMPPF

SEQ ID NO: 3294728 - protein, 29 aa, Plasmodium falciparum
QNDGLQYILVFIFLLYKIIRMNIEKNNTN

SEQ ID NO: 3294729 - protein, 23 aa, Plasmodium falciparum
QNEDILYYLFNSINMEYFKLGKE

SEQ ID NO: 3294730 - protein, 17 aa, Plasmodium falciparum
QNEFSFRNGLYFSPTTV

SEQ ID NO: 3294731 - protein, 20 aa, Plasmodium falciparum
QNEILFRRYFQKNDIYVHAD

SEQ ID NO: 3294732 - protein, 19 aa, Plasmodium falciparum
QNEKLVLIKSYLNDIKNIM

SEQ ID NO: 3294733 - protein, 25 aa, Plasmodium falciparum
QNELKYCDIIYLNYIIKKKCLNKYG

SEQ ID NO: 3294734 - protein, 21 aa, Plasmodium falciparum
QNFPVDSLLLILKQAYIGKEF

SEQ ID NO: 3294735 - protein, 30 aa, Plasmodium falciparum
QNGDGNQILLFNALLKRWVEYFLEDYKKIK

SEQ ID NO: 3294736 - protein, 28 aa, Plasmodium falciparum
QNGKEYIQIRALLKRWVEYFLEDYNKIK

SEQ ID NO: 3294737 - protein, 24 aa, Plasmodium falciparum
QNGLKYLFFYMKNSHKFNLIIDCK

SEQ ID NO: 3294738 - protein, 32 aa, Plasmodium falciparum
QNHKNDFFFLVSLLNKPFFLNISTLYKEFNNK

SEQ ID NO: 3294739 - protein, 26 aa, Plasmodium falciparum
QNIEKIILCFYDTLEYLNLYTCTHIL

SEQ ID NO: 3294740 - protein, 23 aa, Plasmodium falciparum
QNIIHDILLCFKFMNFYSSNENL

SEQ ID NO: 3294741 - protein, 54 aa, Plasmodium falciparum
QNILDILNNSILYKKLLSKILVENQFYKYIISIRDWLFEIIKSKSYSNSNNNNN

SEQ ID NO: 3294742 - protein, 25 aa, Plasmodium falciparum
QNINIQIICCIILSLLIINKTIKDD

SEQ ID NO: 3294743 - protein, 22 aa, Plasmodium falciparum
QNISFLNFLSFDWIRPLINDLI

SEQ ID NO: 3294744 - protein, 26 aa, Plasmodium falciparum
QNKAYVFLIEKILFKLYQLLEHDDFI

SEQ ID NO: 3294745 - protein, 28 aa, Plasmodium falciparum
QNKCPFTNIPLPPIKKKFLGFYITDGSD

SEQ ID NO: 3294746 - protein, 24 aa, Plasmodium falciparum
QNKLRNFMRMLKLNDINNINNMDN

SEQ ID NO: 3294747 - protein, 24 aa, Plasmodium falciparum
QNKQWNIFMYIKNKLINNIYGKEN

SEQ ID NO: 3294748 - protein, 23 aa, Plasmodium falciparum
QNKRIIWNIIFDALRKKFISDVK

SEQ ID NO: 3294749 - protein, 25 aa, Plasmodium falciparum
QNKTNIFDVFLFLKNIGYKNVQKSF

SEQ ID NO: 3294750 - protein, 31 aa, Plasmodium falciparum
QNKYLKYLFIPIILLYYNNIYISYKCIKKIL

SEQ ID NO: 3294751 - protein, 34 aa, Plasmodium falciparum
QNLEHFHNILKILFFWNFELYKNFRKNKIYLNCF

SEQ ID NO: 3294752 - protein, 32 aa, Plasmodium falciparum
QNLKDDIYFFSYYPFYLWPVELMNFIHNFLLS

SEQ ID NO: 3294753 - protein, 24 aa, Plasmodium falciparum
QNMSYYYSLIFLNTDRKSLLTYFN

SEQ ID NO: 3294754 - protein, 23 aa, Plasmodium falciparum
QNNIIFVKFFLYTQNLLQIIFQN

SEQ ID NO: 3294755 - protein, 26 aa, Plasmodium falciparum
QNNNKYILLFLEKCIEFFIDLLSQLY

SEQ ID NO: 3294756 - protein, 23 aa, Plasmodium falciparum
QNNPFFLGSYKKENDIIPCDNNI

SEQ ID NO: 3294757 - protein, 22 aa, Plasmodium falciparum
QNNYIFFLSDFLFINYKKKEYI

SEQ ID NO: 3294758 - protein, 47 aa, Plasmodium falciparum
QNPWEHPIVIPSLATSTLMWTVGIGFATFTYFFLKKKTKSSVGNLFQ

SEQ ID NO: 3294759 - protein, 20 aa, Plasmodium falciparum
QNQLFKINLYLWKDIKKLKN

SEQ ID NO: 3294760 - protein, 22 aa, Plasmodium falciparum
QNQLFKINLYLWKDIKKLKNIY

SEQ ID NO: 3294761 - protein, 25 aa, Plasmodium falciparum
QNRLFIGMILILVFSETLALYGLII

SEQ ID NO: 3294762 - protein, 26 aa, Plasmodium falciparum
QNRPYPKYILYNYITKNRNSYVMFDC

SEQ ID NO: 3294763 - protein, 32 aa, Plasmodium falciparum
QNSRKNICLLKIKSLEELFLYCFEINKNDYMC

SEQ ID NO: 3294764 - protein, 17 aa, Plasmodium falciparum
QNSWLFMGNIRSMILFG

SEQ ID NO: 3294765 - protein, 26 aa, Plasmodium falciparum
QNTLKIFPLFLLDSSTHNLPIVHLLL

SEQ ID NO: 3294766 - protein, 20 aa, Plasmodium falciparum
QNTLLYILCSFQNLFMCISL

SEQ ID NO: 3294767 - protein, 25 aa, Plasmodium falciparum
QNVDEFRLLYELILIEEINEKIKNQ

SEQ ID NO: 3294768 - protein, 25 aa, Plasmodium falciparum
QNVSKRWQFFIPHINKEGLYNIMDK

SEQ ID NO: 3294769 - protein, 25 aa, Plasmodium falciparum
QNYHQLYLIVPYISLIIINICKILT

SEQ ID NO: 3294770 - protein, 25 aa, Plasmodium falciparum
QNYKSIEFFIFLNNLKKIKQLYLDQ

SEQ ID NO: 3294771 - protein, 18 aa, Plasmodium falciparum
QNYMQYYSLFDLSNFTFR

SEQ ID NO: 3294772 - protein, 38 aa, Plasmodium falciparum
QPCGIAALVLLILAVVLIILYIWLYRRRKNSWKHECKK

SEQ ID NO: 3294773 - protein, 19 aa, Plasmodium falciparum
QPKRYKNFLIYFNQNYIKK

SEQ ID NO: 3294774 - protein, 31 aa, Plasmodium falciparum
QPKSFLRKYWFIILIFFLSFSFSKHLTENEP

SEQ ID NO: 3294775 - protein, 26 aa, Plasmodium falciparum
QQEFEDYYKNFLPYVSDNKNMILRRD

SEQ ID NO: 3294776 - protein, 20 aa, Plasmodium falciparum
QQEKLYLENNLKKIFAKIHE

SEQ ID NO: 3294777 - protein, 24 aa, Plasmodium falciparum
QQELLRIQKMKAPNDKLIMILNCC

SEQ ID NO: 3294778 - protein, 26 aa, Plasmodium falciparum
QQIKYASFVLVNLALITLISSIFSIN

SEQ ID NO: 3294779 - protein, 18 aa, Plasmodium falciparum
QQITPYGPSGQIVHYGPY

SEQ ID NO: 3294780 - protein, 21 aa, Plasmodium falciparum
QQKILYRIYYINMFNKKGTKS

SEQ ID NO: 3294781 - protein, 20 aa, Plasmodium falciparum
QQLCLYELFPIIIKNKNDIT

SEQ ID NO: 3294782 - protein, 28 aa, Plasmodium falciparum
QQLPYTYNGYFYILSLPVRPQFEIINAT

SEQ ID NO: 3294783 - protein, 32 aa, Plasmodium falciparum
QQQYLYYCIPYICFIKKYILFCAYVSKEKDLI

SEQ ID NO: 3294784 - protein, 31 aa, Plasmodium falciparum
QQRFSWFLAVVTLLIFIYFLYFKIFHFSLFS

SEQ ID NO: 3294785 - protein, 29 aa, Plasmodium falciparum
QRCFYMFIFCIFVLLLYNYYYVYLYFHLF

SEQ ID NO: 3294786 - protein, 20 aa, Plasmodium falciparum
QRFRQGMFQILIATDIASRG

SEQ ID NO: 3294787 - protein, 17 aa, Plasmodium falciparum
QRILLDSYNRAKNVLNQ

SEQ ID NO: 3294788 - protein, 27 aa, Plasmodium falciparum
QRILLEEIFIFLFIKTIDLLEDNQLWY

SEQ ID NO: 3294789 - protein, 20 aa, Plasmodium falciparum
QRIMNCKFIILNYNKQLGSK

SEQ ID NO: 3294790 - protein, 42 aa, Plasmodium falciparum
QRKGIRNKCVLYKYTDLLLFLFLIFILFQDIYSHNEFTKVDA

SEQ ID NO: 3294791 - protein, 35 aa, Plasmodium falciparum
QRKKYLKIFLCISLCILFFLIGYAFIMYNGSVDGR

SEQ ID NO: 3294792 - protein, 23 aa, Plasmodium falciparum
QRKREVVLALLLRERIQPYVDNN

SEQ ID NO: 3294793 - protein, 19 aa, Plasmodium falciparum
QRKTCFNIALYYCFLKLLN

SEQ ID NO: 3294794 - protein, 31 aa, Plasmodium falciparum
QRLLFHEVINLFVFYVYKFCNWDVLKNYFDI

SEQ ID NO: 3294795 - protein, 27 aa, Plasmodium falciparum
QRMSFPFFLFLLVNVLINDLFIIFLRM

SEQ ID NO: 3294796 - protein, 23 aa, Plasmodium falciparum
QRMSNIHFSIWTYPDILGNSTNQ

SEQ ID NO: 3294797 - protein, 19 aa, Plasmodium falciparum
QRQKIIWKKWIAKHPNKMN

SEQ ID NO: 3294798 - protein, 24 aa, Plasmodium falciparum
QRQYEIIIKPSENITSFVKSHVIK

SEQ ID NO: 3294799 - protein, 21 aa, Plasmodium falciparum
QRSFLFYFINHIKGLLKNNIR

SEQ ID NO: 3294800 - protein, 21 aa, Plasmodium falciparum
QRSVIQCFKLLKRKLFSIDDK

SEQ ID NO: 3294801 - protein, 18 aa, Plasmodium falciparum
QRYFFRCTSELSNFLKRS

SEQ ID NO: 3294802 - protein, 22 aa, Plasmodium falciparum
QRYIKRLKKYQKKKLYFNLIFT

SEQ ID NO: 3294803 - protein, 22 aa, Plasmodium falciparum
QSAMKCVFSVGLFASIGPYLFA

SEQ ID NO: 3294804 - protein, 30 aa, Plasmodium falciparum
QSAQLFINSFAYWFGSFLIKRGTILVDDFM

SEQ ID NO: 3294805 - protein, 27 aa, Plasmodium falciparum
QSDIFIIDQYPIFLRPYYTGSNMYDLR

SEQ ID NO: 3294806 - protein, 17 aa, Plasmodium falciparum
QSDIWYRWVERHAHMLE

SEQ ID NO: 3294807 - protein, 18 aa, Plasmodium falciparum
QSDIWYRWVERHAHMLEK

SEQ ID NO: 3294808 - protein, 19 aa, Plasmodium falciparum
QSDIWYRWVERHAHMLEKW

SEQ ID NO: 3294809 - protein, 20 aa, Plasmodium falciparum
QSDLINIRKLYKNMLHHPLF

SEQ ID NO: 3294810 - protein, 22 aa, Plasmodium falciparum
QSESYHYLYNPSFIKRSKTNNE

SEQ ID NO: 3294811 - protein, 19 aa, Plasmodium falciparum
QSFFYGWPPSSETYLFFYF

SEQ ID NO: 3294812 - protein, 23 aa, Plasmodium falciparum
QSFNLSYVLFLYVNYLKNNKNGI

SEQ ID NO: 3294813 - protein, 25 aa, Plasmodium falciparum
QSHIKYVMLILFPAIIWTTRYRADT

SEQ ID NO: 3294814 - protein, 31 aa, Plasmodium falciparum
QSHKNQIVKILFFLCKILLSIHLEEVKISIL

SEQ ID NO: 3294815 - protein, 26 aa, Plasmodium falciparum
QSHNIFLPLAYLFYNIYKIKCFYNTS

SEQ ID NO: 3294816 - protein, 17 aa, Plasmodium falciparum
QSILKYENYYYPYFSFL

SEQ ID NO: 3294817 - protein, 26 aa, Plasmodium falciparum
QSIPIIALMYLFKYIEEVKLNELNFK

SEQ ID NO: 3294818 - protein, 26 aa, Plasmodium falciparum
QSLLDFYTIHNYFPFILDRNINKKLN

SEQ ID NO: 3294819 - protein, 21 aa, Plasmodium falciparum
QSLLLVGFYESFETPLFSSIL

SEQ ID NO: 3294820 - protein, 18 aa, Plasmodium falciparum
QSLWDRIAEHVWHGMVCA

SEQ ID NO: 3294821 - protein, 17 aa, Plasmodium falciparum
QSMIHWFSIINSIILVI

SEQ ID NO: 3294822 - protein, 34 aa, Plasmodium falciparum
QSNIIPSLYFKYIPNILHIFQFFDISQSFHIARY

SEQ ID NO: 3294823 - protein, 22 aa, Plasmodium falciparum
QSSRLFWTRLLFGRTRSRITGR

SEQ ID NO: 3294824 - protein, 30 aa, Plasmodium falciparum
QSVAIFHALVKYIVYNFSLKIKPFFRSLNF

SEQ ID NO: 3294825 - protein, 25 aa, Plasmodium falciparum
QSVDIKCFKTWFNNINYNNSFNHIL

SEQ ID NO: 3294826 - protein, 20 aa, Plasmodium falciparum
QSYILILKGFMNILYQTKEK

SEQ ID NO: 3294827 - protein, 30 aa, Plasmodium falciparum
QSYKIKINFLVLMFLLLYSSKQIDDNTYCY

SEQ ID NO: 3294828 - protein, 25 aa, Plasmodium falciparum
QTDTPLPLESFPPPFCNVPPNPCGD

SEQ ID NO: 3294829 - protein, 26 aa, Plasmodium falciparum
QTEFFKVFFFVYLEEVYYTIKKKKNY

SEQ ID NO: 3294830 - protein, 36 aa, Plasmodium falciparum
QTFAYNLLMFLLNTIILEILKYLLLSIDQMPLLLQN

SEQ ID NO: 3294831 - protein, 41 aa, Plasmodium falciparum
QTILSLLCTLLVNFFFLYSIIFYFLPINNLPSSYQANSSAP

SEQ ID NO: 3294832 - protein, 37 aa, Plasmodium falciparum
QTINYSVFKLDIWSLGILLFIMTQGFAPFKYMEKELK

SEQ ID NO: 3294833 - protein, 26 aa, Plasmodium falciparum
QTKIDYIVFCLLFITSLFSIYFCSKG

SEQ ID NO: 3294834 - protein, 23 aa, Plasmodium falciparum
QTKNNYFFFISLSNSHDVTKFMD

SEQ ID NO: 3294835 - protein, 23 aa, Plasmodium falciparum
QTNDWILIMVFDGHGPSGHDISN

SEQ ID NO: 3294836 - protein, 31 aa, Plasmodium falciparum
QTSQNIMSSLWFLYILFIIENNHIYVFNDKL

SEQ ID NO: 3294837 - protein, 31 aa, Plasmodium falciparum
QTTHLSKFVLRPPYFRYLEEWGETFCRERKK

SEQ ID NO: 3294838 - protein, 22 aa, Plasmodium falciparum
QTTRLLCECDLYTSIYNNDTEM

SEQ ID NO: 3294839 - protein, 20 aa, Plasmodium falciparum
QTTRSLCECDIYTSIYDNDP

SEQ ID NO: 3294840 - protein, 19 aa, Plasmodium falciparum
QTWWSRNAPSIWKGMICAL

SEQ ID NO: 3294841 - protein, 20 aa, Plasmodium falciparum
QTWWSRNAPSIWKGMICALT

SEQ ID NO: 3294842 - protein, 24 aa, Plasmodium falciparum
QTYDMIKMFIPINMPSLNILNIYS

SEQ ID NO: 3294843 - protein, 28 aa, Plasmodium falciparum
QVCKELYPFLINFPSIPFSLCIHGKEST

SEQ ID NO: 3294844 - protein, 27 aa, Plasmodium falciparum
QVCLNEDLFYLLSKFFKNIELCEKALN

SEQ ID NO: 3294845 - protein, 28 aa, Plasmodium falciparum
QVDCEIAFFCLYLQKLSCPGYNRGIIMD

SEQ ID NO: 3294846 - protein, 20 aa, Plasmodium falciparum
QVFPEIFNLLNGPTLDIIQN

SEQ ID NO: 3294847 - protein, 19 aa, Plasmodium falciparum
QVFYKQLFNKKPPNALNSF

SEQ ID NO: 3294848 - protein, 26 aa, Plasmodium falciparum
QVFYLKCVANFRVLLYNITLFTDYGN

SEQ ID NO: 3294849 - protein, 19 aa, Plasmodium falciparum
QVILSNTFHLLIQPKPHII

SEQ ID NO: 3294850 - protein, 27 aa, Plasmodium falciparum
QVISKYVLLKEPFKYFLSHQDFLDIKA

SEQ ID NO: 3294851 - protein, 25 aa, Plasmodium falciparum
QVKFKDMLILLISILLQCFTDNYVI

SEQ ID NO: 3294852 - protein, 24 aa, Plasmodium falciparum
QVLEKIYHLSIVNTNIREITVEDP

SEQ ID NO: 3294853 - protein, 25 aa, Plasmodium falciparum
QVLLQLTGLLRMSYMNTINLIDSSI

SEQ ID NO: 3294854 - protein, 23 aa, Plasmodium falciparum
QVNKYAYIQLLDKNYQNIYNTNN

SEQ ID NO: 3294855 - protein, 24 aa, Plasmodium falciparum
QVNLDTLFLIKYYIHKQISPYFSN

SEQ ID NO: 3294856 - protein, 23 aa, Plasmodium falciparum
QVNYNILFFFTNYYYGIQDFLNS

SEQ ID NO: 3294857 - protein, 18 aa, Plasmodium falciparum
QVNYYIKNFLSGNIILYA

SEQ ID NO: 3294858 - protein, 20 aa, Plasmodium falciparum
QVPYITLYEQARTVRDGTVI

SEQ ID NO: 3294859 - protein, 25 aa, Plasmodium falciparum
QVQMISVMLYFIKMFEQLFNFRKEP

SEQ ID NO: 3294860 - protein, 30 aa, Plasmodium falciparum
QVTEYVNEFLKCVRLLIFKKRVFESKLESA

SEQ ID NO: 3294861 - protein, 30 aa, Plasmodium falciparum
QVTVVYPIKYLFDIPLKYYEYFKSYKKKDI

SEQ ID NO: 3294862 - protein, 22 aa, Plasmodium falciparum
QVTYIKIVYKCISDICIIGYEQ

SEQ ID NO: 3294863 - protein, 21 aa, Plasmodium falciparum
QVVFYLILVYIKQFLYARRKF

SEQ ID NO: 3294864 - protein, 18 aa, Plasmodium falciparum
QVVLDEFTKFYESIKPAI

SEQ ID NO: 3294865 - protein, 27 aa, Plasmodium falciparum
QVVYLEKLCLLTILDIYKTPLCLIFTP

SEQ ID NO: 3294866 - protein, 25 aa, Plasmodium falciparum
QVYKNFMNLKIFKKLQQKLLSNNNN

SEQ ID NO: 3294867 - protein, 20 aa, Plasmodium falciparum
QVYSYFYYSNVLFGSRYVHQ

SEQ ID NO: 3294868 - protein, 27 aa, Plasmodium falciparum
QWCGVFDYFFGLYFSNNKLKYIFSFFS

SEQ ID NO: 3294869 - protein, 20 aa, Plasmodium falciparum
QWKIYPCEITPFTKIEKWYN

SEQ ID NO: 3294870 - protein, 20 aa, Plasmodium falciparum
QWLQSGTIPTDFLRQMFYTL

SEQ ID NO: 3294871 - protein, 20 aa, Plasmodium falciparum
QWSCGYFCNLDICSLKTSHG

SEQ ID NO: 3294872 - protein, 17 aa, Plasmodium falciparum
QYDRKILLLKDDKIYFY

SEQ ID NO: 3294873 - protein, 20 aa, Plasmodium falciparum
QYDYKIFFDKAFLDSYLSCE

SEQ ID NO: 3294874 - protein, 21 aa, Plasmodium falciparum
QYEFFLMSDSFYHLNRKDYLR

SEQ ID NO: 3294875 - protein, 22 aa, Plasmodium falciparum
QYEKFITQWKSQWEKQSGKYDK

SEQ ID NO: 3294876 - protein, 31 aa, Plasmodium falciparum
QYENSNYIMLMLLQSLYITTPYPGGFIESED

SEQ ID NO: 3294877 - protein, 17 aa, Plasmodium falciparum
QYFYKLLVILIKDLKDE

SEQ ID NO: 3294878 - protein, 39 aa, Plasmodium falciparum
QYGSFFFHFHVNGLTFIQWVFCFLCCLLDLLIYTFISYF

SEQ ID NO: 3294879 - protein, 18 aa, Plasmodium falciparum
QYIHIWKIQKNEKKIYFL

SEQ ID NO: 3294880 - protein, 20 aa, Plasmodium falciparum
QYIYITWDVLKNTFLDRGSK

SEQ ID NO: 3294881 - protein, 27 aa, Plasmodium falciparum
QYKCKLMVYILLIQLCLTDNALPLNLS

SEQ ID NO: 3294882 - protein, 17 aa, Plasmodium falciparum
QYLIHFIYKFFYCHHEK

SEQ ID NO: 3294883 - protein, 44 aa, Plasmodium falciparum
QYLKKFSAYEPVTKFLLTCVSLTQIFEISLIRFKKKNSKHIVHM

SEQ ID NO: 3294884 - protein, 19 aa, Plasmodium falciparum
QYLNLFHHLIYISKYTSFN

SEQ ID NO: 3294885 - protein, 18 aa, Plasmodium falciparum
QYMLYDMSYLTFIKQDKY

SEQ ID NO: 3294886 - protein, 18 aa, Plasmodium falciparum
QYNSFFSFEFLYLAYICS

SEQ ID NO: 3294887 - protein, 19 aa, Plasmodium falciparum
QYPMFLKIQNKPQRCLKDI

SEQ ID NO: 3294888 - protein, 33 aa, Plasmodium falciparum
QYSVENILIIRKFFRVFLNFAQKKFLSLSLKRH

SEQ ID NO: 3294889 - protein, 22 aa, Plasmodium falciparum
QYTLFLKTIAINNLLYLYKKNT

SEQ ID NO: 3294890 - protein, 20 aa, Plasmodium falciparum
QYTWYIIDRFINSLKNIEHF

SEQ ID NO: 3294891 - protein, 31 aa, Plasmodium falciparum
QYTYKRINLINKLPKWLLNFIDPKYCIIDEK

SEQ ID NO: 3294892 - protein, 23 aa, Plasmodium falciparum
RLTHIYIYIYIYTLCVFIYAFVC

SEQ ID NO: 3294893 - protein, 31 aa, Plasmodium falciparum
RMKRVKMILLIKYILILLIIFLMSHAKRRLN

SEQ ID NO: 3294894 - protein, 23 aa, Plasmodium falciparum
RAETLIILAKIMKKIIYDFKKNT

SEQ ID NO: 3294895 - protein, 27 aa, Plasmodium falciparum
RAGRFYPNVYISPRAHQLYLEPLKDLK

SEQ ID NO: 3294896 - protein, 18 aa, Plasmodium falciparum
RAHQLYLEPLKDLKENNT

SEQ ID NO: 3294897 - protein, 17 aa, Plasmodium falciparum
RAILPFIINLCLNEVIH

SEQ ID NO: 3294898 - protein, 24 aa, Plasmodium falciparum
RAKIIQLRIVTGLPIILLGDFNIS

SEQ ID NO: 3294899 - protein, 31 aa, Plasmodium falciparum
RAKKELYLKAFLYHFYSRNITELFKVLLFVK

SEQ ID NO: 3294900 - protein, 30 aa, Plasmodium falciparum
RALVRRWVEYFLEDYNKIRKKLKPCINDGK

SEQ ID NO: 3294901 - protein, 17 aa, Plasmodium falciparum
RANHILLLLLREKKNYS

SEQ ID NO: 3294902 - protein, 25 aa, Plasmodium falciparum
RAVVLLLFVLLLNSSNVKAAYFFVK

SEQ ID NO: 3294903 - protein, 18 aa, Plasmodium falciparum
RCFKKYSLYKEFKKHEIR

SEQ ID NO: 3294904 - protein, 25 aa, Plasmodium falciparum
RCKNEGKCILLIKSYFNDYLCALVN

SEQ ID NO: 3294905 - protein, 26 aa, Plasmodium falciparum
RCLETTKYFLNFKKNIIVYEAVRETA

SEQ ID NO: 3294906 - protein, 23 aa, Plasmodium falciparum
RCSNFILPIINKCIFLKGGILNV

SEQ ID NO: 3294907 - protein, 18 aa, Plasmodium falciparum
RCTNILGLDKRETVIKIN

SEQ ID NO: 3294908 - protein, 33 aa, Plasmodium falciparum
RCVANVPTYFDYVPQYLRWFEEWAEDFCRKKKK

SEQ ID NO: 3294909 - protein, 17 aa, Plasmodium falciparum
RCYLLNNNEFRQYDKKL

SEQ ID NO: 3294910 - protein, 22 aa, Plasmodium falciparum
RDAFIKCAAIETFFSWHKFKKD

SEQ ID NO: 3294911 - protein, 30 aa, Plasmodium falciparum
RDAFIKCAAVETFFLWDRYKKEKEKKKPQE

SEQ ID NO: 3294912 - protein, 17 aa, Plasmodium falciparum
RDDIKKSYKLLKDIKGI

SEQ ID NO: 3294913 - protein, 23 aa, Plasmodium falciparum
RDETLEIFLQVGLELLHQLNTSR

SEQ ID NO: 3294914 - protein, 21 aa, Plasmodium falciparum
RDFMWHYKWANIYLYKVHKLI

SEQ ID NO: 3294915 - protein, 28 aa, Plasmodium falciparum
RDFYINIYVFLSIVIFFCVFFERFKNEI

SEQ ID NO: 3294916 - protein, 30 aa, Plasmodium falciparum
RDIFMTIITVIRYYYLNIYFSIKEFKLNRK

SEQ ID NO: 3294917 - protein, 24 aa, Plasmodium falciparum
RDIKNCFFDIRDIVIGLDMWENNH

SEQ ID NO: 3294918 - protein, 25 aa, Plasmodium falciparum
RDISKENILFLYDKKVEHLNNRKDN

SEQ ID NO: 3294919 - protein, 32 aa, Plasmodium falciparum
RDKENFVIEEDPFKGQLINEGLPVEEEFVTKE

SEQ ID NO: 3294920 - protein, 17 aa, Plasmodium falciparum
RDLFVHMFISFLSRFHS

SEQ ID NO: 3294921 - protein, 25 aa, Plasmodium falciparum
RDLGDFKIILNHLKLFGYKAKPINT

SEQ ID NO: 3294922 - protein, 25 aa, Plasmodium falciparum
RDMREIMKMKLKRTFLTGYHHDVEE

SEQ ID NO: 3294923 - protein, 17 aa, Plasmodium falciparum
RDNILEKLLFLIENEDY

SEQ ID NO: 3294924 - protein, 17 aa, Plasmodium falciparum
RDNLKYVQYKKKYLKIL

SEQ ID NO: 3294925 - protein, 28 aa, Plasmodium falciparum
RDNNYIKFSNFYFYCPVDIDNIVDIDTE

SEQ ID NO: 3294926 - protein, 23 aa, Plasmodium falciparum
RDQINLYIKIKNLLLSSIHISNS

SEQ ID NO: 3294927 - protein, 24 aa, Plasmodium falciparum
RDSQFPDIFYIPIIIKQDDIDEIN

SEQ ID NO: 3294928 - protein, 19 aa, Plasmodium falciparum
RDVGLLYRKENVKLIVVGV

SEQ ID NO: 3294929 - protein, 22 aa, Plasmodium falciparum
RDWFVKSAAVETFFLWDRYKKE

SEQ ID NO: 3294930 - protein, 25 aa, Plasmodium falciparum
RDYDDIWNDYSKFLFIIEKHMKTEL

SEQ ID NO: 3294931 - protein, 17 aa, Plasmodium falciparum
RDYLFLPSQGRSLKLLN

SEQ ID NO: 3294932 - protein, 18 aa, Plasmodium falciparum
RDYYYSFLFLFHFHIFLY

SEQ ID NO: 3294933 - protein, 30 aa, Plasmodium falciparum
REAFIKCAAVETFFLWHKYKEDNNGGEDLQ

SEQ ID NO: 3294934 - protein, 40 aa, Plasmodium falciparum
REAFIQSAAIETFFLWDRYKKEWALQKLAELQRNGDLPFF

SEQ ID NO: 3294935 - protein, 31 aa, Plasmodium falciparum
REAFIQSAAIETFFLWDRYKKVKNKEIAEKK

SEQ ID NO: 3294936 - protein, 17 aa, Plasmodium falciparum
REDWWKVNRDQVWEAIT

SEQ ID NO: 3294937 - protein, 17 aa, Plasmodium falciparum
REDWWTANRDQVWKAIT

SEQ ID NO: 3294938 - protein, 19 aa, Plasmodium falciparum
REDWWTANRDQVWKAMTCV

SEQ ID NO: 3294939 - protein, 17 aa, Plasmodium falciparum
REELNNILPIKKSLDNY

SEQ ID NO: 3294940 - protein, 25 aa, Plasmodium falciparum
REEYEYIKKIYKDLLLSLRGDTYYM

SEQ ID NO: 3294941 - protein, 43 aa, Plasmodium falciparum
REFTPSDWWKVMSASAFPWTVGVAFMALSYWVMKKKSKPRVDL

SEQ ID NO: 3294942 - protein, 17 aa, Plasmodium falciparum
REGKMKRRNKKEKRRKE

SEQ ID NO: 3294943 - protein, 18 aa, Plasmodium falciparum
REHICTSNLEYLLKGNSD

SEQ ID NO: 3294944 - protein, 21 aa, Plasmodium falciparum
REIHFNFFINYILKKYKERKT

SEQ ID NO: 3294945 - protein, 28 aa, Plasmodium falciparum
REKWWDKHAPSIWNGMICALTYEEKTNS

SEQ ID NO: 3294946 - protein, 25 aa, Plasmodium falciparum
RELIELPLKYPEIFMSIGISAPKGV

SEQ ID NO: 3294947 - protein, 26 aa, Plasmodium falciparum
RELIQKLINKILFYSPLSIVSYENDK

SEQ ID NO: 3294948 - protein, 19 aa, Plasmodium falciparum
RELKNLDKLYYYGIHSNIF

SEQ ID NO: 3294949 - protein, 21 aa, Plasmodium falciparum
REMQFLELLVSKLLIKQEGSS

SEQ ID NO: 3294950 - protein, 25 aa, Plasmodium falciparum
RENIYYLNFVYKNLLAKIDLITNLN

SEQ ID NO: 3294951 - protein, 24 aa, Plasmodium falciparum
RENNKYIFYPLTNIKQLCINNIIK

SEQ ID NO: 3294952 - protein, 52 aa, Plasmodium falciparum
RENQILTFQFPKCAIIISAKYLALFLSLIFLIFFFYIIRITSHFNLDNFVKG

SEQ ID NO: 3294953 - protein, 17 aa, Plasmodium falciparum
REQWTKIKGKYKTLYKK

SEQ ID NO: 3294954 - protein, 23 aa, Plasmodium falciparum
RERKRMFNFLNKLKRKLIKNDLY

SEQ ID NO: 3294955 - protein, 22 aa, Plasmodium falciparum
RERYSHILNINKRESIIKINDM

SEQ ID NO: 3294956 - protein, 21 aa, Plasmodium falciparum
RESLENLGCDKKLIALTKIFG

SEQ ID NO: 3294957 - protein, 35 aa, Plasmodium falciparum
RESRQRYIITGLPLHSKIFFYLKCMNISIDHVISF

SEQ ID NO: 3294958 - protein, 23 aa, Plasmodium falciparum
RESVLRMSLRKKGNFKRTASVTS

SEQ ID NO: 3294959 - protein, 24 aa, Plasmodium falciparum
RESYDIFYSYLKLSEKKSLKQSDM

SEQ ID NO: 3294960 - protein, 18 aa, Plasmodium falciparum
RETIEIQIILQPLSDKDN

SEQ ID NO: 3294961 - protein, 27 aa, Plasmodium falciparum
RETNLYLFFLVYIQILNVILNIYYILI

SEQ ID NO: 3294962 - protein, 21 aa, Plasmodium falciparum
REVFGPTGVSGVYFEKSRSSW

SEQ ID NO: 3294963 - protein, 33 aa, Plasmodium falciparum
REYGKNFYLEKQKIIWKRWIARYVKHIDDYIIE

SEQ ID NO: 3294964 - protein, 26 aa, Plasmodium falciparum
REYTIEDFIFLVENLRKYVPNITIST

SEQ ID NO: 3294965 - protein, 23 aa, Plasmodium falciparum
REYWNNFFRIIDNKNFEWYGSYE

SEQ ID NO: 3294966 - protein, 26 aa, Plasmodium falciparum
RFDHITYILMYTLNVPILFNDNTFTQ

SEQ ID NO: 3294967 - protein, 25 aa, Plasmodium falciparum
RFDNKNFFHLLLIASDGVFEYINPY

SEQ ID NO: 3294968 - protein, 24 aa, Plasmodium falciparum
RFDTKNLIYIFRKGKYVNLEKNYN

SEQ ID NO: 3294969 - protein, 24 aa, Plasmodium falciparum
RFFEKICYELFKLKSKNYSDDEDS

SEQ ID NO: 3294970 - protein, 36 aa, Plasmodium falciparum
RFIIKISSTIFHGYAYVFFLFFHKHSIFYNNTNENM

SEQ ID NO: 3294971 - protein, 34 aa, Plasmodium falciparum
RFINFCIISAIIWFIPLYNVYVYLFLNNYRHHLT

SEQ ID NO: 3294972 - protein, 20 aa, Plasmodium falciparum
RFLFFKEIYNITKKYIFPNL

SEQ ID NO: 3294973 - protein, 129 aa, Plasmodium falciparum
RFLFNKQRDWPRITFTFLVFVLGIKTVLCILLYMYNNILLFVVFLILCVVSFYGLIVNTIKSLVLYILILSLVLTSISLSFYNIIYIEYISKVFEHAFLSTVLYSTFPLLVMELFVSIAYTCLKKKKKG

SEQ ID NO: 3294974 - protein, 18 aa, Plasmodium falciparum
RFLKRACLHLYIKFKKEI

SEQ ID NO: 3294975 - protein, 27 aa, Plasmodium falciparum
RFLKRKEIAWRIIIQNILLNIEMWDKY

SEQ ID NO: 3294976 - protein, 20 aa, Plasmodium falciparum
RFLNNYIQIYDSFKLKKNKI

SEQ ID NO: 3294977 - protein, 20 aa, Plasmodium falciparum
RFLNYPYLYVLIKKEKVGIL

SEQ ID NO: 3294978 - protein, 17 aa, Plasmodium falciparum
RFLYDPFANIENRDLET

SEQ ID NO: 3294979 - protein, 17 aa, Plasmodium falciparum
RFLYFDREHKLLVIKYN

SEQ ID NO: 3294980 - protein, 20 aa, Plasmodium falciparum
RFMLVILLDYILKCGITFFF

SEQ ID NO: 3294981 - protein, 19 aa, Plasmodium falciparum
RFNLIELFQYIYKKLHCIN

SEQ ID NO: 3294982 - protein, 26 aa, Plasmodium falciparum
RFNQLLFKFLHLCMNYFLHVAYVYDI

SEQ ID NO: 3294983 - protein, 20 aa, Plasmodium falciparum
RFPEIYIHYSFSSFFMNIEK

SEQ ID NO: 3294984 - protein, 19 aa, Plasmodium falciparum
RFQKNLFILINFTNKYYDY

SEQ ID NO: 3294985 - protein, 17 aa, Plasmodium falciparum
RFRFLKINLETVRPFEM

SEQ ID NO: 3294986 - protein, 19 aa, Plasmodium falciparum
RFSSIIKKNIFYFNFSRYN

SEQ ID NO: 3294987 - protein, 33 aa, Plasmodium falciparum
RFTLKKYYNLLIYVYLLYKMKIIISIYINPNQY

SEQ ID NO: 3294988 - protein, 17 aa, Plasmodium falciparum
RFVLNPPPFMLEGQYMN

SEQ ID NO: 3294989 - protein, 17 aa, Plasmodium falciparum
RFYKNIYTCYKLMCKNE

SEQ ID NO: 3294990 - protein, 20 aa, Plasmodium falciparum
RFYYNIFLICVLCLSNSLCS

SEQ ID NO: 3294991 - protein, 21 aa, Plasmodium falciparum
RGEFSYIFFKKEIAKLYEKEK

SEQ ID NO: 3294992 - protein, 18 aa, Plasmodium falciparum
RGEIPYVTLSKCQCIAGE

SEQ ID NO: 3294993 - protein, 32 aa, Plasmodium falciparum
RGEKTPLDSFIKRPPYFRYLEEWGQNFCKERK

SEQ ID NO: 3294994 - protein, 26 aa, Plasmodium falciparum
RGENRVWVLILCLNFIYCNLNDDIMT

SEQ ID NO: 3294995 - protein, 18 aa, Plasmodium falciparum
RGFYMRKNYISLLGNLSM

SEQ ID NO: 3294996 - protein, 26 aa, Plasmodium falciparum
RGGSLFIFIVFFVLSFIYIGYTGIVL

SEQ ID NO: 3294997 - protein, 18 aa, Plasmodium falciparum
RGIERFLFEDTVSDLFTV

SEQ ID NO: 3294998 - protein, 18 aa, Plasmodium falciparum
RGIHKLDLFPFNRKKKEA

SEQ ID NO: 3294999 - protein, 17 aa, Plasmodium falciparum
RGIKKYILKYIKSINYN

SEQ ID NO: 3295000 - protein, 18 aa, Plasmodium falciparum
RGIKRLFRLIKKNDFKNT

SEQ ID NO: 3295001 - protein, 32 aa, Plasmodium falciparum
RGKRILVDSIYNFLIFLDSTLYERCKSSQVVS

SEQ ID NO: 3295002 - protein, 25 aa, Plasmodium falciparum
RGLQLSIFYEIYRMYNNIYFISCSL

SEQ ID NO: 3295003 - protein, 19 aa, Plasmodium falciparum
RGMSLGVTWKIPISDKYSQ

SEQ ID NO: 3295004 - protein, 21 aa, Plasmodium falciparum
RGQFILLFILSHFINKRKENK

SEQ ID NO: 3295005 - protein, 34 aa, Plasmodium falciparum
RGSYFLSRNFTKFLFFLFFHIDKKQKILFCNTTN

SEQ ID NO: 3295006 - protein, 29 aa, Plasmodium falciparum
RGYFGKIIGKLYPLSCYVLKTIHTGLKPK

SEQ ID NO: 3295007 - protein, 17 aa, Plasmodium falciparum
RHCSFYKKWIDIKKKEF

SEQ ID NO: 3295008 - protein, 17 aa, Plasmodium falciparum
RHEILYCYEHQYMHGTY

SEQ ID NO: 3295009 - protein, 26 aa, Plasmodium falciparum
RHFVFVLSLFCRFFNLYKTKLKYVDM

SEQ ID NO: 3295010 - protein, 25 aa, Plasmodium falciparum
RHGGIPFYSFLKRPKIKIKNKLFNE

SEQ ID NO: 3295011 - protein, 27 aa, Plasmodium falciparum
RHIRKEHWLYIYPCLKNLLFKKKKSKN

SEQ ID NO: 3295012 - protein, 18 aa, Plasmodium falciparum
RHKKELDILIKHLDILLG

SEQ ID NO: 3295013 - protein, 24 aa, Plasmodium falciparum
RHNFKLLLKILKITKKSLLYEESY

SEQ ID NO: 3295014 - protein, 17 aa, Plasmodium falciparum
RHRYMLEKWKKEEWFYN

SEQ ID NO: 3295015 - protein, 28 aa, Plasmodium falciparum
RHSFDFLKYNLYAQTLKLKTLKIICYDK

SEQ ID NO: 3295016 - protein, 27 aa, Plasmodium falciparum
RHSTLYYFYFFVTHYNNYYLNKCLSII

SEQ ID NO: 3295017 - protein, 18 aa, Plasmodium falciparum
RIAKLKFRLVSEAYQVLS

SEQ ID NO: 3295018 - protein, 18 aa, Plasmodium falciparum
RICLSFISLFIYSFILLY

SEQ ID NO: 3295019 - protein, 17 aa, Plasmodium falciparum
RICPKKRNFSLYKTAFE

SEQ ID NO: 3295020 - protein, 20 aa, Plasmodium falciparum
RIDISFLKIFFLLNDVRQIN

SEQ ID NO: 3295021 - protein, 26 aa, Plasmodium falciparum
RIDSFLSDYAFFSESQKFRFIYHFYS

SEQ ID NO: 3295022 - protein, 17 aa, Plasmodium falciparum
RIDWIVYLVTHLEILSL

SEQ ID NO: 3295023 - protein, 17 aa, Plasmodium falciparum
RIDYIKYKTLYEQLIKK

SEQ ID NO: 3295024 - protein, 17 aa, Plasmodium falciparum
RIEPLIYPGIKNIPEPV

SEQ ID NO: 3295025 - protein, 17 aa, Plasmodium falciparum
RIFAENIKIIFFDNHIH

SEQ ID NO: 3295026 - protein, 20 aa, Plasmodium falciparum
RIFKKIILSLFILCMFIYMY

SEQ ID NO: 3295027 - protein, 18 aa, Plasmodium falciparum
RIFNKKKINSWLPVDLYV

SEQ ID NO: 3295028 - protein, 17 aa, Plasmodium falciparum
RIFSITDILFLIKNVYQ

SEQ ID NO: 3295029 - protein, 33 aa, Plasmodium falciparum
RIGYIKIIQFFLLVLFWGLLYILINQMLNTKPM

SEQ ID NO: 3295030 - protein, 29 aa, Plasmodium falciparum
RIHEINFKLLIKLLLGLCYFSFEKVHIYN

SEQ ID NO: 3295031 - protein, 37 aa, Plasmodium falciparum
RIIGLQTFFILIIASSLILMIPFISNMYWFTFVMTLG

SEQ ID NO: 3295032 - protein, 41 aa, Plasmodium falciparum
RIIIEKEKYWRKIWLLIYTLINLILIKCKLYGIKYNEKNVC

SEQ ID NO: 3295033 - protein, 20 aa, Plasmodium falciparum
RIIIMSFRYSSYFMKKWREV

SEQ ID NO: 3295034 - protein, 17 aa, Plasmodium falciparum
RIIRYIIVLFKICYKVT

SEQ ID NO: 3295035 - protein, 29 aa, Plasmodium falciparum
RIKCSYYIFVHSLLRYKGASVYKKIFKVI

SEQ ID NO: 3295036 - protein, 18 aa, Plasmodium falciparum
RIKKIFLKEYKKYIKEKK

SEQ ID NO: 3295037 - protein, 17 aa, Plasmodium falciparum
RIKLFDFISSYLTVDWE

SEQ ID NO: 3295038 - protein, 17 aa, Plasmodium falciparum
RIKLLKNDILKECCYIC

SEQ ID NO: 3295039 - protein, 23 aa, Plasmodium falciparum
RIKNKHKWFCKKKNVFEYFTDHD

SEQ ID NO: 3295040 - protein, 20 aa, Plasmodium falciparum
RILEDILIKEIIKRLIFFKN

SEQ ID NO: 3295041 - protein, 18 aa, Plasmodium falciparum
RILFSRYFHGPSLYKRYI

SEQ ID NO: 3295042 - protein, 24 aa, Plasmodium falciparum
RILKKNYVIKIYLVRHMEALHNTE

SEQ ID NO: 3295043 - protein, 22 aa, Plasmodium falciparum
RINDFLDVIYYKLNIKEINKSL

SEQ ID NO: 3295044 - protein, 23 aa, Plasmodium falciparum
RINDLILYNLKNIFEKINNIEKL

SEQ ID NO: 3295045 - protein, 25 aa, Plasmodium falciparum
RINEKNVRYFFFRSMKYVYNEEKDG

SEQ ID NO: 3295046 - protein, 25 aa, Plasmodium falciparum
RINKRIEVLFITISNYIISENKEYL

SEQ ID NO: 3295047 - protein, 31 aa, Plasmodium falciparum
RINPSTYSIFFFLFFKRLKNYVLERLKDVIK

SEQ ID NO: 3295048 - protein, 23 aa, Plasmodium falciparum
RINTIYELFYNFYFTYLRKKENN

SEQ ID NO: 3295049 - protein, 23 aa, Plasmodium falciparum
RINTKHMFLYKEESIITEINIAL

SEQ ID NO: 3295050 - protein, 20 aa, Plasmodium falciparum
RINYMQAYYPKNNKLKYYFD

SEQ ID NO: 3295051 - protein, 24 aa, Plasmodium falciparum
RIPIMRYFYGLIFLMAFVPITQSL

SEQ ID NO: 3295052 - protein, 21 aa, Plasmodium falciparum
RIRPKLIRTNSLPATLSSSFL

SEQ ID NO: 3295053 - protein, 36 aa, Plasmodium falciparum
RIRRLDYTVSVKDMFILWNHILAHERKKYTKMQEYL

SEQ ID NO: 3295054 - protein, 27 aa, Plasmodium falciparum
RIRTRTFWQNLFGLSSSKYILFNNFLI

SEQ ID NO: 3295055 - protein, 23 aa, Plasmodium falciparum
RIRYGFLHNGYVPNKWYWEIIVF

SEQ ID NO: 3295056 - protein, 17 aa, Plasmodium falciparum
RISIGGLVPIFLTSQNR

SEQ ID NO: 3295057 - protein, 36 aa, Plasmodium falciparum
RISKLVVYMFYKNMVLIFPLFIFGSISLYSGQKIYF

SEQ ID NO: 3295058 - protein, 27 aa, Plasmodium falciparum
RISSPAYPLYFSVFLKRLKSYVSDRIS

SEQ ID NO: 3295059 - protein, 32 aa, Plasmodium falciparum
RITELRKILVEKLRILYLEKNNLFNTQASCIK

SEQ ID NO: 3295060 - protein, 19 aa, Plasmodium falciparum
RITIIIAHRLSTIRYANTI

SEQ ID NO: 3295061 - protein, 26 aa, Plasmodium falciparum
RIVDKTWLLWILIKLNIHKEEKYKEI

SEQ ID NO: 3295062 - protein, 77 aa, Plasmodium falciparum
RIVDTIANSLNKSYNSLYHNLYIEMEKDLLINKTETFNKWSKQHWNKLDNWKEEKWFKLFKRDLKIDMRNTYESDQN

SEQ ID NO: 3295063 - protein, 23 aa, Plasmodium falciparum
RIVKSVFRFNIRKKRKLYQNDII

SEQ ID NO: 3295064 - protein, 29 aa, Plasmodium falciparum
RIYDKNLLMIKEHILAIAIYESRILKRKY

SEQ ID NO: 3295065 - protein, 23 aa, Plasmodium falciparum
RIYELMPKLSFSTCKKVYMYLDD

SEQ ID NO: 3295066 - protein, 22 aa, Plasmodium falciparum
RIYHFYSKYFINKILYARNLSK

SEQ ID NO: 3295067 - protein, 20 aa, Plasmodium falciparum
RIYIHILFFIFYIINNEKFY

SEQ ID NO: 3295068 - protein, 24 aa, Plasmodium falciparum
RIYKILLLTYCNKISTYQNEIKNI

SEQ ID NO: 3295069 - protein, 19 aa, Plasmodium falciparum
RIYLLLKCLLHSYLNEIKE

SEQ ID NO: 3295070 - protein, 17 aa, Plasmodium falciparum
RIYYKDNYKIYSPNALG

SEQ ID NO: 3295071 - protein, 19 aa, Plasmodium falciparum
RIYYLKYIEYYILNISIND

SEQ ID NO: 3295072 - protein, 33 aa, Plasmodium falciparum
RKAFIKCAAAETFFSWYYFKKINDKLNKLDEKL

SEQ ID NO: 3295073 - protein, 26 aa, Plasmodium falciparum
RKDINLYVYILYVLSKFPYSNVNIIN

SEQ ID NO: 3295074 - protein, 26 aa, Plasmodium falciparum
RKDYGSRFFIFSLKIKSSKEEFTKNV

SEQ ID NO: 3295075 - protein, 30 aa, Plasmodium falciparum
RKEIRQIKYIIHTILFFKNNDPMKHMLLNN

SEQ ID NO: 3295076 - protein, 34 aa, Plasmodium falciparum
RKELLDNTFLITIILFLKKSIYFKSIFNCGNINE

SEQ ID NO: 3295077 - protein, 44 aa, Plasmodium falciparum
RKENKIYSYFFNSILAIFIIFIIYQIFMKESTFLWFSKNDKKRR

SEQ ID NO: 3295078 - protein, 23 aa, Plasmodium falciparum
RKEQKLFFLVEAEKRIHITEWKR

SEQ ID NO: 3295079 - protein, 24 aa, Plasmodium falciparum
RKEQMLLYFLYENKSFYVESFLSK

SEQ ID NO: 3295080 - protein, 19 aa, Plasmodium falciparum
RKERLMLNAVRRLSIKKLK

SEQ ID NO: 3295081 - protein, 32 aa, Plasmodium falciparum
RKEYLQCEVFLKKIIFICKTKFYPNNINVISS

SEQ ID NO: 3295082 - protein, 18 aa, Plasmodium falciparum
RKFFVKYLINLIDEKECK

SEQ ID NO: 3295083 - protein, 18 aa, Plasmodium falciparum
RKFLTLHQFFFDASFIVV

SEQ ID NO: 3295084 - protein, 27 aa, Plasmodium falciparum
RKFNMSLSRIWYFFNNIDKIEEIDEKI

SEQ ID NO: 3295085 - protein, 23 aa, Plasmodium falciparum
RKFSLVQVFPIQVLISSAISNIE

SEQ ID NO: 3295086 - protein, 54 aa, Plasmodium falciparum
RKGKGIFELIFLLKHILIVLLICFNIYYGLYYIVFLTLILITFAILEILSNPYD

SEQ ID NO: 3295087 - protein, 22 aa, Plasmodium falciparum
RKHDINHILDLSFLSKEEKKEN

SEQ ID NO: 3295088 - protein, 21 aa, Plasmodium falciparum
RKHILIYLNLINYVETKYIFY

SEQ ID NO: 3295089 - protein, 17 aa, Plasmodium falciparum
RKHILNKIHKIFKIIRL

SEQ ID NO: 3295090 - protein, 17 aa, Plasmodium falciparum
RKICLNISFFILLIIFI

SEQ ID NO: 3295091 - protein, 18 aa, Plasmodium falciparum
RKIFDLFSKVLKKVYIFF

SEQ ID NO: 3295092 - protein, 27 aa, Plasmodium falciparum
RKISIPLSHSFLFYNNITNLQIARPLS

SEQ ID NO: 3295093 - protein, 17 aa, Plasmodium falciparum
RKKDDILLYKDKKFYPL

SEQ ID NO: 3295094 - protein, 35 aa, Plasmodium falciparum
RKKEHGDVLAEDLYGRLEIPAIELPSENERGYYIP

SEQ ID NO: 3295095 - protein, 24 aa, Plasmodium falciparum
RKKELKIFLMKVFKILLNNINDTI

SEQ ID NO: 3295096 - protein, 26 aa, Plasmodium falciparum
RKKERRIFYFIQSLETYKYNIQYKRI

SEQ ID NO: 3295097 - protein, 37 aa, Plasmodium falciparum
RKKERTFFFYYSTFICSFFFTMGIWQYKKMKKKKFLI

SEQ ID NO: 3295098 - protein, 29 aa, Plasmodium falciparum
RKKFKSCSFILYNIKIYGYKSLYRGVYVN

SEQ ID NO: 3295099 - protein, 26 aa, Plasmodium falciparum
RKKFPLYNIRKLFLGRKLFLNKFKRS

SEQ ID NO: 3295100 - protein, 32 aa, Plasmodium falciparum
RKKLCCQISDYCLKYFNFYSIEYYNCIKSEIK

SEQ ID NO: 3295101 - protein, 34 aa, Plasmodium falciparum
RKKLKEYYFNKINKAFFTFLLRSNHANFSFSPHE

SEQ ID NO: 3295102 - protein, 24 aa, Plasmodium falciparum
RKKRKIFLLLILYCFRKMKENNTH

SEQ ID NO: 3295103 - protein, 25 aa, Plasmodium falciparum
RKKRKTLLILLFKISYVFICLKWKE

SEQ ID NO: 3295104 - protein, 23 aa, Plasmodium falciparum
RKLCERFIYYNPNVQGVYPDMFI

SEQ ID NO: 3295105 - protein, 24 aa, Plasmodium falciparum
RKLFIRCAAIETFFLWKKYEEDKK

SEQ ID NO: 3295106 - protein, 22 aa, Plasmodium falciparum
RKLNIYIEYIYQIRNKSNNLIN

SEQ ID NO: 3295107 - protein, 27 aa, Plasmodium falciparum
RKMLFVKYVLPYFIYLTFLNTDPHIQM

SEQ ID NO: 3295108 - protein, 21 aa, Plasmodium falciparum
RKMVHLILRLIFYATHKSLNT

SEQ ID NO: 3295109 - protein, 24 aa, Plasmodium falciparum
RKMYVFLISLLFQQINDLDFIYNS

SEQ ID NO: 3295110 - protein, 38 aa, Plasmodium falciparum
RKNERNADRIPIMFNKFGILLEALIYKCIQYDIINTDI

SEQ ID NO: 3295111 - protein, 22 aa, Plasmodium falciparum
RKNIFRFVSKYILKKTSKKLTP

SEQ ID NO: 3295112 - protein, 33 aa, Plasmodium falciparum
RKNILLKCGRFFRLPLCVVIYYIILMSQFIKTI

SEQ ID NO: 3295113 - protein, 24 aa, Plasmodium falciparum
RKNINIFLYIPIKKDINKMKYYNF

SEQ ID NO: 3295114 - protein, 24 aa, Plasmodium falciparum
RKNKKIIILNLKKKEKKLWGYLHF

SEQ ID NO: 3295115 - protein, 32 aa, Plasmodium falciparum
RKNLDDYIFLRNQICLFFILIDMSVDVQRIDL

SEQ ID NO: 3295116 - protein, 22 aa, Plasmodium falciparum
RKNLWNNIWINSITLTLIIIMI

SEQ ID NO: 3295117 - protein, 22 aa, Plasmodium falciparum
RKNMFSLYLLSFLIFHIYELLN

SEQ ID NO: 3295118 - protein, 23 aa, Plasmodium falciparum
RKNNELCFLYINKSHQKIYNNNN

SEQ ID NO: 3295119 - protein, 24 aa, Plasmodium falciparum
RKNPFFISTYLFYLSKKVKNKIFN

SEQ ID NO: 3295120 - protein, 23 aa, Plasmodium falciparum
RKNSYNFLKPIKYDLFTHKKNVY

SEQ ID NO: 3295121 - protein, 24 aa, Plasmodium falciparum
RKNVLYLILLSFDIFENFNYIKHG

SEQ ID NO: 3295122 - protein, 22 aa, Plasmodium falciparum
RKQKIALFYYSSNVLIHIIEIL

SEQ ID NO: 3295123 - protein, 24 aa, Plasmodium falciparum
RKQNMCIIIGTIKIDHMFCTCSCG

SEQ ID NO: 3295124 - protein, 26 aa, Plasmodium falciparum
RKQTFFYVWLLLYQYEKKYYYIHKQM

SEQ ID NO: 3295125 - protein, 33 aa, Plasmodium falciparum
RKRFQCKNLITQILLADYILDKLKNFPINESIE

SEQ ID NO: 3295126 - protein, 24 aa, Plasmodium falciparum
RKRIIYMLSILRMNKLLNMFKIII

SEQ ID NO: 3295127 - protein, 25 aa, Plasmodium falciparum
RKRKNFVMLLNLKQISLLSLDILNI

SEQ ID NO: 3295128 - protein, 24 aa, Plasmodium falciparum
RKRSYKIFYLELKNNKHKVLLSDA

SEQ ID NO: 3295129 - protein, 27 aa, Plasmodium falciparum
RKSFKIILFSLFKILDLCKLYNIYCIN

SEQ ID NO: 3295130 - protein, 23 aa, Plasmodium falciparum
RKSLFIKLALAISFFFYNNIILL

SEQ ID NO: 3295131 - protein, 30 aa, Plasmodium falciparum
RKSRSYFITNNYILHFKPFGYNKNIIKYNH

SEQ ID NO: 3295132 - protein, 31 aa, Plasmodium falciparum
RKTCVLCYCVRRYYMNFLNKLEKKLTHDFIE

SEQ ID NO: 3295133 - protein, 47 aa, Plasmodium falciparum
RKTKTWSLVNTFFALLSIIYFITTTNFRLRKPTFFVILEQNVENKNT

SEQ ID NO: 3295134 - protein, 17 aa, Plasmodium falciparum
RKVWRFIKKIAKKCKRV

SEQ ID NO: 3295135 - protein, 33 aa, Plasmodium falciparum
RKVYTPIKKIIKKKYIFIYDKTKIFTRKKHHSI

SEQ ID NO: 3295136 - protein, 22 aa, Plasmodium falciparum
RKWFIESSAVETFFLWHEYKME

SEQ ID NO: 3295137 - protein, 21 aa, Plasmodium falciparum
RKYFLNNNIILLTIIEAILIS

SEQ ID NO: 3295138 - protein, 23 aa, Plasmodium falciparum
RKYIDTYIYIIKRYYKNDDYEVL

SEQ ID NO: 3295139 - protein, 18 aa, Plasmodium falciparum
RKYVYIVNLCFSDILLKY

SEQ ID NO: 3295140 - protein, 27 aa, Plasmodium falciparum
RLCFSEIPYVLFLYMDCYKSLGRGDLV

SEQ ID NO: 3295141 - protein, 29 aa, Plasmodium falciparum
RLDIEAVPFNILYKLLNKYALNNNNLYQK

SEQ ID NO: 3295142 - protein, 23 aa, Plasmodium falciparum
RLERIIIMIIGLELILGIMQMIK

SEQ ID NO: 3295143 - protein, 22 aa, Plasmodium falciparum
RLFFFCHLYNLCYFCKIYVNSA

SEQ ID NO: 3295144 - protein, 33 aa, Plasmodium falciparum
RLFLRYSVGIFLGLFYIVLLNICKYDGKARLSK

SEQ ID NO: 3295145 - protein, 39 aa, Plasmodium falciparum
RLGLLRAMFTLIKLIVSILFYVSKLCFKIFQLFKKTNEA

SEQ ID NO: 3295146 - protein, 39 aa, Plasmodium falciparum
RLIKSRWLFIIKEYNNIFLYIYMLSFILKKNKITNNKIN

SEQ ID NO: 3295147 - protein, 18 aa, Plasmodium falciparum
RLILKLFINYFMCNLNVQ

SEQ ID NO: 3295148 - protein, 44 aa, Plasmodium falciparum
RLIPSYSTSGMLLLLTFLDFKYIFPSYVYSFYISKDLKNICYEG

SEQ ID NO: 3295149 - protein, 20 aa, Plasmodium falciparum
RLKIVQFLYTILSRHKNMYQ

SEQ ID NO: 3295150 - protein, 27 aa, Plasmodium falciparum
RLKKRIYGYLFYTTLLKNITSLNNLFV

SEQ ID NO: 3295151 - protein, 38 aa, Plasmodium falciparum
RLKLKKTIFIFYVLSFSLFLFLVIYSIIFLTIRNYKKK

SEQ ID NO: 3295152 - protein, 19 aa, Plasmodium falciparum
RLKMIFSNIKHYFKIFIQQ

SEQ ID NO: 3295153 - protein, 19 aa, Plasmodium falciparum
RLKQDFILQYFKDLPNGLN

SEQ ID NO: 3295154 - protein, 25 aa, Plasmodium falciparum
RLKSCDFVYNLPFFGLCIGGCLGKD

SEQ ID NO: 3295155 - protein, 18 aa, Plasmodium falciparum
RLKSILYPNNLDSEYKNI

SEQ ID NO: 3295156 - protein, 26 aa, Plasmodium falciparum
RLKTYSMVYTLRRLFKSLLKEYNLKQ

SEQ ID NO: 3295157 - protein, 19 aa, Plasmodium falciparum
RLKVIRYVIHPKYNTLLLN

SEQ ID NO: 3295158 - protein, 18 aa, Plasmodium falciparum
RLLIFEYTNNLIIRRKQV

SEQ ID NO: 3295159 - protein, 19 aa, Plasmodium falciparum
RLLIILTGMFRKNINRTTN

SEQ ID NO: 3295160 - protein, 18 aa, Plasmodium falciparum
RLNSILVSLPPLTCVILH

SEQ ID NO: 3295161 - protein, 29 aa, Plasmodium falciparum
RLPTAVTCGFRLLLPQYSSLDILKERLLY

SEQ ID NO: 3295162 - protein, 17 aa, Plasmodium falciparum
RLQNLPDAAAFLKTLGS

SEQ ID NO: 3295163 - protein, 34 aa, Plasmodium falciparum
RLQRNFWILLLCSITWIFYIRFTYLLIYYREKVK

SEQ ID NO: 3295164 - protein, 25 aa, Plasmodium falciparum
RLRYTLIIIYIFFCLTLHVFICITQ

SEQ ID NO: 3295165 - protein, 46 aa, Plasmodium falciparum
RLSKRILYIYMVLIKTLFVICIFMKNKIIPYLFLNSSFLLNTLMDD

SEQ ID NO: 3295166 - protein, 28 aa, Plasmodium falciparum
RLSLLGLLCIFLLNFYIYNGNCNVVEGT

SEQ ID NO: 3295167 - protein, 24 aa, Plasmodium falciparum
RLSLLIIYNFFFLVSILTSITHHF

SEQ ID NO: 3295168 - protein, 18 aa, Plasmodium falciparum
RLTVACIIAWKALSNYVQ

SEQ ID NO: 3295169 - protein, 22 aa, Plasmodium falciparum
RLTVLCRTGWKALYNYVENICK

SEQ ID NO: 3295170 - protein, 19 aa, Plasmodium falciparum
RLYKNKIFNMCSFKRYYNN

SEQ ID NO: 3295171 - protein, 18 aa, Plasmodium falciparum
RLYVGHLQKWAEKYNKVA

SEQ ID NO: 3295172 - protein, 23 aa, Plasmodium falciparum
RLYYKVRFFHAVRAKIIQLRIVT

SEQ ID NO: 3295173 - protein, 17 aa, Plasmodium falciparum
RMDRDALYRVYLEELDR

SEQ ID NO: 3295174 - protein, 23 aa, Plasmodium falciparum
RMERRTYNYLYDVKIKVFTTNKE

SEQ ID NO: 3295175 - protein, 19 aa, Plasmodium falciparum
RMEVFILLLIGVLSFIIRL

SEQ ID NO: 3295176 - protein, 20 aa, Plasmodium falciparum
RMFILIKQIVEYLLKEKYYF

SEQ ID NO: 3295177 - protein, 29 aa, Plasmodium falciparum
RMFSKAQFLMKPMLDMSLILENKNLEELK

SEQ ID NO: 3295178 - protein, 37 aa, Plasmodium falciparum
RMIIIGIVMLILSFIIWPLTTWSLKTSTWGRETYIII

SEQ ID NO: 3295179 - protein, 17 aa, Plasmodium falciparum
RMISEKSADGILDQLFD

SEQ ID NO: 3295180 - protein, 30 aa, Plasmodium falciparum
RMKPYLPQIAGILRWRLNTPLPKVRQQSAD

SEQ ID NO: 3295181 - protein, 18 aa, Plasmodium falciparum
RMLKFEKIFLDNSDYESI

SEQ ID NO: 3295182 - protein, 17 aa, Plasmodium falciparum
RMLWGEYGKLKEYNINE

SEQ ID NO: 3295183 - protein, 25 aa, Plasmodium falciparum
RMMRKYIYLCIQYLLRLREKYKYKK

SEQ ID NO: 3295184 - protein, 24 aa, Plasmodium falciparum
RMQKNIFKYITPLSNRFNLTKIRK

SEQ ID NO: 3295185 - protein, 17 aa, Plasmodium falciparum
RMYKILSYLWNNSSKDS

SEQ ID NO: 3295186 - protein, 40 aa, Plasmodium falciparum
RNAHNHITLIKIYELFILYKYKYKKILTFFFHDVEDEHIE

SEQ ID NO: 3295187 - protein, 27 aa, Plasmodium falciparum
RNCALQFCYYFHLYYCIFFYNKKENAF

SEQ ID NO: 3295188 - protein, 26 aa, Plasmodium falciparum
RNCFDGRYINVDYIRGLLKGKRSGSD

SEQ ID NO: 3295189 - protein, 32 aa, Plasmodium falciparum
RNDLFYVNFHPYIFMFINNIKNFFLNNLSVNE

SEQ ID NO: 3295190 - protein, 18 aa, Plasmodium falciparum
RNDLLLVALSGCIPFICF

SEQ ID NO: 3295191 - protein, 23 aa, Plasmodium falciparum
RNDLYLCIYIYENIMTITKKTIE

SEQ ID NO: 3295192 - protein, 25 aa, Plasmodium falciparum
RNDNLYFVIMSFYYLSFLKCYNFIT

SEQ ID NO: 3295193 - protein, 23 aa, Plasmodium falciparum
RNDYHMLLLLLLNLVNKKIENDN

SEQ ID NO: 3295194 - protein, 17 aa, Plasmodium falciparum
RNEIFISKYSLTLCINY

SEQ ID NO: 3295195 - protein, 34 aa, Plasmodium falciparum
RNERVKYVMIMKNLYNFFLKLKKKYNVDNSFSEK

SEQ ID NO: 3295196 - protein, 35 aa, Plasmodium falciparum
RNFHICSIFIHLSLLLMVILLMGTLSYDFFKSYIS

SEQ ID NO: 3295197 - protein, 20 aa, Plasmodium falciparum
RNFHIFYQVLYGLSDKQLYE

SEQ ID NO: 3295198 - protein, 41 aa, Plasmodium falciparum
RNFKKLIIIEIQRFYLLFVKLLKMLLLLNRQNGYSITCFEY

SEQ ID NO: 3295199 - protein, 26 aa, Plasmodium falciparum
RNFSPSFLFAFSDILLKLTPKINVID

SEQ ID NO: 3295200 - protein, 24 aa, Plasmodium falciparum
RNGNRFEYILDFLRDGVLICENDI

SEQ ID NO: 3295201 - protein, 21 aa, Plasmodium falciparum
RNHFITYTPKRSTRLLCECEL

SEQ ID NO: 3295202 - protein, 25 aa, Plasmodium falciparum
RNIFRYRIWRLISCYNYLNYLKIYF

SEQ ID NO: 3295203 - protein, 20 aa, Plasmodium falciparum
RNIHESEIFDYQWSIPTEPK

SEQ ID NO: 3295204 - protein, 24 aa, Plasmodium falciparum
RNIKSPMILSLRKNGRIWISKEDK

SEQ ID NO: 3295205 - protein, 30 aa, Plasmodium falciparum
RNILENFVYYYILFFLIFKKKQKCISIFSM

SEQ ID NO: 3295206 - protein, 30 aa, Plasmodium falciparum
RNINVNLHPLFWYLVMSNSSYINLSKFHHY

SEQ ID NO: 3295207 - protein, 27 aa, Plasmodium falciparum
RNIPFIQAIILILYKKINYVYERNIKE

SEQ ID NO: 3295208 - protein, 34 aa, Plasmodium falciparum
RNIVTLYVYIQRIQTFLWDKIYYIIQENLDSLNK

SEQ ID NO: 3295209 - protein, 17 aa, Plasmodium falciparum
RNIYKIHFKPYINMNAP

SEQ ID NO: 3295210 - protein, 28 aa, Plasmodium falciparum
RNKATSTFFFFLSRFLLICGFCIELYDN

SEQ ID NO: 3295211 - protein, 37 aa, Plasmodium falciparum
RNKEKFALYLRLMSLFINIIIGIYLIIYFPHTNNDMD

SEQ ID NO: 3295212 - protein, 24 aa, Plasmodium falciparum
RNKIESHLFFLRRRLFDVNRNKTD

SEQ ID NO: 3295213 - protein, 18 aa, Plasmodium falciparum
RNKKIQLRKLLLSGNNIN

SEQ ID NO: 3295214 - protein, 38 aa, Plasmodium falciparum
RNKKKPMILILKTFDCDLIGFFCPFSLNRDYNFVSTSD

SEQ ID NO: 3295215 - protein, 28 aa, Plasmodium falciparum
RNKRQPKKLYFPTPALQNAMLSNTIMWT

SEQ ID NO: 3295216 - protein, 23 aa, Plasmodium falciparum
RNKYISIFHLFKFAICEVAYQNI

SEQ ID NO: 3295217 - protein, 21 aa, Plasmodium falciparum
RNLCCAVSDYCMSYFTYDSEE

SEQ ID NO: 3295218 - protein, 18 aa, Plasmodium falciparum
RNLKYIKPHIYILCINKN

SEQ ID NO: 3295219 - protein, 23 aa, Plasmodium falciparum
RNLTLFYVSLIKLNIHIPIYIYN

SEQ ID NO: 3295220 - protein, 17 aa, Plasmodium falciparum
RNLVTIFGKIKDKIRDE

SEQ ID NO: 3295221 - protein, 17 aa, Plasmodium falciparum
RNMSYFFLMNVIRDHYD

SEQ ID NO: 3295222 - protein, 27 aa, Plasmodium falciparum
RNNERIFSFFILLLDNKKLSDLRRYVC

SEQ ID NO: 3295223 - protein, 30 aa, Plasmodium falciparum
RNNFLIQILCFVFLVISLGAAIFISTYVVQ

SEQ ID NO: 3295224 - protein, 19 aa, Plasmodium falciparum
RNNHKLYTLYYNKKYNIFI

SEQ ID NO: 3295225 - protein, 24 aa, Plasmodium falciparum
RNNKINIELLFVSNDHKLVYINTI

SEQ ID NO: 3295226 - protein, 19 aa, Plasmodium falciparum
RNNLELYFNIVKYLYENSK

SEQ ID NO: 3295227 - protein, 23 aa, Plasmodium falciparum
RNNLHILLLKYRILECMKLKDKD

SEQ ID NO: 3295228 - protein, 23 aa, Plasmodium falciparum
RNNLKLWNYIDVDKIILTCNKKL

SEQ ID NO: 3295229 - protein, 18 aa, Plasmodium falciparum
RNNLYIFKNYESITSIYI

SEQ ID NO: 3295230 - protein, 23 aa, Plasmodium falciparum
RNNYIQFIDILGESWYNLTKKME

SEQ ID NO: 3295231 - protein, 17 aa, Plasmodium falciparum
RNNYWGIWAADHSVNEN

SEQ ID NO: 3295232 - protein, 25 aa, Plasmodium falciparum
RNPYLCDMYQFLKYSYTKEEFNIIL

SEQ ID NO: 3295233 - protein, 23 aa, Plasmodium falciparum
RNQNIFGNLIFFTSLNLHYANLF

SEQ ID NO: 3295234 - protein, 25 aa, Plasmodium falciparum
RNRAMTIYLTHTCFPMISKILSEEL

SEQ ID NO: 3295235 - protein, 26 aa, Plasmodium falciparum
RNRIGGKFFFSTRTDKSYIGQVDLFI

SEQ ID NO: 3295236 - protein, 27 aa, Plasmodium falciparum
RNRLIKGLKYFLFRINKIKKRKVRLHI

SEQ ID NO: 3295237 - protein, 19 aa, Plasmodium falciparum
RNRPLPTLKFFLSDNDIVS

SEQ ID NO: 3295238 - protein, 24 aa, Plasmodium falciparum
RNRRSISLNIPKRSNLFKLRSNVI

SEQ ID NO: 3295239 - protein, 19 aa, Plasmodium falciparum
RNSDYLLWGFCVPSSFRSL

SEQ ID NO: 3295240 - protein, 23 aa, Plasmodium falciparum
RNSFLVYFCIFRNVSFCLCSMIL

SEQ ID NO: 3295241 - protein, 27 aa, Plasmodium falciparum
RNSFMSVLINLILFSQLFSILTIAVIL

SEQ ID NO: 3295242 - protein, 22 aa, Plasmodium falciparum
RNSLVLVSLKRGLNKSNINFIE

SEQ ID NO: 3295243 - protein, 23 aa, Plasmodium falciparum
RNTFEIYILKYINNISIIPRNTS

SEQ ID NO: 3295244 - protein, 26 aa, Plasmodium falciparum
RNTLIKYLIITLTDTNFYLWKENEEH

SEQ ID NO: 3295245 - protein, 25 aa, Plasmodium falciparum
RNTSPFCMNLMFYNFHEDFILILIK

SEQ ID NO: 3295246 - protein, 34 aa, Plasmodium falciparum
RNTYLKNYYIPHIDLLFIIIDLEVYYYYGKKKYK

SEQ ID NO: 3295247 - protein, 24 aa, Plasmodium falciparum
RNVEIYCARLFQYSIYQLHEEKYF

SEQ ID NO: 3295248 - protein, 23 aa, Plasmodium falciparum
RNVNYLKLMYIISNVILPKNGYV

SEQ ID NO: 3295249 - protein, 19 aa, Plasmodium falciparum
RNYDEFLKLYNLKDSSDNQ

SEQ ID NO: 3295250 - protein, 17 aa, Plasmodium falciparum
RNYIIKDSVIRSMFRDE

SEQ ID NO: 3295251 - protein, 30 aa, Plasmodium falciparum
RNYIMNTSKFIIILGKYLQLSFCTICIALY

SEQ ID NO: 3295252 - protein, 22 aa, Plasmodium falciparum
RNYIYYYINMCILLNENLNTLK

SEQ ID NO: 3295253 - protein, 20 aa, Plasmodium falciparum
RNYKHIFMKVLSSCGHIEKL

SEQ ID NO: 3295254 - protein, 23 aa, Plasmodium falciparum
RNYKYTFILISSKCNIIIITLRK

SEQ ID NO: 3295255 - protein, 23 aa, Plasmodium falciparum
RNYLKSFYITNTSNFPLVFMCVY

SEQ ID NO: 3295256 - protein, 18 aa, Plasmodium falciparum
RNYPFFVDLIFWGRANEN

SEQ ID NO: 3295257 - protein, 20 aa, Plasmodium falciparum
RNYRHLWIFPIHMKNKFKVK

SEQ ID NO: 3295258 - protein, 29 aa, Plasmodium falciparum
RPCTFIICSLICCLLLTCGFYFKEHEKDI

SEQ ID NO: 3295259 - protein, 30 aa, Plasmodium falciparum
RPKELYCNLFLLIFVILTIGCTYVKIENLS

SEQ ID NO: 3295260 - protein, 32 aa, Plasmodium falciparum
RPKKQPIMTKRWWFYGILPHTIFEALCVLLSL

SEQ ID NO: 3295261 - protein, 20 aa, Plasmodium falciparum
RPLIYSLHILCVNYLIKIVK

SEQ ID NO: 3295262 - protein, 48 aa, Plasmodium falciparum
RPNICTFYGICIKSNKLMLLLEYYAKGNLFNFLKNKNKIHKKQRLEWA

SEQ ID NO: 3295263 - protein, 27 aa, Plasmodium falciparum
RPNRIQFYGRFPFFFEIPKYHIDDPTF

SEQ ID NO: 3295264 - protein, 21 aa, Plasmodium falciparum
RPQFEIINATKFIIAYATDIN

SEQ ID NO: 3295265 - protein, 18 aa, Plasmodium falciparum
RQCFVCTTVQLICNVVLI

SEQ ID NO: 3295266 - protein, 20 aa, Plasmodium falciparum
RQGFCLGNLNYLLNDDIYNV

SEQ ID NO: 3295267 - protein, 27 aa, Plasmodium falciparum
RQHIDISVLFFFPYNDFIYIIDKTGIL

SEQ ID NO: 3295268 - protein, 27 aa, Plasmodium falciparum
RQHPSDWLIILMIIQKGIYTILEKDIW

SEQ ID NO: 3295269 - protein, 18 aa, Plasmodium falciparum
RQIFIKKLKERSMLYYKK

SEQ ID NO: 3295270 - protein, 35 aa, Plasmodium falciparum
RQIRKYINIKIYALSLLERIFYRKEKENLKLCFVR

SEQ ID NO: 3295271 - protein, 45 aa, Plasmodium falciparum
RQITPKEYRLTDVLLPSAFPLSVGIAFVALSYFVLKKKTKASVGN

SEQ ID NO: 3295272 - protein, 23 aa, Plasmodium falciparum
RQIVEIYIRIINILKLKRVGKRY

SEQ ID NO: 3295273 - protein, 20 aa, Plasmodium falciparum
RQKDIWRKWIKKQNFIIYNY

SEQ ID NO: 3295274 - protein, 17 aa, Plasmodium falciparum
RQKELYLRGAKYNNNSN

SEQ ID NO: 3295275 - protein, 17 aa, Plasmodium falciparum
RQKFILPFILSLISNDK

SEQ ID NO: 3295276 - protein, 30 aa, Plasmodium falciparum
RQKINIYYYKLFIEMFIPLLICVDTKECYH

SEQ ID NO: 3295277 - protein, 23 aa, Plasmodium falciparum
RQMLNPLHRLLISPSLIRLSFYI

SEQ ID NO: 3295278 - protein, 26 aa, Plasmodium falciparum
RQMTFQKLPLILNRMKIEKKLIKMKK

SEQ ID NO: 3295279 - protein, 21 aa, Plasmodium falciparum
RQNKNHIFTYKLKKNIYGKIQ

SEQ ID NO: 3295280 - protein, 22 aa, Plasmodium falciparum
RQNLLWHIYIENNRYISDQWKN

SEQ ID NO: 3295281 - protein, 26 aa, Plasmodium falciparum
RQSRAMFKVYLCTKLLYDRVCEELAL

SEQ ID NO: 3295282 - protein, 21 aa, Plasmodium falciparum
RQWNNMQVPYITLYEQARTVR

SEQ ID NO: 3295283 - protein, 17 aa, Plasmodium falciparum
RQYCILRNSTVSDLFVN

SEQ ID NO: 3295284 - protein, 25 aa, Plasmodium falciparum
RRASRRPMMVKMQRGMKDEVDEWIK

SEQ ID NO: 3295285 - protein, 25 aa, Plasmodium falciparum
RRDIFPIPYFIIYKNKNKNVFSSNE

SEQ ID NO: 3295286 - protein, 17 aa, Plasmodium falciparum
RRDTPPMIIVKPSKENF

SEQ ID NO: 3295287 - protein, 20 aa, Plasmodium falciparum
RREFKKILGYHNFSSKSSLD

SEQ ID NO: 3295288 - protein, 24 aa, Plasmodium falciparum
RRFFIYFIIIMYRLFILYFIPSII

SEQ ID NO: 3295289 - protein, 17 aa, Plasmodium falciparum
RRGPFIKEYLKNSEKSF

SEQ ID NO: 3295290 - protein, 24 aa, Plasmodium falciparum
RRGRKMLDFLIMLNKFYDNINVRH

SEQ ID NO: 3295291 - protein, 25 aa, Plasmodium falciparum
RRHSFKKILYIYLNNNIKINDNDQT

SEQ ID NO: 3295292 - protein, 27 aa, Plasmodium falciparum
RRIFIEMAAIETFFQWHKFKKEKVREI

SEQ ID NO: 3295293 - protein, 26 aa, Plasmodium falciparum
RRIIYKLPVIILNLPSRKNKIYTNIY

SEQ ID NO: 3295294 - protein, 27 aa, Plasmodium falciparum
RRKENYQRVLLLYNPKFNDGAKRNSYI

SEQ ID NO: 3295295 - protein, 21 aa, Plasmodium falciparum
RRKGYTLWYLNLDQTSDSLKT

SEQ ID NO: 3295296 - protein, 33 aa, Plasmodium falciparum
RRKIFQTWYMAYLFIHKIYLISKMWNIVKNWEA

SEQ ID NO: 3295297 - protein, 26 aa, Plasmodium falciparum
RRKRKRLYQIHVIRKYVKKMKSKRSK

SEQ ID NO: 3295298 - protein, 18 aa, Plasmodium falciparum
RRLFKCFSLFIGQQKYMD

SEQ ID NO: 3295299 - protein, 17 aa, Plasmodium falciparum
RRLHLCHHNLENIKDVN

SEQ ID NO: 3295300 - protein, 29 aa, Plasmodium falciparum
RRLNPFSIFYIYEIKKYTCLNLKMKIGNS

SEQ ID NO: 3295301 - protein, 18 aa, Plasmodium falciparum
RRLTVLNQIAWKALSNQI

SEQ ID NO: 3295302 - protein, 24 aa, Plasmodium falciparum
RRNIKFFLIFTNTVRLLIWGFFIP

SEQ ID NO: 3295303 - protein, 27 aa, Plasmodium falciparum
RRNKPKRFPFFIPLKIMKCRKEMHLIK

SEQ ID NO: 3295304 - protein, 30 aa, Plasmodium falciparum
RRPCLKYLISLLLLLMLMLILRKQNDEEEE

SEQ ID NO: 3295305 - protein, 53 aa, Plasmodium falciparum
RRPRRTLELLDNPPFKTALMSSTIMWSIGIGFAAFTYFFLKKKTKSSVGNLFQ

SEQ ID NO: 3295306 - protein, 18 aa, Plasmodium falciparum
RRQLCLIGNRRFVGRVKD

SEQ ID NO: 3295307 - protein, 18 aa, Plasmodium falciparum
RRRHICDQNLEFLDNPHT

SEQ ID NO: 3295308 - protein, 25 aa, Plasmodium falciparum
RRRIDFYFPFFFENTTNVCLYVNNK

SEQ ID NO: 3295309 - protein, 18 aa, Plasmodium falciparum
RRRNIFLMLSYCKYEKSG

SEQ ID NO: 3295310 - protein, 29 aa, Plasmodium falciparum
RRRRLRRLRLLVLRFRRRLRRGHRDYKGP

SEQ ID NO: 3295311 - protein, 17 aa, Plasmodium falciparum
RRWKRFLHMKGSNNRNI

SEQ ID NO: 3295312 - protein, 25 aa, Plasmodium falciparum
RSDEKIFFHLLKIDKLFKKYHIIGK

SEQ ID NO: 3295313 - protein, 34 aa, Plasmodium falciparum
RSDNLLQKLSLTSSFFILISYLTVQVGFFFDVTI

SEQ ID NO: 3295314 - protein, 28 aa, Plasmodium falciparum
RSELQNVYKYIIKLKENYIKKCVLVDNQ

SEQ ID NO: 3295315 - protein, 21 aa, Plasmodium falciparum
RSFILFFKYMSHICNFYNVYK

SEQ ID NO: 3295316 - protein, 26 aa, Plasmodium falciparum
RSFRKFWQAKNFYDIAIYLGYKDEKG

SEQ ID NO: 3295317 - protein, 24 aa, Plasmodium falciparum
RSFVYFVLVCNLINNVIICHKINY

SEQ ID NO: 3295318 - protein, 35 aa, Plasmodium falciparum
RSGCTKMFRFFKKIGLNIIYIFSKTKRICIGIYVL

SEQ ID NO: 3295319 - protein, 35 aa, Plasmodium falciparum
RSICRIFFFLFFLSLSYKTLLNIYLYNENPRTNGQ

SEQ ID NO: 3295320 - protein, 18 aa, Plasmodium falciparum
RSIFFFGGHTIFLKKKKK

SEQ ID NO: 3295321 - protein, 26 aa, Plasmodium falciparum
RSILEKYFYDIWKRNITIKKEIYSLS

SEQ ID NO: 3295322 - protein, 30 aa, Plasmodium falciparum
RSISSFILFLVFIICVMLFNIYISYKFSDI

SEQ ID NO: 3295323 - protein, 21 aa, Plasmodium falciparum
RSKNILLDNYIDILKRDGNEK

SEQ ID NO: 3295324 - protein, 27 aa, Plasmodium falciparum
RSLEKERMLNFPLIHLGENDVIVKRIK

SEQ ID NO: 3295325 - protein, 23 aa, Plasmodium falciparum
RSMLYVFAKYIFNKNVFLELGEL

SEQ ID NO: 3295326 - protein, 21 aa, Plasmodium falciparum
RSNYVCIPDRRIQLCIVNLSI

SEQ ID NO: 3295327 - protein, 36 aa, Plasmodium falciparum
RSRNYIGYRCLIVSLLIFYLIIQLSYDNFGENTYNS

SEQ ID NO: 3295328 - protein, 18 aa, Plasmodium falciparum
RSSLFSFILFFHVFGIIG

SEQ ID NO: 3295329 - protein, 22 aa, Plasmodium falciparum
RSYLIIECISLFLYTYGHLLND

SEQ ID NO: 3295330 - protein, 21 aa, Plasmodium falciparum
RSYNDLIYRCPITLEQALTGH

SEQ ID NO: 3295331 - protein, 27 aa, Plasmodium falciparum
RSYNLFTSFFIVLYSCLIYMLNDESEL

SEQ ID NO: 3295332 - protein, 24 aa, Plasmodium falciparum
RTDENYIFLYLPIVLNEMIKMNNR

SEQ ID NO: 3295333 - protein, 17 aa, Plasmodium falciparum
RTDILKCLLILLSSYMY

SEQ ID NO: 3295334 - protein, 41 aa, Plasmodium falciparum
RTDLKFNLSIIFKAYARKALALFILFQFKDSLTNFTQALEF

SEQ ID NO: 3295335 - protein, 38 aa, Plasmodium falciparum
RTFFSAIICFFKSIFIFLYFCLCPWKLLKLKKKKSNDN

SEQ ID NO: 3295336 - protein, 31 aa, Plasmodium falciparum
RTFMNKIIIHNFLIICYSYIMLIKKQQVDLK

SEQ ID NO: 3295337 - protein, 19 aa, Plasmodium falciparum
RTFYYINIWEKNKAFYDET

SEQ ID NO: 3295338 - protein, 18 aa, Plasmodium falciparum
RTGLLFFISGVTGNLLSA

SEQ ID NO: 3295339 - protein, 35 aa, Plasmodium falciparum
RTHKKIIIYHLLDIIIFFLLFFSCYNFNLELCYKY

SEQ ID NO: 3295340 - protein, 18 aa, Plasmodium falciparum
RTHNILWCYKKKLDFSTS

SEQ ID NO: 3295341 - protein, 21 aa, Plasmodium falciparum
RTIYAIPFIKLLLILLSNLCL

SEQ ID NO: 3295342 - protein, 20 aa, Plasmodium falciparum
RTKNILFSLCYFHSIIVERA

SEQ ID NO: 3295343 - protein, 59 aa, Plasmodium falciparum
RTKNVINIVLCIFKLLILTKEILVYYILNLFIYYYIWLKCYFVLYNIIYEYIERKDYML

SEQ ID NO: 3295344 - protein, 19 aa, Plasmodium falciparum
RTKYPFIQFVYSYSKKKVC

SEQ ID NO: 3295345 - protein, 22 aa, Plasmodium falciparum
RTLILQIFACIFILIVFFVIFS

SEQ ID NO: 3295346 - protein, 46 aa, Plasmodium falciparum
RTNDWNIQMLYYLIMKPANMDLLLYLILTYYKFPFLDIIEQYQNIS

SEQ ID NO: 3295347 - protein, 18 aa, Plasmodium falciparum
RTNILNFLEASFSPQIYL

SEQ ID NO: 3295348 - protein, 49 aa, Plasmodium falciparum
RTNYLIYDINILKDYLYIYLKKYFDDIILLFEYFFSMSSNFFYNDFVNK

SEQ ID NO: 3295349 - protein, 25 aa, Plasmodium falciparum
RTRDLTLLILILRKNNFDNIYYINL

SEQ ID NO: 3295350 - protein, 17 aa, Plasmodium falciparum
RTRIRTRTFWQNLFGLS

SEQ ID NO: 3295351 - protein, 17 aa, Plasmodium falciparum
RTRNEIFISKYSLTLCI

SEQ ID NO: 3295352 - protein, 25 aa, Plasmodium falciparum
RTYEFLFSFFLLLDNIQINISNLID

SEQ ID NO: 3295353 - protein, 29 aa, Plasmodium falciparum
RTYGTHYLFVYLLFAIWLATVETVIMLHF

SEQ ID NO: 3295354 - protein, 17 aa, Plasmodium falciparum
RVAIFSNKLNQFITTFL

SEQ ID NO: 3295355 - protein, 21 aa, Plasmodium falciparum
RVDYKYFLIDTINNEIYEKIE

SEQ ID NO: 3295356 - protein, 21 aa, Plasmodium falciparum
RVEEVLGKEGFVIEEIIEEGS

SEQ ID NO: 3295357 - protein, 20 aa, Plasmodium falciparum
RVEFLNCLKYIFSYNKEMYS

SEQ ID NO: 3295358 - protein, 18 aa, Plasmodium falciparum
RVFLFSFIFFNIKCIQSI

SEQ ID NO: 3295359 - protein, 23 aa, Plasmodium falciparum
RVFVLFMYFFVQNVNSNKSTNVS

SEQ ID NO: 3295360 - protein, 23 aa, Plasmodium falciparum
RVGDILLYFELVQSKDAMKFPIY

SEQ ID NO: 3295361 - protein, 27 aa, Plasmodium falciparum
RVHINLIIILIIYIASIKIYNVRKVQS

SEQ ID NO: 3295362 - protein, 31 aa, Plasmodium falciparum
RVHKSRLILILIYHFLFIISSNNLHNNNNNI

SEQ ID NO: 3295363 - protein, 29 aa, Plasmodium falciparum
RVIQYIIVKIILLLFFYFNNNKCETFLSP

SEQ ID NO: 3295364 - protein, 22 aa, Plasmodium falciparum
RVIVMACRLLWRKTLATLKEEG

SEQ ID NO: 3295365 - protein, 35 aa, Plasmodium falciparum
RVKHTVIQVFLFLVFMLLLFMQLPEQNYYKGLLLS

SEQ ID NO: 3295366 - protein, 20 aa, Plasmodium falciparum
RVKIYLQLNKIYFSLNRYSE

SEQ ID NO: 3295367 - protein, 17 aa, Plasmodium falciparum
RVKLMLQRLSNSYLEAV

SEQ ID NO: 3295368 - protein, 39 aa, Plasmodium falciparum
RVKRCRLYFQLYFQELYDFELSFLNWSFSDLLSSSYIQA

SEQ ID NO: 3295369 - protein, 29 aa, Plasmodium falciparum
RVLNLKYALYQYGILASIVIFFFLIIIFK

SEQ ID NO: 3295370 - protein, 21 aa, Plasmodium falciparum
RVLVPLIMNAILLVDIYYIEE

SEQ ID NO: 3295371 - protein, 34 aa, Plasmodium falciparum
RVNCKNSIYECRGICDKGYKFKPYAKSNEIVESY

SEQ ID NO: 3295372 - protein, 18 aa, Plasmodium falciparum
RVPLPIWTEKEMSISYND

SEQ ID NO: 3295373 - protein, 20 aa, Plasmodium falciparum
RVQILYECSFILSSIINSII

SEQ ID NO: 3295374 - protein, 24 aa, Plasmodium falciparum
RVQKNTIILSPFFMPVGTKCCIKG

SEQ ID NO: 3295375 - protein, 25 aa, Plasmodium falciparum
RVQLLQDYENIFEQIQNMENQNKDK

SEQ ID NO: 3295376 - protein, 21 aa, Plasmodium falciparum
RVSTYHYYAHRIYELMPKLSF

SEQ ID NO: 3295377 - protein, 26 aa, Plasmodium falciparum
RVTKKNIPSILYYCLNNCNDLTCAEL

SEQ ID NO: 3295378 - protein, 18 aa, Plasmodium falciparum
RVTPFNSPGLNMGRPYMF

SEQ ID NO: 3295379 - protein, 23 aa, Plasmodium falciparum
RWALFFFLLVTLFKINNVFSKRK

SEQ ID NO: 3295380 - protein, 22 aa, Plasmodium falciparum
RWDFIIFFVFFVLITLLRLVIS

SEQ ID NO: 3295381 - protein, 21 aa, Plasmodium falciparum
RWFILVFFMLQRFFEFKSKIT

SEQ ID NO: 3295382 - protein, 20 aa, Plasmodium falciparum
RWLCKVIVKSVFRDVNVINP

SEQ ID NO: 3295383 - protein, 28 aa, Plasmodium falciparum
RWNAKRLFKILFVTVFIVLAGGFSYYIF

SEQ ID NO: 3295384 - protein, 40 aa, Plasmodium falciparum
RWNKIKLSSWGYKGSLLINFFYSYFYNTKHKLLVVISYDN

SEQ ID NO: 3295385 - protein, 39 aa, Plasmodium falciparum
RWRGKLFVLHSICIFLLWCSWLFILFNDVKDYLPIVVNV

SEQ ID NO: 3295386 - protein, 42 aa, Plasmodium falciparum
RYEHIKNHFLLIQYRLIFPMYLFISFYFYNQKLIASKNIMDN

SEQ ID NO: 3295387 - protein, 37 aa, Plasmodium falciparum
RYEKDDFFFEQLIFYKIIYAYILLEYGILSQAQRYVE

SEQ ID NO: 3295388 - protein, 18 aa, Plasmodium falciparum
RYEKILNLTYFDINEYDG

SEQ ID NO: 3295389 - protein, 20 aa, Plasmodium falciparum
RYFFNIFEKIIKRYIFNNVM

SEQ ID NO: 3295390 - protein, 17 aa, Plasmodium falciparum
RYFLINSLNINHDVIKF

SEQ ID NO: 3295391 - protein, 18 aa, Plasmodium falciparum
RYFVDYKNLLLQPSQKKN

SEQ ID NO: 3295392 - protein, 26 aa, Plasmodium falciparum
RYGNFFLFFIIYIFTILHIIDFKRNN

SEQ ID NO: 3295393 - protein, 33 aa, Plasmodium falciparum
RYHIRLLFVLLIFYILIIFIIDLSINTSIIYSY

SEQ ID NO: 3295394 - protein, 27 aa, Plasmodium falciparum
RYHRNKILIHLLYELINYEKYKYTINI

SEQ ID NO: 3295395 - protein, 17 aa, Plasmodium falciparum
RYHSYLMSFLMNSLSNE

SEQ ID NO: 3295396 - protein, 29 aa, Plasmodium falciparum
RYIMEKWKYEKWFEELKIEWVKEQGIYIK

SEQ ID NO: 3295397 - protein, 18 aa, Plasmodium falciparum
RYIPYRSGTYKGKTYIYM

SEQ ID NO: 3295398 - protein, 17 aa, Plasmodium falciparum
RYIPYTSGKYRGKRYIY

SEQ ID NO: 3295399 - protein, 39 aa, Plasmodium falciparum
RYKNKIIISAFFTFTLELFICLFCIYIFVYPNECKFRKF

SEQ ID NO: 3295400 - protein, 36 aa, Plasmodium falciparum
RYKSSYLYEIILGTLFFAYILYVKYNYNKEEIFIDR

SEQ ID NO: 3295401 - protein, 20 aa, Plasmodium falciparum
RYKYFHKCLIRLLKEKMKKK

SEQ ID NO: 3295402 - protein, 18 aa, Plasmodium falciparum
RYKYFYYSSYYMNSFDFA

SEQ ID NO: 3295403 - protein, 38 aa, Plasmodium falciparum
RYKYRKDKFLLDRLSILCRFILSYMKTSWIKNFIHFNG

SEQ ID NO: 3295404 - protein, 27 aa, Plasmodium falciparum
RYLLIIYEKVFKVIYIKNLKDKKDENV

SEQ ID NO: 3295405 - protein, 22 aa, Plasmodium falciparum
RYLYRFCEWNNGDYKRIIENDS

SEQ ID NO: 3295406 - protein, 36 aa, Plasmodium falciparum
RYMNKRYMDKIYMDKIYMDKIYMDKIYMDNEYMTDN

SEQ ID NO: 3295407 - protein, 19 aa, Plasmodium falciparum
RYNLPFKTFMLWYMCISVS

SEQ ID NO: 3295408 - protein, 32 aa, Plasmodium falciparum
RYNQLNIRLLFYKVIFKNIIKYILYIKYDDHK

SEQ ID NO: 3295409 - protein, 17 aa, Plasmodium falciparum
RYNSNYSPIPYPEQYNP

SEQ ID NO: 3295410 - protein, 21 aa, Plasmodium falciparum
RYPYLCSYTCNIKNISLTCEE

SEQ ID NO: 3295411 - protein, 21 aa, Plasmodium falciparum
RYQFIFCNILCIIMGFFSVYI

SEQ ID NO: 3295412 - protein, 28 aa, Plasmodium falciparum
RYQYFMYLFFIIFIFFIPQIIKNIYIYN

SEQ ID NO: 3295413 - protein, 32 aa, Plasmodium falciparum
RYSKENYFSVSIYDKKLVYKNIKKIENIQGAS

SEQ ID NO: 3295414 - protein, 30 aa, Plasmodium falciparum
RYSKKSIMYYIFSLFCNKIYNINKKKKCIH

SEQ ID NO: 3295415 - protein, 26 aa, Plasmodium falciparum
RYSMNKFYKYIYIRNIKDRLQQNYIV

SEQ ID NO: 3295416 - protein, 23 aa, Plasmodium falciparum
RYSTLFMLCFFSFMGFLSVVVTT

SEQ ID NO: 3295417 - protein, 57 aa, Plasmodium falciparum
RYYENFFNRRRSKKWNYFIIFFLGVCLGFAIWPFFMTIITYRLFYKDNFNNTNYRTN

SEQ ID NO: 3295418 - protein, 17 aa, Plasmodium falciparum
SAALVLLLIGFLSITQF

SEQ ID NO: 3295419 - protein, 24 aa, Plasmodium falciparum
SAERHNLYLLLKKEKQKIILIDGK

SEQ ID NO: 3295420 - protein, 20 aa, Plasmodium falciparum
SAFCFVIAPDYHKVLSNYLI

SEQ ID NO: 3295421 - protein, 19 aa, Plasmodium falciparum
SAFEFTYMINFGRGQNYWE

SEQ ID NO: 3295422 - protein, 20 aa, Plasmodium falciparum
SAFIFTFNSNFNFYKWSGKN

SEQ ID NO: 3295423 - protein, 17 aa, Plasmodium falciparum
SAFTQLINYIILDFEKK

SEQ ID NO: 3295424 - protein, 19 aa, Plasmodium falciparum
SAFVLLYSLFKYNKYIKMN

SEQ ID NO: 3295425 - protein, 25 aa, Plasmodium falciparum
SAICKSVHFFWISKDLVAGGTTELD

SEQ ID NO: 3295426 - protein, 42 aa, Plasmodium falciparum
SAIFLPCGIAALVLLILTVLLIILYIWLYRRRKRSWKHECKK

SEQ ID NO: 3295427 - protein, 24 aa, Plasmodium falciparum
SALGIPSLILFLKAVCQSKKNWEA

SEQ ID NO: 3295428 - protein, 21 aa, Plasmodium falciparum
SALLTWIGTIAAKAAILGSFP

SEQ ID NO: 3295429 - protein, 23 aa, Plasmodium falciparum
SAMSFLRSIISLSSAPVSRSEGQ

SEQ ID NO: 3295430 - protein, 31 aa, Plasmodium falciparum
SANDNDTVMVIKILKDKWGTGRIVDTIANSL

SEQ ID NO: 3295431 - protein, 30 aa, Plasmodium falciparum
SANILWNVIKIFMFFLQFEENHSLLLFYFY

SEQ ID NO: 3295432 - protein, 27 aa, Plasmodium falciparum
SARRTNLYESLKEYYEKYIIGNKNIKK

SEQ ID NO: 3295433 - protein, 26 aa, Plasmodium falciparum
SASFLGYIYIIPYKNIRFKDYFRIGN

SEQ ID NO: 3295434 - protein, 17 aa, Plasmodium falciparum
SASKLRSLVISIWSNIP

SEQ ID NO: 3295435 - protein, 29 aa, Plasmodium falciparum
SASLRQLYMSILMLYYLYPLHVCTNNTYN

SEQ ID NO: 3295436 - protein, 31 aa, Plasmodium falciparum
SATKLEEFSRRPTFFRWLEEWGEDFCRKRND

SEQ ID NO: 3295437 - protein, 32 aa, Plasmodium falciparum
SAVAAFASYVVGFFTFSLFSSCVTIASSTYLL

SEQ ID NO: 3295438 - protein, 24 aa, Plasmodium falciparum
SAYIYMYIIFFFLCIYVEKNLFLY

SEQ ID NO: 3295439 - protein, 17 aa, Plasmodium falciparum
SAYLYYSKIFTIIKYCN

SEQ ID NO: 3295440 - protein, 23 aa, Plasmodium falciparum
SAYNLYLNYYYFMKRYSSYGIKK

SEQ ID NO: 3295441 - protein, 24 aa, Plasmodium falciparum
SAYNLYLNYYYFMKRYSSYGMKKT

SEQ ID NO: 3295442 - protein, 23 aa, Plasmodium falciparum
SCANIVHPFLFNLNDYKDHKKEI

SEQ ID NO: 3295443 - protein, 24 aa, Plasmodium falciparum
SCAPFVDWIDNQKLEFLKQRKKYT

SEQ ID NO: 3295444 - protein, 24 aa, Plasmodium falciparum
SCCFPNVPDIYLFNWKCDDCLKCN

SEQ ID NO: 3295445 - protein, 35 aa, Plasmodium falciparum
SCDEFCDAWNRSLADYKDIFQGKDMWNDGKYGEAK

SEQ ID NO: 3295446 - protein, 46 aa, Plasmodium falciparum
SCDFRNYFFLIFCNYRKFIDMYSLPYILDVFIMLNKFFTINNNSII

SEQ ID NO: 3295447 - protein, 17 aa, Plasmodium falciparum
SCDNNIIIIYDKYKLYV

SEQ ID NO: 3295448 - protein, 18 aa, Plasmodium falciparum
SCDQNLKHIVIFAKRDIA

SEQ ID NO: 3295449 - protein, 22 aa, Plasmodium falciparum
SCDRSILYLLNLTHYSSSTDEY

SEQ ID NO: 3295450 - protein, 25 aa, Plasmodium falciparum
SCFGLFFIFLILKINFDQSSYDHIN

SEQ ID NO: 3295451 - protein, 17 aa, Plasmodium falciparum
SCFILILSIKHDKYNNE

SEQ ID NO: 3295452 - protein, 26 aa, Plasmodium falciparum
SCINIKYVFFIMKRIFEDTPYITYKQ

SEQ ID NO: 3295453 - protein, 37 aa, Plasmodium falciparum
SCIQSSIYFFLYKYICYHFFSIFIQNILYKIMHSTSP

SEQ ID NO: 3295454 - protein, 32 aa, Plasmodium falciparum
SCISLYLTKLCLFIIPIYGLSVLCLLKSLKRI

SEQ ID NO: 3295455 - protein, 27 aa, Plasmodium falciparum
SCIYTNSFFFIYQFKLHIKYHELLKFN

SEQ ID NO: 3295456 - protein, 31 aa, Plasmodium falciparum
SCKKYIFSVFVFLCCFLMSFNIFEPRIEIIE

SEQ ID NO: 3295457 - protein, 27 aa, Plasmodium falciparum
SCKSSLLFGWQRIFYQCVVSWDDEKLV

SEQ ID NO: 3295458 - protein, 20 aa, Plasmodium falciparum
SCLILPVYTLPFLKQLHLPY

SEQ ID NO: 3295459 - protein, 17 aa, Plasmodium falciparum
SCLLFYKHIGHTKYRYE

SEQ ID NO: 3295460 - protein, 17 aa, Plasmodium falciparum
SCNKFVFVLLRFFKHDN

SEQ ID NO: 3295461 - protein, 26 aa, Plasmodium falciparum
SCTEKNLYEIYLKEFIKFLNNIIVQF

SEQ ID NO: 3295462 - protein, 19 aa, Plasmodium falciparum
SCTHIWLNCYYDITNYHLY

SEQ ID NO: 3295463 - protein, 29 aa, Plasmodium falciparum
SCTKKYTNVCLLLFDYFGYYNVVIQYYKK

SEQ ID NO: 3295464 - protein, 19 aa, Plasmodium falciparum
SCTPTLPALSFDLSINTFL

SEQ ID NO: 3295465 - protein, 30 aa, Plasmodium falciparum
SCVDKYMLGILFIAIWNNGYLWYKSDPLQD

SEQ ID NO: 3295466 - protein, 29 aa, Plasmodium falciparum
SCVMNNKWFLFCRRIILQPNFNLCFLSYN

SEQ ID NO: 3295467 - protein, 32 aa, Plasmodium falciparum
SCVNLRLFRTVFLSWILTVVFSATVTAGIYSF

SEQ ID NO: 3295468 - protein, 25 aa, Plasmodium falciparum
SCWYQINQVFEWLPIGAIVEDKILC

SEQ ID NO: 3295469 - protein, 23 aa, Plasmodium falciparum
SCYMINTMKLSLYFEKYPIIIAF

SEQ ID NO: 3295470 - protein, 26 aa, Plasmodium falciparum
SDASHLFCDLLSFALNLFSIYVSSFQ

SEQ ID NO: 3295471 - protein, 30 aa, Plasmodium falciparum
SDASTDVFILFLSLLLELVLLAATVTTFFS

SEQ ID NO: 3295472 - protein, 27 aa, Plasmodium falciparum
SDAVERFYLFIDAFLVLLKMSTAYRTQ

SEQ ID NO: 3295473 - protein, 26 aa, Plasmodium falciparum
SDDIFKTDFFHKSVLAWYNIKSKSYI

SEQ ID NO: 3295474 - protein, 40 aa, Plasmodium falciparum
SDDVYNYIYILQKYFLSFKFWYFYLRYQGIDKMKKLFNNE

SEQ ID NO: 3295475 - protein, 17 aa, Plasmodium falciparum
SDENFIMRLKRSNMLKF

SEQ ID NO: 3295476 - protein, 26 aa, Plasmodium falciparum
SDENNFHIFYYILNGSSENFKKKYFL

SEQ ID NO: 3295477 - protein, 40 aa, Plasmodium falciparum
SDESILHTTIPFGVALALGSIAFLFLKKKTKSTIDLLRVI

SEQ ID NO: 3295478 - protein, 57 aa, Plasmodium falciparum
SDETKYLRNVLFLKKYYNIFSIILIAWFHNPLSAISFLLWLQKYELAYYISSYLTLL

SEQ ID NO: 3295479 - protein, 26 aa, Plasmodium falciparum
SDFYKLREDWWALNRKEVWKAITCKA

SEQ ID NO: 3295480 - protein, 25 aa, Plasmodium falciparum
SDICTNYFLAFFEDIYFNKHQLNNL

SEQ ID NO: 3295481 - protein, 23 aa, Plasmodium falciparum
SDIDNPFIPLSLDDLFFSCIDEK

SEQ ID NO: 3295482 - protein, 26 aa, Plasmodium falciparum
SDIEIIIRICVDLKYLLYHHEVIKIV

SEQ ID NO: 3295483 - protein, 29 aa, Plasmodium falciparum
SDIHFEFHDLRQIMKFLDEKKKYFKQKKN

SEQ ID NO: 3295484 - protein, 23 aa, Plasmodium falciparum
SDIIFLIITIILSIVIILVVYFI

SEQ ID NO: 3295485 - protein, 42 aa, Plasmodium falciparum
SDIIPYYINPLIRNFFSIILNFSYIFYLNKKLSLVILYCFMI

SEQ ID NO: 3295486 - protein, 23 aa, Plasmodium falciparum
SDIKNTFKYFWYNDFCINVSNIF

SEQ ID NO: 3295487 - protein, 19 aa, Plasmodium falciparum
SDILECFNFCAKKKARIIN

SEQ ID NO: 3295488 - protein, 17 aa, Plasmodium falciparum
SDILQKTIPFGIALALG

SEQ ID NO: 3295489 - protein, 23 aa, Plasmodium falciparum
SDILYILFIVFFYNLYSYFKNHK

SEQ ID NO: 3295490 - protein, 26 aa, Plasmodium falciparum
SDIWALGVMVFFMLTGKYPFEGKNTP

SEQ ID NO: 3295491 - protein, 28 aa, Plasmodium falciparum
SDKDPQTWWNAHAPSIWNAMVCALTYDT

SEQ ID NO: 3295492 - protein, 25 aa, Plasmodium falciparum
SDKKKKYIYFILKKMEFPVETIFNE

SEQ ID NO: 3295493 - protein, 24 aa, Plasmodium falciparum
SDKKNNYFLKYKKITNLISKLEGA

SEQ ID NO: 3295494 - protein, 25 aa, Plasmodium falciparum
SDKTPQQTWWQAHGPDIWNGMVCAL

SEQ ID NO: 3295495 - protein, 21 aa, Plasmodium falciparum
SDLKVLWDLTSLIKAKVIENF

SEQ ID NO: 3295496 - protein, 23 aa, Plasmodium falciparum
SDLLQYFNYVIFFNCVSIRMIYI

SEQ ID NO: 3295497 - protein, 25 aa, Plasmodium falciparum
SDLNKIKIILLFTQIIFDEINQIHM

SEQ ID NO: 3295498 - protein, 24 aa, Plasmodium falciparum
SDLRYLCVHGFFNIISKVEYTYVI

SEQ ID NO: 3295499 - protein, 22 aa, Plasmodium falciparum
SDMKHLCLLLYLITSNKNNNNN

SEQ ID NO: 3295500 - protein, 36 aa, Plasmodium falciparum
SDNELFKIMLDKLVKMGILLIRPYIPLENISKNKSK

SEQ ID NO: 3295501 - protein, 29 aa, Plasmodium falciparum
SDNENIFFGFLFFYGLILEPTRELCQQVY

SEQ ID NO: 3295502 - protein, 25 aa, Plasmodium falciparum
SDNFYSLWICILKLIYKMFHQKKEE

SEQ ID NO: 3295503 - protein, 45 aa, Plasmodium falciparum
SDNKLEFVSYFYFLDLLYKVGTFDFIFNMFNYVMSVYISLLSLYY

SEQ ID NO: 3295504 - protein, 25 aa, Plasmodium falciparum
SDPNYKSVFFYFKKEEISGVLSNKL

SEQ ID NO: 3295505 - protein, 17 aa, Plasmodium falciparum
SDQYVFWSLAFSLMFIT

SEQ ID NO: 3295506 - protein, 26 aa, Plasmodium falciparum
SDRFSLYILILLTQNDFIDNIFLEID

SEQ ID NO: 3295507 - protein, 26 aa, Plasmodium falciparum
SDRQNKIIFHFYTDTNLYLGNFVFNS

SEQ ID NO: 3295508 - protein, 24 aa, Plasmodium falciparum
SDTCQLPFLLPEKGEYAVAQIFLP

SEQ ID NO: 3295509 - protein, 28 aa, Plasmodium falciparum
SDVGRIIDNYLIYVNSVLNENFLCTFVN

SEQ ID NO: 3295510 - protein, 23 aa, Plasmodium falciparum
SDVKPKVINFAHGGFNNKRIVEY

SEQ ID NO: 3295511 - protein, 27 aa, Plasmodium falciparum
SDVYPVRSFLETWIPKIPVANANNDGK

SEQ ID NO: 3295512 - protein, 21 aa, Plasmodium falciparum
SDYDFLTILCMQLLLYHNINN

SEQ ID NO: 3295513 - protein, 24 aa, Plasmodium falciparum
SDYFNYYFYNYIGIRIVRISIHPS

SEQ ID NO: 3295514 - protein, 35 aa, Plasmodium falciparum
SDYIVLFLLIDLFGLFIIFFFSYKWYYQRNVWTHL

SEQ ID NO: 3295515 - protein, 24 aa, Plasmodium falciparum
SEAISLLGYIYLLGLGVPINYDKA

SEQ ID NO: 3295516 - protein, 24 aa, Plasmodium falciparum
SECDDFYILLKIYRMKNTEIYNFL

SEQ ID NO: 3295517 - protein, 27 aa, Plasmodium falciparum
SECPINLFLLYFLNPFINLSDDKIQVV

SEQ ID NO: 3295518 - protein, 37 aa, Plasmodium falciparum
SEDDIEFFIKCKLIYNVKLDIRFLLKEKNMSICEFTK

SEQ ID NO: 3295519 - protein, 17 aa, Plasmodium falciparum
SEDFIAFKYFFNNIICL

SEQ ID NO: 3295520 - protein, 37 aa, Plasmodium falciparum
SEDNKLILISYYYSKLIDLLYNLKLKKSALLINMYNI

SEQ ID NO: 3295521 - protein, 23 aa, Plasmodium falciparum
SEDQFLRWFQEWGKIFCTRKKEL

SEQ ID NO: 3295522 - protein, 23 aa, Plasmodium falciparum
SEEDFFFTFLKSNISLCVDDLDY

SEQ ID NO: 3295523 - protein, 22 aa, Plasmodium falciparum
SEEIIYMKTPVAIKIHDLKDSK

SEQ ID NO: 3295524 - protein, 17 aa, Plasmodium falciparum
SEELFLEKLNKIWKKYD

SEQ ID NO: 3295525 - protein, 25 aa, Plasmodium falciparum
SEFFLNCVISFFRRIRRSYIMTLGY

SEQ ID NO: 3295526 - protein, 18 aa, Plasmodium falciparum
SEFKVLVSAGRYSWRNLL

SEQ ID NO: 3295527 - protein, 23 aa, Plasmodium falciparum
SEFLRSMIYTFGDYRDLCLNTDI

SEQ ID NO: 3295528 - protein, 36 aa, Plasmodium falciparum
SEGQSSIPYFAAGGILVVIVLLLSSASRMGKSNEEY

SEQ ID NO: 3295529 - protein, 25 aa, Plasmodium falciparum
SEGTVLPFYTFLNIKNKLNDPFSNM

SEQ ID NO: 3295530 - protein, 22 aa, Plasmodium falciparum
SEGYGYEAPYNPGFNGAPGSNG

SEQ ID NO: 3295531 - protein, 20 aa, Plasmodium falciparum
SEHIFKCLLKLLYGIISLCS

SEQ ID NO: 3295532 - protein, 25 aa, Plasmodium falciparum
SEHKFMLFQVLLNNIMFNFSQTKKR

SEQ ID NO: 3295533 - protein, 30 aa, Plasmodium falciparum
SEKDLHVDYLILNYIKKLDVRVILQNCVLI

SEQ ID NO: 3295534 - protein, 24 aa, Plasmodium falciparum
SEKKMFRFFFFKTSEKNDTLFKIQ

SEQ ID NO: 3295535 - protein, 24 aa, Plasmodium falciparum
SEKSTLIFKLLNKIINNIQIDIQD

SEQ ID NO: 3295536 - protein, 20 aa, Plasmodium falciparum
SEKYFYISKAFNNVVKYQGQ

SEQ ID NO: 3295537 - protein, 25 aa, Plasmodium falciparum
SEKYIYYINALFNFGFERKYCSSDF

SEQ ID NO: 3295538 - protein, 47 aa, Plasmodium falciparum
SELIICIQLIFIKNMLFKHKFFFFVFFYIFLIYSFSKLFSIHTCQTH

SEQ ID NO: 3295539 - protein, 28 aa, Plasmodium falciparum
SELLCNAYIVFLLLLRELNKFNNVYDYS

SEQ ID NO: 3295540 - protein, 31 aa, Plasmodium falciparum
SELLNELCFSPFKKLYKYLRKIRNNNQIDSV

SEQ ID NO: 3295541 - protein, 28 aa, Plasmodium falciparum
SELNEALYPFIFKNPQIYEDILSCLCFF

SEQ ID NO: 3295542 - protein, 24 aa, Plasmodium falciparum
SELSNFLKRSLFYDFYNNLLCKIS

SEQ ID NO: 3295543 - protein, 21 aa, Plasmodium falciparum
SELYLLNLMIRNSYNLILCVS

SEQ ID NO: 3295544 - protein, 21 aa, Plasmodium falciparum
SEMHFIINALYDYLMYMNLSK

SEQ ID NO: 3295545 - protein, 25 aa, Plasmodium falciparum
SENFKLIKKFFLYLSKLRNIEYQSF

SEQ ID NO: 3295546 - protein, 25 aa, Plasmodium falciparum
SENFYAYNLEKIVYKFLLNNKNFEY

SEQ ID NO: 3295547 - protein, 18 aa, Plasmodium falciparum
SENIFLKENKLNKEGKLI

SEQ ID NO: 3295548 - protein, 28 aa, Plasmodium falciparum
SENKINLNYFLINLLSKIWGISRHKKKM

SEQ ID NO: 3295549 - protein, 24 aa, Plasmodium falciparum
SENSLILPRLSLDIFKNFILNLLT

SEQ ID NO: 3295550 - protein, 25 aa, Plasmodium falciparum
SENVLLLLKFSLFNIFNLYEKYKIN

SEQ ID NO: 3295551 - protein, 31 aa, Plasmodium falciparum
SEPIMLRNVFLEWLCVYLLYVQGLKKENKFH

SEQ ID NO: 3295552 - protein, 26 aa, Plasmodium falciparum
SEQMINYIFNLIKIARIIKIKNKHMK

SEQ ID NO: 3295553 - protein, 22 aa, Plasmodium falciparum
SESILYSVGWVYKNISSRYIKK

SEQ ID NO: 3295554 - protein, 23 aa, Plasmodium falciparum
SETFFKIVDIYKFLFEKNGGVIH

SEQ ID NO: 3295555 - protein, 35 aa, Plasmodium falciparum
SETLYNLYNLIKMNPLLISYFLLGIILEKYIKHTE

SEQ ID NO: 3295556 - protein, 39 aa, Plasmodium falciparum
SETQYRICAMAYLGMYCASLFPICWLPIGLKVAETMPIC

SEQ ID NO: 3295557 - protein, 22 aa, Plasmodium falciparum
SEVIYKYVGKLILAFALYMLIN

SEQ ID NO: 3295558 - protein, 18 aa, Plasmodium falciparum
SEVKPQWQKDYWKSKNES

SEQ ID NO: 3295559 - protein, 25 aa, Plasmodium falciparum
SEVLYNVQYILFPIIVENDYNILSN

SEQ ID NO: 3295560 - protein, 25 aa, Plasmodium falciparum
SEYGYILNILIISSIIYIIVILGIM

SEQ ID NO: 3295561 - protein, 30 aa, Plasmodium falciparum
SEYNSLFEIPPWRNMYLVLATIGSLLLHVL

SEQ ID NO: 3295562 - protein, 27 aa, Plasmodium falciparum
SEYRYPLNVFVLENPKYNLLNLQDIHP

SEQ ID NO: 3295563 - protein, 39 aa, Plasmodium falciparum
SEYYKKRFLSNIKKYVFYYVPIYSFKKKVVFKLSRGQNR

SEQ ID NO: 3295564 - protein, 26 aa, Plasmodium falciparum
SFCLCSMILIFWTGYSAIDAWNPWTK

SEQ ID NO: 3295565 - protein, 23 aa, Plasmodium falciparum
SFCNLCFFMEFPVNFFHLQQCES

SEQ ID NO: 3295566 - protein, 28 aa, Plasmodium falciparum
SFDIQQLILCILFEPYIFKNKYKNVEED

SEQ ID NO: 3295567 - protein, 26 aa, Plasmodium falciparum
SFDKKYIIYYLYDNPKYLKIYFNSLL

SEQ ID NO: 3295568 - protein, 20 aa, Plasmodium falciparum
SFEDTLLAMLFLSSNYYIMN

SEQ ID NO: 3295569 - protein, 42 aa, Plasmodium falciparum
SFENTLKLWDLFFLFGMKILIKLTLILLYYHEDNIIHLSYDE

SEQ ID NO: 3295570 - protein, 17 aa, Plasmodium falciparum
SFFELWSLFYEIMEEKV

SEQ ID NO: 3295571 - protein, 32 aa, Plasmodium falciparum
SFFGELLVISIIVFSLFILKILIKDNNKFSVI

SEQ ID NO: 3295572 - protein, 28 aa, Plasmodium falciparum
SFFHEDMWLFVIYLLYVSLQKELKKKVL

SEQ ID NO: 3295573 - protein, 24 aa, Plasmodium falciparum
SFFKNVMFFPYYDNTHISIYLSSF

SEQ ID NO: 3295574 - protein, 18 aa, Plasmodium falciparum
SFFLNLSFIFFGIGSDNS

SEQ ID NO: 3295575 - protein, 17 aa, Plasmodium falciparum
SFFMHFNIMPIYTNDIE

SEQ ID NO: 3295576 - protein, 20 aa, Plasmodium falciparum
SFFNHFYNLLARVLYHVDHI

SEQ ID NO: 3295577 - protein, 19 aa, Plasmodium falciparum
SFFQVKWRNIALQISLNIL

SEQ ID NO: 3295578 - protein, 21 aa, Plasmodium falciparum
SFFTILVCYLRNNLIKMNKIY

SEQ ID NO: 3295579 - protein, 29 aa, Plasmodium falciparum
SFGNFPNYIKLFLFNWPSGKNLLEFFIAK

SEQ ID NO: 3295580 - protein, 24 aa, Plasmodium falciparum
SFGSKNNCFFFLNKNNYIKNINII

SEQ ID NO: 3295581 - protein, 27 aa, Plasmodium falciparum
SFGVLGVLYFFYLKRFVIQEWDIYKVK

SEQ ID NO: 3295582 - protein, 23 aa, Plasmodium falciparum
SFIEFILCIIYSENYTNLYCNHN

SEQ ID NO: 3295583 - protein, 17 aa, Plasmodium falciparum
SFIEQIINYLYINKDIL

SEQ ID NO: 3295584 - protein, 26 aa, Plasmodium falciparum
SFIGFICSVIMMLLTAILVIHTIYKY

SEQ ID NO: 3295585 - protein, 24 aa, Plasmodium falciparum
SFIGYGWIDSLFRVNIYLCLEIIK

SEQ ID NO: 3295586 - protein, 24 aa, Plasmodium falciparum
SFIKLNYFNETFYNYIFIHILKLC

SEQ ID NO: 3295587 - protein, 21 aa, Plasmodium falciparum
SFILFVCYIIKYADAYLPGMN

SEQ ID NO: 3295588 - protein, 29 aa, Plasmodium falciparum
SFINIKKLYFILLRYSYIKTYKTYLILIR

SEQ ID NO: 3295589 - protein, 17 aa, Plasmodium falciparum
SFIPLSVDVLKLFMNFF

SEQ ID NO: 3295590 - protein, 23 aa, Plasmodium falciparum
SFIRTFFQTFLFSAVNLKIDKDV

SEQ ID NO: 3295591 - protein, 33 aa, Plasmodium falciparum
SFIVIVVIVLIMVIIYLILRYRRKKKMKKKLQY

SEQ ID NO: 3295592 - protein, 25 aa, Plasmodium falciparum
SFIVYIFSMFILRNYFDIMQIMSVM

SEQ ID NO: 3295593 - protein, 17 aa, Plasmodium falciparum
SFKFIYLHLLKKYGHTN

SEQ ID NO: 3295594 - protein, 25 aa, Plasmodium falciparum
SFKKKYKQYLLFNKYINNLNKFKHK

SEQ ID NO: 3295595 - protein, 30 aa, Plasmodium falciparum
SFKNLKKLLLYLDITYDDKILKILYSVLYD

SEQ ID NO: 3295596 - protein, 29 aa, Plasmodium falciparum
SFKNVFSIILSMLFYFFSNDTTSEVNEKI

SEQ ID NO: 3295597 - protein, 26 aa, Plasmodium falciparum
SFKRTPPITKIYLLGTFLLSVLIHMN

SEQ ID NO: 3295598 - protein, 29 aa, Plasmodium falciparum
SFKVKMLRSLFYIIKYKNLCDNLININYQ

SEQ ID NO: 3295599 - protein, 17 aa, Plasmodium falciparum
SFKYLNYPSTPLLIDDL

SEQ ID NO: 3295600 - protein, 18 aa, Plasmodium falciparum
SFKYSIPYIKNKYSNVLI

SEQ ID NO: 3295601 - protein, 18 aa, Plasmodium falciparum
SFLFFIINTQCVTHESYQ

SEQ ID NO: 3295602 - protein, 30 aa, Plasmodium falciparum
SFLFLFHFHIFLYPVPLFFRLVKTPLIYLK

SEQ ID NO: 3295603 - protein, 20 aa, Plasmodium falciparum
SFLFYKICHFFGILVSMRNI

SEQ ID NO: 3295604 - protein, 19 aa, Plasmodium falciparum
SFLIFLRSINANISITNFT

SEQ ID NO: 3295605 - protein, 17 aa, Plasmodium falciparum
SFLLCLDNILYDITFMP

SEQ ID NO: 3295606 - protein, 21 aa, Plasmodium falciparum
SFLLQSYFKKSLNSPHNNNND

SEQ ID NO: 3295607 - protein, 20 aa, Plasmodium falciparum
SFLLWYLFLFLWFYYNIKPS

SEQ ID NO: 3295608 - protein, 18 aa, Plasmodium falciparum
SFLQKDLFYVIYHIYFLQ

SEQ ID NO: 3295609 - protein, 18 aa, Plasmodium falciparum
SFLQTVYLLFRKIEDTYK

SEQ ID NO: 3295610 - protein, 26 aa, Plasmodium falciparum
SFLSLQLLSILIYFTQNRSICSIIHN

SEQ ID NO: 3295611 - protein, 19 aa, Plasmodium falciparum
SFLSYILLYIYMFTKNNLS

SEQ ID NO: 3295612 - protein, 18 aa, Plasmodium falciparum
SFLYNMRYFSIKVLNTFL

SEQ ID NO: 3295613 - protein, 17 aa, Plasmodium falciparum
SFMLIYFTNISIYVSKI

SEQ ID NO: 3295614 - protein, 29 aa, Plasmodium falciparum
SFMLKRWCLKILYTLINKIKDMNLFLDIF

SEQ ID NO: 3295615 - protein, 19 aa, Plasmodium falciparum
SFNISFIYYILSNKKRKQF

SEQ ID NO: 3295616 - protein, 29 aa, Plasmodium falciparum
SFNIYFNEWYYFSFFIVLEYQFNSFILNY

SEQ ID NO: 3295617 - protein, 28 aa, Plasmodium falciparum
SFNKFKSFIDKLPIPFLKKIINDISLKK

SEQ ID NO: 3295618 - protein, 22 aa, Plasmodium falciparum
SFNLNFILYSIFNNTKPIVIVD

SEQ ID NO: 3295619 - protein, 24 aa, Plasmodium falciparum
SFNQFLIDEGYYKLLEPMNLKNVD

SEQ ID NO: 3295620 - protein, 26 aa, Plasmodium falciparum
SFNVIILIILFCHIIIARNNKTIKWI

SEQ ID NO: 3295621 - protein, 17 aa, Plasmodium falciparum
SFPIFKTTAIYILNEFT

SEQ ID NO: 3295622 - protein, 20 aa, Plasmodium falciparum
SFPIIFIICYIFDTYWRQRF

SEQ ID NO: 3295623 - protein, 18 aa, Plasmodium falciparum
SFPLCFYSSIMAIKKKKM

SEQ ID NO: 3295624 - protein, 23 aa, Plasmodium falciparum
SFQELPINFLPTYKKNGNRPIIN

SEQ ID NO: 3295625 - protein, 58 aa, Plasmodium falciparum
SFQTNFCMFFFCKSNYYITLKLYYIFLFLFKYYKYPLRKNFYHLLIYNKYYNNNNKEQ

SEQ ID NO: 3295626 - protein, 24 aa, Plasmodium falciparum
SFQYIHAYIFQKIKGYYYYPFMKN

SEQ ID NO: 3295627 - protein, 17 aa, Plasmodium falciparum
SFRKLCFYTNKKNYKNS

SEQ ID NO: 3295628 - protein, 41 aa, Plasmodium falciparum
SFRNNNMHLFHKYGIQYKDLIPMNMFPTAYLNLGRERRSSK

SEQ ID NO: 3295629 - protein, 25 aa, Plasmodium falciparum
SFRNSILNYVYGYPLFCIKKKNSNN

SEQ ID NO: 3295630 - protein, 31 aa, Plasmodium falciparum
SFSFEIQTSLLFFVEAILLTIGIIIFAKFQT

SEQ ID NO: 3295631 - protein, 21 aa, Plasmodium falciparum
SFSIIYIYGWFIFNSSLNYYN

SEQ ID NO: 3295632 - protein, 23 aa, Plasmodium falciparum
SFSMSLYYSMIYMLKVMNIEEED

SEQ ID NO: 3295633 - protein, 30 aa, Plasmodium falciparum
SFSPHEVMLLKKWNLLKFKQARKNHILRNI

SEQ ID NO: 3295634 - protein, 38 aa, Plasmodium falciparum
SFSSLSSFFFSFFSLLLYMLVLLQIFPKNYYEAGTLSI

SEQ ID NO: 3295635 - protein, 19 aa, Plasmodium falciparum
SFSYIYLIGIVSSLSIYLL

SEQ ID NO: 3295636 - protein, 45 aa, Plasmodium falciparum
SFTIHFFLPFLNFVTFFLFFLFFKMEDLFFITSKKKKLVSEKLLE

SEQ ID NO: 3295637 - protein, 17 aa, Plasmodium falciparum
SFTKCFISKILGYDIKP

SEQ ID NO: 3295638 - protein, 20 aa, Plasmodium falciparum
SFTLINSYDFLLRNSVYFYR

SEQ ID NO: 3295639 - protein, 33 aa, Plasmodium falciparum
SFTTKNIIYIFIGISLLIFIYKILKKNKKDAEV

SEQ ID NO: 3295640 - protein, 18 aa, Plasmodium falciparum
SFTVILNHEYLLSAPECV

SEQ ID NO: 3295641 - protein, 26 aa, Plasmodium falciparum
SFTVSYIFFMSFKILEALLVCISILL

SEQ ID NO: 3295642 - protein, 18 aa, Plasmodium falciparum
SFVFFHWNIRTFIDPYKD

SEQ ID NO: 3295643 - protein, 20 aa, Plasmodium falciparum
SFVLQYIPLNVQYLNLFKLI

SEQ ID NO: 3295644 - protein, 20 aa, Plasmodium falciparum
SFVLYILLSVCEGHKNLTCD

SEQ ID NO: 3295645 - protein, 21 aa, Plasmodium falciparum
SFVWFFVWLYIYIMIMTAGGV

SEQ ID NO: 3295646 - protein, 23 aa, Plasmodium falciparum
SFVYVFFINYFNISVIINKLFLF

SEQ ID NO: 3295647 - protein, 26 aa, Plasmodium falciparum
SFYEDKILNIDFSYDNNLLVTASCNN

SEQ ID NO: 3295648 - protein, 36 aa, Plasmodium falciparum
SFYELQKHLNIFLLLIELLLFISKNIFFENFPHYKE

SEQ ID NO: 3295649 - protein, 23 aa, Plasmodium falciparum
SFYEYLMFTLMKKLIHYKNYIFN

SEQ ID NO: 3295650 - protein, 22 aa, Plasmodium falciparum
SFYFFNIHLYFNCEEDYNISEN

SEQ ID NO: 3295651 - protein, 21 aa, Plasmodium falciparum
SFYFIKHILSFIYKSYISFKY

SEQ ID NO: 3295652 - protein, 19 aa, Plasmodium falciparum
SFYFINITKHKILLYENLQ

SEQ ID NO: 3295653 - protein, 20 aa, Plasmodium falciparum
SFYFYKYLCNIFKRDSRRYI

SEQ ID NO: 3295654 - protein, 18 aa, Plasmodium falciparum
SFYGLKVWDILFNYVSFD

SEQ ID NO: 3295655 - protein, 18 aa, Plasmodium falciparum
SFYKHMLGRKILPADAES

SEQ ID NO: 3295656 - protein, 22 aa, Plasmodium falciparum
SFYNIFLKILLFPVVCPEMWTN

SEQ ID NO: 3295657 - protein, 20 aa, Plasmodium falciparum
SFYNIFVKYVLRCTTAAPGF

SEQ ID NO: 3295658 - protein, 18 aa, Plasmodium falciparum
SFYYESIPMLSQSIFYIC

SEQ ID NO: 3295659 - protein, 24 aa, Plasmodium falciparum
SGAFYRTFPRVIFYNLNLTNNTSK

SEQ ID NO: 3295660 - protein, 23 aa, Plasmodium falciparum
SGALGCEYAKLFSLLDMCTRNSE

SEQ ID NO: 3295661 - protein, 26 aa, Plasmodium falciparum
SGASSIIFLLYQFLKNLEGTSFCAYD

SEQ ID NO: 3295662 - protein, 25 aa, Plasmodium falciparum
SGDTFPVRSFLEGLIPQIAVTDVKN

SEQ ID NO: 3295663 - protein, 25 aa, Plasmodium falciparum
SGDTFPVRSFLEGLIPQIPVADVQG

SEQ ID NO: 3295664 - protein, 19 aa, Plasmodium falciparum
SGDWYKLCLGWGLAVFFGI

SEQ ID NO: 3295665 - protein, 19 aa, Plasmodium falciparum
SGGIISVHFPKNALFINEC

SEQ ID NO: 3295666 - protein, 23 aa, Plasmodium falciparum
SGIIRLKNWLYRKMFKECNFRKY

SEQ ID NO: 3295667 - protein, 36 aa, Plasmodium falciparum
SGKDNAYYRIFYAGGITAVLLLCSSTAFFFIKNSNE

SEQ ID NO: 3295668 - protein, 27 aa, Plasmodium falciparum
SGKKTYIIQALQYALTYYSKLSNRKEA

SEQ ID NO: 3295669 - protein, 24 aa, Plasmodium falciparum
SGKTFICYYVMDKVLRLNNDSVVI

SEQ ID NO: 3295670 - protein, 23 aa, Plasmodium falciparum
SGKTLAFALPLVEKLYKMKTSNE

SEQ ID NO: 3295671 - protein, 19 aa, Plasmodium falciparum
SGLHKSIRAGNVKAAILYL

SEQ ID NO: 3295672 - protein, 37 aa, Plasmodium falciparum
SGLSPSCLLSPPSLLSPPSLLSPPCLLSPSIISPHML

SEQ ID NO: 3295673 - protein, 34 aa, Plasmodium falciparum
SGNHFLFFSIISLFLLHLIYYGNYLIAHKFINTG

SEQ ID NO: 3295674 - protein, 64 aa, Plasmodium falciparum
SGNIVKIILFLFLVIILCIFIIPSLPFCTYFFIKLKWFHKLKTIRLLILWKVQDTFTFFKKIPR

SEQ ID NO: 3295675 - protein, 23 aa, Plasmodium falciparum
SGNNFFYFLVKIENKISALPAEK

SEQ ID NO: 3295676 - protein, 20 aa, Plasmodium falciparum
SGNRKWDKLLRSKKYKKNYK

SEQ ID NO: 3295677 - protein, 42 aa, Plasmodium falciparum
SGNSNLIKEFLIKMKPTFWCLQDIIIYSSLIFHSTYMRYEKM

SEQ ID NO: 3295678 - protein, 26 aa, Plasmodium falciparum
SGSDFPMCTMLARSFADIGDIVRGKD

SEQ ID NO: 3295679 - protein, 29 aa, Plasmodium falciparum
SGSIYKKYILVLIKILYHSYKLSYNYQKN

SEQ ID NO: 3295680 - protein, 39 aa, Plasmodium falciparum
SGSNLYFLKLLSIGSSIFMQLIFLPTIFKIIKKKTTGEL

SEQ ID NO: 3295681 - protein, 25 aa, Plasmodium falciparum
SGTTCTIILYNFITKKIYSAHTGDS

SEQ ID NO: 3295682 - protein, 34 aa, Plasmodium falciparum
SGTTKYYCKTYYYNLVRFPTFQEFINSLKLYNSF

SEQ ID NO: 3295683 - protein, 47 aa, Plasmodium falciparum
SGTYIISIIIPKVGCLYLYPFIYADEICLTLLLLLVVVKSEYLRSCK

SEQ ID NO: 3295684 - protein, 24 aa, Plasmodium falciparum
SGVHTLYIYNLKNIDLQNAVKVNI

SEQ ID NO: 3295685 - protein, 31 aa, Plasmodium falciparum
SGVIMAPVSIFFILYSFYIYLKRSDALVNKE

SEQ ID NO: 3295686 - protein, 40 aa, Plasmodium falciparum
SGVLNASLIYFLCKKYKNYITPVSRFFLTFSLGVYTSMVI

SEQ ID NO: 3295687 - protein, 23 aa, Plasmodium falciparum
SGVRRRAGFFKISNACDLNKFES

SEQ ID NO: 3295688 - protein, 19 aa, Plasmodium falciparum
SGYEVILTCKNCEEILFNS

SEQ ID NO: 3295689 - protein, 21 aa, Plasmodium falciparum
SHDFLYYCPVFKYNSSTQKND

SEQ ID NO: 3295690 - protein, 23 aa, Plasmodium falciparum
SHDLIKQFLLHNNVKYNRNYEND

SEQ ID NO: 3295691 - protein, 23 aa, Plasmodium falciparum
SHEIYDVILIGGGLFNCCLYYYL

SEQ ID NO: 3295692 - protein, 31 aa, Plasmodium falciparum
SHEMQKTFNPFFYYWVVHMLKDSIHWRTKKL

SEQ ID NO: 3295693 - protein, 25 aa, Plasmodium falciparum
SHFKYYIFSFFLYSYVKYINPSHYN

SEQ ID NO: 3295694 - protein, 18 aa, Plasmodium falciparum
SHIFIPNKTIKIKKTSPF

SEQ ID NO: 3295695 - protein, 20 aa, Plasmodium falciparum
SHIKNMEYVVDSFDKIDNAP

SEQ ID NO: 3295696 - protein, 26 aa, Plasmodium falciparum
SHILNVICLLLNALMIWKLLVVFTGC

SEQ ID NO: 3295697 - protein, 26 aa, Plasmodium falciparum
SHINKYILFLMKKEYYIKKFYIINKE

SEQ ID NO: 3295698 - protein, 30 aa, Plasmodium falciparum
SHISSFFHKHLYLIWKLQNCTYRSFLLFFN

SEQ ID NO: 3295699 - protein, 27 aa, Plasmodium falciparum
SHITFPHFLFNMWAFYTITNTLLSPEI

SEQ ID NO: 3295700 - protein, 26 aa, Plasmodium falciparum
SHKSNHIYIIYNYKKKLFVQKCFDHE

SEQ ID NO: 3295701 - protein, 19 aa, Plasmodium falciparum
SHLLSLKENIIKKLLNHIE

SEQ ID NO: 3295702 - protein, 26 aa, Plasmodium falciparum
SHMLTFLFFDYIYNIVSILFNFFTKI

SEQ ID NO: 3295703 - protein, 25 aa, Plasmodium falciparum
SHNKFVEYFFYFAIKKPNDYLKKKQ

SEQ ID NO: 3295704 - protein, 25 aa, Plasmodium falciparum
SHNNNNILILLMNEYLLNKDNDIND

SEQ ID NO: 3295705 - protein, 25 aa, Plasmodium falciparum
SHNPLFNHYLFELLTIIISLIYKSQ

SEQ ID NO: 3295706 - protein, 26 aa, Plasmodium falciparum
SHPAIEIILYLTYKFDMEGRHYLFSS

SEQ ID NO: 3295707 - protein, 24 aa, Plasmodium falciparum
SHPFLVYVTYILYCLTVLSKLNMG

SEQ ID NO: 3295708 - protein, 30 aa, Plasmodium falciparum
SHSEKYINIILLYMLIMNRKIFLHECINNV

SEQ ID NO: 3295709 - protein, 32 aa, Plasmodium falciparum
SHSKIMKFYEFFIFWVTYMLNDCIDWKKKITK

SEQ ID NO: 3295710 - protein, 25 aa, Plasmodium falciparum
SHSSFIVHMLALLDYLDLDFRGLNN

SEQ ID NO: 3295711 - protein, 23 aa, Plasmodium falciparum
SHYKDFGACAPFRRLNLCNKNFP

SEQ ID NO: 3295712 - protein, 17 aa, Plasmodium falciparum
SIAHYKLMRKSCDFLFP

SEQ ID NO: 3295713 - protein, 32 aa, Plasmodium falciparum
SIAIMIIVAIVLIIYLILRYRRKQKIKKKLQY

SEQ ID NO: 3295714 - protein, 17 aa, Plasmodium falciparum
SIAYTCLKKKKKGYIEK

SEQ ID NO: 3295715 - protein, 19 aa, Plasmodium falciparum
SICNYIDYFLYKYEKYINE

SEQ ID NO: 3295716 - protein, 27 aa, Plasmodium falciparum
SICSKMIVNFFTLYKEATAKNYDNKKS

SEQ ID NO: 3295717 - protein, 20 aa, Plasmodium falciparum
SICSKRILFMKGHDHYSCSL

SEQ ID NO: 3295718 - protein, 22 aa, Plasmodium falciparum
SICVPPRRRKLYIKKIVDWAES

SEQ ID NO: 3295719 - protein, 20 aa, Plasmodium falciparum
SICVPPRRRKLYLHKVDDGE

SEQ ID NO: 3295720 - protein, 25 aa, Plasmodium falciparum
SICVPPRRRRLYVGGLTKWAEKQSS

SEQ ID NO: 3295721 - protein, 30 aa, Plasmodium falciparum
SICVPPRRRRLYVGGLTKWAKKYTGNTGES

SEQ ID NO: 3295722 - protein, 24 aa, Plasmodium falciparum
SICVPPRRRRLYVGGLTKWASGNT

SEQ ID NO: 3295723 - protein, 28 aa, Plasmodium falciparum
SICVPPRRRRLYVTPLTTWASGGTTQVE

SEQ ID NO: 3295724 - protein, 17 aa, Plasmodium falciparum
SIDILYKLFLKKKKKIQ

SEQ ID NO: 3295725 - protein, 24 aa, Plasmodium falciparum
SIDKYTLHFLSRNKLKKIKLYNDK

SEQ ID NO: 3295726 - protein, 28 aa, Plasmodium falciparum
SIDLDVLKTFHLFLKEKNEDLKNFRYTE

SEQ ID NO: 3295727 - protein, 33 aa, Plasmodium falciparum
SIDMYIINFFIFLFLDRLYLILETYLRLNYVYS

SEQ ID NO: 3295728 - protein, 37 aa, Plasmodium falciparum
SIDPKINVLGLFIFYPCTLFLMRSGIRFAITLNGKSY

SEQ ID NO: 3295729 - protein, 26 aa, Plasmodium falciparum
SIDSIIFLMILLLFSICSSAYVVYSV

SEQ ID NO: 3295730 - protein, 19 aa, Plasmodium falciparum
SIEITRYFSIFDKFKIQLQ

SEQ ID NO: 3295731 - protein, 26 aa, Plasmodium falciparum
SIEQALIIFLVTFVMQTLISSTVSIV

SEQ ID NO: 3295732 - protein, 49 aa, Plasmodium falciparum
SIFEFQNFLFSIFSIFYILLCCYYKNFIHFIISFTIIFFICINNEKNYE

SEQ ID NO: 3295733 - protein, 18 aa, Plasmodium falciparum
SIFFVINPNLFFNNKNFK

SEQ ID NO: 3295734 - protein, 17 aa, Plasmodium falciparum
SIFGNDYNYALKALLDV

SEQ ID NO: 3295735 - protein, 20 aa, Plasmodium falciparum
SIFKKVYDFLKSFTQKTVIN

SEQ ID NO: 3295736 - protein, 37 aa, Plasmodium falciparum
SIFLSSLFNIFLLSLRFLFLYKKFNQLGLLFLETILK

SEQ ID NO: 3295737 - protein, 18 aa, Plasmodium falciparum
SIFNTLCLFNIDEKIKIL

SEQ ID NO: 3295738 - protein, 24 aa, Plasmodium falciparum
SIFPKIIKIFINLILHNLNRLKET

SEQ ID NO: 3295739 - protein, 30 aa, Plasmodium falciparum
SIFPTKDFPYIIAWILGAIIAGTLFVYGTT

SEQ ID NO: 3295740 - protein, 25 aa, Plasmodium falciparum
SIFSFLSLKFLRHLNLFLGMSMIKN

SEQ ID NO: 3295741 - protein, 19 aa, Plasmodium falciparum
SIFTEEPLLLYQIKNTYMN

SEQ ID NO: 3295742 - protein, 25 aa, Plasmodium falciparum
SIFVLNIIMTIGFISAIPQIFTTLM

SEQ ID NO: 3295743 - protein, 20 aa, Plasmodium falciparum
SIFYCLMLVLSNYLLYKTPC

SEQ ID NO: 3295744 - protein, 23 aa, Plasmodium falciparum
SIFYGCILLIYRDIKFRELNKNN

SEQ ID NO: 3295745 - protein, 19 aa, Plasmodium falciparum
SIGDFYFLKNLNYGIYCWN

SEQ ID NO: 3295746 - protein, 21 aa, Plasmodium falciparum
SIGLLIWSINFMLLKKIFLCI

SEQ ID NO: 3295747 - protein, 32 aa, Plasmodium falciparum
SIGNKNHLFLVFLLFLFFSFSCINFTQCQITK

SEQ ID NO: 3295748 - protein, 22 aa, Plasmodium falciparum
SIGNLNVFFPAENYHFSTYMGF

SEQ ID NO: 3295749 - protein, 24 aa, Plasmodium falciparum
SIGYIFHYTGLYEFTIYNKIIFSK

SEQ ID NO: 3295750 - protein, 37 aa, Plasmodium falciparum
SIHEDTDLMELKRILYNLFLEYNPHMNNKQKAELDKK

SEQ ID NO: 3295751 - protein, 37 aa, Plasmodium falciparum
SIHFSHMLFNYPYLSKFLTFLPCQKIKFIKNNILMNE

SEQ ID NO: 3295752 - protein, 27 aa, Plasmodium falciparum
SIHIIYSLDIGFYILCSINLKIIIYKY

SEQ ID NO: 3295753 - protein, 32 aa, Plasmodium falciparum
SIHKSQLLIFFYTFWSYIFDILLYISKHPEQQ

SEQ ID NO: 3295754 - protein, 19 aa, Plasmodium falciparum
SIHLLVHNIYKIYIVNQIC

SEQ ID NO: 3295755 - protein, 23 aa, Plasmodium falciparum
SIHPINIYFFFHSDNIKITYPEE

SEQ ID NO: 3295756 - protein, 33 aa, Plasmodium falciparum
SIIAILVIVLVMVIIYLILRYRRKKKMKKKLHY

SEQ ID NO: 3295757 - protein, 34 aa, Plasmodium falciparum
SIIAIVVIILIMVIIYFILRYRRKKKLKKKLQYI

SEQ ID NO: 3295758 - protein, 34 aa, Plasmodium falciparum
SIIAIVVIILIMVIIYLILRYRRKKKMKKKLQYI

SEQ ID NO: 3295759 - protein, 33 aa, Plasmodium falciparum
SIIAIVVIILIMVIIYLILRYRRKKRMKKKHQY

SEQ ID NO: 3295760 - protein, 33 aa, Plasmodium falciparum
SIIAIVVIVLIMVIIYLILRYRRKKKMKKKLHY

SEQ ID NO: 3295761 - protein, 33 aa, Plasmodium falciparum
SIIAIVVIVLIMVIIYLILRYRRKKKMKKKLQY

SEQ ID NO: 3295762 - protein, 33 aa, Plasmodium falciparum
SIIAIVVIVLIMVIIYLVLRYRRKKKMKKKLQY

SEQ ID NO: 3295763 - protein, 34 aa, Plasmodium falciparum
SIIAIVVIVLVMLIIYLILRYRRKKKMKKKLQYI

SEQ ID NO: 3295764 - protein, 31 aa, Plasmodium falciparum
SIIEILMLNLPIYFFFKNKLYVKTSFTIMLY

SEQ ID NO: 3295765 - protein, 23 aa, Plasmodium falciparum
SIIESIWLLFTKGSYFNMAMLLF

SEQ ID NO: 3295766 - protein, 21 aa, Plasmodium falciparum
SIIFIFLGVIENFIINKRVLY

SEQ ID NO: 3295767 - protein, 32 aa, Plasmodium falciparum
SIIIGSMCYINFIHGTFSLLTFYLSNKVTVHM

SEQ ID NO: 3295768 - protein, 17 aa, Plasmodium falciparum
SIIIIFQTKQINGLREL

SEQ ID NO: 3295769 - protein, 19 aa, Plasmodium falciparum
SIIMRIKCVITKNLKKTKK

SEQ ID NO: 3295770 - protein, 25 aa, Plasmodium falciparum
SIIMTTLFMRIIILPLTISSERDRR

SEQ ID NO: 3295771 - protein, 22 aa, Plasmodium falciparum
SIIPCFFIALFIYDMKKEQPNY

SEQ ID NO: 3295772 - protein, 21 aa, Plasmodium falciparum
SIIQFFIFYLHLKINFYVMPQ

SEQ ID NO: 3295773 - protein, 25 aa, Plasmodium falciparum
SIIQLFFTYIQFVSLLRYVNSNYDH

SEQ ID NO: 3295774 - protein, 87 aa, Plasmodium falciparum
SIIYNICVVTRNLLLLLPLGIYIFYIIKTCMYCTFKLILTKPIIVTDKTWFFLLYFYKLLFEKLYEYFKLYFIYPMKNEEENKNITS

SEQ ID NO: 3295775 - protein, 27 aa, Plasmodium falciparum
SIIYSYILMFLFFTLCFNFIFYRYLYY

SEQ ID NO: 3295776 - protein, 18 aa, Plasmodium falciparum
SIKEDFRVNCKNSIYECR

SEQ ID NO: 3295777 - protein, 20 aa, Plasmodium falciparum
SIKHFSILFIWYNYLSGGFD

SEQ ID NO: 3295778 - protein, 27 aa, Plasmodium falciparum
SIKKEYDFILFFLSKLNVIKILSFMNT

SEQ ID NO: 3295779 - protein, 17 aa, Plasmodium falciparum
SIKLCIPVEVRKRYIYD

SEQ ID NO: 3295780 - protein, 20 aa, Plasmodium falciparum
SIKLMYLTIFVILIAVTLTT

SEQ ID NO: 3295781 - protein, 25 aa, Plasmodium falciparum
SIKNILYQNLSLYGDLLLLNVPNNM

SEQ ID NO: 3295782 - protein, 26 aa, Plasmodium falciparum
SIKNWIIFQNLPLYNYIILNYLYDKK

SEQ ID NO: 3295783 - protein, 20 aa, Plasmodium falciparum
SIKPCTYPPNPTPNPCGTNN

SEQ ID NO: 3295784 - protein, 23 aa, Plasmodium falciparum
SIKVIFMYFFAFNDNFFLADMTK

SEQ ID NO: 3295785 - protein, 29 aa, Plasmodium falciparum
SIKYRNIIQSFFFIIKEEGVLGLWKGNFV

SEQ ID NO: 3295786 - protein, 40 aa, Plasmodium falciparum
SILALILTFSVAVPFILPLGSLYFFLRYYIDKYNLIYEIC

SEQ ID NO: 3295787 - protein, 26 aa, Plasmodium falciparum
SILDDDIFLILKRVCSFLFYCVKNNK

SEQ ID NO: 3295788 - protein, 18 aa, Plasmodium falciparum
SILFGFLPLLSCMFIMYK

SEQ ID NO: 3295789 - protein, 21 aa, Plasmodium falciparum
SILFYTKCIVILLVLCSIFIF

SEQ ID NO: 3295790 - protein, 19 aa, Plasmodium falciparum
SILIFLRKKFVVDVLMFEF

SEQ ID NO: 3295791 - protein, 17 aa, Plasmodium falciparum
SILIKLKKNILLLNNNA

SEQ ID NO: 3295792 - protein, 34 aa, Plasmodium falciparum
SILKLVRRLMSILLSFLASVVLLFLFGVSADTII

SEQ ID NO: 3295793 - protein, 17 aa, Plasmodium falciparum
SILLSMNLSKLINFIIL

SEQ ID NO: 3295794 - protein, 33 aa, Plasmodium falciparum
SILNDVPLSFIYFKKIYFLLLNNEKDIYDLLKY

SEQ ID NO: 3295795 - protein, 17 aa, Plasmodium falciparum
SILNFFTDIIKFNNDPI

SEQ ID NO: 3295796 - protein, 35 aa, Plasmodium falciparum
SILNNFQYILKKFPYLLLLLHFKIIRKIDNIFYTR

SEQ ID NO: 3295797 - protein, 37 aa, Plasmodium falciparum
SILNTTCLLWWQYLLAIFWALLNLFLDEIVPKVIYRR

SEQ ID NO: 3295798 - protein, 42 aa, Plasmodium falciparum
SILPKNLRAYRFFSYFFYKFKEIIFYIHSYSFYDGLNDFFFK

SEQ ID NO: 3295799 - protein, 27 aa, Plasmodium falciparum
SIMYFYFGFIYIFPRILTKIRKFITCL

SEQ ID NO: 3295800 - protein, 24 aa, Plasmodium falciparum
SINAKFFILIFFKSTMNILHSYGI

SEQ ID NO: 3295801 - protein, 36 aa, Plasmodium falciparum
SINCYKYMLLYGFMISFIKILLFMNAHAVMSEYGYL

SEQ ID NO: 3295802 - protein, 25 aa, Plasmodium falciparum
SINEKNFYLFSLLSNILYNNTSNCS

SEQ ID NO: 3295803 - protein, 18 aa, Plasmodium falciparum
SINHEFLRQIRNLYFSNN

SEQ ID NO: 3295804 - protein, 19 aa, Plasmodium falciparum
SINILIKKWVVWTFKNCDN

SEQ ID NO: 3295805 - protein, 24 aa, Plasmodium falciparum
SINIYSHFFGFLGGFLIGIILKRN

SEQ ID NO: 3295806 - protein, 23 aa, Plasmodium falciparum
SINKFLKFILLKEKEEFNFIYLK

SEQ ID NO: 3295807 - protein, 41 aa, Plasmodium falciparum
SINKILFLLIILIKNYKCIFIWYMNIIIDILLNSLDPSNNV

SEQ ID NO: 3295808 - protein, 19 aa, Plasmodium falciparum
SINLIRIILKTIEDNYVFL

SEQ ID NO: 3295809 - protein, 26 aa, Plasmodium falciparum
SINRIITIYIFLQKKINKFFSFFKYI

SEQ ID NO: 3295810 - protein, 27 aa, Plasmodium falciparum
SINSSYKIFLNFLKNFFKIIIDDFDTF

SEQ ID NO: 3295811 - protein, 26 aa, Plasmodium falciparum
SINTPFLEKYLILIYNIIKDKINIVK

SEQ ID NO: 3295812 - protein, 18 aa, Plasmodium falciparum
SINYFNGFLFSKMARYKY

SEQ ID NO: 3295813 - protein, 29 aa, Plasmodium falciparum
SINYIYNFVIFIYSYFSLNYNLSIDILYK

SEQ ID NO: 3295814 - protein, 22 aa, Plasmodium falciparum
SIPKKWITYSFFSNLQIFHYAT

SEQ ID NO: 3295815 - protein, 38 aa, Plasmodium falciparum
SIQDKFLYNLSFIYNVYNYLILIYIYTYYNEESYLAFC

SEQ ID NO: 3295816 - protein, 25 aa, Plasmodium falciparum
SIQQNLLWNKWIERKRYIIEKWKNE

SEQ ID NO: 3295817 - protein, 21 aa, Plasmodium falciparum
SIRDYVFFDIAIENKYVGRVL

SEQ ID NO: 3295818 - protein, 26 aa, Plasmodium falciparum
SIRKDVWKCGNVCGLDICSLKKINNN

SEQ ID NO: 3295819 - protein, 26 aa, Plasmodium falciparum
SIRLQTLRIFYYYIIQSNYFSKHNIT

SEQ ID NO: 3295820 - protein, 27 aa, Plasmodium falciparum
SIRQDLIMLYILYMSKNNYCIYINILK

SEQ ID NO: 3295821 - protein, 26 aa, Plasmodium falciparum
SIRTCDKVFLFKVNYKYNIYDCNILD

SEQ ID NO: 3295822 - protein, 42 aa, Plasmodium falciparum
SIRYKRRRWYWRVFYTIMFIIFFPVLFIYRRIIKRRKGSSKG

SEQ ID NO: 3295823 - protein, 24 aa, Plasmodium falciparum
SISFFLNYHTSKFFFNESMKFPLY

SEQ ID NO: 3295824 - protein, 40 aa, Plasmodium falciparum
SISFLTFPTNFLLNKNIYIPLPVLIIAYISVILKVVDKKG

SEQ ID NO: 3295825 - protein, 17 aa, Plasmodium falciparum
SISLPLNLKRTVVKIIN

SEQ ID NO: 3295826 - protein, 24 aa, Plasmodium falciparum
SISLSFFFHIILYTLPMGTMFASL

SEQ ID NO: 3295827 - protein, 23 aa, Plasmodium falciparum
SISNYGEFLLLQSSSRVISSYEH

SEQ ID NO: 3295828 - protein, 21 aa, Plasmodium falciparum
SISSWLIIILLLEVGVDWCKH

SEQ ID NO: 3295829 - protein, 24 aa, Plasmodium falciparum
SISYRLPTQKIGFTAPLNIADGYN

SEQ ID NO: 3295830 - protein, 26 aa, Plasmodium falciparum
SITCFEYFFFKLMKLIDNDIIDIYTK

SEQ ID NO: 3295831 - protein, 34 aa, Plasmodium falciparum
SITHEENMLKNKKLALLRKKRNILKMYYSYSSDN

SEQ ID NO: 3295832 - protein, 21 aa, Plasmodium falciparum
SITILLYDIYKKHNYFLNFIK

SEQ ID NO: 3295833 - protein, 32 aa, Plasmodium falciparum
SITKIFQLLIFYIQSLPLWIGPYFGSAFAATF

SEQ ID NO: 3295834 - protein, 25 aa, Plasmodium falciparum
SITLNLGILYLPKFGPYSYVIPQIN

SEQ ID NO: 3295835 - protein, 20 aa, Plasmodium falciparum
SITPYFINVKLKDNIYYIHL

SEQ ID NO: 3295836 - protein, 29 aa, Plasmodium falciparum
SIVAILIIVLIMVIIYLILRYRRKKNEEK

SEQ ID NO: 3295837 - protein, 19 aa, Plasmodium falciparum
SIVAIVIIVMVMVIIYLIL

SEQ ID NO: 3295838 - protein, 33 aa, Plasmodium falciparum
SIVAIVVIVLIMVIIYLILRYRRKKKVNKKLQY

SEQ ID NO: 3295839 - protein, 18 aa, Plasmodium falciparum
SIVLFLTFVLIFALVPFT

SEQ ID NO: 3295840 - protein, 24 aa, Plasmodium falciparum
SIVLNIFLLLFLKHFYYYSKLNYY

SEQ ID NO: 3295841 - protein, 24 aa, Plasmodium falciparum
SIVPILRMIFSMNISINLYTDECS

SEQ ID NO: 3295842 - protein, 19 aa, Plasmodium falciparum
SIVYLYNMKIYCTEPFRLP

SEQ ID NO: 3295843 - protein, 19 aa, Plasmodium falciparum
SIWEGMLCALTYKDGGEGK

SEQ ID NO: 3295844 - protein, 18 aa, Plasmodium falciparum
SIWNAMLCGYKKSGNKII

SEQ ID NO: 3295845 - protein, 37 aa, Plasmodium falciparum
SIYASIIVILIIVLIMVIIYLILRYRRKKKMKKKLQY

SEQ ID NO: 3295846 - protein, 25 aa, Plasmodium falciparum
SIYEYIIKELKKLSSILPLLVDLNN

SEQ ID NO: 3295847 - protein, 24 aa, Plasmodium falciparum
SIYIDNYYILKYKGYDFLNNKTHF

SEQ ID NO: 3295848 - protein, 26 aa, Plasmodium falciparum
SIYILLKVLFIYFNNTYVWYSLGQCL

SEQ ID NO: 3295849 - protein, 22 aa, Plasmodium falciparum
SIYKNFIYIISEIKNFNNKITK

SEQ ID NO: 3295850 - protein, 17 aa, Plasmodium falciparum
SIYLLYISKFNIIQDTY

SEQ ID NO: 3295851 - protein, 17 aa, Plasmodium falciparum
SIYLNLKYYMLKKELIN

SEQ ID NO: 3295852 - protein, 21 aa, Plasmodium falciparum
SIYLTKNINLLIIILKSMLNL

SEQ ID NO: 3295853 - protein, 20 aa, Plasmodium falciparum
SIYPAIEYPTTKYPAIEYPG

SEQ ID NO: 3295854 - protein, 18 aa, Plasmodium falciparum
SKAIGIAIFIFNCSNQMN

SEQ ID NO: 3295855 - protein, 24 aa, Plasmodium falciparum
SKCKNYLYLFSNEYNKKLFTHDEE

SEQ ID NO: 3295856 - protein, 27 aa, Plasmodium falciparum
SKDFMLASFLPVVIPFGLPIICSVFQE

SEQ ID NO: 3295857 - protein, 26 aa, Plasmodium falciparum
SKDILKNVLIFYNTFCYFINNCSKND

SEQ ID NO: 3295858 - protein, 32 aa, Plasmodium falciparum
SKDIYHFFMTYKKLFHKVYNYSIFLLDKHNIN

SEQ ID NO: 3295859 - protein, 24 aa, Plasmodium falciparum
SKDLKFLQMLKFIQGYKLKNTRMC

SEQ ID NO: 3295860 - protein, 29 aa, Plasmodium falciparum
SKDNISYSNFLPFLWKKNMSSLNVEYDLE

SEQ ID NO: 3295861 - protein, 24 aa, Plasmodium falciparum
SKDSFKLSYHFLNSLKNENYEMRD

SEQ ID NO: 3295862 - protein, 22 aa, Plasmodium falciparum
SKEFLILPYTIGVSMNTYFNNY

SEQ ID NO: 3295863 - protein, 22 aa, Plasmodium falciparum
SKEIFHIYLEKIYLNIAKENEN

SEQ ID NO: 3295864 - protein, 34 aa, Plasmodium falciparum
SKEKIFFDAPYIMQAIILVIHYLLAGNDLTLRNK

SEQ ID NO: 3295865 - protein, 28 aa, Plasmodium falciparum
SKELKNMDWLIYTIRYMDYRRLRRRFSG

SEQ ID NO: 3295866 - protein, 20 aa, Plasmodium falciparum
SKELLHIFFLISHNLRNILS

SEQ ID NO: 3295867 - protein, 25 aa, Plasmodium falciparum
SKENSLEIFLKRKSHYFSPMFKQNW

SEQ ID NO: 3295868 - protein, 19 aa, Plasmodium falciparum
SKENTWFPTLSKFDSIYSK

SEQ ID NO: 3295869 - protein, 27 aa, Plasmodium falciparum
SKEYYNSLFFYKIKSLGLGILKLLFER

SEQ ID NO: 3295870 - protein, 19 aa, Plasmodium falciparum
SKFCNDLKNSFLDYGHLAM

SEQ ID NO: 3295871 - protein, 21 aa, Plasmodium falciparum
SKFNLYEIEPLITVLKSIINE

SEQ ID NO: 3295872 - protein, 25 aa, Plasmodium falciparum
SKFSPFNIVLFLNSTTTYRLTQLYF

SEQ ID NO: 3295873 - protein, 22 aa, Plasmodium falciparum
SKGFFFFFFFFFLLYNICIIYK

SEQ ID NO: 3295874 - protein, 28 aa, Plasmodium falciparum
SKGMPTYLIPLVFIIVVAMIKEFFEDWQ

SEQ ID NO: 3295875 - protein, 17 aa, Plasmodium falciparum
SKGWLREYVYTKYRISL

SEQ ID NO: 3295876 - protein, 18 aa, Plasmodium falciparum
SKHFDILHSWDRISKLNE

SEQ ID NO: 3295877 - protein, 91 aa, Plasmodium falciparum
SKHLYTISIILYWNFFKNILLILPIFFYQAYASWSCVKIYPELLYTFFSIFWVFIPIIYYMFLQHNLNYDILYNIPLFYALSRRRYNMNCF

SEQ ID NO: 3295878 - protein, 24 aa, Plasmodium falciparum
SKIKNKMIILENLNIQFDFKKSKL

SEQ ID NO: 3295879 - protein, 22 aa, Plasmodium falciparum
SKILFRLCYYDFMFLSSDIIFK

SEQ ID NO: 3295880 - protein, 32 aa, Plasmodium falciparum
SKINIYEHLLTYFLKNINKMIFKYIKDDKKGS

SEQ ID NO: 3295881 - protein, 24 aa, Plasmodium falciparum
SKKAIYLLLNFNINKNVLKLAKIF

SEQ ID NO: 3295882 - protein, 21 aa, Plasmodium falciparum
SKKDIGMFYLYQEELKNEGDK

SEQ ID NO: 3295883 - protein, 34 aa, Plasmodium falciparum
SKKFRRYMLPIMGILYIIILNLLHLKGILSTEVQ

SEQ ID NO: 3295884 - protein, 25 aa, Plasmodium falciparum
SKKKNFVYITMNYINIFMNDLLNDK

SEQ ID NO: 3295885 - protein, 26 aa, Plasmodium falciparum
SKKKRCFYIPIAIYIGKRNELDKYEK

SEQ ID NO: 3295886 - protein, 21 aa, Plasmodium falciparum
SKKLFKNVLYYFHTLDDIKNA

SEQ ID NO: 3295887 - protein, 24 aa, Plasmodium falciparum
SKKNDLPIYLLNSYLIMVAREIPF

SEQ ID NO: 3295888 - protein, 19 aa, Plasmodium falciparum
SKKRYFAKILKKKKYLYTY

SEQ ID NO: 3295889 - protein, 40 aa, Plasmodium falciparum
SKKSPVKITFPLYNYYLKYSPDFYHNLYYKNFNSKKSMKL

SEQ ID NO: 3295890 - protein, 26 aa, Plasmodium falciparum
SKKWCLKILNIFLYRSIHFDEMNDTW

SEQ ID NO: 3295891 - protein, 27 aa, Plasmodium falciparum
SKKYYTNTFLKLLDFLLNAIKNEIDYQ

SEQ ID NO: 3295892 - protein, 28 aa, Plasmodium falciparum
SKLINDFAYLPYFEYLNNSLQSEHNQDD

SEQ ID NO: 3295893 - protein, 25 aa, Plasmodium falciparum
SKLLKQEFYFITFASLLINFSNETN

SEQ ID NO: 3295894 - protein, 20 aa, Plasmodium falciparum
SKLMKFFYKKVENTKNKYMN

SEQ ID NO: 3295895 - protein, 23 aa, Plasmodium falciparum
SKLNFIHFFIISNIFKAILIQVN

SEQ ID NO: 3295896 - protein, 44 aa, Plasmodium falciparum
SKLNLQDFFFLKLRKYNNCFILFFTILLMYITKLFEIKDPFYFH

SEQ ID NO: 3295897 - protein, 22 aa, Plasmodium falciparum
SKMHIIPYSLLVGDYILTKDIC

SEQ ID NO: 3295898 - protein, 27 aa, Plasmodium falciparum
SKMVDDIFMFFFLMKLNFVMNMKKDIQ

SEQ ID NO: 3295899 - protein, 36 aa, Plasmodium falciparum
SKNDDGYLDLSNHLYIYCLLFISISLIEINEHINFS

SEQ ID NO: 3295900 - protein, 26 aa, Plasmodium falciparum
SKNEKDFYIYDWKKEKWFEDLKNDCK

SEQ ID NO: 3295901 - protein, 22 aa, Plasmodium falciparum
SKNEMFLLKTLLNDIWGITGVS

SEQ ID NO: 3295902 - protein, 17 aa, Plasmodium falciparum
SKNFKPPNPWTTAILCL

SEQ ID NO: 3295903 - protein, 25 aa, Plasmodium falciparum
SKNKIPILWIRIDNDFVLLGRIRRS

SEQ ID NO: 3295904 - protein, 18 aa, Plasmodium falciparum
SKNKLIFHVLFKIWKDIE

SEQ ID NO: 3295905 - protein, 44 aa, Plasmodium falciparum
SKNKRKLLFFVLTKKHFYIFKFNFKHWIFLSPFIEDEKNDLHLY

SEQ ID NO: 3295906 - protein, 34 aa, Plasmodium falciparum
SKNLFICNKLLNIQWNYIFPMDLFISSNLSHETE

SEQ ID NO: 3295907 - protein, 25 aa, Plasmodium falciparum
SKNNNIFYFINLSYLKLLYNQMNYY

SEQ ID NO: 3295908 - protein, 32 aa, Plasmodium falciparum
SKNNYCIYINILKHIFIDVIKFKLNYNFNKIK

SEQ ID NO: 3295909 - protein, 22 aa, Plasmodium falciparum
SKNRYIPYASDRYKGKTYIYME

SEQ ID NO: 3295910 - protein, 46 aa, Plasmodium falciparum
SKNVHIIFNVNLFNLKSYFPKNFFKAVFLILPGLSFNINDIQLKYN

SEQ ID NO: 3295911 - protein, 35 aa, Plasmodium falciparum
SKPNHMYGVPIEVLRFFIPHYKQCRPEDFIYCPGY

SEQ ID NO: 3295912 - protein, 18 aa, Plasmodium falciparum
SKRAHRMNILGSLMLESS

SEQ ID NO: 3295913 - protein, 18 aa, Plasmodium falciparum
SKRIYLREYYDLFCSTNC

SEQ ID NO: 3295914 - protein, 17 aa, Plasmodium falciparum
SKRTYDNFIEKIKLHEN

SEQ ID NO: 3295915 - protein, 19 aa, Plasmodium falciparum
SKSIFILMGCFIFSFVINA

SEQ ID NO: 3295916 - protein, 26 aa, Plasmodium falciparum
SKSIFYSLYPIFLSLELFLKSIEIYK

SEQ ID NO: 3295917 - protein, 29 aa, Plasmodium falciparum
SKSLKFGHISVFIFGILYGVINKLFISDV

SEQ ID NO: 3295918 - protein, 27 aa, Plasmodium falciparum
SKSVQYSPKYIWSYMPEKLYAHFQQED

SEQ ID NO: 3295919 - protein, 35 aa, Plasmodium falciparum
SKTKRSLIFQRFYNILFNLNYALNKYGLKTNENLK

SEQ ID NO: 3295920 - protein, 30 aa, Plasmodium falciparum
SKTPITKLILYFYEIITRKYLFLNNSNANS

SEQ ID NO: 3295921 - protein, 24 aa, Plasmodium falciparum
SKTRFYYFLLLIHNQFDLKENVAK

SEQ ID NO: 3295922 - protein, 67 aa, Plasmodium falciparum
SKTTNEEYIILSRKDLIYNIIVMVHMMVLDQFKYDELKYAKKRFLNRSIDKFIKEKKIKDKETVLDY

SEQ ID NO: 3295923 - protein, 34 aa, Plasmodium falciparum
SKTYFSCLFLFLVLSFLYVIFRIYMLPLEFLKQY

SEQ ID NO: 3295924 - protein, 21 aa, Plasmodium falciparum
SKVCLNYLIKKFKNYLHIKNK

SEQ ID NO: 3295925 - protein, 33 aa, Plasmodium falciparum
SKVETKQFIYILFFLCLYLNTFNYKYTTSYEGS

SEQ ID NO: 3295926 - protein, 70 aa, Plasmodium falciparum
SKVSSATWLIYLYELKRASFFINYYFYHLHLFIYFKNYFINYQKNYKLFQNNKWIILKRNYEKQKKKEKY

SEQ ID NO: 3295927 - protein, 21 aa, Plasmodium falciparum
SKVTFCSIKLKGLLYKHLRND

SEQ ID NO: 3295928 - protein, 20 aa, Plasmodium falciparum
SKWDIYFILFIFYNIVLFLF

SEQ ID NO: 3295929 - protein, 26 aa, Plasmodium falciparum
SKYAEPIWNGMIYALTYKDNTDSGAK

SEQ ID NO: 3295930 - protein, 21 aa, Plasmodium falciparum
SKYAHGYLRKILKNIICTSGT

SEQ ID NO: 3295931 - protein, 27 aa, Plasmodium falciparum
SKYHHVFFIMLSYFYIGYFMSINKCLQ

SEQ ID NO: 3295932 - protein, 22 aa, Plasmodium falciparum
SKYIAIIFTYPLYTIKMRQQVQ

SEQ ID NO: 3295933 - protein, 38 aa, Plasmodium falciparum
SKYMNIKQLILYAYDNGYLIVTFPALCKILESIKNSKI

SEQ ID NO: 3295934 - protein, 23 aa, Plasmodium falciparum
SKYSELYTLPFSFDKFINEYNYL

SEQ ID NO: 3295935 - protein, 25 aa, Plasmodium falciparum
SKYSNTFINNAYNMSIRRSMAESKP

SEQ ID NO: 3295936 - protein, 25 aa, Plasmodium falciparum
SLAKVKLLQHIPAHMLENITSSIRF

SEQ ID NO: 3295937 - protein, 24 aa, Plasmodium falciparum
SLALMLIFFAFANLVLSDANDKAK

SEQ ID NO: 3295938 - protein, 24 aa, Plasmodium falciparum
SLAPVQLLWVNLVTDGLPATALGF

SEQ ID NO: 3295939 - protein, 21 aa, Plasmodium falciparum
SLCGIFLAFQYPVELPMVKNN

SEQ ID NO: 3295940 - protein, 25 aa, Plasmodium falciparum
SLCMNKQIMFASKLLAIVLSKNSSP

SEQ ID NO: 3295941 - protein, 21 aa, Plasmodium falciparum
SLCRLYIRYTRSFFKYFETKY

SEQ ID NO: 3295942 - protein, 20 aa, Plasmodium falciparum
SLCRYLISRSLKSMLCAGIF

SEQ ID NO: 3295943 - protein, 21 aa, Plasmodium falciparum
SLCSNMFYRLKIKIVKKINEY

SEQ ID NO: 3295944 - protein, 40 aa, Plasmodium falciparum
SLCVLKYKIYFFINTLYTYFQWILTYSWNRFLINLSESKS

SEQ ID NO: 3295945 - protein, 19 aa, Plasmodium falciparum
SLCYNLIDMLYLWNHASGE

SEQ ID NO: 3295946 - protein, 18 aa, Plasmodium falciparum
SLDCSYTFEISLFGIQIR

SEQ ID NO: 3295947 - protein, 23 aa, Plasmodium falciparum
SLDDLYILDLRKEQKYTWMTVPT

SEQ ID NO: 3295948 - protein, 26 aa, Plasmodium falciparum
SLDEDILYERNFLKDFELLKSKSYDM

SEQ ID NO: 3295949 - protein, 19 aa, Plasmodium falciparum
SLDFYRIIHLPLDNFFFPF

SEQ ID NO: 3295950 - protein, 27 aa, Plasmodium falciparum
SLDHWFGTNTLIPPRRRHLCLRNIIIK

SEQ ID NO: 3295951 - protein, 28 aa, Plasmodium falciparum
SLDIEIFFSIYIIILERINQSILNVIEN

SEQ ID NO: 3295952 - protein, 24 aa, Plasmodium falciparum
SLDIILKLIILYKEKCINIEKDIM

SEQ ID NO: 3295953 - protein, 17 aa, Plasmodium falciparum
SLDILCKFLKKSKNKCL

SEQ ID NO: 3295954 - protein, 20 aa, Plasmodium falciparum
SLDTSYGLFLKLLGENSYGF

SEQ ID NO: 3295955 - protein, 37 aa, Plasmodium falciparum
SLEFLNIFHSKILIHLYYFKPNLLFLSAGFDGHQLDY

SEQ ID NO: 3295956 - protein, 18 aa, Plasmodium falciparum
SLEHFPCIKLAYQAGIKG

SEQ ID NO: 3295957 - protein, 24 aa, Plasmodium falciparum
SLEKKPLEIKTTPKYPFVTDEQKE

SEQ ID NO: 3295958 - protein, 29 aa, Plasmodium falciparum
SLEQIKNIFYIFITRINLQYIQKCICYNI

SEQ ID NO: 3295959 - protein, 20 aa, Plasmodium falciparum
SLFELLFFSLGIIYNLHLLR

SEQ ID NO: 3295960 - protein, 19 aa, Plasmodium falciparum
SLFFNIILLIVIESLFELK

SEQ ID NO: 3295961 - protein, 19 aa, Plasmodium falciparum
SLFHEEFFRILKYNNKLFS

SEQ ID NO: 3295962 - protein, 18 aa, Plasmodium falciparum
SLFIYVDVYIVAYKVDIL

SEQ ID NO: 3295963 - protein, 24 aa, Plasmodium falciparum
SLFNNVIQNLKPWEYLSMKCTECT

SEQ ID NO: 3295964 - protein, 18 aa, Plasmodium falciparum
SLFNYINIDTVEACIIYL

SEQ ID NO: 3295965 - protein, 20 aa, Plasmodium falciparum
SLFQNFKLKSSYLSSGYFFS

SEQ ID NO: 3295966 - protein, 22 aa, Plasmodium falciparum
SLFRSFWVILCSSFILTVAVVG

SEQ ID NO: 3295967 - protein, 27 aa, Plasmodium falciparum
SLFSIVLCIFIITHKLCLEKIPHNKRN

SEQ ID NO: 3295968 - protein, 31 aa, Plasmodium falciparum
SLFSLFFIYLFIIIFVFPFVLKNMIHSDDSQ

SEQ ID NO: 3295969 - protein, 31 aa, Plasmodium falciparum
SLFYNPLNIMTLFNLIYYYNIKMDVKNSLFY

SEQ ID NO: 3295970 - protein, 36 aa, Plasmodium falciparum
SLGAFHSKKILLIFGIIYVVLLNAYICGDKYEKAVD

SEQ ID NO: 3295971 - protein, 18 aa, Plasmodium falciparum
SLGFIRNVFPFYDKKKRG

SEQ ID NO: 3295972 - protein, 17 aa, Plasmodium falciparum
SLGIMMLDTLQLNLLIL

SEQ ID NO: 3295973 - protein, 40 aa, Plasmodium falciparum
SLGNGFLHSSITFSNDFCKGMNLHFLISAEEIDSKFFLNK

SEQ ID NO: 3295974 - protein, 21 aa, Plasmodium falciparum
SLGQMIFPMCISKIINMYGGK

SEQ ID NO: 3295975 - protein, 36 aa, Plasmodium falciparum
SLHMLSRGLLLLLSRLLKPVMFINLFSYEKYRDVNV

SEQ ID NO: 3295976 - protein, 25 aa, Plasmodium falciparum
SLHQIKIYHIPLKDKCLRNNKINIE

SEQ ID NO: 3295977 - protein, 19 aa, Plasmodium falciparum
SLHYIVKIRCIYSLCFIHN

SEQ ID NO: 3295978 - protein, 35 aa, Plasmodium falciparum
SLICYMNIYKYICSFLLFLISYIERKPIEYLYLSQ

SEQ ID NO: 3295979 - protein, 29 aa, Plasmodium falciparum
SLIEKKCLYLYLIPIPPTNVVNIVHDMFS

SEQ ID NO: 3295980 - protein, 42 aa, Plasmodium falciparum
SLIFHSTYMRYEKMIHFVTFHDYLQLFVQEHLKQFLELFDAL

SEQ ID NO: 3295981 - protein, 18 aa, Plasmodium falciparum
SLIHLLIYSIKNTNTHFR

SEQ ID NO: 3295982 - protein, 19 aa, Plasmodium falciparum
SLIHLLIYSIKNTNTHFRS

SEQ ID NO: 3295983 - protein, 19 aa, Plasmodium falciparum
SLIIFLVFILVFVLNNFSN

SEQ ID NO: 3295984 - protein, 18 aa, Plasmodium falciparum
SLIKIYEILFDVFNKYDY

SEQ ID NO: 3295985 - protein, 20 aa, Plasmodium falciparum
SLIKQKHAFIKKKGFYILCY

SEQ ID NO: 3295986 - protein, 26 aa, Plasmodium falciparum
SLIKSKYVILLFSLLKNLHESSNMLG

SEQ ID NO: 3295987 - protein, 17 aa, Plasmodium falciparum
SLILFIVNFFIYCYFST

SEQ ID NO: 3295988 - protein, 19 aa, Plasmodium falciparum
SLILIKFIFYKECNNNNNY

SEQ ID NO: 3295989 - protein, 22 aa, Plasmodium falciparum
SLILLFFLIIVYKKVLSYKRKF

SEQ ID NO: 3295990 - protein, 26 aa, Plasmodium falciparum
SLILMYPYIPFILKPVIALITDSFSI

SEQ ID NO: 3295991 - protein, 20 aa, Plasmodium falciparum
SLIMIPQFYNTIKSIIFVTK

SEQ ID NO: 3295992 - protein, 19 aa, Plasmodium falciparum
SLINLLKLVLKKKQTHLEK

SEQ ID NO: 3295993 - protein, 26 aa, Plasmodium falciparum
SLIQHEPFIKAFMKKSLIIYSKMFSN

SEQ ID NO: 3295994 - protein, 25 aa, Plasmodium falciparum
SLISHSFFFIMKQYSYFILPKFHII

SEQ ID NO: 3295995 - protein, 27 aa, Plasmodium falciparum
SLISLYIYYVFFFNNIFSYLLYVKGKN

SEQ ID NO: 3295996 - protein, 24 aa, Plasmodium falciparum
SLISVHSSILYKISQFYAILAYFA

SEQ ID NO: 3295997 - protein, 34 aa, Plasmodium falciparum
SLIYNNSLQNIFYRYVFLLIMNLLIDYNANSKYY

SEQ ID NO: 3295998 - protein, 21 aa, Plasmodium falciparum
SLIYRYDYKKYPPPGQNFIDI

SEQ ID NO: 3295999 - protein, 18 aa, Plasmodium falciparum
SLKDEIITIGYPAGGDKL

SEQ ID NO: 3296000 - protein, 37 aa, Plasmodium falciparum
SLKIIRIYYYFTITLYFIPLLFYISLGLFLSIIICIM

SEQ ID NO: 3296001 - protein, 17 aa, Plasmodium falciparum
SLKLTKIIFSQMQLPYL

SEQ ID NO: 3296002 - protein, 21 aa, Plasmodium falciparum
SLKMFIKVIPFFHKNKDLVIF

SEQ ID NO: 3296003 - protein, 40 aa, Plasmodium falciparum
SLKQINIIICLLIVTLEDILKIFYHNFNFKKRSLNIMIES

SEQ ID NO: 3296004 - protein, 31 aa, Plasmodium falciparum
SLKSGTIPIDFLRLMFYTIADYKDIFEGKNM

SEQ ID NO: 3296005 - protein, 51 aa, Plasmodium falciparum
SLLDAEFKIPKRVKIILNIKAGMVFGAAIISLILFCCSVFSAGGAFVGLGY

SEQ ID NO: 3296006 - protein, 34 aa, Plasmodium falciparum
SLLELIELDFYVYYKENFYLYNTIWPVEIKNKSP

SEQ ID NO: 3296007 - protein, 20 aa, Plasmodium falciparum
SLLENFTKLDKNFLKGFFSD

SEQ ID NO: 3296008 - protein, 20 aa, Plasmodium falciparum
SLLFLDNYLCLLWNIMNNNK

SEQ ID NO: 3296009 - protein, 27 aa, Plasmodium falciparum
SLLFLQFYFSYFFKCKICIFSNTFLFI

SEQ ID NO: 3296010 - protein, 22 aa, Plasmodium falciparum
SLLGMWYVCNIFYNIENKKALN

SEQ ID NO: 3296011 - protein, 27 aa, Plasmodium falciparum
SLLHEFNYMYIMYKKFINNVYNEATDI

SEQ ID NO: 3296012 - protein, 21 aa, Plasmodium falciparum
SLLIFLFFCVYVFTQRRRVIS

SEQ ID NO: 3296013 - protein, 26 aa, Plasmodium falciparum
SLLKCFIFYIFTQITSILAVCLVIFC

SEQ ID NO: 3296014 - protein, 20 aa, Plasmodium falciparum
SLLLCLLLTNEWDNIQNDLL

SEQ ID NO: 3296015 - protein, 18 aa, Plasmodium falciparum
SLLLKLKSITMPVLSCTC

SEQ ID NO: 3296016 - protein, 33 aa, Plasmodium falciparum
SLLRDAFIKSAAIETFFLWDRYKKENTKTQSVG

SEQ ID NO: 3296017 - protein, 24 aa, Plasmodium falciparum
SLLVYFTFILPLVNRIILIKEESF

SEQ ID NO: 3296018 - protein, 17 aa, Plasmodium falciparum
SLLYILMCLLLKVKIKE

SEQ ID NO: 3296019 - protein, 32 aa, Plasmodium falciparum
SLMKCKRVFSYVIILHFLMNSICVTYSDDIHS

SEQ ID NO: 3296020 - protein, 17 aa, Plasmodium falciparum
SLMTFLAFYLSSVYAHS

SEQ ID NO: 3296021 - protein, 19 aa, Plasmodium falciparum
SLNELYIELAYVIKKRKNL

SEQ ID NO: 3296022 - protein, 25 aa, Plasmodium falciparum
SLNKESYPRRKFVSELKSNTYSYMN

SEQ ID NO: 3296023 - protein, 18 aa, Plasmodium falciparum
SLNKILYFSFQHYKIYHL

SEQ ID NO: 3296024 - protein, 42 aa, Plasmodium falciparum
SLNKYQINMIVEGYEKFIMQKLYFYLYRMNPNDKDDDEKIYT

SEQ ID NO: 3296025 - protein, 24 aa, Plasmodium falciparum
SLNLSFSFFLELFLKNMKNNQNIK

SEQ ID NO: 3296026 - protein, 42 aa, Plasmodium falciparum
SLNSPDNLLIYKNAIVLLLNDIKLKCLPQLGKQFSDVGRIID

SEQ ID NO: 3296027 - protein, 30 aa, Plasmodium falciparum
SLNVLCRTLYLFTIIMAPFTPFISEYIYQF

SEQ ID NO: 3296028 - protein, 29 aa, Plasmodium falciparum
SLPSAWLSNPFAIIKGFIKGLCALYKESV

SEQ ID NO: 3296029 - protein, 36 aa, Plasmodium falciparum
SLPTPIKYMWPSPFFYIYLFYHYCIYVIYHMNKLKN

SEQ ID NO: 3296030 - protein, 35 aa, Plasmodium falciparum
SLREVIQWLMLCNVPVKWLISFYKNNITGDKLKYI

SEQ ID NO: 3296031 - protein, 18 aa, Plasmodium falciparum
SLRGSLHMEYIFKDSYEL

SEQ ID NO: 3296032 - protein, 67 aa, Plasmodium falciparum
SLRIEKLKFYFFKYTAIFIGFIISLLRYDLLVYFSFIKPEILFSIFSKYFLFLSSYNKNSLFITINV

SEQ ID NO: 3296033 - protein, 19 aa, Plasmodium falciparum
SLRMLANAIRKYILRGKKG

SEQ ID NO: 3296034 - protein, 18 aa, Plasmodium falciparum
SLRNRFLNIIKSTKLNEL

SEQ ID NO: 3296035 - protein, 25 aa, Plasmodium falciparum
SLSCAIISRSVLKWKWFKITDTYER

SEQ ID NO: 3296036 - protein, 24 aa, Plasmodium falciparum
SLSCHEFLRMLFNYKYFIDDNLNY

SEQ ID NO: 3296037 - protein, 21 aa, Plasmodium falciparum
SLSIIFFWFITTLVLFTLFIV

SEQ ID NO: 3296038 - protein, 30 aa, Plasmodium falciparum
SLSNIHIFTNYNLLINFLQNFYYNQTIVNL

SEQ ID NO: 3296039 - protein, 39 aa, Plasmodium falciparum
SLSNLDKFWCFRMFLHSLILEFNNPDYYFFNLNDDMKKK

SEQ ID NO: 3296040 - protein, 19 aa, Plasmodium falciparum
SLSTVFRYTDAEALMNILI

SEQ ID NO: 3296041 - protein, 29 aa, Plasmodium falciparum
SLSVLSVVGFILFYFTPNFRKSDLFKNSS

SEQ ID NO: 3296042 - protein, 25 aa, Plasmodium falciparum
SLSVMLCLLIKVFGLYLDCSSYDLI

SEQ ID NO: 3296043 - protein, 41 aa, Plasmodium falciparum
SLSYNLKLIIYILYLLKYYSSYIYIYNFLKERFQVRPGKIE

SEQ ID NO: 3296044 - protein, 31 aa, Plasmodium falciparum
SLTEICLAFFLLLSFLYTCLTVLYVYHKNII

SEQ ID NO: 3296045 - protein, 25 aa, Plasmodium falciparum
SLTGNYYDFYYKVLVHPRGNSNDDN

SEQ ID NO: 3296046 - protein, 21 aa, Plasmodium falciparum
SLTIFFVLVLFFLTTTAFCDP

SEQ ID NO: 3296047 - protein, 28 aa, Plasmodium falciparum
SLTIPALYLYLYLLQNEKNKKKGFGKTT

SEQ ID NO: 3296048 - protein, 24 aa, Plasmodium falciparum
SLTNEIEFYKIIYKSVCSYSHQDT

SEQ ID NO: 3296049 - protein, 35 aa, Plasmodium falciparum
SLVANILICILTIFNSLLFLRTMTMIPNNIHFNKR

SEQ ID NO: 3296050 - protein, 23 aa, Plasmodium falciparum
SLVIFFPLFLYSKKAKLYILGLC

SEQ ID NO: 3296051 - protein, 21 aa, Plasmodium falciparum
SLVILYCFMISSLLSMISSKL

SEQ ID NO: 3296052 - protein, 21 aa, Plasmodium falciparum
SLVLLYFCCCVGMPVMFTLGC

SEQ ID NO: 3296053 - protein, 27 aa, Plasmodium falciparum
SLVNSFQLFKFISLYSIMQCSQVLILY

SEQ ID NO: 3296054 - protein, 23 aa, Plasmodium falciparum
SLVPIKYINYFKSSILINLLKFI

SEQ ID NO: 3296055 - protein, 19 aa, Plasmodium falciparum
SLVQNMIFKFFNLQKNTTP

SEQ ID NO: 3296056 - protein, 29 aa, Plasmodium falciparum
SLYDGIKFQIWAFRYGFSTIAPLVCTNMF

SEQ ID NO: 3296057 - protein, 33 aa, Plasmodium falciparum
SLYDVKYRLLLLFYKFIIILKHKELLQNENYIK

SEQ ID NO: 3296058 - protein, 18 aa, Plasmodium falciparum
SLYFFYLKYNGISIKKYI

SEQ ID NO: 3296059 - protein, 25 aa, Plasmodium falciparum
SLYFTSFDRLYLLILHYEKILKKCI

SEQ ID NO: 3296060 - protein, 30 aa, Plasmodium falciparum
SLYGLIGALFAYYIEYWKTIPRPCCVLIFM

SEQ ID NO: 3296061 - protein, 21 aa, Plasmodium falciparum
SLYGYTLCLIGTKSIMCCCII

SEQ ID NO: 3296062 - protein, 17 aa, Plasmodium falciparum
SLYIHKYMHNICLDIKK

SEQ ID NO: 3296063 - protein, 25 aa, Plasmodium falciparum
SLYKIFNTKILIIGLGGLGSPVCLY

SEQ ID NO: 3296064 - protein, 23 aa, Plasmodium falciparum
SLYKNSIFYSLLYSQTVCAYLEI

SEQ ID NO: 3296065 - protein, 32 aa, Plasmodium falciparum
SLYLNRSQIYLLENMLLLLDDIYRQGVNHELI

SEQ ID NO: 3296066 - protein, 23 aa, Plasmodium falciparum
SLYNIINLLYTISLKYFLYVFFN

SEQ ID NO: 3296067 - protein, 22 aa, Plasmodium falciparum
SLYSLLLNILLILSHVHNKKKS

SEQ ID NO: 3296068 - protein, 24 aa, Plasmodium falciparum
SLYSSINLIYYNNLVIVCVCDKFG

SEQ ID NO: 3296069 - protein, 17 aa, Plasmodium falciparum
SLYYFNRVIKWYNYILP

SEQ ID NO: 3296070 - protein, 26 aa, Plasmodium falciparum
SMAKADWIFFKDIIKTLYKSVEEKKL

SEQ ID NO: 3296071 - protein, 23 aa, Plasmodium falciparum
SMAKFVRYNPFLDKEFVGEYISH

SEQ ID NO: 3296072 - protein, 20 aa, Plasmodium falciparum
SMALCFLILCAFNYGTSFYL

SEQ ID NO: 3296073 - protein, 18 aa, Plasmodium falciparum
SMDEKPFIMSIHDRNLYS

SEQ ID NO: 3296074 - protein, 21 aa, Plasmodium falciparum
SMEIFLQLWNNESVKIFLLKI

SEQ ID NO: 3296075 - protein, 28 aa, Plasmodium falciparum
SMHLGHLIPFYFCKYLQEAFNVPLVIQL

SEQ ID NO: 3296076 - protein, 24 aa, Plasmodium falciparum
SMILHSIGYYKFYMKKIKGRLFEH

SEQ ID NO: 3296077 - protein, 32 aa, Plasmodium falciparum
SMKEFYNPMLKPRLWRLEFFIKYIHNLESQKQ

SEQ ID NO: 3296078 - protein, 27 aa, Plasmodium falciparum
SMKIQSFYIFYILKICKKRYNVKYVTD

SEQ ID NO: 3296079 - protein, 19 aa, Plasmodium falciparum
SMLYFCYMERIYDLDFLTE

SEQ ID NO: 3296080 - protein, 21 aa, Plasmodium falciparum
SMLYRIFLKVMKSFKNLSVQQ

SEQ ID NO: 3296081 - protein, 21 aa, Plasmodium falciparum
SMNILVDSVYYMWLNSLENES

SEQ ID NO: 3296082 - protein, 34 aa, Plasmodium falciparum
SMNITLFHLCFFGFLFVILNFTLDNSNFSNGGDI

SEQ ID NO: 3296083 - protein, 23 aa, Plasmodium falciparum
SMNSNILLRYIPKNPKGKNNYSI

SEQ ID NO: 3296084 - protein, 23 aa, Plasmodium falciparum
SMSPILRVQFFADFAKQAVHVAK

SEQ ID NO: 3296085 - protein, 29 aa, Plasmodium falciparum
SMSSFIYLPNHLYYKIELTNLFQFEKKII

SEQ ID NO: 3296086 - protein, 29 aa, Plasmodium falciparum
SMVVHYINQVIYFFNSIRYSNFNLSIDLN

SEQ ID NO: 3296087 - protein, 28 aa, Plasmodium falciparum
SMYNSSPYILYPFFKYSKTYLCSITGLH

SEQ ID NO: 3296088 - protein, 26 aa, Plasmodium falciparum
SNAALQKSFLYSLLQLIKTYEQFLRN

SEQ ID NO: 3296089 - protein, 30 aa, Plasmodium falciparum
SNADKFMLGIFFIWVWNNNYIWEKADSFND

SEQ ID NO: 3296090 - protein, 17 aa, Plasmodium falciparum
SNCAEGIYYGCQSFINI

SEQ ID NO: 3296091 - protein, 24 aa, Plasmodium falciparum
SNCEEFLNILPLRKNFNFKDKNSK

SEQ ID NO: 3296092 - protein, 29 aa, Plasmodium falciparum
SNCFLIMINVLLIWEMYLEIPLEILNKMR

SEQ ID NO: 3296093 - protein, 25 aa, Plasmodium falciparum
SNDEQNFIQLLTSLNILFDDDKKQI

SEQ ID NO: 3296094 - protein, 24 aa, Plasmodium falciparum
SNDFKQYTFLIQYTHLFADLYNYK

SEQ ID NO: 3296095 - protein, 20 aa, Plasmodium falciparum
SNDIKCKCFFLHCLCKILSN

SEQ ID NO: 3296096 - protein, 20 aa, Plasmodium falciparum
SNDILSLLFPLKEDLDRGEE

SEQ ID NO: 3296097 - protein, 25 aa, Plasmodium falciparum
SNDKLYIFDPFVDDILIFADKKIHL

SEQ ID NO: 3296098 - protein, 23 aa, Plasmodium falciparum
SNDNQLFCHMPLHKHIKDKYDVQ

SEQ ID NO: 3296099 - protein, 48 aa, Plasmodium falciparum
SNDSIIIDNFLWYNNPALFTIFEKYYLLLKMQKYILQYKHYSKNNLKK

SEQ ID NO: 3296100 - protein, 26 aa, Plasmodium falciparum
SNDTNYIFDELPWLTSLSDLKNSVTY

SEQ ID NO: 3296101 - protein, 32 aa, Plasmodium falciparum
SNDYDELLIPLRLMFLNILKFIHVTVKSEDRK

SEQ ID NO: 3296102 - protein, 22 aa, Plasmodium falciparum
SNEKFIELFENFVQKKKKKILS

SEQ ID NO: 3296103 - protein, 35 aa, Plasmodium falciparum
SNELIYVSGSVLTYICFWQLIIGYTLREMEIRDEL

SEQ ID NO: 3296104 - protein, 25 aa, Plasmodium falciparum
SNELSLFIFNAIMSLNNFYLNMKEP

SEQ ID NO: 3296105 - protein, 22 aa, Plasmodium falciparum
SNEMGMFKKIFYRIKKIIVDKK

SEQ ID NO: 3296106 - protein, 20 aa, Plasmodium falciparum
SNEMISKLDSLFIKNEEILN

SEQ ID NO: 3296107 - protein, 17 aa, Plasmodium falciparum
SNFFKYLKKLNNLRKCI

SEQ ID NO: 3296108 - protein, 29 aa, Plasmodium falciparum
SNFHEHMYLFILLAINKWFKRIIVECERF

SEQ ID NO: 3296109 - protein, 25 aa, Plasmodium falciparum
SNFILKLLAIFYIKLSKNTKFNITN

SEQ ID NO: 3296110 - protein, 30 aa, Plasmodium falciparum
SNFLLIIIMIIFFFFFKKAYFIESLFKDNR

SEQ ID NO: 3296111 - protein, 41 aa, Plasmodium falciparum
SNFMQQIFNYCPIEWPLLDISILIIVCQVVCYIFNLNKYHM

SEQ ID NO: 3296112 - protein, 20 aa, Plasmodium falciparum
SNFPVFDRVYKTGIWRLLVV

SEQ ID NO: 3296113 - protein, 25 aa, Plasmodium falciparum
SNFSYKYMIINRLVEICINSINKKM

SEQ ID NO: 3296114 - protein, 24 aa, Plasmodium falciparum
SNFTFRSCLFPFIYEKKYITDIHN

SEQ ID NO: 3296115 - protein, 24 aa, Plasmodium falciparum
SNGIHISFYLMEYLKRIINGEEKN

SEQ ID NO: 3296116 - protein, 26 aa, Plasmodium falciparum
SNGNNIMFLPFERHKLYLKKAINHLL

SEQ ID NO: 3296117 - protein, 22 aa, Plasmodium falciparum
SNHHILFCKIILNEYIKKYKNV

SEQ ID NO: 3296118 - protein, 17 aa, Plasmodium falciparum
SNIFIRENIKMNLILKE

SEQ ID NO: 3296119 - protein, 23 aa, Plasmodium falciparum
SNIFLTPKNIPLYILQKFISRIK

SEQ ID NO: 3296120 - protein, 32 aa, Plasmodium falciparum
SNIINFFHSIIYLCINNIYAYDLLCILFSDIF

SEQ ID NO: 3296121 - protein, 35 aa, Plasmodium falciparum
SNIKDPFEYHYWFTQPMEYALSFTLTDITKSICIW

SEQ ID NO: 3296122 - protein, 26 aa, Plasmodium falciparum
SNIKLLPCCIPILVILYKYIHRNICS

SEQ ID NO: 3296123 - protein, 26 aa, Plasmodium falciparum
SNIKSYLHIFLTFPKLSLSNTYMNED

SEQ ID NO: 3296124 - protein, 26 aa, Plasmodium falciparum
SNILTFFVLLIPHSSFCLSLDFIFIL

SEQ ID NO: 3296125 - protein, 21 aa, Plasmodium falciparum
SNINLLSFFKYNFKKAYILEM

SEQ ID NO: 3296126 - protein, 26 aa, Plasmodium falciparum
SNINYKYILYILLKLKEYDDKNPPRV

SEQ ID NO: 3296127 - protein, 23 aa, Plasmodium falciparum
SNIQKFVCFLLGTNIGEIIYLSV

SEQ ID NO: 3296128 - protein, 18 aa, Plasmodium falciparum
SNIRIFLSLVLIVIGTYC

SEQ ID NO: 3296129 - protein, 34 aa, Plasmodium falciparum
SNISLFSFALSIWICLFLFKIILSIMIVSYTISE

SEQ ID NO: 3296130 - protein, 26 aa, Plasmodium falciparum
SNKINVLFKNIFLVSAKTGYNVKKLI

SEQ ID NO: 3296131 - protein, 44 aa, Plasmodium falciparum
SNKKMYLSKIFELKYINCIFIFMFLSLLIIFTSMNEYTGIILSL

SEQ ID NO: 3296132 - protein, 24 aa, Plasmodium falciparum
SNKKNIILFLFVISLKIYDISHVN

SEQ ID NO: 3296133 - protein, 24 aa, Plasmodium falciparum
SNKLLDYFEFYIKQLFLQKIINID

SEQ ID NO: 3296134 - protein, 28 aa, Plasmodium falciparum
SNKRAKNYLYYLNDKIKSFIKIFSTNNM

SEQ ID NO: 3296135 - protein, 27 aa, Plasmodium falciparum
SNKSYIIYKYNIIGYIKLIHILKSVRS

SEQ ID NO: 3296136 - protein, 29 aa, Plasmodium falciparum
SNKTIYMYFDAFFPKKYFLKMNVSQVILD

SEQ ID NO: 3296137 - protein, 21 aa, Plasmodium falciparum
SNKYFISFLDGQRIIIPLRNV

SEQ ID NO: 3296138 - protein, 20 aa, Plasmodium falciparum
SNKYLSWLCSGMSLIDVVIN

SEQ ID NO: 3296139 - protein, 22 aa, Plasmodium falciparum
SNLEYLLHVNKGPLLKVEPDKI

SEQ ID NO: 3296140 - protein, 24 aa, Plasmodium falciparum
SNLFRPHLFVTLNEKHFANNPTHN

SEQ ID NO: 3296141 - protein, 25 aa, Plasmodium falciparum
SNLIKWLNLNFVTYSTWKAGILSQF

SEQ ID NO: 3296142 - protein, 25 aa, Plasmodium falciparum
SNLNKIFFVFYTNLNIITYSLRKIS

SEQ ID NO: 3296143 - protein, 24 aa, Plasmodium falciparum
SNLNQYVNPMNFLIQVLNKCNSNT

SEQ ID NO: 3296144 - protein, 27 aa, Plasmodium falciparum
SNLTKKELFFWASLKYYLEHFLGNIKS

SEQ ID NO: 3296145 - protein, 25 aa, Plasmodium falciparum
SNMDFALLPHFAILSCVCPVMRIKI

SEQ ID NO: 3296146 - protein, 22 aa, Plasmodium falciparum
SNMFINLYNILKVNFYCPLFSD

SEQ ID NO: 3296147 - protein, 28 aa, Plasmodium falciparum
SNMNFNKFWTTFFWPKELKIILRQLLDL

SEQ ID NO: 3296148 - protein, 24 aa, Plasmodium falciparum
SNMNYFFNNIYIYLKETYEYLFYL

SEQ ID NO: 3296149 - protein, 17 aa, Plasmodium falciparum
SNMWILLISELMGLYFV

SEQ ID NO: 3296150 - protein, 21 aa, Plasmodium falciparum
SNNIDILNMINFLLINNVHTY

SEQ ID NO: 3296151 - protein, 27 aa, Plasmodium falciparum
SNNKLKYIFSFFSLIDFITTPVSSLIM

SEQ ID NO: 3296152 - protein, 25 aa, Plasmodium falciparum
SNNKQFLLYSFLKKQFFLNKSGKNY

SEQ ID NO: 3296153 - protein, 26 aa, Plasmodium falciparum
SNNLKNAFMNLPKDIFSLFIHAIQSI

SEQ ID NO: 3296154 - protein, 24 aa, Plasmodium falciparum
SNNLYLFFRGFYIYTKHRFVHYLS

SEQ ID NO: 3296155 - protein, 20 aa, Plasmodium falciparum
SNNLYYYYLGYINLGHGKCV

SEQ ID NO: 3296156 - protein, 25 aa, Plasmodium falciparum
SNNNPYLLLFIEFIRRIEFQYLIEE

SEQ ID NO: 3296157 - protein, 30 aa, Plasmodium falciparum
SNNSFFVIRNILYNILYTYNFHLHNFLNTF

SEQ ID NO: 3296158 - protein, 29 aa, Plasmodium falciparum
SNNSFYIKLFYYFLFSIIFTILMCAVNIY

SEQ ID NO: 3296159 - protein, 30 aa, Plasmodium falciparum
SNNSIVNNFFFFFKIFQNVNNLLFSQNNNI

SEQ ID NO: 3296160 - protein, 31 aa, Plasmodium falciparum
SNNSNKLIPIPLYWLVAENSFIWLSIQNEEI

SEQ ID NO: 3296161 - protein, 37 aa, Plasmodium falciparum
SNPYELDIRMLKENCLTVFELLYREKKKWCSLYISTM

SEQ ID NO: 3296162 - protein, 28 aa, Plasmodium falciparum
SNQPDDNIIYYWIIKNSWSKKWGENGFM

SEQ ID NO: 3296163 - protein, 53 aa, Plasmodium falciparum
SNRFFNNIPNINNYFSYLNYYIESLRLLYNKLLRNRNLILILAKEIFSKNKKL

SEQ ID NO: 3296164 - protein, 27 aa, Plasmodium falciparum
SNSLVITWNLYFFSEQLPLIKKKFEKY

SEQ ID NO: 3296165 - protein, 26 aa, Plasmodium falciparum
SNSSKIYELFFNKYKKKKILNIECSG

SEQ ID NO: 3296166 - protein, 21 aa, Plasmodium falciparum
SNTFKQIKFFAPSKKKKRNYL

SEQ ID NO: 3296167 - protein, 21 aa, Plasmodium falciparum
SNTMINMITVKRLAFYMDSLD

SEQ ID NO: 3296168 - protein, 31 aa, Plasmodium falciparum
SNTVCAANHPWLKYFHILNKTQKNKKNKKKK

SEQ ID NO: 3296169 - protein, 27 aa, Plasmodium falciparum
SNVNKMNLYLLYSLSVDGNIFNLIKSI

SEQ ID NO: 3296170 - protein, 25 aa, Plasmodium falciparum
SNYENWIPYFNLIGMYKNYIETSDS

SEQ ID NO: 3296171 - protein, 38 aa, Plasmodium falciparum
SNYIPYFVLSYPSFPLFLENLFNIFFFVRNNLITFFIK

SEQ ID NO: 3296172 - protein, 26 aa, Plasmodium falciparum
SNYKRYGMLPPNFKKYFTLSEECLKN

SEQ ID NO: 3296173 - protein, 24 aa, Plasmodium falciparum
SNYSLYIYIYADNKFIYGGFNEYK

SEQ ID NO: 3296174 - protein, 24 aa, Plasmodium falciparum
SPAGLLIPYHLGVSSLLIEKNILN

SEQ ID NO: 3296175 - protein, 25 aa, Plasmodium falciparum
SPEEIHFLFYLNLLVLINEDFFFKF

SEQ ID NO: 3296176 - protein, 33 aa, Plasmodium falciparum
SPFKNIICIVVIIRYLLWNLYKNHINKIDMKKL

SEQ ID NO: 3296177 - protein, 30 aa, Plasmodium falciparum
SPHLIKYNHILFLFICVKNIFHKYINNLWI

SEQ ID NO: 3296178 - protein, 17 aa, Plasmodium falciparum
SPKYKTLIDVVLEPSKR

SEQ ID NO: 3296179 - protein, 28 aa, Plasmodium falciparum
SPLFSNISKDPYYFLKKLKIDEHHFLLN

SEQ ID NO: 3296180 - protein, 17 aa, Plasmodium falciparum
SPLILNRSPSMLRSLLI

SEQ ID NO: 3296181 - protein, 23 aa, Plasmodium falciparum
SPLVLFNLILSGILVCEKCIIFK

SEQ ID NO: 3296182 - protein, 25 aa, Plasmodium falciparum
SPMPNYKILFMSSTVRIINKCGIPL

SEQ ID NO: 3296183 - protein, 23 aa, Plasmodium falciparum
SPMPYIKIYFLTKNISHQKYTRR

SEQ ID NO: 3296184 - protein, 30 aa, Plasmodium falciparum
SPNQDDFIIITMENLALYAIFDGHGPYGHD

SEQ ID NO: 3296185 - protein, 24 aa, Plasmodium falciparum
SPPLPPLTTALVTSTLAWSVGIGF

SEQ ID NO: 3296186 - protein, 25 aa, Plasmodium falciparum
SPRNLFQSFLLPVSGCLLIGTTYAK

SEQ ID NO: 3296187 - protein, 18 aa, Plasmodium falciparum
SPSYVLKFVLNIDELFQN

SEQ ID NO: 3296188 - protein, 22 aa, Plasmodium falciparum
SPVDLIRVIDIHKGDYGIPTLE

SEQ ID NO: 3296189 - protein, 21 aa, Plasmodium falciparum
SPVDLLRVLDIHKGDYGTPTS

SEQ ID NO: 3296190 - protein, 33 aa, Plasmodium falciparum
SPVHSALSVLTLVVYIVLLNIFSQEYAITKGSP

SEQ ID NO: 3296191 - protein, 23 aa, Plasmodium falciparum
SPYIKKICKILYIIEIYNNFKND

SEQ ID NO: 3296192 - protein, 21 aa, Plasmodium falciparum
SPYRNFLLYVEEIYQVTVVYP

SEQ ID NO: 3296193 - protein, 24 aa, Plasmodium falciparum
SQDFTNNILFKYVLGYSGTSNDIL

SEQ ID NO: 3296194 - protein, 25 aa, Plasmodium falciparum
SQDIKNLLIILTLLHHNNISFSTEK

SEQ ID NO: 3296195 - protein, 32 aa, Plasmodium falciparum
SQDTNIHFIIFLIYRILIFKKLFTHTYIIYTF

SEQ ID NO: 3296196 - protein, 35 aa, Plasmodium falciparum
SQEDLLKWFVKSAAVETFFLWDRYKKENTKRQSGS

SEQ ID NO: 3296197 - protein, 26 aa, Plasmodium falciparum
SQFFYINKIFIFMHNFNRFKNNILKN

SEQ ID NO: 3296198 - protein, 20 aa, Plasmodium falciparum
SQFIFKAIFTKYRGSCLPSP

SEQ ID NO: 3296199 - protein, 36 aa, Plasmodium falciparum
SQFYIFNHIFFPFFFSLFFIIYIYNIRRIKIINSFK

SEQ ID NO: 3296200 - protein, 24 aa, Plasmodium falciparum
SQGLLHYLSILFYSLFKNNNKNDF

SEQ ID NO: 3296201 - protein, 22 aa, Plasmodium falciparum
SQGTFYRSKYCQPCPLCGVERK

SEQ ID NO: 3296202 - protein, 19 aa, Plasmodium falciparum
SQIFFLCDTLIIDEAHFLV

SEQ ID NO: 3296203 - protein, 22 aa, Plasmodium falciparum
SQIGLIRYIDCLLKRYIKNLNH

SEQ ID NO: 3296204 - protein, 17 aa, Plasmodium falciparum
SQKLKDILIINKYLNKA

SEQ ID NO: 3296205 - protein, 23 aa, Plasmodium falciparum
SQKTYYINYYNITFVICIEYIED

SEQ ID NO: 3296206 - protein, 42 aa, Plasmodium falciparum
SQLFNIYDNFHICFLYPLFVTYFFYYHLFVKHKMDNLMKKGV

SEQ ID NO: 3296207 - protein, 25 aa, Plasmodium falciparum
SQLHVSYKLIKIKNILYKINILKKN

SEQ ID NO: 3296208 - protein, 32 aa, Plasmodium falciparum
SQLYSRRILFIFLKYFNVFIYCKISKLNKDKR

SEQ ID NO: 3296209 - protein, 26 aa, Plasmodium falciparum
SQMKILYIFFFVFIGFCMQLGLEYVL

SEQ ID NO: 3296210 - protein, 26 aa, Plasmodium falciparum
SQNIYLYGVLALPLALFSSLYFLNEI

SEQ ID NO: 3296211 - protein, 26 aa, Plasmodium falciparum
SQPYYIFYSAFSLLIFIIYIVASYFP

SEQ ID NO: 3296212 - protein, 27 aa, Plasmodium falciparum
SQQLFLLLHLMYKLSQLFTYFFVKLKL

SEQ ID NO: 3296213 - protein, 22 aa, Plasmodium falciparum
SQQLLHIKLFNYIKKKKRLEMK

SEQ ID NO: 3296214 - protein, 25 aa, Plasmodium falciparum
SQRIHNLPILLFKTLKENKQISLST

SEQ ID NO: 3296215 - protein, 24 aa, Plasmodium falciparum
SQRQKIIWKKWIAKHPYKINEEII

SEQ ID NO: 3296216 - protein, 25 aa, Plasmodium falciparum
SQSKRHLFYMLVKKKYNLPIQKEEN

SEQ ID NO: 3296217 - protein, 26 aa, Plasmodium falciparum
SQSYIFKSNLFPNIFWGICPIDVFQE

SEQ ID NO: 3296218 - protein, 22 aa, Plasmodium falciparum
SQTHFDIVYLNKLNMNAKEEKK

SEQ ID NO: 3296219 - protein, 31 aa, Plasmodium falciparum
SQVGFGFRYKLFLLIVIPAITIGIYIAHNVS

SEQ ID NO: 3296220 - protein, 23 aa, Plasmodium falciparum
SQVIYNVFGWFSAPLLSGIIMDI

SEQ ID NO: 3296221 - protein, 27 aa, Plasmodium falciparum
SQYAVLFVKLLFLSPVFGIGMAMITFA

SEQ ID NO: 3296222 - protein, 31 aa, Plasmodium falciparum
SQYNDLLIKILIISFNKFILLNDTQQLIFYN

SEQ ID NO: 3296223 - protein, 20 aa, Plasmodium falciparum
SQYNHIFTRILSEINLKGEH

SEQ ID NO: 3296224 - protein, 24 aa, Plasmodium falciparum
SQYNNFFITIYNILKIKELKNAKD

SEQ ID NO: 3296225 - protein, 29 aa, Plasmodium falciparum
SRDDTEDQFLRFFAEWEEEFCDGLNKHEE

SEQ ID NO: 3296226 - protein, 33 aa, Plasmodium falciparum
SRDERIVRIFYYSGFSFLPYLGWVIASIYASFC

SEQ ID NO: 3296227 - protein, 45 aa, Plasmodium falciparum
SRDIFFKINKFILLRKSRMIYLRQLKKRVYSYYSLIPIYGNIQQT

SEQ ID NO: 3296228 - protein, 25 aa, Plasmodium falciparum
SRDLYLFTLMVIYKKYRCIENFKIL

SEQ ID NO: 3296229 - protein, 24 aa, Plasmodium falciparum
SRDMYIKILYNILSDDIFKTDFFH

SEQ ID NO: 3296230 - protein, 19 aa, Plasmodium falciparum
SREYEECYYLIQKSYKILT

SEQ ID NO: 3296231 - protein, 42 aa, Plasmodium falciparum
SREYNIKKNRMWYYIFVKILFLSFFICILNGSSYDTYCKEGN

SEQ ID NO: 3296232 - protein, 22 aa, Plasmodium falciparum
SRINSFFEQQLFDSGIKKDKQK

SEQ ID NO: 3296233 - protein, 19 aa, Plasmodium falciparum
SRIVCTIILYFTNAFYNRM

SEQ ID NO: 3296234 - protein, 23 aa, Plasmodium falciparum
SRIYHYIRAQPFMKLYVVLNMLE

SEQ ID NO: 3296235 - protein, 18 aa, Plasmodium falciparum
SRIYIKKYHKKIFRILLL

SEQ ID NO: 3296236 - protein, 26 aa, Plasmodium falciparum
SRKGNRLFYLINKKIILKGINNISYK

SEQ ID NO: 3296237 - protein, 34 aa, Plasmodium falciparum
SRKIGHIFYFQFFYDIIIRIFNELYYLEYSNIPR

SEQ ID NO: 3296238 - protein, 26 aa, Plasmodium falciparum
SRKVYNYVPIFYTSKINFLQVISRNI

SEQ ID NO: 3296239 - protein, 38 aa, Plasmodium falciparum
SRKYKLYSEVFFVLFLIIFIILIILGGYIFKFKEILNK

SEQ ID NO: 3296240 - protein, 22 aa, Plasmodium falciparum
SRLKMHSFIFPYDAYIKGYNRN

SEQ ID NO: 3296241 - protein, 34 aa, Plasmodium falciparum
SRLNDICFDFIYIFSLIMLGNILMSLNKFAKAIK

SEQ ID NO: 3296242 - protein, 27 aa, Plasmodium falciparum
SRMQNVYLIICKKLLYYQKNQKDMEKN

SEQ ID NO: 3296243 - protein, 17 aa, Plasmodium falciparum
SRNDHLLDKPKFTVLKE

SEQ ID NO: 3296244 - protein, 45 aa, Plasmodium falciparum
SRNITELFKVLLFVKVPYLSIFDIKNIIFYILSNLNGDFVNHNYI

SEQ ID NO: 3296245 - protein, 25 aa, Plasmodium falciparum
SRNSYECSFPLLTNGPYYYENENNT

SEQ ID NO: 3296246 - protein, 23 aa, Plasmodium falciparum
SRNTLLTINILKDTWKKFREMMN

SEQ ID NO: 3296247 - protein, 18 aa, Plasmodium falciparum
SRPILMINTIVDVSLIGD

SEQ ID NO: 3296248 - protein, 25 aa, Plasmodium falciparum
SRQRYWGEPFPFLYKMKDKNGYMDN

SEQ ID NO: 3296249 - protein, 29 aa, Plasmodium falciparum
SRRKKVKVNLKDNLAKREGKMKRRNKKEK

SEQ ID NO: 3296250 - protein, 28 aa, Plasmodium falciparum
SRRKRKRFMLDKDLYLGYNKYLCNTDKV

SEQ ID NO: 3296251 - protein, 19 aa, Plasmodium falciparum
SRRRTLYNKLTFNKSFFNN

SEQ ID NO: 3296252 - protein, 22 aa, Plasmodium falciparum
SRSRMLLTYFFSTLICHKRYFK

SEQ ID NO: 3296253 - protein, 44 aa, Plasmodium falciparum
SRTKIFLYTLWYSIIFTYLMDFFFNLLFFFLYMPYTNIISKTIF

SEQ ID NO: 3296254 - protein, 22 aa, Plasmodium falciparum
SRTLTFFNMKKKKNVKLYLVKD

SEQ ID NO: 3296255 - protein, 30 aa, Plasmodium falciparum
SRYDVLITRFFLFASFLMVLFMCENFLKKS

SEQ ID NO: 3296256 - protein, 26 aa, Plasmodium falciparum
SRYSHPFLNYFLFDYDMIIRSKMDNE

SEQ ID NO: 3296257 - protein, 19 aa, Plasmodium falciparum
SSAIFLTPALYIDSHKWKD

SEQ ID NO: 3296258 - protein, 26 aa, Plasmodium falciparum
SSCFKLIKYLLTEYYYYPDIFNEKCH

SEQ ID NO: 3296259 - protein, 32 aa, Plasmodium falciparum
SSCIFFLYVFYKIIKIIWFQYFYKIYRKYYEK

SEQ ID NO: 3296260 - protein, 36 aa, Plasmodium falciparum
SSCKLKIFEIIFYYTLKVYLCFINKNYIGTFISKIA

SEQ ID NO: 3296261 - protein, 29 aa, Plasmodium falciparum
SSCTVSIFNINLFNCIYLKKYKKHGEIYL

SEQ ID NO: 3296262 - protein, 29 aa, Plasmodium falciparum
SSCYKVLEKYNHWLYNRKLEWNDISKKYQ

SEQ ID NO: 3296263 - protein, 26 aa, Plasmodium falciparum
SSDINLILYHNNYPFLEFKKPFCILN

SEQ ID NO: 3296264 - protein, 32 aa, Plasmodium falciparum
SSDTPTLDSFIKRPPYFRYLEEWGQNFCKERK

SEQ ID NO: 3296265 - protein, 17 aa, Plasmodium falciparum
SSDYGISQFRFLKNLLL

SEQ ID NO: 3296266 - protein, 58 aa, Plasmodium falciparum
SSDYISKLHLFIVKKEKVLFFPILYAEMIIRYNMKFFPLSKLYNIKNTASLMKCKRVF

SEQ ID NO: 3296267 - protein, 25 aa, Plasmodium falciparum
SSELNPFFFYISRYMWDMLSFYMNK

SEQ ID NO: 3296268 - protein, 24 aa, Plasmodium falciparum
SSERYLIVLDAFYNLLCFRITYKN

SEQ ID NO: 3296269 - protein, 21 aa, Plasmodium falciparum
SSFFNHFYNLLARVLYHVDHI

SEQ ID NO: 3296270 - protein, 23 aa, Plasmodium falciparum
SSFFTILVCYLRNNLIKMNKIYT

SEQ ID NO: 3296271 - protein, 32 aa, Plasmodium falciparum
SSFHSKQIILIFGIIYVALLNVYICGDKYQQD

SEQ ID NO: 3296272 - protein, 28 aa, Plasmodium falciparum
SSFIIYEKFIIFILNKMVLLKKPQIVNI

SEQ ID NO: 3296273 - protein, 18 aa, Plasmodium falciparum
SSFIRPDYETKCPPRYPL

SEQ ID NO: 3296274 - protein, 24 aa, Plasmodium falciparum
SSFIRTDYMTKCPPRFPLNHTMFG

SEQ ID NO: 3296275 - protein, 18 aa, Plasmodium falciparum
SSFITYLGVFSSSFRIKL

SEQ ID NO: 3296276 - protein, 51 aa, Plasmodium falciparum
SSFLIKNIHKIFYYLLIHTFFNIYMSLKLIHPFLDLLYYKMCMENNLKKCN

SEQ ID NO: 3296277 - protein, 17 aa, Plasmodium falciparum
SSFLLNSTLFFNELFER

SEQ ID NO: 3296278 - protein, 42 aa, Plasmodium falciparum
SSFLNTICFFIFVIMFLWALAILSRFYLSYNIMKYLKNRKAI

SEQ ID NO: 3296279 - protein, 26 aa, Plasmodium falciparum
SSFNILLLLAQFLNSQSFIFYEKHNE

SEQ ID NO: 3296280 - protein, 24 aa, Plasmodium falciparum
SSFVQTRIFPPKPTIFSLEKNDDF

SEQ ID NO: 3296281 - protein, 30 aa, Plasmodium falciparum
SSGDLYVILNPILNVTYYSKMIDYCMSCIP

SEQ ID NO: 3296282 - protein, 22 aa, Plasmodium falciparum
SSGFINYFTKLFSNNNLFLEKL

SEQ ID NO: 3296283 - protein, 24 aa, Plasmodium falciparum
SSGISFYSLIFKYNSNLINTLHTD

SEQ ID NO: 3296284 - protein, 25 aa, Plasmodium falciparum
SSGLREIFVYLAKNKFIDVVVTTAG

SEQ ID NO: 3296285 - protein, 20 aa, Plasmodium falciparum
SSHFIIHLMEYLYVLLIQNR

SEQ ID NO: 3296286 - protein, 21 aa, Plasmodium falciparum
SSHIFFDKTILRIPTYKIQNV

SEQ ID NO: 3296287 - protein, 23 aa, Plasmodium falciparum
SSICFLYFTFLYLKKLNLNLNAQ

SEQ ID NO: 3296288 - protein, 18 aa, Plasmodium falciparum
SSIFDLFHKWINGSIHEL

SEQ ID NO: 3296289 - protein, 28 aa, Plasmodium falciparum
SSIFLIYEIILILQKIYIYDNINFYLYV

SEQ ID NO: 3296290 - protein, 24 aa, Plasmodium falciparum
SSIGFVCNGLFWEYFKFNIPNFIK

SEQ ID NO: 3296291 - protein, 32 aa, Plasmodium falciparum
SSIGIIIKNINIFEIFLECKHFIFDKTGTLTV

SEQ ID NO: 3296292 - protein, 19 aa, Plasmodium falciparum
SSIIFDMICPYLDITNIRI

SEQ ID NO: 3296293 - protein, 48 aa, Plasmodium falciparum
SSIIVNICRTFLFHKPLIPFKKVIYKSIICVIAMAIKLHKPHLIPSSE

SEQ ID NO: 3296294 - protein, 28 aa, Plasmodium falciparum
SSILRTYIVLIFLFILVSKVFSVISPIY

SEQ ID NO: 3296295 - protein, 34 aa, Plasmodium falciparum
SSIQGYIIIILLFNYKYHFLWENNYFNILKTNND

SEQ ID NO: 3296296 - protein, 31 aa, Plasmodium falciparum
SSIVAIVIIVLFIVIIYLILHYRRKKKNKKK

SEQ ID NO: 3296297 - protein, 26 aa, Plasmodium falciparum
SSKEIREYWWALNRDQVWKALTCDEE

SEQ ID NO: 3296298 - protein, 28 aa, Plasmodium falciparum
SSKEKYTYYFVPIPGIFNLFSHYKKYSC

SEQ ID NO: 3296299 - protein, 24 aa, Plasmodium falciparum
SSKFLLFRRLSQCLNPLLPSGVHS

SEQ ID NO: 3296300 - protein, 27 aa, Plasmodium falciparum
SSKLLLRFIVTLSEICLILTPHYVNII

SEQ ID NO: 3296301 - protein, 23 aa, Plasmodium falciparum
SSKLNFMFLFNIFFCVLLIVFFI

SEQ ID NO: 3296302 - protein, 33 aa, Plasmodium falciparum
SSKLSKTILVTLGLIVILTITLGIVGIAAGSSI

SEQ ID NO: 3296303 - protein, 26 aa, Plasmodium falciparum
SSKSSKYILFIFKNGSVIIWENFNNH

SEQ ID NO: 3296304 - protein, 24 aa, Plasmodium falciparum
SSKYFIHLCIYYIYNNEKSKFLKL

SEQ ID NO: 3296305 - protein, 40 aa, Plasmodium falciparum
SSLCSFLIHRGFILTYLQFIYSYIFFSIPVSIFQGWLQIG

SEQ ID NO: 3296306 - protein, 28 aa, Plasmodium falciparum
SSLFFGYLMVLTFLLSFLCIEAKLEKKK

SEQ ID NO: 3296307 - protein, 17 aa, Plasmodium falciparum
SSLFYNYIPFDINNLYN

SEQ ID NO: 3296308 - protein, 25 aa, Plasmodium falciparum
SSLIQIMVMFFSHYKLKDLIVQSLK

SEQ ID NO: 3296309 - protein, 27 aa, Plasmodium falciparum
SSLIYSPSIFFFHIINNIDIATFQKLL

SEQ ID NO: 3296310 - protein, 26 aa, Plasmodium falciparum
SSLLSKRMVIPMLGVLYVVLLNVCLH

SEQ ID NO: 3296311 - protein, 30 aa, Plasmodium falciparum
SSLPFILFFCGYTSYMYILTSILPNLFIFY

SEQ ID NO: 3296312 - protein, 23 aa, Plasmodium falciparum
SSLSFSLCFCKEKNIYFSFKNIN

SEQ ID NO: 3296313 - protein, 25 aa, Plasmodium falciparum
SSLTNKDILLLKSLYEDKNKNKNKN

SEQ ID NO: 3296314 - protein, 31 aa, Plasmodium falciparum
SSNAWSIFVVYLLRELLIDGNYDPINRLLNT

SEQ ID NO: 3296315 - protein, 22 aa, Plasmodium falciparum
SSNISLLMNPLGNNNKIIKNHE

SEQ ID NO: 3296316 - protein, 24 aa, Plasmodium falciparum
SSNKKLILNFLKNKYGFIIANEKY

SEQ ID NO: 3296317 - protein, 24 aa, Plasmodium falciparum
SSNKKLYLCSLLSIGLVGYIYFNW

SEQ ID NO: 3296318 - protein, 23 aa, Plasmodium falciparum
SSNKKYIKLVGTYGYIAPEIIKG

SEQ ID NO: 3296319 - protein, 37 aa, Plasmodium falciparum
SSNNNKWNSCGFLFFLCYILQYILKHLKYDLFNSTVN

SEQ ID NO: 3296320 - protein, 21 aa, Plasmodium falciparum
SSNRYIPYASDRYKGKTYIYM

SEQ ID NO: 3296321 - protein, 21 aa, Plasmodium falciparum
SSNRYIPYASERYKGKTYIYM

SEQ ID NO: 3296322 - protein, 26 aa, Plasmodium falciparum
SSNVLLIDLLTFKIIPEIIDGIFICK

SEQ ID NO: 3296323 - protein, 26 aa, Plasmodium falciparum
SSNVNGIYFYNSVFKLIQNGTFLLKY

SEQ ID NO: 3296324 - protein, 18 aa, Plasmodium falciparum
SSPFYYIPEELLFFHMNK

SEQ ID NO: 3296325 - protein, 32 aa, Plasmodium falciparum
SSPLIKLNYLFKVILRFTFLVSFSFLAIIVST

SEQ ID NO: 3296326 - protein, 22 aa, Plasmodium falciparum
SSPNYLAFLKNYYKPINRGLYN

SEQ ID NO: 3296327 - protein, 24 aa, Plasmodium falciparum
SSPSIWLTNLIYELTPYPFLSKGR

SEQ ID NO: 3296328 - protein, 26 aa, Plasmodium falciparum
SSQHHYYSLFLLLDFINNILSHNLID

SEQ ID NO: 3296329 - protein, 44 aa, Plasmodium falciparum
SSRGLPPYLYVNPVFYWTYGAIWTFILYFKFNYCILYDHGYSSI

SEQ ID NO: 3296330 - protein, 17 aa, Plasmodium falciparum
SSSLHIPPLILKDAEFL

SEQ ID NO: 3296331 - protein, 32 aa, Plasmodium falciparum
SSSLNMDPYFLSTINFYFLNNLNKNLILCDIK

SEQ ID NO: 3296332 - protein, 18 aa, Plasmodium falciparum
SSSLVLVSCKKPLKNMLI

SEQ ID NO: 3296333 - protein, 24 aa, Plasmodium falciparum
SSSNLFVFYILYILLSFNNERKKE

SEQ ID NO: 3296334 - protein, 23 aa, Plasmodium falciparum
SSSNRELIPYKKEILPFGVSNSE

SEQ ID NO: 3296335 - protein, 26 aa, Plasmodium falciparum
SSSNSADLFSFQKNIWSPSVSSKDNC

SEQ ID NO: 3296336 - protein, 18 aa, Plasmodium falciparum
SSSYKFISFIKTIEDVKE

SEQ ID NO: 3296337 - protein, 26 aa, Plasmodium falciparum
SSTDYFFLKKLGIYFLIKRNEKTAVL

SEQ ID NO: 3296338 - protein, 25 aa, Plasmodium falciparum
SSTKNFFLIILIEKAKKMFFRNLDF

SEQ ID NO: 3296339 - protein, 23 aa, Plasmodium falciparum
SSVDLLRVLNIPKGDYEMPTLKS

SEQ ID NO: 3296340 - protein, 25 aa, Plasmodium falciparum
SSVGNLFQILQIPKSDYGTPTPKSK

SEQ ID NO: 3296341 - protein, 25 aa, Plasmodium falciparum
SSVLLNYFFILYTYIQSVGNKRDEE

SEQ ID NO: 3296342 - protein, 30 aa, Plasmodium falciparum
SSVPTYLDYVPQFLRWFDEWSEEFCRKRNI

SEQ ID NO: 3296343 - protein, 28 aa, Plasmodium falciparum
SSVSTFTMCTMLARSFADIGDIVRGRDL

SEQ ID NO: 3296344 - protein, 19 aa, Plasmodium falciparum
SSWVKRWDQIYKRYSKYIE

SEQ ID NO: 3296345 - protein, 21 aa, Plasmodium falciparum
SSYFYQIIYNHNIPNLNHISC

SEQ ID NO: 3296346 - protein, 69 aa, Plasmodium falciparum
SSYKKHINYFKRFFFYFIKLDKKLFFPLKSVLKILALRKLSFHFLSWINYFFHEIQKYFSCFNFLGIFE

SEQ ID NO: 3296347 - protein, 26 aa, Plasmodium falciparum
SSYLGNNDISLFSSAKLKKMFNLSHT

SEQ ID NO: 3296348 - protein, 19 aa, Plasmodium falciparum
SSYNFPYHVTFGKVLAVVV

SEQ ID NO: 3296349 - protein, 19 aa, Plasmodium falciparum
SSYSYFFLYYFRLKDEINI

SEQ ID NO: 3296350 - protein, 41 aa, Plasmodium falciparum
SSYYKIMIIIIYNTFMKFFYLYFFQLLRKYVKRYQAVIDEY

SEQ ID NO: 3296351 - protein, 25 aa, Plasmodium falciparum
STAFKKIKRKWLFKKQRTNIYFNEN

SEQ ID NO: 3296352 - protein, 22 aa, Plasmodium falciparum
STCLHILLNISQKKLRYIFDNI

SEQ ID NO: 3296353 - protein, 24 aa, Plasmodium falciparum
STCQKCIMIYYFLQKKLVEKISSN

SEQ ID NO: 3296354 - protein, 22 aa, Plasmodium falciparum
STDKHFTVFFPLIIQKTNENFN

SEQ ID NO: 3296355 - protein, 31 aa, Plasmodium falciparum
STDPPTYFDYVPQYLRWFEEWTEEFCRKKKK

SEQ ID NO: 3296356 - protein, 24 aa, Plasmodium falciparum
STDVYLLKKFLKVIIRILRLDIQK

SEQ ID NO: 3296357 - protein, 20 aa, Plasmodium falciparum
STEILDMLNILLSRKKGILQ

SEQ ID NO: 3296358 - protein, 23 aa, Plasmodium falciparum
STEKLMCKILFDDLLYKDVDEIR

SEQ ID NO: 3296359 - protein, 23 aa, Plasmodium falciparum
STFFIFTYPLFKRLTYYAQVYLS

SEQ ID NO: 3296360 - protein, 24 aa, Plasmodium falciparum
STFFPYGMAIVVLIALTIIVIILY

SEQ ID NO: 3296361 - protein, 20 aa, Plasmodium falciparum
STFNFICAMLIFFSVSHKNA

SEQ ID NO: 3296362 - protein, 24 aa, Plasmodium falciparum
STFVRYQFLTIYKYILYLKNNISL

SEQ ID NO: 3296363 - protein, 21 aa, Plasmodium falciparum
STHFFFKQIYYDTYIKIKNER

SEQ ID NO: 3296364 - protein, 20 aa, Plasmodium falciparum
STHNHLLLTCIIFLLILLIL

SEQ ID NO: 3296365 - protein, 25 aa, Plasmodium falciparum
STHNLPIVHLLLRIMETLLDFTPNF

SEQ ID NO: 3296366 - protein, 25 aa, Plasmodium falciparum
STIFIYFIYHIFVILFNEVNIMIIN

SEQ ID NO: 3296367 - protein, 22 aa, Plasmodium falciparum
STIPYMCFQSIKKKFTNIINGF

SEQ ID NO: 3296368 - protein, 24 aa, Plasmodium falciparum
STISNSIIIILIRAICRNTNLLYL

SEQ ID NO: 3296369 - protein, 24 aa, Plasmodium falciparum
STISSFLLFSFTSLKIHIFKNGNI

SEQ ID NO: 3296370 - protein, 24 aa, Plasmodium falciparum
STIYTIIKIIYKNFFNKIIRDINI

SEQ ID NO: 3296371 - protein, 25 aa, Plasmodium falciparum
STKEYVYFIYLQDIYYNINIFKNKG

SEQ ID NO: 3296372 - protein, 28 aa, Plasmodium falciparum
STKKSMFFLLFVFFLKRKYDRKEKKLYH

SEQ ID NO: 3296373 - protein, 28 aa, Plasmodium falciparum
STKSMQWPVILDLLVPSFSRGSYNECNR

SEQ ID NO: 3296374 - protein, 27 aa, Plasmodium falciparum
STKTFLYKPVIPFYNLHNEMLKKKKDI

SEQ ID NO: 3296375 - protein, 18 aa, Plasmodium falciparum
STKYKAFCNCFNISSLYG

SEQ ID NO: 3296376 - protein, 32 aa, Plasmodium falciparum
STLAWSVGIGFAAFTYFYLKKKTKASVGNLFQ

SEQ ID NO: 3296377 - protein, 20 aa, Plasmodium falciparum
STLHLYPKPSPYIVSYKNEN

SEQ ID NO: 3296378 - protein, 35 aa, Plasmodium falciparum
STLIPMSTFILYFVIHLFYSFFDKNLLTLYDNKEY

SEQ ID NO: 3296379 - protein, 25 aa, Plasmodium falciparum
STLKKNIKLCIYLKNLYLKHDMFNS

SEQ ID NO: 3296380 - protein, 34 aa, Plasmodium falciparum
STLMIISSLIINILYKLVLYKNENFPYSDILYVG

SEQ ID NO: 3296381 - protein, 25 aa, Plasmodium falciparum
STLVRDIPFSAIYWSLNEYFVSYIK

SEQ ID NO: 3296382 - protein, 47 aa, Plasmodium falciparum
STMLEFPLIDSHHIIQKCLLTMKKLEKAIFYIKNNLLFHSFTSNDNP

SEQ ID NO: 3296383 - protein, 40 aa, Plasmodium falciparum
STMQFGERFWQGFFFGVIIFFVLSKYIRSYKKRKGMRILK

SEQ ID NO: 3296384 - protein, 29 aa, Plasmodium falciparum
STNFRSHYDPSCRNVFDYSMSIKEDFRVN

SEQ ID NO: 3296385 - protein, 27 aa, Plasmodium falciparum
STNLDMIKIWFRNLVRQIKNSHINDLI

SEQ ID NO: 3296386 - protein, 30 aa, Plasmodium falciparum
STNSDFVLLFHPVLYYFMLFNEQSTNSNTN

SEQ ID NO: 3296387 - protein, 23 aa, Plasmodium falciparum
STNTSPTWYAAHPFRRICHNGEI

SEQ ID NO: 3296388 - protein, 17 aa, Plasmodium falciparum
STPLNLYNIWSPALGIA

SEQ ID NO: 3296389 - protein, 23 aa, Plasmodium falciparum
STQVFLNKLKNNLILVCKNKAHT

SEQ ID NO: 3296390 - protein, 17 aa, Plasmodium falciparum
STRLLCECELYTSIFDN

SEQ ID NO: 3296391 - protein, 18 aa, Plasmodium falciparum
STRYLFLYINKYKEMYIK

SEQ ID NO: 3296392 - protein, 23 aa, Plasmodium falciparum
STSMLIPHKLRKLVVSMKKGLLK

SEQ ID NO: 3296393 - protein, 40 aa, Plasmodium falciparum
STSPQVALLRDAFIQSAAIETFFLWHKYKMEKKKEKEETQ

SEQ ID NO: 3296394 - protein, 23 aa, Plasmodium falciparum
STTIIKSIIWIKKKKKEKGKHFN

SEQ ID NO: 3296395 - protein, 24 aa, Plasmodium falciparum
STTLIIFEYFFFDDVFMILRSNNG

SEQ ID NO: 3296396 - protein, 34 aa, Plasmodium falciparum
STVCYFLGKKNIYFWLVQICFYASILCSNIISIV

SEQ ID NO: 3296397 - protein, 21 aa, Plasmodium falciparum
STYSNFLSWCHNIYLFTMDGM

SEQ ID NO: 3296398 - protein, 25 aa, Plasmodium falciparum
STYVHLVHFFLLKVAETFSFYEGDM

SEQ ID NO: 3296399 - protein, 32 aa, Plasmodium falciparum
STYYEHPFLITYFYNLLFLLKNIKSYIDTSLS

SEQ ID NO: 3296400 - protein, 24 aa, Plasmodium falciparum
SVANLFQILQIPKGDYDIPTLKSS

SEQ ID NO: 3296401 - protein, 23 aa, Plasmodium falciparum
SVCFSLVIYFPNMDIQKKIIYLL

SEQ ID NO: 3296402 - protein, 22 aa, Plasmodium falciparum
SVCIPPRRRKLYVGELTKWAES

SEQ ID NO: 3296403 - protein, 25 aa, Plasmodium falciparum
SVCVPPRRRKLYVGGLTKWAEIQLK

SEQ ID NO: 3296404 - protein, 29 aa, Plasmodium falciparum
SVDKYMLGIVFIWIWNYNFLWKRSDPSYD

SEQ ID NO: 3296405 - protein, 46 aa, Plasmodium falciparum
SVDVLKLFMNFFLNQYLYTPSLIKHFISISLIIISFQIMNEIFIKE

SEQ ID NO: 3296406 - protein, 19 aa, Plasmodium falciparum
SVERKLFFLNKKKIKKNKD

SEQ ID NO: 3296407 - protein, 24 aa, Plasmodium falciparum
SVESIFLFTPLPVVIYRYVYGSIV

SEQ ID NO: 3296408 - protein, 19 aa, Plasmodium falciparum
SVFYFTIYVNKNTPLLLCL

SEQ ID NO: 3296409 - protein, 25 aa, Plasmodium falciparum
SVGNLFQILQIPKGDYDIPTLKSTN

SEQ ID NO: 3296410 - protein, 24 aa, Plasmodium falciparum
SVGNLFQILQIPKSDFDIPTKLSP

SEQ ID NO: 3296411 - protein, 25 aa, Plasmodium falciparum
SVGNLFQILQIPKSDYDIPTLKSKN

SEQ ID NO: 3296412 - protein, 25 aa, Plasmodium falciparum
SVGNLFQILQIPKSDYDIPTLKSSN

SEQ ID NO: 3296413 - protein, 24 aa, Plasmodium falciparum
SVGNLFQILQIPKSDYDIPTPKSS

SEQ ID NO: 3296414 - protein, 24 aa, Plasmodium falciparum
SVGNLFQILQIPKSNYDIPTKRSP

SEQ ID NO: 3296415 - protein, 24 aa, Plasmodium falciparum
SVGSLFLTLIGLAAAKKAALAYFS

SEQ ID NO: 3296416 - protein, 33 aa, Plasmodium falciparum
SVHHDISLFFFIFFYIILFFSNDYNYLYSFMKY

SEQ ID NO: 3296417 - protein, 18 aa, Plasmodium falciparum
SVHIYFLYSIKLPKKTFK

SEQ ID NO: 3296418 - protein, 25 aa, Plasmodium falciparum
SVIKSRILIILFYLCNRDYSREKLL

SEQ ID NO: 3296419 - protein, 23 aa, Plasmodium falciparum
SVILIIIFPFFLFHIYLTSKNYT

SEQ ID NO: 3296420 - protein, 24 aa, Plasmodium falciparum
SVKKILDPLIYRMDLKNGKRKFDE

SEQ ID NO: 3296421 - protein, 34 aa, Plasmodium falciparum
SVKKSIRHLLPFYAIFRFMSDVKIFIIFHINIIK

SEQ ID NO: 3296422 - protein, 30 aa, Plasmodium falciparum
SVMSIYIRLMWLSIYMFLRYYVSEDCVLDG

SEQ ID NO: 3296423 - protein, 21 aa, Plasmodium falciparum
SVMVRYLNLLLKYMNCERYQI

SEQ ID NO: 3296424 - protein, 29 aa, Plasmodium falciparum
SVNEELILFIIYQIIVSVLQLHFLDVLHG

SEQ ID NO: 3296425 - protein, 25 aa, Plasmodium falciparum
SVNGELYIFSFFYKFFNFKKNKCCY

SEQ ID NO: 3296426 - protein, 62 aa, Plasmodium falciparum
SVNKIFYIMQCLLYLKLDYHMFYKSVLNMFMNYLPFSNNLIMLFFLLAKNKLFPSKTIHIFD

SEQ ID NO: 3296427 - protein, 27 aa, Plasmodium falciparum
SVNLFFISLFIYLYYFVHMCIIIKLSS

SEQ ID NO: 3296428 - protein, 20 aa, Plasmodium falciparum
SVNNIYYFDNFYRDNRFNYV

SEQ ID NO: 3296429 - protein, 34 aa, Plasmodium falciparum
SVNPSKKFYSILYITLICLSVIGVLIFILDRKEK

SEQ ID NO: 3296430 - protein, 24 aa, Plasmodium falciparum
SVQDFFDLLILFDEEYKNLEMLNS

SEQ ID NO: 3296431 - protein, 31 aa, Plasmodium falciparum
SVRIISVKILKYIIYFNIYIKRYNGSIYKKN

SEQ ID NO: 3296432 - protein, 54 aa, Plasmodium falciparum
SVRNKQLPFFIYKRKDFVKYVKYILNAFIQFLPKCYHYLRKLNFDLAAWTARCI

SEQ ID NO: 3296433 - protein, 25 aa, Plasmodium falciparum
SVRQIFLNLLSIVGIVLVVILNSIS

SEQ ID NO: 3296434 - protein, 24 aa, Plasmodium falciparum
SVRQLLDPLIYRMDLANGKGKINE

SEQ ID NO: 3296435 - protein, 28 aa, Plasmodium falciparum
SVSSFLFVEALFQEYQCYGSSSNTRVLN

SEQ ID NO: 3296436 - protein, 25 aa, Plasmodium falciparum
SVSSNVSLFFYKVDKYKPHILSILN

SEQ ID NO: 3296437 - protein, 33 aa, Plasmodium falciparum
SVTAILIIVLIMLIIYLILRYRRKKKMNKKLQY

SEQ ID NO: 3296438 - protein, 34 aa, Plasmodium falciparum
SVTAILVIVLVMVIIYLILRYRRKKKMKKKLQYI

SEQ ID NO: 3296439 - protein, 20 aa, Plasmodium falciparum
SVTFFLRSPQIYRKRFKRSR

SEQ ID NO: 3296440 - protein, 33 aa, Plasmodium falciparum
SVVAIIIIALVMIIIYLVLRYRRKKKMKKKAEY

SEQ ID NO: 3296441 - protein, 34 aa, Plasmodium falciparum
SVVAIIIIALVMIIIYLVLRYRRKKKMKKKAEYT

SEQ ID NO: 3296442 - protein, 33 aa, Plasmodium falciparum
SVVAIIIIALVMIIIYLVLRYRRKKKMKKKLQY

SEQ ID NO: 3296443 - protein, 33 aa, Plasmodium falciparum
SVVAIIIIALVMIIIYLVLRYRRKKKMNKKAQY

SEQ ID NO: 3296444 - protein, 33 aa, Plasmodium falciparum
SVVAIIIIALVMIIIYLVLRYRRKKKMNKKLQY

SEQ ID NO: 3296445 - protein, 33 aa, Plasmodium falciparum
SVVAILIIVLIMLIIYLILRYRRKKKMKKKLQY

SEQ ID NO: 3296446 - protein, 33 aa, Plasmodium falciparum
SVVAILIIVLIMVIIYLILRYRRKKKMKKKAQY

SEQ ID NO: 3296447 - protein, 34 aa, Plasmodium falciparum
SVVAILIIVLVMIIIYLILRYRRKKKMKKKAQYT

SEQ ID NO: 3296448 - protein, 31 aa, Plasmodium falciparum
SVVAILIIVLVMIIIYLVLCYRRKKKINKKD

SEQ ID NO: 3296449 - protein, 33 aa, Plasmodium falciparum
SVVAILIIVLVMIIIYLVLRYRRKKKMNKKAQY

SEQ ID NO: 3296450 - protein, 33 aa, Plasmodium falciparum
SVVAILIIVLVMIIIYLVLRYRRKKKMNKKLQY

SEQ ID NO: 3296451 - protein, 33 aa, Plasmodium falciparum
SVVAILVIVLVMIIIYLVLRYRRKKKMKKKAQY

SEQ ID NO: 3296452 - protein, 33 aa, Plasmodium falciparum
SVVALLIIVLVMIIIYLVLRYRRKKKMNKKQQY

SEQ ID NO: 3296453 - protein, 18 aa, Plasmodium falciparum
SVVIKSFFMNFDINVLIY

SEQ ID NO: 3296454 - protein, 19 aa, Plasmodium falciparum
SVVLFIDILNDTYLEQVHL

SEQ ID NO: 3296455 - protein, 18 aa, Plasmodium falciparum
SVVYLKYVIRFVSIIFCN

SEQ ID NO: 3296456 - protein, 18 aa, Plasmodium falciparum
SVWCTLLYGRNNILIVLI

SEQ ID NO: 3296457 - protein, 32 aa, Plasmodium falciparum
SVYIKTLYSCFILRFLELWKRWYKIKYNEEVI

SEQ ID NO: 3296458 - protein, 19 aa, Plasmodium falciparum
SVYIQYLHFLKYKNTHKNN

SEQ ID NO: 3296459 - protein, 17 aa, Plasmodium falciparum
SVYKYMIPYDHLELIKI

SEQ ID NO: 3296460 - protein, 26 aa, Plasmodium falciparum
SVYLFNVLCFYPSLLYMIIKFCKMNI

SEQ ID NO: 3296461 - protein, 44 aa, Plasmodium falciparum
SVYTKLIMICIQFPKLKILWSPFSLFTVKLFWSLKVNASQPDIF

SEQ ID NO: 3296462 - protein, 25 aa, Plasmodium falciparum
SVYVYFFILTLFEYYLKIFFFVFLN

SEQ ID NO: 3296463 - protein, 25 aa, Plasmodium falciparum
SWEHHKIYRIYLDTLLNFACMNILL

SEQ ID NO: 3296464 - protein, 26 aa, Plasmodium falciparum
SWILSLLYICWIFFLIISILTIFFNP

SEQ ID NO: 3296465 - protein, 21 aa, Plasmodium falciparum
SWLCEHFINNSQYKYYYPHFY

SEQ ID NO: 3296466 - protein, 35 aa, Plasmodium falciparum
SWNFVNSLLSRNLILFTLTFLFLNILNCVNYNQYD

SEQ ID NO: 3296467 - protein, 26 aa, Plasmodium falciparum
SWNNIFSFFDIFNYLMTYTSPTKGNN

SEQ ID NO: 3296468 - protein, 21 aa, Plasmodium falciparum
SWTYTHLFNNSSCTPLGIVYI

SEQ ID NO: 3296469 - protein, 24 aa, Plasmodium falciparum
SYAIHGFIAFIISNNIYAHILREK

SEQ ID NO: 3296470 - protein, 21 aa, Plasmodium falciparum
SYDIIPFTWWIFLSSSNYQGS

SEQ ID NO: 3296471 - protein, 36 aa, Plasmodium falciparum
SYDINNLFPMYMLSCSLFLFSSFFLKRRIHAVKKKI

SEQ ID NO: 3296472 - protein, 22 aa, Plasmodium falciparum
SYDMKYYNLLFLIKKCYSTENI

SEQ ID NO: 3296473 - protein, 22 aa, Plasmodium falciparum
SYDRFHIFLFEKYVKNSIPGGE

SEQ ID NO: 3296474 - protein, 24 aa, Plasmodium falciparum
SYDSIFPAKPFIFNCTVNFKEEEN

SEQ ID NO: 3296475 - protein, 27 aa, Plasmodium falciparum
SYEFIELFLTFLLKNYSLLYNKYYNKV

SEQ ID NO: 3296476 - protein, 20 aa, Plasmodium falciparum
SYEFINFVFTSFHVITNFLV

SEQ ID NO: 3296477 - protein, 19 aa, Plasmodium falciparum
SYEFVFYCNCYMDDKVHAY

SEQ ID NO: 3296478 - protein, 21 aa, Plasmodium falciparum
SYEHILRLLHQAKVYLEFVRC

SEQ ID NO: 3296479 - protein, 27 aa, Plasmodium falciparum
SYENITKFLLYDDKLYMSIYNTNVLLY

SEQ ID NO: 3296480 - protein, 18 aa, Plasmodium falciparum
SYEYRKIIKLKIKKILNL

SEQ ID NO: 3296481 - protein, 30 aa, Plasmodium falciparum
SYEYRNVLIPHFYPLFKLIALNVNNVKYKD

SEQ ID NO: 3296482 - protein, 26 aa, Plasmodium falciparum
SYFFDIHLILLFFPLGLYECFKKNGS

SEQ ID NO: 3296483 - protein, 20 aa, Plasmodium falciparum
SYFKVPYYNMKYYLYNQKSY

SEQ ID NO: 3296484 - protein, 17 aa, Plasmodium falciparum
SYFLFVDNPFEVGKNVA

SEQ ID NO: 3296485 - protein, 19 aa, Plasmodium falciparum
SYFMEFMLRLSIIDNEMLY

SEQ ID NO: 3296486 - protein, 30 aa, Plasmodium falciparum
SYFNFKIYKKILYFLQKYISILTCHDISNI

SEQ ID NO: 3296487 - protein, 21 aa, Plasmodium falciparum
SYFNISLYYYKYLLNIIQTND

SEQ ID NO: 3296488 - protein, 29 aa, Plasmodium falciparum
SYFPSISLYMYKLKILIEYLKIYQTYMKL

SEQ ID NO: 3296489 - protein, 26 aa, Plasmodium falciparum
SYFSPEWGYYIYTTSNFNIFSSTVKF

SEQ ID NO: 3296490 - protein, 35 aa, Plasmodium falciparum
SYGISAVFLILISVIFVLLYIWMRKRRKRSWKHEY

SEQ ID NO: 3296491 - protein, 21 aa, Plasmodium falciparum
SYHMKIFAYYLRVQCLLNSLN

SEQ ID NO: 3296492 - protein, 23 aa, Plasmodium falciparum
SYHNQYMYIYPNISYDIILYFND

SEQ ID NO: 3296493 - protein, 22 aa, Plasmodium falciparum
SYHNYFLYINYLKDVKIELIIS

SEQ ID NO: 3296494 - protein, 25 aa, Plasmodium falciparum
SYIELTDIYNLPGSFFLIGNSELYS

SEQ ID NO: 3296495 - protein, 24 aa, Plasmodium falciparum
SYIFTKLLNLLKKNNIYYTSHQFD

SEQ ID NO: 3296496 - protein, 20 aa, Plasmodium falciparum
SYIIDFFKCKKYLPCLLLSC

SEQ ID NO: 3296497 - protein, 24 aa, Plasmodium falciparum
SYIIFICISILMYLKKYLINITTN

SEQ ID NO: 3296498 - protein, 18 aa, Plasmodium falciparum
SYIINTYIILPNNKTIKK

SEQ ID NO: 3296499 - protein, 18 aa, Plasmodium falciparum
SYIITLFNKYSLLHNQHD

SEQ ID NO: 3296500 - protein, 34 aa, Plasmodium falciparum
SYIKRNINFYNIFFKVIIPLLNRITNIFENLETL

SEQ ID NO: 3296501 - protein, 20 aa, Plasmodium falciparum
SYINIHSFSFFTSINETIFL

SEQ ID NO: 3296502 - protein, 20 aa, Plasmodium falciparum
SYINKIIFYMAKNSYNFFKH

SEQ ID NO: 3296503 - protein, 18 aa, Plasmodium falciparum
SYINKYVIFFLTNILSKV

SEQ ID NO: 3296504 - protein, 26 aa, Plasmodium falciparum
SYINPDHLHFFKFVGKFIAKAIYDGQ

SEQ ID NO: 3296505 - protein, 19 aa, Plasmodium falciparum
SYIYISQYFLVISKEDLQN

SEQ ID NO: 3296506 - protein, 23 aa, Plasmodium falciparum
SYIYLKICDCFIKQTNKNFMTKS

SEQ ID NO: 3296507 - protein, 29 aa, Plasmodium falciparum
SYKCLEVCIYIIILLKHFKNFFQLNDIII

SEQ ID NO: 3296508 - protein, 19 aa, Plasmodium falciparum
SYKDFLKSKLFYKSINYTN

SEQ ID NO: 3296509 - protein, 31 aa, Plasmodium falciparum
SYKENCYIYIYMLSLLNFFFNKEMNIFEENC

SEQ ID NO: 3296510 - protein, 24 aa, Plasmodium falciparum
SYKKENIFFIISKKEKIINKLKIQ

SEQ ID NO: 3296511 - protein, 33 aa, Plasmodium falciparum
SYKRGCFFNPLFLSFLFFFSSSFFPNVCRELFF

SEQ ID NO: 3296512 - protein, 26 aa, Plasmodium falciparum
SYKSRKKIFIIFKPLERHINYQNYYF

SEQ ID NO: 3296513 - protein, 25 aa, Plasmodium falciparum
SYKVLVLIVLLPTFNIVYGLLFSIY

SEQ ID NO: 3296514 - protein, 26 aa, Plasmodium falciparum
SYLGLYFSLLFLEECFFLISIMNLYE

SEQ ID NO: 3296515 - protein, 18 aa, Plasmodium falciparum
SYLKRLCIIKWRNITREF

SEQ ID NO: 3296516 - protein, 30 aa, Plasmodium falciparum
SYMEKSSDWLYLFLSLSLNIEKYSNHLFAT

SEQ ID NO: 3296517 - protein, 19 aa, Plasmodium falciparum
SYMINYVFHKDIGLLFFNE

SEQ ID NO: 3296518 - protein, 26 aa, Plasmodium falciparum
SYMLSFDILKILYFLYEHTNIKLLMF

SEQ ID NO: 3296519 - protein, 19 aa, Plasmodium falciparum
SYMNYHLNLYNIFCKQLYN

SEQ ID NO: 3296520 - protein, 19 aa, Plasmodium falciparum
SYNALAYVTIYLTLCILYT

SEQ ID NO: 3296521 - protein, 24 aa, Plasmodium falciparum
SYNNELIYFFFNFVFDINNEQTKL

SEQ ID NO: 3296522 - protein, 23 aa, Plasmodium falciparum
SYPDDILLYCLLPHKNYKNMILF

SEQ ID NO: 3296523 - protein, 22 aa, Plasmodium falciparum
SYPFNKSKIFYLKSSSLLNNIK

SEQ ID NO: 3296524 - protein, 23 aa, Plasmodium falciparum
SYPVLLKELLQKLLINIIGKHSC

SEQ ID NO: 3296525 - protein, 27 aa, Plasmodium falciparum
SYPYYTTFITILLLKKCVLTLKSFSSE

SEQ ID NO: 3296526 - protein, 18 aa, Plasmodium falciparum
SYRNIFSYIFQKIKRKRK

SEQ ID NO: 3296527 - protein, 39 aa, Plasmodium falciparum
SYSFCIFVFFSFFFVKMRKVIYFFLIICLHSNVGWHPFF

SEQ ID NO: 3296528 - protein, 24 aa, Plasmodium falciparum
SYSHNFLFLYKKFVNNFNTLYFEK

SEQ ID NO: 3296529 - protein, 24 aa, Plasmodium falciparum
SYSKTIFHYIPPEIKNKLKIVDCE

SEQ ID NO: 3296530 - protein, 36 aa, Plasmodium falciparum
SYSLILCNMVHINPYFFSFIWRKIGKTTYWEKRKSQ

SEQ ID NO: 3296531 - protein, 20 aa, Plasmodium falciparum
SYSVKFFGKILFPEKQVNKE

SEQ ID NO: 3296532 - protein, 23 aa, Plasmodium falciparum
SYSVYFIPLFFYSLIWLRYMKNL

SEQ ID NO: 3296533 - protein, 30 aa, Plasmodium falciparum
SYTKPLFYEILPIIMKSLFFINKKVTSKLK

SEQ ID NO: 3296534 - protein, 22 aa, Plasmodium falciparum
SYVDYIMFIAIFIYNNKYNDDK

SEQ ID NO: 3296535 - protein, 36 aa, Plasmodium falciparum
SYVFHYVHLLFVVIFLVLVYICVNYYFVPMFYKNKI

SEQ ID NO: 3296536 - protein, 21 aa, Plasmodium falciparum
SYVKFTYLESAPLITKLVCLI

SEQ ID NO: 3296537 - protein, 26 aa, Plasmodium falciparum
SYVRIPYKYLLLNENKPKWFSMKNIE

SEQ ID NO: 3296538 - protein, 28 aa, Plasmodium falciparum
SYYCSSFFIALIFFYKNPYENTFNLSYA

SEQ ID NO: 3296539 - protein, 20 aa, Plasmodium falciparum
SYYIFVKSVVILEKMLIMFQ

SEQ ID NO: 3296540 - protein, 32 aa, Plasmodium falciparum
SYYIQSLLYEKNFFQVLFLLSNIYYSDVANKK

SEQ ID NO: 3296541 - protein, 52 aa, Plasmodium falciparum
SYYTKLIKDYLGRFVTIAILIFLAPSLIPLLPFIIKFFISCASLPMKLFSNF

SEQ ID NO: 3296542 - protein, 30 aa, Plasmodium falciparum
TIGMFLKILIVLLILWEIQNMFEIIYIPEL

SEQ ID NO: 3296543 - protein, 24 aa, Plasmodium falciparum
TAAPGFFNFFSFDNNIYADGAICF

SEQ ID NO: 3296544 - protein, 26 aa, Plasmodium falciparum
TAEKYMEMLLLLLYNNMRLYDKDKIN

SEQ ID NO: 3296545 - protein, 30 aa, Plasmodium falciparum
TAFIQSAAIETFFLWHKYKAENTKTQSVGS

SEQ ID NO: 3296546 - protein, 26 aa, Plasmodium falciparum
TAFLIQPIVLLMKLHPELLVHIPINI

SEQ ID NO: 3296547 - protein, 19 aa, Plasmodium falciparum
TAFLPYGIAALVLIILVVA

SEQ ID NO: 3296548 - protein, 24 aa, Plasmodium falciparum
TAHSNNIIKLWNLKKSEMNKVMNE

SEQ ID NO: 3296549 - protein, 34 aa, Plasmodium falciparum
TAIEQNLFFPEPWILFVTQFLWQFPHFYSLAYLY

SEQ ID NO: 3296550 - protein, 23 aa, Plasmodium falciparum
TAKLYALLYEPYRKYIQEDSPPK

SEQ ID NO: 3296551 - protein, 34 aa, Plasmodium falciparum
TAKYKLYSFLPLIVFFQFLRLGNLYFLSISMLQL

SEQ ID NO: 3296552 - protein, 27 aa, Plasmodium falciparum
TALSKYIIKYIFTFNKKFIQNYEKKIN

SEQ ID NO: 3296553 - protein, 28 aa, Plasmodium falciparum
TANYYKLREAWWALNRQDVWKALTCDAH

SEQ ID NO: 3296554 - protein, 18 aa, Plasmodium falciparum
TCDISFWERSYDSHTFIE

SEQ ID NO: 3296555 - protein, 17 aa, Plasmodium falciparum
TCESIFYSFLNIGTNVV

SEQ ID NO: 3296556 - protein, 40 aa, Plasmodium falciparum
TCFRKEAFSSMPYYAGAGVLFIILVILGASQAKYQSSEGV

SEQ ID NO: 3296557 - protein, 18 aa, Plasmodium falciparum
TCGARSNDLLIKRGWRTS

SEQ ID NO: 3296558 - protein, 26 aa, Plasmodium falciparum
TCGLSIYFYPMIVRTLRCIIFLCGFN

SEQ ID NO: 3296559 - protein, 18 aa, Plasmodium falciparum
TCIPTYIPLNISSYLYIG

SEQ ID NO: 3296560 - protein, 19 aa, Plasmodium falciparum
TCLFILINIVLTTYSKVIK

SEQ ID NO: 3296561 - protein, 18 aa, Plasmodium falciparum
TCLIRDMFVRKSEIYYFN

SEQ ID NO: 3296562 - protein, 26 aa, Plasmodium falciparum
TCLLFFYIQIWINCLFCFGYNINKNL

SEQ ID NO: 3296563 - protein, 17 aa, Plasmodium falciparum
TCNDILKNLLFIDISFN

SEQ ID NO: 3296564 - protein, 32 aa, Plasmodium falciparum
TCNLSIHIIIQLIIDLPIYKAIQILKTISLEK

SEQ ID NO: 3296565 - protein, 17 aa, Plasmodium falciparum
TCTFFLLIFYKSLKALR

SEQ ID NO: 3296566 - protein, 17 aa, Plasmodium falciparum
TCYERVEFLNCLKYIFS

SEQ ID NO: 3296567 - protein, 19 aa, Plasmodium falciparum
TDCLYACYPYVHWIDKKKE

SEQ ID NO: 3296568 - protein, 35 aa, Plasmodium falciparum
TDEDFYYKVKMNPSYFFLLYAIKKDYDKRNKNKLI

SEQ ID NO: 3296569 - protein, 23 aa, Plasmodium falciparum
TDEEYYMKFLKKKKFRNYIMNTS

SEQ ID NO: 3296570 - protein, 34 aa, Plasmodium falciparum
TDEIINSLFYFFNNPYLIFTFHKNVLYYIEKKSR

SEQ ID NO: 3296571 - protein, 30 aa, Plasmodium falciparum
TDEKIILARKYIFGPTIYNLECKFLEKLKK

SEQ ID NO: 3296572 - protein, 31 aa, Plasmodium falciparum
TDEVLLNRFNFWIKLYIYQERMKIIKMIIKA

SEQ ID NO: 3296573 - protein, 19 aa, Plasmodium falciparum
TDIFLFQNSLALLLTGFSF

SEQ ID NO: 3296574 - protein, 19 aa, Plasmodium falciparum
TDILYYDYLYLFNKNKITY

SEQ ID NO: 3296575 - protein, 23 aa, Plasmodium falciparum
TDISSILILFDFLSSYQIDEIMI

SEQ ID NO: 3296576 - protein, 26 aa, Plasmodium falciparum
TDITKSICIWYLRYNRKLIMNSSSFS

SEQ ID NO: 3296577 - protein, 24 aa, Plasmodium falciparum
TDKSYYVVVFLLPECYDYPYYMNK

SEQ ID NO: 3296578 - protein, 35 aa, Plasmodium falciparum
TDKVVLFTLYLSLINYLIFIIYINNYKNDNFIEGV

SEQ ID NO: 3296579 - protein, 25 aa, Plasmodium falciparum
TDLFNYPIQMIYINSIILNTVTYIF

SEQ ID NO: 3296580 - protein, 24 aa, Plasmodium falciparum
TDLLSFLLCLYKYFHNLQKQNKQH

SEQ ID NO: 3296581 - protein, 20 aa, Plasmodium falciparum
TDLYIFISILIKNVTLSYHK

SEQ ID NO: 3296582 - protein, 30 aa, Plasmodium falciparum
TDMKFTNFLFLRNLYYFVKFYAVTGDLTYS

SEQ ID NO: 3296583 - protein, 23 aa, Plasmodium falciparum
TDNVMAFYKLLFKPNNKNNYIIN

SEQ ID NO: 3296584 - protein, 31 aa, Plasmodium falciparum
TDPPTYFDYVPQYLRWFEEWAEDFCRKKKIY

SEQ ID NO: 3296585 - protein, 30 aa, Plasmodium falciparum
TDPPTYFDYVPQYLRWFEEWAEDFCRKKKK

SEQ ID NO: 3296586 - protein, 30 aa, Plasmodium falciparum
TDPPTYFDYVPQYLRWFEEWAEDFCRKKNK

SEQ ID NO: 3296587 - protein, 32 aa, Plasmodium falciparum
TDPPTYFDYVPQYLRWFEEWAEEFCRIKELKL

SEQ ID NO: 3296588 - protein, 32 aa, Plasmodium falciparum
TDQVPTYFDYVPQFLRWFEEWAEDFCRKKKHK

SEQ ID NO: 3296589 - protein, 33 aa, Plasmodium falciparum
TDQVPTYFDYVPQYLRWFEEWAEDFCRKKKIYV

SEQ ID NO: 3296590 - protein, 32 aa, Plasmodium falciparum
TDQVPTYFDYVPQYLRWFEEWAEDFCRKKKKY

SEQ ID NO: 3296591 - protein, 19 aa, Plasmodium falciparum
TDRTINIISKFFGGVNKSN

SEQ ID NO: 3296592 - protein, 19 aa, Plasmodium falciparum
TDTFSSVLFYFILNADMDK

SEQ ID NO: 3296593 - protein, 25 aa, Plasmodium falciparum
TDTYKKFLYLSSFAWYIISLLEKKL

SEQ ID NO: 3296594 - protein, 26 aa, Plasmodium falciparum
TDYEERIIKLWAGTWNLCGGDLEELH

SEQ ID NO: 3296595 - protein, 21 aa, Plasmodium falciparum
TDYFQLREDWWTANRHTVWKA

SEQ ID NO: 3296596 - protein, 18 aa, Plasmodium falciparum
TDYLFLRKYFIHDEKRII

SEQ ID NO: 3296597 - protein, 25 aa, Plasmodium falciparum
TEAQKYVHYIFQKNLDIYSGDNYMP

SEQ ID NO: 3296598 - protein, 27 aa, Plasmodium falciparum
TEDEIPQFHRWLIEWAKQACKEYRIRK

SEQ ID NO: 3296599 - protein, 25 aa, Plasmodium falciparum
TEDILVEESVTGDILVEGSVTEEVV

SEQ ID NO: 3296600 - protein, 30 aa, Plasmodium falciparum
TEEEYTFYIFSLFNDIYMLTNGKYKKMSSI

SEQ ID NO: 3296601 - protein, 28 aa, Plasmodium falciparum
TEENRPIIKGFLWPNPKCRLAFIDVSIG

SEQ ID NO: 3296602 - protein, 24 aa, Plasmodium falciparum
TEETYYFDLLIPRIYINMSNEHFF

SEQ ID NO: 3296603 - protein, 18 aa, Plasmodium falciparum
TEFLINENVLFDIYQYNE

SEQ ID NO: 3296604 - protein, 20 aa, Plasmodium falciparum
TEFLLLYINMYNILYEIIYN

SEQ ID NO: 3296605 - protein, 24 aa, Plasmodium falciparum
TEIKYYLFFLKANRNIIFSLCILG

SEQ ID NO: 3296606 - protein, 57 aa, Plasmodium falciparum
TEKGKYKIFFLSLIVLSYGIFSGLSSFFFGFFNSVFSFFTFLFIGTLNQIQTLTMKS

SEQ ID NO: 3296607 - protein, 31 aa, Plasmodium falciparum
TEKLDIYPCIYYIFNEKIYFLKFSKELYEHL

SEQ ID NO: 3296608 - protein, 24 aa, Plasmodium falciparum
TEPRRIACIALSKILSELTNEKLG

SEQ ID NO: 3296609 - protein, 26 aa, Plasmodium falciparum
TERKVYYYNIYPYYEKKNVKPKQHRT

SEQ ID NO: 3296610 - protein, 36 aa, Plasmodium falciparum
TESLRKWFIETAAIETFFLWHRYKKEWEAQKKAELQ

SEQ ID NO: 3296611 - protein, 84 aa, Plasmodium falciparum
TETNPLKWHQVVRNKYRKLHFGWKLFVNISPPAALAIIGTAVAIIPSGASFCAIPFALMAGILFFQVYRLTKKHYYNRKKTVTK

SEQ ID NO: 3296612 - protein, 25 aa, Plasmodium falciparum
TEVIKIFRLLLYCNIYVESVDYFHD

SEQ ID NO: 3296613 - protein, 25 aa, Plasmodium falciparum
TEWKKSPIWIPLKSSQYKKCKAKLL

SEQ ID NO: 3296614 - protein, 17 aa, Plasmodium falciparum
TEWWSQNGEHIWNAMIC

SEQ ID NO: 3296615 - protein, 40 aa, Plasmodium falciparum
TEYERKLMIFLKFHVYLLFVICMYLWYHAQVHFSMKPPCP

SEQ ID NO: 3296616 - protein, 21 aa, Plasmodium falciparum
TEYINLCECLYYIDDYKKVAE

SEQ ID NO: 3296617 - protein, 25 aa, Plasmodium falciparum
TEYYHFIYNMLLLCSLRLCYPNVVE

SEQ ID NO: 3296618 - protein, 24 aa, Plasmodium falciparum
TFCEFYYLPYIFPCLQDNNHKVYF

SEQ ID NO: 3296619 - protein, 18 aa, Plasmodium falciparum
TFCRQRTRMLAKIRGECV

SEQ ID NO: 3296620 - protein, 24 aa, Plasmodium falciparum
TFDDNLLDIYKRFKKAAEISKIVN

SEQ ID NO: 3296621 - protein, 19 aa, Plasmodium falciparum
TFDLLKIKKEVYEKPLLKI

SEQ ID NO: 3296622 - protein, 24 aa, Plasmodium falciparum
TFDNYYMYIIIDLKRKKIFNNICN

SEQ ID NO: 3296623 - protein, 34 aa, Plasmodium falciparum
TFECLYRFLNIYPPNPFRIVYLEKVLKMIDYNFY

SEQ ID NO: 3296624 - protein, 32 aa, Plasmodium falciparum
TFEEKIYLLENLFYLLKSYPLDYDENRGCFYM

SEQ ID NO: 3296625 - protein, 19 aa, Plasmodium falciparum
TFENIFFDVIKYISTIMEA

SEQ ID NO: 3296626 - protein, 31 aa, Plasmodium falciparum
TFEYFFNVLCLLYFLKNIYFDLNYKTNENSY

SEQ ID NO: 3296627 - protein, 40 aa, Plasmodium falciparum
TFFETFFENFWDNIFYMNKYIFNIYYYMFDYTKKVKKKIE

SEQ ID NO: 3296628 - protein, 17 aa, Plasmodium falciparum
TFFFTCDQIYYIQNFTK

SEQ ID NO: 3296629 - protein, 21 aa, Plasmodium falciparum
TFFILMFFFYFLKKTTQFDGL

SEQ ID NO: 3296630 - protein, 19 aa, Plasmodium falciparum
TFFKLKNIFCGAAFKDKEC

SEQ ID NO: 3296631 - protein, 21 aa, Plasmodium falciparum
TFFNRIIGFFKGLKIFSMPIL

SEQ ID NO: 3296632 - protein, 25 aa, Plasmodium falciparum
TFFSSEIFLVGWIIDLLKQYLSLIT

SEQ ID NO: 3296633 - protein, 25 aa, Plasmodium falciparum
TFFYFLFFLLDMYQGNDAIPSKEKK

SEQ ID NO: 3296634 - protein, 28 aa, Plasmodium falciparum
TFGIFFGYVLNYLLQTYKIIQPIKYDIK

SEQ ID NO: 3296635 - protein, 18 aa, Plasmodium falciparum
TFGSVYIIIVLIAIIFLN

SEQ ID NO: 3296636 - protein, 19 aa, Plasmodium falciparum
TFGWIKNIGLFLLNLNIYL

SEQ ID NO: 3296637 - protein, 31 aa, Plasmodium falciparum
TFHDKIERILYLLFLLDKYKNFTFHVPINYS

SEQ ID NO: 3296638 - protein, 20 aa, Plasmodium falciparum
TFHINNLCIALLCFSRIYCL

SEQ ID NO: 3296639 - protein, 24 aa, Plasmodium falciparum
TFIQTLIKIIYFILSIYSCRKNNN

SEQ ID NO: 3296640 - protein, 22 aa, Plasmodium falciparum
TFKHAKYCDPCPKFKVDCKNGK

SEQ ID NO: 3296641 - protein, 45 aa, Plasmodium falciparum
TFKKAIHRIFPQFSIFSLTLYVTFIQWVIFILLISVKSDFPLTPS

SEQ ID NO: 3296642 - protein, 17 aa, Plasmodium falciparum
TFKQLWSKSVQYSPKYI

SEQ ID NO: 3296643 - protein, 18 aa, Plasmodium falciparum
TFLAFYLSSVYAHSYILL

SEQ ID NO: 3296644 - protein, 25 aa, Plasmodium falciparum
TFLKNKYNISFNNLKFYNIKHENKN

SEQ ID NO: 3296645 - protein, 19 aa, Plasmodium falciparum
TFLKVIWLVAYYVTNNYLP

SEQ ID NO: 3296646 - protein, 27 aa, Plasmodium falciparum
TFLLIFEIFIFFCYILQNEFVKGSYES

SEQ ID NO: 3296647 - protein, 20 aa, Plasmodium falciparum
TFLNFLYELLYSNKKIISKE

SEQ ID NO: 3296648 - protein, 20 aa, Plasmodium falciparum
TFLNLPRICFYYGKLKATAQ

SEQ ID NO: 3296649 - protein, 34 aa, Plasmodium falciparum
TFLNWCNSLLLRKDYYRKLIKANRLKWKELSIKT

SEQ ID NO: 3296650 - protein, 24 aa, Plasmodium falciparum
TFLNYKCHLLIIKAHRFLNAYEKY

SEQ ID NO: 3296651 - protein, 39 aa, Plasmodium falciparum
TFLTALGGIILLVTLLYRYTFLGLLFGRKKKDVKKKKID

SEQ ID NO: 3296652 - protein, 19 aa, Plasmodium falciparum
TFMNLLLRFYDLKNDHIIL

SEQ ID NO: 3296653 - protein, 19 aa, Plasmodium falciparum
TFNDYNVLQFLINFKRSKS

SEQ ID NO: 3296654 - protein, 31 aa, Plasmodium falciparum
TFNFHSFRISFIQFYPYLVLINLTKYNFEMK

SEQ ID NO: 3296655 - protein, 26 aa, Plasmodium falciparum
TFNKMNIFILFINILVIDLFCVSVEF

SEQ ID NO: 3296656 - protein, 85 aa, Plasmodium falciparum
TFNPDNLFNISSYVFILLFLETAIIKFLFLLTCRDINLSFLHILSFISYKFVIMCALIITKIFFYFLYFMYASVFGGGGTFPDIS

SEQ ID NO: 3296657 - protein, 38 aa, Plasmodium falciparum
TFNSPHFYFFLQIIKVLLKTFFLYNPLILTLRQKKEEN

SEQ ID NO: 3296658 - protein, 21 aa, Plasmodium falciparum
TFPGRLIRPLLNLKTKDIEFI

SEQ ID NO: 3296659 - protein, 23 aa, Plasmodium falciparum
TFSRLFFKIYPYCLIWGIGTALG

SEQ ID NO: 3296660 - protein, 38 aa, Plasmodium falciparum
TFSSFKKKYIFYPYLDMLMINFLFSLPFCIIETPMGYI

SEQ ID NO: 3296661 - protein, 38 aa, Plasmodium falciparum
TFSTALYVMVGVCAFLSLSFPGLLFSRAKRTKAFIEKY

SEQ ID NO: 3296662 - protein, 50 aa, Plasmodium falciparum
TFSVTIILAIIYYFLPIFLYIILRLIFFVVILILVFLKRKSPTPKRILKK

SEQ ID NO: 3296663 - protein, 27 aa, Plasmodium falciparum
TFSYNNNFLFSLDYFDILNTIRSVKCD

SEQ ID NO: 3296664 - protein, 25 aa, Plasmodium falciparum
TFTNKIYRMITPQFPLVVTRDYEFY

SEQ ID NO: 3296665 - protein, 20 aa, Plasmodium falciparum
TFVLRPFCFRSFKGKMVNGY

SEQ ID NO: 3296666 - protein, 32 aa, Plasmodium falciparum
TFVRVFTFRLMLFSLLYMFLTLNKYTLDQLTN

SEQ ID NO: 3296667 - protein, 20 aa, Plasmodium falciparum
TFVSLVFKHNFFANGILTTK

SEQ ID NO: 3296668 - protein, 20 aa, Plasmodium falciparum
TFVSPLSNFYFKFENMHKLK

SEQ ID NO: 3296669 - protein, 19 aa, Plasmodium falciparum
TFVYKFFNDTLPTGSTLST

SEQ ID NO: 3296670 - protein, 39 aa, Plasmodium falciparum
TFVYYIYNCIYCFFHIYINRFAFFIIFIKQEHMNLHDYI

SEQ ID NO: 3296671 - protein, 28 aa, Plasmodium falciparum
TFYITDILELLHKIFLNYIRKEKEHIYN

SEQ ID NO: 3296672 - protein, 24 aa, Plasmodium falciparum
TFYNYIFIHILKLCVISTHDLISI

SEQ ID NO: 3296673 - protein, 18 aa, Plasmodium falciparum
TFYRSEYCQPCPYCGVKK

SEQ ID NO: 3296674 - protein, 23 aa, Plasmodium falciparum
TGFIFAFVTAYNFLNRYKNILIV

SEQ ID NO: 3296675 - protein, 27 aa, Plasmodium falciparum
TGFYTYLITILIISLPIYLISTNKKFY

SEQ ID NO: 3296676 - protein, 18 aa, Plasmodium falciparum
TGGIISHPFLPFFALIHI

SEQ ID NO: 3296677 - protein, 18 aa, Plasmodium falciparum
TGICCSCGYLQIPAFMIN

SEQ ID NO: 3296678 - protein, 42 aa, Plasmodium falciparum
TGIFYPCGIAALVLLILAVVLIILYIWLYRRRKRSWKHECKK

SEQ ID NO: 3296679 - protein, 34 aa, Plasmodium falciparum
TGIKTKCMFPSCSTYFHIYCYYNKYMQHVRKKKN

SEQ ID NO: 3296680 - protein, 37 aa, Plasmodium falciparum
TGILFILGISYCISYYYFDQYLLYNTSALRRCFMKNE

SEQ ID NO: 3296681 - protein, 26 aa, Plasmodium falciparum
TGIYLEVFLCILEKLKYKCPLLKDHI

SEQ ID NO: 3296682 - protein, 27 aa, Plasmodium falciparum
TGKDKNLYSYYNFSPFFPMSSSDIINV

SEQ ID NO: 3296683 - protein, 29 aa, Plasmodium falciparum
TGMLFQTCILVDLLFITMSLTFIATSVVK

SEQ ID NO: 3296684 - protein, 29 aa, Plasmodium falciparum
TGNVGKKYFFISLLFNIDYYNVRGMNIGN

SEQ ID NO: 3296685 - protein, 17 aa, Plasmodium falciparum
TGPNIFFLLFTYIIIII

SEQ ID NO: 3296686 - protein, 36 aa, Plasmodium falciparum
TGSEKQKIMPFDAFFFLWLTQMLDDSIEWRKKLKTC

SEQ ID NO: 3296687 - protein, 21 aa, Plasmodium falciparum
TGTAIFNWRIVYPNITHPLNT

SEQ ID NO: 3296688 - protein, 28 aa, Plasmodium falciparum
TGTGKTFIYLLPLFQEISNYNFLEYEQN

SEQ ID NO: 3296689 - protein, 25 aa, Plasmodium falciparum
TGVISFLYSVILTRGLHNVKNDMDD

SEQ ID NO: 3296690 - protein, 29 aa, Plasmodium falciparum
TGVPYVTLQMLFFDLYKNIFQTYSSNHYN

SEQ ID NO: 3296691 - protein, 29 aa, Plasmodium falciparum
TGYVFTFVAPLLFIIFISLINEVVDDLKR

SEQ ID NO: 3296692 - protein, 25 aa, Plasmodium falciparum
THANFKQYCLYLYVVDHVSKIYSKH

SEQ ID NO: 3296693 - protein, 26 aa, Plasmodium falciparum
THAYKNSLICRVLSNYSKQIRKEKNR

SEQ ID NO: 3296694 - protein, 17 aa, Plasmodium falciparum
THDVVLDGVLKEEFLKG

SEQ ID NO: 3296695 - protein, 20 aa, Plasmodium falciparum
THELLQEKLYLYIDKLDNLK

SEQ ID NO: 3296696 - protein, 27 aa, Plasmodium falciparum
THELVTNIFFFSFFKNFNKFYTKKEGK

SEQ ID NO: 3296697 - protein, 22 aa, Plasmodium falciparum
THFIKKLRYLLSIFYDVVYKKD

SEQ ID NO: 3296698 - protein, 18 aa, Plasmodium falciparum
THGKEFLYILSKNRLQLY

SEQ ID NO: 3296699 - protein, 17 aa, Plasmodium falciparum
THILLLTICIIILSLKP

SEQ ID NO: 3296700 - protein, 18 aa, Plasmodium falciparum
THINEIILLKDSITQRIA

SEQ ID NO: 3296701 - protein, 18 aa, Plasmodium falciparum
THKFYYYQYKIHKLKIVP

SEQ ID NO: 3296702 - protein, 32 aa, Plasmodium falciparum
THKINILFNLLDILFLYFSKFQATTQIISRIF

SEQ ID NO: 3296703 - protein, 25 aa, Plasmodium falciparum
THKKKKIYLFLQKEYKNKILGFINF

SEQ ID NO: 3296704 - protein, 26 aa, Plasmodium falciparum
THLIHKHMILLYFSFNFLKMSSYEYS

SEQ ID NO: 3296705 - protein, 19 aa, Plasmodium falciparum
THLVFIKDWIDKFTKYMFQ

SEQ ID NO: 3296706 - protein, 22 aa, Plasmodium falciparum
THLWSNSNFPLKNQIKKVSSVF

SEQ ID NO: 3296707 - protein, 27 aa, Plasmodium falciparum
THNNNILYMIYYNDYIMKYLLKNKVYE

SEQ ID NO: 3296708 - protein, 28 aa, Plasmodium falciparum
THQFMCVKSLFLFYLYSRCTKKKIYNKR

SEQ ID NO: 3296709 - protein, 39 aa, Plasmodium falciparum
THVYFYNEKYYKIIYYLLLYNFKYVFKKLKLKYSIYDLL

SEQ ID NO: 3296710 - protein, 25 aa, Plasmodium falciparum
TIACFIFPLYKDKIFRDLFLYMKNN

SEQ ID NO: 3296711 - protein, 31 aa, Plasmodium falciparum
TIASTLSAALTWPLALIKYASNLDNVYLLIR

SEQ ID NO: 3296712 - protein, 21 aa, Plasmodium falciparum
TICKIVAHFTLLILKNPDSSI

SEQ ID NO: 3296713 - protein, 20 aa, Plasmodium falciparum
TIDILIKIIKILSVAMGSAH

SEQ ID NO: 3296714 - protein, 26 aa, Plasmodium falciparum
TIDLFFSIYYTLFTLGLSLYEKKKIY

SEQ ID NO: 3296715 - protein, 41 aa, Plasmodium falciparum
TIEFRNELFLFVVEKWRLLSKFYYMDKYRSIYKIEKVHYIP

SEQ ID NO: 3296716 - protein, 26 aa, Plasmodium falciparum
TIELSRLEEVLLNNGYKKKIEDVEKN

SEQ ID NO: 3296717 - protein, 18 aa, Plasmodium falciparum
TIENYLLRVFEPLANFCK

SEQ ID NO: 3296718 - protein, 22 aa, Plasmodium falciparum
TIEPYLFNYLKNSTNILMKKKK

SEQ ID NO: 3296719 - protein, 35 aa, Plasmodium falciparum
TIETSILITYEKIYNFLLQIILTGYMIKNADYRLT

SEQ ID NO: 3296720 - protein, 25 aa, Plasmodium falciparum
TIFEALCVLLSLAFSLYICTGFYNL

SEQ ID NO: 3296721 - protein, 19 aa, Plasmodium falciparum
TIFFHLYIFIFNNCKKKEI

SEQ ID NO: 3296722 - protein, 18 aa, Plasmodium falciparum
TIFGHIYDELKNGKTNGE

SEQ ID NO: 3296723 - protein, 20 aa, Plasmodium falciparum
TIFIITKLLLMLRRFFQNQY

SEQ ID NO: 3296724 - protein, 41 aa, Plasmodium falciparum
TIFPCVFWIFCDTAIFLFLLIFLFIMSLFLLYIYNTEIEKD

SEQ ID NO: 3296725 - protein, 25 aa, Plasmodium falciparum
TIGESSFFYAKLPSGELIKLKVNDS

SEQ ID NO: 3296726 - protein, 19 aa, Plasmodium falciparum
TIGFFFYGNINIRKYIYKN

SEQ ID NO: 3296727 - protein, 25 aa, Plasmodium falciparum
TIGIHNFFVIYNFFINNLNIKIVKG

SEQ ID NO: 3296728 - protein, 27 aa, Plasmodium falciparum
TIGKFSSYIYLINQIFGSGIVSIPYVF

SEQ ID NO: 3296729 - protein, 27 aa, Plasmodium falciparum
TIGNINCFYSWLQNVLLKKGRSINDLH

SEQ ID NO: 3296730 - protein, 30 aa, Plasmodium falciparum
TIGSLLLHVLILYIPPLARIFGVVPLSAYD

SEQ ID NO: 3296731 - protein, 24 aa, Plasmodium falciparum
TIGTLFFCYTKYKNIYCNKVPIIE

SEQ ID NO: 3296732 - protein, 37 aa, Plasmodium falciparum
TIGYSITAILIIVLIMVIIYLILRYRRKKKMKKKLQY

SEQ ID NO: 3296733 - protein, 18 aa, Plasmodium falciparum
TIHFWAPTFKWSISLANI

SEQ ID NO: 3296734 - protein, 19 aa, Plasmodium falciparum
TIHSYFIYDKIRLIIPKKS

SEQ ID NO: 3296735 - protein, 24 aa, Plasmodium falciparum
TIIERCMHRFNFNEWSNLLIVQHI

SEQ ID NO: 3296736 - protein, 25 aa, Plasmodium falciparum
TIIEWIYLVYLVGSLLWDGVIKPIF

SEQ ID NO: 3296737 - protein, 27 aa, Plasmodium falciparum
TIIGLIFTFICVFISVLFKWTEDDKFR

SEQ ID NO: 3296738 - protein, 19 aa, Plasmodium falciparum
TIIKSIMILLIFYNQKNTD

SEQ ID NO: 3296739 - protein, 27 aa, Plasmodium falciparum
TIISFFSFIFLSSFFEVVLSTLFIFIK

SEQ ID NO: 3296740 - protein, 17 aa, Plasmodium falciparum
TIIYALPFMLYLNKNYL

SEQ ID NO: 3296741 - protein, 26 aa, Plasmodium falciparum
TIIYNKTNYYLIFYQRKTNKKIVNLL

SEQ ID NO: 3296742 - protein, 22 aa, Plasmodium falciparum
TIKIKIGLISNSYFYLNVDISY

SEQ ID NO: 3296743 - protein, 28 aa, Plasmodium falciparum
TIKKSLPYLLFLILYLISFSAGDYISNV

SEQ ID NO: 3296744 - protein, 24 aa, Plasmodium falciparum
TIKNKLNLYVKLMLDKYIQESSNY

SEQ ID NO: 3296745 - protein, 25 aa, Plasmodium falciparum
TIKTKYIHILYNEIFSLLLIEPYND

SEQ ID NO: 3296746 - protein, 31 aa, Plasmodium falciparum
TIKTSTFFTFSKYLYFVYSYDGIGGVSDICI

SEQ ID NO: 3296747 - protein, 23 aa, Plasmodium falciparum
TILCYILLILIEKSHQNNIYKVN

SEQ ID NO: 3296748 - protein, 30 aa, Plasmodium falciparum
TILGKYHYLLYHLVPCIYPRMLVTVNEKLE

SEQ ID NO: 3296749 - protein, 27 aa, Plasmodium falciparum
TILKNIIHFTLIPIYDYINKYINSFIT

SEQ ID NO: 3296750 - protein, 30 aa, Plasmodium falciparum
TILKSLHKTFFYMPIFILVTKVYIKNINNL

SEQ ID NO: 3296751 - protein, 27 aa, Plasmodium falciparum
TILMFEHDFFYKFIVSHNYKKPTIDVI

SEQ ID NO: 3296752 - protein, 20 aa, Plasmodium falciparum
TILRYGTFLNLMNIAQLENI

SEQ ID NO: 3296753 - protein, 30 aa, Plasmodium falciparum
TILSKFAERPPFLRWFIEWGEEFCKKRKEQ

SEQ ID NO: 3296754 - protein, 25 aa, Plasmodium falciparum
TILTIKNFFHFYQDGYIELVNVVFN

SEQ ID NO: 3296755 - protein, 31 aa, Plasmodium falciparum
TILYGFAPLNKRDYWPLIFSKIAYTNAEQIN

SEQ ID NO: 3296756 - protein, 34 aa, Plasmodium falciparum
TIMASILFELLSAKLLVTISIILLSISLYIFSHA

SEQ ID NO: 3296757 - protein, 41 aa, Plasmodium falciparum
TINCKFYLHCSYNTIYLFIKKNYIFVIRMIQHYVNEKRIAL

SEQ ID NO: 3296758 - protein, 22 aa, Plasmodium falciparum
TINNYYYYDFYEKLQKNEYGNI

SEQ ID NO: 3296759 - protein, 17 aa, Plasmodium falciparum
TINRYVPTLIDPGYFFL

SEQ ID NO: 3296760 - protein, 33 aa, Plasmodium falciparum
TINYQYVVFMIFMSSFLYLSVSSTIYLLSQNYI

SEQ ID NO: 3296761 - protein, 27 aa, Plasmodium falciparum
TIPDDFLRQMFYTFGDYRDIFFGNNIG

SEQ ID NO: 3296762 - protein, 26 aa, Plasmodium falciparum
TIPEEFLRSMYFTYGDYRDICLNTDI

SEQ ID NO: 3296763 - protein, 18 aa, Plasmodium falciparum
TIPIIIHYMFRCLNFQIF

SEQ ID NO: 3296764 - protein, 33 aa, Plasmodium falciparum
TIPIINFHMFFPINIFLITLLKSIRSLIMIPQF

SEQ ID NO: 3296765 - protein, 27 aa, Plasmodium falciparum
TIPNFITIELLIIRIYLCIKKYLNQNE

SEQ ID NO: 3296766 - protein, 27 aa, Plasmodium falciparum
TIPPDFLRQMFYTLGDYRDILFGDTTM

SEQ ID NO: 3296767 - protein, 28 aa, Plasmodium falciparum
TIPTDFLRQMFYTLGDYRDILFSGSNDT

SEQ ID NO: 3296768 - protein, 27 aa, Plasmodium falciparum
TIPTTETPPQFLRWIKEWGTNVCIQKE

SEQ ID NO: 3296769 - protein, 27 aa, Plasmodium falciparum
TIQEITCLTFWYEEILPLVNNDKKKNL

SEQ ID NO: 3296770 - protein, 19 aa, Plasmodium falciparum
TIQMIQIFKSIHLYIHDNN

SEQ ID NO: 3296771 - protein, 20 aa, Plasmodium falciparum
TIQVWWRNFYKLRKIFQNFP

SEQ ID NO: 3296772 - protein, 36 aa, Plasmodium falciparum; identical to SEQ ID NO: 3276040

SEQ ID NO: 3296773 - protein, 17 aa, Plasmodium falciparum
TISLKYFLYVFFNAIRK

SEQ ID NO: 3296774 - protein, 20 aa, Plasmodium falciparum
TISVILKLNKHILSAFPMLK

SEQ ID NO: 3296775 - protein, 36 aa, Plasmodium falciparum
TITNILAVYNVGFSIVLPLFAQYYKSVDYDPNVFPA

SEQ ID NO: 3296776 - protein, 21 aa, Plasmodium falciparum
TITNISFLLLVIALTAHADMI

SEQ ID NO: 3296777 - protein, 18 aa, Plasmodium falciparum
TITWKYTKTIGPFASFIY

SEQ ID NO: 3296778 - protein, 27 aa, Plasmodium falciparum
TIVFFPLYILLFFTRYHIRLLFVLLIF

SEQ ID NO: 3296779 - protein, 29 aa, Plasmodium falciparum
TIVVIILVMIVIYLILRYSRKKKMKKKLQ

SEQ ID NO: 3296780 - protein, 23 aa, Plasmodium falciparum
TIVYSFLYIIYGVPLFIFHQCLG

SEQ ID NO: 3296781 - protein, 20 aa, Plasmodium falciparum
TIYNSLFIRHPLNFQYIFII

SEQ ID NO: 3296782 - protein, 26 aa, Plasmodium falciparum
TKCNSYILRKKYLDNLFFVNYDTVPL

SEQ ID NO: 3296783 - protein, 36 aa, Plasmodium falciparum
TKDCSLFFIIKKQSCPLLYIILSILYITYCMECIVC

SEQ ID NO: 3296784 - protein, 26 aa, Plasmodium falciparum
TKDLELNLQKIFGKLFRKYIKKNNTA

SEQ ID NO: 3296785 - protein, 18 aa, Plasmodium falciparum
TKDLLFFNRDREIMNVFL

SEQ ID NO: 3296786 - protein, 28 aa, Plasmodium falciparum
TKDVLKVLYYWLEFCISKLLIEGKVEQW

SEQ ID NO: 3296787 - protein, 23 aa, Plasmodium falciparum
TKDYFIDTTYIYSIPRGTDNINY

SEQ ID NO: 3296788 - protein, 22 aa, Plasmodium falciparum
TKEAREFLFDQFRKRNVYKEYI

SEQ ID NO: 3296789 - protein, 20 aa, Plasmodium falciparum
TKELYLLARKYYQLIHTNHD

SEQ ID NO: 3296790 - protein, 32 aa, Plasmodium falciparum
TKEMYLSYMSFISLVAFIKYPEIITQDNIILV

SEQ ID NO: 3296791 - protein, 26 aa, Plasmodium falciparum
TKFEYKYLFYFASFVSINLGICNEYI

SEQ ID NO: 3296792 - protein, 20 aa, Plasmodium falciparum
TKFINYITSTIIYLNNLFQY

SEQ ID NO: 3296793 - protein, 30 aa, Plasmodium falciparum
TKHEKLHFIILIILCIFISIFKVYYNNKNN

SEQ ID NO: 3296794 - protein, 38 aa, Plasmodium falciparum
TKHPYILELEKLQKGLYLLVFRLEEAMLFIKYCDYDMD

SEQ ID NO: 3296795 - protein, 18 aa, Plasmodium falciparum
TKIFNIVPSIEECIKYSE

SEQ ID NO: 3296796 - protein, 26 aa, Plasmodium falciparum
TKIFQEFFVFLWSMSKLKINNIYIDL

SEQ ID NO: 3296797 - protein, 37 aa, Plasmodium falciparum
TKIIFSQMQLPYLSQMFYMQAPYFGHFIGKWQKKRQQ

SEQ ID NO: 3296798 - protein, 27 aa, Plasmodium falciparum
TKIITLIFFLVLFPLFNFFVIYTIDFI

SEQ ID NO: 3296799 - protein, 25 aa, Plasmodium falciparum
TKIKNMILLFIMKRFVCIDIKNINI

SEQ ID NO: 3296800 - protein, 21 aa, Plasmodium falciparum
TKILRQTYRLVFSKINFFDEN

SEQ ID NO: 3296801 - protein, 41 aa, Plasmodium falciparum
TKIVKGLSLRLFFIFVLSSFVYIYYGFSFVLNGYKNLKNNM

SEQ ID NO: 3296802 - protein, 41 aa, Plasmodium falciparum
TKKESTNLFFYYFFDFVLSFFKFNFSYLYYKKREHYYKQNK

SEQ ID NO: 3296803 - protein, 31 aa, Plasmodium falciparum
TKKIFRYYHKIFILFLLYICNMYFQNLKDDI

SEQ ID NO: 3296804 - protein, 34 aa, Plasmodium falciparum
TKKLKFVSYIVSLIFTSIFIYSIFMSIYKRGKIF

SEQ ID NO: 3296805 - protein, 31 aa, Plasmodium falciparum
TKKLKRIMFLKYWKTYFLCACFLIIGFKVYR

SEQ ID NO: 3296806 - protein, 31 aa, Plasmodium falciparum
TKKMYNYKLLFHAFIYGILSFIKICYGNYAS

SEQ ID NO: 3296807 - protein, 18 aa, Plasmodium falciparum
TKLCPLNYIFTLYNNFME

SEQ ID NO: 3296808 - protein, 30 aa, Plasmodium falciparum
TKLENFVERPPFFRWLHEWGSDFCGKRARM

SEQ ID NO: 3296809 - protein, 25 aa, Plasmodium falciparum
TKLNTYIYIDLYKEIFMKSPHLTKN

SEQ ID NO: 3296810 - protein, 24 aa, Plasmodium falciparum
TKMLEYNVLLDKNTSMKMLVQDLE

SEQ ID NO: 3296811 - protein, 26 aa, Plasmodium falciparum
TKMVCNFFLYKYPIIYHLYSNKLFHE

SEQ ID NO: 3296812 - protein, 26 aa, Plasmodium falciparum
TKNFSILLGFHYFLINNINLNKNDIL

SEQ ID NO: 3296813 - protein, 25 aa, Plasmodium falciparum
TKNKDLLYLFFLYSHQLVDKDEHYC

SEQ ID NO: 3296814 - protein, 23 aa, Plasmodium falciparum
TKPKHEVDMIRILQMSQNKYGIP

SEQ ID NO: 3296815 - protein, 22 aa, Plasmodium falciparum
TKPLIKFGTYVLNNFYVVVDQE

SEQ ID NO: 3296816 - protein, 40 aa, Plasmodium falciparum
TKRICIGIYVLFIQLILSLLFSITLILQSLINLVEKVNIN

SEQ ID NO: 3296817 - protein, 19 aa, Plasmodium falciparum
TKSCFPMKRIIFEFTENYG

SEQ ID NO: 3296818 - protein, 28 aa, Plasmodium falciparum
TKSNKKLCYLRNQLIEKFFDSLNYKIDQ

SEQ ID NO: 3296819 - protein, 25 aa, Plasmodium falciparum
TKSQSFFFRLYKKCFNIFLLYAFAL

SEQ ID NO: 3296820 - protein, 26 aa, Plasmodium falciparum
TKSSKWYEYLLLTKPKKWTAHATFEI

SEQ ID NO: 3296821 - protein, 28 aa, Plasmodium falciparum
TKTLFAPFDRIKLFYQIQPMFNQFKKEE

SEQ ID NO: 3296822 - protein, 32 aa, Plasmodium falciparum
TKTQKVLFTLFDWPTKINSKLILIAISNTMDL

SEQ ID NO: 3296823 - protein, 29 aa, Plasmodium falciparum
TKTQSVGSPLLLLPQLPRSGSDDKDPETS

SEQ ID NO: 3296824 - protein, 32 aa, Plasmodium falciparum
TKVIKIHIIHFVFKIWIYQYASIMLLSNENIN

SEQ ID NO: 3296825 - protein, 27 aa, Plasmodium falciparum
TKVNFKIYYLISHIHYSYLFNKDIFIC

SEQ ID NO: 3296826 - protein, 25 aa, Plasmodium falciparum
TKYIIRLPLNILKYIFKEIFKYLSK

SEQ ID NO: 3296827 - protein, 21 aa, Plasmodium falciparum
TKYILLYNKYKYKLLINYFHF

SEQ ID NO: 3296828 - protein, 32 aa, Plasmodium falciparum
TKYKKWLLSNYPFHIIYIPYYKWNMLTHKQKE

SEQ ID NO: 3296829 - protein, 25 aa, Plasmodium falciparum
TKYNIYFEYILINILLCFINNLQNI

SEQ ID NO: 3296830 - protein, 32 aa, Plasmodium falciparum
TKYNSIEHLILLLWSFNPKLSILCAEILNIYY

SEQ ID NO: 3296831 - protein, 25 aa, Plasmodium falciparum
TKYSNFYLLFFDKKHLLFSASYNLS

SEQ ID NO: 3296832 - protein, 19 aa, Plasmodium falciparum
TKYYKLLLFHENSKHVYGY

SEQ ID NO: 3296833 - protein, 29 aa, Plasmodium falciparum
TLANDPANWLPWLKWISSKRAIVHVTKLN

SEQ ID NO: 3296834 - protein, 31 aa, Plasmodium falciparum
TLAWSVGIGFAAFTYFFLKKKTKASVGNLFQ

SEQ ID NO: 3296835 - protein, 31 aa, Plasmodium falciparum
TLAWSVGIGFAAFTYFFLKKKTKSTIDLLRV

SEQ ID NO: 3296836 - protein, 31 aa, Plasmodium falciparum
TLAWSVGIGFAAFTYFYLKKKTKASVGNLFQ

SEQ ID NO: 3296837 - protein, 31 aa, Plasmodium falciparum
TLAWSVGIGFAAFTYFYLKKKTKSSVGNLFQ

SEQ ID NO: 3296838 - protein, 19 aa, Plasmodium falciparum
TLCFISMYLGLNYFDLIIK

SEQ ID NO: 3296839 - protein, 27 aa, Plasmodium falciparum
TLDILSWRMIYIFKKYLYIYGKVVKGF

SEQ ID NO: 3296840 - protein, 18 aa, Plasmodium falciparum
TLDQKPFIMSIHDRDLYS

SEQ ID NO: 3296841 - protein, 24 aa, Plasmodium falciparum
TLDYYVDKLFYYKNKINYKYLIIN

SEQ ID NO: 3296842 - protein, 28 aa, Plasmodium falciparum
TLECMKYFSILMFPFIPNISLAILRNIG

SEQ ID NO: 3296843 - protein, 24 aa, Plasmodium falciparum
TLEDILKFIYSFLEHFKTLKKELQ

SEQ ID NO: 3296844 - protein, 24 aa, Plasmodium falciparum
TLEFLRQLLTYKLIYDRDNLDEKK

SEQ ID NO: 3296845 - protein, 29 aa, Plasmodium falciparum
TLEKFAQTPQFLRWFIEWSDEFCRERKEK

SEQ ID NO: 3296846 - protein, 23 aa, Plasmodium falciparum
TLETLYFYIYFSDWHIMDKDAII

SEQ ID NO: 3296847 - protein, 24 aa, Plasmodium falciparum
TLEYILNEFFMDKIEKAYGIEKSK

SEQ ID NO: 3296848 - protein, 22 aa, Plasmodium falciparum
TLFKLYNNLLFYLFIQEEKKKK

SEQ ID NO: 3296849 - protein, 17 aa, Plasmodium falciparum
TLFLRFFDQIINKEERK

SEQ ID NO: 3296850 - protein, 20 aa, Plasmodium falciparum
TLFNKLRRKYFNKIKKINIA

SEQ ID NO: 3296851 - protein, 27 aa, Plasmodium falciparum
TLFRIFFVPIFLFLPKLHYIYNFSYFM

SEQ ID NO: 3296852 - protein, 21 aa, Plasmodium falciparum
TLFYWLHIYLNFTLSKRIYLK

SEQ ID NO: 3296853 - protein, 24 aa, Plasmodium falciparum
TLGALETFLKLGYNGKLIICSKDA

SEQ ID NO: 3296854 - protein, 18 aa, Plasmodium falciparum
TLGQLKDSIFALNYPIYQ

SEQ ID NO: 3296855 - protein, 20 aa, Plasmodium falciparum
TLHINYFAYWSVRSVYTFFG

SEQ ID NO: 3296856 - protein, 26 aa, Plasmodium falciparum
TLIDPSLLFMMLFSSEKLCDYIGVYD

SEQ ID NO: 3296857 - protein, 19 aa, Plasmodium falciparum
TLILKRFFICFEKEKNVNN

SEQ ID NO: 3296858 - protein, 29 aa, Plasmodium falciparum
TLIQNMIFNPIFNNVLFKLKEYYIIINNL

SEQ ID NO: 3296859 - protein, 28 aa, Plasmodium falciparum
TLITYRYMYIFSLINILKTTSVIIKTRH

SEQ ID NO: 3296860 - protein, 22 aa, Plasmodium falciparum
TLKKEPFVSELWINVINFNVED

SEQ ID NO: 3296861 - protein, 26 aa, Plasmodium falciparum
TLKKSQNLFLYLSRIFILTDISKQLI

SEQ ID NO: 3296862 - protein, 21 aa, Plasmodium falciparum
TLKKYCHIIYQDLLTFNDIDK

SEQ ID NO: 3296863 - protein, 28 aa, Plasmodium falciparum
TLKNFVERPPYFRYLEEWGEEFCRKQKH

SEQ ID NO: 3296864 - protein, 26 aa, Plasmodium falciparum
TLKRFNEILLYLTSWIDIFHTSEEEQ

SEQ ID NO: 3296865 - protein, 32 aa, Plasmodium falciparum
TLKVQDYFIYVLLRAYFQLLSFFINTLKELKN

SEQ ID NO: 3296866 - protein, 24 aa, Plasmodium falciparum
TLLEIYNFVIFLFDEEKGYFHFSL

SEQ ID NO: 3296867 - protein, 21 aa, Plasmodium falciparum
TLLIALVLPIRSIQLHSVNYA

SEQ ID NO: 3296868 - protein, 31 aa, Plasmodium falciparum
TLLIIFLFLFLYLFVLILQKCNFLIFLCSYF

SEQ ID NO: 3296869 - protein, 18 aa, Plasmodium falciparum
TLLLFPPVLCVLLCIFLT

SEQ ID NO: 3296870 - protein, 17 aa, Plasmodium falciparum
TLLNFIEITKDSSTYRL

SEQ ID NO: 3296871 - protein, 25 aa, Plasmodium falciparum
TLLNQLYNIIFDFSNYILKLCAPKN

SEQ ID NO: 3296872 - protein, 34 aa, Plasmodium falciparum
TLLSFTNIFLLNLQIIILKFLLNISQTYIMKKRY

SEQ ID NO: 3296873 - protein, 19 aa, Plasmodium falciparum
TLLSLAMVFLIINAYTNIN

SEQ ID NO: 3296874 - protein, 17 aa, Plasmodium falciparum
TLLSLLPFDYELKTLNC

SEQ ID NO: 3296875 - protein, 27 aa, Plasmodium falciparum
TLLSNNGIFIIYFTSAIILYKKEELLN

SEQ ID NO: 3296876 - protein, 21 aa, Plasmodium falciparum
TLLYIESLLWESVIDIRKEEE

SEQ ID NO: 3296877 - protein, 21 aa, Plasmodium falciparum
TLNFDVRSRPLPNEPLHFMNI

SEQ ID NO: 3296878 - protein, 26 aa, Plasmodium falciparum
TLNNIYTFLYFFKFLYENNSYYFKNC

SEQ ID NO: 3296879 - protein, 32 aa, Plasmodium falciparum
TLNNPKLSDFVLRPPYFRYLEEWGQNFCKKRT

SEQ ID NO: 3296880 - protein, 27 aa, Plasmodium falciparum
TLNNYNCYFLLHLILNIFKTSKKERNI

SEQ ID NO: 3296881 - protein, 18 aa, Plasmodium falciparum
TLNSSLFQNFKLKSSYLS

SEQ ID NO: 3296882 - protein, 17 aa, Plasmodium falciparum
TLNYFIKRVWFNKVGPS

SEQ ID NO: 3296883 - protein, 28 aa, Plasmodium falciparum
TLPGHVSLFLIGIRMFKPLKDPSVTVCF

SEQ ID NO: 3296884 - protein, 28 aa, Plasmodium falciparum
TLPTINTFIILDIILRILKIRGNKKKRE

SEQ ID NO: 3296885 - protein, 20 aa, Plasmodium falciparum
TLQFIFYLYISKFYTRKWYV

SEQ ID NO: 3296886 - protein, 23 aa, Plasmodium falciparum
TLQHIFHIFIYNPIKSIVKKEKD

SEQ ID NO: 3296887 - protein, 22 aa, Plasmodium falciparum
TLQYILVFLFLNNIYHRYIQFI

SEQ ID NO: 3296888 - protein, 31 aa, Plasmodium falciparum
TLREMTKPFFLFFRIFNRILVEKSKKLDFIL

SEQ ID NO: 3296889 - protein, 37 aa, Plasmodium falciparum
TLRRKKAFPVFTKILLVSFLVWVLKCSNNCNNGNGSG

SEQ ID NO: 3296890 - protein, 27 aa, Plasmodium falciparum
TLSEKHQLIFFFYMVCMINIYKKDIDY

SEQ ID NO: 3296891 - protein, 28 aa, Plasmodium falciparum
TLSSIEFIKFIFLLLDKNISTNSNTLFK

SEQ ID NO: 3296892 - protein, 40 aa, Plasmodium falciparum
TLSSYYFIISFIFSTLMFFYFCTFYVISLFFLYISSFCKS

SEQ ID NO: 3296893 - protein, 30 aa, Plasmodium falciparum
TLSTLLFFFYKFFVLRLLFILNSYNFFSQK

SEQ ID NO: 3296894 - protein, 21 aa, Plasmodium falciparum
TLTEFQVNLLLKDLEKKKVNK

SEQ ID NO: 3296895 - protein, 25 aa, Plasmodium falciparum
TLTLKNNKWMGKKLTTVALGLGENP

SEQ ID NO: 3296896 - protein, 26 aa, Plasmodium falciparum
TLTLLMFLEIFFFLLDGINTFEVITL

SEQ ID NO: 3296897 - protein, 32 aa, Plasmodium falciparum
TLTNPKLKDFVLRPTYFRYLEEWGQNFCKERK

SEQ ID NO: 3296898 - protein, 25 aa, Plasmodium falciparum
TLTNYNYLYIIYKNQINNFKSKNNI

SEQ ID NO: 3296899 - protein, 29 aa, Plasmodium falciparum
TLTSHLSFYLILLIILYSKEEKFKNSYKD

SEQ ID NO: 3296900 - protein, 17 aa, Plasmodium falciparum
TLWSKYAEPIWNGMICA

SEQ ID NO: 3296901 - protein, 31 aa, Plasmodium falciparum
TLYMNYEVYLLILVCLLTLCKFAIISQTFCQ

SEQ ID NO: 3296902 - protein, 27 aa, Plasmodium falciparum
TLYYDIKYLCILICLSVFISLYKISLT

SEQ ID NO: 3296903 - protein, 19 aa, Plasmodium falciparum
TMCFMFKKLIYSNFKLITP

SEQ ID NO: 3296904 - protein, 24 aa, Plasmodium falciparum
TMCYLCYFVSEYYLNLSGPLSIVC

SEQ ID NO: 3296905 - protein, 19 aa, Plasmodium falciparum
TMDFTKFQWYILSFKNTMN

SEQ ID NO: 3296906 - protein, 25 aa, Plasmodium falciparum
TMDLPDRLIPRCRSRLAFGRLVFSP

SEQ ID NO: 3296907 - protein, 19 aa, Plasmodium falciparum
TMEIKKYSKYFFLKSFLNR

SEQ ID NO: 3296908 - protein, 45 aa, Plasmodium falciparum
TMKKNKYYWLVPLSVISCIYIYYKMRVRVCFFFKNTYSNVCRFMT

SEQ ID NO: 3296909 - protein, 28 aa, Plasmodium falciparum
TMKNENIYFLYMLKSFMLQKFIETMFGN

SEQ ID NO: 3296910 - protein, 20 aa, Plasmodium falciparum
TMKTLFYMINCYLVNYSYCI

SEQ ID NO: 3296911 - protein, 26 aa, Plasmodium falciparum
TMLGPFFCLILFYVYNDKWNIKNIFI

SEQ ID NO: 3296912 - protein, 44 aa, Plasmodium falciparum
TMNDMFKLIPFSFFIIIPFAEFLLPIFLKIYPNLLPSTFKNDDN

SEQ ID NO: 3296913 - protein, 20 aa, Plasmodium falciparum
TMNIISMVILVLSVGFSIDH

SEQ ID NO: 3296914 - protein, 35 aa, Plasmodium falciparum
TMNLREFILYMTVGLYFSYLWLDALRQYRLDMKLF

SEQ ID NO: 3296915 - protein, 28 aa, Plasmodium falciparum
TMVQYAYYVLFYYYYNKYMKICPDDKMY

SEQ ID NO: 3296916 - protein, 22 aa, Plasmodium falciparum
TNAIFRKIIHRFYNYIKDIMEK

SEQ ID NO: 3296917 - protein, 41 aa, Plasmodium falciparum
TNCLLCLIFCMMSLHSYFLLFDILERLIIIPGGSNQKFNVS

SEQ ID NO: 3296918 - protein, 19 aa, Plasmodium falciparum
TNCMNYNLGLLKLINQNNK

SEQ ID NO: 3296919 - protein, 28 aa, Plasmodium falciparum
TNDEEKHIFLQFLKIKTEWVLVELNNLE

SEQ ID NO: 3296920 - protein, 17 aa, Plasmodium falciparum
TNDIFPNINLYSSKNIY

SEQ ID NO: 3296921 - protein, 24 aa, Plasmodium falciparum
TNDLQYHFNSVILLDEEKGKDTDC

SEQ ID NO: 3296922 - protein, 21 aa, Plasmodium falciparum
TNDLYNILFVENKKKKKKIII

SEQ ID NO: 3296923 - protein, 27 aa, Plasmodium falciparum
TNEFTLHPFLFAFYKTSNNKKNDYSAH

SEQ ID NO: 3296924 - protein, 25 aa, Plasmodium falciparum
TNEGFHFYIHFYSSSLNMDPYFLST

SEQ ID NO: 3296925 - protein, 27 aa, Plasmodium falciparum
TNFEKLLCLIIIEIFNLIYDNRQYSVE

SEQ ID NO: 3296926 - protein, 35 aa, Plasmodium falciparum
TNFELKRIHLKIKAFIYKCLLRLLQSYEKSTESRV

SEQ ID NO: 3296927 - protein, 23 aa, Plasmodium falciparum
TNFFDKIFFFLKKNKKSHWKKKL

SEQ ID NO: 3296928 - protein, 22 aa, Plasmodium falciparum
TNFLLIYLSNFPLYINNEHLIN

SEQ ID NO: 3296929 - protein, 19 aa, Plasmodium falciparum
TNFTLPLPLTTYYFPHSYN

SEQ ID NO: 3296930 - protein, 40 aa, Plasmodium falciparum
TNGGNSNIFVLLKYSIYTILLWIVTITYNNYTYNGYNNDG

SEQ ID NO: 3296931 - protein, 23 aa, Plasmodium falciparum
TNGLSFVLLIRLSPILPASVVSY

SEQ ID NO: 3296932 - protein, 38 aa, Plasmodium falciparum
TNHNIFLFKEKKLDWFVFFLLKILMRKLWFDKHDDHDN

SEQ ID NO: 3296933 - protein, 24 aa, Plasmodium falciparum
TNHPYIFFHIKKYLHFHNLSTNFI

SEQ ID NO: 3296934 - protein, 33 aa, Plasmodium falciparum
TNHVDDVIIKFLLYMFYEKFINKFNKYINIHHH

SEQ ID NO: 3296935 - protein, 27 aa, Plasmodium falciparum
TNIINMCMIMYFLKAFIYRCVVRPTNI

SEQ ID NO: 3296936 - protein, 31 aa, Plasmodium falciparum
TNIINMFSNGKWIFTMPLFNPNKRKCEVSEY

SEQ ID NO: 3296937 - protein, 20 aa, Plasmodium falciparum
TNIKIYRRSLEKERMLNFPL

SEQ ID NO: 3296938 - protein, 23 aa, Plasmodium falciparum
TNIKLLMFIYYLIINCVNIFDKN

SEQ ID NO: 3296939 - protein, 24 aa, Plasmodium falciparum
TNIKNIFFEILSFELQLFESTYLC

SEQ ID NO: 3296940 - protein, 24 aa, Plasmodium falciparum
TNILDIIYNIIYPEKKNWEHINDN

SEQ ID NO: 3296941 - protein, 24 aa, Plasmodium falciparum
TNISSFILHYFYKDVQRFKEDYIC

SEQ ID NO: 3296942 - protein, 26 aa, Plasmodium falciparum
TNISYYLYFCSRFNYIPTIKYVDEYL

SEQ ID NO: 3296943 - protein, 24 aa, Plasmodium falciparum
TNIYNFIDIFTLSILTFHFNCADI

SEQ ID NO: 3296944 - protein, 31 aa, Plasmodium falciparum
TNIYNIEIFIYLLKIIILLLITNNRSSNICK

SEQ ID NO: 3296945 - protein, 23 aa, Plasmodium falciparum
TNKCRYIMGIGYIVDIIFCSLFG

SEQ ID NO: 3296946 - protein, 17 aa, Plasmodium falciparum
TNKFICDILPELKFLMF

SEQ ID NO: 3296947 - protein, 17 aa, Plasmodium falciparum
TNKFREYFFRKIQNNYN

SEQ ID NO: 3296948 - protein, 22 aa, Plasmodium falciparum
TNKHLLLLLDTNKIAYLPFSND

SEQ ID NO: 3296949 - protein, 27 aa, Plasmodium falciparum
TNKIIQSLLIILFNLIFDKMVDNDVLD

SEQ ID NO: 3296950 - protein, 22 aa, Plasmodium falciparum
TNKINLFHKWLDRHRDMCEKWE

SEQ ID NO: 3296951 - protein, 23 aa, Plasmodium falciparum
TNKINLFHKWLDRHRDMCEKWEN

SEQ ID NO: 3296952 - protein, 22 aa, Plasmodium falciparum
TNKIYTFLLEITLPIQQTQVSI

SEQ ID NO: 3296953 - protein, 22 aa, Plasmodium falciparum
TNKLLLKHAWTVRLDIESLRNE

SEQ ID NO: 3296954 - protein, 25 aa, Plasmodium falciparum
TNKMTIIIWVIQMIICLISAYYNAI

SEQ ID NO: 3296955 - protein, 27 aa, Plasmodium falciparum
TNKNNLYVYFLLLTLLRVDFNYDEKLV

SEQ ID NO: 3296956 - protein, 24 aa, Plasmodium falciparum
TNKQPFMFIFDTGSANLWVPSVNC

SEQ ID NO: 3296957 - protein, 24 aa, Plasmodium falciparum
TNKRIKYFSLISLSFEKLKIYYSK

SEQ ID NO: 3296958 - protein, 37 aa, Plasmodium falciparum
TNKRKKIFFFLFIKQECINNFLKIKLLIHKMKEKKNN

SEQ ID NO: 3296959 - protein, 26 aa, Plasmodium falciparum
TNLDYFNTILFFYFNQIYNLSKYQDG

SEQ ID NO: 3296960 - protein, 28 aa, Plasmodium falciparum
TNLDYVPQFLRWFDEWAEEFCRIKNIKI

SEQ ID NO: 3296961 - protein, 27 aa, Plasmodium falciparum
TNLDYVPQFLRWFDEWAEEFCRIRNHK

SEQ ID NO: 3296962 - protein, 25 aa, Plasmodium falciparum
TNLIDPFVLFMLSYISINMSEYVGK

SEQ ID NO: 3296963 - protein, 19 aa, Plasmodium falciparum
TNLLQNFLSFIKNFKQKDE

SEQ ID NO: 3296964 - protein, 17 aa, Plasmodium falciparum
TNLSFCVRFYKDEKYTY

SEQ ID NO: 3296965 - protein, 23 aa, Plasmodium falciparum
TNLVTLVPIYIILQSIYSIGNIW

SEQ ID NO: 3296966 - protein, 34 aa, Plasmodium falciparum
TNLYNELEMNYYGKQENWYSLKKNSRSLGENDDG

SEQ ID NO: 3296967 - protein, 18 aa, Plasmodium falciparum
TNLYYYNLNRKKNNYKII

SEQ ID NO: 3296968 - protein, 25 aa, Plasmodium falciparum
TNMDYVPQYLRWFEEWAEEFCRKRK

SEQ ID NO: 3296969 - protein, 28 aa, Plasmodium falciparum
TNMNNMIYKYLYLYKKKKSLKYKHLKEQ

SEQ ID NO: 3296970 - protein, 27 aa, Plasmodium falciparum
TNNIHIYIYIYIYIYIHKMVTERIHNK

SEQ ID NO: 3296971 - protein, 27 aa, Plasmodium falciparum
TNNKIRLFVLFLELVLCTILHTTIELN

SEQ ID NO: 3296972 - protein, 17 aa, Plasmodium falciparum
TNNLCINFYFYEIETNR

SEQ ID NO: 3296973 - protein, 22 aa, Plasmodium falciparum
TNNMILLPKYLENVRNCIYNHQ

SEQ ID NO: 3296974 - protein, 24 aa, Plasmodium falciparum
TNNSRIAILLRQLSAFYCKDTNAI

SEQ ID NO: 3296975 - protein, 23 aa, Plasmodium falciparum
TNQINLFHKWLDRHRDMCEKWKN

SEQ ID NO: 3296976 - protein, 17 aa, Plasmodium falciparum
TNRLLCECELYTPIYDD

SEQ ID NO: 3296977 - protein, 33 aa, Plasmodium falciparum
TNVCIKKELYKYFFLVLRKYNKKKYYKMLDKYI

SEQ ID NO: 3296978 - protein, 25 aa, Plasmodium falciparum
TNVGFKIPFHILINRYNINYEIYSG

SEQ ID NO: 3296979 - protein, 19 aa, Plasmodium falciparum
TNVKYLFDLIGETVQKKAK

SEQ ID NO: 3296980 - protein, 34 aa, Plasmodium falciparum
TNVTINFYVLLFLLFFNFVFIAKILISLCYSYIE

SEQ ID NO: 3296981 - protein, 29 aa, Plasmodium falciparum
TNVYIIHSYVLLNISYFLTFFFNHMVFCN

SEQ ID NO: 3296982 - protein, 25 aa, Plasmodium falciparum
TNYISMFDILNLCEDLHIIKNFINS

SEQ ID NO: 3296983 - protein, 20 aa, Plasmodium falciparum
TNYLIDISLALGISGRNNLK

SEQ ID NO: 3296984 - protein, 27 aa, Plasmodium falciparum
TNYLIDKYFCKILTFCKIKKIKQDLIN

SEQ ID NO: 3296985 - protein, 23 aa, Plasmodium falciparum
TNYLRKILDIFSTKELYLLARKY

SEQ ID NO: 3296986 - protein, 25 aa, Plasmodium falciparum
TNYLYFTFLLFLYISSNDLCSCNLK

SEQ ID NO: 3296987 - protein, 27 aa, Plasmodium falciparum
TNYPKWIMPNYWYHYFTHFTVSSGPSI

SEQ ID NO: 3296988 - protein, 20 aa, Plasmodium falciparum
TNYSYYYILNNFLKNNAPCT

SEQ ID NO: 3296989 - protein, 18 aa, Plasmodium falciparum
TPDALLEGVLEKGVLLTS

SEQ ID NO: 3296990 - protein, 26 aa, Plasmodium falciparum
TPILDDSIILKIWDWNYLSNDELIAI

SEQ ID NO: 3296991 - protein, 17 aa, Plasmodium falciparum
TPILIKIIFCMLKSNIK

SEQ ID NO: 3296992 - protein, 29 aa, Plasmodium falciparum
TPILISLYIILLFILVYNILSIINFLKLK

SEQ ID NO: 3296993 - protein, 34 aa, Plasmodium falciparum
TPIRKFLKKLYVYGLFYIFSFPIIFIICYIFDTY

SEQ ID NO: 3296994 - protein, 21 aa, Plasmodium falciparum
TPKTWWEENGPHIWNAMVCAL

SEQ ID NO: 3296995 - protein, 27 aa, Plasmodium falciparum
TPLFNLCTLVYIFTKMLMPLINACTEK

SEQ ID NO: 3296996 - protein, 27 aa, Plasmodium falciparum
TPLPHLCFVFLVISIYLQIHFLNVGLT

SEQ ID NO: 3296997 - protein, 26 aa, Plasmodium falciparum
TPLPNFVQPFNIYYIIQNYFINNNYF

SEQ ID NO: 3296998 - protein, 21 aa, Plasmodium falciparum
TPQPFRQLSDFKPSYYIRILY

SEQ ID NO: 3296999 - protein, 26 aa, Plasmodium falciparum
TPQQTLWKDFAPQIWNGMICALTYED

SEQ ID NO: 3297000 - protein, 20 aa, Plasmodium falciparum
TPQQTWWKKYGEDIWNGMIC

SEQ ID NO: 3297001 - protein, 21 aa, Plasmodium falciparum
TPQTIYIYIHIYIYIYIYICF

SEQ ID NO: 3297002 - protein, 37 aa, Plasmodium falciparum
TPRVLILIHSFLFILIVFIFLMVFFKKEPIFRFNMPS

SEQ ID NO: 3297003 - protein, 25 aa, Plasmodium falciparum
TPSDPIINQLYLYHKWIDKHRDICE

SEQ ID NO: 3297004 - protein, 30 aa, Plasmodium falciparum
TPSELKTQDFWYIYKYNPFDTSFAFRTGTE

SEQ ID NO: 3297005 - protein, 26 aa, Plasmodium falciparum
TPTHPVLDKLIYMNTIISKTNELDNK

SEQ ID NO: 3297006 - protein, 23 aa, Plasmodium falciparum
TPTLYYPFICIGKKKIINMFERY

SEQ ID NO: 3297007 - protein, 23 aa, Plasmodium falciparum
TPVGRYSFFLFSKNKKKYETVNK

SEQ ID NO: 3297008 - protein, 39 aa, Plasmodium falciparum
TPVKITPYLMFTPAVLLIVFISIILNLMNKKKPMIPVKI

SEQ ID NO: 3297009 - protein, 19 aa, Plasmodium falciparum
TPVSFVHKLFFIKNVLIHL

SEQ ID NO: 3297010 - protein, 17 aa, Plasmodium falciparum
TQDIFNPFIDIMNNLFC

SEQ ID NO: 3297011 - protein, 41 aa, Plasmodium falciparum
TQGKCRCIDFSVPTYFDYVPQYLRWFEEWAEDFCRLRKHKL

SEQ ID NO: 3297012 - protein, 19 aa, Plasmodium falciparum
TQHFRLFINNPLSNNLTAV

SEQ ID NO: 3297013 - protein, 25 aa, Plasmodium falciparum
TQHNNYILHIFYIYKQNKNYNSTNY

SEQ ID NO: 3297014 - protein, 24 aa, Plasmodium falciparum
TQIISRIFKLLNHLVSSKYFDFMP

SEQ ID NO: 3297015 - protein, 30 aa, Plasmodium falciparum
TQINEKLFKYSFLNLSLYRYMKNLENQRNK

SEQ ID NO: 3297016 - protein, 29 aa, Plasmodium falciparum
TQIYVGLPIFLIPWLLKLRNQPELFYDEQ

SEQ ID NO: 3297017 - protein, 29 aa, Plasmodium falciparum
TQKKFWFFIYFIFHINGIHYYQSVYKYNE

SEQ ID NO: 3297018 - protein, 27 aa, Plasmodium falciparum
TQKNDKLLFFFPLPCIYNKMIYKKLRV

SEQ ID NO: 3297019 - protein, 32 aa, Plasmodium falciparum
TQLQSGTIPPDFLRQMFYTLGDYRDICIGGDR

SEQ ID NO: 3297020 - protein, 34 aa, Plasmodium falciparum
TQNQNQIIIITAFVKLWVEYFFEDYKKIKHKISH

SEQ ID NO: 3297021 - protein, 26 aa, Plasmodium falciparum
TQPRIHTILSFFFPFIGCLSYLINLK

SEQ ID NO: 3297022 - protein, 27 aa, Plasmodium falciparum
TQQFFLALKILFSISAFLFMRFDSYVV

SEQ ID NO: 3297023 - protein, 25 aa, Plasmodium falciparum
TQSDLLDLYFLIISLIHDNKRFLLL

SEQ ID NO: 3297024 - protein, 22 aa, Plasmodium falciparum
TQSESLLLPPQPVPVVDNDNPQ

SEQ ID NO: 3297025 - protein, 27 aa, Plasmodium falciparum
TQTTFALLHYFLIIAFSAYEIDLPYKF

SEQ ID NO: 3297026 - protein, 57 aa, Plasmodium falciparum
TQVDDNFIFMAWEIANFYFSILYYKLDLKTILTELFKWIKLFENYPNKRFFRILKFR

SEQ ID NO: 3297027 - protein, 25 aa, Plasmodium falciparum
TQYEYLPFHLLYYNFKIVNFENSVI

SEQ ID NO: 3297028 - protein, 24 aa, Plasmodium falciparum
TRAQNIGILLRFPMSTQEIVDKIN

SEQ ID NO: 3297029 - protein, 27 aa, Plasmodium falciparum
TREDWWKEYGSQIWKGMLCALSYDNET

SEQ ID NO: 3297030 - protein, 24 aa, Plasmodium falciparum
TRFGFTHDVVLGEFLELQFLNENN

SEQ ID NO: 3297031 - protein, 22 aa, Plasmodium falciparum
TRFKPMMYIPQTSGYRLLCGCK

SEQ ID NO: 3297032 - protein, 18 aa, Plasmodium falciparum
TRILLISCLFSFIVSWNQ

SEQ ID NO: 3297033 - protein, 37 aa, Plasmodium falciparum
TRISNNFFYYNFNNFLYLYKYNYYLYYIHKNKVHINH

SEQ ID NO: 3297034 - protein, 34 aa, Plasmodium falciparum
TRKILWKIRYMPIIKAFAFLYYYGTNKYTVNIYK

SEQ ID NO: 3297035 - protein, 25 aa, Plasmodium falciparum
TRKKKEIIIYTLKKHLKNIKSNSNI

SEQ ID NO: 3297036 - protein, 18 aa, Plasmodium falciparum
TRLLCECELYAPATYDDD

SEQ ID NO: 3297037 - protein, 30 aa, Plasmodium falciparum
TRRNGLRYVLKRRTILSVFAVICMLSLNLS

SEQ ID NO: 3297038 - protein, 24 aa, Plasmodium falciparum
TRSPLFLTFKTIPPSLNQLLFVHP

SEQ ID NO: 3297039 - protein, 27 aa, Plasmodium falciparum
TRVYAFFVLNLLGFYPEIQKSLLLSSH

SEQ ID NO: 3297040 - protein, 24 aa, Plasmodium falciparum
TRYTSLYIHKFFKSVTLLKGNFLY

SEQ ID NO: 3297041 - protein, 27 aa, Plasmodium falciparum
TSCFGLIFLYEFMRYILKIDKSILFYS

SEQ ID NO: 3297042 - protein, 35 aa, Plasmodium falciparum
TSCIYPQWKTIFRLYYYLLLLKKIEKKKKKCLTFS

SEQ ID NO: 3297043 - protein, 40 aa, Plasmodium falciparum
TSDILKTTIPFGIALALTSIAFLFLKKKTHAPLDLFSVID

SEQ ID NO: 3297044 - protein, 38 aa, Plasmodium falciparum
TSDILKTTIPFGIALALTSIALLFLKKKPKSPVDLIRV

SEQ ID NO: 3297045 - protein, 39 aa, Plasmodium falciparum
TSDILKTTIPFGIALALTSIALLFLKKKTKHPVDLFSVI

SEQ ID NO: 3297046 - protein, 38 aa, Plasmodium falciparum
TSDILKTTIPFGIALALTSIALLFLKKKTKSTIDLLRV

SEQ ID NO: 3297047 - protein, 38 aa, Plasmodium falciparum
TSDILKTTIPFGIALALTSIVFLYLKKKTKSTIDLLRV

SEQ ID NO: 3297048 - protein, 17 aa, Plasmodium falciparum
TSDLIYERLRTKVLWYI

SEQ ID NO: 3297049 - protein, 38 aa, Plasmodium falciparum
TSECFNAFFNFIKYIEFYYLYKGGCTKIFNIVPSIEEC

SEQ ID NO: 3297050 - protein, 19 aa, Plasmodium falciparum
TSENYFLNRNFLSSQKPDS

SEQ ID NO: 3297051 - protein, 23 aa, Plasmodium falciparum
TSFFIDIELEKMLSFIITKSGQK

SEQ ID NO: 3297052 - protein, 31 aa, Plasmodium falciparum
TSFHAKNITLIFGIIYVALLGVYICASQYKQ

SEQ ID NO: 3297053 - protein, 19 aa, Plasmodium falciparum
TSFLIKKKLALKQLSILFC

SEQ ID NO: 3297054 - protein, 29 aa, Plasmodium falciparum
TSFNKNMIWIIPILSYHFNKPLNVLYMKD

SEQ ID NO: 3297055 - protein, 27 aa, Plasmodium falciparum
TSFVVNTLIISVFLYSVYTLAPNETIS

SEQ ID NO: 3297056 - protein, 18 aa, Plasmodium falciparum
TSFWWGYNASICNFLSFS

SEQ ID NO: 3297057 - protein, 35 aa, Plasmodium falciparum
TSGNDMLNLLFPYPKKYLLLWHEDYSLKNVNECLH

SEQ ID NO: 3297058 - protein, 27 aa, Plasmodium falciparum
TSGYFIDILYELYINKKISLISIDEVH

SEQ ID NO: 3297059 - protein, 27 aa, Plasmodium falciparum
TSHKFLKIFLFLLISLFLMNIITVWDF

SEQ ID NO: 3297060 - protein, 25 aa, Plasmodium falciparum
TSHKKFFIYLVENIHIYILFKKIHQ

SEQ ID NO: 3297061 - protein, 26 aa, Plasmodium falciparum
TSHSFLDDDFFFYNPKDIQDNINHDN

SEQ ID NO: 3297062 - protein, 22 aa, Plasmodium falciparum
TSHWIIGLYIYAALIEDMHPQC

SEQ ID NO: 3297063 - protein, 23 aa, Plasmodium falciparum
TSIAMSRLPFSNYLDIDMCPKYG

SEQ ID NO: 3297064 - protein, 25 aa, Plasmodium falciparum
TSICNSFIYIITKYCFYIFDNKDFS

SEQ ID NO: 3297065 - protein, 30 aa, Plasmodium falciparum
TSICPTFSHILFLLISILYVENYNILYIKK

SEQ ID NO: 3297066 - protein, 26 aa, Plasmodium falciparum
TSIEEYYLLLCATKLVWRIVMENIKH

SEQ ID NO: 3297067 - protein, 28 aa, Plasmodium falciparum
TSIESVFDFFFTLYFYQTNDLNNTIVLP

SEQ ID NO: 3297068 - protein, 32 aa, Plasmodium falciparum
TSIIIIILVIVLIIFIYFLIKKSEILENERVQ

SEQ ID NO: 3297069 - protein, 22 aa, Plasmodium falciparum
TSIIIWLSIKYICSMITSIVDF

SEQ ID NO: 3297070 - protein, 37 aa, Plasmodium falciparum
TSIIPRFLNYHDYKLLKVFFFMLQNSSNKFISKNIHL

SEQ ID NO: 3297071 - protein, 18 aa, Plasmodium falciparum
TSILAVCLVIFCIGFLIG

SEQ ID NO: 3297072 - protein, 30 aa, Plasmodium falciparum
TSILFYIYIVLFLSYVIFLFGYTKNIFSRI

SEQ ID NO: 3297073 - protein, 22 aa, Plasmodium falciparum
TSIWIELCLFLSKNFNIYGSKF

SEQ ID NO: 3297074 - protein, 30 aa, Plasmodium falciparum
TSKLKGVNFIKYKKAWCFTYVDVDDKKKKK

SEQ ID NO: 3297075 - protein, 44 aa, Plasmodium falciparum
TSKLQIIFSLIVGFMLFPTFKEYGFLKYVLFALSVGFSVIVINI

SEQ ID NO: 3297076 - protein, 20 aa, Plasmodium falciparum
TSLFFKNDLIEWNNSGVKNK

SEQ ID NO: 3297077 - protein, 35 aa, Plasmodium falciparum
TSLFGLIMNGNRLPIFLGIDVCRLVYWCCVVYILQ

SEQ ID NO: 3297078 - protein, 21 aa, Plasmodium falciparum
TSLHFLHSISFILKKFNNNNF

SEQ ID NO: 3297079 - protein, 20 aa, Plasmodium falciparum
TSLHIFYDDIYFYYRNYDDH

SEQ ID NO: 3297080 - protein, 29 aa, Plasmodium falciparum
TSLHYITVTLCMYLPNLNMNLLENDLLSV

SEQ ID NO: 3297081 - protein, 23 aa, Plasmodium falciparum
TSLIVTLIYYIFISVREDINKKV

SEQ ID NO: 3297082 - protein, 34 aa, Plasmodium falciparum
TSLKNGTIPLPFLRQMFYTLADYKDILFSGDKDD

SEQ ID NO: 3297083 - protein, 20 aa, Plasmodium falciparum
TSLLLLFNEIVKINIELLRN

SEQ ID NO: 3297084 - protein, 25 aa, Plasmodium falciparum
TSLLNFFFLFFINHISFLIKHKKKF

SEQ ID NO: 3297085 - protein, 30 aa, Plasmodium falciparum
TSLNNLFVHYILNNYFFFHSKSMYMLKKRK

SEQ ID NO: 3297086 - protein, 19 aa, Plasmodium falciparum
TSLSLFFFILSVLTINCFS

SEQ ID NO: 3297087 - protein, 24 aa, Plasmodium falciparum
TSNKIKIIILQPSILKVYYENIKK

SEQ ID NO: 3297088 - protein, 24 aa, Plasmodium falciparum
TSNNILYVIDLLKKYNTNHNILKK

SEQ ID NO: 3297089 - protein, 45 aa, Plasmodium falciparum
TSNSIFLEELLYFLKYHKYVHFNTLRIIFDLLITSIESHLYYKVV

SEQ ID NO: 3297090 - protein, 23 aa, Plasmodium falciparum
TSNTIGVNFFFLSSLETAIKTGA

SEQ ID NO: 3297091 - protein, 24 aa, Plasmodium falciparum
TSNYFLYFLIVILTASLIFFIMIL

SEQ ID NO: 3297092 - protein, 23 aa, Plasmodium falciparum
TSQSNMPWVFEPEQKYIIVKPGE

SEQ ID NO: 3297093 - protein, 23 aa, Plasmodium falciparum
TSQYFIWCIPFLPIILCAITLSK

SEQ ID NO: 3297094 - protein, 18 aa, Plasmodium falciparum
TSTHNLLVDVLLAAKYEG

SEQ ID NO: 3297095 - protein, 27 aa, Plasmodium falciparum
TSTPLTWYTLLYFIKNIDFLRSKYSLK

SEQ ID NO: 3297096 - protein, 24 aa, Plasmodium falciparum
TSVDMEIVPPYMPDLIITESPTNT

SEQ ID NO: 3297097 - protein, 22 aa, Plasmodium falciparum
TSVVLTQLFYLIKSLWSVNPLL

SEQ ID NO: 3297098 - protein, 27 aa, Plasmodium falciparum
TSWIKNFIHFNGLKILMTFTNLPCFPP

SEQ ID NO: 3297099 - protein, 29 aa, Plasmodium falciparum
TSYAYLNLAYYYLIKKKNFIYAYKILYKA

SEQ ID NO: 3297100 - protein, 30 aa, Plasmodium falciparum
TSYDIIRYNNDYFWKWIRVLNYEIKNELWN

SEQ ID NO: 3297101 - protein, 30 aa, Plasmodium falciparum
TSYNYIENIIKLLFNYIFNLNEDYLDYDTT

SEQ ID NO: 3297102 - protein, 21 aa, Plasmodium falciparum
TSYVSLLPVLELHFSCSYKSM

SEQ ID NO: 3297103 - protein, 18 aa, Plasmodium falciparum
TTAFLTFAYVYNGSIMDS

SEQ ID NO: 3297104 - protein, 24 aa, Plasmodium falciparum
TTATIIVHLFKEKKLYVAYVGDSR

SEQ ID NO: 3297105 - protein, 20 aa, Plasmodium falciparum
TTCRAIRYSFADIGDIIRGK

SEQ ID NO: 3297106 - protein, 25 aa, Plasmodium falciparum
TTDKFIINIIIKKILSLLLNYTFLE

SEQ ID NO: 3297107 - protein, 25 aa, Plasmodium falciparum
TTDSTVLLIPWYVAFNLISTYCKES

SEQ ID NO: 3297108 - protein, 26 aa, Plasmodium falciparum
TTESSNINYTPYIEKNNLSLKTDKIY

SEQ ID NO: 3297109 - protein, 23 aa, Plasmodium falciparum
TTETYLFFHISFDIIKYNNQYLK

SEQ ID NO: 3297110 - protein, 17 aa, Plasmodium falciparum
TTFILFLISYCFQPLLI

SEQ ID NO: 3297111 - protein, 22 aa, Plasmodium falciparum
TTFKLYNFYCACRNFSPSFLFA

SEQ ID NO: 3297112 - protein, 18 aa, Plasmodium falciparum
TTFPWPIKFVFKSSLLKV

SEQ ID NO: 3297113 - protein, 27 aa, Plasmodium falciparum
TTICLYYLILKFFYNCEFIFKEDIERE

SEQ ID NO: 3297114 - protein, 38 aa, Plasmodium falciparum
TTIGYSVLAILIIVLIMVIIYLILRYRRKKKMKKKLQY

SEQ ID NO: 3297115 - protein, 27 aa, Plasmodium falciparum
TTIIKFSIFFYILYKYADYPNHIKKFF

SEQ ID NO: 3297116 - protein, 23 aa, Plasmodium falciparum
TTINNIILLLYGIKNMYPYRYIS

SEQ ID NO: 3297117 - protein, 29 aa, Plasmodium falciparum
TTIPVDLSLFFIFRKEYLKSVLITISQNF

SEQ ID NO: 3297118 - protein, 24 aa, Plasmodium falciparum
TTISVIFHIFVSAGLFFNKHIMII

SEQ ID NO: 3297119 - protein, 22 aa, Plasmodium falciparum
TTKDKLIIGHYRKLSILNYIQN

SEQ ID NO: 3297120 - protein, 17 aa, Plasmodium falciparum
TTKYNLSLLLHLKIYLT

SEQ ID NO: 3297121 - protein, 29 aa, Plasmodium falciparum
TTLDSFVKRPTYFRYLEEWGETFCRERKK

SEQ ID NO: 3297122 - protein, 26 aa, Plasmodium falciparum
TTLIYFYKMFTVNEYVYILLNINEHF

SEQ ID NO: 3297123 - protein, 33 aa, Plasmodium falciparum
TTLNNPKLSDFVLRPPYFRYLEEWGQNFCKERK

SEQ ID NO: 3297124 - protein, 23 aa, Plasmodium falciparum
TTNDILCNIIIRSLFLLHYDENK

SEQ ID NO: 3297125 - protein, 29 aa, Plasmodium falciparum
TTNKNLIRLKSVLLLIEIVMSFYSFFIRW

SEQ ID NO: 3297126 - protein, 24 aa, Plasmodium falciparum
TTNRYYNALPSFLKAHNITLKHIQ

SEQ ID NO: 3297127 - protein, 27 aa, Plasmodium falciparum
TTNYYQLREDWWYANRATVWEAITCDV

SEQ ID NO: 3297128 - protein, 17 aa, Plasmodium falciparum
TTPYRLGIYAFNIRPND

SEQ ID NO: 3297129 - protein, 19 aa, Plasmodium falciparum
TTPYYTPIIVSIVAIVVII

SEQ ID NO: 3297130 - protein, 20 aa, Plasmodium falciparum
TTQISLLLILCLYPNVDKYV

SEQ ID NO: 3297131 - protein, 39 aa, Plasmodium falciparum
TTSKTFVHLFCVIFFISNVFCYNIYNMNYWNVNQLKDYE

SEQ ID NO: 3297132 - protein, 24 aa, Plasmodium falciparum
TTSRLICLLLKCFKYKESALLIGE

SEQ ID NO: 3297133 - protein, 32 aa, Plasmodium falciparum
TTTWIDNYIFLIYFLNNELIFLSFAKPCRNLY

SEQ ID NO: 3297134 - protein, 24 aa, Plasmodium falciparum
TTVPINHVMNFPNSYMSGANMPSQ

SEQ ID NO: 3297135 - protein, 25 aa, Plasmodium falciparum
TTVQYVTFPLFLKNYDLLISSFKSS

SEQ ID NO: 3297136 - protein, 24 aa, Plasmodium falciparum
TTYNNVVFFITYSPPNIYKDFKKV

SEQ ID NO: 3297137 - protein, 18 aa, Plasmodium falciparum
TVDLIRVLNIPKRDYEMP

SEQ ID NO: 3297138 - protein, 26 aa, Plasmodium falciparum
TVEKDVINLFKKYILIHIYNINKIHD

SEQ ID NO: 3297139 - protein, 23 aa, Plasmodium falciparum
TVEMILRHFLMQCGFMEYVCRFV

SEQ ID NO: 3297140 - protein, 32 aa, Plasmodium falciparum
TVGFISFFLIYIKYVLQILIYIDNNFRTNKML

SEQ ID NO: 3297141 - protein, 28 aa, Plasmodium falciparum
TVINEFNVLLELQLCILDMLCKKNKILK

SEQ ID NO: 3297142 - protein, 24 aa, Plasmodium falciparum
TVKNKELLLYIKSLKLKKNNNVYS

SEQ ID NO: 3297143 - protein, 18 aa, Plasmodium falciparum
TVLARSFADIGDIIRGRD

SEQ ID NO: 3297144 - protein, 18 aa, Plasmodium falciparum
TVLARSFADIGDIVRGRD

SEQ ID NO: 3297145 - protein, 17 aa, Plasmodium falciparum
TVLIENGFFLKSAAKRK

SEQ ID NO: 3297146 - protein, 28 aa, Plasmodium falciparum
TVLIQYLQFSWIFKNHFFKKLYNDRDVS

SEQ ID NO: 3297147 - protein, 27 aa, Plasmodium falciparum
TVLPNKYFLTFFLSSIPYHDNVIIQTR

SEQ ID NO: 3297148 - protein, 25 aa, Plasmodium falciparum
TVLYDIFPNITFPNYIFVNTKDIVI

SEQ ID NO: 3297149 - protein, 25 aa, Plasmodium falciparum
TVMNILKNIIKFIFLATTRSYDVDV

SEQ ID NO: 3297150 - protein, 21 aa, Plasmodium falciparum
TVPYIRIPLILEFFCDKNRIK

SEQ ID NO: 3297151 - protein, 28 aa, Plasmodium falciparum
TVQIVGKKILWFANNILIFCKDFSYEMK

SEQ ID NO: 3297152 - protein, 19 aa, Plasmodium falciparum
TVRKHMHSFFIKPSLLKDS

SEQ ID NO: 3297153 - protein, 30 aa, Plasmodium falciparum
TVRLLIWGFFIPFLYFLYKNEIKKYYVNRT

SEQ ID NO: 3297154 - protein, 22 aa, Plasmodium falciparum
TVSSYAYEYLNKSLKKLCPDGS

SEQ ID NO: 3297155 - protein, 34 aa, Plasmodium falciparum
TVTPLVDYIPQRLRWMMEWAEWYCKYQSKAYSEL

SEQ ID NO: 3297156 - protein, 32 aa, Plasmodium falciparum
TVTPLVDYIPQRLRWMTEWAEWFCKMQSQEYE

SEQ ID NO: 3297157 - protein, 20 aa, Plasmodium falciparum
TVVFFADFFWVIFLSWCANK

SEQ ID NO: 3297158 - protein, 19 aa, Plasmodium falciparum
TVVTNYWYPSPIKKYYTLY

SEQ ID NO: 3297159 - protein, 24 aa, Plasmodium falciparum
TVYKIPCNNAILINKIYRELHNSK

SEQ ID NO: 3297160 - protein, 24 aa, Plasmodium falciparum
TVYLSFYLIIKIIVFIFSYVLENK

SEQ ID NO: 3297161 - protein, 25 aa, Plasmodium falciparum
TWCNNDLMCLPAILTKPYECYEDSS

SEQ ID NO: 3297162 - protein, 22 aa, Plasmodium falciparum
TWEKHYIINCLLILYIEEGNNE

SEQ ID NO: 3297163 - protein, 25 aa, Plasmodium falciparum
TWKVGIACSVLFPPLWNYNERRKAK

SEQ ID NO: 3297164 - protein, 18 aa, Plasmodium falciparum
TWLSPFIVIFVNSIIQPA

SEQ ID NO: 3297165 - protein, 19 aa, Plasmodium falciparum
TWNNNFFHINNIHNYTFEG

SEQ ID NO: 3297166 - protein, 36 aa, Plasmodium falciparum
TYCAPPYDLMFCQCLLNFIYSVLKKEGIYYKDEFKK

SEQ ID NO: 3297167 - protein, 30 aa, Plasmodium falciparum
TYCDRHVSLINILVNMFKIYNKKKTYLNVT

SEQ ID NO: 3297168 - protein, 26 aa, Plasmodium falciparum
TYCKIMLMIIMLISLRTRCDTNNFLN

SEQ ID NO: 3297169 - protein, 19 aa, Plasmodium falciparum
TYCSSAFCFVIAPDYHKVL

SEQ ID NO: 3297170 - protein, 17 aa, Plasmodium falciparum
TYDFNIALFFYYTNERQ

SEQ ID NO: 3297171 - protein, 20 aa, Plasmodium falciparum
TYDIILAFSVIKWIHLNNGD

SEQ ID NO: 3297172 - protein, 19 aa, Plasmodium falciparum
TYDNFIEKIKLHENKELTL

SEQ ID NO: 3297173 - protein, 24 aa, Plasmodium falciparum
TYDPTLACIVPLDSIYLRSLCESV

SEQ ID NO: 3297174 - protein, 22 aa, Plasmodium falciparum
TYDSFYFLMEIKKIYSCDGFFD

SEQ ID NO: 3297175 - protein, 33 aa, Plasmodium falciparum
TYDVISLYCVYIMNLYYAYIMYKRNIVTLYVYI

SEQ ID NO: 3297176 - protein, 20 aa, Plasmodium falciparum
TYEEFIYHLDLYKKHIFDIF

SEQ ID NO: 3297177 - protein, 30 aa, Plasmodium falciparum
TYEELICFYFLIILLLVHIIGTFLNYLVPY

SEQ ID NO: 3297178 - protein, 26 aa, Plasmodium falciparum
TYEKNLLFFERIIKMYMELLGEYKKA

SEQ ID NO: 3297179 - protein, 27 aa, Plasmodium falciparum
TYEKRIYYIFFYRLYKNFGSVLNSSNK

SEQ ID NO: 3297180 - protein, 29 aa, Plasmodium falciparum
TYELYQKYLIILLYIFKLIEYSQNHDIKP

SEQ ID NO: 3297181 - protein, 22 aa, Plasmodium falciparum
TYEYYYNIFINLLKTVKHQDQI

SEQ ID NO: 3297182 - protein, 29 aa, Plasmodium falciparum
TYFDMSLFSFYKLYLLKKYDSNTLFNVYE

SEQ ID NO: 3297183 - protein, 24 aa, Plasmodium falciparum
TYFLSLKHIIIVIINIIMITHQFN

SEQ ID NO: 3297184 - protein, 21 aa, Plasmodium falciparum
TYFNMYMKYHHEWILNKKEII

SEQ ID NO: 3297185 - protein, 21 aa, Plasmodium falciparum
TYFYLTKLVLSLQNKLNFPII

SEQ ID NO: 3297186 - protein, 25 aa, Plasmodium falciparum
TYGQFQFLFLFLGSIVLTISPILLF

SEQ ID NO: 3297187 - protein, 18 aa, Plasmodium falciparum
TYIFIFPEELEKENYFSP

SEQ ID NO: 3297188 - protein, 20 aa, Plasmodium falciparum
TYIKQFLSSLYYNNTDEFVE

SEQ ID NO: 3297189 - protein, 26 aa, Plasmodium falciparum
TYILQYIKDLLNILSIFVIYDISLKD

SEQ ID NO: 3297190 - protein, 22 aa, Plasmodium falciparum
TYILSAYIPYIYMSVRDIYIVL

SEQ ID NO: 3297191 - protein, 19 aa, Plasmodium falciparum
TYILYYWSRINEGTLINCF

SEQ ID NO: 3297192 - protein, 26 aa, Plasmodium falciparum
TYIMKRLYSFDLSYLLNLFSTDSTYN

SEQ ID NO: 3297193 - protein, 35 aa, Plasmodium falciparum
TYIPSFLNYKLIQAFLLFFKYSWFCKILVCETCDV

SEQ ID NO: 3297194 - protein, 33 aa, Plasmodium falciparum
TYIQKNPLIKYILIFLKMFLYQHDLNDASKGGI

SEQ ID NO: 3297195 - protein, 24 aa, Plasmodium falciparum
TYITHLFNLFIWKIKMEKNIKKGI

SEQ ID NO: 3297196 - protein, 24 aa, Plasmodium falciparum
TYKDIKYLFLYIEFDNKSVKHFFE

SEQ ID NO: 3297197 - protein, 35 aa, Plasmodium falciparum
TYKTLYELLFLPPMKIFIILFLINRLPFASVEVGT

SEQ ID NO: 3297198 - protein, 24 aa, Plasmodium falciparum
TYKYYLMKIIIDVYLLNISYLCNY

SEQ ID NO: 3297199 - protein, 26 aa, Plasmodium falciparum
TYLFSFFFFILYYYNSYIIFVLFVFF

SEQ ID NO: 3297200 - protein, 26 aa, Plasmodium falciparum
TYLGVFSSSFRIKLWKHLWLEHIKNS

SEQ ID NO: 3297201 - protein, 33 aa, Plasmodium falciparum
TYLIRSSIILLIFSNLFFCKFINFVHNKSHTIE

SEQ ID NO: 3297202 - protein, 28 aa, Plasmodium falciparum
TYLKSLNLILYLRISPELFLKKLIVSGI

SEQ ID NO: 3297203 - protein, 34 aa, Plasmodium falciparum
TYLLKNIYRIHISKFFYIFVALSKFFLMNSYQQS

SEQ ID NO: 3297204 - protein, 18 aa, Plasmodium falciparum
TYLNVPLCILNYNGFLFL

SEQ ID NO: 3297205 - protein, 26 aa, Plasmodium falciparum
TYLSEIYNILFFYKMYKECVHILLLC

SEQ ID NO: 3297206 - protein, 20 aa, Plasmodium falciparum
TYMFFIVISFVVVVLIALFI

SEQ ID NO: 3297207 - protein, 25 aa, Plasmodium falciparum
TYNDFFNFWVAHMLKDSIHWRTKKI

SEQ ID NO: 3297208 - protein, 25 aa, Plasmodium falciparum
TYNKDFYKIFIKPSDIWIKKKKSIS

SEQ ID NO: 3297209 - protein, 25 aa, Plasmodium falciparum
TYNKNILLYIYELTYKGYFNEKFLS

SEQ ID NO: 3297210 - protein, 21 aa, Plasmodium falciparum
TYNMIWGFNKIPTYIYNMLLI

SEQ ID NO: 3297211 - protein, 23 aa, Plasmodium falciparum
TYNNFIYAIHLYTGLILYKIDTN

SEQ ID NO: 3297212 - protein, 24 aa, Plasmodium falciparum
TYNNKICLLFIYISCSIVSQTYKH

SEQ ID NO: 3297213 - protein, 43 aa, Plasmodium falciparum
TYNWYTTISYSITAILIIVLIMVIIYLILRYRRKKKMKKKLQY

SEQ ID NO: 3297214 - protein, 18 aa, Plasmodium falciparum
TYQYEYYFYEWNQEYKQI

SEQ ID NO: 3297215 - protein, 28 aa, Plasmodium falciparum
TYRLTQLYFYITVTIQMIQIFKSIHLYI

SEQ ID NO: 3297216 - protein, 29 aa, Plasmodium falciparum
TYSHNIPKKHLYYLDLNKLEILKLCSNKL

SEQ ID NO: 3297217 - protein, 29 aa, Plasmodium falciparum
TYSIFDKLYNFFFVFKKSGAPISPVSVKE

SEQ ID NO: 3297218 - protein, 26 aa, Plasmodium falciparum
TYTALYPAFILLIFIIHIVARYFPDM

SEQ ID NO: 3297219 - protein, 28 aa, Plasmodium falciparum
TYTLILLHIFVYFLWNIAEPSRNSYNYY

SEQ ID NO: 3297220 - protein, 31 aa, Plasmodium falciparum
TYTQPMHIMSLPAATAYFLCKIKLSMSSSGS

SEQ ID NO: 3297221 - protein, 24 aa, Plasmodium falciparum
TYVLLFLSYLFIKYRDTYLFLRET

SEQ ID NO: 3297222 - protein, 22 aa, Plasmodium falciparum
TYVNVLLLSLFFTFIHKYLDQT

SEQ ID NO: 3297223 - protein, 19 aa, Plasmodium falciparum
TYVYNFFKTFFVTLISISS

SEQ ID NO: 3297224 - protein, 22 aa, Plasmodium falciparum
TYYAYFLIQYIIKKQTFFFDNN

SEQ ID NO: 3297225 - protein, 24 aa, Plasmodium falciparum
TYYDYKLYICACFKYYYTNDLVIC

SEQ ID NO: 3297226 - protein, 24 aa, Plasmodium falciparum
TYYEDIHVLLFYKLSREMLCNQYI

SEQ ID NO: 3297227 - protein, 19 aa, Plasmodium falciparum
TYYEQSKNYFYFKNKKDNF

SEQ ID NO: 3297228 - protein, 26 aa, Plasmodium falciparum
VACAYLSEHYPGLTPKLYKVLYEPEC

SEQ ID NO: 3297229 - protein, 24 aa, Plasmodium falciparum
VACDPFVHWIDNEKLEFLKQKKKY

SEQ ID NO: 3297230 - protein, 24 aa, Plasmodium falciparum
VADYYLNITFYYIKDNFNNYYMSS

SEQ ID NO: 3297231 - protein, 17 aa, Plasmodium falciparum
VAFIMRIICYHSVYLPI

SEQ ID NO: 3297232 - protein, 18 aa, Plasmodium falciparum
VAHKKREKSISPHSYQKV

SEQ ID NO: 3297233 - protein, 28 aa, Plasmodium falciparum
VAIAVILLIIYLILRYRRKKKMKKKLQY

SEQ ID NO: 3297234 - protein, 31 aa, Plasmodium falciparum
VAILVIVLVMVIIYLILRYRRKKKMNKKQQY

SEQ ID NO: 3297235 - protein, 19 aa, Plasmodium falciparum
VAINIWKPAALKAAIKTAI

SEQ ID NO: 3297236 - protein, 28 aa, Plasmodium falciparum
VAIVIIVLIMVIIYKILRYRRKKKMKKK

SEQ ID NO: 3297237 - protein, 31 aa, Plasmodium falciparum
VAIVLIVLIMVIIYKILRYRRKRKMKKKLQY

SEQ ID NO: 3297238 - protein, 31 aa, Plasmodium falciparum
VAIVVIVLIMIIIYLILRYRRKKKMKKKLQY

SEQ ID NO: 3297239 - protein, 29 aa, Plasmodium falciparum
VAIVVIVLIMVIIYKILRYRRKKKMKKKL

SEQ ID NO: 3297240 - protein, 31 aa, Plasmodium falciparum
VAIVVIVLVMIIIYLVLRYRRKKKMKKKLEY

SEQ ID NO: 3297241 - protein, 18 aa, Plasmodium falciparum
VAKIPFPLTYKFKSTLQM

SEQ ID NO: 3297242 - protein, 26 aa, Plasmodium falciparum
VAKSHFNYFIIKDISFFILKELIHHK

SEQ ID NO: 3297243 - protein, 31 aa, Plasmodium falciparum
VALLIIALVMIIIYLVLRYRRKKKMNKKAHY

SEQ ID NO: 3297244 - protein, 26 aa, Plasmodium falciparum
VALNIIKMILLNKKFTQFYKYIINID

SEQ ID NO: 3297245 - protein, 28 aa, Plasmodium falciparum
VAMKYACRHMLKKYLLFRPNNYKEKNYN

SEQ ID NO: 3297246 - protein, 29 aa, Plasmodium falciparum
VAMVLMTVWQRFFWTIYATRRIDFGKIKY

SEQ ID NO: 3297247 - protein, 23 aa, Plasmodium falciparum
VAPGWGLVGGLWYATWSQYVTKT

SEQ ID NO: 3297248 - protein, 26 aa, Plasmodium falciparum
VAPIWGLVSGLWYATWSQYVSAKVLE

SEQ ID NO: 3297249 - protein, 29 aa, Plasmodium falciparum
VAPVWGLVSGLWYVKWSQYVPVAVTKAGI

SEQ ID NO: 3297250 - protein, 22 aa, Plasmodium falciparum
VAQYLAFFPFSLARFRYLVDRI

SEQ ID NO: 3297251 - protein, 24 aa, Plasmodium falciparum
VATLILSYKYNLLNQLILNNIIDI

SEQ ID NO: 3297252 - protein, 25 aa, Plasmodium falciparum
VATQLCEPFKLWNKLDTKRQELMLN

SEQ ID NO: 3297253 - protein, 26 aa, Plasmodium falciparum
VAVLATILMVYLYKRKGNAEKYDKMD

SEQ ID NO: 3297254 - protein, 32 aa, Plasmodium falciparum
VAVVVIILIMVIIYLILRYRRKKKMKKKLQYI

SEQ ID NO: 3297255 - protein, 24 aa, Plasmodium falciparum
VCANDYCQIPFNLKIRANELDVLK

SEQ ID NO: 3297256 - protein, 22 aa, Plasmodium falciparum
VCCYVPVFYKNISLTYRNIYKC

SEQ ID NO: 3297257 - protein, 33 aa, Plasmodium falciparum
VCDKFGYISFFLLNYFLTPFLISLNKFKKEENK

SEQ ID NO: 3297258 - protein, 30 aa, Plasmodium falciparum
VCETLQLTYFFFFLLWKDTYELYNNIIKRF

SEQ ID NO: 3297259 - protein, 25 aa, Plasmodium falciparum
VCFHFIIFHYFFYYGIDNYQNLTIY

SEQ ID NO: 3297260 - protein, 19 aa, Plasmodium falciparum
VCFHFVVRALTYPGSLFIY

SEQ ID NO: 3297261 - protein, 19 aa, Plasmodium falciparum
VCFKIRYYEIPLTVFKKVD

SEQ ID NO: 3297262 - protein, 27 aa, Plasmodium falciparum
VCIKYNIYYIYIYFNQDIINNNSSNVL

SEQ ID NO: 3297263 - protein, 29 aa, Plasmodium falciparum
VCINMFVYIINILFMIKKRNGTFFSLYFF

SEQ ID NO: 3297264 - protein, 34 aa, Plasmodium falciparum
VCKYPIHLLELIFLTLFHPLLIRFEINNFIDKRN

SEQ ID NO: 3297265 - protein, 19 aa, Plasmodium falciparum
VCLLAIYISKLESDLFLYI

SEQ ID NO: 3297266 - protein, 24 aa, Plasmodium falciparum
VCNSTFIRIRYQRILIQTEELSPT

SEQ ID NO: 3297267 - protein, 34 aa, Plasmodium falciparum
VCPKYMVTSGFLNYIYFKIMTPLHKADVNQAIQI

SEQ ID NO: 3297268 - protein, 20 aa, Plasmodium falciparum
VCRDIQFIFYDFRDIIQGTD

SEQ ID NO: 3297269 - protein, 17 aa, Plasmodium falciparum
VCSFLFYCVKNNKFDCL

SEQ ID NO: 3297270 - protein, 24 aa, Plasmodium falciparum
VCSGIFFFSIIGLVLYVFSLILIF

SEQ ID NO: 3297271 - protein, 26 aa, Plasmodium falciparum
VCSKLNIIYIPLFASLSIVFINKINL

SEQ ID NO: 3297272 - protein, 29 aa, Plasmodium falciparum
VCSLPFHLLLMILSPIKKKSYIFNKIKLG

SEQ ID NO: 3297273 - protein, 29 aa, Plasmodium falciparum
VCSSIIYSFFLFIWYSLKTNLIGKKKDDP

SEQ ID NO: 3297274 - protein, 25 aa, Plasmodium falciparum
VCVPPRRRKLYIHDLQSLGVEVDKA

SEQ ID NO: 3297275 - protein, 29 aa, Plasmodium falciparum
VDDCHGMFLLILLFFMNTPQKIKCKHTYI

SEQ ID NO: 3297276 - protein, 33 aa, Plasmodium falciparum
VDFCGFFGSILFILCMVSLICITLLNVWTSYEF

SEQ ID NO: 3297277 - protein, 18 aa, Plasmodium falciparum
VDFMLSLKNILYNYSLEK

SEQ ID NO: 3297278 - protein, 18 aa, Plasmodium falciparum
VDFVLIHPSGSMAFICAL

SEQ ID NO: 3297279 - protein, 18 aa, Plasmodium falciparum
VDGNRYVWRNLLKHLEIA

SEQ ID NO: 3297280 - protein, 24 aa, Plasmodium falciparum
VDHLIINMFGYTIGFVIYPNIEMR

SEQ ID NO: 3297281 - protein, 20 aa, Plasmodium falciparum
VDICYVIHMLKHLCALNYKD

SEQ ID NO: 3297282 - protein, 31 aa, Plasmodium falciparum
VDIDTEFLILYNRYLFYFRTLEQINEFVKNP

SEQ ID NO: 3297283 - protein, 25 aa, Plasmodium falciparum
VDIEKISPIFILQKVLNLICRVIHK

SEQ ID NO: 3297284 - protein, 17 aa, Plasmodium falciparum
VDIFSMLYFCYMERIYD

SEQ ID NO: 3297285 - protein, 23 aa, Plasmodium falciparum
VDIIYFSIIISVFIYIIVEYMFD

SEQ ID NO: 3297286 - protein, 35 aa, Plasmodium falciparum
VDISYLRYHEITLKDIIYFIYRNYKSELNKSVRSN

SEQ ID NO: 3297287 - protein, 24 aa, Plasmodium falciparum
VDKILIFLKYIYYAYDHKIIFNEH

SEQ ID NO: 3297288 - protein, 24 aa, Plasmodium falciparum
VDKKIILYLLSIIKEHIKNKITWN

SEQ ID NO: 3297289 - protein, 24 aa, Plasmodium falciparum
VDNTILIEYILKNINKKWTLLINY

SEQ ID NO: 3297290 - protein, 25 aa, Plasmodium falciparum
VDNYIYHIILILTFHLFCLFLRIAP

SEQ ID NO: 3297291 - protein, 30 aa, Plasmodium falciparum
VDPPTYFDYVPQYLRWFEEWAEDFCRKKNK

SEQ ID NO: 3297292 - protein, 37 aa, Plasmodium falciparum
VDRNLSFKFHYFFTRKFWLIYLSLAFIVLPGGFGTLD

SEQ ID NO: 3297293 - protein, 17 aa, Plasmodium falciparum
VDSARVPILTLKKNKIV

SEQ ID NO: 3297294 - protein, 35 aa, Plasmodium falciparum
VDSCYSFWMGSIFFLIYEIYILKSILFNKGDITKN

SEQ ID NO: 3297295 - protein, 22 aa, Plasmodium falciparum
VDSFYIKNYFILKNTFSLITLD

SEQ ID NO: 3297296 - protein, 26 aa, Plasmodium falciparum
VDSFYTYMFIYYHKFKHYQSICRYSY

SEQ ID NO: 3297297 - protein, 22 aa, Plasmodium falciparum
VDTHLLFLMNNLLLLQRNTFYS

SEQ ID NO: 3297298 - protein, 44 aa, Plasmodium falciparum
VDTKRYAYIKLPENTLIFVITANKFFFQDLIYSNNKYLSVKRKF

SEQ ID NO: 3297299 - protein, 28 aa, Plasmodium falciparum
VDYNMYMNHFFWVFKKCSIPIYHNDYIY

SEQ ID NO: 3297300 - protein, 25 aa, Plasmodium falciparum
VDYVELYLFIFNQLIRIRVNKIYVS

SEQ ID NO: 3297301 - protein, 18 aa, Plasmodium falciparum
VEALTLLIIIFGCCSGST

SEQ ID NO: 3297302 - protein, 37 aa, Plasmodium falciparum
VEEIILNNLRYKKNFFFFLPLLKLKVKCKKNDGQWNE

SEQ ID NO: 3297303 - protein, 17 aa, Plasmodium falciparum
VEEKPFIMSIHDRNLFS

SEQ ID NO: 3297304 - protein, 18 aa, Plasmodium falciparum
VEEKYGFNLFKKSNHKIK

SEQ ID NO: 3297305 - protein, 19 aa, Plasmodium falciparum
VEESLKRFFKKDSSVLNPT

SEQ ID NO: 3297306 - protein, 22 aa, Plasmodium falciparum
VEHHLFYINRILEKFIYEKEVI

SEQ ID NO: 3297307 - protein, 19 aa, Plasmodium falciparum
VEHLPWKALIYKSLNTFID

SEQ ID NO: 3297308 - protein, 17 aa, Plasmodium falciparum
VEICFYYDESDEQRIRE

SEQ ID NO: 3297309 - protein, 20 aa, Plasmodium falciparum
VEIIKTYDILIIYYTQRDKE

SEQ ID NO: 3297310 - protein, 23 aa, Plasmodium falciparum
VEIPKIMLPFLLGGLSILCAGFQ

SEQ ID NO: 3297311 - protein, 20 aa, Plasmodium falciparum
VEIPKIPYNIPKPSIYQQKK

SEQ ID NO: 3297312 - protein, 27 aa, Plasmodium falciparum
VEKAFRELQFIKLRDRTRPRKHVNVMG

SEQ ID NO: 3297313 - protein, 25 aa, Plasmodium falciparum
VEKDFKYYFYCKKKKKKKIVHMNIQ

SEQ ID NO: 3297314 - protein, 84 aa, Plasmodium falciparum
VEKFDYPLYIKFHMHLALIYKYIGSFRKFTFTIYLLCISFYLNKKYYLAYFLVNNILPFYNLSYLHMYYLFKRITYEDDTSDLL

SEQ ID NO: 3297315 - protein, 31 aa, Plasmodium falciparum
VEKKILFNYKKFYNFFLIQNFKYLDFTETSK

SEQ ID NO: 3297316 - protein, 28 aa, Plasmodium falciparum
VEKLLYYRHSFENGLIKLIYVFLKETDC

SEQ ID NO: 3297317 - protein, 32 aa, Plasmodium falciparum
VEKNPCYNLIYIPSLLWIYKILNYKNNCTYNI

SEQ ID NO: 3297318 - protein, 29 aa, Plasmodium falciparum
VEKNPWEHPIVIPALVTSTLAWSVGIGFA

SEQ ID NO: 3297319 - protein, 23 aa, Plasmodium falciparum
VEKPRNIIIIAVFINSSTSFYYD

SEQ ID NO: 3297320 - protein, 26 aa, Plasmodium falciparum
VEKQITLFMNLFLQIYSSDAIIEKGK

SEQ ID NO: 3297321 - protein, 25 aa, Plasmodium falciparum
VEKSFRILFRLLKVNNCKDPVFLFN

SEQ ID NO: 3297322 - protein, 17 aa, Plasmodium falciparum
VELFRRKLKEYTSDVLL

SEQ ID NO: 3297323 - protein, 24 aa, Plasmodium falciparum
VELMNFIHNFLLSNFNFFYNDIIS

SEQ ID NO: 3297324 - protein, 20 aa, Plasmodium falciparum
VELTGFRILMNMKDKFKEKK

SEQ ID NO: 3297325 - protein, 25 aa, Plasmodium falciparum
VENIPPQFFGLKNNIKYLWNNNYNI

SEQ ID NO: 3297326 - protein, 22 aa, Plasmodium falciparum
VENKYFLDLIDYNIDLQKININ

SEQ ID NO: 3297327 - protein, 27 aa, Plasmodium falciparum
VENLINLLLSYIYLDIPVDLLLHSCIP

SEQ ID NO: 3297328 - protein, 24 aa, Plasmodium falciparum
VEQIKPKWIKLKGSKYTKAMYANN

SEQ ID NO: 3297329 - protein, 23 aa, Plasmodium falciparum
VEQPNICPQLPKPPPQPGDEDGC

SEQ ID NO: 3297330 - protein, 19 aa, Plasmodium falciparum
VERHKFAMMQYRLMKYIGH

SEQ ID NO: 3297331 - protein, 26 aa, Plasmodium falciparum
VESAAVETFFLWDRYKKENTKRQGGG

SEQ ID NO: 3297332 - protein, 29 aa, Plasmodium falciparum
VESAAVETFFLWDRYKKEWMAQKLAEQGL

SEQ ID NO: 3297333 - protein, 27 aa, Plasmodium falciparum
VESAAVETFFLWDRYKKIKEKEKKEKK

SEQ ID NO: 3297334 - protein, 29 aa, Plasmodium falciparum
VESAAVETFFLWDRYKKLNTKRQGVGAGA

SEQ ID NO: 3297335 - protein, 27 aa, Plasmodium falciparum
VESAAVETFFLWHKYKMDKQKELDEKK

SEQ ID NO: 3297336 - protein, 19 aa, Plasmodium falciparum
VESMKIFLCIAMRATVVLF

SEQ ID NO: 3297337 - protein, 31 aa, Plasmodium falciparum
VESMNMLLFYNIFFYYCKLLSRVFINKIRNS

SEQ ID NO: 3297338 - protein, 23 aa, Plasmodium falciparum
VESNLHFLGFLIFTNNMEKNAPD

SEQ ID NO: 3297339 - protein, 26 aa, Plasmodium falciparum
VETCIWLIFLLLVILLMNTYWLILMA

SEQ ID NO: 3297340 - protein, 17 aa, Plasmodium falciparum
VEYLLCNIINPNENYHI

SEQ ID NO: 3297341 - protein, 19 aa, Plasmodium falciparum
VFALLISMNVFVPGFMNVL

SEQ ID NO: 3297342 - protein, 23 aa, Plasmodium falciparum
VFDYLVEKPLDIIFTKKIKNIYK

SEQ ID NO: 3297343 - protein, 17 aa, Plasmodium falciparum
VFFDKLFHNFYDVLYTD

SEQ ID NO: 3297344 - protein, 24 aa, Plasmodium falciparum
VFFNLVILFVFLNFERVELKLNNI

SEQ ID NO: 3297345 - protein, 27 aa, Plasmodium falciparum
VFFNYYNIIYILEYIHYIGLHNLSAKK

SEQ ID NO: 3297346 - protein, 18 aa, Plasmodium falciparum
VFHYICITSYVLCDLLLK

SEQ ID NO: 3297347 - protein, 19 aa, Plasmodium falciparum
VFIAIIVIVIFLYVYLRNR

SEQ ID NO: 3297348 - protein, 19 aa, Plasmodium falciparum
VFIAVIIIVIFLYVYLRNR

SEQ ID NO: 3297349 - protein, 24 aa, Plasmodium falciparum
VFIIFFFLFLKRRVICSINESKNV

SEQ ID NO: 3297350 - protein, 23 aa, Plasmodium falciparum
VFIKILRDLHFPIMLKGRKIDKY

SEQ ID NO: 3297351 - protein, 17 aa, Plasmodium falciparum
VFILKIYDNKHIFKILE

SEQ ID NO: 3297352 - protein, 21 aa, Plasmodium falciparum
VFKFFIFVIIINWITTKSVVI

SEQ ID NO: 3297353 - protein, 32 aa, Plasmodium falciparum
VFKIIKIITLYYFVCFYMCPPLLYDTNKQTYD

SEQ ID NO: 3297354 - protein, 22 aa, Plasmodium falciparum
VFKNSGWLPSLVANILICILTI

SEQ ID NO: 3297355 - protein, 19 aa, Plasmodium falciparum
VFKYICKIIYRFLEYNFSV

SEQ ID NO: 3297356 - protein, 18 aa, Plasmodium falciparum
VFLFYIDIKYNRCSLLHY

SEQ ID NO: 3297357 - protein, 18 aa, Plasmodium falciparum
VFLLFFYIKNPYLSVYQY

SEQ ID NO: 3297358 - protein, 17 aa, Plasmodium falciparum
VFLNGKLVAWRFHYFQK

SEQ ID NO: 3297359 - protein, 22 aa, Plasmodium falciparum
VFLVILICLLILPITFRNKVGS

SEQ ID NO: 3297360 - protein, 23 aa, Plasmodium falciparum
VFNIIFFSLISFFYYFTFNGSNI

SEQ ID NO: 3297361 - protein, 24 aa, Plasmodium falciparum
VFNIIFFSLISFFYYFTFNGSNID

SEQ ID NO: 3297362 - protein, 25 aa, Plasmodium falciparum
VFNILKAFILLVLLIINALYSHTPE

SEQ ID NO: 3297363 - protein, 22 aa, Plasmodium falciparum
VFNYICYRIPILLLHMKQFSIN

SEQ ID NO: 3297364 - protein, 23 aa, Plasmodium falciparum
VFNYNICLFLFLFKKEDIEEYFF

SEQ ID NO: 3297365 - protein, 37 aa, Plasmodium falciparum
VFPMTYIYPSFTFVSFLLFSYLFSHFTYILKYEKKII

SEQ ID NO: 3297366 - protein, 17 aa, Plasmodium falciparum
VFQFEFKEKKYFLIFNN

SEQ ID NO: 3297367 - protein, 22 aa, Plasmodium falciparum
VFRTLNIHFFNGLEFKNYEEFS

SEQ ID NO: 3297368 - protein, 35 aa, Plasmodium falciparum
VFSVQPYYLDIYTCKEAILFTTSFYKDLDKSSITK

SEQ ID NO: 3297369 - protein, 36 aa, Plasmodium falciparum
VFSVQPYYLDIYTCKEAILFTTSFYKDLDKSSITKI

SEQ ID NO: 3297370 - protein, 27 aa, Plasmodium falciparum
VFTFEHYFNLLNRYLLINYDASIFINI

SEQ ID NO: 3297371 - protein, 20 aa, Plasmodium falciparum
VFTLAWIHYTNYLRKILDIF

SEQ ID NO: 3297372 - protein, 26 aa, Plasmodium falciparum
VFTYGNFFNIYNFDLKKLLLSERKIK

SEQ ID NO: 3297373 - protein, 20 aa, Plasmodium falciparum
VFVFLFCYKYYDSFSDLQIN

SEQ ID NO: 3297374 - protein, 24 aa, Plasmodium falciparum
VFVLHLFYIIGIIILFLDHVQSSK

SEQ ID NO: 3297375 - protein, 19 aa, Plasmodium falciparum
VFVLLRFFKHDNSFLRYLS

SEQ ID NO: 3297376 - protein, 34 aa, Plasmodium falciparum
VFVMYRLFLDVIPYPIFVTWWQLAQGLLVAYVCG

SEQ ID NO: 3297377 - protein, 25 aa, Plasmodium falciparum
VFVNMPLFNFYNFYNFFQIDHVEKY

SEQ ID NO: 3297378 - protein, 27 aa, Plasmodium falciparum
VFWFSLYIYVFIWLVQTIQMFISFQVC

SEQ ID NO: 3297379 - protein, 17 aa, Plasmodium falciparum
VFYKFFYIYKKLKSKNY

SEQ ID NO: 3297380 - protein, 18 aa, Plasmodium falciparum
VFYLCISIWCLFVNICKN

SEQ ID NO: 3297381 - protein, 24 aa, Plasmodium falciparum
VFYQNLNLLIISSSFFFYYNNEIG

SEQ ID NO: 3297382 - protein, 24 aa, Plasmodium falciparum
VGACAPFRRLHLCDYNLEKMGSTK

SEQ ID NO: 3297383 - protein, 26 aa, Plasmodium falciparum
VGACAPFRRLHLCVRNLENINIKKKI

SEQ ID NO: 3297384 - protein, 26 aa, Plasmodium falciparum
VGACAPYRRLFLCNKNMEKMGRTSTT

SEQ ID NO: 3297385 - protein, 19 aa, Plasmodium falciparum
VGACKWFLISKDSGKLFFK

SEQ ID NO: 3297386 - protein, 22 aa, Plasmodium falciparum
VGDLAAFVGPCTKGPVAGQNTT

SEQ ID NO: 3297387 - protein, 17 aa, Plasmodium falciparum
VGDLKLFYFIKEAFEKK

SEQ ID NO: 3297388 - protein, 27 aa, Plasmodium falciparum
VGHGLCIFLFALFLIIMNNKVKNKKNN

SEQ ID NO: 3297389 - protein, 26 aa, Plasmodium falciparum
VGIGFAAISYFLLKKKPKSPVDLIRV

SEQ ID NO: 3297390 - protein, 22 aa, Plasmodium falciparum
VGKYLNILCKILSIINMYDFKL

SEQ ID NO: 3297391 - protein, 24 aa, Plasmodium falciparum
VGNDKYLFCFLLRKKYNMNCLVSY

SEQ ID NO: 3297392 - protein, 28 aa, Plasmodium falciparum
VGNTLTNFLEILIPKIDLTNDKKKIKDL

SEQ ID NO: 3297393 - protein, 26 aa, Plasmodium falciparum
VGQGIPHYIILEQFLENEYFDGISDA

SEQ ID NO: 3297394 - protein, 18 aa, Plasmodium falciparum
VGSAFLTLIGLAAAKKAA

SEQ ID NO: 3297395 - protein, 18 aa, Plasmodium falciparum
VGSALLTMFGLAVAKKAA

SEQ ID NO: 3297396 - protein, 17 aa, Plasmodium falciparum
VGSLFLTFIGLAAARAT

SEQ ID NO: 3297397 - protein, 18 aa, Plasmodium falciparum
VGYKLNEYLTYKNKVKRS

SEQ ID NO: 3297398 - protein, 19 aa, Plasmodium falciparum
VHDMLHDSVEWRERLNSCI

SEQ ID NO: 3297399 - protein, 35 aa, Plasmodium falciparum
VHDVCLVFITLYFHKFFLRYKKYVFLEHFISRYVV

SEQ ID NO: 3297400 - protein, 23 aa, Plasmodium falciparum
VHFFNLYILIYLVYNLSEEKFEV

SEQ ID NO: 3297401 - protein, 18 aa, Plasmodium falciparum
VHHKVVHHFLLGTIQNND

SEQ ID NO: 3297402 - protein, 26 aa, Plasmodium falciparum
VHIDMEIIFILFFQSISILYEPFIAP

SEQ ID NO: 3297403 - protein, 26 aa, Plasmodium falciparum
VHIKSDFFLLYYALPFEEEINIKNVT

SEQ ID NO: 3297404 - protein, 27 aa, Plasmodium falciparum
VHIYISYFLFCHHLFNIFLRMNTELDL

SEQ ID NO: 3297405 - protein, 20 aa, Plasmodium falciparum
VHKIIRRINIMCLAFFIDIF

SEQ ID NO: 3297406 - protein, 25 aa, Plasmodium falciparum
VHKLLLFINILIKSNIYINYEWSLY

SEQ ID NO: 3297407 - protein, 18 aa, Plasmodium falciparum
VHKLVSIELWEKLIDECV

SEQ ID NO: 3297408 - protein, 26 aa, Plasmodium falciparum
VHKNYIHYHIFFPITYMDIEKRENCK

SEQ ID NO: 3297409 - protein, 26 aa, Plasmodium falciparum
VHLIHKYFVLFILLYSINRKTNITLH

SEQ ID NO: 3297410 - protein, 29 aa, Plasmodium falciparum
VHLLKFVYNIYLLSLLFYKNMDVIRIASE

SEQ ID NO: 3297411 - protein, 26 aa, Plasmodium falciparum
VHLNAILSTLLLLDILMKKKSCVEKL

SEQ ID NO: 3297412 - protein, 27 aa, Plasmodium falciparum
VHLSLKLLLHILLNIFYKEKTTYNIKK

SEQ ID NO: 3297413 - protein, 23 aa, Plasmodium falciparum
VHMSIISIIMLLNVLRKNCNYSL

SEQ ID NO: 3297414 - protein, 27 aa, Plasmodium falciparum
VHPSSLFPILYTGYYINSPKYFFYNLS

SEQ ID NO: 3297415 - protein, 27 aa, Plasmodium falciparum
VHPYYKSIRIFPGRTFLPYYQNVKDKK

SEQ ID NO: 3297416 - protein, 66 aa, Plasmodium falciparum
VHQYIHYFQILLLEYLYYFIYILCLFIVLYIFDYKEFLFMSFFCFLLLYGFNIFLSICLFSSLYLH

SEQ ID NO: 3297417 - protein, 38 aa, Plasmodium falciparum
VHRPHPWGLLITFIELIRNPIFKFWQCSFVSVVPEIEN

SEQ ID NO: 3297418 - protein, 24 aa, Plasmodium falciparum
VHTSEILFFINQKKFILFIQETIL

SEQ ID NO: 3297419 - protein, 35 aa, Plasmodium falciparum
VHVKLYKSYYYILMYWKFIILRILQRNKTFKNYMD

SEQ ID NO: 3297420 - protein, 21 aa, Plasmodium falciparum
VHVNNLFKKYLKLYMKKNIKG

SEQ ID NO: 3297421 - protein, 28 aa, Plasmodium falciparum
VHYKLMFFKSIYTLNFYNSPFLKHTYSI

SEQ ID NO: 3297422 - protein, 18 aa, Plasmodium falciparum
VHYLSKRNSILKNEMLVK

SEQ ID NO: 3297423 - protein, 26 aa, Plasmodium falciparum
VHYPHLLIILPIFLKENFNLLTYDIK

SEQ ID NO: 3297424 - protein, 17 aa, Plasmodium falciparum
VHYYFYVHKIPKNILVN

SEQ ID NO: 3297425 - protein, 32 aa, Plasmodium falciparum
VIAILIIVLVMIIIYLILRYRRKKKMNKKAQY

SEQ ID NO: 3297426 - protein, 27 aa, Plasmodium falciparum
VIAILIIVLVMIIIYLILRYRRTKKMN

SEQ ID NO: 3297427 - protein, 27 aa, Plasmodium falciparum
VIAILVIVLVMVIIYLILHYRRKKKMK

SEQ ID NO: 3297428 - protein, 26 aa, Plasmodium falciparum
VIAMLLLHLIFYKVSIYYLLRHLDIL

SEQ ID NO: 3297429 - protein, 34 aa, Plasmodium falciparum
VICEYMFPFYSFILFKFVKMLSLLLPSILSCEKK

SEQ ID NO: 3297430 - protein, 37 aa, Plasmodium falciparum
VICHGNVIRYFLCRALQIPLFAWLRFSSYNCGITWLV

SEQ ID NO: 3297431 - protein, 19 aa, Plasmodium falciparum
VICPTCPVSVICALALSTY

SEQ ID NO: 3297432 - protein, 30 aa, Plasmodium falciparum
VICTKGYCSPECALLVFLLSSLNKSDQFRK

SEQ ID NO: 3297433 - protein, 17 aa, Plasmodium falciparum
VIDDFYQFLVFIRDIIS

SEQ ID NO: 3297434 - protein, 26 aa, Plasmodium falciparum
VIDFVHFFFYSIYKRIQYLYSNGDNI

SEQ ID NO: 3297435 - protein, 26 aa, Plasmodium falciparum
VIDIFLLFLTFYFKSLNKWALHGKNL

SEQ ID NO: 3297436 - protein, 29 aa, Plasmodium falciparum
VIDSNVLQLLIYPSFFFQNNLDNDLIIKS

SEQ ID NO: 3297437 - protein, 23 aa, Plasmodium falciparum
VIEMFSSYLITKPIRLCTKDIPI

SEQ ID NO: 3297438 - protein, 28 aa, Plasmodium falciparum
VIENFSFFLILYFLNIKRRKFQECLDIN

SEQ ID NO: 3297439 - protein, 26 aa, Plasmodium falciparum
VIERKYMYLYFLFIKFMGVLKKKKKQ

SEQ ID NO: 3297440 - protein, 17 aa, Plasmodium falciparum
VIFDEYDFFFNSMKVKN

SEQ ID NO: 3297441 - protein, 18 aa, Plasmodium falciparum
VIFFIYLKDRLNKKEEIK

SEQ ID NO: 3297442 - protein, 27 aa, Plasmodium falciparum
VIFFNVLTGLAFIYLLKNYNENTKHIL

SEQ ID NO: 3297443 - protein, 18 aa, Plasmodium falciparum
VIFNNWFQMSLTLSHQRN

SEQ ID NO: 3297444 - protein, 36 aa, Plasmodium falciparum
VIFPSYFFIKHFKILRDFIFFFIIERNNSPLNFCYI

SEQ ID NO: 3297445 - protein, 24 aa, Plasmodium falciparum
VIFVNHRIPIFTILYDHIYKIITK

SEQ ID NO: 3297446 - protein, 25 aa, Plasmodium falciparum
VIGKGCINCLYACNPYVDWINNQKE

SEQ ID NO: 3297447 - protein, 19 aa, Plasmodium falciparum
VIGTGFKFVKTLIKTSSLA

SEQ ID NO: 3297448 - protein, 22 aa, Plasmodium falciparum
VIHFFMFLIAYFVIQLVWSFYR

SEQ ID NO: 3297449 - protein, 19 aa, Plasmodium falciparum
VIHNLYIPKTLYNKYRRHM

SEQ ID NO: 3297450 - protein, 25 aa, Plasmodium falciparum
VIHVKALDVLFISKNKLKKKIKKNI

SEQ ID NO: 3297451 - protein, 29 aa, Plasmodium falciparum
VIIAIIVVLIILYIWLRKTRKNSWKHECK

SEQ ID NO: 3297452 - protein, 23 aa, Plasmodium falciparum
VIIFLIFLSLIIELYLSLHIQKK

SEQ ID NO: 3297453 - protein, 26 aa, Plasmodium falciparum
VIIGIMNFFKLYKKFKILKYKEKEEY

SEQ ID NO: 3297454 - protein, 20 aa, Plasmodium falciparum
VIIHLCLYIIKAKVNSIYYY

SEQ ID NO: 3297455 - protein, 24 aa, Plasmodium falciparum
VIIYMLMYETRIFKPLRIQQKLNN

SEQ ID NO: 3297456 - protein, 25 aa, Plasmodium falciparum
VIKCKDYYLFCYFKQILMDNMHVLN

SEQ ID NO: 3297457 - protein, 25 aa, Plasmodium falciparum
VIKEVIFYCLSFRFNIHRNNLFNSI

SEQ ID NO: 3297458 - protein, 21 aa, Plasmodium falciparum
VIKIYNWMNTYFKMYIEKKKK

SEQ ID NO: 3297459 - protein, 25 aa, Plasmodium falciparum
VIKKNINILFRKWYTQHVYYNKNEY

SEQ ID NO: 3297460 - protein, 23 aa, Plasmodium falciparum
VIKKNLMVPSKKWKKEITYNKQS

SEQ ID NO: 3297461 - protein, 22 aa, Plasmodium falciparum
VIKLCKLNLKKTVKLLLIINIK

SEQ ID NO: 3297462 - protein, 28 aa, Plasmodium falciparum
VIKNSNSLFLLYYWKWITHMIHKCSDYV

SEQ ID NO: 3297463 - protein, 26 aa, Plasmodium falciparum
VIKSYIFEYFHWYLSKKLCTYNQPHV

SEQ ID NO: 3297464 - protein, 22 aa, Plasmodium falciparum
VIKVPFLPFYVTLCNNSKLPTF

SEQ ID NO: 3297465 - protein, 29 aa, Plasmodium falciparum
VIKYIREYFYIFVFFQKIIHNKENCYDLC

SEQ ID NO: 3297466 - protein, 20 aa, Plasmodium falciparum
VILALQHFKLDNLFPEIYNA

SEQ ID NO: 3297467 - protein, 32 aa, Plasmodium falciparum
VILFITFYSTYICNILCVLLKESSYHNINHIP

SEQ ID NO: 3297468 - protein, 21 aa, Plasmodium falciparum
VILHLFRCAYAKYLKDMNIKR

SEQ ID NO: 3297469 - protein, 17 aa, Plasmodium falciparum
VILILNRYSMIINVYNI

SEQ ID NO: 3297470 - protein, 17 aa, Plasmodium falciparum
VILKKITSATLIGTLIF

SEQ ID NO: 3297471 - protein, 20 aa, Plasmodium falciparum
VILKLIHYSFYNLTYKHSCN

SEQ ID NO: 3297472 - protein, 28 aa, Plasmodium falciparum
VILKLSLIYIYCTYFMNIYIIKDYRRKN

SEQ ID NO: 3297473 - protein, 25 aa, Plasmodium falciparum
VILVLNMFIPTIIKYALCIALIENP

SEQ ID NO: 3297474 - protein, 18 aa, Plasmodium falciparum
VILYIICLTLLYAYLAFQ

SEQ ID NO: 3297475 - protein, 26 aa, Plasmodium falciparum
VILYPYYYFYLTLLKAFPTYLFLSSF

SEQ ID NO: 3297476 - protein, 20 aa, Plasmodium falciparum
VINCDRYIYQNNLYNNLVGL

SEQ ID NO: 3297477 - protein, 24 aa, Plasmodium falciparum
VINIPYFDWAILNTDFDKKAYIKK

SEQ ID NO: 3297478 - protein, 25 aa, Plasmodium falciparum
VINLSYFDIFLLLQNIYPETFKKNE

SEQ ID NO: 3297479 - protein, 43 aa, Plasmodium falciparum
VINNIIRNSFVFKILFYFFKLKKTLLYLLKCFGIEQIKKEKKV

SEQ ID NO: 3297480 - protein, 31 aa, Plasmodium falciparum
VINVYSKNDWLLGFLYRYMEWKINVAGLIAV

SEQ ID NO: 3297481 - protein, 34 aa, Plasmodium falciparum
VIPNTGIRILLNEIYFILLKKNLYFHTDEYNNLT

SEQ ID NO: 3297482 - protein, 22 aa, Plasmodium falciparum
VIQIVLILLYIYIKTNDEVSII

SEQ ID NO: 3297483 - protein, 26 aa, Plasmodium falciparum
VIRKNIHKIIKQYYPFLLTETKNVNN

SEQ ID NO: 3297484 - protein, 17 aa, Plasmodium falciparum
VIRYASMSFLKNKKGHI

SEQ ID NO: 3297485 - protein, 23 aa, Plasmodium falciparum
VISEMFLIVYEKIYKKYIKKKNK

SEQ ID NO: 3297486 - protein, 21 aa, Plasmodium falciparum
VISFPFWEIKPWFSKTRKESY

SEQ ID NO: 3297487 - protein, 30 aa, Plasmodium falciparum
VISIAVILLIIYLILRYRRKIKMNKKLQYI

SEQ ID NO: 3297488 - protein, 27 aa, Plasmodium falciparum
VISIFSFFCLFFYFLHIIYFSLFNNIT

SEQ ID NO: 3297489 - protein, 24 aa, Plasmodium falciparum
VISIYYIYGDYLHFDDWLKLINLF

SEQ ID NO: 3297490 - protein, 20 aa, Plasmodium falciparum
VISLFFLYISSFCKSIKVTQ

SEQ ID NO: 3297491 - protein, 17 aa, Plasmodium falciparum
VISLKLCLLFTCIHLKN

SEQ ID NO: 3297492 - protein, 34 aa, Plasmodium falciparum
VISTIVLLCIALMLLIIYLILRYRRKSRMKKKFQ

SEQ ID NO: 3297493 - protein, 19 aa, Plasmodium falciparum
VIVIFLYVYLRNRRKHSCK

SEQ ID NO: 3297494 - protein, 27 aa, Plasmodium falciparum
VIVLVMIIIYLILRYRRKKKMKKKLQY

SEQ ID NO: 3297495 - protein, 26 aa, Plasmodium falciparum
VIVSIFFFFKLPLYVLTPIFFADPMA

SEQ ID NO: 3297496 - protein, 26 aa, Plasmodium falciparum
VIVVIVLVMIIIYLVLRNRRKTKMTK

SEQ ID NO: 3297497 - protein, 35 aa, Plasmodium falciparum
VIYDIIKMFFLHNKLYIISLYYTKLKYALQNKQHG

SEQ ID NO: 3297498 - protein, 17 aa, Plasmodium falciparum
VIYILYSYEILRTILHI

SEQ ID NO: 3297499 - protein, 31 aa, Plasmodium falciparum
VKCSFIQYPFNLYYWLVLNPGKPNISLSSKT

SEQ ID NO: 3297500 - protein, 26 aa, Plasmodium falciparum
VKCSQDILLCLLPILFNKINLKNILE

SEQ ID NO: 3297501 - protein, 26 aa, Plasmodium falciparum
VKDEDILYFLFINYNYCILNYKNNKK

SEQ ID NO: 3297502 - protein, 20 aa, Plasmodium falciparum
VKDELFFESLNIIELLNNKE

SEQ ID NO: 3297503 - protein, 23 aa, Plasmodium falciparum
VKDYHYIFLLTYIKRNEYKMEID

SEQ ID NO: 3297504 - protein, 32 aa, Plasmodium falciparum
VKENICKYIISQILQAVYYLHYHNIIHRDIKP

SEQ ID NO: 3297505 - protein, 25 aa, Plasmodium falciparum
VKEQLKETILYPLEYKHLYNKFNSN

SEQ ID NO: 3297506 - protein, 22 aa, Plasmodium falciparum
VKEYFNLFFRPENVNFFVYGDV

SEQ ID NO: 3297507 - protein, 27 aa, Plasmodium falciparum
VKFHFYSFLFILLYEFTDSNDFLTFLL

SEQ ID NO: 3297508 - protein, 17 aa, Plasmodium falciparum
VKFRLGYNSFCFNNIHL

SEQ ID NO: 3297509 - protein, 30 aa, Plasmodium falciparum
VKFSYEEVYFIIRYYVKIKQLINKLKKEKF

SEQ ID NO: 3297510 - protein, 37 aa, Plasmodium falciparum
VKGENTFLYANLLSRFLYFYNYNISQYSKIIYIFIFI

SEQ ID NO: 3297511 - protein, 23 aa, Plasmodium falciparum
VKHFFNFVIIYLESLSRHIDSFI

SEQ ID NO: 3297512 - protein, 49 aa, Plasmodium falciparum
VKHYNIDNIFIQWIYTIFLTCLPFNIYIRLFDIYTFNEKIIYEVIICIF

SEQ ID NO: 3297513 - protein, 28 aa, Plasmodium falciparum
VKIEKYLVSIFYILKLSFNKLKSIEIIN

SEQ ID NO: 3297514 - protein, 27 aa, Plasmodium falciparum
VKISNSLKWPLHFYRNLCYKNNYKVAS

SEQ ID NO: 3297515 - protein, 18 aa, Plasmodium falciparum
VKKKIIGYLFFSSNMNRT

SEQ ID NO: 3297516 - protein, 26 aa, Plasmodium falciparum
VKKKINIFNIILWTIYNFMNNKKTIM

SEQ ID NO: 3297517 - protein, 29 aa, Plasmodium falciparum
VKKKNFFKDFFLFFMVKKNSLLLLSNDYK

SEQ ID NO: 3297518 - protein, 25 aa, Plasmodium falciparum
VKKMDFFVDIFFNIPSNIYKDNFIC

SEQ ID NO: 3297519 - protein, 21 aa, Plasmodium falciparum
VKKNIFLWYIKKKGGDICKSV

SEQ ID NO: 3297520 - protein, 20 aa, Plasmodium falciparum
VKLFIFMCLLSIANLSLFTY

SEQ ID NO: 3297521 - protein, 18 aa, Plasmodium falciparum
VKLLMYYYRDKIYNIETS

SEQ ID NO: 3297522 - protein, 31 aa, Plasmodium falciparum
VKLLTCCIITTLFFYFTLKKVPEGYVCLVQN

SEQ ID NO: 3297523 - protein, 21 aa, Plasmodium falciparum
VKLSRKIIPLIFQKIKEIMEN

SEQ ID NO: 3297524 - protein, 25 aa, Plasmodium falciparum
VKNINRYFLFPFYDKYDLYELLKDE

SEQ ID NO: 3297525 - protein, 17 aa, Plasmodium falciparum
VKNMFLDDYLKIINIGC

SEQ ID NO: 3297526 - protein, 30 aa, Plasmodium falciparum
VKNSLFYSYLLHIILMKIWKKGFYRTNIAS

SEQ ID NO: 3297527 - protein, 23 aa, Plasmodium falciparum
VKNVYSMRKLFKIALEGSEEKVI

SEQ ID NO: 3297528 - protein, 26 aa, Plasmodium falciparum
VKNYSILCMLNYVFFQLNTNLDNIVI

SEQ ID NO: 3297529 - protein, 19 aa, Plasmodium falciparum
VKPSMFYLDIIHKIKNRIK

SEQ ID NO: 3297530 - protein, 38 aa, Plasmodium falciparum
VKRKFTFAMNYLIRNLKKKIFFRNYQYQYLFKDDSFAY

SEQ ID NO: 3297531 - protein, 27 aa, Plasmodium falciparum
VKRNEFYFFYFYILMFHNYIDEKKKEE

SEQ ID NO: 3297532 - protein, 25 aa, Plasmodium falciparum
VKRNILSIMLWAPLANWGFVIAGCN

SEQ ID NO: 3297533 - protein, 33 aa, Plasmodium falciparum
VKSDYKFNRILSDPFFLELNEPTPKYLDKLLKS

SEQ ID NO: 3297534 - protein, 26 aa, Plasmodium falciparum
VKSKQYLLLYILNISEMIINISESSK

SEQ ID NO: 3297535 - protein, 28 aa, Plasmodium falciparum
VKSSFFEFKYILFGFYDLFLMNQKNYTD

SEQ ID NO: 3297536 - protein, 28 aa, Plasmodium falciparum
VKTDDLYNYLLLPLHLYNNTHEICEGIL

SEQ ID NO: 3297537 - protein, 20 aa, Plasmodium falciparum
VKTIKYLELQMKYSIYIMNK

SEQ ID NO: 3297538 - protein, 23 aa, Plasmodium falciparum
VKTQIPIISFVLFRDSNLSKKCL

SEQ ID NO: 3297539 - protein, 27 aa, Plasmodium falciparum
VKVGKKFIFFLLDYLIDLLIQCDIPIN

SEQ ID NO: 3297540 - protein, 20 aa, Plasmodium falciparum
VKVLTPRKLLGESWGFICPV

SEQ ID NO: 3297541 - protein, 17 aa, Plasmodium falciparum
VKVPALFIYRKNGKCLE

SEQ ID NO: 3297542 - protein, 17 aa, Plasmodium falciparum
VKYIIRKIQKKIDFSTL

SEQ ID NO: 3297543 - protein, 26 aa, Plasmodium falciparum
VKYTLLYSNIIPISILISVDLISILQ

SEQ ID NO: 3297544 - protein, 27 aa, Plasmodium falciparum
VLAILFFILVVFLFTRFKNFLNIIHIV

SEQ ID NO: 3297545 - protein, 23 aa, Plasmodium falciparum
VLCFLYLLFLYISSTPTFHLFLI

SEQ ID NO: 3297546 - protein, 32 aa, Plasmodium falciparum
VLDALYNLSYYSYFSIHICIIIKNILVKHIHD

SEQ ID NO: 3297547 - protein, 17 aa, Plasmodium falciparum
VLDLLNYGYKIVMSPDV

SEQ ID NO: 3297548 - protein, 24 aa, Plasmodium falciparum
VLDNFIRIISRIYNFYYTRVRNTE

SEQ ID NO: 3297549 - protein, 21 aa, Plasmodium falciparum
VLEILFFISIIVTCTLSLIID

SEQ ID NO: 3297550 - protein, 19 aa, Plasmodium falciparum
VLFFIFSLFCNFIKIILFV

SEQ ID NO: 3297551 - protein, 24 aa, Plasmodium falciparum
VLFLILFIFFHVAGNFVLSNANTN

SEQ ID NO: 3297552 - protein, 23 aa, Plasmodium falciparum
VLFLLCDVLKIYNKIKKLKKHFE

SEQ ID NO: 3297553 - protein, 33 aa, Plasmodium falciparum
VLFMVYSMISSIYYYFIQFKLYNIKKKYIIARV

SEQ ID NO: 3297554 - protein, 20 aa, Plasmodium falciparum
VLFNLIFEFTKTPIKKRNGG

SEQ ID NO: 3297555 - protein, 21 aa, Plasmodium falciparum
VLFSKVFSFKYSSNYIYSLNI

SEQ ID NO: 3297556 - protein, 33 aa, Plasmodium falciparum
VLHKNLYYYAFHYIFLLLYIKKIYSAVIFYLEK

SEQ ID NO: 3297557 - protein, 19 aa, Plasmodium falciparum
VLHYFDNLLPKTMKKDLKA

SEQ ID NO: 3297558 - protein, 19 aa, Plasmodium falciparum
VLIDYDTCHFINNLQPTSP

SEQ ID NO: 3297559 - protein, 17 aa, Plasmodium falciparum
VLIICQVFISLIVAIAG

SEQ ID NO: 3297560 - protein, 28 aa, Plasmodium falciparum
VLIKKNPLIYFIYIKVLIDFYNKKEDVF

SEQ ID NO: 3297561 - protein, 19 aa, Plasmodium falciparum
VLIKYFPKEKGKKYFFFIN

SEQ ID NO: 3297562 - protein, 34 aa, Plasmodium falciparum
VLINLPYRKCIIFKDFLLYIPTFTNSTIPEIAEK

SEQ ID NO: 3297563 - protein, 20 aa, Plasmodium falciparum
VLINYWRNNGARYWFEWDKN

SEQ ID NO: 3297564 - protein, 25 aa, Plasmodium falciparum
VLISIITHIYKYFKKLYFSKNNEEV

SEQ ID NO: 3297565 - protein, 23 aa, Plasmodium falciparum
VLISMFMLTIILPNITEYMKALE

SEQ ID NO: 3297566 - protein, 34 aa, Plasmodium falciparum
VLIYTAVLASCSFPYLLQPFKLLEKKYNKENVYR

SEQ ID NO: 3297567 - protein, 36 aa, Plasmodium falciparum
VLKFTIQYIFVLAYILIHAFMHLVRFLSLNIAINSS

SEQ ID NO: 3297568 - protein, 18 aa, Plasmodium falciparum
VLKIYFLIEKNLNNLLLD

SEQ ID NO: 3297569 - protein, 24 aa, Plasmodium falciparum
VLKKVYIFFNFYERRIITLENELF

SEQ ID NO: 3297570 - protein, 37 aa, Plasmodium falciparum
VLKQHDKVFIFLYKRIYPIWFPLSWGGEQDLGPDNQP

SEQ ID NO: 3297571 - protein, 19 aa, Plasmodium falciparum
VLKSKTILREKLQLLQLKI

SEQ ID NO: 3297572 - protein, 19 aa, Plasmodium falciparum
VLLFSLPLNILVHNKNKLY

SEQ ID NO: 3297573 - protein, 20 aa, Plasmodium falciparum
VLLFSLPLNILVHNKNKLYI

SEQ ID NO: 3297574 - protein, 25 aa, Plasmodium falciparum
VLLFSLPLNILVYSKNKPYITPRHT

SEQ ID NO: 3297575 - protein, 19 aa, Plasmodium falciparum
VLLFSVPLNILVHNKNKSY

SEQ ID NO: 3297576 - protein, 24 aa, Plasmodium falciparum
VLLFSYFCFFVYTWYVNIVCVYPL

SEQ ID NO: 3297577 - protein, 22 aa, Plasmodium falciparum
VLLFVYFMLIVLTNRLFFGWPN

SEQ ID NO: 3297578 - protein, 30 aa, Plasmodium falciparum
VLLIIGISTFSFFRIYFIETSIEKITRRLR

SEQ ID NO: 3297579 - protein, 21 aa, Plasmodium falciparum
VLLIISILFIIRPFEIVKRDI

SEQ ID NO: 3297580 - protein, 25 aa, Plasmodium falciparum
VLLINSQLFNRFLFLSTYISGDKKD

SEQ ID NO: 3297581 - protein, 17 aa, Plasmodium falciparum
VLLIYIRIRNKATSTFF

SEQ ID NO: 3297582 - protein, 40 aa, Plasmodium falciparum
VLLKYLNCRYNFVLIFGIILYIFLLNINIYDDRYGSEYII

SEQ ID NO: 3297583 - protein, 22 aa, Plasmodium falciparum
VLLNLIFVSLCRCLNIPSRICM

SEQ ID NO: 3297584 - protein, 18 aa, Plasmodium falciparum
VLLPPRRRHMCTSNLEYL

SEQ ID NO: 3297585 - protein, 24 aa, Plasmodium falciparum
VLLYMKNYVYFLYKIIYHFDKFQN

SEQ ID NO: 3297586 - protein, 17 aa, Plasmodium falciparum
VLMYPYLIKYLSHDNVN

SEQ ID NO: 3297587 - protein, 27 aa, Plasmodium falciparum
VLNEKPWYLKIFKKCSCLINLSTFVLR

SEQ ID NO: 3297588 - protein, 20 aa, Plasmodium falciparum
VLNELLIGFSFNPIYDYMCK

SEQ ID NO: 3297589 - protein, 28 aa, Plasmodium falciparum
VLNFCVCFFFFFVIDLCINKNIFITNYN

SEQ ID NO: 3297590 - protein, 18 aa, Plasmodium falciparum
VLNIIRIEQLTSLCRYLI

SEQ ID NO: 3297591 - protein, 17 aa, Plasmodium falciparum
VLNILLYNNKDLSFPFE

SEQ ID NO: 3297592 - protein, 25 aa, Plasmodium falciparum
VLNKSFILTYIFFDKLRKYKKCDND

SEQ ID NO: 3297593 - protein, 25 aa, Plasmodium falciparum
VLNLDMCFIPYISFKDFLMFASYNL

SEQ ID NO: 3297594 - protein, 27 aa, Plasmodium falciparum
VLNNDNYIFNFFSKKIQLYKYANTPDK

SEQ ID NO: 3297595 - protein, 19 aa, Plasmodium falciparum
VLQLFFLIQSLTPPNYNIH

SEQ ID NO: 3297596 - protein, 25 aa, Plasmodium falciparum
VLQSFQHAFFWFYKSLNNGNLLAAY

SEQ ID NO: 3297597 - protein, 19 aa, Plasmodium falciparum
VLSGLWALLKWMYKFKIVQ

SEQ ID NO: 3297598 - protein, 17 aa, Plasmodium falciparum
VLSLICIIGLISLFVYL

SEQ ID NO: 3297599 - protein, 28 aa, Plasmodium falciparum
VLSSLEIQLLLLYIFNQPYDNVIYDIGH

SEQ ID NO: 3297600 - protein, 27 aa, Plasmodium falciparum
VLSYKNYCFYIVWISNLLLNHKIEYES

SEQ ID NO: 3297601 - protein, 21 aa, Plasmodium falciparum
VLTFFTAGLIYILFCSFDKIE

SEQ ID NO: 3297602 - protein, 20 aa, Plasmodium falciparum
VLTFIYFINMRVFAVRARLT

SEQ ID NO: 3297603 - protein, 25 aa, Plasmodium falciparum
VLTGEKFYILQPIPVKIYVEYDLKI

SEQ ID NO: 3297604 - protein, 23 aa, Plasmodium falciparum
VLTIILFFFNMTKWIGIDGNLNI

SEQ ID NO: 3297605 - protein, 35 aa, Plasmodium falciparum
VLVNINRALKYFKKVFLLLLFFFGNPMCSLNSHPF

SEQ ID NO: 3297606 - protein, 23 aa, Plasmodium falciparum
VLVSLLICYFLYKRKIKNKQNIV

SEQ ID NO: 3297607 - protein, 17 aa, Plasmodium falciparum
VLYLTKGYRPTIIQSEY

SEQ ID NO: 3297608 - protein, 20 aa, Plasmodium falciparum
VLYNKRGYMASCPLTVKGKI

SEQ ID NO: 3297609 - protein, 29 aa, Plasmodium falciparum
VLYVFSLILIFFLIFSQCFCRRLFKLFMG

SEQ ID NO: 3297610 - protein, 25 aa, Plasmodium falciparum
VLYVNDLPYFHPSLDLRDVEILLQY

SEQ ID NO: 3297611 - protein, 34 aa, Plasmodium falciparum
VMKKEYEFLLYSLQSIQNIFRFLKKQNTHKNFKQ

SEQ ID NO: 3297612 - protein, 27 aa, Plasmodium falciparum
VMNITLLFFILLYLRNIDYGRVIMIYY

SEQ ID NO: 3297613 - protein, 23 aa, Plasmodium falciparum
VMNNILDVLIYFIKDKDPKGYVN

SEQ ID NO: 3297614 - protein, 24 aa, Plasmodium falciparum
VMNQLDLFHKWLDRHRDMCEKWDT

SEQ ID NO: 3297615 - protein, 20 aa, Plasmodium falciparum
VMPNVWIYDFLSEYIYQYQS

SEQ ID NO: 3297616 - protein, 25 aa, Plasmodium falciparum
VMSILTFFFIFFFIKETKGGEIGTS

SEQ ID NO: 3297617 - protein, 19 aa, Plasmodium falciparum
VMSVYISLLSLYYKKKKEN

SEQ ID NO: 3297618 - protein, 27 aa, Plasmodium falciparum
VNAYRINRYFMYRNTLVARTINLNATN

SEQ ID NO: 3297619 - protein, 37 aa, Plasmodium falciparum
VNCHRIFINGPILNEALYNMLLQLPDFPHIIIDMTID

SEQ ID NO: 3297620 - protein, 24 aa, Plasmodium falciparum
VNCKEILLLIWGGLRGGIVLVLGL

SEQ ID NO: 3297621 - protein, 29 aa, Plasmodium falciparum
VNCKYNKIFYKYYISVINDMLCISKNNMI

SEQ ID NO: 3297622 - protein, 17 aa, Plasmodium falciparum
VNCNLNEVCISLLSVYK

SEQ ID NO: 3297623 - protein, 23 aa, Plasmodium falciparum
VNCPLFIYSTYNIIFEFFSKEVL

SEQ ID NO: 3297624 - protein, 17 aa, Plasmodium falciparum
VNCSFNILIKKLNFCLC

SEQ ID NO: 3297625 - protein, 27 aa, Plasmodium falciparum
VNDIVKKRFLLFKKKKTEKVNESELDS

SEQ ID NO: 3297626 - protein, 25 aa, Plasmodium falciparum
VNECKWLYIYRKITTLYFIVEQNKE

SEQ ID NO: 3297627 - protein, 35 aa, Plasmodium falciparum
VNEKHIIQIRALIKRWLEYLFEDYNRIRKKLNHCM

SEQ ID NO: 3297628 - protein, 30 aa, Plasmodium falciparum
VNEKRVPIFSILIVGALHKYLLSKNLRTKC

SEQ ID NO: 3297629 - protein, 30 aa, Plasmodium falciparum
VNENGRYFLFLYFYYLLCIISKQQFSNYSD

SEQ ID NO: 3297630 - protein, 23 aa, Plasmodium falciparum
VNENLIELLLMISTCRRASAKKI

SEQ ID NO: 3297631 - protein, 18 aa, Plasmodium falciparum
VNEPLNFNFIPNMNQPNN

SEQ ID NO: 3297632 - protein, 18 aa, Plasmodium falciparum
VNEQFFKNLIYILKSGPP

SEQ ID NO: 3297633 - protein, 47 aa, Plasmodium falciparum
VNEYFRGLSLASYLIEYTIYFFYFILYKMFLYNDKFYCYIDNYTFYS

SEQ ID NO: 3297634 - protein, 19 aa, Plasmodium falciparum
VNFLFFLIKSFFTPKATIY

SEQ ID NO: 3297635 - protein, 22 aa, Plasmodium falciparum
VNFYIISNFRFLDRYYNAFNKY

SEQ ID NO: 3297636 - protein, 56 aa, Plasmodium falciparum
VNGKKLKSTFNPFKRRRNKLKERKMQELHKFKKNYKKYQKLLEREKRENPDGEPLN

SEQ ID NO: 3297637 - protein, 18 aa, Plasmodium falciparum
VNHLFYNNNIMDGRYNIS

SEQ ID NO: 3297638 - protein, 38 aa, Plasmodium falciparum
VNIIKTMIYVLDKSLIRLFIMKTLTYCAPPYDLMFCQC

SEQ ID NO: 3297639 - protein, 27 aa, Plasmodium falciparum
VNIKKNILLLLKIYKYINKIKIYRNRF

SEQ ID NO: 3297640 - protein, 29 aa, Plasmodium falciparum
VNIKSYKILLKCEILTHFNFFNVINCDRY

SEQ ID NO: 3297641 - protein, 23 aa, Plasmodium falciparum
VNILDVFNYLYKKLYKNISYLKE

SEQ ID NO: 3297642 - protein, 17 aa, Plasmodium falciparum
VNINICTVLARSFADIG

SEQ ID NO: 3297643 - protein, 24 aa, Plasmodium falciparum
VNIQKKIFFCIIQMINNITKYRHI

SEQ ID NO: 3297644 - protein, 31 aa, Plasmodium falciparum
VNIRYNFFLIYFWVIFMYPCETNKGNVKPLN

SEQ ID NO: 3297645 - protein, 31 aa, Plasmodium falciparum
VNIVPTYFDYVPQYLRWFEEWAEDFCRKKKK

SEQ ID NO: 3297646 - protein, 32 aa, Plasmodium falciparum
VNIVPTYFDYVPQYLRWFEEWAEDFCRKKKKK

SEQ ID NO: 3297647 - protein, 33 aa, Plasmodium falciparum
VNIVPTYFDYVPQYLRWFEEWAEDFCRLRKHKL

SEQ ID NO: 3297648 - protein, 24 aa, Plasmodium falciparum
VNKCTIIQIFIFDTSITNSFEINE

SEQ ID NO: 3297649 - protein, 26 aa, Plasmodium falciparum
VNKFLTLHKIPYIYQTALPVIEIINF

SEQ ID NO: 3297650 - protein, 21 aa, Plasmodium falciparum
VNKKFIKIFEKFFERMNKHRV

SEQ ID NO: 3297651 - protein, 32 aa, Plasmodium falciparum
VNKKIIFFNMIYLMVLFVVCFIGGILLGFLTT

SEQ ID NO: 3297652 - protein, 21 aa, Plasmodium falciparum
VNKTILWNKINMLYCHLYDER

SEQ ID NO: 3297653 - protein, 31 aa, Plasmodium falciparum
VNKYNEKLKKLIRTFFLHCPTGTGKTFIYLL

SEQ ID NO: 3297654 - protein, 48 aa, Plasmodium falciparum
VNLHNVFLEFIDKLSYPLFIDTIISMTYDCILILFKYINELKEVSAFR

SEQ ID NO: 3297655 - protein, 33 aa, Plasmodium falciparum
VNMEFFINISVDKIFDYLLLKKNIITMVNIKKL

SEQ ID NO: 3297656 - protein, 35 aa, Plasmodium falciparum
VNMFKLFRLQSYCIVILAGILYVLLHNVSLINEDN

SEQ ID NO: 3297657 - protein, 25 aa, Plasmodium falciparum
VNNAPYEPFIYFLFENIKKNNINYS

SEQ ID NO: 3297658 - protein, 20 aa, Plasmodium falciparum
VNNELSCFYPNNADVFHFLS

SEQ ID NO: 3297659 - protein, 20 aa, Plasmodium falciparum
VNNFELIKVIKHPLLKHVAG

SEQ ID NO: 3297660 - protein, 26 aa, Plasmodium falciparum
VNNFNTLYFEKILQDLYYIHLNSSEE

SEQ ID NO: 3297661 - protein, 26 aa, Plasmodium falciparum
VNNILYTIDLIIFLTKKCITGTIDII

SEQ ID NO: 3297662 - protein, 28 aa, Plasmodium falciparum
VNNNKLCYYLPINKNLLIDYILLEQYEN

SEQ ID NO: 3297663 - protein, 27 aa, Plasmodium falciparum
VNNRDNLIMKIWICICMMILEECKKDE

SEQ ID NO: 3297664 - protein, 17 aa, Plasmodium falciparum
VNNYYYKNNNHNGDDKN

SEQ ID NO: 3297665 - protein, 31 aa, Plasmodium falciparum
VNPPFDIFLINKLIIYILFKLKMDVNHLTFF

SEQ ID NO: 3297666 - protein, 23 aa, Plasmodium falciparum
VNQINLFHKWLDRHRNMCEQWDK

SEQ ID NO: 3297667 - protein, 20 aa, Plasmodium falciparum
VNRFTRCYLLNNNEFRQYDK

SEQ ID NO: 3297668 - protein, 38 aa, Plasmodium falciparum
VNSEEIWLNKFYLNVNKIPLFLSFSIAKKILMTGKSVY

SEQ ID NO: 3297669 - protein, 35 aa, Plasmodium falciparum
VNSFTFSYFFFSLSYLLFILFYHPDMYASYIFFKT

SEQ ID NO: 3297670 - protein, 19 aa, Plasmodium falciparum
VNSIIIDSLFFFKCINEIK

SEQ ID NO: 3297671 - protein, 23 aa, Plasmodium falciparum
VNSIKFPLYIKFEEELFKSYRKV

SEQ ID NO: 3297672 - protein, 17 aa, Plasmodium falciparum
VNSKNGENFLLKNNEQN

SEQ ID NO: 3297673 - protein, 37 aa, Plasmodium falciparum
VNSNNNIILIVIILIVVVIIIIIIIVVIIINREMNKN

SEQ ID NO: 3297674 - protein, 22 aa, Plasmodium falciparum
VNSYIFINRLPFDIKIVTDSVR

SEQ ID NO: 3297675 - protein, 24 aa, Plasmodium falciparum
VNTCIYYLIYCINLSIFSCNYEGL

SEQ ID NO: 3297676 - protein, 31 aa, Plasmodium falciparum
VNTKLEQFARRPTYFRWLEEWGEEFCKKRTD

SEQ ID NO: 3297677 - protein, 22 aa, Plasmodium falciparum
VNVDIFLHYYFKKRKYDLFNNF

SEQ ID NO: 3297678 - protein, 19 aa, Plasmodium falciparum
VNVIFSLFDNGNNCYLLIY

SEQ ID NO: 3297679 - protein, 40 aa, Plasmodium falciparum
VNVITTWRSPFLIQAFLLLPIFLIMIFIPSDKINITSNNS

SEQ ID NO: 3297680 - protein, 17 aa, Plasmodium falciparum
VNVYDFCFLENIILNFS

SEQ ID NO: 3297681 - protein, 28 aa, Plasmodium falciparum
VNVYLHNMELYGGIPYPFEYKYIDDFYD

SEQ ID NO: 3297682 - protein, 21 aa, Plasmodium falciparum
VNYLYLIYYNNIPIFKKKSGN

SEQ ID NO: 3297683 - protein, 33 aa, Plasmodium falciparum
VNYYNDIYRLTSLLYFSLLNLNYIFLIFSTLCR

SEQ ID NO: 3297684 - protein, 38 aa, Plasmodium falciparum
VPCGIAALVLLILAVVLIILYIWLYRRRKNSWKHECKK

SEQ ID NO: 3297685 - protein, 38 aa, Plasmodium falciparum
VPCGITALVLLILAVVLIIIYIWLYRRRKRSWKHECKK

SEQ ID NO: 3297686 - protein, 28 aa, Plasmodium falciparum
VPDDDYIDQFLRWLTEWAQQYCKEKLIK

SEQ ID NO: 3297687 - protein, 27 aa, Plasmodium falciparum
VPDDEKIKFIFLYLKEKFSNEQNVSTL

SEQ ID NO: 3297688 - protein, 17 aa, Plasmodium falciparum
VPDIKFICENMLMSFGF

SEQ ID NO: 3297689 - protein, 33 aa, Plasmodium falciparum
VPEILYFSKFFMNACFISLLIITVNCFNYENFV

SEQ ID NO: 3297690 - protein, 24 aa, Plasmodium falciparum
VPEKLIEEVIPEELIKEVVPEELI

SEQ ID NO: 3297691 - protein, 31 aa, Plasmodium falciparum
VPEKRPLGIKLHWQLLPTHKIEGTVFNEIKT

SEQ ID NO: 3297692 - protein, 24 aa, Plasmodium falciparum
VPERKILLLLWNQTIGLYNEQLED

SEQ ID NO: 3297693 - protein, 29 aa, Plasmodium falciparum
VPGLNFFIYYYITTFKYYYSKLFGTLGNI

SEQ ID NO: 3297694 - protein, 27 aa, Plasmodium falciparum
VPHISSFFCTFLIHPSYFMPNDLDENM

SEQ ID NO: 3297695 - protein, 30 aa, Plasmodium falciparum
VPLCILNYNGFLFLETMMKFIIQMVVNKTI

SEQ ID NO: 3297696 - protein, 17 aa, Plasmodium falciparum
VPLFYHILQYINYICTY

SEQ ID NO: 3297697 - protein, 17 aa, Plasmodium falciparum
VPLLYKPLQTIFQKQRT

SEQ ID NO: 3297698 - protein, 28 aa, Plasmodium falciparum
VPLSAYDWFLVFLWSFPVIILDEIIKFY

SEQ ID NO: 3297699 - protein, 23 aa, Plasmodium falciparum
VPLSFLIEMFYGYGKKEILSYSG

SEQ ID NO: 3297700 - protein, 19 aa, Plasmodium falciparum
VPMKILFNNTFELFCLFVF

SEQ ID NO: 3297701 - protein, 41 aa, Plasmodium falciparum
VPPQPQAPAPLPPPPPPLPPLKTALMSSTIMWSVGIGFAAI

SEQ ID NO: 3297702 - protein, 21 aa, Plasmodium falciparum
VPPRRKHICLRNITANFLENK

SEQ ID NO: 3297703 - protein, 18 aa, Plasmodium falciparum
VPPRRQQLCLYELFPIII

SEQ ID NO: 3297704 - protein, 21 aa, Plasmodium falciparum
VPSYYLEYNLDKLYGKYWKKG

SEQ ID NO: 3297705 - protein, 29 aa, Plasmodium falciparum
VPTNFDYVPQYLRWFEEWAEDFCRKRKHK

SEQ ID NO: 3297706 - protein, 17 aa, Plasmodium falciparum
VPTYYVFWTFFGTLGGL

SEQ ID NO: 3297707 - protein, 25 aa, Plasmodium falciparum
VPYANRTYNRILYSTEKKKVNRREQ

SEQ ID NO: 3297708 - protein, 27 aa, Plasmodium falciparum
VQANLILLNLFINTNILYFSITNMDID

SEQ ID NO: 3297709 - protein, 29 aa, Plasmodium falciparum
VQDYLLKNYILYYNIYFYIQDHLKKNQYY

SEQ ID NO: 3297710 - protein, 53 aa, Plasmodium falciparum
VQEHLKQFLELFDALQEPIPKKFLRKIKIYRRLEFSLIFTLCETRKKLHAYSS

SEQ ID NO: 3297711 - protein, 35 aa, Plasmodium falciparum
VQENKMIYILKEIYLLLHFHITHIWITIKEHTEEL

SEQ ID NO: 3297712 - protein, 32 aa, Plasmodium falciparum
VQFEWKSICVIAFIFLLIFIGSNYALSIGGYR

SEQ ID NO: 3297713 - protein, 18 aa, Plasmodium falciparum
VQKELLLPHLYINKKEYD

SEQ ID NO: 3297714 - protein, 22 aa, Plasmodium falciparum
VQKELPYMIIKNENFLKNPKEV

SEQ ID NO: 3297715 - protein, 28 aa, Plasmodium falciparum
VQKNNIYIYILILYYMDVRIIRVIQINN

SEQ ID NO: 3297716 - protein, 32 aa, Plasmodium falciparum
VQKQKTFHNFFYYWVAHMLKDSIYWRTEKLER

SEQ ID NO: 3297717 - protein, 18 aa, Plasmodium falciparum
VQLKDQILGVLDYLEKQQ

SEQ ID NO: 3297718 - protein, 28 aa, Plasmodium falciparum
VQNDLYKIIQPVLYNLNIFFNQNVIKDI

SEQ ID NO: 3297719 - protein, 26 aa, Plasmodium falciparum
VQNILSYFYYDVIDTNWHAFKKKIFL

SEQ ID NO: 3297720 - protein, 29 aa, Plasmodium falciparum
VQPGSFIEFSPYGVLDLVLKGGNLLQNIK

SEQ ID NO: 3297721 - protein, 20 aa, Plasmodium falciparum
VQRILLVLSIFLHNNNIFEN

SEQ ID NO: 3297722 - protein, 21 aa, Plasmodium falciparum
VQRILNRLLFLLKYNVHNKIL

SEQ ID NO: 3297723 - protein, 26 aa, Plasmodium falciparum
VQSDIDSFFKHLIDIGLTTPSSYLSI

SEQ ID NO: 3297724 - protein, 40 aa, Plasmodium falciparum
VQTALMSSTIMWSIGIGFAAFTYFYLKKKTKHPVDLFSVI

SEQ ID NO: 3297725 - protein, 24 aa, Plasmodium falciparum
VQVYINAILYFEFIYNKQNDYIKR

SEQ ID NO: 3297726 - protein, 22 aa, Plasmodium falciparum
VQYAYPYIFGFDCKWLGAENEL

SEQ ID NO: 3297727 - protein, 34 aa, Plasmodium falciparum
VRDEDKKIIMFEFLKLLIKLHNAGLVHLDISPEN

SEQ ID NO: 3297728 - protein, 20 aa, Plasmodium falciparum
VREICLGLTIFLLTSYPLYF

SEQ ID NO: 3297729 - protein, 26 aa, Plasmodium falciparum
VREYTLYIFYNFCKHFFDIENLIIYQ

SEQ ID NO: 3297730 - protein, 25 aa, Plasmodium falciparum
VRFILFIIHILWWFIVFFGIISRKK

SEQ ID NO: 3297731 - protein, 19 aa, Plasmodium falciparum
VRIIHPLVNVLRKCFKYIK

SEQ ID NO: 3297732 - protein, 21 aa, Plasmodium falciparum
VRIINKCGIPLEFCFFDGSRN

SEQ ID NO: 3297733 - protein, 33 aa, Plasmodium falciparum
VRKRSIVHFGLKLFLFSFCIWTLQYANNNYDYR

SEQ ID NO: 3297734 - protein, 28 aa, Plasmodium falciparum
VRKSEIYYFNYFLVDLSSQLSFTYLTKC

SEQ ID NO: 3297735 - protein, 26 aa, Plasmodium falciparum
VRLVLDINSFFFLSKIIKYIHDLCIS

SEQ ID NO: 3297736 - protein, 27 aa, Plasmodium falciparum
VRNINYILFDSIILYLWSFDYNKQNDD

SEQ ID NO: 3297737 - protein, 17 aa, Plasmodium falciparum
VRRLPYIYQLSRRKYFL

SEQ ID NO: 3297738 - protein, 27 aa, Plasmodium falciparum
VRRRVLFLFSEFLYINSKYYYKNILHF

SEQ ID NO: 3297739 - protein, 31 aa, Plasmodium falciparum
VRSADKYMLGIFFIFLWNDGYLWDSAEMEDD

SEQ ID NO: 3297740 - protein, 27 aa, Plasmodium falciparum
VRSDENIHIFRKKNENFVKKIENEKSS

SEQ ID NO: 3297741 - protein, 28 aa, Plasmodium falciparum
VRSSIRLRSLLKAVLKWGNYVNYGINDN

SEQ ID NO: 3297742 - protein, 33 aa, Plasmodium falciparum
VRSVTKLLPYSFKYMESFIVFNLLHNNNYSIPL

SEQ ID NO: 3297743 - protein, 31 aa, Plasmodium falciparum
VRSVYTFFGFVLWLLFHYRTRPEVSSLLNIK

SEQ ID NO: 3297744 - protein, 25 aa, Plasmodium falciparum
VRVLKYPHNILFTNLTNDLFTYLPK

SEQ ID NO: 3297745 - protein, 28 aa, Plasmodium falciparum
VRVPQFRYENILLNYLFGTLQHLHDKFY

SEQ ID NO: 3297746 - protein, 23 aa, Plasmodium falciparum
VRYFFVFFILIIVIIHVKCNKHH

SEQ ID NO: 3297747 - protein, 28 aa, Plasmodium falciparum
VRYILCMIITFIFIYNQRKFYNIKKNTS

SEQ ID NO: 3297748 - protein, 23 aa, Plasmodium falciparum
VSAILLFKFKYQLASILFGFLPL

SEQ ID NO: 3297749 - protein, 24 aa, Plasmodium falciparum
VSALIELKVFFDKKDIEYKLLQSY

SEQ ID NO: 3297750 - protein, 27 aa, Plasmodium falciparum
VSCFSSENWFYSFFNIYKKGNFYDIDK

SEQ ID NO: 3297751 - protein, 18 aa, Plasmodium falciparum
VSCKKPLKNMLIQNLRNI

SEQ ID NO: 3297752 - protein, 30 aa, Plasmodium falciparum
VSDHFFDYIFYYDLFKYLYKKNFYMKCVIK

SEQ ID NO: 3297753 - protein, 26 aa, Plasmodium falciparum
VSEGIVFFCFIFISATMLQFILSKIH

SEQ ID NO: 3297754 - protein, 34 aa, Plasmodium falciparum
VSELLNYNYIDSWTKMIITMLKLVDIEKISPIFI

SEQ ID NO: 3297755 - protein, 31 aa, Plasmodium falciparum
VSERWKRYNFIQLYIIRSALNIHVMSKYNML

SEQ ID NO: 3297756 - protein, 35 aa, Plasmodium falciparum
VSESYRANDLFGVKKFCYQLLHGATCKSYNEWSEW

SEQ ID NO: 3297757 - protein, 21 aa, Plasmodium falciparum
VSFLNMFPYILATHLKCFLYN

SEQ ID NO: 3297758 - protein, 21 aa, Plasmodium falciparum
VSFRIPPNMMPEKPIYCFCEN

SEQ ID NO: 3297759 - protein, 28 aa, Plasmodium falciparum
VSFSKLPAYIQPFVFHWEGAMWGAFSAL

SEQ ID NO: 3297760 - protein, 24 aa, Plasmodium falciparum
VSFTIIFFYFVIKYDYKNLFKSKD

SEQ ID NO: 3297761 - protein, 31 aa, Plasmodium falciparum
VSFYTADWYDILYRLFFDASSRFYEMLLKHH

SEQ ID NO: 3297762 - protein, 37 aa, Plasmodium falciparum
VSIKFIELSIIEYGFIKKWIQPMIPISRTGKKVAIVG

SEQ ID NO: 3297763 - protein, 24 aa, Plasmodium falciparum
VSILLILSITFFLIGSYIYYESLN

SEQ ID NO: 3297764 - protein, 17 aa, Plasmodium falciparum
VSILLIVFIINDEFQRK

SEQ ID NO: 3297765 - protein, 25 aa, Plasmodium falciparum
VSILPPCNTYYYYPKNYKNVPFGSS

SEQ ID NO: 3297766 - protein, 24 aa, Plasmodium falciparum
VSKALPFILPFVPPFMVYKYGYAK

SEQ ID NO: 3297767 - protein, 24 aa, Plasmodium falciparum
VSKHVWLALKELIKYKFYEDNVND

SEQ ID NO: 3297768 - protein, 23 aa, Plasmodium falciparum
VSKKFFVYEYITSNVWKNEFEKA

SEQ ID NO: 3297769 - protein, 22 aa, Plasmodium falciparum
VSKKYYINILNYHLKNKVHGYS

SEQ ID NO: 3297770 - protein, 23 aa, Plasmodium falciparum
VSKVFLVLGSYYFINNNNSKKSI

SEQ ID NO: 3297771 - protein, 18 aa, Plasmodium falciparum
VSKYNIFFNKELAGFIVA

SEQ ID NO: 3297772 - protein, 29 aa, Plasmodium falciparum
VSLEKFVLYFKFFYRGIINKSEYYFKEEI

SEQ ID NO: 3297773 - protein, 31 aa, Plasmodium falciparum
VSLFEPMMLYYIILIYFYKSAKNKYKHLFNM

SEQ ID NO: 3297774 - protein, 39 aa, Plasmodium falciparum
VSLFGLYGFFESYNPEFFLYDIFLKFCLKYIDGEICHDL

SEQ ID NO: 3297775 - protein, 20 aa, Plasmodium falciparum
VSLMRFSFDIIYENLLSNSI

SEQ ID NO: 3297776 - protein, 25 aa, Plasmodium falciparum
VSMHKLYGGWFHFLGIMVINGYNCN

SEQ ID NO: 3297777 - protein, 27 aa, Plasmodium falciparum
VSRKQLIYIEYIYFINKHIVNKIQENF

SEQ ID NO: 3297778 - protein, 32 aa, Plasmodium falciparum
VSSLLNIKWMIFFLNLLFISAACVFSIAYLWA

SEQ ID NO: 3297779 - protein, 24 aa, Plasmodium falciparum
VSSNIICFLLSELILKNKLSFDYL

SEQ ID NO: 3297780 - protein, 25 aa, Plasmodium falciparum
VSSTFFLYFSILVIVSLLSSLFIEV

SEQ ID NO: 3297781 - protein, 22 aa, Plasmodium falciparum
VSSYFLLFFSITELSFLHFTTL

SEQ ID NO: 3297782 - protein, 24 aa, Plasmodium falciparum
VSTFVKLFFEKNISVEDISYYVGE

SEQ ID NO: 3297783 - protein, 27 aa, Plasmodium falciparum
VSTKSKFYFFHIITGTLLYEYCYYNEE

SEQ ID NO: 3297784 - protein, 18 aa, Plasmodium falciparum
VSTPSNFLFFYKTPQNPT

SEQ ID NO: 3297785 - protein, 19 aa, Plasmodium falciparum
VSTTLLLIIIMIVCLFSVD

SEQ ID NO: 3297786 - protein, 17 aa, Plasmodium falciparum
VSVFYTINKISYEYNIK

SEQ ID NO: 3297787 - protein, 19 aa, Plasmodium falciparum
VSVIGSCFYIYKKNRPLND

SEQ ID NO: 3297788 - protein, 31 aa, Plasmodium falciparum
VSVPLGLIRYLCVCVLYIISFFNYHSFLSYE

SEQ ID NO: 3297789 - protein, 25 aa, Plasmodium falciparum
VTAILLCSCYFLYNTFGSVYIIIVL

SEQ ID NO: 3297790 - protein, 32 aa, Plasmodium falciparum
VTAILVIVLVMVIIYLILRYRRKKKMKKKLQY

SEQ ID NO: 3297791 - protein, 27 aa, Plasmodium falciparum
VTDRDIIPLLFFIDKKLHLNYSLVHPY

SEQ ID NO: 3297792 - protein, 18 aa, Plasmodium falciparum
VTELFGEDLFQYINKRNE

SEQ ID NO: 3297793 - protein, 21 aa, Plasmodium falciparum
VTEYPFFKGIVKKLTLDKSRF

SEQ ID NO: 3297794 - protein, 25 aa, Plasmodium falciparum
VTFLGILYFILIFSGTFNHTSVSSY

SEQ ID NO: 3297795 - protein, 33 aa, Plasmodium falciparum
VTHAYVIQKILFILIPYIYIRKALCESRTYYVY

SEQ ID NO: 3297796 - protein, 26 aa, Plasmodium falciparum
VTHERMLQALRSITFISSIPTQYQSP

SEQ ID NO: 3297797 - protein, 18 aa, Plasmodium falciparum
VTHYKKLLELLKPNFIHI

SEQ ID NO: 3297798 - protein, 43 aa, Plasmodium falciparum
VTILHYVFCILSLGLLPLILSWFPIFYFRLLHSACTLNECEKV

SEQ ID NO: 3297799 - protein, 25 aa, Plasmodium falciparum
VTILLFLTLLLFLTYYNYDTFSKTK

SEQ ID NO: 3297800 - protein, 31 aa, Plasmodium falciparum
VTIVPTYFDYVPQYLRWFEEWAEDFCRKKKK

SEQ ID NO: 3297801 - protein, 17 aa, Plasmodium falciparum
VTKKISHYLKTKNPKIL

SEQ ID NO: 3297802 - protein, 17 aa, Plasmodium falciparum
VTKQILKHLYGMNMLLF

SEQ ID NO: 3297803 - protein, 31 aa, Plasmodium falciparum
VTMLFDGRYMLLLMGFFAVYAGFLYNDFFSM

SEQ ID NO: 3297804 - protein, 17 aa, Plasmodium falciparum
VTNADIFYLYYNLNKYK

SEQ ID NO: 3297805 - protein, 28 aa, Plasmodium falciparum
VTNINYFLFHLIFIKLIIFSLFEDNINV

SEQ ID NO: 3297806 - protein, 38 aa, Plasmodium falciparum
VTNKRKKYFLIYKIVKDSFFRILILNTEKLEKNILQVM

SEQ ID NO: 3297807 - protein, 17 aa, Plasmodium falciparum
VTQKFFCLAKKLGIYDD

SEQ ID NO: 3297808 - protein, 32 aa, Plasmodium falciparum
VTSNFREKLFIFIILCLISVCLALLVSIAIKV

SEQ ID NO: 3297809 - protein, 28 aa, Plasmodium falciparum
VTYNNSYPSIFYWTPPEILRGKKNKKFY

SEQ ID NO: 3297810 - protein, 32 aa, Plasmodium falciparum
VVAILIIVLVMIIIYLVLRYRRKKKMNKKAQY

SEQ ID NO: 3297811 - protein, 33 aa, Plasmodium falciparum
VVAILVIVLVMIIIYLILRYRRKKKMTKKLQYT

SEQ ID NO: 3297812 - protein, 31 aa, Plasmodium falciparum
VVAILVIVLVMIIIYLILRYRRKTKMKKKLQ

SEQ ID NO: 3297813 - protein, 33 aa, Plasmodium falciparum
VVAILVIVLVMLIIYLILRYRRKKKMKKKLQYI

SEQ ID NO: 3297814 - protein, 32 aa, Plasmodium falciparum
VVAILVIVLVMMIIYLILRYRRKKKMKKKDQY

SEQ ID NO: 3297815 - protein, 33 aa, Plasmodium falciparum
VVAILVIVLVMMIIYLILRYRRKKKMNKKLQYT

SEQ ID NO: 3297816 - protein, 32 aa, Plasmodium falciparum
VVAILVIVLVMMIIYLILRYRRKKKMNKKQQY

SEQ ID NO: 3297817 - protein, 33 aa, Plasmodium falciparum
VVAILVIVLVMMIIYLILRYRRKKKMNKRAQYT

SEQ ID NO: 3297818 - protein, 33 aa, Plasmodium falciparum
VVAILVIVLVMVIIYLILRYRRKKKMNKKLQYT

SEQ ID NO: 3297819 - protein, 32 aa, Plasmodium falciparum
VVAIVVIALVMIIIYLVLRYRRKKKMNKKAQY

SEQ ID NO: 3297820 - protein, 31 aa, Plasmodium falciparum
VVDIVPPLIPPPIWINRPLPCLPMITGKNCL

SEQ ID NO: 3297821 - protein, 25 aa, Plasmodium falciparum
VVDKKGLYLFNTISKWILKNINIFI

SEQ ID NO: 3297822 - protein, 26 aa, Plasmodium falciparum
VVEKVKNFILNFPNNLSREKAANNIH

SEQ ID NO: 3297823 - protein, 22 aa, Plasmodium falciparum
VVFILFFIFYFIFKNHVKHVKF

SEQ ID NO: 3297824 - protein, 25 aa, Plasmodium falciparum
VVFTFFFWLLKYGKTRSYPKSGHKG

SEQ ID NO: 3297825 - protein, 25 aa, Plasmodium falciparum
VVGPPKIFFKFLKKKKKLLIIQKHF

SEQ ID NO: 3297826 - protein, 26 aa, Plasmodium falciparum
VVHFFIICTINFDKLYISYSYNIVPE

SEQ ID NO: 3297827 - protein, 29 aa, Plasmodium falciparum
VVHNKRYDLLFLYNKKFINFIESIKNRKG

SEQ ID NO: 3297828 - protein, 27 aa, Plasmodium falciparum
VVIFRYFSMVLYILLFFCILSFILMCV

SEQ ID NO: 3297829 - protein, 20 aa, Plasmodium falciparum
VVILTLFGVLWLHTFKEETE

SEQ ID NO: 3297830 - protein, 27 aa, Plasmodium falciparum
VVIPFLIFAYIIYKNVCKIINENKKRN

SEQ ID NO: 3297831 - protein, 30 aa, Plasmodium falciparum
VVISIVVILLIIYLILRYRRKIKMNKKLQY

SEQ ID NO: 3297832 - protein, 31 aa, Plasmodium falciparum
VVISIVVILLIIYLILRYRRKIKMNKKLQYI

SEQ ID NO: 3297833 - protein, 23 aa, Plasmodium falciparum
VVKIPFLPLYITTCNNPKLPTLE

SEQ ID NO: 3297834 - protein, 47 aa, Plasmodium falciparum
VVKKDALHDLKVYNLIKLLSMPIISSLLFVYPVMYLIHMKGRHNEID

SEQ ID NO: 3297835 - protein, 17 aa, Plasmodium falciparum
VVKKGIFYLGNKVPKVV

SEQ ID NO: 3297836 - protein, 26 aa, Plasmodium falciparum
VVKKKKYHHILFKPFPYVIYNIIHKF

SEQ ID NO: 3297837 - protein, 24 aa, Plasmodium falciparum
VVLCLAPLTFPALHVGPNEVNDII

SEQ ID NO: 3297838 - protein, 18 aa, Plasmodium falciparum
VVLLFLFGVSADTIIVTG

SEQ ID NO: 3297839 - protein, 19 aa, Plasmodium falciparum
VVLNVSFFLINFESTLKLI

SEQ ID NO: 3297840 - protein, 35 aa, Plasmodium falciparum
VVMHTIVYILFLLWFLQIIYIFLKVIGSLFRRKKI

SEQ ID NO: 3297841 - protein, 29 aa, Plasmodium falciparum
VVNKCPYYLFRNLIYNFIPENAFIKKDGN

SEQ ID NO: 3297842 - protein, 17 aa, Plasmodium falciparum
VVPVTVLFGWILNKPMT

SEQ ID NO: 3297843 - protein, 30 aa, Plasmodium falciparum
VVPVWLIFLSQYCSPVVLLLLVAAVASLAL

SEQ ID NO: 3297844 - protein, 23 aa, Plasmodium falciparum
VVQFYFFEIYFVINFVHEKLYSM

SEQ ID NO: 3297845 - protein, 25 aa, Plasmodium falciparum
VVRTAIKFMLFSVAFFQLVMFTFFS

SEQ ID NO: 3297846 - protein, 36 aa, Plasmodium falciparum
VVSFYLSYINILLSFLIYVYKFKICNFVLNKIEFIH

SEQ ID NO: 3297847 - protein, 35 aa, Plasmodium falciparum
VVTAYIIKGFYSCVIIALIIFLIDLCIFGFMCLCG

SEQ ID NO: 3297848 - protein, 30 aa, Plasmodium falciparum
VVTIAVILIIIYLILRYRRKKKMKKKLQYI

SEQ ID NO: 3297849 - protein, 29 aa, Plasmodium falciparum
VVTIAVILLIIYLILRYRRKKKMNKKLQY

SEQ ID NO: 3297850 - protein, 30 aa, Plasmodium falciparum
VVVIIAVIILIIYLILRYRRKKKMKKKLQY

SEQ ID NO: 3297851 - protein, 30 aa, Plasmodium falciparum
VVVIIAVILLIIYLILRYRRKKKMKKKEQY

SEQ ID NO: 3297852 - protein, 30 aa, Plasmodium falciparum
VVVIIAVILLIIYLILRYRRKKKMKQKQQY

SEQ ID NO: 3297853 - protein, 21 aa, Plasmodium falciparum
VVVIIKIFNYIFEIIDIERNK

SEQ ID NO: 3297854 - protein, 52 aa, Plasmodium falciparum
VVVPVNKNKSSFPDKFRAPDKKRTMFYRLSELFPIVPRKDNELAVSGDCMDS

SEQ ID NO: 3297855 - protein, 18 aa, Plasmodium falciparum
VVYEVRRFLEGLQPQNDL

SEQ ID NO: 3297856 - protein, 23 aa, Plasmodium falciparum
VWCRLYESWIDNQKLEFLKQKQK

SEQ ID NO: 3297857 - protein, 20 aa, Plasmodium falciparum
VWDILFNYVSFDFLNYLLSN

SEQ ID NO: 3297858 - protein, 17 aa, Plasmodium falciparum
VWEAMQCPTIPPVTTSC

SEQ ID NO: 3297859 - protein, 17 aa, Plasmodium falciparum
VWECKKPYKLSTKDVCV

SEQ ID NO: 3297860 - protein, 18 aa, Plasmodium falciparum
VWENIYSIILNQKIDDIT

SEQ ID NO: 3297861 - protein, 22 aa, Plasmodium falciparum
VWGIGIPLMSYLVLYKNRKQLH

SEQ ID NO: 3297862 - protein, 17 aa, Plasmodium falciparum
VWKCVNICGVDVCGLKK

SEQ ID NO: 3297863 - protein, 17 aa, Plasmodium falciparum
VWRFIKKIAKKCKRVLF

SEQ ID NO: 3297864 - protein, 23 aa, Plasmodium falciparum
VYCFIACLLLCNINQVFTLHVLN

SEQ ID NO: 3297865 - protein, 27 aa, Plasmodium falciparum
VYCMKHIDIFYKYLKYFVYQNKSASVI

SEQ ID NO: 3297866 - protein, 20 aa, Plasmodium falciparum
VYDFCFLENIILNFSLSFYR

SEQ ID NO: 3297867 - protein, 21 aa, Plasmodium falciparum
VYDKLMWNAFAKKNLTDCIYG

SEQ ID NO: 3297868 - protein, 32 aa, Plasmodium falciparum
VYDLNYYLFTCLYKYEFLFFNKNECVRFYLNE

SEQ ID NO: 3297869 - protein, 30 aa, Plasmodium falciparum
VYEIEILELLFLCFFLVPFCGNHLKKRFSP

SEQ ID NO: 3297870 - protein, 29 aa, Plasmodium falciparum
VYEQGVYHFLFFFKVPLETFLSFRNCTVH

SEQ ID NO: 3297871 - protein, 27 aa, Plasmodium falciparum
VYEYFIIFNILFFIYILNYCKQLLKGK

SEQ ID NO: 3297872 - protein, 19 aa, Plasmodium falciparum
VYFCYKNNFSLLKSSILKF

SEQ ID NO: 3297873 - protein, 28 aa, Plasmodium falciparum
VYFIYDYIITFIYFLHIPKIQIQIYNIE

SEQ ID NO: 3297874 - protein, 34 aa, Plasmodium falciparum
VYFKEKKHFYFYFPKFLLINKKLKLLFKINENVC

SEQ ID NO: 3297875 - protein, 21 aa, Plasmodium falciparum
VYGCFFFNIILLMGISTKRYL

SEQ ID NO: 3297876 - protein, 28 aa, Plasmodium falciparum
VYHAFRPVFLAIILTLLMFIVVEIYKYK

SEQ ID NO: 3297877 - protein, 29 aa, Plasmodium falciparum
VYIFGELFSLFLFFFYDSNIIRGEICESK

SEQ ID NO: 3297878 - protein, 27 aa, Plasmodium falciparum
VYIGIKKLYLLLQESYKILRVLVGVID

SEQ ID NO: 3297879 - protein, 20 aa, Plasmodium falciparum
VYIIIVLIAIIFLNLDNNND

SEQ ID NO: 3297880 - protein, 19 aa, Plasmodium falciparum
VYIQSWFRKIIQQRKYKAM

SEQ ID NO: 3297881 - protein, 39 aa, Plasmodium falciparum
VYIYKYIIHDRLYINYLSYLYIRILFNECLLTGININTI

SEQ ID NO: 3297882 - protein, 18 aa, Plasmodium falciparum
VYKDIHMFKYVLSSTDLQ

SEQ ID NO: 3297883 - protein, 20 aa, Plasmodium falciparum
VYKGLLTPSQIYLYFEDLLS

SEQ ID NO: 3297884 - protein, 23 aa, Plasmodium falciparum
VYKIKIIFPDNYPLKPPIVYFLQ

SEQ ID NO: 3297885 - protein, 27 aa, Plasmodium falciparum
VYKMDYIITLFILFKNGSRLLCSEKKY

SEQ ID NO: 3297886 - protein, 18 aa, Plasmodium falciparum
VYKNIKKIENIQGASYYE

SEQ ID NO: 3297887 - protein, 21 aa, Plasmodium falciparum
VYKNNYGFLYVNSKNIITYGL

SEQ ID NO: 3297888 - protein, 23 aa, Plasmodium falciparum
VYKNSYPYYYNNKYSLLYILKKE

SEQ ID NO: 3297889 - protein, 20 aa, Plasmodium falciparum
VYLKACFPFINSIIVSYSCY

SEQ ID NO: 3297890 - protein, 18 aa, Plasmodium falciparum
VYLLNTLFGIIEELLYLI

SEQ ID NO: 3297891 - protein, 28 aa, Plasmodium falciparum
VYLNMYIFYKLFKIICILLLIGLLLCVF

SEQ ID NO: 3297892 - protein, 17 aa, Plasmodium falciparum
VYMKTIKLTLCCTHSNE

SEQ ID NO: 3297893 - protein, 19 aa, Plasmodium falciparum
VYMQLSEIFEFHMALDSWW

SEQ ID NO: 3297894 - protein, 30 aa, Plasmodium falciparum
VYMSDLKLYFYVKSFKRHTYFTKLLNIENV

SEQ ID NO: 3297895 - protein, 31 aa, Plasmodium falciparum
VYMYNTMKKLSPYLWLLNKKCNDIEIRNFFY

SEQ ID NO: 3297896 - protein, 29 aa, Plasmodium falciparum
VYNDKVMKYFWGFLLNKKQLNEVLSGYFS

SEQ ID NO: 3297897 - protein, 21 aa, Plasmodium falciparum
VYNILSIINFLKLKLSFVRDV

SEQ ID NO: 3297898 - protein, 20 aa, Plasmodium falciparum
VYQYCTLIGSVLGILFGCAL

SEQ ID NO: 3297899 - protein, 25 aa, Plasmodium falciparum
VYSLNVFSRIINGLFILIRNNDDTN

SEQ ID NO: 3297900 - protein, 23 aa, Plasmodium falciparum
VYSNLKKLFNLYKKLHNDKSKLE

SEQ ID NO: 3297901 - protein, 25 aa, Plasmodium falciparum
VYTLQLFMNILWCASADLHAKKNNP

SEQ ID NO: 3297902 - protein, 20 aa, Plasmodium falciparum
VYVINNHLLYKLKYRSFVVI

SEQ ID NO: 3297903 - protein, 22 aa, Plasmodium falciparum
VYVKLCNPFLSISLKKKKKKNQ

SEQ ID NO: 3297904 - protein, 24 aa, Plasmodium falciparum
VYVTLLLLLLLPYFVYMGIFGNTK

SEQ ID NO: 3297905 - protein, 24 aa, Plasmodium falciparum
VYYGSYYFYRFLKITYFDTQHVSN

SEQ ID NO: 3297906 - protein, 23 aa, Plasmodium falciparum
VYYKYLFMFLYQLSDLIFHIIVT

SEQ ID NO: 3297907 - protein, 19 aa, Plasmodium falciparum
VYYLPFQPFLDVVSFPNII

SEQ ID NO: 3297908 - protein, 19 aa, Plasmodium falciparum
WCCVLYIFRYRGDVLYFSL

SEQ ID NO: 3297909 - protein, 38 aa, Plasmodium falciparum
WCVDCTLFHFFYRNNIILLLYLFIYIHSVHHGSIYASY

SEQ ID NO: 3297910 - protein, 35 aa, Plasmodium falciparum
WCVFFWFVSFFYFPVFYFFHILIKCVHIKKIRTRC

SEQ ID NO: 3297911 - protein, 18 aa, Plasmodium falciparum
WDGFFILGALRWIITLHA

SEQ ID NO: 3297912 - protein, 20 aa, Plasmodium falciparum
WDKHAPSIWDGMVCALTYNT

SEQ ID NO: 3297913 - protein, 18 aa, Plasmodium falciparum
WDKLLRSKKYKKNYKNER

SEQ ID NO: 3297914 - protein, 31 aa, Plasmodium falciparum
WDQFINKELVRALGLWLEFNDNPTNASSFVY

SEQ ID NO: 3297915 - protein, 17 aa, Plasmodium falciparum
WEAMLCGYKLAGGEIKP

SEQ ID NO: 3297916 - protein, 18 aa, Plasmodium falciparum
WEKKEPNFFIIFVEEIEK

SEQ ID NO: 3297917 - protein, 30 aa, Plasmodium falciparum
WENSYIMINVILVFFFLLSGIMKKKFSKNI

SEQ ID NO: 3297918 - protein, 20 aa, Plasmodium falciparum
WFLTLFASKCNMRILNLIYM

SEQ ID NO: 3297919 - protein, 23 aa, Plasmodium falciparum
WFNIYIIFFLKYIGLDIILMCIV

SEQ ID NO: 3297920 - protein, 39 aa, Plasmodium falciparum
WFPTLSKFDSIYSKCSWLTMFKIHKPYFIISSNTLIGIY

SEQ ID NO: 3297921 - protein, 25 aa, Plasmodium falciparum
WFSYQNFRNILFLKKKSTIIKDNDG

SEQ ID NO: 3297922 - protein, 20 aa, Plasmodium falciparum
WFTREKCWFLKLFSFDLRYF

SEQ ID NO: 3297923 - protein, 18 aa, Plasmodium falciparum
WFYYSIFLQLLLSNIFCF

SEQ ID NO: 3297924 - protein, 21 aa, Plasmodium falciparum
WGFLSGIVYTGWKAAALAAAT

SEQ ID NO: 3297925 - protein, 20 aa, Plasmodium falciparum
WGIAALVLLILAVALIILYI

SEQ ID NO: 3297926 - protein, 20 aa, Plasmodium falciparum
WGIYQWCNLAKKKKKKYMKI

SEQ ID NO: 3297927 - protein, 18 aa, Plasmodium falciparum
WGKYSYYNDLDLPKYILV

SEQ ID NO: 3297928 - protein, 24 aa, Plasmodium falciparum
WGLISGIVYTGWKAAALAAAKKAA

SEQ ID NO: 3297929 - protein, 35 aa, Plasmodium falciparum
WGNYNMVLKVEFLFFWIPTLIIFSIAIPCFTMLYM

SEQ ID NO: 3297930 - protein, 25 aa, Plasmodium falciparum
WGRETYIIILFHTLMAINTLILIFF

SEQ ID NO: 3297931 - protein, 25 aa, Plasmodium falciparum
WGYWNYTYITFYKFYEQIQNKVFRD

SEQ ID NO: 3297932 - protein, 26 aa, Plasmodium falciparum
WIAQKLFKMYVPELLCVVLALQTNMF

SEQ ID NO: 3297933 - protein, 20 aa, Plasmodium falciparum
WICSMNKAFHSRFFICICVL

SEQ ID NO: 3297934 - protein, 22 aa, Plasmodium falciparum
WIDKWYIIRLNPNDFFYFIIIH

SEQ ID NO: 3297935 - protein, 19 aa, Plasmodium falciparum
WIESFILIIEGCNRILLDQ

SEQ ID NO: 3297936 - protein, 39 aa, Plasmodium falciparum
WIGLSEVFIYLNVCPKLIIYFFHIINTYINFYLSLNKNN

SEQ ID NO: 3297937 - protein, 44 aa, Plasmodium falciparum
WIIDLLKQYLSLITFPFYFRIFLFFILFFNFLCSYSYEKYIIKY

SEQ ID NO: 3297938 - protein, 19 aa, Plasmodium falciparum
WIINLENFVCFIPSFQRGF

SEQ ID NO: 3297939 - protein, 18 aa, Plasmodium falciparum
WIKYYSYNIEKLYDYLRN

SEQ ID NO: 3297940 - protein, 18 aa, Plasmodium falciparum
WILKTTFFLKKEDDMLFS

SEQ ID NO: 3297941 - protein, 29 aa, Plasmodium falciparum
WINSKSVVIFLFRFLNTFPYSHKIKNSIK

SEQ ID NO: 3297942 - protein, 27 aa, Plasmodium falciparum
WIPVIFGNVFVCSVAVFCSLMILRAMT

SEQ ID NO: 3297943 - protein, 17 aa, Plasmodium falciparum
WIRQYNLMNDNDGEYLL

SEQ ID NO: 3297944 - protein, 24 aa, Plasmodium falciparum
WITEYMSVVLLTEKMKIVTVSTLC

SEQ ID NO: 3297945 - protein, 17 aa, Plasmodium falciparum
WKALSNHLKYTLKMTII

SEQ ID NO: 3297946 - protein, 17 aa, Plasmodium falciparum
WKEFKKDIKFLKKTGCI

SEQ ID NO: 3297947 - protein, 18 aa, Plasmodium falciparum
WKPKFFFIIEKMDHFGIF

SEQ ID NO: 3297948 - protein, 17 aa, Plasmodium falciparum
WKQTYVIAVKLYHFINS

SEQ ID NO: 3297949 - protein, 31 aa, Plasmodium falciparum
WKTSKNVYYPISYYSFFYGSIIDMLNESIEW

SEQ ID NO: 3297950 - protein, 23 aa, Plasmodium falciparum
WLDHNPWKNWKVQRIKMFQPHES

SEQ ID NO: 3297951 - protein, 30 aa, Plasmodium falciparum
WLDSLSLPDPYYILPILSSLLLLSNNELTL

SEQ ID NO: 3297952 - protein, 19 aa, Plasmodium falciparum
WLFIEQLIMSIMNFSYLCF

SEQ ID NO: 3297953 - protein, 17 aa, Plasmodium falciparum
WLFVYRNEKFKKLNEEV

SEQ ID NO: 3297954 - protein, 18 aa, Plasmodium falciparum
WLGFITLGRNRPLKSKIL

SEQ ID NO: 3297955 - protein, 32 aa, Plasmodium falciparum
WLLCKYICVNIIVIILIILIICSIDEYEKSEV

SEQ ID NO: 3297956 - protein, 33 aa, Plasmodium falciparum
WLLCKYICVNIIVIILIILIICSIDEYEKSEVL

SEQ ID NO: 3297957 - protein, 18 aa, Plasmodium falciparum
WLNFVSFNWITQLLRCLK

SEQ ID NO: 3297958 - protein, 21 aa, Plasmodium falciparum
WLSFCFSCLIAFALISFTTSM

SEQ ID NO: 3297959 - protein, 34 aa, Plasmodium falciparum
WLVFLFFFLELAKCGIPGLHKWVINNFPSCVKIV

SEQ ID NO: 3297960 - protein, 21 aa, Plasmodium falciparum
WLYIHIDAHVKLLNLLPLQVF

SEQ ID NO: 3297961 - protein, 27 aa, Plasmodium falciparum
WMTNDTIEFFFYLVILHHNTGMLFQTC

SEQ ID NO: 3297962 - protein, 21 aa, Plasmodium falciparum
WNIYKFRKYLQYLTSSFSILK

SEQ ID NO: 3297963 - protein, 28 aa, Plasmodium falciparum
WNNIWINSINFFVIIIMIACVVVGLIEA

SEQ ID NO: 3297964 - protein, 17 aa, Plasmodium falciparum
WNNLLHISVCDLLQTII

SEQ ID NO: 3297965 - protein, 18 aa, Plasmodium falciparum
WNNPSYLILHKYLTYENK

SEQ ID NO: 3297966 - protein, 30 aa, Plasmodium falciparum
WPPSSETYLFFYFFTNLYLDAYKSFPGGFG

SEQ ID NO: 3297967 - protein, 24 aa, Plasmodium falciparum
WRNRIFKEYIEWKEWIYYKGQSAN

SEQ ID NO: 3297968 - protein, 18 aa, Plasmodium falciparum
WRTKKIKGCLSNGAKIRC

SEQ ID NO: 3297969 - protein, 22 aa, Plasmodium falciparum
WSIYILIYTKCNSYILRKKYLD

SEQ ID NO: 3297970 - protein, 19 aa, Plasmodium falciparum
WSNIFWSCANIGLGLYKDM

SEQ ID NO: 3297971 - protein, 21 aa, Plasmodium falciparum
WSNRGFNFMDLLKNGYLQSHG

SEQ ID NO: 3297972 - protein, 22 aa, Plasmodium falciparum
WTEIFCIKRKTLYDKMVTECQK

SEQ ID NO: 3297973 - protein, 31 aa, Plasmodium falciparum
WTHVFSIMMIRYLILKKPEFIKYLYHEEKKL

SEQ ID NO: 3297974 - protein, 17 aa, Plasmodium falciparum
WTNMPKTEILNKIKIFF

SEQ ID NO: 3297975 - protein, 19 aa, Plasmodium falciparum
WTNTPFYKAFLTFAQKEGI

SEQ ID NO: 3297976 - protein, 23 aa, Plasmodium falciparum
WTSMFAFAFMLWYSRIFDPPPLE

SEQ ID NO: 3297977 - protein, 28 aa, Plasmodium falciparum
WVKFQNFHSLFWFIPASDFNINLLAIIG

SEQ ID NO: 3297978 - protein, 47 aa, Plasmodium falciparum
WVVFSLFFFIEYLIDIILFWVPFYYLIKLLFLLYLYMPQVRGAVMVY

SEQ ID NO: 3297979 - protein, 17 aa, Plasmodium falciparum
WVVHDFSQRLDVRKGKL

SEQ ID NO: 3297980 - protein, 24 aa, Plasmodium falciparum
WVWDLFHIYFCTIIVYVNILLIYG

SEQ ID NO: 3297981 - protein, 19 aa, Plasmodium falciparum
WWANPFGMGLIFYLGYKTW

SEQ ID NO: 3297982 - protein, 27 aa, Plasmodium falciparum
WWTLGIFIYEILVGCPPFYANEPLLIY

SEQ ID NO: 3297983 - protein, 20 aa, Plasmodium falciparum
WYFACFSFVLYMSALFGCFL

SEQ ID NO: 3297984 - protein, 26 aa, Plasmodium falciparum
WYIFIFNIINKIYFENIRYVKNYEVV

SEQ ID NO: 3297985 - protein, 26 aa, Plasmodium falciparum
WYKKLKKYWRDKASTYFNFLRQKDND

SEQ ID NO: 3297986 - protein, 18 aa, Plasmodium falciparum
WYNLQLPLRLVDEIKKEL

SEQ ID NO: 3297987 - protein, 20 aa, Plasmodium falciparum
WYNYILPQLKKYMNINNGPI

SEQ ID NO: 3297988 - protein, 23 aa, Plasmodium falciparum
WYVKLIYDLLNSTKLFFDCTWMS

SEQ ID NO: 3297989 - protein, 17 aa, Plasmodium falciparum
WYVNIVCVYPLNFSSTY

SEQ ID NO: 3297990 - protein, 20 aa, Plasmodium falciparum
YADKFFVSFFNTALKRDEDK

SEQ ID NO: 3297991 - protein, 21 aa, Plasmodium falciparum
YADYLFINFINNNTLYKPKFI

SEQ ID NO: 3297992 - protein, 42 aa, Plasmodium falciparum
YAIKLIKIFNYELLHFPNLFFYLNYKSYNYLLSSFDKKYIIY

SEQ ID NO: 3297993 - protein, 22 aa, Plasmodium falciparum
YAKKIMNILFMLYSMDIYKKKK

SEQ ID NO: 3297994 - protein, 23 aa, Plasmodium falciparum
YAKYFYNTYFFNLVKNNFFLYIN

SEQ ID NO: 3297995 - protein, 23 aa, Plasmodium falciparum
YALIKLNIACDIRIIKDARVKIL

SEQ ID NO: 3297996 - protein, 19 aa, Plasmodium falciparum
YALKLKYHKGYTTSLYNLY

SEQ ID NO: 3297997 - protein, 22 aa, Plasmodium falciparum
YALMRTINLIHLNKLYIYDIFI

SEQ ID NO: 3297998 - protein, 26 aa, Plasmodium falciparum
YALNYRVHYLWKYFSLHSIADYLYVI

SEQ ID NO: 3297999 - protein, 19 aa, Plasmodium falciparum
YALSLFYFRVFPYSYNDTD

SEQ ID NO: 3298000 - protein, 20 aa, Plasmodium falciparum
YANDIFLVVKFSYPSIWNTN

SEQ ID NO: 3298001 - protein, 25 aa, Plasmodium falciparum
YANEPLLIYQKILEGIIYFPKFLDN

SEQ ID NO: 3298002 - protein, 25 aa, Plasmodium falciparum
YANGNIILFLILYEKENKEKEQNEK

SEQ ID NO: 3298003 - protein, 28 aa, Plasmodium falciparum
YASFAHKNLFILPVSVLGGAVSFGFFLG

SEQ ID NO: 3298004 - protein, 35 aa, Plasmodium falciparum
YASIIVILIIVLIMVIIYLILRYRRKKKMKKKLQY

SEQ ID NO: 3298005 - protein, 31 aa, Plasmodium falciparum
YASILKKNFLLYSLDFYTLKYFSRRDLYVNM

SEQ ID NO: 3298006 - protein, 26 aa, Plasmodium falciparum
YASSFLGLYIWSLIKNARLTLCITCV

SEQ ID NO: 3298007 - protein, 19 aa, Plasmodium falciparum
YASSWFLTLFASKCNMRIL

SEQ ID NO: 3298008 - protein, 18 aa, Plasmodium falciparum
YASYFFFINGIINPAVKI

SEQ ID NO: 3298009 - protein, 23 aa, Plasmodium falciparum
YAVLIVVLIPCSPFILLGGIGRC

SEQ ID NO: 3298010 - protein, 29 aa, Plasmodium falciparum
YAYKNYIFSNYFYLKYIICGTNYDIKEML

SEQ ID NO: 3298011 - protein, 20 aa, Plasmodium falciparum
YAYTPIDIIKYFLINKNYVL

SEQ ID NO: 3298012 - protein, 25 aa, Plasmodium falciparum
YCDEYFYIFKNILYVLKRCEVFYFY

SEQ ID NO: 3298013 - protein, 30 aa, Plasmodium falciparum
YCEVGNYYKYPIYPIWVISSSNHYTVLFSL

SEQ ID NO: 3298014 - protein, 17 aa, Plasmodium falciparum
YCFFFYDNEIIKILSFS

SEQ ID NO: 3298015 - protein, 18 aa, Plasmodium falciparum
YCFKYVASLSQYSQWKLT

SEQ ID NO: 3298016 - protein, 18 aa, Plasmodium falciparum
YCFNNIKIVILLLEINRC

SEQ ID NO: 3298017 - protein, 19 aa, Plasmodium falciparum
YCFNNYIMFFQTTQNKYLL

SEQ ID NO: 3298018 - protein, 26 aa, Plasmodium falciparum
YCFSYEDLFILFYLICRINYKDTQII

SEQ ID NO: 3298019 - protein, 56 aa, Plasmodium falciparum
YCGTYYLAGFIYGLGLLQFFQNIKIYLFIQYILKFKNRCLYICSILGLSLSLINSQ

SEQ ID NO: 3298020 - protein, 26 aa, Plasmodium falciparum
YCHNNIYLFLFMQYSELLIYKNYKKM

SEQ ID NO: 3298021 - protein, 19 aa, Plasmodium falciparum
YCIKGKIPTFLLVQNKCLL

SEQ ID NO: 3298022 - protein, 23 aa, Plasmodium falciparum
YCISFFCILWSALTASRFFEVAL

SEQ ID NO: 3298023 - protein, 31 aa, Plasmodium falciparum
YCKAVEMFIPKYFLTMTRWRNFLLEYRKIMP

SEQ ID NO: 3298024 - protein, 22 aa, Plasmodium falciparum
YCKEKIYMSTFFFDNFNLKIIN

SEQ ID NO: 3298025 - protein, 25 aa, Plasmodium falciparum
YCKKNIYIFLSYFMKEYYIQYIQNN

SEQ ID NO: 3298026 - protein, 27 aa, Plasmodium falciparum
YCKSILFKIFPCHIFFKPRKIVCTQFT

SEQ ID NO: 3298027 - protein, 18 aa, Plasmodium falciparum
YCLFYLYYYNEENHFKAY

SEQ ID NO: 3298028 - protein, 33 aa, Plasmodium falciparum
YCLNIKKKLFLDFYIDIFLFNHFIYSNKCSFIK

SEQ ID NO: 3298029 - protein, 30 aa, Plasmodium falciparum
YCLSERLIKSFLKIIKLKTPFINREDFYVN

SEQ ID NO: 3298030 - protein, 30 aa, Plasmodium falciparum
YCLYIMLLSYLFIGYRILRISENSPCSNVG

SEQ ID NO: 3298031 - protein, 18 aa, Plasmodium falciparum
YCNILCDVLYKYEKLKGV

SEQ ID NO: 3298032 - protein, 57 aa, Plasmodium falciparum
YCNKHVYPLIKTYTPLFVYIMIIILFVFISFFTIFLLPLLYLTFKQKKYICPYCEKN

SEQ ID NO: 3298033 - protein, 25 aa, Plasmodium falciparum
YCNVKQAMFFFYNPTYNKVDYVFNT

SEQ ID NO: 3298034 - protein, 17 aa, Plasmodium falciparum
YCPYLKPLEIKGIKRAD

SEQ ID NO: 3298035 - protein, 17 aa, Plasmodium falciparum
YCPYLYNNKLSPLAPSN

SEQ ID NO: 3298036 - protein, 26 aa, Plasmodium falciparum
YCQKDKLLWSLYINCIIKVDILLIEM

SEQ ID NO: 3298037 - protein, 31 aa, Plasmodium falciparum
YCSCIFDSIKCRFILISKMKNTKKLVYEKRI

SEQ ID NO: 3298038 - protein, 17 aa, Plasmodium falciparum
YCSSYRKWIERKGKEFI

SEQ ID NO: 3298039 - protein, 23 aa, Plasmodium falciparum
YCYIWFDLFVHVSNFYIKPKNYY

SEQ ID NO: 3298040 - protein, 17 aa, Plasmodium falciparum
YCYYNKMLSFHKNDIYN

SEQ ID NO: 3298041 - protein, 18 aa, Plasmodium falciparum
YDAYVRKNERNADRIPIM

SEQ ID NO: 3298042 - protein, 39 aa, Plasmodium falciparum
YDCKKELFSFIQYNSFFWYILYKQYNMFLTYYDMTNHCN

SEQ ID NO: 3298043 - protein, 34 aa, Plasmodium falciparum
YDDDFFSNYYFIYLYYFKINLLQKIFQQNNFLKD

SEQ ID NO: 3298044 - protein, 26 aa, Plasmodium falciparum
YDDEKKFYFNFKKFKDIINVIKGSDE

SEQ ID NO: 3298045 - protein, 26 aa, Plasmodium falciparum
YDDIYIIIKTFKYISFFSIDLIDIWK

SEQ ID NO: 3298046 - protein, 31 aa, Plasmodium falciparum
YDDIYNILMKKNYLDIFPIFEENKKNNFHHM

SEQ ID NO: 3298047 - protein, 24 aa, Plasmodium falciparum
YDDKKLLFILMNKLKESIILGTSS

SEQ ID NO: 3298048 - protein, 22 aa, Plasmodium falciparum
YDDKTMFSIKDKLLKSLFERYD

SEQ ID NO: 3298049 - protein, 30 aa, Plasmodium falciparum
YDDLDYEIIYRILLIFKNLTRYKSFYHVIL

SEQ ID NO: 3298050 - protein, 25 aa, Plasmodium falciparum
YDDNDYVILLKDYKYYISFQLKNII

SEQ ID NO: 3298051 - protein, 21 aa, Plasmodium falciparum
YDDRILLLSDVDLLEKGDVYI

SEQ ID NO: 3298052 - protein, 34 aa, Plasmodium falciparum
YDEIQICLQKIFPLYLIQTALIYMVHISCCFLTN

SEQ ID NO: 3298053 - protein, 23 aa, Plasmodium falciparum
YDEKIDYFAKLLLNKGYDYYGTE

SEQ ID NO: 3298054 - protein, 25 aa, Plasmodium falciparum
YDENRGCFYMLYPQKNKMFKNSEYD

SEQ ID NO: 3298055 - protein, 26 aa, Plasmodium falciparum
YDHYLVKFLYFFTFGIPINEFLDCVF

SEQ ID NO: 3298056 - protein, 26 aa, Plasmodium falciparum
YDIDQRLLLYVYEKCYKFSFEFVNIY

SEQ ID NO: 3298057 - protein, 37 aa, Plasmodium falciparum
YDIIRRNIFDILTYTFSILTFYYIYEKNILNCNNVDY

SEQ ID NO: 3298058 - protein, 30 aa, Plasmodium falciparum
YDIKNTFINLFTYLFFFSLKVQEFSRFQIM

SEQ ID NO: 3298059 - protein, 30 aa, Plasmodium falciparum
YDIKVYLINIFFFIFIKTDKYKIYKQNNKK

SEQ ID NO: 3298060 - protein, 29 aa, Plasmodium falciparum
YDIPTKLSPNRYIPYTSGKYRGKRYIYLE

SEQ ID NO: 3298061 - protein, 25 aa, Plasmodium falciparum
YDIQRKIDYLFFNKYNFIKKEIKKN

SEQ ID NO: 3298062 - protein, 28 aa, Plasmodium falciparum
YDIRKYYCIYFLYLSLKYNIMSSQGLLH

SEQ ID NO: 3298063 - protein, 24 aa, Plasmodium falciparum
YDISLCILKWYIYQIYRYEEEKKK

SEQ ID NO: 3298064 - protein, 17 aa, Plasmodium falciparum
YDISLTTYLYYKYLNIF

SEQ ID NO: 3298065 - protein, 25 aa, Plasmodium falciparum
YDIYKKHNYFLNFIKNYNSSSIYLK

SEQ ID NO: 3298066 - protein, 33 aa, Plasmodium falciparum
YDKDILYYNYCIKILLICYYLSKNNIMDNRYMD

SEQ ID NO: 3298067 - protein, 25 aa, Plasmodium falciparum
YDKEKLFLFTYAYDKIQTYTYEELK

SEQ ID NO: 3298068 - protein, 27 aa, Plasmodium falciparum
YDKFQKIPQFLRWFKEWGDDFCEKRKE

SEQ ID NO: 3298069 - protein, 42 aa, Plasmodium falciparum
YDKIYIYQTLQLIYHPYFYLMYKLYKYLKIDASPVLLHDFYE

SEQ ID NO: 3298070 - protein, 25 aa, Plasmodium falciparum
YDKKKILTTILWIQIHMMVLEESKK

SEQ ID NO: 3298071 - protein, 24 aa, Plasmodium falciparum
YDKMKLINYLIYKHKQHKMRSDLK

SEQ ID NO: 3298072 - protein, 34 aa, Plasmodium falciparum
YDKNSYDFLYFDENLLFMTGVSFGICLFKFINFL

SEQ ID NO: 3298073 - protein, 17 aa, Plasmodium falciparum
YDLEFVLERLIRFNILR

SEQ ID NO: 3298074 - protein, 22 aa, Plasmodium falciparum
YDLLCILFSDIFCKKGNMYTNR

SEQ ID NO: 3298075 - protein, 30 aa, Plasmodium falciparum
YDLMKQNLIYHYFYKYYIIDEYIHNFCIKR

SEQ ID NO: 3298076 - protein, 20 aa, Plasmodium falciparum
YDMKRLYKFSLQNKIYMIDN

SEQ ID NO: 3298077 - protein, 26 aa, Plasmodium falciparum
YDMQQLQIYLYFNDIKYIIYKIKEVE

SEQ ID NO: 3298078 - protein, 31 aa, Plasmodium falciparum
YDNCRVLLPALFPFWKIIQNFYMAYFDLFLK

SEQ ID NO: 3298079 - protein, 18 aa, Plasmodium falciparum
YDNIINEYKKIKDINNNI

SEQ ID NO: 3298080 - protein, 17 aa, Plasmodium falciparum
YDNILMNLTKYVDLVFI

SEQ ID NO: 3298081 - protein, 27 aa, Plasmodium falciparum
YDNIQKMLMILCFQLTALYLSSRIKLD

SEQ ID NO: 3298082 - protein, 25 aa, Plasmodium falciparum
YDNMNIGNVCRSIFFFGGHTIFLKK

SEQ ID NO: 3298083 - protein, 32 aa, Plasmodium falciparum
YDNNDCLLFLYSIINLLKLPTFIMISIEIHRY

SEQ ID NO: 3298084 - protein, 24 aa, Plasmodium falciparum
YDNNLIITYLLIKKVLHNIIGDNT

SEQ ID NO: 3298085 - protein, 31 aa, Plasmodium falciparum
YDNNYYADVQKKLFYPIQKNTNLHPERKIIK

SEQ ID NO: 3298086 - protein, 22 aa, Plasmodium falciparum
YDNTLLILKHHFPNKFLSKINK

SEQ ID NO: 3298087 - protein, 19 aa, Plasmodium falciparum
YDPNVFPACKVKIALMNDE

SEQ ID NO: 3298088 - protein, 17 aa, Plasmodium falciparum
YDQINKKQFFLFLICFY

SEQ ID NO: 3298089 - protein, 47 aa, Plasmodium falciparum
YDRKKDYFNLQLQKLWSLFYIDTMNLLIYTILITIVSLYATYHKLIY

SEQ ID NO: 3298090 - protein, 23 aa, Plasmodium falciparum
YDRYIFYDMIGKSLYFPYILYIY

SEQ ID NO: 3298091 - protein, 21 aa, Plasmodium falciparum
YDSFIINQFFDVIGGILHLGQ

SEQ ID NO: 3298092 - protein, 18 aa, Plasmodium falciparum
YDSIKRLLRSGFSRIPVI

SEQ ID NO: 3298093 - protein, 24 aa, Plasmodium falciparum
YDSLIFFCNLLFKEFKRMKNLLLQ

SEQ ID NO: 3298094 - protein, 38 aa, Plasmodium falciparum
YDTHKRFIYIYILKEIYLLLHFHITHIWITIKEHTEEL

SEQ ID NO: 3298095 - protein, 26 aa, Plasmodium falciparum
YDTIYYKIIYIYDSIKYILKANKCFE

SEQ ID NO: 3298096 - protein, 26 aa, Plasmodium falciparum
YDTTKKFIYLMNPIQQIFISCMLFKL

SEQ ID NO: 3298097 - protein, 26 aa, Plasmodium falciparum
YDVEKIFLMKKYSYIIKGLRKNENIK

SEQ ID NO: 3298098 - protein, 29 aa, Plasmodium falciparum
YDYFHMNKILKVFNFIFNLLECTLHNNDV

SEQ ID NO: 3298099 - protein, 41 aa, Plasmodium falciparum
YDYNDYIHFFIEDIFHMNIKDFFFFNIYIDNMNKCITKKNI

SEQ ID NO: 3298100 - protein, 22 aa, Plasmodium falciparum
YDYYCINLLKIFYYIIQDKNIV

SEQ ID NO: 3298101 - protein, 20 aa, Plasmodium falciparum
YEAESLIPYHDQYKLTYGDS

SEQ ID NO: 3298102 - protein, 20 aa, Plasmodium falciparum
YEAFILLRNLYLFEKNKKDM

SEQ ID NO: 3298103 - protein, 21 aa, Plasmodium falciparum
YEAKFQFFKNNKIYISTFAVV

SEQ ID NO: 3298104 - protein, 34 aa, Plasmodium falciparum
YEALIKLLPFSSIQFLLKRKKWIPLLYTMYNKKE

SEQ ID NO: 3298105 - protein, 18 aa, Plasmodium falciparum
YECLLYIKEEEKILFYMC

SEQ ID NO: 3298106 - protein, 26 aa, Plasmodium falciparum
YEDDYDFFRLVFVKFLIKVQYLNKHV

SEQ ID NO: 3298107 - protein, 18 aa, Plasmodium falciparum
YEDEQFCLFICRIKNVHK

SEQ ID NO: 3298108 - protein, 25 aa, Plasmodium falciparum
YEDIDINNIYPYKSPKYKTLIDVVL

SEQ ID NO: 3298109 - protein, 18 aa, Plasmodium falciparum
YEDILSCLCFFPNLKYIK

SEQ ID NO: 3298110 - protein, 25 aa, Plasmodium falciparum
YEDLSLHIFLRIKKKLKFTFSHLQK

SEQ ID NO: 3298111 - protein, 23 aa, Plasmodium falciparum
YEDVIHLLLMYFYNIQGTHLSKY

SEQ ID NO: 3298112 - protein, 27 aa, Plasmodium falciparum
YEEICSLIIFFLINSYKRIYVYFNGLN

SEQ ID NO: 3298113 - protein, 25 aa, Plasmodium falciparum
YEEISLYDYYYYVFHILEISHEQYY

SEQ ID NO: 3298114 - protein, 27 aa, Plasmodium falciparum
YEEIVETKFYGMRENALGELDEYEERY

SEQ ID NO: 3298115 - protein, 24 aa, Plasmodium falciparum
YEELDINDIYPYQSPKYKTLIEVV

SEQ ID NO: 3298116 - protein, 24 aa, Plasmodium falciparum
YEELDINEIYPYQSPKYKTLIEVV

SEQ ID NO: 3298117 - protein, 31 aa, Plasmodium falciparum
YEELDLFSLGLLLYELWHTPFKSKEEKLINI

SEQ ID NO: 3298118 - protein, 25 aa, Plasmodium falciparum
YEELLLNFMLISLCYYSDSLIFLSY

SEQ ID NO: 3298119 - protein, 31 aa, Plasmodium falciparum
YEELSFNCALFLWYILCLTNAKGFVLAISGG

SEQ ID NO: 3298120 - protein, 60 aa, Plasmodium falciparum
YEEQILSKPESIKYFFEVITEILIVIRLGLIYRYTNFLIPFKNFLISKTLENVEMVCVTF

SEQ ID NO: 3298121 - protein, 26 aa, Plasmodium falciparum
YEERINYIYKISKWYIIKENKLLKEL

SEQ ID NO: 3298122 - protein, 26 aa, Plasmodium falciparum
YEGDKENYFFKLREDWWTANRATVWE

SEQ ID NO: 3298123 - protein, 19 aa, Plasmodium falciparum
YEGYESKFYKILKGDYGSV

SEQ ID NO: 3298124 - protein, 30 aa, Plasmodium falciparum
YEHEQIVQDLFFYFNIYQYVKKKKKEKILH

SEQ ID NO: 3298125 - protein, 26 aa, Plasmodium falciparum
YEHICFLFLITEMLSVVLLPYINFHI

SEQ ID NO: 3298126 - protein, 17 aa, Plasmodium falciparum
YEHIKLLYQFIIKKKEE

SEQ ID NO: 3298127 - protein, 18 aa, Plasmodium falciparum
YEHLKVVAFIVLLNRNEY

SEQ ID NO: 3298128 - protein, 23 aa, Plasmodium falciparum
YEINDLFLFHKIKLRSLKIFITF

SEQ ID NO: 3298129 - protein, 19 aa, Plasmodium falciparum
YEINPFLLKNMKLSLHLLS

SEQ ID NO: 3298130 - protein, 24 aa, Plasmodium falciparum
YEKEYFTFIFYEYNMLIQCFYHYE

SEQ ID NO: 3298131 - protein, 23 aa, Plasmodium falciparum
YEKILRFFNPAVLIIKVLSEIYN

SEQ ID NO: 3298132 - protein, 29 aa, Plasmodium falciparum
YEKINLQYIINYTFTILNCLLIKYSYNKN

SEQ ID NO: 3298133 - protein, 25 aa, Plasmodium falciparum
YEKKKKSCIIWLSFTSNMISSGLRE

SEQ ID NO: 3298134 - protein, 25 aa, Plasmodium falciparum
YEKKYLNLVIYMKLMKQKFKENHIF

SEQ ID NO: 3298135 - protein, 23 aa, Plasmodium falciparum
YEKLIHKFTFKKLCNSKAAFNNT

SEQ ID NO: 3298136 - protein, 37 aa, Plasmodium falciparum
YEKNIYLKIFNFFELLLLPSKLIRLEILYNIIRKYVK

SEQ ID NO: 3298137 - protein, 27 aa, Plasmodium falciparum
YEKNYKLACVYFRKGLIQLDYSFPDTN

SEQ ID NO: 3298138 - protein, 44 aa, Plasmodium falciparum
YEKRFKKLKLILKKIFMYLNIICMIIKYIKLKKWIFNENFDMHT

SEQ ID NO: 3298139 - protein, 42 aa, Plasmodium falciparum
YELICIGIILCSSKLLLQDYILNWFFPKLKERRLVKDDVDLK

SEQ ID NO: 3298140 - protein, 30 aa, Plasmodium falciparum
YELKKPKHLFLVKWMFLNTDNYKIKKNKQK

SEQ ID NO: 3298141 - protein, 18 aa, Plasmodium falciparum
YELMENPLIVQFKLLFLE

SEQ ID NO: 3298142 - protein, 28 aa, Plasmodium falciparum
YEMNKKILLFLLTFLKKSKYNETLVEKV

SEQ ID NO: 3298143 - protein, 25 aa, Plasmodium falciparum
YENIPTFFVPIIFVILHGGKNIVNN

SEQ ID NO: 3298144 - protein, 25 aa, Plasmodium falciparum
YENITLFLFKRLFKCFLRYEGLVNN

SEQ ID NO: 3298145 - protein, 23 aa, Plasmodium falciparum
YENKDFLTIIFISPITLTTYYTL

SEQ ID NO: 3298146 - protein, 23 aa, Plasmodium falciparum
YENLLYVIKTMWPNLFSVHICRG

SEQ ID NO: 3298147 - protein, 22 aa, Plasmodium falciparum
YENYIAFVFLQPEDYYYSSSEK

SEQ ID NO: 3298148 - protein, 23 aa, Plasmodium falciparum
YEPKLYHLSIFLTTLWAYKNIKC

SEQ ID NO: 3298149 - protein, 26 aa, Plasmodium falciparum
YEQDFNNIYYFNPLDYNKNIPINENH

SEQ ID NO: 3298150 - protein, 26 aa, Plasmodium falciparum
YEQKKYLFCAFLLLEFFTHPKDDFIL

SEQ ID NO: 3298151 - protein, 21 aa, Plasmodium falciparum
YEQWEQFMLLEKEKKKKFIGK

SEQ ID NO: 3298152 - protein, 27 aa, Plasmodium falciparum
YERKQVIFNFIIKIIDKIIPKYIINEY

SEQ ID NO: 3298153 - protein, 27 aa, Plasmodium falciparum
YERMSTYFKYFIFSSAKNIFYNILCGI

SEQ ID NO: 3298154 - protein, 27 aa, Plasmodium falciparum
YERTNSEDFLFFQPINISPIKEANYKL

SEQ ID NO: 3298155 - protein, 17 aa, Plasmodium falciparum
YERVEFLNCLKYIFSYN

SEQ ID NO: 3298156 - protein, 20 aa, Plasmodium falciparum
YERVSFISLVLLCGIVISCT

SEQ ID NO: 3298157 - protein, 27 aa, Plasmodium falciparum
YESFLKPLFVLLFTFLQHYKNDIIKIK

SEQ ID NO: 3298158 - protein, 23 aa, Plasmodium falciparum
YESKIFHILLPLPKTSEEIKIYK

SEQ ID NO: 3298159 - protein, 50 aa, Plasmodium falciparum
YESMLSPFFIFQFFSIVLWMLDSYWYFGIFSIFILIILESQLINKRIREF

SEQ ID NO: 3298160 - protein, 31 aa, Plasmodium falciparum
YESSIRYLSFLLLLFIYGVSYILAIIPDIAN

SEQ ID NO: 3298161 - protein, 24 aa, Plasmodium falciparum
YETIKIFLLYYNKNVDKYLNKKRT

SEQ ID NO: 3298162 - protein, 20 aa, Plasmodium falciparum
YETKLNAPILKLVILKDIFL

SEQ ID NO: 3298163 - protein, 22 aa, Plasmodium falciparum
YEVDLNYWKLWGLQTTHKLIKN

SEQ ID NO: 3298164 - protein, 30 aa, Plasmodium falciparum
YEVLPYKFTIIVESLFRLGFVKIIFSNKNL

SEQ ID NO: 3298165 - protein, 26 aa, Plasmodium falciparum
YEVQNYLYLLIFQRLHLLNYRNNDTL

SEQ ID NO: 3298166 - protein, 19 aa, Plasmodium falciparum
YEVYGLWNYLNQREKRKYT

SEQ ID NO: 3298167 - protein, 20 aa, Plasmodium falciparum
YEVYRLLCLFSILTNGINQN

SEQ ID NO: 3298168 - protein, 23 aa, Plasmodium falciparum
YEYFLGLLIFILHVFMRKNIFKR

SEQ ID NO: 3298169 - protein, 30 aa, Plasmodium falciparum
YEYHTCIMEPWDGPALIIFTDGYKVGASLD

SEQ ID NO: 3298170 - protein, 23 aa, Plasmodium falciparum
YEYIKDMLFLDLFQVHIITNSNL

SEQ ID NO: 3298171 - protein, 18 aa, Plasmodium falciparum
YEYILSDKILCISKKMPL

SEQ ID NO: 3298172 - protein, 23 aa, Plasmodium falciparum
YEYLKYMHFGKTTSRLICLLLKC

SEQ ID NO: 3298173 - protein, 17 aa, Plasmodium falciparum
YEYRIYKKFLPIIIHIY

SEQ ID NO: 3298174 - protein, 41 aa, Plasmodium falciparum
YEYVEYFYYLVTFIFIVDFIFKWIYMFISHNLRLCAAYHLE

SEQ ID NO: 3298175 - protein, 17 aa, Plasmodium falciparum
YEYVICFFMKKKIKNIL

SEQ ID NO: 3298176 - protein, 20 aa, Plasmodium falciparum
YEYYPMFNNYFSLAIIIKRI

SEQ ID NO: 3298177 - protein, 26 aa, Plasmodium falciparum
YFALVTHLYLYTYDYIFQKIINVIYE

SEQ ID NO: 3298178 - protein, 17 aa, Plasmodium falciparum
YFASLLKKKLFKKRIWD

SEQ ID NO: 3298179 - protein, 18 aa, Plasmodium falciparum
YFAYKDKLLKYMNTCKYT

SEQ ID NO: 3298180 - protein, 18 aa, Plasmodium falciparum
YFCNLFIHDSSRKTYYNL

SEQ ID NO: 3298181 - protein, 49 aa, Plasmodium falciparum
YFCSGYNFFSFKKKFVFFFIQRLFRLLCFRLMCLFLSTVHLNKFTSEII

SEQ ID NO: 3298182 - protein, 31 aa, Plasmodium falciparum
YFCSMYYQNYLHIFMYFSKIGTFIRYIKIFI

SEQ ID NO: 3298183 - protein, 33 aa, Plasmodium falciparum
YFDDFNLISPLVILLLEYFEYPRLYQLLKCNFQ

SEQ ID NO: 3298184 - protein, 25 aa, Plasmodium falciparum
YFDEVLVPMLFFYADGKVPNPDIMC

SEQ ID NO: 3298185 - protein, 17 aa, Plasmodium falciparum
YFDFTKFELNEIFSLTE

SEQ ID NO: 3298186 - protein, 18 aa, Plasmodium falciparum
YFDLTYIEVPTLNSTYTW

SEQ ID NO: 3298187 - protein, 19 aa, Plasmodium falciparum
YFDNNIIIDLFLKNIDSKN

SEQ ID NO: 3298188 - protein, 27 aa, Plasmodium falciparum
YFDNSFPNLLYLFYYNMNKKKKEKKKL

SEQ ID NO: 3298189 - protein, 18 aa, Plasmodium falciparum
YFDVLTAEKYMLGIFFMW

SEQ ID NO: 3298190 - protein, 20 aa, Plasmodium falciparum
YFDYNFFFLIEKRIFHNFHK

SEQ ID NO: 3298191 - protein, 19 aa, Plasmodium falciparum
YFEKYPIIIAFEKKKDFLY

SEQ ID NO: 3298192 - protein, 26 aa, Plasmodium falciparum
YFENINFLFFLFNIKTTWKELYIMSK

SEQ ID NO: 3298193 - protein, 20 aa, Plasmodium falciparum
YFESIIYFFIKKIEDWHCIN

SEQ ID NO: 3298194 - protein, 18 aa, Plasmodium falciparum
YFFDICEYILYNPYIIET

SEQ ID NO: 3298195 - protein, 20 aa, Plasmodium falciparum
YFFFRIFLYFYYIVLPLSNT

SEQ ID NO: 3298196 - protein, 21 aa, Plasmodium falciparum
YFFIVIFLILFLSYKNTLTKI

SEQ ID NO: 3298197 - protein, 20 aa, Plasmodium falciparum
YFFLSYKKGTIQDHVLLLCC

SEQ ID NO: 3298198 - protein, 18 aa, Plasmodium falciparum
YFFNHIYLNYLRIYNYSN

SEQ ID NO: 3298199 - protein, 19 aa, Plasmodium falciparum
YFFSNWLFIIMFTLSFFYR

SEQ ID NO: 3298200 - protein, 30 aa, Plasmodium falciparum
YFFTNNCEYIIFLFYNYHLLIEKEKLNKSC

SEQ ID NO: 3298201 - protein, 27 aa, Plasmodium falciparum
YFHKKDYNLLFQIKDKLLLPKNKIYQS

SEQ ID NO: 3298202 - protein, 18 aa, Plasmodium falciparum
YFICKYKHIDWLRNISND

SEQ ID NO: 3298203 - protein, 18 aa, Plasmodium falciparum
YFIILTNIYFYNYHLNIC

SEQ ID NO: 3298204 - protein, 17 aa, Plasmodium falciparum
YFIKLTYYNFNLGTFFS

SEQ ID NO: 3298205 - protein, 26 aa, Plasmodium falciparum
YFIKQNIFLCLSIINGYFIQSKFLCS

SEQ ID NO: 3298206 - protein, 18 aa, Plasmodium falciparum
YFILPKFHIINFYETFFS

SEQ ID NO: 3298207 - protein, 18 aa, Plasmodium falciparum
YFINDIYKDAFILNYHNI

SEQ ID NO: 3298208 - protein, 26 aa, Plasmodium falciparum
YFIRMKRRILKYNYIILHLSYFVSLK

SEQ ID NO: 3298209 - protein, 25 aa, Plasmodium falciparum
YFITTIFIFLLISNLLHHVYENNKL

SEQ ID NO: 3298210 - protein, 25 aa, Plasmodium falciparum
YFIYDKIRLIIPKKSSSPEFKILPE

SEQ ID NO: 3298211 - protein, 21 aa, Plasmodium falciparum
YFIYGGIVFSILTRSLYVYTQ

SEQ ID NO: 3298212 - protein, 24 aa, Plasmodium falciparum
YFKKKWKHFNIYIPPSAYILLDIL

SEQ ID NO: 3298213 - protein, 36 aa, Plasmodium falciparum
YFKNRKIFMNAFSSHLFLHPNPRWIDNKSKPVYIRE

SEQ ID NO: 3298214 - protein, 17 aa, Plasmodium falciparum
YFKPARGLLINILDHHT

SEQ ID NO: 3298215 - protein, 24 aa, Plasmodium falciparum
YFKSSILINLLKFISNTKLNNRIV

SEQ ID NO: 3298216 - protein, 17 aa, Plasmodium falciparum
YFKYEEFYHFFNNKMKK

SEQ ID NO: 3298217 - protein, 18 aa, Plasmodium falciparum
YFLDVISNFIYFGVLNLN

SEQ ID NO: 3298218 - protein, 21 aa, Plasmodium falciparum
YFLEEVFMKWLAAFSYDKIYM

SEQ ID NO: 3298219 - protein, 19 aa, Plasmodium falciparum
YFLIKKYEKIIALAYFTRF

SEQ ID NO: 3298220 - protein, 22 aa, Plasmodium falciparum
YFLILIFINSCHLYLSSENQKK

SEQ ID NO: 3298221 - protein, 40 aa, Plasmodium falciparum
YFLKDSFYQSFLYLLSSKIIWNPLLYNIWCNIYHTTLPLK

SEQ ID NO: 3298222 - protein, 17 aa, Plasmodium falciparum
YFLLKKKSKSSVDLLRV

SEQ ID NO: 3298223 - protein, 19 aa, Plasmodium falciparum
YFLNSYLDYFYFSIISIST

SEQ ID NO: 3298224 - protein, 17 aa, Plasmodium falciparum
YFLPKYILTNDDENKNK

SEQ ID NO: 3298225 - protein, 22 aa, Plasmodium falciparum
YFLQIYYHFFYNNQIYNRKNYN

SEQ ID NO: 3298226 - protein, 19 aa, Plasmodium falciparum
YFLRILNYINNNILLFLCK

SEQ ID NO: 3298227 - protein, 21 aa, Plasmodium falciparum
YFLVYITYVILAKSKNDLKVT

SEQ ID NO: 3298228 - protein, 27 aa, Plasmodium falciparum
YFMSNEKYKFVSFLYHLGNICNNICGI

SEQ ID NO: 3298229 - protein, 23 aa, Plasmodium falciparum
YFNFSYDLKYRPTLSPFIINKNK

SEQ ID NO: 3298230 - protein, 31 aa, Plasmodium falciparum
YFNKLKNLPDSHLFFSKLLLTLSQNDDKDKN

SEQ ID NO: 3298231 - protein, 20 aa, Plasmodium falciparum
YFNKNMILNNLNYINYVNGI

SEQ ID NO: 3298232 - protein, 17 aa, Plasmodium falciparum
YFNKVMKYIYSWDINKK

SEQ ID NO: 3298233 - protein, 26 aa, Plasmodium falciparum
YFNKYIHYYGYLRLFHLILINEGQDN

SEQ ID NO: 3298234 - protein, 17 aa, Plasmodium falciparum
YFNTFYKLKIINNQYVH

SEQ ID NO: 3298235 - protein, 23 aa, Plasmodium falciparum
YFNVRSCLETFIPQIPVADVKNE

SEQ ID NO: 3298236 - protein, 17 aa, Plasmodium falciparum
YFNYYELMVKVFTRNMI

SEQ ID NO: 3298237 - protein, 17 aa, Plasmodium falciparum
YFPLIISSLISHSFFFI

SEQ ID NO: 3298238 - protein, 23 aa, Plasmodium falciparum
YFRNTLRFIKLWAKSRGIYSNIL

SEQ ID NO: 3298239 - protein, 21 aa, Plasmodium falciparum
YFSFNQFVVYFFNYSFHFIKH

SEQ ID NO: 3298240 - protein, 22 aa, Plasmodium falciparum
YFSHIFKYMKKGDLFLIVTLCQ

SEQ ID NO: 3298241 - protein, 18 aa, Plasmodium falciparum
YFSIFQLIKATYGQFQFL

SEQ ID NO: 3298242 - protein, 19 aa, Plasmodium falciparum
YFSNFDIYFQNIQSPYWSD

SEQ ID NO: 3298243 - protein, 29 aa, Plasmodium falciparum
YFSSLRCTIYLLFLILILVIIILVVFRII

SEQ ID NO: 3298244 - protein, 17 aa, Plasmodium falciparum
YFTQEQLMFIIHLNIIL

SEQ ID NO: 3298245 - protein, 21 aa, Plasmodium falciparum
YFVKDFHSIFSFLSLKFLRHL

SEQ ID NO: 3298246 - protein, 25 aa, Plasmodium falciparum
YFVNNIFFHNFFYTYDNSLTLLLNS

SEQ ID NO: 3298247 - protein, 27 aa, Plasmodium falciparum
YFVVSFFVFLCIFITYILKDVRTYFLV

SEQ ID NO: 3298248 - protein, 19 aa, Plasmodium falciparum
YFYFHCLNKYIKSKNKIEG

SEQ ID NO: 3298249 - protein, 17 aa, Plasmodium falciparum
YFYLFNIYKNEEGKIYN

SEQ ID NO: 3298250 - protein, 18 aa, Plasmodium falciparum
YFYLIHPKNQLKVLNLSI

SEQ ID NO: 3298251 - protein, 18 aa, Plasmodium falciparum
YFYNLDHYNLYLSINKYN

SEQ ID NO: 3298252 - protein, 39 aa, Plasmodium falciparum
YFYNNIFENIFILCYKHLLYFFFSLLENYEKIFMKRNNF

SEQ ID NO: 3298253 - protein, 33 aa, Plasmodium falciparum
YFYQNHHTIYIPFFKLILMAIINPILKNMENIA

SEQ ID NO: 3298254 - protein, 21 aa, Plasmodium falciparum
YFYRLFYFISLLPRSFYFILL

SEQ ID NO: 3298255 - protein, 32 aa, Plasmodium falciparum
YGCQSFINILTISFVNIIYKPFIAIQKSKEFK

SEQ ID NO: 3298256 - protein, 17 aa, Plasmodium falciparum
YGDTLFLILKKKKLTFL

SEQ ID NO: 3298257 - protein, 25 aa, Plasmodium falciparum
YGELKIMFFFWLYSDTFQGAGYLYF

SEQ ID NO: 3298258 - protein, 23 aa, Plasmodium falciparum
YGERRLTCDLLELVLNAIMLINI

SEQ ID NO: 3298259 - protein, 24 aa, Plasmodium falciparum
YGFCLNMFWVLLCLCEPITVNKIN

SEQ ID NO: 3298260 - protein, 19 aa, Plasmodium falciparum
YGFINYFGMQRFGIYKNTF

SEQ ID NO: 3298261 - protein, 32 aa, Plasmodium falciparum
YGGNFKFLMNFFYPLLIFYIDLYQKEEEHTIK

SEQ ID NO: 3298262 - protein, 22 aa, Plasmodium falciparum
YGIAALVLIILVVALIVLYIWL

SEQ ID NO: 3298263 - protein, 21 aa, Plasmodium falciparum
YGICLLILFGLLPILMTKFAF

SEQ ID NO: 3298264 - protein, 18 aa, Plasmodium falciparum
YGIHAYAYAVGEKDKPVV

SEQ ID NO: 3298265 - protein, 19 aa, Plasmodium falciparum
YGILYLLIFLEVFVTLYFK

SEQ ID NO: 3298266 - protein, 23 aa, Plasmodium falciparum
YGINFFDICEYDPFPFDPDSYRK

SEQ ID NO: 3298267 - protein, 21 aa, Plasmodium falciparum
YGKFLIHMNYIKSYFNGIFNE

SEQ ID NO: 3298268 - protein, 20 aa, Plasmodium falciparum
YGLKMKFSINPFFINTTEKK

SEQ ID NO: 3298269 - protein, 22 aa, Plasmodium falciparum
YGLNVFIKVLVYKNDLGHINDH

SEQ ID NO: 3298270 - protein, 17 aa, Plasmodium falciparum
YGLVFSNCSIYFDDLEI

SEQ ID NO: 3298271 - protein, 18 aa, Plasmodium falciparum
YGMFCGSFFFFQSIGHKI

SEQ ID NO: 3298272 - protein, 32 aa, Plasmodium falciparum
YGNHPIYLYKSLNVLLIFFIPTMLGIDNNISE

SEQ ID NO: 3298273 - protein, 28 aa, Plasmodium falciparum
YGNIDDIPQFLRWFREWGTYVCEESEKN

SEQ ID NO: 3298274 - protein, 29 aa, Plasmodium falciparum
YGNITSLWFFRIITYLILCTEFYYILIGT

SEQ ID NO: 3298275 - protein, 39 aa, Plasmodium falciparum
YGPIGYSILAILIIVLIMLIIYLILRYRRKKKMKKKAQY

SEQ ID NO: 3298276 - protein, 25 aa, Plasmodium falciparum
YGPVIILYILILELGSMLISYILLQ

SEQ ID NO: 3298277 - protein, 28 aa, Plasmodium falciparum
YGQEHFIELYLIVYYVLGVRQLSHLYNN

SEQ ID NO: 3298278 - protein, 32 aa, Plasmodium falciparum
YGTKKMAIVNPLIYFNGIFTTQLMHEYIGTTE

SEQ ID NO: 3298279 - protein, 17 aa, Plasmodium falciparum
YGTLFDILHKYKINMKL

SEQ ID NO: 3298280 - protein, 24 aa, Plasmodium falciparum
YGVENSHFIVWMKTAALSEFRKKY

SEQ ID NO: 3298281 - protein, 33 aa, Plasmodium falciparum
YGYKYSFHVLDIRFRIMRLLESLQFHDLFCTYD

SEQ ID NO: 3298282 - protein, 26 aa, Plasmodium falciparum
YGYLFFDNVILLLLAKSMTLSKPACK

SEQ ID NO: 3298283 - protein, 40 aa, Plasmodium falciparum
YGYVGLGTYFFVFLLTFCSSYFFVHFKYISLADLKYVSEK

SEQ ID NO: 3298284 - protein, 19 aa, Plasmodium falciparum
YHEAGHAIVAYFLQPKTDP

SEQ ID NO: 3298285 - protein, 25 aa, Plasmodium falciparum
YHEKKYSFLLYKYLSNHFITLYSNN

SEQ ID NO: 3298286 - protein, 20 aa, Plasmodium falciparum
YHEYKFLFIAIIECIMPSIV

SEQ ID NO: 3298287 - protein, 17 aa, Plasmodium falciparum
YHFFSKNYKLHKKYHME

SEQ ID NO: 3298288 - protein, 24 aa, Plasmodium falciparum
YHFNCPICFIYIILNIIRKKKKNI

SEQ ID NO: 3298289 - protein, 21 aa, Plasmodium falciparum
YHFNFLLSLTYLHLYYRYVNV

SEQ ID NO: 3298290 - protein, 34 aa, Plasmodium falciparum
YHFTMKRKKLFVYFIFLSFIINFNFNININFVCS

SEQ ID NO: 3298291 - protein, 30 aa, Plasmodium falciparum
YHGYLLNGFIDICIAIFLNIAILQNISGFK

SEQ ID NO: 3298292 - protein, 27 aa, Plasmodium falciparum
YHHYFRNKIESFYKNYLLKVKNNKKQN

SEQ ID NO: 3298293 - protein, 20 aa, Plasmodium falciparum
YHIIEKIILLFFNNLKNMMG

SEQ ID NO: 3298294 - protein, 20 aa, Plasmodium falciparum
YHIKDFIKLKNIIFLTSCEV

SEQ ID NO: 3298295 - protein, 19 aa, Plasmodium falciparum
YHIKKNNSFLLYKGKRKKS

SEQ ID NO: 3298296 - protein, 18 aa, Plasmodium falciparum
YHIKSNKTFLLIFVNVKS

SEQ ID NO: 3298297 - protein, 33 aa, Plasmodium falciparum
YHIMIRYVIFTSFFMLIIQYHSFITCFNINHIT

SEQ ID NO: 3298298 - protein, 24 aa, Plasmodium falciparum
YHKIDFKILFYMDNYRMEKTVTAK

SEQ ID NO: 3298299 - protein, 26 aa, Plasmodium falciparum
YHKKFYIYAFFFNLIDVYIKFVEKYN

SEQ ID NO: 3298300 - protein, 54 aa, Plasmodium falciparum
YHKKNFFFIHTIFFYTLFTLSYLMCFSKKLKYFILYFINYKKYIHKVLFRKSII

SEQ ID NO: 3298301 - protein, 18 aa, Plasmodium falciparum
YHKNIIIFFYTDMKLQNQ

SEQ ID NO: 3298302 - protein, 20 aa, Plasmodium falciparum
YHLTKFFYKEYIIDSIINTL

SEQ ID NO: 3298303 - protein, 19 aa, Plasmodium falciparum
YHLVEFLEPSFYFQYTRCI

SEQ ID NO: 3298304 - protein, 18 aa, Plasmodium falciparum
YHNIWKGFNIFTFNLFNV

SEQ ID NO: 3298305 - protein, 17 aa, Plasmodium falciparum
YHNLMSYPFNKSKIFYL

SEQ ID NO: 3298306 - protein, 52 aa, Plasmodium falciparum
YHNVYKKIYYYKIKEGMLPFLCDHIFKCNYNLFYIFNRYNFQFNAYNILLNC

SEQ ID NO: 3298307 - protein, 30 aa, Plasmodium falciparum
YHPKSRHGLYIFLIHLIIVIKKHIQDENDR

SEQ ID NO: 3298308 - protein, 23 aa, Plasmodium falciparum
YHQEYIQYIYKYYTYNKTNKDPM

SEQ ID NO: 3298309 - protein, 26 aa, Plasmodium falciparum
YHQRINFKPILFYSNTSNIIILMKKK

SEQ ID NO: 3298310 - protein, 48 aa, Plasmodium falciparum
YHRAEIIGALFSIFFIWSLSAYILYTAIFRLFDVPKVNGYIMFVTAFI

SEQ ID NO: 3298311 - protein, 50 aa, Plasmodium falciparum
YHSGYVVGLWRDFPRNTFLPWRFSVELFLWDLLNVLPHELPHPAKLIMTY

SEQ ID NO: 3298312 - protein, 29 aa, Plasmodium falciparum
YHSYYFLTIFILIYIFRLYSSYKKWMRQY

SEQ ID NO: 3298313 - protein, 28 aa, Plasmodium falciparum
YHTERLIFFFNLLNGNNLFYYLSLHYLV

SEQ ID NO: 3298314 - protein, 20 aa, Plasmodium falciparum
YHVCCLYYNNITRNNCIYHI

SEQ ID NO: 3298315 - protein, 24 aa, Plasmodium falciparum
YHVKKILIQLLASKDFQYFQLENV

SEQ ID NO: 3298316 - protein, 35 aa, Plasmodium falciparum
YHVKNNFYNFYILATLLDFLNLFTIIQSKTRLAKL

SEQ ID NO: 3298317 - protein, 49 aa, Plasmodium falciparum
YHYENWYQIFTNNFYVIFFYILFIIFIVNNFLCFMFYKHLSNKLNAYVK

SEQ ID NO: 3298318 - protein, 18 aa, Plasmodium falciparum
YHYIYNNIDWVVAYVDRC

SEQ ID NO: 3298319 - protein, 38 aa, Plasmodium falciparum
YIAYKLLKNYFYLVSYMMTLPFIKWNILKSYINSFHMF

SEQ ID NO: 3298320 - protein, 24 aa, Plasmodium falciparum
YICENILHIFYKYKINIFELDNHF

SEQ ID NO: 3298321 - protein, 32 aa, Plasmodium falciparum
YICINNLITLNFFYNFSILSFINLLHISIDKS

SEQ ID NO: 3298322 - protein, 34 aa, Plasmodium falciparum
YICKYTNIHFVFYFRFIYLFFNKVCIDILNIINC

SEQ ID NO: 3298323 - protein, 20 aa, Plasmodium falciparum
YICLTICVIGMLCIKLRDKY

SEQ ID NO: 3298324 - protein, 22 aa, Plasmodium falciparum
YICNLIYNCLIYILQIKYTYNE

SEQ ID NO: 3298325 - protein, 23 aa, Plasmodium falciparum
YICNSLIMFIYLSPYICISMFQN

SEQ ID NO: 3298326 - protein, 20 aa, Plasmodium falciparum
YICRCFVFKVLIGTSLIRFK

SEQ ID NO: 3298327 - protein, 18 aa, Plasmodium falciparum
YIDIILLIFILYLKRCCK

SEQ ID NO: 3298328 - protein, 18 aa, Plasmodium falciparum
YIDIKNIYKDIDKCPYTH

SEQ ID NO: 3298329 - protein, 20 aa, Plasmodium falciparum
YIDKFPRINILKNNKFYNFY

SEQ ID NO: 3298330 - protein, 20 aa, Plasmodium falciparum
YIDKIYIYRIIKQIQKNVNK

SEQ ID NO: 3298331 - protein, 28 aa, Plasmodium falciparum
YIDKLLKNFLFLLKKYKYAFMINVHHII

SEQ ID NO: 3298332 - protein, 17 aa, Plasmodium falciparum
YIDLTLTNPIRYSYNDQ

SEQ ID NO: 3298333 - protein, 23 aa, Plasmodium falciparum
YIDMYVFCFQEVVELTGFRILMN

SEQ ID NO: 3298334 - protein, 20 aa, Plasmodium falciparum
YIDNINKGMFYWIGYNINDF

SEQ ID NO: 3298335 - protein, 30 aa, Plasmodium falciparum
YIDSRHNDILFIRPLKDLLSKEIYIYSYYK

SEQ ID NO: 3298336 - protein, 25 aa, Plasmodium falciparum
YIDTYIKMELLKKLNILLPTLYIKE

SEQ ID NO: 3298337 - protein, 19 aa, Plasmodium falciparum
YIEIKLLTILKNNFFLGPS

SEQ ID NO: 3298338 - protein, 29 aa, Plasmodium falciparum
YIEIQPHYHYFIYPFILTIKSKNNPTQLN

SEQ ID NO: 3298339 - protein, 32 aa, Plasmodium falciparum
YIEKFNDFHFYLFNKIFLFIYEDTKTENKIFL

SEQ ID NO: 3298340 - protein, 21 aa, Plasmodium falciparum
YIEKIFVLNKKKKLFFMSSFN

SEQ ID NO: 3298341 - protein, 20 aa, Plasmodium falciparum
YIEKPILLHSSYFKKNLFFV

SEQ ID NO: 3298342 - protein, 24 aa, Plasmodium falciparum
YIEKRIYLLLNKWVKEENGRKFIL

SEQ ID NO: 3298343 - protein, 27 aa, Plasmodium falciparum
YIENFFKKMPILYVPQNSWLFMGNIRS

SEQ ID NO: 3298344 - protein, 24 aa, Plasmodium falciparum
YIENNILHELWGDINFKWIDEDNE

SEQ ID NO: 3298345 - protein, 71 aa, Plasmodium falciparum
YIENSSLILILYSILCRIVVNTKLLQYVLKKFIKSLFLRGCLFYVQKMCEFYFLLFPYENKGKYESFTTKG

SEQ ID NO: 3298346 - protein, 26 aa, Plasmodium falciparum
YIERKDYMLMGLYNNSKRFKDNDKKD

SEQ ID NO: 3298347 - protein, 22 aa, Plasmodium falciparum
YIESYLQFHLSKLKLKNSYTLK

SEQ ID NO: 3298348 - protein, 18 aa, Plasmodium falciparum
YIEYTISILFITSISIIL

SEQ ID NO: 3298349 - protein, 20 aa, Plasmodium falciparum
YIFFISYIIQLCFNTKYIYC

SEQ ID NO: 3298350 - protein, 20 aa, Plasmodium falciparum
YIFFNLLMKIIEKVNEIDII

SEQ ID NO: 3298351 - protein, 24 aa, Plasmodium falciparum
YIFIDIVTILPLSIFMCWTSASEK

SEQ ID NO: 3298352 - protein, 20 aa, Plasmodium falciparum
YIFKIMLHCINLIRYSNISN

SEQ ID NO: 3298353 - protein, 19 aa, Plasmodium falciparum
YIFKNFLLKNKELKRKIFC

SEQ ID NO: 3298354 - protein, 26 aa, Plasmodium falciparum
YIFKNYLFYIVSLILPIYYGLKVYND

SEQ ID NO: 3298355 - protein, 19 aa, Plasmodium falciparum
YIFLIFISSFKCEVYKKFS

SEQ ID NO: 3298356 - protein, 17 aa, Plasmodium falciparum
YIFLITSLGLFSCALSF

SEQ ID NO: 3298357 - protein, 31 aa, Plasmodium falciparum
YIFNGYMRNIKLYKYLFNLLRSRVLAVCINY

SEQ ID NO: 3298358 - protein, 21 aa, Plasmodium falciparum
YIFSFNFIFLILSIFLIILFS

SEQ ID NO: 3298359 - protein, 18 aa, Plasmodium falciparum
YIFSHANCITFMYISRFV

SEQ ID NO: 3298360 - protein, 22 aa, Plasmodium falciparum
YIFSNYFLYPSYYHNVKEFQYL

SEQ ID NO: 3298361 - protein, 31 aa, Plasmodium falciparum
YIGENIFFNNIWLLLLRHPEIRTNILNFLEA

SEQ ID NO: 3298362 - protein, 18 aa, Plasmodium falciparum
YIGFIYTSPKLSDHIAVK

SEQ ID NO: 3298363 - protein, 31 aa, Plasmodium falciparum
YIHFISKYINILLYVYNFNNTLFTILHKYYI

SEQ ID NO: 3298364 - protein, 33 aa, Plasmodium falciparum
YIHIFEYHPIYSLIMKIYLYASFKSLYNQFLYP

SEQ ID NO: 3298365 - protein, 30 aa, Plasmodium falciparum
YIHILNIICTLWRSFLDKMITLRLEEERLA

SEQ ID NO: 3298366 - protein, 19 aa, Plasmodium falciparum
YIICFVLIVYMIMNYIFYN

SEQ ID NO: 3298367 - protein, 22 aa, Plasmodium falciparum
YIICMLFFFLFAINLFHISEKV

SEQ ID NO: 3298368 - protein, 21 aa, Plasmodium falciparum
YIICVIFIINVIRTRGEEDDD

SEQ ID NO: 3298369 - protein, 21 aa, Plasmodium falciparum
YIIESFLLKMSIKYNYVLYSP

SEQ ID NO: 3298370 - protein, 17 aa, Plasmodium falciparum
YIIFIMPTQTLISDLFL

SEQ ID NO: 3298371 - protein, 18 aa, Plasmodium falciparum
YIIFLFYFRYNLITKYIF

SEQ ID NO: 3298372 - protein, 17 aa, Plasmodium falciparum
YIIGNKNIKKSKNIIII

SEQ ID NO: 3298373 - protein, 25 aa, Plasmodium falciparum
YIIIILLFSLIIKRYTSLNRYHNVC

SEQ ID NO: 3298374 - protein, 18 aa, Plasmodium falciparum
YIIKNWIFILKKGLTSIF

SEQ ID NO: 3298375 - protein, 42 aa, Plasmodium falciparum
YIIKTYKFLCYYINQYNILLLNKFILFLYMYQNIKMSSLYEL

SEQ ID NO: 3298376 - protein, 23 aa, Plasmodium falciparum
YIILFILFCSYYINGRGVNRIYK

SEQ ID NO: 3298377 - protein, 26 aa, Plasmodium falciparum
YIINTFLYFLFVYISDLIFTHCIFTL

SEQ ID NO: 3298378 - protein, 17 aa, Plasmodium falciparum
YIINTFVRFFLEKKLQE

SEQ ID NO: 3298379 - protein, 30 aa, Plasmodium falciparum
YIIQLDVFKLRLKPFYYNIKIDISNIGPDY

SEQ ID NO: 3298380 - protein, 18 aa, Plasmodium falciparum
YIITYICTNIYHCIKNEI

SEQ ID NO: 3298381 - protein, 28 aa, Plasmodium falciparum
YIIVTILFIIFLLLFSFFSYFKHKKFNI

SEQ ID NO: 3298382 - protein, 23 aa, Plasmodium falciparum
YIKDFIHIIINYFIMNKYMIHTN

SEQ ID NO: 3298383 - protein, 38 aa, Plasmodium falciparum
YIKEFVNYIPITIKNINILLALSLYFLNFNINNNCTEN

SEQ ID NO: 3298384 - protein, 31 aa, Plasmodium falciparum
YIKEIRSKDVGIYFFSDDSIYSKNIILNISE

SEQ ID NO: 3298385 - protein, 20 aa, Plasmodium falciparum
YIKIYEFLTFRTIIEKRQMT

SEQ ID NO: 3298386 - protein, 18 aa, Plasmodium falciparum
YIKKLFYKIFKKAKKKIY

SEQ ID NO: 3298387 - protein, 24 aa, Plasmodium falciparum
YIKKPFYSTALLKSLLFVNCMLNP

SEQ ID NO: 3298388 - protein, 28 aa, Plasmodium falciparum
YIKKRKILIYIHKYFLKKKINIYEYIIL

SEQ ID NO: 3298389 - protein, 28 aa, Plasmodium falciparum
YIKKRQALFNFFFYKRSYITHYEKYFTN

SEQ ID NO: 3298390 - protein, 18 aa, Plasmodium falciparum
YIKLIYYTTLCVYISLLH

SEQ ID NO: 3298391 - protein, 21 aa, Plasmodium falciparum
YIKNHYLLRNRYKFTKDIKEV

SEQ ID NO: 3298392 - protein, 29 aa, Plasmodium falciparum
YIKNIFHFKFITLVNLIKLLIINYGEVFT

SEQ ID NO: 3298393 - protein, 17 aa, Plasmodium falciparum
YIKNKLWNPKDVYYHLK

SEQ ID NO: 3298394 - protein, 25 aa, Plasmodium falciparum
YIKNLYLHYTPFYFPYINDSNTYIL

SEQ ID NO: 3298395 - protein, 24 aa, Plasmodium falciparum
YIKNNLMMKLIIKDNIFLWLDLIM

SEQ ID NO: 3298396 - protein, 17 aa, Plasmodium falciparum
YIKTRWFTLLGLFITYI

SEQ ID NO: 3298397 - protein, 19 aa, Plasmodium falciparum
YILCNYFKFMPIEITMIIN

SEQ ID NO: 3298398 - protein, 17 aa, Plasmodium falciparum
YILCSFQNLFMCISLNI

SEQ ID NO: 3298399 - protein, 29 aa, Plasmodium falciparum
YILEKKICKLLLGYYKYKKIHNLINNTFY

SEQ ID NO: 3298400 - protein, 17 aa, Plasmodium falciparum
YILFCAYVSKEKDLIKL

SEQ ID NO: 3298401 - protein, 17 aa, Plasmodium falciparum
YILFLRYNDHILSTTYK

SEQ ID NO: 3298402 - protein, 19 aa, Plasmodium falciparum
YILIFCIIIKNVFSFQPSQ

SEQ ID NO: 3298403 - protein, 19 aa, Plasmodium falciparum
YILIFCVLVHICPIHTLNI

SEQ ID NO: 3298404 - protein, 19 aa, Plasmodium falciparum
YILILGPVSPTQLLYICKG

SEQ ID NO: 3298405 - protein, 18 aa, Plasmodium falciparum
YILLCIFMGFFYAVGYGI

SEQ ID NO: 3298406 - protein, 18 aa, Plasmodium falciparum
YILMKYFIKIKGSIYIFI

SEQ ID NO: 3298407 - protein, 18 aa, Plasmodium falciparum
YILNKYTLFLQPTTDYMK

SEQ ID NO: 3298408 - protein, 17 aa, Plasmodium falciparum
YILNYINYFFSFGKYGI

SEQ ID NO: 3298409 - protein, 18 aa, Plasmodium falciparum
YILNYMLIDNLIVFINYD

SEQ ID NO: 3298410 - protein, 25 aa, Plasmodium falciparum
YILRILSFCYLKIYVLLNSYNNISK

SEQ ID NO: 3298411 - protein, 17 aa, Plasmodium falciparum
YILRSYIIDFFKCKKYL

SEQ ID NO: 3298412 - protein, 19 aa, Plasmodium falciparum
YILSTLCFIIMKLIDKYET

SEQ ID NO: 3298413 - protein, 63 aa, Plasmodium falciparum
YIMELMERSHMFLLIKIFFVLFLFEVNVKMYFIVSGMFILYNRGFFDLIINNLNFVSSNDSIE

SEQ ID NO: 3298414 - protein, 20 aa, Plasmodium falciparum
YIMEQVFLYLLNFCYKNRED

SEQ ID NO: 3298415 - protein, 30 aa, Plasmodium falciparum
YIMFERWNQLRYSLFYTISLMNSSIQYNHN

SEQ ID NO: 3298416 - protein, 17 aa, Plasmodium falciparum
YIMHIKIIVFTFEHYFN

SEQ ID NO: 3298417 - protein, 18 aa, Plasmodium falciparum
YIMKMMVLIFKIIYNYDI

SEQ ID NO: 3298418 - protein, 21 aa, Plasmodium falciparum
YIMKSFHPHILDEFWFNLSCQ

SEQ ID NO: 3298419 - protein, 31 aa, Plasmodium falciparum
YIMNHIFYLLFIFFSLLFFVFVTNTTLNPMF

SEQ ID NO: 3298420 - protein, 17 aa, Plasmodium falciparum
YIMNINKNKNKNILGFT

SEQ ID NO: 3298421 - protein, 28 aa, Plasmodium falciparum
YIMTYYIFGYFYFCTFFLGPYIVFNAWL

SEQ ID NO: 3298422 - protein, 25 aa, Plasmodium falciparum
YINDDIFLNIIKFNKDLTGTKTNIN

SEQ ID NO: 3298423 - protein, 23 aa, Plasmodium falciparum
YINDFFLFYLHQCGYVNKYYYYK

SEQ ID NO: 3298424 - protein, 21 aa, Plasmodium falciparum
YINDIFLFLNSNEQYSCVFSD

SEQ ID NO: 3298425 - protein, 19 aa, Plasmodium falciparum
YINDIYFYMKRFKSIMNIQ

SEQ ID NO: 3298426 - protein, 26 aa, Plasmodium falciparum
YINDYFYNNLPNYNWFFYSTKKIINN

SEQ ID NO: 3298427 - protein, 20 aa, Plasmodium falciparum
YINEIIIKKIKDELLKNYNI

SEQ ID NO: 3298428 - protein, 22 aa, Plasmodium falciparum
YINELHIILKELKIEENKMLEN

SEQ ID NO: 3298429 - protein, 33 aa, Plasmodium falciparum
YINENIFGFLGLTHLLVIVLDMSYDLIRQFKTI

SEQ ID NO: 3298430 - protein, 19 aa, Plasmodium falciparum
YINFDQKMFLNIEKGIMSM

SEQ ID NO: 3298431 - protein, 19 aa, Plasmodium falciparum
YINFKYILPPKCDIIIRFE

SEQ ID NO: 3298432 - protein, 28 aa, Plasmodium falciparum
YINFLKSIFVYILLLSNFKYEFSRLSKR

SEQ ID NO: 3298433 - protein, 37 aa, Plasmodium falciparum
YINFNIQITPILFIVYLFISIFFFSHNKKFAFTYLSH

SEQ ID NO: 3298434 - protein, 29 aa, Plasmodium falciparum
YINFSNTIIYNFLKIILKFIHHSTEVEPK

SEQ ID NO: 3298435 - protein, 26 aa, Plasmodium falciparum
YINHNLLKRFLILLIYSSNVINMVGM

SEQ ID NO: 3298436 - protein, 19 aa, Plasmodium falciparum
YINILILYYIITQKEKTNK

SEQ ID NO: 3298437 - protein, 25 aa, Plasmodium falciparum
YINKTYTFKPLFTHHFFSDSEQVIG

SEQ ID NO: 3298438 - protein, 17 aa, Plasmodium falciparum
YINKWVLKLLDTHSSKE

SEQ ID NO: 3298439 - protein, 23 aa, Plasmodium falciparum
YINKYDFFFSYHQNDLFLFFSFF

SEQ ID NO: 3298440 - protein, 19 aa, Plasmodium falciparum
YINKYLINNGFCLFACPYL

SEQ ID NO: 3298441 - protein, 18 aa, Plasmodium falciparum
YINLFILALIVVNIVVVI

SEQ ID NO: 3298442 - protein, 17 aa, Plasmodium falciparum
YINLLKNIKDPTDKAIR

SEQ ID NO: 3298443 - protein, 21 aa, Plasmodium falciparum
YINLSLPYIPYIEKYLDVIHY

SEQ ID NO: 3298444 - protein, 25 aa, Plasmodium falciparum
YINNDKSFFIILLSYEELFNIYRYS

SEQ ID NO: 3298445 - protein, 33 aa, Plasmodium falciparum
YINNDYYKNILNKNICFFFDNNIQDIYLKKYYD

SEQ ID NO: 3298446 - protein, 17 aa, Plasmodium falciparum
YINNRKICYLNDYLKYV

SEQ ID NO: 3298447 - protein, 24 aa, Plasmodium falciparum
YINNSFLELYYNIGKDIIYLVHVM

SEQ ID NO: 3298448 - protein, 29 aa, Plasmodium falciparum
YINRSTPNLLLLNSLLPHLNYLYIQNCIQ

SEQ ID NO: 3298449 - protein, 22 aa, Plasmodium falciparum
YINSKYYYKNILHFLEKYNIDN

SEQ ID NO: 3298450 - protein, 32 aa, Plasmodium falciparum
YINTYSSLLYIILLNNYVFIYNYNTGQFIRSI

SEQ ID NO: 3298451 - protein, 23 aa, Plasmodium falciparum
YINVLHYTSFFMYHYYDEMKWNH

SEQ ID NO: 3298452 - protein, 21 aa, Plasmodium falciparum
YINYDCCILPIGISNYFELNI

SEQ ID NO: 3298453 - protein, 25 aa, Plasmodium falciparum
YINYVEAYFIYKLVLYIKNIISKHQ

SEQ ID NO: 3298454 - protein, 19 aa, Plasmodium falciparum
YIPDNMKISIILDAATKQD

SEQ ID NO: 3298455 - protein, 17 aa, Plasmodium falciparum
YIPILNTLISFIEVIYK

SEQ ID NO: 3298456 - protein, 20 aa, Plasmodium falciparum
YIPNLDLYIILKLAQMKEYI

SEQ ID NO: 3298457 - protein, 21 aa, Plasmodium falciparum
YIPQRLRWMTEWAEWFCKEQS

SEQ ID NO: 3298458 - protein, 25 aa, Plasmodium falciparum
YIPQRLRWMTEWAEWYCKAQKKEYD

SEQ ID NO: 3298459 - protein, 22 aa, Plasmodium falciparum
YIPQRLRWMTEWAEWYCKMQSQ

SEQ ID NO: 3298460 - protein, 20 aa, Plasmodium falciparum
YIQELLIKNFYKYIFVIIDT

SEQ ID NO: 3298461 - protein, 18 aa, Plasmodium falciparum
YIQIMFFIWICISSISGY

SEQ ID NO: 3298462 - protein, 26 aa, Plasmodium falciparum
YIQNVMLFRQLGISAPKIRFFPEIHK

SEQ ID NO: 3298463 - protein, 23 aa, Plasmodium falciparum
YIRENICFYLYNNNNSSVPSVIN

SEQ ID NO: 3298464 - protein, 41 aa, Plasmodium falciparum
YIRKFNWNDSFFLYILKKYIFKYLMYMSIYQINNLASLLYQ

SEQ ID NO: 3298465 - protein, 23 aa, Plasmodium falciparum
YIRKKTILCFYKLVISNLSILHT

SEQ ID NO: 3298466 - protein, 19 aa, Plasmodium falciparum
YIRNSIIISIKHNYIRLLL

SEQ ID NO: 3298467 - protein, 32 aa, Plasmodium falciparum
YIRNYGELYRLFWSMYLHGGFMHILFNVICQI

SEQ ID NO: 3298468 - protein, 20 aa, Plasmodium falciparum
YISFILFTLYVLPKKLVPLL

SEQ ID NO: 3298469 - protein, 25 aa, Plasmodium falciparum
YISFKKLKFFNFFYRRGKSKNKTHN

SEQ ID NO: 3298470 - protein, 19 aa, Plasmodium falciparum
YISFLVLFILFPFFFIWNI

SEQ ID NO: 3298471 - protein, 18 aa, Plasmodium falciparum
YISGCIYIVYYKSLYCFS

SEQ ID NO: 3298472 - protein, 19 aa, Plasmodium falciparum
YISGFLFSSRALCKLENYI

SEQ ID NO: 3298473 - protein, 23 aa, Plasmodium falciparum
YISKIIHELLFLHTIDITKMYPY

SEQ ID NO: 3298474 - protein, 27 aa, Plasmodium falciparum
YISKLESDLFLYIFNNNLNSSINIILN

SEQ ID NO: 3298475 - protein, 37 aa, Plasmodium falciparum
YISKRAFSVFLFYLFFFLFFHFYFLCSSSFAVIIHES

SEQ ID NO: 3298476 - protein, 57 aa, Plasmodium falciparum
YISKYINVIIFLMFIFDPLYLEKFINKYYKYIYFKKILFFISFFNYLYTNEQNIFSF

SEQ ID NO: 3298477 - protein, 17 aa, Plasmodium falciparum
YISLFLCGSIFSNLISL

SEQ ID NO: 3298478 - protein, 35 aa, Plasmodium falciparum
YISLKFLCLSLYMIGFYYVFLYNSFESVSLEIFKN

SEQ ID NO: 3298479 - protein, 23 aa, Plasmodium falciparum
YISNIHFAVLFLTLTVYPINNFI

SEQ ID NO: 3298480 - protein, 24 aa, Plasmodium falciparum
YISQVLHIPLYVLDKFYNNLNDLQ

SEQ ID NO: 3298481 - protein, 27 aa, Plasmodium falciparum
YISSCFILFDLCFSFHLLKMKYKNHMN

SEQ ID NO: 3298482 - protein, 18 aa, Plasmodium falciparum
YISSFILNIIFSLTKYYL

SEQ ID NO: 3298483 - protein, 17 aa, Plasmodium falciparum
YISSLNFKYNFLNIKQM

SEQ ID NO: 3298484 - protein, 34 aa, Plasmodium falciparum
YISSMLYINIYLCQIFFILLNILRINNTNIYTNI

SEQ ID NO: 3298485 - protein, 26 aa, Plasmodium falciparum
YISSPRIIDPYKSKIFFLINPNGDLK

SEQ ID NO: 3298486 - protein, 22 aa, Plasmodium falciparum
YISYLYLFINYFFHRYIISYLM

SEQ ID NO: 3298487 - protein, 25 aa, Plasmodium falciparum
YITKSYLCVSFLNQLYYSKTQCIMI

SEQ ID NO: 3298488 - protein, 21 aa, Plasmodium falciparum
YITNVFIKWNKKIYKYSCKYI

SEQ ID NO: 3298489 - protein, 31 aa, Plasmodium falciparum
YITPYCNIFINFFHYHYIHILNIICTLWRSF

SEQ ID NO: 3298490 - protein, 18 aa, Plasmodium falciparum
YITTPYPGGFIESEDKFL

SEQ ID NO: 3298491 - protein, 28 aa, Plasmodium falciparum
YITTTIFIKFLREFGIIPHFFNNDRCLS

SEQ ID NO: 3298492 - protein, 17 aa, Plasmodium falciparum
YIVDIIFCSLFGYDMYD

SEQ ID NO: 3298493 - protein, 18 aa, Plasmodium falciparum
YIVLSIHSSKLFLNFRNL

SEQ ID NO: 3298494 - protein, 30 aa, Plasmodium falciparum
YIWASYYFLSFNYFIFLLFNYYNMYYLNVI

SEQ ID NO: 3298495 - protein, 19 aa, Plasmodium falciparum
YIWNDLYNNSIKSKISNFI

SEQ ID NO: 3298496 - protein, 24 aa, Plasmodium falciparum
YIYESLVLVTWSNGIISLFNHKYN

SEQ ID NO: 3298497 - protein, 17 aa, Plasmodium falciparum
YIYFCSFCYNFITTQNS

SEQ ID NO: 3298498 - protein, 17 aa, Plasmodium falciparum
YIYIAHSIYFYLNNLSF

SEQ ID NO: 3298499 - protein, 18 aa, Plasmodium falciparum
YIYIHNFFHFLSCYLLYD

SEQ ID NO: 3298500 - protein, 19 aa, Plasmodium falciparum
YIYILFLSYYKKGNCFIHN

SEQ ID NO: 3298501 - protein, 24 aa, Plasmodium falciparum
YIYKEHFVLYFFKLNLYETMKVCE

SEQ ID NO: 3298502 - protein, 24 aa, Plasmodium falciparum
YIYKYLFYESFNVNGWIICFNENK

SEQ ID NO: 3298503 - protein, 32 aa, Plasmodium falciparum
YIYLKETYEYLFYLLKNYKLPYYSSKYTMNII

SEQ ID NO: 3298504 - protein, 32 aa, Plasmodium falciparum
YIYMRNYIFFLIIMIEIYLFIYFNQIGYTYTN

SEQ ID NO: 3298505 - protein, 17 aa, Plasmodium falciparum
YIYRRFIFKNLDHYLSN

SEQ ID NO: 3298506 - protein, 18 aa, Plasmodium falciparum
YIYSQEYIYFTLQNALHL

SEQ ID NO: 3298507 - protein, 25 aa, Plasmodium falciparum
YIYVLIYIIFNNILVSFYSCYILLN

SEQ ID NO: 3298508 - protein, 27 aa, Plasmodium falciparum
YKAVKLYMNMFLNNYKLKKGKGNCKNL

SEQ ID NO: 3298509 - protein, 19 aa, Plasmodium falciparum
YKCKYVHQLFAYSIYDYMG

SEQ ID NO: 3298510 - protein, 33 aa, Plasmodium falciparum
YKCLMNYFILFFLIYFFLMNSLLFTIICMQFSN

SEQ ID NO: 3298511 - protein, 26 aa, Plasmodium falciparum
YKCTLKINICELLYICIYRSYIHANI

SEQ ID NO: 3298512 - protein, 17 aa, Plasmodium falciparum
YKCVYFFFNTQYTYSFV

SEQ ID NO: 3298513 - protein, 25 aa, Plasmodium falciparum
YKDFKEFILVLINIRKYEKALKKLK

SEQ ID NO: 3298514 - protein, 24 aa, Plasmodium falciparum
YKDHLLFLSFCYMNKLIEKYYNIY

SEQ ID NO: 3298515 - protein, 45 aa, Plasmodium falciparum
YKDIYTVLKLYSYIDKHLSFVFPVGAFILFKRMLKLSNNKLLCLI

SEQ ID NO: 3298516 - protein, 19 aa, Plasmodium falciparum
YKDLLKLRKNNMQKEAKVM

SEQ ID NO: 3298517 - protein, 23 aa, Plasmodium falciparum
YKDQKWFKDVLYKYEKELKELEN

SEQ ID NO: 3298518 - protein, 24 aa, Plasmodium falciparum
YKDYKYAFYKLQRKSLIESVLKMI

SEQ ID NO: 3298519 - protein, 22 aa, Plasmodium falciparum
YKECNRLFTLNYKKLYPLNNYI

SEQ ID NO: 3298520 - protein, 17 aa, Plasmodium falciparum
YKELFDIFLKNISLTCV

SEQ ID NO: 3298521 - protein, 27 aa, Plasmodium falciparum
YKELIYYKKLITFFKKCYKKNIKKNNK

SEQ ID NO: 3298522 - protein, 17 aa, Plasmodium falciparum
YKELKIIYKIPRNLRKR

SEQ ID NO: 3298523 - protein, 17 aa, Plasmodium falciparum
YKELKNRYGSVETFLVL

SEQ ID NO: 3298524 - protein, 23 aa, Plasmodium falciparum
YKENELNFLFSQRPYVEDDCMYL

SEQ ID NO: 3298525 - protein, 22 aa, Plasmodium falciparum
YKEQLLIKKRIIINNEIVIIND

SEQ ID NO: 3298526 - protein, 31 aa, Plasmodium falciparum
YKEQYFFAELSKLFYYFTQKIIYIQFSQYKE

SEQ ID NO: 3298527 - protein, 18 aa, Plasmodium falciparum
YKFISFIKTIEDVKEKWK

SEQ ID NO: 3298528 - protein, 18 aa, Plasmodium falciparum
YKFLQMVYKVLLLLNIYL

SEQ ID NO: 3298529 - protein, 17 aa, Plasmodium falciparum
YKGFKQIKWTKCYDMLI

SEQ ID NO: 3298530 - protein, 19 aa, Plasmodium falciparum
YKGINYFADNKGAALHPST

SEQ ID NO: 3298531 - protein, 23 aa, Plasmodium falciparum
YKGKLYIHPLNKEKLQQSYHNNK

SEQ ID NO: 3298532 - protein, 25 aa, Plasmodium falciparum
YKHISYFFIYNYKYLIKIFNDKEGD

SEQ ID NO: 3298533 - protein, 30 aa, Plasmodium falciparum
YKIDRLLIKKLYDILFLYKKELYHYMNLFN

SEQ ID NO: 3298534 - protein, 17 aa, Plasmodium falciparum
YKIIFKNVIPFTKYDDF

SEQ ID NO: 3298535 - protein, 23 aa, Plasmodium falciparum
YKIIHKYINYILSISLNTIDDYN

SEQ ID NO: 3298536 - protein, 27 aa, Plasmodium falciparum
YKIKDDIYYILKNAYAKYFKIDVYKKG

SEQ ID NO: 3298537 - protein, 18 aa, Plasmodium falciparum
YKILKDCCFFFDTFKMDR

SEQ ID NO: 3298538 - protein, 35 aa, Plasmodium falciparum
YKILKSRLKTLFFVKSILNVLFNFFYNLTHDNNEF

SEQ ID NO: 3298539 - protein, 17 aa, Plasmodium falciparum
YKILLERKIINPYNNMS

SEQ ID NO: 3298540 - protein, 17 aa, Plasmodium falciparum
YKILRKNEYFFNNIILI

SEQ ID NO: 3298541 - protein, 32 aa, Plasmodium falciparum
YKINILNYCLLFSFFLFYASYFFFINGIINPA

SEQ ID NO: 3298542 - protein, 45 aa, Plasmodium falciparum
YKIPLYNNYTNNMIYPFPFLISPHYVQDLNYLYPFNYHNKYAEEN

SEQ ID NO: 3298543 - protein, 29 aa, Plasmodium falciparum
YKITLNIYFFLLLFLNNYVTRYIRNDMKY

SEQ ID NO: 3298544 - protein, 30 aa, Plasmodium falciparum
YKIVKSIYNIFLSYSLFIFRFCSLSNLKDE

SEQ ID NO: 3298545 - protein, 44 aa, Plasmodium falciparum
YKIYIVNQICKYFIYLKLNLINELLYIFPLDSTKIHFLPCKYYE

SEQ ID NO: 3298546 - protein, 24 aa, Plasmodium falciparum
YKIYLYDNFIFNYPAYYVEQKKDH

SEQ ID NO: 3298547 - protein, 34 aa, Plasmodium falciparum
YKKAYNINMIFTKLLILILFDTQLLKISLKYFNH

SEQ ID NO: 3298548 - protein, 42 aa, Plasmodium falciparum
YKKDEKIILLILYNSWFLYHYIYIIYLNTIKLKNFLSYKQNI

SEQ ID NO: 3298549 - protein, 33 aa, Plasmodium falciparum
YKKENILIMKKILHYFPLLKLINNPSDLKKLKK

SEQ ID NO: 3298550 - protein, 27 aa, Plasmodium falciparum
YKKFDYFYDIFIKILKTILFIEYNNKN

SEQ ID NO: 3298551 - protein, 31 aa, Plasmodium falciparum
YKKFRLILFCFIFFPYCLIVQLIGCIKLKTS

SEQ ID NO: 3298552 - protein, 20 aa, Plasmodium falciparum
YKKFYDLYNRGFKLTEKDYI

SEQ ID NO: 3298553 - protein, 41 aa, Plasmodium falciparum
YKKGCLPYFLVIEIFSVIILGFIYVTFLDTRPYIGNSFIAT

SEQ ID NO: 3298554 - protein, 30 aa, Plasmodium falciparum
YKKILIFIHFFFNCFGLKPWFFLCSDKNGE

SEQ ID NO: 3298555 - protein, 30 aa, Plasmodium falciparum
YKKKKKKLINKIWIQIHMMLLEEYKKEECK

SEQ ID NO: 3298556 - protein, 27 aa, Plasmodium falciparum
YKKKRRFRFFFYRNNINKPLESEDFRI

SEQ ID NO: 3298557 - protein, 37 aa, Plasmodium falciparum
YKKKSQLIHIMFLTFFPFFKLYNLTDLLNNINKYDIQ

SEQ ID NO: 3298558 - protein, 18 aa, Plasmodium falciparum
YKKLYKNISYLKEKYYIY

SEQ ID NO: 3298559 - protein, 23 aa, Plasmodium falciparum
YKKNILMLNVSTLRFLYSHMKSE

SEQ ID NO: 3298560 - protein, 23 aa, Plasmodium falciparum
YKKNNYFLTLYKQKIFDFRNYTI

SEQ ID NO: 3298561 - protein, 24 aa, Plasmodium falciparum
YKKRKFILYFLKLFKLYDTKQRLY

SEQ ID NO: 3298562 - protein, 18 aa, Plasmodium falciparum
YKKSFYKCFSYFLHNKLS

SEQ ID NO: 3298563 - protein, 23 aa, Plasmodium falciparum
YKKWMRQYFLSYFNFSNLNTPDI

SEQ ID NO: 3298564 - protein, 31 aa, Plasmodium falciparum
YKKYSLFYKIYKYIYLAEILYNLARALHHLS

SEQ ID NO: 3298565 - protein, 24 aa, Plasmodium falciparum
YKLDRKFIRFLKTNYKKNIILLIL

SEQ ID NO: 3298566 - protein, 26 aa, Plasmodium falciparum
YKLGIHHYYFNIRTFISWVMNSLFHG

SEQ ID NO: 3298567 - protein, 18 aa, Plasmodium falciparum
YKLINIITNIFNMLDVEQ

SEQ ID NO: 3298568 - protein, 21 aa, Plasmodium falciparum
YKLKLFYIKIIVFIHYVNACE

SEQ ID NO: 3298569 - protein, 26 aa, Plasmodium falciparum
YKLNDLYEYIYFKIYSFYKETRLKKR

SEQ ID NO: 3298570 - protein, 24 aa, Plasmodium falciparum
YKLWNNYIAIPYVKKYNPIKYNDI

SEQ ID NO: 3298571 - protein, 18 aa, Plasmodium falciparum
YKMILMNLTLYDYSQNVN

SEQ ID NO: 3298572 - protein, 23 aa, Plasmodium falciparum
YKMNIILTIVFLLQNTNMKLSNW

SEQ ID NO: 3298573 - protein, 24 aa, Plasmodium falciparum
YKMQIDFFFFYHCLKHYIPCDDEN

SEQ ID NO: 3298574 - protein, 26 aa, Plasmodium falciparum
YKNEKGLYEFLLSPIIKIICNENDKK

SEQ ID NO: 3298575 - protein, 54 aa, Plasmodium falciparum
YKNEQIYFSFVLIHDILLSCKYFYEHFYSNYLSVFIYTLYWLKNEHNLFNYHMD

SEQ ID NO: 3298576 - protein, 24 aa, Plasmodium falciparum
YKNFLNFYQFLYYSIFYEHKSYMD

SEQ ID NO: 3298577 - protein, 27 aa, Plasmodium falciparum
YKNFNNYIYPLIFFNIINKKYNLKYFF

SEQ ID NO: 3298578 - protein, 26 aa, Plasmodium falciparum
YKNFQLQLLIKYIMNFIYTDLAIYID

SEQ ID NO: 3298579 - protein, 44 aa, Plasmodium falciparum
YKNFTFHVPINYSIYWRIVKIPMNLYIMKKKIWEKKYDTILDFL

SEQ ID NO: 3298580 - protein, 29 aa, Plasmodium falciparum
YKNHKCKCLYFFAYAPTYLGKYYNHYFLS

SEQ ID NO: 3298581 - protein, 19 aa, Plasmodium falciparum
YKNIIQNILRISFNFTYFF

SEQ ID NO: 3298582 - protein, 25 aa, Plasmodium falciparum
YKNIKGIIVILPEIFYNYINMNEME

SEQ ID NO: 3298583 - protein, 35 aa, Plasmodium falciparum
YKNIKIKFYKFLTYYDFVFLKNRLNFIKITYKNDN

SEQ ID NO: 3298584 - protein, 19 aa, Plasmodium falciparum
YKNILHFLEKYNIDNIIKS

SEQ ID NO: 3298585 - protein, 32 aa, Plasmodium falciparum
YKNINTIKPFLYFLFIFILKECENYQLLYYIK

SEQ ID NO: 3298586 - protein, 28 aa, Plasmodium falciparum
YKNLLLLQCFSEYFYWLCKLKKSNKTNI

SEQ ID NO: 3298587 - protein, 19 aa, Plasmodium falciparum
YKNLYCYYTTTDIIKRLLK

SEQ ID NO: 3298588 - protein, 38 aa, Plasmodium falciparum
YKNNYNKLIKLLYLPSEKLLIILYNFINNLKKIFPQEL

SEQ ID NO: 3298589 - protein, 20 aa, Plasmodium falciparum
YKNSPLYTLPLKNLNKCIKH

SEQ ID NO: 3298590 - protein, 19 aa, Plasmodium falciparum
YKNVHMGVLLFSEYTRDIV

SEQ ID NO: 3298591 - protein, 28 aa, Plasmodium falciparum
YKNVTIYAKYVIVALPLGCLIENDKKRK

SEQ ID NO: 3298592 - protein, 26 aa, Plasmodium falciparum
YKPINRGLYNYIYVNILKIKNLEHIK

SEQ ID NO: 3298593 - protein, 26 aa, Plasmodium falciparum
YKPSILFFQKIILLNFLSIYNNKENT

SEQ ID NO: 3298594 - protein, 31 aa, Plasmodium falciparum
YKQLICYRDIIFFILFNFDQFLLLIKDEEQN

SEQ ID NO: 3298595 - protein, 31 aa, Plasmodium falciparum
YKQLIKEIKILFLWIYKLTNIEIRPLIHFKD

SEQ ID NO: 3298596 - protein, 26 aa, Plasmodium falciparum
YKRIYYYCNLLKCDILTFIKKDIENL

SEQ ID NO: 3298597 - protein, 31 aa, Plasmodium falciparum
YKSIFLFQIFLFLIYFLVLLIGSFNFSFKLF

SEQ ID NO: 3298598 - protein, 23 aa, Plasmodium falciparum
YKSKWIYDFLNCIKLTINLNDQH

SEQ ID NO: 3298599 - protein, 35 aa, Plasmodium falciparum
YKSNFEMQFLLFKPFFFFIVNPYISYRSYFISSFL

SEQ ID NO: 3298600 - protein, 32 aa, Plasmodium falciparum
YKSTWALNLLLYILNVLLIYLQMHMFYFLFEI

SEQ ID NO: 3298601 - protein, 18 aa, Plasmodium falciparum
YKSVLFICINNLFVYTFN

SEQ ID NO: 3298602 - protein, 25 aa, Plasmodium falciparum
YKSYYIFKHILLSKYYKIVHLPLYD

SEQ ID NO: 3298603 - protein, 18 aa, Plasmodium falciparum
YKTIISFKKKYKQYLLFN

SEQ ID NO: 3298604 - protein, 26 aa, Plasmodium falciparum
YKTINHLLLLLFFMDNRKIIKENFLK

SEQ ID NO: 3298605 - protein, 25 aa, Plasmodium falciparum
YKTLKLLYIILQKIQDIYIIDILFN

SEQ ID NO: 3298606 - protein, 19 aa, Plasmodium falciparum
YKVCDSVLFPISSYADEEN

SEQ ID NO: 3298607 - protein, 22 aa, Plasmodium falciparum
YKVTFMYEKIYPYSYPNVVIHM

SEQ ID NO: 3298608 - protein, 27 aa, Plasmodium falciparum
YKVYDLCKLYPHLKFTLNGGIQTIQEA

SEQ ID NO: 3298609 - protein, 35 aa, Plasmodium falciparum
YKWYDNIVWILARYTYYFLLSYKFNGLSQKIVESY

SEQ ID NO: 3298610 - protein, 17 aa, Plasmodium falciparum
YKYCPYLKPLEIKGIKR

SEQ ID NO: 3298611 - protein, 21 aa, Plasmodium falciparum
YKYEKAIFYNFFKSSVDLFLL

SEQ ID NO: 3298612 - protein, 27 aa, Plasmodium falciparum
YKYIIFTVLILANILYDNKKRCMIKKN

SEQ ID NO: 3298613 - protein, 20 aa, Plasmodium falciparum
YKYKKSIILYLHEITKKTLL

SEQ ID NO: 3298614 - protein, 23 aa, Plasmodium falciparum
YKYKYRFFYIIIKKNYSNKIKRK

SEQ ID NO: 3298615 - protein, 17 aa, Plasmodium falciparum
YKYMIPYDHLELIKIRL

SEQ ID NO: 3298616 - protein, 25 aa, Plasmodium falciparum
YKYTRYIFCFIIAKLLYDVVTNLKL

SEQ ID NO: 3298617 - protein, 17 aa, Plasmodium falciparum
YKYYHHCSILRKELYDR

SEQ ID NO: 3298618 - protein, 22 aa, Plasmodium falciparum
YLAHELMHAYIWLTKMEKSHNY

SEQ ID NO: 3298619 - protein, 27 aa, Plasmodium falciparum
YLALLLIYIFFLCNKKGFHFCHRIILR

SEQ ID NO: 3298620 - protein, 17 aa, Plasmodium falciparum
YLARYHFSWFEKEKIIN

SEQ ID NO: 3298621 - protein, 26 aa, Plasmodium falciparum
YLCKDLLIELILVPMLYRSNTTIELF

SEQ ID NO: 3298622 - protein, 18 aa, Plasmodium falciparum
YLCLCSSLYFLNRAEEKS

SEQ ID NO: 3298623 - protein, 20 aa, Plasmodium falciparum
YLDDILIPSLPLIKKCNDIS

SEQ ID NO: 3298624 - protein, 20 aa, Plasmodium falciparum
YLDKIKINFIFNTIIQRIKQ

SEQ ID NO: 3298625 - protein, 17 aa, Plasmodium falciparum
YLDLYKYEKKKFNEMDK

SEQ ID NO: 3298626 - protein, 29 aa, Plasmodium falciparum
YLDNDNLIKIMFIQIYMLALEEYKKEQFF

SEQ ID NO: 3298627 - protein, 17 aa, Plasmodium falciparum
YLEDIPCNRLFKDVNYE

SEQ ID NO: 3298628 - protein, 20 aa, Plasmodium falciparum
YLEFAYLNCLELFKKVYISG

SEQ ID NO: 3298629 - protein, 27 aa, Plasmodium falciparum
YLEKQQSAWPFLKPVSLSEAPDYYDII

SEQ ID NO: 3298630 - protein, 17 aa, Plasmodium falciparum
YLESLPFYNDSYITSMY

SEQ ID NO: 3298631 - protein, 19 aa, Plasmodium falciparum
YLFLLEIYKSYIYCGINYE

SEQ ID NO: 3298632 - protein, 22 aa, Plasmodium falciparum
YLFLLFYFIFINCSYIHFRKEK

SEQ ID NO: 3298633 - protein, 19 aa, Plasmodium falciparum
YLFLNNVPRFNIKFLKLFN

SEQ ID NO: 3298634 - protein, 17 aa, Plasmodium falciparum
YLFLYDSYLMNIIFLLF

SEQ ID NO: 3298635 - protein, 23 aa, Plasmodium falciparum
YLFLYIFIIMKCYDFFIIPKNMK

SEQ ID NO: 3298636 - protein, 18 aa, Plasmodium falciparum
YLFYNFFNQLEKTKHGSS

SEQ ID NO: 3298637 - protein, 19 aa, Plasmodium falciparum
YLGFAMFCLIASSLGQMIF

SEQ ID NO: 3298638 - protein, 23 aa, Plasmodium falciparum
YLGPIIIFPFFYFCDKYVYSHTN

SEQ ID NO: 3298639 - protein, 20 aa, Plasmodium falciparum
YLHDFPFPYFVVVDDLNNIP

SEQ ID NO: 3298640 - protein, 24 aa, Plasmodium falciparum
YLHNRKMIKNIFPLMKLSSMEHYI

SEQ ID NO: 3298641 - protein, 19 aa, Plasmodium falciparum
YLIDKNKLNKIFLLAIQYI

SEQ ID NO: 3298642 - protein, 18 aa, Plasmodium falciparum
YLIDNIRELFFSSKNIRI

SEQ ID NO: 3298643 - protein, 21 aa, Plasmodium falciparum
YLIESINLPTNLPLNDSQKLA

SEQ ID NO: 3298644 - protein, 19 aa, Plasmodium falciparum
YLIFSLYERIAMLNYLYSN

SEQ ID NO: 3298645 - protein, 18 aa, Plasmodium falciparum
YLIFVCLMKIIPGFFTNK

SEQ ID NO: 3298646 - protein, 24 aa, Plasmodium falciparum
YLIKDVDNVLWLFEKFSIEHNSFK

SEQ ID NO: 3298647 - protein, 22 aa, Plasmodium falciparum
YLINILFALSDVKGISTHDTCD

SEQ ID NO: 3298648 - protein, 23 aa, Plasmodium falciparum
YLINITHLFPPLYSFIKNTTEEE

SEQ ID NO: 3298649 - protein, 27 aa, Plasmodium falciparum
YLINVFTNFYYYAIIELMYNKSLSLDI

SEQ ID NO: 3298650 - protein, 18 aa, Plasmodium falciparum
YLINYVILIIFLTTLSLL

SEQ ID NO: 3298651 - protein, 20 aa, Plasmodium falciparum
YLKDNILFLLSNSNIYFIFI

SEQ ID NO: 3298652 - protein, 22 aa, Plasmodium falciparum
YLKILWNLSLSFLSFVGVLLIT

SEQ ID NO: 3298653 - protein, 19 aa, Plasmodium falciparum
YLKIPIINILRYIVISNDI

SEQ ID NO: 3298654 - protein, 24 aa, Plasmodium falciparum
YLKNFFTFNYSNIFPKLLSTSSYI

SEQ ID NO: 3298655 - protein, 19 aa, Plasmodium falciparum
YLLENFSKYIPISPKMFLL

SEQ ID NO: 3298656 - protein, 27 aa, Plasmodium falciparum
YLLKNYTMHDLIYKYIIYYYCRKKLKR

SEQ ID NO: 3298657 - protein, 17 aa, Plasmodium falciparum
YLLLHNKNFYVSPKRKI

SEQ ID NO: 3298658 - protein, 36 aa, Plasmodium falciparum
YLLNIIYNLIFYDDSGYFIFHFGYSIFVCLEEIQHI

SEQ ID NO: 3298659 - protein, 27 aa, Plasmodium falciparum
YLLSKERIKMLLPYKDHLVLSSIIYCL

SEQ ID NO: 3298660 - protein, 18 aa, Plasmodium falciparum
YLLTYKKNNFNSFVYLLH

SEQ ID NO: 3298661 - protein, 17 aa, Plasmodium falciparum
YLLVGIPFSTVGLILIT

SEQ ID NO: 3298662 - protein, 29 aa, Plasmodium falciparum
YLMGLYVLFFFILLVIALITLLIISIYIK

SEQ ID NO: 3298663 - protein, 27 aa, Plasmodium falciparum
YLMKSKLLIDIFFSAPCTYLFSKFIFV

SEQ ID NO: 3298664 - protein, 22 aa, Plasmodium falciparum
YLMNFIKYFKNFSQIFFLCDTL

SEQ ID NO: 3298665 - protein, 20 aa, Plasmodium falciparum
YLMNVKLKTFYRPRLNDNST

SEQ ID NO: 3298666 - protein, 19 aa, Plasmodium falciparum
YLNDILTILIIILAIIIFS

SEQ ID NO: 3298667 - protein, 20 aa, Plasmodium falciparum
YLNFSSFFNAFFELSDIWTP

SEQ ID NO: 3298668 - protein, 17 aa, Plasmodium falciparum
YLNFYKLLNFDNLLVDS

SEQ ID NO: 3298669 - protein, 26 aa, Plasmodium falciparum
YLNKFFGILGIFNFFLGNYLCLIGIT

SEQ ID NO: 3298670 - protein, 38 aa, Plasmodium falciparum
YLNKKSFYLYDVFNIEPIKYKYLPSPPIINEEKGVIIA

SEQ ID NO: 3298671 - protein, 21 aa, Plasmodium falciparum
YLNLYSPLCSNNPYFSFREIL

SEQ ID NO: 3298672 - protein, 20 aa, Plasmodium falciparum
YLNNFLNLNILKSAYENIGC

SEQ ID NO: 3298673 - protein, 41 aa, Plasmodium falciparum
YLNNKRFIFKFTTQYFYFILFIYFAYFFLQNILSPNQIMNA

SEQ ID NO: 3298674 - protein, 18 aa, Plasmodium falciparum
YLNNPSSLYFFSKYENYV

SEQ ID NO: 3298675 - protein, 23 aa, Plasmodium falciparum
YLNRNYYAYHKLKFFFSCTHFIK

SEQ ID NO: 3298676 - protein, 17 aa, Plasmodium falciparum
YLPPRREHICTSNLEYL

SEQ ID NO: 3298677 - protein, 27 aa, Plasmodium falciparum
YLQKDILNLMFLLLSRCMCIHVIKSFN

SEQ ID NO: 3298678 - protein, 37 aa, Plasmodium falciparum
YLQTYNKYYIFVKVKKLLYPLPFINNKKPNIFLTYQI

SEQ ID NO: 3298679 - protein, 26 aa, Plasmodium falciparum
YLSDSLFYYELLINMIIYQNLNYENN

SEQ ID NO: 3298680 - protein, 17 aa, Plasmodium falciparum
YLSFLTKNYITAKEDAK

SEQ ID NO: 3298681 - protein, 29 aa, Plasmodium falciparum
YLSHDINWYTFLFLFRLTSFKEIAKKNVA

SEQ ID NO: 3298682 - protein, 25 aa, Plasmodium falciparum
YLSYDQIWQLVYNPNLFYNLHNRGE

SEQ ID NO: 3298683 - protein, 29 aa, Plasmodium falciparum
YLTDDRFIHLLATIPPKTILILEDIDFIF

SEQ ID NO: 3298684 - protein, 24 aa, Plasmodium falciparum
YLTGKEFILTRFKKLVYDSIDAIE

SEQ ID NO: 3298685 - protein, 21 aa, Plasmodium falciparum
YLTIEPLLFHFFLKYNKNSHT

SEQ ID NO: 3298686 - protein, 18 aa, Plasmodium falciparum
YLTKFIFLLKIQNKREHY

SEQ ID NO: 3298687 - protein, 19 aa, Plasmodium falciparum
YLTPLMLACRIGCEECVQN

SEQ ID NO: 3298688 - protein, 19 aa, Plasmodium falciparum
YLTTLIFVLLFLIIIKHLY

SEQ ID NO: 3298689 - protein, 31 aa, Plasmodium falciparum
YLTYHVYVLYLCRILIFLISTIFALLVLKAE

SEQ ID NO: 3298690 - protein, 34 aa, Plasmodium falciparum
YLVHDHSLFIIYFNSLFSILILLLNDAIPEIRYL

SEQ ID NO: 3298691 - protein, 19 aa, Plasmodium falciparum
YLVIIFIYLQILSLKTYDY

SEQ ID NO: 3298692 - protein, 26 aa, Plasmodium falciparum
YLVKNILFDDLLRQLPFYSSEVLYEL

SEQ ID NO: 3298693 - protein, 24 aa, Plasmodium falciparum
YLVNVIERLLPIIIKPIKNNNTIK

SEQ ID NO: 3298694 - protein, 17 aa, Plasmodium falciparum
YLVSVYGIYILHKASKE

SEQ ID NO: 3298695 - protein, 17 aa, Plasmodium falciparum
YLYDLTQNKWKKLITEN

SEQ ID NO: 3298696 - protein, 18 aa, Plasmodium falciparum
YLYERMWNEYISRFYETI

SEQ ID NO: 3298697 - protein, 24 aa, Plasmodium falciparum
YLYGTYVVFLVYVFTGIYGIILSS

SEQ ID NO: 3298698 - protein, 29 aa, Plasmodium falciparum
YLYISIIYFFIYFLLFIRTSTFLDILFVA

SEQ ID NO: 3298699 - protein, 17 aa, Plasmodium falciparum
YLYKNFNLTFHKKIIKN

SEQ ID NO: 3298700 - protein, 17 aa, Plasmodium falciparum
YLYLNYQNFILSNIANM

SEQ ID NO: 3298701 - protein, 25 aa, Plasmodium falciparum
YLYNNIYLYYCDILFHNKNKQVHSI

SEQ ID NO: 3298702 - protein, 17 aa, Plasmodium falciparum
YLYPIKTLPFYNDESIY

SEQ ID NO: 3298703 - protein, 32 aa, Plasmodium falciparum
YLYRLNEGMFYSWKLRYFVIKNNKLCYYVNHS

SEQ ID NO: 3298704 - protein, 17 aa, Plasmodium falciparum
YLYSFMNIQIKEITAKL

SEQ ID NO: 3298705 - protein, 24 aa, Plasmodium falciparum
YMCDNILRNIIINTYTYFLDLLNN

SEQ ID NO: 3298706 - protein, 21 aa, Plasmodium falciparum
YMDFTVFHMLPSILSEEICSL

SEQ ID NO: 3298707 - protein, 17 aa, Plasmodium falciparum
YMDKRYMNKRYMDKIYM

SEQ ID NO: 3298708 - protein, 20 aa, Plasmodium falciparum
YMDLLTHMLQFQDPLFESLI

SEQ ID NO: 3298709 - protein, 23 aa, Plasmodium falciparum
YMDRKYDMLLLKNIKSDINNDNN

SEQ ID NO: 3298710 - protein, 21 aa, Plasmodium falciparum
YMEEEVKDKMFIEREQGTEEE

SEQ ID NO: 3298711 - protein, 21 aa, Plasmodium falciparum
YMFEKFCIINIFLSVFEFLIG

SEQ ID NO: 3298712 - protein, 30 aa, Plasmodium falciparum
YMFLMVVCVNKLYAFFAYTFDERHQRNLYT

SEQ ID NO: 3298713 - protein, 44 aa, Plasmodium falciparum
YMGKKKYILYAITIYTYVYSIYYLLLHVFGFVKSILDSQINVQF

SEQ ID NO: 3298714 - protein, 22 aa, Plasmodium falciparum
YMILYSFLYNCRFSIFCILFIF

SEQ ID NO: 3298715 - protein, 22 aa, Plasmodium falciparum
YMKKIYKELLISLRGDTYYMSQ

SEQ ID NO: 3298716 - protein, 21 aa, Plasmodium falciparum
YMLCLFMLHGELLFFCKKHEN

SEQ ID NO: 3298717 - protein, 20 aa, Plasmodium falciparum
YMLEKWKKEEWFYNLKNEWI

SEQ ID NO: 3298718 - protein, 31 aa, Plasmodium falciparum
YMLPTHVNFIYYLYSIYYLRKKKSTHIFNCC

SEQ ID NO: 3298719 - protein, 19 aa, Plasmodium falciparum
YMNKGINFLLTNISKLQSE

SEQ ID NO: 3298720 - protein, 17 aa, Plasmodium falciparum
YMNTYTNNINPFDVSIF

SEQ ID NO: 3298721 - protein, 20 aa, Plasmodium falciparum
YMNYKDMFHFYIFSDDILLQ

SEQ ID NO: 3298722 - protein, 19 aa, Plasmodium falciparum
YMQINLLHFISIFNDFYSL

SEQ ID NO: 3298723 - protein, 27 aa, Plasmodium falciparum
YMSKEKLHFFLLQLLVDPILGSLYQEK

SEQ ID NO: 3298724 - protein, 27 aa, Plasmodium falciparum
YMSQKQKIIWRRWVAKHPYRIREKKID

SEQ ID NO: 3298725 - protein, 24 aa, Plasmodium falciparum
YMTDEYYFVCFYEYTKNAYNEKKD

SEQ ID NO: 3298726 - protein, 28 aa, Plasmodium falciparum
YMYIYGCYIYVCIYLLYLNMLYIYIFVY

SEQ ID NO: 3298727 - protein, 21 aa, Plasmodium falciparum
YMYIYIAPIYIPMYVIHKPTC

SEQ ID NO: 3298728 - protein, 26 aa, Plasmodium falciparum
YMYKDENILTLFYIRKNYLKAESKEE

SEQ ID NO: 3298729 - protein, 17 aa, Plasmodium falciparum
YMYMYYWISANILKKMQ

SEQ ID NO: 3298730 - protein, 25 aa, Plasmodium falciparum
YMYNIFLSYFSYLHYVMKYMLPSSN

SEQ ID NO: 3298731 - protein, 18 aa, Plasmodium falciparum
YMYNSFLPNKQQSFFNNN

SEQ ID NO: 3298732 - protein, 20 aa, Plasmodium falciparum
YMYNYELVLIDYDTCHFINN

SEQ ID NO: 3298733 - protein, 38 aa, Plasmodium falciparum
YMYNYPFVFFYIFVFFLSFILIFFNTILFFILSCYYYF

SEQ ID NO: 3298734 - protein, 25 aa, Plasmodium falciparum
YMYRLNMPLFINKLKLLNDYLNYKI

SEQ ID NO: 3298735 - protein, 27 aa, Plasmodium falciparum
YNASICNFLSFSFLRLLFHDQIKYNLS

SEQ ID NO: 3298736 - protein, 34 aa, Plasmodium falciparum
YNCDKYIFLLLLHNTIECIFYVLLEEYKRWNKTH

SEQ ID NO: 3298737 - protein, 17 aa, Plasmodium falciparum
YNCEMLRYYIIIGVLQA

SEQ ID NO: 3298738 - protein, 30 aa, Plasmodium falciparum
YNCGTVCRFILPLLCLYICKQNIKAQEENK

SEQ ID NO: 3298739 - protein, 27 aa, Plasmodium falciparum
YNDEQNIFFYLLKCYFRKMISLLYLYT

SEQ ID NO: 3298740 - protein, 27 aa, Plasmodium falciparum
YNDEYYFYLLNNFVISYFHLRGSGGLM

SEQ ID NO: 3298741 - protein, 25 aa, Plasmodium falciparum
YNDFFNFWVAHMLKDSIHWKKKLEK

SEQ ID NO: 3298742 - protein, 17 aa, Plasmodium falciparum
YNDFLYNLNKFYEVILS

SEQ ID NO: 3298743 - protein, 18 aa, Plasmodium falciparum
YNDIVIMKKLIICKIFID

SEQ ID NO: 3298744 - protein, 19 aa, Plasmodium falciparum
YNDLKLHILNILDETRKCI

SEQ ID NO: 3298745 - protein, 18 aa, Plasmodium falciparum
YNDLLSYYYVLVNMFFID

SEQ ID NO: 3298746 - protein, 42 aa, Plasmodium falciparum
YNDYIKPHWPLILLKYYILPYLILYFLLNTLYNLIAWIYKSN

SEQ ID NO: 3298747 - protein, 28 aa, Plasmodium falciparum
YNEDYFVNMFGSLKYINEIIIKKIKDEL

SEQ ID NO: 3298748 - protein, 24 aa, Plasmodium falciparum
YNEEFCLNLKWSYGDYGDIIKGTD

SEQ ID NO: 3298749 - protein, 20 aa, Plasmodium falciparum
YNEKISRCPIWIPLKNIPKN

SEQ ID NO: 3298750 - protein, 25 aa, Plasmodium falciparum
YNEMILKFMSIAKPISLFLKEYHNT

SEQ ID NO: 3298751 - protein, 40 aa, Plasmodium falciparum
YNEQIKFLFCFHSLYFPLKNLLFISFINLFYHKNIERNIV

SEQ ID NO: 3298752 - protein, 35 aa, Plasmodium falciparum
YNERYISIKVLFKRWLEYFLEDYNKLKEKLNPCMY

SEQ ID NO: 3298753 - protein, 31 aa, Plasmodium falciparum
YNESICPNIWLFYYPFLMNNININKKNYLYF

SEQ ID NO: 3298754 - protein, 33 aa, Plasmodium falciparum
YNESKIHGFFLLRCLPPIKMFPKQLVIQETQKL

SEQ ID NO: 3298755 - protein, 22 aa, Plasmodium falciparum
YNFCLFIGIYNKLYFKMNGIDI

SEQ ID NO: 3298756 - protein, 21 aa, Plasmodium falciparum
YNFCSRGLVFYIGNKSLKLLK

SEQ ID NO: 3298757 - protein, 23 aa, Plasmodium falciparum
YNFDNFFFSIFSKYINKIFVEIY

SEQ ID NO: 3298758 - protein, 26 aa, Plasmodium falciparum
YNFHEDFILILIKTYMNILKKYESYN

SEQ ID NO: 3298759 - protein, 26 aa, Plasmodium falciparum
YNFIGNFQWHRLMRELFVFKKKSEKQ

SEQ ID NO: 3298760 - protein, 17 aa, Plasmodium falciparum
YNFKTLYTFFYTTKKKS

SEQ ID NO: 3298761 - protein, 27 aa, Plasmodium falciparum
YNFNKMNFLLFYKFLCNDYNYIINYYM

SEQ ID NO: 3298762 - protein, 26 aa, Plasmodium falciparum
YNFSYYMNMKLFIKNQPWYDKGRIYN

SEQ ID NO: 3298763 - protein, 37 aa, Plasmodium falciparum
YNFYNPHQHMVYGRPYYWVPPPPALEYTKGFNPMEQR

SEQ ID NO: 3298764 - protein, 31 aa, Plasmodium falciparum
YNGIKNFNFIYPSLFYFFSCLKKYDYYTGTP

SEQ ID NO: 3298765 - protein, 21 aa, Plasmodium falciparum
YNHILFDYTHLWDNAQFTRTK

SEQ ID NO: 3298766 - protein, 38 aa, Plasmodium falciparum
YNHMLITKYLHISFRNFFLIFKYIYMYSSYKTTELFSL

SEQ ID NO: 3298767 - protein, 27 aa, Plasmodium falciparum
YNHNSESIFIIPWANISVLCSIVIDIF

SEQ ID NO: 3298768 - protein, 31 aa, Plasmodium falciparum
YNHRSTYEYPFIWSYIQSTWGRCILNLGMEV

SEQ ID NO: 3298769 - protein, 34 aa, Plasmodium falciparum
YNHTEPIFYMSFLKSPFYFSRKFKLFISVGAKNS

SEQ ID NO: 3298770 - protein, 17 aa, Plasmodium falciparum
YNHVQYFHGEKKEIICF

SEQ ID NO: 3298771 - protein, 28 aa, Plasmodium falciparum
YNIDIWNSTFFYLHFNENINILCFSSYL

SEQ ID NO: 3298772 - protein, 26 aa, Plasmodium falciparum
YNIDVFYEVLLCALIGLYTAYINNAL

SEQ ID NO: 3298773 - protein, 30 aa, Plasmodium falciparum
YNIHATQSLVLYQRLFIPEIYNALNTSNIM

SEQ ID NO: 3298774 - protein, 23 aa, Plasmodium falciparum
YNIIFYISLVLFSIISTLVNGLE

SEQ ID NO: 3298775 - protein, 17 aa, Plasmodium falciparum
YNIIKTCKKYIILTDTV

SEQ ID NO: 3298776 - protein, 23 aa, Plasmodium falciparum
YNIKINFIIGLKFSFYNLNSYYN

SEQ ID NO: 3298777 - protein, 18 aa, Plasmodium falciparum
YNIKYSYEKNLFFSLFYI

SEQ ID NO: 3298778 - protein, 17 aa, Plasmodium falciparum
YNINYYKLVKKFYNIFK

SEQ ID NO: 3298779 - protein, 28 aa, Plasmodium falciparum
YNIPTKLSPNRYIPYTSGKYRGKRYIYL

SEQ ID NO: 3298780 - protein, 18 aa, Plasmodium falciparum
YNISALTYEIIKYYDDIS

SEQ ID NO: 3298781 - protein, 23 aa, Plasmodium falciparum
YNISDFYFNLYYNSIHKGINIKL

SEQ ID NO: 3298782 - protein, 30 aa, Plasmodium falciparum
YNIVLEKMFAWLFYYIINIDDNKIRKINKR

SEQ ID NO: 3298783 - protein, 21 aa, Plasmodium falciparum
YNIWNHVLGITKEGFEDKIFL

SEQ ID NO: 3298784 - protein, 18 aa, Plasmodium falciparum
YNIYKLYTYLIFNKLDKC

SEQ ID NO: 3298785 - protein, 24 aa, Plasmodium falciparum
YNIYLFIVFFQMISITWVYGSEYT

SEQ ID NO: 3298786 - protein, 20 aa, Plasmodium falciparum
YNKDNLLYLKKWYLKNVYIL

SEQ ID NO: 3298787 - protein, 26 aa, Plasmodium falciparum
YNKFQKKYYYLSKKKSNYTNLILIDI

SEQ ID NO: 3298788 - protein, 28 aa, Plasmodium falciparum
YNKIGYCIVFFLFSILKIFCTCDDDTTL

SEQ ID NO: 3298789 - protein, 28 aa, Plasmodium falciparum
YNKKKFIRPYDLSLLKSILIYRQRVTRN

SEQ ID NO: 3298790 - protein, 25 aa, Plasmodium falciparum
YNKKKYYKMLDKYISYIKRSINNEL

SEQ ID NO: 3298791 - protein, 20 aa, Plasmodium falciparum
YNKLVYYIKDMLLELDNRCK

SEQ ID NO: 3298792 - protein, 32 aa, Plasmodium falciparum
YNKNLFYFRTNIFILLNFILCVPKKNIDYTYI

SEQ ID NO: 3298793 - protein, 25 aa, Plasmodium falciparum
YNKPFLNKYLNYFLERIKIKYTLRI

SEQ ID NO: 3298794 - protein, 23 aa, Plasmodium falciparum
YNKQFFHFIMQTSKLHVDLEECV

SEQ ID NO: 3298795 - protein, 24 aa, Plasmodium falciparum
YNKRLFSSFIWSYSKYISFLNKKN

SEQ ID NO: 3298796 - protein, 29 aa, Plasmodium falciparum
YNKRYVHIQIIDYFRYIKKEILLSYDNIN

SEQ ID NO: 3298797 - protein, 26 aa, Plasmodium falciparum
YNKSKILNLIYYYLYKYKNNVDNKTK

SEQ ID NO: 3298798 - protein, 18 aa, Plasmodium falciparum
YNLFYSVHHDISLFFFIF

SEQ ID NO: 3298799 - protein, 27 aa, Plasmodium falciparum
YNLHYTYLYQILLIKFNLFLLKDRKIY

SEQ ID NO: 3298800 - protein, 43 aa, Plasmodium falciparum
YNLIYIFYSIEFICLLLFIFLHFLLFLLSQWNIKINLFISYKS

SEQ ID NO: 3298801 - protein, 34 aa, Plasmodium falciparum
YNLKKYVNLFSQYFIYFYCQLFSNLSQDVQIFFY

SEQ ID NO: 3298802 - protein, 27 aa, Plasmodium falciparum
YNLKSKIHYLFMLGSPLSALLSLYKPE

SEQ ID NO: 3298803 - protein, 23 aa, Plasmodium falciparum
YNMEETYLLFLKKNFYQIDHFYD

SEQ ID NO: 3298804 - protein, 39 aa, Plasmodium falciparum
YNMNCFKFLPWIFEAIFYSMIIYFFAYAALKENSHLNNG

SEQ ID NO: 3298805 - protein, 28 aa, Plasmodium falciparum
YNMQMKLWNFCEILAFEYKIPQSTLANE

SEQ ID NO: 3298806 - protein, 24 aa, Plasmodium falciparum
YNNDKIYFKYLDYKTHNNFFSSDH

SEQ ID NO: 3298807 - protein, 17 aa, Plasmodium falciparum
YNNFLPISNFSFLFDKI

SEQ ID NO: 3298808 - protein, 20 aa, Plasmodium falciparum
YNNIFYVHKFFLFNDDEEKK

SEQ ID NO: 3298809 - protein, 18 aa, Plasmodium falciparum
YNNILNLIQPVNAIVPVY

SEQ ID NO: 3298810 - protein, 34 aa, Plasmodium falciparum
YNNINCIFYHYYNSFLHSLFYSDEYIELIRKEER

SEQ ID NO: 3298811 - protein, 26 aa, Plasmodium falciparum
YNNKFGMLVYKFPIDVKKYKLTFYKN

SEQ ID NO: 3298812 - protein, 28 aa, Plasmodium falciparum
YNNMEYIKKCPFFYQIPSHLYKEKIYIF

SEQ ID NO: 3298813 - protein, 28 aa, Plasmodium falciparum
YNNNIYVIYFNLLYIYNFYSTKNYDISL

SEQ ID NO: 3298814 - protein, 25 aa, Plasmodium falciparum
YNNNIYYDNVYKIPLYNNYTNNMIY

SEQ ID NO: 3298815 - protein, 30 aa, Plasmodium falciparum
YNNNIYYYSYFKLHQLFLKKKNIHFPTDKY

SEQ ID NO: 3298816 - protein, 22 aa, Plasmodium falciparum
YNNNYYYYKKKKKIYLYKGYFK

SEQ ID NO: 3298817 - protein, 40 aa, Plasmodium falciparum
YNNVIRIALYIWLIQLYIYSIDLYAYLYKSTSYYFHTKRK

SEQ ID NO: 3298818 - protein, 36 aa, Plasmodium falciparum
YNPNDETCYFYLFKTILNVFSIFKRNFKTTSDYYIC

SEQ ID NO: 3298819 - protein, 28 aa, Plasmodium falciparum
YNPVRKWLIILMILYICLSILSYLIFLF

SEQ ID NO: 3298820 - protein, 24 aa, Plasmodium falciparum
YNQKKKMKIIQLSFLKILLKMQEW

SEQ ID NO: 3298821 - protein, 24 aa, Plasmodium falciparum
YNQLPLFFLSLLDLYKNTFDVYEF

SEQ ID NO: 3298822 - protein, 30 aa, Plasmodium falciparum
YNQNINFYLWGMFNWDYRKTLRVSLNSISN

SEQ ID NO: 3298823 - protein, 25 aa, Plasmodium falciparum
YNQSSDILFEYFLDDIRLNCYDGNI

SEQ ID NO: 3298824 - protein, 21 aa, Plasmodium falciparum
YNQWFPKAIKNRKFPCISRND

SEQ ID NO: 3298825 - protein, 25 aa, Plasmodium falciparum
YNRDGLLLRTYSWIVKGAIGIFVLV

SEQ ID NO: 3298826 - protein, 25 aa, Plasmodium falciparum
YNRNKLNDILLKMDMKDILKYFIDF

SEQ ID NO: 3298827 - protein, 21 aa, Plasmodium falciparum
YNSCHFILERKKIWIFKDLID

SEQ ID NO: 3298828 - protein, 28 aa, Plasmodium falciparum
YNSDSFYFLIILIHIYINRIKKMDTYLY

SEQ ID NO: 3298829 - protein, 27 aa, Plasmodium falciparum
YNSFLQKYILYIYKLNLERFNIKILKK

SEQ ID NO: 3298830 - protein, 43 aa, Plasmodium falciparum
YNSFRNCWSIYINIIFKLVTIDLLPIFFYPHIFINNTQFNIDK

SEQ ID NO: 3298831 - protein, 35 aa, Plasmodium falciparum
YNSKLLKMNYNFICILYLCLIYIYNYIVKFFHSYS

SEQ ID NO: 3298832 - protein, 20 aa, Plasmodium falciparum
YNSLFFIHLLTLCILSMFYL

SEQ ID NO: 3298833 - protein, 17 aa, Plasmodium falciparum
YNSNIPTYILFNKKLND

SEQ ID NO: 3298834 - protein, 24 aa, Plasmodium falciparum
YNSSLSWKIYLKNLLKKRKSKDIL

SEQ ID NO: 3298835 - protein, 28 aa, Plasmodium falciparum
YNTDLNIIYILLEISLLLSYHNYFNCFS

SEQ ID NO: 3298836 - protein, 26 aa, Plasmodium falciparum
YNTFLFDTVIAFWSLPTGILAILPFY

SEQ ID NO: 3298837 - protein, 31 aa, Plasmodium falciparum
YNTNFYDYYIFFQHYIIKNKIKYVKHFPHHL

SEQ ID NO: 3298838 - protein, 17 aa, Plasmodium falciparum
YNTNKLLHDDLQILFNL

SEQ ID NO: 3298839 - protein, 33 aa, Plasmodium falciparum
YNTVDPELVYLFWSSIQIIYWRTNIILKSDSNE

SEQ ID NO: 3298840 - protein, 35 aa, Plasmodium falciparum
YNVCNSYILNYLPFHLLLLILLNYDNKNILLYLLN

SEQ ID NO: 3298841 - protein, 20 aa, Plasmodium falciparum
YNVDIIPINAAINNSLNIDD

SEQ ID NO: 3298842 - protein, 18 aa, Plasmodium falciparum
YNVKLIKIPNAVILFLIF

SEQ ID NO: 3298843 - protein, 17 aa, Plasmodium falciparum
YNVLKKNVLQKIRNNTK

SEQ ID NO: 3298844 - protein, 17 aa, Plasmodium falciparum
YNVNIQKKIFFCIIQMI

SEQ ID NO: 3298845 - protein, 22 aa, Plasmodium falciparum
YNVNLNFLFKLDYMCIEDKQKS

SEQ ID NO: 3298846 - protein, 18 aa, Plasmodium falciparum
YNWAMLGIALSLFLSIMG

SEQ ID NO: 3298847 - protein, 30 aa, Plasmodium falciparum
YNWSKHYFHVFFNDPFLYNYFNECLKYEQE

SEQ ID NO: 3298848 - protein, 22 aa, Plasmodium falciparum
YNYEHVYFIYMICNNKQMLIKT

SEQ ID NO: 3298849 - protein, 28 aa, Plasmodium falciparum
YNYFMNIKQHFFFKKKIKEFNVKLGGDN

SEQ ID NO: 3298850 - protein, 21 aa, Plasmodium falciparum
YNYIFYYLSMLNDEKYLIKFI

SEQ ID NO: 3298851 - protein, 18 aa, Plasmodium falciparum
YNYIYYEDYLRDIPVVLY

SEQ ID NO: 3298852 - protein, 19 aa, Plasmodium falciparum
YNYLFKFIISLGNINYFYI

SEQ ID NO: 3298853 - protein, 37 aa, Plasmodium falciparum
YNYLYTFSIDICPICKYDLIFFPKGLANKYGIKNVFY

SEQ ID NO: 3298854 - protein, 18 aa, Plasmodium falciparum
YNYLYVQDYLLKNYILYY

SEQ ID NO: 3298855 - protein, 21 aa, Plasmodium falciparum
YNYMNILYGIYSCVYVFSNVF

SEQ ID NO: 3298856 - protein, 33 aa, Plasmodium falciparum
YNYNYQCFLDPIKIHPFILICLDKVIGTHQLKI

SEQ ID NO: 3298857 - protein, 24 aa, Plasmodium falciparum
YNYTYSIKLLRYINTILSFNINHS

SEQ ID NO: 3298858 - protein, 17 aa, Plasmodium falciparum
YNYVLFPFLFVILSLCI

SEQ ID NO: 3298859 - protein, 20 aa, Plasmodium falciparum
YNYWVKTVLFNYYKSTWALN

SEQ ID NO: 3298860 - protein, 37 aa, Plasmodium falciparum
YPCGIAALVLLILAVVLIILYIWLYRRRKNSWKHECK

SEQ ID NO: 3298861 - protein, 50 aa, Plasmodium falciparum
YPDFFNYLYLESDPYHLILGRLFFMKNSKFLFLSALIQLNAWGLINIIIK

SEQ ID NO: 3298862 - protein, 17 aa, Plasmodium falciparum
YPFLEFKKPFCILNNYN

SEQ ID NO: 3298863 - protein, 32 aa, Plasmodium falciparum
YPGLTIQLSAIKFLALFFYKENKLFSIPLRKT

SEQ ID NO: 3298864 - protein, 22 aa, Plasmodium falciparum
YPHFHNFVLTYFHKFLTHDQFN

SEQ ID NO: 3298865 - protein, 17 aa, Plasmodium falciparum
YPHIFRKIIVSCNNSLL

SEQ ID NO: 3298866 - protein, 17 aa, Plasmodium falciparum
YPHIYKIYKPKFEDDLI

SEQ ID NO: 3298867 - protein, 20 aa, Plasmodium falciparum
YPIFFPSLYIYIIKNDHLNS

SEQ ID NO: 3298868 - protein, 27 aa, Plasmodium falciparum
YPIINTKNYILFLRKKINSLEKQLNIL

SEQ ID NO: 3298869 - protein, 18 aa, Plasmodium falciparum
YPKYLATYNDSPSQICTM

SEQ ID NO: 3298870 - protein, 24 aa, Plasmodium falciparum
YPKYYNLILNILNKNTLILFLFIL

SEQ ID NO: 3298871 - protein, 29 aa, Plasmodium falciparum
YPLCIFPVFMLYMLVRFFPDMKMGFKKIK

SEQ ID NO: 3298872 - protein, 19 aa, Plasmodium falciparum
YPLKPPIVYFLQKPPKHTH

SEQ ID NO: 3298873 - protein, 17 aa, Plasmodium falciparum
YPMITEIKKCTLSFFCM

SEQ ID NO: 3298874 - protein, 17 aa, Plasmodium falciparum
YPNIFHYCSTYKIKNKE

SEQ ID NO: 3298875 - protein, 30 aa, Plasmodium falciparum
YPNSHTHYFSCLILFIFSQSNDIIIQEQII

SEQ ID NO: 3298876 - protein, 23 aa, Plasmodium falciparum
YPNTYNYFPLLIINNIYNKKQFK

SEQ ID NO: 3298877 - protein, 20 aa, Plasmodium falciparum
YPPLFKEHILNILLSFCINN

SEQ ID NO: 3298878 - protein, 27 aa, Plasmodium falciparum
YPQKRYLTLHFLKELYIFIIEKEKALE

SEQ ID NO: 3298879 - protein, 32 aa, Plasmodium falciparum
YPQYVIAEILRQLLNVCLYLYRNKIFHSDIKP

SEQ ID NO: 3298880 - protein, 26 aa, Plasmodium falciparum
YPVITCLQWLIEILIYKSNEIKTYYD

SEQ ID NO: 3298881 - protein, 19 aa, Plasmodium falciparum
YPYIKLRSDWWSANRDKVW

SEQ ID NO: 3298882 - protein, 19 aa, Plasmodium falciparum
YPYSYEYISPLDILNISNL

SEQ ID NO: 3298883 - protein, 25 aa, Plasmodium falciparum
YQEIELLYIYMYLNNFTNIQSLSIT

SEQ ID NO: 3298884 - protein, 26 aa, Plasmodium falciparum
YQFSYILKEFLLYIYNKKTYKIENVI

SEQ ID NO: 3298885 - protein, 21 aa, Plasmodium falciparum
YQIHKYPYILKNSYIIYFEEN

SEQ ID NO: 3298886 - protein, 27 aa, Plasmodium falciparum
YQIIQTIYCRLLLFYLGFLYLDEQYAN

SEQ ID NO: 3298887 - protein, 25 aa, Plasmodium falciparum
YQIKNVLFFFSLYKNNFILNNVDLG

SEQ ID NO: 3298888 - protein, 27 aa, Plasmodium falciparum
YQKKAFYFISYAKLYHNIQLKKLANLM

SEQ ID NO: 3298889 - protein, 23 aa, Plasmodium falciparum
YQKQLSIWAIFNDFYETGKNRYQ

SEQ ID NO: 3298890 - protein, 21 aa, Plasmodium falciparum
YQKYFSYHLVIYNVKKKKIKE

SEQ ID NO: 3298891 - protein, 32 aa, Plasmodium falciparum
YQLNMRFSFTYYSFYYNLLMNTNFNRLNYLNN

SEQ ID NO: 3298892 - protein, 17 aa, Plasmodium falciparum
YQNQLYGICNETCTTCG

SEQ ID NO: 3298893 - protein, 22 aa, Plasmodium falciparum
YQNVYILLHLRTSIKNRSVSFC

SEQ ID NO: 3298894 - protein, 22 aa, Plasmodium falciparum
YQQNLIHKLIDKMYLIIIICHS

SEQ ID NO: 3298895 - protein, 27 aa, Plasmodium falciparum
YQRYIYYGVFIVVGYFLHDLINYAQRE

SEQ ID NO: 3298896 - protein, 17 aa, Plasmodium falciparum
YQSPFVADTLKLFKPYL

SEQ ID NO: 3298897 - protein, 33 aa, Plasmodium falciparum
YQSSKPFPLSIFYLIYFSFGYLNPDLLSQATYK

SEQ ID NO: 3298898 - protein, 18 aa, Plasmodium falciparum
YQTYVLLIEFNNKNLFYF

SEQ ID NO: 3298899 - protein, 17 aa, Plasmodium falciparum
YQWLIKYANLNKNYQII

SEQ ID NO: 3298900 - protein, 19 aa, Plasmodium falciparum
YQYESFLYLSKQVYVILIC

SEQ ID NO: 3298901 - protein, 30 aa, Plasmodium falciparum
YRCIRTILISLLIYIWLSKNVMTYNRNIKR

SEQ ID NO: 3298902 - protein, 17 aa, Plasmodium falciparum
YRDLFFKYIERENNKYI

SEQ ID NO: 3298903 - protein, 28 aa, Plasmodium falciparum
YREKRYIFFKIIDILRMFNLSIFPKFYE

SEQ ID NO: 3298904 - protein, 18 aa, Plasmodium falciparum
YRFEPYIMKNFNLLLECY

SEQ ID NO: 3298905 - protein, 23 aa, Plasmodium falciparum
YRGKVLASFLKAIGLIIPLMDSY

SEQ ID NO: 3298906 - protein, 18 aa, Plasmodium falciparum
YRGMSLLFLQFYFSYFFK

SEQ ID NO: 3298907 - protein, 22 aa, Plasmodium falciparum
YRHFNKIRLLTEYKDTLQIKVE

SEQ ID NO: 3298908 - protein, 33 aa, Plasmodium falciparum
YRHITIKHYLRKVYFILLIYDKICFLKRKMNFC

SEQ ID NO: 3298909 - protein, 20 aa, Plasmodium falciparum
YRIIHLPLDNFFFPFLCFLF

SEQ ID NO: 3298910 - protein, 30 aa, Plasmodium falciparum
YRINDNILKLLKFYVNYKIKIYQDEKKYNW

SEQ ID NO: 3298911 - protein, 17 aa, Plasmodium falciparum
YRIYKKFLPIIIHIYFT

SEQ ID NO: 3298912 - protein, 27 aa, Plasmodium falciparum
YRKEILYIYSLFILKKKQKQYYYYVMK

SEQ ID NO: 3298913 - protein, 21 aa, Plasmodium falciparum
YRKIEVILYEWLYFHYNNVYN

SEQ ID NO: 3298914 - protein, 21 aa, Plasmodium falciparum
YRLFILYFIPSIIQYVIYKFH

SEQ ID NO: 3298915 - protein, 26 aa, Plasmodium falciparum
YRNEAINLYIILYEKLKNKKNYAVVN

SEQ ID NO: 3298916 - protein, 29 aa, Plasmodium falciparum
YRNNELFYSLLYLLNKLLSFNDWLGSNNI

SEQ ID NO: 3298917 - protein, 26 aa, Plasmodium falciparum
YRNSINHLIFYIKSKVFQRFRNLLER

SEQ ID NO: 3298918 - protein, 21 aa, Plasmodium falciparum
YRRFFFFILNLSILSTIICFI

SEQ ID NO: 3298919 - protein, 27 aa, Plasmodium falciparum
YRYCFNKLIYILDIYKNMYYVHMKTFC

SEQ ID NO: 3298920 - protein, 25 aa, Plasmodium falciparum
YRYDYIHLYYNILLQNRYVIPCLKK

SEQ ID NO: 3298921 - protein, 25 aa, Plasmodium falciparum
YSASNFFFALFFDYTFKRIVCAKYY

SEQ ID NO: 3298922 - protein, 21 aa, Plasmodium falciparum
YSCHPFFSILIYITLFLLLFV

SEQ ID NO: 3298923 - protein, 24 aa, Plasmodium falciparum
YSCIPFRTWIDNQKLEFLKQKNKY

SEQ ID NO: 3298924 - protein, 22 aa, Plasmodium falciparum
YSDFLILLFSPFNTKLNKNNLQ

SEQ ID NO: 3298925 - protein, 24 aa, Plasmodium falciparum
YSDNFIQLIIFKIINNIFINEEEF

SEQ ID NO: 3298926 - protein, 21 aa, Plasmodium falciparum
YSELFSLIFLFHKRNDMRPII

SEQ ID NO: 3298927 - protein, 29 aa, Plasmodium falciparum
YSELILSMILFLVFIFYMFNEKNKYECIP

SEQ ID NO: 3298928 - protein, 41 aa, Plasmodium falciparum
YSENNFFYVLFDYIIGVLKYKIIYMLSEVYFLLECKYSKKI

SEQ ID NO: 3298929 - protein, 19 aa, Plasmodium falciparum
YSFFYKLLCKHYNIKKPKD

SEQ ID NO: 3298930 - protein, 19 aa, Plasmodium falciparum
YSFGIYIDYIFEIHNFMHE

SEQ ID NO: 3298931 - protein, 23 aa, Plasmodium falciparum
YSFILLYYMFFMIKDVYVYFSFY

SEQ ID NO: 3298932 - protein, 19 aa, Plasmodium falciparum
YSFSNIFKIIQKNTDDFLR

SEQ ID NO: 3298933 - protein, 20 aa, Plasmodium falciparum
YSFYVENICSKKMRHKRRNI

SEQ ID NO: 3298934 - protein, 28 aa, Plasmodium falciparum
YSGQKIYFEFLLHLFNVLFTAIPVVIHA

SEQ ID NO: 3298935 - protein, 24 aa, Plasmodium falciparum
YSHFCYVPYYKKHKLTILLKPKTI

SEQ ID NO: 3298936 - protein, 25 aa, Plasmodium falciparum
YSHIKRIFKILYKYGNYLLKDEYYI

SEQ ID NO: 3298937 - protein, 26 aa, Plasmodium falciparum
YSHLHNRPLFGIPEISYHSGRLNTLL

SEQ ID NO: 3298938 - protein, 24 aa, Plasmodium falciparum
YSHSFIWQVYCLELEQFCVLKFKR

SEQ ID NO: 3298939 - protein, 29 aa, Plasmodium falciparum
YSITFFFSLLLIFLFVVIDIIFFNFSSPL

SEQ ID NO: 3298940 - protein, 18 aa, Plasmodium falciparum
YSIWVCLIFFCHAGTFAI

SEQ ID NO: 3298941 - protein, 27 aa, Plasmodium falciparum
YSKCIYYIKIFINKGIFKVWLNDSYNN

SEQ ID NO: 3298942 - protein, 37 aa, Plasmodium falciparum
YSKHVVRYYTWWCEEPQFLPMHLMPKEIQNLVKKNKD

SEQ ID NO: 3298943 - protein, 25 aa, Plasmodium falciparum
YSKILSKKILLLFDLCEHNLSNQKH

SEQ ID NO: 3298944 - protein, 22 aa, Plasmodium falciparum
YSKKKKYIFKKKTLVPFEHVDN

SEQ ID NO: 3298945 - protein, 24 aa, Plasmodium falciparum
YSKKYLLNILLHNNITRSSDINFY

SEQ ID NO: 3298946 - protein, 22 aa, Plasmodium falciparum
YSKLIRRIWSLYMLIISDDYVK

SEQ ID NO: 3298947 - protein, 28 aa, Plasmodium falciparum
YSKYGRNVFFFIYEKLSAHKKECLQDIL

SEQ ID NO: 3298948 - protein, 17 aa, Plasmodium falciparum
YSLCFHFIKKNNKKKKN

SEQ ID NO: 3298949 - protein, 28 aa, Plasmodium falciparum
YSLEEQYFNWQYYKFPVPPNHTFVGFPI

SEQ ID NO: 3298950 - protein, 23 aa, Plasmodium falciparum
YSLFFSIFYILLLFGLCYTIIIR

SEQ ID NO: 3298951 - protein, 18 aa, Plasmodium falciparum
YSLFTINSNYYHNNYYIC

SEQ ID NO: 3298952 - protein, 20 aa, Plasmodium falciparum
YSLIELHKIFFILHDKSIDI

SEQ ID NO: 3298953 - protein, 17 aa, Plasmodium falciparum
YSLKNWIVQYSCSFLKR

SEQ ID NO: 3298954 - protein, 25 aa, Plasmodium falciparum
YSLNPSIWFDILFFNVMKGTCNNKE

SEQ ID NO: 3298955 - protein, 18 aa, Plasmodium falciparum
YSLRNPHSFIYPDISSRI

SEQ ID NO: 3298956 - protein, 30 aa, Plasmodium falciparum
YSMENNCHKCFFACNPFVKWLGNQKLEFDK

SEQ ID NO: 3298957 - protein, 35 aa, Plasmodium falciparum
YSMKEIRKIPLNKFFYYVYSFVLLSFFKSKEITKI

SEQ ID NO: 3298958 - protein, 26 aa, Plasmodium falciparum
YSMVAWTMTLIIFVFLTISNTNVTIN

SEQ ID NO: 3298959 - protein, 50 aa, Plasmodium falciparum
YSNDLLIYLNCFSEIFLLLSPLRIPAFCFSWVELISSKYFMPKFLSNICG

SEQ ID NO: 3298960 - protein, 21 aa, Plasmodium falciparum
YSNEMISKLDSLFIKNEEILN

SEQ ID NO: 3298961 - protein, 19 aa, Plasmodium falciparum
YSNFILIKKKEYQSLNSQY

SEQ ID NO: 3298962 - protein, 20 aa, Plasmodium falciparum
YSNIFCNFSNYFYTFSTYEK

SEQ ID NO: 3298963 - protein, 21 aa, Plasmodium falciparum
YSNLISAKFTPENALLLFGIN

SEQ ID NO: 3298964 - protein, 21 aa, Plasmodium falciparum
YSPFNCALAYRIPDTNLNIST

SEQ ID NO: 3298965 - protein, 17 aa, Plasmodium falciparum
YSSCYMINTMKLSLYFE

SEQ ID NO: 3298966 - protein, 31 aa, Plasmodium falciparum
YSSEDIMSLEYLFLYFSPSSYVLHNNTLYKK

SEQ ID NO: 3298967 - protein, 24 aa, Plasmodium falciparum
YSSFPFKLFLHSLYMIFICFIYFV

SEQ ID NO: 3298968 - protein, 17 aa, Plasmodium falciparum
YSSGIYLLDCSTHLYLY

SEQ ID NO: 3298969 - protein, 24 aa, Plasmodium falciparum
YSSHTYNWFNFSNVLSKDKDKLLT

SEQ ID NO: 3298970 - protein, 26 aa, Plasmodium falciparum
YSSIIFILFIFLVYSIIIVYFFMCII

SEQ ID NO: 3298971 - protein, 22 aa, Plasmodium falciparum
YSSKIFYHLINNINYDKFFGKI

SEQ ID NO: 3298972 - protein, 21 aa, Plasmodium falciparum
YSSNILFLRIIEKMHLVFHNS

SEQ ID NO: 3298973 - protein, 27 aa, Plasmodium falciparum
YSSSKPKILSFLGIVLICIMNLWIYKN

SEQ ID NO: 3298974 - protein, 61 aa, Plasmodium falciparum
YSTIRKNIHYMKEGTKLYYSLVKILLITFFICIFTRLNHGQFYEKWKNKPNIKSICGRRLH

SEQ ID NO: 3298975 - protein, 24 aa, Plasmodium falciparum
YSTKKYIYNHIYTPNIQYSCRQHN

SEQ ID NO: 3298976 - protein, 18 aa, Plasmodium falciparum
YSTNPFHMYVLISVISLL

SEQ ID NO: 3298977 - protein, 33 aa, Plasmodium falciparum
YSVIAILIILLIMVIIYLILRYRRKKKMNKKKN

SEQ ID NO: 3298978 - protein, 34 aa, Plasmodium falciparum
YSVIAILIILLVMVIIYLILRYRRKKKMNKKLQY

SEQ ID NO: 3298979 - protein, 19 aa, Plasmodium falciparum
YSVIIFFVFKSWSYKYTVE

SEQ ID NO: 3298980 - protein, 34 aa, Plasmodium falciparum
YSVLAILIIVLVMLIIYLILRYRRKKKMKKKLQY

SEQ ID NO: 3298981 - protein, 28 aa, Plasmodium falciparum
YSYEKNLFFSLFYIDCNIHILNFLLDLL

SEQ ID NO: 3298982 - protein, 21 aa, Plasmodium falciparum
YSYIYSYFDPILDLSSILRKN

SEQ ID NO: 3298983 - protein, 26 aa, Plasmodium falciparum
YSYYLKNNFFPYKYKGKRGKAKKGML

SEQ ID NO: 3298984 - protein, 27 aa, Plasmodium falciparum
YSYYLNYIKYVLLYNPYIYMNIKNKLK

SEQ ID NO: 3298985 - protein, 20 aa, Plasmodium falciparum
YTCHKECLYFNNYTFNHIYG

SEQ ID NO: 3298986 - protein, 19 aa, Plasmodium falciparum
YTCLWFLNPLVIIISLRGN

SEQ ID NO: 3298987 - protein, 25 aa, Plasmodium falciparum
YTCMIYCCYILIKNKYYLDFFCLYL

SEQ ID NO: 3298988 - protein, 24 aa, Plasmodium falciparum
YTCTHILCVLAYLNIKNDEYPYFF

SEQ ID NO: 3298989 - protein, 30 aa, Plasmodium falciparum
YTCTNTYFVRYIIRLMLYYADSDVNTIKTY

SEQ ID NO: 3298990 - protein, 24 aa, Plasmodium falciparum
YTDNKLLKFFFKKSYNNWFNDPSQ

SEQ ID NO: 3298991 - protein, 19 aa, Plasmodium falciparum
YTDTKSVHKIIYKKSKDGE

SEQ ID NO: 3298992 - protein, 30 aa, Plasmodium falciparum
YTESNRIMYLQFKYIYLQSLNITVSFVPPN

SEQ ID NO: 3298993 - protein, 24 aa, Plasmodium falciparum
YTFATARYIYLQPYTGIIKKNTRK

SEQ ID NO: 3298994 - protein, 18 aa, Plasmodium falciparum
YTFHLFKIYNIENVYFYI

SEQ ID NO: 3298995 - protein, 26 aa, Plasmodium falciparum
YTFSQRIRRFFLNNNIRQCFVCTTVQ

SEQ ID NO: 3298996 - protein, 26 aa, Plasmodium falciparum
YTGSPQIVTLMKFLFEKKLTVNDLDT

SEQ ID NO: 3298997 - protein, 23 aa, Plasmodium falciparum
YTGTPHITSILKFLFEKKLTMDD

SEQ ID NO: 3298998 - protein, 31 aa, Plasmodium falciparum
YTHIYKNKYLILYYLHTFYDEIYIYEYIDQK

SEQ ID NO: 3298999 - protein, 20 aa, Plasmodium falciparum
YTHKYFYYNIKNIIYIINYI

SEQ ID NO: 3299000 - protein, 18 aa, Plasmodium falciparum
YTHLKPVVHFLQKLEFNK

SEQ ID NO: 3299001 - protein, 30 aa, Plasmodium falciparum
YTHMDKNLIFFWFNFLKVLLNVTIDKHLMI

SEQ ID NO: 3299002 - protein, 21 aa, Plasmodium falciparum
YTIKTNKFIQPLFYDFNNDSF

SEQ ID NO: 3299003 - protein, 29 aa, Plasmodium falciparum
YTILTFIPLFLFYQFADFLNLFYLCVSLL

SEQ ID NO: 3299004 - protein, 17 aa, Plasmodium falciparum
YTISILFITSISIILEL

SEQ ID NO: 3299005 - protein, 46 aa, Plasmodium falciparum
YTKMQEYLMYYSQYLEKTYLVPTAFRKKYWWRVHYMLTEEVVKRER

SEQ ID NO: 3299006 - protein, 29 aa, Plasmodium falciparum
YTKTIGPFASFIYLFNQSIGSGLFDIPSL

SEQ ID NO: 3299007 - protein, 24 aa, Plasmodium falciparum
YTLILLCFCHPLLFYKNINNYKSQ

SEQ ID NO: 3299008 - protein, 25 aa, Plasmodium falciparum
YTLRIVYIYFVTIMVQLIMSQKKLN

SEQ ID NO: 3299009 - protein, 48 aa, Plasmodium falciparum
YTLYKSIKIFVIYLYFNLPKSMCHYFLNIYLMFFKKKNIKPVHILSKM

SEQ ID NO: 3299010 - protein, 20 aa, Plasmodium falciparum
YTLYLWVIFCFSKCPYFKVL

SEQ ID NO: 3299011 - protein, 34 aa, Plasmodium falciparum
YTMKNLYLCKTIIIPLFYKWKLLNIYIIDHLKFL

SEQ ID NO: 3299012 - protein, 23 aa, Plasmodium falciparum
YTMNIISIFLSLNDSLKGSNKLS

SEQ ID NO: 3299013 - protein, 28 aa, Plasmodium falciparum
YTNENYIKILYIISKLLLYINNEEYVKK

SEQ ID NO: 3299014 - protein, 25 aa, Plasmodium falciparum
YTNFITSVIFIAFSNPYNIGDRIRL

SEQ ID NO: 3299015 - protein, 17 aa, Plasmodium falciparum
YTNHKYIHEIKNVEFNN

SEQ ID NO: 3299016 - protein, 33 aa, Plasmodium falciparum
YTNLILIDISRTFPELLIFDKYAQQQLYRVLNA

SEQ ID NO: 3299017 - protein, 28 aa, Plasmodium falciparum
YTNNIDIIFFLLYLYVNNILNGTFVFNI

SEQ ID NO: 3299018 - protein, 23 aa, Plasmodium falciparum
YTNTQIFLIFLLSGFFSNLISYY

SEQ ID NO: 3299019 - protein, 24 aa, Plasmodium falciparum
YTNTYILIFIYRKKPNITSGRTNL

SEQ ID NO: 3299020 - protein, 36 aa, Plasmodium falciparum
YTSEFLMSAIKLNKLKLFFVLKDELKYIFPDIPEGL

SEQ ID NO: 3299021 - protein, 18 aa, Plasmodium falciparum
YTSLGKFLRAYFFSFFCG

SEQ ID NO: 3299022 - protein, 28 aa, Plasmodium falciparum
YTSTWYSRIWYLFYSLKGTLNFNYFSLL

SEQ ID NO: 3299023 - protein, 19 aa, Plasmodium falciparum
YTVDIFYVIYIIITDIFNQ

SEQ ID NO: 3299024 - protein, 19 aa, Plasmodium falciparum
YTVNKMIFIYLSVKKKKGN

SEQ ID NO: 3299025 - protein, 23 aa, Plasmodium falciparum
YTWLNIFLLILFKTIQILMTQTN

SEQ ID NO: 3299026 - protein, 20 aa, Plasmodium falciparum
YTYDPRLLIFEYTNNLIIRR

SEQ ID NO: 3299027 - protein, 25 aa, Plasmodium falciparum
YTYFNNFLENFLYYQKNYNMEVDRN

SEQ ID NO: 3299028 - protein, 29 aa, Plasmodium falciparum
YTYILKSLLILFDNYLILILQLYIKNESY

SEQ ID NO: 3299029 - protein, 31 aa, Plasmodium falciparum
YTYSAVILNWIIPSIYFHYNKEKYEIKNNYF

SEQ ID NO: 3299030 - protein, 24 aa, Plasmodium falciparum
YTYSFVNTYFLYDTLRNPSPSFKI

SEQ ID NO: 3299031 - protein, 27 aa, Plasmodium falciparum
YTYSYLSEYLCLIRNLLKDHPTINYIE

SEQ ID NO: 3299032 - protein, 19 aa, Plasmodium falciparum
YTYVLFILHLFIQIMDKLK

SEQ ID NO: 3299033 - protein, 26 aa, Plasmodium falciparum
YTYYDNYYNYYYAIRKSRYGYQSYRN

SEQ ID NO: 3299034 - protein, 19 aa, Plasmodium falciparum
YVCDFYFNPLTNVKPTVVG

SEQ ID NO: 3299035 - protein, 29 aa, Plasmodium falciparum
YVCYGYIILILIPCLLTAAFLLPLKPFKA

SEQ ID NO: 3299036 - protein, 21 aa, Plasmodium falciparum
YVDFMIILKLLSKYIKIEKKV

SEQ ID NO: 3299037 - protein, 24 aa, Plasmodium falciparum
YVDRCIHFYNLIYTYRKVHNKYVL

SEQ ID NO: 3299038 - protein, 20 aa, Plasmodium falciparum
YVEIYLLFHMARLFDSRIER

SEQ ID NO: 3299039 - protein, 24 aa, Plasmodium falciparum
YVENYNILYIKKSPDFFMINDIYN

SEQ ID NO: 3299040 - protein, 17 aa, Plasmodium falciparum
YVFFQLNTNLDNIVISK

SEQ ID NO: 3299041 - protein, 17 aa, Plasmodium falciparum
YVFIQIYNNYFVSFCDI

SEQ ID NO: 3299042 - protein, 33 aa, Plasmodium falciparum
YVFLHLDYKLENDLFLLMIKRGLHTYVEDVYYK

SEQ ID NO: 3299043 - protein, 17 aa, Plasmodium falciparum
YVFLLNIQKKKNVCFWI

SEQ ID NO: 3299044 - protein, 17 aa, Plasmodium falciparum
YVFWTFFGTLGGLVKFN

SEQ ID NO: 3299045 - protein, 17 aa, Plasmodium falciparum
YVGMFLLCRFDGNTNRK

SEQ ID NO: 3299046 - protein, 17 aa, Plasmodium falciparum
YVHFLNINFLKNVNDQK

SEQ ID NO: 3299047 - protein, 25 aa, Plasmodium falciparum
YVHIKRFYFDFFFTILKNINDMEST

SEQ ID NO: 3299048 - protein, 23 aa, Plasmodium falciparum
YVHINYLKYLFNKKSYLNKKQYE

SEQ ID NO: 3299049 - protein, 19 aa, Plasmodium falciparum
YVIFLVLLFIYKAYKNKRK

SEQ ID NO: 3299050 - protein, 17 aa, Plasmodium falciparum
YVIILFLIGCTATCTAP

SEQ ID NO: 3299051 - protein, 24 aa, Plasmodium falciparum
YVIIYILLIIIKLNHGNSKLNYNK

SEQ ID NO: 3299052 - protein, 18 aa, Plasmodium falciparum
YVIKIISSFLLNSTLFFN

SEQ ID NO: 3299053 - protein, 22 aa, Plasmodium falciparum
YVKIPKYFFKNIIDKEKRKIHG

SEQ ID NO: 3299054 - protein, 27 aa, Plasmodium falciparum
YVKKRIYLYFQFVYLFKNKFNNEENKM

SEQ ID NO: 3299055 - protein, 30 aa, Plasmodium falciparum
YVKKTFEVYIYYFLIFFNSTIINSYNNYAM

SEQ ID NO: 3299056 - protein, 23 aa, Plasmodium falciparum
YVKNIITIFLKSLNIFNNIINDY

SEQ ID NO: 3299057 - protein, 19 aa, Plasmodium falciparum
YVKYAKYFYQKKSFFLLDK

SEQ ID NO: 3299058 - protein, 19 aa, Plasmodium falciparum
YVLFPFLFVILSLCIRSIS

SEQ ID NO: 3299059 - protein, 18 aa, Plasmodium falciparum
YVLGLFLLPSLVSYIGSN

SEQ ID NO: 3299060 - protein, 17 aa, Plasmodium falciparum
YVLHNNTLYKKISRKNQ

SEQ ID NO: 3299061 - protein, 31 aa, Plasmodium falciparum
YVLIVITVLLIILYIWLYRRRKNSWKHECKK

SEQ ID NO: 3299062 - protein, 18 aa, Plasmodium falciparum
YVLLIEFNNKNLFYFASL

SEQ ID NO: 3299063 - protein, 25 aa, Plasmodium falciparum
YVLQGNFIFLILNTIIIPLLSLSPL

SEQ ID NO: 3299064 - protein, 23 aa, Plasmodium falciparum
YVLYAIFFLSYVSFYILLKYYIF

SEQ ID NO: 3299065 - protein, 22 aa, Plasmodium falciparum
YVLYMCKHILFHTYFNKIWKSV

SEQ ID NO: 3299066 - protein, 31 aa, Plasmodium falciparum
YVMCSIYFLLIFSCIYFLTLLLYTKCIKTTL

SEQ ID NO: 3299067 - protein, 25 aa, Plasmodium falciparum
YVNFRNFYFYLNIKNYILKHKIYKQ

SEQ ID NO: 3299068 - protein, 35 aa, Plasmodium falciparum
YVNGNPFDLFKFCNLLVLCYTYYSMPYVKAQTSVL

SEQ ID NO: 3299069 - protein, 18 aa, Plasmodium falciparum
YVNICLIKILYYLNNFNL

SEQ ID NO: 3299070 - protein, 17 aa, Plasmodium falciparum
YVNIFAFIFNLLASLII

SEQ ID NO: 3299071 - protein, 19 aa, Plasmodium falciparum
YVNLHFYDYSLYYIEKEIF

SEQ ID NO: 3299072 - protein, 25 aa, Plasmodium falciparum
YVNLVPIPSYFYKKSFYKCFSYFLH

SEQ ID NO: 3299073 - protein, 26 aa, Plasmodium falciparum
YVPASFLLIFIIYIVARYFPDMKIGF

SEQ ID NO: 3299074 - protein, 18 aa, Plasmodium falciparum
YVPPHGAGYSAPYGVPHG

SEQ ID NO: 3299075 - protein, 19 aa, Plasmodium falciparum
YVPQHLRWFDEWSEEFCRK

SEQ ID NO: 3299076 - protein, 30 aa, Plasmodium falciparum
YVPYYIYDFFINYPLLKWYITNKTTHKISD

SEQ ID NO: 3299077 - protein, 19 aa, Plasmodium falciparum
YVQNTFLKIIFLQVVKSKH

SEQ ID NO: 3299078 - protein, 29 aa, Plasmodium falciparum
YVQSNLFIFYIEYVLFLILKKGTKTRAQN

SEQ ID NO: 3299079 - protein, 25 aa, Plasmodium falciparum
YVRKKFSPNLLFHPLIYTIDCAYFN

SEQ ID NO: 3299080 - protein, 32 aa, Plasmodium falciparum
YVSILCNLIIVGRFLYSSFLFLFSENILNYFE

SEQ ID NO: 3299081 - protein, 30 aa, Plasmodium falciparum
YVSLCIIYFIFFFIKILKYINKIYNEDIQG

SEQ ID NO: 3299082 - protein, 41 aa, Plasmodium falciparum
YVSRRRYIFFLLYLIFLLINIFLLFRLQYLIKCPFLNNNNN

SEQ ID NO: 3299083 - protein, 28 aa, Plasmodium falciparum
YVSYYLFKKLWNIINKIFYIPYNQCDEN

SEQ ID NO: 3299084 - protein, 17 aa, Plasmodium falciparum
YVTHRKCGYYKDMLAKI

SEQ ID NO: 3299085 - protein, 18 aa, Plasmodium falciparum
YVTSLYLPGYYNAVEMSF

SEQ ID NO: 3299086 - protein, 17 aa, Plasmodium falciparum
YVTTFNNMLILINPTDN

SEQ ID NO: 3299087 - protein, 21 aa, Plasmodium falciparum
YVVAICLINLIIKIPLDKLYD

SEQ ID NO: 3299088 - protein, 19 aa, Plasmodium falciparum
YVVAILLAFLVLHALLYMK

SEQ ID NO: 3299089 - protein, 30 aa, Plasmodium falciparum
YVVFRILAYTTLCIFLYIGSYTSELQIRYV

SEQ ID NO: 3299090 - protein, 17 aa, Plasmodium falciparum
YVYIINYLNKNQKYIEN

SEQ ID NO: 3299091 - protein, 17 aa, Plasmodium falciparum
YVYLTKGLKIQKVSSLI

SEQ ID NO: 3299092 - protein, 26 aa, Plasmodium falciparum
YVYSTYLQFFLLWRKKKKKNYEDDNN

SEQ ID NO: 3299093 - protein, 18 aa, Plasmodium falciparum
YVYVYYYKTNIFDSLYNY

SEQ ID NO: 3299094 - protein, 18 aa, Plasmodium falciparum
YVYYNCYDYIILNNPYSN

SEQ ID NO: 3299095 - protein, 29 aa, Plasmodium falciparum
YWLKETINLIKIFKILFTSKYYIPECLTN

SEQ ID NO: 3299096 - protein, 18 aa, Plasmodium falciparum
YWMNIVYSYLSFGTYENI

SEQ ID NO: 3299097 - protein, 26 aa, Plasmodium falciparum
YWVYEFFDKILYFIKFSKSQKSKDSK

SEQ ID NO: 3299098 - protein, 31 aa, Plasmodium falciparum
YYADFCLNAIKPIFTFYFLRNVKVSKCLHLL

SEQ ID NO: 3299099 - protein, 17 aa, Plasmodium falciparum
YYAHRIYELMPKLSFST

SEQ ID NO: 3299100 - protein, 32 aa, Plasmodium falciparum
YYDENLYIYRSLLIILLNKYFCSGYNFFSFKK

SEQ ID NO: 3299101 - protein, 18 aa, Plasmodium falciparum
YYDFNEFLNYMYKDENIL

SEQ ID NO: 3299102 - protein, 21 aa, Plasmodium falciparum
YYDICSLYHVYVYKKNFDATI

SEQ ID NO: 3299103 - protein, 26 aa, Plasmodium falciparum
YYDNIPFLHIFLYNIHKFSLENASLL

SEQ ID NO: 3299104 - protein, 30 aa, Plasmodium falciparum
YYDYEMCLYLYQILLLGKLKSRNYVLFLSC

SEQ ID NO: 3299105 - protein, 26 aa, Plasmodium falciparum
YYEGDVYFMYIPLRNIANKLELAYDY

SEQ ID NO: 3299106 - protein, 20 aa, Plasmodium falciparum
YYEHPYINFLLYSNCKIGNT

SEQ ID NO: 3299107 - protein, 20 aa, Plasmodium falciparum
YYEIVYLSGLFLKLLELRNI

SEQ ID NO: 3299108 - protein, 41 aa, Plasmodium falciparum
YYEKRKDFFLYFFFLLIPFLLISFHLFLRNISDKYSLEIYN

SEQ ID NO: 3299109 - protein, 17 aa, Plasmodium falciparum
YYENWILKNINFRNSSN

SEQ ID NO: 3299110 - protein, 25 aa, Plasmodium falciparum
YYESFLCTYFYIISLYICKLKNDIN

SEQ ID NO: 3299111 - protein, 17 aa, Plasmodium falciparum
YYFESFTNYLREYDTLD

SEQ ID NO: 3299112 - protein, 34 aa, Plasmodium falciparum
YYFSKLHICLFKNVWKFLICHIQVNHFIKNILEN

SEQ ID NO: 3299113 - protein, 17 aa, Plasmodium falciparum
YYFSNKYNNIFYSSLYA

SEQ ID NO: 3299114 - protein, 20 aa, Plasmodium falciparum
YYFSPPSIKTYCLNNYFICL

SEQ ID NO: 3299115 - protein, 33 aa, Plasmodium falciparum
YYFVNLYLKRRQCLWRYYIFNYFINENDTMLIV

SEQ ID NO: 3299116 - protein, 34 aa, Plasmodium falciparum
YYFYNLIIEPHNILLYLLCIIDFKLNEVLCILQK

SEQ ID NO: 3299117 - protein, 19 aa, Plasmodium falciparum
YYGEKLNYLLLLDQINNDG

SEQ ID NO: 3299118 - protein, 26 aa, Plasmodium falciparum
YYGFTGWRICYFIISFFPVFVSIFIF

SEQ ID NO: 3299119 - protein, 23 aa, Plasmodium falciparum
YYGYIIINFFFSLKEYIMFEYKA

SEQ ID NO: 3299120 - protein, 17 aa, Plasmodium falciparum
YYHENAPFPFYYKKIDQ

SEQ ID NO: 3299121 - protein, 25 aa, Plasmodium falciparum
YYHLQELFQYLLVKKISININNVDC

SEQ ID NO: 3299122 - protein, 18 aa, Plasmodium falciparum
YYHNEFIFILCYNTEYYK

SEQ ID NO: 3299123 - protein, 37 aa, Plasmodium falciparum
YYHNILWSILKTFKFRIILIISFYILETLIVTLGGKF

SEQ ID NO: 3299124 - protein, 20 aa, Plasmodium falciparum
YYIDNIYLIDILKEKRFFDE

SEQ ID NO: 3299125 - protein, 19 aa, Plasmodium falciparum
YYIISNFVFFFSKMHKNNI

SEQ ID NO: 3299126 - protein, 20 aa, Plasmodium falciparum
YYIKMSFIFNDFKLCYTKMQ

SEQ ID NO: 3299127 - protein, 19 aa, Plasmodium falciparum
YYIPEELLFFHMNKFINTN

SEQ ID NO: 3299128 - protein, 22 aa, Plasmodium falciparum
YYISRFIYFLKQKLNLLIKAMF

SEQ ID NO: 3299129 - protein, 19 aa, Plasmodium falciparum
YYKGVILIDIDVGQPIIGL

SEQ ID NO: 3299130 - protein, 24 aa, Plasmodium falciparum
YYKHKRLFYIKYNCNVFDIKMLMN

SEQ ID NO: 3299131 - protein, 30 aa, Plasmodium falciparum
YYKLREDWWNNNRLMVWYAITCGAPKEAQY

SEQ ID NO: 3299132 - protein, 22 aa, Plasmodium falciparum
YYKNIFLYHYKLSPVTYTLILL

SEQ ID NO: 3299133 - protein, 18 aa, Plasmodium falciparum
YYKNLKNASLYLFFHYHF

SEQ ID NO: 3299134 - protein, 35 aa, Plasmodium falciparum
YYKNNFYELVYFIIKIIYKNIYINNFFNIFCSIMD

SEQ ID NO: 3299135 - protein, 18 aa, Plasmodium falciparum
YYKRLTKPLYGHIHKASC

SEQ ID NO: 3299136 - protein, 19 aa, Plasmodium falciparum
YYKTVLRVLFLHDKLRRMK

SEQ ID NO: 3299137 - protein, 20 aa, Plasmodium falciparum
YYKYIKYLSFKTFKKIYSYL

SEQ ID NO: 3299138 - protein, 21 aa, Plasmodium falciparum
YYLCSSIYFIKLTYYNFNLGT

SEQ ID NO: 3299139 - protein, 17 aa, Plasmodium falciparum
YYLGLKPVNRNVCNALY

SEQ ID NO: 3299140 - protein, 19 aa, Plasmodium falciparum
YYLYNLCIHIIRLKSVNTI

SEQ ID NO: 3299141 - protein, 26 aa, Plasmodium falciparum
YYMDIMNALLIYRVPTKWNFLGNHKK

SEQ ID NO: 3299142 - protein, 36 aa, Plasmodium falciparum
YYMKNVRLVFMEILFYLIYILYEDNLFRPKENVVST

SEQ ID NO: 3299143 - protein, 31 aa, Plasmodium falciparum
YYMRTFLIGFIFIIISIIALILCIFYLIRMN

SEQ ID NO: 3299144 - protein, 18 aa, Plasmodium falciparum
YYMVYITTTIFIFKDKYN

SEQ ID NO: 3299145 - protein, 32 aa, Plasmodium falciparum
YYNEMKIYNNCYILFDFILNKYDNNLKKNKKK

SEQ ID NO: 3299146 - protein, 33 aa, Plasmodium falciparum
YYNEPIHKYIPIYMYIIYYDKNQKIRTNAILCL

SEQ ID NO: 3299147 - protein, 20 aa, Plasmodium falciparum
YYNFYLKSNCAPLPDNKRLL

SEQ ID NO: 3299148 - protein, 18 aa, Plasmodium falciparum
YYNHYYEKELYDIVDIYE

SEQ ID NO: 3299149 - protein, 19 aa, Plasmodium falciparum
YYNKCVIFLLLNLSTLIYT

SEQ ID NO: 3299150 - protein, 26 aa, Plasmodium falciparum
YYNKLKDVFDRFLFQVMFALDQDEKG

SEQ ID NO: 3299151 - protein, 19 aa, Plasmodium falciparum
YYNLLGNIHFTILDANYIY

SEQ ID NO: 3299152 - protein, 27 aa, Plasmodium falciparum
YYNNPFNIIIFYLFDRWKNFSYKGRDF

SEQ ID NO: 3299153 - protein, 34 aa, Plasmodium falciparum
YYNNYNYYYYNRVFIKKCFFIISKILGTNINDLL

SEQ ID NO: 3299154 - protein, 37 aa, Plasmodium falciparum
YYNSIINLNKILLRKNKYFLPTIFTLTPKNEKAKLEQ

SEQ ID NO: 3299155 - protein, 23 aa, Plasmodium falciparum
YYPDMQIPILYSLTWPDRIKTNL

SEQ ID NO: 3299156 - protein, 20 aa, Plasmodium falciparum
YYPIPRFWLSCKHPAHKNKV

SEQ ID NO: 3299157 - protein, 19 aa, Plasmodium falciparum
YYPMFTNDFFCYENMFVKN

SEQ ID NO: 3299158 - protein, 25 aa, Plasmodium falciparum
YYQNTILNIPLFETIQIFVGKTHTI

SEQ ID NO: 3299159 - protein, 22 aa, Plasmodium falciparum
YYRCMEVLLNFLFNTDKRLCRK

SEQ ID NO: 3299160 - protein, 26 aa, Plasmodium falciparum
YYRCTSTLICLFIDSFYKTLGGDKHK

SEQ ID NO: 3299161 - protein, 19 aa, Plasmodium falciparum
YYSFIKFKTLRRLINKWFL

SEQ ID NO: 3299162 - protein, 24 aa, Plasmodium falciparum
YYSINYLINFFYQLLTKYLCELDY

SEQ ID NO: 3299163 - protein, 25 aa, Plasmodium falciparum
YYSNTLPIYGSYIFQIVVSFEIDNS

SEQ ID NO: 3299164 - protein, 25 aa, Plasmodium falciparum
YYSNYIIFIILKFFENNNIKVICYF

SEQ ID NO: 3299165 - protein, 27 aa, Plasmodium falciparum
YYSPKYKQFFIHHLENYKLYQTSDLSK

SEQ ID NO: 3299166 - protein, 30 aa, Plasmodium falciparum
YYSYNYFFDVLIYFTYFKQINVIEGLLIMA

SEQ ID NO: 3299167 - protein, 31 aa, Plasmodium falciparum
YYTDISTIFFYIHFKINVPKLLRIFFDHKVV

SEQ ID NO: 3299168 - protein, 19 aa, Plasmodium falciparum
YYTNFFYFYNLCVSSLKGT

SEQ ID NO: 3299169 - protein, 28 aa, Plasmodium falciparum
YYTNIYKFKWRPYDFLKLIYETIHNYNH

SEQ ID NO: 3299170 - protein, 25 aa, Plasmodium falciparum
YYVINYLNFLFLNNSKNFFFDCRGH

SEQ ID NO: 3299171 - protein, 31 aa, Plasmodium falciparum
YYYDYYDYYDYYLYYLYYYDCMVSQHIFQNI

SEQ ID NO: 3299172 - protein, 31 aa, Plasmodium falciparum
YYYHINNDLGLYFYFLVGFIIKKKNCTISLK

SEQ ID NO: 3299173 - protein, 17 aa, Plasmodium falciparum
YYYLHMLLNYNMEHILC

SEQ ID NO: 3299174 - protein, 25 aa, Plasmodium falciparum
YYYLQLHNMIYYILNMVSISINILA

SEQ ID NO: 3299175 - protein, 28 aa, Plasmodium falciparum
YYYTQLNFLLFRIFYNEKNLSYFFKMFF

SEQ ID NO: 3299176 - protein, 25 aa, Plasmodium falciparum
YYYYNKFLSLWKYYIVMRKGYPSSE

SEQ ID NO: 3299177 - protein, 32 aa, Plasmodium falciparum
YYYYYNCNTLSIYFFIKLIYKFFKVIQRGTAP

SEQ ID NO: 3299178 - protein, 19 aa, Plasmodium falciparum
FDYVPQYLRWFEEWAEDFC

SEQ ID NO: 3299179 - protein, 17 aa, Plasmodium falciparum
LLFFFPSNILLTSYHVH

SEQ ID NO: 3299180 - protein, 23 aa, Plasmodium falciparum
RKKKLICIIWIKIYMMIIEEHKK

SEQ ID NO: 3299181 - protein, 24 aa, Plasmodium falciparum
YTTFKVLLIYWLEDFIEGYYILKK

SEQ ID NO: 3299182 - protein, 20 aa, Plasmodium falciparum
DFLRLMFYTLADYRDICIGG

SEQ ID NO: 3299183 - protein, 17 aa, Plasmodium falciparum
DYVPQYLRWFEEWAEDF

SEQ ID NO: 3299184 - protein, 18 aa, Plasmodium falciparum
FDYVPQFLRWFEEWAEDF

SEQ ID NO: 3299185 - protein, 18 aa, Plasmodium falciparum
FDYVPQYLRWFEEWAEDF

SEQ ID NO: 3299186 - protein, 19 aa, Plasmodium falciparum
IIIMKSFYDIIISEKASMD

SEQ ID NO: 3299187 - protein, 20 aa, Plasmodium falciparum
ILKFFLFKCIFVVIIGILCM

SEQ ID NO: 3299188 - protein, 20 aa, Plasmodium falciparum
LLFFFPLYILVTSYHVYSKN

SEQ ID NO: 3299189 - protein, 18 aa, Plasmodium falciparum
LRQMFYTLGDYRDILFSG

SEQ ID NO: 3299190 - protein, 23 aa, Plasmodium falciparum
NVKEIFMFFFFKNNIIIQKIITL

SEQ ID NO: 3299191 - protein, 21 aa, Plasmodium falciparum
SSYTPLMYFLIVSITAFVIYK

SEQ ID NO: 3299192 - protein, 19 aa, Plasmodium falciparum
VLIMLIIYLILRYRRKKKM

SEQ ID NO: 3299193 - protein, 18 aa, Plasmodium falciparum
YIFFILFHTFILSNTNIP

SEQ ID NO: 3299194 - protein, 23 aa, Plasmodium falciparum
YIMSFYAFFDLWVKNLLIDSINW

SEQ ID NO: 3299195 - protein, 21 aa, Plasmodium falciparum
YISFKFLCLCLYMIGFYYVFL

SEQ ID NO: 3299196 - protein, 23 aa, Plasmodium falciparum
YKKKVLVVILWIKIYMSMLEEYV

SEQ ID NO: 3299197 - protein, 24 aa, Plasmodium falciparum
ACLFAEWYFIYKNYLNILKMSISN

SEQ ID NO: 3299198 - protein, 19 aa, Plasmodium falciparum
ADWYDILYRLFFDASSRFY

SEQ ID NO: 3299199 - protein, 32 aa, Plasmodium falciparum
AEEIDSKFFLNKMLLLILGGSSYMRYSKENYF

SEQ ID NO: 3299200 - protein, 25 aa, Plasmodium falciparum
AFFICKFLFFYYIYKKPILPFDSLK

SEQ ID NO: 3299201 - protein, 18 aa, Plasmodium falciparum
AFLQIILFRLTMSNFFVY

SEQ ID NO: 3299202 - protein, 28 aa, Plasmodium falciparum
AFSVFLFYLFFFLFFHFYFLCSSSFAVI

SEQ ID NO: 3299203 - protein, 23 aa, Plasmodium falciparum
AHSHFFNFLMNPYYYNLTFKQIK

SEQ ID NO: 3299204 - protein, 26 aa, Plasmodium falciparum
AIFAYFAIILFPIKFHHLVILKLLHW

SEQ ID NO: 3299205 - protein, 21 aa, Plasmodium falciparum
AIFLVVLIFIKSSHPALKEKK

SEQ ID NO: 3299206 - protein, 24 aa, Plasmodium falciparum
AIFTLSIWTTLLYSNKNLKCNFYY

SEQ ID NO: 3299207 - protein, 18 aa, Plasmodium falciparum
AIFYSMIIYFFAYAALKE

SEQ ID NO: 3299208 - protein, 18 aa, Plasmodium falciparum
AISIFYFYHLYPVLIITP

SEQ ID NO: 3299209 - protein, 18 aa, Plasmodium falciparum
AKLWWRLMFLFPSVISLI

SEQ ID NO: 3299210 - protein, 21 aa, Plasmodium falciparum
AKRLFKILFVTVFIVLAGGFS

SEQ ID NO: 3299211 - protein, 28 aa, Plasmodium falciparum
ALFLSLIFLIFFFYIIRITSHFNLDNFV

SEQ ID NO: 3299212 - protein, 19 aa, Plasmodium falciparum
ALFNFFFYKRSYITHYEKY

SEQ ID NO: 3299213 - protein, 18 aa, Plasmodium falciparum
ALFSIFFIWSLSAYILYT

SEQ ID NO: 3299214 - protein, 22 aa, Plasmodium falciparum
ALLFFYILLIKGYYGRTESKNI

SEQ ID NO: 3299215 - protein, 27 aa, Plasmodium falciparum
ALVTFVFLFMFLVFNKMNPFGTTIVQG

SEQ ID NO: 3299216 - protein, 18 aa, Plasmodium falciparum
ANFISFYFFFLHIKDILN

SEQ ID NO: 3299217 - protein, 17 aa, Plasmodium falciparum
ANFYFSILYYKLDLKTI

SEQ ID NO: 3299218 - protein, 21 aa, Plasmodium falciparum
ANWLPWLKWISSKRAIVHVTK

SEQ ID NO: 3299219 - protein, 19 aa, Plasmodium falciparum
APAPLPPPPPPLPPLKTAL

SEQ ID NO: 3299220 - protein, 23 aa, Plasmodium falciparum
ARVIFYCLKYLYSKKLYNIVSNA

SEQ ID NO: 3299221 - protein, 22 aa, Plasmodium falciparum
ASKYLFFYFFTNLYLDAYKSFP

SEQ ID NO: 3299222 - protein, 22 aa, Plasmodium falciparum
ASYDLYMMLYYYQFFTFQSICN

SEQ ID NO: 3299223 - protein, 19 aa, Plasmodium falciparum
ATWLIYLYELKRASFFINY

SEQ ID NO: 3299224 - protein, 17 aa, Plasmodium falciparum
AVFWIWIQSLFSDISYL

SEQ ID NO: 3299225 - protein, 22 aa, Plasmodium falciparum
AWSIFVVYLLRELLIDGNYDPI

SEQ ID NO: 3299226 - protein, 25 aa, Plasmodium falciparum
CDKKNYFFLYLFINDILLFYEEEKN

SEQ ID NO: 3299227 - protein, 23 aa, Plasmodium falciparum
CENSFFFLFKFIYIYMYKIIKNV

SEQ ID NO: 3299228 - protein, 26 aa, Plasmodium falciparum
CFFKSIFIFLYFCLCPWKLLKLKKKK

SEQ ID NO: 3299229 - protein, 22 aa, Plasmodium falciparum
CFGCFLFVFFPSLLFICFAYLS

SEQ ID NO: 3299230 - protein, 17 aa, Plasmodium falciparum
CHLILILNRYNWSFSSN

SEQ ID NO: 3299231 - protein, 27 aa, Plasmodium falciparum
CICIPKLIFYMLLWMKNLLLHQYKIDF

SEQ ID NO: 3299232 - protein, 18 aa, Plasmodium falciparum
CIISLFYLFILDNEIFEK

SEQ ID NO: 3299233 - protein, 19 aa, Plasmodium falciparum
CIIYLLQTMWKFYISYILS

SEQ ID NO: 3299234 - protein, 28 aa, Plasmodium falciparum
CIKFMLYFLWLLYLLFLNIEFIKFKTFQ

SEQ ID NO: 3299235 - protein, 18 aa, Plasmodium falciparum
CINFNFFYKYMSSPSLLS

SEQ ID NO: 3299236 - protein, 18 aa, Plasmodium falciparum
CIYIIIWILLTLYCLFNK

SEQ ID NO: 3299237 - protein, 26 aa, Plasmodium falciparum
CKRLLNFIKLFFFIDIGISDVLIKYF

SEQ ID NO: 3299238 - protein, 22 aa, Plasmodium falciparum
CKVFLWIIYLKITVVSFYFFHN

SEQ ID NO: 3299239 - protein, 19 aa, Plasmodium falciparum
CLALWLLFLLDVRKCEKLI

SEQ ID NO: 3299240 - protein, 26 aa, Plasmodium falciparum
CLFYIILLFCFFLWCIFKKYHENRIN

SEQ ID NO: 3299241 - protein, 28 aa, Plasmodium falciparum
CLGFAIWPFFMTIITYRLFYKDNFNNTN

SEQ ID NO: 3299242 - protein, 24 aa, Plasmodium falciparum
CLVFSYYILLLWVLKYYMLTCQAI

SEQ ID NO: 3299243 - protein, 17 aa, Plasmodium falciparum
CLYRFLNIYPPNPFRIV

SEQ ID NO: 3299244 - protein, 18 aa, Plasmodium falciparum
CNAYIVFLLLLRELNKFN

SEQ ID NO: 3299245 - protein, 17 aa, Plasmodium falciparum
CPFYIYPRKFNLSYKSR

SEQ ID NO: 3299246 - protein, 18 aa, Plasmodium falciparum
CPICKYDLIFFPKGLANK

SEQ ID NO: 3299247 - protein, 21 aa, Plasmodium falciparum
CRKKKLEVILWIKIYMSVLEE

SEQ ID NO: 3299248 - protein, 23 aa, Plasmodium falciparum
CRKVWIELFPQLFYFFNKEEIKI

SEQ ID NO: 3299249 - protein, 23 aa, Plasmodium falciparum
CSFPLLFCILFLNTLGKFGKSVL

SEQ ID NO: 3299250 - protein, 19 aa, Plasmodium falciparum
CSIFPINFIQLRNLVLSAF

SEQ ID NO: 3299251 - protein, 34 aa, Plasmodium falciparum
CSNDEIYMYFFLFKKFIFSCYIYFNLVSIQIYSN

SEQ ID NO: 3299252 - protein, 17 aa, Plasmodium falciparum
CTSTLICLFIDSFYKTL

SEQ ID NO: 3299253 - protein, 23 aa, Plasmodium falciparum
CVEFFKMLFLVSLFLITSYYSFI

SEQ ID NO: 3299254 - protein, 17 aa, Plasmodium falciparum
CVLFYFFCTHLFFLHVI

SEQ ID NO: 3299255 - protein, 18 aa, Plasmodium falciparum
CVYFYFYRIIKNFQIYIQ

SEQ ID NO: 3299256 - protein, 23 aa, Plasmodium falciparum
CYTLLFGIILYFFKNNIKRICRY

SEQ ID NO: 3299257 - protein, 19 aa, Plasmodium falciparum
DAHLWLFVEYLNVGIYLYK

SEQ ID NO: 3299258 - protein, 22 aa, Plasmodium falciparum
DAPIYLYFYFFSNLYLDSAKYF

SEQ ID NO: 3299259 - protein, 18 aa, Plasmodium falciparum
DDKSIYLIFLFLGNIFTV

SEQ ID NO: 3299260 - protein, 27 aa, Plasmodium falciparum
DDWLSSDVLLSCFLNFIKLKKYVNITE

SEQ ID NO: 3299261 - protein, 24 aa, Plasmodium falciparum
DEEKHIFLQFLKIKTEWVLVELNN

SEQ ID NO: 3299262 - protein, 25 aa, Plasmodium falciparum
DEQKKLFFFNYVNYINTLYYCNHND

SEQ ID NO: 3299263 - protein, 20 aa, Plasmodium falciparum
DETCYFYLFKTILNVFSIFK

SEQ ID NO: 3299264 - protein, 24 aa, Plasmodium falciparum
DEVLPLLIYVIIKTNPPEIISNII

SEQ ID NO: 3299265 - protein, 20 aa, Plasmodium falciparum
DFLRLMFYTLGDYRDICIGV

SEQ ID NO: 3299266 - protein, 18 aa, Plasmodium falciparum
DFVLRPPYFRYLEEWGQN

SEQ ID NO: 3299267 - protein, 19 aa, Plasmodium falciparum
DIIYILYLIDENELKIYSK

SEQ ID NO: 3299268 - protein, 18 aa, Plasmodium falciparum
DILFIRPLKDLLSKEIYI

SEQ ID NO: 3299269 - protein, 17 aa, Plasmodium falciparum
DILFLYFSKFQATTQII

SEQ ID NO: 3299270 - protein, 25 aa, Plasmodium falciparum
DIMSLEYLFLYFSPSSYVLHNNTLY

SEQ ID NO: 3299271 - protein, 23 aa, Plasmodium falciparum
DINSITILFYFYKTFYNFHTKKN

SEQ ID NO: 3299272 - protein, 22 aa, Plasmodium falciparum
DIRLLFFELIYFGNYRGLYNYK

SEQ ID NO: 3299273 - protein, 17 aa, Plasmodium falciparum
DISLFFFIFFYIILFFS

SEQ ID NO: 3299274 - protein, 23 aa, Plasmodium falciparum
DIYNMICILYPLVIYNILRKMNN

SEQ ID NO: 3299275 - protein, 26 aa, Plasmodium falciparum
DKIERILYLLFLLDKYKNFTFHVPIN

SEQ ID NO: 3299276 - protein, 30 aa, Plasmodium falciparum
DKKRTFYYLFFFFTFLVYVLYFDNIKSVLR

SEQ ID NO: 3299277 - protein, 17 aa, Plasmodium falciparum
DKTWLLWILIKLNIHKE

SEQ ID NO: 3299278 - protein, 25 aa, Plasmodium falciparum
DKYMLGIFFIFLWNDGYLWDSAEME

SEQ ID NO: 3299279 - protein, 17 aa, Plasmodium falciparum
DLDFFFFLRNDPFSKFL

SEQ ID NO: 3299280 - protein, 21 aa, Plasmodium falciparum
DLIKILFFFQVPHLFIMYVYI

SEQ ID NO: 3299281 - protein, 24 aa, Plasmodium falciparum
DLRVTIFNVFWLREWTEFNYRLTG

SEQ ID NO: 3299282 - protein, 24 aa, Plasmodium falciparum
DMLWFLLRIFLLLKLPVHCLALIL

SEQ ID NO: 3299283 - protein, 24 aa, Plasmodium falciparum
DNENIFFGFLFFYGLILEPTRELC

SEQ ID NO: 3299284 - protein, 24 aa, Plasmodium falciparum
DNKFPFNILFHRWITDFIQYYNKS

SEQ ID NO: 3299285 - protein, 28 aa, Plasmodium falciparum
DNNFKYIYLQLYMYFIETYLGIDIYSVS

SEQ ID NO: 3299286 - protein, 25 aa, Plasmodium falciparum
DNYLYDFVILLIRILLLIYNKKNTM

SEQ ID NO: 3299287 - protein, 25 aa, Plasmodium falciparum
DPPAYLYFHFFLNLYFDSGKYFPGG

SEQ ID NO: 3299288 - protein, 23 aa, Plasmodium falciparum
DQDKLFLFPLPYGNYTHYSNFVV

SEQ ID NO: 3299289 - protein, 21 aa, Plasmodium falciparum
DQKFYFFSLYTLLKRHIYKCI

SEQ ID NO: 3299290 - protein, 17 aa, Plasmodium falciparum
DSFDLWIYIMNLLICFN

SEQ ID NO: 3299291 - protein, 23 aa, Plasmodium falciparum
DSVPDFMKKTFYLAAAGEGKKLR

SEQ ID NO: 3299292 - protein, 22 aa, Plasmodium falciparum
DVDIIVVFLFSLFLYFNANNIV

SEQ ID NO: 3299293 - protein, 22 aa, Plasmodium falciparum
DWEEWFPTIYYNWLAYVNNLEE

SEQ ID NO: 3299294 - protein, 22 aa, Plasmodium falciparum
DYDKYFLNLRKFKYVKLKSVSM

SEQ ID NO: 3299295 - protein, 17 aa, Plasmodium falciparum
DYVPQYLRWFEEWGEDF

SEQ ID NO: 3299296 - protein, 18 aa, Plasmodium falciparum
EAFSSMPYYAGAGVLFII

SEQ ID NO: 3299297 - protein, 28 aa, Plasmodium falciparum
EANFIFFLWLIYLLILLDSLQALDSNVS

SEQ ID NO: 3299298 - protein, 22 aa, Plasmodium falciparum
EDIINFFIYLIHLLYEKKKNAE

SEQ ID NO: 3299299 - protein, 26 aa, Plasmodium falciparum
EDKKIIMFEFLKLLIKLHNAGLVHLD

SEQ ID NO: 3299300 - protein, 22 aa, Plasmodium falciparum
EEYFFFFFFLFYFLLLNNNKSC

SEQ ID NO: 3299301 - protein, 23 aa, Plasmodium falciparum
EFIYFFMIIAFWILVTHLILYGT

SEQ ID NO: 3299302 - protein, 19 aa, Plasmodium falciparum
EFLFFWIPTLIIFSIAIPC

SEQ ID NO: 3299303 - protein, 26 aa, Plasmodium falciparum
EFRNELFLFVVEKWRLLSKFYYMDKY

SEQ ID NO: 3299304 - protein, 22 aa, Plasmodium falciparum
EFVEIPPFFRWLHEWGSDFCDK

SEQ ID NO: 3299305 - protein, 22 aa, Plasmodium falciparum
EFVSYFYFLDLLYKVGTFDFIF

SEQ ID NO: 3299306 - protein, 19 aa, Plasmodium falciparum
EGDIPYRVFIKNKFYPGLA

SEQ ID NO: 3299307 - protein, 26 aa, Plasmodium falciparum
EGFQNLIDFLFNKYKIIFLQTTTEIP

SEQ ID NO: 3299308 - protein, 17 aa, Plasmodium falciparum
EGLIICKLLTYLDLLRS

SEQ ID NO: 3299309 - protein, 18 aa, Plasmodium falciparum
EHFHNILKILFFWNFELY

SEQ ID NO: 3299310 - protein, 22 aa, Plasmodium falciparum
EHLILLLWSFNPKLSILCAEIL

SEQ ID NO: 3299311 - protein, 19 aa, Plasmodium falciparum
EIFLLLSPLRIPAFCFSWV

SEQ ID NO: 3299312 - protein, 20 aa, Plasmodium falciparum
EIFVYIPWNFGVDTGMYTPL

SEQ ID NO: 3299313 - protein, 26 aa, Plasmodium falciparum
EIINMCLYLLYLYYLCNVLYKCVRIN

SEQ ID NO: 3299314 - protein, 18 aa, Plasmodium falciparum
EIINYLFSFFYMNEFFFK

SEQ ID NO: 3299315 - protein, 27 aa, Plasmodium falciparum
EILHFILLKLLYYIIVIFICSLNGNIL

SEQ ID NO: 3299316 - protein, 27 aa, Plasmodium falciparum
EILHFLPLKYLLDLLILYDLKDYIKFK

SEQ ID NO: 3299317 - protein, 29 aa, Plasmodium falciparum
EIQKTFHDFFYFWIRRFLNDSMYWRGKVN

SEQ ID NO: 3299318 - protein, 24 aa, Plasmodium falciparum
EIQKTFYDFFYYWVAHMLKDSIYW

SEQ ID NO: 3299319 - protein, 24 aa, Plasmodium falciparum
EIRKILFHFYFIKRFLSLIFNKHA

SEQ ID NO: 3299320 - protein, 23 aa, Plasmodium falciparum
EIYRNVIFLKYKYLKSYKTAIHN

SEQ ID NO: 3299321 - protein, 28 aa, Plasmodium falciparum
EKEKLIKMYLLLSLLLMPFGYIYMYCIE

SEQ ID NO: 3299322 - protein, 24 aa, Plasmodium falciparum
EKFNDFHFYLFNKIFLFIYEDTKT

SEQ ID NO: 3299323 - protein, 21 aa, Plasmodium falciparum
EKKCLYLYLIPIPPTNVVNIV

SEQ ID NO: 3299324 - protein, 21 aa, Plasmodium falciparum
EKLLFLINNYYYIIYILKQNK

SEQ ID NO: 3299325 - protein, 23 aa, Plasmodium falciparum
EKRKKLKLILWIKIYMYVWEEVE

SEQ ID NO: 3299326 - protein, 25 aa, Plasmodium falciparum
EKTYLVPTAFRKKYWWRVHYMLTEE

SEQ ID NO: 3299327 - protein, 18 aa, Plasmodium falciparum
EKVSYNLNKLYKGSFEEL

SEQ ID NO: 3299328 - protein, 21 aa, Plasmodium falciparum
EKVSYNLNKLYKGSFEELESE

SEQ ID NO: 3299329 - protein, 27 aa, Plasmodium falciparum
ELDDAYICFFFLIFIDIYKFLTTGFNL

SEQ ID NO: 3299330 - protein, 26 aa, Plasmodium falciparum
ELDGFPYIILLLSSFLWLVYGMLLNN

SEQ ID NO: 3299331 - protein, 19 aa, Plasmodium falciparum
ELFDFLYMDDRLKYFLNID

SEQ ID NO: 3299332 - protein, 35 aa, Plasmodium falciparum
ELKKKIRIKKFVQLTLLLLLISIIVFISTYGFSYI

SEQ ID NO: 3299333 - protein, 34 aa, Plasmodium falciparum
ELMERSHMFLLIKIFFVLFLFEVNVKMYFIVSGM

SEQ ID NO: 3299334 - protein, 37 aa, Plasmodium falciparum
ELSINFSITFIFINILLVFFSTFLYRNIKKVNDPDSY

SEQ ID NO: 3299335 - protein, 24 aa, Plasmodium falciparum
ELSLHLYFFIIFVYHLLNFLFTEN

SEQ ID NO: 3299336 - protein, 24 aa, Plasmodium falciparum
EMIIRYNMKFFPLSKLYNIKNTAS

SEQ ID NO: 3299337 - protein, 23 aa, Plasmodium falciparum
EMLFSFLFCKKKNYFYNIKNKYF

SEQ ID NO: 3299338 - protein, 22 aa, Plasmodium falciparum
EMSLCFYFLLLNNILRDIKCVF

SEQ ID NO: 3299339 - protein, 24 aa, Plasmodium falciparum
ENGRYFLFLYFYYLLCIISKQQFS

SEQ ID NO: 3299340 - protein, 26 aa, Plasmodium falciparum
ENILLYILFILFFIKNWYTRLLILKD

SEQ ID NO: 3299341 - protein, 17 aa, Plasmodium falciparum
ENKFRYLFLRDLSYYID

SEQ ID NO: 3299342 - protein, 22 aa, Plasmodium falciparum
ENMPQFFRWFSQWAHFFCKEKE

SEQ ID NO: 3299343 - protein, 27 aa, Plasmodium falciparum
ENNNLVPNLFTFKYLVSYYSNDPNFLQ

SEQ ID NO: 3299344 - protein, 24 aa, Plasmodium falciparum
ENQIIIIRALFKRWLEYFLEDYNK

SEQ ID NO: 3299345 - protein, 23 aa, Plasmodium falciparum
ENRPIIKGFLWPNPKCRLAFIDV

SEQ ID NO: 3299346 - protein, 26 aa, Plasmodium falciparum
EQFLRLPNIWFLLISLLEFIPQYQNL

SEQ ID NO: 3299347 - protein, 19 aa, Plasmodium falciparum
ERHPFFRWFIEWTDEFCQE

SEQ ID NO: 3299348 - protein, 29 aa, Plasmodium falciparum
ERKEKRRNWILRSLRRDKLREIEQLEKLN

SEQ ID NO: 3299349 - protein, 20 aa, Plasmodium falciparum
ERYFLPLISFIPIIILYDYL

SEQ ID NO: 3299350 - protein, 22 aa, Plasmodium falciparum
ESEKYIILLLEKNPFDIKALHV

SEQ ID NO: 3299351 - protein, 25 aa, Plasmodium falciparum
ESTNLFFYYFFDFVLSFFKFNFSYL

SEQ ID NO: 3299352 - protein, 38 aa, Plasmodium falciparum
ESYSFIKLLFRKCIIFFIIYFLFIIPLNEVIYNKYDYS

SEQ ID NO: 3299353 - protein, 22 aa, Plasmodium falciparum
ETYEYLFYLLKNYKLPYYSSKY

SEQ ID NO: 3299354 - protein, 20 aa, Plasmodium falciparum
EVMLLKKWNLLKFKQARKNH

SEQ ID NO: 3299355 - protein, 19 aa, Plasmodium falciparum
EVMVYHPFFWKWVTEMLDD

SEQ ID NO: 3299356 - protein, 18 aa, Plasmodium falciparum
EVYIYYFLIFFNSTIINS

SEQ ID NO: 3299357 - protein, 21 aa, Plasmodium falciparum
EWYYIYPIIIILSLNYSKYIQ

SEQ ID NO: 3299358 - protein, 21 aa, Plasmodium falciparum
EYDYRWSVILPYIIFKHDKSK

SEQ ID NO: 3299359 - protein, 22 aa, Plasmodium falciparum
EYIPIILFFLNNVKNDLYNCYK

SEQ ID NO: 3299360 - protein, 27 aa, Plasmodium falciparum
EYMFPFYSFILFKFVKMLSLLLPSILS

SEQ ID NO: 3299361 - protein, 30 aa, Plasmodium falciparum
EYTTFKVLIVYWLEDFLYSYYILKKKIELC

SEQ ID NO: 3299362 - protein, 18 aa, Plasmodium falciparum
FAFIILALFVCALNTYIY

SEQ ID NO: 3299363 - protein, 17 aa, Plasmodium falciparum
FAIINYHKISSFILLIF

SEQ ID NO: 3299364 - protein, 30 aa, Plasmodium falciparum
FAISLFMYIVLKNLYYLYIFKRTRIKIIES

SEQ ID NO: 3299365 - protein, 28 aa, Plasmodium falciparum
FAPLIYVLKFLLYLFAKPTSLLLDHFVG

SEQ ID NO: 3299366 - protein, 27 aa, Plasmodium falciparum
FAQLIYFMLIFLYKIFFQPIKTTDTML

SEQ ID NO: 3299367 - protein, 24 aa, Plasmodium falciparum
FAWFKYFLFFILYSINFQFRDKKV

SEQ ID NO: 3299368 - protein, 18 aa, Plasmodium falciparum
FCIKLLYIMTLFNISFTN

SEQ ID NO: 3299369 - protein, 18 aa, Plasmodium falciparum
FCIYLYRDCIISFFLLYI

SEQ ID NO: 3299370 - protein, 17 aa, Plasmodium falciparum
FCKGMNLHFLISAEEID

SEQ ID NO: 3299371 - protein, 29 aa, Plasmodium falciparum
FCKNMKLPILFFLLIKRLLIMEVSNSNLN

SEQ ID NO: 3299372 - protein, 18 aa, Plasmodium falciparum
FCLYMLFFTLYNVLHKYN

SEQ ID NO: 3299373 - protein, 23 aa, Plasmodium falciparum
FCTYFFIKLKWFHKLKTIRLLIL

SEQ ID NO: 3299374 - protein, 17 aa, Plasmodium falciparum
FDYLLLKKNIITMVNIK

SEQ ID NO: 3299375 - protein, 17 aa, Plasmodium falciparum
FEDTCFLCFLYKPFINT

SEQ ID NO: 3299376 - protein, 31 aa, Plasmodium falciparum
FEKFYFFIFIFILTVLWISCAFIFLIIKIYK

SEQ ID NO: 3299377 - protein, 23 aa, Plasmodium falciparum
FELYKYFYYLNYPLNLNTHELLQ

SEQ ID NO: 3299378 - protein, 23 aa, Plasmodium falciparum
FERRQRIIPLKITNIESTNFRSH

SEQ ID NO: 3299379 - protein, 24 aa, Plasmodium falciparum
FFFEQLIFYKIIYAYILLEYGILS

SEQ ID NO: 3299380 - protein, 20 aa, Plasmodium falciparum
FFFFFFSFFFIYINNVSIAR

SEQ ID NO: 3299381 - protein, 20 aa, Plasmodium falciparum
FFFFLSLFYLEYFLIYCHFF

SEQ ID NO: 3299382 - protein, 20 aa, Plasmodium falciparum
FFFFLVHIFYIFHIEGIYIN

SEQ ID NO: 3299383 - protein, 27 aa, Plasmodium falciparum
FFFGCVAPFLFAWIFSNGLIFSDTFNY

SEQ ID NO: 3299384 - protein, 19 aa, Plasmodium falciparum
FFFILIIFLPWRHINYHTS

SEQ ID NO: 3299385 - protein, 19 aa, Plasmodium falciparum
FFFLFLVILYFNNVVEGEN

SEQ ID NO: 3299386 - protein, 24 aa, Plasmodium falciparum
FFFNYLFIHLYLKNKLLLKNEIHK

SEQ ID NO: 3299387 - protein, 17 aa, Plasmodium falciparum
FFFYIKNKRIDIPFQKF

SEQ ID NO: 3299388 - protein, 24 aa, Plasmodium falciparum
FFHIKWIVYTLQSFIFYNFFFKKI

SEQ ID NO: 3299389 - protein, 19 aa, Plasmodium falciparum
FFIIFFFFIFIAIKITILV

SEQ ID NO: 3299390 - protein, 17 aa, Plasmodium falciparum
FFILTIYTFLRTSFMDP

SEQ ID NO: 3299391 - protein, 18 aa, Plasmodium falciparum
FFKKFHLLDWFYNPNDET

SEQ ID NO: 3299392 - protein, 18 aa, Plasmodium falciparum
FFLIFFSFYNPVKGEGYI

SEQ ID NO: 3299393 - protein, 17 aa, Plasmodium falciparum
FFLLFVFFLKRKYDRKE

SEQ ID NO: 3299394 - protein, 18 aa, Plasmodium falciparum
FFNNIWLLLLRHPEIRTN

SEQ ID NO: 3299395 - protein, 18 aa, Plasmodium falciparum
FFNYPFFKKPLIGDIITN

SEQ ID NO: 3299396 - protein, 25 aa, Plasmodium falciparum
FFRLSKFFFNKYKNKAYKHLLKQIN

SEQ ID NO: 3299397 - protein, 18 aa, Plasmodium falciparum
FFSMKPFFLYIIKEDINL

SEQ ID NO: 3299398 - protein, 25 aa, Plasmodium falciparum
FFSNYYFIYLYYFKINLLQKIFQQN

SEQ ID NO: 3299399 - protein, 23 aa, Plasmodium falciparum
FFSPLIFLLLLFFSIILSIYYNF

SEQ ID NO: 3299400 - protein, 18 aa, Plasmodium falciparum
FFVYIILNILIVLVISKN

SEQ ID NO: 3299401 - protein, 17 aa, Plasmodium falciparum
FFYFWIGRFLNDSMYWR

SEQ ID NO: 3299402 - protein, 17 aa, Plasmodium falciparum
FFYIQIWINCLFCFGYN

SEQ ID NO: 3299403 - protein, 18 aa, Plasmodium falciparum
FFYLLILSFILYNKIINV

SEQ ID NO: 3299404 - protein, 28 aa, Plasmodium falciparum
FGNSFNFYLYVFNNLALFEWFVFEVKSF

SEQ ID NO: 3299405 - protein, 17 aa, Plasmodium falciparum
FHFMCLVVYIISLFFIT

SEQ ID NO: 3299406 - protein, 24 aa, Plasmodium falciparum
FHSKILIHLYYFKPNLLFLSAGFD

SEQ ID NO: 3299407 - protein, 19 aa, Plasmodium falciparum
FIFFCSVVIFIRFIGYFFC

SEQ ID NO: 3299408 - protein, 20 aa, Plasmodium falciparum
FIFFIHILNLLPCNFSLLSN

SEQ ID NO: 3299409 - protein, 20 aa, Plasmodium falciparum
FIFIFLLLLVYFLVCGEFPL

SEQ ID NO: 3299410 - protein, 17 aa, Plasmodium falciparum
FIFLYYYLFFSLDFYRI

SEQ ID NO: 3299411 - protein, 18 aa, Plasmodium falciparum
FIFPIFVIYAYHIYMFYH

SEQ ID NO: 3299412 - protein, 17 aa, Plasmodium falciparum
FIGVIIINVFFFEYVKC

SEQ ID NO: 3299413 - protein, 17 aa, Plasmodium falciparum
FIIIPFAEFLLPIFLKI

SEQ ID NO: 3299414 - protein, 18 aa, Plasmodium falciparum
FIILFYFTCELNVLLFPI

SEQ ID NO: 3299415 - protein, 18 aa, Plasmodium falciparum
FIIMFCILGIIWSMEREH

SEQ ID NO: 3299416 - protein, 23 aa, Plasmodium falciparum
FIISEILFFIDPTNNLYFEILTL

SEQ ID NO: 3299417 - protein, 17 aa, Plasmodium falciparum
FIKKIYYVLLKLYFYNL

SEQ ID NO: 3299418 - protein, 17 aa, Plasmodium falciparum
FILFYFKNNCYFSYCCC

SEQ ID NO: 3299419 - protein, 30 aa, Plasmodium falciparum
FILILCIVVFFIWFILTFFDIVNIKKENYF

SEQ ID NO: 3299420 - protein, 17 aa, Plasmodium falciparum
FILIVFIFLMVFFKKEP

SEQ ID NO: 3299421 - protein, 19 aa, Plasmodium falciparum
FINIPRYICSSYIFVKENE

SEQ ID NO: 3299422 - protein, 26 aa, Plasmodium falciparum
FIQNTILRIFVLRNYKFIDKTRIDYF

SEQ ID NO: 3299423 - protein, 19 aa, Plasmodium falciparum
FISFFLFYFLKYKVTKNYN

SEQ ID NO: 3299424 - protein, 23 aa, Plasmodium falciparum
FISFFTIFLLPLLYLTFKQKKYI

SEQ ID NO: 3299425 - protein, 19 aa, Plasmodium falciparum
FISIYLYFIQSRVYNPILF

SEQ ID NO: 3299426 - protein, 24 aa, Plasmodium falciparum
FITPKFIALFFPSYLKYLKDGTKQ

SEQ ID NO: 3299427 - protein, 25 aa, Plasmodium falciparum
FIVDYLYFIYLFKWINKLYRKYEKI

SEQ ID NO: 3299428 - protein, 17 aa, Plasmodium falciparum
FIYHFYSVRLLGVSPSD

SEQ ID NO: 3299429 - protein, 18 aa, Plasmodium falciparum
FIYLLPLFQEISNYNFLE

SEQ ID NO: 3299430 - protein, 20 aa, Plasmodium falciparum
FKCNYNLFYIFNRYNFQFNA

SEQ ID NO: 3299431 - protein, 25 aa, Plasmodium falciparum
FKDMFFLKLFFFTLYLFFISYNSAN

SEQ ID NO: 3299432 - protein, 25 aa, Plasmodium falciparum
FKHKFFFFVFFYIFLIYSFSKLFSI

SEQ ID NO: 3299433 - protein, 27 aa, Plasmodium falciparum
FKKENRLFFLLFYKTIKMMKLYIRNLF

SEQ ID NO: 3299434 - protein, 22 aa, Plasmodium falciparum
FKLTLPFPHLFLCKPNSLYLNN

SEQ ID NO: 3299435 - protein, 25 aa, Plasmodium falciparum
FKNILLILPIFFYQAYASWSCVKIY

SEQ ID NO: 3299436 - protein, 24 aa, Plasmodium falciparum
FKPLIPNIKILLFSLNKILFNKHR

SEQ ID NO: 3299437 - protein, 24 aa, Plasmodium falciparum
FKSLLLFFYPLIIPFRGAFAFAIS

SEQ ID NO: 3299438 - protein, 18 aa, Plasmodium falciparum
FLCRALQIPLFAWLRFSS

SEQ ID NO: 3299439 - protein, 19 aa, Plasmodium falciparum
FLDLLLKWTYYTLYGHKNN

SEQ ID NO: 3299440 - protein, 17 aa, Plasmodium falciparum
FLFFCFFFLYFPSEEIK

SEQ ID NO: 3299441 - protein, 17 aa, Plasmodium falciparum
FLFFFKVPLETFLSFRN

SEQ ID NO: 3299442 - protein, 17 aa, Plasmodium falciparum
FLFIIAPIAWTLTFLLK

SEQ ID NO: 3299443 - protein, 17 aa, Plasmodium falciparum
FLFLLIFLFIMSLFLLY

SEQ ID NO: 3299444 - protein, 25 aa, Plasmodium falciparum
FLFLLLFMFLLRIVLLIILYIWLYR

SEQ ID NO: 3299445 - protein, 17 aa, Plasmodium falciparum
FLFLVNILNIYGTPLFY

SEQ ID NO: 3299446 - protein, 19 aa, Plasmodium falciparum
FLIIFIQDILCLKYEDYIK

SEQ ID NO: 3299447 - protein, 18 aa, Plasmodium falciparum
FLILPSFFFMNNSFYFSC

SEQ ID NO: 3299448 - protein, 21 aa, Plasmodium falciparum
FLIPLIFLYNVIRINESIIGR

SEQ ID NO: 3299449 - protein, 17 aa, Plasmodium falciparum
FLISYIEYIYILLLIIK

SEQ ID NO: 3299450 - protein, 17 aa, Plasmodium falciparum
FLKILIVIFLFYTKYYI

SEQ ID NO: 3299451 - protein, 19 aa, Plasmodium falciparum
FLKILIVLLILWEIQNMFE

SEQ ID NO: 3299452 - protein, 18 aa, Plasmodium falciparum
FLKNIHWLITFPILLYIV

SEQ ID NO: 3299453 - protein, 18 aa, Plasmodium falciparum
FLLFLYVNNTSAINNPQE

SEQ ID NO: 3299454 - protein, 19 aa, Plasmodium falciparum
FLLFVVLIYLYLKLKKVNK

SEQ ID NO: 3299455 - protein, 20 aa, Plasmodium falciparum
FLLICILLNKQWILLNKAES

SEQ ID NO: 3299456 - protein, 17 aa, Plasmodium falciparum
FLLKIGKSLIRFLIFIG

SEQ ID NO: 3299457 - protein, 22 aa, Plasmodium falciparum
FLLLSVPYFFLFLWNEDIKCQS

SEQ ID NO: 3299458 - protein, 17 aa, Plasmodium falciparum
FLNIYPPNPFRIVYLEK

SEQ ID NO: 3299459 - protein, 22 aa, Plasmodium falciparum
FLNKLLYFFFLPIKPSINKNLS

SEQ ID NO: 3299460 - protein, 18 aa, Plasmodium falciparum
FLRLMFYTLADYKDILFS

SEQ ID NO: 3299461 - protein, 19 aa, Plasmodium falciparum
FLRQMFYTLGDYRDILYSG

SEQ ID NO: 3299462 - protein, 24 aa, Plasmodium falciparum
FLSFKFWYFYLRYQGIDKMKKLFN

SEQ ID NO: 3299463 - protein, 25 aa, Plasmodium falciparum
FLSNFSFIYFLPWPYEALVNVSNKF

SEQ ID NO: 3299464 - protein, 17 aa, Plasmodium falciparum
FLTFLLLLDVYILDHTL

SEQ ID NO: 3299465 - protein, 22 aa, Plasmodium falciparum
FLYLFYLTYIFKVVIIYCDSSF

SEQ ID NO: 3299466 - protein, 29 aa, Plasmodium falciparum
FLYMSFICLLIRCLILFYICRIIRKKYSV

SEQ ID NO: 3299467 - protein, 17 aa, Plasmodium falciparum
FMLLIYYYEIYINRTNS

SEQ ID NO: 3299468 - protein, 23 aa, Plasmodium falciparum
FNDIFYPYILIIPRFFHCKKKNS

SEQ ID NO: 3299469 - protein, 28 aa, Plasmodium falciparum
FNFLFSFFINIFFILLASGAFYSLNYVF

SEQ ID NO: 3299470 - protein, 20 aa, Plasmodium falciparum
FNPLFLSFLFFFSSSFFPNV

SEQ ID NO: 3299471 - protein, 17 aa, Plasmodium falciparum
FPFIMLIIYFFVFNKYS

SEQ ID NO: 3299472 - protein, 21 aa, Plasmodium falciparum
FPFLCFLFFSFLFIFKIIMSL

SEQ ID NO: 3299473 - protein, 18 aa, Plasmodium falciparum
FPFLFKRIQLYISKFFLY

SEQ ID NO: 3299474 - protein, 21 aa, Plasmodium falciparum
FPMYIYIMLICLIFSILQDDG

SEQ ID NO: 3299475 - protein, 31 aa, Plasmodium falciparum
FPRNTFLPWRFSVELFLWDLLNVLPHELPHP

SEQ ID NO: 3299476 - protein, 17 aa, Plasmodium falciparum
FPVQWNLPSIYLTNDEI

SEQ ID NO: 3299477 - protein, 24 aa, Plasmodium falciparum
FQHKYLFIHIFVYTLNLIIFFKLL

SEQ ID NO: 3299478 - protein, 26 aa, Plasmodium falciparum
FQKTFHDFFYFWIGRFLNDSMYWRGK

SEQ ID NO: 3299479 - protein, 22 aa, Plasmodium falciparum
FQKTFHDLFYYWVAHMLKDSIY

SEQ ID NO: 3299480 - protein, 21 aa, Plasmodium falciparum
FQKTFYDFFTYWVAHMLKDSI

SEQ ID NO: 3299481 - protein, 23 aa, Plasmodium falciparum
FQNFLFSIFSIFYILLCCYYKNF

SEQ ID NO: 3299482 - protein, 33 aa, Plasmodium falciparum
FRENKIIFLFFIKIFLFSLFIWELCCFNKEKFQ

SEQ ID NO: 3299483 - protein, 19 aa, Plasmodium falciparum
FRLVLLDFYYVYFFDLHGN

SEQ ID NO: 3299484 - protein, 21 aa, Plasmodium falciparum
FSCFLLFLPLHIVRTHYAKNE

SEQ ID NO: 3299485 - protein, 23 aa, Plasmodium falciparum
FSCIYFLIIIWKFSYVYNESYSN

SEQ ID NO: 3299486 - protein, 26 aa, Plasmodium falciparum
FSFYEYLFLLLFYKKGIHKIFDYVYV

SEQ ID NO: 3299487 - protein, 19 aa, Plasmodium falciparum
FSIYLYHSWLKRILFVFLS

SEQ ID NO: 3299488 - protein, 25 aa, Plasmodium falciparum
FSLFFIYLFIIIFVFPFVLKNMIHS

SEQ ID NO: 3299489 - protein, 21 aa, Plasmodium falciparum
FSLFILYYFYLGYIRGYLSVN

SEQ ID NO: 3299490 - protein, 24 aa, Plasmodium falciparum
FSNNLIMLFFLLAKNKLFPSKTIH

SEQ ID NO: 3299491 - protein, 24 aa, Plasmodium falciparum
FSSIFTSIFYFIFGLIFCLNNSFQ

SEQ ID NO: 3299492 - protein, 26 aa, Plasmodium falciparum
FSSLYFFFFFFFFFNMNFVKTYYKNC

SEQ ID NO: 3299493 - protein, 17 aa, Plasmodium falciparum
FSYFLMYVFMFFCYNDI

SEQ ID NO: 3299494 - protein, 26 aa, Plasmodium falciparum
FSYIYDLVLLLYFLKICFFYLNEHIH

SEQ ID NO: 3299495 - protein, 18 aa, Plasmodium falciparum
FTFIYSIILLCEYLSFIK

SEQ ID NO: 3299496 - protein, 19 aa, Plasmodium falciparum
FTLIVWCSFLLDKMHMMSD

SEQ ID NO: 3299497 - protein, 25 aa, Plasmodium falciparum
FTLTDFMYLIFRWLETYISFNDRDH

SEQ ID NO: 3299498 - protein, 17 aa, Plasmodium falciparum
FVILFLYIILSSVIQIC

SEQ ID NO: 3299499 - protein, 25 aa, Plasmodium falciparum
FVNNNLLFFLYFYSKYKTILDYVSN

SEQ ID NO: 3299500 - protein, 18 aa, Plasmodium falciparum
FVYLVYLFHMFSLSLRMQ

SEQ ID NO: 3299501 - protein, 17 aa, Plasmodium falciparum
FWKEIITSLIWMIISIL

SEQ ID NO: 3299502 - protein, 20 aa, Plasmodium falciparum
FYELVYFIIKIIYKNIYINN

SEQ ID NO: 3299503 - protein, 24 aa, Plasmodium falciparum
FYFILVNLLIFHINGKIIKNSEKD

SEQ ID NO: 3299504 - protein, 18 aa, Plasmodium falciparum
FYFQFFYDIIIRIFNELY

SEQ ID NO: 3299505 - protein, 20 aa, Plasmodium falciparum
FYFSILYYKLDLKTILTELF

SEQ ID NO: 3299506 - protein, 17 aa, Plasmodium falciparum
FYGICIKSNKLMLLLEY

SEQ ID NO: 3299507 - protein, 19 aa, Plasmodium falciparum
FYHLYYIYIYYRDILFLLK

SEQ ID NO: 3299508 - protein, 21 aa, Plasmodium falciparum
FYIFFLHIDIYVNIYSTCFVV

SEQ ID NO: 3299509 - protein, 20 aa, Plasmodium falciparum
FYIIIFFIMYLNYYCYIKKN

SEQ ID NO: 3299510 - protein, 18 aa, Plasmodium falciparum
FYINFNIFYIYIKSLIKL

SEQ ID NO: 3299511 - protein, 20 aa, Plasmodium falciparum
FYISYFKIIKLLFSKIDMNK

SEQ ID NO: 3299512 - protein, 18 aa, Plasmodium falciparum
FYKFCFFPIRYIPYIQRY

SEQ ID NO: 3299513 - protein, 19 aa, Plasmodium falciparum
FYKLLLKILSYFSYFYIFF

SEQ ID NO: 3299514 - protein, 18 aa, Plasmodium falciparum
FYLCIHVSIFIILINPFS

SEQ ID NO: 3299515 - protein, 20 aa, Plasmodium falciparum
FYLYILFSIIMRIKCVITKN

SEQ ID NO: 3299516 - protein, 18 aa, Plasmodium falciparum
FYMSFLKSPFYFSRKFKL

SEQ ID NO: 3299517 - protein, 26 aa, Plasmodium falciparum
FYRSYLFFLTWYFIGIFYISLKCTYQ

SEQ ID NO: 3299518 - protein, 22 aa, Plasmodium falciparum
FYSYKYYFYYYYVIKLKYILYD

SEQ ID NO: 3299519 - protein, 20 aa, Plasmodium falciparum
FYSYMCIYIFLKNGHIYLIR

SEQ ID NO: 3299520 - protein, 19 aa, Plasmodium falciparum
FYTLFRFLFTLFLLIYMVK

SEQ ID NO: 3299521 - protein, 17 aa, Plasmodium falciparum
FYYFLLIQNLHIDKNIP

SEQ ID NO: 3299522 - protein, 25 aa, Plasmodium falciparum
GATVLAGLFVLLASVLVFKKVKGFT

SEQ ID NO: 3299523 - protein, 24 aa, Plasmodium falciparum
GCYLFMRLMNVIPLIKLKIYSPLS

SEQ ID NO: 3299524 - protein, 20 aa, Plasmodium falciparum
GFAALSYFLLKVNGCIYMCM

SEQ ID NO: 3299525 - protein, 29 aa, Plasmodium falciparum
GFCLFSQLWYWFPLIHMISLTFMPTCLIG

SEQ ID NO: 3299526 - protein, 24 aa, Plasmodium falciparum
GFEDKIFLALYRRLFKKIEYQCYH

SEQ ID NO: 3299527 - protein, 18 aa, Plasmodium falciparum
GFQILYVLLFCSVMCGLF

SEQ ID NO: 3299528 - protein, 19 aa, Plasmodium falciparum
GFREKFPTTRILVKRKRNK

SEQ ID NO: 3299529 - protein, 22 aa, Plasmodium falciparum
GGVVCCVLFFASITFFSMDRSN

SEQ ID NO: 3299530 - protein, 17 aa, Plasmodium falciparum
GHIFYFQFFYDIIIRIF

SEQ ID NO: 3299531 - protein, 18 aa, Plasmodium falciparum
GIFIIYFTSAIILYKKEE

SEQ ID NO: 3299532 - protein, 21 aa, Plasmodium falciparum
GIIWGIYRWLWKSNGKFICPL

SEQ ID NO: 3299533 - protein, 17 aa, Plasmodium falciparum
GIPLYNIITTKIKIIEI

SEQ ID NO: 3299534 - protein, 19 aa, Plasmodium falciparum
GIVLILLFVIGSKMIIGKW

SEQ ID NO: 3299535 - protein, 24 aa, Plasmodium falciparum
GKFKRLFLFIGFQSIPIIALMYLF

SEQ ID NO: 3299536 - protein, 19 aa, Plasmodium falciparum
GKRWMLMFWFIPFSKKKEN

SEQ ID NO: 3299537 - protein, 25 aa, Plasmodium falciparum
GLSLRLFFIFVLSSFVYIYYGFSFV

SEQ ID NO: 3299538 - protein, 24 aa, Plasmodium falciparum
GLVYLSGYFLWLVAFLNNEKQEII

SEQ ID NO: 3299539 - protein, 18 aa, Plasmodium falciparum
GLYIFLIHLIIVIKKHIQ

SEQ ID NO: 3299540 - protein, 17 aa, Plasmodium falciparum
GLYLLVFRLEEAMLFIK

SEQ ID NO: 3299541 - protein, 18 aa, Plasmodium falciparum
GMFLLILLFFMNTPQKIK

SEQ ID NO: 3299542 - protein, 27 aa, Plasmodium falciparum
GNKNHLFLVFLLFLFFSFSCINFTQCQ

SEQ ID NO: 3299543 - protein, 24 aa, Plasmodium falciparum
GNSYLFYFLLIAPLMFCFDDKILL

SEQ ID NO: 3299544 - protein, 19 aa, Plasmodium falciparum
GRFIIYFLLLFFISIILLD

SEQ ID NO: 3299545 - protein, 18 aa, Plasmodium falciparum
GRPYYPWVPFMGDGRGYN

SEQ ID NO: 3299546 - protein, 31 aa, Plasmodium falciparum
GSFHLILLYAILVFLFISISLLLHILLKYKT

SEQ ID NO: 3299547 - protein, 17 aa, Plasmodium falciparum
GVALTLGLLLFKMRRKA

SEQ ID NO: 3299548 - protein, 28 aa, Plasmodium falciparum
GYEKFIMQKLYFYLYRMNPNDKDDDEKI

SEQ ID NO: 3299549 - protein, 24 aa, Plasmodium falciparum
GYIMSFFAFFDLWVKNLLIDTINW

SEQ ID NO: 3299550 - protein, 22 aa, Plasmodium falciparum
GYISFFLLNYFLTPFLISLNKF

SEQ ID NO: 3299551 - protein, 20 aa, Plasmodium falciparum
HAFLSTVLYSTFPLLVMELF

SEQ ID NO: 3299552 - protein, 17 aa, Plasmodium falciparum
HASFLFLIILALFMVFG

SEQ ID NO: 3299553 - protein, 25 aa, Plasmodium falciparum
HCNFFNIFLFHFFNYTFNFPMDNFF

SEQ ID NO: 3299554 - protein, 19 aa, Plasmodium falciparum
HFYPYDNFIFFLKVLNTKS

SEQ ID NO: 3299555 - protein, 19 aa, Plasmodium falciparum
HGFFLLRCLPPIKMFPKQL

SEQ ID NO: 3299556 - protein, 24 aa, Plasmodium falciparum
HHTIYIPFFKLILMAIINPILKNM

SEQ ID NO: 3299557 - protein, 18 aa, Plasmodium falciparum
HIFFFVLFFITIYEIKCQ

SEQ ID NO: 3299558 - protein, 23 aa, Plasmodium falciparum
HIFQPFFINQLFPYFFNSFFYTY

SEQ ID NO: 3299559 - protein, 25 aa, Plasmodium falciparum
HIKFETLLIYIIIPKTTTKSLCYKD

SEQ ID NO: 3299560 - protein, 19 aa, Plasmodium falciparum
HILLLFYSIFLTKNFFYIG

SEQ ID NO: 3299561 - protein, 19 aa, Plasmodium falciparum
HILLLQFLLCLIRCYVHND

SEQ ID NO: 3299562 - protein, 27 aa, Plasmodium falciparum
HINYFKRFFFYFIKLDKKLFFPLKSVL

SEQ ID NO: 3299563 - protein, 26 aa, Plasmodium falciparum
HITLLFYLILLFYLKNFTISFIDVPK

SEQ ID NO: 3299564 - protein, 17 aa, Plasmodium falciparum
HKRFIYIYILKEIYLLL

SEQ ID NO: 3299565 - protein, 25 aa, Plasmodium falciparum
HLKNFIFFSISLWLCLFTGSALVPV

SEQ ID NO: 3299566 - protein, 17 aa, Plasmodium falciparum
HPFFWKWVHDMLHDSVE

SEQ ID NO: 3299567 - protein, 28 aa, Plasmodium falciparum
HQHMVYGRPYYWVPPPPALEYTKGFNPM

SEQ ID NO: 3299568 - protein, 22 aa, Plasmodium falciparum
HRRVEWFYHWFIESASNIEYDY

SEQ ID NO: 3299569 - protein, 25 aa, Plasmodium falciparum
HSKKILLIFGIIYVVLLNAYICGDK

SEQ ID NO: 3299570 - protein, 23 aa, Plasmodium falciparum
HSYILFLFFNFIFCGIISIVIYV

SEQ ID NO: 3299571 - protein, 24 aa, Plasmodium falciparum
HTHYFSCLLLWIFKVSNTEIINEQ

SEQ ID NO: 3299572 - protein, 25 aa, Plasmodium falciparum
HTIVYILFLLWFLQIIYIFLKVIGS

SEQ ID NO: 3299573 - protein, 20 aa, Plasmodium falciparum
HTLIHLLQKILVLQTEAMRN

SEQ ID NO: 3299574 - protein, 17 aa, Plasmodium falciparum
HYALFNYYFFFFYKYIK

SEQ ID NO: 3299575 - protein, 19 aa, Plasmodium falciparum
HYFFTRKFWLIYLSLAFIV

SEQ ID NO: 3299576 - protein, 18 aa, Plasmodium falciparum
HYFLNIYLMFFKKKNIKP

SEQ ID NO: 3299577 - protein, 21 aa, Plasmodium falciparum
HYNILLYLLLLHFDVFKNKNM

SEQ ID NO: 3299578 - protein, 22 aa, Plasmodium falciparum
IATFLLFFLFSSFRLIIHSGAS

SEQ ID NO: 3299579 - protein, 17 aa, Plasmodium falciparum
ICFFFCLFLTNVVYEYV

SEQ ID NO: 3299580 - protein, 17 aa, Plasmodium falciparum
ICFMFALMLFYFTRNEN

SEQ ID NO: 3299581 - protein, 29 aa, Plasmodium falciparum
ICICIPKLIFYMLLWMKNLLLHQYKIDFL

SEQ ID NO: 3299582 - protein, 22 aa, Plasmodium falciparum
ICIDTLYFFKGYNSHLCLSILS

SEQ ID NO: 3299583 - protein, 18 aa, Plasmodium falciparum
ICIILLIKLGIPSTYLFA

SEQ ID NO: 3299584 - protein, 17 aa, Plasmodium falciparum
ICIVVIIRYLLWNLYKN

SEQ ID NO: 3299585 - protein, 17 aa, Plasmodium falciparum
ICLFFLSLGGYYIYTPY

SEQ ID NO: 3299586 - protein, 37 aa, Plasmodium falciparum
ICMFGKYVIQVILFISFFIYIYFKKKPYKTICTTVLV

SEQ ID NO: 3299587 - protein, 24 aa, Plasmodium falciparum
ICPLFYSFMIFFNQLNSRKKLMKI

SEQ ID NO: 3299588 - protein, 17 aa, Plasmodium falciparum
ICPYLYKLKNFKLIIET

SEQ ID NO: 3299589 - protein, 18 aa, Plasmodium falciparum
ICVIAFIFLLIFIGSNYA

SEQ ID NO: 3299590 - protein, 24 aa, Plasmodium falciparum
ICYRDIIFFILFNFDQFLLLIKDE

SEQ ID NO: 3299591 - protein, 23 aa, Plasmodium falciparum
IDEYIFCNFLILLFLYKFLSKEK

SEQ ID NO: 3299592 - protein, 23 aa, Plasmodium falciparum
IDHYFFLLLLFNILSNLPYSIIP

SEQ ID NO: 3299593 - protein, 23 aa, Plasmodium falciparum
IDHYTSHDWFRLLRQGNKAQNSI

SEQ ID NO: 3299594 - protein, 19 aa, Plasmodium falciparum
IDIFIIKLYGYTILFQIYP

SEQ ID NO: 3299595 - protein, 21 aa, Plasmodium falciparum
IDILPFLMFFRTLPFFINNKN

SEQ ID NO: 3299596 - protein, 25 aa, Plasmodium falciparum
IDKHLMIKIFFFFCKKNFLLSSFFH

SEQ ID NO: 3299597 - protein, 23 aa, Plasmodium falciparum
IDKKFYIILLSLKYFLITLLHLY

SEQ ID NO: 3299598 - protein, 18 aa, Plasmodium falciparum
IDLIFLFLSKIKGANVNF

SEQ ID NO: 3299599 - protein, 26 aa, Plasmodium falciparum
IDNIFIQWIYTIFLTCLPFNIYIRLF

SEQ ID NO: 3299600 - protein, 24 aa, Plasmodium falciparum
IDYFKIHMLLKLICTFTPCYNSRI

SEQ ID NO: 3299601 - protein, 24 aa, Plasmodium falciparum
IEIQRFYLLFVKLLKMLLLLNRQN

SEQ ID NO: 3299602 - protein, 32 aa, Plasmodium falciparum
IEKEKYWRKIWLLIYTLINLILIKCKLYGIKY

SEQ ID NO: 3299603 - protein, 27 aa, Plasmodium falciparum
IEKIYFLLAILGTLSVVSLYLYIPNEN

SEQ ID NO: 3299604 - protein, 25 aa, Plasmodium falciparum
IEKRKKLKLILWIQIYMYVWEEVEK

SEQ ID NO: 3299605 - protein, 18 aa, Plasmodium falciparum
IETFFLWDRYKKIKAKEK

SEQ ID NO: 3299606 - protein, 18 aa, Plasmodium falciparum
IETFFLWHRYKKEWEAQK

SEQ ID NO: 3299607 - protein, 20 aa, Plasmodium falciparum
IFCFYVSFYILFITLFTKKN

SEQ ID NO: 3299608 - protein, 17 aa, Plasmodium falciparum
IFCMILSIYLYIIQNWI

SEQ ID NO: 3299609 - protein, 23 aa, Plasmodium falciparum
IFDEFLDIYLLFRLRGGKGGFGA

SEQ ID NO: 3299610 - protein, 30 aa, Plasmodium falciparum
IFELKYINCIFIFMFLSLLIIFTSMNEYTG

SEQ ID NO: 3299611 - protein, 23 aa, Plasmodium falciparum
IFFLLYLIFLLINIFLLFRLQYL

SEQ ID NO: 3299612 - protein, 21 aa, Plasmodium falciparum
IFFPLIIWGSFYWTYENFFIF

SEQ ID NO: 3299613 - protein, 21 aa, Plasmodium falciparum
IFFQRFFPLFLLVGYANGNII

SEQ ID NO: 3299614 - protein, 20 aa, Plasmodium falciparum
IFGIILYIFLLNINIYDDRY

SEQ ID NO: 3299615 - protein, 19 aa, Plasmodium falciparum
IFIICAVILLLFFENDKLD

SEQ ID NO: 3299616 - protein, 23 aa, Plasmodium falciparum
IFIIFGHSLWFLHFFKYFLKESH

SEQ ID NO: 3299617 - protein, 17 aa, Plasmodium falciparum
IFILLNCQWLSDSFVNN

SEQ ID NO: 3299618 - protein, 20 aa, Plasmodium falciparum
IFIYLFIFIFLLLLVYFLVC

SEQ ID NO: 3299619 - protein, 19 aa, Plasmodium falciparum
IFLYILIIILNTIYQNIFD

SEQ ID NO: 3299620 - protein, 18 aa, Plasmodium falciparum
IFLYYYKLLIKSISLKMI

SEQ ID NO: 3299621 - protein, 24 aa, Plasmodium falciparum
IFQTWYMAYLFIHKIYLISKMWNI

SEQ ID NO: 3299622 - protein, 24 aa, Plasmodium falciparum
IFVHLFFCIFFISLSYKYGKFVPP

SEQ ID NO: 3299623 - protein, 19 aa, Plasmodium falciparum
IFYIFITRINLQYIQKCIC

SEQ ID NO: 3299624 - protein, 20 aa, Plasmodium falciparum
IFYLCYFFYFLTYSYEIIFL

SEQ ID NO: 3299625 - protein, 19 aa, Plasmodium falciparum
IFYTIYKYLFKIISYPSLK

SEQ ID NO: 3299626 - protein, 19 aa, Plasmodium falciparum
IFYVYLYIFLSIPIFIFPW

SEQ ID NO: 3299627 - protein, 36 aa, Plasmodium falciparum
IGKRKILYYMSVNVLFFLCFIFIFSRFNSGQFYEKW

SEQ ID NO: 3299628 - protein, 17 aa, Plasmodium falciparum
IGKRLYFFLYQSLLYGN

SEQ ID NO: 3299629 - protein, 18 aa, Plasmodium falciparum
IGVALTLGLLLFKMRRKA

SEQ ID NO: 3299630 - protein, 20 aa, Plasmodium falciparum
IHHLLFLYYYFTVKKYYVLQ

SEQ ID NO: 3299631 - protein, 19 aa, Plasmodium falciparum
IICVIAMAIKLHKPHLIPS

SEQ ID NO: 3299632 - protein, 17 aa, Plasmodium falciparum
IIDFFIGVIIINVFFFE

SEQ ID NO: 3299633 - protein, 20 aa, Plasmodium falciparum
IIEFILYLYILTYKIHYTVS

SEQ ID NO: 3299634 - protein, 17 aa, Plasmodium falciparum
IIFIIFYIIYYWKDKNW

SEQ ID NO: 3299635 - protein, 26 aa, Plasmodium falciparum
IIFIRALFKIWLEYFLKDYNKINAKI

SEQ ID NO: 3299636 - protein, 19 aa, Plasmodium falciparum
IIFIVVFLPLIFSLTYLCV

SEQ ID NO: 3299637 - protein, 24 aa, Plasmodium falciparum
IIHLYILFCLLFILYEFLKRATKF

SEQ ID NO: 3299638 - protein, 25 aa, Plasmodium falciparum
IIIHFFLLILLFYSNKHYIQCTIPF

SEQ ID NO: 3299639 - protein, 23 aa, Plasmodium falciparum
IIKEFILLLIFLFQRIRAENEYK

SEQ ID NO: 3299640 - protein, 25 aa, Plasmodium falciparum
IIKKMYWFLIFLITLPFSVFLIFHN

SEQ ID NO: 3299641 - protein, 18 aa, Plasmodium falciparum
IILGYYFVTLKLLYLKSI

SEQ ID NO: 3299642 - protein, 21 aa, Plasmodium falciparum
IILLFLLFPLNIFLSFSFIRY

SEQ ID NO: 3299643 - protein, 18 aa, Plasmodium falciparum
IILLVMVIIYLVLRYRRK

SEQ ID NO: 3299644 - protein, 19 aa, Plasmodium falciparum
IILRFYPYNFTWPFDSLQI

SEQ ID NO: 3299645 - protein, 21 aa, Plasmodium falciparum
IINFFIFVTFNIKNESKYSNT

SEQ ID NO: 3299646 - protein, 22 aa, Plasmodium falciparum
IIPIFLFFYFHVYVIKQIILDF

SEQ ID NO: 3299647 - protein, 19 aa, Plasmodium falciparum
IIRALFKIWLEYFLEDYNK

SEQ ID NO: 3299648 - protein, 25 aa, Plasmodium falciparum
IIRHIYYFIFFFLTIPVRPCMRKRA

SEQ ID NO: 3299649 - protein, 19 aa, Plasmodium falciparum
IISFIFSTLMFFYFCTFYV

SEQ ID NO: 3299650 - protein, 25 aa, Plasmodium falciparum
IITKIFFYFLYFMYASVFGGGGTFP

SEQ ID NO: 3299651 - protein, 26 aa, Plasmodium falciparum
IITLFYFLLYIFILFHCLNSLIIKYN

SEQ ID NO: 3299652 - protein, 26 aa, Plasmodium falciparum
IIVINYIFFLDLKKIFYFLIIFLIYL

SEQ ID NO: 3299653 - protein, 30 aa, Plasmodium falciparum
IIVTDKTWFFLLYFYKLLFEKLYEYFKLYF

SEQ ID NO: 3299654 - protein, 17 aa, Plasmodium falciparum
IIYIFILLLLHKYHFIY

SEQ ID NO: 3299655 - protein, 17 aa, Plasmodium falciparum
IIYILYLLKYYSSYIYI

SEQ ID NO: 3299656 - protein, 23 aa, Plasmodium falciparum
IIYKYIRIWLLRLKLQDVDVFFC

SEQ ID NO: 3299657 - protein, 18 aa, Plasmodium falciparum
IIYTILTLWFVVGLLCYH

SEQ ID NO: 3299658 - protein, 35 aa, Plasmodium falciparum
IIYYFLPIFLYIILRLIFFVVILILVFLKRKSPTP

SEQ ID NO: 3299659 - protein, 18 aa, Plasmodium falciparum
IKEFLIKMKPTFWCLQDI

SEQ ID NO: 3299660 - protein, 24 aa, Plasmodium falciparum
IKEIKILFLWIYKLTNIEIRPLIH

SEQ ID NO: 3299661 - protein, 22 aa, Plasmodium falciparum
IKFLNLIKRKLIYKILFPDIQI

SEQ ID NO: 3299662 - protein, 17 aa, Plasmodium falciparum
IKILFFYIFFYFGDHYF

SEQ ID NO: 3299663 - protein, 24 aa, Plasmodium falciparum
IKKFFCDFIYLPYTIKYGYIRSLD

SEQ ID NO: 3299664 - protein, 21 aa, Plasmodium falciparum
IKNLSFLLYLFYKVTNDNEFL

SEQ ID NO: 3299665 - protein, 24 aa, Plasmodium falciparum
IKPYWYQLLIQILYLIKIKNLYSF

SEQ ID NO: 3299666 - protein, 28 aa, Plasmodium falciparum
IKSEGFIFFVLVFFICIIFGCIYESLHE

SEQ ID NO: 3299667 - protein, 27 aa, Plasmodium falciparum
IKVIASILLLFYKLLHSFGPHIICVKT

SEQ ID NO: 3299668 - protein, 26 aa, Plasmodium falciparum
IKYVFIYLLKYIFLFKIYKYDYKKKT

SEQ ID NO: 3299669 - protein, 18 aa, Plasmodium falciparum
ILAFGYYLCILNPIRVPA

SEQ ID NO: 3299670 - protein, 18 aa, Plasmodium falciparum
ILCYYYLIYLFSNLSEKK

SEQ ID NO: 3299671 - protein, 18 aa, Plasmodium falciparum
ILFIIRFIVIRGSKYRYE

SEQ ID NO: 3299672 - protein, 18 aa, Plasmodium falciparum
ILFLLNKFIIIPQKILSL

SEQ ID NO: 3299673 - protein, 26 aa, Plasmodium falciparum
ILFYIYQKFILMKYLKKKSNVYMFYY

SEQ ID NO: 3299674 - protein, 19 aa, Plasmodium falciparum
ILKILFFWNFELYKNFRKN

SEQ ID NO: 3299675 - protein, 19 aa, Plasmodium falciparum
ILLCFLLYVICFGFVISSL

SEQ ID NO: 3299676 - protein, 24 aa, Plasmodium falciparum
ILLFLIYIIFCFIIIIISYLNITS

SEQ ID NO: 3299677 - protein, 19 aa, Plasmodium falciparum
ILLIFSNLFFCKFINFVHN

SEQ ID NO: 3299678 - protein, 17 aa, Plasmodium falciparum
ILLIIFIISYYDILLFK

SEQ ID NO: 3299679 - protein, 17 aa, Plasmodium falciparum
ILLIIYLILRYRRKKKM

SEQ ID NO: 3299680 - protein, 17 aa, Plasmodium falciparum
ILLIIYLILRYRRKRKM

SEQ ID NO: 3299681 - protein, 19 aa, Plasmodium falciparum
ILLLSFFFFDYNFCSRGLV

SEQ ID NO: 3299682 - protein, 19 aa, Plasmodium falciparum
ILLNLFLVFFYKSVLFICI

SEQ ID NO: 3299683 - protein, 25 aa, Plasmodium falciparum
ILLYKILKKLNILNLIYFRFLKEED

SEQ ID NO: 3299684 - protein, 20 aa, Plasmodium falciparum
ILNFFMLSLTSSLGNGFLHS

SEQ ID NO: 3299685 - protein, 18 aa, Plasmodium falciparum
ILNFQWPIEFIIETTIAC

SEQ ID NO: 3299686 - protein, 25 aa, Plasmodium falciparum
ILNKTYYYNLYKNKILLFNKYIIKL

SEQ ID NO: 3299687 - protein, 22 aa, Plasmodium falciparum
ILNYLPFHLLLLILLNYDNKNI

SEQ ID NO: 3299688 - protein, 17 aa, Plasmodium falciparum
ILPLFFAAAFIVSTFVY

SEQ ID NO: 3299689 - protein, 21 aa, Plasmodium falciparum
ILRIIMLMLFYFNIKHMYVIC

SEQ ID NO: 3299690 - protein, 19 aa, Plasmodium falciparum
ILRYITYFWFYLSEDNKLI

SEQ ID NO: 3299691 - protein, 18 aa, Plasmodium falciparum
ILSLLFSITLILQSLINL

SEQ ID NO: 3299692 - protein, 23 aa, Plasmodium falciparum
ILTNISFLLFKNRLKFLLDEYFH

SEQ ID NO: 3299693 - protein, 20 aa, Plasmodium falciparum
ILYFFFWLFNYVKSKIVLKN

SEQ ID NO: 3299694 - protein, 19 aa, Plasmodium falciparum
ILYIFIIYIIFLLHLNNII

SEQ ID NO: 3299695 - protein, 20 aa, Plasmodium falciparum
ILYILLVIIFNIKSSASNLI

SEQ ID NO: 3299696 - protein, 25 aa, Plasmodium falciparum
ILYNSWFLYHYIYIIYLNTIKLKNF

SEQ ID NO: 3299697 - protein, 23 aa, Plasmodium falciparum
ILYYNIFFIYNLLPIFIKNLLYS

SEQ ID NO: 3299698 - protein, 17 aa, Plasmodium falciparum
IMEILHFLPLKYLLDLL

SEQ ID NO: 3299699 - protein, 17 aa, Plasmodium falciparum
IMFFIQSLKFICIHNIH

SEQ ID NO: 3299700 - protein, 22 aa, Plasmodium falciparum
IMIFFICCIFYLNELYIKYNNS

SEQ ID NO: 3299701 - protein, 18 aa, Plasmodium falciparum
IMINVILVFFFLLSGIMK

SEQ ID NO: 3299702 - protein, 24 aa, Plasmodium falciparum
IMKFYEFFIFWVTYMLNDCIDWKK

SEQ ID NO: 3299703 - protein, 18 aa, Plasmodium falciparum
IMKKILHYFPLLKLINNP

SEQ ID NO: 3299704 - protein, 25 aa, Plasmodium falciparum
IMNMFYMFIFFLYDLLTKENMWKYM

SEQ ID NO: 3299705 - protein, 24 aa, Plasmodium falciparum
IMTKRWWFYGILPHTIFEALCVLL

SEQ ID NO: 3299706 - protein, 19 aa, Plasmodium falciparum
IMTVFLFVLSLLNQFSKNP

SEQ ID NO: 3299707 - protein, 17 aa, Plasmodium falciparum
IMYLFRICIYYLGRSKD

SEQ ID NO: 3299708 - protein, 21 aa, Plasmodium falciparum
IMYYIFSLFCNKIYNINKKKK

SEQ ID NO: 3299709 - protein, 24 aa, Plasmodium falciparum
INCAAIETFWLWYKYKKDKNVDAE

SEQ ID NO: 3299710 - protein, 32 aa, Plasmodium falciparum
INFIILFTLFILNLLFFIKLLFCLFFECLDNI

SEQ ID NO: 3299711 - protein, 19 aa, Plasmodium falciparum
INHLYYLYNIYPLLFKLKE

SEQ ID NO: 3299712 - protein, 24 aa, Plasmodium falciparum
INIFEYFHFFIKDLFLMLSDENKD

SEQ ID NO: 3299713 - protein, 22 aa, Plasmodium falciparum
INIFFFNWFLLHIYKIKLKNTS

SEQ ID NO: 3299714 - protein, 23 aa, Plasmodium falciparum
INIIFILFIFYFISKKFISKNKY

SEQ ID NO: 3299715 - protein, 29 aa, Plasmodium falciparum
ININKYTYLFYRLPLFLFGDKYINDIDDV

SEQ ID NO: 3299716 - protein, 22 aa, Plasmodium falciparum
INKNYLLLLNNDELKWIRGKNN

SEQ ID NO: 3299717 - protein, 22 aa, Plasmodium falciparum
INMNLLIYFYLLKCILFDDMDD

SEQ ID NO: 3299718 - protein, 19 aa, Plasmodium falciparum
INNLIILYFSKSDLIDVCI

SEQ ID NO: 3299719 - protein, 27 aa, Plasmodium falciparum
INNLLHALIFGFLKFLFNLRKKYHKQP

SEQ ID NO: 3299720 - protein, 23 aa, Plasmodium falciparum
INTLYTYFQWILTYSWNRFLINL

SEQ ID NO: 3299721 - protein, 17 aa, Plasmodium falciparum
IPFSFFIIIPFAEFLLP

SEQ ID NO: 3299722 - protein, 23 aa, Plasmodium falciparum
IPLDFLRLMFYTLGDYRDILVRG

SEQ ID NO: 3299723 - protein, 24 aa, Plasmodium falciparum
IPPDFLRLMFYTLGDYRDILFSSS

SEQ ID NO: 3299724 - protein, 18 aa, Plasmodium falciparum
IPQKILSLIFFKLLIVYN

SEQ ID NO: 3299725 - protein, 25 aa, Plasmodium falciparum
IPSILFFLLLIFLFQKITLKNVTNS

SEQ ID NO: 3299726 - protein, 24 aa, Plasmodium falciparum
IPYPTIHIPFFPRSPRIYKGLYGG

SEQ ID NO: 3299727 - protein, 25 aa, Plasmodium falciparum
IQGYIIIILLFNYKYHFLWENNYFN

SEQ ID NO: 3299728 - protein, 17 aa, Plasmodium falciparum
IQKTFHDFFYYWVAHML

SEQ ID NO: 3299729 - protein, 22 aa, Plasmodium falciparum
IQKTFHNFFYYWVAHMLKDSIH

SEQ ID NO: 3299730 - protein, 24 aa, Plasmodium falciparum
IQTKLFTFYWIYQVYVYGSIFLKD

SEQ ID NO: 3299731 - protein, 41 aa, Plasmodium falciparum
IRGRKNILIFLLKIFLFSPLIWILIYSEYFTVVKNYNKIDN

SEQ ID NO: 3299732 - protein, 20 aa, Plasmodium falciparum
IRIVLWCIVWIWAASYMERK

SEQ ID NO: 3299733 - protein, 31 aa, Plasmodium falciparum
IRKKKIYLYIIYLYYYIINHLRFFLYNQDII

SEQ ID NO: 3299734 - protein, 24 aa, Plasmodium falciparum
IRLSFFFPLLFYKTYYINDILSSS

SEQ ID NO: 3299735 - protein, 18 aa, Plasmodium falciparum
IRVIYLFSLKYFPTLFLK

SEQ ID NO: 3299736 - protein, 25 aa, Plasmodium falciparum
IRYNFFLIYFWVIFMYPCETNKGNV

SEQ ID NO: 3299737 - protein, 17 aa, Plasmodium falciparum
ISAFFTFTLELFICLFC

SEQ ID NO: 3299738 - protein, 21 aa, Plasmodium falciparum
ISFCNIIFFFLELSHEHFVGQ

SEQ ID NO: 3299739 - protein, 22 aa, Plasmodium falciparum
ISFCNIIFFFLELSHEHFVGQS

SEQ ID NO: 3299740 - protein, 26 aa, Plasmodium falciparum
ISFFLLYIFILYLYKYYNHIIKIRDI

SEQ ID NO: 3299741 - protein, 18 aa, Plasmodium falciparum
ISFIYLYDYLLIMTLNEI

SEQ ID NO: 3299742 - protein, 21 aa, Plasmodium falciparum
ISKLHLFIVKKEKVLFFPILY

SEQ ID NO: 3299743 - protein, 24 aa, Plasmodium falciparum
ISLKIILIFFYYYICKKICMQFFT

SEQ ID NO: 3299744 - protein, 23 aa, Plasmodium falciparum
ISMFFYTFLILYISHVRIFYDCL

SEQ ID NO: 3299745 - protein, 17 aa, Plasmodium falciparum
ISPMFYFFYYIELIRYV

SEQ ID NO: 3299746 - protein, 24 aa, Plasmodium falciparum
ISSNFFLYSILFLLEYLKDSQKKK

SEQ ID NO: 3299747 - protein, 18 aa, Plasmodium falciparum
ISYISSIVFLMVTLLYFM

SEQ ID NO: 3299748 - protein, 23 aa, Plasmodium falciparum
ITFFLIKFLLYFYHPYKLKYEKG

SEQ ID NO: 3299749 - protein, 17 aa, Plasmodium falciparum
ITLKYYLDILFKEKIKE

SEQ ID NO: 3299750 - protein, 30 aa, Plasmodium falciparum
ITSLSIFLLTLLGIWVYKTLIINKEKKKKK

SEQ ID NO: 3299751 - protein, 22 aa, Plasmodium falciparum
IVFLIFFFLFIGFYVLINISTP

SEQ ID NO: 3299752 - protein, 23 aa, Plasmodium falciparum
IVFNVFFLLFFFSYIYLYIKTFS

SEQ ID NO: 3299753 - protein, 23 aa, Plasmodium falciparum
IVGNHLRFRGFRILAENEYEMKT

SEQ ID NO: 3299754 - protein, 17 aa, Plasmodium falciparum
IVHFGLKLFLFSFCIWT

SEQ ID NO: 3299755 - protein, 22 aa, Plasmodium falciparum
IVIEFFIYFMNLLKICFEHPLY

SEQ ID NO: 3299756 - protein, 24 aa, Plasmodium falciparum
IVIFITFFYILLNILHDNLFMIKL

SEQ ID NO: 3299757 - protein, 20 aa, Plasmodium falciparum
IVLIMIIIYLVLRYRRKKKM

SEQ ID NO: 3299758 - protein, 20 aa, Plasmodium falciparum
IVLLYFFSAFSFLNSYFIYK

SEQ ID NO: 3299759 - protein, 23 aa, Plasmodium falciparum
IVLNLIWLKFLNVIFYLLYVKNY

SEQ ID NO: 3299760 - protein, 17 aa, Plasmodium falciparum
IVMLILSFIIWPLTTWS

SEQ ID NO: 3299761 - protein, 18 aa, Plasmodium falciparum
IVMYLLIIILVLFITSRS

SEQ ID NO: 3299762 - protein, 23 aa, Plasmodium falciparum
IVNICRTFLFHKPLIPFKKVIYK

SEQ ID NO: 3299763 - protein, 17 aa, Plasmodium falciparum
IVNILLYIFMKVIKRFI

SEQ ID NO: 3299764 - protein, 18 aa, Plasmodium falciparum
IVNVFFFILTIYTFLRTS

SEQ ID NO: 3299765 - protein, 17 aa, Plasmodium falciparum
IVQSVISFVYSFLLFIY

SEQ ID NO: 3299766 - protein, 18 aa, Plasmodium falciparum
IYCHSIVSILLFLSSHPM

SEQ ID NO: 3299767 - protein, 18 aa, Plasmodium falciparum
IYEVIICIFTYFNKYHPT

SEQ ID NO: 3299768 - protein, 26 aa, Plasmodium falciparum
IYFLFNYFIMPLIRRFFFLTKSEQTL

SEQ ID NO: 3299769 - protein, 18 aa, Plasmodium falciparum
IYFNIFFLLYYSICNKYN

SEQ ID NO: 3299770 - protein, 20 aa, Plasmodium falciparum
IYFYNYISIFFYLLKNIDIS

SEQ ID NO: 3299771 - protein, 18 aa, Plasmodium falciparum
IYILRIFYLWFNKTSDNQ

SEQ ID NO: 3299772 - protein, 17 aa, Plasmodium falciparum
IYIYILKEIYLLLHFHI

SEQ ID NO: 3299773 - protein, 18 aa, Plasmodium falciparum
IYIYIYIYILYKNDIYMH

SEQ ID NO: 3299774 - protein, 44 aa, Plasmodium falciparum
IYLIFLFIFYLFIYLFVYFLFIFYSFYIYIFIYYFKPWAYNKYT

SEQ ID NO: 3299775 - protein, 25 aa, Plasmodium falciparum
IYMFSYIPFVFFRFLFFVTCSYFII

SEQ ID NO: 3299776 - protein, 26 aa, Plasmodium falciparum
IYNIIVMVHMMVLDQFKYDELKYAKK

SEQ ID NO: 3299777 - protein, 23 aa, Plasmodium falciparum
IYSDVYVWYFLKNVYKKMEICSF

SEQ ID NO: 3299778 - protein, 18 aa, Plasmodium falciparum
IYSLIMKIYLYASFKSLY

SEQ ID NO: 3299779 - protein, 23 aa, Plasmodium falciparum
IYTQIYLLIYILTKIIIMWKKLM

SEQ ID NO: 3299780 - protein, 19 aa, Plasmodium falciparum
IYYLLLHVFGFVKSILDSQ

SEQ ID NO: 3299781 - protein, 26 aa, Plasmodium falciparum
KAFLNYLYIYFKFLVEYLDISRIHQT

SEQ ID NO: 3299782 - protein, 23 aa, Plasmodium falciparum
KCETLFFKYFLLSLKPIVINADI

SEQ ID NO: 3299783 - protein, 19 aa, Plasmodium falciparum
KCFLFYMWLNIFIPLEYAK

SEQ ID NO: 3299784 - protein, 23 aa, Plasmodium falciparum
KDFVEIPPFFRWLHEWGSDFCGK

SEQ ID NO: 3299785 - protein, 24 aa, Plasmodium falciparum
KDHHFWIPFDYWKASHKRYFYYMY

SEQ ID NO: 3299786 - protein, 23 aa, Plasmodium falciparum
KDKFKRLYVLAALGLIAKLKLIL

SEQ ID NO: 3299787 - protein, 42 aa, Plasmodium falciparum
KDTKKDRIRFHFYFYFFIVKIILLSLLIWTVIYSNNCSNGKY

SEQ ID NO: 3299788 - protein, 26 aa, Plasmodium falciparum
KEFDRNLIICFLYSVLHSIFYIMCNI

SEQ ID NO: 3299789 - protein, 36 aa, Plasmodium falciparum
KEGTKLYYSLVKILLITFFICIFTRLNHGQFYEKWK

SEQ ID NO: 3299790 - protein, 18 aa, Plasmodium falciparum
KEIIIIIIIIIIITFLIV

SEQ ID NO: 3299791 - protein, 23 aa, Plasmodium falciparum
KEYPMHFLIYYYSGIHFEPGVHV

SEQ ID NO: 3299792 - protein, 18 aa, Plasmodium falciparum
KFIIVGQNNFIIDSDDMK

SEQ ID NO: 3299793 - protein, 25 aa, Plasmodium falciparum
KFIIYTITLVYFILLLKTGKIQFNT

SEQ ID NO: 3299794 - protein, 26 aa, Plasmodium falciparum
KFLNKKTLIKFIKKYSLYSSSPSSSL

SEQ ID NO: 3299795 - protein, 20 aa, Plasmodium falciparum
KFMFFFYIFIYIISIYIFNK

SEQ ID NO: 3299796 - protein, 18 aa, Plasmodium falciparum
KFRLSKLFILKYIDLYTI

SEQ ID NO: 3299797 - protein, 19 aa, Plasmodium falciparum
KFRYLFLRDLSYYIDIPRD

SEQ ID NO: 3299798 - protein, 33 aa, Plasmodium falciparum
KFYKTFTPWYRFIFLLLGVFFLYVWKLESSLSQ

SEQ ID NO: 3299799 - protein, 21 aa, Plasmodium falciparum
KFYTFMYHIFYKYKPKNQGGN

SEQ ID NO: 3299800 - protein, 18 aa, Plasmodium falciparum
KGKVCYYTNKSFLFLVRN

SEQ ID NO: 3299801 - protein, 20 aa, Plasmodium falciparum
KGYILLLLWVIIILKNEYIY

SEQ ID NO: 3299802 - protein, 19 aa, Plasmodium falciparum
KHFEKVFLIWLALSEGFDV

SEQ ID NO: 3299803 - protein, 21 aa, Plasmodium falciparum
KHGEKMIKILKIKTSKKKKKR

SEQ ID NO: 3299804 - protein, 19 aa, Plasmodium falciparum
KHLIVFVIINILILFKLNV

SEQ ID NO: 3299805 - protein, 20 aa, Plasmodium falciparum
KHYIFKGYIFLLYLKLKKIK

SEQ ID NO: 3299806 - protein, 24 aa, Plasmodium falciparum
KICGFICFLLYAFLYILSYEQYEV

SEQ ID NO: 3299807 - protein, 33 aa, Plasmodium falciparum
KICIKHFLIFNKILLLFILVWIFQYSNEEFTCK

SEQ ID NO: 3299808 - protein, 20 aa, Plasmodium falciparum
KICLYYPHYFFLACLFNYKY

SEQ ID NO: 3299809 - protein, 26 aa, Plasmodium falciparum
KIDPINLLITTRYYFFKKSKIMNFPK

SEQ ID NO: 3299810 - protein, 22 aa, Plasmodium falciparum
KIDRYIYFYPKLKTDIILFFFK

SEQ ID NO: 3299811 - protein, 36 aa, Plasmodium falciparum
KIFKYSHIILVYFIPFFKKYYFLWKFIEHEIDKDIM

SEQ ID NO: 3299812 - protein, 18 aa, Plasmodium falciparum
KIFWKIYIFFLFYKNRRF

SEQ ID NO: 3299813 - protein, 22 aa, Plasmodium falciparum
KIILFPLYFFPLYNDVYSLEIK

SEQ ID NO: 3299814 - protein, 20 aa, Plasmodium falciparum
KIILLILYNSWFLYHYIYII

SEQ ID NO: 3299815 - protein, 20 aa, Plasmodium falciparum
KIINILFFKLNKDYFLIIFL

SEQ ID NO: 3299816 - protein, 24 aa, Plasmodium falciparum
KIIQFFLLVLFWGLLYILINQMLN

SEQ ID NO: 3299817 - protein, 27 aa, Plasmodium falciparum
KIIRSLLFILMLFILFCTEFLFVYNNL

SEQ ID NO: 3299818 - protein, 19 aa, Plasmodium falciparum
KIIWKSWIVKNVNNIENWF

SEQ ID NO: 3299819 - protein, 22 aa, Plasmodium falciparum
KIKIKLIYLLKLIYYVYENIQY

SEQ ID NO: 3299820 - protein, 23 aa, Plasmodium falciparum
KIKKYLMLPINKFTFENMSKRNY

SEQ ID NO: 3299821 - protein, 22 aa, Plasmodium falciparum
KILIYIIFIYILYFIDYKYLLN

SEQ ID NO: 3299822 - protein, 23 aa, Plasmodium falciparum
KILKFRLFILKGILKRFLFCCSY

SEQ ID NO: 3299823 - protein, 19 aa, Plasmodium falciparum
KILYIYLYFLLTLKCYMNI

SEQ ID NO: 3299824 - protein, 27 aa, Plasmodium falciparum
KINNSCFHLLLFFLPLSVPPFKSKINI

SEQ ID NO: 3299825 - protein, 19 aa, Plasmodium falciparum
KIQILLKLKESLIPQIDGN

SEQ ID NO: 3299826 - protein, 32 aa, Plasmodium falciparum
KIWKAVKYFFFFYYLFKYTLLKLFFERSRKRP

SEQ ID NO: 3299827 - protein, 29 aa, Plasmodium falciparum
KKAFPVFTKILLVSFLVWVLKCSNNCNNG

SEQ ID NO: 3299828 - protein, 23 aa, Plasmodium falciparum
KKDTLFFLFIFYTSLIFEQQKLN

SEQ ID NO: 3299829 - protein, 26 aa, Plasmodium falciparum
KKELYKYFFLVLRKYNKKKYYKMLDK

SEQ ID NO: 3299830 - protein, 24 aa, Plasmodium falciparum
KKENIFLKIFRYVKNWFPIKSSNN

SEQ ID NO: 3299831 - protein, 28 aa, Plasmodium falciparum
KKEYLFLFLYLYLYLYKFVYIKDMPFYL

SEQ ID NO: 3299832 - protein, 22 aa, Plasmodium falciparum
KKHFYFYFPKFLLINKKLKLLF

SEQ ID NO: 3299833 - protein, 20 aa, Plasmodium falciparum
KKIYYVLLKLYFYNLCFHIN

SEQ ID NO: 3299834 - protein, 26 aa, Plasmodium falciparum
KKKFDFRIYILLLPGKNYPKIYLSKV

SEQ ID NO: 3299835 - protein, 26 aa, Plasmodium falciparum
KKKKILFNILYFKLFRLIFDKIETYH

SEQ ID NO: 3299836 - protein, 26 aa, Plasmodium falciparum
KKKKLFYFYDPWLYGYDSFLSFIQLD

SEQ ID NO: 3299837 - protein, 21 aa, Plasmodium falciparum
KKKSFFQMLGCNFLCNKNIET

SEQ ID NO: 3299838 - protein, 25 aa, Plasmodium falciparum
KKLDWFVFFLLKILMRKLWFDKHDD

SEQ ID NO: 3299839 - protein, 23 aa, Plasmodium falciparum
KKMLIILSFFIYHSYIYIRLSNL

SEQ ID NO: 3299840 - protein, 26 aa, Plasmodium falciparum
KKNILVNYWYAFYTLIFHNFIFQYKE

SEQ ID NO: 3299841 - protein, 23 aa, Plasmodium falciparum
KKNKKQMHLLKNKNFYLISCEES

SEQ ID NO: 3299842 - protein, 21 aa, Plasmodium falciparum
KKNKRDFLYICLKEINKLSED

SEQ ID NO: 3299843 - protein, 22 aa, Plasmodium falciparum
KKNPLIYFIYIKVLIDFYNKKE

SEQ ID NO: 3299844 - protein, 23 aa, Plasmodium falciparum
KKNVLIRTLFKRWLEYFFEDYNR

SEQ ID NO: 3299845 - protein, 23 aa, Plasmodium falciparum
KKNVLIRTLFKRWLEYFLQDYIK

SEQ ID NO: 3299846 - protein, 23 aa, Plasmodium falciparum
KKNYFWKWITIIEIHLLIIEDIR

SEQ ID NO: 3299847 - protein, 26 aa, Plasmodium falciparum
KKTSKWMFYLTVTIIILILIIFFPII

SEQ ID NO: 3299848 - protein, 17 aa, Plasmodium falciparum
KKVIDLIYFFFVTKEKK

SEQ ID NO: 3299849 - protein, 17 aa, Plasmodium falciparum
KKYFLIYKIVKDSFFRI

SEQ ID NO: 3299850 - protein, 24 aa, Plasmodium falciparum
KKYYIYHILFLYIFFLRITYTYAE

SEQ ID NO: 3299851 - protein, 20 aa, Plasmodium falciparum
KLCLFIIPIYGLSVLCLLKS

SEQ ID NO: 3299852 - protein, 24 aa, Plasmodium falciparum
KLFKFFLHILILKQIIFESFINLA

SEQ ID NO: 3299853 - protein, 22 aa, Plasmodium falciparum
KLFKKKFRYLSLKLKNILMSHC

SEQ ID NO: 3299854 - protein, 23 aa, Plasmodium falciparum
KLITFLLCWICHLYFLNNICNNK

SEQ ID NO: 3299855 - protein, 19 aa, Plasmodium falciparum
KLKYFFLHLCLESGISINV

SEQ ID NO: 3299856 - protein, 24 aa, Plasmodium falciparum
KLNKDYFLIIFLTGRPILIYKSFF

SEQ ID NO: 3299857 - protein, 29 aa, Plasmodium falciparum
KLNTPWMCMIFPYYFISYFNYKIFCILKC

SEQ ID NO: 3299858 - protein, 19 aa, Plasmodium falciparum
KLPALLWNKIIGKGNDNEV

SEQ ID NO: 3299859 - protein, 20 aa, Plasmodium falciparum
KLVKLFFISFYKYLKNYFLQ

SEQ ID NO: 3299860 - protein, 24 aa, Plasmodium falciparum
KLYLVKRILYMFIRIVYPFLQTCH

SEQ ID NO: 3299861 - protein, 20 aa, Plasmodium falciparum
KMIFFLIKWIPMLVFSIILS

SEQ ID NO: 3299862 - protein, 20 aa, Plasmodium falciparum
KMNFLLFYKFLCNDYNYIIN

SEQ ID NO: 3299863 - protein, 21 aa, Plasmodium falciparum
KMRIYFLLLYKIKFVRKIKSY

SEQ ID NO: 3299864 - protein, 26 aa, Plasmodium falciparum
KNASAFFYLLINLLFNLSIDRFRLVI

SEQ ID NO: 3299865 - protein, 20 aa, Plasmodium falciparum
KNDFFFLVSLLNKPFFLNIS

SEQ ID NO: 3299866 - protein, 17 aa, Plasmodium falciparum
KNDWLLGFLYRYMEWKI

SEQ ID NO: 3299867 - protein, 25 aa, Plasmodium falciparum
KNELIWLIYLFYFYNIKKNIIQTRM

SEQ ID NO: 3299868 - protein, 22 aa, Plasmodium falciparum
KNFFFIHTIFFYTLFTLSYLMC

SEQ ID NO: 3299869 - protein, 23 aa, Plasmodium falciparum
KNFLFKNFILQKLFWVYKINKHN

SEQ ID NO: 3299870 - protein, 28 aa, Plasmodium falciparum
KNHFLLIQYRLIFPMYLFISFYFYNQKL

SEQ ID NO: 3299871 - protein, 25 aa, Plasmodium falciparum
KNILISLAIFGVIFLFIFSNKHRSL

SEQ ID NO: 3299872 - protein, 23 aa, Plasmodium falciparum
KNKFYFWCFLFLHIIRINFNKSL

SEQ ID NO: 3299873 - protein, 24 aa, Plasmodium falciparum
KNKHLYLFYFIFNIISIMSCMYSF

SEQ ID NO: 3299874 - protein, 23 aa, Plasmodium falciparum
KNKSSFPDKFRAPDKKRTMFYRL

SEQ ID NO: 3299875 - protein, 17 aa, Plasmodium falciparum
KNKYFFFYIKNKRIDIP

SEQ ID NO: 3299876 - protein, 21 aa, Plasmodium falciparum
KNLIFFWFNFLKVLLNVTIDK

SEQ ID NO: 3299877 - protein, 18 aa, Plasmodium falciparum
KNMVLIFPLFIFGSISLY

SEQ ID NO: 3299878 - protein, 23 aa, Plasmodium falciparum
KNSIIYFRFVYLTSLLYSNDIET

SEQ ID NO: 3299879 - protein, 21 aa, Plasmodium falciparum
KNVMPYHPFFWKWVHDMLHDS

SEQ ID NO: 3299880 - protein, 25 aa, Plasmodium falciparum
KNVMSYNAFFWKWVHDMLIDSMQWR

SEQ ID NO: 3299881 - protein, 23 aa, Plasmodium falciparum
KNYIFFILVNFLILLQILFCIII

SEQ ID NO: 3299882 - protein, 24 aa, Plasmodium falciparum
KNYPFYFYIYLSLIYFILFILIIL

SEQ ID NO: 3299883 - protein, 19 aa, Plasmodium falciparum
KPFLHFLFTYVYMGINKDY

SEQ ID NO: 3299884 - protein, 25 aa, Plasmodium falciparum
KQFLKMFMVILYELVFLFSKKSALI

SEQ ID NO: 3299885 - protein, 30 aa, Plasmodium falciparum
KQHDKVFIFLYKRIYPIWFPLSWGGEQDLG

SEQ ID NO: 3299886 - protein, 22 aa, Plasmodium falciparum
KQIILIRALIKRWLEYFLEDYN

SEQ ID NO: 3299887 - protein, 22 aa, Plasmodium falciparum
KQKIMPFDAFFFLWLTQMLDDS

SEQ ID NO: 3299888 - protein, 17 aa, Plasmodium falciparum
KQKTFHNFFYYWVAHML

SEQ ID NO: 3299889 - protein, 23 aa, Plasmodium falciparum
KQKTFYDFFYYWVAHMLKDSIHW

SEQ ID NO: 3299890 - protein, 34 aa, Plasmodium falciparum
KQLFNKYRLYIIFIFIILTFLLILSIKYNRYVKK

SEQ ID NO: 3299891 - protein, 23 aa, Plasmodium falciparum
KQNILIRALFKRWLEHFLEDYNK

SEQ ID NO: 3299892 - protein, 56 aa, Plasmodium falciparum
KQRDWPRITFTFLVFVLGIKTVLCILLYMYNNILLFVVFLILCVVSFYGLIVNTIK

SEQ ID NO: 3299893 - protein, 22 aa, Plasmodium falciparum
KRAIPIFWLYDCTLPYIKILRK

SEQ ID NO: 3299894 - protein, 20 aa, Plasmodium falciparum
KRFLFLFKMNKWLLYFFLYL

SEQ ID NO: 3299895 - protein, 26 aa, Plasmodium falciparum
KRFQILYVFFFLLITGALFYYLIDNV

SEQ ID NO: 3299896 - protein, 17 aa, Plasmodium falciparum
KRILYIYMVLIKTLFVI

SEQ ID NO: 3299897 - protein, 24 aa, Plasmodium falciparum
KRKFSFFINFFLNIFNIINILLFG

SEQ ID NO: 3299898 - protein, 24 aa, Plasmodium falciparum
KRKIFCSLFFLLCSKMAIIYTPIL

SEQ ID NO: 3299899 - protein, 21 aa, Plasmodium falciparum
KRKKKIVKENILLILRNLCYE

SEQ ID NO: 3299900 - protein, 34 aa, Plasmodium falciparum
KRRRWYWRVFYTIMFIIFFPVLFIYRRIIKRRKG

SEQ ID NO: 3299901 - protein, 17 aa, Plasmodium falciparum
KSFLQYIFILKNGIYSL

SEQ ID NO: 3299902 - protein, 25 aa, Plasmodium falciparum
KSFNFFYLFSYIFKIFPFIGKINKE

SEQ ID NO: 3299903 - protein, 17 aa, Plasmodium falciparum
KSFYKFCFFPIRYIPYI

SEQ ID NO: 3299904 - protein, 22 aa, Plasmodium falciparum
KSIKIFVIYLYFNLPKSMCHYF

SEQ ID NO: 3299905 - protein, 21 aa, Plasmodium falciparum
KSILIIFLILYLRNLTKRKYN

SEQ ID NO: 3299906 - protein, 23 aa, Plasmodium falciparum
KSMHYHPFFWKWVTEMLIDSMYW

SEQ ID NO: 3299907 - protein, 19 aa, Plasmodium falciparum
KSPYFVLELVLELEYFPLI

SEQ ID NO: 3299908 - protein, 26 aa, Plasmodium falciparum
KSQLIHIMFLTFFPFFKLYNLTDLLN

SEQ ID NO: 3299909 - protein, 23 aa, Plasmodium falciparum
KSSKYILFIFKNGSVIIWENFNN

SEQ ID NO: 3299910 - protein, 26 aa, Plasmodium falciparum
KSYFPKNFFKAVFLILPGLSFNINDI

SEQ ID NO: 3299911 - protein, 20 aa, Plasmodium falciparum
KTFHDFFYYWVAHMLKDSIH

SEQ ID NO: 3299912 - protein, 21 aa, Plasmodium falciparum
KTFHNFFYYWVAHMLKDSIYW

SEQ ID NO: 3299913 - protein, 21 aa, Plasmodium falciparum
KTIFRLYYYLLLLKKIEKKKK

SEQ ID NO: 3299914 - protein, 17 aa, Plasmodium falciparum
KTIPFFSVFYMLGSYFY

SEQ ID NO: 3299915 - protein, 18 aa, Plasmodium falciparum
KTLFYLTIIPWILSFIFY

SEQ ID NO: 3299916 - protein, 22 aa, Plasmodium falciparum
KTRLFMYYGLYGLGGRLGANIK

SEQ ID NO: 3299917 - protein, 26 aa, Plasmodium falciparum
KTYNDFFYFWIRRFLNDSMYWRGKIG

SEQ ID NO: 3299918 - protein, 25 aa, Plasmodium falciparum
KTYYLIAILIWFILISVVLSRGEII

SEQ ID NO: 3299919 - protein, 29 aa, Plasmodium falciparum
KVETKQFIYILFFLCLYLNTFNYKYTTSY

SEQ ID NO: 3299920 - protein, 17 aa, Plasmodium falciparum
KVLLLFSLPLNILVTLH

SEQ ID NO: 3299921 - protein, 23 aa, Plasmodium falciparum
KVSLFFLLIFKYSYKNIVKKGRQ

SEQ ID NO: 3299922 - protein, 27 aa, Plasmodium falciparum
KVTTLRIYYFLILVTLEITYISMKNSN

SEQ ID NO: 3299923 - protein, 30 aa, Plasmodium falciparum
KYDNYFFYIFFILLLFFLLFVDSNGLYNEI

SEQ ID NO: 3299924 - protein, 18 aa, Plasmodium falciparum
KYIPIYMYIIYYDKNQKI

SEQ ID NO: 3299925 - protein, 24 aa, Plasmodium falciparum
KYKKKLLVVILWIKIYMSMLEEYV

SEQ ID NO: 3299926 - protein, 20 aa, Plasmodium falciparum
KYLNFFVILLSLFLKKYLYK

SEQ ID NO: 3299927 - protein, 20 aa, Plasmodium falciparum
KYMVLYKICIFMLTCLIQTI

SEQ ID NO: 3299928 - protein, 21 aa, Plasmodium falciparum
KYNLFIFFKRLQLFYFMNTKK

SEQ ID NO: 3299929 - protein, 22 aa, Plasmodium falciparum
KYNLLLIWYIKYGKDVFFSMLE

SEQ ID NO: 3299930 - protein, 31 aa, Plasmodium falciparum
KYPDIYGFFLIILILYILKYVFKKMMYKLYY

SEQ ID NO: 3299931 - protein, 25 aa, Plasmodium falciparum
KYRHILLYYILYTYPKFLYIFNIIK

SEQ ID NO: 3299932 - protein, 28 aa, Plasmodium falciparum
KYTTFKVFLLYWLEDFLYGYYISKKRKI

SEQ ID NO: 3299933 - protein, 19 aa, Plasmodium falciparum
KYVFKKMMYKLYYNKYGMG

SEQ ID NO: 3299934 - protein, 19 aa, Plasmodium falciparum
KYYCIYFLYLSLKYNIMSS

SEQ ID NO: 3299935 - protein, 17 aa, Plasmodium falciparum
KYYIFRINLLLNKLYIS

SEQ ID NO: 3299936 - protein, 26 aa, Plasmodium falciparum
KYYKIIYYLLLYNFKYVFKKLKLKYS

SEQ ID NO: 3299937 - protein, 20 aa, Plasmodium falciparum
KYYNLLIYVYLLYKMKIIIS

SEQ ID NO: 3299938 - protein, 21 aa, Plasmodium falciparum
LAAILFLGLSLYFINNRKGNK

SEQ ID NO: 3299939 - protein, 19 aa, Plasmodium falciparum
LALFFIIFNKESLAEKTNK

SEQ ID NO: 3299940 - protein, 19 aa, Plasmodium falciparum
LCDLFLKYKFDPSLKNNNN

SEQ ID NO: 3299941 - protein, 26 aa, Plasmodium falciparum
LCEIPRMYYIFYLKDLRLFLEYLDDG

SEQ ID NO: 3299942 - protein, 19 aa, Plasmodium falciparum
LCFLFMKLYFYYYFYINNE

SEQ ID NO: 3299943 - protein, 23 aa, Plasmodium falciparum
LDYFYLLILLNFYSLFYILISDQ

SEQ ID NO: 3299944 - protein, 18 aa, Plasmodium falciparum
LECYYCLLHKYKFKPLNI

SEQ ID NO: 3299945 - protein, 19 aa, Plasmodium falciparum
LEKNPFFYFYFSLALLILH

SEQ ID NO: 3299946 - protein, 29 aa, Plasmodium falciparum
LELGFFVGSFFFIWYITGEKIFKRKKKIV

SEQ ID NO: 3299947 - protein, 29 aa, Plasmodium falciparum
LFCKYINVLIWYILLYIIILNVCLWNSIS

SEQ ID NO: 3299948 - protein, 18 aa, Plasmodium falciparum
LFCWLCLSAWIKKNNDCP

SEQ ID NO: 3299949 - protein, 23 aa, Plasmodium falciparum
LFELYYIYIYIILHIINFYNDSF

SEQ ID NO: 3299950 - protein, 19 aa, Plasmodium falciparum
LFEYNLFFVFKFISYYCLI

SEQ ID NO: 3299951 - protein, 20 aa, Plasmodium falciparum
LFFFYSILYVVLCTYVLGIS

SEQ ID NO: 3299952 - protein, 19 aa, Plasmodium falciparum
LFFLFYFSSYNIYFVLTRN

SEQ ID NO: 3299953 - protein, 20 aa, Plasmodium falciparum
LFFLVFFLSKISVVLSKDDG

SEQ ID NO: 3299954 - protein, 18 aa, Plasmodium falciparum
LFLLIFFIFHLNSTKNYK

SEQ ID NO: 3299955 - protein, 18 aa, Plasmodium falciparum
LFLVFFYKSVLFICINNL

SEQ ID NO: 3299956 - protein, 20 aa, Plasmodium falciparum
LFLYLIIFLEAYFCVSLFST

SEQ ID NO: 3299957 - protein, 17 aa, Plasmodium falciparum
LFPLYTFVILRLPFVNA

SEQ ID NO: 3299958 - protein, 23 aa, Plasmodium falciparum
LFRTIFDILFLFFINKIRVEVLI

SEQ ID NO: 3299959 - protein, 23 aa, Plasmodium falciparum
LFSENWLYFLPSSSDYLLNEKKK

SEQ ID NO: 3299960 - protein, 30 aa, Plasmodium falciparum
LFSFIQYNSFFWYILYKQYNMFLTYYDMTN

SEQ ID NO: 3299961 - protein, 18 aa, Plasmodium falciparum
LFTLFDWPTKINSKLILI

SEQ ID NO: 3299962 - protein, 17 aa, Plasmodium falciparum
LFWLFLYNRKRCINDVS

SEQ ID NO: 3299963 - protein, 19 aa, Plasmodium falciparum
LFYIFNRYNFQFNAYNILL

SEQ ID NO: 3299964 - protein, 19 aa, Plasmodium falciparum
LFYLFVNILLFYVCFHFVV

SEQ ID NO: 3299965 - protein, 27 aa, Plasmodium falciparum
LGLIYRYTNFLIPFKNFLISKTLENVE

SEQ ID NO: 3299966 - protein, 19 aa, Plasmodium falciparum
LGYVLLGWYILSCLKAQKK

SEQ ID NO: 3299967 - protein, 22 aa, Plasmodium falciparum
LHDNLFMIKLVNNYSYSYLWNI

SEQ ID NO: 3299968 - protein, 18 aa, Plasmodium falciparum
LHFPNLFFYLNYKSYNYL

SEQ ID NO: 3299969 - protein, 35 aa, Plasmodium falciparum
LHKNYLFTVTFIKNFLLFILIDIFFMLSYIIKTHY

SEQ ID NO: 3299970 - protein, 22 aa, Plasmodium falciparum
LHTFLHIFLLNRFPYFFQYLYK

SEQ ID NO: 3299971 - protein, 17 aa, Plasmodium falciparum
LHYFPLLKLINNPSDLK

SEQ ID NO: 3299972 - protein, 25 aa, Plasmodium falciparum
LIASFFYYFSIYKISPWAIIKNVDF

SEQ ID NO: 3299973 - protein, 20 aa, Plasmodium falciparum
LICLYLFKHFSYILDYLLLL

SEQ ID NO: 3299974 - protein, 27 aa, Plasmodium falciparum
LIEYTIYFFYFILYKMFLYNDKFYCYI

SEQ ID NO: 3299975 - protein, 24 aa, Plasmodium falciparum
LIFLIMFLIFFLSSHFEQPKAVYS

SEQ ID NO: 3299976 - protein, 18 aa, Plasmodium falciparum
LIFMFLINALVLPHYENC

SEQ ID NO: 3299977 - protein, 17 aa, Plasmodium falciparum
LIHLLLNIRFYYNIFHS

SEQ ID NO: 3299978 - protein, 25 aa, Plasmodium falciparum
LIIHYVFSKFYRLHTIKFKKFLRKF

SEQ ID NO: 3299979 - protein, 18 aa, Plasmodium falciparum
LIILLYKADYYRCTSTLI

SEQ ID NO: 3299980 - protein, 23 aa, Plasmodium falciparum
LIIRKFFRVFLNFAQKKFLSLSL

SEQ ID NO: 3299981 - protein, 18 aa, Plasmodium falciparum
LIKLLIEFFYFYSIDFKL

SEQ ID NO: 3299982 - protein, 18 aa, Plasmodium falciparum
LILIILDIKLVIKKAVER

SEQ ID NO: 3299983 - protein, 17 aa, Plasmodium falciparum
LILILYYYFKLNLIPIQ

SEQ ID NO: 3299984 - protein, 19 aa, Plasmodium falciparum
LILKLIWFLYFPYPKCELF

SEQ ID NO: 3299985 - protein, 24 aa, Plasmodium falciparum
LIMILNCCRIVTSVLYAAKRNLKR

SEQ ID NO: 3299986 - protein, 18 aa, Plasmodium falciparum
LIMVIIYLILRYRRKMKL

SEQ ID NO: 3299987 - protein, 23 aa, Plasmodium falciparum
LINIIRFPLLYEINLKKLMKIFC

SEQ ID NO: 3299988 - protein, 18 aa, Plasmodium falciparum
LINNIIMFFIQSLKFICI

SEQ ID NO: 3299989 - protein, 19 aa, Plasmodium falciparum
LIPIPLYWLVAENSFIWLS

SEQ ID NO: 3299990 - protein, 23 aa, Plasmodium falciparum
LIVSLLIFYLIIQLSYDNFGENT

SEQ ID NO: 3299991 - protein, 18 aa, Plasmodium falciparum
LIWNIFRQVLESLSYLHK

SEQ ID NO: 3299992 - protein, 18 aa, Plasmodium falciparum
LIYFILLVNINLFKKKKF

SEQ ID NO: 3299993 - protein, 18 aa, Plasmodium falciparum
LIYIFLYSLCYQHVNNVF

SEQ ID NO: 3299994 - protein, 24 aa, Plasmodium falciparum
LIYILCILLFLLTSLFRSIVYLIN

SEQ ID NO: 3299995 - protein, 23 aa, Plasmodium falciparum
LIYNLLFFIFFGIPFILILTIII

SEQ ID NO: 3299996 - protein, 20 aa, Plasmodium falciparum
LKCYYKCFLILNLKLYENNM

SEQ ID NO: 3299997 - protein, 19 aa, Plasmodium falciparum
LKFYFFKYTAIFIGFIISL

SEQ ID NO: 3299998 - protein, 27 aa, Plasmodium falciparum
LKKIFYFLIIFLIYLYIRAKLEFLNHI

SEQ ID NO: 3299999 - protein, 17 aa, Plasmodium falciparum
LKKLIRTFFLHCPTGTG

SEQ ID NO: 3300000 - protein, 22 aa, Plasmodium falciparum
LKLFLLYFFHKLLYNLLTEQDN

SEQ ID NO: 3300001 - protein, 24 aa, Plasmodium falciparum
LKNVMRLLKFFLKVRTLPSMKQGG

SEQ ID NO: 3300002 - protein, 23 aa, Plasmodium falciparum
LKRASFFINYYFYHLHLFIYFKN

SEQ ID NO: 3300003 - protein, 23 aa, Plasmodium falciparum
LKTYSMVYTLRRLFKSLLKEYNL

SEQ ID NO: 3300004 - protein, 23 aa, Plasmodium falciparum
LKVFYFLFFYLSFEDIYYHCINI

SEQ ID NO: 3300005 - protein, 22 aa, Plasmodium falciparum
LKYFKKVFLLLLFFFGNPMCSL

SEQ ID NO: 3300006 - protein, 20 aa, Plasmodium falciparum
LLCFLLYFHSFLDLLCGLRD

SEQ ID NO: 3300007 - protein, 24 aa, Plasmodium falciparum
LLEYLYYFIYILCLFIVLYIFDYK

SEQ ID NO: 3300008 - protein, 18 aa, Plasmodium falciparum
LLFFFLLNILLTSYYAHN

SEQ ID NO: 3300009 - protein, 17 aa, Plasmodium falciparum
LLFFFPLNILLTSPSNS

SEQ ID NO: 3300010 - protein, 18 aa, Plasmodium falciparum
LLFFFPLNILLTSYHAHN

SEQ ID NO: 3300011 - protein, 17 aa, Plasmodium falciparum
LLFFFPLNILLTSYHEH

SEQ ID NO: 3300012 - protein, 17 aa, Plasmodium falciparum
LLFFFPLNILLTSYHVH

SEQ ID NO: 3300013 - protein, 19 aa, Plasmodium falciparum
LLFFFPLNILVTSYHAYNK

SEQ ID NO: 3300014 - protein, 19 aa, Plasmodium falciparum
LLFFFPLNILVTSYHGNNN

SEQ ID NO: 3300015 - protein, 18 aa, Plasmodium falciparum
LLFFFPLNILVTSYHVYN

SEQ ID NO: 3300016 - protein, 19 aa, Plasmodium falciparum
LLFFFPLNILVTSYHVYSK

SEQ ID NO: 3300017 - protein, 17 aa, Plasmodium falciparum
LLFFFPLNVLLTSYHAH

SEQ ID NO: 3300018 - protein, 18 aa, Plasmodium falciparum
LLFFFPLPCIYNKMIYKK

SEQ ID NO: 3300019 - protein, 18 aa, Plasmodium falciparum
LLFFFPLYILEHNQNKPY

SEQ ID NO: 3300020 - protein, 17 aa, Plasmodium falciparum
LLFFFPLYILVTSYHVY

SEQ ID NO: 3300021 - protein, 22 aa, Plasmodium falciparum
LLFFFPLYILVYSKNKPSITPH

SEQ ID NO: 3300022 - protein, 18 aa, Plasmodium falciparum
LLFLIPLNTLVTSSSYVH

SEQ ID NO: 3300023 - protein, 17 aa, Plasmodium falciparum
LLFLLPLNILLTLHQVH

SEQ ID NO: 3300024 - protein, 19 aa, Plasmodium falciparum
LLFLLPLNILVTSLSNVHN

SEQ ID NO: 3300025 - protein, 19 aa, Plasmodium falciparum
LLFLLPLNILVTSLSNVHS

SEQ ID NO: 3300026 - protein, 19 aa, Plasmodium falciparum
LLFLLPLNILVTSLSNVYS

SEQ ID NO: 3300027 - protein, 18 aa, Plasmodium falciparum
LLFSLLLHRLLLSSSKVN

SEQ ID NO: 3300028 - protein, 17 aa, Plasmodium falciparum
LLFSVPLNLLISSSYEH

SEQ ID NO: 3300029 - protein, 19 aa, Plasmodium falciparum
LLFVYPVMYLIHMKGRHNE

SEQ ID NO: 3300030 - protein, 17 aa, Plasmodium falciparum
LLFYLPLNVLFISYKCP

SEQ ID NO: 3300031 - protein, 18 aa, Plasmodium falciparum
LLGFLYRYMEWKINVAGL

SEQ ID NO: 3300032 - protein, 18 aa, Plasmodium falciparum
LLHVLILYIPPLARIFGV

SEQ ID NO: 3300033 - protein, 17 aa, Plasmodium falciparum
LLICLPLNILVLSSYVH

SEQ ID NO: 3300034 - protein, 20 aa, Plasmodium falciparum
LLIFFYTFWSYIFDILLYIS

SEQ ID NO: 3300035 - protein, 17 aa, Plasmodium falciparum
LLIILIKNYKCIFIWYM

SEQ ID NO: 3300036 - protein, 19 aa, Plasmodium falciparum
LLILSFLCFFYSSLSYDED

SEQ ID NO: 3300037 - protein, 25 aa, Plasmodium falciparum
LLIYKNAIVLLLNDIKLKCLPQLGK

SEQ ID NO: 3300038 - protein, 19 aa, Plasmodium falciparum
LLKIHTLIHLLQKILVLQT

SEQ ID NO: 3300039 - protein, 17 aa, Plasmodium falciparum
LLLFAHPLNILLLSSSH

SEQ ID NO: 3300040 - protein, 17 aa, Plasmodium falciparum
LLLFFFISLFYSSARTL

SEQ ID NO: 3300041 - protein, 18 aa, Plasmodium falciparum
LLLFIKVLRIIPPYWIEY

SEQ ID NO: 3300042 - protein, 17 aa, Plasmodium falciparum
LLLLFYKFIIILKHKEL

SEQ ID NO: 3300043 - protein, 24 aa, Plasmodium falciparum
LLLNQLIFIFSLILSFFILKRKYN

SEQ ID NO: 3300044 - protein, 21 aa, Plasmodium falciparum
LLNFLILLLYTFFNSFLSIKF

SEQ ID NO: 3300045 - protein, 17 aa, Plasmodium falciparum
LLNILVVCHFIISCLCR

SEQ ID NO: 3300046 - protein, 21 aa, Plasmodium falciparum
LLPLILSWFPIFYFRLLHSAC

SEQ ID NO: 3300047 - protein, 19 aa, Plasmodium falciparum
LLQTMWKFYISYILSIPNE

SEQ ID NO: 3300048 - protein, 17 aa, Plasmodium falciparum
LLSKFYYMDKYRSIYKI

SEQ ID NO: 3300049 - protein, 27 aa, Plasmodium falciparum
LLTTLLKIYYLLFKIKPFNFIDNSLVY

SEQ ID NO: 3300050 - protein, 20 aa, Plasmodium falciparum
LLYFSYLIYCIFVSSYSTSK

SEQ ID NO: 3300051 - protein, 20 aa, Plasmodium falciparum
LLYIVFAVRLLFLSIISFIF

SEQ ID NO: 3300052 - protein, 19 aa, Plasmodium falciparum
LLYYILALTTFLPKCLRYF

SEQ ID NO: 3300053 - protein, 26 aa, Plasmodium falciparum
LMELKRILYNLFLEYNPHMNNKQKAE

SEQ ID NO: 3300054 - protein, 20 aa, Plasmodium falciparum
LMIFFFYFYYSYLSFLVFII

SEQ ID NO: 3300055 - protein, 18 aa, Plasmodium falciparum
LNAIYYYNKALKKCKDKN

SEQ ID NO: 3300056 - protein, 18 aa, Plasmodium falciparum
LNFFQFLKNMYLSKAPKG

SEQ ID NO: 3300057 - protein, 22 aa, Plasmodium falciparum
LNHVFFIYSNYFYNFHNLFLFF

SEQ ID NO: 3300058 - protein, 20 aa, Plasmodium falciparum
LNIFSIMYLFRICIYYLGRS

SEQ ID NO: 3300059 - protein, 17 aa, Plasmodium falciparum
LNILYIYPQLYVSCIIS

SEQ ID NO: 3300060 - protein, 55 aa, Plasmodium falciparum
LNINYVFLQIIYNIILYFVYLYIYYTKYIYYILRTYLFLLLYNSFHIIRENCYYP

SEQ ID NO: 3300061 - protein, 24 aa, Plasmodium falciparum
LNKFLLFFIRFLLVLEPLLPIYIK

SEQ ID NO: 3300062 - protein, 23 aa, Plasmodium falciparum
LNKLKLFFVLKDELKYIFPDIPE

SEQ ID NO: 3300063 - protein, 19 aa, Plasmodium falciparum
LNMKLLSLFLFSNKYFKYE

SEQ ID NO: 3300064 - protein, 21 aa, Plasmodium falciparum
LNNMFICCILNYYLSLIYDEH

SEQ ID NO: 3300065 - protein, 21 aa, Plasmodium falciparum
LNPTAWWRRYGTRLWKTMIQP

SEQ ID NO: 3300066 - protein, 21 aa, Plasmodium falciparum
LNTLLQMYVLFKPELGYVQGM

SEQ ID NO: 3300067 - protein, 26 aa, Plasmodium falciparum
LNTTCLLWWQYLLAIFWALLNLFLDE

SEQ ID NO: 3300068 - protein, 22 aa, Plasmodium falciparum
LNTVILDPIITFNVIFGDDTMF

SEQ ID NO: 3300069 - protein, 26 aa, Plasmodium falciparum
LNVVTLIWLSYLFLLKPHGTLKNMMV

SEQ ID NO: 3300070 - protein, 20 aa, Plasmodium falciparum
LQDYILNWFFPKLKERRLVK

SEQ ID NO: 3300071 - protein, 32 aa, Plasmodium falciparum
LQLYNIAFCLLLEIYILLLTINYEYIENFKNQ

SEQ ID NO: 3300072 - protein, 21 aa, Plasmodium falciparum
LQYILVFIFLLYKIIRMNIEK

SEQ ID NO: 3300073 - protein, 25 aa, Plasmodium falciparum
LREQNFFFSILLFPLINIDYFSESD

SEQ ID NO: 3300074 - protein, 21 aa, Plasmodium falciparum
LRKYWFIILIFFLSFSFSKHL

SEQ ID NO: 3300075 - protein, 19 aa, Plasmodium falciparum
LRQMFYTLGDYRDILFSGS

SEQ ID NO: 3300076 - protein, 26 aa, Plasmodium falciparum
LRYKKNFFFFLPLLKLKVKCKKNDGQ

SEQ ID NO: 3300077 - protein, 18 aa, Plasmodium falciparum
LRYVHLVYYFIIISFCIH

SEQ ID NO: 3300078 - protein, 24 aa, Plasmodium falciparum
LSAYDWFLVFLWSFPVIILDEIIK

SEQ ID NO: 3300079 - protein, 22 aa, Plasmodium falciparum
LSEFYFLLIELKLKYFRNLPSY

SEQ ID NO: 3300080 - protein, 24 aa, Plasmodium falciparum
LSFFLLFFCICIIYIYISNHKPIN

SEQ ID NO: 3300081 - protein, 20 aa, Plasmodium falciparum
LSFLLLVRFLWGISLTNLIS

SEQ ID NO: 3300082 - protein, 19 aa, Plasmodium falciparum
LSFYLILLIILYSKEEKFK

SEQ ID NO: 3300083 - protein, 28 aa, Plasmodium falciparum
LSIIMKIFFFYLLKYVIYFNHGDVFYSC

SEQ ID NO: 3300084 - protein, 21 aa, Plasmodium falciparum
LSIWICLFLFKIILSIMIVSY

SEQ ID NO: 3300085 - protein, 18 aa, Plasmodium falciparum
LSLFLFSNKYFKYEEFYH

SEQ ID NO: 3300086 - protein, 29 aa, Plasmodium falciparum
LSLFLFYNYICLYLTKILLYKSGGALITI

SEQ ID NO: 3300087 - protein, 24 aa, Plasmodium falciparum
LSLIIIVKIIIFSGPLLAIYGFFC

SEQ ID NO: 3300088 - protein, 23 aa, Plasmodium falciparum
LSLTLIFMFFLNSLLKILIFQCI

SEQ ID NO: 3300089 - protein, 21 aa, Plasmodium falciparum
LSRIFYIFYIINIKFKYDVIQ

SEQ ID NO: 3300090 - protein, 21 aa, Plasmodium falciparum
LSSLFNIFLLSLRFLFLYKKF

SEQ ID NO: 3300091 - protein, 25 aa, Plasmodium falciparum
LSSYGFIFVFLYFGLNNLVLCNAWF

SEQ ID NO: 3300092 - protein, 24 aa, Plasmodium falciparum
LSVCSSILFWLNFNKKDNFAIINY

SEQ ID NO: 3300093 - protein, 17 aa, Plasmodium falciparum
LSVVGFILFYFTPNFRK

SEQ ID NO: 3300094 - protein, 23 aa, Plasmodium falciparum
LSYLIWPFYLLYPIKRNANIYVF

SEQ ID NO: 3300095 - protein, 21 aa, Plasmodium falciparum
LTLDIFYKNISYSLYFLIFIN

SEQ ID NO: 3300096 - protein, 33 aa, Plasmodium falciparum
LTMNVHFFFIVLFAYYNFLVPLYILLCRKETKK

SEQ ID NO: 3300097 - protein, 23 aa, Plasmodium falciparum
LTTLGMLYIFLLKVDIGTIKNCT

SEQ ID NO: 3300098 - protein, 29 aa, Plasmodium falciparum
LTYNEIFFLIFIYFIKIICMFGKYVIQVI

SEQ ID NO: 3300099 - protein, 18 aa, Plasmodium falciparum
LVFINNLIILYFSKSDLI

SEQ ID NO: 3300100 - protein, 23 aa, Plasmodium falciparum
LVFYHPILLLNYIKMGLFSHVHL

SEQ ID NO: 3300101 - protein, 17 aa, Plasmodium falciparum
LVIIFLMLVVLTSNIIS

SEQ ID NO: 3300102 - protein, 17 aa, Plasmodium falciparum
LVLIFFLSFIFLFIYFY

SEQ ID NO: 3300103 - protein, 20 aa, Plasmodium falciparum
LVLLGGSITFYFLRKEKTEK

SEQ ID NO: 3300104 - protein, 17 aa, Plasmodium falciparum
LVMLIIYLILRYRRKKK

SEQ ID NO: 3300105 - protein, 23 aa, Plasmodium falciparum
LVNFFFLYSIIFYFLPINNLPSS

SEQ ID NO: 3300106 - protein, 18 aa, Plasmodium falciparum
LVSYFYVLSIVGIIYCLL

SEQ ID NO: 3300107 - protein, 23 aa, Plasmodium falciparum
LVTLGLIVILTITLGIVGIAAGS

SEQ ID NO: 3300108 - protein, 18 aa, Plasmodium falciparum
LVVFIIMFCILGIIWSME

SEQ ID NO: 3300109 - protein, 21 aa, Plasmodium falciparum
LVWIIIFGNFFVVHFFLCFKI

SEQ ID NO: 3300110 - protein, 18 aa, Plasmodium falciparum
LYEFLLSPIIKIICNEND

SEQ ID NO: 3300111 - protein, 18 aa, Plasmodium falciparum
LYFFLYQSLLYGNNMKEY

SEQ ID NO: 3300112 - protein, 18 aa, Plasmodium falciparum
LYFLKWPSVAIEENFSGS

SEQ ID NO: 3300113 - protein, 17 aa, Plasmodium falciparum
LYGYYLLKKKKKIYLCT

SEQ ID NO: 3300114 - protein, 18 aa, Plasmodium falciparum
LYIVLPIPFILYIHNHIV

SEQ ID NO: 3300115 - protein, 20 aa, Plasmodium falciparum
LYIYRSLLIILLNKYFCSGY

SEQ ID NO: 3300116 - protein, 19 aa, Plasmodium falciparum
LYKICYFFILSKKLITNVE

SEQ ID NO: 3300117 - protein, 25 aa, Plasmodium falciparum
LYLNLVDMFLFYSYKYYFYYYYVIK

SEQ ID NO: 3300118 - protein, 17 aa, Plasmodium falciparum
LYMNMFLNNYKLKKGKG

SEQ ID NO: 3300119 - protein, 19 aa, Plasmodium falciparum
LYMSLYFKFKRFMIFIPYL

SEQ ID NO: 3300120 - protein, 20 aa, Plasmodium falciparum
LYNLIKMNPLLISYFLLGII

SEQ ID NO: 3300121 - protein, 19 aa, Plasmodium falciparum
LYRMYYYIKFLYLHNILRH

SEQ ID NO: 3300122 - protein, 25 aa, Plasmodium falciparum
LYSDPIYLFLFIKNYFELTIDRKAW

SEQ ID NO: 3300123 - protein, 23 aa, Plasmodium falciparum
LYTFLLFFLLFLMIFNMPIYSYI

SEQ ID NO: 3300124 - protein, 26 aa, Plasmodium falciparum
LYTISIILYWNFFKNILLILPIFFYQ

SEQ ID NO: 3300125 - protein, 17 aa, Plasmodium falciparum
LYTLYFCIFIPVLVSLL

SEQ ID NO: 3300126 - protein, 21 aa, Plasmodium falciparum
MALNIWPMFLKITLQGLLTSR

SEQ ID NO: 3300127 - protein, 25 aa, Plasmodium falciparum
MFALYIFLWILLLYLYSKRKRLNLF

SEQ ID NO: 3300128 - protein, 19 aa, Plasmodium falciparum
MFFFLLFIYVIIRKKQNKK

SEQ ID NO: 3300129 - protein, 18 aa, Plasmodium falciparum
MFLYIYISFSLFFCIVLL

SEQ ID NO: 3300130 - protein, 25 aa, Plasmodium falciparum
MHDTFFFNFLYFFYNKYSKNCKNNY

SEQ ID NO: 3300131 - protein, 22 aa, Plasmodium falciparum
MIFVFYIFYFRLFKRRYTSNES

SEQ ID NO: 3300132 - protein, 17 aa, Plasmodium falciparum
MIRPLINLVYRKINRKQ

SEQ ID NO: 3300133 - protein, 18 aa, Plasmodium falciparum
MKLYIRNLFMKYIKIYYK

SEQ ID NO: 3300134 - protein, 17 aa, Plasmodium falciparum
MKNFFIFILYNLMKLCL

SEQ ID NO: 3300135 - protein, 25 aa, Plasmodium falciparum
MKRKKLFVYFIFLSFIINFNFNINI

SEQ ID NO: 3300136 - protein, 17 aa, Plasmodium falciparum
MKYCYLLEYFSCLRSLV

SEQ ID NO: 3300137 - protein, 18 aa, Plasmodium falciparum
MLDSYWYFGIFSIFILII

SEQ ID NO: 3300138 - protein, 22 aa, Plasmodium falciparum
MLGVLFIWIWTSGNLWVCSDPL

SEQ ID NO: 3300139 - protein, 18 aa, Plasmodium falciparum
MLKNIILIIFTLLSMIVY

SEQ ID NO: 3300140 - protein, 24 aa, Plasmodium falciparum
MLKNKWMYFLQKLLNQYIHMKCFK

SEQ ID NO: 3300141 - protein, 22 aa, Plasmodium falciparum
MLPYNFFLFIKALHLMSIYDII

SEQ ID NO: 3300142 - protein, 18 aa, Plasmodium falciparum
MLSPFFIFQFFSIVLWML

SEQ ID NO: 3300143 - protein, 18 aa, Plasmodium falciparum
MLSRIYIYIINYALKRGN

SEQ ID NO: 3300144 - protein, 20 aa, Plasmodium falciparum
MLTYIIYITYYVFLKVMNSY

SEQ ID NO: 3300145 - protein, 18 aa, Plasmodium falciparum
MLYIIAMYLLFQMNIIYN

SEQ ID NO: 3300146 - protein, 26 aa, Plasmodium falciparum
MLYINIILIFMYIYCFFIITVHGGLE

SEQ ID NO: 3300147 - protein, 20 aa, Plasmodium falciparum
MLYYFVLYILKYIKYKIKKR

SEQ ID NO: 3300148 - protein, 19 aa, Plasmodium falciparum
MLYYLIMKPANMDLLLYLI

SEQ ID NO: 3300149 - protein, 18 aa, Plasmodium falciparum
MMLYYIILIYFYKSAKNK

SEQ ID NO: 3300150 - protein, 36 aa, Plasmodium falciparum
MNCLSVIMFIILYIISLHIFFYKTNSFHLSLREPVP

SEQ ID NO: 3300151 - protein, 23 aa, Plasmodium falciparum
MNKWLLYFFLYLMNIYFSKDNFY

SEQ ID NO: 3300152 - protein, 25 aa, Plasmodium falciparum
MNSLQKLLLLLYKLSIKLYKSYYYH

SEQ ID NO: 3300153 - protein, 25 aa, Plasmodium falciparum
MNTFLFFIQLLFYGIKKNNPLILLA

SEQ ID NO: 3300154 - protein, 17 aa, Plasmodium falciparum
MNTLYEYALIRFPIYNE

SEQ ID NO: 3300155 - protein, 27 aa, Plasmodium falciparum
MNYFILFFLIYFFLMNSLLFTIICMQF

SEQ ID NO: 3300156 - protein, 20 aa, Plasmodium falciparum
MNYIQLCLFLLPLKNHFLYI

SEQ ID NO: 3300157 - protein, 33 aa, Plasmodium falciparum
MREKINKYFFLIKILTCTILIWAVQYANNSDIN

SEQ ID NO: 3300158 - protein, 26 aa, Plasmodium falciparum
MSILILFFLILLWSIIFYGPYAIYAL

SEQ ID NO: 3300159 - protein, 23 aa, Plasmodium falciparum
MVDDIFMFFFLMKLNFVMNMKKD

SEQ ID NO: 3300160 - protein, 25 aa, Plasmodium falciparum
MWSIGIIFYILMTGITPLPMCLMIN

SEQ ID NO: 3300161 - protein, 17 aa, Plasmodium falciparum
MWWIIYIISVLVLFLCC

SEQ ID NO: 3300162 - protein, 18 aa, Plasmodium falciparum
MYDKFYYFLLIQNLHIDK

SEQ ID NO: 3300163 - protein, 24 aa, Plasmodium falciparum
MYIYFYFILFYFIFILFCCDLIIL

SEQ ID NO: 3300164 - protein, 20 aa, Plasmodium falciparum
MYLSKIFELKYINCIFIFMF

SEQ ID NO: 3300165 - protein, 23 aa, Plasmodium falciparum
MYNYIYFIIDILLYFLVISKGKY

SEQ ID NO: 3300166 - protein, 18 aa, Plasmodium falciparum
NCHKCFFACNPFVKWLGN

SEQ ID NO: 3300167 - protein, 24 aa, Plasmodium falciparum
NDAYLFLYVYLYSNVYYKSFFSLM

SEQ ID NO: 3300168 - protein, 18 aa, Plasmodium falciparum
NDDSFIFTLFYSFQFLFI

SEQ ID NO: 3300169 - protein, 28 aa, Plasmodium falciparum
NDEMLHMLLYIYFIIWGEDLHFYELKKV

SEQ ID NO: 3300170 - protein, 20 aa, Plasmodium falciparum
NDLPLYFYFLNKKKKRCKKS

SEQ ID NO: 3300171 - protein, 23 aa, Plasmodium falciparum
NDLYVFFLNILYDLSFIFNSNKN

SEQ ID NO: 3300172 - protein, 26 aa, Plasmodium falciparum
NDRAFVFFIFLLLCFIITYGILTVRK

SEQ ID NO: 3300173 - protein, 23 aa, Plasmodium falciparum
NDYPILNYPLDSLILYLLSFNIK

SEQ ID NO: 3300174 - protein, 20 aa, Plasmodium falciparum
NECLKYFISFLFPNKEFNIF

SEQ ID NO: 3300175 - protein, 17 aa, Plasmodium falciparum
NEFFYFWIGRFLNDSMY

SEQ ID NO: 3300176 - protein, 23 aa, Plasmodium falciparum
NEQICIFVYIYSKLKFLHNMNLI

SEQ ID NO: 3300177 - protein, 32 aa, Plasmodium falciparum
NEYTTFKVLLIYWLEDFLYGYYLLKKKKKIYL

SEQ ID NO: 3300178 - protein, 35 aa, Plasmodium falciparum
NFFDVFMIFSFSILAFFFIFICLNSISFIITSTIL

SEQ ID NO: 3300179 - protein, 18 aa, Plasmodium falciparum
NFFFFFKIFQNVNNLLFS

SEQ ID NO: 3300180 - protein, 26 aa, Plasmodium falciparum
NFFGIIYLFLYLYKIHYYIYKITDMN

SEQ ID NO: 3300181 - protein, 18 aa, Plasmodium falciparum
NFFIFILYNLMKLCLDER

SEQ ID NO: 3300182 - protein, 24 aa, Plasmodium falciparum
NFIFTYYYIFYLLNYMDTYIQFLF

SEQ ID NO: 3300183 - protein, 17 aa, Plasmodium falciparum
NFIYPSLFYFFSCLKKY

SEQ ID NO: 3300184 - protein, 26 aa, Plasmodium falciparum
NFKFLMNFFYPLLIFYIDLYQKEEEH

SEQ ID NO: 3300185 - protein, 23 aa, Plasmodium falciparum
NFLKLIICLPFILITVLWIFLTI

SEQ ID NO: 3300186 - protein, 29 aa, Plasmodium falciparum
NFLYVIRIIFLPFEKIYFSLKSLIMIKKM

SEQ ID NO: 3300187 - protein, 21 aa, Plasmodium falciparum
NFMKISVLYNVLFKIVVYDQR

SEQ ID NO: 3300188 - protein, 25 aa, Plasmodium falciparum
NFNFYFYILLLYYYIYIYNTTRKIK

SEQ ID NO: 3300189 - protein, 21 aa, Plasmodium falciparum
NFVKKYKVFAAPFISAVAAFA

SEQ ID NO: 3300190 - protein, 24 aa, Plasmodium falciparum
NGVISFWKIFLKRLKRKSSSYMKD

SEQ ID NO: 3300191 - protein, 17 aa, Plasmodium falciparum
NHDKFILMLFYYHSNML

SEQ ID NO: 3300192 - protein, 19 aa, Plasmodium falciparum
NHNKIILRFYPYNFTWPFD

SEQ ID NO: 3300193 - protein, 19 aa, Plasmodium falciparum
NICTFYGICIKSNKLMLLL

SEQ ID NO: 3300194 - protein, 17 aa, Plasmodium falciparum
NIFALRKRFPLGMNDED

SEQ ID NO: 3300195 - protein, 20 aa, Plasmodium falciparum
NIFFLLYVRLLYNLKIPKDI

SEQ ID NO: 3300196 - protein, 18 aa, Plasmodium falciparum
NIFFLLYYSICNKYNIKL

SEQ ID NO: 3300197 - protein, 19 aa, Plasmodium falciparum
NIFIHIWRFAPDSIILIIY

SEQ ID NO: 3300198 - protein, 20 aa, Plasmodium falciparum
NIFLFVYLFAGKLISFVDFD

SEQ ID NO: 3300199 - protein, 18 aa, Plasmodium falciparum
NIHFVFYFRFIYLFFNKV

SEQ ID NO: 3300200 - protein, 23 aa, Plasmodium falciparum
NIHKIFYYLLIHTFFNIYMSLKL

SEQ ID NO: 3300201 - protein, 17 aa, Plasmodium falciparum
NIIMFFIQSLKFICIHN

SEQ ID NO: 3300202 - protein, 23 aa, Plasmodium falciparum
NIKLIIFLFLFIKKKYMTIFLNS

SEQ ID NO: 3300203 - protein, 20 aa, Plasmodium falciparum
NILEYMFLFPSYPVHLCFTN

SEQ ID NO: 3300204 - protein, 21 aa, Plasmodium falciparum
NILLYIFMKVIKRFIKSFVIL

SEQ ID NO: 3300205 - protein, 25 aa, Plasmodium falciparum
NINFYNIFFKVIIPLLNRITNIFEN

SEQ ID NO: 3300206 - protein, 21 aa, Plasmodium falciparum
NINILLYIYVMHIYINKLCKN

SEQ ID NO: 3300207 - protein, 19 aa, Plasmodium falciparum
NIPQFFRWFSEWGDDYCQD

SEQ ID NO: 3300208 - protein, 24 aa, Plasmodium falciparum
NIRFKFFFFFLMLVDIFLPYLVTN

SEQ ID NO: 3300209 - protein, 17 aa, Plasmodium falciparum
NISVLLFFIISKYNPHN

SEQ ID NO: 3300210 - protein, 25 aa, Plasmodium falciparum
NISYSNFLPFLWKKNMSSLNVEYDL

SEQ ID NO: 3300211 - protein, 26 aa, Plasmodium falciparum
NITLFHLCFFGFLFVILNFTLDNSNF

SEQ ID NO: 3300212 - protein, 29 aa, Plasmodium falciparum
NIVKIILFLFLVIILCIFIIPSLPFCTYF

SEQ ID NO: 3300213 - protein, 29 aa, Plasmodium falciparum
NIYFKKILLFLLLLLLLFSSYNNLNNTNV

SEQ ID NO: 3300214 - protein, 34 aa, Plasmodium falciparum
NKCVLYKYTDLLLFLFLIFILFQDIYSHNEFTKV

SEQ ID NO: 3300215 - protein, 17 aa, Plasmodium falciparum
NKFLNIEPLILFAKKLN

SEQ ID NO: 3300216 - protein, 35 aa, Plasmodium falciparum
NKIYSYFFNSILAIFIIFIIYQIFMKESTFLWFSK

SEQ ID NO: 3300217 - protein, 17 aa, Plasmodium falciparum
NKKMLYSIYLQSLLNNL

SEQ ID NO: 3300218 - protein, 24 aa, Plasmodium falciparum
NKKNYFPNYIILNNLNILITDLNE

SEQ ID NO: 3300219 - protein, 18 aa, Plasmodium falciparum
NKKRNYFIVYYKRYIKRG

SEQ ID NO: 3300220 - protein, 23 aa, Plasmodium falciparum
NKRKLLFFVLTKKHFYIFKFNFK

SEQ ID NO: 3300221 - protein, 24 aa, Plasmodium falciparum
NKSKNKFFFLFRKKGSIASSSHDK

SEQ ID NO: 3300222 - protein, 24 aa, Plasmodium falciparum
NKWVSFFFPFNVYYFNFFNFSKND

SEQ ID NO: 3300223 - protein, 27 aa, Plasmodium falciparum
NKYYYYDFMLIFLKTFYDYINVNRDMR

SEQ ID NO: 3300224 - protein, 21 aa, Plasmodium falciparum
NLCIVLLIYFKASVVYCIIHC

SEQ ID NO: 3300225 - protein, 18 aa, Plasmodium falciparum
NLCRLYINGILPFVFTKI

SEQ ID NO: 3300226 - protein, 21 aa, Plasmodium falciparum
NLELFLISRKLLRYLFINLNK

SEQ ID NO: 3300227 - protein, 25 aa, Plasmodium falciparum
NLIRIISLVMFFFVFINTSLSYPNM

SEQ ID NO: 3300228 - protein, 17 aa, Plasmodium falciparum
NLIYPKFILLKYIVDKY

SEQ ID NO: 3300229 - protein, 29 aa, Plasmodium falciparum
NLKNMYNIIKFIVVIYIAFNWSEVIYKYV

SEQ ID NO: 3300230 - protein, 23 aa, Plasmodium falciparum
NLMLYKIFKGYILLLLWVIIILK

SEQ ID NO: 3300231 - protein, 26 aa, Plasmodium falciparum
NLSKDLGLIEKQKIIWKSWIVKNVNN

SEQ ID NO: 3300232 - protein, 22 aa, Plasmodium falciparum
NLSLLLRIILLIIMILKFSLLY

SEQ ID NO: 3300233 - protein, 19 aa, Plasmodium falciparum
NLYLYYIYLIYNIQTQKKH

SEQ ID NO: 3300234 - protein, 24 aa, Plasmodium falciparum
NMDLLLYLILTYYKFPFLDIIEQY

SEQ ID NO: 3300235 - protein, 22 aa, Plasmodium falciparum
NMFLKIYILLIEKILINTKSFD

SEQ ID NO: 3300236 - protein, 24 aa, Plasmodium falciparum
NNCFILFFTILLMYITKLFEIKDP

SEQ ID NO: 3300237 - protein, 24 aa, Plasmodium falciparum
NNFFVFIYYFFIKGYISLVLVNIN

SEQ ID NO: 3300238 - protein, 20 aa, Plasmodium falciparum
NNFLFLYLYVYYIIHYFSLY

SEQ ID NO: 3300239 - protein, 22 aa, Plasmodium falciparum
NNICILFKYVWVLGLLLCHKDI

SEQ ID NO: 3300240 - protein, 29 aa, Plasmodium falciparum
NNICNIFLYFFVMIFFHLYIQNSDDKRKE

SEQ ID NO: 3300241 - protein, 23 aa, Plasmodium falciparum
NNIILIVIILIVVVIIIIIIIVV

SEQ ID NO: 3300242 - protein, 23 aa, Plasmodium falciparum
NNIYIYILILYYMDVRIIRVIQI

SEQ ID NO: 3300243 - protein, 22 aa, Plasmodium falciparum
NNKLYAIKFLKIFSLKYMKKVK

SEQ ID NO: 3300244 - protein, 21 aa, Plasmodium falciparum
NNLYILLLYIFCIYSRCLCNI

SEQ ID NO: 3300245 - protein, 24 aa, Plasmodium falciparum
NNNCLLWCLIYLKGYLKKITKNLH

SEQ ID NO: 3300246 - protein, 22 aa, Plasmodium falciparum
NNSIWLFYFVVENFLFIVTLNN

SEQ ID NO: 3300247 - protein, 25 aa, Plasmodium falciparum
NNTYSIYFFLFLDFIFNTLKKKYIY

SEQ ID NO: 3300248 - protein, 19 aa, Plasmodium falciparum
NNYDQFFTLLRKNYLNSIN

SEQ ID NO: 3300249 - protein, 18 aa, Plasmodium falciparum
NPIKCMFFYFLSIISHKP

SEQ ID NO: 3300250 - protein, 23 aa, Plasmodium falciparum
NQIIIIRALFKRWLEYFLEDYNK

SEQ ID NO: 3300251 - protein, 24 aa, Plasmodium falciparum
NQIIIIRALFKRWLEYFLQDYNKI

SEQ ID NO: 3300252 - protein, 24 aa, Plasmodium falciparum
NRKSFLFFFFLYNKYFFGKQEQIR

SEQ ID NO: 3300253 - protein, 22 aa, Plasmodium falciparum
NRLSLKRLGILLGLDEIGDENE

SEQ ID NO: 3300254 - protein, 21 aa, Plasmodium falciparum
NRMFFLFVIIFFSLFILYYFY

SEQ ID NO: 3300255 - protein, 18 aa, Plasmodium falciparum
NSLYLLIHLLLNIRFYYN

SEQ ID NO: 3300256 - protein, 30 aa, Plasmodium falciparum
NSNIFVLLKYSIYTILLWIVTITYNNYTYN

SEQ ID NO: 3300257 - protein, 25 aa, Plasmodium falciparum
NSNMYIFFYIYNINGLYYIYQFYNY

SEQ ID NO: 3300258 - protein, 17 aa, Plasmodium falciparum
NSNYIMLMLLQSLYITT

SEQ ID NO: 3300259 - protein, 19 aa, Plasmodium falciparum
NSYLLYLYDTLLEKTKYIF

SEQ ID NO: 3300260 - protein, 24 aa, Plasmodium falciparum
NTFMKFFYLYFFQLLRKYVKRYQA

SEQ ID NO: 3300261 - protein, 18 aa, Plasmodium falciparum
NTFTLFIMLWYSHINDHF

SEQ ID NO: 3300262 - protein, 26 aa, Plasmodium falciparum
NTICFFIFVIMFLWALAILSRFYLSY

SEQ ID NO: 3300263 - protein, 19 aa, Plasmodium falciparum
NVFFQRWLRYFVYDYNILK

SEQ ID NO: 3300264 - protein, 26 aa, Plasmodium falciparum
NVFILIYIYIFYYIYSMYLKYKINNL

SEQ ID NO: 3300265 - protein, 25 aa, Plasmodium falciparum
NVGKKYFFISLLFNIDYYNVRGMNI

SEQ ID NO: 3300266 - protein, 26 aa, Plasmodium falciparum
NVKFIFFYILKIFFYLKNNPYSTIFD

SEQ ID NO: 3300267 - protein, 22 aa, Plasmodium falciparum
NVKLLFYILIQENLNYSPLGEM

SEQ ID NO: 3300268 - protein, 26 aa, Plasmodium falciparum
NVPVVFWIILLLFGWNEILFFIRMFF

SEQ ID NO: 3300269 - protein, 17 aa, Plasmodium falciparum
NVSILYIHFLKLAYRNT

SEQ ID NO: 3300270 - protein, 17 aa, Plasmodium falciparum
NVYLYFYFIFEKYQKKN

SEQ ID NO: 3300271 - protein, 18 aa, Plasmodium falciparum
NVYMFYYIPSAEKQNCIT

SEQ ID NO: 3300272 - protein, 26 aa, Plasmodium falciparum
NYGWMLLKLLHIIIIKFRSLTPLKTI

SEQ ID NO: 3300273 - protein, 20 aa, Plasmodium falciparum
NYIMLMLLQSLYITTPYPGG

SEQ ID NO: 3300274 - protein, 23 aa, Plasmodium falciparum
NYKCIYIVLFYFTIKLIIILGNN

SEQ ID NO: 3300275 - protein, 21 aa, Plasmodium falciparum
NYLTNSLFWLCLYRLYIFPNA

SEQ ID NO: 3300276 - protein, 19 aa, Plasmodium falciparum
NYLYLFFQIIHNRSFILYY

SEQ ID NO: 3300277 - protein, 25 aa, Plasmodium falciparum
NYNKKDLFLLFYKTEKKLIDLLKIV

SEQ ID NO: 3300278 - protein, 25 aa, Plasmodium falciparum
NYYFYHLHLFIYFKNYFINYQKNYK

SEQ ID NO: 3300279 - protein, 24 aa, Plasmodium falciparum
PCGYLNMRIFYNLPSYYLFQIYKN

SEQ ID NO: 3300280 - protein, 20 aa, Plasmodium falciparum
PFDFVLRIYGIYLFEGQKTL

SEQ ID NO: 3300281 - protein, 23 aa, Plasmodium falciparum
PFEKFLFIFILVVWLAFQTNKRP

SEQ ID NO: 3300282 - protein, 20 aa, Plasmodium falciparum
PFFIFQFFSIVLWMLDSYWY

SEQ ID NO: 3300283 - protein, 19 aa, Plasmodium falciparum
PFFYFYFSLALLILHRNIF

SEQ ID NO: 3300284 - protein, 20 aa, Plasmodium falciparum
PFILFLIFFLINLVLHYEHS

SEQ ID NO: 3300285 - protein, 21 aa, Plasmodium falciparum
PFLWLLLLIKNRNLKTFCILD

SEQ ID NO: 3300286 - protein, 19 aa, Plasmodium falciparum
PFVIILIYFFVFKRFSRGC

SEQ ID NO: 3300287 - protein, 19 aa, Plasmodium falciparum
PHGFLRQMFYTLGDYRDIL

SEQ ID NO: 3300288 - protein, 19 aa, Plasmodium falciparum
PHLIFIRFLFIYTLFAPIL

SEQ ID NO: 3300289 - protein, 18 aa, Plasmodium falciparum
PHSLGYIFLPLYNKLSRS

SEQ ID NO: 3300290 - protein, 18 aa, Plasmodium falciparum
PIFSILFLNLIRTPLFHK

SEQ ID NO: 3300291 - protein, 22 aa, Plasmodium falciparum
PIKFHHLVILKLLHWYYKGYLR

SEQ ID NO: 3300292 - protein, 18 aa, Plasmodium falciparum
PINFIQLRNLVLSAFPRN

SEQ ID NO: 3300293 - protein, 19 aa, Plasmodium falciparum
PKRSFIKLIFNWINNKKDD

SEQ ID NO: 3300294 - protein, 18 aa, Plasmodium falciparum
PKVDLVSFFYLFLSNYFS

SEQ ID NO: 3300295 - protein, 20 aa, Plasmodium falciparum
PLISLLIISCALFFLFKRSE

SEQ ID NO: 3300296 - protein, 21 aa, Plasmodium falciparum
PLLKFTVFTLLIWIVTFINNY

SEQ ID NO: 3300297 - protein, 18 aa, Plasmodium falciparum
PLNLLYFLISRKIWKAVK

SEQ ID NO: 3300298 - protein, 18 aa, Plasmodium falciparum
PLNYLLLLDVLKLFIQKQ

SEQ ID NO: 3300299 - protein, 20 aa, Plasmodium falciparum
PNIWLFYYPFLMNNININKK

SEQ ID NO: 3300300 - protein, 23 aa, Plasmodium falciparum
PPDFLRLMFYTLGDYRDICIGDD

SEQ ID NO: 3300301 - protein, 22 aa, Plasmodium falciparum
PPDFLRLMFYTLGDYRDILDGK

SEQ ID NO: 3300302 - protein, 17 aa, Plasmodium falciparum
PPIFFFMKILPSNCIFF

SEQ ID NO: 3300303 - protein, 17 aa, Plasmodium falciparum
PPNPWTVSILNLLGELH

SEQ ID NO: 3300304 - protein, 18 aa, Plasmodium falciparum
PSDWLIILMIIQKGIYTI

SEQ ID NO: 3300305 - protein, 18 aa, Plasmodium falciparum
PSPFFYIYLFYHYCIYVI

SEQ ID NO: 3300306 - protein, 28 aa, Plasmodium falciparum
PYTTFKVLLHYWLEDFLYGYYISKKKIE

SEQ ID NO: 3300307 - protein, 25 aa, Plasmodium falciparum
QDTNIHFIIFLIYRILIFKKLFTHT

SEQ ID NO: 3300308 - protein, 22 aa, Plasmodium falciparum
QFFLFLICFYINQALYYWSNDG

SEQ ID NO: 3300309 - protein, 33 aa, Plasmodium falciparum
QFGERFWQGFFFGVIIFFVLSKYIRSYKKRKGM

SEQ ID NO: 3300310 - protein, 19 aa, Plasmodium falciparum
QFVLRPPYFRYLEEWGETF

SEQ ID NO: 3300311 - protein, 19 aa, Plasmodium falciparum
QIFFFFYFSLFFFVSSLSN

SEQ ID NO: 3300312 - protein, 20 aa, Plasmodium falciparum
QIFFYPFFYFLNNMIIITIY

SEQ ID NO: 3300313 - protein, 28 aa, Plasmodium falciparum
QIKLVTFIYFLYIPVLPFYENSIRHNEQ

SEQ ID NO: 3300314 - protein, 23 aa, Plasmodium falciparum
QIKYIIHTILFFKNNDPMKHMLL

SEQ ID NO: 3300315 - protein, 19 aa, Plasmodium falciparum
QINILFFFKLLHVLDICNY

SEQ ID NO: 3300316 - protein, 21 aa, Plasmodium falciparum
QIRRDVFFFNLLKSVIKKKTS

SEQ ID NO: 3300317 - protein, 28 aa, Plasmodium falciparum
QISNFLIYYIFKGLIKFLYPFIPHICEI

SEQ ID NO: 3300318 - protein, 26 aa, Plasmodium falciparum
QITPILFIVYLFISIFFFSHNKKFAF

SEQ ID NO: 3300319 - protein, 17 aa, Plasmodium falciparum
QIYYILYIFTKKSLFNY

SEQ ID NO: 3300320 - protein, 25 aa, Plasmodium falciparum
QKHLNIFLLLIELLLFISKNIFFEN

SEQ ID NO: 3300321 - protein, 20 aa, Plasmodium falciparum
QKIYFLFPKIYFYIKLFICS

SEQ ID NO: 3300322 - protein, 25 aa, Plasmodium falciparum
QKNINLIIIPYIIELIIYLMNVRKE

SEQ ID NO: 3300323 - protein, 18 aa, Plasmodium falciparum
QKNKYLIWNIFRQVLESL

SEQ ID NO: 3300324 - protein, 27 aa, Plasmodium falciparum
QKTFNDFFYFWIRRFLNDSMYWRGKVE

SEQ ID NO: 3300325 - protein, 26 aa, Plasmodium falciparum
QLIYHPYFYLMYKLYKYLKIDASPVL

SEQ ID NO: 3300326 - protein, 22 aa, Plasmodium falciparum
QNAPIRVLFKRWIENFLKDHNK

SEQ ID NO: 3300327 - protein, 35 aa, Plasmodium falciparum
QNIICRILYYIFFKLLLYWFIKIFFKFYYIKIEQV

SEQ ID NO: 3300328 - protein, 25 aa, Plasmodium falciparum
QNIYPFYFNIYLFLLFKVPKDSKMK

SEQ ID NO: 3300329 - protein, 24 aa, Plasmodium falciparum
QQEDPLLNFLFKKSYFKNILHKNE

SEQ ID NO: 3300330 - protein, 21 aa, Plasmodium falciparum
QQYIIFFFLIYSTSHKKFFIY

SEQ ID NO: 3300331 - protein, 41 aa, Plasmodium falciparum
QSPFDYKRFFRKYTIFAPFILVYFTLMFFVNSTVQNGTMLL

SEQ ID NO: 3300332 - protein, 27 aa, Plasmodium falciparum
QSVISFVYSFLLFIYMCVIRTIKSYKT

SEQ ID NO: 3300333 - protein, 21 aa, Plasmodium falciparum
QTPLFFIFYFSMKRIASYPDI

SEQ ID NO: 3300334 - protein, 24 aa, Plasmodium falciparum
QTRLSLHWPIYASYIFIICAVILL

SEQ ID NO: 3300335 - protein, 26 aa, Plasmodium falciparum
QYFIKLFYYLSFYNPIFSILFLNLIR

SEQ ID NO: 3300336 - protein, 26 aa, Plasmodium falciparum
QYLLQFFFLLIFPFSFYFLSSIFKAD

SEQ ID NO: 3300337 - protein, 21 aa, Plasmodium falciparum
RAKNYLYYLNDKIKSFIKIFS

SEQ ID NO: 3300338 - protein, 34 aa, Plasmodium falciparum
RAPDKKRTMFYRLSELFPIVPRKDNELAVSGDCM

SEQ ID NO: 3300339 - protein, 20 aa, Plasmodium falciparum
REKLFIFIILCLISVCLALL

SEQ ID NO: 3300340 - protein, 26 aa, Plasmodium falciparum
REMTKPFFLFFRIFNRILVEKSKKLD

SEQ ID NO: 3300341 - protein, 24 aa, Plasmodium falciparum
RERIINLLFFLYKKYIDKKDLELS

SEQ ID NO: 3300342 - protein, 17 aa, Plasmodium falciparum
RFICPYLYKLKNFKLII

SEQ ID NO: 3300343 - protein, 18 aa, Plasmodium falciparum
RFRFFFYRNNINKPLESE

SEQ ID NO: 3300344 - protein, 18 aa, Plasmodium falciparum
RIFFLFEFYFNIIVYILN

SEQ ID NO: 3300345 - protein, 20 aa, Plasmodium falciparum
RIFLNLLSIVGILLLVGLNN

SEQ ID NO: 3300346 - protein, 23 aa, Plasmodium falciparum
RIHLKIKAFIYKCLLRLLQSYEK

SEQ ID NO: 3300347 - protein, 21 aa, Plasmodium falciparum
RILFKVLFERWLKYFIQDFNN

SEQ ID NO: 3300348 - protein, 21 aa, Plasmodium falciparum
RIMYLQFKYIYLQSLNITVSF

SEQ ID NO: 3300349 - protein, 18 aa, Plasmodium falciparum
RISIFKIILIILFLCLFK

SEQ ID NO: 3300350 - protein, 18 aa, Plasmodium falciparum
RKCIIFKDFLLYIPTFTN

SEQ ID NO: 3300351 - protein, 21 aa, Plasmodium falciparum
RKCYNGIDLIFLFLSKIKGAN

SEQ ID NO: 3300352 - protein, 26 aa, Plasmodium falciparum
RKDFFLYFFFLLIPFLLISFHLFLRN

SEQ ID NO: 3300353 - protein, 23 aa, Plasmodium falciparum
RKDIKCFFLMYYILYKQNVSNNI

SEQ ID NO: 3300354 - protein, 21 aa, Plasmodium falciparum
RKEHWLYIYPCLKNLLFKKKK

SEQ ID NO: 3300355 - protein, 24 aa, Plasmodium falciparum
RKFTKLLIWILYDKDNKIKICCLK

SEQ ID NO: 3300356 - protein, 33 aa, Plasmodium falciparum
RKGFIFYRNFYFVLFLLVYIFQSFNECPFNHYC

SEQ ID NO: 3300357 - protein, 18 aa, Plasmodium falciparum
RKIKFFIQILFSLSPNTY

SEQ ID NO: 3300358 - protein, 24 aa, Plasmodium falciparum
RKVNFFIFVYILIYIIKTSTRKIQ

SEQ ID NO: 3300359 - protein, 20 aa, Plasmodium falciparum
RKVYWFEKFHWFISSENYLV

SEQ ID NO: 3300360 - protein, 28 aa, Plasmodium falciparum
RLCTVPLYIYLYFDIPLSHTLILTSLSS

SEQ ID NO: 3300361 - protein, 20 aa, Plasmodium falciparum
RLSQYLCLYILYKDINIYNI

SEQ ID NO: 3300362 - protein, 22 aa, Plasmodium falciparum
RLTILFMLLFVIQIPIMIYANF

SEQ ID NO: 3300363 - protein, 18 aa, Plasmodium falciparum
RNFFLIFKYIYMYSSYKT

SEQ ID NO: 3300364 - protein, 22 aa, Plasmodium falciparum
RNFTKFLFFLFFHIDKKQKILF

SEQ ID NO: 3300365 - protein, 30 aa, Plasmodium falciparum
RNKYRKLHFGWKLFVNISPPAALAIIGTAV

SEQ ID NO: 3300366 - protein, 22 aa, Plasmodium falciparum
RNMFNNLYLYHTNPMRYLPHYN

SEQ ID NO: 3300367 - protein, 29 aa, Plasmodium falciparum
RNSFVFKILFYFFKLKKTLLYLLKCFGIE

SEQ ID NO: 3300368 - protein, 20 aa, Plasmodium falciparum
RNYFIVYYKRYIKRGYANSG

SEQ ID NO: 3300369 - protein, 21 aa, Plasmodium falciparum
RPFYSFVFDIFKNLKHYLQQM

SEQ ID NO: 3300370 - protein, 17 aa, Plasmodium falciparum
RQMFYTLGDYRDILFSG

SEQ ID NO: 3300371 - protein, 22 aa, Plasmodium falciparum
RRILFIFLKYFNVFIYCKISKL

SEQ ID NO: 3300372 - protein, 17 aa, Plasmodium falciparum
RRKFLNLLSITGILLVV

SEQ ID NO: 3300373 - protein, 23 aa, Plasmodium falciparum
RRMSFFLICTFFNLIFLVSLLVL

SEQ ID NO: 3300374 - protein, 19 aa, Plasmodium falciparum
RRTLRWRGYKDAKLNSPFV

SEQ ID NO: 3300375 - protein, 26 aa, Plasmodium falciparum
RSICRIFFFLFFLSLSYKTLLNIYLY

SEQ ID NO: 3300376 - protein, 20 aa, Plasmodium falciparum
RSILIKFIIISFLGILYLFF

SEQ ID NO: 3300377 - protein, 25 aa, Plasmodium falciparum
RSKKWNYFIIFFLGVCLGFAIWPFF

SEQ ID NO: 3300378 - protein, 24 aa, Plasmodium falciparum
RSNNFLIIYILFTLYSFLPMCTYN

SEQ ID NO: 3300379 - protein, 22 aa, Plasmodium falciparum
RSYIKYIYNIWFKWLKKRKGEL

SEQ ID NO: 3300380 - protein, 25 aa, Plasmodium falciparum
RVPKRFWLYIQKLFLYKCYLINKTV

SEQ ID NO: 3300381 - protein, 32 aa, Plasmodium falciparum
RWLINKLEIIYFYFFCHLLLLCIFQNIFLLTY

SEQ ID NO: 3300382 - protein, 21 aa, Plasmodium falciparum
RYAEWFLKTYLFYKYKYSDNT

SEQ ID NO: 3300383 - protein, 24 aa, Plasmodium falciparum
RYILFYIYFLIYKFMKLKGLDVLC

SEQ ID NO: 3300384 - protein, 20 aa, Plasmodium falciparum
RYLLIIYEKVFKVIYIKNLK

SEQ ID NO: 3300385 - protein, 24 aa, Plasmodium falciparum
RYLSFLLLLFIYGVSYILAIIPDI

SEQ ID NO: 3300386 - protein, 23 aa, Plasmodium falciparum
RYVHICYYLFIYCTYKYHCELCD

SEQ ID NO: 3300387 - protein, 27 aa, Plasmodium falciparum
RYVIFTSFFMLIIQYHSFITCFNINHI

SEQ ID NO: 3300388 - protein, 24 aa, Plasmodium falciparum
SCLLFFFRFYINCLMLLNINIDID

SEQ ID NO: 3300389 - protein, 22 aa, Plasmodium falciparum
SCTLFVYFLYIHFFLLKQNNFC

SEQ ID NO: 3300390 - protein, 21 aa, Plasmodium falciparum
SDSFFFFFWYLLSLNQTSTKW

SEQ ID NO: 3300391 - protein, 20 aa, Plasmodium falciparum
SDYYYFFPYFIQKLLEKGGM

SEQ ID NO: 3300392 - protein, 23 aa, Plasmodium falciparum
SEYCYYFYLFGLATTYTFFTFQF

SEQ ID NO: 3300393 - protein, 25 aa, Plasmodium falciparum
SEYIYFFFFILFFKSNYDKTNDNNI

SEQ ID NO: 3300394 - protein, 19 aa, Plasmodium falciparum
SFFLNLLLSECLPINHLGF

SEQ ID NO: 3300395 - protein, 21 aa, Plasmodium falciparum
SFFYFFYIFFFNKKLYMNNYL

SEQ ID NO: 3300396 - protein, 19 aa, Plasmodium falciparum
SFIFTLFYSFQFLFIPTYI

SEQ ID NO: 3300397 - protein, 27 aa, Plasmodium falciparum
SFISLYLYFKIYFLSFFLLFFCICIIY

SEQ ID NO: 3300398 - protein, 17 aa, Plasmodium falciparum
SFLFILIVFIFLMVFFK

SEQ ID NO: 3300399 - protein, 19 aa, Plasmodium falciparum
SFLLYAFVKYLKNVKNRQS

SEQ ID NO: 3300400 - protein, 19 aa, Plasmodium falciparum
SFLRFFNYPFFKKPLIGDI

SEQ ID NO: 3300401 - protein, 22 aa, Plasmodium falciparum
SFSLYFFLRPYIKKKHILIDID

SEQ ID NO: 3300402 - protein, 37 aa, Plasmodium falciparum
SFTIHFFLPFLNFVTFFLFFLFFKMEDLFFITSKKKK

SEQ ID NO: 3300403 - protein, 19 aa, Plasmodium falciparum
SFVILLFLYIFFVQRFHIL

SEQ ID NO: 3300404 - protein, 36 aa, Plasmodium falciparum
SGASFCAIPFALMAGILFFQVYRLTKKHYYNRKKTV

SEQ ID NO: 3300405 - protein, 18 aa, Plasmodium falciparum
SICKFYLLYIPTIFNMYK

SEQ ID NO: 3300406 - protein, 24 aa, Plasmodium falciparum
SIIYSFFLFIWYSLKTNLIGKKKD

SEQ ID NO: 3300407 - protein, 20 aa, Plasmodium falciparum
SIMAFFPFFYIMLMKNCNYV

SEQ ID NO: 3300408 - protein, 23 aa, Plasmodium falciparum
SIWKILIYIFYNIKINIFSIKVK

SEQ ID NO: 3300409 - protein, 21 aa, Plasmodium falciparum
SIYECRGICDKGYKFKPYAKS

SEQ ID NO: 3300410 - protein, 24 aa, Plasmodium falciparum
SKIPEPIIREAPKYVPKKPVPPQH

SEQ ID NO: 3300411 - protein, 20 aa, Plasmodium falciparum
SKLHIFVFLLLNTLLKIEKN

SEQ ID NO: 3300412 - protein, 18 aa, Plasmodium falciparum
SKLNYFYIFLRLTKNIKH

SEQ ID NO: 3300413 - protein, 19 aa, Plasmodium falciparum
SKSGFLDLLLKWTYYTLYG

SEQ ID NO: 3300414 - protein, 26 aa, Plasmodium falciparum
SKYGFLYLIFLFFKIDKHTVQNVITF

SEQ ID NO: 3300415 - protein, 23 aa, Plasmodium falciparum
SLFFFIFFYIILFFSNDYNYLYS

SEQ ID NO: 3300416 - protein, 30 aa, Plasmodium falciparum
SLITFPFYFRIFLFFILFFNFLCSYSYEKY

SEQ ID NO: 3300417 - protein, 22 aa, Plasmodium falciparum
SLKIFIVYYYYILIYLNKDKIN

SEQ ID NO: 3300418 - protein, 22 aa, Plasmodium falciparum
SLLFLCIFIYRLYYISINEHLF

SEQ ID NO: 3300419 - protein, 21 aa, Plasmodium falciparum
SLLLCSLFLGIPVLAFVCFGT

SEQ ID NO: 3300420 - protein, 25 aa, Plasmodium falciparum
SLLNIKWMIFFLNLLFISAACVFSI

SEQ ID NO: 3300421 - protein, 18 aa, Plasmodium falciparum
SLLYLFFHFIKKCYNSFR

SEQ ID NO: 3300422 - protein, 27 aa, Plasmodium falciparum
SLNAFIYLLIRFFIYFFENTSFWMITK

SEQ ID NO: 3300423 - protein, 18 aa, Plasmodium falciparum
SLWLLRRNVFQILLDADK

SEQ ID NO: 3300424 - protein, 17 aa, Plasmodium falciparum
SLYMLYLYALKKKDKKK

SEQ ID NO: 3300425 - protein, 21 aa, Plasmodium falciparum
SMIGLFIIIFIDEALVDHIRE

SEQ ID NO: 3300426 - protein, 25 aa, Plasmodium falciparum
SNDIKMFWFFMLNEIRPDLVPVDLD

SEQ ID NO: 3300427 - protein, 26 aa, Plasmodium falciparum
SNHMYFYKIFFYLLSFLNFYLEDMIK

SEQ ID NO: 3300428 - protein, 23 aa, Plasmodium falciparum
SNIYLLAHFLVLSLAYLSYNEYF

SEQ ID NO: 3300429 - protein, 20 aa, Plasmodium falciparum
SNLILFFHFFQNINICCNYY

SEQ ID NO: 3300430 - protein, 24 aa, Plasmodium falciparum
SNSIYVFFYLFVHINNIINSIIIQ

SEQ ID NO: 3300431 - protein, 24 aa, Plasmodium falciparum
SNTMVILFFFYKIYIILKKLEIRN

SEQ ID NO: 3300432 - protein, 18 aa, Plasmodium falciparum
SPPCHLILILNRYNWSFS

SEQ ID NO: 3300433 - protein, 23 aa, Plasmodium falciparum
SQIMPYFVFIPIGLVIVLISIIL

SEQ ID NO: 3300434 - protein, 24 aa, Plasmodium falciparum
SRDINFHFFIFNLILYKCKNEFPC

SEQ ID NO: 3300435 - protein, 23 aa, Plasmodium falciparum
SRNTYYIYILFILCVIQIKILLS

SEQ ID NO: 3300436 - protein, 20 aa, Plasmodium falciparum
SSDWLYLFLSLSLNIEKYSN

SEQ ID NO: 3300437 - protein, 23 aa, Plasmodium falciparum
SSETYLFFYFFTNLYLDAYKSFP

SEQ ID NO: 3300438 - protein, 22 aa, Plasmodium falciparum
SSHLMLIFLLLAFFLVVVYRLY

SEQ ID NO: 3300439 - protein, 29 aa, Plasmodium falciparum
SSLKKYMKFCLCTIICVFLLDIYTNCESP

SEQ ID NO: 3300440 - protein, 25 aa, Plasmodium falciparum
SSLSSFFFSFFSLLLYMLVLLQIFP

SEQ ID NO: 3300441 - protein, 28 aa, Plasmodium falciparum
SSPLNIWYDYWKFDFWFPFSSIEYNLQP

SEQ ID NO: 3300442 - protein, 23 aa, Plasmodium falciparum
SSRFYVFIIIILTLLILDIQSYY

SEQ ID NO: 3300443 - protein, 25 aa, Plasmodium falciparum
SSSFSYFYSLLLLLFCLIFSIDLNG

SEQ ID NO: 3300444 - protein, 17 aa, Plasmodium falciparum
SSSVWIFFFFNFITSIP

SEQ ID NO: 3300445 - protein, 34 aa, Plasmodium falciparum
SSTYCAIPFALMAGILFFQVYRLTKKHYYNRKKT

SEQ ID NO: 3300446 - protein, 17 aa, Plasmodium falciparum
SSYIFFDVFFNFDLFFD

SEQ ID NO: 3300447 - protein, 22 aa, Plasmodium falciparum
STKLNFIPFKSFYYLLLSETNL

SEQ ID NO: 3300448 - protein, 24 aa, Plasmodium falciparum
STPINFLCIFIPTLFDMNNMDLLK

SEQ ID NO: 3300449 - protein, 24 aa, Plasmodium falciparum
STYSIFFFLFFKRLKNYVLERLKD

SEQ ID NO: 3300450 - protein, 22 aa, Plasmodium falciparum
SVFLLLFLFFGFVFCLLYHAFL

SEQ ID NO: 3300451 - protein, 17 aa, Plasmodium falciparum
SVKIFLLKIGKSLIRFL

SEQ ID NO: 3300452 - protein, 21 aa, Plasmodium falciparum
SVLFLILTIFFLCLRIALIIS

SEQ ID NO: 3300453 - protein, 22 aa, Plasmodium falciparum
SVLSVVGFVLFYFTPNSRKSDL

SEQ ID NO: 3300454 - protein, 24 aa, Plasmodium falciparum
SVSSFLFVEALFQEYQCYGSSSNT

SEQ ID NO: 3300455 - protein, 20 aa, Plasmodium falciparum
SYFLNRYYYFDSFIALVISK

SEQ ID NO: 3300456 - protein, 19 aa, Plasmodium falciparum
SYIFFFVHLIVINIKCKEI

SEQ ID NO: 3300457 - protein, 22 aa, Plasmodium falciparum
SYIILIFILINYQKKIFYIINI

SEQ ID NO: 3300458 - protein, 33 aa, Plasmodium falciparum
SYIRQLLSVLLPQPPIYPPFEIWFFMSKKCASQ

SEQ ID NO: 3300459 - protein, 17 aa, Plasmodium falciparum
SYNLNKLYKGSFEELES

SEQ ID NO: 3300460 - protein, 23 aa, Plasmodium falciparum
SYSVFFYNLFIKGLYLNKQNLEH

SEQ ID NO: 3300461 - protein, 17 aa, Plasmodium falciparum
SYVIILHFLMNSICVTY

SEQ ID NO: 3300462 - protein, 21 aa, Plasmodium falciparum
SYYDYIFLKTHKIFFSKKGVK

SEQ ID NO: 3300463 - protein, 24 aa, Plasmodium falciparum
SYYLSYICSYIFSNKYHMLLPYYD

SEQ ID NO: 3300464 - protein, 23 aa, Plasmodium falciparum
TAKSILFIIFIMGIVMLIITYIC

SEQ ID NO: 3300465 - protein, 18 aa, Plasmodium falciparum
TCLYLLRYIFKYIFNIYN

SEQ ID NO: 3300466 - protein, 17 aa, Plasmodium falciparum
TCSFHLFYYLKFLLKKN

SEQ ID NO: 3300467 - protein, 23 aa, Plasmodium falciparum
TDHIFFFYRTIKALFLYNYKYYN

SEQ ID NO: 3300468 - protein, 22 aa, Plasmodium falciparum
TDKMEVIFLLNKYFKKLNKYKK

SEQ ID NO: 3300469 - protein, 22 aa, Plasmodium falciparum
TEDQFLRFFAEWEEEFCDGLNK

SEQ ID NO: 3300470 - protein, 18 aa, Plasmodium falciparum
TFFFFLSRFLLICGFCIE

SEQ ID NO: 3300471 - protein, 22 aa, Plasmodium falciparum
TFFYFLFFLLDMYQGNDAIPSK

SEQ ID NO: 3300472 - protein, 23 aa, Plasmodium falciparum
TFFYLFFGFLMASLIIYAFYEYY

SEQ ID NO: 3300473 - protein, 17 aa, Plasmodium falciparum
TFLIFTNLYRKVPNNYL

SEQ ID NO: 3300474 - protein, 23 aa, Plasmodium falciparum
TFLSHFVLRPPYFRYLEEWGETF

SEQ ID NO: 3300475 - protein, 24 aa, Plasmodium falciparum
TFNEFFYFWIVRFLNDSMYWRGKI

SEQ ID NO: 3300476 - protein, 19 aa, Plasmodium falciparum
THYFSCLILFIFSQSNDII

SEQ ID NO: 3300477 - protein, 25 aa, Plasmodium falciparum
TICFFLSLILFIFKNIHTIKIIRSH

SEQ ID NO: 3300478 - protein, 23 aa, Plasmodium falciparum
TICVYIFFPLQFHYLRKLLCDKE

SEQ ID NO: 3300479 - protein, 39 aa, Plasmodium falciparum
TIHMKKIYKILFLLKEKIILFIFYIYKKIYKNAYINISY

SEQ ID NO: 3300480 - protein, 18 aa, Plasmodium falciparum
TIILFLKKSIYFKSIFNC

SEQ ID NO: 3300481 - protein, 22 aa, Plasmodium falciparum
TIKPFLYFLFIFILKECENYQL

SEQ ID NO: 3300482 - protein, 18 aa, Plasmodium falciparum
TILCYILLILIEKSHQNN

SEQ ID NO: 3300483 - protein, 19 aa, Plasmodium falciparum
TKCMFPSCSTYFHIYCYYN

SEQ ID NO: 3300484 - protein, 21 aa, Plasmodium falciparum
TKKCYFIFYKNKCTSCLITHN

SEQ ID NO: 3300485 - protein, 18 aa, Plasmodium falciparum
TLEWVLDLSYFPIIKEAH

SEQ ID NO: 3300486 - protein, 23 aa, Plasmodium falciparum
TLFKSWIPFYTFPFKFGITDCKL

SEQ ID NO: 3300487 - protein, 21 aa, Plasmodium falciparum
TLFPYLFKMLSISKPLSIQIH

SEQ ID NO: 3300488 - protein, 21 aa, Plasmodium falciparum
TLGRLLYLLFLKMNNLMIKKK

SEQ ID NO: 3300489 - protein, 27 aa, Plasmodium falciparum
TLHTFELYYLFHIFKKLLLKKKDIEDD

SEQ ID NO: 3300490 - protein, 23 aa, Plasmodium falciparum
TLIDFFLLMQEISLLIFPYISHL

SEQ ID NO: 3300491 - protein, 17 aa, Plasmodium falciparum
TLIFFIIYVLYISWNNE

SEQ ID NO: 3300492 - protein, 26 aa, Plasmodium falciparum
TLIKIYELFILYKYKYKKILTFFFHD

SEQ ID NO: 3300493 - protein, 21 aa, Plasmodium falciparum
TLITYRYMYIFSLINILKTTS

SEQ ID NO: 3300494 - protein, 27 aa, Plasmodium falciparum
TLIYTFFTNFFLLYYILYHADQCFDNK

SEQ ID NO: 3300495 - protein, 22 aa, Plasmodium falciparum
TLLTFLSFPFFFSKLKVKPNYI

SEQ ID NO: 3300496 - protein, 23 aa, Plasmodium falciparum
TLLTSLIYWLWKHKMNLFFIKEN

SEQ ID NO: 3300497 - protein, 23 aa, Plasmodium falciparum
TLNNTLYFIFKVLSIRIICYEFQ

SEQ ID NO: 3300498 - protein, 26 aa, Plasmodium falciparum
TLQLTYFFFFLLWKDTYELYNNIIKR

SEQ ID NO: 3300499 - protein, 21 aa, Plasmodium falciparum
TLSVVSLYLYIPNENINLSFH

SEQ ID NO: 3300500 - protein, 20 aa, Plasmodium falciparum
TLVNILILFLICYSISFIIY

SEQ ID NO: 3300501 - protein, 36 aa, Plasmodium falciparum
TMVLVPGVLTVFLLTIIWVLVYKHSLIDRVHGTGKT

SEQ ID NO: 3300502 - protein, 24 aa, Plasmodium falciparum
TNAINYLPWAFKIFLTCLIIELRI

SEQ ID NO: 3300503 - protein, 24 aa, Plasmodium falciparum
TNEEYIILSRKDLIYNIIVMVHMM

SEQ ID NO: 3300504 - protein, 22 aa, Plasmodium falciparum
TNFCMFFFCKSNYYITLKLYYI

SEQ ID NO: 3300505 - protein, 25 aa, Plasmodium falciparum
TNKMIIIDPLIFFNLIFTSDMMYEY

SEQ ID NO: 3300506 - protein, 30 aa, Plasmodium falciparum
TNVFQYYYALFFILYILHLSRNDMFLKAVN

SEQ ID NO: 3300507 - protein, 25 aa, Plasmodium falciparum
TPLFVYIMIIILFVFISFFTIFLLP

SEQ ID NO: 3300508 - protein, 25 aa, Plasmodium falciparum
TQKKFWFFIYFIFHINGIHYYQSVY

SEQ ID NO: 3300509 - protein, 21 aa, Plasmodium falciparum
TRNLLLLLPLGIYIFYIIKTC

SEQ ID NO: 3300510 - protein, 29 aa, Plasmodium falciparum
TSLLNLFLMQFLKLFPIPWLKKKKCHFKY

SEQ ID NO: 3300511 - protein, 22 aa, Plasmodium falciparum
TTLGMLYIFLLKVDIGTIKNCT

SEQ ID NO: 3300512 - protein, 28 aa, Plasmodium falciparum
TTVLVSFPVLLFCLSFIILSYRSFNTEY

SEQ ID NO: 3300513 - protein, 25 aa, Plasmodium falciparum
TVHTLYFIWFVLGTLYFFLSIFDKD

SEQ ID NO: 3300514 - protein, 24 aa, Plasmodium falciparum
TVLSPLYFLIFSNYFLIFNMCPHP

SEQ ID NO: 3300515 - protein, 19 aa, Plasmodium falciparum
TVSILTLLKIHTLIHLLQK

SEQ ID NO: 3300516 - protein, 24 aa, Plasmodium falciparum
TYEYPFIWSYIQSTWGRCILNLGM

SEQ ID NO: 3300517 - protein, 19 aa, Plasmodium falciparum
TYFFVFLLTFCSSYFFVHF

SEQ ID NO: 3300518 - protein, 24 aa, Plasmodium falciparum
TYMNVLILFFLFKYEIFLRNYNIY

SEQ ID NO: 3300519 - protein, 21 aa, Plasmodium falciparum
VAIFFFFFFLVMVVIYLILRY

SEQ ID NO: 3300520 - protein, 37 aa, Plasmodium falciparum
VAKQNYLYVVIFLFFVINILLFINFYNLGKRKGYYLA

SEQ ID NO: 3300521 - protein, 27 aa, Plasmodium falciparum
VCYYTNKSFLFLVRNIYRIRKMWIREK

SEQ ID NO: 3300522 - protein, 17 aa, Plasmodium falciparum
VEKKRFLFLFKMNKWLL

SEQ ID NO: 3300523 - protein, 22 aa, Plasmodium falciparum
VFFVLFLIIFIILIILGGYIFK

SEQ ID NO: 3300524 - protein, 23 aa, Plasmodium falciparum
VFGVLFVFILFNKEWIDKESHDI

SEQ ID NO: 3300525 - protein, 25 aa, Plasmodium falciparum
VFIITIFCLILISWKYFNISYENNK

SEQ ID NO: 3300526 - protein, 20 aa, Plasmodium falciparum
VFLFNILWSLILKYSKYCRK

SEQ ID NO: 3300527 - protein, 20 aa, Plasmodium falciparum
VFNIYILISLLLLSSIHIKD

SEQ ID NO: 3300528 - protein, 24 aa, Plasmodium falciparum
VFSPFLFTFLMFCSSIIVILSSLS

SEQ ID NO: 3300529 - protein, 22 aa, Plasmodium falciparum
VFTLVFLLLLYFNNIVYTHVDD

SEQ ID NO: 3300530 - protein, 24 aa, Plasmodium falciparum
VFTPFLIFLFKRILPQFICLNYPS

SEQ ID NO: 3300531 - protein, 30 aa, Plasmodium falciparum
VHCVDKYMLGIFYIWIWNLNYIWKRADPPN

SEQ ID NO: 3300532 - protein, 23 aa, Plasmodium falciparum
VHINLIIILIIYIASIKIYNVRK

SEQ ID NO: 3300533 - protein, 23 aa, Plasmodium falciparum
VHLFCFFLLLLFLKFSLNTVSIN

SEQ ID NO: 3300534 - protein, 18 aa, Plasmodium falciparum
VHLLICPFSFFFSVYKEK

SEQ ID NO: 3300535 - protein, 21 aa, Plasmodium falciparum
VIFFYILFIIFIVNNFLCFMF

SEQ ID NO: 3300536 - protein, 23 aa, Plasmodium falciparum
VIIKFLLYMFYEKFINKFNKYIN

SEQ ID NO: 3300537 - protein, 17 aa, Plasmodium falciparum
VIIWLIRSIYLFIITYI

SEQ ID NO: 3300538 - protein, 24 aa, Plasmodium falciparum
VIQKILFILIPYIYIRKALCESRT

SEQ ID NO: 3300539 - protein, 24 aa, Plasmodium falciparum
VIQVFLFLVFMLLLFMQLPEQNYY

SEQ ID NO: 3300540 - protein, 26 aa, Plasmodium falciparum
VIRNDKFSYFTLYKNNLFPNSNNYFL

SEQ ID NO: 3300541 - protein, 22 aa, Plasmodium falciparum
VISIKVFIKRWLESFLKDYNKL

SEQ ID NO: 3300542 - protein, 19 aa, Plasmodium falciparum
VIYFLFLFYIKLPSNVQLN

SEQ ID NO: 3300543 - protein, 26 aa, Plasmodium falciparum
VKIIQMILWMIIIVLHLMNMKKLKVI

SEQ ID NO: 3300544 - protein, 22 aa, Plasmodium falciparum
VKISCFFMIFIIMNKKINRYKQ

SEQ ID NO: 3300545 - protein, 23 aa, Plasmodium falciparum
VKSYNGFFWKWVHDMLIDSMQWR

SEQ ID NO: 3300546 - protein, 19 aa, Plasmodium falciparum
VLFIIISFIWFFLNRTKHL

SEQ ID NO: 3300547 - protein, 19 aa, Plasmodium falciparum
VLFIQLILSLLFSITLILQ

SEQ ID NO: 3300548 - protein, 21 aa, Plasmodium falciparum
VLFLILFIFFHVAGNFVLSNA

SEQ ID NO: 3300549 - protein, 30 aa, Plasmodium falciparum
VLKNNFLLYIKLFYYLLLVGNIYTTIVFLS

SEQ ID NO: 3300550 - protein, 18 aa, Plasmodium falciparum
VLLFSLPLNILVYSKNKP

SEQ ID NO: 3300551 - protein, 27 aa, Plasmodium falciparum
VLLIKQYLVIILWFNDIKPFFPLFNYP

SEQ ID NO: 3300552 - protein, 18 aa, Plasmodium falciparum
VLLILYSFLIYKIKWEHI

SEQ ID NO: 3300553 - protein, 24 aa, Plasmodium falciparum
VLNKIFFLFHLLKIRIIYGHILAV

SEQ ID NO: 3300554 - protein, 17 aa, Plasmodium falciparum
VLPYKPIRMFYSNNFLF

SEQ ID NO: 3300555 - protein, 17 aa, Plasmodium falciparum
VLYILQLNDCLFKKGIL

SEQ ID NO: 3300556 - protein, 19 aa, Plasmodium falciparum
VNEFLKCVRLLIFKKRVFE

SEQ ID NO: 3300557 - protein, 18 aa, Plasmodium falciparum
VNFFFLFVLVMDIFPFLN

SEQ ID NO: 3300558 - protein, 17 aa, Plasmodium falciparum
VNIKKYMVLYKICIFML

SEQ ID NO: 3300559 - protein, 24 aa, Plasmodium falciparum
VNINIFFLLFFWIDYLPSSHKNIL

SEQ ID NO: 3300560 - protein, 21 aa, Plasmodium falciparum
VNLHPLFWYLVMSNSSYINLS

SEQ ID NO: 3300561 - protein, 26 aa, Plasmodium falciparum
VNSILRIFFFFFLISFLFSNCKLNDY

SEQ ID NO: 3300562 - protein, 30 aa, Plasmodium falciparum
VNTIKSLVLYILILSLVLTSISLSFYNIIY

SEQ ID NO: 3300563 - protein, 20 aa, Plasmodium falciparum
VPIKYILWLLLQFLTLCKLK

SEQ ID NO: 3300564 - protein, 30 aa, Plasmodium falciparum
VQILFFMGLICKFPILWIIGSIVFCITPSE

SEQ ID NO: 3300565 - protein, 32 aa, Plasmodium falciparum
VRNKYRKLHFGWKLFVNISPPAALAIIGTAVA

SEQ ID NO: 3300566 - protein, 34 aa, Plasmodium falciparum
VRNNLSRFILSVSLILFFFHFVLCSTIENVEILK

SEQ ID NO: 3300567 - protein, 21 aa, Plasmodium falciparum
VRSFLFFFIFYHDLIYIEIIK

SEQ ID NO: 3300568 - protein, 24 aa, Plasmodium falciparum
VSPGLWFFIHFIMNLIVLCVSLSS

SEQ ID NO: 3300569 - protein, 25 aa, Plasmodium falciparum
VTINFYVLLFLLFFNFVFIAKILIS

SEQ ID NO: 3300570 - protein, 26 aa, Plasmodium falciparum
VVAWGIIWFLIFSIILFYMLKNSSLV

SEQ ID NO: 3300571 - protein, 23 aa, Plasmodium falciparum
VVFTFFFWLLKYGKTRSYPKSGH

SEQ ID NO: 3300572 - protein, 25 aa, Plasmodium falciparum
VVQLFYILTIIILKYVFKSVNKDIK

SEQ ID NO: 3300573 - protein, 28 aa, Plasmodium falciparum
VYYILNLFIYYYIWLKCYFVLYNIIYEY

SEQ ID NO: 3300574 - protein, 19 aa, Plasmodium falciparum
WCCRITLVIIFLMLVVLTS

SEQ ID NO: 3300575 - protein, 25 aa, Plasmodium falciparum
WDNYKKLLIHLFTFLKCFLKKIQVS

SEQ ID NO: 3300576 - protein, 19 aa, Plasmodium falciparum
WHQVVRNKYRKLHFGWKLF

SEQ ID NO: 3300577 - protein, 24 aa, Plasmodium falciparum
WIDNYIFLIYFLNNELIFLSFAKP

SEQ ID NO: 3300578 - protein, 19 aa, Plasmodium falciparum
WIYILKHFLTKKLNIPILN

SEQ ID NO: 3300579 - protein, 25 aa, Plasmodium falciparum
WKMYLYFFFYDFFCIAFNQLFYILY

SEQ ID NO: 3300580 - protein, 17 aa, Plasmodium falciparum
WLCLILLEYLNVLDSYI

SEQ ID NO: 3300581 - protein, 18 aa, Plasmodium falciparum
WLITFPILLYIVFAVRLL

SEQ ID NO: 3300582 - protein, 20 aa, Plasmodium falciparum
WLVFLFFFLELAKCGIPGLH

SEQ ID NO: 3300583 - protein, 26 aa, Plasmodium falciparum
WNEILFFIRMFFKLNVILPLFFAAAF

SEQ ID NO: 3300584 - protein, 31 aa, Plasmodium falciparum
WNKLDNWKEEKWFKLFKRDLKIDMRNTYESD

SEQ ID NO: 3300585 - protein, 25 aa, Plasmodium falciparum
WNSCGFLFFLCYILQYILKHLKYDL

SEQ ID NO: 3300586 - protein, 19 aa, Plasmodium falciparum
WNTYLWGYGFKYYPIFYPK

SEQ ID NO: 3300587 - protein, 26 aa, Plasmodium falciparum
WRSPFLIQAFLLLPIFLIMIFIPSDK

SEQ ID NO: 3300588 - protein, 26 aa, Plasmodium falciparum
WSAHYFLKLPIFVILMIVFSLNAFIY

SEQ ID NO: 3300589 - protein, 21 aa, Plasmodium falciparum
WSILLFILLFTFLSPLFMSVE

SEQ ID NO: 3300590 - protein, 20 aa, Plasmodium falciparum
WSYSLLFYGFKFKETTKLLI

SEQ ID NO: 3300591 - protein, 19 aa, Plasmodium falciparum
WTFILYFKFNYCILYDHGY

SEQ ID NO: 3300592 - protein, 19 aa, Plasmodium falciparum
WYDYDIILYFFLNLLKNCN

SEQ ID NO: 3300593 - protein, 21 aa, Plasmodium falciparum
WYIFIFNIINKIYFENIRYVK

SEQ ID NO: 3300594 - protein, 18 aa, Plasmodium falciparum
WYIFLYADNFVILRSTLF

SEQ ID NO: 3300595 - protein, 26 aa, Plasmodium falciparum
WYIYNKLLIYLLEFLYIFLKNNYLTD

SEQ ID NO: 3300596 - protein, 23 aa, Plasmodium falciparum
YACQWFLFSFIFSTISIFKFVQF

SEQ ID NO: 3300597 - protein, 26 aa, Plasmodium falciparum
YCKSYILFLLLFYPYLHNYIRILKNN

SEQ ID NO: 3300598 - protein, 24 aa, Plasmodium falciparum
YCLYIMLLSYLFIGYRILRISENS

SEQ ID NO: 3300599 - protein, 26 aa, Plasmodium falciparum
YDKYTFFLYLFYMKNSSYILKKQMKK

SEQ ID NO: 3300600 - protein, 24 aa, Plasmodium falciparum
YDNFHICFLYPLFVTYFFYYHLFV

SEQ ID NO: 3300601 - protein, 24 aa, Plasmodium falciparum
YDVLITRFFLFASFLMVLFMCENF

SEQ ID NO: 3300602 - protein, 40 aa, Plasmodium falciparum
YEDKIILFYMIFISLFLIFHLMYILFIFLSKENNFTKLFT

SEQ ID NO: 3300603 - protein, 18 aa, Plasmodium falciparum
YEFPILYLFFPNKLLCKI

SEQ ID NO: 3300604 - protein, 23 aa, Plasmodium falciparum
YEKLIIYFLYFWNLIFTHGLMNK

SEQ ID NO: 3300605 - protein, 24 aa, Plasmodium falciparum
YEPIWIVAILIRIVLWCIVWIWAA

SEQ ID NO: 3300606 - protein, 17 aa, Plasmodium falciparum
YEYALIRFPIYNENKDM

SEQ ID NO: 3300607 - protein, 17 aa, Plasmodium falciparum
YEYIILLSYLFYKKSKY

SEQ ID NO: 3300608 - protein, 24 aa, Plasmodium falciparum
YEYVFFFLIIFYKYMQINLLHFIS

SEQ ID NO: 3300609 - protein, 27 aa, Plasmodium falciparum
YFAGGGLFFIILFLLGAKSSILNWSED

SEQ ID NO: 3300610 - protein, 20 aa, Plasmodium falciparum
YFFFINIIVYCILTVLYDIF

SEQ ID NO: 3300611 - protein, 17 aa, Plasmodium falciparum
YFFHIITGTLLYEYCYY

SEQ ID NO: 3300612 - protein, 18 aa, Plasmodium falciparum
YFFLFLWNEDIKCQSLLP

SEQ ID NO: 3300613 - protein, 18 aa, Plasmodium falciparum
YFFLYKYICYHFFSIFIQ

SEQ ID NO: 3300614 - protein, 18 aa, Plasmodium falciparum
YFFNFLYNIFLHKYKNDK

SEQ ID NO: 3300615 - protein, 19 aa, Plasmodium falciparum
YFFYLYFLQFTSASIFIDE

SEQ ID NO: 3300616 - protein, 18 aa, Plasmodium falciparum
YFILFIYFAYFFLQNILS

SEQ ID NO: 3300617 - protein, 18 aa, Plasmodium falciparum
YFIMYYHPYFISLLIFRL

SEQ ID NO: 3300618 - protein, 19 aa, Plasmodium falciparum
YFISFFFFFKIHYLFFLIK

SEQ ID NO: 3300619 - protein, 25 aa, Plasmodium falciparum
YFKFKRFMIFIPYLYNLYKRYNNNN

SEQ ID NO: 3300620 - protein, 21 aa, Plasmodium falciparum
YFKREFFFKTLIGNNIILLLA

SEQ ID NO: 3300621 - protein, 19 aa, Plasmodium falciparum
YFLFNRFFYFLLMYIRKFC

SEQ ID NO: 3300622 - protein, 21 aa, Plasmodium falciparum
YFLILIFINSCHLYLSSENQK

SEQ ID NO: 3300623 - protein, 17 aa, Plasmodium falciparum
YFLIYKIVKDSFFRILI

SEQ ID NO: 3300624 - protein, 21 aa, Plasmodium falciparum
YFLLFVFFFLFKWLTFKIIRN

SEQ ID NO: 3300625 - protein, 23 aa, Plasmodium falciparum
YFSLYMFLIYYKYRYVRGTLKNI

SEQ ID NO: 3300626 - protein, 18 aa, Plasmodium falciparum
YFSYFYIFFLSCLQPVQM

SEQ ID NO: 3300627 - protein, 24 aa, Plasmodium falciparum
YFVLRWILIFFKNKNQFFLSQKKM

SEQ ID NO: 3300628 - protein, 17 aa, Plasmodium falciparum
YFWIGRFLNDSMYWRGK

SEQ ID NO: 3300629 - protein, 19 aa, Plasmodium falciparum
YFYQLIGLDILLDNNGKAW

SEQ ID NO: 3300630 - protein, 21 aa, Plasmodium falciparum
YFYYHYFVYILLPKLNYLNSS

SEQ ID NO: 3300631 - protein, 25 aa, Plasmodium falciparum
YGRNNILIVLILNIILWNVCITNNG

SEQ ID NO: 3300632 - protein, 31 aa, Plasmodium falciparum
YHFNFYQIFILLLQISMISLFLFIIIFIYTS

SEQ ID NO: 3300633 - protein, 19 aa, Plasmodium falciparum
YHIMIRYVIFTSFFMLIIQ

SEQ ID NO: 3300634 - protein, 29 aa, Plasmodium falciparum
YHKKIFRILLLILFYFSLPTFPFSKKFFI

SEQ ID NO: 3300635 - protein, 20 aa, Plasmodium falciparum
YHKLIYPHLLKFYLDHFFLS

SEQ ID NO: 3300636 - protein, 24 aa, Plasmodium falciparum
YHLMFICKVFWYIFLYADNFVILR

SEQ ID NO: 3300637 - protein, 21 aa, Plasmodium falciparum
YICCSLFLKLPFGILPGIYIT

SEQ ID NO: 3300638 - protein, 24 aa, Plasmodium falciparum
YICILIFWLFFFDLVVLSPFSLIF

SEQ ID NO: 3300639 - protein, 18 aa, Plasmodium falciparum
YIEYIYILLLIIKEKKNT

SEQ ID NO: 3300640 - protein, 20 aa, Plasmodium falciparum
YIFEKTFFFFILDLNNNMDD

SEQ ID NO: 3300641 - protein, 19 aa, Plasmodium falciparum
YIFFDVFFNFDLFFDELEK

SEQ ID NO: 3300642 - protein, 18 aa, Plasmodium falciparum
YIFLGIHSFLFAFELYFV

SEQ ID NO: 3300643 - protein, 17 aa, Plasmodium falciparum
YIFLIFISSFKCEVYKK

SEQ ID NO: 3300644 - protein, 18 aa, Plasmodium falciparum
YIFLIYSFSKLFSIHTCQ

SEQ ID NO: 3300645 - protein, 27 aa, Plasmodium falciparum
YIFLLHFFFFLIFYFYSKPKKKHLKKI

SEQ ID NO: 3300646 - protein, 22 aa, Plasmodium falciparum
YIFNLIFFLTFLLLLDVYILDH

SEQ ID NO: 3300647 - protein, 20 aa, Plasmodium falciparum
YIFTLIRFYYIFKTFYRNKK

SEQ ID NO: 3300648 - protein, 25 aa, Plasmodium falciparum
YIGFIGLQLIYFITYILFGNNNVYL

SEQ ID NO: 3300649 - protein, 17 aa, Plasmodium falciparum
YIICVIFIINVIRTRGE

SEQ ID NO: 3300650 - protein, 20 aa, Plasmodium falciparum
YIIIILLFSLIIKRYTSLNR

SEQ ID NO: 3300651 - protein, 19 aa, Plasmodium falciparum
YIILFILFCSYYINGRGVN

SEQ ID NO: 3300652 - protein, 21 aa, Plasmodium falciparum
YIINFFIFLFLDRLYLILETY

SEQ ID NO: 3300653 - protein, 21 aa, Plasmodium falciparum
YILHLYIPIYPYMHKPTCIPT

SEQ ID NO: 3300654 - protein, 22 aa, Plasmodium falciparum
YILIILVFMYFKLILKGPLPND

SEQ ID NO: 3300655 - protein, 18 aa, Plasmodium falciparum
YILIWSYNNYINPLYALI

SEQ ID NO: 3300656 - protein, 18 aa, Plasmodium falciparum
YIMFLLINYIISIQFLYI

SEQ ID NO: 3300657 - protein, 27 aa, Plasmodium falciparum
YIQNNLFIYISLFKSVLFIISEILFFI

SEQ ID NO: 3300658 - protein, 24 aa, Plasmodium falciparum
YIREYFYIFVFFQKIIHNKENCYD

SEQ ID NO: 3300659 - protein, 18 aa, Plasmodium falciparum
YIRLLLIFNKLFLFVLYI

SEQ ID NO: 3300660 - protein, 25 aa, Plasmodium falciparum
YIRNLLYYLFVFSKYNKFAYYLCNI

SEQ ID NO: 3300661 - protein, 20 aa, Plasmodium falciparum
YISLLFVIILTFLAATYLSQ

SEQ ID NO: 3300662 - protein, 17 aa, Plasmodium falciparum
YISMFLIFFLIVIFYMY

SEQ ID NO: 3300663 - protein, 28 aa, Plasmodium falciparum
YISTGFFLFLLLITFFVYLSAFTNIINQ

SEQ ID NO: 3300664 - protein, 18 aa, Plasmodium falciparum
YISWIQKMCYLYFLIQIM

SEQ ID NO: 3300665 - protein, 18 aa, Plasmodium falciparum
YITIGYLFKLFLHHKNMY

SEQ ID NO: 3300666 - protein, 28 aa, Plasmodium falciparum
YITLKLYYIFLFLFKYYKYPLRKNFYHL

SEQ ID NO: 3300667 - protein, 19 aa, Plasmodium falciparum
YIVLNFFFYLFDNTSTFFY

SEQ ID NO: 3300668 - protein, 24 aa, Plasmodium falciparum
YIYDILYICIWIFSLSVSKYRKIR

SEQ ID NO: 3300669 - protein, 20 aa, Plasmodium falciparum
YIYFFVIFYSLNLNNKNENF

SEQ ID NO: 3300670 - protein, 26 aa, Plasmodium falciparum
YIYINYFLFLYLQILINLISYLNFST

SEQ ID NO: 3300671 - protein, 18 aa, Plasmodium falciparum
YIYIYYYILLYYKKMARS

SEQ ID NO: 3300672 - protein, 23 aa, Plasmodium falciparum
YIYVFIAFVFLMLLFNVPSIEEN

SEQ ID NO: 3300673 - protein, 18 aa, Plasmodium falciparum
YKIFYLFNFVIDIDIRLL

SEQ ID NO: 3300674 - protein, 23 aa, Plasmodium falciparum
YKKHLLLTFLRYIKNFLLNICSC

SEQ ID NO: 3300675 - protein, 37 aa, Plasmodium falciparum
YKKIYFYDFFFIYLLRKLFWNIFSLYYIYLQKYNDRR

SEQ ID NO: 3300676 - protein, 24 aa, Plasmodium falciparum
YKLCWILIDFFFYPICKKLTVPMN

SEQ ID NO: 3300677 - protein, 17 aa, Plasmodium falciparum
YKLLFHAFIYGILSFIK

SEQ ID NO: 3300678 - protein, 20 aa, Plasmodium falciparum
YKMNFMFLHRLYSLSIYQLY

SEQ ID NO: 3300679 - protein, 29 aa, Plasmodium falciparum
YKNISYSLYFLIFINLLTQLWEKLSFDIK

SEQ ID NO: 3300680 - protein, 26 aa, Plasmodium falciparum
YKNTNIFFLILFFNIFLPYTNNDILI

SEQ ID NO: 3300681 - protein, 23 aa, Plasmodium falciparum
YKSYYYILMYWKFIILRILQRNK

SEQ ID NO: 3300682 - protein, 22 aa, Plasmodium falciparum
YLALLLIYIFFLCNKKGFHFCH

SEQ ID NO: 3300683 - protein, 18 aa, Plasmodium falciparum
YLCILNPIRVPAFVFAWL

SEQ ID NO: 3300684 - protein, 28 aa, Plasmodium falciparum
YLDLSNHLYIYCLLFISISLIEINEHIN

SEQ ID NO: 3300685 - protein, 17 aa, Plasmodium falciparum
YLFIITYIWIILKTKLK

SEQ ID NO: 3300686 - protein, 17 aa, Plasmodium falciparum
YLIFLFLGNIFTVLYNS

SEQ ID NO: 3300687 - protein, 17 aa, Plasmodium falciparum
YLIFPFLQHIFVHIFYY

SEQ ID NO: 3300688 - protein, 17 aa, Plasmodium falciparum
YLIICKKLLYYQKNQKD

SEQ ID NO: 3300689 - protein, 17 aa, Plasmodium falciparum
YLINIFFFIFIKTDKYK

SEQ ID NO: 3300690 - protein, 19 aa, Plasmodium falciparum
YLINILFALSDVKGISTHD

SEQ ID NO: 3300691 - protein, 18 aa, Plasmodium falciparum
YLLCYPSFLSSLLTMNNL

SEQ ID NO: 3300692 - protein, 19 aa, Plasmodium falciparum
YLLFYHFFFHFLNCSDFFS

SEQ ID NO: 3300693 - protein, 18 aa, Plasmodium falciparum
YLLKLIYYVYENIQYIIR

SEQ ID NO: 3300694 - protein, 27 aa, Plasmodium falciparum
YLSCYIILYFFVFLPNYSYAININNYH

SEQ ID NO: 3300695 - protein, 35 aa, Plasmodium falciparum
YLSNFIIYTFFFLSYIFFGFVIIFLKRIVYHIFYD

SEQ ID NO: 3300696 - protein, 17 aa, Plasmodium falciparum
YLSPLLIKSILSFTFPL

SEQ ID NO: 3300697 - protein, 20 aa, Plasmodium falciparum
YLTIIPWILSFIFYSLLHFT

SEQ ID NO: 3300698 - protein, 19 aa, Plasmodium falciparum
YLYIYLKKYFDDIILLFEY

SEQ ID NO: 3300699 - protein, 25 aa, Plasmodium falciparum
YMDTYIQFLFYYLKNTYILFSVVKV

SEQ ID NO: 3300700 - protein, 20 aa, Plasmodium falciparum
YMFFVFIIIHFFLLILLFYS

SEQ ID NO: 3300701 - protein, 22 aa, Plasmodium falciparum
YMLGILYIWIWNNNYIWKRADP

SEQ ID NO: 3300702 - protein, 23 aa, Plasmodium falciparum
YMLSYFIAFLKKWKYMLSIYLSQ

SEQ ID NO: 3300703 - protein, 28 aa, Plasmodium falciparum
YNELIFNYYIYYILPYEKRLLFYKKNEQ

SEQ ID NO: 3300704 - protein, 25 aa, Plasmodium falciparum
YNFSFDLLFYILFYCFKRLHIYCLP

SEQ ID NO: 3300705 - protein, 37 aa, Plasmodium falciparum
YNIKKNRMWYYIFVKILFLSFFICILNGSSYDTYCKE

SEQ ID NO: 3300706 - protein, 27 aa, Plasmodium falciparum
YNITNVCMFLLLPEIFCKYYKKGDKKK

SEQ ID NO: 3300707 - protein, 17 aa, Plasmodium falciparum
YNKIFYKYYISVINDML

SEQ ID NO: 3300708 - protein, 24 aa, Plasmodium falciparum
YNLKTFINLFLNKYPKWFHKIKAD

SEQ ID NO: 3300709 - protein, 27 aa, Plasmodium falciparum
YNLSFVFYFLFFYYIKAYNLNKIYDRY

SEQ ID NO: 3300710 - protein, 23 aa, Plasmodium falciparum
YNNIFHFFFFLPTNYFTLNNFVD

SEQ ID NO: 3300711 - protein, 19 aa, Plasmodium falciparum
YNNIFLLPKFYPINKEYAI

SEQ ID NO: 3300712 - protein, 24 aa, Plasmodium falciparum
YNTQYLFNFLLHNFLFYSKDADEY

SEQ ID NO: 3300713 - protein, 18 aa, Plasmodium falciparum
YNVPLVPYGLLAGGILTG

SEQ ID NO: 3300714 - protein, 24 aa, Plasmodium falciparum
YNYEKFYVFILLCIKCIVSIRNDK

SEQ ID NO: 3300715 - protein, 21 aa, Plasmodium falciparum
YPHYFFLACLFNYKYDTNLSN

SEQ ID NO: 3300716 - protein, 25 aa, Plasmodium falciparum
YPKILYIIWNIVLLIKQYLVIILWF

SEQ ID NO: 3300717 - protein, 24 aa, Plasmodium falciparum
YQIPNFIFYFFRYYYRINNNINKH

SEQ ID NO: 3300718 - protein, 24 aa, Plasmodium falciparum
YRANDLFGVKKFCYQLLHGATCKS

SEQ ID NO: 3300719 - protein, 34 aa, Plasmodium falciparum
YRPYGLLRIMPKYLFIPFIRELAYLNLLYVISEY

SEQ ID NO: 3300720 - protein, 21 aa, Plasmodium falciparum
YSCFFLIIYIILFSIYIYDTS

SEQ ID NO: 3300721 - protein, 22 aa, Plasmodium falciparum
YSQKFPFFLNFTNNITSNKDNK

SEQ ID NO: 3300722 - protein, 19 aa, Plasmodium falciparum
YSTFPLLVMELFVSIAYTC

SEQ ID NO: 3300723 - protein, 23 aa, Plasmodium falciparum
YTEYLCVLCTPLVQIIFDDLIQA

SEQ ID NO: 3300724 - protein, 22 aa, Plasmodium falciparum
YTKLIMICIQFPKLKILWSPFS

SEQ ID NO: 3300725 - protein, 27 aa, Plasmodium falciparum
YTNTYFLIPYFILPLYTLSIGRKLTPN

SEQ ID NO: 3300726 - protein, 23 aa, Plasmodium falciparum
YTNTYILIFIYRKKPNITSGRTN

SEQ ID NO: 3300727 - protein, 23 aa, Plasmodium falciparum
YTSLYIYLIDISLSYLFTPNMGI

SEQ ID NO: 3300728 - protein, 29 aa, Plasmodium falciparum
YTTFKVFLEYWLDDFLYGYYLLKKRKIIE

SEQ ID NO: 3300729 - protein, 24 aa, Plasmodium falciparum
YTTFKVLLIYWLEDFIEGYYLLKK

SEQ ID NO: 3300730 - protein, 23 aa, Plasmodium falciparum
YTYRIVMLLLFIHVLALLLNDFL

SEQ ID NO: 3300731 - protein, 19 aa, Plasmodium falciparum
YTYVSLFLFIFNNALFYLF

SEQ ID NO: 3300732 - protein, 25 aa, Plasmodium falciparum
YVFILLFLETAIIKFLFLLTCRDIN

SEQ ID NO: 3300733 - protein, 21 aa, Plasmodium falciparum
YVHFFLIFFIITVFTSLFYYR

SEQ ID NO: 3300734 - protein, 19 aa, Plasmodium falciparum
YVHRDIWIYLILKALKKKN

SEQ ID NO: 3300735 - protein, 18 aa, Plasmodium falciparum
YVIIYILLIIIKLNHGNS

SEQ ID NO: 3300736 - protein, 23 aa, Plasmodium falciparum
YVNWILFLFILSIIVFITYFFFK

SEQ ID NO: 3300737 - protein, 18 aa, Plasmodium falciparum
YVQLFIIYLFIWTENKYN

SEQ ID NO: 3300738 - protein, 17 aa, Plasmodium falciparum
YVYLLYKMKIIISIYIN

SEQ ID NO: 3300739 - protein, 23 aa, Plasmodium falciparum
YWNIFELNLFFFLVGIPKEILEI

SEQ ID NO: 3300740 - protein, 22 aa, Plasmodium falciparum
YYGLYYIVFLTLILITFAILEI

SEQ ID NO: 3300741 - protein, 19 aa, Plasmodium falciparum
YYHKIFILFLLYICNMYFQ

SEQ ID NO: 3300742 - protein, 24 aa, Plasmodium falciparum
YYILPYLILYFLLNTLYNLIAWIY

SEQ ID NO: 3300743 - protein, 19 aa, Plasmodium falciparum
YYLTVFFLDLLYIIKMEDQ

SEQ ID NO: 3300744 - protein, 19 aa, Plasmodium falciparum
YYNFLFLYILINKLHFYIN

SEQ ID NO: 3300745 - protein, 27 aa, Plasmodium falciparum
YYSWLLFYFIILFFYNIIFTLVVYFYV

SEQ ID NO: 3300746 - protein, 25 aa, Plasmodium falciparum
YYYSYFYALPLYSLFFYFSKQKILS

SEQ ID NO: 3300747 - protein, 17 aa, Plasmodium falciparum
YYYTFQQYFYLYKFLED

SEQ ID NO: 3300748 - protein, 4 aa, Plasmodium falciparum
NNNN

SEQ ID NO: 3300749 - protein, 5 aa, Plasmodium falciparum
TVRRS

SEQ ID NO: 3300750 - protein, 5 aa, Plasmodium falciparum
CVNTN

SEQ ID NO: 3300751 - protein, 9 aa, Plasmodium falciparum
NNDDSNNTI

SEQ ID NO: 3300752 - protein, 6 aa, Plasmodium falciparum
NNMVDD

SEQ ID NO: 3300753 - protein, 5 aa, Plasmodium falciparum
NNNNN

SEQ ID NO: 3300754 - protein, 9 aa, Plasmodium falciparum
NNTNNNDKH

SEQ ID NO: 3300755 - protein, 7 aa, Plasmodium falciparum
QNAEGDT

SEQ ID NO: 3300756 - protein, 10 aa, Plasmodium falciparum
RNKKKEDDLD

SEQ ID NO: 3300757 - protein, 7 aa, Plasmodium falciparum
ANSGINK

SEQ ID NO: 3300758 - protein, 5 aa, Plasmodium falciparum
NIREE

SEQ ID NO: 3300759 - protein, 9 aa, Plasmodium falciparum
NNNNNNNNN

SEQ ID NO: 3300760 - protein, 6 aa, Plasmodium falciparum
YSSPDY

SEQ ID NO: 3300761 - protein, 4 aa, Plasmodium falciparum
NNNM

SEQ ID NO: 3300762 - protein, 8 aa, Plasmodium falciparum
NNNNNNNN

SEQ ID NO: 3300763 - protein, 4 aa, Plasmodium falciparum
ENNN

SEQ ID NO: 3300764 - protein, 5 aa, Plasmodium falciparum
EPNDD

SEQ ID NO: 3300765 - protein, 7 aa, Plasmodium falciparum
EPSDTIE

SEQ ID NO: 3300766 - protein, 8 aa, Plasmodium falciparum
GPPGTGKT

SEQ ID NO: 3300767 - protein, 12 aa, Plasmodium falciparum
KIQDKEGIPPDQ

SEQ ID NO: 3300768 - protein, 11 aa, Plasmodium falciparum
KKKKLDEENEL

SEQ ID NO: 3300769 - protein, 7 aa, Plasmodium falciparum
LEDGRTL

SEQ ID NO: 3300770 - protein, 9 aa, Plasmodium falciparum
LKEEERIRE

SEQ ID NO: 3300771 - protein, 4 aa, Plasmodium falciparum
NINN

SEQ ID NO: 3300772 - protein, 8 aa, Plasmodium falciparum
NKNKEEEN

SEQ ID NO: 3300773 - protein, 4 aa, Plasmodium falciparum
NNNI

SEQ ID NO: 3300774 - protein, 7 aa, Plasmodium falciparum
NNNNNNN

SEQ ID NO: 3300775 - protein, 4 aa, Plasmodium falciparum
NNNY

SEQ ID NO: 3300776 - protein, 6 aa, Plasmodium falciparum
EEIKEE

SEQ ID NO: 3300777 - protein, 9 aa, Plasmodium falciparum
GDKNEDDDL

SEQ ID NO: 3300778 - protein, 20 aa, Plasmodium falciparum
IKNKDEEITKEEIKKEDKDI

SEQ ID NO: 3300779 - protein, 4 aa, Plasmodium falciparum
KNNN

SEQ ID NO: 3300780 - protein, 11 aa, Plasmodium falciparum
KSDKINDYDNI

SEQ ID NO: 3300781 - protein, 17 aa, Plasmodium falciparum
LSEETQEKSHTKKKKSS

SEQ ID NO: 3300782 - protein, 8 aa, Plasmodium falciparum
NKENEKYD

SEQ ID NO: 3300783 - protein, 6 aa, Plasmodium falciparum
NNIYDE

SEQ ID NO: 3300784 - protein, 6 aa, Plasmodium falciparum
NNNNNN

SEQ ID NO: 3300785 - protein, 4 aa, Plasmodium falciparum
NNNV

SEQ ID NO: 3300786 - protein, 4 aa, Plasmodium falciparum
QEEK

SEQ ID NO: 3300787 - protein, 4 aa, Plasmodium falciparum
SENI

SEQ ID NO: 3300788 - protein, 8 aa, Plasmodium falciparum
SPKKDKHC

SEQ ID NO: 3300789 - protein, 7 aa, Plasmodium falciparum
VNMSGEK

SEQ ID NO: 3300790 - protein, 4 aa, Plasmodium falciparum
DEEE

SEQ ID NO: 3300791 - protein, 5 aa, Plasmodium falciparum
DENKT

SEQ ID NO: 3300792 - protein, 5 aa, Plasmodium falciparum
DENNT

SEQ ID NO: 3300793 - protein, 4 aa, Plasmodium falciparum
DNEE

SEQ ID NO: 3300794 - protein, 7 aa, Plasmodium falciparum
DNHSDNH

SEQ ID NO: 3300795 - protein, 4 aa, Plasmodium falciparum
DNNI

SEQ ID NO: 3300796 - protein, 6 aa, Plasmodium falciparum
EKEKED

SEQ ID NO: 3300797 - protein, 8 aa, Plasmodium falciparum
EKKPEKTI

SEQ ID NO: 3300798 - protein, 4 aa, Plasmodium falciparum
ENNI

SEQ ID NO: 3300799 - protein, 7 aa, Plasmodium falciparum
ERKPEKT

SEQ ID NO: 3300800 - protein, 6 aa, Plasmodium falciparum
HNNNND

SEQ ID NO: 3300801 - protein, 4 aa, Plasmodium falciparum
INNN

SEQ ID NO: 3300802 - protein, 4 aa, Plasmodium falciparum
IRTY

SEQ ID NO: 3300803 - protein, 4 aa, Plasmodium falciparum
KKEE

SEQ ID NO: 3300804 - protein, 5 aa, Plasmodium falciparum
KKNEN

SEQ ID NO: 3300805 - protein, 10 aa, Plasmodium falciparum
KKYDHGDGHH

SEQ ID NO: 3300806 - protein, 4 aa, Plasmodium falciparum
KKYN

SEQ ID NO: 3300807 - protein, 4 aa, Plasmodium falciparum
KNEK

SEQ ID NO: 3300808 - protein, 9 aa, Plasmodium falciparum
KSKETLDNK

SEQ ID NO: 3300809 - protein, 4 aa, Plasmodium falciparum
NEEE

SEQ ID NO: 3300810 - protein, 4 aa, Plasmodium falciparum
NEEY

SEQ ID NO: 3300811 - protein, 5 aa, Plasmodium falciparum
NINVD

SEQ ID NO: 3300812 - protein, 7 aa, Plasmodium falciparum
NKMYDDT

SEQ ID NO: 3300813 - protein, 4 aa, Plasmodium falciparum
NKNI

SEQ ID NO: 3300814 - protein, 4 aa, Plasmodium falciparum
NNIN

SEQ ID NO: 3300815 - protein, 4 aa, Plasmodium falciparum
NNMN

SEQ ID NO: 3300816 - protein, 4 aa, Plasmodium falciparum
NNNL

SEQ ID NO: 3300817 - protein, 7 aa, Plasmodium falciparum
NNNNNNI

SEQ ID NO: 3300818 - protein, 7 aa, Plasmodium falciparum
NNNQHGD

SEQ ID NO: 3300819 - protein, 4 aa, Plasmodium falciparum
NNNT

SEQ ID NO: 3300820 - protein, 4 aa, Plasmodium falciparum
YDKN

SEQ ID NO: 3300821 - protein, 5 aa, Plasmodium falciparum
YSSPD

SEQ ID NO: 3300822 - protein, 5 aa, Plasmodium falciparum
AGKTT

SEQ ID NO: 3300823 - protein, 10 aa, Plasmodium falciparum
CEKSNADARA

SEQ ID NO: 3300824 - protein, 13 aa, Plasmodium falciparum
CEKSNADARASEK

SEQ ID NO: 3300825 - protein, 10 aa, Plasmodium falciparum
DDKKDPPNLL

SEQ ID NO: 3300826 - protein, 8 aa, Plasmodium falciparum
DDTICNNN

SEQ ID NO: 3300827 - protein, 4 aa, Plasmodium falciparum
DEIN

SEQ ID NO: 3300828 - protein, 4 aa, Plasmodium falciparum
DENN

SEQ ID NO: 3300829 - protein, 7 aa, Plasmodium falciparum
DININND

SEQ ID NO: 3300830 - protein, 4 aa, Plasmodium falciparum
DKNV

SEQ ID NO: 3300831 - protein, 5 aa, Plasmodium falciparum
DVPSK

SEQ ID NO: 3300832 - protein, 4 aa, Plasmodium falciparum
EDEL

SEQ ID NO: 3300833 - protein, 33 aa, Plasmodium falciparum
EEEEKSDDKRDDKKNDNTREKNNLDNKKSFPSN

SEQ ID NO: 3300834 - protein, 4 aa, Plasmodium falciparum
EEEY

SEQ ID NO: 3300835 - protein, 4 aa, Plasmodium falciparum
EEKN

SEQ ID NO: 3300836 - protein, 4 aa, Plasmodium falciparum
EKEE

SEQ ID NO: 3300837 - protein, 8 aa, Plasmodium falciparum
EKNGDCDN

SEQ ID NO: 3300838 - protein, 5 aa, Plasmodium falciparum
ENINN

SEQ ID NO: 3300839 - protein, 9 aa, Plasmodium falciparum
ESEKEENEK

SEQ ID NO: 3300840 - protein, 4 aa, Plasmodium falciparum
ESKK

SEQ ID NO: 3300841 - protein, 8 aa, Plasmodium falciparum
ESTRSKHP

SEQ ID NO: 3300842 - protein, 9 aa, Plasmodium falciparum
GKNLTGTAR

SEQ ID NO: 3300843 - protein, 7 aa, Plasmodium falciparum
GPPGTGK

SEQ ID NO: 3300844 - protein, 4 aa, Plasmodium falciparum
GSTN

SEQ ID NO: 3300845 - protein, 13 aa, Plasmodium falciparum
HHNDQNDHTQQNE

SEQ ID NO: 3300846 - protein, 16 aa, Plasmodium falciparum
IDTQNGTTKSTGNNSV

SEQ ID NO: 3300847 - protein, 9 aa, Plasmodium falciparum
IKKSDGIKN

SEQ ID NO: 3300848 - protein, 7 aa, Plasmodium falciparum
INKDDNL

SEQ ID NO: 3300849 - protein, 4 aa, Plasmodium falciparum
ITND

SEQ ID NO: 3300850 - protein, 4 aa, Plasmodium falciparum
ITNK

SEQ ID NO: 3300851 - protein, 8 aa, Plasmodium falciparum
KDGKSIDE

SEQ ID NO: 3300852 - protein, 4 aa, Plasmodium falciparum
KDNY

SEQ ID NO: 3300853 - protein, 4 aa, Plasmodium falciparum
KEEI

SEQ ID NO: 3300854 - protein, 4 aa, Plasmodium falciparum
KEEK

SEQ ID NO: 3300855 - protein, 6 aa, Plasmodium falciparum
KEENNL

SEQ ID NO: 3300856 - protein, 8 aa, Plasmodium falciparum
KEKKNEMN

SEQ ID NO: 3300857 - protein, 4 aa, Plasmodium falciparum
KEND

SEQ ID NO: 3300858 - protein, 4 aa, Plasmodium falciparum
KENN

SEQ ID NO: 3300859 - protein, 4 aa, Plasmodium falciparum
KGSK

SEQ ID NO: 3300860 - protein, 4 aa, Plasmodium falciparum
KKEN

SEQ ID NO: 3300861 - protein, 4 aa, Plasmodium falciparum
KKKE

SEQ ID NO: 3300862 - protein, 8 aa, Plasmodium falciparum
KKLGSGSF

SEQ ID NO: 3300863 - protein, 4 aa, Plasmodium falciparum
KKTS

SEQ ID NO: 3300864 - protein, 4 aa, Plasmodium falciparum
KNDV

SEQ ID NO: 3300865 - protein, 5 aa, Plasmodium falciparum
KNINN

SEQ ID NO: 3300866 - protein, 4 aa, Plasmodium falciparum
KNKK

SEQ ID NO: 3300867 - protein, 5 aa, Plasmodium falciparum
KNNNI

SEQ ID NO: 3300868 - protein, 6 aa, Plasmodium falciparum
KQSGEK

SEQ ID NO: 3300869 - protein, 4 aa, Plasmodium falciparum
KSSI

SEQ ID NO: 3300870 - protein, 4 aa, Plasmodium falciparum
KTKN

SEQ ID NO: 3300871 - protein, 7 aa, Plasmodium falciparum
KTNPLTS

SEQ ID NO: 3300872 - protein, 4 aa, Plasmodium falciparum
KTNT

SEQ ID NO: 3300873 - protein, 4 aa, Plasmodium falciparum
LNEE

SEQ ID NO: 3300874 - protein, 4 aa, Plasmodium falciparum
LNEQ

SEQ ID NO: 3300875 - protein, 4 aa, Plasmodium falciparum
NDEN

SEQ ID NO: 3300876 - protein, 7 aa, Plasmodium falciparum
NDLRTND

SEQ ID NO: 3300877 - protein, 4 aa, Plasmodium falciparum
NDNN

SEQ ID NO: 3300878 - protein, 4 aa, Plasmodium falciparum
NEDN

SEQ ID NO: 3300879 - protein, 4 aa, Plasmodium falciparum
NEEN

SEQ ID NO: 3300880 - protein, 5 aa, Plasmodium falciparum
NEKED

SEQ ID NO: 3300881 - protein, 8 aa, Plasmodium falciparum
NEKNESNH

SEQ ID NO: 3300882 - protein, 5 aa, Plasmodium falciparum
NENKN

SEQ ID NO: 3300883 - protein, 4 aa, Plasmodium falciparum
NKEK

SEQ ID NO: 3300884 - protein, 4 aa, Plasmodium falciparum
NKKK

SEQ ID NO: 3300885 - protein, 4 aa, Plasmodium falciparum
NKLK

SEQ ID NO: 3300886 - protein, 4 aa, Plasmodium falciparum
NKSI

SEQ ID NO: 3300887 - protein, 9 aa, Plasmodium falciparum
NMNNTNNMN

SEQ ID NO: 3300888 - protein, 10 aa, Plasmodium falciparum
NNDDNNNDTI

SEQ ID NO: 3300889 - protein, 9 aa, Plasmodium falciparum
NNDDTKNNI

SEQ ID NO: 3300890 - protein, 4 aa, Plasmodium falciparum
NNDI

SEQ ID NO: 3300891 - protein, 25 aa, Plasmodium falciparum
NNDTKKENCESCKKEKTETQEESLN

SEQ ID NO: 3300892 - protein, 4 aa, Plasmodium falciparum
NNKM

SEQ ID NO: 3300893 - protein, 4 aa, Plasmodium falciparum
NNKN

SEQ ID NO: 3300894 - protein, 8 aa, Plasmodium falciparum
NNKQHGDI

SEQ ID NO: 3300895 - protein, 5 aa, Plasmodium falciparum
NNLGN

SEQ ID NO: 3300896 - protein, 8 aa, Plasmodium falciparum
NNNDGDTM

SEQ ID NO: 3300897 - protein, 5 aa, Plasmodium falciparum
NNNNI

SEQ ID NO: 3300898 - protein, 6 aa, Plasmodium falciparum
NNNNNI

SEQ ID NO: 3300899 - protein, 10 aa, Plasmodium falciparum
NNNNNNNNNN

SEQ ID NO: 3300900 - protein, 8 aa, Plasmodium falciparum
NNNNNNSI

SEQ ID NO: 3300901 - protein, 5 aa, Plasmodium falciparum
NNNNY

SEQ ID NO: 3300902 - protein, 7 aa, Plasmodium falciparum
NNSPEKQ

SEQ ID NO: 3300903 - protein, 4 aa, Plasmodium falciparum
NSKL

SEQ ID NO: 3300904 - protein, 4 aa, Plasmodium falciparum
NSNI

SEQ ID NO: 3300905 - protein, 5 aa, Plasmodium falciparum
NTEKA

SEQ ID NO: 3300906 - protein, 6 aa, Plasmodium falciparum
NTEYNN

SEQ ID NO: 3300907 - protein, 4 aa, Plasmodium falciparum
NTYN

SEQ ID NO: 3300908 - protein, 5 aa, Plasmodium falciparum
PPGCG

SEQ ID NO: 3300909 - protein, 12 aa, Plasmodium falciparum
QCEKSNADARSC

SEQ ID NO: 3300910 - protein, 4 aa, Plasmodium falciparum
QNIS

SEQ ID NO: 3300911 - protein, 7 aa, Plasmodium falciparum
QSRRDDI

SEQ ID NO: 3300912 - protein, 7 aa, Plasmodium falciparum
QSSKIES

SEQ ID NO: 3300913 - protein, 4 aa, Plasmodium falciparum
RKEK

SEQ ID NO: 3300914 - protein, 6 aa, Plasmodium falciparum
RKPEKT

SEQ ID NO: 3300915 - protein, 10 aa, Plasmodium falciparum
RNKKKEDDVN

SEQ ID NO: 3300916 - protein, 10 aa, Plasmodium falciparum
SEKDKKKMLE

SEQ ID NO: 3300917 - protein, 8 aa, Plasmodium falciparum
SKKDKYDK

SEQ ID NO: 3300918 - protein, 4 aa, Plasmodium falciparum
SLEN

SEQ ID NO: 3300919 - protein, 4 aa, Plasmodium falciparum
SNNN

SEQ ID NO: 3300920 - protein, 6 aa, Plasmodium falciparum
SNNNNN

SEQ ID NO: 3300921 - protein, 4 aa, Plasmodium falciparum
SPNI

SEQ ID NO: 3300922 - protein, 4 aa, Plasmodium falciparum
SSSS

SEQ ID NO: 3300923 - protein, 9 aa, Plasmodium falciparum
TDDDVDDNK

SEQ ID NO: 3300924 - protein, 4 aa, Plasmodium falciparum
TENG

SEQ ID NO: 3300925 - protein, 4 aa, Plasmodium falciparum
TGDI

SEQ ID NO: 3300926 - protein, 6 aa, Plasmodium falciparum
TLTPSE

SEQ ID NO: 3300927 - protein, 4 aa, Plasmodium falciparum
TNEN

SEQ ID NO: 3300928 - protein, 4 aa, Plasmodium falciparum
TNNN

SEQ ID NO: 3300929 - protein, 4 aa, Plasmodium falciparum
YPSK

SEQ ID NO: 3300930 - protein, 7 aa, Plasmodium falciparum
YRDSRSH

SEQ ID NO: 3300931 - protein, 11 aa, Plasmodium falciparum
ADRDGDGEINE

SEQ ID NO: 3300932 - protein, 6 aa, Plasmodium falciparum
AERERG

SEQ ID NO: 3300933 - protein, 6 aa, Plasmodium falciparum
AGQERY

SEQ ID NO: 3300934 - protein, 4 aa, Plasmodium falciparum
AKNE

SEQ ID NO: 3300935 - protein, 4 aa, Plasmodium falciparum
ANNP

SEQ ID NO: 3300936 - protein, 4 aa, Plasmodium falciparum
APNI

SEQ ID NO: 3300937 - protein, 6 aa, Plasmodium falciparum
APPERK

SEQ ID NO: 3300938 - protein, 6 aa, Plasmodium falciparum
ASDDRG

SEQ ID NO: 3300939 - protein, 4 aa, Plasmodium falciparum
ASDN

SEQ ID NO: 3300940 - protein, 14 aa, Plasmodium falciparum
ASDTKNEPAKGCSK

SEQ ID NO: 3300941 - protein, 7 aa, Plasmodium falciparum
ASKNESK

SEQ ID NO: 3300942 - protein, 14 aa, Plasmodium falciparum
ATVAKKNDKTSKGY

SEQ ID NO: 3300943 - protein, 10 aa, Plasmodium falciparum
CSSKPSCNSL

SEQ ID NO: 3300944 - protein, 5 aa, Plasmodium falciparum
DANGD

SEQ ID NO: 3300945 - protein, 9 aa, Plasmodium falciparum
DDEDDEKKQ

SEQ ID NO: 3300946 - protein, 4 aa, Plasmodium falciparum
DDEQ

SEQ ID NO: 3300947 - protein, 4 aa, Plasmodium falciparum
DDIE

SEQ ID NO: 3300948 - protein, 9 aa, Plasmodium falciparum
DDIKTSDDI

SEQ ID NO: 3300949 - protein, 8 aa, Plasmodium falciparum
DDKKDPSI

SEQ ID NO: 3300950 - protein, 6 aa, Plasmodium falciparum
DDKQKH

SEQ ID NO: 3300951 - protein, 8 aa, Plasmodium falciparum
DDNNNNYN

SEQ ID NO: 3300952 - protein, 5 aa, Plasmodium falciparum
DDNSE

SEQ ID NO: 3300953 - protein, 4 aa, Plasmodium falciparum
DDTE

SEQ ID NO: 3300954 - protein, 6 aa, Plasmodium falciparum
DDTICN

SEQ ID NO: 3300955 - protein, 4 aa, Plasmodium falciparum
DEEA

SEQ ID NO: 3300956 - protein, 9 aa, Plasmodium falciparum
DEEKKYNKQ

SEQ ID NO: 3300957 - protein, 8 aa, Plasmodium falciparum
DEEYDNNN

SEQ ID NO: 3300958 - protein, 4 aa, Plasmodium falciparum
DEHN

SEQ ID NO: 3300959 - protein, 4 aa, Plasmodium falciparum
DEKG

SEQ ID NO: 3300960 - protein, 11 aa, Plasmodium falciparum
DEKKGSEGDNI

SEQ ID NO: 3300961 - protein, 4 aa, Plasmodium falciparum
DEQN

SEQ ID NO: 3300962 - protein, 4 aa, Plasmodium falciparum
DESG

SEQ ID NO: 3300963 - protein, 4 aa, Plasmodium falciparum
DESN

SEQ ID NO: 3300964 - protein, 10 aa, Plasmodium falciparum
DETKENEQDI

SEQ ID NO: 3300965 - protein, 4 aa, Plasmodium falciparum
DEYD

SEQ ID NO: 3300966 - protein, 4 aa, Plasmodium falciparum
DGNE

SEQ ID NO: 3300967 - protein, 4 aa, Plasmodium falciparum
DGRL

SEQ ID NO: 3300968 - protein, 7 aa, Plasmodium falciparum
DHIQTDE

SEQ ID NO: 3300969 - protein, 8 aa, Plasmodium falciparum
DHIQTDEI

SEQ ID NO: 3300970 - protein, 17 aa, Plasmodium falciparum
DHNNKDQLGSNSTLSDE

SEQ ID NO: 3300971 - protein, 4 aa, Plasmodium falciparum
DHSD

SEQ ID NO: 3300972 - protein, 7 aa, Plasmodium falciparum
DHSNNHE

SEQ ID NO: 3300973 - protein, 19 aa, Plasmodium falciparum
DHSSSNKNRKKNNPNNAYH

SEQ ID NO: 3300974 - protein, 4 aa, Plasmodium falciparum
DKEL

SEQ ID NO: 3300975 - protein, 4 aa, Plasmodium falciparum
DKGV

SEQ ID NO: 3300976 - protein, 9 aa, Plasmodium falciparum
DKKDPPNLL

SEQ ID NO: 3300977 - protein, 5 aa, Plasmodium falciparum
DKNPF

SEQ ID NO: 3300978 - protein, 8 aa, Plasmodium falciparum
DKPLGTDF

SEQ ID NO: 3300979 - protein, 4 aa, Plasmodium falciparum
DLEN

SEQ ID NO: 3300980 - protein, 4 aa, Plasmodium falciparum
DLPK

SEQ ID NO: 3300981 - protein, 4 aa, Plasmodium falciparum
DNEF

SEQ ID NO: 3300982 - protein, 4 aa, Plasmodium falciparum
DNIN

SEQ ID NO: 3300983 - protein, 45 aa, Plasmodium falciparum
DNINNNTNSNTNNNTNSNTNNNTNNNTNSNTNNNNNNNNNNIQAN

SEQ ID NO: 3300984 - protein, 9 aa, Plasmodium falciparum
DNKMDQGHD

SEQ ID NO: 3300985 - protein, 4 aa, Plasmodium falciparum
DNLK

SEQ ID NO: 3300986 - protein, 4 aa, Plasmodium falciparum
DNNG

SEQ ID NO: 3300987 - protein, 10 aa, Plasmodium falciparum
DNNNNNNNKL

SEQ ID NO: 3300988 - protein, 10 aa, Plasmodium falciparum
DNNSNMEEEQ

SEQ ID NO: 3300989 - protein, 4 aa, Plasmodium falciparum
DNNT

SEQ ID NO: 3300990 - protein, 5 aa, Plasmodium falciparum
DNQPG

SEQ ID NO: 3300991 - protein, 4 aa, Plasmodium falciparum
DNSY

SEQ ID NO: 3300992 - protein, 14 aa, Plasmodium falciparum
DPEDQEKNNNEIDE

SEQ ID NO: 3300993 - protein, 13 aa, Plasmodium falciparum
DPNEMNKDESIPS

SEQ ID NO: 3300994 - protein, 5 aa, Plasmodium falciparum
DPRHG

SEQ ID NO: 3300995 - protein, 20 aa, Plasmodium falciparum
DPSDFQKEQKKSDNNNLSND

SEQ ID NO: 3300996 - protein, 9 aa, Plasmodium falciparum
DQGNRTTPS

SEQ ID NO: 3300997 - protein, 9 aa, Plasmodium falciparum
DSGKSTTTG

SEQ ID NO: 3300998 - protein, 11 aa, Plasmodium falciparum
DSIAKDSLNND

SEQ ID NO: 3300999 - protein, 4 aa, Plasmodium falciparum
DSKI

SEQ ID NO: 3301000 - protein, 5 aa, Plasmodium falciparum
DSMDG

SEQ ID NO: 3301001 - protein, 13 aa, Plasmodium falciparum
DSTYSNQNNLEKK

SEQ ID NO: 3301002 - protein, 7 aa, Plasmodium falciparum
DTEASQK

SEQ ID NO: 3301003 - protein, 9 aa, Plasmodium falciparum
DTEQTNEHT

SEQ ID NO: 3301004 - protein, 11 aa, Plasmodium falciparum
DTHNKGGDDNF

SEQ ID NO: 3301005 - protein, 7 aa, Plasmodium falciparum
DTICNNN

SEQ ID NO: 3301006 - protein, 4 aa, Plasmodium falciparum
DTIT

SEQ ID NO: 3301007 - protein, 4 aa, Plasmodium falciparum
DTLE

SEQ ID NO: 3301008 - protein, 4 aa, Plasmodium falciparum
DTSV

SEQ ID NO: 3301009 - protein, 4 aa, Plasmodium falciparum
DTYE

SEQ ID NO: 3301010 - protein, 10 aa, Plasmodium falciparum
DVDDDDEDVD

SEQ ID NO: 3301011 - protein, 19 aa, Plasmodium falciparum
DVRSYQNSYPYETQNEKGA

SEQ ID NO: 3301012 - protein, 10 aa, Plasmodium falciparum
EAQNTSGGIY

SEQ ID NO: 3301013 - protein, 8 aa, Plasmodium falciparum
EARPGDNI

SEQ ID NO: 3301014 - protein, 4 aa, Plasmodium falciparum
ECPS

SEQ ID NO: 3301015 - protein, 4 aa, Plasmodium falciparum
EDEK

SEQ ID NO: 3301016 - protein, 4 aa, Plasmodium falciparum
EDIH

SEQ ID NO: 3301017 - protein, 4 aa, Plasmodium falciparum
EDNK

SEQ ID NO: 3301018 - protein, 4 aa, Plasmodium falciparum
EDTH

SEQ ID NO: 3301019 - protein, 9 aa, Plasmodium falciparum
EDTVNSNED

SEQ ID NO: 3301020 - protein, 21 aa, Plasmodium falciparum
EEAKKEKRKKEQEEEEEKKKK

SEQ ID NO: 3301021 - protein, 6 aa, Plasmodium falciparum
EEANPV

SEQ ID NO: 3301022 - protein, 8 aa, Plasmodium falciparum
EEDNNPTD

SEQ ID NO: 3301023 - protein, 4 aa, Plasmodium falciparum
EEDQ

SEQ ID NO: 3301024 - protein, 5 aa, Plasmodium falciparum
EEDVK

SEQ ID NO: 3301025 - protein, 6 aa, Plasmodium falciparum
EEEIKN

SEQ ID NO: 3301026 - protein, 4 aa, Plasmodium falciparum
EEEK

SEQ ID NO: 3301027 - protein, 4 aa, Plasmodium falciparum
EEGI

SEQ ID NO: 3301028 - protein, 10 aa, Plasmodium falciparum
EEIKEEVKEE

SEQ ID NO: 3301029 - protein, 4 aa, Plasmodium falciparum
EEIP

SEQ ID NO: 3301030 - protein, 5 aa, Plasmodium falciparum
EEKEE

SEQ ID NO: 3301031 - protein, 7 aa, Plasmodium falciparum
EEKEPRH

SEQ ID NO: 3301032 - protein, 6 aa, Plasmodium falciparum
EEKERE

SEQ ID NO: 3301033 - protein, 5 aa, Plasmodium falciparum
EEKNK

SEQ ID NO: 3301034 - protein, 10 aa, Plasmodium falciparum
EELKKDTCKD

SEQ ID NO: 3301035 - protein, 5 aa, Plasmodium falciparum
EEMNN

SEQ ID NO: 3301036 - protein, 4 aa, Plasmodium falciparum
EENE

SEQ ID NO: 3301037 - protein, 4 aa, Plasmodium falciparum
EENK

SEQ ID NO: 3301038 - protein, 7 aa, Plasmodium falciparum
EENKMDS

SEQ ID NO: 3301039 - protein, 4 aa, Plasmodium falciparum
EENL

SEQ ID NO: 3301040 - protein, 4 aa, Plasmodium falciparum
EEQD

SEQ ID NO: 3301041 - protein, 4 aa, Plasmodium falciparum
EEQK

SEQ ID NO: 3301042 - protein, 4 aa, Plasmodium falciparum
EERE

SEQ ID NO: 3301043 - protein, 4 aa, Plasmodium falciparum
EERK

SEQ ID NO: 3301044 - protein, 5 aa, Plasmodium falciparum
EERTE

SEQ ID NO: 3301045 - protein, 5 aa, Plasmodium falciparum
EETNN

SEQ ID NO: 3301046 - protein, 4 aa, Plasmodium falciparum
EEYI

SEQ ID NO: 3301047 - protein, 4 aa, Plasmodium falciparum
EEYK

SEQ ID NO: 3301048 - protein, 4 aa, Plasmodium falciparum
EEYV

SEQ ID NO: 3301049 - protein, 4 aa, Plasmodium falciparum
EGEE

SEQ ID NO: 3301050 - protein, 4 aa, Plasmodium falciparum
EGSN

SEQ ID NO: 3301051 - protein, 4 aa, Plasmodium falciparum
EHKN

SEQ ID NO: 3301052 - protein, 4 aa, Plasmodium falciparum
EHNN

SEQ ID NO: 3301053 - protein, 6 aa, Plasmodium falciparum
EIKNGY

SEQ ID NO: 3301054 - protein, 4 aa, Plasmodium falciparum
EISG

SEQ ID NO: 3301055 - protein, 5 aa, Plasmodium falciparum
EKEKE

SEQ ID NO: 3301056 - protein, 4 aa, Plasmodium falciparum
EKEN

SEQ ID NO: 3301057 - protein, 4 aa, Plasmodium falciparum
EKID

SEQ ID NO: 3301058 - protein, 15 aa, Plasmodium falciparum
EKKEPGAVTAKAPAK

SEQ ID NO: 3301059 - protein, 5 aa, Plasmodium falciparum
EKKGY

SEQ ID NO: 3301060 - protein, 4 aa, Plasmodium falciparum
EKKI

SEQ ID NO: 3301061 - protein, 5 aa, Plasmodium falciparum
EKKNE

SEQ ID NO: 3301062 - protein, 4 aa, Plasmodium falciparum
EKLP

SEQ ID NO: 3301063 - protein, 5 aa, Plasmodium falciparum
EKNDV

SEQ ID NO: 3301064 - protein, 4 aa, Plasmodium falciparum
EKNV

SEQ ID NO: 3301065 - protein, 4 aa, Plasmodium falciparum
EKNY

SEQ ID NO: 3301066 - protein, 5 aa, Plasmodium falciparum
EKNYM

SEQ ID NO: 3301067 - protein, 9 aa, Plasmodium falciparum
EKSDKTPWY

SEQ ID NO: 3301068 - protein, 4 aa, Plasmodium falciparum
EKTK

SEQ ID NO: 3301069 - protein, 4 aa, Plasmodium falciparum
EKTT

SEQ ID NO: 3301070 - protein, 4 aa, Plasmodium falciparum
EKYE

SEQ ID NO: 3301071 - protein, 11 aa, Plasmodium falciparum
EMSKDEKDRRI

SEQ ID NO: 3301072 - protein, 4 aa, Plasmodium falciparum
ENAT

SEQ ID NO: 3301073 - protein, 7 aa, Plasmodium falciparum
ENDDNMN

SEQ ID NO: 3301074 - protein, 8 aa, Plasmodium falciparum
ENGDPLKS

SEQ ID NO: 3301075 - protein, 4 aa, Plasmodium falciparum
ENGS

SEQ ID NO: 3301076 - protein, 4 aa, Plasmodium falciparum
ENKE

SEQ ID NO: 3301077 - protein, 4 aa, Plasmodium falciparum
ENKK

SEQ ID NO: 3301078 - protein, 8 aa, Plasmodium falciparum
ENKKNKSL

SEQ ID NO: 3301079 - protein, 6 aa, Plasmodium falciparum
ENKSSK

SEQ ID NO: 3301080 - protein, 4 aa, Plasmodium falciparum
ENNK

SEQ ID NO: 3301081 - protein, 14 aa, Plasmodium falciparum
ENNLDEIKKEEKDV

SEQ ID NO: 3301082 - protein, 5 aa, Plasmodium falciparum
ENNNL

SEQ ID NO: 3301083 - protein, 4 aa, Plasmodium falciparum
ENNT

SEQ ID NO: 3301084 - protein, 4 aa, Plasmodium falciparum
ENNY

SEQ ID NO: 3301085 - protein, 4 aa, Plasmodium falciparum
ENPN

SEQ ID NO: 3301086 - protein, 4 aa, Plasmodium falciparum
ENSP

SEQ ID NO: 3301087 - protein, 6 aa, Plasmodium falciparum
EPKKED

SEQ ID NO: 3301088 - protein, 4 aa, Plasmodium falciparum
EPSG

SEQ ID NO: 3301089 - protein, 10 aa, Plasmodium falciparum
EPVHKNDGST

SEQ ID NO: 3301090 - protein, 5 aa, Plasmodium falciparum
EQDQN

SEQ ID NO: 3301091 - protein, 4 aa, Plasmodium falciparum
EQNN

SEQ ID NO: 3301092 - protein, 4 aa, Plasmodium falciparum
EQNS

SEQ ID NO: 3301093 - protein, 17 aa, Plasmodium falciparum
ERKKNGTSLYRSDERAR

SEQ ID NO: 3301094 - protein, 4 aa, Plasmodium falciparum
ERSE

SEQ ID NO: 3301095 - protein, 22 aa, Plasmodium falciparum
ESLKESLEKSKESLSGGENDKN

SEQ ID NO: 3301096 - protein, 4 aa, Plasmodium falciparum
ESNM

SEQ ID NO: 3301097 - protein, 4 aa, Plasmodium falciparum
ESSI

SEQ ID NO: 3301098 - protein, 4 aa, Plasmodium falciparum
ESTN

SEQ ID NO: 3301099 - protein, 7 aa, Plasmodium falciparum
ETVQNKK

SEQ ID NO: 3301100 - protein, 4 aa, Plasmodium falciparum
EVEE

SEQ ID NO: 3301101 - protein, 4 aa, Plasmodium falciparum
EVQV

SEQ ID NO: 3301102 - protein, 22 aa, Plasmodium falciparum
EWENETHSGNTHPSESNKTLNT

SEQ ID NO: 3301103 - protein, 4 aa, Plasmodium falciparum
FDRK

SEQ ID NO: 3301104 - protein, 20 aa, Plasmodium falciparum
FEGESNYRSEFGPKPLPELP

SEQ ID NO: 3301105 - protein, 12 aa, Plasmodium falciparum
FEPSKEQELKKE

SEQ ID NO: 3301106 - protein, 4 aa, Plasmodium falciparum
FGES

SEQ ID NO: 3301107 - protein, 13 aa, Plasmodium falciparum
FGSPSNKDDKDKA

SEQ ID NO: 3301108 - protein, 11 aa, Plasmodium falciparum
FKDNISEKNKT

SEQ ID NO: 3301109 - protein, 12 aa, Plasmodium falciparum
FKKEDNKYKNYQ

SEQ ID NO: 3301110 - protein, 4 aa, Plasmodium falciparum
FNET

SEQ ID NO: 3301111 - protein, 10 aa, Plasmodium falciparum
FNKKEGTKKI

SEQ ID NO: 3301112 - protein, 4 aa, Plasmodium falciparum
FNTT

SEQ ID NO: 3301113 - protein, 5 aa, Plasmodium falciparum
GDDLR

SEQ ID NO: 3301114 - protein, 4 aa, Plasmodium falciparum
GEDH

SEQ ID NO: 3301115 - protein, 5 aa, Plasmodium falciparum
GEPQN

SEQ ID NO: 3301116 - protein, 7 aa, Plasmodium falciparum
GGGTGSG

SEQ ID NO: 3301117 - protein, 4 aa, Plasmodium falciparum
GGNN

SEQ ID NO: 3301118 - protein, 9 aa, Plasmodium falciparum
GHGESDGYQ

SEQ ID NO: 3301119 - protein, 10 aa, Plasmodium falciparum
GHNKNEDNIY

SEQ ID NO: 3301120 - protein, 4 aa, Plasmodium falciparum
GHNN

SEQ ID NO: 3301121 - protein, 4 aa, Plasmodium falciparum
GKNV

SEQ ID NO: 3301122 - protein, 10 aa, Plasmodium falciparum
GKSDKNLPNK

SEQ ID NO: 3301123 - protein, 4 aa, Plasmodium falciparum
GKTR

SEQ ID NO: 3301124 - protein, 4 aa, Plasmodium falciparum
GKTT

SEQ ID NO: 3301125 - protein, 10 aa, Plasmodium falciparum
GNESSNYANN

SEQ ID NO: 3301126 - protein, 4 aa, Plasmodium falciparum
GNEY

SEQ ID NO: 3301127 - protein, 4 aa, Plasmodium falciparum
GNKT

SEQ ID NO: 3301128 - protein, 7 aa, Plasmodium falciparum
GNNNINR

SEQ ID NO: 3301129 - protein, 4 aa, Plasmodium falciparum
GNPE

SEQ ID NO: 3301130 - protein, 4 aa, Plasmodium falciparum
GPDD

SEQ ID NO: 3301131 - protein, 9 aa, Plasmodium falciparum
GPNGSGKSN

SEQ ID NO: 3301132 - protein, 4 aa, Plasmodium falciparum
GQER

SEQ ID NO: 3301133 - protein, 5 aa, Plasmodium falciparum
GQNNN

SEQ ID NO: 3301134 - protein, 6 aa, Plasmodium falciparum
GSGKSN

SEQ ID NO: 3301135 - protein, 11 aa, Plasmodium falciparum
GSSPKYDESQL

SEQ ID NO: 3301136 - protein, 4 aa, Plasmodium falciparum
GSVE

SEQ ID NO: 3301137 - protein, 5 aa, Plasmodium falciparum
GTFRP

SEQ ID NO: 3301138 - protein, 4 aa, Plasmodium falciparum
GTNI

SEQ ID NO: 3301139 - protein, 5 aa, Plasmodium falciparum
GTSQA

SEQ ID NO: 3301140 - protein, 5 aa, Plasmodium falciparum
GVGKT

SEQ ID NO: 3301141 - protein, 4 aa, Plasmodium falciparum
GYQA

SEQ ID NO: 3301142 - protein, 4 aa, Plasmodium falciparum
HANP

SEQ ID NO: 3301143 - protein, 5 aa, Plasmodium falciparum
HDDNN

SEQ ID NO: 3301144 - protein, 11 aa, Plasmodium falciparum
HDPASINSTSC

SEQ ID NO: 3301145 - protein, 13 aa, Plasmodium falciparum
HDTSTVDSNNMDV

SEQ ID NO: 3301146 - protein, 11 aa, Plasmodium falciparum
HINGNNSMNDA

SEQ ID NO: 3301147 - protein, 7 aa, Plasmodium falciparum
HMNGHTN

SEQ ID NO: 3301148 - protein, 4 aa, Plasmodium falciparum
HNEK

SEQ ID NO: 3301149 - protein, 6 aa, Plasmodium falciparum
HNKRNY

SEQ ID NO: 3301150 - protein, 8 aa, Plasmodium falciparum
HNNDSNRS

SEQ ID NO: 3301151 - protein, 37 aa, Plasmodium falciparum
HNNNMNNNNNVNNNNNINNNNNINNSNNINNNNNINN

SEQ ID NO: 3301152 - protein, 7 aa, Plasmodium falciparum
HSGMNQP

SEQ ID NO: 3301153 - protein, 5 aa, Plasmodium falciparum
HSNID

SEQ ID NO: 3301154 - protein, 14 aa, Plasmodium falciparum
HSTNYDSDSSENEI

SEQ ID NO: 3301155 - protein, 21 aa, Plasmodium falciparum
IDKRSGKVVEENPKAIKSGDS

SEQ ID NO: 3301156 - protein, 4 aa, Plasmodium falciparum
IDNE

SEQ ID NO: 3301157 - protein, 4 aa, Plasmodium falciparum
IDSS

SEQ ID NO: 3301158 - protein, 4 aa, Plasmodium falciparum
IEED

SEQ ID NO: 3301159 - protein, 4 aa, Plasmodium falciparum
IEEK

SEQ ID NO: 3301160 - protein, 5 aa, Plasmodium falciparum
IKEED

SEQ ID NO: 3301161 - protein, 4 aa, Plasmodium falciparum
IKEL

SEQ ID NO: 3301162 - protein, 9 aa, Plasmodium falciparum
IKGNNKCAD

SEQ ID NO: 3301163 - protein, 6 aa, Plasmodium falciparum
IKGSGE

SEQ ID NO: 3301164 - protein, 4 aa, Plasmodium falciparum
IKGT

SEQ ID NO: 3301165 - protein, 5 aa, Plasmodium falciparum
IKPPK

SEQ ID NO: 3301166 - protein, 4 aa, Plasmodium falciparum
INEA

SEQ ID NO: 3301167 - protein, 4 aa, Plasmodium falciparum
INEK

SEQ ID NO: 3301168 - protein, 5 aa, Plasmodium falciparum
INEKK

SEQ ID NO: 3301169 - protein, 4 aa, Plasmodium falciparum
INEQ

SEQ ID NO: 3301170 - protein, 4 aa, Plasmodium falciparum
INND

SEQ ID NO: 3301171 - protein, 11 aa, Plasmodium falciparum
INNGNRNVDVG

SEQ ID NO: 3301172 - protein, 22 aa, Plasmodium falciparum
INNNINNNNNVGDNEANRKKEY

SEQ ID NO: 3301173 - protein, 10 aa, Plasmodium falciparum
INNNKNNHNM

SEQ ID NO: 3301174 - protein, 10 aa, Plasmodium falciparum
INNNNNNNLS

SEQ ID NO: 3301175 - protein, 4 aa, Plasmodium falciparum
INSD

SEQ ID NO: 3301176 - protein, 29 aa, Plasmodium falciparum
INTNKDDKNNNNNNNMSHSPNKLKEDKRF

SEQ ID NO: 3301177 - protein, 4 aa, Plasmodium falciparum
INTS

SEQ ID NO: 3301178 - protein, 4 aa, Plasmodium falciparum
IPPP

SEQ ID NO: 3301179 - protein, 6 aa, Plasmodium falciparum
IPSNTI

SEQ ID NO: 3301180 - protein, 4 aa, Plasmodium falciparum
IQND

SEQ ID NO: 3301181 - protein, 4 aa, Plasmodium falciparum
IREN

SEQ ID NO: 3301182 - protein, 4 aa, Plasmodium falciparum
IRPY

SEQ ID NO: 3301183 - protein, 21 aa, Plasmodium falciparum
ISDTSLNSNYTQKNNTSINNN

SEQ ID NO: 3301184 - protein, 16 aa, Plasmodium falciparum
ISENKKGKLNGHTNNR

SEQ ID NO: 3301185 - protein, 4 aa, Plasmodium falciparum
ISGK

SEQ ID NO: 3301186 - protein, 5 aa, Plasmodium falciparum
ISKED

SEQ ID NO: 3301187 - protein, 4 aa, Plasmodium falciparum
ISNI

SEQ ID NO: 3301188 - protein, 4 aa, Plasmodium falciparum
ISNN

SEQ ID NO: 3301189 - protein, 4 aa, Plasmodium falciparum
ISNT

SEQ ID NO: 3301190 - protein, 5 aa, Plasmodium falciparum
ISSIE

SEQ ID NO: 3301191 - protein, 6 aa, Plasmodium falciparum
ITKESR

SEQ ID NO: 3301192 - protein, 4 aa, Plasmodium falciparum
ITKN

SEQ ID NO: 3301193 - protein, 4 aa, Plasmodium falciparum
ITNE

SEQ ID NO: 3301194 - protein, 4 aa, Plasmodium falciparum
IYEK

SEQ ID NO: 3301195 - protein, 5 aa, Plasmodium falciparum
KCEES

SEQ ID NO: 3301196 - protein, 5 aa, Plasmodium falciparum
KDEEN

SEQ ID NO: 3301197 - protein, 4 aa, Plasmodium falciparum
KDEQ

SEQ ID NO: 3301198 - protein, 6 aa, Plasmodium falciparum
KDFNNN

SEQ ID NO: 3301199 - protein, 4 aa, Plasmodium falciparum
KDKI

SEQ ID NO: 3301200 - protein, 4 aa, Plasmodium falciparum
KDNI

SEQ ID NO: 3301201 - protein, 8 aa, Plasmodium falciparum
KDNTYNLN

SEQ ID NO: 3301202 - protein, 8 aa, Plasmodium falciparum
KDPDNSIY

SEQ ID NO: 3301203 - protein, 4 aa, Plasmodium falciparum
KEDI

SEQ ID NO: 3301204 - protein, 4 aa, Plasmodium falciparum
KEDV

SEQ ID NO: 3301205 - protein, 4 aa, Plasmodium falciparum
KEED

SEQ ID NO: 3301206 - protein, 4 aa, Plasmodium falciparum
KEEE

SEQ ID NO: 3301207 - protein, 5 aa, Plasmodium falciparum
KEEKN

SEQ ID NO: 3301208 - protein, 5 aa, Plasmodium falciparum
KEENK

SEQ ID NO: 3301209 - protein, 6 aa, Plasmodium falciparum
KEENPL

SEQ ID NO: 3301210 - protein, 4 aa, Plasmodium falciparum
KEEQ

SEQ ID NO: 3301211 - protein, 4 aa, Plasmodium falciparum
KEEV

SEQ ID NO: 3301212 - protein, 11 aa, Plasmodium falciparum
KEGYKNNEYST

SEQ ID NO: 3301213 - protein, 4 aa, Plasmodium falciparum
KEHS

SEQ ID NO: 3301214 - protein, 4 aa, Plasmodium falciparum
KEIE

SEQ ID NO: 3301215 - protein, 4 aa, Plasmodium falciparum
KEKA

SEQ ID NO: 3301216 - protein, 9 aa, Plasmodium falciparum
KEKESRVMN

SEQ ID NO: 3301217 - protein, 4 aa, Plasmodium falciparum
KEKH

SEQ ID NO: 3301218 - protein, 4 aa, Plasmodium falciparum
KEKI

SEQ ID NO: 3301219 - protein, 6 aa, Plasmodium falciparum
KEKKNF

SEQ ID NO: 3301220 - protein, 9 aa, Plasmodium falciparum
KEKQNISND

SEQ ID NO: 3301221 - protein, 6 aa, Plasmodium falciparum
KEKVNP

SEQ ID NO: 3301222 - protein, 4 aa, Plasmodium falciparum
KELE

SEQ ID NO: 3301223 - protein, 4 aa, Plasmodium falciparum
KELN

SEQ ID NO: 3301224 - protein, 4 aa, Plasmodium falciparum
KELR

SEQ ID NO: 3301225 - protein, 5 aa, Plasmodium falciparum
KENAF

SEQ ID NO: 3301226 - protein, 4 aa, Plasmodium falciparum
KENE

SEQ ID NO: 3301227 - protein, 6 aa, Plasmodium falciparum
KENEEI

SEQ ID NO: 3301228 - protein, 5 aa, Plasmodium falciparum
KENEI

SEQ ID NO: 3301229 - protein, 8 aa, Plasmodium falciparum
KENEQTKD

SEQ ID NO: 3301230 - protein, 4 aa, Plasmodium falciparum
KENR

SEQ ID NO: 3301231 - protein, 7 aa, Plasmodium falciparum
KEPDNTE

SEQ ID NO: 3301232 - protein, 4 aa, Plasmodium falciparum
KEQK

SEQ ID NO: 3301233 - protein, 4 aa, Plasmodium falciparum
KERI

SEQ ID NO: 3301234 - protein, 9 aa, Plasmodium falciparum
KESAEMGKG

SEQ ID NO: 3301235 - protein, 4 aa, Plasmodium falciparum
KEVE

SEQ ID NO: 3301236 - protein, 4 aa, Plasmodium falciparum
KEYE

SEQ ID NO: 3301237 - protein, 4 aa, Plasmodium falciparum
KEYY

SEQ ID NO: 3301238 - protein, 5 aa, Plasmodium falciparum
KFDPS

SEQ ID NO: 3301239 - protein, 13 aa, Plasmodium falciparum
KFKATQRTEGVST

SEQ ID NO: 3301240 - protein, 4 aa, Plasmodium falciparum
KFSN

SEQ ID NO: 3301241 - protein, 10 aa, Plasmodium falciparum
KGFGGQTKPV

SEQ ID NO: 3301242 - protein, 6 aa, Plasmodium falciparum
KGKDEQ

SEQ ID NO: 3301243 - protein, 8 aa, Plasmodium falciparum
KHNSNEKN

SEQ ID NO: 3301244 - protein, 5 aa, Plasmodium falciparum
KIEEK

SEQ ID NO: 3301245 - protein, 4 aa, Plasmodium falciparum
KIIQ

SEQ ID NO: 3301246 - protein, 6 aa, Plasmodium falciparum
KIIQND

SEQ ID NO: 3301247 - protein, 5 aa, Plasmodium falciparum
KIKDE

SEQ ID NO: 3301248 - protein, 4 aa, Plasmodium falciparum
KIKG

SEQ ID NO: 3301249 - protein, 4 aa, Plasmodium falciparum
KIND

SEQ ID NO: 3301250 - protein, 5 aa, Plasmodium falciparum
KINTN

SEQ ID NO: 3301251 - protein, 4 aa, Plasmodium falciparum
KISE

SEQ ID NO: 3301252 - protein, 5 aa, Plasmodium falciparum
KIYED

SEQ ID NO: 3301253 - protein, 7 aa, Plasmodium falciparum
KKDANIR

SEQ ID NO: 3301254 - protein, 8 aa, Plasmodium falciparum
KKDKRKNI

SEQ ID NO: 3301255 - protein, 4 aa, Plasmodium falciparum
KKED

SEQ ID NO: 3301256 - protein, 6 aa, Plasmodium falciparum
KKENDI

SEQ ID NO: 3301257 - protein, 5 aa, Plasmodium falciparum
KKGDM

SEQ ID NO: 3301258 - protein, 7 aa, Plasmodium falciparum
KKGEEQY

SEQ ID NO: 3301259 - protein, 28 aa, Plasmodium falciparum
KKHKKRNHNDNNKNKDTNIKKKQNTFED

SEQ ID NO: 3301260 - protein, 50 aa, Plasmodium falciparum
KKIDNNDNNNDDDNNNDDNNNNDDNNKEEDNNNNDDNNKEEDNNQSSISN

SEQ ID NO: 3301261 - protein, 5 aa, Plasmodium falciparum
KKILS

SEQ ID NO: 3301262 - protein, 5 aa, Plasmodium falciparum
KKINE

SEQ ID NO: 3301263 - protein, 5 aa, Plasmodium falciparum
KKKEI

SEQ ID NO: 3301264 - protein, 4 aa, Plasmodium falciparum
KKKG

SEQ ID NO: 3301265 - protein, 4 aa, Plasmodium falciparum
KKKK

SEQ ID NO: 3301266 - protein, 8 aa, Plasmodium falciparum
KKKKKKKL

SEQ ID NO: 3301267 - protein, 7 aa, Plasmodium falciparum
KKKKKKN

SEQ ID NO: 3301268 - protein, 7 aa, Plasmodium falciparum
KKKKKNY

SEQ ID NO: 3301269 - protein, 4 aa, Plasmodium falciparum
KKKR

SEQ ID NO: 3301270 - protein, 9 aa, Plasmodium falciparum
KKLKSRGSS

SEQ ID NO: 3301271 - protein, 4 aa, Plasmodium falciparum
KKND

SEQ ID NO: 3301272 - protein, 5 aa, Plasmodium falciparum
KKNEK

SEQ ID NO: 3301273 - protein, 4 aa, Plasmodium falciparum
KKNI

SEQ ID NO: 3301274 - protein, 6 aa, Plasmodium falciparum
KKNIYE

SEQ ID NO: 3301275 - protein, 6 aa, Plasmodium falciparum
KKNKDI

SEQ ID NO: 3301276 - protein, 5 aa, Plasmodium falciparum
KKNKN

SEQ ID NO: 3301277 - protein, 5 aa, Plasmodium falciparum
KKNLN

SEQ ID NO: 3301278 - protein, 4 aa, Plasmodium falciparum
KKNM

SEQ ID NO: 3301279 - protein, 6 aa, Plasmodium falciparum
KKNVHA

SEQ ID NO: 3301280 - protein, 6 aa, Plasmodium falciparum
KKQDDK

SEQ ID NO: 3301281 - protein, 4 aa, Plasmodium falciparum
KKRI

SEQ ID NO: 3301282 - protein, 6 aa, Plasmodium falciparum
KKRNIS

SEQ ID NO: 3301283 - protein, 4 aa, Plasmodium falciparum
KKVT

SEQ ID NO: 3301284 - protein, 12 aa, Plasmodium falciparum
KKYDHSDGHHHK

SEQ ID NO: 3301285 - protein, 5 aa, Plasmodium falciparum
KKYDK

SEQ ID NO: 3301286 - protein, 4 aa, Plasmodium falciparum
KKYR

SEQ ID NO: 3301287 - protein, 17 aa, Plasmodium falciparum
KLDSQQKSQSSNDNKKT

SEQ ID NO: 3301288 - protein, 8 aa, Plasmodium falciparum
KLNDEKRI

SEQ ID NO: 3301289 - protein, 5 aa, Plasmodium falciparum
KLNEP

SEQ ID NO: 3301290 - protein, 18 aa, Plasmodium falciparum
KNCEDNFKEGDNPSNISV

SEQ ID NO: 3301291 - protein, 4 aa, Plasmodium falciparum
KNDE

SEQ ID NO: 3301292 - protein, 5 aa, Plasmodium falciparum
KNDIN

SEQ ID NO: 3301293 - protein, 4 aa, Plasmodium falciparum
KNDK

SEQ ID NO: 3301294 - protein, 7 aa, Plasmodium falciparum
KNDNERL

SEQ ID NO: 3301295 - protein, 5 aa, Plasmodium falciparum
KNDNI

SEQ ID NO: 3301296 - protein, 20 aa, Plasmodium falciparum
KNDNIQTDEIKNDNIQTDEI

SEQ ID NO: 3301297 - protein, 7 aa, Plasmodium falciparum
KNDQEIA

SEQ ID NO: 3301298 - protein, 4 aa, Plasmodium falciparum
KNEE

SEQ ID NO: 3301299 - protein, 6 aa, Plasmodium falciparum
KNEKEK

SEQ ID NO: 3301300 - protein, 10 aa, Plasmodium falciparum
KNENKQNKKI

SEQ ID NO: 3301301 - protein, 9 aa, Plasmodium falciparum
KNENTNGPI

SEQ ID NO: 3301302 - protein, 4 aa, Plasmodium falciparum
KNES

SEQ ID NO: 3301303 - protein, 4 aa, Plasmodium falciparum
KNGE

SEQ ID NO: 3301304 - protein, 5 aa, Plasmodium falciparum
KNIEE

SEQ ID NO: 3301305 - protein, 4 aa, Plasmodium falciparum
KNIN

SEQ ID NO: 3301306 - protein, 4 aa, Plasmodium falciparum
KNIP

SEQ ID NO: 3301307 - protein, 4 aa, Plasmodium falciparum
KNKE

SEQ ID NO: 3301308 - protein, 8 aa, Plasmodium falciparum
KNKGKYDS

SEQ ID NO: 3301309 - protein, 15 aa, Plasmodium falciparum
KNKIPSKKSVSKNSE

SEQ ID NO: 3301310 - protein, 6 aa, Plasmodium falciparum
KNKNDI

SEQ ID NO: 3301311 - protein, 5 aa, Plasmodium falciparum
KNKNL

SEQ ID NO: 3301312 - protein, 7 aa, Plasmodium falciparum
KNNEPNM

SEQ ID NO: 3301313 - protein, 4 aa, Plasmodium falciparum
KNNF

SEQ ID NO: 3301314 - protein, 4 aa, Plasmodium falciparum
KNNI

SEQ ID NO: 3301315 - protein, 7 aa, Plasmodium falciparum
KNNNDSN

SEQ ID NO: 3301316 - protein, 5 aa, Plasmodium falciparum
KNNNN

SEQ ID NO: 3301317 - protein, 4 aa, Plasmodium falciparum
KNNP

SEQ ID NO: 3301318 - protein, 4 aa, Plasmodium falciparum
KNNS

SEQ ID NO: 3301319 - protein, 4 aa, Plasmodium falciparum
KNPE

SEQ ID NO: 3301320 - protein, 4 aa, Plasmodium falciparum
KNQA

SEQ ID NO: 3301321 - protein, 4 aa, Plasmodium falciparum
KNQI

SEQ ID NO: 3301322 - protein, 4 aa, Plasmodium falciparum
KNSE

SEQ ID NO: 3301323 - protein, 5 aa, Plasmodium falciparum
KNSIP

SEQ ID NO: 3301324 - protein, 7 aa, Plasmodium falciparum
KNTMNYD

SEQ ID NO: 3301325 - protein, 4 aa, Plasmodium falciparum
KNTS

SEQ ID NO: 3301326 - protein, 10 aa, Plasmodium falciparum
KNTSTAQIKA

SEQ ID NO: 3301327 - protein, 12 aa, Plasmodium falciparum
KNVESEYTNDSN

SEQ ID NO: 3301328 - protein, 4 aa, Plasmodium falciparum
KNVV

SEQ ID NO: 3301329 - protein, 8 aa, Plasmodium falciparum
KPHRYRPG

SEQ ID NO: 3301330 - protein, 16 aa, Plasmodium falciparum
KQIEQNNTKNQESQKN

SEQ ID NO: 3301331 - protein, 12 aa, Plasmodium falciparum
KQNDELKSQDDI

SEQ ID NO: 3301332 - protein, 18 aa, Plasmodium falciparum
KQSSIKNKNEKAYTPNEF

SEQ ID NO: 3301333 - protein, 11 aa, Plasmodium falciparum
KRETNGKSRGY

SEQ ID NO: 3301334 - protein, 53 aa, Plasmodium falciparum
KRNARSSDNERGPSRDDSKRKKRYDRVRKSTSVSNSERRRYRNSPDRSPRYRR

SEQ ID NO: 3301335 - protein, 4 aa, Plasmodium falciparum
KSDK

SEQ ID NO: 3301336 - protein, 4 aa, Plasmodium falciparum
KSID

SEQ ID NO: 3301337 - protein, 4 aa, Plasmodium falciparum
KSIN

SEQ ID NO: 3301338 - protein, 4 aa, Plasmodium falciparum
KSKE

SEQ ID NO: 3301339 - protein, 26 aa, Plasmodium falciparum
KSLPFEGETNYRSEFGPKPLPELPPR

SEQ ID NO: 3301340 - protein, 7 aa, Plasmodium falciparum
KSLRPSG

SEQ ID NO: 3301341 - protein, 6 aa, Plasmodium falciparum
KSNLSK

SEQ ID NO: 3301342 - protein, 7 aa, Plasmodium falciparum
KSPEKQI

SEQ ID NO: 3301343 - protein, 7 aa, Plasmodium falciparum
KSPNRYV

SEQ ID NO: 3301344 - protein, 5 aa, Plasmodium falciparum
KSSSS

SEQ ID NO: 3301345 - protein, 5 aa, Plasmodium falciparum
KSTNS

SEQ ID NO: 3301346 - protein, 5 aa, Plasmodium falciparum
KSTTF

SEQ ID NO: 3301347 - protein, 4 aa, Plasmodium falciparum
KTFG

SEQ ID NO: 3301348 - protein, 7 aa, Plasmodium falciparum
KTGTGKT

SEQ ID NO: 3301349 - protein, 19 aa, Plasmodium falciparum
KTKHNNANDPDENKIQAKE

SEQ ID NO: 3301350 - protein, 6 aa, Plasmodium falciparum
KTLRTS

SEQ ID NO: 3301351 - protein, 7 aa, Plasmodium falciparum
KTNKKNS

SEQ ID NO: 3301352 - protein, 4 aa, Plasmodium falciparum
KTNS

SEQ ID NO: 3301353 - protein, 7 aa, Plasmodium falciparum
KTPLSGL

SEQ ID NO: 3301354 - protein, 4 aa, Plasmodium falciparum
KTRA

SEQ ID NO: 3301355 - protein, 4 aa, Plasmodium falciparum
KTTT

SEQ ID NO: 3301356 - protein, 8 aa, Plasmodium falciparum
KVKKATEI

SEQ ID NO: 3301357 - protein, 8 aa, Plasmodium falciparum
KVQAAKKS

SEQ ID NO: 3301358 - protein, 5 aa, Plasmodium falciparum
KVSNN

SEQ ID NO: 3301359 - protein, 5 aa, Plasmodium falciparum
KYEKI

SEQ ID NO: 3301360 - protein, 4 aa, Plasmodium falciparum
KYNS

SEQ ID NO: 3301361 - protein, 4 aa, Plasmodium falciparum
KYPS

SEQ ID NO: 3301362 - protein, 4 aa, Plasmodium falciparum
KYQV

SEQ ID NO: 3301363 - protein, 4 aa, Plasmodium falciparum
LDDE

SEQ ID NO: 3301364 - protein, 6 aa, Plasmodium falciparum
LDEKTR

SEQ ID NO: 3301365 - protein, 4 aa, Plasmodium falciparum
LEES

SEQ ID NO: 3301366 - protein, 11 aa, Plasmodium falciparum
LESSEEEVDNY

SEQ ID NO: 3301367 - protein, 14 aa, Plasmodium falciparum
LETNEKGKYKKHQD

SEQ ID NO: 3301368 - protein, 8 aa, Plasmodium falciparum
LGENITDE

SEQ ID NO: 3301369 - protein, 5 aa, Plasmodium falciparum
LGPNG

SEQ ID NO: 3301370 - protein, 4 aa, Plasmodium falciparum
LKEG

SEQ ID NO: 3301371 - protein, 4 aa, Plasmodium falciparum
LKNK

SEQ ID NO: 3301372 - protein, 12 aa, Plasmodium falciparum
LKTNVKTHKENN

SEQ ID NO: 3301373 - protein, 6 aa, Plasmodium falciparum
LNKENK

SEQ ID NO: 3301374 - protein, 4 aa, Plasmodium falciparum
LNKT

SEQ ID NO: 3301375 - protein, 6 aa, Plasmodium falciparum
LNNKTS

SEQ ID NO: 3301376 - protein, 4 aa, Plasmodium falciparum
LPND

SEQ ID NO: 3301377 - protein, 4 aa, Plasmodium falciparum
LQEE

SEQ ID NO: 3301378 - protein, 4 aa, Plasmodium falciparum
LSDD

SEQ ID NO: 3301379 - protein, 5 aa, Plasmodium falciparum
LSEEE

SEQ ID NO: 3301380 - protein, 4 aa, Plasmodium falciparum
LSGL

SEQ ID NO: 3301381 - protein, 4 aa, Plasmodium falciparum
LSNE

SEQ ID NO: 3301382 - protein, 5 aa, Plasmodium falciparum
LTKNK

SEQ ID NO: 3301383 - protein, 4 aa, Plasmodium falciparum
LTNE

SEQ ID NO: 3301384 - protein, 14 aa, Plasmodium falciparum
MDNTPDRHDAYDGY

SEQ ID NO: 3301385 - protein, 11 aa, Plasmodium falciparum
MEEGEFSEARE

SEQ ID NO: 3301386 - protein, 10 aa, Plasmodium falciparum
MEPPKRPYDK

SEQ ID NO: 3301387 - protein, 7 aa, Plasmodium falciparum
MKRTGHE

SEQ ID NO: 3301388 - protein, 4 aa, Plasmodium falciparum
MNDN

SEQ ID NO: 3301389 - protein, 33 aa, Plasmodium falciparum
MNETNSNADIKDDEKKVTDENDAIDTQNKNEHN

SEQ ID NO: 3301390 - protein, 4 aa, Plasmodium falciparum
MNNS

SEQ ID NO: 3301391 - protein, 14 aa, Plasmodium falciparum
MPNNRYNSRVSTND

SEQ ID NO: 3301392 - protein, 4 aa, Plasmodium falciparum
NADN

SEQ ID NO: 3301393 - protein, 13 aa, Plasmodium falciparum
NCDNNNKNNYDNH

SEQ ID NO: 3301394 - protein, 4 aa, Plasmodium falciparum
NDDL

SEQ ID NO: 3301395 - protein, 4 aa, Plasmodium falciparum
NDEE

SEQ ID NO: 3301396 - protein, 5 aa, Plasmodium falciparum
NDEEY

SEQ ID NO: 3301397 - protein, 4 aa, Plasmodium falciparum
NDEY

SEQ ID NO: 3301398 - protein, 4 aa, Plasmodium falciparum
NDIE

SEQ ID NO: 3301399 - protein, 4 aa, Plasmodium falciparum
NDIN

SEQ ID NO: 3301400 - protein, 4 aa, Plasmodium falciparum
NDKE

SEQ ID NO: 3301401 - protein, 4 aa, Plasmodium falciparum
NDKP

SEQ ID NO: 3301402 - protein, 4 aa, Plasmodium falciparum
NDKT

SEQ ID NO: 3301403 - protein, 4 aa, Plasmodium falciparum
NDNM

SEQ ID NO: 3301404 - protein, 14 aa, Plasmodium falciparum
NDRDQEDNEKKKKN

SEQ ID NO: 3301405 - protein, 7 aa, Plasmodium falciparum
NDSNMNS

SEQ ID NO: 3301406 - protein, 4 aa, Plasmodium falciparum
NDTN

SEQ ID NO: 3301407 - protein, 4 aa, Plasmodium falciparum
NDTQ

SEQ ID NO: 3301408 - protein, 8 aa, Plasmodium falciparum
NDTYNNND

SEQ ID NO: 3301409 - protein, 5 aa, Plasmodium falciparum
NDYED

SEQ ID NO: 3301410 - protein, 4 aa, Plasmodium falciparum
NEDE

SEQ ID NO: 3301411 - protein, 4 aa, Plasmodium falciparum
NEDV

SEQ ID NO: 3301412 - protein, 4 aa, Plasmodium falciparum
NEEG

SEQ ID NO: 3301413 - protein, 4 aa, Plasmodium falciparum
NEEI

SEQ ID NO: 3301414 - protein, 9 aa, Plasmodium falciparum
NEERKEKEI

SEQ ID NO: 3301415 - protein, 4 aa, Plasmodium falciparum
NEEV

SEQ ID NO: 3301416 - protein, 11 aa, Plasmodium falciparum
NEFARNKSMNK

SEQ ID NO: 3301417 - protein, 4 aa, Plasmodium falciparum
NEGY

SEQ ID NO: 3301418 - protein, 4 aa, Plasmodium falciparum
NEHN

SEQ ID NO: 3301419 - protein, 4 aa, Plasmodium falciparum
NEKC

SEQ ID NO: 3301420 - protein, 4 aa, Plasmodium falciparum
NEKK

SEQ ID NO: 3301421 - protein, 4 aa, Plasmodium falciparum
NEKN

SEQ ID NO: 3301422 - protein, 8 aa, Plasmodium falciparum
NEKNKNEM

SEQ ID NO: 3301423 - protein, 10 aa, Plasmodium falciparum
NEKNNESNNV

SEQ ID NO: 3301424 - protein, 13 aa, Plasmodium falciparum
NEKYNNKQKESIK

SEQ ID NO: 3301425 - protein, 4 aa, Plasmodium falciparum
NELN

SEQ ID NO: 3301426 - protein, 9 aa, Plasmodium falciparum
NENPKGNDI

SEQ ID NO: 3301427 - protein, 10 aa, Plasmodium falciparum
NENSDNDSDI

SEQ ID NO: 3301428 - protein, 4 aa, Plasmodium falciparum
NENT

SEQ ID NO: 3301429 - protein, 4 aa, Plasmodium falciparum
NEPN

SEQ ID NO: 3301430 - protein, 9 aa, Plasmodium falciparum
NEQEKPEER

SEQ ID NO: 3301431 - protein, 7 aa, Plasmodium falciparum
NEQGPYM

SEQ ID NO: 3301432 - protein, 23 aa, Plasmodium falciparum
NEQNNEQLKKKKKEKEMEKKKDK

SEQ ID NO: 3301433 - protein, 4 aa, Plasmodium falciparum
NEQR

SEQ ID NO: 3301434 - protein, 4 aa, Plasmodium falciparum
NEQV

SEQ ID NO: 3301435 - protein, 7 aa, Plasmodium falciparum
NESDKIN

SEQ ID NO: 3301436 - protein, 4 aa, Plasmodium falciparum
NESF

SEQ ID NO: 3301437 - protein, 4 aa, Plasmodium falciparum
NESN

SEQ ID NO: 3301438 - protein, 4 aa, Plasmodium falciparum
NESY

SEQ ID NO: 3301439 - protein, 4 aa, Plasmodium falciparum
NETN

SEQ ID NO: 3301440 - protein, 4 aa, Plasmodium falciparum
NEYI

SEQ ID NO: 3301441 - protein, 4 aa, Plasmodium falciparum
NEYY

SEQ ID NO: 3301442 - protein, 4 aa, Plasmodium falciparum
NFNS

SEQ ID NO: 3301443 - protein, 13 aa, Plasmodium falciparum
NFPSSKNEENKTT

SEQ ID NO: 3301444 - protein, 6 aa, Plasmodium falciparum
NGNNFN

SEQ ID NO: 3301445 - protein, 8 aa, Plasmodium falciparum
NGTGRIDA

SEQ ID NO: 3301446 - protein, 5 aa, Plasmodium falciparum
NGTNI

SEQ ID NO: 3301447 - protein, 5 aa, Plasmodium falciparum
NGYRH

SEQ ID NO: 3301448 - protein, 6 aa, Plasmodium falciparum
NHESRQ

SEQ ID NO: 3301449 - protein, 23 aa, Plasmodium falciparum
NHKKNSNLKNDTEVRKKNDFDFF

SEQ ID NO: 3301450 - protein, 11 aa, Plasmodium falciparum
NHNNNHNNKKI

SEQ ID NO: 3301451 - protein, 13 aa, Plasmodium falciparum
NHSNNNNNNNNNI

SEQ ID NO: 3301452 - protein, 5 aa, Plasmodium falciparum
NIEED

SEQ ID NO: 3301453 - protein, 10 aa, Plasmodium falciparum
NIEKKEEENV

SEQ ID NO: 3301454 - protein, 4 aa, Plasmodium falciparum
NIKK

SEQ ID NO: 3301455 - protein, 5 aa, Plasmodium falciparum
NINNN

SEQ ID NO: 3301456 - protein, 6 aa, Plasmodium falciparum
NINNNN

SEQ ID NO: 3301457 - protein, 4 aa, Plasmodium falciparum
NIRK

SEQ ID NO: 3301458 - protein, 7 aa, Plasmodium falciparum
NISEEQN

SEQ ID NO: 3301459 - protein, 4 aa, Plasmodium falciparum
NKCS

SEQ ID NO: 3301460 - protein, 4 aa, Plasmodium falciparum
NKDN

SEQ ID NO: 3301461 - protein, 4 aa, Plasmodium falciparum
NKEI

SEQ ID NO: 3301462 - protein, 5 aa, Plasmodium falciparum
NKEKK

SEQ ID NO: 3301463 - protein, 4 aa, Plasmodium falciparum
NKEN

SEQ ID NO: 3301464 - protein, 8 aa, Plasmodium falciparum
NKENETYD

SEQ ID NO: 3301465 - protein, 5 aa, Plasmodium falciparum
NKENI

SEQ ID NO: 3301466 - protein, 9 aa, Plasmodium falciparum
NKERGHISN

SEQ ID NO: 3301467 - protein, 6 aa, Plasmodium falciparum
NKETYN

SEQ ID NO: 3301468 - protein, 4 aa, Plasmodium falciparum
NKGK

SEQ ID NO: 3301469 - protein, 6 aa, Plasmodium falciparum
NKGNMK

SEQ ID NO: 3301470 - protein, 5 aa, Plasmodium falciparum
NKGNS

SEQ ID NO: 3301471 - protein, 5 aa, Plasmodium falciparum
NKIKE

SEQ ID NO: 3301472 - protein, 20 aa, Plasmodium falciparum
NKINKKESEEQYDSDDDNDK

SEQ ID NO: 3301473 - protein, 5 aa, Plasmodium falciparum
NKKKK

SEQ ID NO: 3301474 - protein, 4 aa, Plasmodium falciparum
NKLY

SEQ ID NO: 3301475 - protein, 5 aa, Plasmodium falciparum
NKNAG

SEQ ID NO: 3301476 - protein, 5 aa, Plasmodium falciparum
NKNDI

SEQ ID NO: 3301477 - protein, 4 aa, Plasmodium falciparum
NKNE

SEQ ID NO: 3301478 - protein, 4 aa, Plasmodium falciparum
NKNK

SEQ ID NO: 3301479 - protein, 6 aa, Plasmodium falciparum
NKNNNI

SEQ ID NO: 3301480 - protein, 6 aa, Plasmodium falciparum
NKNTNK

SEQ ID NO: 3301481 - protein, 5 aa, Plasmodium falciparum
NKNYD

SEQ ID NO: 3301482 - protein, 4 aa, Plasmodium falciparum
NKQI

SEQ ID NO: 3301483 - protein, 7 aa, Plasmodium falciparum
NKSNKTY

SEQ ID NO: 3301484 - protein, 9 aa, Plasmodium falciparum
NKTEATNIT

SEQ ID NO: 3301485 - protein, 4 aa, Plasmodium falciparum
NKTY

SEQ ID NO: 3301486 - protein, 11 aa, Plasmodium falciparum
NKVDDTSFNNE

SEQ ID NO: 3301487 - protein, 12 aa, Plasmodium falciparum
NKYDNYLTPTFP

SEQ ID NO: 3301488 - protein, 5 aa, Plasmodium falciparum
NKYKK

SEQ ID NO: 3301489 - protein, 9 aa, Plasmodium falciparum
NLKNEKECE

SEQ ID NO: 3301490 - protein, 5 aa, Plasmodium falciparum
NLNNS

SEQ ID NO: 3301491 - protein, 4 aa, Plasmodium falciparum
NLNS

SEQ ID NO: 3301492 - protein, 4 aa, Plasmodium falciparum
NLSE

SEQ ID NO: 3301493 - protein, 14 aa, Plasmodium falciparum
NLSNESNDNTYSTT

SEQ ID NO: 3301494 - protein, 10 aa, Plasmodium falciparum
NMNDSNQKIK

SEQ ID NO: 3301495 - protein, 4 aa, Plasmodium falciparum
NMNK

SEQ ID NO: 3301496 - protein, 4 aa, Plasmodium falciparum
NMNN

SEQ ID NO: 3301497 - protein, 4 aa, Plasmodium falciparum
NNAE

SEQ ID NO: 3301498 - protein, 4 aa, Plasmodium falciparum
NNDN

SEQ ID NO: 3301499 - protein, 5 aa, Plasmodium falciparum
NNDNI

SEQ ID NO: 3301500 - protein, 34 aa, Plasmodium falciparum
NNDTKKENCESCKKEKTETQEESLNKEAAEGCST

SEQ ID NO: 3301501 - protein, 4 aa, Plasmodium falciparum
NNDV

SEQ ID NO: 3301502 - protein, 4 aa, Plasmodium falciparum
NNEA

SEQ ID NO: 3301503 - protein, 4 aa, Plasmodium falciparum
NNED

SEQ ID NO: 3301504 - protein, 4 aa, Plasmodium falciparum
NNEN

SEQ ID NO: 3301505 - protein, 5 aa, Plasmodium falciparum
NNFNN

SEQ ID NO: 3301506 - protein, 5 aa, Plasmodium falciparum
NNGCN

SEQ ID NO: 3301507 - protein, 4 aa, Plasmodium falciparum
NNGT

SEQ ID NO: 3301508 - protein, 4 aa, Plasmodium falciparum
NNHN

SEQ ID NO: 3301509 - protein, 7 aa, Plasmodium falciparum
NNHNEAN

SEQ ID NO: 3301510 - protein, 4 aa, Plasmodium falciparum
NNID

SEQ ID NO: 3301511 - protein, 4 aa, Plasmodium falciparum
NNIH

SEQ ID NO: 3301512 - protein, 4 aa, Plasmodium falciparum
NNIK

SEQ ID NO: 3301513 - protein, 4 aa, Plasmodium falciparum
NNIS

SEQ ID NO: 3301514 - protein, 5 aa, Plasmodium falciparum
NNISN

SEQ ID NO: 3301515 - protein, 6 aa, Plasmodium falciparum
NNIYDD

SEQ ID NO: 3301516 - protein, 6 aa, Plasmodium falciparum
NNKIND

SEQ ID NO: 3301517 - protein, 4 aa, Plasmodium falciparum
NNKS

SEQ ID NO: 3301518 - protein, 6 aa, Plasmodium falciparum
NNMNGN

SEQ ID NO: 3301519 - protein, 4 aa, Plasmodium falciparum
NNND

SEQ ID NO: 3301520 - protein, 8 aa, Plasmodium falciparum
NNNDADTM

SEQ ID NO: 3301521 - protein, 5 aa, Plasmodium falciparum
NNNDI

SEQ ID NO: 3301522 - protein, 4 aa, Plasmodium falciparum
NNNE

SEQ ID NO: 3301523 - protein, 7 aa, Plasmodium falciparum
NNNEDNS

SEQ ID NO: 3301524 - protein, 4 aa, Plasmodium falciparum
NNNH

SEQ ID NO: 3301525 - protein, 5 aa, Plasmodium falciparum
NNNHL

SEQ ID NO: 3301526 - protein, 6 aa, Plasmodium falciparum
NNNHLN

SEQ ID NO: 3301527 - protein, 9 aa, Plasmodium falciparum
NNNHNNDNI

SEQ ID NO: 3301528 - protein, 7 aa, Plasmodium falciparum
NNNKSDV

SEQ ID NO: 3301529 - protein, 7 aa, Plasmodium falciparum
NNNNNNM

SEQ ID NO: 3301530 - protein, 8 aa, Plasmodium falciparum
NNNNNNNI

SEQ ID NO: 3301531 - protein, 8 aa, Plasmodium falciparum
NNNNNNNK

SEQ ID NO: 3301532 - protein, 10 aa, Plasmodium falciparum
NNNNNNNNIN

SEQ ID NO: 3301533 - protein, 10 aa, Plasmodium falciparum
NNNNNNNNNM

SEQ ID NO: 3301534 - protein, 11 aa, Plasmodium falciparum
NNNNNNNNNNN

SEQ ID NO: 3301535 - protein, 12 aa, Plasmodium falciparum
NNNNNNNNNNNN

SEQ ID NO: 3301536 - protein, 17 aa, Plasmodium falciparum
NNNNNNNNNNNNNNNNN

SEQ ID NO: 3301537 - protein, 4 aa, Plasmodium falciparum
NNNS

SEQ ID NO: 3301538 - protein, 6 aa, Plasmodium falciparum
NNNSNM

SEQ ID NO: 3301539 - protein, 6 aa, Plasmodium falciparum
NNRFRR

SEQ ID NO: 3301540 - protein, 4 aa, Plasmodium falciparum
NNRN

SEQ ID NO: 3301541 - protein, 5 aa, Plasmodium falciparum
NNSSF

SEQ ID NO: 3301542 - protein, 4 aa, Plasmodium falciparum
NNST

SEQ ID NO: 3301543 - protein, 4 aa, Plasmodium falciparum
NNSV

SEQ ID NO: 3301544 - protein, 4 aa, Plasmodium falciparum
NNTD

SEQ ID NO: 3301545 - protein, 4 aa, Plasmodium falciparum
NNTN

SEQ ID NO: 3301546 - protein, 6 aa, Plasmodium falciparum
NNTNNY

SEQ ID NO: 3301547 - protein, 7 aa, Plasmodium falciparum
NNTYEKN

SEQ ID NO: 3301548 - protein, 4 aa, Plasmodium falciparum
NNYE

SEQ ID NO: 3301549 - protein, 4 aa, Plasmodium falciparum
NNYY

SEQ ID NO: 3301550 - protein, 4 aa, Plasmodium falciparum
NPTD

SEQ ID NO: 3301551 - protein, 4 aa, Plasmodium falciparum
NQIN

SEQ ID NO: 3301552 - protein, 5 aa, Plasmodium falciparum
NQKNK

SEQ ID NO: 3301553 - protein, 4 aa, Plasmodium falciparum
NQNN

SEQ ID NO: 3301554 - protein, 10 aa, Plasmodium falciparum
NQTPQNKKKY

SEQ ID NO: 3301555 - protein, 27 aa, Plasmodium falciparum
NSDSNESEHSNEKKKMLKNKKDEYNKN

SEQ ID NO: 3301556 - protein, 11 aa, Plasmodium falciparum
NSEDAENAMNK

SEQ ID NO: 3301557 - protein, 4 aa, Plasmodium falciparum
NSEK

SEQ ID NO: 3301558 - protein, 4 aa, Plasmodium falciparum
NSEN

SEQ ID NO: 3301559 - protein, 4 aa, Plasmodium falciparum
NSIN

SEQ ID NO: 3301560 - protein, 4 aa, Plasmodium falciparum
NSLK

SEQ ID NO: 3301561 - protein, 4 aa, Plasmodium falciparum
NSLN

SEQ ID NO: 3301562 - protein, 11 aa, Plasmodium falciparum
NSNNANDQNEA

SEQ ID NO: 3301563 - protein, 5 aa, Plasmodium falciparum
NSNNV

SEQ ID NO: 3301564 - protein, 4 aa, Plasmodium falciparum
NSQP

SEQ ID NO: 3301565 - protein, 4 aa, Plasmodium falciparum
NSSS

SEQ ID NO: 3301566 - protein, 4 aa, Plasmodium falciparum
NSST

SEQ ID NO: 3301567 - protein, 4 aa, Plasmodium falciparum
NSSY

SEQ ID NO: 3301568 - protein, 13 aa, Plasmodium falciparum
NSYNSPPPPPPPM

SEQ ID NO: 3301569 - protein, 4 aa, Plasmodium falciparum
NTEE

SEQ ID NO: 3301570 - protein, 5 aa, Plasmodium falciparum
NTINN

SEQ ID NO: 3301571 - protein, 5 aa, Plasmodium falciparum
NTNEE

SEQ ID NO: 3301572 - protein, 4 aa, Plasmodium falciparum
NTNK

SEQ ID NO: 3301573 - protein, 4 aa, Plasmodium falciparum
NTSK

SEQ ID NO: 3301574 - protein, 4 aa, Plasmodium falciparum
NTSL

SEQ ID NO: 3301575 - protein, 4 aa, Plasmodium falciparum
NTST

SEQ ID NO: 3301576 - protein, 8 aa, Plasmodium falciparum
NTTIPTKK

SEQ ID NO: 3301577 - protein, 4 aa, Plasmodium falciparum
NTYK

SEQ ID NO: 3301578 - protein, 9 aa, Plasmodium falciparum
NVNGNVNDN

SEQ ID NO: 3301579 - protein, 4 aa, Plasmodium falciparum
NVSN

SEQ ID NO: 3301580 - protein, 21 aa, Plasmodium falciparum
NVSNNYQSSNNISKNMPAQNI

SEQ ID NO: 3301581 - protein, 7 aa, Plasmodium falciparum
NVTERKR

SEQ ID NO: 3301582 - protein, 13 aa, Plasmodium falciparum
NYDEEKKEEFEKS

SEQ ID NO: 3301583 - protein, 5 aa, Plasmodium falciparum
NYEQN

SEQ ID NO: 3301584 - protein, 5 aa, Plasmodium falciparum
NYNEN

SEQ ID NO: 3301585 - protein, 7 aa, Plasmodium falciparum
NYPSEYY

SEQ ID NO: 3301586 - protein, 13 aa, Plasmodium falciparum
NYSDGYSKNDNGQ

SEQ ID NO: 3301587 - protein, 13 aa, Plasmodium falciparum
NYSDNKLAQSVTS

SEQ ID NO: 3301588 - protein, 4 aa, Plasmodium falciparum
NYSE

SEQ ID NO: 3301589 - protein, 9 aa, Plasmodium falciparum
PDNKKEPYQ

SEQ ID NO: 3301590 - protein, 4 aa, Plasmodium falciparum
PGIG

SEQ ID NO: 3301591 - protein, 7 aa, Plasmodium falciparum
PHNNNSS

SEQ ID NO: 3301592 - protein, 8 aa, Plasmodium falciparum
PKNGNGNR

SEQ ID NO: 3301593 - protein, 5 aa, Plasmodium falciparum
PKNTL

SEQ ID NO: 3301594 - protein, 5 aa, Plasmodium falciparum
PKPIN

SEQ ID NO: 3301595 - protein, 4 aa, Plasmodium falciparum
PLQN

SEQ ID NO: 3301596 - protein, 5 aa, Plasmodium falciparum
PNDNI

SEQ ID NO: 3301597 - protein, 4 aa, Plasmodium falciparum
PNET

SEQ ID NO: 3301598 - protein, 6 aa, Plasmodium falciparum
PNHPPQ

SEQ ID NO: 3301599 - protein, 9 aa, Plasmodium falciparum
PNLESPANV

SEQ ID NO: 3301600 - protein, 14 aa, Plasmodium falciparum
PNPRSKRNELNEEQ

SEQ ID NO: 3301601 - protein, 8 aa, Plasmodium falciparum
PPGTGKTS

SEQ ID NO: 3301602 - protein, 4 aa, Plasmodium falciparum
PPSY

SEQ ID NO: 3301603 - protein, 4 aa, Plasmodium falciparum
PSTL

SEQ ID NO: 3301604 - protein, 4 aa, Plasmodium falciparum
PTKD

SEQ ID NO: 3301605 - protein, 26 aa, Plasmodium falciparum
PYANNQKKKKKKKSKGKSFSFDEENE

SEQ ID NO: 3301606 - protein, 4 aa, Plasmodium falciparum
QEQV

SEQ ID NO: 3301607 - protein, 5 aa, Plasmodium falciparum
QHSDT

SEQ ID NO: 3301608 - protein, 5 aa, Plasmodium falciparum
QIDPD

SEQ ID NO: 3301609 - protein, 4 aa, Plasmodium falciparum
QKED

SEQ ID NO: 3301610 - protein, 5 aa, Plasmodium falciparum
QKNNK

SEQ ID NO: 3301611 - protein, 5 aa, Plasmodium falciparum
QKNNT

SEQ ID NO: 3301612 - protein, 4 aa, Plasmodium falciparum
QNGE

SEQ ID NO: 3301613 - protein, 5 aa, Plasmodium falciparum
QNNYN

SEQ ID NO: 3301614 - protein, 4 aa, Plasmodium falciparum
QNVQ

SEQ ID NO: 3301615 - protein, 9 aa, Plasmodium falciparum
QPPTVVPGG

SEQ ID NO: 3301616 - protein, 4 aa, Plasmodium falciparum
QQSA

SEQ ID NO: 3301617 - protein, 4 aa, Plasmodium falciparum
QSNN

SEQ ID NO: 3301618 - protein, 4 aa, Plasmodium falciparum
QSSH

SEQ ID NO: 3301619 - protein, 4 aa, Plasmodium falciparum
QTDE

SEQ ID NO: 3301620 - protein, 5 aa, Plasmodium falciparum
QTNQM

SEQ ID NO: 3301621 - protein, 8 aa, Plasmodium falciparum
QVQSTGES

SEQ ID NO: 3301622 - protein, 12 aa, Plasmodium falciparum
QYKKGKERLSSL

SEQ ID NO: 3301623 - protein, 5 aa, Plasmodium falciparum
QYSNK

SEQ ID NO: 3301624 - protein, 6 aa, Plasmodium falciparum
REEENV

SEQ ID NO: 3301625 - protein, 16 aa, Plasmodium falciparum
RENEKKYPSTANKQKQ

SEQ ID NO: 3301626 - protein, 15 aa, Plasmodium falciparum
RFDQTADQEGRDQRN

SEQ ID NO: 3301627 - protein, 4 aa, Plasmodium falciparum
RGEY

SEQ ID NO: 3301628 - protein, 37 aa, Plasmodium falciparum
RGNKNDKKSKNEKKPSLESVKQNADEQKEQPTDSQIS

SEQ ID NO: 3301629 - protein, 4 aa, Plasmodium falciparum
RHDP

SEQ ID NO: 3301630 - protein, 4 aa, Plasmodium falciparum
RKDI

SEQ ID NO: 3301631 - protein, 4 aa, Plasmodium falciparum
RKKK

SEQ ID NO: 3301632 - protein, 4 aa, Plasmodium falciparum
RKNE

SEQ ID NO: 3301633 - protein, 4 aa, Plasmodium falciparum
RLTE

SEQ ID NO: 3301634 - protein, 5 aa, Plasmodium falciparum
RNEKN

SEQ ID NO: 3301635 - protein, 4 aa, Plasmodium falciparum
RNEN

SEQ ID NO: 3301636 - protein, 13 aa, Plasmodium falciparum
RNEPHEPTPGEYK

SEQ ID NO: 3301637 - protein, 4 aa, Plasmodium falciparum
RNIS

SEQ ID NO: 3301638 - protein, 9 aa, Plasmodium falciparum
RNKKKEDDL

SEQ ID NO: 3301639 - protein, 9 aa, Plasmodium falciparum
RNKNKEDDM

SEQ ID NO: 3301640 - protein, 7 aa, Plasmodium falciparum
RRDAEIK

SEQ ID NO: 3301641 - protein, 5 aa, Plasmodium falciparum
RSDKM

SEQ ID NO: 3301642 - protein, 4 aa, Plasmodium falciparum
RTGT

SEQ ID NO: 3301643 - protein, 4 aa, Plasmodium falciparum
RVTE

SEQ ID NO: 3301644 - protein, 4 aa, Plasmodium falciparum
RYEE

SEQ ID NO: 3301645 - protein, 12 aa, Plasmodium falciparum
SCKTNNNSNSND

SEQ ID NO: 3301646 - protein, 8 aa, Plasmodium falciparum
SDHLSNSD

SEQ ID NO: 3301647 - protein, 4 aa, Plasmodium falciparum
SDIK

SEQ ID NO: 3301648 - protein, 6 aa, Plasmodium falciparum
SDKTEL

SEQ ID NO: 3301649 - protein, 5 aa, Plasmodium falciparum
SDMEK

SEQ ID NO: 3301650 - protein, 9 aa, Plasmodium falciparum
SDNSNKDYV

SEQ ID NO: 3301651 - protein, 4 aa, Plasmodium falciparum
SEED

SEQ ID NO: 3301652 - protein, 4 aa, Plasmodium falciparum
SEKN

SEQ ID NO: 3301653 - protein, 4 aa, Plasmodium falciparum
SEQN

SEQ ID NO: 3301654 - protein, 5 aa, Plasmodium falciparum
SEYTD

SEQ ID NO: 3301655 - protein, 5 aa, Plasmodium falciparum
SEYTI

SEQ ID NO: 3301656 - protein, 5 aa, Plasmodium falciparum
SFKTP

SEQ ID NO: 3301657 - protein, 6 aa, Plasmodium falciparum
SGDGVS

SEQ ID NO: 3301658 - protein, 4 aa, Plasmodium falciparum
SGKD

SEQ ID NO: 3301659 - protein, 10 aa, Plasmodium falciparum
SGKEDAANNF

SEQ ID NO: 3301660 - protein, 8 aa, Plasmodium falciparum
SGKEVNIN

SEQ ID NO: 3301661 - protein, 16 aa, Plasmodium falciparum
SGMTSSITNNMTSSMT

SEQ ID NO: 3301662 - protein, 6 aa, Plasmodium falciparum
SGRFGR

SEQ ID NO: 3301663 - protein, 4 aa, Plasmodium falciparum
SGSL

SEQ ID NO: 3301664 - protein, 5 aa, Plasmodium falciparum
SGSPK

SEQ ID NO: 3301665 - protein, 4 aa, Plasmodium falciparum
SGVG

SEQ ID NO: 3301666 - protein, 6 aa, Plasmodium falciparum
SGVGKS

SEQ ID NO: 3301667 - protein, 5 aa, Plasmodium falciparum
SIKEN

SEQ ID NO: 3301668 - protein, 4 aa, Plasmodium falciparum
SINN

SEQ ID NO: 3301669 - protein, 16 aa, Plasmodium falciparum
SKAKPRNEKKNETSNK

SEQ ID NO: 3301670 - protein, 8 aa, Plasmodium falciparum
SKEGQTKE

SEQ ID NO: 3301671 - protein, 4 aa, Plasmodium falciparum
SKEL

SEQ ID NO: 3301672 - protein, 5 aa, Plasmodium falciparum
SKITT

SEQ ID NO: 3301673 - protein, 4 aa, Plasmodium falciparum
SKKN

SEQ ID NO: 3301674 - protein, 5 aa, Plasmodium falciparum
SKKNI

SEQ ID NO: 3301675 - protein, 4 aa, Plasmodium falciparum
SKKV

SEQ ID NO: 3301676 - protein, 18 aa, Plasmodium falciparum
SKNEEKNVLTEKTDSVEK

SEQ ID NO: 3301677 - protein, 4 aa, Plasmodium falciparum
SKNI

SEQ ID NO: 3301678 - protein, 10 aa, Plasmodium falciparum
SLRNKSGSSL

SEQ ID NO: 3301679 - protein, 17 aa, Plasmodium falciparum
SNDDNLENHKNIDNKDN

SEQ ID NO: 3301680 - protein, 4 aa, Plasmodium falciparum
SNDL

SEQ ID NO: 3301681 - protein, 5 aa, Plasmodium falciparum
SNKKL

SEQ ID NO: 3301682 - protein, 4 aa, Plasmodium falciparum
SNLY

SEQ ID NO: 3301683 - protein, 4 aa, Plasmodium falciparum
SNMN

SEQ ID NO: 3301684 - protein, 4 aa, Plasmodium falciparum
SNNE

SEQ ID NO: 3301685 - protein, 5 aa, Plasmodium falciparum
SNNKS

SEQ ID NO: 3301686 - protein, 4 aa, Plasmodium falciparum
SNNM

SEQ ID NO: 3301687 - protein, 8 aa, Plasmodium falciparum
SNNNISSN

SEQ ID NO: 3301688 - protein, 23 aa, Plasmodium falciparum
SNNNISSNNNISSNNNNNITNSG

SEQ ID NO: 3301689 - protein, 4 aa, Plasmodium falciparum
SNNT

SEQ ID NO: 3301690 - protein, 5 aa, Plasmodium falciparum
SNRNI

SEQ ID NO: 3301691 - protein, 5 aa, Plasmodium falciparum
SNSNN

SEQ ID NO: 3301692 - protein, 4 aa, Plasmodium falciparum
SNVN

SEQ ID NO: 3301693 - protein, 4 aa, Plasmodium falciparum
SPNG

SEQ ID NO: 3301694 - protein, 4 aa, Plasmodium falciparum
SQQN

SEQ ID NO: 3301695 - protein, 4 aa, Plasmodium falciparum
SRGL

SEQ ID NO: 3301696 - protein, 4 aa, Plasmodium falciparum
SRNI

SEQ ID NO: 3301697 - protein, 5 aa, Plasmodium falciparum
SSDDS

SEQ ID NO: 3301698 - protein, 4 aa, Plasmodium falciparum
SSDN

SEQ ID NO: 3301699 - protein, 6 aa, Plasmodium falciparum
SSDSNG

SEQ ID NO: 3301700 - protein, 10 aa, Plasmodium falciparum
SSGAHKNINE

SEQ ID NO: 3301701 - protein, 5 aa, Plasmodium falciparum
SSLEN

SEQ ID NO: 3301702 - protein, 4 aa, Plasmodium falciparum
SSNE

SEQ ID NO: 3301703 - protein, 4 aa, Plasmodium falciparum
SSNK

SEQ ID NO: 3301704 - protein, 6 aa, Plasmodium falciparum
SSSESI

SEQ ID NO: 3301705 - protein, 13 aa, Plasmodium falciparum
SSSNETNKRKIKP

SEQ ID NO: 3301706 - protein, 4 aa, Plasmodium falciparum
SSTY

SEQ ID NO: 3301707 - protein, 4 aa, Plasmodium falciparum
SSYE

SEQ ID NO: 3301708 - protein, 8 aa, Plasmodium falciparum
STQDNDIT

SEQ ID NO: 3301709 - protein, 4 aa, Plasmodium falciparum
STTF

SEQ ID NO: 3301710 - protein, 10 aa, Plasmodium falciparum
SVNQTTKDPN

SEQ ID NO: 3301711 - protein, 4 aa, Plasmodium falciparum
SYEN

SEQ ID NO: 3301712 - protein, 5 aa, Plasmodium falciparum
SYNKN

SEQ ID NO: 3301713 - protein, 5 aa, Plasmodium falciparum
SYNPS

SEQ ID NO: 3301714 - protein, 6 aa, Plasmodium falciparum
SYSKNY

SEQ ID NO: 3301715 - protein, 4 aa, Plasmodium falciparum
SYSR

SEQ ID NO: 3301716 - protein, 9 aa, Plasmodium falciparum
TAKNDKKEI

SEQ ID NO: 3301717 - protein, 14 aa, Plasmodium falciparum
TDVSTNTQKGSHIS

SEQ ID NO: 3301718 - protein, 5 aa, Plasmodium falciparum
TEKEL

SEQ ID NO: 3301719 - protein, 6 aa, Plasmodium falciparum
TGAGKH

SEQ ID NO: 3301720 - protein, 6 aa, Plasmodium falciparum
TGNVYS

SEQ ID NO: 3301721 - protein, 8 aa, Plasmodium falciparum
TGRRPTGL

SEQ ID NO: 3301722 - protein, 4 aa, Plasmodium falciparum
THKI

SEQ ID NO: 3301723 - protein, 17 aa, Plasmodium falciparum
TKNKELHKKDKTTEKQE

SEQ ID NO: 3301724 - protein, 39 aa, Plasmodium falciparum
TKNSDIKNNDTKNKNKNNNNNNNNNNNNNNNNNNINNSS

SEQ ID NO: 3301725 - protein, 17 aa, Plasmodium falciparum
TKSEIKNNIGGRSNIND

SEQ ID NO: 3301726 - protein, 4 aa, Plasmodium falciparum
TKSS

SEQ ID NO: 3301727 - protein, 4 aa, Plasmodium falciparum
TKTI

SEQ ID NO: 3301728 - protein, 6 aa, Plasmodium falciparum
TLGPRG

SEQ ID NO: 3301729 - protein, 6 aa, Plasmodium falciparum
TNEEKN

SEQ ID NO: 3301730 - protein, 4 aa, Plasmodium falciparum
TNEY

SEQ ID NO: 3301731 - protein, 10 aa, Plasmodium falciparum
TNMDTNFTSN

SEQ ID NO: 3301732 - protein, 5 aa, Plasmodium falciparum
TNPSN

SEQ ID NO: 3301733 - protein, 7 aa, Plasmodium falciparum
TNSKTKI

SEQ ID NO: 3301734 - protein, 5 aa, Plasmodium falciparum
TNYTN

SEQ ID NO: 3301735 - protein, 4 aa, Plasmodium falciparum
TQPE

SEQ ID NO: 3301736 - protein, 8 aa, Plasmodium falciparum
TSGENNNI

SEQ ID NO: 3301737 - protein, 4 aa, Plasmodium falciparum
TSRE

SEQ ID NO: 3301738 - protein, 4 aa, Plasmodium falciparum
TSTL

SEQ ID NO: 3301739 - protein, 9 aa, Plasmodium falciparum
VDKDGSGTI

SEQ ID NO: 3301740 - protein, 6 aa, Plasmodium falciparum
VEEPTV

SEQ ID NO: 3301741 - protein, 4 aa, Plasmodium falciparum
VGGK

SEQ ID NO: 3301742 - protein, 4 aa, Plasmodium falciparum
VKKN

SEQ ID NO: 3301743 - protein, 4 aa, Plasmodium falciparum
VNAQ

SEQ ID NO: 3301744 - protein, 4 aa, Plasmodium falciparum
VNKD

SEQ ID NO: 3301745 - protein, 4 aa, Plasmodium falciparum
VPYD

SEQ ID NO: 3301746 - protein, 12 aa, Plasmodium falciparum
VQQDGLGLVKWW

SEQ ID NO: 3301747 - protein, 20 aa, Plasmodium falciparum
VSEYDEDQEQIGEKEKNDVP

SEQ ID NO: 3301748 - protein, 5 aa, Plasmodium falciparum
VTEEE

SEQ ID NO: 3301749 - protein, 4 aa, Plasmodium falciparum
VTND

SEQ ID NO: 3301750 - protein, 10 aa, Plasmodium falciparum
WDDNRQKGTC

SEQ ID NO: 3301751 - protein, 5 aa, Plasmodium falciparum
WSDKD

SEQ ID NO: 3301752 - protein, 4 aa, Plasmodium falciparum
YAQD

SEQ ID NO: 3301753 - protein, 4 aa, Plasmodium falciparum
YDDN

SEQ ID NO: 3301754 - protein, 11 aa, Plasmodium falciparum
YDEKRKRKKIT

SEQ ID NO: 3301755 - protein, 4 aa, Plasmodium falciparum
YDIN

SEQ ID NO: 3301756 - protein, 5 aa, Plasmodium falciparum
YDNSK

SEQ ID NO: 3301757 - protein, 20 aa, Plasmodium falciparum
YDRPYDRRRYDSRRVNPYGR

SEQ ID NO: 3301758 - protein, 16 aa, Plasmodium falciparum
YDRRPRNDYRNYDRRS

SEQ ID NO: 3301759 - protein, 15 aa, Plasmodium falciparum
YDVKSKMSDKEKEIK

SEQ ID NO: 3301760 - protein, 6 aa, Plasmodium falciparum
YEHVDG

SEQ ID NO: 3301761 - protein, 5 aa, Plasmodium falciparum
YENDE

SEQ ID NO: 3301762 - protein, 9 aa, Plasmodium falciparum
YIPKQGDSS

SEQ ID NO: 3301763 - protein, 8 aa, Plasmodium falciparum
YIPPTDSR

SEQ ID NO: 3301764 - protein, 4 aa, Plasmodium falciparum
YKNN

SEQ ID NO: 3301765 - protein, 17 aa, Plasmodium falciparum
YNDNENDKLYKNDQKIK

SEQ ID NO: 3301766 - protein, 5 aa, Plasmodium falciparum
YNDNS

SEQ ID NO: 3301767 - protein, 4 aa, Plasmodium falciparum
YNEK

SEQ ID NO: 3301768 - protein, 5 aa, Plasmodium falciparum
YNEPY

SEQ ID NO: 3301769 - protein, 4 aa, Plasmodium falciparum
YNNN

SEQ ID NO: 3301770 - protein, 6 aa, Plasmodium falciparum
YNNNNN

SEQ ID NO: 3301771 - protein, 5 aa, Plasmodium falciparum
YNNYN

SEQ ID NO: 3301772 - protein, 9 aa, Plasmodium falciparum
YSEDRYEEI

SEQ ID NO: 3301773 - protein, 4 aa, Plasmodium falciparum
YSEQ

SEQ ID NO: 3301774 - protein, 15 aa, Plasmodium falciparum
YSKKNNEKYDSYDEY

SEQ ID NO: 3301775 - protein, 4 aa, Plasmodium falciparum
YSNE

SEQ ID NO: 3301776 - protein, 4 aa, Plasmodium falciparum
YSNP

SEQ ID NO: 3301777 - protein, 6 aa, Plasmodium falciparum
YTNEEE

SEQ ID NO: 3301778 - protein, 22 aa, Plasmodium falciparum
AAAASGRTKKKKWGKGKNKEKL

SEQ ID NO: 3301779 - protein, 40 aa, Plasmodium falciparum
AAAPAGAAAVETAEAKKEDKKEEKKEEEEEEEDDLGFSLF

SEQ ID NO: 3301780 - protein, 41 aa, Plasmodium falciparum
AAAPPASTKKKTPSRKTQPSQPAREMQADEPASPSRRASLK

SEQ ID NO: 3301781 - protein, 9 aa, Plasmodium falciparum
AADEKSNFE

SEQ ID NO: 3301782 - protein, 9 aa, Plasmodium falciparum
AADKNPSEI

SEQ ID NO: 3301783 - protein, 19 aa, Plasmodium falciparum
AADNGGLDTSSGDIDPKDK

SEQ ID NO: 3301784 - protein, 7 aa, Plasmodium falciparum
AADNQTQ

SEQ ID NO: 3301785 - protein, 6 aa, Plasmodium falciparum
AADRTG

SEQ ID NO: 3301786 - protein, 19 aa, Plasmodium falciparum
AADVEGADVEGADVEGADV

SEQ ID NO: 3301787 - protein, 20 aa, Plasmodium falciparum
AADVEGEGVEAADVEGAGVE

SEQ ID NO: 3301788 - protein, 9 aa, Plasmodium falciparum
AAEAPYDEW

SEQ ID NO: 3301789 - protein, 15 aa, Plasmodium falciparum
AAEHVTTTASGEGKF

SEQ ID NO: 3301790 - protein, 6 aa, Plasmodium falciparum
AAEKEI

SEQ ID NO: 3301791 - protein, 8 aa, Plasmodium falciparum
AAEKKTEL

SEQ ID NO: 3301792 - protein, 16 aa, Plasmodium falciparum
AAESNERYQDPQNYEL

SEQ ID NO: 3301793 - protein, 7 aa, Plasmodium falciparum
AAGQPLG

SEQ ID NO: 3301794 - protein, 10 aa, Plasmodium falciparum
AAGTTYEEKD

SEQ ID NO: 3301795 - protein, 9 aa, Plasmodium falciparum
AAINSEKNN

SEQ ID NO: 3301796 - protein, 10 aa, Plasmodium falciparum
AAINSNGGLS

SEQ ID NO: 3301797 - protein, 6 aa, Plasmodium falciparum
AAKKID

SEQ ID NO: 3301798 - protein, 22 aa, Plasmodium falciparum
AAKKTAGKTLGPRHKRKRRTES

SEQ ID NO: 3301799 - protein, 14 aa, Plasmodium falciparum
AAKNQASRNPENTV

SEQ ID NO: 3301800 - protein, 14 aa, Plasmodium falciparum
AAKNQVARNPENTV

SEQ ID NO: 3301801 - protein, 10 aa, Plasmodium falciparum
AAKTAEEAEE

SEQ ID NO: 3301802 - protein, 9 aa, Plasmodium falciparum
AAKTGSGKT

SEQ ID NO: 3301803 - protein, 7 aa, Plasmodium falciparum
AANTHKK

SEQ ID NO: 3301804 - protein, 5 aa, Plasmodium falciparum
AANTK

SEQ ID NO: 3301805 - protein, 15 aa, Plasmodium falciparum
AANTNDKAGDGTTTA

SEQ ID NO: 3301806 - protein, 5 aa, Plasmodium falciparum
AAPEE

SEQ ID NO: 3301807 - protein, 6 aa, Plasmodium falciparum
AAPNAI

SEQ ID NO: 3301808 - protein, 9 aa, Plasmodium falciparum
AAPNPPKEA

SEQ ID NO: 3301809 - protein, 4 aa, Plasmodium falciparum
AAQA

SEQ ID NO: 3301810 - protein, 6 aa, Plasmodium falciparum
AAQGGI

SEQ ID NO: 3301811 - protein, 15 aa, Plasmodium falciparum
AAQISSVESTSEDMN

SEQ ID NO: 3301812 - protein, 7 aa, Plasmodium falciparum
AAQSAGD

SEQ ID NO: 3301813 - protein, 34 aa, Plasmodium falciparum
AARKAAEKAYKANNKRENYDSDSSDSSYSEPDFS

SEQ ID NO: 3301814 - protein, 6 aa, Plasmodium falciparum
AARNKS

SEQ ID NO: 3301815 - protein, 14 aa, Plasmodium falciparum
AASISNDQNNSINK

SEQ ID NO: 3301816 - protein, 4 aa, Plasmodium falciparum
AASL

SEQ ID NO: 3301817 - protein, 8 aa, Plasmodium falciparum
AASNGKAG

SEQ ID NO: 3301818 - protein, 19 aa, Plasmodium falciparum
AASQYDGGTLNNQKIKVFV

SEQ ID NO: 3301819 - protein, 10 aa, Plasmodium falciparum
AASSDNSCSI

SEQ ID NO: 3301820 - protein, 10 aa, Plasmodium falciparum
AASSPNESNL

SEQ ID NO: 3301821 - protein, 4 aa, Plasmodium falciparum
AATD

SEQ ID NO: 3301822 - protein, 8 aa, Plasmodium falciparum
AATSGQAF

SEQ ID NO: 3301823 - protein, 9 aa, Plasmodium falciparum
AATSTSSNL

SEQ ID NO: 3301824 - protein, 4 aa, Plasmodium falciparum
AATY

SEQ ID NO: 3301825 - protein, 64 aa, Plasmodium falciparum
AAVTNDNNKNDDDNNKNDNDNNKGGGDNNKNGDGGDDGGDDGGDDGGDDGDDDDDDGDDDINNG

SEQ ID NO: 3301826 - protein, 12 aa, Plasmodium falciparum
ACEEEKKNVKKS

SEQ ID NO: 3301827 - protein, 4 aa, Plasmodium falciparum
ACEN

SEQ ID NO: 3301828 - protein, 14 aa, Plasmodium falciparum
ACKQERRSTDKSKI

SEQ ID NO: 3301829 - protein, 6 aa, Plasmodium falciparum
ACNNDE

SEQ ID NO: 3301830 - protein, 7 aa, Plasmodium falciparum
ACRKDSE

SEQ ID NO: 3301831 - protein, 8 aa, Plasmodium falciparum
ACSPDNET

SEQ ID NO: 3301832 - protein, 6 aa, Plasmodium falciparum
ACSTKR

SEQ ID NO: 3301833 - protein, 7 aa, Plasmodium falciparum
ACTGDGN

SEQ ID NO: 3301834 - protein, 8 aa, Plasmodium falciparum
ACTSKNEK

SEQ ID NO: 3301835 - protein, 9 aa, Plasmodium falciparum
ADAKTSEKT

SEQ ID NO: 3301836 - protein, 16 aa, Plasmodium falciparum
ADAPEFVPSTKSLQNN

SEQ ID NO: 3301837 - protein, 6 aa, Plasmodium falciparum
ADCKDD

SEQ ID NO: 3301838 - protein, 28 aa, Plasmodium falciparum
ADDEHNENHNNTTNINNNNNNNNSSSYD

SEQ ID NO: 3301839 - protein, 7 aa, Plasmodium falciparum
ADDINKN

SEQ ID NO: 3301840 - protein, 14 aa, Plasmodium falciparum
ADDKNTNDKNNDNI

SEQ ID NO: 3301841 - protein, 6 aa, Plasmodium falciparum
ADDPEA

SEQ ID NO: 3301842 - protein, 7 aa, Plasmodium falciparum
ADDSHNE

SEQ ID NO: 3301843 - protein, 6 aa, Plasmodium falciparum
ADDYDD

SEQ ID NO: 3301844 - protein, 26 aa, Plasmodium falciparum
ADEEAEYQEDDDYEDMEDEDGDDDDL

SEQ ID NO: 3301845 - protein, 9 aa, Plasmodium falciparum
ADEEDTRDN

SEQ ID NO: 3301846 - protein, 4 aa, Plasmodium falciparum
ADEH

SEQ ID NO: 3301847 - protein, 7 aa, Plasmodium falciparum
ADENDDN

SEQ ID NO: 3301848 - protein, 7 aa, Plasmodium falciparum
ADENDEF

SEQ ID NO: 3301849 - protein, 7 aa, Plasmodium falciparum
ADENMPN

SEQ ID NO: 3301850 - protein, 7 aa, Plasmodium falciparum
ADEQNDN

SEQ ID NO: 3301851 - protein, 4 aa, Plasmodium falciparum
ADER

SEQ ID NO: 3301852 - protein, 6 aa, Plasmodium falciparum
ADERNK

SEQ ID NO: 3301853 - protein, 4 aa, Plasmodium falciparum
ADET

SEQ ID NO: 3301854 - protein, 4 aa, Plasmodium falciparum
ADEV

SEQ ID NO: 3301855 - protein, 6 aa, Plasmodium falciparum
ADFDGD

SEQ ID NO: 3301856 - protein, 14 aa, Plasmodium falciparum
ADFEKNNSKKEKLE

SEQ ID NO: 3301857 - protein, 10 aa, Plasmodium falciparum
ADGGIKNSGN

SEQ ID NO: 3301858 - protein, 9 aa, Plasmodium falciparum
ADGIEQSDN

SEQ ID NO: 3301859 - protein, 9 aa, Plasmodium falciparum
ADGNENTEK

SEQ ID NO: 3301860 - protein, 8 aa, Plasmodium falciparum
ADGNEVSG

SEQ ID NO: 3301861 - protein, 8 aa, Plasmodium falciparum
ADGPNEYM

SEQ ID NO: 3301862 - protein, 11 aa, Plasmodium falciparum
ADHERSEGEGV

SEQ ID NO: 3301863 - protein, 7 aa, Plasmodium falciparum
ADIDEDN

SEQ ID NO: 3301864 - protein, 6 aa, Plasmodium falciparum
ADIDEK

SEQ ID NO: 3301865 - protein, 6 aa, Plasmodium falciparum
ADIKDD

SEQ ID NO: 3301866 - protein, 6 aa, Plasmodium falciparum
ADINNS

SEQ ID NO: 3301867 - protein, 8 aa, Plasmodium falciparum
ADKDGDGM

SEQ ID NO: 3301868 - protein, 19 aa, Plasmodium falciparum
ADKEEQKVKDLDDENVGDV

SEQ ID NO: 3301869 - protein, 12 aa, Plasmodium falciparum
ADKGKYKRKEKM

SEQ ID NO: 3301870 - protein, 10 aa, Plasmodium falciparum
ADKKGIAPHA

SEQ ID NO: 3301871 - protein, 13 aa, Plasmodium falciparum
ADKKNNKDEEDMD

SEQ ID NO: 3301872 - protein, 11 aa, Plasmodium falciparum
ADKNNGSNEQC

SEQ ID NO: 3301873 - protein, 7 aa, Plasmodium falciparum
ADKPNGN

SEQ ID NO: 3301874 - protein, 10 aa, Plasmodium falciparum
ADKYGDNNNN

SEQ ID NO: 3301875 - protein, 14 aa, Plasmodium falciparum
ADLYKDKKKTSFND

SEQ ID NO: 3301876 - protein, 21 aa, Plasmodium falciparum
ADMENKCKDAKSKKKKINPKN

SEQ ID NO: 3301877 - protein, 4 aa, Plasmodium falciparum
ADMK

SEQ ID NO: 3301878 - protein, 7 aa, Plasmodium falciparum
ADMSTSD

SEQ ID NO: 3301879 - protein, 5 aa, Plasmodium falciparum
ADNEI

SEQ ID NO: 3301880 - protein, 12 aa, Plasmodium falciparum
ADNELGQGNDIN

SEQ ID NO: 3301881 - protein, 13 aa, Plasmodium falciparum
ADNEQNDKNDKNH

SEQ ID NO: 3301882 - protein, 10 aa, Plasmodium falciparum
ADNIDNKDDI

SEQ ID NO: 3301883 - protein, 68 aa, Plasmodium falciparum
ADNKQKKSYALPKEKKSLTHANSRTHENNDNNKYNNNNSNNNDTSDTLSDTDNNKKYEYQKSKKISST

SEQ ID NO: 3301884 - protein, 8 aa, Plasmodium falciparum
ADNPEDNE

SEQ ID NO: 3301885 - protein, 10 aa, Plasmodium falciparum
ADNSSSFPLS

SEQ ID NO: 3301886 - protein, 8 aa, Plasmodium falciparum
ADNTSKIK

SEQ ID NO: 3301887 - protein, 16 aa, Plasmodium falciparum
ADNYKNINDKKEAEIK

SEQ ID NO: 3301888 - protein, 7 aa, Plasmodium falciparum
ADQNKDA

SEQ ID NO: 3301889 - protein, 8 aa, Plasmodium falciparum
ADRGENAT

SEQ ID NO: 3301890 - protein, 10 aa, Plasmodium falciparum
ADRPNQQNYN

SEQ ID NO: 3301891 - protein, 12 aa, Plasmodium falciparum
ADRSNNDNLPEI

SEQ ID NO: 3301892 - protein, 14 aa, Plasmodium falciparum
ADSDSHNKKDYEIA

SEQ ID NO: 3301893 - protein, 9 aa, Plasmodium falciparum
ADSKGEGEI

SEQ ID NO: 3301894 - protein, 45 aa, Plasmodium falciparum
ADSQQNANNNNNNNNNNNNSNNNNNNNNNNNNNNNNNNNNNNNNN

SEQ ID NO: 3301895 - protein, 9 aa, Plasmodium falciparum
ADSSNSYRY

SEQ ID NO: 3301896 - protein, 7 aa, Plasmodium falciparum
ADTAEDQ

SEQ ID NO: 3301897 - protein, 5 aa, Plasmodium falciparum
ADTDG

SEQ ID NO: 3301898 - protein, 7 aa, Plasmodium falciparum
ADTDQTK

SEQ ID NO: 3301899 - protein, 7 aa, Plasmodium falciparum
ADTEKRS

SEQ ID NO: 3301900 - protein, 8 aa, Plasmodium falciparum
ADTLKTDE

SEQ ID NO: 3301901 - protein, 7 aa, Plasmodium falciparum
ADTPWEG

SEQ ID NO: 3301902 - protein, 12 aa, Plasmodium falciparum
ADTSDNHKEDAD

SEQ ID NO: 3301903 - protein, 10 aa, Plasmodium falciparum
ADTSGKRKTK

SEQ ID NO: 3301904 - protein, 15 aa, Plasmodium falciparum
ADTTCAPPECDNTND

SEQ ID NO: 3301905 - protein, 9 aa, Plasmodium falciparum
ADTTSPGKI

SEQ ID NO: 3301906 - protein, 13 aa, Plasmodium falciparum
ADYENYKNKCRSE

SEQ ID NO: 3301907 - protein, 6 aa, Plasmodium falciparum
ADYSTK

SEQ ID NO: 3301908 - protein, 14 aa, Plasmodium falciparum
ADYTVDKKKKKSLK

SEQ ID NO: 3301909 - protein, 6 aa, Plasmodium falciparum
AEAEDS

SEQ ID NO: 3301910 - protein, 4 aa, Plasmodium falciparum
AEAK

SEQ ID NO: 3301911 - protein, 6 aa, Plasmodium falciparum
AEAKSK

SEQ ID NO: 3301912 - protein, 89 aa, Plasmodium falciparum
AEANVEHDAEENVEHDAEENVEENVEENVEENVEENVEENVEENVEENVEENVEENVEENVEENVEENVEENVEENVEEYDEENVEEVE

SEQ ID NO: 3301913 - protein, 7 aa, Plasmodium falciparum
AEASETA

SEQ ID NO: 3301914 - protein, 7 aa, Plasmodium falciparum
AEATATE

SEQ ID NO: 3301915 - protein, 4 aa, Plasmodium falciparum
AEAY

SEQ ID NO: 3301916 - protein, 5 aa, Plasmodium falciparum
AECRE

SEQ ID NO: 3301917 - protein, 94 aa, Plasmodium falciparum
AEDASSVSERRDRHKSKHRNRSITRSRSRSRHRSGSRDRHRSRSRSRHRSRSRDRRRSRSRHRRRHRKGRSPSRSRSRERNKHRSGRNRSRSLE

SEQ ID NO: 3301918 - protein, 6 aa, Plasmodium falciparum
AEDEPR

SEQ ID NO: 3301919 - protein, 14 aa, Plasmodium falciparum
AEDKYNEKVRKNEK

SEQ ID NO: 3301920 - protein, 4 aa, Plasmodium falciparum
AEDN

SEQ ID NO: 3301921 - protein, 5 aa, Plasmodium falciparum
AEDSR

SEQ ID NO: 3301922 - protein, 10 aa, Plasmodium falciparum
AEDSSVENQN

SEQ ID NO: 3301923 - protein, 9 aa, Plasmodium falciparum
AEDTIKNNE

SEQ ID NO: 3301924 - protein, 6 aa, Plasmodium falciparum
AEECED

SEQ ID NO: 3301925 - protein, 29 aa, Plasmodium falciparum
AEEEDEDDDGDDDDDDEEEEEEEEEEDDD

SEQ ID NO: 3301926 - protein, 5 aa, Plasmodium falciparum
AEEEG

SEQ ID NO: 3301927 - protein, 6 aa, Plasmodium falciparum
AEEEMK

SEQ ID NO: 3301928 - protein, 13 aa, Plasmodium falciparum
AEEERKRREEEEE

SEQ ID NO: 3301929 - protein, 9 aa, Plasmodium falciparum
AEEKTKDLK

SEQ ID NO: 3301930 - protein, 47 aa, Plasmodium falciparum
AEEMNKKSKLELSNKKENEQNETNENDVHNKTEQQANDQQKNDDDNI

SEQ ID NO: 3301931 - protein, 6 aa, Plasmodium falciparum
AEENIG

SEQ ID NO: 3301932 - protein, 11 aa, Plasmodium falciparum
AEENKRNDEIY

SEQ ID NO: 3301933 - protein, 5 aa, Plasmodium falciparum
AEEPK

SEQ ID NO: 3301934 - protein, 5 aa, Plasmodium falciparum
AEEPL

SEQ ID NO: 3301935 - protein, 5 aa, Plasmodium falciparum
AEERD

SEQ ID NO: 3301936 - protein, 15 aa, Plasmodium falciparum
AEERKKKKKKMEQEK

SEQ ID NO: 3301937 - protein, 21 aa, Plasmodium falciparum
AEESDEDSSDNSSDSDKEKII

SEQ ID NO: 3301938 - protein, 18 aa, Plasmodium falciparum
AEESEDENLEDPEERKKI

SEQ ID NO: 3301939 - protein, 12 aa, Plasmodium falciparum
AEESKKSETYDL

SEQ ID NO: 3301940 - protein, 19 aa, Plasmodium falciparum
AEETDRESENSNTDDEEIE

SEQ ID NO: 3301941 - protein, 7 aa, Plasmodium falciparum
AEETQRM

SEQ ID NO: 3301942 - protein, 6 aa, Plasmodium falciparum
AEEYKD

SEQ ID NO: 3301943 - protein, 5 aa, Plasmodium falciparum
AEEYR

SEQ ID NO: 3301944 - protein, 7 aa, Plasmodium falciparum
AEGGFNE

SEQ ID NO: 3301945 - protein, 6 aa, Plasmodium falciparum
AEIDGN

SEQ ID NO: 3301946 - protein, 7 aa, Plasmodium falciparum
AEIPNGY

SEQ ID NO: 3301947 - protein, 6 aa, Plasmodium falciparum
AEKALK

SEQ ID NO: 3301948 - protein, 4 aa, Plasmodium falciparum
AEKE

SEQ ID NO: 3301949 - protein, 6 aa, Plasmodium falciparum
AEKEAS

SEQ ID NO: 3301950 - protein, 11 aa, Plasmodium falciparum
AEKEASIEEKI

SEQ ID NO: 3301951 - protein, 8 aa, Plasmodium falciparum
AEKENAEV

SEQ ID NO: 3301952 - protein, 4 aa, Plasmodium falciparum
AEKK

SEQ ID NO: 3301953 - protein, 22 aa, Plasmodium falciparum
AEKKKDEENDDKNIKNNKRKMS

SEQ ID NO: 3301954 - protein, 10 aa, Plasmodium falciparum
AEKKKKEYGE

SEQ ID NO: 3301955 - protein, 6 aa, Plasmodium falciparum
AEKKRK

SEQ ID NO: 3301956 - protein, 6 aa, Plasmodium falciparum
AEKKRQ

SEQ ID NO: 3301957 - protein, 17 aa, Plasmodium falciparum
AEKQQKEETSPSEQRPA

SEQ ID NO: 3301958 - protein, 13 aa, Plasmodium falciparum
AEKRRTSENADNC

SEQ ID NO: 3301959 - protein, 8 aa, Plasmodium falciparum
AEKTKRSR

SEQ ID NO: 3301960 - protein, 20 aa, Plasmodium falciparum
AEKYKAEDEENRKRIEARNS

SEQ ID NO: 3301961 - protein, 18 aa, Plasmodium falciparum
AEKYKEEDEQNKNRIEAR

SEQ ID NO: 3301962 - protein, 24 aa, Plasmodium falciparum
AELKNKGAIKKKKKITKKKKNVSK

SEQ ID NO: 3301963 - protein, 6 aa, Plasmodium falciparum
AELNQK

SEQ ID NO: 3301964 - protein, 8 aa, Plasmodium falciparum
AELTNQKN

SEQ ID NO: 3301965 - protein, 24 aa, Plasmodium falciparum
AEMNSSSSDENTDNDNDDSSINEY

SEQ ID NO: 3301966 - protein, 8 aa, Plasmodium falciparum
AENDEGLP

SEQ ID NO: 3301967 - protein, 4 aa, Plasmodium falciparum
AENE

SEQ ID NO: 3301968 - protein, 5 aa, Plasmodium falciparum
AENET

SEQ ID NO: 3301969 - protein, 25 aa, Plasmodium falciparum
AENFKEDENNDDESKKNHSYHDDPH

SEQ ID NO: 3301970 - protein, 12 aa, Plasmodium falciparum
AENKDYPRKDIC

SEQ ID NO: 3301971 - protein, 9 aa, Plasmodium falciparum
AENKKQNMN

SEQ ID NO: 3301972 - protein, 20 aa, Plasmodium falciparum
AENKKQVKKKKKKSVEDSRK

SEQ ID NO: 3301973 - protein, 13 aa, Plasmodium falciparum
AENNEKKKKQKIK

SEQ ID NO: 3301974 - protein, 16 aa, Plasmodium falciparum
AENNSSIDSFQSKDDK

SEQ ID NO: 3301975 - protein, 6 aa, Plasmodium falciparum
AENPAL

SEQ ID NO: 3301976 - protein, 10 aa, Plasmodium falciparum
AENPETVSPL

SEQ ID NO: 3301977 - protein, 8 aa, Plasmodium falciparum
AENSHTSR

SEQ ID NO: 3301978 - protein, 5 aa, Plasmodium falciparum
AENTY

SEQ ID NO: 3301979 - protein, 10 aa, Plasmodium falciparum
AENVTTESVG

SEQ ID NO: 3301980 - protein, 16 aa, Plasmodium falciparum
AENYDTDYKNDYEENG

SEQ ID NO: 3301981 - protein, 4 aa, Plasmodium falciparum
AEPE

SEQ ID NO: 3301982 - protein, 6 aa, Plasmodium falciparum
AEPESE

SEQ ID NO: 3301983 - protein, 6 aa, Plasmodium falciparum
AEPNRG

SEQ ID NO: 3301984 - protein, 8 aa, Plasmodium falciparum
AEQAERYD

SEQ ID NO: 3301985 - protein, 5 aa, Plasmodium falciparum
AEQKR

SEQ ID NO: 3301986 - protein, 6 aa, Plasmodium falciparum
AEQLNK

SEQ ID NO: 3301987 - protein, 14 aa, Plasmodium falciparum
AERENLKKQSEEII

SEQ ID NO: 3301988 - protein, 35 aa, Plasmodium falciparum
AERNEANMNDEQQDNEQKDTVSNNNNNNNNNENQN

SEQ ID NO: 3301989 - protein, 10 aa, Plasmodium falciparum
AERNQGEKEL

SEQ ID NO: 3301990 - protein, 20 aa, Plasmodium falciparum
AERRKNRRQQKKDIKFKSKD

SEQ ID NO: 3301991 - protein, 11 aa, Plasmodium falciparum
AESAKNAMDNL

SEQ ID NO: 3301992 - protein, 9 aa, Plasmodium falciparum
AESDEPDEN

SEQ ID NO: 3301993 - protein, 5 aa, Plasmodium falciparum
AESNM

SEQ ID NO: 3301994 - protein, 7 aa, Plasmodium falciparum
AESRMKE

SEQ ID NO: 3301995 - protein, 38 aa, Plasmodium falciparum
AETEIEEDKSDDTNNKVEDSDELNSVSPKCQEYTSKEQ

SEQ ID NO: 3301996 - protein, 8 aa, Plasmodium falciparum
AETGSGKT

SEQ ID NO: 3301997 - protein, 8 aa, Plasmodium falciparum
AETKKSFD

SEQ ID NO: 3301998 - protein, 4 aa, Plasmodium falciparum
AETN

SEQ ID NO: 3301999 - protein, 6 aa, Plasmodium falciparum
AETNSE

SEQ ID NO: 3302000 - protein, 6 aa, Plasmodium falciparum
AEVNTK

SEQ ID NO: 3302001 - protein, 17 aa, Plasmodium falciparum
AEWSKKNDQKKFNDGEE

SEQ ID NO: 3302002 - protein, 6 aa, Plasmodium falciparum
AEWSNK

SEQ ID NO: 3302003 - protein, 7 aa, Plasmodium falciparum
AEYNPSK

SEQ ID NO: 3302004 - protein, 11 aa, Plasmodium falciparum
AEYRGDRRSVT

SEQ ID NO: 3302005 - protein, 30 aa, Plasmodium falciparum
AFEEKQKQNEYSTDINKNKNKELNEEEKNK

SEQ ID NO: 3302006 - protein, 5 aa, Plasmodium falciparum
AFENE

SEQ ID NO: 3302007 - protein, 23 aa, Plasmodium falciparum
AFGNNETSSFQKKKRRIDENSQM

SEQ ID NO: 3302008 - protein, 5 aa, Plasmodium falciparum
AFPGG

SEQ ID NO: 3302009 - protein, 6 aa, Plasmodium falciparum
AFPSNE

SEQ ID NO: 3302010 - protein, 16 aa, Plasmodium falciparum
AFQPGENVKLNLNNES

SEQ ID NO: 3302011 - protein, 5 aa, Plasmodium falciparum
AFRDE

SEQ ID NO: 3302012 - protein, 4 aa, Plasmodium falciparum
AGAA

SEQ ID NO: 3302013 - protein, 5 aa, Plasmodium falciparum
AGANQ

SEQ ID NO: 3302014 - protein, 7 aa, Plasmodium falciparum
AGAQEEK

SEQ ID NO: 3302015 - protein, 9 aa, Plasmodium falciparum
AGARRSVSQ

SEQ ID NO: 3302016 - protein, 9 aa, Plasmodium falciparum
AGASQTYPV

SEQ ID NO: 3302017 - protein, 48 aa, Plasmodium falciparum
AGDKNKKHENKIQKSGEQNKRDERKEDTYKKYEKRDNMPMNSSSNNNI

SEQ ID NO: 3302018 - protein, 6 aa, Plasmodium falciparum
AGDSAE

SEQ ID NO: 3302019 - protein, 17 aa, Plasmodium falciparum
AGDSIEDSNFNTDTANS

SEQ ID NO: 3302020 - protein, 5 aa, Plasmodium falciparum
AGDSR

SEQ ID NO: 3302021 - protein, 15 aa, Plasmodium falciparum
AGDTKRSAGPNENDE

SEQ ID NO: 3302022 - protein, 4 aa, Plasmodium falciparum
AGDV

SEQ ID NO: 3302023 - protein, 14 aa, Plasmodium falciparum
AGEAASASVHGANR

SEQ ID NO: 3302024 - protein, 4 aa, Plasmodium falciparum
AGEC

SEQ ID NO: 3302025 - protein, 34 aa, Plasmodium falciparum
AGEKINSKKNHMNNNNNNNNNNNNNHFSSNSLGQ

SEQ ID NO: 3302026 - protein, 6 aa, Plasmodium falciparum
AGEPDF

SEQ ID NO: 3302027 - protein, 12 aa, Plasmodium falciparum
AGFKDDDKPSVG

SEQ ID NO: 3302028 - protein, 6 aa, Plasmodium falciparum
AGFTTP

SEQ ID NO: 3302029 - protein, 6 aa, Plasmodium falciparum
AGGEGL

SEQ ID NO: 3302030 - protein, 16 aa, Plasmodium falciparum
AGGKRNDKKAKKYDTQ

SEQ ID NO: 3302031 - protein, 4 aa, Plasmodium falciparum
AGGL

SEQ ID NO: 3302032 - protein, 15 aa, Plasmodium falciparum
AGGNDAIKSNQDYQY

SEQ ID NO: 3302033 - protein, 7 aa, Plasmodium falciparum
AGGRGNE

SEQ ID NO: 3302034 - protein, 6 aa, Plasmodium falciparum
AGGRID

SEQ ID NO: 3302035 - protein, 6 aa, Plasmodium falciparum
AGGSFT

SEQ ID NO: 3302036 - protein, 9 aa, Plasmodium falciparum
AGGTGSGMG

SEQ ID NO: 3302037 - protein, 5 aa, Plasmodium falciparum
AGGYD

SEQ ID NO: 3302038 - protein, 16 aa, Plasmodium falciparum
AGISTSSGLQDFRGPT

SEQ ID NO: 3302039 - protein, 10 aa, Plasmodium falciparum
AGKGNNKVQT

SEQ ID NO: 3302040 - protein, 8 aa, Plasmodium falciparum
AGKHSNNN

SEQ ID NO: 3302041 - protein, 22 aa, Plasmodium falciparum
AGKKHKNDKMNNMNSTKIDDNT

SEQ ID NO: 3302042 - protein, 7 aa, Plasmodium falciparum
AGKKSDQ

SEQ ID NO: 3302043 - protein, 7 aa, Plasmodium falciparum
AGKSTAC

SEQ ID NO: 3302044 - protein, 6 aa, Plasmodium falciparum
AGKTTL

SEQ ID NO: 3302045 - protein, 8 aa, Plasmodium falciparum
AGLTPRAA

SEQ ID NO: 3302046 - protein, 48 aa, Plasmodium falciparum
AGNDINKKKKKKKKKKKKKTMKNKIKNEEKNNNTNNIKKTKQKNLCDT

SEQ ID NO: 3302047 - protein, 6 aa, Plasmodium falciparum
AGNGGD

SEQ ID NO: 3302048 - protein, 6 aa, Plasmodium falciparum
AGNNGD

SEQ ID NO: 3302049 - protein, 5 aa, Plasmodium falciparum
AGNNI

SEQ ID NO: 3302050 - protein, 15 aa, Plasmodium falciparum
AGNPSAPEEKRKRPI

SEQ ID NO: 3302051 - protein, 6 aa, Plasmodium falciparum
AGNTSL

SEQ ID NO: 3302052 - protein, 8 aa, Plasmodium falciparum
AGPKSIEN

SEQ ID NO: 3302053 - protein, 4 aa, Plasmodium falciparum
AGPS

SEQ ID NO: 3302054 - protein, 8 aa, Plasmodium falciparum
AGQEKFGG

SEQ ID NO: 3302055 - protein, 5 aa, Plasmodium falciparum
AGQER

SEQ ID NO: 3302056 - protein, 7 aa, Plasmodium falciparum
AGQERYR

SEQ ID NO: 3302057 - protein, 6 aa, Plasmodium falciparum
AGQESF

SEQ ID NO: 3302058 - protein, 6 aa, Plasmodium falciparum
AGRFGT

SEQ ID NO: 3302059 - protein, 11 aa, Plasmodium falciparum
AGRFNPSCTNK

SEQ ID NO: 3302060 - protein, 6 aa, Plasmodium falciparum
AGRGIG

SEQ ID NO: 3302061 - protein, 8 aa, Plasmodium falciparum
AGRTIGNT

SEQ ID NO: 3302062 - protein, 6 aa, Plasmodium falciparum
AGSEDG

SEQ ID NO: 3302063 - protein, 5 aa, Plasmodium falciparum
AGSEV

SEQ ID NO: 3302064 - protein, 8 aa, Plasmodium falciparum
AGSGSVGI

SEQ ID NO: 3302065 - protein, 16 aa, Plasmodium falciparum
AGSSNFPKASTSSLQQ

SEQ ID NO: 3302066 - protein, 8 aa, Plasmodium falciparum
AGSTGYNG

SEQ ID NO: 3302067 - protein, 9 aa, Plasmodium falciparum
AGTKKRPIT

SEQ ID NO: 3302068 - protein, 4 aa, Plasmodium falciparum
AGTL

SEQ ID NO: 3302069 - protein, 4 aa, Plasmodium falciparum
AGTR

SEQ ID NO: 3302070 - protein, 13 aa, Plasmodium falciparum
AGVNTVANTPQTL

SEQ ID NO: 3302071 - protein, 11 aa, Plasmodium falciparum
AGWDDDDDDDD

SEQ ID NO: 3302072 - protein, 13 aa, Plasmodium falciparum
AGYETSAESWGTG

SEQ ID NO: 3302073 - protein, 8 aa, Plasmodium falciparum
AGYQPPLD

SEQ ID NO: 3302074 - protein, 13 aa, Plasmodium falciparum
AHCEDEKKSEAWN

SEQ ID NO: 3302075 - protein, 10 aa, Plasmodium falciparum
AHDEKNTNGF

SEQ ID NO: 3302076 - protein, 15 aa, Plasmodium falciparum
AHEEKGNLNDDKRDE

SEQ ID NO: 3302077 - protein, 26 aa, Plasmodium falciparum
AHEKGQSTKEDYIKREDTQNGEHMTN

SEQ ID NO: 3302078 - protein, 11 aa, Plasmodium falciparum
AHEKNNINNTN

SEQ ID NO: 3302079 - protein, 19 aa, Plasmodium falciparum
AHGNNPSISPGGNNNMSTN

SEQ ID NO: 3302080 - protein, 6 aa, Plasmodium falciparum
AHHNES

SEQ ID NO: 3302081 - protein, 11 aa, Plasmodium falciparum
AHINDNKEYNY

SEQ ID NO: 3302082 - protein, 7 aa, Plasmodium falciparum
AHINNDK

SEQ ID NO: 3302083 - protein, 10 aa, Plasmodium falciparum
AHINNDKEKN

SEQ ID NO: 3302084 - protein, 5 aa, Plasmodium falciparum
AHKEK

SEQ ID NO: 3302085 - protein, 4 aa, Plasmodium falciparum
AHKK

SEQ ID NO: 3302086 - protein, 125 aa, Plasmodium falciparum
AHKKKKKKKKKKKEKEKEKEKEKEKEKVKEKEKEKEKEKEKEKEKEKHKDEHKDEHKDEHKDTYNDKHSDKHSDKHSDKHNDKHSDKHSDKHSDKHNDKHNDKHNDKHNNKHNNKYKKRKSKSKL

SEQ ID NO: 3302087 - protein, 8 aa, Plasmodium falciparum
AHKSNSVC

SEQ ID NO: 3302088 - protein, 6 aa, Plasmodium falciparum
AHNEQS

SEQ ID NO: 3302089 - protein, 5 aa, Plasmodium falciparum
AHNGS

SEQ ID NO: 3302090 - protein, 9 aa, Plasmodium falciparum
AHNQDELKS

SEQ ID NO: 3302091 - protein, 6 aa, Plasmodium falciparum
AHPTYQ

SEQ ID NO: 3302092 - protein, 4 aa, Plasmodium falciparum
AHRI

SEQ ID NO: 3302093 - protein, 12 aa, Plasmodium falciparum
AHRVVDQSNKFV

SEQ ID NO: 3302094 - protein, 7 aa, Plasmodium falciparum
AHSIKND

SEQ ID NO: 3302095 - protein, 5 aa, Plasmodium falciparum
AHTGE

SEQ ID NO: 3302096 - protein, 5 aa, Plasmodium falciparum
AHTQK

SEQ ID NO: 3302097 - protein, 5 aa, Plasmodium falciparum
AIAQG

SEQ ID NO: 3302098 - protein, 27 aa, Plasmodium falciparum
AIDGESGTSMDSKPKENKISTEPGADQ

SEQ ID NO: 3302099 - protein, 4 aa, Plasmodium falciparum
AIEE

SEQ ID NO: 3302100 - protein, 5 aa, Plasmodium falciparum
AIEPS

SEQ ID NO: 3302101 - protein, 23 aa, Plasmodium falciparum
AIESTTKESLYRKGGSKNEIDND

SEQ ID NO: 3302102 - protein, 5 aa, Plasmodium falciparum
AIGKN

SEQ ID NO: 3302103 - protein, 6 aa, Plasmodium falciparum
AIHNSR

SEQ ID NO: 3302104 - protein, 5 aa, Plasmodium falciparum
AIKIT

SEQ ID NO: 3302105 - protein, 5 aa, Plasmodium falciparum
AIKST

SEQ ID NO: 3302106 - protein, 5 aa, Plasmodium falciparum
AILTN

SEQ ID NO: 3302107 - protein, 9 aa, Plasmodium falciparum
AINNNSNDN

SEQ ID NO: 3302108 - protein, 10 aa, Plasmodium falciparum
AIPAQPASMQ

SEQ ID NO: 3302109 - protein, 4 aa, Plasmodium falciparum
AIPG

SEQ ID NO: 3302110 - protein, 5 aa, Plasmodium falciparum
AIQAG

SEQ ID NO: 3302111 - protein, 13 aa, Plasmodium falciparum
AISENNQSTAHGN

SEQ ID NO: 3302112 - protein, 5 aa, Plasmodium falciparum
AISKD

SEQ ID NO: 3302113 - protein, 6 aa, Plasmodium falciparum
AITGEG

SEQ ID NO: 3302114 - protein, 9 aa, Plasmodium falciparum
AITNPENTV

SEQ ID NO: 3302115 - protein, 34 aa, Plasmodium falciparum
AITNQNNKYSNNNNNNNNNTLTNQEQKTNKNVST

SEQ ID NO: 3302116 - protein, 8 aa, Plasmodium falciparum
AKAGNLPG

SEQ ID NO: 3302117 - protein, 11 aa, Plasmodium falciparum
AKAKEEKKKNE

SEQ ID NO: 3302118 - protein, 5 aa, Plasmodium falciparum
AKAKH

SEQ ID NO: 3302119 - protein, 11 aa, Plasmodium falciparum
AKASGGAKNSL

SEQ ID NO: 3302120 - protein, 8 aa, Plasmodium falciparum
AKASPDTL

SEQ ID NO: 3302121 - protein, 5 aa, Plasmodium falciparum
AKCTY

SEQ ID NO: 3302122 - protein, 8 aa, Plasmodium falciparum
AKDNNNND

SEQ ID NO: 3302123 - protein, 28 aa, Plasmodium falciparum
AKDNTINNNETDDHQNEQTLNDGTLTNN

SEQ ID NO: 3302124 - protein, 12 aa, Plasmodium falciparum
AKDREKENPCRG

SEQ ID NO: 3302125 - protein, 6 aa, Plasmodium falciparum
AKDVPF

SEQ ID NO: 3302126 - protein, 4 aa, Plasmodium falciparum
AKEA

SEQ ID NO: 3302127 - protein, 10 aa, Plasmodium falciparum
AKEAKDAQEY

SEQ ID NO: 3302128 - protein, 7 aa, Plasmodium falciparum
AKEDIEK

SEQ ID NO: 3302129 - protein, 8 aa, Plasmodium falciparum
AKEEGNLE

SEQ ID NO: 3302130 - protein, 9 aa, Plasmodium falciparum
AKEEIDPRK

SEQ ID NO: 3302131 - protein, 8 aa, Plasmodium falciparum
AKEEREKK

SEQ ID NO: 3302132 - protein, 10 aa, Plasmodium falciparum
AKEKGKYKNS

SEQ ID NO: 3302133 - protein, 5 aa, Plasmodium falciparum
AKEKI

SEQ ID NO: 3302134 - protein, 8 aa, Plasmodium falciparum
AKEKNLNV

SEQ ID NO: 3302135 - protein, 14 aa, Plasmodium falciparum
AKERKEQKQNEQNA

SEQ ID NO: 3302136 - protein, 7 aa, Plasmodium falciparum
AKERPSA

SEQ ID NO: 3302137 - protein, 9 aa, Plasmodium falciparum
AKESGYRAR

SEQ ID NO: 3302138 - protein, 19 aa, Plasmodium falciparum
AKEYEGSSNLNDDNNMNDG

SEQ ID NO: 3302139 - protein, 5 aa, Plasmodium falciparum
AKGAG

SEQ ID NO: 3302140 - protein, 8 aa, Plasmodium falciparum
AKGGNGTV

SEQ ID NO: 3302141 - protein, 8 aa, Plasmodium falciparum
AKGKPTDL

SEQ ID NO: 3302142 - protein, 4 aa, Plasmodium falciparum
AKGL

SEQ ID NO: 3302143 - protein, 25 aa, Plasmodium falciparum
AKGNQNDSTNDSIYNTSSNNSSNTL

SEQ ID NO: 3302144 - protein, 7 aa, Plasmodium falciparum
AKGSKVN

SEQ ID NO: 3302145 - protein, 8 aa, Plasmodium falciparum
AKHNKKDD

SEQ ID NO: 3302146 - protein, 8 aa, Plasmodium falciparum
AKHREQMN

SEQ ID NO: 3302147 - protein, 5 aa, Plasmodium falciparum
AKIGD

SEQ ID NO: 3302148 - protein, 10 aa, Plasmodium falciparum
AKINNKGAHP

SEQ ID NO: 3302149 - protein, 14 aa, Plasmodium falciparum
AKITNEQNRSFTYA

SEQ ID NO: 3302150 - protein, 9 aa, Plasmodium falciparum
AKKAKSLKT

SEQ ID NO: 3302151 - protein, 13 aa, Plasmodium falciparum
AKKDSYSKKEKDD

SEQ ID NO: 3302152 - protein, 8 aa, Plasmodium falciparum
AKKEPSIV

SEQ ID NO: 3302153 - protein, 8 aa, Plasmodium falciparum
AKKERRKK

SEQ ID NO: 3302154 - protein, 7 aa, Plasmodium falciparum
AKKGDTM

SEQ ID NO: 3302155 - protein, 8 aa, Plasmodium falciparum
AKKGNKIE

SEQ ID NO: 3302156 - protein, 6 aa, Plasmodium falciparum
AKKGNY

SEQ ID NO: 3302157 - protein, 6 aa, Plasmodium falciparum
AKKGSE

SEQ ID NO: 3302158 - protein, 6 aa, Plasmodium falciparum
AKKIES

SEQ ID NO: 3302159 - protein, 8 aa, Plasmodium falciparum
AKKIKNNN

SEQ ID NO: 3302160 - protein, 42 aa, Plasmodium falciparum
AKKKEQEEIERKEKERKEKEKEEREKERKSVINNSSSSINYG

SEQ ID NO: 3302161 - protein, 9 aa, Plasmodium falciparum
AKKKRGYKS

SEQ ID NO: 3302162 - protein, 5 aa, Plasmodium falciparum
AKKNK

SEQ ID NO: 3302163 - protein, 9 aa, Plasmodium falciparum
AKKNLQEGT

SEQ ID NO: 3302164 - protein, 5 aa, Plasmodium falciparum
AKKNN

SEQ ID NO: 3302165 - protein, 66 aa, Plasmodium falciparum
AKKNNESIKKDEGDIPKEDGKNDNNINNNNNDDNISSSRSSSRSSGRSSSRSCGRSSSRRSNNNVS

SEQ ID NO: 3302166 - protein, 7 aa, Plasmodium falciparum
AKKNSKE

SEQ ID NO: 3302167 - protein, 8 aa, Plasmodium falciparum
AKKRNKKY

SEQ ID NO: 3302168 - protein, 14 aa, Plasmodium falciparum
AKKSDYNNEKKKNE

SEQ ID NO: 3302169 - protein, 8 aa, Plasmodium falciparum
AKKTPTDP

SEQ ID NO: 3302170 - protein, 5 aa, Plasmodium falciparum
AKKVQ

SEQ ID NO: 3302171 - protein, 8 aa, Plasmodium falciparum
AKKVSSTM

SEQ ID NO: 3302172 - protein, 7 aa, Plasmodium falciparum
AKKYNNQ

SEQ ID NO: 3302173 - protein, 15 aa, Plasmodium falciparum
AKLKKEKTKTNHSNV

SEQ ID NO: 3302174 - protein, 11 aa, Plasmodium falciparum
AKLQKAEEEGL

SEQ ID NO: 3302175 - protein, 7 aa, Plasmodium falciparum
AKMDKSQ

SEQ ID NO: 3302176 - protein, 5 aa, Plasmodium falciparum
AKNCK

SEQ ID NO: 3302177 - protein, 6 aa, Plasmodium falciparum
AKNDND

SEQ ID NO: 3302178 - protein, 7 aa, Plasmodium falciparum
AKNDTRN

SEQ ID NO: 3302179 - protein, 8 aa, Plasmodium falciparum
AKNFKAGS

SEQ ID NO: 3302180 - protein, 9 aa, Plasmodium falciparum
AKNGTGKTA

SEQ ID NO: 3302181 - protein, 9 aa, Plasmodium falciparum
AKNIPKDNY

SEQ ID NO: 3302182 - protein, 24 aa, Plasmodium falciparum
AKNKAKFGTKEKEDKKKTKDDKKK

SEQ ID NO: 3302183 - protein, 6 aa, Plasmodium falciparum
AKNKIK

SEQ ID NO: 3302184 - protein, 9 aa, Plasmodium falciparum
AKNKKKALH

SEQ ID NO: 3302185 - protein, 6 aa, Plasmodium falciparum
AKNKRL

SEQ ID NO: 3302186 - protein, 4 aa, Plasmodium falciparum
AKNN

SEQ ID NO: 3302187 - protein, 7 aa, Plasmodium falciparum
AKNNAED

SEQ ID NO: 3302188 - protein, 9 aa, Plasmodium falciparum
AKNNDVQTN

SEQ ID NO: 3302189 - protein, 8 aa, Plasmodium falciparum
AKNNQGEY

SEQ ID NO: 3302190 - protein, 10 aa, Plasmodium falciparum
AKNNTTINNN

SEQ ID NO: 3302191 - protein, 5 aa, Plasmodium falciparum
AKNNV

SEQ ID NO: 3302192 - protein, 4 aa, Plasmodium falciparum
AKNR

SEQ ID NO: 3302193 - protein, 30 aa, Plasmodium falciparum
AKNRDQNESVPVDSTSQQSTSADKEEGKVE

SEQ ID NO: 3302194 - protein, 8 aa, Plasmodium falciparum
AKNSKYEL

SEQ ID NO: 3302195 - protein, 4 aa, Plasmodium falciparum
AKNT

SEQ ID NO: 3302196 - protein, 6 aa, Plasmodium falciparum
AKNVDE

SEQ ID NO: 3302197 - protein, 9 aa, Plasmodium falciparum
AKPDINSKE

SEQ ID NO: 3302198 - protein, 8 aa, Plasmodium falciparum
AKPDITPS

SEQ ID NO: 3302199 - protein, 4 aa, Plasmodium falciparum
AKPF

SEQ ID NO: 3302200 - protein, 5 aa, Plasmodium falciparum
AKPYG

SEQ ID NO: 3302201 - protein, 9 aa, Plasmodium falciparum
AKQAESLNK

SEQ ID NO: 3302202 - protein, 32 aa, Plasmodium falciparum
AKQAGSAWKKKETENVEEEGEEKEKKIDDESF

SEQ ID NO: 3302203 - protein, 4 aa, Plasmodium falciparum
AKQC

SEQ ID NO: 3302204 - protein, 5 aa, Plasmodium falciparum
AKQGK

SEQ ID NO: 3302205 - protein, 13 aa, Plasmodium falciparum
AKQKNDLNKSENQ

SEQ ID NO: 3302206 - protein, 4 aa, Plasmodium falciparum
AKQM

SEQ ID NO: 3302207 - protein, 9 aa, Plasmodium falciparum
AKQNNTQKN

SEQ ID NO: 3302208 - protein, 8 aa, Plasmodium falciparum
AKQPNSAY

SEQ ID NO: 3302209 - protein, 15 aa, Plasmodium falciparum
AKQQKIKEDRERKNL

SEQ ID NO: 3302210 - protein, 4 aa, Plasmodium falciparum
AKQS

SEQ ID NO: 3302211 - protein, 19 aa, Plasmodium falciparum
AKRAEQNLSTYETKNDNSL

SEQ ID NO: 3302212 - protein, 6 aa, Plasmodium falciparum
AKRDNN

SEQ ID NO: 3302213 - protein, 15 aa, Plasmodium falciparum
AKRKKKKKKKKKNMN

SEQ ID NO: 3302214 - protein, 6 aa, Plasmodium falciparum
AKRREL

SEQ ID NO: 3302215 - protein, 6 aa, Plasmodium falciparum
AKRRTK

SEQ ID NO: 3302216 - protein, 15 aa, Plasmodium falciparum
AKRSTAKNKGDDDYH

SEQ ID NO: 3302217 - protein, 6 aa, Plasmodium falciparum
AKRTSS

SEQ ID NO: 3302218 - protein, 11 aa, Plasmodium falciparum
AKRYGKISEGN

SEQ ID NO: 3302219 - protein, 6 aa, Plasmodium falciparum
AKSEEL

SEQ ID NO: 3302220 - protein, 6 aa, Plasmodium falciparum
AKSEMK

SEQ ID NO: 3302221 - protein, 7 aa, Plasmodium falciparum
AKSFDRA

SEQ ID NO: 3302222 - protein, 6 aa, Plasmodium falciparum
AKSFSS

SEQ ID NO: 3302223 - protein, 109 aa, Plasmodium falciparum
AKSHAGEENTGKSYEGEENTGKSYEGEENTGKSYEGEENTGKSYEGEENTGKSNEGEENTGKSYEDEENTGKTYEDEENTGKTYEVDEKQKGKAKRGRPKRKSKRKGKI

SEQ ID NO: 3302224 - protein, 5 aa, Plasmodium falciparum
AKSLE

SEQ ID NO: 3302225 - protein, 22 aa, Plasmodium falciparum
AKSNDNNNNNNNNTHNSNNNNN

SEQ ID NO: 3302226 - protein, 13 aa, Plasmodium falciparum
AKSNSIEQKLDDE

SEQ ID NO: 3302227 - protein, 6 aa, Plasmodium falciparum
AKSPHG

SEQ ID NO: 3302228 - protein, 11 aa, Plasmodium falciparum
AKSQFKNKSIA

SEQ ID NO: 3302229 - protein, 57 aa, Plasmodium falciparum
AKSSISVQSKNNENNMNKEKDNKKKNNNNNNNNNNNNNNNNNNNNNNNNNNNNNNNN

SEQ ID NO: 3302230 - protein, 12 aa, Plasmodium falciparum
AKSTDTEIPKSE

SEQ ID NO: 3302231 - protein, 4 aa, Plasmodium falciparum
AKTG

SEQ ID NO: 3302232 - protein, 6 aa, Plasmodium falciparum
AKTGEL

SEQ ID NO: 3302233 - protein, 7 aa, Plasmodium falciparum
AKTGENI

SEQ ID NO: 3302234 - protein, 7 aa, Plasmodium falciparum
AKTGTNI

SEQ ID NO: 3302235 - protein, 14 aa, Plasmodium falciparum
AKTIKTSKDNPSSF

SEQ ID NO: 3302236 - protein, 10 aa, Plasmodium falciparum
AKTKKYKDIP

SEQ ID NO: 3302237 - protein, 10 aa, Plasmodium falciparum
AKTQGRNDIT

SEQ ID NO: 3302238 - protein, 10 aa, Plasmodium falciparum
AKTQKNKATN

SEQ ID NO: 3302239 - protein, 13 aa, Plasmodium falciparum
AKTSLSSKIVSSK

SEQ ID NO: 3302240 - protein, 6 aa, Plasmodium falciparum
AKTSPD

SEQ ID NO: 3302241 - protein, 22 aa, Plasmodium falciparum
AKTSTDETNMSNTKNEEGTKPK

SEQ ID NO: 3302242 - protein, 7 aa, Plasmodium falciparum
AKTSTLK

SEQ ID NO: 3302243 - protein, 13 aa, Plasmodium falciparum
AKTVKNNNSSRYG

SEQ ID NO: 3302244 - protein, 4 aa, Plasmodium falciparum
AKTY

SEQ ID NO: 3302245 - protein, 12 aa, Plasmodium falciparum
AKTYDTNTITES

SEQ ID NO: 3302246 - protein, 5 aa, Plasmodium falciparum
AKYDN

SEQ ID NO: 3302247 - protein, 10 aa, Plasmodium falciparum
AKYESMNPNS

SEQ ID NO: 3302248 - protein, 13 aa, Plasmodium falciparum
AKYNKDAKNEKVK

SEQ ID NO: 3302249 - protein, 12 aa, Plasmodium falciparum
ALDERKEELGND

SEQ ID NO: 3302250 - protein, 12 aa, Plasmodium falciparum
ALDNDDAKSGLN

SEQ ID NO: 3302251 - protein, 7 aa, Plasmodium falciparum
ALDTDNT

SEQ ID NO: 3302252 - protein, 6 aa, Plasmodium falciparum
ALGGAD

SEQ ID NO: 3302253 - protein, 6 aa, Plasmodium falciparum
ALGPYK

SEQ ID NO: 3302254 - protein, 7 aa, Plasmodium falciparum
ALKENNQ

SEQ ID NO: 3302255 - protein, 5 aa, Plasmodium falciparum
ALKGA

SEQ ID NO: 3302256 - protein, 10 aa, Plasmodium falciparum
ALKGNKKAIE

SEQ ID NO: 3302257 - protein, 5 aa, Plasmodium falciparum
ALKKT

SEQ ID NO: 3302258 - protein, 7 aa, Plasmodium falciparum
ALKQQEE

SEQ ID NO: 3302259 - protein, 15 aa, Plasmodium falciparum
ALNGSGANDINSNSN

SEQ ID NO: 3302260 - protein, 17 aa, Plasmodium falciparum
ALNKKKKNNKEEWEQDE

SEQ ID NO: 3302261 - protein, 11 aa, Plasmodium falciparum
ALNTSKNYTTD

SEQ ID NO: 3302262 - protein, 6 aa, Plasmodium falciparum
ALPKSK

SEQ ID NO: 3302263 - protein, 5 aa, Plasmodium falciparum
ALQGS

SEQ ID NO: 3302264 - protein, 12 aa, Plasmodium falciparum
ALRKKKKKEKEN

SEQ ID NO: 3302265 - protein, 6 aa, Plasmodium falciparum
ALRNRK

SEQ ID NO: 3302266 - protein, 4 aa, Plasmodium falciparum
ALSG

SEQ ID NO: 3302267 - protein, 11 aa, Plasmodium falciparum
ALSNSSNINSF

SEQ ID NO: 3302268 - protein, 6 aa, Plasmodium falciparum
ALTNDD

SEQ ID NO: 3302269 - protein, 13 aa, Plasmodium falciparum
ALTTSDNKQSDIR

SEQ ID NO: 3302270 - protein, 4 aa, Plasmodium falciparum
ALVN

SEQ ID NO: 3302271 - protein, 9 aa, Plasmodium falciparum
ALYSKKNKT

SEQ ID NO: 3302272 - protein, 19 aa, Plasmodium falciparum
AMDTQNGNIKNDNIKNDNI

SEQ ID NO: 3302273 - protein, 5 aa, Plasmodium falciparum
AMKEE

SEQ ID NO: 3302274 - protein, 15 aa, Plasmodium falciparum
AMKPSEEGVSEYLSK

SEQ ID NO: 3302275 - protein, 12 aa, Plasmodium falciparum
AMSTTKENVNDS

SEQ ID NO: 3302276 - protein, 6 aa, Plasmodium falciparum
ANAGLG

SEQ ID NO: 3302277 - protein, 10 aa, Plasmodium falciparum
ANANANVNVE

SEQ ID NO: 3302278 - protein, 9 aa, Plasmodium falciparum
ANANMGNNN

SEQ ID NO: 3302279 - protein, 8 aa, Plasmodium falciparum
ANASGKSS

SEQ ID NO: 3302280 - protein, 17 aa, Plasmodium falciparum
ANATSNQNKNKNNSKRG

SEQ ID NO: 3302281 - protein, 23 aa, Plasmodium falciparum
ANDDSSKNGNNKEKEKKYEGSKW

SEQ ID NO: 3302282 - protein, 11 aa, Plasmodium falciparum
ANDECKEKKEK

SEQ ID NO: 3302283 - protein, 7 aa, Plasmodium falciparum
ANDEPNN

SEQ ID NO: 3302284 - protein, 11 aa, Plasmodium falciparum
ANDERNSQNLR

SEQ ID NO: 3302285 - protein, 71 aa, Plasmodium falciparum
ANDGTNMTETNNINDNHNNDNNNNNDGVVNADGNNIYGPNNNNVIGSDGNVNNANNTTTNNNNNNNNNNLG

SEQ ID NO: 3302286 - protein, 10 aa, Plasmodium falciparum
ANDINPNDAN

SEQ ID NO: 3302287 - protein, 10 aa, Plasmodium falciparum
ANDLERTPED

SEQ ID NO: 3302288 - protein, 41 aa, Plasmodium falciparum
ANDNNNNIDDENMPGNINRGKKKNHNNNKYHNGKDNHMSTT

SEQ ID NO: 3302289 - protein, 6 aa, Plasmodium falciparum
ANDPKY

SEQ ID NO: 3302290 - protein, 5 aa, Plasmodium falciparum
ANDPL

SEQ ID NO: 3302291 - protein, 7 aa, Plasmodium falciparum
ANDQEPI

SEQ ID NO: 3302292 - protein, 21 aa, Plasmodium falciparum
ANDQINKDKQSYNHGESQGNI

SEQ ID NO: 3302293 - protein, 7 aa, Plasmodium falciparum
ANEAKKI

SEQ ID NO: 3302294 - protein, 8 aa, Plasmodium falciparum
ANEDEDRK

SEQ ID NO: 3302295 - protein, 6 aa, Plasmodium falciparum
ANEDGY

SEQ ID NO: 3302296 - protein, 6 aa, Plasmodium falciparum
ANEEDE

SEQ ID NO: 3302297 - protein, 37 aa, Plasmodium falciparum
ANEEKNSEQIRKKKKKNKKKIKKKKKKKKDKKNKLPA

SEQ ID NO: 3302298 - protein, 5 aa, Plasmodium falciparum
ANEEL

SEQ ID NO: 3302299 - protein, 10 aa, Plasmodium falciparum
ANEENTPTAP

SEQ ID NO: 3302300 - protein, 8 aa, Plasmodium falciparum
ANEESTNI

SEQ ID NO: 3302301 - protein, 5 aa, Plasmodium falciparum
ANEFN

SEQ ID NO: 3302302 - protein, 80 aa, Plasmodium falciparum
ANEINGDIKKDENNDDDNIKDENNDDNNNNDDNNNNDDNIKDENNDDNNNNDDRNNHNNIHKSDDQNHNEAGGDANQNCK

SEQ ID NO: 3302303 - protein, 6 aa, Plasmodium falciparum
ANEKDY

SEQ ID NO: 3302304 - protein, 11 aa, Plasmodium falciparum
ANEKKEKEKQQ

SEQ ID NO: 3302305 - protein, 12 aa, Plasmodium falciparum
ANEKKSDFSVPN

SEQ ID NO: 3302306 - protein, 7 aa, Plasmodium falciparum
ANENMED

SEQ ID NO: 3302307 - protein, 6 aa, Plasmodium falciparum
ANEQNG

SEQ ID NO: 3302308 - protein, 6 aa, Plasmodium falciparum
ANEQRC

SEQ ID NO: 3302309 - protein, 5 aa, Plasmodium falciparum
ANERN

SEQ ID NO: 3302310 - protein, 4 aa, Plasmodium falciparum
ANET

SEQ ID NO: 3302311 - protein, 9 aa, Plasmodium falciparum
ANETNGDGK

SEQ ID NO: 3302312 - protein, 6 aa, Plasmodium falciparum
ANETSA

SEQ ID NO: 3302313 - protein, 4 aa, Plasmodium falciparum
ANEY

SEQ ID NO: 3302314 - protein, 8 aa, Plasmodium falciparum
ANFEQERS

SEQ ID NO: 3302315 - protein, 6 aa, Plasmodium falciparum
ANFKRQ

SEQ ID NO: 3302316 - protein, 14 aa, Plasmodium falciparum
ANGLGQGNKNNINI

SEQ ID NO: 3302317 - protein, 4 aa, Plasmodium falciparum
ANGN

SEQ ID NO: 3302318 - protein, 6 aa, Plasmodium falciparum
ANGNDA

SEQ ID NO: 3302319 - protein, 7 aa, Plasmodium falciparum
ANGNLKN

SEQ ID NO: 3302320 - protein, 6 aa, Plasmodium falciparum
ANGTKR

SEQ ID NO: 3302321 - protein, 7 aa, Plasmodium falciparum
ANGTSVS

SEQ ID NO: 3302322 - protein, 4 aa, Plasmodium falciparum
ANGY

SEQ ID NO: 3302323 - protein, 36 aa, Plasmodium falciparum
ANIKGSQNKTTDGNNNNINNSNSSSCCSNNNNESDI

SEQ ID NO: 3302324 - protein, 5 aa, Plasmodium falciparum
ANINE

SEQ ID NO: 3302325 - protein, 11 aa, Plasmodium falciparum
ANINNNNNMNN

SEQ ID NO: 3302326 - protein, 5 aa, Plasmodium falciparum
ANITT

SEQ ID NO: 3302327 - protein, 13 aa, Plasmodium falciparum
ANKDMETKREISN

SEQ ID NO: 3302328 - protein, 10 aa, Plasmodium falciparum
ANKHTSKKNY

SEQ ID NO: 3302329 - protein, 19 aa, Plasmodium falciparum
ANKISSDISVTSKNNFKET

SEQ ID NO: 3302330 - protein, 5 aa, Plasmodium falciparum
ANKKG

SEQ ID NO: 3302331 - protein, 9 aa, Plasmodium falciparum
ANKKNIKKS

SEQ ID NO: 3302332 - protein, 7 aa, Plasmodium falciparum
ANKKNVT

SEQ ID NO: 3302333 - protein, 13 aa, Plasmodium falciparum
ANKNYKDTYKEEE

SEQ ID NO: 3302334 - protein, 6 aa, Plasmodium falciparum
ANKPFE

SEQ ID NO: 3302335 - protein, 8 aa, Plasmodium falciparum
ANKRNTWD

SEQ ID NO: 3302336 - protein, 32 aa, Plasmodium falciparum
ANKTNGGNKTFDGNNTFDGNNTFDGNNTFDGN

SEQ ID NO: 3302337 - protein, 12 aa, Plasmodium falciparum
ANLKEPKEFDRE

SEQ ID NO: 3302338 - protein, 10 aa, Plasmodium falciparum
ANLKEPKELE

SEQ ID NO: 3302339 - protein, 14 aa, Plasmodium falciparum
ANLNANENSTNSAE

SEQ ID NO: 3302340 - protein, 6 aa, Plasmodium falciparum
ANMEKE

SEQ ID NO: 3302341 - protein, 6 aa, Plasmodium falciparum
ANMPST

SEQ ID NO: 3302342 - protein, 7 aa, Plasmodium falciparum
ANMQNSG

SEQ ID NO: 3302343 - protein, 5 aa, Plasmodium falciparum
ANNCK

SEQ ID NO: 3302344 - protein, 4 aa, Plasmodium falciparum
ANNE

SEQ ID NO: 3302345 - protein, 43 aa, Plasmodium falciparum
ANNEDNTQKEINNNNNNNNNNSNNNNSNNNNSNNNNSNSNLYG

SEQ ID NO: 3302346 - protein, 8 aa, Plasmodium falciparum
ANNEEQNK

SEQ ID NO: 3302347 - protein, 12 aa, Plasmodium falciparum
ANNFDEPTNNTF

SEQ ID NO: 3302348 - protein, 18 aa, Plasmodium falciparum
ANNKSSLFSKDNNNNSNT

SEQ ID NO: 3302349 - protein, 11 aa, Plasmodium falciparum
ANNLKDKNNDI

SEQ ID NO: 3302350 - protein, 12 aa, Plasmodium falciparum
ANNLNKTKKITA

SEQ ID NO: 3302351 - protein, 5 aa, Plasmodium falciparum
ANNMQ

SEQ ID NO: 3302352 - protein, 9 aa, Plasmodium falciparum
ANNNDQQDI

SEQ ID NO: 3302353 - protein, 8 aa, Plasmodium falciparum
ANNNNDPS

SEQ ID NO: 3302354 - protein, 29 aa, Plasmodium falciparum
ANNNNNNHNNNNNNNNNNYSQKDSHTNKY

SEQ ID NO: 3302355 - protein, 7 aa, Plasmodium falciparum
ANNQNDV

SEQ ID NO: 3302356 - protein, 15 aa, Plasmodium falciparum
ANNQQQFRQILSNIV

SEQ ID NO: 3302357 - protein, 27 aa, Plasmodium falciparum
ANNTKNNNNNINNNNNNNNNNNNNNTK

SEQ ID NO: 3302358 - protein, 16 aa, Plasmodium falciparum
ANNTNNTENIPNKKPC

SEQ ID NO: 3302359 - protein, 8 aa, Plasmodium falciparum
ANNTSREM

SEQ ID NO: 3302360 - protein, 4 aa, Plasmodium falciparum
ANNY

SEQ ID NO: 3302361 - protein, 14 aa, Plasmodium falciparum
ANPDFANRQATSPA

SEQ ID NO: 3302362 - protein, 4 aa, Plasmodium falciparum
ANPE

SEQ ID NO: 3302363 - protein, 12 aa, Plasmodium falciparum
ANPINSRYDKNK

SEQ ID NO: 3302364 - protein, 7 aa, Plasmodium falciparum
ANPKYNT

SEQ ID NO: 3302365 - protein, 59 aa, Plasmodium falciparum
ANPNNNNPNDNPKNNYKDKNNNKNNNKNNNKNNNKNNNKNNNKNNNKNNNNNKNNLNSN

SEQ ID NO: 3302366 - protein, 26 aa, Plasmodium falciparum
ANPNQNQNKNQNKNQNKNQNNINNNI

SEQ ID NO: 3302367 - protein, 7 aa, Plasmodium falciparum
ANPSGLN

SEQ ID NO: 3302368 - protein, 8 aa, Plasmodium falciparum
ANPVNGKY

SEQ ID NO: 3302369 - protein, 9 aa, Plasmodium falciparum
ANQHSHEKQ

SEQ ID NO: 3302370 - protein, 9 aa, Plasmodium falciparum
ANQNENHSY

SEQ ID NO: 3302371 - protein, 9 aa, Plasmodium falciparum
ANQNITDKP

SEQ ID NO: 3302372 - protein, 6 aa, Plasmodium falciparum
ANQNNN

SEQ ID NO: 3302373 - protein, 5 aa, Plasmodium falciparum
ANRPY

SEQ ID NO: 3302374 - protein, 13 aa, Plasmodium falciparum
ANRRKRGAGQKGV

SEQ ID NO: 3302375 - protein, 5 aa, Plasmodium falciparum
ANSDS

SEQ ID NO: 3302376 - protein, 5 aa, Plasmodium falciparum
ANSEK

SEQ ID NO: 3302377 - protein, 10 aa, Plasmodium falciparum
ANSETGSGKT

SEQ ID NO: 3302378 - protein, 21 aa, Plasmodium falciparum
ANSETNKNPTSHSNSTTTSLN

SEQ ID NO: 3302379 - protein, 7 aa, Plasmodium falciparum
ANSFSNE

SEQ ID NO: 3302380 - protein, 8 aa, Plasmodium falciparum
ANSKAGVI

SEQ ID NO: 3302381 - protein, 29 aa, Plasmodium falciparum
ANSLATYGKYKGGAGGENAGASLYEKKYV

SEQ ID NO: 3302382 - protein, 14 aa, Plasmodium falciparum
ANSNALNNSHYKRD

SEQ ID NO: 3302383 - protein, 52 aa, Plasmodium falciparum
ANSNDGTSYNNGMDKTQNDKNHTHNNNNNNNNNSSEKNHNMHSNDKEYADNV

SEQ ID NO: 3302384 - protein, 5 aa, Plasmodium falciparum
ANSNS

SEQ ID NO: 3302385 - protein, 6 aa, Plasmodium falciparum
ANSNTL

SEQ ID NO: 3302386 - protein, 7 aa, Plasmodium falciparum
ANSPEDK

SEQ ID NO: 3302387 - protein, 21 aa, Plasmodium falciparum
ANSQEKEDKKSKNYYKKTYNN

SEQ ID NO: 3302388 - protein, 9 aa, Plasmodium falciparum
ANSQISSNK

SEQ ID NO: 3302389 - protein, 62 aa, Plasmodium falciparum
ANSQSSLKDDLSSDCDKKNNNQYKKKNEHGRGNEKEKEKEKEKGKEKEKEKGKEKEKEKEKQ

SEQ ID NO: 3302390 - protein, 7 aa, Plasmodium falciparum
ANSRGTT

SEQ ID NO: 3302391 - protein, 39 aa, Plasmodium falciparum
ANSRRNDQINNDDNKTVKDKMKRKNKTTVDNKRSENFNE

SEQ ID NO: 3302392 - protein, 14 aa, Plasmodium falciparum
ANSSIKNNSDNSTK

SEQ ID NO: 3302393 - protein, 10 aa, Plasmodium falciparum
ANSSNENNNV

SEQ ID NO: 3302394 - protein, 16 aa, Plasmodium falciparum
ANSSSDEENEEDEEIV

SEQ ID NO: 3302395 - protein, 10 aa, Plasmodium falciparum
ANSSSSLSSF

SEQ ID NO: 3302396 - protein, 7 aa, Plasmodium falciparum
ANSTMKS

SEQ ID NO: 3302397 - protein, 9 aa, Plasmodium falciparum
ANSYPSINT

SEQ ID NO: 3302398 - protein, 5 aa, Plasmodium falciparum
ANTAS

SEQ ID NO: 3302399 - protein, 4 aa, Plasmodium falciparum
ANTH

SEQ ID NO: 3302400 - protein, 30 aa, Plasmodium falciparum
ANTKKEKKELEKKNSGNEDEENEGQSDDEE

SEQ ID NO: 3302401 - protein, 6 aa, Plasmodium falciparum
ANTLNN

SEQ ID NO: 3302402 - protein, 5 aa, Plasmodium falciparum
ANTNI

SEQ ID NO: 3302403 - protein, 7 aa, Plasmodium falciparum
ANTNKKS

SEQ ID NO: 3302404 - protein, 15 aa, Plasmodium falciparum
ANTNTLNSSSNYNKI

SEQ ID NO: 3302405 - protein, 70 aa, Plasmodium falciparum
ANTNTNANTNTNANVNTNVNTNVNTNVNTNVNTNTNTNVNTNTNTNVNTNTNTNAETNAEINTESFDREE

SEQ ID NO: 3302406 - protein, 6 aa, Plasmodium falciparum
ANTRYN

SEQ ID NO: 3302407 - protein, 8 aa, Plasmodium falciparum
ANTSREEV

SEQ ID NO: 3302408 - protein, 7 aa, Plasmodium falciparum
ANTTKLS

SEQ ID NO: 3302409 - protein, 6 aa, Plasmodium falciparum
ANTTLK

SEQ ID NO: 3302410 - protein, 5 aa, Plasmodium falciparum
ANTTV

SEQ ID NO: 3302411 - protein, 4 aa, Plasmodium falciparum
ANTY

SEQ ID NO: 3302412 - protein, 10 aa, Plasmodium falciparum
ANVDADESGL

SEQ ID NO: 3302413 - protein, 4 aa, Plasmodium falciparum
ANVI

SEQ ID NO: 3302414 - protein, 16 aa, Plasmodium falciparum
ANVTEGNITKGNNMKE

SEQ ID NO: 3302415 - protein, 5 aa, Plasmodium falciparum
ANVTN

SEQ ID NO: 3302416 - protein, 13 aa, Plasmodium falciparum
ANYDNDKGDQLNI

SEQ ID NO: 3302417 - protein, 8 aa, Plasmodium falciparum
ANYDSTSD

SEQ ID NO: 3302418 - protein, 16 aa, Plasmodium falciparum
APAAPGTPDIENIEKN

SEQ ID NO: 3302419 - protein, 14 aa, Plasmodium falciparum
APAPDTNPPPLPSD

SEQ ID NO: 3302420 - protein, 36 aa, Plasmodium falciparum
APASAAKADEPKKEEAKKVEEEEEEEEDGFMGFGMF

SEQ ID NO: 3302421 - protein, 5 aa, Plasmodium falciparum
APDGS

SEQ ID NO: 3302422 - protein, 6 aa, Plasmodium falciparum
APDGST

SEQ ID NO: 3302423 - protein, 5 aa, Plasmodium falciparum
APDKH

SEQ ID NO: 3302424 - protein, 13 aa, Plasmodium falciparum
APDNDINHTNDTY

SEQ ID NO: 3302425 - protein, 13 aa, Plasmodium falciparum
APDNSQTNSGFTS

SEQ ID NO: 3302426 - protein, 6 aa, Plasmodium falciparum
APEESM

SEQ ID NO: 3302427 - protein, 9 aa, Plasmodium falciparum
APEIDGSKD

SEQ ID NO: 3302428 - protein, 6 aa, Plasmodium falciparum
APESYK

SEQ ID NO: 3302429 - protein, 5 aa, Plasmodium falciparum
APEYG

SEQ ID NO: 3302430 - protein, 5 aa, Plasmodium falciparum
APFDS

SEQ ID NO: 3302431 - protein, 4 aa, Plasmodium falciparum
APFK

SEQ ID NO: 3302432 - protein, 26 aa, Plasmodium falciparum
APFSNNEDHNINKNEYDQNNYYNKKN

SEQ ID NO: 3302433 - protein, 9 aa, Plasmodium falciparum
APGGGKSTR

SEQ ID NO: 3302434 - protein, 8 aa, Plasmodium falciparum
APGGTDEK

SEQ ID NO: 3302435 - protein, 9 aa, Plasmodium falciparum
APGKKDESI

SEQ ID NO: 3302436 - protein, 8 aa, Plasmodium falciparum
APGSKTAQ

SEQ ID NO: 3302437 - protein, 8 aa, Plasmodium falciparum
APGTGKTT

SEQ ID NO: 3302438 - protein, 13 aa, Plasmodium falciparum
APGTGTVAKGGLN

SEQ ID NO: 3302439 - protein, 12 aa, Plasmodium falciparum
APKAGKKGEGFD

SEQ ID NO: 3302440 - protein, 13 aa, Plasmodium falciparum
APKAKMNQQRSRR

SEQ ID NO: 3302441 - protein, 9 aa, Plasmodium falciparum
APKEKTSNV

SEQ ID NO: 3302442 - protein, 7 aa, Plasmodium falciparum
APKENEA

SEQ ID NO: 3302443 - protein, 13 aa, Plasmodium falciparum
APKFPEDTLTNSN

SEQ ID NO: 3302444 - protein, 4 aa, Plasmodium falciparum
APKP

SEQ ID NO: 3302445 - protein, 9 aa, Plasmodium falciparum
APKRPGDKL

SEQ ID NO: 3302446 - protein, 9 aa, Plasmodium falciparum
APKTSDAKL

SEQ ID NO: 3302447 - protein, 4 aa, Plasmodium falciparum
APKY

SEQ ID NO: 3302448 - protein, 5 aa, Plasmodium falciparum
APLES

SEQ ID NO: 3302449 - protein, 6 aa, Plasmodium falciparum
APLSPR

SEQ ID NO: 3302450 - protein, 14 aa, Plasmodium falciparum
APLTNQYSGPKKNT

SEQ ID NO: 3302451 - protein, 8 aa, Plasmodium falciparum
APNAGKSS

SEQ ID NO: 3302452 - protein, 7 aa, Plasmodium falciparum
APNEKKK

SEQ ID NO: 3302453 - protein, 7 aa, Plasmodium falciparum
APNKEAL

SEQ ID NO: 3302454 - protein, 6 aa, Plasmodium falciparum
APNKEK

SEQ ID NO: 3302455 - protein, 21 aa, Plasmodium falciparum
APNKNDNISDMEETKLKKKKR

SEQ ID NO: 3302456 - protein, 27 aa, Plasmodium falciparum
APNKSNQTNINKKNDDSKDQNYFDLMF

SEQ ID NO: 3302457 - protein, 4 aa, Plasmodium falciparum
APNL

SEQ ID NO: 3302458 - protein, 5 aa, Plasmodium falciparum
APNNF

SEQ ID NO: 3302459 - protein, 10 aa, Plasmodium falciparum
APNNNNNNNN

SEQ ID NO: 3302460 - protein, 29 aa, Plasmodium falciparum
APNNNNNNNNNNNNNNNNNNNNNNNINKG

SEQ ID NO: 3302461 - protein, 7 aa, Plasmodium falciparum
APNNTND

SEQ ID NO: 3302462 - protein, 6 aa, Plasmodium falciparum
APNQRK

SEQ ID NO: 3302463 - protein, 5 aa, Plasmodium falciparum
APNQT

SEQ ID NO: 3302464 - protein, 7 aa, Plasmodium falciparum
APNVGKS

SEQ ID NO: 3302465 - protein, 22 aa, Plasmodium falciparum
APPELKGSELEKRGEKRQKAEE

SEQ ID NO: 3302466 - protein, 5 aa, Plasmodium falciparum
APPER

SEQ ID NO: 3302467 - protein, 4 aa, Plasmodium falciparum
APPG

SEQ ID NO: 3302468 - protein, 8 aa, Plasmodium falciparum
APPKDDTP

SEQ ID NO: 3302469 - protein, 18 aa, Plasmodium falciparum
APPLENENKPWTQEDDKQ

SEQ ID NO: 3302470 - protein, 8 aa, Plasmodium falciparum
APPNAKGR

SEQ ID NO: 3302471 - protein, 14 aa, Plasmodium falciparum
APPPYAGDNTASVN

SEQ ID NO: 3302472 - protein, 4 aa, Plasmodium falciparum
APQE

SEQ ID NO: 3302473 - protein, 6 aa, Plasmodium falciparum
APRGTQ

SEQ ID NO: 3302474 - protein, 7 aa, Plasmodium falciparum
APRNPRY

SEQ ID NO: 3302475 - protein, 27 aa, Plasmodium falciparum
APSKDEEDEKEKKKKKKKKKKKKNELI

SEQ ID NO: 3302476 - protein, 29 aa, Plasmodium falciparum
APSNQHKKYYTDKKGIPNNHNDDIKHSKK

SEQ ID NO: 3302477 - protein, 8 aa, Plasmodium falciparum
APSSIDEK

SEQ ID NO: 3302478 - protein, 11 aa, Plasmodium falciparum
APSSKNNITDN

SEQ ID NO: 3302479 - protein, 4 aa, Plasmodium falciparum
APST

SEQ ID NO: 3302480 - protein, 5 aa, Plasmodium falciparum
APTGH

SEQ ID NO: 3302481 - protein, 8 aa, Plasmodium falciparum
APTGSGKT

SEQ ID NO: 3302482 - protein, 8 aa, Plasmodium falciparum
APVTPQES

SEQ ID NO: 3302483 - protein, 10 aa, Plasmodium falciparum
APYDRPVPKT

SEQ ID NO: 3302484 - protein, 11 aa, Plasmodium falciparum
APYGSAKNVNQ

SEQ ID NO: 3302485 - protein, 5 aa, Plasmodium falciparum
AQANL

SEQ ID NO: 3302486 - protein, 19 aa, Plasmodium falciparum
AQDEGENKSHNISNNSKSA

SEQ ID NO: 3302487 - protein, 9 aa, Plasmodium falciparum
AQDKDVNNK

SEQ ID NO: 3302488 - protein, 12 aa, Plasmodium falciparum
AQDVEAGDGTTS

SEQ ID NO: 3302489 - protein, 4 aa, Plasmodium falciparum
AQEG

SEQ ID NO: 3302490 - protein, 4 aa, Plasmodium falciparum
AQEN

SEQ ID NO: 3302491 - protein, 8 aa, Plasmodium falciparum
AQEQKTNN

SEQ ID NO: 3302492 - protein, 10 aa, Plasmodium falciparum
AQESPPGSMP

SEQ ID NO: 3302493 - protein, 7 aa, Plasmodium falciparum
AQGEAEA

SEQ ID NO: 3302494 - protein, 19 aa, Plasmodium falciparum
AQGNKEQDIKKAEESKNET

SEQ ID NO: 3302495 - protein, 4 aa, Plasmodium falciparum
AQGR

SEQ ID NO: 3302496 - protein, 10 aa, Plasmodium falciparum
AQHTKGNKYA

SEQ ID NO: 3302497 - protein, 7 aa, Plasmodium falciparum
AQKDEYD

SEQ ID NO: 3302498 - protein, 15 aa, Plasmodium falciparum
AQKDKVDKNKSKKNY

SEQ ID NO: 3302499 - protein, 9 aa, Plasmodium falciparum
AQKENKDSH

SEQ ID NO: 3302500 - protein, 5 aa, Plasmodium falciparum
AQKEY

SEQ ID NO: 3302501 - protein, 14 aa, Plasmodium falciparum
AQKKKKADDSNKDE

SEQ ID NO: 3302502 - protein, 8 aa, Plasmodium falciparum
AQKNLQEK

SEQ ID NO: 3302503 - protein, 4 aa, Plasmodium falciparum
AQKY

SEQ ID NO: 3302504 - protein, 15 aa, Plasmodium falciparum
AQLKESTDDKDNDDV

SEQ ID NO: 3302505 - protein, 10 aa, Plasmodium falciparum
AQNDDTDKLR

SEQ ID NO: 3302506 - protein, 28 aa, Plasmodium falciparum
AQNGQQQPNLNAAGQHNAQQLQQQGNNQ

SEQ ID NO: 3302507 - protein, 4 aa, Plasmodium falciparum
AQNK

SEQ ID NO: 3302508 - protein, 8 aa, Plasmodium falciparum
AQNKRTKK

SEQ ID NO: 3302509 - protein, 10 aa, Plasmodium falciparum
AQNSDQRVSS

SEQ ID NO: 3302510 - protein, 18 aa, Plasmodium falciparum
AQNSRNSSTFNNNEVGKN

SEQ ID NO: 3302511 - protein, 9 aa, Plasmodium falciparum
AQNTSGGMY

SEQ ID NO: 3302512 - protein, 6 aa, Plasmodium falciparum
AQPDQA

SEQ ID NO: 3302513 - protein, 6 aa, Plasmodium falciparum
AQQIND

SEQ ID NO: 3302514 - protein, 38 aa, Plasmodium falciparum
AQQKEEKKEQDVSNKEYLGNKTKRENPEEENQDESVEY

SEQ ID NO: 3302515 - protein, 4 aa, Plasmodium falciparum
AQQT

SEQ ID NO: 3302516 - protein, 8 aa, Plasmodium falciparum
AQRKDKAK

SEQ ID NO: 3302517 - protein, 8 aa, Plasmodium falciparum
AQSDAKGK

SEQ ID NO: 3302518 - protein, 10 aa, Plasmodium falciparum
AQSIGEPGTQ

SEQ ID NO: 3302519 - protein, 5 aa, Plasmodium falciparum
AQSPQ

SEQ ID NO: 3302520 - protein, 10 aa, Plasmodium falciparum
AQSQNGSGKT

SEQ ID NO: 3302521 - protein, 22 aa, Plasmodium falciparum
AQTEEEKEEIKKEMKKTEEGQD

SEQ ID NO: 3302522 - protein, 6 aa, Plasmodium falciparum
AQTEQK

SEQ ID NO: 3302523 - protein, 9 aa, Plasmodium falciparum
AQTGTRADK

SEQ ID NO: 3302524 - protein, 17 aa, Plasmodium falciparum
AQTNQNKDNQNDNDQTC

SEQ ID NO: 3302525 - protein, 14 aa, Plasmodium falciparum
AQVGDDDEEEEYES

SEQ ID NO: 3302526 - protein, 6 aa, Plasmodium falciparum
AQVGNS

SEQ ID NO: 3302527 - protein, 18 aa, Plasmodium falciparum
AQVSSAGNKTEEEKNRSG

SEQ ID NO: 3302528 - protein, 11 aa, Plasmodium falciparum
AQYQRGETYPG

SEQ ID NO: 3302529 - protein, 8 aa, Plasmodium falciparum
ARARGPRQ

SEQ ID NO: 3302530 - protein, 17 aa, Plasmodium falciparum
ARDAADAIKEKDGCDFE

SEQ ID NO: 3302531 - protein, 57 aa, Plasmodium falciparum
ARDKQENNKNGDNKNKNGDNNNKNGDNKNKNGDNKNKNGDNKNKNGDNKNKNGDNNN

SEQ ID NO: 3302532 - protein, 7 aa, Plasmodium falciparum
AREEKKK

SEQ ID NO: 3302533 - protein, 4 aa, Plasmodium falciparum
AREG

SEQ ID NO: 3302534 - protein, 21 aa, Plasmodium falciparum
AREKEKEKKLQQKKNESYDRE

SEQ ID NO: 3302535 - protein, 5 aa, Plasmodium falciparum
ARENY

SEQ ID NO: 3302536 - protein, 8 aa, Plasmodium falciparum
AREQSDDD

SEQ ID NO: 3302537 - protein, 13 aa, Plasmodium falciparum
ARHQKKKQNFGEF

SEQ ID NO: 3302538 - protein, 7 aa, Plasmodium falciparum
ARIGKEG

SEQ ID NO: 3302539 - protein, 8 aa, Plasmodium falciparum
ARKEKGLA

SEQ ID NO: 3302540 - protein, 20 aa, Plasmodium falciparum
ARKGPNSKTLNKKQSNEESF

SEQ ID NO: 3302541 - protein, 9 aa, Plasmodium falciparum
ARKKKEYED

SEQ ID NO: 3302542 - protein, 7 aa, Plasmodium falciparum
ARKQINQ

SEQ ID NO: 3302543 - protein, 8 aa, Plasmodium falciparum
ARKSPALD

SEQ ID NO: 3302544 - protein, 33 aa, Plasmodium falciparum
ARMNNNNNNNNMSNNMSNNNNNYHNPNNPSSSS

SEQ ID NO: 3302545 - protein, 8 aa, Plasmodium falciparum
ARNANESS

SEQ ID NO: 3302546 - protein, 6 aa, Plasmodium falciparum
ARNDGY

SEQ ID NO: 3302547 - protein, 10 aa, Plasmodium falciparum
ARNPKRPFEK

SEQ ID NO: 3302548 - protein, 8 aa, Plasmodium falciparum
ARPGRRRT

SEQ ID NO: 3302549 - protein, 8 aa, Plasmodium falciparum
ARQKNEKY

SEQ ID NO: 3302550 - protein, 6 aa, Plasmodium falciparum
ARQPTK

SEQ ID NO: 3302551 - protein, 4 aa, Plasmodium falciparum
ARQS

SEQ ID NO: 3302552 - protein, 7 aa, Plasmodium falciparum
ARSEANT

SEQ ID NO: 3302553 - protein, 17 aa, Plasmodium falciparum
ARSEYERGEDKKEYSRE

SEQ ID NO: 3302554 - protein, 9 aa, Plasmodium falciparum
ARSHASKTY

SEQ ID NO: 3302555 - protein, 6 aa, Plasmodium falciparum
ARSLNN

SEQ ID NO: 3302556 - protein, 6 aa, Plasmodium falciparum
ARSRGP

SEQ ID NO: 3302557 - protein, 8 aa, Plasmodium falciparum
ARSSAINK

SEQ ID NO: 3302558 - protein, 9 aa, Plasmodium falciparum
ARSVTGKSN

SEQ ID NO: 3302559 - protein, 9 aa, Plasmodium falciparum
ARTDNKGNC

SEQ ID NO: 3302560 - protein, 7 aa, Plasmodium falciparum
ARTDSVN

SEQ ID NO: 3302561 - protein, 11 aa, Plasmodium falciparum
ARTQKNKATEY

SEQ ID NO: 3302562 - protein, 14 aa, Plasmodium falciparum
ARTQMEKGGDWERK

SEQ ID NO: 3302563 - protein, 9 aa, Plasmodium falciparum
ASAGKDGSI

SEQ ID NO: 3302564 - protein, 8 aa, Plasmodium falciparum
ASAPPSMQ

SEQ ID NO: 3302565 - protein, 8 aa, Plasmodium falciparum
ASARANRN

SEQ ID NO: 3302566 - protein, 6 aa, Plasmodium falciparum
ASCGNY

SEQ ID NO: 3302567 - protein, 7 aa, Plasmodium falciparum
ASCKEDN

SEQ ID NO: 3302568 - protein, 11 aa, Plasmodium falciparum
ASCQKNKKEKI

SEQ ID NO: 3302569 - protein, 6 aa, Plasmodium falciparum
ASDACD

SEQ ID NO: 3302570 - protein, 17 aa, Plasmodium falciparum
ASDDNSSNMHLLDISPY

SEQ ID NO: 3302571 - protein, 8 aa, Plasmodium falciparum
ASDDPANW

SEQ ID NO: 3302572 - protein, 7 aa, Plasmodium falciparum
ASDDRGI

SEQ ID NO: 3302573 - protein, 4 aa, Plasmodium falciparum
ASDL

SEQ ID NO: 3302574 - protein, 24 aa, Plasmodium falciparum
ASDNFNSALSSGANTNANSNSSSL

SEQ ID NO: 3302575 - protein, 9 aa, Plasmodium falciparum
ASDNKEMPN

SEQ ID NO: 3302576 - protein, 10 aa, Plasmodium falciparum
ASDNTSDSII

SEQ ID NO: 3302577 - protein, 5 aa, Plasmodium falciparum
ASDSE

SEQ ID NO: 3302578 - protein, 5 aa, Plasmodium falciparum
ASDST

SEQ ID NO: 3302579 - protein, 4 aa, Plasmodium falciparum
ASDY

SEQ ID NO: 3302580 - protein, 17 aa, Plasmodium falciparum
ASEAKEISKKAEEELQY

SEQ ID NO: 3302581 - protein, 4 aa, Plasmodium falciparum
ASED

SEQ ID NO: 3302582 - protein, 22 aa, Plasmodium falciparum
ASEDEASKYGDVKGSDEGQNNI

SEQ ID NO: 3302583 - protein, 5 aa, Plasmodium falciparum
ASEEE

SEQ ID NO: 3302584 - protein, 9 aa, Plasmodium falciparum
ASEENNKQN

SEQ ID NO: 3302585 - protein, 7 aa, Plasmodium falciparum
ASEGTYQ

SEQ ID NO: 3302586 - protein, 6 aa, Plasmodium falciparum
ASEKPF

SEQ ID NO: 3302587 - protein, 4 aa, Plasmodium falciparum
ASEL

SEQ ID NO: 3302588 - protein, 8 aa, Plasmodium falciparum
ASENSRNV

SEQ ID NO: 3302589 - protein, 6 aa, Plasmodium falciparum
ASEPEL

SEQ ID NO: 3302590 - protein, 7 aa, Plasmodium falciparum
ASEQSAR

SEQ ID NO: 3302591 - protein, 5 aa, Plasmodium falciparum
ASEVG

SEQ ID NO: 3302592 - protein, 6 aa, Plasmodium falciparum
ASFNKN

SEQ ID NO: 3302593 - protein, 4 aa, Plasmodium falciparum
ASGE

SEQ ID NO: 3302594 - protein, 17 aa, Plasmodium falciparum
ASGGTKSKTPGPGAQSA

SEQ ID NO: 3302595 - protein, 4 aa, Plasmodium falciparum
ASGQ

SEQ ID NO: 3302596 - protein, 5 aa, Plasmodium falciparum
ASGQL

SEQ ID NO: 3302597 - protein, 9 aa, Plasmodium falciparum
ASGSGKDTQ

SEQ ID NO: 3302598 - protein, 7 aa, Plasmodium falciparum
ASGTEPK

SEQ ID NO: 3302599 - protein, 8 aa, Plasmodium falciparum
ASGTKNYT

SEQ ID NO: 3302600 - protein, 4 aa, Plasmodium falciparum
ASGV

SEQ ID NO: 3302601 - protein, 11 aa, Plasmodium falciparum
ASHNKGNTSID

SEQ ID NO: 3302602 - protein, 6 aa, Plasmodium falciparum
ASHNNN

SEQ ID NO: 3302603 - protein, 16 aa, Plasmodium falciparum
ASHNSGNFDEEKKNSV

SEQ ID NO: 3302604 - protein, 12 aa, Plasmodium falciparum
ASISSQKSPSLS

SEQ ID NO: 3302605 - protein, 6 aa, Plasmodium falciparum
ASKDKT

SEQ ID NO: 3302606 - protein, 13 aa, Plasmodium falciparum
ASKGTSNSAKAGL

SEQ ID NO: 3302607 - protein, 7 aa, Plasmodium falciparum
ASKKDLE

SEQ ID NO: 3302608 - protein, 5 aa, Plasmodium falciparum
ASKRG

SEQ ID NO: 3302609 - protein, 9 aa, Plasmodium falciparum
ASKSDSKSK

SEQ ID NO: 3302610 - protein, 11 aa, Plasmodium falciparum
ASKSQGNNNYN

SEQ ID NO: 3302611 - protein, 8 aa, Plasmodium falciparum
ASKSQNKQ

SEQ ID NO: 3302612 - protein, 15 aa, Plasmodium falciparum
ASLEKQKQEEEEKEC

SEQ ID NO: 3302613 - protein, 8 aa, Plasmodium falciparum
ASLSSISK

SEQ ID NO: 3302614 - protein, 18 aa, Plasmodium falciparum
ASMDSYKNDDIYTKFLTE

SEQ ID NO: 3302615 - protein, 13 aa, Plasmodium falciparum
ASNDSGNSNELTN

SEQ ID NO: 3302616 - protein, 6 aa, Plasmodium falciparum
ASNESL

SEQ ID NO: 3302617 - protein, 4 aa, Plasmodium falciparum
ASNG

SEQ ID NO: 3302618 - protein, 29 aa, Plasmodium falciparum
ASNGEKKKKKKKRKKKKTNTNKNKNKNIN

SEQ ID NO: 3302619 - protein, 18 aa, Plasmodium falciparum
ASNGKTIEVGNTDAEGRL

SEQ ID NO: 3302620 - protein, 13 aa, Plasmodium falciparum
ASNGSIKNGNSYD

SEQ ID NO: 3302621 - protein, 11 aa, Plasmodium falciparum
ASNLKTNEDYE

SEQ ID NO: 3302622 - protein, 4 aa, Plasmodium falciparum
ASNM

SEQ ID NO: 3302623 - protein, 5 aa, Plasmodium falciparum
ASNNA

SEQ ID NO: 3302624 - protein, 8 aa, Plasmodium falciparum
ASNNDINK

SEQ ID NO: 3302625 - protein, 6 aa, Plasmodium falciparum
ASNNKI

SEQ ID NO: 3302626 - protein, 10 aa, Plasmodium falciparum
ASNNRKKNTL

SEQ ID NO: 3302627 - protein, 5 aa, Plasmodium falciparum
ASNQL

SEQ ID NO: 3302628 - protein, 12 aa, Plasmodium falciparum
ASNSLQNSYSPY

SEQ ID NO: 3302629 - protein, 7 aa, Plasmodium falciparum
ASNSSFD

SEQ ID NO: 3302630 - protein, 12 aa, Plasmodium falciparum
ASNTHSNNEDNA

SEQ ID NO: 3302631 - protein, 6 aa, Plasmodium falciparum
ASNTKK

SEQ ID NO: 3302632 - protein, 9 aa, Plasmodium falciparum
ASNTTTKHN

SEQ ID NO: 3302633 - protein, 7 aa, Plasmodium falciparum
ASPDETA

SEQ ID NO: 3302634 - protein, 10 aa, Plasmodium falciparum
ASPKDEKDVK

SEQ ID NO: 3302635 - protein, 7 aa, Plasmodium falciparum
ASPNLSD

SEQ ID NO: 3302636 - protein, 8 aa, Plasmodium falciparum
ASPQSPQL

SEQ ID NO: 3302637 - protein, 6 aa, Plasmodium falciparum
ASPRGN

SEQ ID NO: 3302638 - protein, 31 aa, Plasmodium falciparum
ASPSKKKKKYDYEDDEIESDYDDEEDQDSKD

SEQ ID NO: 3302639 - protein, 9 aa, Plasmodium falciparum
ASQAAGKVP

SEQ ID NO: 3302640 - protein, 15 aa, Plasmodium falciparum
ASQDNIPYDNTKQNS

SEQ ID NO: 3302641 - protein, 15 aa, Plasmodium falciparum
ASQDNIPYNNSSSEN

SEQ ID NO: 3302642 - protein, 6 aa, Plasmodium falciparum
ASQEGV

SEQ ID NO: 3302643 - protein, 37 aa, Plasmodium falciparum
ASQHEDDKYNEEETFNEDDNYNEENKYNDDEGSDEGY

SEQ ID NO: 3302644 - protein, 4 aa, Plasmodium falciparum
ASQI

SEQ ID NO: 3302645 - protein, 10 aa, Plasmodium falciparum
ASQIKQKNTE

SEQ ID NO: 3302646 - protein, 48 aa, Plasmodium falciparum
ASQNNKNKSNNNNNNNNKDEKNNNNDDDDDGGGGGGGANTSGNNTSKV

SEQ ID NO: 3302647 - protein, 6 aa, Plasmodium falciparum
ASQTNA

SEQ ID NO: 3302648 - protein, 4 aa, Plasmodium falciparum
ASRA

SEQ ID NO: 3302649 - protein, 6 aa, Plasmodium falciparum
ASRDGS

SEQ ID NO: 3302650 - protein, 6 aa, Plasmodium falciparum
ASRDKT

SEQ ID NO: 3302651 - protein, 12 aa, Plasmodium falciparum
ASRFKENNNINK

SEQ ID NO: 3302652 - protein, 4 aa, Plasmodium falciparum
ASRG

SEQ ID NO: 3302653 - protein, 10 aa, Plasmodium falciparum
ASRHGQKGTI

SEQ ID NO: 3302654 - protein, 7 aa, Plasmodium falciparum
ASRRSRT

SEQ ID NO: 3302655 - protein, 4 aa, Plasmodium falciparum
ASRV

SEQ ID NO: 3302656 - protein, 11 aa, Plasmodium falciparum
ASRYDKERKRF

SEQ ID NO: 3302657 - protein, 9 aa, Plasmodium falciparum
ASSGDNIKN

SEQ ID NO: 3302658 - protein, 14 aa, Plasmodium falciparum
ASSILSNNSTENSV

SEQ ID NO: 3302659 - protein, 4 aa, Plasmodium falciparum
ASSK

SEQ ID NO: 3302660 - protein, 9 aa, Plasmodium falciparum
ASSKKQWNE

SEQ ID NO: 3302661 - protein, 14 aa, Plasmodium falciparum
ASSKNVDDEKDDIN

SEQ ID NO: 3302662 - protein, 33 aa, Plasmodium falciparum
ASSNNNNNNNSNSNNIYKNGRKRSNNRNNKNEE

SEQ ID NO: 3302663 - protein, 10 aa, Plasmodium falciparum
ASSSDEQHYE

SEQ ID NO: 3302664 - protein, 8 aa, Plasmodium falciparum
ASSSKEDT

SEQ ID NO: 3302665 - protein, 8 aa, Plasmodium falciparum
ASSTDDFQ

SEQ ID NO: 3302666 - protein, 11 aa, Plasmodium falciparum
ASSYEKHKKEV

SEQ ID NO: 3302667 - protein, 5 aa, Plasmodium falciparum
ASSYK

SEQ ID NO: 3302668 - protein, 14 aa, Plasmodium falciparum
ASTEISQNLNMDTN

SEQ ID NO: 3302669 - protein, 7 aa, Plasmodium falciparum
ASTGKGY

SEQ ID NO: 3302670 - protein, 5 aa, Plasmodium falciparum
ASTIK

SEQ ID NO: 3302671 - protein, 8 aa, Plasmodium falciparum
ASTKIGKN

SEQ ID NO: 3302672 - protein, 5 aa, Plasmodium falciparum
ASTKN

SEQ ID NO: 3302673 - protein, 5 aa, Plasmodium falciparum
ASTND

SEQ ID NO: 3302674 - protein, 12 aa, Plasmodium falciparum
ASTNKEAKEKIS

SEQ ID NO: 3302675 - protein, 5 aa, Plasmodium falciparum
ASTNN

SEQ ID NO: 3302676 - protein, 11 aa, Plasmodium falciparum
ASTNTLKNNLN

SEQ ID NO: 3302677 - protein, 4 aa, Plasmodium falciparum
ASTS

SEQ ID NO: 3302678 - protein, 8 aa, Plasmodium falciparum
ASTSKKEQ

SEQ ID NO: 3302679 - protein, 12 aa, Plasmodium falciparum
ASTTTLRYPGSM

SEQ ID NO: 3302680 - protein, 19 aa, Plasmodium falciparum
ASTVKDSSFSSKQFGTHET

SEQ ID NO: 3302681 - protein, 9 aa, Plasmodium falciparum
ASTYKNSDE

SEQ ID NO: 3302682 - protein, 7 aa, Plasmodium falciparum
ASVEKSE

SEQ ID NO: 3302683 - protein, 10 aa, Plasmodium falciparum
ASVENKQDNM

SEQ ID NO: 3302684 - protein, 9 aa, Plasmodium falciparum
ASVNGSEEN

SEQ ID NO: 3302685 - protein, 16 aa, Plasmodium falciparum
ASVNQRTGRAGRKRDG

SEQ ID NO: 3302686 - protein, 10 aa, Plasmodium falciparum
ASWGNNKNQM

SEQ ID NO: 3302687 - protein, 6 aa, Plasmodium falciparum
ASYDKS

SEQ ID NO: 3302688 - protein, 6 aa, Plasmodium falciparum
ASYNYT

SEQ ID NO: 3302689 - protein, 7 aa, Plasmodium falciparum
ASYPTDS

SEQ ID NO: 3302690 - protein, 6 aa, Plasmodium falciparum
ASYSAS

SEQ ID NO: 3302691 - protein, 16 aa, Plasmodium falciparum
ASYSDKNKEEKKLTEE

SEQ ID NO: 3302692 - protein, 13 aa, Plasmodium falciparum
ASYTERQKHDNIN

SEQ ID NO: 3302693 - protein, 5 aa, Plasmodium falciparum
ATADK

SEQ ID NO: 3302694 - protein, 4 aa, Plasmodium falciparum
ATAS

SEQ ID NO: 3302695 - protein, 7 aa, Plasmodium falciparum
ATATEDA

SEQ ID NO: 3302696 - protein, 10 aa, Plasmodium falciparum
ATCNSTNKRT

SEQ ID NO: 3302697 - protein, 5 aa, Plasmodium falciparum
ATDIN

SEQ ID NO: 3302698 - protein, 17 aa, Plasmodium falciparum
ATDNNETCGKGKEDRFS

SEQ ID NO: 3302699 - protein, 11 aa, Plasmodium falciparum
ATDNSKLNISP

SEQ ID NO: 3302700 - protein, 4 aa, Plasmodium falciparum
ATEI

SEQ ID NO: 3302701 - protein, 5 aa, Plasmodium falciparum
ATEIG

SEQ ID NO: 3302702 - protein, 10 aa, Plasmodium falciparum
ATEKNTGRNR

SEQ ID NO: 3302703 - protein, 4 aa, Plasmodium falciparum
ATEL

SEQ ID NO: 3302704 - protein, 4 aa, Plasmodium falciparum
ATEM

SEQ ID NO: 3302705 - protein, 4 aa, Plasmodium falciparum
ATEN

SEQ ID NO: 3302706 - protein, 4 aa, Plasmodium falciparum
ATER

SEQ ID NO: 3302707 - protein, 5 aa, Plasmodium falciparum
ATERS

SEQ ID NO: 3302708 - protein, 7 aa, Plasmodium falciparum
ATESYKK

SEQ ID NO: 3302709 - protein, 6 aa, Plasmodium falciparum
ATFKND

SEQ ID NO: 3302710 - protein, 8 aa, Plasmodium falciparum
ATGAGKTH

SEQ ID NO: 3302711 - protein, 7 aa, Plasmodium falciparum
ATGGNDG

SEQ ID NO: 3302712 - protein, 6 aa, Plasmodium falciparum
ATGGRY

SEQ ID NO: 3302713 - protein, 14 aa, Plasmodium falciparum
ATGLRKGKKYGRKR

SEQ ID NO: 3302714 - protein, 7 aa, Plasmodium falciparum
ATGNAIG

SEQ ID NO: 3302715 - protein, 8 aa, Plasmodium falciparum
ATGSGKTY

SEQ ID NO: 3302716 - protein, 9 aa, Plasmodium falciparum
ATHESEEKE

SEQ ID NO: 3302717 - protein, 10 aa, Plasmodium falciparum
ATIDNQSKYR

SEQ ID NO: 3302718 - protein, 9 aa, Plasmodium falciparum
ATIGGNDKD

SEQ ID NO: 3302719 - protein, 4 aa, Plasmodium falciparum
ATIS

SEQ ID NO: 3302720 - protein, 9 aa, Plasmodium falciparum
ATKARSNKL

SEQ ID NO: 3302721 - protein, 8 aa, Plasmodium falciparum
ATKKDFDE

SEQ ID NO: 3302722 - protein, 7 aa, Plasmodium falciparum
ATKKRSK

SEQ ID NO: 3302723 - protein, 5 aa, Plasmodium falciparum
ATKPS

SEQ ID NO: 3302724 - protein, 8 aa, Plasmodium falciparum
ATKPTITQ

SEQ ID NO: 3302725 - protein, 15 aa, Plasmodium falciparum
ATKTEYKYGKKPNTL

SEQ ID NO: 3302726 - protein, 5 aa, Plasmodium falciparum
ATKTG

SEQ ID NO: 3302727 - protein, 6 aa, Plasmodium falciparum
ATMNPE

SEQ ID NO: 3302728 - protein, 21 aa, Plasmodium falciparum
ATNCRNKKCGRTNQLRPKKKL

SEQ ID NO: 3302729 - protein, 7 aa, Plasmodium falciparum
ATNDDNS

SEQ ID NO: 3302730 - protein, 9 aa, Plasmodium falciparum
ATNDQINES

SEQ ID NO: 3302731 - protein, 6 aa, Plasmodium falciparum
ATNEDE

SEQ ID NO: 3302732 - protein, 6 aa, Plasmodium falciparum
ATNGDL

SEQ ID NO: 3302733 - protein, 13 aa, Plasmodium falciparum
ATNGNTSLGGEDF

SEQ ID NO: 3302734 - protein, 8 aa, Plasmodium falciparum
ATNKGGVI

SEQ ID NO: 3302735 - protein, 7 aa, Plasmodium falciparum
ATNKKER

SEQ ID NO: 3302736 - protein, 5 aa, Plasmodium falciparum
ATNLS

SEQ ID NO: 3302737 - protein, 9 aa, Plasmodium falciparum
ATNNGGGYN

SEQ ID NO: 3302738 - protein, 6 aa, Plasmodium falciparum
ATNNNT

SEQ ID NO: 3302739 - protein, 5 aa, Plasmodium falciparum
ATNNP

SEQ ID NO: 3302740 - protein, 6 aa, Plasmodium falciparum
ATNQDE

SEQ ID NO: 3302741 - protein, 15 aa, Plasmodium falciparum
ATNQNNNNNNNDNIS

SEQ ID NO: 3302742 - protein, 11 aa, Plasmodium falciparum
ATNSTTDSSKM

SEQ ID NO: 3302743 - protein, 10 aa, Plasmodium falciparum
ATNTDSLKNV

SEQ ID NO: 3302744 - protein, 4 aa, Plasmodium falciparum
ATNY

SEQ ID NO: 3302745 - protein, 10 aa, Plasmodium falciparum
ATPKEAKEGV

SEQ ID NO: 3302746 - protein, 13 aa, Plasmodium falciparum
ATPNNTQAPIPEK

SEQ ID NO: 3302747 - protein, 13 aa, Plasmodium falciparum
ATQDGTNTGIKEA

SEQ ID NO: 3302748 - protein, 11 aa, Plasmodium falciparum
ATQNNNKGNIY

SEQ ID NO: 3302749 - protein, 13 aa, Plasmodium falciparum
ATQPRGKQGPKLS

SEQ ID NO: 3302750 - protein, 7 aa, Plasmodium falciparum
ATQSTEP

SEQ ID NO: 3302751 - protein, 17 aa, Plasmodium falciparum
ATRDNRRYYPEKEEEIY

SEQ ID NO: 3302752 - protein, 5 aa, Plasmodium falciparum
ATREY

SEQ ID NO: 3302753 - protein, 6 aa, Plasmodium falciparum
ATRGDG

SEQ ID NO: 3302754 - protein, 5 aa, Plasmodium falciparum
ATRPY

SEQ ID NO: 3302755 - protein, 5 aa, Plasmodium falciparum
ATRTY

SEQ ID NO: 3302756 - protein, 6 aa, Plasmodium falciparum
ATSENN

SEQ ID NO: 3302757 - protein, 13 aa, Plasmodium falciparum
ATSGDTHLGGEDF

SEQ ID NO: 3302758 - protein, 25 aa, Plasmodium falciparum
ATSGEKKIQDDISKQGEQNKEEVSN

SEQ ID NO: 3302759 - protein, 6 aa, Plasmodium falciparum
ATSHEI

SEQ ID NO: 3302760 - protein, 7 aa, Plasmodium falciparum
ATSKTGY

SEQ ID NO: 3302761 - protein, 7 aa, Plasmodium falciparum
ATSMSTG

SEQ ID NO: 3302762 - protein, 10 aa, Plasmodium falciparum
ATSQNMRSSR

SEQ ID NO: 3302763 - protein, 5 aa, Plasmodium falciparum
ATTEH

SEQ ID NO: 3302764 - protein, 8 aa, Plasmodium falciparum
ATTGRNSQ

SEQ ID NO: 3302765 - protein, 4 aa, Plasmodium falciparum
ATTI

SEQ ID NO: 3302766 - protein, 4 aa, Plasmodium falciparum
ATTL

SEQ ID NO: 3302767 - protein, 20 aa, Plasmodium falciparum
ATTQNDKSSSFLKSNNNNNN

SEQ ID NO: 3302768 - protein, 17 aa, Plasmodium falciparum
ATTSTNDMKDEDKKNNY

SEQ ID NO: 3302769 - protein, 7 aa, Plasmodium falciparum
ATYEENN

SEQ ID NO: 3302770 - protein, 12 aa, Plasmodium falciparum
ATYKNSKNMDTL

SEQ ID NO: 3302771 - protein, 8 aa, Plasmodium falciparum
AVASKDNK

SEQ ID NO: 3302772 - protein, 9 aa, Plasmodium falciparum
AVASSPSTR

SEQ ID NO: 3302773 - protein, 4 aa, Plasmodium falciparum
AVDN

SEQ ID NO: 3302774 - protein, 14 aa, Plasmodium falciparum
AVDNNNKCNEKDNK

SEQ ID NO: 3302775 - protein, 5 aa, Plasmodium falciparum
AVEAS

SEQ ID NO: 3302776 - protein, 25 aa, Plasmodium falciparum
AVEEQKKRRKMTKEERENEKQLQKE

SEQ ID NO: 3302777 - protein, 12 aa, Plasmodium falciparum
AVEKSKNDCKHR

SEQ ID NO: 3302778 - protein, 6 aa, Plasmodium falciparum
AVGARR

SEQ ID NO: 3302779 - protein, 16 aa, Plasmodium falciparum
AVGSTPGSSNTFSHRQ

SEQ ID NO: 3302780 - protein, 4 aa, Plasmodium falciparum
AVKG

SEQ ID NO: 3302781 - protein, 10 aa, Plasmodium falciparum
AVKPQTSSQI

SEQ ID NO: 3302782 - protein, 7 aa, Plasmodium falciparum
AVKQAED

SEQ ID NO: 3302783 - protein, 8 aa, Plasmodium falciparum
AVNNGGIF

SEQ ID NO: 3302784 - protein, 9 aa, Plasmodium falciparum
AVQREDEES

SEQ ID NO: 3302785 - protein, 14 aa, Plasmodium falciparum
AVSEGTKAVTKFTS

SEQ ID NO: 3302786 - protein, 16 aa, Plasmodium falciparum
AVSEGTKAVTKYTTSA

SEQ ID NO: 3302787 - protein, 15 aa, Plasmodium falciparum
AVSKKDNEKETKIKK

SEQ ID NO: 3302788 - protein, 7 aa, Plasmodium falciparum
AVTKQKY

SEQ ID NO: 3302789 - protein, 6 aa, Plasmodium falciparum
AVTQPR

SEQ ID NO: 3302790 - protein, 10 aa, Plasmodium falciparum
AVYNSGGSFK

SEQ ID NO: 3302791 - protein, 26 aa, Plasmodium falciparum
AWRNNNNNNNNNNNNSNNNNTGQVKT

SEQ ID NO: 3302792 - protein, 6 aa, Plasmodium falciparum
AYAPYN

SEQ ID NO: 3302793 - protein, 5 aa, Plasmodium falciparum
AYDPQ

SEQ ID NO: 3302794 - protein, 86 aa, Plasmodium falciparum
AYDSHNNNNDNNNNNNNNNNNNNNNNNNNNNNNNNSDNNNNSSSNNNTTNDSTTTNNNTNSSTYNGTQNNTNLSNNNNSNNSNNSF

SEQ ID NO: 3302795 - protein, 4 aa, Plasmodium falciparum
AYEK

SEQ ID NO: 3302796 - protein, 8 aa, Plasmodium falciparum
AYENSKPY

SEQ ID NO: 3302797 - protein, 6 aa, Plasmodium falciparum
AYEPIP

SEQ ID NO: 3302798 - protein, 10 aa, Plasmodium falciparum
AYEPTPGVNE

SEQ ID NO: 3302799 - protein, 6 aa, Plasmodium falciparum
AYGEGD

SEQ ID NO: 3302800 - protein, 7 aa, Plasmodium falciparum
AYGEKGV

SEQ ID NO: 3302801 - protein, 12 aa, Plasmodium falciparum
AYGNNQNVKNGR

SEQ ID NO: 3302802 - protein, 15 aa, Plasmodium falciparum
AYGSQDNLTAMLLKF

SEQ ID NO: 3302803 - protein, 6 aa, Plasmodium falciparum
AYGTPG

SEQ ID NO: 3302804 - protein, 10 aa, Plasmodium falciparum
AYGYNRPKNS

SEQ ID NO: 3302805 - protein, 6 aa, Plasmodium falciparum
AYHETA

SEQ ID NO: 3302806 - protein, 5 aa, Plasmodium falciparum
AYKNK

SEQ ID NO: 3302807 - protein, 6 aa, Plasmodium falciparum
AYKNNE

SEQ ID NO: 3302808 - protein, 13 aa, Plasmodium falciparum
AYKYSTDSDDIER

SEQ ID NO: 3302809 - protein, 29 aa, Plasmodium falciparum
AYNDQTKSNNNNNNDNNNNNNNNEDDNVH

SEQ ID NO: 3302810 - protein, 4 aa, Plasmodium falciparum
AYNG

SEQ ID NO: 3302811 - protein, 9 aa, Plasmodium falciparum
AYNNQPNLS

SEQ ID NO: 3302812 - protein, 9 aa, Plasmodium falciparum
AYNQPEEKK

SEQ ID NO: 3302813 - protein, 4 aa, Plasmodium falciparum
AYPA

SEQ ID NO: 3302814 - protein, 5 aa, Plasmodium falciparum
AYPSE

SEQ ID NO: 3302815 - protein, 5 aa, Plasmodium falciparum
AYPST

SEQ ID NO: 3302816 - protein, 9 aa, Plasmodium falciparum
AYQKQEGAS

SEQ ID NO: 3302817 - protein, 4 aa, Plasmodium falciparum
AYQR

SEQ ID NO: 3302818 - protein, 6 aa, Plasmodium falciparum
AYREND

SEQ ID NO: 3302819 - protein, 13 aa, Plasmodium falciparum
AYRNETDNKPYIS

SEQ ID NO: 3302820 - protein, 19 aa, Plasmodium falciparum
AYSKSESGGTTGERGSGFK

SEQ ID NO: 3302821 - protein, 4 aa, Plasmodium falciparum
AYSR

SEQ ID NO: 3302822 - protein, 7 aa, Plasmodium falciparum
AYSSSDN

SEQ ID NO: 3302823 - protein, 7 aa, Plasmodium falciparum
AYTKPPD

SEQ ID NO: 3302824 - protein, 6 aa, Plasmodium falciparum
AYTNKY

SEQ ID NO: 3302825 - protein, 5 aa, Plasmodium falciparum
AYTNN

SEQ ID NO: 3302826 - protein, 12 aa, Plasmodium falciparum
AYTSTKKEGAYE

SEQ ID NO: 3302827 - protein, 4 aa, Plasmodium falciparum
AYVD

SEQ ID NO: 3302828 - protein, 8 aa, Plasmodium falciparum
AYVDPNDP

SEQ ID NO: 3302829 - protein, 10 aa, Plasmodium falciparum
AYYNSDKPGR

SEQ ID NO: 3302830 - protein, 16 aa, Plasmodium falciparum
AYYSPTSPKNQNDQMN

SEQ ID NO: 3302831 - protein, 11 aa, Plasmodium falciparum
CAAANDKGNEI

SEQ ID NO: 3302832 - protein, 6 aa, Plasmodium falciparum
CAEGES

SEQ ID NO: 3302833 - protein, 9 aa, Plasmodium falciparum
CAEKDSDTE

SEQ ID NO: 3302834 - protein, 5 aa, Plasmodium falciparum
CAENN

SEQ ID NO: 3302835 - protein, 24 aa, Plasmodium falciparum
CAESDSGDDEINTSKYKSASNGNI

SEQ ID NO: 3302836 - protein, 4 aa, Plasmodium falciparum
CANV

SEQ ID NO: 3302837 - protein, 8 aa, Plasmodium falciparum
CAPPGKRM

SEQ ID NO: 3302838 - protein, 23 aa, Plasmodium falciparum
CAQDSEKNDLKVNEDEEKNKKKC

SEQ ID NO: 3302839 - protein, 9 aa, Plasmodium falciparum
CASGGKDGV

SEQ ID NO: 3302840 - protein, 23 aa, Plasmodium falciparum
CASSEEKRIPEEFSDSENTDSDE

SEQ ID NO: 3302841 - protein, 9 aa, Plasmodium falciparum
CATKTYDNI

SEQ ID NO: 3302842 - protein, 5 aa, Plasmodium falciparum
CATYK

SEQ ID NO: 3302843 - protein, 6 aa, Plasmodium falciparum
CDDEPE

SEQ ID NO: 3302844 - protein, 19 aa, Plasmodium falciparum
CDDHNSSDSHIKKKTYKQL

SEQ ID NO: 3302845 - protein, 17 aa, Plasmodium falciparum
CDDIKDKCDDEDDNHNI

SEQ ID NO: 3302846 - protein, 8 aa, Plasmodium falciparum
CDDIQENI

SEQ ID NO: 3302847 - protein, 10 aa, Plasmodium falciparum
CDDNKRHDGD

SEQ ID NO: 3302848 - protein, 5 aa, Plasmodium falciparum
CDEDD

SEQ ID NO: 3302849 - protein, 10 aa, Plasmodium falciparum
CDEDKNKDHI

SEQ ID NO: 3302850 - protein, 31 aa, Plasmodium falciparum
CDEGKKEASNCAQEAYQKATDIAENELPSTH

SEQ ID NO: 3302851 - protein, 12 aa, Plasmodium falciparum
CDEKDNTKKTSF

SEQ ID NO: 3302852 - protein, 6 aa, Plasmodium falciparum
CDEKKR

SEQ ID NO: 3302853 - protein, 17 aa, Plasmodium falciparum
CDEKRRKKTLSNTSTNS

SEQ ID NO: 3302854 - protein, 6 aa, Plasmodium falciparum
CDENHR

SEQ ID NO: 3302855 - protein, 10 aa, Plasmodium falciparum
CDENSNNYDY

SEQ ID NO: 3302856 - protein, 16 aa, Plasmodium falciparum
CDETNSPKNEKDEKDF

SEQ ID NO: 3302857 - protein, 13 aa, Plasmodium falciparum
CDETSSVLSEEDE

SEQ ID NO: 3302858 - protein, 5 aa, Plasmodium falciparum
CDGNI

SEQ ID NO: 3302859 - protein, 8 aa, Plasmodium falciparum
CDKDEKRI

SEQ ID NO: 3302860 - protein, 9 aa, Plasmodium falciparum
CDKEGNPSN

SEQ ID NO: 3302861 - protein, 20 aa, Plasmodium falciparum
CDKENDQNIPKSGNKNKDTN

SEQ ID NO: 3302862 - protein, 8 aa, Plasmodium falciparum
CDKKTKNK

SEQ ID NO: 3302863 - protein, 8 aa, Plasmodium falciparum
CDKNEENL

SEQ ID NO: 3302864 - protein, 9 aa, Plasmodium falciparum
CDKNEGNKM

SEQ ID NO: 3302865 - protein, 12 aa, Plasmodium falciparum
CDKNNNNNINNY

SEQ ID NO: 3302866 - protein, 11 aa, Plasmodium falciparum
CDKNYDNGSPK

SEQ ID NO: 3302867 - protein, 13 aa, Plasmodium falciparum
CDKPTNYKSNKKY

SEQ ID NO: 3302868 - protein, 10 aa, Plasmodium falciparum
CDKTKNDDLI

SEQ ID NO: 3302869 - protein, 4 aa, Plasmodium falciparum
CDLP

SEQ ID NO: 3302870 - protein, 11 aa, Plasmodium falciparum
CDNKKNTEGYD

SEQ ID NO: 3302871 - protein, 52 aa, Plasmodium falciparum
CDNKNDHCDNKNDHCDNKNDHCDNKNDHCDNKNDHCDNKNDHCDNKNDHCDN

SEQ ID NO: 3302872 - protein, 5 aa, Plasmodium falciparum
CDNNK

SEQ ID NO: 3302873 - protein, 13 aa, Plasmodium falciparum
CDNNNNNNNMHND

SEQ ID NO: 3302874 - protein, 10 aa, Plasmodium falciparum
CDNSKSENYI

SEQ ID NO: 3302875 - protein, 12 aa, Plasmodium falciparum
CDNSSSEKNISN

SEQ ID NO: 3302876 - protein, 11 aa, Plasmodium falciparum
CDNTQTNKNKH

SEQ ID NO: 3302877 - protein, 4 aa, Plasmodium falciparum
CDPN

SEQ ID NO: 3302878 - protein, 13 aa, Plasmodium falciparum
CDQDEKDNIKDFS

SEQ ID NO: 3302879 - protein, 10 aa, Plasmodium falciparum
CDSRGDDSPI

SEQ ID NO: 3302880 - protein, 5 aa, Plasmodium falciparum
CDTNI

SEQ ID NO: 3302881 - protein, 5 aa, Plasmodium falciparum
CDYNT

SEQ ID NO: 3302882 - protein, 9 aa, Plasmodium falciparum
CEDDDNNKY

SEQ ID NO: 3302883 - protein, 20 aa, Plasmodium falciparum
CEDDNKNDIENMNERTSNIQ

SEQ ID NO: 3302884 - protein, 9 aa, Plasmodium falciparum
CEDNGRSLY

SEQ ID NO: 3302885 - protein, 13 aa, Plasmodium falciparum
CEDQNVEDSNTNN

SEQ ID NO: 3302886 - protein, 6 aa, Plasmodium falciparum
CEDSNK

SEQ ID NO: 3302887 - protein, 31 aa, Plasmodium falciparum
CEDSTSPTKEVTLNKSKKNQENNKNNKEVRG

SEQ ID NO: 3302888 - protein, 10 aa, Plasmodium falciparum
CEDYKKGSCN

SEQ ID NO: 3302889 - protein, 14 aa, Plasmodium falciparum
CEEENDQNYDKQER

SEQ ID NO: 3302890 - protein, 8 aa, Plasmodium falciparum
CEEGNEEK

SEQ ID NO: 3302891 - protein, 16 aa, Plasmodium falciparum
CEEKEKKTKKEQDENN

SEQ ID NO: 3302892 - protein, 9 aa, Plasmodium falciparum
CEEKPKNKT

SEQ ID NO: 3302893 - protein, 4 aa, Plasmodium falciparum
CEEN

SEQ ID NO: 3302894 - protein, 6 aa, Plasmodium falciparum
CEENRK

SEQ ID NO: 3302895 - protein, 11 aa, Plasmodium falciparum
CEEQKDQNHNY

SEQ ID NO: 3302896 - protein, 6 aa, Plasmodium falciparum
CEERQK

SEQ ID NO: 3302897 - protein, 48 aa, Plasmodium falciparum
CEESEYDQNGECSHVPKDDYSYDPNNDCSYGPNNEYPYDQNNECPYNQ

SEQ ID NO: 3302898 - protein, 12 aa, Plasmodium falciparum
CEESKKKIEECD

SEQ ID NO: 3302899 - protein, 13 aa, Plasmodium falciparum
CEGKMKKENDNIK

SEQ ID NO: 3302900 - protein, 9 aa, Plasmodium falciparum
CEGSKGTNN

SEQ ID NO: 3302901 - protein, 32 aa, Plasmodium falciparum
CEKDISNDASNKKSPTNNNKNNTSSSISISSN

SEQ ID NO: 3302902 - protein, 8 aa, Plasmodium falciparum
CEKDNGNI

SEQ ID NO: 3302903 - protein, 11 aa, Plasmodium falciparum
CEKDPPNNKKN

SEQ ID NO: 3302904 - protein, 47 aa, Plasmodium falciparum
CEKDTQNNKKNTCEKDTQNNKKNTCEKDPPNNKKNTCEKDPPNNKKN

SEQ ID NO: 3302905 - protein, 10 aa, Plasmodium falciparum
CEKEEVNSNN

SEQ ID NO: 3302906 - protein, 20 aa, Plasmodium falciparum
CEKNEKNDNKLEKSSDEHMN

SEQ ID NO: 3302907 - protein, 31 aa, Plasmodium falciparum
CEKSDDTESTEKKKKYIDDNDDDKNEQSTIN

SEQ ID NO: 3302908 - protein, 12 aa, Plasmodium falciparum
CEKSNADARASE

SEQ ID NO: 3302909 - protein, 13 aa, Plasmodium falciparum
CEKSTADARANEK

SEQ ID NO: 3302910 - protein, 4 aa, Plasmodium falciparum
CELS

SEQ ID NO: 3302911 - protein, 9 aa, Plasmodium falciparum
CENATQRSF

SEQ ID NO: 3302912 - protein, 5 aa, Plasmodium falciparum
CENDE

SEQ ID NO: 3302913 - protein, 9 aa, Plasmodium falciparum
CENDKRQKY

SEQ ID NO: 3302914 - protein, 4 aa, Plasmodium falciparum
CENN

SEQ ID NO: 3302915 - protein, 7 aa, Plasmodium falciparum
CENNYND

SEQ ID NO: 3302916 - protein, 33 aa, Plasmodium falciparum
CENSKGADENTKNFNNNKTLNNYEPENKSYNYS

SEQ ID NO: 3302917 - protein, 4 aa, Plasmodium falciparum
CENT

SEQ ID NO: 3302918 - protein, 12 aa, Plasmodium falciparum
CEQDKKDNTIEH

SEQ ID NO: 3302919 - protein, 14 aa, Plasmodium falciparum
CEQNEENENHEKSD

SEQ ID NO: 3302920 - protein, 4 aa, Plasmodium falciparum
CERR

SEQ ID NO: 3302921 - protein, 33 aa, Plasmodium falciparum
CESDNKNVSKEGEEEKKDIAENKEEVDKNKEEV

SEQ ID NO: 3302922 - protein, 4 aa, Plasmodium falciparum
CESG

SEQ ID NO: 3302923 - protein, 14 aa, Plasmodium falciparum
CESGEKLQNKKSEG

SEQ ID NO: 3302924 - protein, 7 aa, Plasmodium falciparum
CESGTRI

SEQ ID NO: 3302925 - protein, 13 aa, Plasmodium falciparum
CESKYKQNEYRQN

SEQ ID NO: 3302926 - protein, 12 aa, Plasmodium falciparum
CESSNEKREVSD

SEQ ID NO: 3302927 - protein, 12 aa, Plasmodium falciparum
CESSPSSSSSSM

SEQ ID NO: 3302928 - protein, 4 aa, Plasmodium falciparum
CETD

SEQ ID NO: 3302929 - protein, 10 aa, Plasmodium falciparum
CETTKNSSSL

SEQ ID NO: 3302930 - protein, 5 aa, Plasmodium falciparum
CEVND

SEQ ID NO: 3302931 - protein, 18 aa, Plasmodium falciparum
CGDANKQCGDANKQYDDL

SEQ ID NO: 3302932 - protein, 15 aa, Plasmodium falciparum
CGDNEDKKKKCTSAC

SEQ ID NO: 3302933 - protein, 22 aa, Plasmodium falciparum
CGDNGKTQKGVNRKVGPGRKKN

SEQ ID NO: 3302934 - protein, 12 aa, Plasmodium falciparum
CGEEDMSNNHNK

SEQ ID NO: 3302935 - protein, 4 aa, Plasmodium falciparum
CGEK

SEQ ID NO: 3302936 - protein, 12 aa, Plasmodium falciparum
CGGCGSKVPSNV

SEQ ID NO: 3302937 - protein, 6 aa, Plasmodium falciparum
CGGGLH

SEQ ID NO: 3302938 - protein, 26 aa, Plasmodium falciparum
CGNKRNYTSNNSGDYNESVKSNNYYN

SEQ ID NO: 3302939 - protein, 6 aa, Plasmodium falciparum
CGNNNN

SEQ ID NO: 3302940 - protein, 5 aa, Plasmodium falciparum
CGNNT

SEQ ID NO: 3302941 - protein, 4 aa, Plasmodium falciparum
CGNQ

SEQ ID NO: 3302942 - protein, 4 aa, Plasmodium falciparum
CGNT

SEQ ID NO: 3302943 - protein, 8 aa, Plasmodium falciparum
CGPNTNGS

SEQ ID NO: 3302944 - protein, 12 aa, Plasmodium falciparum
CGQANSTNSGLG

SEQ ID NO: 3302945 - protein, 16 aa, Plasmodium falciparum
CGQNNNTKDVNEQKKK

SEQ ID NO: 3302946 - protein, 7 aa, Plasmodium falciparum
CGRRNVG

SEQ ID NO: 3302947 - protein, 20 aa, Plasmodium falciparum
CGRSPRYEGSKKSYAENNSR

SEQ ID NO: 3302948 - protein, 41 aa, Plasmodium falciparum
CGRSQKKLYDSTSSCKNFDESTNKSYMTPDRRYTDSSGLPP

SEQ ID NO: 3302949 - protein, 6 aa, Plasmodium falciparum
CGRTNK

SEQ ID NO: 3302950 - protein, 9 aa, Plasmodium falciparum
CGSNSVGKK

SEQ ID NO: 3302951 - protein, 22 aa, Plasmodium falciparum
CGSRGNQNDASGYVGNKRKPIE

SEQ ID NO: 3302952 - protein, 6 aa, Plasmodium falciparum
CGTGKT

SEQ ID NO: 3302953 - protein, 10 aa, Plasmodium falciparum
CGTPTKDGFG

SEQ ID NO: 3302954 - protein, 6 aa, Plasmodium falciparum
CGVTSN

SEQ ID NO: 3302955 - protein, 9 aa, Plasmodium falciparum
CHDKKKSSK

SEQ ID NO: 3302956 - protein, 8 aa, Plasmodium falciparum
CHNNENKI

SEQ ID NO: 3302957 - protein, 7 aa, Plasmodium falciparum
CHNNYDN

SEQ ID NO: 3302958 - protein, 18 aa, Plasmodium falciparum
CHSPNENKNKDNHNQCED

SEQ ID NO: 3302959 - protein, 26 aa, Plasmodium falciparum
CIDDEEQKEPFHNNANTQNDNKCNNN

SEQ ID NO: 3302960 - protein, 10 aa, Plasmodium falciparum
CINGNKNNSL

SEQ ID NO: 3302961 - protein, 6 aa, Plasmodium falciparum
CINNNN

SEQ ID NO: 3302962 - protein, 7 aa, Plasmodium falciparum
CISPKNN

SEQ ID NO: 3302963 - protein, 5 aa, Plasmodium falciparum
CKAQA

SEQ ID NO: 3302964 - protein, 12 aa, Plasmodium falciparum
CKDKSGTPSDNK

SEQ ID NO: 3302965 - protein, 17 aa, Plasmodium falciparum
CKDNNYDIKQEGTASTY

SEQ ID NO: 3302966 - protein, 8 aa, Plasmodium falciparum
CKDQNNNM

SEQ ID NO: 3302967 - protein, 57 aa, Plasmodium falciparum
CKDSTNDLNKDDTNDLNKDNTNDLNKDDTNDLNKDDTNDLNKDDTNDLSKDSTYNLN

SEQ ID NO: 3302968 - protein, 8 aa, Plasmodium falciparum
CKDTERQS

SEQ ID NO: 3302969 - protein, 9 aa, Plasmodium falciparum
CKEKGKRQA

SEQ ID NO: 3302970 - protein, 9 aa, Plasmodium falciparum
CKEKSSNND

SEQ ID NO: 3302971 - protein, 7 aa, Plasmodium falciparum
CKENQRH

SEQ ID NO: 3302972 - protein, 7 aa, Plasmodium falciparum
CKESEEI

SEQ ID NO: 3302973 - protein, 5 aa, Plasmodium falciparum
CKESY

SEQ ID NO: 3302974 - protein, 33 aa, Plasmodium falciparum
CKGGRNNNGEEKDGDMNGHNNNNNDNNNIDDDE

SEQ ID NO: 3302975 - protein, 16 aa, Plasmodium falciparum
CKGREKNGHNKNDVDN

SEQ ID NO: 3302976 - protein, 7 aa, Plasmodium falciparum
CKIEQTE

SEQ ID NO: 3302977 - protein, 16 aa, Plasmodium falciparum
CKIKNEDIKTNVNNTF

SEQ ID NO: 3302978 - protein, 8 aa, Plasmodium falciparum
CKKAKNNS

SEQ ID NO: 3302979 - protein, 6 aa, Plasmodium falciparum
CKKKKE

SEQ ID NO: 3302980 - protein, 12 aa, Plasmodium falciparum
CKKRNKKNESNI

SEQ ID NO: 3302981 - protein, 10 aa, Plasmodium falciparum
CKKSSTDGHT

SEQ ID NO: 3302982 - protein, 11 aa, Plasmodium falciparum
CKNEAPDHNTD

SEQ ID NO: 3302983 - protein, 10 aa, Plasmodium falciparum
CKNEKNDNMD

SEQ ID NO: 3302984 - protein, 6 aa, Plasmodium falciparum
CKNKKR

SEQ ID NO: 3302985 - protein, 9 aa, Plasmodium falciparum
CKNQNESIQ

SEQ ID NO: 3302986 - protein, 8 aa, Plasmodium falciparum
CKNYNKKR

SEQ ID NO: 3302987 - protein, 5 aa, Plasmodium falciparum
CKPNI

SEQ ID NO: 3302988 - protein, 6 aa, Plasmodium falciparum
CKPSLS

SEQ ID NO: 3302989 - protein, 9 aa, Plasmodium falciparum
CKQKTKREM

SEQ ID NO: 3302990 - protein, 4 aa, Plasmodium falciparum
CKQN

SEQ ID NO: 3302991 - protein, 7 aa, Plasmodium falciparum
CKQNNVN

SEQ ID NO: 3302992 - protein, 6 aa, Plasmodium falciparum
CKREGN

SEQ ID NO: 3302993 - protein, 7 aa, Plasmodium falciparum
CKRKEKK

SEQ ID NO: 3302994 - protein, 9 aa, Plasmodium falciparum
CKSKEEKNS

SEQ ID NO: 3302995 - protein, 10 aa, Plasmodium falciparum
CKSKQNSEHV

SEQ ID NO: 3302996 - protein, 27 aa, Plasmodium falciparum
CKSNDSTTHSSDYSRNYENNDEINSSS

SEQ ID NO: 3302997 - protein, 10 aa, Plasmodium falciparum
CKSPNKYKSN

SEQ ID NO: 3302998 - protein, 18 aa, Plasmodium falciparum
CKSSGGGISETREQARDK

SEQ ID NO: 3302999 - protein, 12 aa, Plasmodium falciparum
CKSTTCNNYTEN

SEQ ID NO: 3303000 - protein, 9 aa, Plasmodium falciparum
CKTDENAHP

SEQ ID NO: 3303001 - protein, 8 aa, Plasmodium falciparum
CKTNPEEE

SEQ ID NO: 3303002 - protein, 18 aa, Plasmodium falciparum
CKTTNKCKNDYDKNKCEK

SEQ ID NO: 3303003 - protein, 11 aa, Plasmodium falciparum
CKVEENVKRND

SEQ ID NO: 3303004 - protein, 19 aa, Plasmodium falciparum
CLNDSGENNKKKNTKGENI

SEQ ID NO: 3303005 - protein, 11 aa, Plasmodium falciparum
CLSKNDDNCYV

SEQ ID NO: 3303006 - protein, 15 aa, Plasmodium falciparum
CMNTPNNNNSNNNNS

SEQ ID NO: 3303007 - protein, 11 aa, Plasmodium falciparum
CNAKSNQKNLG

SEQ ID NO: 3303008 - protein, 14 aa, Plasmodium falciparum
CNANNGSDKEHLKE

SEQ ID NO: 3303009 - protein, 5 aa, Plasmodium falciparum
CNDEC

SEQ ID NO: 3303010 - protein, 9 aa, Plasmodium falciparum
CNDEEENYS

SEQ ID NO: 3303011 - protein, 18 aa, Plasmodium falciparum
CNDEKGNTQNDIKEEDKM

SEQ ID NO: 3303012 - protein, 12 aa, Plasmodium falciparum
CNDEKKSSRYVK

SEQ ID NO: 3303013 - protein, 7 aa, Plasmodium falciparum
CNDKKTN

SEQ ID NO: 3303014 - protein, 6 aa, Plasmodium falciparum
CNDKSM

SEQ ID NO: 3303015 - protein, 7 aa, Plasmodium falciparum
CNDKSTS

SEQ ID NO: 3303016 - protein, 8 aa, Plasmodium falciparum
CNDNDTLS

SEQ ID NO: 3303017 - protein, 8 aa, Plasmodium falciparum
CNDNKNSM

SEQ ID NO: 3303018 - protein, 13 aa, Plasmodium falciparum
CNDNYDSEPSNYS

SEQ ID NO: 3303019 - protein, 10 aa, Plasmodium falciparum
CNDSTHSNYN

SEQ ID NO: 3303020 - protein, 6 aa, Plasmodium falciparum
CNDTYP

SEQ ID NO: 3303021 - protein, 10 aa, Plasmodium falciparum
CNEDTGSRCK

SEQ ID NO: 3303022 - protein, 6 aa, Plasmodium falciparum
CNEEHS

SEQ ID NO: 3303023 - protein, 7 aa, Plasmodium falciparum
CNEESIQ

SEQ ID NO: 3303024 - protein, 7 aa, Plasmodium falciparum
CNEGSNC

SEQ ID NO: 3303025 - protein, 29 aa, Plasmodium falciparum
CNEKKTEEENKSNQNINNNINDEKKEGSV

SEQ ID NO: 3303026 - protein, 4 aa, Plasmodium falciparum
CNEN

SEQ ID NO: 3303027 - protein, 6 aa, Plasmodium falciparum
CNENER

SEQ ID NO: 3303028 - protein, 7 aa, Plasmodium falciparum
CNESVEK

SEQ ID NO: 3303029 - protein, 12 aa, Plasmodium falciparum
CNGRKNKKLQPH

SEQ ID NO: 3303030 - protein, 14 aa, Plasmodium falciparum
CNGSSDDANVPYEN

SEQ ID NO: 3303031 - protein, 6 aa, Plasmodium falciparum
CNHNGV

SEQ ID NO: 3303032 - protein, 11 aa, Plasmodium falciparum
CNIKDTSDDMK

SEQ ID NO: 3303033 - protein, 8 aa, Plasmodium falciparum
CNKENKNI

SEQ ID NO: 3303034 - protein, 7 aa, Plasmodium falciparum
CNKNDDK

SEQ ID NO: 3303035 - protein, 7 aa, Plasmodium falciparum
CNKNKEF

SEQ ID NO: 3303036 - protein, 10 aa, Plasmodium falciparum
CNKNVEGGTH

SEQ ID NO: 3303037 - protein, 7 aa, Plasmodium falciparum
CNKSGSQ

SEQ ID NO: 3303038 - protein, 4 aa, Plasmodium falciparum
CNMN

SEQ ID NO: 3303039 - protein, 5 aa, Plasmodium falciparum
CNNEE

SEQ ID NO: 3303040 - protein, 26 aa, Plasmodium falciparum
CNNESGKANNANEKENNNNNNNSNNM

SEQ ID NO: 3303041 - protein, 5 aa, Plasmodium falciparum
CNNKD

SEQ ID NO: 3303042 - protein, 5 aa, Plasmodium falciparum
CNNKN

SEQ ID NO: 3303043 - protein, 13 aa, Plasmodium falciparum
CNNKTKNKNTLRK

SEQ ID NO: 3303044 - protein, 10 aa, Plasmodium falciparum
CNNNDDNNKG

SEQ ID NO: 3303045 - protein, 7 aa, Plasmodium falciparum
CNNNESH

SEQ ID NO: 3303046 - protein, 7 aa, Plasmodium falciparum
CNNNLTS

SEQ ID NO: 3303047 - protein, 20 aa, Plasmodium falciparum
CNNNNIKNNMSDESDHHQDV

SEQ ID NO: 3303048 - protein, 6 aa, Plasmodium falciparum
CNNNNN

SEQ ID NO: 3303049 - protein, 13 aa, Plasmodium falciparum
CNNNNNDNTSNNM

SEQ ID NO: 3303050 - protein, 9 aa, Plasmodium falciparum
CNNNNNNNI

SEQ ID NO: 3303051 - protein, 25 aa, Plasmodium falciparum
CNNNNNNNNNNSSNSNSNSNSNSNP

SEQ ID NO: 3303052 - protein, 11 aa, Plasmodium falciparum
CNNNSNNSSNN

SEQ ID NO: 3303053 - protein, 11 aa, Plasmodium falciparum
CNNNSNSNNNI

SEQ ID NO: 3303054 - protein, 4 aa, Plasmodium falciparum
CNNP

SEQ ID NO: 3303055 - protein, 11 aa, Plasmodium falciparum
CNNQMKEKKKT

SEQ ID NO: 3303056 - protein, 9 aa, Plasmodium falciparum
CNNSPDCSQ

SEQ ID NO: 3303057 - protein, 9 aa, Plasmodium falciparum
CNNSSQKDM

SEQ ID NO: 3303058 - protein, 5 aa, Plasmodium falciparum
CNNTN

SEQ ID NO: 3303059 - protein, 17 aa, Plasmodium falciparum
CNNTQDNKNVLKPSNEK

SEQ ID NO: 3303060 - protein, 9 aa, Plasmodium falciparum
CNPNDQDNF

SEQ ID NO: 3303061 - protein, 13 aa, Plasmodium falciparum
CNPPTDAGRNPLS

SEQ ID NO: 3303062 - protein, 6 aa, Plasmodium falciparum
CNPSSL

SEQ ID NO: 3303063 - protein, 19 aa, Plasmodium falciparum
CNPTKDSGYTKADKSYTSK

SEQ ID NO: 3303064 - protein, 73 aa, Plasmodium falciparum
CNQGFQDNNRHKNKQNKQDKQNKQDKQNKQNKQNKQNKKVKKIKKNKKNKKIKKNKRNKKIKRNKKNIQNNSL

SEQ ID NO: 3303065 - protein, 7 aa, Plasmodium falciparum
CNQKEEI

SEQ ID NO: 3303066 - protein, 18 aa, Plasmodium falciparum
CNQKKQQQEKEKDTYSNI

SEQ ID NO: 3303067 - protein, 13 aa, Plasmodium falciparum
CNQKNNNNNYNND

SEQ ID NO: 3303068 - protein, 10 aa, Plasmodium falciparum
CNQNKKDEEV

SEQ ID NO: 3303069 - protein, 9 aa, Plasmodium falciparum
CNQPKGIPS

SEQ ID NO: 3303070 - protein, 8 aa, Plasmodium falciparum
CNSDGSLK

SEQ ID NO: 3303071 - protein, 12 aa, Plasmodium falciparum
CNSEETLKDDST

SEQ ID NO: 3303072 - protein, 5 aa, Plasmodium falciparum
CNSEK

SEQ ID NO: 3303073 - protein, 7 aa, Plasmodium falciparum
CNSGSSI

SEQ ID NO: 3303074 - protein, 11 aa, Plasmodium falciparum
CNSKEENKNAI

SEQ ID NO: 3303075 - protein, 15 aa, Plasmodium falciparum
CNSNDKNKKNTTLNN

SEQ ID NO: 3303076 - protein, 12 aa, Plasmodium falciparum
CNSNISSNTTSN

SEQ ID NO: 3303077 - protein, 10 aa, Plasmodium falciparum
CNSPRKESKS

SEQ ID NO: 3303078 - protein, 6 aa, Plasmodium falciparum
CNSPTF

SEQ ID NO: 3303079 - protein, 18 aa, Plasmodium falciparum
CNSRSTSNSSSNSSDMSQ

SEQ ID NO: 3303080 - protein, 4 aa, Plasmodium falciparum
CNST

SEQ ID NO: 3303081 - protein, 13 aa, Plasmodium falciparum
CNSYNNNNTYDHS

SEQ ID NO: 3303082 - protein, 5 aa, Plasmodium falciparum
CNTEP

SEQ ID NO: 3303083 - protein, 7 aa, Plasmodium falciparum
CNTKETN

SEQ ID NO: 3303084 - protein, 6 aa, Plasmodium falciparum
CNTNNM

SEQ ID NO: 3303085 - protein, 5 aa, Plasmodium falciparum
CNVEE

SEQ ID NO: 3303086 - protein, 12 aa, Plasmodium falciparum
CNYNKKKRYQKT

SEQ ID NO: 3303087 - protein, 34 aa, Plasmodium falciparum
CPEYQNSNEQYHQKQSSMTNSINSKSNIYNNSSS

SEQ ID NO: 3303088 - protein, 6 aa, Plasmodium falciparum
CPKENE

SEQ ID NO: 3303089 - protein, 5 aa, Plasmodium falciparum
CPKES

SEQ ID NO: 3303090 - protein, 77 aa, Plasmodium falciparum
CPPSQNKACPSSQNNVCPSSQNNVCPSSQNNVCPSSQNNVCPSSQNNVCPSSQNNVCPPSQNNVPPKTHVPSENNKV

SEQ ID NO: 3303091 - protein, 4 aa, Plasmodium falciparum
CPSS

SEQ ID NO: 3303092 - protein, 8 aa, Plasmodium falciparum
CPSYNNNN

SEQ ID NO: 3303093 - protein, 4 aa, Plasmodium falciparum
CPTI

SEQ ID NO: 3303094 - protein, 7 aa, Plasmodium falciparum
CPTSKPK

SEQ ID NO: 3303095 - protein, 5 aa, Plasmodium falciparum
CPYDP

SEQ ID NO: 3303096 - protein, 13 aa, Plasmodium falciparum
CQENDCNKEINEE

SEQ ID NO: 3303097 - protein, 5 aa, Plasmodium falciparum
CQGHK

SEQ ID NO: 3303098 - protein, 10 aa, Plasmodium falciparum
CQGQGENCET

SEQ ID NO: 3303099 - protein, 5 aa, Plasmodium falciparum
CQKGT

SEQ ID NO: 3303100 - protein, 5 aa, Plasmodium falciparum
CQNNK

SEQ ID NO: 3303101 - protein, 10 aa, Plasmodium falciparum
CQRTDDEKKY

SEQ ID NO: 3303102 - protein, 11 aa, Plasmodium falciparum
CQSNNKKEENV

SEQ ID NO: 3303103 - protein, 4 aa, Plasmodium falciparum
CQTN

SEQ ID NO: 3303104 - protein, 11 aa, Plasmodium falciparum
CRCSNKDNFKA

SEQ ID NO: 3303105 - protein, 5 aa, Plasmodium falciparum
CRDEN

SEQ ID NO: 3303106 - protein, 11 aa, Plasmodium falciparum
CRDTKELSNEQ

SEQ ID NO: 3303107 - protein, 9 aa, Plasmodium falciparum
CREDENNHN

SEQ ID NO: 3303108 - protein, 6 aa, Plasmodium falciparum
CRGEGG

SEQ ID NO: 3303109 - protein, 9 aa, Plasmodium falciparum
CRGQDSNGS

SEQ ID NO: 3303110 - protein, 8 aa, Plasmodium falciparum
CRKGKKKE

SEQ ID NO: 3303111 - protein, 9 aa, Plasmodium falciparum
CRNKSGKGA

SEQ ID NO: 3303112 - protein, 9 aa, Plasmodium falciparum
CRNNINDKD

SEQ ID NO: 3303113 - protein, 10 aa, Plasmodium falciparum
CRQDEDDPLI

SEQ ID NO: 3303114 - protein, 10 aa, Plasmodium falciparum
CRQSYDGIST

SEQ ID NO: 3303115 - protein, 9 aa, Plasmodium falciparum
CRSDRKEGK

SEQ ID NO: 3303116 - protein, 5 aa, Plasmodium falciparum
CRTEE

SEQ ID NO: 3303117 - protein, 8 aa, Plasmodium falciparum
CRTSKGKV

SEQ ID NO: 3303118 - protein, 4 aa, Plasmodium falciparum
CSAN

SEQ ID NO: 3303119 - protein, 5 aa, Plasmodium falciparum
CSDPE

SEQ ID NO: 3303120 - protein, 5 aa, Plasmodium falciparum
CSDTE

SEQ ID NO: 3303121 - protein, 19 aa, Plasmodium falciparum
CSDTSKKDTHYRKYGSNEN

SEQ ID NO: 3303122 - protein, 12 aa, Plasmodium falciparum
CSEDNSKNMNYS

SEQ ID NO: 3303123 - protein, 4 aa, Plasmodium falciparum
CSEK

SEQ ID NO: 3303124 - protein, 8 aa, Plasmodium falciparum
CSERANNI

SEQ ID NO: 3303125 - protein, 11 aa, Plasmodium falciparum
CSGESNNEKSV

SEQ ID NO: 3303126 - protein, 4 aa, Plasmodium falciparum
CSGK

SEQ ID NO: 3303127 - protein, 5 aa, Plasmodium falciparum
CSGKT

SEQ ID NO: 3303128 - protein, 6 aa, Plasmodium falciparum
CSGNGQ

SEQ ID NO: 3303129 - protein, 4 aa, Plasmodium falciparum
CSGS

SEQ ID NO: 3303130 - protein, 6 aa, Plasmodium falciparum
CSGTGV

SEQ ID NO: 3303131 - protein, 4 aa, Plasmodium falciparum
CSKD

SEQ ID NO: 3303132 - protein, 7 aa, Plasmodium falciparum
CSKEKDN

SEQ ID NO: 3303133 - protein, 7 aa, Plasmodium falciparum
CSKEKNN

SEQ ID NO: 3303134 - protein, 6 aa, Plasmodium falciparum
CSKEQT

SEQ ID NO: 3303135 - protein, 59 aa, Plasmodium falciparum
CSKGNPRDKWDEQSNTSNKKKNKNNNKKNKNNNKKNKNNNKKNKNNNNNDNDNDNNDRY

SEQ ID NO: 3303136 - protein, 7 aa, Plasmodium falciparum
CSKGQNK

SEQ ID NO: 3303137 - protein, 7 aa, Plasmodium falciparum
CSKKGTM

SEQ ID NO: 3303138 - protein, 5 aa, Plasmodium falciparum
CSKKN

SEQ ID NO: 3303139 - protein, 8 aa, Plasmodium falciparum
CSKNQCND

SEQ ID NO: 3303140 - protein, 5 aa, Plasmodium falciparum
CSNDG

SEQ ID NO: 3303141 - protein, 4 aa, Plasmodium falciparum
CSNE

SEQ ID NO: 3303142 - protein, 5 aa, Plasmodium falciparum
CSNEN

SEQ ID NO: 3303143 - protein, 5 aa, Plasmodium falciparum
CSNNH

SEQ ID NO: 3303144 - protein, 8 aa, Plasmodium falciparum
CSNSDEDS

SEQ ID NO: 3303145 - protein, 10 aa, Plasmodium falciparum
CSNSDSKKLF

SEQ ID NO: 3303146 - protein, 8 aa, Plasmodium falciparum
CSNTPLGK

SEQ ID NO: 3303147 - protein, 8 aa, Plasmodium falciparum
CSNTSSEV

SEQ ID NO: 3303148 - protein, 16 aa, Plasmodium falciparum
CSPENKSNNNNNINSN

SEQ ID NO: 3303149 - protein, 12 aa, Plasmodium falciparum
CSPGDSDPTKVE

SEQ ID NO: 3303150 - protein, 5 aa, Plasmodium falciparum
CSPGY

SEQ ID NO: 3303151 - protein, 7 aa, Plasmodium falciparum
CSPNSVS

SEQ ID NO: 3303152 - protein, 11 aa, Plasmodium falciparum
CSQKNQDNDIN

SEQ ID NO: 3303153 - protein, 5 aa, Plasmodium falciparum
CSRNN

SEQ ID NO: 3303154 - protein, 10 aa, Plasmodium falciparum
CSRTHEDFNS

SEQ ID NO: 3303155 - protein, 6 aa, Plasmodium falciparum
CSSASD

SEQ ID NO: 3303156 - protein, 18 aa, Plasmodium falciparum
CSSEEKLKKKEKNISNAK

SEQ ID NO: 3303157 - protein, 41 aa, Plasmodium falciparum
CSSNEKKKSKKQNVVKRNEDVDKQNDEVMKKNNDKLKGNDK

SEQ ID NO: 3303158 - protein, 11 aa, Plasmodium falciparum
CSSNKKTANYV

SEQ ID NO: 3303159 - protein, 19 aa, Plasmodium falciparum
CSSNKRDNESNEEFNNSSY

SEQ ID NO: 3303160 - protein, 39 aa, Plasmodium falciparum
CSSNNNNHNNNNNHNNNNNLNNNNNHNNSNNNNNNKGTY

SEQ ID NO: 3303161 - protein, 11 aa, Plasmodium falciparum
CSSSESSNVPD

SEQ ID NO: 3303162 - protein, 6 aa, Plasmodium falciparum
CSSSGM

SEQ ID NO: 3303163 - protein, 5 aa, Plasmodium falciparum
CSSSS

SEQ ID NO: 3303164 - protein, 42 aa, Plasmodium falciparum
CSSSSSNNNNNNENNNNNDNNNNDDNNNDDDNNNDDDNYNNG

SEQ ID NO: 3303165 - protein, 10 aa, Plasmodium falciparum
CSSSSSSYYY

SEQ ID NO: 3303166 - protein, 5 aa, Plasmodium falciparum
CSTNT

SEQ ID NO: 3303167 - protein, 8 aa, Plasmodium falciparum
CSTTDEKT

SEQ ID NO: 3303168 - protein, 9 aa, Plasmodium falciparum
CSYAHSPDK

SEQ ID NO: 3303169 - protein, 5 aa, Plasmodium falciparum
CSYTN

SEQ ID NO: 3303170 - protein, 9 aa, Plasmodium falciparum
CTEENERTF

SEQ ID NO: 3303171 - protein, 15 aa, Plasmodium falciparum
CTENKTNNEKSHSIK

SEQ ID NO: 3303172 - protein, 6 aa, Plasmodium falciparum
CTGTGA

SEQ ID NO: 3303173 - protein, 11 aa, Plasmodium falciparum
CTHNKDSVYDK

SEQ ID NO: 3303174 - protein, 27 aa, Plasmodium falciparum
CTKEKHGKNKNENTNNPLNDNKNERIH

SEQ ID NO: 3303175 - protein, 11 aa, Plasmodium falciparum
CTKENKQTNHC

SEQ ID NO: 3303176 - protein, 11 aa, Plasmodium falciparum
CTKKKKKKKTI

SEQ ID NO: 3303177 - protein, 10 aa, Plasmodium falciparum
CTLDKENKEL

SEQ ID NO: 3303178 - protein, 4 aa, Plasmodium falciparum
CTMK

SEQ ID NO: 3303179 - protein, 5 aa, Plasmodium falciparum
CTNEN

SEQ ID NO: 3303180 - protein, 5 aa, Plasmodium falciparum
CTNGY

SEQ ID NO: 3303181 - protein, 9 aa, Plasmodium falciparum
CTNKDETNI

SEQ ID NO: 3303182 - protein, 6 aa, Plasmodium falciparum
CTNKNC

SEQ ID NO: 3303183 - protein, 10 aa, Plasmodium falciparum
CTNKSKNPFN

SEQ ID NO: 3303184 - protein, 5 aa, Plasmodium falciparum
CTNNP

SEQ ID NO: 3303185 - protein, 14 aa, Plasmodium falciparum
CTNPSEAVNLSTIH

SEQ ID NO: 3303186 - protein, 10 aa, Plasmodium falciparum
CTNPSSSMSK

SEQ ID NO: 3303187 - protein, 10 aa, Plasmodium falciparum
CTNTSNSSSM

SEQ ID NO: 3303188 - protein, 13 aa, Plasmodium falciparum
CTPKEKKKNSVKN

SEQ ID NO: 3303189 - protein, 10 aa, Plasmodium falciparum
CTQSHTDDHV

SEQ ID NO: 3303190 - protein, 18 aa, Plasmodium falciparum
CTSDEKSSNKSSSRSVEK

SEQ ID NO: 3303191 - protein, 9 aa, Plasmodium falciparum
CTSHNNTNN

SEQ ID NO: 3303192 - protein, 11 aa, Plasmodium falciparum
CTSKENVSNKI

SEQ ID NO: 3303193 - protein, 6 aa, Plasmodium falciparum
CTSNMD

SEQ ID NO: 3303194 - protein, 6 aa, Plasmodium falciparum
CTSPAT

SEQ ID NO: 3303195 - protein, 4 aa, Plasmodium falciparum
CTYE

SEQ ID NO: 3303196 - protein, 12 aa, Plasmodium falciparum
CVDPDKEEHKKN

SEQ ID NO: 3303197 - protein, 9 aa, Plasmodium falciparum
CVERGNEDL

SEQ ID NO: 3303198 - protein, 16 aa, Plasmodium falciparum
CVKGKGATTKSSKFGE

SEQ ID NO: 3303199 - protein, 10 aa, Plasmodium falciparum
CYEEKENKIV

SEQ ID NO: 3303200 - protein, 28 aa, Plasmodium falciparum
CYEKDKNVDDEEIKREDKEKVKKEDDIK

SEQ ID NO: 3303201 - protein, 8 aa, Plasmodium falciparum
CYNKSKEK

SEQ ID NO: 3303202 - protein, 42 aa, Plasmodium falciparum
CYNNNNDDDTYKNYNNDDTYKNYNNDNTYKNYNDDDHGNHES

SEQ ID NO: 3303203 - protein, 6 aa, Plasmodium falciparum
DAAERI

SEQ ID NO: 3303204 - protein, 23 aa, Plasmodium falciparum
DAAGAAGGMPGGMPGGMPGGMPG

SEQ ID NO: 3303205 - protein, 10 aa, Plasmodium falciparum
DAAPSGLDYP

SEQ ID NO: 3303206 - protein, 6 aa, Plasmodium falciparum
DADDNK

SEQ ID NO: 3303207 - protein, 8 aa, Plasmodium falciparum
DADEDEYE

SEQ ID NO: 3303208 - protein, 13 aa, Plasmodium falciparum
DADLKRTANATGA

SEQ ID NO: 3303209 - protein, 8 aa, Plasmodium falciparum
DADMKPPE

SEQ ID NO: 3303210 - protein, 25 aa, Plasmodium falciparum
DADVEYNDSDSDDFTIDDDEDVDSL

SEQ ID NO: 3303211 - protein, 9 aa, Plasmodium falciparum
DAEDDNNEC

SEQ ID NO: 3303212 - protein, 5 aa, Plasmodium falciparum
DAEDI

SEQ ID NO: 3303213 - protein, 22 aa, Plasmodium falciparum
DAEEDEDNNNNNNNNNNNSNIS

SEQ ID NO: 3303214 - protein, 10 aa, Plasmodium falciparum
DAEEYKKNDM

SEQ ID NO: 3303215 - protein, 6 aa, Plasmodium falciparum
DAEKKL

SEQ ID NO: 3303216 - protein, 5 aa, Plasmodium falciparum
DAEKS

SEQ ID NO: 3303217 - protein, 15 aa, Plasmodium falciparum
DAEKVPHNENKNNIN

SEQ ID NO: 3303218 - protein, 10 aa, Plasmodium falciparum
DAENAKDALD

SEQ ID NO: 3303219 - protein, 7 aa, Plasmodium falciparum
DAEPKCR

SEQ ID NO: 3303220 - protein, 16 aa, Plasmodium falciparum
DAEQEQVEENVQNEAN

SEQ ID NO: 3303221 - protein, 7 aa, Plasmodium falciparum
DAERSDK

SEQ ID NO: 3303222 - protein, 6 aa, Plasmodium falciparum
DAETRS

SEQ ID NO: 3303223 - protein, 12 aa, Plasmodium falciparum
DAFKTNKKSTNN

SEQ ID NO: 3303224 - protein, 5 aa, Plasmodium falciparum
DAGGF

SEQ ID NO: 3303225 - protein, 13 aa, Plasmodium falciparum
DAGKRKSKKTFDP

SEQ ID NO: 3303226 - protein, 11 aa, Plasmodium falciparum
DAGNPIKDNTG

SEQ ID NO: 3303227 - protein, 25 aa, Plasmodium falciparum
DAGNVHSNNRDQNSNEPMNENKQPI

SEQ ID NO: 3303228 - protein, 12 aa, Plasmodium falciparum
DAGSKPSNTNDY

SEQ ID NO: 3303229 - protein, 14 aa, Plasmodium falciparum
DAINENAKKNEHDI

SEQ ID NO: 3303230 - protein, 16 aa, Plasmodium falciparum
DAIPKKLSAESGNDFK

SEQ ID NO: 3303231 - protein, 9 aa, Plasmodium falciparum
DAKAQQQKY

SEQ ID NO: 3303232 - protein, 21 aa, Plasmodium falciparum
DAKESQTYDELKQKKKNKKKI

SEQ ID NO: 3303233 - protein, 9 aa, Plasmodium falciparum
DAKETSTVD

SEQ ID NO: 3303234 - protein, 5 aa, Plasmodium falciparum
DAKGD

SEQ ID NO: 3303235 - protein, 8 aa, Plasmodium falciparum
DAKGRSFN

SEQ ID NO: 3303236 - protein, 28 aa, Plasmodium falciparum
DAKNKNHNNDHDKSINNNNNNNNNNNND

SEQ ID NO: 3303237 - protein, 8 aa, Plasmodium falciparum
DAKRSNSF

SEQ ID NO: 3303238 - protein, 15 aa, Plasmodium falciparum
DALEADDKYQINKNE

SEQ ID NO: 3303239 - protein, 7 aa, Plasmodium falciparum
DALESRA

SEQ ID NO: 3303240 - protein, 30 aa, Plasmodium falciparum
DALKSDALKSDELKSDALKNDMSKKNLDKQ

SEQ ID NO: 3303241 - protein, 14 aa, Plasmodium falciparum
DALNNTSNNNETKI

SEQ ID NO: 3303242 - protein, 7 aa, Plasmodium falciparum
DALNTDR

SEQ ID NO: 3303243 - protein, 16 aa, Plasmodium falciparum
DALSEEEKKRRKENID

SEQ ID NO: 3303244 - protein, 56 aa, Plasmodium falciparum
DALTENENNKNDAECSDSTTVKNKKGKRTSTNNVSSNSLKNESMKSSTTNKEQVSK

SEQ ID NO: 3303245 - protein, 4 aa, Plasmodium falciparum
DANE

SEQ ID NO: 3303246 - protein, 9 aa, Plasmodium falciparum
DANEEEEKN

SEQ ID NO: 3303247 - protein, 4 aa, Plasmodium falciparum
DANG

SEQ ID NO: 3303248 - protein, 15 aa, Plasmodium falciparum
DANNNKYNTQANKTF

SEQ ID NO: 3303249 - protein, 6 aa, Plasmodium falciparum
DANNNM

SEQ ID NO: 3303250 - protein, 4 aa, Plasmodium falciparum
DANR

SEQ ID NO: 3303251 - protein, 5 aa, Plasmodium falciparum
DANSS

SEQ ID NO: 3303252 - protein, 14 aa, Plasmodium falciparum
DAPEDDDDSKNSFS

SEQ ID NO: 3303253 - protein, 12 aa, Plasmodium falciparum
DAPEKKKKKKEN

SEQ ID NO: 3303254 - protein, 7 aa, Plasmodium falciparum
DAPKENC

SEQ ID NO: 3303255 - protein, 5 aa, Plasmodium falciparum
DAPLS

SEQ ID NO: 3303256 - protein, 5 aa, Plasmodium falciparum
DAPVP

SEQ ID NO: 3303257 - protein, 15 aa, Plasmodium falciparum
DAQKAIDKYDGSEIE

SEQ ID NO: 3303258 - protein, 4 aa, Plasmodium falciparum
DAQR

SEQ ID NO: 3303259 - protein, 9 aa, Plasmodium falciparum
DAQTGADRE

SEQ ID NO: 3303260 - protein, 13 aa, Plasmodium falciparum
DAQYDNNEKTSNV

SEQ ID NO: 3303261 - protein, 8 aa, Plasmodium falciparum
DARENIKE

SEQ ID NO: 3303262 - protein, 5 aa, Plasmodium falciparum
DARNE

SEQ ID NO: 3303263 - protein, 5 aa, Plasmodium falciparum
DARRK

SEQ ID NO: 3303264 - protein, 8 aa, Plasmodium falciparum
DARSGKYC

SEQ ID NO: 3303265 - protein, 16 aa, Plasmodium falciparum
DASEDYEDKNEKTYRE

SEQ ID NO: 3303266 - protein, 8 aa, Plasmodium falciparum
DASKSNVE

SEQ ID NO: 3303267 - protein, 5 aa, Plasmodium falciparum
DASPQ

SEQ ID NO: 3303268 - protein, 8 aa, Plasmodium falciparum
DASTAKNR

SEQ ID NO: 3303269 - protein, 5 aa, Plasmodium falciparum
DASTM

SEQ ID NO: 3303270 - protein, 64 aa, Plasmodium falciparum
DASTNYNDNINNNTNNNTSNNTNNNTNNNTSNNTSNNTSNNTNNYTNNNTSNNTSNNTNNNTYN

SEQ ID NO: 3303271 - protein, 7 aa, Plasmodium falciparum
DATDDKW

SEQ ID NO: 3303272 - protein, 9 aa, Plasmodium falciparum
DATNPSRRS

SEQ ID NO: 3303273 - protein, 8 aa, Plasmodium falciparum
DATQKNSF

SEQ ID NO: 3303274 - protein, 5 aa, Plasmodium falciparum
DATSH

SEQ ID NO: 3303275 - protein, 46 aa, Plasmodium falciparum
DAVSDNNNSINSSVNKKRHKNKIKTKTYYKKSESVNEHATSKDDPV

SEQ ID NO: 3303276 - protein, 9 aa, Plasmodium falciparum
DAYDPKEVE

SEQ ID NO: 3303277 - protein, 4 aa, Plasmodium falciparum
DAYE

SEQ ID NO: 3303278 - protein, 19 aa, Plasmodium falciparum
DAYGSKNDEMNKNNNEMYK

SEQ ID NO: 3303279 - protein, 5 aa, Plasmodium falciparum
DAYKA

SEQ ID NO: 3303280 - protein, 71 aa, Plasmodium falciparum
DAYSDNKNKNNNNKNNNNNNNNNNNNNNNNNNNNNNKNNNNNNKNNNNNNNNNNNNNSYEKSAKKKNAELN

SEQ ID NO: 3303281 - protein, 5 aa, Plasmodium falciparum
DAYSP

SEQ ID NO: 3303282 - protein, 11 aa, Plasmodium falciparum
DCDDSSNSFDS

SEQ ID NO: 3303283 - protein, 10 aa, Plasmodium falciparum
DCDEETSDEE

SEQ ID NO: 3303284 - protein, 28 aa, Plasmodium falciparum
DCDGDGDNYNDDGDHHDDNDDNDEEPND

SEQ ID NO: 3303285 - protein, 5 aa, Plasmodium falciparum
DCEEE

SEQ ID NO: 3303286 - protein, 115 aa, Plasmodium falciparum
DCEETEQPRDISNQSNDDNNDDEEENHVNDQNDDDEDNHDNDHNNNNNNGGGSSSGSSDNNNNNNNNRGGNNNNQYYGNNNNNNNNNNSNNNNNNNNNNNNSNNSNNSNNNNYNC

SEQ ID NO: 3303287 - protein, 6 aa, Plasmodium falciparum
DCENEK

SEQ ID NO: 3303288 - protein, 5 aa, Plasmodium falciparum
DCKTS

SEQ ID NO: 3303289 - protein, 4 aa, Plasmodium falciparum
DCND

SEQ ID NO: 3303290 - protein, 6 aa, Plasmodium falciparum
DCNDKE

SEQ ID NO: 3303291 - protein, 49 aa, Plasmodium falciparum
DCNDKNGLSLNEGPRYNDNNNNNNNNNNNNNNNNNNNNNNNNNNNNNNH

SEQ ID NO: 3303292 - protein, 6 aa, Plasmodium falciparum
DCNDSI

SEQ ID NO: 3303293 - protein, 5 aa, Plasmodium falciparum
DCNEE

SEQ ID NO: 3303294 - protein, 5 aa, Plasmodium falciparum
DCNTP

SEQ ID NO: 3303295 - protein, 6 aa, Plasmodium falciparum
DCPSKK

SEQ ID NO: 3303296 - protein, 5 aa, Plasmodium falciparum
DCPYA

SEQ ID NO: 3303297 - protein, 6 aa, Plasmodium falciparum
DCPYNP

SEQ ID NO: 3303298 - protein, 7 aa, Plasmodium falciparum
DCQNEKI

SEQ ID NO: 3303299 - protein, 4 aa, Plasmodium falciparum
DCQT

SEQ ID NO: 3303300 - protein, 8 aa, Plasmodium falciparum
DCSAETNE

SEQ ID NO: 3303301 - protein, 12 aa, Plasmodium falciparum
DCSHDVKESNTQ

SEQ ID NO: 3303302 - protein, 7 aa, Plasmodium falciparum
DCSPNNI

SEQ ID NO: 3303303 - protein, 6 aa, Plasmodium falciparum
DCSRPM

SEQ ID NO: 3303304 - protein, 8 aa, Plasmodium falciparum
DCTEPYSD

SEQ ID NO: 3303305 - protein, 5 aa, Plasmodium falciparum
DCTTK

SEQ ID NO: 3303306 - protein, 6 aa, Plasmodium falciparum
DCTTND

SEQ ID NO: 3303307 - protein, 12 aa, Plasmodium falciparum
DDALNKKENDMV

SEQ ID NO: 3303308 - protein, 14 aa, Plasmodium falciparum
DDALNSECKTSTIT

SEQ ID NO: 3303309 - protein, 9 aa, Plasmodium falciparum
DDANEYNNK

SEQ ID NO: 3303310 - protein, 6 aa, Plasmodium falciparum
DDASPI

SEQ ID NO: 3303311 - protein, 10 aa, Plasmodium falciparum
DDASSDDSLK

SEQ ID NO: 3303312 - protein, 15 aa, Plasmodium falciparum
DDATNEQYDNSQKDT

SEQ ID NO: 3303313 - protein, 9 aa, Plasmodium falciparum
DDAVNNKDS

SEQ ID NO: 3303314 - protein, 7 aa, Plasmodium falciparum
DDCEDND

SEQ ID NO: 3303315 - protein, 7 aa, Plasmodium falciparum
DDCNEDD

SEQ ID NO: 3303316 - protein, 8 aa, Plasmodium falciparum
DDCSAKNN

SEQ ID NO: 3303317 - protein, 4 aa, Plasmodium falciparum
DDDD

SEQ ID NO: 3303318 - protein, 22 aa, Plasmodium falciparum
DDDDDDDDDDNENFEEESQGDD

SEQ ID NO: 3303319 - protein, 12 aa, Plasmodium falciparum
DDDDDDDDDNHH

SEQ ID NO: 3303320 - protein, 7 aa, Plasmodium falciparum
DDDDDDL

SEQ ID NO: 3303321 - protein, 16 aa, Plasmodium falciparum
DDDDDDNDNNEEPKEM

SEQ ID NO: 3303322 - protein, 12 aa, Plasmodium falciparum
DDDDDDREMDEE

SEQ ID NO: 3303323 - protein, 27 aa, Plasmodium falciparum
DDDDDNENKIEKKEKPKKKKSKKKKKR

SEQ ID NO: 3303324 - protein, 9 aa, Plasmodium falciparum
DDDDGDIKK

SEQ ID NO: 3303325 - protein, 11 aa, Plasmodium falciparum
DDDDKNNTETY

SEQ ID NO: 3303326 - protein, 5 aa, Plasmodium falciparum
DDDDL

SEQ ID NO: 3303327 - protein, 5 aa, Plasmodium falciparum
DDDDN

SEQ ID NO: 3303328 - protein, 7 aa, Plasmodium falciparum
DDDDNNI

SEQ ID NO: 3303329 - protein, 20 aa, Plasmodium falciparum
DDDDNNNEHDNKIGKINEDE

SEQ ID NO: 3303330 - protein, 12 aa, Plasmodium falciparum
DDDDNTKDSASN

SEQ ID NO: 3303331 - protein, 10 aa, Plasmodium falciparum
DDDDRKKEYN

SEQ ID NO: 3303332 - protein, 5 aa, Plasmodium falciparum
DDDDV

SEQ ID NO: 3303333 - protein, 7 aa, Plasmodium falciparum
DDDDVNV

SEQ ID NO: 3303334 - protein, 13 aa, Plasmodium falciparum
DDDEFEDADVEEK

SEQ ID NO: 3303335 - protein, 6 aa, Plasmodium falciparum
DDDEID

SEQ ID NO: 3303336 - protein, 19 aa, Plasmodium falciparum
DDDEKEDIQNKNGVYNNDD

SEQ ID NO: 3303337 - protein, 9 aa, Plasmodium falciparum
DDDEKREDE

SEQ ID NO: 3303338 - protein, 7 aa, Plasmodium falciparum
DDDENHK

SEQ ID NO: 3303339 - protein, 11 aa, Plasmodium falciparum
DDDESINDNEI

SEQ ID NO: 3303340 - protein, 8 aa, Plasmodium falciparum
DDDGQNGV

SEQ ID NO: 3303341 - protein, 5 aa, Plasmodium falciparum
DDDGY

SEQ ID NO: 3303342 - protein, 7 aa, Plasmodium falciparum
DDDGYNN

SEQ ID NO: 3303343 - protein, 91 aa, Plasmodium falciparum
DDDHNQNRDNDEDKDKDHNQDKDRNQDKDRNQDKDRNQDKDHNQDKDRNQDKDRNQDKDHNQDKDHNQDKDHNQDKDHNQDQNQDQNQDSI

SEQ ID NO: 3303344 - protein, 6 aa, Plasmodium falciparum
DDDIDV

SEQ ID NO: 3303345 - protein, 9 aa, Plasmodium falciparum
DDDIPENED

SEQ ID NO: 3303346 - protein, 19 aa, Plasmodium falciparum
DDDIQSDQLNKHTNKHNGK

SEQ ID NO: 3303347 - protein, 4 aa, Plasmodium falciparum
DDDK

SEQ ID NO: 3303348 - protein, 14 aa, Plasmodium falciparum
DDDKEVKGNNVGTH

SEQ ID NO: 3303349 - protein, 61 aa, Plasmodium falciparum
DDDKKEEDNDDIEDKYGDEKDKCGDEKDKCGDEQDKCGDKQDKCGDEQDKCGDKQDKCGDI

SEQ ID NO: 3303350 - protein, 15 aa, Plasmodium falciparum
DDDKLNKKRKKKIPG

SEQ ID NO: 3303351 - protein, 19 aa, Plasmodium falciparum
DDDKLYSNSKHTKEQSKLQ

SEQ ID NO: 3303352 - protein, 20 aa, Plasmodium falciparum
DDDKNKEAFHNDDDKNKEAF

SEQ ID NO: 3303353 - protein, 7 aa, Plasmodium falciparum
DDDKPDL

SEQ ID NO: 3303354 - protein, 10 aa, Plasmodium falciparum
DDDLKNDEND

SEQ ID NO: 3303355 - protein, 49 aa, Plasmodium falciparum
DDDNDDNNDDNNDDNNDDDNNDDDDEEKEEGPKYYDEENVSDDDNYYES

SEQ ID NO: 3303356 - protein, 19 aa, Plasmodium falciparum
DDDNINYDNEQGHTDRQYE

SEQ ID NO: 3303357 - protein, 12 aa, Plasmodium falciparum
DDDNIQDEYDQE

SEQ ID NO: 3303358 - protein, 9 aa, Plasmodium falciparum
DDDNKNTYQ

SEQ ID NO: 3303359 - protein, 9 aa, Plasmodium falciparum
DDDNKTNIL

SEQ ID NO: 3303360 - protein, 57 aa, Plasmodium falciparum
DDDNNNNNNNNNNNNNNNNNNNNNNNNNNNNNNKNNSYANTKNKKYYDNYNNPNDDI

SEQ ID NO: 3303361 - protein, 11 aa, Plasmodium falciparum
DDDNNNNNNNY

SEQ ID NO: 3303362 - protein, 15 aa, Plasmodium falciparum
DDDNNSYSSETNESY

SEQ ID NO: 3303363 - protein, 9 aa, Plasmodium falciparum
DDDNSNSII

SEQ ID NO: 3303364 - protein, 37 aa, Plasmodium falciparum
DDDNTVDDYKDYKNKDVKSNKENNNISGNKENHGNEN

SEQ ID NO: 3303365 - protein, 20 aa, Plasmodium falciparum
DDDPEEDSIEEAVDEEENMK

SEQ ID NO: 3303366 - protein, 9 aa, Plasmodium falciparum
DDDPINRGA

SEQ ID NO: 3303367 - protein, 7 aa, Plasmodium falciparum
DDDQNKN

SEQ ID NO: 3303368 - protein, 6 aa, Plasmodium falciparum
DDDQRS

SEQ ID NO: 3303369 - protein, 5 aa, Plasmodium falciparum
DDDQS

SEQ ID NO: 3303370 - protein, 5 aa, Plasmodium falciparum
DDDSD

SEQ ID NO: 3303371 - protein, 8 aa, Plasmodium falciparum
DDDSDNNY

SEQ ID NO: 3303372 - protein, 8 aa, Plasmodium falciparum
DDDSGPNA

SEQ ID NO: 3303373 - protein, 6 aa, Plasmodium falciparum
DDDTFQ

SEQ ID NO: 3303374 - protein, 7 aa, Plasmodium falciparum
DDDTGKI

SEQ ID NO: 3303375 - protein, 5 aa, Plasmodium falciparum
DDDVW

SEQ ID NO: 3303376 - protein, 31 aa, Plasmodium falciparum
DDDYDDDDDDYDDDDDYDDDDLDDDENYSDN

SEQ ID NO: 3303377 - protein, 12 aa, Plasmodium falciparum
DDDYDNNSYEKD

SEQ ID NO: 3303378 - protein, 4 aa, Plasmodium falciparum
DDEA

SEQ ID NO: 3303379 - protein, 6 aa, Plasmodium falciparum
DDECSK

SEQ ID NO: 3303380 - protein, 4 aa, Plasmodium falciparum
DDED

SEQ ID NO: 3303381 - protein, 5 aa, Plasmodium falciparum
DDEDD

SEQ ID NO: 3303382 - protein, 8 aa, Plasmodium falciparum
DDEDDDNI

SEQ ID NO: 3303383 - protein, 80 aa, Plasmodium falciparum
DDEDDVNNNVDGNNIDGDNIDGDNIDGDNIDGDNIDGDNIDGDNIDGNNIDGNNIDDNNIDGNNMNSNNMNSNNMSESNS

SEQ ID NO: 3303384 - protein, 52 aa, Plasmodium falciparum
DDEDDYDEEDYDGDNHNEEEDYDDDGDDNDGDDNDDDDDEDDGDDDHNNNNF

SEQ ID NO: 3303385 - protein, 24 aa, Plasmodium falciparum
DDEDEEDEDGVGDDDKTSKNSSYS

SEQ ID NO: 3303386 - protein, 14 aa, Plasmodium falciparum
DDEDITSDEDEESL

SEQ ID NO: 3303387 - protein, 23 aa, Plasmodium falciparum
DDEDNEGKSKLKTSISSSENGIP

SEQ ID NO: 3303388 - protein, 11 aa, Plasmodium falciparum
DDEDNENNPIG

SEQ ID NO: 3303389 - protein, 9 aa, Plasmodium falciparum
DDEDNISNY

SEQ ID NO: 3303390 - protein, 4 aa, Plasmodium falciparum
DDEE

SEQ ID NO: 3303391 - protein, 41 aa, Plasmodium falciparum
DDEEDDDDDYNNNNNNNNGDTGTKTNIATNNTHGLTTSKSQ

SEQ ID NO: 3303392 - protein, 11 aa, Plasmodium falciparum
DDEEDDDDIND

SEQ ID NO: 3303393 - protein, 15 aa, Plasmodium falciparum
DDEEDKKSKKNQKSD

SEQ ID NO: 3303394 - protein, 8 aa, Plasmodium falciparum
DDEEDNMS

SEQ ID NO: 3303395 - protein, 16 aa, Plasmodium falciparum
DDEEEADNDDQENDNV

SEQ ID NO: 3303396 - protein, 11 aa, Plasmodium falciparum
DDEEEKDQGGI

SEQ ID NO: 3303397 - protein, 7 aa, Plasmodium falciparum
DDEEEVG

SEQ ID NO: 3303398 - protein, 21 aa, Plasmodium falciparum
DDEEKLEKKQTQIQKQKQNIN

SEQ ID NO: 3303399 - protein, 12 aa, Plasmodium falciparum
DDEELEKAENFE

SEQ ID NO: 3303400 - protein, 27 aa, Plasmodium falciparum
DDEENDDHQEQDEQDKEYRDDDDHHDE

SEQ ID NO: 3303401 - protein, 32 aa, Plasmodium falciparum
DDEENDDKNGDNNKNDDNDEDDDNDDDNFHNN

SEQ ID NO: 3303402 - protein, 61 aa, Plasmodium falciparum
DDEENDDSDDLLDSDKSISNGKKENKKNKKKDTSSSNNNNSNNNNNNSSSSNSKKKKEEEN

SEQ ID NO: 3303403 - protein, 6 aa, Plasmodium falciparum
DDEENK

SEQ ID NO: 3303404 - protein, 18 aa, Plasmodium falciparum
DDEENSDDRNNKNHTYDC

SEQ ID NO: 3303405 - protein, 9 aa, Plasmodium falciparum
DDEETINYE

SEQ ID NO: 3303406 - protein, 9 aa, Plasmodium falciparum
DDEGDLTNK

SEQ ID NO: 3303407 - protein, 4 aa, Plasmodium falciparum
DDEH

SEQ ID NO: 3303408 - protein, 60 aa, Plasmodium falciparum
DDEHDGKDRQLDGGDGEDGENDEVDEDEEDDEDEDDDLGEEEEEEEEEVEEEVEEDMQED

SEQ ID NO: 3303409 - protein, 4 aa, Plasmodium falciparum
DDEI

SEQ ID NO: 3303410 - protein, 5 aa, Plasmodium falciparum
DDEIE

SEQ ID NO: 3303411 - protein, 13 aa, Plasmodium falciparum
DDEIKKHESNNKY

SEQ ID NO: 3303412 - protein, 15 aa, Plasmodium falciparum
DDEIQNKKKKKKKEI

SEQ ID NO: 3303413 - protein, 18 aa, Plasmodium falciparum
DDEKDKYNRNSINDNDEL

SEQ ID NO: 3303414 - protein, 9 aa, Plasmodium falciparum
DDEKEAKRS

SEQ ID NO: 3303415 - protein, 9 aa, Plasmodium falciparum
DDEKENKII

SEQ ID NO: 3303416 - protein, 8 aa, Plasmodium falciparum
DDEKETVA

SEQ ID NO: 3303417 - protein, 9 aa, Plasmodium falciparum
DDEKKEEHK

SEQ ID NO: 3303418 - protein, 8 aa, Plasmodium falciparum
DDEKKKKN

SEQ ID NO: 3303419 - protein, 6 aa, Plasmodium falciparum
DDEKRG

SEQ ID NO: 3303420 - protein, 45 aa, Plasmodium falciparum
DDEKSKKVGSLKDEVTKGKSHVDKNEENSDNNKNDNKNDSTHANT

SEQ ID NO: 3303421 - protein, 31 aa, Plasmodium falciparum
DDEKYDEEKEDKEENIPSEEKEKENEKSNER

SEQ ID NO: 3303422 - protein, 4 aa, Plasmodium falciparum
DDEL

SEQ ID NO: 3303423 - protein, 7 aa, Plasmodium falciparum
DDENDSV

SEQ ID NO: 3303424 - protein, 23 aa, Plasmodium falciparum
DDENENEYKNRKKRVTELIVKKK

SEQ ID NO: 3303425 - protein, 7 aa, Plasmodium falciparum
DDENERK

SEQ ID NO: 3303426 - protein, 7 aa, Plasmodium falciparum
DDENISS

SEQ ID NO: 3303427 - protein, 10 aa, Plasmodium falciparum
DDENKKRDSL

SEQ ID NO: 3303428 - protein, 9 aa, Plasmodium falciparum
DDENKSSRN

SEQ ID NO: 3303429 - protein, 5 aa, Plasmodium falciparum
DDENL

SEQ ID NO: 3303430 - protein, 19 aa, Plasmodium falciparum
DDENNKNDTVKKGIENTNN

SEQ ID NO: 3303431 - protein, 8 aa, Plasmodium falciparum
DDENSRSL

SEQ ID NO: 3303432 - protein, 18 aa, Plasmodium falciparum
DDEQNDISKNNDNKNEDT

SEQ ID NO: 3303433 - protein, 6 aa, Plasmodium falciparum
DDEQNH

SEQ ID NO: 3303434 - protein, 7 aa, Plasmodium falciparum
DDEQNNI

SEQ ID NO: 3303435 - protein, 13 aa, Plasmodium falciparum
DDEQNNKDSSYKI

SEQ ID NO: 3303436 - protein, 5 aa, Plasmodium falciparum
DDERN

SEQ ID NO: 3303437 - protein, 8 aa, Plasmodium falciparum
DDERRRQY

SEQ ID NO: 3303438 - protein, 4 aa, Plasmodium falciparum
DDES

SEQ ID NO: 3303439 - protein, 11 aa, Plasmodium falciparum
DDESKPQKTIP

SEQ ID NO: 3303440 - protein, 16 aa, Plasmodium falciparum
DDESQLNSIQSRNENN

SEQ ID NO: 3303441 - protein, 13 aa, Plasmodium falciparum
DDESSNMNNNNNM

SEQ ID NO: 3303442 - protein, 11 aa, Plasmodium falciparum
DDESYTTYRDN

SEQ ID NO: 3303443 - protein, 7 aa, Plasmodium falciparum
DDETGKI

SEQ ID NO: 3303444 - protein, 14 aa, Plasmodium falciparum
DDETLTKSNKSHNI

SEQ ID NO: 3303445 - protein, 14 aa, Plasmodium falciparum
DDETYKNEEANLQN

SEQ ID NO: 3303446 - protein, 12 aa, Plasmodium falciparum
DDETYRNDNNYN

SEQ ID NO: 3303447 - protein, 19 aa, Plasmodium falciparum
DDEVTYENNKNEENKSSNR

SEQ ID NO: 3303448 - protein, 13 aa, Plasmodium falciparum
DDEYEELKKGKNK

SEQ ID NO: 3303449 - protein, 16 aa, Plasmodium falciparum
DDEYEYNNSSNNNNNI

SEQ ID NO: 3303450 - protein, 36 aa, Plasmodium falciparum
DDEYTNEGIQGKKVEEDNGKRRRRRRRRRKGEGNNE

SEQ ID NO: 3303451 - protein, 12 aa, Plasmodium falciparum
DDFEDYDNYDEK

SEQ ID NO: 3303452 - protein, 12 aa, Plasmodium falciparum
DDFNEEKSLGDL

SEQ ID NO: 3303453 - protein, 6 aa, Plasmodium falciparum
DDFPND

SEQ ID NO: 3303454 - protein, 4 aa, Plasmodium falciparum
DDFY

SEQ ID NO: 3303455 - protein, 22 aa, Plasmodium falciparum
DDFYNNKKKKKNSFNNTSDHDM

SEQ ID NO: 3303456 - protein, 7 aa, Plasmodium falciparum
DDGDYKN

SEQ ID NO: 3303457 - protein, 4 aa, Plasmodium falciparum
DDGE

SEQ ID NO: 3303458 - protein, 5 aa, Plasmodium falciparum
DDGEE

SEQ ID NO: 3303459 - protein, 19 aa, Plasmodium falciparum
DDGEEEEDDDDDEEEPSYV

SEQ ID NO: 3303460 - protein, 6 aa, Plasmodium falciparum
DDGEGL

SEQ ID NO: 3303461 - protein, 9 aa, Plasmodium falciparum
DDGGYGRYN

SEQ ID NO: 3303462 - protein, 10 aa, Plasmodium falciparum
DDGKEEGNHK

SEQ ID NO: 3303463 - protein, 21 aa, Plasmodium falciparum
DDGMSTKFPNSRDVEPGYNSD

SEQ ID NO: 3303464 - protein, 5 aa, Plasmodium falciparum
DDGNK

SEQ ID NO: 3303465 - protein, 8 aa, Plasmodium falciparum
DDGNQSQN

SEQ ID NO: 3303466 - protein, 6 aa, Plasmodium falciparum
DDGNSK

SEQ ID NO: 3303467 - protein, 11 aa, Plasmodium falciparum
DDGNSPDDERN

SEQ ID NO: 3303468 - protein, 11 aa, Plasmodium falciparum
DDGPKKIEQTY

SEQ ID NO: 3303469 - protein, 10 aa, Plasmodium falciparum
DDGSGKGAAI

SEQ ID NO: 3303470 - protein, 24 aa, Plasmodium falciparum
DDGTNLPRKKQKTKNKKNKSVSEE

SEQ ID NO: 3303471 - protein, 8 aa, Plasmodium falciparum
DDGVDTTY

SEQ ID NO: 3303472 - protein, 5 aa, Plasmodium falciparum
DDGYD

SEQ ID NO: 3303473 - protein, 6 aa, Plasmodium falciparum
DDGYIK

SEQ ID NO: 3303474 - protein, 4 aa, Plasmodium falciparum
DDHK

SEQ ID NO: 3303475 - protein, 23 aa, Plasmodium falciparum
DDHKKEKDKRNKISSNGNMQDNN

SEQ ID NO: 3303476 - protein, 8 aa, Plasmodium falciparum
DDHNDEKI

SEQ ID NO: 3303477 - protein, 7 aa, Plasmodium falciparum
DDHNPIK

SEQ ID NO: 3303478 - protein, 5 aa, Plasmodium falciparum
DDHTN

SEQ ID NO: 3303479 - protein, 5 aa, Plasmodium falciparum
DDHTS

SEQ ID NO: 3303480 - protein, 13 aa, Plasmodium falciparum
DDHYDDDDYDKDN

SEQ ID NO: 3303481 - protein, 22 aa, Plasmodium falciparum
DDIDDDEEEENTDKNNNTIRSS

SEQ ID NO: 3303482 - protein, 11 aa, Plasmodium falciparum
DDIDNDCDNTC

SEQ ID NO: 3303483 - protein, 24 aa, Plasmodium falciparum
DDIEEEKINDKKKKNSSNNYYNKN

SEQ ID NO: 3303484 - protein, 8 aa, Plasmodium falciparum
DDIETNKK

SEQ ID NO: 3303485 - protein, 9 aa, Plasmodium falciparum
DDIGNTDKN

SEQ ID NO: 3303486 - protein, 5 aa, Plasmodium falciparum
DDIHG

SEQ ID NO: 3303487 - protein, 12 aa, Plasmodium falciparum
DDIKEKTEKITS

SEQ ID NO: 3303488 - protein, 32 aa, Plasmodium falciparum
DDIKKRKKKERKKNENIYNNRNKSSINTEEHN

SEQ ID NO: 3303489 - protein, 48 aa, Plasmodium falciparum
DDIKNNDDINNDDRNNNDDINNNNNDRNNNNGRNNNNDRNNNNEDEDH

SEQ ID NO: 3303490 - protein, 40 aa, Plasmodium falciparum
DDIKTSDEIKTSDNIKSNDPIQSSDHIQSNDHIKSNDNNL

SEQ ID NO: 3303491 - protein, 4 aa, Plasmodium falciparum
DDIN

SEQ ID NO: 3303492 - protein, 17 aa, Plasmodium falciparum
DDINKKRDNENNNNNNM

SEQ ID NO: 3303493 - protein, 15 aa, Plasmodium falciparum
DDINKQAKEKMKNRI

SEQ ID NO: 3303494 - protein, 8 aa, Plasmodium falciparum
DDINTTNM

SEQ ID NO: 3303495 - protein, 6 aa, Plasmodium falciparum
DDIPAP

SEQ ID NO: 3303496 - protein, 13 aa, Plasmodium falciparum
DDIQERKEEIKEE

SEQ ID NO: 3303497 - protein, 18 aa, Plasmodium falciparum
DDIQGNDNYSLKNEGQDD

SEQ ID NO: 3303498 - protein, 24 aa, Plasmodium falciparum
DDISDYEKEKNTKNEKRSESNSTF

SEQ ID NO: 3303499 - protein, 16 aa, Plasmodium falciparum
DDISEKNCNSNGNTEH

SEQ ID NO: 3303500 - protein, 7 aa, Plasmodium falciparum
DDISNND

SEQ ID NO: 3303501 - protein, 34 aa, Plasmodium falciparum
DDKCDDNNNKSDHNNNKSGHNNNKSDDNKNNNNN

SEQ ID NO: 3303502 - protein, 6 aa, Plasmodium falciparum
DDKDAI

SEQ ID NO: 3303503 - protein, 8 aa, Plasmodium falciparum
DDKDQGGN

SEQ ID NO: 3303504 - protein, 23 aa, Plasmodium falciparum
DDKDTNYSSEENNKGDNKYNKEL

SEQ ID NO: 3303505 - protein, 4 aa, Plasmodium falciparum
DDKE

SEQ ID NO: 3303506 - protein, 18 aa, Plasmodium falciparum
DDKEENKESYEKNDKKTI

SEQ ID NO: 3303507 - protein, 10 aa, Plasmodium falciparum
DDKEKNDIHK

SEQ ID NO: 3303508 - protein, 7 aa, Plasmodium falciparum
DDKEKYT

SEQ ID NO: 3303509 - protein, 11 aa, Plasmodium falciparum
DDKENNLNNEN

SEQ ID NO: 3303510 - protein, 7 aa, Plasmodium falciparum
DDKETSN

SEQ ID NO: 3303511 - protein, 9 aa, Plasmodium falciparum
DDKEYNENV

SEQ ID NO: 3303512 - protein, 69 aa, Plasmodium falciparum
DDKGENDDRGKNDDGGKNDDKEKNDDKEKNYDKGKNDDKEKNYNKGKNDDKEKNDDKEKNDDKEKNDDI

SEQ ID NO: 3303513 - protein, 19 aa, Plasmodium falciparum
DDKGENTKNTFKKSAYDKN

SEQ ID NO: 3303514 - protein, 44 aa, Plasmodium falciparum
DDKGNNNEKNNNNNYSNNDSNNDSNNNSNNDSNNNSNSCYNNSY

SEQ ID NO: 3303515 - protein, 12 aa, Plasmodium falciparum
DDKIGRHNESND

SEQ ID NO: 3303516 - protein, 7 aa, Plasmodium falciparum
DDKIKNN

SEQ ID NO: 3303517 - protein, 9 aa, Plasmodium falciparum
DDKINTDNK

SEQ ID NO: 3303518 - protein, 4 aa, Plasmodium falciparum
DDKK

SEQ ID NO: 3303519 - protein, 7 aa, Plasmodium falciparum
DDKKAID

SEQ ID NO: 3303520 - protein, 9 aa, Plasmodium falciparum
DDKKEEDKN

SEQ ID NO: 3303521 - protein, 9 aa, Plasmodium falciparum
DDKKENVSI

SEQ ID NO: 3303522 - protein, 9 aa, Plasmodium falciparum
DDKKGEKLF

SEQ ID NO: 3303523 - protein, 7 aa, Plasmodium falciparum
DDKKKIK

SEQ ID NO: 3303524 - protein, 10 aa, Plasmodium falciparum
DDKKLSKDTT

SEQ ID NO: 3303525 - protein, 9 aa, Plasmodium falciparum
DDKKNGNKN

SEQ ID NO: 3303526 - protein, 16 aa, Plasmodium falciparum
DDKKNKRKKRTTKMNN

SEQ ID NO: 3303527 - protein, 8 aa, Plasmodium falciparum
DDKKNYTL

SEQ ID NO: 3303528 - protein, 22 aa, Plasmodium falciparum
DDKKRKKKTSEWNKAVERTLIQ

SEQ ID NO: 3303529 - protein, 8 aa, Plasmodium falciparum
DDKKVQAK

SEQ ID NO: 3303530 - protein, 5 aa, Plasmodium falciparum
DDKKY

SEQ ID NO: 3303531 - protein, 4 aa, Plasmodium falciparum
DDKM

SEQ ID NO: 3303532 - protein, 29 aa, Plasmodium falciparum
DDKNDAHKDHPGNSSNNNNNNNNNNNNES

SEQ ID NO: 3303533 - protein, 12 aa, Plasmodium falciparum
DDKNDQSDTAKS

SEQ ID NO: 3303534 - protein, 5 aa, Plasmodium falciparum
DDKNE

SEQ ID NO: 3303535 - protein, 9 aa, Plasmodium falciparum
DDKNEDGDL

SEQ ID NO: 3303536 - protein, 7 aa, Plasmodium falciparum
DDKNEDL

SEQ ID NO: 3303537 - protein, 10 aa, Plasmodium falciparum
DDKNELSKKG

SEQ ID NO: 3303538 - protein, 9 aa, Plasmodium falciparum
DDKNENDDL

SEQ ID NO: 3303539 - protein, 15 aa, Plasmodium falciparum
DDKNIKYNNNKEKSY

SEQ ID NO: 3303540 - protein, 8 aa, Plasmodium falciparum
DDKNKENI

SEQ ID NO: 3303541 - protein, 41 aa, Plasmodium falciparum
DDKNKETFHNDDDKNKEALHNDDDKNKEALHNDDDKNVEAY

SEQ ID NO: 3303542 - protein, 9 aa, Plasmodium falciparum
DDKNKNHNN

SEQ ID NO: 3303543 - protein, 5 aa, Plasmodium falciparum
DDKNP

SEQ ID NO: 3303544 - protein, 7 aa, Plasmodium falciparum
DDKNRGN

SEQ ID NO: 3303545 - protein, 7 aa, Plasmodium falciparum
DDKPPKE

SEQ ID NO: 3303546 - protein, 14 aa, Plasmodium falciparum
DDKQKNYNHSNNNI

SEQ ID NO: 3303547 - protein, 9 aa, Plasmodium falciparum
DDKRNSIDN

SEQ ID NO: 3303548 - protein, 7 aa, Plasmodium falciparum
DDKSIKK

SEQ ID NO: 3303549 - protein, 8 aa, Plasmodium falciparum
DDKSNDNM

SEQ ID NO: 3303550 - protein, 11 aa, Plasmodium falciparum
DDKSVENKTTT

SEQ ID NO: 3303551 - protein, 10 aa, Plasmodium falciparum
DDKTDNKKIS

SEQ ID NO: 3303552 - protein, 8 aa, Plasmodium falciparum
DDKTNQMS

SEQ ID NO: 3303553 - protein, 7 aa, Plasmodium falciparum
DDKTRNI

SEQ ID NO: 3303554 - protein, 6 aa, Plasmodium falciparum
DDKTRS

SEQ ID NO: 3303555 - protein, 4 aa, Plasmodium falciparum
DDKV

SEQ ID NO: 3303556 - protein, 6 aa, Plasmodium falciparum
DDKVGT

SEQ ID NO: 3303557 - protein, 6 aa, Plasmodium falciparum
DDKVKQ

SEQ ID NO: 3303558 - protein, 29 aa, Plasmodium falciparum
DDKYDTSKSSTNPYDPKNEEKEKKKGGGW

SEQ ID NO: 3303559 - protein, 8 aa, Plasmodium falciparum
DDKYKNRK

SEQ ID NO: 3303560 - protein, 11 aa, Plasmodium falciparum
DDLEKESTKDD

SEQ ID NO: 3303561 - protein, 5 aa, Plasmodium falciparum
DDLKN

SEQ ID NO: 3303562 - protein, 4 aa, Plasmodium falciparum
DDLN

SEQ ID NO: 3303563 - protein, 7 aa, Plasmodium falciparum
DDLNEQI

SEQ ID NO: 3303564 - protein, 16 aa, Plasmodium falciparum
DDLNNKENIKKRKTIK

SEQ ID NO: 3303565 - protein, 8 aa, Plasmodium falciparum
DDLNNSNI

SEQ ID NO: 3303566 - protein, 15 aa, Plasmodium falciparum
DDLNNTLNDGDNHNA

SEQ ID NO: 3303567 - protein, 8 aa, Plasmodium falciparum
DDLPNDSK

SEQ ID NO: 3303568 - protein, 4 aa, Plasmodium falciparum
DDLQ

SEQ ID NO: 3303569 - protein, 6 aa, Plasmodium falciparum
DDMENG

SEQ ID NO: 3303570 - protein, 45 aa, Plasmodium falciparum
DDMENHRDNNMHNNNNNNSNNNNNNNSNNNNSNNNNSNNNSNVRG

SEQ ID NO: 3303571 - protein, 13 aa, Plasmodium falciparum
DDMGSNQESRDYN

SEQ ID NO: 3303572 - protein, 17 aa, Plasmodium falciparum
DDMKKKEKNKYKNKGKL

SEQ ID NO: 3303573 - protein, 28 aa, Plasmodium falciparum
DDMNDALKNKTDKEDNGDDLKKSEYMNN

SEQ ID NO: 3303574 - protein, 8 aa, Plasmodium falciparum
DDMRKKKS

SEQ ID NO: 3303575 - protein, 6 aa, Plasmodium falciparum
DDMSGN

SEQ ID NO: 3303576 - protein, 4 aa, Plasmodium falciparum
DDMT

SEQ ID NO: 3303577 - protein, 9 aa, Plasmodium falciparum
DDNDEENNS

SEQ ID NO: 3303578 - protein, 11 aa, Plasmodium falciparum
DDNDMNSSGQN

SEQ ID NO: 3303579 - protein, 10 aa, Plasmodium falciparum
DDNDNNEDNK

SEQ ID NO: 3303580 - protein, 14 aa, Plasmodium falciparum
DDNDNYQYNENEGM

SEQ ID NO: 3303581 - protein, 22 aa, Plasmodium falciparum
DDNDTKKKDIINQKKDEKNKKH

SEQ ID NO: 3303582 - protein, 14 aa, Plasmodium falciparum
DDNDTKRKSQKKKK

SEQ ID NO: 3303583 - protein, 4 aa, Plasmodium falciparum
DDNE

SEQ ID NO: 3303584 - protein, 9 aa, Plasmodium falciparum
DDNEDEDDV

SEQ ID NO: 3303585 - protein, 58 aa, Plasmodium falciparum
DDNEEDENNDYYDENNNNYDDENNNYDDDNNNYYDDDNNNYYDGDNNNYYDGDNNNYY

SEQ ID NO: 3303586 - protein, 14 aa, Plasmodium falciparum
DDNEHADKKKKNTY

SEQ ID NO: 3303587 - protein, 9 aa, Plasmodium falciparum
DDNEHNEET

SEQ ID NO: 3303588 - protein, 6 aa, Plasmodium falciparum
DDNENV

SEQ ID NO: 3303589 - protein, 5 aa, Plasmodium falciparum
DDNFT

SEQ ID NO: 3303590 - protein, 6 aa, Plasmodium falciparum
DDNHLS

SEQ ID NO: 3303591 - protein, 14 aa, Plasmodium falciparum
DDNHSDDNSDGHSG

SEQ ID NO: 3303592 - protein, 4 aa, Plasmodium falciparum
DDNI

SEQ ID NO: 3303593 - protein, 43 aa, Plasmodium falciparum
DDNIDNVKDKKEIKKKKKKDKKKKKKKKKLDKHSSDNNINNDN

SEQ ID NO: 3303594 - protein, 62 aa, Plasmodium falciparum
DDNIKNDDNIKNDDNIKNDDNIKNDDNIKNDDNIKNDDNKNNNEEDAEFENNTNKIRKKKKI

SEQ ID NO: 3303595 - protein, 6 aa, Plasmodium falciparum
DDNIND

SEQ ID NO: 3303596 - protein, 74 aa, Plasmodium falciparum
DDNINDDNINGDNINGDNINGDNINGDNINGDNINGDNINGDNINGDNINDDNINDDKINDDNINDDNINNDNI

SEQ ID NO: 3303597 - protein, 19 aa, Plasmodium falciparum
DDNINGDDNINGDKNIYDD

SEQ ID NO: 3303598 - protein, 22 aa, Plasmodium falciparum
DDNISEEDQFHEKEKKKDGSSI

SEQ ID NO: 3303599 - protein, 43 aa, Plasmodium falciparum
DDNKCAREENGKVDEDKNQRRDKNRYINDNNNNINVDQNNAKM

SEQ ID NO: 3303600 - protein, 30 aa, Plasmodium falciparum
DDNKCYQDNNDNDNYITGDDKNMNNNIKNK

SEQ ID NO: 3303601 - protein, 8 aa, Plasmodium falciparum
DDNKDDIK

SEQ ID NO: 3303602 - protein, 6 aa, Plasmodium falciparum
DDNKDE

SEQ ID NO: 3303603 - protein, 21 aa, Plasmodium falciparum
DDNKEEIENNNNNNNNNQEEG

SEQ ID NO: 3303604 - protein, 6 aa, Plasmodium falciparum
DDNKFY

SEQ ID NO: 3303605 - protein, 10 aa, Plasmodium falciparum
DDNKGDGNIY

SEQ ID NO: 3303606 - protein, 91 aa, Plasmodium falciparum
DDNKKDHDDERSLRKDHNNDDERSLRKDHNNDDEKGDKKDHDNDDEKGNRKDNNNEEEKGDKKDHNNDDDKKGNIKDNNNEEEKKTNDDNK

SEQ ID NO: 3303607 - protein, 14 aa, Plasmodium falciparum
DDNKKDQPSVPEKN

SEQ ID NO: 3303608 - protein, 49 aa, Plasmodium falciparum
DDNKNGDKKEKKMKKKEHKKKSSTFSNNSDYSDNSNNSNNSDYSDYSDY

SEQ ID NO: 3303609 - protein, 11 aa, Plasmodium falciparum
DDNKNNNDEVN

SEQ ID NO: 3303610 - protein, 9 aa, Plasmodium falciparum
DDNKNTIDP

SEQ ID NO: 3303611 - protein, 9 aa, Plasmodium falciparum
DDNKRKYSL

SEQ ID NO: 3303612 - protein, 6 aa, Plasmodium falciparum
DDNKTM

SEQ ID NO: 3303613 - protein, 5 aa, Plasmodium falciparum
DDNMN

SEQ ID NO: 3303614 - protein, 6 aa, Plasmodium falciparum
DDNMSD

SEQ ID NO: 3303615 - protein, 16 aa, Plasmodium falciparum
DDNMSDHNVDNGSDNM

SEQ ID NO: 3303616 - protein, 44 aa, Plasmodium falciparum
DDNNDEEEHEEEAEEDIEGREEEDDDDDDGDDGEEEDYEDEEDE

SEQ ID NO: 3303617 - protein, 14 aa, Plasmodium falciparum
DDNNDEHDKMDSKS

SEQ ID NO: 3303618 - protein, 20 aa, Plasmodium falciparum
DDNNHNDDNHNKDDNKKERD

SEQ ID NO: 3303619 - protein, 5 aa, Plasmodium falciparum
DDNNI

SEQ ID NO: 3303620 - protein, 6 aa, Plasmodium falciparum
DDNNKL

SEQ ID NO: 3303621 - protein, 13 aa, Plasmodium falciparum
DDNNLGRKKRSCT

SEQ ID NO: 3303622 - protein, 30 aa, Plasmodium falciparum
DDNNNDDNNNDDNNNDDSSNMGDDQSVDNS

SEQ ID NO: 3303623 - protein, 17 aa, Plasmodium falciparum
DDNNNEDTYQNNESNSI

SEQ ID NO: 3303624 - protein, 10 aa, Plasmodium falciparum
DDNNNENSEI

SEQ ID NO: 3303625 - protein, 28 aa, Plasmodium falciparum
DDNNNINGDSVNNNNMNDDSVNNNNMND

SEQ ID NO: 3303626 - protein, 35 aa, Plasmodium falciparum
DDNNNKDNINKENINDDNINNNNINNNNISSENNN

SEQ ID NO: 3303627 - protein, 8 aa, Plasmodium falciparum
DDNNNKYK

SEQ ID NO: 3303628 - protein, 64 aa, Plasmodium falciparum
DDNNNNKNVTYDDNNKNVTYDNNNKNVTYDNNNKNVTYDNNNKNVTYDNNNKNVTYDNNNNNSC

SEQ ID NO: 3303629 - protein, 8 aa, Plasmodium falciparum
DDNNNNLN

SEQ ID NO: 3303630 - protein, 9 aa, Plasmodium falciparum
DDNNNNNND

SEQ ID NO: 3303631 - protein, 16 aa, Plasmodium falciparum
DDNNNNNNKGSTQNNM

SEQ ID NO: 3303632 - protein, 16 aa, Plasmodium falciparum
DDNNNNNNNNLADNSS

SEQ ID NO: 3303633 - protein, 58 aa, Plasmodium falciparum
DDNNNNNNYNNNNNNYNNNYNNNNSNYNNNYNNNNNNNNNSANVKTKNSRKDKKYKKE

SEQ ID NO: 3303634 - protein, 21 aa, Plasmodium falciparum
DDNNNNVPNGGEEENVPNKRS

SEQ ID NO: 3303635 - protein, 9 aa, Plasmodium falciparum
DDNNNTQLK

SEQ ID NO: 3303636 - protein, 48 aa, Plasmodium falciparum
DDNNNTSYDEIGSDNSSEMKNNDDTDFSSSSSNENSLEHETKKLSDTW

SEQ ID NO: 3303637 - protein, 7 aa, Plasmodium falciparum
DDNNQMN

SEQ ID NO: 3303638 - protein, 8 aa, Plasmodium falciparum
DDNNSMNN

SEQ ID NO: 3303639 - protein, 5 aa, Plasmodium falciparum
DDNPV

SEQ ID NO: 3303640 - protein, 4 aa, Plasmodium falciparum
DDNQ

SEQ ID NO: 3303641 - protein, 32 aa, Plasmodium falciparum
DDNQSYNNKKQKNDDDDISHNKHKNGDDKIDN

SEQ ID NO: 3303642 - protein, 4 aa, Plasmodium falciparum
DDNS

SEQ ID NO: 3303643 - protein, 7 aa, Plasmodium falciparum
DDNSDRY

SEQ ID NO: 3303644 - protein, 9 aa, Plasmodium falciparum
DDNSENNNL

SEQ ID NO: 3303645 - protein, 7 aa, Plasmodium falciparum
DDNSLDS

SEQ ID NO: 3303646 - protein, 7 aa, Plasmodium falciparum
DDNSLSK

SEQ ID NO: 3303647 - protein, 22 aa, Plasmodium falciparum
DDNSLSRKTKKKKSSKNKSVDS

SEQ ID NO: 3303648 - protein, 6 aa, Plasmodium falciparum
DDNSQV

SEQ ID NO: 3303649 - protein, 6 aa, Plasmodium falciparum
DDNSRN

SEQ ID NO: 3303650 - protein, 34 aa, Plasmodium falciparum
DDNSSNNNHNKKNNSMLNNNSNNNIPSIDQPPSD

SEQ ID NO: 3303651 - protein, 11 aa, Plasmodium falciparum
DDNSVNNNMNS

SEQ ID NO: 3303652 - protein, 4 aa, Plasmodium falciparum
DDNT

SEQ ID NO: 3303653 - protein, 7 aa, Plasmodium falciparum
DDNTDDV

SEQ ID NO: 3303654 - protein, 8 aa, Plasmodium falciparum
DDNTNKPI

SEQ ID NO: 3303655 - protein, 12 aa, Plasmodium falciparum
DDNTSDDKGAEL

SEQ ID NO: 3303656 - protein, 7 aa, Plasmodium falciparum
DDNTVNK

SEQ ID NO: 3303657 - protein, 8 aa, Plasmodium falciparum
DDNTYGNN

SEQ ID NO: 3303658 - protein, 7 aa, Plasmodium falciparum
DDNVNKN

SEQ ID NO: 3303659 - protein, 4 aa, Plasmodium falciparum
DDNY

SEQ ID NO: 3303660 - protein, 8 aa, Plasmodium falciparum
DDNYEEKI

SEQ ID NO: 3303661 - protein, 7 aa, Plasmodium falciparum
DDNYNNN

SEQ ID NO: 3303662 - protein, 15 aa, Plasmodium falciparum
DDNYSNKSYEQGGEI

SEQ ID NO: 3303663 - protein, 6 aa, Plasmodium falciparum
DDPGML

SEQ ID NO: 3303664 - protein, 9 aa, Plasmodium falciparum
DDPHEDNDY

SEQ ID NO: 3303665 - protein, 4 aa, Plasmodium falciparum
DDPI

SEQ ID NO: 3303666 - protein, 6 aa, Plasmodium falciparum
DDPKEL

SEQ ID NO: 3303667 - protein, 16 aa, Plasmodium falciparum
DDPKEQNDDVGTSEEM

SEQ ID NO: 3303668 - protein, 9 aa, Plasmodium falciparum
DDPKGKKEF

SEQ ID NO: 3303669 - protein, 7 aa, Plasmodium falciparum
DDPKISN

SEQ ID NO: 3303670 - protein, 22 aa, Plasmodium falciparum
DDPQNNNDDDINDDNSLDKKRN

SEQ ID NO: 3303671 - protein, 18 aa, Plasmodium falciparum
DDPSINEQNEYDDEDSSL

SEQ ID NO: 3303672 - protein, 5 aa, Plasmodium falciparum
DDPTC

SEQ ID NO: 3303673 - protein, 16 aa, Plasmodium falciparum
DDQCENETKCKSYTHS

SEQ ID NO: 3303674 - protein, 10 aa, Plasmodium falciparum
DDQKNYKDEL

SEQ ID NO: 3303675 - protein, 7 aa, Plasmodium falciparum
DDQNEEY

SEQ ID NO: 3303676 - protein, 5 aa, Plasmodium falciparum
DDQNG

SEQ ID NO: 3303677 - protein, 6 aa, Plasmodium falciparum
DDQNNN

SEQ ID NO: 3303678 - protein, 8 aa, Plasmodium falciparum
DDQNNSRN

SEQ ID NO: 3303679 - protein, 8 aa, Plasmodium falciparum
DDQNVDGN

SEQ ID NO: 3303680 - protein, 8 aa, Plasmodium falciparum
DDQNVDSQ

SEQ ID NO: 3303681 - protein, 6 aa, Plasmodium falciparum
DDQPNN

SEQ ID NO: 3303682 - protein, 11 aa, Plasmodium falciparum
DDQRKHFDEKE

SEQ ID NO: 3303683 - protein, 8 aa, Plasmodium falciparum
DDQSCDDH

SEQ ID NO: 3303684 - protein, 12 aa, Plasmodium falciparum
DDQTHKKGNQIS

SEQ ID NO: 3303685 - protein, 10 aa, Plasmodium falciparum
DDRDNETKTN

SEQ ID NO: 3303686 - protein, 19 aa, Plasmodium falciparum
DDRKKEEKTYQTKNTNNNI

SEQ ID NO: 3303687 - protein, 6 aa, Plasmodium falciparum
DDRKKR

SEQ ID NO: 3303688 - protein, 5 aa, Plasmodium falciparum
DDRNP

SEQ ID NO: 3303689 - protein, 5 aa, Plasmodium falciparum
DDRNY

SEQ ID NO: 3303690 - protein, 5 aa, Plasmodium falciparum
DDRPL

SEQ ID NO: 3303691 - protein, 5 aa, Plasmodium falciparum
DDRPY

SEQ ID NO: 3303692 - protein, 4 aa, Plasmodium falciparum
DDRT

SEQ ID NO: 3303693 - protein, 31 aa, Plasmodium falciparum
DDSDDESDKEETNITTNVKSDKKKKDFDKGN

SEQ ID NO: 3303694 - protein, 8 aa, Plasmodium falciparum
DDSDIRKD

SEQ ID NO: 3303695 - protein, 7 aa, Plasmodium falciparum
DDSFGDS

SEQ ID NO: 3303696 - protein, 5 aa, Plasmodium falciparum
DDSKD

SEQ ID NO: 3303697 - protein, 8 aa, Plasmodium falciparum
DDSKDECQ

SEQ ID NO: 3303698 - protein, 8 aa, Plasmodium falciparum
DDSKKSYK

SEQ ID NO: 3303699 - protein, 8 aa, Plasmodium falciparum
DDSNAELK

SEQ ID NO: 3303700 - protein, 9 aa, Plasmodium falciparum
DDSNKINGK

SEQ ID NO: 3303701 - protein, 23 aa, Plasmodium falciparum
DDSNKQDDNKKKVEEEGEKDDTL

SEQ ID NO: 3303702 - protein, 8 aa, Plasmodium falciparum
DDSNKRRG

SEQ ID NO: 3303703 - protein, 15 aa, Plasmodium falciparum
DDSNNKKDDDDLNSS

SEQ ID NO: 3303704 - protein, 24 aa, Plasmodium falciparum
DDSNYKKKKQRTNKKKIQNNSNIS

SEQ ID NO: 3303705 - protein, 11 aa, Plasmodium falciparum
DDSPEKDTNNV

SEQ ID NO: 3303706 - protein, 12 aa, Plasmodium falciparum
DDSQYNGKNDKE

SEQ ID NO: 3303707 - protein, 8 aa, Plasmodium falciparum
DDSRDKHK

SEQ ID NO: 3303708 - protein, 4 aa, Plasmodium falciparum
DDSS

SEQ ID NO: 3303709 - protein, 11 aa, Plasmodium falciparum
DDSSCSENNEY

SEQ ID NO: 3303710 - protein, 10 aa, Plasmodium falciparum
DDSTAASDQD

SEQ ID NO: 3303711 - protein, 5 aa, Plasmodium falciparum
DDSTL

SEQ ID NO: 3303712 - protein, 5 aa, Plasmodium falciparum
DDSTR

SEQ ID NO: 3303713 - protein, 8 aa, Plasmodium falciparum
DDSYSNYV

SEQ ID NO: 3303714 - protein, 7 aa, Plasmodium falciparum
DDSYYNS

SEQ ID NO: 3303715 - protein, 14 aa, Plasmodium falciparum
DDTCGHTNDDTCDH

SEQ ID NO: 3303716 - protein, 9 aa, Plasmodium falciparum
DDTCSSNNI

SEQ ID NO: 3303717 - protein, 8 aa, Plasmodium falciparum
DDTCTHNK

SEQ ID NO: 3303718 - protein, 5 aa, Plasmodium falciparum
DDTDI

SEQ ID NO: 3303719 - protein, 10 aa, Plasmodium falciparum
DDTDKMNSSD

SEQ ID NO: 3303720 - protein, 8 aa, Plasmodium falciparum
DDTDLSNR

SEQ ID NO: 3303721 - protein, 6 aa, Plasmodium falciparum
DDTDPY

SEQ ID NO: 3303722 - protein, 22 aa, Plasmodium falciparum
DDTHHSDDKKHSTDHENSKKHN

SEQ ID NO: 3303723 - protein, 9 aa, Plasmodium falciparum
DDTHKKEKG

SEQ ID NO: 3303724 - protein, 7 aa, Plasmodium falciparum
DDTICNN

SEQ ID NO: 3303725 - protein, 16 aa, Plasmodium falciparum
DDTICNNNKDDTICNN

SEQ ID NO: 3303726 - protein, 11 aa, Plasmodium falciparum
DDTINNSKKNN

SEQ ID NO: 3303727 - protein, 68 aa, Plasmodium falciparum
DDTKIDNGQKEDNITTNNNNSNCNSEGKDNRHDNKNNDINNNDINNNDINNNDINNNDINNNDINNND

SEQ ID NO: 3303728 - protein, 21 aa, Plasmodium falciparum
DDTKKSSKIINNDQSTKSNKH

SEQ ID NO: 3303729 - protein, 6 aa, Plasmodium falciparum
DDTLSA

SEQ ID NO: 3303730 - protein, 4 aa, Plasmodium falciparum
DDTN

SEQ ID NO: 3303731 - protein, 13 aa, Plasmodium falciparum
DDTNDIKNDQTSA

SEQ ID NO: 3303732 - protein, 112 aa, Plasmodium falciparum
DDTNEHNKDDAKEQNKDDAKEQNKDDTYEPNNNHTNEPNNNLTNEPNNNHTNEPNNNHTNEPNNNHTNEPNNNHTNEPNNNLTNEPNNNHTNEQNKDDTNEPNNNHTNEQNK

SEQ ID NO: 3303733 - protein, 10 aa, Plasmodium falciparum
DDTNMNSKKS

SEQ ID NO: 3303734 - protein, 11 aa, Plasmodium falciparum
DDTNNDDLSTN

SEQ ID NO: 3303735 - protein, 11 aa, Plasmodium falciparum
DDTNNEYEDEE

SEQ ID NO: 3303736 - protein, 6 aa, Plasmodium falciparum
DDTNNK

SEQ ID NO: 3303737 - protein, 8 aa, Plasmodium falciparum
DDTNNSYY

SEQ ID NO: 3303738 - protein, 29 aa, Plasmodium falciparum
DDTNTNLQNDEDNYISSDSSSFKSRSSLG

SEQ ID NO: 3303739 - protein, 35 aa, Plasmodium falciparum
DDTQKENNNNNKKNKKNNNNKKNKKNGNKNEHSDD

SEQ ID NO: 3303740 - protein, 5 aa, Plasmodium falciparum
DDTQL

SEQ ID NO: 3303741 - protein, 9 aa, Plasmodium falciparum
DDTQNEKMN

SEQ ID NO: 3303742 - protein, 7 aa, Plasmodium falciparum
DDTRLEK

SEQ ID NO: 3303743 - protein, 7 aa, Plasmodium falciparum
DDTSHED

SEQ ID NO: 3303744 - protein, 5 aa, Plasmodium falciparum
DDTSI

SEQ ID NO: 3303745 - protein, 8 aa, Plasmodium falciparum
DDTSNISK

SEQ ID NO: 3303746 - protein, 8 aa, Plasmodium falciparum
DDTSSYAS

SEQ ID NO: 3303747 - protein, 7 aa, Plasmodium falciparum
DDTSYSD

SEQ ID NO: 3303748 - protein, 5 aa, Plasmodium falciparum
DDTTI

SEQ ID NO: 3303749 - protein, 17 aa, Plasmodium falciparum
DDTTTTATVTNNNSNYL

SEQ ID NO: 3303750 - protein, 5 aa, Plasmodium falciparum
DDTTV

SEQ ID NO: 3303751 - protein, 17 aa, Plasmodium falciparum
DDTYENEELFKNFNVFL

SEQ ID NO: 3303752 - protein, 20 aa, Plasmodium falciparum
DDTYKKEEKKYASKNDDKEN

SEQ ID NO: 3303753 - protein, 27 aa, Plasmodium falciparum
DDVDDKKSNNNNKIKAKKKKKSKSEDV

SEQ ID NO: 3303754 - protein, 12 aa, Plasmodium falciparum
DDVEGAKELSIT

SEQ ID NO: 3303755 - protein, 8 aa, Plasmodium falciparum
DDVEKSKI

SEQ ID NO: 3303756 - protein, 10 aa, Plasmodium falciparum
DDVKKSSSPF

SEQ ID NO: 3303757 - protein, 4 aa, Plasmodium falciparum
DDVN

SEQ ID NO: 3303758 - protein, 5 aa, Plasmodium falciparum
DDVNN

SEQ ID NO: 3303759 - protein, 11 aa, Plasmodium falciparum
DDVNNSHLNDD

SEQ ID NO: 3303760 - protein, 4 aa, Plasmodium falciparum
DDYA

SEQ ID NO: 3303761 - protein, 6 aa, Plasmodium falciparum
DDYEIE

SEQ ID NO: 3303762 - protein, 17 aa, Plasmodium falciparum
DDYENVRNKNEDSSNIY

SEQ ID NO: 3303763 - protein, 4 aa, Plasmodium falciparum
DDYK

SEQ ID NO: 3303764 - protein, 4 aa, Plasmodium falciparum
DDYN

SEQ ID NO: 3303765 - protein, 14 aa, Plasmodium falciparum
DDYNNNDDEGEDDM

SEQ ID NO: 3303766 - protein, 5 aa, Plasmodium falciparum
DDYPE

SEQ ID NO: 3303767 - protein, 23 aa, Plasmodium falciparum
DDYPESNYSNSDSSIYDENTIKS

SEQ ID NO: 3303768 - protein, 19 aa, Plasmodium falciparum
DDYQKNNEKNNKNLKSYED

SEQ ID NO: 3303769 - protein, 4 aa, Plasmodium falciparum
DDYR

SEQ ID NO: 3303770 - protein, 10 aa, Plasmodium falciparum
DDYSDERRER

SEQ ID NO: 3303771 - protein, 7 aa, Plasmodium falciparum
DDYSKEN

SEQ ID NO: 3303772 - protein, 22 aa, Plasmodium falciparum
DDYTKDDDNADDENEDHENGDA

SEQ ID NO: 3303773 - protein, 20 aa, Plasmodium falciparum
DDYTQKEKNKNRRKYRDREN

SEQ ID NO: 3303774 - protein, 70 aa, Plasmodium falciparum
DDYYDEEDNYYEDDENIHDEQPYNSPNSSSSYDINKKKKHKAVSKLKGKRKKKNKKKKKRNISSTNKVNL

SEQ ID NO: 3303775 - protein, 13 aa, Plasmodium falciparum
DDYYGDKNFNEKD

SEQ ID NO: 3303776 - protein, 5 aa, Plasmodium falciparum
DEAGQ

SEQ ID NO: 3303777 - protein, 5 aa, Plasmodium falciparum
DEAHQ

SEQ ID NO: 3303778 - protein, 7 aa, Plasmodium falciparum
DEAKENK

SEQ ID NO: 3303779 - protein, 11 aa, Plasmodium falciparum
DEAKNDDPFSP

SEQ ID NO: 3303780 - protein, 9 aa, Plasmodium falciparum
DEAKQEDHK

SEQ ID NO: 3303781 - protein, 7 aa, Plasmodium falciparum
DEAKQKM

SEQ ID NO: 3303782 - protein, 5 aa, Plasmodium falciparum
DEARI

SEQ ID NO: 3303783 - protein, 4 aa, Plasmodium falciparum
DECA

SEQ ID NO: 3303784 - protein, 4 aa, Plasmodium falciparum
DEDD

SEQ ID NO: 3303785 - protein, 12 aa, Plasmodium falciparum
DEDDEDLKSEKF

SEQ ID NO: 3303786 - protein, 9 aa, Plasmodium falciparum
DEDDEEYAT

SEQ ID NO: 3303787 - protein, 6 aa, Plasmodium falciparum
DEDDIR

SEQ ID NO: 3303788 - protein, 13 aa, Plasmodium falciparum
DEDDKEDTPEKKN

SEQ ID NO: 3303789 - protein, 5 aa, Plasmodium falciparum
DEDDP

SEQ ID NO: 3303790 - protein, 5 aa, Plasmodium falciparum
DEDDR

SEQ ID NO: 3303791 - protein, 8 aa, Plasmodium falciparum
DEDDTKRT

SEQ ID NO: 3303792 - protein, 8 aa, Plasmodium falciparum
DEDDTQYS

SEQ ID NO: 3303793 - protein, 11 aa, Plasmodium falciparum
DEDEHASTNDL

SEQ ID NO: 3303794 - protein, 7 aa, Plasmodium falciparum
DEDEKKD

SEQ ID NO: 3303795 - protein, 5 aa, Plasmodium falciparum
DEDEN

SEQ ID NO: 3303796 - protein, 9 aa, Plasmodium falciparum
DEDENENTN

SEQ ID NO: 3303797 - protein, 21 aa, Plasmodium falciparum
DEDENSENGDNDQEEENEDPV

SEQ ID NO: 3303798 - protein, 4 aa, Plasmodium falciparum
DEDF

SEQ ID NO: 3303799 - protein, 9 aa, Plasmodium falciparum
DEDGDTSET

SEQ ID NO: 3303800 - protein, 8 aa, Plasmodium falciparum
DEDGKNSI

SEQ ID NO: 3303801 - protein, 5 aa, Plasmodium falciparum
DEDIK

SEQ ID NO: 3303802 - protein, 5 aa, Plasmodium falciparum
DEDKK

SEQ ID NO: 3303803 - protein, 10 aa, Plasmodium falciparum
DEDKKKNDMN

SEQ ID NO: 3303804 - protein, 7 aa, Plasmodium falciparum
DEDKLKK

SEQ ID NO: 3303805 - protein, 13 aa, Plasmodium falciparum
DEDKNKKAKKECI

SEQ ID NO: 3303806 - protein, 17 aa, Plasmodium falciparum
DEDKNKTNEDSFASPTF

SEQ ID NO: 3303807 - protein, 8 aa, Plasmodium falciparum
DEDKTNPF

SEQ ID NO: 3303808 - protein, 7 aa, Plasmodium falciparum
DEDLPTI

SEQ ID NO: 3303809 - protein, 7 aa, Plasmodium falciparum
DEDNDIH

SEQ ID NO: 3303810 - protein, 5 aa, Plasmodium falciparum
DEDNE

SEQ ID NO: 3303811 - protein, 6 aa, Plasmodium falciparum
DEDNKM

SEQ ID NO: 3303812 - protein, 12 aa, Plasmodium falciparum
DEDNKRKEEGND

SEQ ID NO: 3303813 - protein, 18 aa, Plasmodium falciparum
DEDNNDDTPAYVVDEDLY

SEQ ID NO: 3303814 - protein, 6 aa, Plasmodium falciparum
DEDNSV

SEQ ID NO: 3303815 - protein, 6 aa, Plasmodium falciparum
DEDNTE

SEQ ID NO: 3303816 - protein, 11 aa, Plasmodium falciparum
DEDNTQDDEEL

SEQ ID NO: 3303817 - protein, 29 aa, Plasmodium falciparum
DEDNYDNNNNKNNTETNSHTYNNNYSGNS

SEQ ID NO: 3303818 - protein, 6 aa, Plasmodium falciparum
DEDRSI

SEQ ID NO: 3303819 - protein, 8 aa, Plasmodium falciparum
DEDSKKDL

SEQ ID NO: 3303820 - protein, 8 aa, Plasmodium falciparum
DEDSNDED

SEQ ID NO: 3303821 - protein, 5 aa, Plasmodium falciparum
DEDSQ

SEQ ID NO: 3303822 - protein, 19 aa, Plasmodium falciparum
DEDSTNLDSIENNKYSNQT

SEQ ID NO: 3303823 - protein, 9 aa, Plasmodium falciparum
DEDTKKDIE

SEQ ID NO: 3303824 - protein, 5 aa, Plasmodium falciparum
DEDTT

SEQ ID NO: 3303825 - protein, 7 aa, Plasmodium falciparum
DEDWKPS

SEQ ID NO: 3303826 - protein, 6 aa, Plasmodium falciparum
DEDYSN

SEQ ID NO: 3303827 - protein, 6 aa, Plasmodium falciparum
DEDYYN

SEQ ID NO: 3303828 - protein, 5 aa, Plasmodium falciparum
DEECG

SEQ ID NO: 3303829 - protein, 5 aa, Plasmodium falciparum
DEECT

SEQ ID NO: 3303830 - protein, 7 aa, Plasmodium falciparum
DEEDAFK

SEQ ID NO: 3303831 - protein, 59 aa, Plasmodium falciparum
DEEDDEDEYDDDDEEDEEYEDDEEYEDDEEENEEYVDESDDDEDENHDDDDYHEEEQYN

SEQ ID NO: 3303832 - protein, 6 aa, Plasmodium falciparum
DEEDMS

SEQ ID NO: 3303833 - protein, 22 aa, Plasmodium falciparum
DEEDNKSDKYRNDRDVRDRRKG

SEQ ID NO: 3303834 - protein, 8 aa, Plasmodium falciparum
DEEEAEKN

SEQ ID NO: 3303835 - protein, 94 aa, Plasmodium falciparum
DEEEANKEENNKEENYKEEDNKEENYKEEDNKEEDNKEEDNKEEDNKEEVNKEEVNKEEDNKEEDNKEENYKEENYKKENYKKEDNKEEFNKEE

SEQ ID NO: 3303836 - protein, 18 aa, Plasmodium falciparum
DEEEDDRDESNESDDDVQ

SEQ ID NO: 3303837 - protein, 7 aa, Plasmodium falciparum
DEEEEDI

SEQ ID NO: 3303838 - protein, 45 aa, Plasmodium falciparum
DEEEGQEKGQEIGQEKDQEKDQKKDQNKDQKKDQNKDQKKEQARN

SEQ ID NO: 3303839 - protein, 15 aa, Plasmodium falciparum
DEEEKEEEERRRRRR

SEQ ID NO: 3303840 - protein, 8 aa, Plasmodium falciparum
DEEEKEEI

SEQ ID NO: 3303841 - protein, 18 aa, Plasmodium falciparum
DEEEKKKEERTSQYHNQN

SEQ ID NO: 3303842 - protein, 8 aa, Plasmodium falciparum
DEEEKKQY

SEQ ID NO: 3303843 - protein, 6 aa, Plasmodium falciparum
DEEENK

SEQ ID NO: 3303844 - protein, 8 aa, Plasmodium falciparum
DEEENKTD

SEQ ID NO: 3303845 - protein, 8 aa, Plasmodium falciparum
DEEENNDI

SEQ ID NO: 3303846 - protein, 39 aa, Plasmodium falciparum
DEEENVKSDEDENIKSDEEESIKSNEDESIKSDDEENIK

SEQ ID NO: 3303847 - protein, 6 aa, Plasmodium falciparum
DEEESN

SEQ ID NO: 3303848 - protein, 7 aa, Plasmodium falciparum
DEEEYDN

SEQ ID NO: 3303849 - protein, 6 aa, Plasmodium falciparum
DEEEYY

SEQ ID NO: 3303850 - protein, 4 aa, Plasmodium falciparum
DEEG

SEQ ID NO: 3303851 - protein, 10 aa, Plasmodium falciparum
DEEGEKKVNY

SEQ ID NO: 3303852 - protein, 37 aa, Plasmodium falciparum
DEEGFEQGPKSMNNTNENKSHNNNKNNNNNNYSGNKQ

SEQ ID NO: 3303853 - protein, 6 aa, Plasmodium falciparum
DEEGIP

SEQ ID NO: 3303854 - protein, 10 aa, Plasmodium falciparum
DEEGNDSKAL

SEQ ID NO: 3303855 - protein, 8 aa, Plasmodium falciparum
DEEHKNET

SEQ ID NO: 3303856 - protein, 36 aa, Plasmodium falciparum
DEEHNKKKGNSGTNTTTCTNKKSNKAAGGDDDDDND

SEQ ID NO: 3303857 - protein, 6 aa, Plasmodium falciparum
DEEIEN

SEQ ID NO: 3303858 - protein, 10 aa, Plasmodium falciparum
DEEIKSTSSY

SEQ ID NO: 3303859 - protein, 4 aa, Plasmodium falciparum
DEEK

SEQ ID NO: 3303860 - protein, 11 aa, Plasmodium falciparum
DEEKENVPQVS

SEQ ID NO: 3303861 - protein, 7 aa, Plasmodium falciparum
DEEKEQI

SEQ ID NO: 3303862 - protein, 10 aa, Plasmodium falciparum
DEEKKIKGKQ

SEQ ID NO: 3303863 - protein, 6 aa, Plasmodium falciparum
DEEKKN

SEQ ID NO: 3303864 - protein, 9 aa, Plasmodium falciparum
DEEKKYKNQ

SEQ ID NO: 3303865 - protein, 9 aa, Plasmodium falciparum
DEEKKYNNQ

SEQ ID NO: 3303866 - protein, 5 aa, Plasmodium falciparum
DEEKN

SEQ ID NO: 3303867 - protein, 7 aa, Plasmodium falciparum
DEEKNHE

SEQ ID NO: 3303868 - protein, 6 aa, Plasmodium falciparum
DEEKRK

SEQ ID NO: 3303869 - protein, 6 aa, Plasmodium falciparum
DEEKRL

SEQ ID NO: 3303870 - protein, 9 aa, Plasmodium falciparum
DEEKRNENK

SEQ ID NO: 3303871 - protein, 5 aa, Plasmodium falciparum
DEEKT

SEQ ID NO: 3303872 - protein, 4 aa, Plasmodium falciparum
DEEN

SEQ ID NO: 3303873 - protein, 17 aa, Plasmodium falciparum
DEENAKYYNSNNKQNIM

SEQ ID NO: 3303874 - protein, 11 aa, Plasmodium falciparum
DEENDDTINGN

SEQ ID NO: 3303875 - protein, 5 aa, Plasmodium falciparum
DEENI

SEQ ID NO: 3303876 - protein, 13 aa, Plasmodium falciparum
DEENIHKDKNRDE

SEQ ID NO: 3303877 - protein, 211 aa, Plasmodium falciparum
DEENKKEENKNEVNKKEENKKEENKKEENKNEVNKKEENKKEENKKEENKKEENKKEVNKNEENKNEVNKKEENKKEENKNEENKNEVNKNEVNKKEENKNEENKNEENKNEENKYEENKNEENKYEGNKNEVNKKEENKNEVNKNEVNKKEENKNEENKNEENKNEENKYEENQNEENKYEENKNEENKNEENKNQINKNETKKNEEKMN

SEQ ID NO: 3303878 - protein, 12 aa, Plasmodium falciparum
DEENKNVQDNDE

SEQ ID NO: 3303879 - protein, 20 aa, Plasmodium falciparum
DEENLKKKTKQKKKKDSLDE

SEQ ID NO: 3303880 - protein, 9 aa, Plasmodium falciparum
DEENNEDEE

SEQ ID NO: 3303881 - protein, 8 aa, Plasmodium falciparum
DEENNKKI

SEQ ID NO: 3303882 - protein, 14 aa, Plasmodium falciparum
DEENNNSDNNKNDI

SEQ ID NO: 3303883 - protein, 7 aa, Plasmodium falciparum
DEEPPLD

SEQ ID NO: 3303884 - protein, 6 aa, Plasmodium falciparum
DEEPWD

SEQ ID NO: 3303885 - protein, 10 aa, Plasmodium falciparum
DEEQEITPNS

SEQ ID NO: 3303886 - protein, 7 aa, Plasmodium falciparum
DEEQNYS

SEQ ID NO: 3303887 - protein, 9 aa, Plasmodium falciparum
DEEQQQEKK

SEQ ID NO: 3303888 - protein, 10 aa, Plasmodium falciparum
DEEQSFEKKE

SEQ ID NO: 3303889 - protein, 6 aa, Plasmodium falciparum
DEEQYE

SEQ ID NO: 3303890 - protein, 18 aa, Plasmodium falciparum
DEERSISETISSEQEQSS

SEQ ID NO: 3303891 - protein, 4 aa, Plasmodium falciparum
DEES

SEQ ID NO: 3303892 - protein, 6 aa, Plasmodium falciparum
DEESAG

SEQ ID NO: 3303893 - protein, 9 aa, Plasmodium falciparum
DEESAKEAI

SEQ ID NO: 3303894 - protein, 12 aa, Plasmodium falciparum
DEESDNQNVVLI

SEQ ID NO: 3303895 - protein, 5 aa, Plasmodium falciparum
DEESN

SEQ ID NO: 3303896 - protein, 13 aa, Plasmodium falciparum
DEESSSDDDEKNT

SEQ ID NO: 3303897 - protein, 13 aa, Plasmodium falciparum
DEESTESVSNDYG

SEQ ID NO: 3303898 - protein, 20 aa, Plasmodium falciparum
DEETEDVKAEDPSKAAGRRE

SEQ ID NO: 3303899 - protein, 7 aa, Plasmodium falciparum
DEETKNI

SEQ ID NO: 3303900 - protein, 9 aa, Plasmodium falciparum
DEEYDEEKR

SEQ ID NO: 3303901 - protein, 19 aa, Plasmodium falciparum
DEEYDPKKKKSSFSSNNIN

SEQ ID NO: 3303902 - protein, 5 aa, Plasmodium falciparum
DEEYE

SEQ ID NO: 3303903 - protein, 12 aa, Plasmodium falciparum
DEEYEQNEDVQD

SEQ ID NO: 3303904 - protein, 14 aa, Plasmodium falciparum
DEEYKKKDDKKKEI

SEQ ID NO: 3303905 - protein, 22 aa, Plasmodium falciparum
DEEYKPDNKDSNCDNSNMNESE

SEQ ID NO: 3303906 - protein, 5 aa, Plasmodium falciparum
DEEYN

SEQ ID NO: 3303907 - protein, 24 aa, Plasmodium falciparum
DEEYNKDENCSSYEEKKKQRYNTN

SEQ ID NO: 3303908 - protein, 6 aa, Plasmodium falciparum
DEFENY

SEQ ID NO: 3303909 - protein, 19 aa, Plasmodium falciparum
DEFKKKKKKKKHTHKDEKK

SEQ ID NO: 3303910 - protein, 4 aa, Plasmodium falciparum
DEFP

SEQ ID NO: 3303911 - protein, 7 aa, Plasmodium falciparum
DEFSGTK

SEQ ID NO: 3303912 - protein, 30 aa, Plasmodium falciparum
DEGENPYNRNNKNYRTDNKNSDDNNNNNNY

SEQ ID NO: 3303913 - protein, 6 aa, Plasmodium falciparum
DEGEYY

SEQ ID NO: 3303914 - protein, 4 aa, Plasmodium falciparum
DEGK

SEQ ID NO: 3303915 - protein, 19 aa, Plasmodium falciparum
DEGKANLDTYKNDKNGMSN

SEQ ID NO: 3303916 - protein, 5 aa, Plasmodium falciparum
DEGKK

SEQ ID NO: 3303917 - protein, 7 aa, Plasmodium falciparum
DEGKKNE

SEQ ID NO: 3303918 - protein, 12 aa, Plasmodium falciparum
DEGKQYLKEGSP

SEQ ID NO: 3303919 - protein, 19 aa, Plasmodium falciparum
DEGNLSDEGEEVEEENVDE

SEQ ID NO: 3303920 - protein, 14 aa, Plasmodium falciparum
DEGNWNNKYEKSKM

SEQ ID NO: 3303921 - protein, 15 aa, Plasmodium falciparum
DEGRLNEEERQAELE

SEQ ID NO: 3303922 - protein, 14 aa, Plasmodium falciparum
DEGRNKKKNSCSND

SEQ ID NO: 3303923 - protein, 5 aa, Plasmodium falciparum
DEGSL

SEQ ID NO: 3303924 - protein, 12 aa, Plasmodium falciparum
DEGYYSEGQDNQ

SEQ ID NO: 3303925 - protein, 11 aa, Plasmodium falciparum
DEHKKDDDNIR

SEQ ID NO: 3303926 - protein, 7 aa, Plasmodium falciparum
DEHKKSL

SEQ ID NO: 3303927 - protein, 15 aa, Plasmodium falciparum
DEHNMNQQKTLSEKH

SEQ ID NO: 3303928 - protein, 23 aa, Plasmodium falciparum
DEHNNDANQCNNKGEEESSNTHE

SEQ ID NO: 3303929 - protein, 7 aa, Plasmodium falciparum
DEHNSEI

SEQ ID NO: 3303930 - protein, 9 aa, Plasmodium falciparum
DEHNVDNQK

SEQ ID NO: 3303931 - protein, 7 aa, Plasmodium falciparum
DEHNYNS

SEQ ID NO: 3303932 - protein, 12 aa, Plasmodium falciparum
DEHQPAKSKQKN

SEQ ID NO: 3303933 - protein, 7 aa, Plasmodium falciparum
DEHTEKS

SEQ ID NO: 3303934 - protein, 13 aa, Plasmodium falciparum
DEIDNLKQENESY

SEQ ID NO: 3303935 - protein, 17 aa, Plasmodium falciparum
DEIEDKKKGISTDENKQ

SEQ ID NO: 3303936 - protein, 33 aa, Plasmodium falciparum
DEIEKGSDKKDKNNSNVSISEKENNEKGKKIDK

SEQ ID NO: 3303937 - protein, 20 aa, Plasmodium falciparum
DEIEKSKLDDNDVTGNYSNE

SEQ ID NO: 3303938 - protein, 5 aa, Plasmodium falciparum
DEIEN

SEQ ID NO: 3303939 - protein, 7 aa, Plasmodium falciparum
DEIGDEL

SEQ ID NO: 3303940 - protein, 7 aa, Plasmodium falciparum
DEIGENN

SEQ ID NO: 3303941 - protein, 5 aa, Plasmodium falciparum
DEIIQ

SEQ ID NO: 3303942 - protein, 11 aa, Plasmodium falciparum
DEIKEKNEYTK

SEQ ID NO: 3303943 - protein, 6 aa, Plasmodium falciparum
DEIKEQ

SEQ ID NO: 3303944 - protein, 7 aa, Plasmodium falciparum
DEIKNND

SEQ ID NO: 3303945 - protein, 13 aa, Plasmodium falciparum
DEIKRKKKKKKNI

SEQ ID NO: 3303946 - protein, 21 aa, Plasmodium falciparum
DEIKSNNNNNNDDNDDNYCQN

SEQ ID NO: 3303947 - protein, 22 aa, Plasmodium falciparum
DEINGDKKKENDNTVSSNNDSI

SEQ ID NO: 3303948 - protein, 27 aa, Plasmodium falciparum
DEINSSNEKDDEEKEDSLKKTENLNEE

SEQ ID NO: 3303949 - protein, 6 aa, Plasmodium falciparum
DEIPKL

SEQ ID NO: 3303950 - protein, 13 aa, Plasmodium falciparum
DEIQNDNGNVDYT

SEQ ID NO: 3303951 - protein, 4 aa, Plasmodium falciparum
DEIS

SEQ ID NO: 3303952 - protein, 34 aa, Plasmodium falciparum
DEISDEIKDEIKDEIKDQVENKINDDIKDEIRDE

SEQ ID NO: 3303953 - protein, 10 aa, Plasmodium falciparum
DEISKKTKRV

SEQ ID NO: 3303954 - protein, 14 aa, Plasmodium falciparum
DEISSSNNKNKDIS

SEQ ID NO: 3303955 - protein, 13 aa, Plasmodium falciparum
DEITDDSDKGDVS

SEQ ID NO: 3303956 - protein, 7 aa, Plasmodium falciparum
DEKDEDT

SEQ ID NO: 3303957 - protein, 6 aa, Plasmodium falciparum
DEKDIT

SEQ ID NO: 3303958 - protein, 8 aa, Plasmodium falciparum
DEKDKNVP

SEQ ID NO: 3303959 - protein, 29 aa, Plasmodium falciparum
DEKDNELSSYENNSNDEIKMEKKKKKKFR

SEQ ID NO: 3303960 - protein, 8 aa, Plasmodium falciparum
DEKDNVPI

SEQ ID NO: 3303961 - protein, 6 aa, Plasmodium falciparum
DEKDTN

SEQ ID NO: 3303962 - protein, 8 aa, Plasmodium falciparum
DEKEETYM

SEQ ID NO: 3303963 - protein, 7 aa, Plasmodium falciparum
DEKEKGS

SEQ ID NO: 3303964 - protein, 15 aa, Plasmodium falciparum
DEKEKKKEFQNGQSN

SEQ ID NO: 3303965 - protein, 6 aa, Plasmodium falciparum
DEKELQ

SEQ ID NO: 3303966 - protein, 13 aa, Plasmodium falciparum
DEKEMKKKSESFE

SEQ ID NO: 3303967 - protein, 8 aa, Plasmodium falciparum
DEKENIRK

SEQ ID NO: 3303968 - protein, 5 aa, Plasmodium falciparum
DEKEP

SEQ ID NO: 3303969 - protein, 21 aa, Plasmodium falciparum
DEKERKKKTIEHNDKDGHEYY

SEQ ID NO: 3303970 - protein, 14 aa, Plasmodium falciparum
DEKEVQVKKKKSRL

SEQ ID NO: 3303971 - protein, 4 aa, Plasmodium falciparum
DEKF

SEQ ID NO: 3303972 - protein, 11 aa, Plasmodium falciparum
DEKGKRDDKIG

SEQ ID NO: 3303973 - protein, 17 aa, Plasmodium falciparum
DEKGNIPNRFSGEDNNI

SEQ ID NO: 3303974 - protein, 7 aa, Plasmodium falciparum
DEKGQND

SEQ ID NO: 3303975 - protein, 21 aa, Plasmodium falciparum
DEKGYNNNDDDDNYNEEEVDE

SEQ ID NO: 3303976 - protein, 7 aa, Plasmodium falciparum
DEKHKRD

SEQ ID NO: 3303977 - protein, 10 aa, Plasmodium falciparum
DEKHKYKDKH

SEQ ID NO: 3303978 - protein, 10 aa, Plasmodium falciparum
DEKHTDKINA

SEQ ID NO: 3303979 - protein, 4 aa, Plasmodium falciparum
DEKI

SEQ ID NO: 3303980 - protein, 37 aa, Plasmodium falciparum
DEKIKKENYDKDENISDDENNDDQHNNSDKDDDQHIH

SEQ ID NO: 3303981 - protein, 4 aa, Plasmodium falciparum
DEKK

SEQ ID NO: 3303982 - protein, 26 aa, Plasmodium falciparum
DEKKDIHNNNNNNNENSYKKDSISTQ

SEQ ID NO: 3303983 - protein, 5 aa, Plasmodium falciparum
DEKKE

SEQ ID NO: 3303984 - protein, 6 aa, Plasmodium falciparum
DEKKEL

SEQ ID NO: 3303985 - protein, 7 aa, Plasmodium falciparum
DEKKEMQ

SEQ ID NO: 3303986 - protein, 8 aa, Plasmodium falciparum
DEKKESKS

SEQ ID NO: 3303987 - protein, 7 aa, Plasmodium falciparum
DEKKIKN

SEQ ID NO: 3303988 - protein, 5 aa, Plasmodium falciparum
DEKKK

SEQ ID NO: 3303989 - protein, 9 aa, Plasmodium falciparum
DEKKKENNM

SEQ ID NO: 3303990 - protein, 9 aa, Plasmodium falciparum
DEKKKGTNY

SEQ ID NO: 3303991 - protein, 6 aa, Plasmodium falciparum
DEKKKI

SEQ ID NO: 3303992 - protein, 14 aa, Plasmodium falciparum
DEKKKKDEESYNSE

SEQ ID NO: 3303993 - protein, 9 aa, Plasmodium falciparum
DEKKKLKDE

SEQ ID NO: 3303994 - protein, 11 aa, Plasmodium falciparum
DEKKKNDQNYE

SEQ ID NO: 3303995 - protein, 10 aa, Plasmodium falciparum
DEKKKNNIKT

SEQ ID NO: 3303996 - protein, 16 aa, Plasmodium falciparum
DEKKKNSPYAKSLTRP

SEQ ID NO: 3303997 - protein, 8 aa, Plasmodium falciparum
DEKKKQLQ

SEQ ID NO: 3303998 - protein, 6 aa, Plasmodium falciparum
DEKKLN

SEQ ID NO: 3303999 - protein, 7 aa, Plasmodium falciparum
DEKKLNE

SEQ ID NO: 3304000 - protein, 7 aa, Plasmodium falciparum
DEKKMNQ

SEQ ID NO: 3304001 - protein, 5 aa, Plasmodium falciparum
DEKKN

SEQ ID NO: 3304002 - protein, 11 aa, Plasmodium falciparum
DEKKNNSSNKK

SEQ ID NO: 3304003 - protein, 9 aa, Plasmodium falciparum
DEKKNYNTS

SEQ ID NO: 3304004 - protein, 5 aa, Plasmodium falciparum
DEKKQ

SEQ ID NO: 3304005 - protein, 17 aa, Plasmodium falciparum
DEKKRGKQKNKNKNKNI

SEQ ID NO: 3304006 - protein, 4 aa, Plasmodium falciparum
DEKL

SEQ ID NO: 3304007 - protein, 10 aa, Plasmodium falciparum
DEKMNHDTDG

SEQ ID NO: 3304008 - protein, 4 aa, Plasmodium falciparum
DEKN

SEQ ID NO: 3304009 - protein, 63 aa, Plasmodium falciparum
DEKNEDDKEYKIRESSQIENNNNDNNNNDDNNDNNNNDNNNDNNNNNNDNNNKKKNKNNKNKG

SEQ ID NO: 3304010 - protein, 21 aa, Plasmodium falciparum
DEKNEDTTGNKKNNNTNDSLE

SEQ ID NO: 3304011 - protein, 13 aa, Plasmodium falciparum
DEKNERQNIPTEK

SEQ ID NO: 3304012 - protein, 11 aa, Plasmodium falciparum
DEKNETNDLEN

SEQ ID NO: 3304013 - protein, 10 aa, Plasmodium falciparum
DEKNEYNDED

SEQ ID NO: 3304014 - protein, 8 aa, Plasmodium falciparum
DEKNKKNY

SEQ ID NO: 3304015 - protein, 6 aa, Plasmodium falciparum
DEKNKS

SEQ ID NO: 3304016 - protein, 7 aa, Plasmodium falciparum
DEKNNDT

SEQ ID NO: 3304017 - protein, 10 aa, Plasmodium falciparum
DEKNPPKPRY

SEQ ID NO: 3304018 - protein, 7 aa, Plasmodium falciparum
DEKNRYY

SEQ ID NO: 3304019 - protein, 15 aa, Plasmodium falciparum
DEKNTHKNCTSQKDG

SEQ ID NO: 3304020 - protein, 12 aa, Plasmodium falciparum
DEKNYSNMTNEE

SEQ ID NO: 3304021 - protein, 8 aa, Plasmodium falciparum
DEKPEAPV

SEQ ID NO: 3304022 - protein, 9 aa, Plasmodium falciparum
DEKQESLYK

SEQ ID NO: 3304023 - protein, 8 aa, Plasmodium falciparum
DEKQKKSY

SEQ ID NO: 3304024 - protein, 11 aa, Plasmodium falciparum
DEKQQKLDEKD

SEQ ID NO: 3304025 - protein, 13 aa, Plasmodium falciparum
DEKRDDKKYDRMN

SEQ ID NO: 3304026 - protein, 15 aa, Plasmodium falciparum
DEKRGSFSKSQDGIE

SEQ ID NO: 3304027 - protein, 9 aa, Plasmodium falciparum
DEKSDDDHH

SEQ ID NO: 3304028 - protein, 6 aa, Plasmodium falciparum
DEKSDI

SEQ ID NO: 3304029 - protein, 8 aa, Plasmodium falciparum
DEKSEAKV

SEQ ID NO: 3304030 - protein, 10 aa, Plasmodium falciparum
DEKSKSQEQN

SEQ ID NO: 3304031 - protein, 6 aa, Plasmodium falciparum
DEKSQH

SEQ ID NO: 3304032 - protein, 4 aa, Plasmodium falciparum
DEKT

SEQ ID NO: 3304033 - protein, 11 aa, Plasmodium falciparum
DEKTNDNMEDN

SEQ ID NO: 3304034 - protein, 13 aa, Plasmodium falciparum
DEKTQNNKNFKND

SEQ ID NO: 3304035 - protein, 11 aa, Plasmodium falciparum
DEKTYSNNSGL

SEQ ID NO: 3304036 - protein, 4 aa, Plasmodium falciparum
DEKV

SEQ ID NO: 3304037 - protein, 9 aa, Plasmodium falciparum
DEKVENDED

SEQ ID NO: 3304038 - protein, 8 aa, Plasmodium falciparum
DEKYDKKN

SEQ ID NO: 3304039 - protein, 46 aa, Plasmodium falciparum
DEKYEDKHSEQNDEHDGEHDDEHDDEHDGEHHDKYEDEYDDEYDDE

SEQ ID NO: 3304040 - protein, 15 aa, Plasmodium falciparum
DEKYKSSNKLEDTKN

SEQ ID NO: 3304041 - protein, 15 aa, Plasmodium falciparum
DEKYNNKDKENNINE

SEQ ID NO: 3304042 - protein, 6 aa, Plasmodium falciparum
DEKYWN

SEQ ID NO: 3304043 - protein, 6 aa, Plasmodium falciparum
DELDRK

SEQ ID NO: 3304044 - protein, 6 aa, Plasmodium falciparum
DELEED

SEQ ID NO: 3304045 - protein, 14 aa, Plasmodium falciparum
DELEKRKEKISEQK

SEQ ID NO: 3304046 - protein, 4 aa, Plasmodium falciparum
DELG

SEQ ID NO: 3304047 - protein, 13 aa, Plasmodium falciparum
DELGDNIEHNNNT

SEQ ID NO: 3304048 - protein, 19 aa, Plasmodium falciparum
DELKRKQSQITKENQKYDA

SEQ ID NO: 3304049 - protein, 7 aa, Plasmodium falciparum
DELKTEP

SEQ ID NO: 3304050 - protein, 18 aa, Plasmodium falciparum
DELNNNNNNNNDNNNDNY

SEQ ID NO: 3304051 - protein, 5 aa, Plasmodium falciparum
DELPR

SEQ ID NO: 3304052 - protein, 18 aa, Plasmodium falciparum
DELQKKDKDQHQRDTSKN

SEQ ID NO: 3304053 - protein, 8 aa, Plasmodium falciparum
DELRGSGK

SEQ ID NO: 3304054 - protein, 18 aa, Plasmodium falciparum
DELSTSAPQMAQKVEIFD

SEQ ID NO: 3304055 - protein, 17 aa, Plasmodium falciparum
DELYDERDDEGINKEPI

SEQ ID NO: 3304056 - protein, 9 aa, Plasmodium falciparum
DEMEKSQGT

SEQ ID NO: 3304057 - protein, 7 aa, Plasmodium falciparum
DEMERKK

SEQ ID NO: 3304058 - protein, 15 aa, Plasmodium falciparum
DEMKEEKEERNEDRG

SEQ ID NO: 3304059 - protein, 9 aa, Plasmodium falciparum
DEMKENKNV

SEQ ID NO: 3304060 - protein, 6 aa, Plasmodium falciparum
DENAKK

SEQ ID NO: 3304061 - protein, 12 aa, Plasmodium falciparum
DENASDGNNVEN

SEQ ID NO: 3304062 - protein, 4 aa, Plasmodium falciparum
DENC

SEQ ID NO: 3304063 - protein, 5 aa, Plasmodium falciparum
DENDD

SEQ ID NO: 3304064 - protein, 5 aa, Plasmodium falciparum
DENDE

SEQ ID NO: 3304065 - protein, 10 aa, Plasmodium falciparum
DENDGSSNIR

SEQ ID NO: 3304066 - protein, 13 aa, Plasmodium falciparum
DENDTISEKSYNN

SEQ ID NO: 3304067 - protein, 5 aa, Plasmodium falciparum
DENEE

SEQ ID NO: 3304068 - protein, 10 aa, Plasmodium falciparum
DENEETDEEE

SEQ ID NO: 3304069 - protein, 7 aa, Plasmodium falciparum
DENEKHE

SEQ ID NO: 3304070 - protein, 14 aa, Plasmodium falciparum
DENEKKKIKDNYQY

SEQ ID NO: 3304071 - protein, 11 aa, Plasmodium falciparum
DENENDTEYNE

SEQ ID NO: 3304072 - protein, 5 aa, Plasmodium falciparum
DENES

SEQ ID NO: 3304073 - protein, 5 aa, Plasmodium falciparum
DENET

SEQ ID NO: 3304074 - protein, 9 aa, Plasmodium falciparum
DENETNTQM

SEQ ID NO: 3304075 - protein, 5 aa, Plasmodium falciparum
DENEV

SEQ ID NO: 3304076 - protein, 5 aa, Plasmodium falciparum
DENFG

SEQ ID NO: 3304077 - protein, 12 aa, Plasmodium falciparum
DENGEKKTTTNY

SEQ ID NO: 3304078 - protein, 36 aa, Plasmodium falciparum
DENIDKKDYKSKYNEKKRSKTNKEKHDSDDSDKENE

SEQ ID NO: 3304079 - protein, 5 aa, Plasmodium falciparum
DENIK

SEQ ID NO: 3304080 - protein, 17 aa, Plasmodium falciparum
DENIKRQEQRKEEHIES

SEQ ID NO: 3304081 - protein, 5 aa, Plasmodium falciparum
DENIL

SEQ ID NO: 3304082 - protein, 6 aa, Plasmodium falciparum
DENIQN

SEQ ID NO: 3304083 - protein, 4 aa, Plasmodium falciparum
DENK

SEQ ID NO: 3304084 - protein, 5 aa, Plasmodium falciparum
DENKA

SEQ ID NO: 3304085 - protein, 7 aa, Plasmodium falciparum
DENKEKL

SEQ ID NO: 3304086 - protein, 9 aa, Plasmodium falciparum
DENKHQKEI

SEQ ID NO: 3304087 - protein, 7 aa, Plasmodium falciparum
DENKIDD

SEQ ID NO: 3304088 - protein, 5 aa, Plasmodium falciparum
DENKK

SEQ ID NO: 3304089 - protein, 9 aa, Plasmodium falciparum
DENKKKQHS

SEQ ID NO: 3304090 - protein, 18 aa, Plasmodium falciparum
DENKKKREEDDEEKEKLK

SEQ ID NO: 3304091 - protein, 13 aa, Plasmodium falciparum
DENKKSSNDYEKQ

SEQ ID NO: 3304092 - protein, 5 aa, Plasmodium falciparum
DENKM

SEQ ID NO: 3304093 - protein, 8 aa, Plasmodium falciparum
DENKMHPD

SEQ ID NO: 3304094 - protein, 9 aa, Plasmodium falciparum
DENKNQKTN

SEQ ID NO: 3304095 - protein, 9 aa, Plasmodium falciparum
DENKSTNFV

SEQ ID NO: 3304096 - protein, 29 aa, Plasmodium falciparum
DENMDENMGENMDENMGENMDENMGENMD

SEQ ID NO: 3304097 - protein, 8 aa, Plasmodium falciparum
DENNASTY

SEQ ID NO: 3304098 - protein, 5 aa, Plasmodium falciparum
DENND

SEQ ID NO: 3304099 - protein, 5 aa, Plasmodium falciparum
DENNE

SEQ ID NO: 3304100 - protein, 40 aa, Plasmodium falciparum
DENNEFSSNNVDNKSTNKNSRKKKPKIADSTNDNNSELNS

SEQ ID NO: 3304101 - protein, 15 aa, Plasmodium falciparum
DENNENEKDKKKSKW

SEQ ID NO: 3304102 - protein, 11 aa, Plasmodium falciparum
DENNEVEERKT

SEQ ID NO: 3304103 - protein, 14 aa, Plasmodium falciparum
DENNGENKVPKKKN

SEQ ID NO: 3304104 - protein, 6 aa, Plasmodium falciparum
DENNKG

SEQ ID NO: 3304105 - protein, 8 aa, Plasmodium falciparum
DENNKNAK

SEQ ID NO: 3304106 - protein, 6 aa, Plasmodium falciparum
DENNLN

SEQ ID NO: 3304107 - protein, 6 aa, Plasmodium falciparum
DENNLS

SEQ ID NO: 3304108 - protein, 6 aa, Plasmodium falciparum
DENNLT

SEQ ID NO: 3304109 - protein, 7 aa, Plasmodium falciparum
DENNMNA

SEQ ID NO: 3304110 - protein, 6 aa, Plasmodium falciparum
DENNNE

SEQ ID NO: 3304111 - protein, 8 aa, Plasmodium falciparum
DENNNISN

SEQ ID NO: 3304112 - protein, 6 aa, Plasmodium falciparum
DENNNN

SEQ ID NO: 3304113 - protein, 22 aa, Plasmodium falciparum
DENNNNNNNNNNNNNNNNNKNN

SEQ ID NO: 3304114 - protein, 19 aa, Plasmodium falciparum
DENNNNNNNNNNNNNTYLN

SEQ ID NO: 3304115 - protein, 6 aa, Plasmodium falciparum
DENNSN

SEQ ID NO: 3304116 - protein, 6 aa, Plasmodium falciparum
DENNSS

SEQ ID NO: 3304117 - protein, 9 aa, Plasmodium falciparum
DENNSVRNH

SEQ ID NO: 3304118 - protein, 6 aa, Plasmodium falciparum
DENNTM

SEQ ID NO: 3304119 - protein, 8 aa, Plasmodium falciparum
DENNVKDL

SEQ ID NO: 3304120 - protein, 7 aa, Plasmodium falciparum
DENPSVD

SEQ ID NO: 3304121 - protein, 6 aa, Plasmodium falciparum
DENQTI

SEQ ID NO: 3304122 - protein, 83 aa, Plasmodium falciparum
DENREDHINDPKCRDNKNKKNNDDDDDDNDESESIHGDNNNNNKKNKNDDDDDDDNDESESIRSDYNNESESIHSDYNNDSDS

SEQ ID NO: 3304123 - protein, 14 aa, Plasmodium falciparum
DENREEKKDNKERE

SEQ ID NO: 3304124 - protein, 12 aa, Plasmodium falciparum
DENRENQEYEEF

SEQ ID NO: 3304125 - protein, 9 aa, Plasmodium falciparum
DENRKQTYD

SEQ ID NO: 3304126 - protein, 29 aa, Plasmodium falciparum
DENRRKSMPNIGRGRRGTYTKRNTKPSVS

SEQ ID NO: 3304127 - protein, 8 aa, Plasmodium falciparum
DENSHKRK

SEQ ID NO: 3304128 - protein, 9 aa, Plasmodium falciparum
DENSYEYTK

SEQ ID NO: 3304129 - protein, 9 aa, Plasmodium falciparum
DENTEKENY

SEQ ID NO: 3304130 - protein, 34 aa, Plasmodium falciparum
DENTETEEKDTSGVHNEDGDTSMGVTNQKGKDKF

SEQ ID NO: 3304131 - protein, 8 aa, Plasmodium falciparum
DENTGSDQ

SEQ ID NO: 3304132 - protein, 11 aa, Plasmodium falciparum
DENTHYEHTDK

SEQ ID NO: 3304133 - protein, 7 aa, Plasmodium falciparum
DENTKEI

SEQ ID NO: 3304134 - protein, 8 aa, Plasmodium falciparum
DENTTEVE

SEQ ID NO: 3304135 - protein, 8 aa, Plasmodium falciparum
DENVDESG

SEQ ID NO: 3304136 - protein, 6 aa, Plasmodium falciparum
DENVKD

SEQ ID NO: 3304137 - protein, 7 aa, Plasmodium falciparum
DENVKNS

SEQ ID NO: 3304138 - protein, 7 aa, Plasmodium falciparum
DENVNEV

SEQ ID NO: 3304139 - protein, 13 aa, Plasmodium falciparum
DENVQYPSGNTEP

SEQ ID NO: 3304140 - protein, 31 aa, Plasmodium falciparum
DENVSIKKGKDNIKKYSKEGNDEEKSEEDDK

SEQ ID NO: 3304141 - protein, 8 aa, Plasmodium falciparum
DENVTQPK

SEQ ID NO: 3304142 - protein, 4 aa, Plasmodium falciparum
DENY

SEQ ID NO: 3304143 - protein, 43 aa, Plasmodium falciparum
DENYAEGELEEKSEEDEVGDNNMNGNNIDDDNINDDDNYNYHD

SEQ ID NO: 3304144 - protein, 5 aa, Plasmodium falciparum
DENYY

SEQ ID NO: 3304145 - protein, 4 aa, Plasmodium falciparum
DEPA

SEQ ID NO: 3304146 - protein, 15 aa, Plasmodium falciparum
DEPDYKSLKSKLSQT

SEQ ID NO: 3304147 - protein, 7 aa, Plasmodium falciparum
DEPHHNN

SEQ ID NO: 3304148 - protein, 10 aa, Plasmodium falciparum
DEPKDEIKKE

SEQ ID NO: 3304149 - protein, 8 aa, Plasmodium falciparum
DEPLKDNY

SEQ ID NO: 3304150 - protein, 18 aa, Plasmodium falciparum
DEPLSINSKKYPTPFRGL

SEQ ID NO: 3304151 - protein, 7 aa, Plasmodium falciparum
DEPNHSN

SEQ ID NO: 3304152 - protein, 27 aa, Plasmodium falciparum
DEPNKNKKYDTDINQNDQNDNDTHTDD

SEQ ID NO: 3304153 - protein, 6 aa, Plasmodium falciparum
DEPNKV

SEQ ID NO: 3304154 - protein, 13 aa, Plasmodium falciparum
DEPWGHPNKQSNF

SEQ ID NO: 3304155 - protein, 4 aa, Plasmodium falciparum
DEPY

SEQ ID NO: 3304156 - protein, 8 aa, Plasmodium falciparum
DEQDEHNK

SEQ ID NO: 3304157 - protein, 5 aa, Plasmodium falciparum
DEQDN

SEQ ID NO: 3304158 - protein, 9 aa, Plasmodium falciparum
DEQDPLSTF

SEQ ID NO: 3304159 - protein, 6 aa, Plasmodium falciparum
DEQEDY

SEQ ID NO: 3304160 - protein, 8 aa, Plasmodium falciparum
DEQEKEKI

SEQ ID NO: 3304161 - protein, 6 aa, Plasmodium falciparum
DEQELK

SEQ ID NO: 3304162 - protein, 4 aa, Plasmodium falciparum
DEQI

SEQ ID NO: 3304163 - protein, 5 aa, Plasmodium falciparum
DEQIN

SEQ ID NO: 3304164 - protein, 9 aa, Plasmodium falciparum
DEQKDQSNK

SEQ ID NO: 3304165 - protein, 7 aa, Plasmodium falciparum
DEQKRGN

SEQ ID NO: 3304166 - protein, 19 aa, Plasmodium falciparum
DEQNENVQKNKKKNKNNKI

SEQ ID NO: 3304167 - protein, 6 aa, Plasmodium falciparum
DEQNIN

SEQ ID NO: 3304168 - protein, 49 aa, Plasmodium falciparum
DEQNKPNPNNNNNNKDNDNDNNNNNNNNNNNNNNNNNNNNNNNNNNIGM

SEQ ID NO: 3304169 - protein, 16 aa, Plasmodium falciparum
DEQNNDHIPTKDKINN

SEQ ID NO: 3304170 - protein, 9 aa, Plasmodium falciparum
DEQNNLQTD

SEQ ID NO: 3304171 - protein, 6 aa, Plasmodium falciparum
DEQQLK

SEQ ID NO: 3304172 - protein, 6 aa, Plasmodium falciparum
DEQSPD

SEQ ID NO: 3304173 - protein, 8 aa, Plasmodium falciparum
DEQTKEKQ

SEQ ID NO: 3304174 - protein, 4 aa, Plasmodium falciparum
DEQY

SEQ ID NO: 3304175 - protein, 9 aa, Plasmodium falciparum
DERDEHENK

SEQ ID NO: 3304176 - protein, 21 aa, Plasmodium falciparum
DERDKIQNTSLPDEGNKNNSY

SEQ ID NO: 3304177 - protein, 10 aa, Plasmodium falciparum
DEREKKINHN

SEQ ID NO: 3304178 - protein, 6 aa, Plasmodium falciparum
DEREYK

SEQ ID NO: 3304179 - protein, 7 aa, Plasmodium falciparum
DERHNYE

SEQ ID NO: 3304180 - protein, 6 aa, Plasmodium falciparum
DERIDN

SEQ ID NO: 3304181 - protein, 6 aa, Plasmodium falciparum
DERKYP

SEQ ID NO: 3304182 - protein, 8 aa, Plasmodium falciparum
DERRNAGE

SEQ ID NO: 3304183 - protein, 14 aa, Plasmodium falciparum
DERRREKKKDNDKL

SEQ ID NO: 3304184 - protein, 9 aa, Plasmodium falciparum
DERSKIGST

SEQ ID NO: 3304185 - protein, 7 aa, Plasmodium falciparum
DERSKKK

SEQ ID NO: 3304186 - protein, 12 aa, Plasmodium falciparum
DERVKSGRDKFC

SEQ ID NO: 3304187 - protein, 21 aa, Plasmodium falciparum
DESDEEAQEEMNNARRLDIED

SEQ ID NO: 3304188 - protein, 15 aa, Plasmodium falciparum
DESDENKSDQDNHSI

SEQ ID NO: 3304189 - protein, 23 aa, Plasmodium falciparum
DESDLEEGYEQKNKTYNNDSEKI

SEQ ID NO: 3304190 - protein, 10 aa, Plasmodium falciparum
DESEKNVEEH

SEQ ID NO: 3304191 - protein, 5 aa, Plasmodium falciparum
DESER

SEQ ID NO: 3304192 - protein, 6 aa, Plasmodium falciparum
DESFDE

SEQ ID NO: 3304193 - protein, 6 aa, Plasmodium falciparum
DESGEH

SEQ ID NO: 3304194 - protein, 12 aa, Plasmodium falciparum
DESLKAEKQSVE

SEQ ID NO: 3304195 - protein, 17 aa, Plasmodium falciparum
DESLSKVKKENQDDDDI

SEQ ID NO: 3304196 - protein, 7 aa, Plasmodium falciparum
DESNNLN

SEQ ID NO: 3304197 - protein, 7 aa, Plasmodium falciparum
DESQNIP

SEQ ID NO: 3304198 - protein, 5 aa, Plasmodium falciparum
DESSK

SEQ ID NO: 3304199 - protein, 14 aa, Plasmodium falciparum
DESSNTNDSNIPHN

SEQ ID NO: 3304200 - protein, 9 aa, Plasmodium falciparum
DESSPDNFY

SEQ ID NO: 3304201 - protein, 8 aa, Plasmodium falciparum
DESSPVPS

SEQ ID NO: 3304202 - protein, 8 aa, Plasmodium falciparum
DESTKKEL

SEQ ID NO: 3304203 - protein, 7 aa, Plasmodium falciparum
DESTQTI

SEQ ID NO: 3304204 - protein, 7 aa, Plasmodium falciparum
DESTSIP

SEQ ID NO: 3304205 - protein, 9 aa, Plasmodium falciparum
DESTSLPLE

SEQ ID NO: 3304206 - protein, 6 aa, Plasmodium falciparum
DESTYL

SEQ ID NO: 3304207 - protein, 7 aa, Plasmodium falciparum
DESVKNE

SEQ ID NO: 3304208 - protein, 7 aa, Plasmodium falciparum
DESVNSA

SEQ ID NO: 3304209 - protein, 6 aa, Plasmodium falciparum
DETEAP

SEQ ID NO: 3304210 - protein, 23 aa, Plasmodium falciparum
DETEESVTIGDPKEGHISQEDRM

SEQ ID NO: 3304211 - protein, 5 aa, Plasmodium falciparum
DETEN

SEQ ID NO: 3304212 - protein, 12 aa, Plasmodium falciparum
DETFGKKEKNLN

SEQ ID NO: 3304213 - protein, 5 aa, Plasmodium falciparum
DETFK

SEQ ID NO: 3304214 - protein, 6 aa, Plasmodium falciparum
DETFNS

SEQ ID NO: 3304215 - protein, 5 aa, Plasmodium falciparum
DETHE

SEQ ID NO: 3304216 - protein, 7 aa, Plasmodium falciparum
DETIESK

SEQ ID NO: 3304217 - protein, 12 aa, Plasmodium falciparum
DETISEKDYVTD

SEQ ID NO: 3304218 - protein, 8 aa, Plasmodium falciparum
DETKYDTK

SEQ ID NO: 3304219 - protein, 4 aa, Plasmodium falciparum
DETN

SEQ ID NO: 3304220 - protein, 17 aa, Plasmodium falciparum
DETSRGEGGFGSTSNNK

SEQ ID NO: 3304221 - protein, 4 aa, Plasmodium falciparum
DETT

SEQ ID NO: 3304222 - protein, 5 aa, Plasmodium falciparum
DETTR

SEQ ID NO: 3304223 - protein, 8 aa, Plasmodium falciparum
DETTYDEE

SEQ ID NO: 3304224 - protein, 6 aa, Plasmodium falciparum
DETVSK

SEQ ID NO: 3304225 - protein, 6 aa, Plasmodium falciparum
DETVVN

SEQ ID NO: 3304226 - protein, 4 aa, Plasmodium falciparum
DEVD

SEQ ID NO: 3304227 - protein, 6 aa, Plasmodium falciparum
DEVEEE

SEQ ID NO: 3304228 - protein, 56 aa, Plasmodium falciparum
DEVHDNNISSDDNNNIPSDDNNNIPSGDNNNIPSGDNNSNNNNNNNANNDYKPRLD

SEQ ID NO: 3304229 - protein, 22 aa, Plasmodium falciparum
DEVKDQDIKTYEDTNKNNDKVN

SEQ ID NO: 3304230 - protein, 7 aa, Plasmodium falciparum
DEVPAKS

SEQ ID NO: 3304231 - protein, 9 aa, Plasmodium falciparum
DEVSDDTRK

SEQ ID NO: 3304232 - protein, 8 aa, Plasmodium falciparum
DEVSKNEK

SEQ ID NO: 3304233 - protein, 5 aa, Plasmodium falciparum
DEVSR

SEQ ID NO: 3304234 - protein, 4 aa, Plasmodium falciparum
DEWP

SEQ ID NO: 3304235 - protein, 13 aa, Plasmodium falciparum
DEYDDKDNDEEKK

SEQ ID NO: 3304236 - protein, 16 aa, Plasmodium falciparum
DEYDEKCDKEVDECNK

SEQ ID NO: 3304237 - protein, 15 aa, Plasmodium falciparum
DEYDEQKNEDNKNHI

SEQ ID NO: 3304238 - protein, 18 aa, Plasmodium falciparum
DEYDNENDDKNVDSANNS

SEQ ID NO: 3304239 - protein, 8 aa, Plasmodium falciparum
DEYDQEEK

SEQ ID NO: 3304240 - protein, 6 aa, Plasmodium falciparum
DEYEKL

SEQ ID NO: 3304241 - protein, 6 aa, Plasmodium falciparum
DEYINK

SEQ ID NO: 3304242 - protein, 10 aa, Plasmodium falciparum
DEYKKNNKIS

SEQ ID NO: 3304243 - protein, 15 aa, Plasmodium falciparum
DEYNEYGKYGQNDGI

SEQ ID NO: 3304244 - protein, 5 aa, Plasmodium falciparum
DEYNH

SEQ ID NO: 3304245 - protein, 11 aa, Plasmodium falciparum
DEYNKTYDQTN

SEQ ID NO: 3304246 - protein, 6 aa, Plasmodium falciparum
DEYNNQ

SEQ ID NO: 3304247 - protein, 13 aa, Plasmodium falciparum
DEYNSNHKSKGKN

SEQ ID NO: 3304248 - protein, 4 aa, Plasmodium falciparum
DEYP

SEQ ID NO: 3304249 - protein, 9 aa, Plasmodium falciparum
DEYPDYTDQ

SEQ ID NO: 3304250 - protein, 32 aa, Plasmodium falciparum
DEYQDEYQDGYQDEEKKKEIDKYKKKKGNNTY

SEQ ID NO: 3304251 - protein, 8 aa, Plasmodium falciparum
DEYQQYKK

SEQ ID NO: 3304252 - protein, 93 aa, Plasmodium falciparum
DEYRRNNDANISDYNKKNNNNNVNKSNNVVRSSDESLSSDTINKSDCKNKVEENSSRNADESHKKEDGDLINKDKDEKEGENLSVPKESNETY

SEQ ID NO: 3304253 - protein, 48 aa, Plasmodium falciparum
DEYYEENEQDNDDDDDDDEDDGEDDDDDEDDDDEDDDHHHDDNNDDNK

SEQ ID NO: 3304254 - protein, 10 aa, Plasmodium falciparum
DFDKCQSSNN

SEQ ID NO: 3304255 - protein, 5 aa, Plasmodium falciparum
DFDSN

SEQ ID NO: 3304256 - protein, 5 aa, Plasmodium falciparum
DFDTY

SEQ ID NO: 3304257 - protein, 7 aa, Plasmodium falciparum
DFEDKSP

SEQ ID NO: 3304258 - protein, 11 aa, Plasmodium falciparum
DFEKKKKKKIL

SEQ ID NO: 3304259 - protein, 12 aa, Plasmodium falciparum
DFEKKKKKSLEN

SEQ ID NO: 3304260 - protein, 17 aa, Plasmodium falciparum
DFENANLENKSNSSISN

SEQ ID NO: 3304261 - protein, 19 aa, Plasmodium falciparum
DFENNDIKRKEKVESNEED

SEQ ID NO: 3304262 - protein, 40 aa, Plasmodium falciparum
DFENSQNDYDCTEETDIRKNKYKNKEEEEEEEEKKKKKKK

SEQ ID NO: 3304263 - protein, 19 aa, Plasmodium falciparum
DFESDTSTDSDDSKGDFKN

SEQ ID NO: 3304264 - protein, 14 aa, Plasmodium falciparum
DFETSKNEPNNKDE

SEQ ID NO: 3304265 - protein, 5 aa, Plasmodium falciparum
DFEYT

SEQ ID NO: 3304266 - protein, 4 aa, Plasmodium falciparum
DFID

SEQ ID NO: 3304267 - protein, 8 aa, Plasmodium falciparum
DFKENKKN

SEQ ID NO: 3304268 - protein, 10 aa, Plasmodium falciparum
DFKKQEDNKD

SEQ ID NO: 3304269 - protein, 17 aa, Plasmodium falciparum
DFNKKSNQGTKNALDEE

SEQ ID NO: 3304270 - protein, 7 aa, Plasmodium falciparum
DFNNKNG

SEQ ID NO: 3304271 - protein, 25 aa, Plasmodium falciparum
DFNQNRNRNNYPQYDKNSNDNDRNY

SEQ ID NO: 3304272 - protein, 12 aa, Plasmodium falciparum
DFNSDVGREDEI

SEQ ID NO: 3304273 - protein, 16 aa, Plasmodium falciparum
DFNSSDKLNDQNHYSN

SEQ ID NO: 3304274 - protein, 10 aa, Plasmodium falciparum
DFPDTSGGIS

SEQ ID NO: 3304275 - protein, 20 aa, Plasmodium falciparum
DFPEDNKKKQTQDSIQPKKG

SEQ ID NO: 3304276 - protein, 5 aa, Plasmodium falciparum
DFPEK

SEQ ID NO: 3304277 - protein, 12 aa, Plasmodium falciparum
DFPNAKKEYDEA

SEQ ID NO: 3304278 - protein, 11 aa, Plasmodium falciparum
DFPSDKTNTDF

SEQ ID NO: 3304279 - protein, 13 aa, Plasmodium falciparum
DFSDDQNLKKKET

SEQ ID NO: 3304280 - protein, 21 aa, Plasmodium falciparum
DFSEGEKKTEALTKKSKNINV

SEQ ID NO: 3304281 - protein, 5 aa, Plasmodium falciparum
DFSKY

SEQ ID NO: 3304282 - protein, 31 aa, Plasmodium falciparum
DFSTPDKSIQKQKKIKAATTKNKASHLEFSH

SEQ ID NO: 3304283 - protein, 7 aa, Plasmodium falciparum
DFTGEDS

SEQ ID NO: 3304284 - protein, 4 aa, Plasmodium falciparum
DFYS

SEQ ID NO: 3304285 - protein, 4 aa, Plasmodium falciparum
DFYT

SEQ ID NO: 3304286 - protein, 9 aa, Plasmodium falciparum
DGASNKSYG

SEQ ID NO: 3304287 - protein, 8 aa, Plasmodium falciparum
DGATYEGE

SEQ ID NO: 3304288 - protein, 6 aa, Plasmodium falciparum
DGCEAN

SEQ ID NO: 3304289 - protein, 36 aa, Plasmodium falciparum
DGCIKNDDGYIKNDDGYIKNDDGYIKNDDDYNNNGE

SEQ ID NO: 3304290 - protein, 4 aa, Plasmodium falciparum
DGDA

SEQ ID NO: 3304291 - protein, 8 aa, Plasmodium falciparum
DGDAPTED

SEQ ID NO: 3304292 - protein, 4 aa, Plasmodium falciparum
DGDD

SEQ ID NO: 3304293 - protein, 27 aa, Plasmodium falciparum
DGDDDDDDDNEHDEEDYDDEKEEGEYE

SEQ ID NO: 3304294 - protein, 14 aa, Plasmodium falciparum
DGDESEDDEGHDNK

SEQ ID NO: 3304295 - protein, 9 aa, Plasmodium falciparum
DGDGTITTK

SEQ ID NO: 3304296 - protein, 7 aa, Plasmodium falciparum
DGDGYIS

SEQ ID NO: 3304297 - protein, 4 aa, Plasmodium falciparum
DGDH

SEQ ID NO: 3304298 - protein, 12 aa, Plasmodium falciparum
DGDINSKKNTHD

SEQ ID NO: 3304299 - protein, 13 aa, Plasmodium falciparum
DGDIQSDAVAQGY

SEQ ID NO: 3304300 - protein, 24 aa, Plasmodium falciparum
DGDLDSCSSSSSEDEHSDESDVSE

SEQ ID NO: 3304301 - protein, 10 aa, Plasmodium falciparum
DGDNNKNEVN

SEQ ID NO: 3304302 - protein, 9 aa, Plasmodium falciparum
DGDNNVNNV

SEQ ID NO: 3304303 - protein, 20 aa, Plasmodium falciparum
DGDNSGNLSEYEKKNDEKIN

SEQ ID NO: 3304304 - protein, 6 aa, Plasmodium falciparum
DGDPIE

SEQ ID NO: 3304305 - protein, 14 aa, Plasmodium falciparum
DGDQCYDNNGCTTN

SEQ ID NO: 3304306 - protein, 11 aa, Plasmodium falciparum
DGEDDGEDDGF

SEQ ID NO: 3304307 - protein, 5 aa, Plasmodium falciparum
DGEDK

SEQ ID NO: 3304308 - protein, 6 aa, Plasmodium falciparum
DGEDPY

SEQ ID NO: 3304309 - protein, 5 aa, Plasmodium falciparum
DGEGI

SEQ ID NO: 3304310 - protein, 10 aa, Plasmodium falciparum
DGEKDPSYYN

SEQ ID NO: 3304311 - protein, 6 aa, Plasmodium falciparum
DGEKSN

SEQ ID NO: 3304312 - protein, 5 aa, Plasmodium falciparum
DGETE

SEQ ID NO: 3304313 - protein, 12 aa, Plasmodium falciparum
DGETKDAKNYYD

SEQ ID NO: 3304314 - protein, 8 aa, Plasmodium falciparum
DGETLTDG

SEQ ID NO: 3304315 - protein, 12 aa, Plasmodium falciparum
DGFPKKTMNPPK

SEQ ID NO: 3304316 - protein, 4 aa, Plasmodium falciparum
DGFT

SEQ ID NO: 3304317 - protein, 5 aa, Plasmodium falciparum
DGGDA

SEQ ID NO: 3304318 - protein, 6 aa, Plasmodium falciparum
DGGFGN

SEQ ID NO: 3304319 - protein, 7 aa, Plasmodium falciparum
DGGLSHE

SEQ ID NO: 3304320 - protein, 5 aa, Plasmodium falciparum
DGGRH

SEQ ID NO: 3304321 - protein, 6 aa, Plasmodium falciparum
DGHKNS

SEQ ID NO: 3304322 - protein, 21 aa, Plasmodium falciparum
DGHKYNDNNNKNDNYDNNYDN

SEQ ID NO: 3304323 - protein, 5 aa, Plasmodium falciparum
DGHNN

SEQ ID NO: 3304324 - protein, 6 aa, Plasmodium falciparum
DGIDPS

SEQ ID NO: 3304325 - protein, 9 aa, Plasmodium falciparum
DGIDPSKTA

SEQ ID NO: 3304326 - protein, 6 aa, Plasmodium falciparum
DGIGEY

SEQ ID NO: 3304327 - protein, 19 aa, Plasmodium falciparum
DGIIKNDSKECKDSHHESQ

SEQ ID NO: 3304328 - protein, 34 aa, Plasmodium falciparum
DGISSDDDDYNTSDEDDENSSEEDENTSEDEEEE

SEQ ID NO: 3304329 - protein, 5 aa, Plasmodium falciparum
DGIYK

SEQ ID NO: 3304330 - protein, 9 aa, Plasmodium falciparum
DGKEAGQTV

SEQ ID NO: 3304331 - protein, 10 aa, Plasmodium falciparum
DGKENEKEYN

SEQ ID NO: 3304332 - protein, 5 aa, Plasmodium falciparum
DGKEY

SEQ ID NO: 3304333 - protein, 10 aa, Plasmodium falciparum
DGKGNRNEIQ

SEQ ID NO: 3304334 - protein, 8 aa, Plasmodium falciparum
DGKGYITK

SEQ ID NO: 3304335 - protein, 5 aa, Plasmodium falciparum
DGKHF

SEQ ID NO: 3304336 - protein, 7 aa, Plasmodium falciparum
DGKKIEN

SEQ ID NO: 3304337 - protein, 14 aa, Plasmodium falciparum
DGKKNNLNSNTSDF

SEQ ID NO: 3304338 - protein, 8 aa, Plasmodium falciparum
DGKKPTTI

SEQ ID NO: 3304339 - protein, 8 aa, Plasmodium falciparum
DGKLDDDI

SEQ ID NO: 3304340 - protein, 10 aa, Plasmodium falciparum
DGKMDNNNNN

SEQ ID NO: 3304341 - protein, 11 aa, Plasmodium falciparum
DGKNKTANDTL

SEQ ID NO: 3304342 - protein, 8 aa, Plasmodium falciparum
DGKNKYNN

SEQ ID NO: 3304343 - protein, 6 aa, Plasmodium falciparum
DGKNNR

SEQ ID NO: 3304344 - protein, 12 aa, Plasmodium falciparum
DGKPKSKENPQQ

SEQ ID NO: 3304345 - protein, 8 aa, Plasmodium falciparum
DGKPVSQE

SEQ ID NO: 3304346 - protein, 4 aa, Plasmodium falciparum
DGKR

SEQ ID NO: 3304347 - protein, 12 aa, Plasmodium falciparum
DGKSASQLSKKG

SEQ ID NO: 3304348 - protein, 8 aa, Plasmodium falciparum
DGKSTDEM

SEQ ID NO: 3304349 - protein, 32 aa, Plasmodium falciparum
DGKTKVNNNNNNDNSNNNNDNSNNNKNNNNDM

SEQ ID NO: 3304350 - protein, 6 aa, Plasmodium falciparum
DGKYPV

SEQ ID NO: 3304351 - protein, 22 aa, Plasmodium falciparum
DGLREKNGKYKKCEEDDKKDLN

SEQ ID NO: 3304352 - protein, 7 aa, Plasmodium falciparum
DGMGNNR

SEQ ID NO: 3304353 - protein, 4 aa, Plasmodium falciparum
DGMT

SEQ ID NO: 3304354 - protein, 6 aa, Plasmodium falciparum
DGNDER

SEQ ID NO: 3304355 - protein, 12 aa, Plasmodium falciparum
DGNDPFPNDPDV

SEQ ID NO: 3304356 - protein, 7 aa, Plasmodium falciparum
DGNEKSV

SEQ ID NO: 3304357 - protein, 9 aa, Plasmodium falciparum
DGNFGNEKG

SEQ ID NO: 3304358 - protein, 5 aa, Plasmodium falciparum
DGNGH

SEQ ID NO: 3304359 - protein, 16 aa, Plasmodium falciparum
DGNGMNNETLADTSEQ

SEQ ID NO: 3304360 - protein, 5 aa, Plasmodium falciparum
DGNIE

SEQ ID NO: 3304361 - protein, 6 aa, Plasmodium falciparum
DGNIGD

SEQ ID NO: 3304362 - protein, 26 aa, Plasmodium falciparum
DGNINNNNYYQSKEGDYEKEKDKREI

SEQ ID NO: 3304363 - protein, 50 aa, Plasmodium falciparum
DGNKEHVEQKENYKFDDNNDDDNNKNDNNNDKNDDHSKNNNNNNNNNNAD

SEQ ID NO: 3304364 - protein, 13 aa, Plasmodium falciparum
DGNKKKKNSNKLD

SEQ ID NO: 3304365 - protein, 4 aa, Plasmodium falciparum
DGNL

SEQ ID NO: 3304366 - protein, 8 aa, Plasmodium falciparum
DGNNKDDN

SEQ ID NO: 3304367 - protein, 7 aa, Plasmodium falciparum
DGNNNNM

SEQ ID NO: 3304368 - protein, 5 aa, Plasmodium falciparum
DGNQD

SEQ ID NO: 3304369 - protein, 18 aa, Plasmodium falciparum
DGNTIGGSNKHDKKDHIN

SEQ ID NO: 3304370 - protein, 17 aa, Plasmodium falciparum
DGNVYTGDEEEEIDIDA

SEQ ID NO: 3304371 - protein, 4 aa, Plasmodium falciparum
DGNY

SEQ ID NO: 3304372 - protein, 8 aa, Plasmodium falciparum
DGNYEHDE

SEQ ID NO: 3304373 - protein, 46 aa, Plasmodium falciparum
DGNYKDKDDDDNKGDDNNNNDHNNDHNNDHNNDNDNNDDRHSDDPM

SEQ ID NO: 3304374 - protein, 6 aa, Plasmodium falciparum
DGPPGA

SEQ ID NO: 3304375 - protein, 11 aa, Plasmodium falciparum
DGPSKGGKDWR

SEQ ID NO: 3304376 - protein, 7 aa, Plasmodium falciparum
DGQETND

SEQ ID NO: 3304377 - protein, 20 aa, Plasmodium falciparum
DGQINNNNNNNNNNNNNNNI

SEQ ID NO: 3304378 - protein, 7 aa, Plasmodium falciparum
DGRRKGM

SEQ ID NO: 3304379 - protein, 6 aa, Plasmodium falciparum
DGSEAI

SEQ ID NO: 3304380 - protein, 6 aa, Plasmodium falciparum
DGSENI

SEQ ID NO: 3304381 - protein, 5 aa, Plasmodium falciparum
DGSFI

SEQ ID NO: 3304382 - protein, 5 aa, Plasmodium falciparum
DGSFK

SEQ ID NO: 3304383 - protein, 11 aa, Plasmodium falciparum
DGSGGDNFNEA

SEQ ID NO: 3304384 - protein, 8 aa, Plasmodium falciparum
DGSGHRRK

SEQ ID NO: 3304385 - protein, 13 aa, Plasmodium falciparum
DGSHTEKNENNSL

SEQ ID NO: 3304386 - protein, 8 aa, Plasmodium falciparum
DGSKNEWG

SEQ ID NO: 3304387 - protein, 11 aa, Plasmodium falciparum
DGSKSKKCSWG

SEQ ID NO: 3304388 - protein, 5 aa, Plasmodium falciparum
DGSKY

SEQ ID NO: 3304389 - protein, 5 aa, Plasmodium falciparum
DGSLD

SEQ ID NO: 3304390 - protein, 8 aa, Plasmodium falciparum
DGSNENIN

SEQ ID NO: 3304391 - protein, 6 aa, Plasmodium falciparum
DGSNFN

SEQ ID NO: 3304392 - protein, 11 aa, Plasmodium falciparum
DGSNNENMRNN

SEQ ID NO: 3304393 - protein, 7 aa, Plasmodium falciparum
DGSPLRG

SEQ ID NO: 3304394 - protein, 12 aa, Plasmodium falciparum
DGSSKGSNDENY

SEQ ID NO: 3304395 - protein, 10 aa, Plasmodium falciparum
DGSSSMSKRN

SEQ ID NO: 3304396 - protein, 5 aa, Plasmodium falciparum
DGSSY

SEQ ID NO: 3304397 - protein, 31 aa, Plasmodium falciparum
DGSSYEGEFKNGKKEGKGKWSDGNGNSYEGE

SEQ ID NO: 3304398 - protein, 6 aa, Plasmodium falciparum
DGTCAP

SEQ ID NO: 3304399 - protein, 7 aa, Plasmodium falciparum
DGTGSNS

SEQ ID NO: 3304400 - protein, 4 aa, Plasmodium falciparum
DGTI

SEQ ID NO: 3304401 - protein, 20 aa, Plasmodium falciparum
DGTKDNVNKFNDDNYNNRKK

SEQ ID NO: 3304402 - protein, 4 aa, Plasmodium falciparum
DGTR

SEQ ID NO: 3304403 - protein, 4 aa, Plasmodium falciparum
DGVR

SEQ ID NO: 3304404 - protein, 7 aa, Plasmodium falciparum
DGVSNNP

SEQ ID NO: 3304405 - protein, 4 aa, Plasmodium falciparum
DGYE

SEQ ID NO: 3304406 - protein, 5 aa, Plasmodium falciparum
DGYEE

SEQ ID NO: 3304407 - protein, 22 aa, Plasmodium falciparum
DGYKNSRKYKLSEKKYSPYDNE

SEQ ID NO: 3304408 - protein, 5 aa, Plasmodium falciparum
DGYLK

SEQ ID NO: 3304409 - protein, 6 aa, Plasmodium falciparum
DGYNHN

SEQ ID NO: 3304410 - protein, 5 aa, Plasmodium falciparum
DGYSG

SEQ ID NO: 3304411 - protein, 6 aa, Plasmodium falciparum
DHDGYE

SEQ ID NO: 3304412 - protein, 32 aa, Plasmodium falciparum
DHDNNNNNNNNNNNNNNNNNNNNNNNNNNFND

SEQ ID NO: 3304413 - protein, 8 aa, Plasmodium falciparum
DHDNYNDH

SEQ ID NO: 3304414 - protein, 6 aa, Plasmodium falciparum
DHEGSY

SEQ ID NO: 3304415 - protein, 5 aa, Plasmodium falciparum
DHEHV

SEQ ID NO: 3304416 - protein, 7 aa, Plasmodium falciparum
DHEKEEK

SEQ ID NO: 3304417 - protein, 11 aa, Plasmodium falciparum
DHEKKEKEKNM

SEQ ID NO: 3304418 - protein, 7 aa, Plasmodium falciparum
DHELDEN

SEQ ID NO: 3304419 - protein, 8 aa, Plasmodium falciparum
DHHSYNKS

SEQ ID NO: 3304420 - protein, 10 aa, Plasmodium falciparum
DHINNKGNNI

SEQ ID NO: 3304421 - protein, 6 aa, Plasmodium falciparum
DHKCGK

SEQ ID NO: 3304422 - protein, 7 aa, Plasmodium falciparum
DHKKEGN

SEQ ID NO: 3304423 - protein, 4 aa, Plasmodium falciparum
DHKN

SEQ ID NO: 3304424 - protein, 21 aa, Plasmodium falciparum
DHKNHKKYTRSHENDNEVNAY

SEQ ID NO: 3304425 - protein, 10 aa, Plasmodium falciparum
DHKNKHDENI

SEQ ID NO: 3304426 - protein, 14 aa, Plasmodium falciparum
DHKNKKVSKNQHND

SEQ ID NO: 3304427 - protein, 12 aa, Plasmodium falciparum
DHKPYNKKEKER

SEQ ID NO: 3304428 - protein, 4 aa, Plasmodium falciparum
DHME

SEQ ID NO: 3304429 - protein, 50 aa, Plasmodium falciparum
DHMKGTNVDEEDKEKTKNGCSELDTNNIKEDTDVNINGKENPNDENVNGQ

SEQ ID NO: 3304430 - protein, 44 aa, Plasmodium falciparum
DHNAINQNNYNNNNHVTKSNNHTNEHNNHSNVSSTSNNNNIKYA

SEQ ID NO: 3304431 - protein, 12 aa, Plasmodium falciparum
DHNARKKSKSSK

SEQ ID NO: 3304432 - protein, 6 aa, Plasmodium falciparum
DHNDGK

SEQ ID NO: 3304433 - protein, 11 aa, Plasmodium falciparum
DHNEEPSEHYN

SEQ ID NO: 3304434 - protein, 21 aa, Plasmodium falciparum
DHNEYYTNPDEQKNKDSYNEH

SEQ ID NO: 3304435 - protein, 8 aa, Plasmodium falciparum
DHNGDAKQ

SEQ ID NO: 3304436 - protein, 7 aa, Plasmodium falciparum
DHNKIEC

SEQ ID NO: 3304437 - protein, 8 aa, Plasmodium falciparum
DHNKNKYN

SEQ ID NO: 3304438 - protein, 4 aa, Plasmodium falciparum
DHNL

SEQ ID NO: 3304439 - protein, 22 aa, Plasmodium falciparum
DHNNNNNKNHNNYDKDNSNESY

SEQ ID NO: 3304440 - protein, 8 aa, Plasmodium falciparum
DHNNNNNN

SEQ ID NO: 3304441 - protein, 14 aa, Plasmodium falciparum
DHNNNNNNNNIRDN

SEQ ID NO: 3304442 - protein, 51 aa, Plasmodium falciparum
DHNNNNNNNNKNNDDDRNQNIQTQNKNNDNKKKSQDNDKGNVCNNEPPFDR

SEQ ID NO: 3304443 - protein, 12 aa, Plasmodium falciparum
DHNNNPNDNIQN

SEQ ID NO: 3304444 - protein, 25 aa, Plasmodium falciparum
DHNNNTEEERKKNDTFYKKNGDYKN

SEQ ID NO: 3304445 - protein, 8 aa, Plasmodium falciparum
DHNSDDDC

SEQ ID NO: 3304446 - protein, 17 aa, Plasmodium falciparum
DHNSEYDNETNEAQVNT

SEQ ID NO: 3304447 - protein, 52 aa, Plasmodium falciparum
DHNSSTNSLYSNGNSTTISNSNTTNMNNNVNNNVNSNVNNNVNNNVNNNVNN

SEQ ID NO: 3304448 - protein, 6 aa, Plasmodium falciparum
DHPAGF

SEQ ID NO: 3304449 - protein, 19 aa, Plasmodium falciparum
DHPDGDKNIDKNNIDKNNI

SEQ ID NO: 3304450 - protein, 6 aa, Plasmodium falciparum
DHPGLG

SEQ ID NO: 3304451 - protein, 39 aa, Plasmodium falciparum
DHPNGKNIDNNKKYDDDDNNNKKYDDDNNNNNNDNNLNE

SEQ ID NO: 3304452 - protein, 6 aa, Plasmodium falciparum
DHQNEQ

SEQ ID NO: 3304453 - protein, 5 aa, Plasmodium falciparum
DHREI

SEQ ID NO: 3304454 - protein, 6 aa, Plasmodium falciparum
DHRIEE

SEQ ID NO: 3304455 - protein, 6 aa, Plasmodium falciparum
DHRNDD

SEQ ID NO: 3304456 - protein, 7 aa, Plasmodium falciparum
DHSKKRT

SEQ ID NO: 3304457 - protein, 6 aa, Plasmodium falciparum
DHSKNN

SEQ ID NO: 3304458 - protein, 9 aa, Plasmodium falciparum
DHSNGKNND

SEQ ID NO: 3304459 - protein, 7 aa, Plasmodium falciparum
DHSPQNI

SEQ ID NO: 3304460 - protein, 5 aa, Plasmodium falciparum
DHSRT

SEQ ID NO: 3304461 - protein, 4 aa, Plasmodium falciparum
DHSS

SEQ ID NO: 3304462 - protein, 25 aa, Plasmodium falciparum
DHSSNNEKIQKKNENTSDTNGYSNN

SEQ ID NO: 3304463 - protein, 10 aa, Plasmodium falciparum
DHSSTGSCKA

SEQ ID NO: 3304464 - protein, 29 aa, Plasmodium falciparum
DHTKNVDHTKNVDHTKNIDHTKNVDHTKN

SEQ ID NO: 3304465 - protein, 12 aa, Plasmodium falciparum
DHTNKEIYNDGN

SEQ ID NO: 3304466 - protein, 8 aa, Plasmodium falciparum
DHTNNSNK

SEQ ID NO: 3304467 - protein, 7 aa, Plasmodium falciparum
DHTSKKN

SEQ ID NO: 3304468 - protein, 11 aa, Plasmodium falciparum
DHTTNQNETTC

SEQ ID NO: 3304469 - protein, 11 aa, Plasmodium falciparum
DIANNQDNKNV

SEQ ID NO: 3304470 - protein, 4 aa, Plasmodium falciparum
DIDA

SEQ ID NO: 3304471 - protein, 11 aa, Plasmodium falciparum
DIDADDDLEAN

SEQ ID NO: 3304472 - protein, 7 aa, Plasmodium falciparum
DIDDDDN

SEQ ID NO: 3304473 - protein, 4 aa, Plasmodium falciparum
DIDE

SEQ ID NO: 3304474 - protein, 15 aa, Plasmodium falciparum
DIDEEGSEKEDTYVT

SEQ ID NO: 3304475 - protein, 7 aa, Plasmodium falciparum
DIDEESD

SEQ ID NO: 3304476 - protein, 13 aa, Plasmodium falciparum
DIDENDEKNDHLK

SEQ ID NO: 3304477 - protein, 13 aa, Plasmodium falciparum
DIDENSNNSDDQC

SEQ ID NO: 3304478 - protein, 4 aa, Plasmodium falciparum
DIDG

SEQ ID NO: 3304479 - protein, 5 aa, Plasmodium falciparum
DIDKK

SEQ ID NO: 3304480 - protein, 9 aa, Plasmodium falciparum
DIDKNKVEC

SEQ ID NO: 3304481 - protein, 11 aa, Plasmodium falciparum
DIDNENNTNNL

SEQ ID NO: 3304482 - protein, 9 aa, Plasmodium falciparum
DIDNKQNEV

SEQ ID NO: 3304483 - protein, 20 aa, Plasmodium falciparum
DIDNNDNKDKIINETSSGTF

SEQ ID NO: 3304484 - protein, 23 aa, Plasmodium falciparum
DIDNNNNNNNNNNNHNNNNYNNN

SEQ ID NO: 3304485 - protein, 6 aa, Plasmodium falciparum
DIDNNQ

SEQ ID NO: 3304486 - protein, 18 aa, Plasmodium falciparum
DIDNPEKGLRKKSNRNDF

SEQ ID NO: 3304487 - protein, 11 aa, Plasmodium falciparum
DIDNSKNPIFT

SEQ ID NO: 3304488 - protein, 6 aa, Plasmodium falciparum
DIDPEE

SEQ ID NO: 3304489 - protein, 21 aa, Plasmodium falciparum
DIDRERDRERDRERDRNRDRD

SEQ ID NO: 3304490 - protein, 10 aa, Plasmodium falciparum
DIDRSSPSLI

SEQ ID NO: 3304491 - protein, 64 aa, Plasmodium falciparum
DIDSDEEYSDYNEDGMSDGEYSKGSSNNDDNEEDNDDDNEEDNEEDDEEDNEEDNDDKSGKRNK

SEQ ID NO: 3304492 - protein, 5 aa, Plasmodium falciparum
DIDSI

SEQ ID NO: 3304493 - protein, 9 aa, Plasmodium falciparum
DIDTSQENT

SEQ ID NO: 3304494 - protein, 5 aa, Plasmodium falciparum
DIEED

SEQ ID NO: 3304495 - protein, 5 aa, Plasmodium falciparum
DIEEM

SEQ ID NO: 3304496 - protein, 126 aa, Plasmodium falciparum
DIEGDNNKKDMEDDKNEKDMENDNNKKDMEGDQDKKDMEGDQDKKDMEGDNNKKDMEGDKNEKDMEGDNNKKDMEGDKNEKDMEGDNNKKDMEGDKNEKDMEGDNNKKDMEGDNNKKDMEGDKDAK

SEQ ID NO: 3304497 - protein, 5 aa, Plasmodium falciparum
DIEGK

SEQ ID NO: 3304498 - protein, 4 aa, Plasmodium falciparum
DIEK

SEQ ID NO: 3304499 - protein, 8 aa, Plasmodium falciparum
DIEKENVD

SEQ ID NO: 3304500 - protein, 13 aa, Plasmodium falciparum
DIEKGKKKTIYNN

SEQ ID NO: 3304501 - protein, 18 aa, Plasmodium falciparum
DIEKKQKKKKKNYSSNSM

SEQ ID NO: 3304502 - protein, 14 aa, Plasmodium falciparum
DIEKNKNNNTSNKY

SEQ ID NO: 3304503 - protein, 4 aa, Plasmodium falciparum
DIEN

SEQ ID NO: 3304504 - protein, 8 aa, Plasmodium falciparum
DIENDKNI

SEQ ID NO: 3304505 - protein, 21 aa, Plasmodium falciparum
DIENEKRKNEERKEKEKFNKQ

SEQ ID NO: 3304506 - protein, 31 aa, Plasmodium falciparum
DIENEQTNLSINENKNKINKTPTNHSTNKGA

SEQ ID NO: 3304507 - protein, 10 aa, Plasmodium falciparum
DIENNKEVEK

SEQ ID NO: 3304508 - protein, 16 aa, Plasmodium falciparum
DIENSNRKKNKTSSSI

SEQ ID NO: 3304509 - protein, 11 aa, Plasmodium falciparum
DIENVKSNEQF

SEQ ID NO: 3304510 - protein, 7 aa, Plasmodium falciparum
DIENYSS

SEQ ID NO: 3304511 - protein, 7 aa, Plasmodium falciparum
DIEQEKK

SEQ ID NO: 3304512 - protein, 15 aa, Plasmodium falciparum
DIEQNELNDHTQQNE

SEQ ID NO: 3304513 - protein, 29 aa, Plasmodium falciparum
DIERDRNRDIERDRNRDMERDRERERYRE

SEQ ID NO: 3304514 - protein, 5 aa, Plasmodium falciparum
DIETE

SEQ ID NO: 3304515 - protein, 6 aa, Plasmodium falciparum
DIETKL

SEQ ID NO: 3304516 - protein, 6 aa, Plasmodium falciparum
DIETPT

SEQ ID NO: 3304517 - protein, 4 aa, Plasmodium falciparum
DIFN

SEQ ID NO: 3304518 - protein, 6 aa, Plasmodium falciparum
DIGPTN

SEQ ID NO: 3304519 - protein, 6 aa, Plasmodium falciparum
DIGSKE

SEQ ID NO: 3304520 - protein, 6 aa, Plasmodium falciparum
DIHDKK

SEQ ID NO: 3304521 - protein, 4 aa, Plasmodium falciparum
DIHE

SEQ ID NO: 3304522 - protein, 17 aa, Plasmodium falciparum
DIHNGKNEIHNNPDEKN

SEQ ID NO: 3304523 - protein, 11 aa, Plasmodium falciparum
DIHPNNTKANQ

SEQ ID NO: 3304524 - protein, 10 aa, Plasmodium falciparum
DIKDNEGQTP

SEQ ID NO: 3304525 - protein, 6 aa, Plasmodium falciparum
DIKEDD

SEQ ID NO: 3304526 - protein, 6 aa, Plasmodium falciparum
DIKEEL

SEQ ID NO: 3304527 - protein, 14 aa, Plasmodium falciparum
DIKEMKDDEKEKED

SEQ ID NO: 3304528 - protein, 4 aa, Plasmodium falciparum
DIKG

SEQ ID NO: 3304529 - protein, 8 aa, Plasmodium falciparum
DIKKGSVI

SEQ ID NO: 3304530 - protein, 17 aa, Plasmodium falciparum
DIKKKGLKKIKENKKIS

SEQ ID NO: 3304531 - protein, 14 aa, Plasmodium falciparum
DIKKKNEDKKDEDR

SEQ ID NO: 3304532 - protein, 10 aa, Plasmodium falciparum
DIKKTEDKSL

SEQ ID NO: 3304533 - protein, 17 aa, Plasmodium falciparum
DIKNDVKNDVKNDIKND

SEQ ID NO: 3304534 - protein, 9 aa, Plasmodium falciparum
DIKNEERNE

SEQ ID NO: 3304535 - protein, 15 aa, Plasmodium falciparum
DIKNEKGENNQNDNK

SEQ ID NO: 3304536 - protein, 9 aa, Plasmodium falciparum
DIKNNETFE

SEQ ID NO: 3304537 - protein, 25 aa, Plasmodium falciparum
DIKNQKNQKNQNSEQKSNDNKREDN

SEQ ID NO: 3304538 - protein, 10 aa, Plasmodium falciparum
DIKPNKKSNY

SEQ ID NO: 3304539 - protein, 34 aa, Plasmodium falciparum
DIKPSTKKKEENEKKNKENIKNTDENNKETYDKD

SEQ ID NO: 3304540 - protein, 12 aa, Plasmodium falciparum
DIKQHKENIHNI

SEQ ID NO: 3304541 - protein, 14 aa, Plasmodium falciparum
DIKQKGKNQNTNEE

SEQ ID NO: 3304542 - protein, 10 aa, Plasmodium falciparum
DIKRDNTSDH

SEQ ID NO: 3304543 - protein, 4 aa, Plasmodium falciparum
DIKS

SEQ ID NO: 3304544 - protein, 7 aa, Plasmodium falciparum
DIKSNHN

SEQ ID NO: 3304545 - protein, 6 aa, Plasmodium falciparum
DIKTEN

SEQ ID NO: 3304546 - protein, 7 aa, Plasmodium falciparum
DIKTNKQ

SEQ ID NO: 3304547 - protein, 13 aa, Plasmodium falciparum
DIKYDRKEDGFSD

SEQ ID NO: 3304548 - protein, 16 aa, Plasmodium falciparum
DILSKNKKQNYASKED

SEQ ID NO: 3304549 - protein, 4 aa, Plasmodium falciparum
DINA

SEQ ID NO: 3304550 - protein, 18 aa, Plasmodium falciparum
DINDDNNNLNKENHVQNE

SEQ ID NO: 3304551 - protein, 40 aa, Plasmodium falciparum
DINDKDGSYHGNNNSDDDGDDNFDDDDENFDDDDDYFDED

SEQ ID NO: 3304552 - protein, 10 aa, Plasmodium falciparum
DINEKRYNDH

SEQ ID NO: 3304553 - protein, 41 aa, Plasmodium falciparum
DINENKKEKDNIEELKSDNVKEEKKTKKKHLEDNNNNKKKE

SEQ ID NO: 3304554 - protein, 5 aa, Plasmodium falciparum
DINEQ

SEQ ID NO: 3304555 - protein, 8 aa, Plasmodium falciparum
DINGDKSY

SEQ ID NO: 3304556 - protein, 9 aa, Plasmodium falciparum
DINGNDHIN

SEQ ID NO: 3304557 - protein, 6 aa, Plasmodium falciparum
DININN

SEQ ID NO: 3304558 - protein, 27 aa, Plasmodium falciparum
DININSDDDININNNDDMNKNNNDDNI

SEQ ID NO: 3304559 - protein, 5 aa, Plasmodium falciparum
DINKG

SEQ ID NO: 3304560 - protein, 22 aa, Plasmodium falciparum
DINKKNGNDPTINNNNNNNKDC

SEQ ID NO: 3304561 - protein, 9 aa, Plasmodium falciparum
DINKNKKEV

SEQ ID NO: 3304562 - protein, 11 aa, Plasmodium falciparum
DINKRDNENNI

SEQ ID NO: 3304563 - protein, 12 aa, Plasmodium falciparum
DINNKNNRNYTL

SEQ ID NO: 3304564 - protein, 6 aa, Plasmodium falciparum
DINNLS

SEQ ID NO: 3304565 - protein, 54 aa, Plasmodium falciparum
DINNNNNADVNNNNNVDINNNNNNNNNNNNNNVDINNNNNVDINNEANNENDEV

SEQ ID NO: 3304566 - protein, 18 aa, Plasmodium falciparum
DINNNNNNNNNNNNNDNN

SEQ ID NO: 3304567 - protein, 54 aa, Plasmodium falciparum
DINNSGNSDISNSSNIDNDNDNDNDNNNNNNSNEEEENDYTHTKDKKLSSYINS

SEQ ID NO: 3304568 - protein, 14 aa, Plasmodium falciparum
DINNSNEKNEELPK

SEQ ID NO: 3304569 - protein, 6 aa, Plasmodium falciparum
DINNTN

SEQ ID NO: 3304570 - protein, 15 aa, Plasmodium falciparum
DINQEKAKTDNSQDN

SEQ ID NO: 3304571 - protein, 8 aa, Plasmodium falciparum
DINQERRE

SEQ ID NO: 3304572 - protein, 11 aa, Plasmodium falciparum
DINQKGKNIKN

SEQ ID NO: 3304573 - protein, 17 aa, Plasmodium falciparum
DINQNKKDIQKKEEEHI

SEQ ID NO: 3304574 - protein, 18 aa, Plasmodium falciparum
DINQNNDSNNMQENEEYE

SEQ ID NO: 3304575 - protein, 4 aa, Plasmodium falciparum
DINS

SEQ ID NO: 3304576 - protein, 5 aa, Plasmodium falciparum
DINSC

SEQ ID NO: 3304577 - protein, 15 aa, Plasmodium falciparum
DINSKQEHLRSSTNF

SEQ ID NO: 3304578 - protein, 10 aa, Plasmodium falciparum
DINSRTSSNI

SEQ ID NO: 3304579 - protein, 6 aa, Plasmodium falciparum
DINTNE

SEQ ID NO: 3304580 - protein, 41 aa, Plasmodium falciparum
DINTNTNSNTNSNTNTNINTNANTNTNTNEKAQDEKFQYNG

SEQ ID NO: 3304581 - protein, 4 aa, Plasmodium falciparum
DIPD

SEQ ID NO: 3304582 - protein, 9 aa, Plasmodium falciparum
DIPDDKKEI

SEQ ID NO: 3304583 - protein, 6 aa, Plasmodium falciparum
DIPITQ

SEQ ID NO: 3304584 - protein, 5 aa, Plasmodium falciparum
DIPLN

SEQ ID NO: 3304585 - protein, 10 aa, Plasmodium falciparum
DIPNSDVSSN

SEQ ID NO: 3304586 - protein, 43 aa, Plasmodium falciparum
DIPSNNKTDNKENNHIPKNNPLNCNDNNQKNLQNIGNNKNKIR

SEQ ID NO: 3304587 - protein, 9 aa, Plasmodium falciparum
DIPSNNYTN

SEQ ID NO: 3304588 - protein, 5 aa, Plasmodium falciparum
DIPSS

SEQ ID NO: 3304589 - protein, 7 aa, Plasmodium falciparum
DIPSTSS

SEQ ID NO: 3304590 - protein, 6 aa, Plasmodium falciparum
DIPTKI

SEQ ID NO: 3304591 - protein, 5 aa, Plasmodium falciparum
DIPTY

SEQ ID NO: 3304592 - protein, 21 aa, Plasmodium falciparum
DIQDEDSTYINSTKNNKKKLT

SEQ ID NO: 3304593 - protein, 22 aa, Plasmodium falciparum
DIQEENKDNMTSINENKDSTEK

SEQ ID NO: 3304594 - protein, 13 aa, Plasmodium falciparum
DIQENTKDQPIDV

SEQ ID NO: 3304595 - protein, 5 aa, Plasmodium falciparum
DIQGA

SEQ ID NO: 3304596 - protein, 5 aa, Plasmodium falciparum
DIQGK

SEQ ID NO: 3304597 - protein, 10 aa, Plasmodium falciparum
DIQKEKKSLI

SEQ ID NO: 3304598 - protein, 6 aa, Plasmodium falciparum
DIQNEL

SEQ ID NO: 3304599 - protein, 5 aa, Plasmodium falciparum
DIQNN

SEQ ID NO: 3304600 - protein, 11 aa, Plasmodium falciparum
DIQQKEDKNKN

SEQ ID NO: 3304601 - protein, 14 aa, Plasmodium falciparum
DIQREDDKKTQNDN

SEQ ID NO: 3304602 - protein, 5 aa, Plasmodium falciparum
DIQRV

SEQ ID NO: 3304603 - protein, 13 aa, Plasmodium falciparum
DIQSDDDDNNNIN

SEQ ID NO: 3304604 - protein, 26 aa, Plasmodium falciparum
DIRDNHNGTVQNINDDNNSSNNYQKS

SEQ ID NO: 3304605 - protein, 13 aa, Plasmodium falciparum
DIREKNKENVKNN

SEQ ID NO: 3304606 - protein, 5 aa, Plasmodium falciparum
DIRNN

SEQ ID NO: 3304607 - protein, 6 aa, Plasmodium falciparum
DIRNPT

SEQ ID NO: 3304608 - protein, 5 aa, Plasmodium falciparum
DISDK

SEQ ID NO: 3304609 - protein, 20 aa, Plasmodium falciparum
DISDKSNSLSYNNTDLSDDN

SEQ ID NO: 3304610 - protein, 4 aa, Plasmodium falciparum
DISE

SEQ ID NO: 3304611 - protein, 11 aa, Plasmodium falciparum
DISELKKDEGK

SEQ ID NO: 3304612 - protein, 6 aa, Plasmodium falciparum
DISHPN

SEQ ID NO: 3304613 - protein, 10 aa, Plasmodium falciparum
DISKEETKEH

SEQ ID NO: 3304614 - protein, 19 aa, Plasmodium falciparum
DISKKKEHLGEEEEENEKL

SEQ ID NO: 3304615 - protein, 8 aa, Plasmodium falciparum
DISKKNEN

SEQ ID NO: 3304616 - protein, 10 aa, Plasmodium falciparum
DISKNIDQKE

SEQ ID NO: 3304617 - protein, 4 aa, Plasmodium falciparum
DISN

SEQ ID NO: 3304618 - protein, 32 aa, Plasmodium falciparum
DISNKEENEKEEKKSNNKELLENNKEKSCSGI

SEQ ID NO: 3304619 - protein, 8 aa, Plasmodium falciparum
DISNNSNY

SEQ ID NO: 3304620 - protein, 18 aa, Plasmodium falciparum
DISPNQDISPNQDISPND

SEQ ID NO: 3304621 - protein, 5 aa, Plasmodium falciparum
DISPS

SEQ ID NO: 3304622 - protein, 7 aa, Plasmodium falciparum
DISPSKV

SEQ ID NO: 3304623 - protein, 6 aa, Plasmodium falciparum
DISPTS

SEQ ID NO: 3304624 - protein, 4 aa, Plasmodium falciparum
DISS

SEQ ID NO: 3304625 - protein, 8 aa, Plasmodium falciparum
DISSISDE

SEQ ID NO: 3304626 - protein, 14 aa, Plasmodium falciparum
DISSKKKKKKNQVQ

SEQ ID NO: 3304627 - protein, 16 aa, Plasmodium falciparum
DISSTNNSINIPTNNS

SEQ ID NO: 3304628 - protein, 8 aa, Plasmodium falciparum
DISTDPNF

SEQ ID NO: 3304629 - protein, 7 aa, Plasmodium falciparum
DISTEPK

SEQ ID NO: 3304630 - protein, 7 aa, Plasmodium falciparum
DISTPLK

SEQ ID NO: 3304631 - protein, 4 aa, Plasmodium falciparum
DITD

SEQ ID NO: 3304632 - protein, 5 aa, Plasmodium falciparum
DITEE

SEQ ID NO: 3304633 - protein, 7 aa, Plasmodium falciparum
DITHSGA

SEQ ID NO: 3304634 - protein, 4 aa, Plasmodium falciparum
DITK

SEQ ID NO: 3304635 - protein, 43 aa, Plasmodium falciparum
DITKGDLKKRTRDIEKGMGTNVNNNVNNNVNNNVNNNVNNNVD

SEQ ID NO: 3304636 - protein, 5 aa, Plasmodium falciparum
DITKN

SEQ ID NO: 3304637 - protein, 27 aa, Plasmodium falciparum
DITKRTNKISTLKKKKKKKKNEKEEIY

SEQ ID NO: 3304638 - protein, 5 aa, Plasmodium falciparum
DITKS

SEQ ID NO: 3304639 - protein, 7 aa, Plasmodium falciparum
DITNDTN

SEQ ID NO: 3304640 - protein, 22 aa, Plasmodium falciparum
DITNESSYRSGQYHNAEEEGGE

SEQ ID NO: 3304641 - protein, 13 aa, Plasmodium falciparum
DITNGNGSGGESI

SEQ ID NO: 3304642 - protein, 5 aa, Plasmodium falciparum
DITQN

SEQ ID NO: 3304643 - protein, 8 aa, Plasmodium falciparum
DITQNEDM

SEQ ID NO: 3304644 - protein, 4 aa, Plasmodium falciparum
DITS

SEQ ID NO: 3304645 - protein, 13 aa, Plasmodium falciparum
DITSKNNSLENNE

SEQ ID NO: 3304646 - protein, 7 aa, Plasmodium falciparum
DITSSQE

SEQ ID NO: 3304647 - protein, 6 aa, Plasmodium falciparum
DITTDK

SEQ ID NO: 3304648 - protein, 7 aa, Plasmodium falciparum
DITYKKN

SEQ ID NO: 3304649 - protein, 4 aa, Plasmodium falciparum
DIYG

SEQ ID NO: 3304650 - protein, 4 aa, Plasmodium falciparum
DIYN

SEQ ID NO: 3304651 - protein, 5 aa, Plasmodium falciparum
DIYNN

SEQ ID NO: 3304652 - protein, 5 aa, Plasmodium falciparum
DIYRD

SEQ ID NO: 3304653 - protein, 5 aa, Plasmodium falciparum
DKADM

SEQ ID NO: 3304654 - protein, 7 aa, Plasmodium falciparum
DKAEEKV

SEQ ID NO: 3304655 - protein, 7 aa, Plasmodium falciparum
DKAEGIT

SEQ ID NO: 3304656 - protein, 4 aa, Plasmodium falciparum
DKAG

SEQ ID NO: 3304657 - protein, 4 aa, Plasmodium falciparum
DKAK

SEQ ID NO: 3304658 - protein, 9 aa, Plasmodium falciparum
DKAKQSDQL

SEQ ID NO: 3304659 - protein, 17 aa, Plasmodium falciparum
DKARKIEEAKKKEISAK

SEQ ID NO: 3304660 - protein, 7 aa, Plasmodium falciparum
DKATRKA

SEQ ID NO: 3304661 - protein, 7 aa, Plasmodium falciparum
DKCEKNG

SEQ ID NO: 3304662 - protein, 6 aa, Plasmodium falciparum
DKCKPK

SEQ ID NO: 3304663 - protein, 13 aa, Plasmodium falciparum
DKCNDDNKISNNI

SEQ ID NO: 3304664 - protein, 15 aa, Plasmodium falciparum
DKCNDENNDMSDESH

SEQ ID NO: 3304665 - protein, 11 aa, Plasmodium falciparum
DKCNNDESQPL

SEQ ID NO: 3304666 - protein, 24 aa, Plasmodium falciparum
DKCSNDNIKNDDDLYDKKRKKKIY

SEQ ID NO: 3304667 - protein, 13 aa, Plasmodium falciparum
DKDATEKEQEIAS

SEQ ID NO: 3304668 - protein, 7 aa, Plasmodium falciparum
DKDATGS

SEQ ID NO: 3304669 - protein, 8 aa, Plasmodium falciparum
DKDCDDNQ

SEQ ID NO: 3304670 - protein, 6 aa, Plasmodium falciparum
DKDCYN

SEQ ID NO: 3304671 - protein, 11 aa, Plasmodium falciparum
DKDDKETTSER

SEQ ID NO: 3304672 - protein, 13 aa, Plasmodium falciparum
DKDDKIKNGSNKY

SEQ ID NO: 3304673 - protein, 11 aa, Plasmodium falciparum
DKDDKKEAVDE

SEQ ID NO: 3304674 - protein, 9 aa, Plasmodium falciparum
DKDDKNENK

SEQ ID NO: 3304675 - protein, 18 aa, Plasmodium falciparum
DKDDQESEEKKENYNSHD

SEQ ID NO: 3304676 - protein, 17 aa, Plasmodium falciparum
DKDDVNKDNVGNHKKEN

SEQ ID NO: 3304677 - protein, 9 aa, Plasmodium falciparum
DKDEEDKYA

SEQ ID NO: 3304678 - protein, 15 aa, Plasmodium falciparum
DKDEIDSKKENNKNK

SEQ ID NO: 3304679 - protein, 7 aa, Plasmodium falciparum
DKDERTK

SEQ ID NO: 3304680 - protein, 6 aa, Plasmodium falciparum
DKDETL

SEQ ID NO: 3304681 - protein, 6 aa, Plasmodium falciparum
DKDEYK

SEQ ID NO: 3304682 - protein, 4 aa, Plasmodium falciparum
DKDF

SEQ ID NO: 3304683 - protein, 6 aa, Plasmodium falciparum
DKDGET

SEQ ID NO: 3304684 - protein, 4 aa, Plasmodium falciparum
DKDH

SEQ ID NO: 3304685 - protein, 4 aa, Plasmodium falciparum
DKDI

SEQ ID NO: 3304686 - protein, 14 aa, Plasmodium falciparum
DKDINTSLSSYQKS

SEQ ID NO: 3304687 - protein, 31 aa, Plasmodium falciparum
DKDIPGKDKNGKTDIDNDNNNNNNDKIKSNN

SEQ ID NO: 3304688 - protein, 6 aa, Plasmodium falciparum
DKDIPN

SEQ ID NO: 3304689 - protein, 8 aa, Plasmodium falciparum
DKDKDISS

SEQ ID NO: 3304690 - protein, 9 aa, Plasmodium falciparum
DKDKEYKGT

SEQ ID NO: 3304691 - protein, 7 aa, Plasmodium falciparum
DKDKKEN

SEQ ID NO: 3304692 - protein, 50 aa, Plasmodium falciparum
DKDKNEDKDDMSKNSKEEFKNDDKENSDDQNNNDSNKKDDENNINNGDTN

SEQ ID NO: 3304693 - protein, 8 aa, Plasmodium falciparum
DKDKNKRK

SEQ ID NO: 3304694 - protein, 4 aa, Plasmodium falciparum
DKDL

SEQ ID NO: 3304695 - protein, 5 aa, Plasmodium falciparum
DKDLE

SEQ ID NO: 3304696 - protein, 9 aa, Plasmodium falciparum
DKDNENQHF

SEQ ID NO: 3304697 - protein, 15 aa, Plasmodium falciparum
DKDNISNQRSHTSNI

SEQ ID NO: 3304698 - protein, 5 aa, Plasmodium falciparum
DKDNN

SEQ ID NO: 3304699 - protein, 8 aa, Plasmodium falciparum
DKDNSIYA

SEQ ID NO: 3304700 - protein, 6 aa, Plasmodium falciparum
DKDNSL

SEQ ID NO: 3304701 - protein, 13 aa, Plasmodium falciparum
DKDNTFNNSEKSD

SEQ ID NO: 3304702 - protein, 5 aa, Plasmodium falciparum
DKDPV

SEQ ID NO: 3304703 - protein, 15 aa, Plasmodium falciparum
DKDQTVKQKNVSSYD

SEQ ID NO: 3304704 - protein, 6 aa, Plasmodium falciparum
DKDSYK

SEQ ID NO: 3304705 - protein, 9 aa, Plasmodium falciparum
DKDTISDKT

SEQ ID NO: 3304706 - protein, 23 aa, Plasmodium falciparum
DKDTQLHKENNNNNNMNSGNVEN

SEQ ID NO: 3304707 - protein, 7 aa, Plasmodium falciparum
DKDTTNE

SEQ ID NO: 3304708 - protein, 7 aa, Plasmodium falciparum
DKDVPYE

SEQ ID NO: 3304709 - protein, 4 aa, Plasmodium falciparum
DKDY

SEQ ID NO: 3304710 - protein, 12 aa, Plasmodium falciparum
DKDYNYNNNDKK

SEQ ID NO: 3304711 - protein, 4 aa, Plasmodium falciparum
DKEA

SEQ ID NO: 3304712 - protein, 20 aa, Plasmodium falciparum
DKECSDAKENNINKNNCSVD

SEQ ID NO: 3304713 - protein, 5 aa, Plasmodium falciparum
DKEDD

SEQ ID NO: 3304714 - protein, 8 aa, Plasmodium falciparum
DKEDDMKK

SEQ ID NO: 3304715 - protein, 61 aa, Plasmodium falciparum
DKEDKNKKVNYDDDKKVSDDDDKKVSDDDDNKKVSDDDDKKVSDDDDKKVSNDDNKKVYYD

SEQ ID NO: 3304716 - protein, 6 aa, Plasmodium falciparum
DKEDNP

SEQ ID NO: 3304717 - protein, 8 aa, Plasmodium falciparum
DKEDQPLN

SEQ ID NO: 3304718 - protein, 4 aa, Plasmodium falciparum
DKEE

SEQ ID NO: 3304719 - protein, 14 aa, Plasmodium falciparum
DKEEEEDKENLANL

SEQ ID NO: 3304720 - protein, 18 aa, Plasmodium falciparum
DKEEEEIEYEEKKEDDNI

SEQ ID NO: 3304721 - protein, 6 aa, Plasmodium falciparum
DKEEID

SEQ ID NO: 3304722 - protein, 7 aa, Plasmodium falciparum
DKEENER

SEQ ID NO: 3304723 - protein, 5 aa, Plasmodium falciparum
DKEES

SEQ ID NO: 3304724 - protein, 20 aa, Plasmodium falciparum
DKEESDNEEKGLSEQNSKGY

SEQ ID NO: 3304725 - protein, 32 aa, Plasmodium falciparum
DKEETKELNKTSKANKKNHEKLEENKIGTNIK

SEQ ID NO: 3304726 - protein, 5 aa, Plasmodium falciparum
DKEGI

SEQ ID NO: 3304727 - protein, 13 aa, Plasmodium falciparum
DKEGMKKKEKNNK

SEQ ID NO: 3304728 - protein, 6 aa, Plasmodium falciparum
DKEGND

SEQ ID NO: 3304729 - protein, 12 aa, Plasmodium falciparum
DKEGPNLDNPED

SEQ ID NO: 3304730 - protein, 10 aa, Plasmodium falciparum
DKEGTEMKSN

SEQ ID NO: 3304731 - protein, 4 aa, Plasmodium falciparum
DKEH

SEQ ID NO: 3304732 - protein, 19 aa, Plasmodium falciparum
DKEHESIKNDKNNSKDYPF

SEQ ID NO: 3304733 - protein, 15 aa, Plasmodium falciparum
DKEIEEKNKKIKELN

SEQ ID NO: 3304734 - protein, 17 aa, Plasmodium falciparum
DKEIKNKKERAKKKNIL

SEQ ID NO: 3304735 - protein, 7 aa, Plasmodium falciparum
DKEIQKK

SEQ ID NO: 3304736 - protein, 4 aa, Plasmodium falciparum
DKEK

SEQ ID NO: 3304737 - protein, 10 aa, Plasmodium falciparum
DKEKEESNVN

SEQ ID NO: 3304738 - protein, 7 aa, Plasmodium falciparum
DKEKEIE

SEQ ID NO: 3304739 - protein, 13 aa, Plasmodium falciparum
DKEKEQIEKNKEE

SEQ ID NO: 3304740 - protein, 5 aa, Plasmodium falciparum
DKEKI

SEQ ID NO: 3304741 - protein, 7 aa, Plasmodium falciparum
DKEKKAS

SEQ ID NO: 3304742 - protein, 6 aa, Plasmodium falciparum
DKEKKK

SEQ ID NO: 3304743 - protein, 9 aa, Plasmodium falciparum
DKEKKKKEL

SEQ ID NO: 3304744 - protein, 11 aa, Plasmodium falciparum
DKEKKNNNINN

SEQ ID NO: 3304745 - protein, 7 aa, Plasmodium falciparum
DKEKNEL

SEQ ID NO: 3304746 - protein, 7 aa, Plasmodium falciparum
DKEKNIN

SEQ ID NO: 3304747 - protein, 6 aa, Plasmodium falciparum
DKEKNK

SEQ ID NO: 3304748 - protein, 8 aa, Plasmodium falciparum
DKEKNSNR

SEQ ID NO: 3304749 - protein, 10 aa, Plasmodium falciparum
DKEKQSYYGS

SEQ ID NO: 3304750 - protein, 9 aa, Plasmodium falciparum
DKEKRKSTL

SEQ ID NO: 3304751 - protein, 8 aa, Plasmodium falciparum
DKEKSVRE

SEQ ID NO: 3304752 - protein, 10 aa, Plasmodium falciparum
DKEKTNINSD

SEQ ID NO: 3304753 - protein, 8 aa, Plasmodium falciparum
DKELSKGT

SEQ ID NO: 3304754 - protein, 9 aa, Plasmodium falciparum
DKENDIDKE

SEQ ID NO: 3304755 - protein, 15 aa, Plasmodium falciparum
DKENEEDESDEDSID

SEQ ID NO: 3304756 - protein, 7 aa, Plasmodium falciparum
DKENEYN

SEQ ID NO: 3304757 - protein, 7 aa, Plasmodium falciparum
DKENGKK

SEQ ID NO: 3304758 - protein, 6 aa, Plasmodium falciparum
DKENHD

SEQ ID NO: 3304759 - protein, 8 aa, Plasmodium falciparum
DKENIETK

SEQ ID NO: 3304760 - protein, 12 aa, Plasmodium falciparum
DKENIKQKNPSA

SEQ ID NO: 3304761 - protein, 8 aa, Plasmodium falciparum
DKENKDAI

SEQ ID NO: 3304762 - protein, 16 aa, Plasmodium falciparum
DKENNDNCKNKNSVEN

SEQ ID NO: 3304763 - protein, 8 aa, Plasmodium falciparum
DKENQEEI

SEQ ID NO: 3304764 - protein, 5 aa, Plasmodium falciparum
DKENY

SEQ ID NO: 3304765 - protein, 17 aa, Plasmodium falciparum
DKEPDTEWKKKAESAFK

SEQ ID NO: 3304766 - protein, 17 aa, Plasmodium falciparum
DKEQNEKENEDKESKQI

SEQ ID NO: 3304767 - protein, 5 aa, Plasmodium falciparum
DKEQR

SEQ ID NO: 3304768 - protein, 9 aa, Plasmodium falciparum
DKERDKKIE

SEQ ID NO: 3304769 - protein, 9 aa, Plasmodium falciparum
DKERKDTMS

SEQ ID NO: 3304770 - protein, 36 aa, Plasmodium falciparum
DKERTKRYIRSNSSSIYNDRERKKYEDRKRKKKNHI

SEQ ID NO: 3304771 - protein, 4 aa, Plasmodium falciparum
DKES

SEQ ID NO: 3304772 - protein, 18 aa, Plasmodium falciparum
DKESKEKKGKNINDKEQD

SEQ ID NO: 3304773 - protein, 14 aa, Plasmodium falciparum
DKESKKEKKKKENL

SEQ ID NO: 3304774 - protein, 9 aa, Plasmodium falciparum
DKESSKNDK

SEQ ID NO: 3304775 - protein, 7 aa, Plasmodium falciparum
DKESYPE

SEQ ID NO: 3304776 - protein, 4 aa, Plasmodium falciparum
DKET

SEQ ID NO: 3304777 - protein, 6 aa, Plasmodium falciparum
DKETDR

SEQ ID NO: 3304778 - protein, 6 aa, Plasmodium falciparum
DKETEE

SEQ ID NO: 3304779 - protein, 18 aa, Plasmodium falciparum
DKETQSKKNKKKKKKGID

SEQ ID NO: 3304780 - protein, 7 aa, Plasmodium falciparum
DKETSTI

SEQ ID NO: 3304781 - protein, 102 aa, Plasmodium falciparum
DKEVDKNDKDDKDDKDDKDDKDDKDDKDDKDDKDDKDDKDDKDDKDDKESVKKKKKKKKEKNKKNKDKNDKNDKNDKNDKNDKNDKNDKKDKQYKQKKEQNI

SEQ ID NO: 3304782 - protein, 7 aa, Plasmodium falciparum
DKEVSYE

SEQ ID NO: 3304783 - protein, 4 aa, Plasmodium falciparum
DKEY

SEQ ID NO: 3304784 - protein, 13 aa, Plasmodium falciparum
DKEYKPAEGCDED

SEQ ID NO: 3304785 - protein, 16 aa, Plasmodium falciparum
DKFDTSGSMSGGSNKN

SEQ ID NO: 3304786 - protein, 6 aa, Plasmodium falciparum
DKFGSH

SEQ ID NO: 3304787 - protein, 7 aa, Plasmodium falciparum
DKFKNSE

SEQ ID NO: 3304788 - protein, 12 aa, Plasmodium falciparum
DKFNENEEENEM

SEQ ID NO: 3304789 - protein, 19 aa, Plasmodium falciparum
DKFNNNNNNNNSSSDEDNF

SEQ ID NO: 3304790 - protein, 7 aa, Plasmodium falciparum
DKFNQKD

SEQ ID NO: 3304791 - protein, 13 aa, Plasmodium falciparum
DKFNTEKNNDKSL

SEQ ID NO: 3304792 - protein, 8 aa, Plasmodium falciparum
DKFPDKYR

SEQ ID NO: 3304793 - protein, 28 aa, Plasmodium falciparum
DKGDRHNKNEIHDQNDVYDNKKNEDSDS

SEQ ID NO: 3304794 - protein, 7 aa, Plasmodium falciparum
DKGECKN

SEQ ID NO: 3304795 - protein, 8 aa, Plasmodium falciparum
DKGETRRN

SEQ ID NO: 3304796 - protein, 6 aa, Plasmodium falciparum
DKGGIN

SEQ ID NO: 3304797 - protein, 9 aa, Plasmodium falciparum
DKGGNKKCQ

SEQ ID NO: 3304798 - protein, 4 aa, Plasmodium falciparum
DKGI

SEQ ID NO: 3304799 - protein, 4 aa, Plasmodium falciparum
DKGK

SEQ ID NO: 3304800 - protein, 14 aa, Plasmodium falciparum
DKGKTPYRLYQPRL

SEQ ID NO: 3304801 - protein, 10 aa, Plasmodium falciparum
DKGNGKSNAT

SEQ ID NO: 3304802 - protein, 31 aa, Plasmodium falciparum
DKGNNNNNSNTTSRLSSNRKGNHYSRRSGER

SEQ ID NO: 3304803 - protein, 5 aa, Plasmodium falciparum
DKGPF

SEQ ID NO: 3304804 - protein, 7 aa, Plasmodium falciparum
DKGPGNF

SEQ ID NO: 3304805 - protein, 7 aa, Plasmodium falciparum
DKGPPRI

SEQ ID NO: 3304806 - protein, 18 aa, Plasmodium falciparum
DKGQLGRTLDGNEKSQNY

SEQ ID NO: 3304807 - protein, 8 aa, Plasmodium falciparum
DKGRLSQD

SEQ ID NO: 3304808 - protein, 6 aa, Plasmodium falciparum
DKGRRI

SEQ ID NO: 3304809 - protein, 27 aa, Plasmodium falciparum
DKGSKMNNNNNNNNNNNNNNNNNNIER

SEQ ID NO: 3304810 - protein, 22 aa, Plasmodium falciparum
DKGSRDVEDKSVYDKKNESLSN

SEQ ID NO: 3304811 - protein, 11 aa, Plasmodium falciparum
DKGTGKQNQIT

SEQ ID NO: 3304812 - protein, 5 aa, Plasmodium falciparum
DKGTY

SEQ ID NO: 3304813 - protein, 5 aa, Plasmodium falciparum
DKGYS

SEQ ID NO: 3304814 - protein, 7 aa, Plasmodium falciparum
DKGYSTK

SEQ ID NO: 3304815 - protein, 28 aa, Plasmodium falciparum
DKHANKKLNEEKKKENKNNNQANKSEQI

SEQ ID NO: 3304816 - protein, 8 aa, Plasmodium falciparum
DKHIGDDD

SEQ ID NO: 3304817 - protein, 7 aa, Plasmodium falciparum
DKHKNKM

SEQ ID NO: 3304818 - protein, 10 aa, Plasmodium falciparum
DKHKPSTSNL

SEQ ID NO: 3304819 - protein, 11 aa, Plasmodium falciparum
DKHNDNSNNNI

SEQ ID NO: 3304820 - protein, 7 aa, Plasmodium falciparum
DKHNDTN

SEQ ID NO: 3304821 - protein, 6 aa, Plasmodium falciparum
DKHNLD

SEQ ID NO: 3304822 - protein, 19 aa, Plasmodium falciparum
DKHNNDNNNNNDSSSSNKC

SEQ ID NO: 3304823 - protein, 22 aa, Plasmodium falciparum
DKHNNNDNNNDNDNICNSSNNN

SEQ ID NO: 3304824 - protein, 15 aa, Plasmodium falciparum
DKHNTNNNNNNNNNM

SEQ ID NO: 3304825 - protein, 4 aa, Plasmodium falciparum
DKHT

SEQ ID NO: 3304826 - protein, 6 aa, Plasmodium falciparum
DKIDTN

SEQ ID NO: 3304827 - protein, 11 aa, Plasmodium falciparum
DKIEKNENNKY

SEQ ID NO: 3304828 - protein, 11 aa, Plasmodium falciparum
DKIENKKNNYN

SEQ ID NO: 3304829 - protein, 14 aa, Plasmodium falciparum
DKIGDKINDETNDK

SEQ ID NO: 3304830 - protein, 8 aa, Plasmodium falciparum
DKIGKEDI

SEQ ID NO: 3304831 - protein, 4 aa, Plasmodium falciparum
DKIK

SEQ ID NO: 3304832 - protein, 11 aa, Plasmodium falciparum
DKIKEEDDHEI

SEQ ID NO: 3304833 - protein, 6 aa, Plasmodium falciparum
DKIKGI

SEQ ID NO: 3304834 - protein, 6 aa, Plasmodium falciparum
DKIKNT

SEQ ID NO: 3304835 - protein, 24 aa, Plasmodium falciparum
DKIKRKTKQLKEDQKKKENEKKDF

SEQ ID NO: 3304836 - protein, 6 aa, Plasmodium falciparum
DKIKRS

SEQ ID NO: 3304837 - protein, 4 aa, Plasmodium falciparum
DKIN

SEQ ID NO: 3304838 - protein, 5 aa, Plasmodium falciparum
DKINE

SEQ ID NO: 3304839 - protein, 10 aa, Plasmodium falciparum
DKINNSINDN

SEQ ID NO: 3304840 - protein, 11 aa, Plasmodium falciparum
DKINSKGNGAI

SEQ ID NO: 3304841 - protein, 4 aa, Plasmodium falciparum
DKIP

SEQ ID NO: 3304842 - protein, 17 aa, Plasmodium falciparum
DKIPNTHKEDYKNNRYV

SEQ ID NO: 3304843 - protein, 17 aa, Plasmodium falciparum
DKIQQNKISSKNDTFNE

SEQ ID NO: 3304844 - protein, 7 aa, Plasmodium falciparum
DKISEEE

SEQ ID NO: 3304845 - protein, 6 aa, Plasmodium falciparum
DKISEQ

SEQ ID NO: 3304846 - protein, 5 aa, Plasmodium falciparum
DKISI

SEQ ID NO: 3304847 - protein, 7 aa, Plasmodium falciparum
DKISNKV

SEQ ID NO: 3304848 - protein, 35 aa, Plasmodium falciparum
DKISSGDADKYSKMDDDKDVNDSIHEANDDNNKMN

SEQ ID NO: 3304849 - protein, 13 aa, Plasmodium falciparum
DKKDEKKKNKDDF

SEQ ID NO: 3304850 - protein, 29 aa, Plasmodium falciparum
DKKDEKMQNLNNEKTKERCDKNKNENNIY

SEQ ID NO: 3304851 - protein, 74 aa, Plasmodium falciparum
DKKDERNKNHKDDENDENGENEKNDKNEKNDKNDKNYKNEKNEKNNDKNDKNNVGNNSKMNVSQSKNKRNINEE

SEQ ID NO: 3304852 - protein, 6 aa, Plasmodium falciparum
DKKDGY

SEQ ID NO: 3304853 - protein, 32 aa, Plasmodium falciparum
DKKDKKKKENIKEKNEETGKNKSSRSSSNSSL

SEQ ID NO: 3304854 - protein, 9 aa, Plasmodium falciparum
DKKDNDKIV

SEQ ID NO: 3304855 - protein, 8 aa, Plasmodium falciparum
DKKDNNNN

SEQ ID NO: 3304856 - protein, 7 aa, Plasmodium falciparum
DKKDPPI

SEQ ID NO: 3304857 - protein, 8 aa, Plasmodium falciparum
DKKDQTTN

SEQ ID NO: 3304858 - protein, 4 aa, Plasmodium falciparum
DKKE

SEQ ID NO: 3304859 - protein, 7 aa, Plasmodium falciparum
DKKEDIK

SEQ ID NO: 3304860 - protein, 60 aa, Plasmodium falciparum
DKKEEKKKKKQNSKMNNKNEDESSNKKDNDINNKEHVNNDNSNNNNDDVSLKDDKHDKYE

SEQ ID NO: 3304861 - protein, 10 aa, Plasmodium falciparum
DKKEKEDITK

SEQ ID NO: 3304862 - protein, 29 aa, Plasmodium falciparum
DKKEKKEKLKKKEKDGEKNKKKKYSEEEK

SEQ ID NO: 3304863 - protein, 14 aa, Plasmodium falciparum
DKKEKKYISKKEED

SEQ ID NO: 3304864 - protein, 6 aa, Plasmodium falciparum
DKKENN

SEQ ID NO: 3304865 - protein, 9 aa, Plasmodium falciparum
DKKENNKLD

SEQ ID NO: 3304866 - protein, 15 aa, Plasmodium falciparum
DKKEPSNKENTSNIR

SEQ ID NO: 3304867 - protein, 11 aa, Plasmodium falciparum
DKKESKNIKSR

SEQ ID NO: 3304868 - protein, 8 aa, Plasmodium falciparum
DKKEYNYD

SEQ ID NO: 3304869 - protein, 122 aa, Plasmodium falciparum
DKKGDIDNEKFGHNKKEDGDNKKEDGDNKKEDGDNKKEDGDNKKEDGDNKKEDGDNEKNGDNEKNGDNKKNGDNEKYDDNKKNGDNKKNGDNNNSNNNNNMNANPYKNRNNIYNNNNKEDIS

SEQ ID NO: 3304870 - protein, 7 aa, Plasmodium falciparum
DKKGEKC

SEQ ID NO: 3304871 - protein, 7 aa, Plasmodium falciparum
DKKGIHY

SEQ ID NO: 3304872 - protein, 7 aa, Plasmodium falciparum
DKKIKPN

SEQ ID NO: 3304873 - protein, 5 aa, Plasmodium falciparum
DKKIS

SEQ ID NO: 3304874 - protein, 7 aa, Plasmodium falciparum
DKKITNE

SEQ ID NO: 3304875 - protein, 15 aa, Plasmodium falciparum
DKKKDQFDRPTYRKK

SEQ ID NO: 3304876 - protein, 9 aa, Plasmodium falciparum
DKKKEEENK

SEQ ID NO: 3304877 - protein, 9 aa, Plasmodium falciparum
DKKKEINKT

SEQ ID NO: 3304878 - protein, 6 aa, Plasmodium falciparum
DKKKEK

SEQ ID NO: 3304879 - protein, 15 aa, Plasmodium falciparum
DKKKEKKAKKLAEKE

SEQ ID NO: 3304880 - protein, 9 aa, Plasmodium falciparum
DKKKEKTKN

SEQ ID NO: 3304881 - protein, 13 aa, Plasmodium falciparum
DKKKGSESDNNAL

SEQ ID NO: 3304882 - protein, 7 aa, Plasmodium falciparum
DKKKHKK

SEQ ID NO: 3304883 - protein, 8 aa, Plasmodium falciparum
DKKKKDKL

SEQ ID NO: 3304884 - protein, 6 aa, Plasmodium falciparum
DKKKKF

SEQ ID NO: 3304885 - protein, 14 aa, Plasmodium falciparum
DKKKKGDESIKNYE

SEQ ID NO: 3304886 - protein, 7 aa, Plasmodium falciparum
DKKKKKK

SEQ ID NO: 3304887 - protein, 11 aa, Plasmodium falciparum
DKKKKKKGFYQ

SEQ ID NO: 3304888 - protein, 21 aa, Plasmodium falciparum
DKKKKKKKQTNQKNGSGKEIE

SEQ ID NO: 3304889 - protein, 12 aa, Plasmodium falciparum
DKKKKKKQKEEG

SEQ ID NO: 3304890 - protein, 12 aa, Plasmodium falciparum
DKKKKKKSKGMK

SEQ ID NO: 3304891 - protein, 33 aa, Plasmodium falciparum
DKKKKKNKDNNLNNGDSNNTHNKNNNTYDNNTH

SEQ ID NO: 3304892 - protein, 7 aa, Plasmodium falciparum
DKKKKQQ

SEQ ID NO: 3304893 - protein, 11 aa, Plasmodium falciparum
DKKKKTKYEPV

SEQ ID NO: 3304894 - protein, 10 aa, Plasmodium falciparum
DKKKNDSNFL

SEQ ID NO: 3304895 - protein, 6 aa, Plasmodium falciparum
DKKKNE

SEQ ID NO: 3304896 - protein, 11 aa, Plasmodium falciparum
DKKKNKNTQPQ

SEQ ID NO: 3304897 - protein, 27 aa, Plasmodium falciparum
DKKKNNNIENNNETNDTYINKDNKEYE

SEQ ID NO: 3304898 - protein, 28 aa, Plasmodium falciparum
DKKKNNNNNNNNTSKNNMNNITSNNKSL

SEQ ID NO: 3304899 - protein, 13 aa, Plasmodium falciparum
DKKKNNNSNNYSH

SEQ ID NO: 3304900 - protein, 10 aa, Plasmodium falciparum
DKKKQSKSTL

SEQ ID NO: 3304901 - protein, 9 aa, Plasmodium falciparum
DKKKSGLNN

SEQ ID NO: 3304902 - protein, 10 aa, Plasmodium falciparum
DKKKTSVTNV

SEQ ID NO: 3304903 - protein, 7 aa, Plasmodium falciparum
DKKLNDD

SEQ ID NO: 3304904 - protein, 14 aa, Plasmodium falciparum
DKKLREKPLDPEEN

SEQ ID NO: 3304905 - protein, 10 aa, Plasmodium falciparum
DKKNDKDKVQ

SEQ ID NO: 3304906 - protein, 6 aa, Plasmodium falciparum
DKKNED

SEQ ID NO: 3304907 - protein, 6 aa, Plasmodium falciparum
DKKNEN

SEQ ID NO: 3304908 - protein, 8 aa, Plasmodium falciparum
DKKNEYHD

SEQ ID NO: 3304909 - protein, 7 aa, Plasmodium falciparum
DKKNFYG

SEQ ID NO: 3304910 - protein, 8 aa, Plasmodium falciparum
DKKNIENN

SEQ ID NO: 3304911 - protein, 7 aa, Plasmodium falciparum
DKKNKKS

SEQ ID NO: 3304912 - protein, 10 aa, Plasmodium falciparum
DKKNKNNDED

SEQ ID NO: 3304913 - protein, 5 aa, Plasmodium falciparum
DKKNN

SEQ ID NO: 3304914 - protein, 8 aa, Plasmodium falciparum
DKKNPNFN

SEQ ID NO: 3304915 - protein, 7 aa, Plasmodium falciparum
DKKNQRL

SEQ ID NO: 3304916 - protein, 16 aa, Plasmodium falciparum
DKKNRIVDSTKNDNDI

SEQ ID NO: 3304917 - protein, 10 aa, Plasmodium falciparum
DKKNSKNINQ

SEQ ID NO: 3304918 - protein, 8 aa, Plasmodium falciparum
DKKNSRNE

SEQ ID NO: 3304919 - protein, 7 aa, Plasmodium falciparum
DKKNTKN

SEQ ID NO: 3304920 - protein, 9 aa, Plasmodium falciparum
DKKNYDDIE

SEQ ID NO: 3304921 - protein, 8 aa, Plasmodium falciparum
DKKPEKDD

SEQ ID NO: 3304922 - protein, 6 aa, Plasmodium falciparum
DKKPIT

SEQ ID NO: 3304923 - protein, 7 aa, Plasmodium falciparum
DKKQEER

SEQ ID NO: 3304924 - protein, 21 aa, Plasmodium falciparum
DKKQGGSKLNEKKGSKVTELT

SEQ ID NO: 3304925 - protein, 27 aa, Plasmodium falciparum
DKKQVKGSDENNNNDDDDNNNNNDNVI

SEQ ID NO: 3304926 - protein, 11 aa, Plasmodium falciparum
DKKREDDDQYN

SEQ ID NO: 3304927 - protein, 7 aa, Plasmodium falciparum
DKKREND

SEQ ID NO: 3304928 - protein, 7 aa, Plasmodium falciparum
DKKRGVN

SEQ ID NO: 3304929 - protein, 6 aa, Plasmodium falciparum
DKKRID

SEQ ID NO: 3304930 - protein, 7 aa, Plasmodium falciparum
DKKRVAT

SEQ ID NO: 3304931 - protein, 5 aa, Plasmodium falciparum
DKKRY

SEQ ID NO: 3304932 - protein, 7 aa, Plasmodium falciparum
DKKSDYD

SEQ ID NO: 3304933 - protein, 7 aa, Plasmodium falciparum
DKKSEYN

SEQ ID NO: 3304934 - protein, 5 aa, Plasmodium falciparum
DKKSG

SEQ ID NO: 3304935 - protein, 8 aa, Plasmodium falciparum
DKKSKDLN

SEQ ID NO: 3304936 - protein, 9 aa, Plasmodium falciparum
DKKSSNNNK

SEQ ID NO: 3304937 - protein, 26 aa, Plasmodium falciparum
DKKTEEDKETKTETTNMEQKDKKHKE

SEQ ID NO: 3304938 - protein, 8 aa, Plasmodium falciparum
DKKTEKNQ

SEQ ID NO: 3304939 - protein, 15 aa, Plasmodium falciparum
DKKTKGKKEVNPKQY

SEQ ID NO: 3304940 - protein, 21 aa, Plasmodium falciparum
DKKTKMKNNNNNNKNKTVRNM

SEQ ID NO: 3304941 - protein, 6 aa, Plasmodium falciparum
DKKTKR

SEQ ID NO: 3304942 - protein, 12 aa, Plasmodium falciparum
DKKTKVKLKKKK

SEQ ID NO: 3304943 - protein, 5 aa, Plasmodium falciparum
DKKTN

SEQ ID NO: 3304944 - protein, 10 aa, Plasmodium falciparum
DKKYDQSDTV

SEQ ID NO: 3304945 - protein, 19 aa, Plasmodium falciparum
DKKYEDNNNSYLNEDDNAS

SEQ ID NO: 3304946 - protein, 8 aa, Plasmodium falciparum
DKKYEYDT

SEQ ID NO: 3304947 - protein, 6 aa, Plasmodium falciparum
DKKYNA

SEQ ID NO: 3304948 - protein, 7 aa, Plasmodium falciparum
DKKYNSE

SEQ ID NO: 3304949 - protein, 26 aa, Plasmodium falciparum
DKKYSELEKEKGEEGKNKETQEKRDN

SEQ ID NO: 3304950 - protein, 7 aa, Plasmodium falciparum
DKKYTSN

SEQ ID NO: 3304951 - protein, 11 aa, Plasmodium falciparum
DKLCEEQGQDH

SEQ ID NO: 3304952 - protein, 11 aa, Plasmodium falciparum
DKLCNNENEYN

SEQ ID NO: 3304953 - protein, 24 aa, Plasmodium falciparum
DKLEETQEKKMEDVAQKDEQQIDN

SEQ ID NO: 3304954 - protein, 9 aa, Plasmodium falciparum
DKLKDKDKK

SEQ ID NO: 3304955 - protein, 9 aa, Plasmodium falciparum
DKLKENTQK

SEQ ID NO: 3304956 - protein, 9 aa, Plasmodium falciparum
DKLKGENLE

SEQ ID NO: 3304957 - protein, 8 aa, Plasmodium falciparum
DKLKKNQH

SEQ ID NO: 3304958 - protein, 5 aa, Plasmodium falciparum
DKLKN

SEQ ID NO: 3304959 - protein, 13 aa, Plasmodium falciparum
DKLKNSHTCDNNK

SEQ ID NO: 3304960 - protein, 10 aa, Plasmodium falciparum
DKLKSKTLEH

SEQ ID NO: 3304961 - protein, 4 aa, Plasmodium falciparum
DKLN

SEQ ID NO: 3304962 - protein, 8 aa, Plasmodium falciparum
DKLNGNNN

SEQ ID NO: 3304963 - protein, 11 aa, Plasmodium falciparum
DKLNNKDEQMS

SEQ ID NO: 3304964 - protein, 6 aa, Plasmodium falciparum
DKLPSG

SEQ ID NO: 3304965 - protein, 11 aa, Plasmodium falciparum
DKLQNSEKDKY

SEQ ID NO: 3304966 - protein, 9 aa, Plasmodium falciparum
DKLSKEEKD

SEQ ID NO: 3304967 - protein, 18 aa, Plasmodium falciparum
DKLSKENKNNKKNENSID

SEQ ID NO: 3304968 - protein, 14 aa, Plasmodium falciparum
DKLSKNDNKNEELE

SEQ ID NO: 3304969 - protein, 19 aa, Plasmodium falciparum
DKLSNSNVSMKKDTSSLYP

SEQ ID NO: 3304970 - protein, 10 aa, Plasmodium falciparum
DKLTTVDKER

SEQ ID NO: 3304971 - protein, 13 aa, Plasmodium falciparum
DKMASQTSQTNIK

SEQ ID NO: 3304972 - protein, 7 aa, Plasmodium falciparum
DKMDERN

SEQ ID NO: 3304973 - protein, 9 aa, Plasmodium falciparum
DKMKDTNDL

SEQ ID NO: 3304974 - protein, 5 aa, Plasmodium falciparum
DKMNP

SEQ ID NO: 3304975 - protein, 6 aa, Plasmodium falciparum
DKMPEL

SEQ ID NO: 3304976 - protein, 10 aa, Plasmodium falciparum
DKMYTKDKQK

SEQ ID NO: 3304977 - protein, 9 aa, Plasmodium falciparum
DKNARRENK

SEQ ID NO: 3304978 - protein, 11 aa, Plasmodium falciparum
DKNDDNNNNNN

SEQ ID NO: 3304979 - protein, 13 aa, Plasmodium falciparum
DKNDDTLEKMPRE

SEQ ID NO: 3304980 - protein, 5 aa, Plasmodium falciparum
DKNDE

SEQ ID NO: 3304981 - protein, 8 aa, Plasmodium falciparum
DKNDEDYT

SEQ ID NO: 3304982 - protein, 8 aa, Plasmodium falciparum
DKNDEIRK

SEQ ID NO: 3304983 - protein, 10 aa, Plasmodium falciparum
DKNDKEKNNI

SEQ ID NO: 3304984 - protein, 26 aa, Plasmodium falciparum
DKNDKTYTDEIKSNNSDHNNNNSKEH

SEQ ID NO: 3304985 - protein, 7 aa, Plasmodium falciparum
DKNDMNN

SEQ ID NO: 3304986 - protein, 11 aa, Plasmodium falciparum
DKNDNNKKNIH

SEQ ID NO: 3304987 - protein, 10 aa, Plasmodium falciparum
DKNDNTNKSD

SEQ ID NO: 3304988 - protein, 62 aa, Plasmodium falciparum
DKNDQNGENDDIRKNDENDEIRKNDENGDNDEIRKNDEIRKNDEIRKNDEDCKNSKNNNYEE

SEQ ID NO: 3304989 - protein, 8 aa, Plasmodium falciparum
DKNDRINT

SEQ ID NO: 3304990 - protein, 8 aa, Plasmodium falciparum
DKNDRNEV

SEQ ID NO: 3304991 - protein, 6 aa, Plasmodium falciparum
DKNDVK

SEQ ID NO: 3304992 - protein, 4 aa, Plasmodium falciparum
DKNE

SEQ ID NO: 3304993 - protein, 15 aa, Plasmodium falciparum
DKNEEGNNTKESTNS

SEQ ID NO: 3304994 - protein, 8 aa, Plasmodium falciparum
DKNEENEI

SEQ ID NO: 3304995 - protein, 17 aa, Plasmodium falciparum
DKNEEQKENPDNKNNPL

SEQ ID NO: 3304996 - protein, 8 aa, Plasmodium falciparum
DKNEEQNN

SEQ ID NO: 3304997 - protein, 6 aa, Plasmodium falciparum
DKNEFE

SEQ ID NO: 3304998 - protein, 8 aa, Plasmodium falciparum
DKNEHINK

SEQ ID NO: 3304999 - protein, 17 aa, Plasmodium falciparum
DKNEKSNFNNDKNADEN

SEQ ID NO: 3305000 - protein, 16 aa, Plasmodium falciparum
DKNEKSTLHTDPNDRT

SEQ ID NO: 3305001 - protein, 6 aa, Plasmodium falciparum
DKNEND

SEQ ID NO: 3305002 - protein, 10 aa, Plasmodium falciparum
DKNENEGNSH

SEQ ID NO: 3305003 - protein, 7 aa, Plasmodium falciparum
DKNENKK

SEQ ID NO: 3305004 - protein, 21 aa, Plasmodium falciparum
DKNENNNNNNNNNNNNNDNNN

SEQ ID NO: 3305005 - protein, 8 aa, Plasmodium falciparum
DKNENSDI

SEQ ID NO: 3305006 - protein, 6 aa, Plasmodium falciparum
DKNENT

SEQ ID NO: 3305007 - protein, 9 aa, Plasmodium falciparum
DKNESNKEL

SEQ ID NO: 3305008 - protein, 9 aa, Plasmodium falciparum
DKNEYNNND

SEQ ID NO: 3305009 - protein, 6 aa, Plasmodium falciparum
DKNEYS

SEQ ID NO: 3305010 - protein, 4 aa, Plasmodium falciparum
DKNG

SEQ ID NO: 3305011 - protein, 9 aa, Plasmodium falciparum
DKNGDGQLD

SEQ ID NO: 3305012 - protein, 10 aa, Plasmodium falciparum
DKNGDGQLDK

SEQ ID NO: 3305013 - protein, 31 aa, Plasmodium falciparum
DKNGDIIKNNNNNNNNHNHNNHNNNNHINNH

SEQ ID NO: 3305014 - protein, 31 aa, Plasmodium falciparum
DKNGNNDDNNNDDDDNNDDDNNNNDDNNNDN

SEQ ID NO: 3305015 - protein, 28 aa, Plasmodium falciparum
DKNGRYNDDTEYKECEPRESNTLSSYNN

SEQ ID NO: 3305016 - protein, 15 aa, Plasmodium falciparum
DKNGSDKDSGNNDIH

SEQ ID NO: 3305017 - protein, 9 aa, Plasmodium falciparum
DKNGTKNYP

SEQ ID NO: 3305018 - protein, 50 aa, Plasmodium falciparum
DKNGTNEKNNMHNNNNNNNNNNNSNNNNNNNNNNNNNNNNNNNNNGDGSL

SEQ ID NO: 3305019 - protein, 9 aa, Plasmodium falciparum
DKNGTYNIN

SEQ ID NO: 3305020 - protein, 12 aa, Plasmodium falciparum
DKNGYPQSDDKE

SEQ ID NO: 3305021 - protein, 4 aa, Plasmodium falciparum
DKNI

SEQ ID NO: 3305022 - protein, 7 aa, Plasmodium falciparum
DKNIEKS

SEQ ID NO: 3305023 - protein, 16 aa, Plasmodium falciparum
DKNIHNNNNNNNNNIK

SEQ ID NO: 3305024 - protein, 5 aa, Plasmodium falciparum
DKNIN

SEQ ID NO: 3305025 - protein, 6 aa, Plasmodium falciparum
DKNIQG

SEQ ID NO: 3305026 - protein, 16 aa, Plasmodium falciparum
DKNIQMNNNNNNNNNN

SEQ ID NO: 3305027 - protein, 5 aa, Plasmodium falciparum
DKNIR

SEQ ID NO: 3305028 - protein, 22 aa, Plasmodium falciparum
DKNITGEDKNITGEDKNITGDD

SEQ ID NO: 3305029 - protein, 6 aa, Plasmodium falciparum
DKNIYG

SEQ ID NO: 3305030 - protein, 23 aa, Plasmodium falciparum
DKNKDKKGKISNYDKYNNNNNNI

SEQ ID NO: 3305031 - protein, 7 aa, Plasmodium falciparum
DKNKEDA

SEQ ID NO: 3305032 - protein, 7 aa, Plasmodium falciparum
DKNKEKK

SEQ ID NO: 3305033 - protein, 8 aa, Plasmodium falciparum
DKNKETNF

SEQ ID NO: 3305034 - protein, 10 aa, Plasmodium falciparum
DKNKETTKDM

SEQ ID NO: 3305035 - protein, 8 aa, Plasmodium falciparum
DKNKGTNI

SEQ ID NO: 3305036 - protein, 12 aa, Plasmodium falciparum
DKNKKKDDSVDH

SEQ ID NO: 3305037 - protein, 53 aa, Plasmodium falciparum
DKNKKKKNPSYNDNNNDNNKNNDYDKNNDYDNYNDNDNYKNISSYSNNSSNKF

SEQ ID NO: 3305038 - protein, 13 aa, Plasmodium falciparum
DKNKKKNEENKTY

SEQ ID NO: 3305039 - protein, 9 aa, Plasmodium falciparum
DKNKKKRNI

SEQ ID NO: 3305040 - protein, 8 aa, Plasmodium falciparum
DKNKKTLT

SEQ ID NO: 3305041 - protein, 13 aa, Plasmodium falciparum
DKNKKTNKHDMPQ

SEQ ID NO: 3305042 - protein, 14 aa, Plasmodium falciparum
DKNKKTQTYENDKV

SEQ ID NO: 3305043 - protein, 6 aa, Plasmodium falciparum
DKNKMK

SEQ ID NO: 3305044 - protein, 25 aa, Plasmodium falciparum
DKNKNGDNKNINKDSMKEKSYNEKL

SEQ ID NO: 3305045 - protein, 8 aa, Plasmodium falciparum
DKNKNISI

SEQ ID NO: 3305046 - protein, 8 aa, Plasmodium falciparum
DKNKNKND

SEQ ID NO: 3305047 - protein, 24 aa, Plasmodium falciparum
DKNKNKNIYNKKNGHLNKNNTHNM

SEQ ID NO: 3305048 - protein, 18 aa, Plasmodium falciparum
DKNKNNMCDKSKNNMCDK

SEQ ID NO: 3305049 - protein, 23 aa, Plasmodium falciparum
DKNKNNNNNNNINNGNVSPLSSK

SEQ ID NO: 3305050 - protein, 40 aa, Plasmodium falciparum
DKNKNNNNNNNNNNNNNNNNNNKNNNNNNSDWGDKEDIKS

SEQ ID NO: 3305051 - protein, 6 aa, Plasmodium falciparum
DKNKRN

SEQ ID NO: 3305052 - protein, 5 aa, Plasmodium falciparum
DKNKS

SEQ ID NO: 3305053 - protein, 8 aa, Plasmodium falciparum
DKNKSGYR

SEQ ID NO: 3305054 - protein, 9 aa, Plasmodium falciparum
DKNKSNDKF

SEQ ID NO: 3305055 - protein, 17 aa, Plasmodium falciparum
DKNKSRNKRSDRGKDSD

SEQ ID NO: 3305056 - protein, 44 aa, Plasmodium falciparum
DKNKSVNKKIGNDSINKNKNDNKKNVNEKINKNRNGTSNSTTKM

SEQ ID NO: 3305057 - protein, 24 aa, Plasmodium falciparum
DKNKTSSDNKRKAKVTRKTNDIKL

SEQ ID NO: 3305058 - protein, 23 aa, Plasmodium falciparum
DKNKYMNKKQTNKLNNNNNNNNN

SEQ ID NO: 3305059 - protein, 4 aa, Plasmodium falciparum
DKNL

SEQ ID NO: 3305060 - protein, 9 aa, Plasmodium falciparum
DKNLKDDNK

SEQ ID NO: 3305061 - protein, 11 aa, Plasmodium falciparum
DKNLSSDKEKN

SEQ ID NO: 3305062 - protein, 7 aa, Plasmodium falciparum
DKNLSYN

SEQ ID NO: 3305063 - protein, 4 aa, Plasmodium falciparum
DKNM

SEQ ID NO: 3305064 - protein, 6 aa, Plasmodium falciparum
DKNMND

SEQ ID NO: 3305065 - protein, 13 aa, Plasmodium falciparum
DKNNCDNKSTYYN

SEQ ID NO: 3305066 - protein, 6 aa, Plasmodium falciparum
DKNNCN

SEQ ID NO: 3305067 - protein, 5 aa, Plasmodium falciparum
DKNND

SEQ ID NO: 3305068 - protein, 6 aa, Plasmodium falciparum
DKNNDE

SEQ ID NO: 3305069 - protein, 7 aa, Plasmodium falciparum
DKNNDGK

SEQ ID NO: 3305070 - protein, 5 aa, Plasmodium falciparum
DKNNE

SEQ ID NO: 3305071 - protein, 7 aa, Plasmodium falciparum
DKNNEDI

SEQ ID NO: 3305072 - protein, 5 aa, Plasmodium falciparum
DKNNI

SEQ ID NO: 3305073 - protein, 15 aa, Plasmodium falciparum
DKNNIDDDRNNHTSQ

SEQ ID NO: 3305074 - protein, 10 aa, Plasmodium falciparum
DKNNKPQSNL

SEQ ID NO: 3305075 - protein, 27 aa, Plasmodium falciparum
DKNNKRKSNCDNTTIGHNNKRRKNEIH

SEQ ID NO: 3305076 - protein, 10 aa, Plasmodium falciparum
DKNNKSNENF

SEQ ID NO: 3305077 - protein, 12 aa, Plasmodium falciparum
DKNNKTKKKKEV

SEQ ID NO: 3305078 - protein, 22 aa, Plasmodium falciparum
DKNNLGKDNIKREDTPWPNNEN

SEQ ID NO: 3305079 - protein, 50 aa, Plasmodium falciparum
DKNNMKYSRKGSLGAKQQQQQQQQQALSTSKGKKSASQKKKKSKNATATI

SEQ ID NO: 3305080 - protein, 8 aa, Plasmodium falciparum
DKNNMNGT

SEQ ID NO: 3305081 - protein, 16 aa, Plasmodium falciparum
DKNNNEQKTREECNPY

SEQ ID NO: 3305082 - protein, 9 aa, Plasmodium falciparum
DKNNNNNNI

SEQ ID NO: 3305083 - protein, 40 aa, Plasmodium falciparum
DKNNNSENKKINSSYNDINSQGNNDNSQYNNNSSQNNISY

SEQ ID NO: 3305084 - protein, 19 aa, Plasmodium falciparum
DKNNSTGTNQENNDKNGGN

SEQ ID NO: 3305085 - protein, 22 aa, Plasmodium falciparum
DKNNYSTNKNDLNERNKRFSSK

SEQ ID NO: 3305086 - protein, 4 aa, Plasmodium falciparum
DKNP

SEQ ID NO: 3305087 - protein, 15 aa, Plasmodium falciparum
DKNPLNYSKKKKKTF

SEQ ID NO: 3305088 - protein, 6 aa, Plasmodium falciparum
DKNPPL

SEQ ID NO: 3305089 - protein, 61 aa, Plasmodium falciparum
DKNPYSKSDDNNNNNDNDNNNNSNNNNNNDNDNNNNSNNNNNDNNDNNELSGEGRLSSTGM

SEQ ID NO: 3305090 - protein, 7 aa, Plasmodium falciparum
DKNQTMQ

SEQ ID NO: 3305091 - protein, 9 aa, Plasmodium falciparum
DKNQYSDNY

SEQ ID NO: 3305092 - protein, 4 aa, Plasmodium falciparum
DKNR

SEQ ID NO: 3305093 - protein, 5 aa, Plasmodium falciparum
DKNRF

SEQ ID NO: 3305094 - protein, 8 aa, Plasmodium falciparum
DKNRNSNI

SEQ ID NO: 3305095 - protein, 6 aa, Plasmodium falciparum
DKNSDA

SEQ ID NO: 3305096 - protein, 10 aa, Plasmodium falciparum
DKNSDNNYDE

SEQ ID NO: 3305097 - protein, 27 aa, Plasmodium falciparum
DKNSGISKNMSKKNNTNEKKNTNQYTD

SEQ ID NO: 3305098 - protein, 29 aa, Plasmodium falciparum
DKNSINNDDTKKKKKKTLDQVGKGRVKEN

SEQ ID NO: 3305099 - protein, 21 aa, Plasmodium falciparum
DKNSKHLKKKRQRRTSTHITE

SEQ ID NO: 3305100 - protein, 6 aa, Plasmodium falciparum
DKNSNK

SEQ ID NO: 3305101 - protein, 8 aa, Plasmodium falciparum
DKNSNTFN

SEQ ID NO: 3305102 - protein, 7 aa, Plasmodium falciparum
DKNSPVS

SEQ ID NO: 3305103 - protein, 8 aa, Plasmodium falciparum
DKNSSTYK

SEQ ID NO: 3305104 - protein, 5 aa, Plasmodium falciparum
DKNSY

SEQ ID NO: 3305105 - protein, 7 aa, Plasmodium falciparum
DKNSYPK

SEQ ID NO: 3305106 - protein, 5 aa, Plasmodium falciparum
DKNTD

SEQ ID NO: 3305107 - protein, 8 aa, Plasmodium falciparum
DKNTEEIS

SEQ ID NO: 3305108 - protein, 24 aa, Plasmodium falciparum
DKNTIHKDTSNKNDNSNKTSSATS

SEQ ID NO: 3305109 - protein, 10 aa, Plasmodium falciparum
DKNTNKKNKL

SEQ ID NO: 3305110 - protein, 11 aa, Plasmodium falciparum
DKNTYDDTDPM

SEQ ID NO: 3305111 - protein, 7 aa, Plasmodium falciparum
DKNVPKI

SEQ ID NO: 3305112 - protein, 6 aa, Plasmodium falciparum
DKNVTW

SEQ ID NO: 3305113 - protein, 11 aa, Plasmodium falciparum
DKNYDTSSEQN

SEQ ID NO: 3305114 - protein, 10 aa, Plasmodium falciparum
DKNYITDENS

SEQ ID NO: 3305115 - protein, 5 aa, Plasmodium falciparum
DKNYN

SEQ ID NO: 3305116 - protein, 7 aa, Plasmodium falciparum
DKNYTLK

SEQ ID NO: 3305117 - protein, 7 aa, Plasmodium falciparum
DKPAPNH

SEQ ID NO: 3305118 - protein, 14 aa, Plasmodium falciparum
DKPEDYSSFKKKDS

SEQ ID NO: 3305119 - protein, 5 aa, Plasmodium falciparum
DKPFL

SEQ ID NO: 3305120 - protein, 7 aa, Plasmodium falciparum
DKPGSKL

SEQ ID NO: 3305121 - protein, 8 aa, Plasmodium falciparum
DKPHKSSI

SEQ ID NO: 3305122 - protein, 18 aa, Plasmodium falciparum
DKPKSNKPSESKEGGNNS

SEQ ID NO: 3305123 - protein, 8 aa, Plasmodium falciparum
DKPNENIS

SEQ ID NO: 3305124 - protein, 8 aa, Plasmodium falciparum
DKPPIDAG

SEQ ID NO: 3305125 - protein, 7 aa, Plasmodium falciparum
DKPRRGI

SEQ ID NO: 3305126 - protein, 7 aa, Plasmodium falciparum
DKPSNGS

SEQ ID NO: 3305127 - protein, 13 aa, Plasmodium falciparum
DKPSNMKKKEEIE

SEQ ID NO: 3305128 - protein, 28 aa, Plasmodium falciparum
DKPVAPSGVSSLGEKKSKDEKKNRKKYN

SEQ ID NO: 3305129 - protein, 7 aa, Plasmodium falciparum
DKQAHAD

SEQ ID NO: 3305130 - protein, 14 aa, Plasmodium falciparum
DKQAYKDKKYEKYK

SEQ ID NO: 3305131 - protein, 5 aa, Plasmodium falciparum
DKQED

SEQ ID NO: 3305132 - protein, 5 aa, Plasmodium falciparum
DKQGK

SEQ ID NO: 3305133 - protein, 7 aa, Plasmodium falciparum
DKQINNN

SEQ ID NO: 3305134 - protein, 10 aa, Plasmodium falciparum
DKQKKWTKDE

SEQ ID NO: 3305135 - protein, 14 aa, Plasmodium falciparum
DKQLNEKKECQTDL

SEQ ID NO: 3305136 - protein, 4 aa, Plasmodium falciparum
DKQN

SEQ ID NO: 3305137 - protein, 13 aa, Plasmodium falciparum
DKQNDKCITSSYD

SEQ ID NO: 3305138 - protein, 34 aa, Plasmodium falciparum
DKQNDQKVKEDGQTIKNQTTANNVQKKRNKNYVK

SEQ ID NO: 3305139 - protein, 10 aa, Plasmodium falciparum
DKQNKDCHNY

SEQ ID NO: 3305140 - protein, 54 aa, Plasmodium falciparum
DKQPSDNNHNKNNYRDNNRNKNNYRDNNRNKNNYRDKNHNSNNNKNNNKNKNNN

SEQ ID NO: 3305141 - protein, 49 aa, Plasmodium falciparum
DKQQEQRNKNEENEENKENNNKKYSNSNNNNNKNNNYYNHSSNEIKNES

SEQ ID NO: 3305142 - protein, 7 aa, Plasmodium falciparum
DKQQLSA

SEQ ID NO: 3305143 - protein, 17 aa, Plasmodium falciparum
DKQSELYNDKSSDATIY

SEQ ID NO: 3305144 - protein, 8 aa, Plasmodium falciparum
DKQSRQST

SEQ ID NO: 3305145 - protein, 10 aa, Plasmodium falciparum
DKQVAQQESE

SEQ ID NO: 3305146 - protein, 7 aa, Plasmodium falciparum
DKQYNNK

SEQ ID NO: 3305147 - protein, 14 aa, Plasmodium falciparum
DKQYYDENNRNSSN

SEQ ID NO: 3305148 - protein, 13 aa, Plasmodium falciparum
DKREEDTEQNYHN

SEQ ID NO: 3305149 - protein, 5 aa, Plasmodium falciparum
DKREN

SEQ ID NO: 3305150 - protein, 8 aa, Plasmodium falciparum
DKRESSSS

SEQ ID NO: 3305151 - protein, 6 aa, Plasmodium falciparum
DKRGNF

SEQ ID NO: 3305152 - protein, 8 aa, Plasmodium falciparum
DKRHEQNY

SEQ ID NO: 3305153 - protein, 8 aa, Plasmodium falciparum
DKRKEKEY

SEQ ID NO: 3305154 - protein, 9 aa, Plasmodium falciparum
DKRKTRGFS

SEQ ID NO: 3305155 - protein, 4 aa, Plasmodium falciparum
DKRN

SEQ ID NO: 3305156 - protein, 7 aa, Plasmodium falciparum
DKRNEIK

SEQ ID NO: 3305157 - protein, 10 aa, Plasmodium falciparum
DKRNNKTKGY

SEQ ID NO: 3305158 - protein, 46 aa, Plasmodium falciparum
DKRNPKNNINKSNINYNDNKYKSTHKMNNNYNNDDDDNNNDYNDDA

SEQ ID NO: 3305159 - protein, 5 aa, Plasmodium falciparum
DKRQE

SEQ ID NO: 3305160 - protein, 13 aa, Plasmodium falciparum
DKRREEFDDQNIN

SEQ ID NO: 3305161 - protein, 35 aa, Plasmodium falciparum
DKRRNNINRKRRSYSYSSSSSLNEEKKKKKKKRSN

SEQ ID NO: 3305162 - protein, 14 aa, Plasmodium falciparum
DKRRYEKNEEDEGN

SEQ ID NO: 3305163 - protein, 4 aa, Plasmodium falciparum
DKRS

SEQ ID NO: 3305164 - protein, 9 aa, Plasmodium falciparum
DKRVGNEKI

SEQ ID NO: 3305165 - protein, 9 aa, Plasmodium falciparum
DKRVSLSER

SEQ ID NO: 3305166 - protein, 9 aa, Plasmodium falciparum
DKSALNKNK

SEQ ID NO: 3305167 - protein, 4 aa, Plasmodium falciparum
DKSD

SEQ ID NO: 3305168 - protein, 7 aa, Plasmodium falciparum
DKSDNVC

SEQ ID NO: 3305169 - protein, 7 aa, Plasmodium falciparum
DKSEEKL

SEQ ID NO: 3305170 - protein, 9 aa, Plasmodium falciparum
DKSEEKQNK

SEQ ID NO: 3305171 - protein, 9 aa, Plasmodium falciparum
DKSEKENFV

SEQ ID NO: 3305172 - protein, 52 aa, Plasmodium falciparum
DKSEKYERNERNEKNEKNERNEKNEKYEKNDKSEKNEKYEKNKNYEKTCGGS

SEQ ID NO: 3305173 - protein, 10 aa, Plasmodium falciparum
DKSENSTNKV

SEQ ID NO: 3305174 - protein, 10 aa, Plasmodium falciparum
DKSESKDYND

SEQ ID NO: 3305175 - protein, 8 aa, Plasmodium falciparum
DKSESKNR

SEQ ID NO: 3305176 - protein, 6 aa, Plasmodium falciparum
DKSEYN

SEQ ID NO: 3305177 - protein, 14 aa, Plasmodium falciparum
DKSFGNSNGNTTFT

SEQ ID NO: 3305178 - protein, 16 aa, Plasmodium falciparum
DKSFNSLNEKDDSTNM

SEQ ID NO: 3305179 - protein, 9 aa, Plasmodium falciparum
DKSGKITKE

SEQ ID NO: 3305180 - protein, 5 aa, Plasmodium falciparum
DKSGR

SEQ ID NO: 3305181 - protein, 6 aa, Plasmodium falciparum
DKSGYI

SEQ ID NO: 3305182 - protein, 6 aa, Plasmodium falciparum
DKSHMS

SEQ ID NO: 3305183 - protein, 13 aa, Plasmodium falciparum
DKSIKEGQKQGNV

SEQ ID NO: 3305184 - protein, 11 aa, Plasmodium falciparum
DKSINDSNGLS

SEQ ID NO: 3305185 - protein, 4 aa, Plasmodium falciparum
DKSK

SEQ ID NO: 3305186 - protein, 11 aa, Plasmodium falciparum
DKSKKTKENNV

SEQ ID NO: 3305187 - protein, 37 aa, Plasmodium falciparum
DKSKNDIISENKDTQIAPPNNSNNNNNNNCGDDDNFN

SEQ ID NO: 3305188 - protein, 8 aa, Plasmodium falciparum
DKSKNKNK

SEQ ID NO: 3305189 - protein, 63 aa, Plasmodium falciparum
DKSKQNNYNDKYNDNNYNDKYKQNNYNDKYKQNNYNDKYNDNNYNDKYKQNNYNDKYNDNNYN

SEQ ID NO: 3305190 - protein, 9 aa, Plasmodium falciparum
DKSKSTLGS

SEQ ID NO: 3305191 - protein, 10 aa, Plasmodium falciparum
DKSKVKESNV

SEQ ID NO: 3305192 - protein, 9 aa, Plasmodium falciparum
DKSLADNNK

SEQ ID NO: 3305193 - protein, 12 aa, Plasmodium falciparum
DKSLENNKKKQM

SEQ ID NO: 3305194 - protein, 8 aa, Plasmodium falciparum
DKSLETRK

SEQ ID NO: 3305195 - protein, 68 aa, Plasmodium falciparum
DKSLRDEDNKSIKEGNNNNNTNTNTDNNNNNNNNSSNISIKGDEEEHDEKSLGEDNKSVKDDESEAEK

SEQ ID NO: 3305196 - protein, 22 aa, Plasmodium falciparum
DKSNFNKKDNYNINDTNNNNYH

SEQ ID NO: 3305197 - protein, 6 aa, Plasmodium falciparum
DKSNIV

SEQ ID NO: 3305198 - protein, 10 aa, Plasmodium falciparum
DKSNKKNKVN

SEQ ID NO: 3305199 - protein, 14 aa, Plasmodium falciparum
DKSNLENDNETINE

SEQ ID NO: 3305200 - protein, 8 aa, Plasmodium falciparum
DKSNLNNE

SEQ ID NO: 3305201 - protein, 14 aa, Plasmodium falciparum
DKSNNNKKNIHNNN

SEQ ID NO: 3305202 - protein, 7 aa, Plasmodium falciparum
DKSNNSI

SEQ ID NO: 3305203 - protein, 8 aa, Plasmodium falciparum
DKSNVEEE

SEQ ID NO: 3305204 - protein, 5 aa, Plasmodium falciparum
DKSPI

SEQ ID NO: 3305205 - protein, 7 aa, Plasmodium falciparum
DKSPVNK

SEQ ID NO: 3305206 - protein, 9 aa, Plasmodium falciparum
DKSQDERER

SEQ ID NO: 3305207 - protein, 4 aa, Plasmodium falciparum
DKSS

SEQ ID NO: 3305208 - protein, 7 aa, Plasmodium falciparum
DKSSNKT

SEQ ID NO: 3305209 - protein, 9 aa, Plasmodium falciparum
DKSSNQKSF

SEQ ID NO: 3305210 - protein, 5 aa, Plasmodium falciparum
DKSSS

SEQ ID NO: 3305211 - protein, 7 aa, Plasmodium falciparum
DKSTARN

SEQ ID NO: 3305212 - protein, 20 aa, Plasmodium falciparum
DKSTEGNDEKRSSHQNGTSC

SEQ ID NO: 3305213 - protein, 8 aa, Plasmodium falciparum
DKSTIEVE

SEQ ID NO: 3305214 - protein, 17 aa, Plasmodium falciparum
DKSTLTNKTKSARLRRR

SEQ ID NO: 3305215 - protein, 12 aa, Plasmodium falciparum
DKSTNSTYQRTN

SEQ ID NO: 3305216 - protein, 7 aa, Plasmodium falciparum
DKSTYNV

SEQ ID NO: 3305217 - protein, 6 aa, Plasmodium falciparum
DKSVKL

SEQ ID NO: 3305218 - protein, 7 aa, Plasmodium falciparum
DKSVQKV

SEQ ID NO: 3305219 - protein, 18 aa, Plasmodium falciparum
DKTAKDSGRPPASDPEGR

SEQ ID NO: 3305220 - protein, 5 aa, Plasmodium falciparum
DKTDL

SEQ ID NO: 3305221 - protein, 6 aa, Plasmodium falciparum
DKTEQI

SEQ ID NO: 3305222 - protein, 22 aa, Plasmodium falciparum
DKTEQISTEPTSNNRKDNYNND

SEQ ID NO: 3305223 - protein, 8 aa, Plasmodium falciparum
DKTEQPNK

SEQ ID NO: 3305224 - protein, 6 aa, Plasmodium falciparum
DKTEYY

SEQ ID NO: 3305225 - protein, 34 aa, Plasmodium falciparum
DKTFNEEDNIKDTYNNYNSDDVEKYNASNYNSLN

SEQ ID NO: 3305226 - protein, 7 aa, Plasmodium falciparum
DKTGSIS

SEQ ID NO: 3305227 - protein, 20 aa, Plasmodium falciparum
DKTHEETNNETDDGINKKTY

SEQ ID NO: 3305228 - protein, 12 aa, Plasmodium falciparum
DKTHKNDSIQET

SEQ ID NO: 3305229 - protein, 8 aa, Plasmodium falciparum
DKTKDKKI

SEQ ID NO: 3305230 - protein, 88 aa, Plasmodium falciparum
DKTKGQKKKVTGGDDNDDSDDDEDSEDNEDNEDNDDNDDNEDNDDNDNNEDNDNNDDNDNNDDTDNNDEIQSDSYNRKGKKKNGHRNN

SEQ ID NO: 3305231 - protein, 40 aa, Plasmodium falciparum
DKTKINNRNTTYTNGNNNNNNNNIDDDKNDHGDDKNNNID

SEQ ID NO: 3305232 - protein, 21 aa, Plasmodium falciparum
DKTKKGRGRKKRRKRRRSSMG

SEQ ID NO: 3305233 - protein, 8 aa, Plasmodium falciparum
DKTKKQVK

SEQ ID NO: 3305234 - protein, 5 aa, Plasmodium falciparum
DKTKN

SEQ ID NO: 3305235 - protein, 6 aa, Plasmodium falciparum
DKTNAK

SEQ ID NO: 3305236 - protein, 7 aa, Plasmodium falciparum
DKTNATI

SEQ ID NO: 3305237 - protein, 13 aa, Plasmodium falciparum
DKTNIEDVKEKKA

SEQ ID NO: 3305238 - protein, 8 aa, Plasmodium falciparum
DKTNIQNE

SEQ ID NO: 3305239 - protein, 8 aa, Plasmodium falciparum
DKTNKNVN

SEQ ID NO: 3305240 - protein, 12 aa, Plasmodium falciparum
DKTNMKNGDITT

SEQ ID NO: 3305241 - protein, 32 aa, Plasmodium falciparum
DKTNNYQNNNQTKQNIQSNNHYNNNNNNNGNH

SEQ ID NO: 3305242 - protein, 12 aa, Plasmodium falciparum
DKTNPIQQSGKD

SEQ ID NO: 3305243 - protein, 8 aa, Plasmodium falciparum
DKTNSGHI

SEQ ID NO: 3305244 - protein, 6 aa, Plasmodium falciparum
DKTNTL

SEQ ID NO: 3305245 - protein, 29 aa, Plasmodium falciparum
DKTPMKNNIDNNSNNNNNNNDNNNNNGNT

SEQ ID NO: 3305246 - protein, 10 aa, Plasmodium falciparum
DKTPQNMNDK

SEQ ID NO: 3305247 - protein, 10 aa, Plasmodium falciparum
DKTPSGNMKD

SEQ ID NO: 3305248 - protein, 15 aa, Plasmodium falciparum
DKTSDCSTSEKTPKG

SEQ ID NO: 3305249 - protein, 8 aa, Plasmodium falciparum
DKTSFSTD

SEQ ID NO: 3305250 - protein, 7 aa, Plasmodium falciparum
DKTSMDS

SEQ ID NO: 3305251 - protein, 7 aa, Plasmodium falciparum
DKTTEEI

SEQ ID NO: 3305252 - protein, 10 aa, Plasmodium falciparum
DKVEEGDNSS

SEQ ID NO: 3305253 - protein, 4 aa, Plasmodium falciparum
DKVK

SEQ ID NO: 3305254 - protein, 23 aa, Plasmodium falciparum
DKVKKKKKKKSVQREEAADFNKG

SEQ ID NO: 3305255 - protein, 8 aa, Plasmodium falciparum
DKVKSEKV

SEQ ID NO: 3305256 - protein, 6 aa, Plasmodium falciparum
DKVKTD

SEQ ID NO: 3305257 - protein, 95 aa, Plasmodium falciparum
DKVSEKKTTFKEKNNLNGNQKKDKISNVDKQKGKTSTNDEKKKVKCDEKMKETSKEDEKQVKSDENKRKKRRKPKNKKKNLNDLEKEEKTSQVEE

SEQ ID NO: 3305258 - protein, 6 aa, Plasmodium falciparum
DKVSTH

SEQ ID NO: 3305259 - protein, 83 aa, Plasmodium falciparum
DKVVKSEKNDDDKDDDKDDDKDDDKDDDKDDDKDDNNDDNNDDNNDDNNDDNNDDNNDDNYNDDDEIYDESSNSSNSNDYEDE

SEQ ID NO: 3305260 - protein, 9 aa, Plasmodium falciparum
DKWKKKEEI

SEQ ID NO: 3305261 - protein, 17 aa, Plasmodium falciparum
DKYANKKNEIDKNQNDS

SEQ ID NO: 3305262 - protein, 5 aa, Plasmodium falciparum
DKYDD

SEQ ID NO: 3305263 - protein, 13 aa, Plasmodium falciparum
DKYDKSNDTNNKH

SEQ ID NO: 3305264 - protein, 9 aa, Plasmodium falciparum
DKYENSQQN

SEQ ID NO: 3305265 - protein, 5 aa, Plasmodium falciparum
DKYKN

SEQ ID NO: 3305266 - protein, 8 aa, Plasmodium falciparum
DKYKNPND

SEQ ID NO: 3305267 - protein, 14 aa, Plasmodium falciparum
DKYNDDKNKGSHFK

SEQ ID NO: 3305268 - protein, 25 aa, Plasmodium falciparum
DKYNDNDNDKDNDNDNDNDNDYSKD

SEQ ID NO: 3305269 - protein, 6 aa, Plasmodium falciparum
DKYNNT

SEQ ID NO: 3305270 - protein, 7 aa, Plasmodium falciparum
DKYNNTS

SEQ ID NO: 3305271 - protein, 13 aa, Plasmodium falciparum
DKYNSDRSSINDT

SEQ ID NO: 3305272 - protein, 7 aa, Plasmodium falciparum
DKYNTEE

SEQ ID NO: 3305273 - protein, 16 aa, Plasmodium falciparum
DKYNYNEENEQDREEE

SEQ ID NO: 3305274 - protein, 6 aa, Plasmodium falciparum
DKYPED

SEQ ID NO: 3305275 - protein, 7 aa, Plasmodium falciparum
DKYPEGY

SEQ ID NO: 3305276 - protein, 7 aa, Plasmodium falciparum
DKYREQI

SEQ ID NO: 3305277 - protein, 7 aa, Plasmodium falciparum
DKYRKPR

SEQ ID NO: 3305278 - protein, 13 aa, Plasmodium falciparum
DKYRNDKKRSDEL

SEQ ID NO: 3305279 - protein, 14 aa, Plasmodium falciparum
DKYSDMNKDSINGN

SEQ ID NO: 3305280 - protein, 11 aa, Plasmodium falciparum
DKYSEMNRSTT

SEQ ID NO: 3305281 - protein, 13 aa, Plasmodium falciparum
DKYSSYPKVPTEN

SEQ ID NO: 3305282 - protein, 11 aa, Plasmodium falciparum
DKYTNTNNNSI

SEQ ID NO: 3305283 - protein, 7 aa, Plasmodium falciparum
DKYYNND

SEQ ID NO: 3305284 - protein, 6 aa, Plasmodium falciparum
DLAEES

SEQ ID NO: 3305285 - protein, 4 aa, Plasmodium falciparum
DLAS

SEQ ID NO: 3305286 - protein, 17 aa, Plasmodium falciparum
DLASSVNDSIENENKKT

SEQ ID NO: 3305287 - protein, 6 aa, Plasmodium falciparum
DLDEGK

SEQ ID NO: 3305288 - protein, 19 aa, Plasmodium falciparum
DLDEREESLNNDKAQMEES

SEQ ID NO: 3305289 - protein, 13 aa, Plasmodium falciparum
DLDNSSDSSYSNK

SEQ ID NO: 3305290 - protein, 18 aa, Plasmodium falciparum
DLDNTKQELSEKEKTSLE

SEQ ID NO: 3305291 - protein, 8 aa, Plasmodium falciparum
DLEEPKSD

SEQ ID NO: 3305292 - protein, 10 aa, Plasmodium falciparum
DLEKKKSENI

SEQ ID NO: 3305293 - protein, 11 aa, Plasmodium falciparum
DLENENNNEEL

SEQ ID NO: 3305294 - protein, 11 aa, Plasmodium falciparum
DLENKKNKPPF

SEQ ID NO: 3305295 - protein, 5 aa, Plasmodium falciparum
DLENS

SEQ ID NO: 3305296 - protein, 13 aa, Plasmodium falciparum
DLEREQKNDKEKI

SEQ ID NO: 3305297 - protein, 19 aa, Plasmodium falciparum
DLGEKTKNHQTNYSNNPKF

SEQ ID NO: 3305298 - protein, 4 aa, Plasmodium falciparum
DLGG

SEQ ID NO: 3305299 - protein, 7 aa, Plasmodium falciparum
DLGNGEH

SEQ ID NO: 3305300 - protein, 9 aa, Plasmodium falciparum
DLIEGGEKK

SEQ ID NO: 3305301 - protein, 15 aa, Plasmodium falciparum
DLKDNKKNISEKNVE

SEQ ID NO: 3305302 - protein, 6 aa, Plasmodium falciparum
DLKEGK

SEQ ID NO: 3305303 - protein, 9 aa, Plasmodium falciparum
DLKENIRDQ

SEQ ID NO: 3305304 - protein, 6 aa, Plasmodium falciparum
DLKENK

SEQ ID NO: 3305305 - protein, 81 aa, Plasmodium falciparum
DLKENNSHSKEKDHHDNNKKNKKNKNKNNKKETGNNNNNNNNNKSNSSSSSNNNSNNSNSSSSSSVQDTSFNNKSKNVEKV

SEQ ID NO: 3305306 - protein, 6 aa, Plasmodium falciparum
DLKEQK

SEQ ID NO: 3305307 - protein, 9 aa, Plasmodium falciparum
DLKGHEKKD

SEQ ID NO: 3305308 - protein, 6 aa, Plasmodium falciparum
DLKKSE

SEQ ID NO: 3305309 - protein, 17 aa, Plasmodium falciparum
DLKNSDGKKGKKKANSV

SEQ ID NO: 3305310 - protein, 8 aa, Plasmodium falciparum
DLKQSTSH

SEQ ID NO: 3305311 - protein, 15 aa, Plasmodium falciparum
DLKRDRSENTTGSES

SEQ ID NO: 3305312 - protein, 5 aa, Plasmodium falciparum
DLKSD

SEQ ID NO: 3305313 - protein, 16 aa, Plasmodium falciparum
DLKYNNQTNNSDDFPT

SEQ ID NO: 3305314 - protein, 40 aa, Plasmodium falciparum
DLMNDKNEKPLNNGDKEDPLNNNESNNMDKNKNDEEGSSC

SEQ ID NO: 3305315 - protein, 4 aa, Plasmodium falciparum
DLND

SEQ ID NO: 3305316 - protein, 6 aa, Plasmodium falciparum
DLNEEE

SEQ ID NO: 3305317 - protein, 10 aa, Plasmodium falciparum
DLNKEKGNTY

SEQ ID NO: 3305318 - protein, 10 aa, Plasmodium falciparum
DLNKNNTGKN

SEQ ID NO: 3305319 - protein, 25 aa, Plasmodium falciparum
DLNKSEEKKDIQENSYNNNNNNNEY

SEQ ID NO: 3305320 - protein, 4 aa, Plasmodium falciparum
DLNN

SEQ ID NO: 3305321 - protein, 7 aa, Plasmodium falciparum
DLNNKDY

SEQ ID NO: 3305322 - protein, 12 aa, Plasmodium falciparum
DLNNKGENLSVP

SEQ ID NO: 3305323 - protein, 6 aa, Plasmodium falciparum
DLNNKN

SEQ ID NO: 3305324 - protein, 10 aa, Plasmodium falciparum
DLNRKENEYN

SEQ ID NO: 3305325 - protein, 17 aa, Plasmodium falciparum
DLNRKSNTSQKSDISIS

SEQ ID NO: 3305326 - protein, 8 aa, Plasmodium falciparum
DLNRNPIN

SEQ ID NO: 3305327 - protein, 4 aa, Plasmodium falciparum
DLNS

SEQ ID NO: 3305328 - protein, 13 aa, Plasmodium falciparum
DLNSSGKKKVDKK

SEQ ID NO: 3305329 - protein, 22 aa, Plasmodium falciparum
DLNSTNEKKKKKMKKNKKSYTN

SEQ ID NO: 3305330 - protein, 21 aa, Plasmodium falciparum
DLPKNKKGSRNVKDEKCNRNI

SEQ ID NO: 3305331 - protein, 16 aa, Plasmodium falciparum
DLPKNLPNTKNIKNRK

SEQ ID NO: 3305332 - protein, 6 aa, Plasmodium falciparum
DLPTSP

SEQ ID NO: 3305333 - protein, 5 aa, Plasmodium falciparum
DLQDP

SEQ ID NO: 3305334 - protein, 5 aa, Plasmodium falciparum
DLQNK

SEQ ID NO: 3305335 - protein, 6 aa, Plasmodium falciparum
DLQQYD

SEQ ID NO: 3305336 - protein, 9 aa, Plasmodium falciparum
DLQYSDKSI

SEQ ID NO: 3305337 - protein, 13 aa, Plasmodium falciparum
DLRKKSNEKNKTV

SEQ ID NO: 3305338 - protein, 8 aa, Plasmodium falciparum
DLRNQKDR

SEQ ID NO: 3305339 - protein, 6 aa, Plasmodium falciparum
DLRRNN

SEQ ID NO: 3305340 - protein, 4 aa, Plasmodium falciparum
DLRS

SEQ ID NO: 3305341 - protein, 5 aa, Plasmodium falciparum
DLSDD

SEQ ID NO: 3305342 - protein, 7 aa, Plasmodium falciparum
DLSEDMK

SEQ ID NO: 3305343 - protein, 7 aa, Plasmodium falciparum
DLSESEA

SEQ ID NO: 3305344 - protein, 6 aa, Plasmodium falciparum
DLSGGE

SEQ ID NO: 3305345 - protein, 6 aa, Plasmodium falciparum
DLSGGK

SEQ ID NO: 3305346 - protein, 7 aa, Plasmodium falciparum
DLSKEKG

SEQ ID NO: 3305347 - protein, 59 aa, Plasmodium falciparum
DLSKGKAKDIINNNDNNNDDNNNNKDNDDNNNNNNNNNNNNNNNNNYNYNHNNNQDRYN

SEQ ID NO: 3305348 - protein, 19 aa, Plasmodium falciparum
DLSKKGNDGKNKKKNKMKK

SEQ ID NO: 3305349 - protein, 7 aa, Plasmodium falciparum
DLSNDSN

SEQ ID NO: 3305350 - protein, 10 aa, Plasmodium falciparum
DLSQNNHKGT

SEQ ID NO: 3305351 - protein, 6 aa, Plasmodium falciparum
DLSTNE

SEQ ID NO: 3305352 - protein, 7 aa, Plasmodium falciparum
DLSTNNK

SEQ ID NO: 3305353 - protein, 10 aa, Plasmodium falciparum
DLTDPAPATT

SEQ ID NO: 3305354 - protein, 9 aa, Plasmodium falciparum
DLTDRNKNG

SEQ ID NO: 3305355 - protein, 5 aa, Plasmodium falciparum
DLTDS

SEQ ID NO: 3305356 - protein, 10 aa, Plasmodium falciparum
DLTKDRTKLE

SEQ ID NO: 3305357 - protein, 29 aa, Plasmodium falciparum
DLTKEKDKNKMENGEANKYEDKHNNNNIH

SEQ ID NO: 3305358 - protein, 4 aa, Plasmodium falciparum
DLTL

SEQ ID NO: 3305359 - protein, 12 aa, Plasmodium falciparum
DLYDNTDNEEEH

SEQ ID NO: 3305360 - protein, 11 aa, Plasmodium falciparum
DLYNNPNNTSF

SEQ ID NO: 3305361 - protein, 58 aa, Plasmodium falciparum
DMASEQNNNINNNNNDNNNDNNNDNNNDNNDDKNINKNNNNNNNNDNNNDNNNNNNIS

SEQ ID NO: 3305362 - protein, 15 aa, Plasmodium falciparum
DMDDRNGKYGKYDRY

SEQ ID NO: 3305363 - protein, 8 aa, Plasmodium falciparum
DMDEETKK

SEQ ID NO: 3305364 - protein, 13 aa, Plasmodium falciparum
DMDKGNKKEDDTI

SEQ ID NO: 3305365 - protein, 7 aa, Plasmodium falciparum
DMDKSTL

SEQ ID NO: 3305366 - protein, 13 aa, Plasmodium falciparum
DMDNNKNDNSIQS

SEQ ID NO: 3305367 - protein, 19 aa, Plasmodium falciparum
DMDNRNKQNNNNNNNNKMN

SEQ ID NO: 3305368 - protein, 9 aa, Plasmodium falciparum
DMEDRKNME

SEQ ID NO: 3305369 - protein, 5 aa, Plasmodium falciparum
DMHEQ

SEQ ID NO: 3305370 - protein, 11 aa, Plasmodium falciparum
DMKEEKNSTNI

SEQ ID NO: 3305371 - protein, 18 aa, Plasmodium falciparum
DMKENYKYEDNNYNSTNN

SEQ ID NO: 3305372 - protein, 28 aa, Plasmodium falciparum
DMKGNNRKKYNTEKRDNIKRNENDNEKK

SEQ ID NO: 3305373 - protein, 17 aa, Plasmodium falciparum
DMKNNGANQKKDNINMR

SEQ ID NO: 3305374 - protein, 9 aa, Plasmodium falciparum
DMNESRYTG

SEQ ID NO: 3305375 - protein, 13 aa, Plasmodium falciparum
DMNGTQEHSKEEG

SEQ ID NO: 3305376 - protein, 4 aa, Plasmodium falciparum
DMNK

SEQ ID NO: 3305377 - protein, 8 aa, Plasmodium falciparum
DMNKEEDN

SEQ ID NO: 3305378 - protein, 12 aa, Plasmodium falciparum
DMNKGDTNQGDH

SEQ ID NO: 3305379 - protein, 29 aa, Plasmodium falciparum
DMNKTKSNENNNKCNEENVEKNEHSISND

SEQ ID NO: 3305380 - protein, 12 aa, Plasmodium falciparum
DMNNDTSDNTLD

SEQ ID NO: 3305381 - protein, 11 aa, Plasmodium falciparum
DMNQKKNSDIS

SEQ ID NO: 3305382 - protein, 11 aa, Plasmodium falciparum
DMNRNKKDDTL

SEQ ID NO: 3305383 - protein, 7 aa, Plasmodium falciparum
DMNSSSR

SEQ ID NO: 3305384 - protein, 5 aa, Plasmodium falciparum
DMNTP

SEQ ID NO: 3305385 - protein, 17 aa, Plasmodium falciparum
DMPGNDNDVHTSENKVE

SEQ ID NO: 3305386 - protein, 4 aa, Plasmodium falciparum
DMPN

SEQ ID NO: 3305387 - protein, 5 aa, Plasmodium falciparum
DMQDD

SEQ ID NO: 3305388 - protein, 6 aa, Plasmodium falciparum
DMQYND

SEQ ID NO: 3305389 - protein, 19 aa, Plasmodium falciparum
DMSDESKKNNQRKKDTFSS

SEQ ID NO: 3305390 - protein, 5 aa, Plasmodium falciparum
DMSDT

SEQ ID NO: 3305391 - protein, 9 aa, Plasmodium falciparum
DMSNKVEDG

SEQ ID NO: 3305392 - protein, 6 aa, Plasmodium falciparum
DMSNYS

SEQ ID NO: 3305393 - protein, 10 aa, Plasmodium falciparum
DMSSNKDKHC

SEQ ID NO: 3305394 - protein, 5 aa, Plasmodium falciparum
DMSST

SEQ ID NO: 3305395 - protein, 7 aa, Plasmodium falciparum
DMSSTYD

SEQ ID NO: 3305396 - protein, 4 aa, Plasmodium falciparum
DMTK

SEQ ID NO: 3305397 - protein, 14 aa, Plasmodium falciparum
DMTNGDKKNKMENT

SEQ ID NO: 3305398 - protein, 18 aa, Plasmodium falciparum
DMTTSKDEKSNNKKPHLR

SEQ ID NO: 3305399 - protein, 22 aa, Plasmodium falciparum
DMYEQKRDESVKNVETRREDLT

SEQ ID NO: 3305400 - protein, 18 aa, Plasmodium falciparum
DMYSEPTNKIENNDIKNG

SEQ ID NO: 3305401 - protein, 26 aa, Plasmodium falciparum
DMYSNNNNNNNIDYNKSEHSKSSITN

SEQ ID NO: 3305402 - protein, 9 aa, Plasmodium falciparum
DNAANTNEY

SEQ ID NO: 3305403 - protein, 5 aa, Plasmodium falciparum
DNADP

SEQ ID NO: 3305404 - protein, 9 aa, Plasmodium falciparum
DNADSFSSR

SEQ ID NO: 3305405 - protein, 7 aa, Plasmodium falciparum
DNAEYRQ

SEQ ID NO: 3305406 - protein, 12 aa, Plasmodium falciparum
DNAFSSSNRMTD

SEQ ID NO: 3305407 - protein, 8 aa, Plasmodium falciparum
DNAHKEAD

SEQ ID NO: 3305408 - protein, 19 aa, Plasmodium falciparum
DNAKEFDKKDEKEYGSKYE

SEQ ID NO: 3305409 - protein, 7 aa, Plasmodium falciparum
DNAKKHD

SEQ ID NO: 3305410 - protein, 7 aa, Plasmodium falciparum
DNANENK

SEQ ID NO: 3305411 - protein, 7 aa, Plasmodium falciparum
DNANRTK

SEQ ID NO: 3305412 - protein, 6 aa, Plasmodium falciparum
DNANSC

SEQ ID NO: 3305413 - protein, 6 aa, Plasmodium falciparum
DNAQKE

SEQ ID NO: 3305414 - protein, 9 aa, Plasmodium falciparum
DNASSSATD

SEQ ID NO: 3305415 - protein, 26 aa, Plasmodium falciparum
DNATEVTNMNNNNNNNNNICNNNNNN

SEQ ID NO: 3305416 - protein, 30 aa, Plasmodium falciparum
DNCEQDDKVGNLKSDKMTEQNEKCDNISNE

SEQ ID NO: 3305417 - protein, 8 aa, Plasmodium falciparum
DNCSTSGK

SEQ ID NO: 3305418 - protein, 16 aa, Plasmodium falciparum
DNDCDNYNDSNNNNVT

SEQ ID NO: 3305419 - protein, 4 aa, Plasmodium falciparum
DNDD

SEQ ID NO: 3305420 - protein, 27 aa, Plasmodium falciparum
DNDDDDDDNMSEDTDEISSKDHDNMNY

SEQ ID NO: 3305421 - protein, 36 aa, Plasmodium falciparum
DNDDDDDNNKDDKKKNKQEESEEQKANTYGDIQSNA

SEQ ID NO: 3305422 - protein, 14 aa, Plasmodium falciparum
DNDDDNLLSNNSDT

SEQ ID NO: 3305423 - protein, 9 aa, Plasmodium falciparum
DNDDGNCRK

SEQ ID NO: 3305424 - protein, 18 aa, Plasmodium falciparum
DNDDLNKNDEKNKNKEKT

SEQ ID NO: 3305425 - protein, 11 aa, Plasmodium falciparum
DNDDNNNISND

SEQ ID NO: 3305426 - protein, 11 aa, Plasmodium falciparum
DNDDSNNNNNN

SEQ ID NO: 3305427 - protein, 8 aa, Plasmodium falciparum
DNDDYDDD

SEQ ID NO: 3305428 - protein, 9 aa, Plasmodium falciparum
DNDEENLTK

SEQ ID NO: 3305429 - protein, 14 aa, Plasmodium falciparum
DNDEISDESQKNAE

SEQ ID NO: 3305430 - protein, 7 aa, Plasmodium falciparum
DNDHDKH

SEQ ID NO: 3305431 - protein, 7 aa, Plasmodium falciparum
DNDIDAE

SEQ ID NO: 3305432 - protein, 9 aa, Plasmodium falciparum
DNDIENEDK

SEQ ID NO: 3305433 - protein, 49 aa, Plasmodium falciparum
DNDIRDKYSPNKTKNNNSSLPDNKKTNKSNSYVNPTQKKDKINNSNTTV

SEQ ID NO: 3305434 - protein, 13 aa, Plasmodium falciparum
DNDITNNIQSDQI

SEQ ID NO: 3305435 - protein, 5 aa, Plasmodium falciparum
DNDIY

SEQ ID NO: 3305436 - protein, 12 aa, Plasmodium falciparum
DNDKENNNNNNM

SEQ ID NO: 3305437 - protein, 5 aa, Plasmodium falciparum
DNDKK

SEQ ID NO: 3305438 - protein, 21 aa, Plasmodium falciparum
DNDKKKKDRKKEDVKNKDNYN

SEQ ID NO: 3305439 - protein, 11 aa, Plasmodium falciparum
DNDKNKKSSYI

SEQ ID NO: 3305440 - protein, 9 aa, Plasmodium falciparum
DNDKPKYAL

SEQ ID NO: 3305441 - protein, 19 aa, Plasmodium falciparum
DNDKSKNKCDNKNYSNNNC

SEQ ID NO: 3305442 - protein, 7 aa, Plasmodium falciparum
DNDKSKY

SEQ ID NO: 3305443 - protein, 13 aa, Plasmodium falciparum
DNDKVKKKNLHSI

SEQ ID NO: 3305444 - protein, 5 aa, Plasmodium falciparum
DNDKY

SEQ ID NO: 3305445 - protein, 4 aa, Plasmodium falciparum
DNDN

SEQ ID NO: 3305446 - protein, 9 aa, Plasmodium falciparum
DNDNDNDDD

SEQ ID NO: 3305447 - protein, 25 aa, Plasmodium falciparum
DNDNDNTFKRNSSSSNLDKDKNHTL

SEQ ID NO: 3305448 - protein, 9 aa, Plasmodium falciparum
DNDNENPYF

SEQ ID NO: 3305449 - protein, 5 aa, Plasmodium falciparum
DNDNF

SEQ ID NO: 3305450 - protein, 15 aa, Plasmodium falciparum
DNDNHNHNGKVDNIN

SEQ ID NO: 3305451 - protein, 5 aa, Plasmodium falciparum
DNDNI

SEQ ID NO: 3305452 - protein, 10 aa, Plasmodium falciparum
DNDNIENNDH

SEQ ID NO: 3305453 - protein, 11 aa, Plasmodium falciparum
DNDNKKQVDNM

SEQ ID NO: 3305454 - protein, 9 aa, Plasmodium falciparum
DNDNMGNNT

SEQ ID NO: 3305455 - protein, 6 aa, Plasmodium falciparum
DNDNND

SEQ ID NO: 3305456 - protein, 30 aa, Plasmodium falciparum
DNDNSDHNDDSDDNGDSDDNGDSDYNNENI

SEQ ID NO: 3305457 - protein, 4 aa, Plasmodium falciparum
DNDP

SEQ ID NO: 3305458 - protein, 5 aa, Plasmodium falciparum
DNDQL

SEQ ID NO: 3305459 - protein, 9 aa, Plasmodium falciparum
DNDRQRSKM

SEQ ID NO: 3305460 - protein, 4 aa, Plasmodium falciparum
DNDS

SEQ ID NO: 3305461 - protein, 25 aa, Plasmodium falciparum
DNDSDSEESDDEEEKNTPNNTINSN

SEQ ID NO: 3305462 - protein, 7 aa, Plasmodium falciparum
DNDSPDH

SEQ ID NO: 3305463 - protein, 10 aa, Plasmodium falciparum
DNDSQKLRKD

SEQ ID NO: 3305464 - protein, 4 aa, Plasmodium falciparum
DNDT

SEQ ID NO: 3305465 - protein, 20 aa, Plasmodium falciparum
DNDVDNNNYIETDDDVDDNK

SEQ ID NO: 3305466 - protein, 4 aa, Plasmodium falciparum
DNDY

SEQ ID NO: 3305467 - protein, 7 aa, Plasmodium falciparum
DNDYDTK

SEQ ID NO: 3305468 - protein, 7 aa, Plasmodium falciparum
DNDYPRK

SEQ ID NO: 3305469 - protein, 5 aa, Plasmodium falciparum
DNDYQ

SEQ ID NO: 3305470 - protein, 18 aa, Plasmodium falciparum
DNDYSEKKMTSYNNNNKD

SEQ ID NO: 3305471 - protein, 8 aa, Plasmodium falciparum
DNEDFNDN

SEQ ID NO: 3305472 - protein, 5 aa, Plasmodium falciparum
DNEDK

SEQ ID NO: 3305473 - protein, 37 aa, Plasmodium falciparum
DNEDNGDITNDDNNNNDNNNNDDDNNNNNNDNIKENH

SEQ ID NO: 3305474 - protein, 7 aa, Plasmodium falciparum
DNEDNNK

SEQ ID NO: 3305475 - protein, 16 aa, Plasmodium falciparum
DNEDNNKNYVETDEQN

SEQ ID NO: 3305476 - protein, 9 aa, Plasmodium falciparum
DNEEDKKKR

SEQ ID NO: 3305477 - protein, 5 aa, Plasmodium falciparum
DNEEI

SEQ ID NO: 3305478 - protein, 7 aa, Plasmodium falciparum
DNEELNK

SEQ ID NO: 3305479 - protein, 15 aa, Plasmodium falciparum
DNEERGKNESKNVDS

SEQ ID NO: 3305480 - protein, 30 aa, Plasmodium falciparum
DNEESDNNNNNNNNNNSSTKERNNNRSSVN

SEQ ID NO: 3305481 - protein, 7 aa, Plasmodium falciparum
DNEETVK

SEQ ID NO: 3305482 - protein, 6 aa, Plasmodium falciparum
DNEGCS

SEQ ID NO: 3305483 - protein, 10 aa, Plasmodium falciparum
DNEGKNKKKI

SEQ ID NO: 3305484 - protein, 12 aa, Plasmodium falciparum
DNEHSKDKYGEN

SEQ ID NO: 3305485 - protein, 22 aa, Plasmodium falciparum
DNEINRRGKNGTNAGNNSKDKI

SEQ ID NO: 3305486 - protein, 4 aa, Plasmodium falciparum
DNEK

SEQ ID NO: 3305487 - protein, 6 aa, Plasmodium falciparum
DNEKEL

SEQ ID NO: 3305488 - protein, 5 aa, Plasmodium falciparum
DNEKK

SEQ ID NO: 3305489 - protein, 11 aa, Plasmodium falciparum
DNEKKEENTNI

SEQ ID NO: 3305490 - protein, 12 aa, Plasmodium falciparum
DNEKKKNVPPKK

SEQ ID NO: 3305491 - protein, 10 aa, Plasmodium falciparum
DNEKLNENTE

SEQ ID NO: 3305492 - protein, 5 aa, Plasmodium falciparum
DNEKS

SEQ ID NO: 3305493 - protein, 12 aa, Plasmodium falciparum
DNEKYEKENEYN

SEQ ID NO: 3305494 - protein, 51 aa, Plasmodium falciparum
DNEMAGDNQMEGDNQMEGDNQMEGDNEMEGDNEMEGDNKMEGDNKMEGDNQ

SEQ ID NO: 3305495 - protein, 6 aa, Plasmodium falciparum
DNENDA

SEQ ID NO: 3305496 - protein, 9 aa, Plasmodium falciparum
DNENGNEDI

SEQ ID NO: 3305497 - protein, 9 aa, Plasmodium falciparum
DNENGVKGL

SEQ ID NO: 3305498 - protein, 15 aa, Plasmodium falciparum
DNENKKKKKKNNGTV

SEQ ID NO: 3305499 - protein, 11 aa, Plasmodium falciparum
DNENKKNEINN

SEQ ID NO: 3305500 - protein, 10 aa, Plasmodium falciparum
DNENKQDNIN

SEQ ID NO: 3305501 - protein, 9 aa, Plasmodium falciparum
DNENNKYDG

SEQ ID NO: 3305502 - protein, 57 aa, Plasmodium falciparum
DNENNQEYDNNEDHNNNNNRRLSGNVNNENMKKRNEDEDKKRSSKASIKEKENNAHY

SEQ ID NO: 3305503 - protein, 7 aa, Plasmodium falciparum
DNENNQS

SEQ ID NO: 3305504 - protein, 11 aa, Plasmodium falciparum
DNENNTQENKT

SEQ ID NO: 3305505 - protein, 5 aa, Plasmodium falciparum
DNENQ

SEQ ID NO: 3305506 - protein, 30 aa, Plasmodium falciparum
DNENSDKKESFRTKNKSTIKRSSQIDDEDN

SEQ ID NO: 3305507 - protein, 9 aa, Plasmodium falciparum
DNENSDNMS

SEQ ID NO: 3305508 - protein, 11 aa, Plasmodium falciparum
DNENVETKNEL

SEQ ID NO: 3305509 - protein, 9 aa, Plasmodium falciparum
DNEPKDDDD

SEQ ID NO: 3305510 - protein, 6 aa, Plasmodium falciparum
DNEQEE

SEQ ID NO: 3305511 - protein, 9 aa, Plasmodium falciparum
DNEQEEENT

SEQ ID NO: 3305512 - protein, 7 aa, Plasmodium falciparum
DNEQINS

SEQ ID NO: 3305513 - protein, 13 aa, Plasmodium falciparum
DNEQKKNSTIKET

SEQ ID NO: 3305514 - protein, 4 aa, Plasmodium falciparum
DNER

SEQ ID NO: 3305515 - protein, 7 aa, Plasmodium falciparum
DNERKGV

SEQ ID NO: 3305516 - protein, 11 aa, Plasmodium falciparum
DNERKQEKKEN

SEQ ID NO: 3305517 - protein, 9 aa, Plasmodium falciparum
DNESDISNF

SEQ ID NO: 3305518 - protein, 13 aa, Plasmodium falciparum
DNESESSEESYKD

SEQ ID NO: 3305519 - protein, 7 aa, Plasmodium falciparum
DNESNEK

SEQ ID NO: 3305520 - protein, 10 aa, Plasmodium falciparum
DNESNHSDYY

SEQ ID NO: 3305521 - protein, 5 aa, Plasmodium falciparum
DNETD

SEQ ID NO: 3305522 - protein, 8 aa, Plasmodium falciparum
DNETGKSK

SEQ ID NO: 3305523 - protein, 13 aa, Plasmodium falciparum
DNETLQKKREDDE

SEQ ID NO: 3305524 - protein, 5 aa, Plasmodium falciparum
DNETS

SEQ ID NO: 3305525 - protein, 19 aa, Plasmodium falciparum
DNETTNLEDNCNEDKTNSW

SEQ ID NO: 3305526 - protein, 15 aa, Plasmodium falciparum
DNEVEDSYKDDKYNQ

SEQ ID NO: 3305527 - protein, 5 aa, Plasmodium falciparum
DNEYA

SEQ ID NO: 3305528 - protein, 9 aa, Plasmodium falciparum
DNEYNNSNF

SEQ ID NO: 3305529 - protein, 8 aa, Plasmodium falciparum
DNEYTSSV

SEQ ID NO: 3305530 - protein, 16 aa, Plasmodium falciparum
DNFDETHSYNNEDITS

SEQ ID NO: 3305531 - protein, 7 aa, Plasmodium falciparum
DNFDQKD

SEQ ID NO: 3305532 - protein, 23 aa, Plasmodium falciparum
DNFNGGKDWAKDSLKKHDSDKRE

SEQ ID NO: 3305533 - protein, 6 aa, Plasmodium falciparum
DNFPKH

SEQ ID NO: 3305534 - protein, 8 aa, Plasmodium falciparum
DNFPNEKK

SEQ ID NO: 3305535 - protein, 7 aa, Plasmodium falciparum
DNFQGTP

SEQ ID NO: 3305536 - protein, 7 aa, Plasmodium falciparum
DNFSETN

SEQ ID NO: 3305537 - protein, 4 aa, Plasmodium falciparum
DNGD

SEQ ID NO: 3305538 - protein, 26 aa, Plasmodium falciparum
DNGDKNFDDDNNFDDYDDDVDGDGEN

SEQ ID NO: 3305539 - protein, 5 aa, Plasmodium falciparum
DNGEA

SEQ ID NO: 3305540 - protein, 6 aa, Plasmodium falciparum
DNGKNC

SEQ ID NO: 3305541 - protein, 7 aa, Plasmodium falciparum
DNGMNNV

SEQ ID NO: 3305542 - protein, 23 aa, Plasmodium falciparum
DNGNTELKNGSTKNDENNKLNEA

SEQ ID NO: 3305543 - protein, 4 aa, Plasmodium falciparum
DNGS

SEQ ID NO: 3305544 - protein, 5 aa, Plasmodium falciparum
DNGSS

SEQ ID NO: 3305545 - protein, 10 aa, Plasmodium falciparum
DNGSSNDDIL

SEQ ID NO: 3305546 - protein, 4 aa, Plasmodium falciparum
DNGT

SEQ ID NO: 3305547 - protein, 35 aa, Plasmodium falciparum
DNGTCKKRKLNEGDISNDINEENNNFNRKKQRKDM

SEQ ID NO: 3305548 - protein, 4 aa, Plasmodium falciparum
DNGV

SEQ ID NO: 3305549 - protein, 5 aa, Plasmodium falciparum
DNGVK

SEQ ID NO: 3305550 - protein, 12 aa, Plasmodium falciparum
DNHALKKNKEQL

SEQ ID NO: 3305551 - protein, 5 aa, Plasmodium falciparum
DNHEK

SEQ ID NO: 3305552 - protein, 4 aa, Plasmodium falciparum
DNHF

SEQ ID NO: 3305553 - protein, 15 aa, Plasmodium falciparum
DNHIDDTQPVTNSEP

SEQ ID NO: 3305554 - protein, 8 aa, Plasmodium falciparum
DNHKKKDV

SEQ ID NO: 3305555 - protein, 9 aa, Plasmodium falciparum
DNHKRNSRN

SEQ ID NO: 3305556 - protein, 7 aa, Plasmodium falciparum
DNHKTKI

SEQ ID NO: 3305557 - protein, 9 aa, Plasmodium falciparum
DNHQKTDSV

SEQ ID NO: 3305558 - protein, 12 aa, Plasmodium falciparum
DNHRNKPKNYKQ

SEQ ID NO: 3305559 - protein, 16 aa, Plasmodium falciparum
DNHSDNHCDNHSDNHC

SEQ ID NO: 3305560 - protein, 21 aa, Plasmodium falciparum
DNHTNYGDHTSDNDEENDNKD

SEQ ID NO: 3305561 - protein, 6 aa, Plasmodium falciparum
DNIAEK

SEQ ID NO: 3305562 - protein, 15 aa, Plasmodium falciparum
DNIARKEKEIESKNS

SEQ ID NO: 3305563 - protein, 5 aa, Plasmodium falciparum
DNIAS

SEQ ID NO: 3305564 - protein, 4 aa, Plasmodium falciparum
DNID

SEQ ID NO: 3305565 - protein, 34 aa, Plasmodium falciparum
DNIDISKDKSINHNNNNNNNNNNNMNGKDQYNPI

SEQ ID NO: 3305566 - protein, 7 aa, Plasmodium falciparum
DNIDNKD

SEQ ID NO: 3305567 - protein, 9 aa, Plasmodium falciparum
DNIDNKDDI

SEQ ID NO: 3305568 - protein, 41 aa, Plasmodium falciparum
DNIDNSDDNDSDNNNGDNSDDDDDDDDNNNNNNNNNNNNNF

SEQ ID NO: 3305569 - protein, 28 aa, Plasmodium falciparum
DNIDSMNSTTNNNSKDFSCTKDNTEQPN

SEQ ID NO: 3305570 - protein, 29 aa, Plasmodium falciparum
DNIENNTKYKNKKNNNDINNSSDTLQRNK

SEQ ID NO: 3305571 - protein, 10 aa, Plasmodium falciparum
DNIHSNNNNY

SEQ ID NO: 3305572 - protein, 6 aa, Plasmodium falciparum
DNIHTN

SEQ ID NO: 3305573 - protein, 4 aa, Plasmodium falciparum
DNII

SEQ ID NO: 3305574 - protein, 4 aa, Plasmodium falciparum
DNIK

SEQ ID NO: 3305575 - protein, 17 aa, Plasmodium falciparum
DNIKDKNYIDEEDIKPN

SEQ ID NO: 3305576 - protein, 12 aa, Plasmodium falciparum
DNIKGEDNNSSI

SEQ ID NO: 3305577 - protein, 6 aa, Plasmodium falciparum
DNIKTK

SEQ ID NO: 3305578 - protein, 6 aa, Plasmodium falciparum
DNIMSP

SEQ ID NO: 3305579 - protein, 10 aa, Plasmodium falciparum
DNINDNINDN

SEQ ID NO: 3305580 - protein, 41 aa, Plasmodium falciparum
DNINDNISDSISDNISDNKNNNSHKVDKYNSNKNKLSAQNK

SEQ ID NO: 3305581 - protein, 14 aa, Plasmodium falciparum
DNINEDDKNQTIYE

SEQ ID NO: 3305582 - protein, 7 aa, Plasmodium falciparum
DNINEHE

SEQ ID NO: 3305583 - protein, 7 aa, Plasmodium falciparum
DNINEKY

SEQ ID NO: 3305584 - protein, 83 aa, Plasmodium falciparum
DNINGDNINGDNINGDNINGDNINGDNINGDNINGDNINGDNINGDNINGDNINGDNINDDNINDDNINDVNNNHNNNHNSDN

SEQ ID NO: 3305585 - protein, 12 aa, Plasmodium falciparum
DNINGEKKDENN

SEQ ID NO: 3305586 - protein, 6 aa, Plasmodium falciparum
DNINKE

SEQ ID NO: 3305587 - protein, 6 aa, Plasmodium falciparum
DNINKN

SEQ ID NO: 3305588 - protein, 6 aa, Plasmodium falciparum
DNINKQ

SEQ ID NO: 3305589 - protein, 34 aa, Plasmodium falciparum
DNINNDDNINNDDNINNDDNINNDDNINNDDDIN

SEQ ID NO: 3305590 - protein, 15 aa, Plasmodium falciparum
DNINNHDDVNGDNIN

SEQ ID NO: 3305591 - protein, 28 aa, Plasmodium falciparum
DNINNINNNNNINKNYEENRKSSYGTSI

SEQ ID NO: 3305592 - protein, 6 aa, Plasmodium falciparum
DNINNN

SEQ ID NO: 3305593 - protein, 16 aa, Plasmodium falciparum
DNINNNNNNNEKNNMN

SEQ ID NO: 3305594 - protein, 15 aa, Plasmodium falciparum
DNINNNSHMNPNNNT

SEQ ID NO: 3305595 - protein, 6 aa, Plasmodium falciparum
DNINQN

SEQ ID NO: 3305596 - protein, 7 aa, Plasmodium falciparum
DNINSDD

SEQ ID NO: 3305597 - protein, 18 aa, Plasmodium falciparum
DNINSGQNIPKEEKNNMD

SEQ ID NO: 3305598 - protein, 13 aa, Plasmodium falciparum
DNINVNDTNTINN

SEQ ID NO: 3305599 - protein, 4 aa, Plasmodium falciparum
DNIP

SEQ ID NO: 3305600 - protein, 74 aa, Plasmodium falciparum
DNIPNNKKEEQNIGEPLDDKNKEKSAELSHDNNINKKSEIKNVKDQDNDGKNKTNANDNSNNLPIDNSSNIEPE

SEQ ID NO: 3305601 - protein, 7 aa, Plasmodium falciparum
DNIPYNN

SEQ ID NO: 3305602 - protein, 9 aa, Plasmodium falciparum
DNIQNDNTI

SEQ ID NO: 3305603 - protein, 14 aa, Plasmodium falciparum
DNIQNGSNPNNIPN

SEQ ID NO: 3305604 - protein, 7 aa, Plasmodium falciparum
DNIQPTN

SEQ ID NO: 3305605 - protein, 6 aa, Plasmodium falciparum
DNIQSP

SEQ ID NO: 3305606 - protein, 5 aa, Plasmodium falciparum
DNIRD

SEQ ID NO: 3305607 - protein, 6 aa, Plasmodium falciparum
DNISAY

SEQ ID NO: 3305608 - protein, 16 aa, Plasmodium falciparum
DNISDNTSDTISDNIN

SEQ ID NO: 3305609 - protein, 6 aa, Plasmodium falciparum
DNISNE

SEQ ID NO: 3305610 - protein, 12 aa, Plasmodium falciparum
DNISNEKCDNVP

SEQ ID NO: 3305611 - protein, 19 aa, Plasmodium falciparum
DNISNENNNFGYSKNEESK

SEQ ID NO: 3305612 - protein, 16 aa, Plasmodium falciparum
DNISSNKKKDVERNTY

SEQ ID NO: 3305613 - protein, 5 aa, Plasmodium falciparum
DNITN

SEQ ID NO: 3305614 - protein, 8 aa, Plasmodium falciparum
DNITSKRK

SEQ ID NO: 3305615 - protein, 6 aa, Plasmodium falciparum
DNIYGG

SEQ ID NO: 3305616 - protein, 4 aa, Plasmodium falciparum
DNKD

SEQ ID NO: 3305617 - protein, 10 aa, Plasmodium falciparum
DNKDDTNGFN

SEQ ID NO: 3305618 - protein, 6 aa, Plasmodium falciparum
DNKDEN

SEQ ID NO: 3305619 - protein, 8 aa, Plasmodium falciparum
DNKDNTNN

SEQ ID NO: 3305620 - protein, 7 aa, Plasmodium falciparum
DNKEIKE

SEQ ID NO: 3305621 - protein, 8 aa, Plasmodium falciparum
DNKEISNN

SEQ ID NO: 3305622 - protein, 6 aa, Plasmodium falciparum
DNKEKD

SEQ ID NO: 3305623 - protein, 8 aa, Plasmodium falciparum
DNKELNKL

SEQ ID NO: 3305624 - protein, 26 aa, Plasmodium falciparum
DNKEMEKEEEKKYEETNKEPTNQMKE

SEQ ID NO: 3305625 - protein, 22 aa, Plasmodium falciparum
DNKENCNKEENNYSKSENNTYF

SEQ ID NO: 3305626 - protein, 10 aa, Plasmodium falciparum
DNKENDDLTQ

SEQ ID NO: 3305627 - protein, 9 aa, Plasmodium falciparum
DNKEQGPFN

SEQ ID NO: 3305628 - protein, 12 aa, Plasmodium falciparum
DNKERNKKLQGN

SEQ ID NO: 3305629 - protein, 47 aa, Plasmodium falciparum
DNKESNKLQEDKTELNNNTNGNNNNNNNNNSNNSNNNYNNSNNNNNN

SEQ ID NO: 3305630 - protein, 5 aa, Plasmodium falciparum
DNKEV

SEQ ID NO: 3305631 - protein, 7 aa, Plasmodium falciparum
DNKEVFG

SEQ ID NO: 3305632 - protein, 13 aa, Plasmodium falciparum
DNKGGRRYRLKKQ

SEQ ID NO: 3305633 - protein, 64 aa, Plasmodium falciparum
DNKHNNKNVHGGSTNLGTNNSTPTHNNSNTGKGKGSKNTNSNNKKINEKESMKKRQKTNSYNED

SEQ ID NO: 3305634 - protein, 4 aa, Plasmodium falciparum
DNKI

SEQ ID NO: 3305635 - protein, 18 aa, Plasmodium falciparum
DNKIDDEDKEEEEQITND

SEQ ID NO: 3305636 - protein, 7 aa, Plasmodium falciparum
DNKIDNK

SEQ ID NO: 3305637 - protein, 16 aa, Plasmodium falciparum
DNKIGDDNKIGDDNKI

SEQ ID NO: 3305638 - protein, 15 aa, Plasmodium falciparum
DNKIKQSNNYKDYTR

SEQ ID NO: 3305639 - protein, 27 aa, Plasmodium falciparum
DNKINKNNNKKKSKNKNKKEKIETCQG

SEQ ID NO: 3305640 - protein, 9 aa, Plasmodium falciparum
DNKISRENN

SEQ ID NO: 3305641 - protein, 4 aa, Plasmodium falciparum
DNKK

SEQ ID NO: 3305642 - protein, 70 aa, Plasmodium falciparum
DNKKCDDNKKCDDNKKCVDNKKCDDNKKCDDNKKCVDNKKCDDNKKCDDNKKCVDNKKCDDNKKCDDNID

SEQ ID NO: 3305643 - protein, 7 aa, Plasmodium falciparum
DNKKEKK

SEQ ID NO: 3305644 - protein, 11 aa, Plasmodium falciparum
DNKKEKNYEEY

SEQ ID NO: 3305645 - protein, 53 aa, Plasmodium falciparum
DNKKENTSNDDEKERISNADENMKDENKEAEKKKKKRKKKRKSKKSDNKENEV

SEQ ID NO: 3305646 - protein, 10 aa, Plasmodium falciparum
DNKKGECDPR

SEQ ID NO: 3305647 - protein, 27 aa, Plasmodium falciparum
DNKKGSEDYNKNEENKSKEEKTPNDDK

SEQ ID NO: 3305648 - protein, 16 aa, Plasmodium falciparum
DNKKKEASDDTRKDNI

SEQ ID NO: 3305649 - protein, 19 aa, Plasmodium falciparum
DNKKKKVEETENKVKPKVT

SEQ ID NO: 3305650 - protein, 6 aa, Plasmodium falciparum
DNKKNA

SEQ ID NO: 3305651 - protein, 20 aa, Plasmodium falciparum
DNKKNEKISGLEENEEHNNN

SEQ ID NO: 3305652 - protein, 15 aa, Plasmodium falciparum
DNKKNMKEEKEERKE

SEQ ID NO: 3305653 - protein, 8 aa, Plasmodium falciparum
DNKKNREK

SEQ ID NO: 3305654 - protein, 18 aa, Plasmodium falciparum
DNKKRNKKEKKKTIPNND

SEQ ID NO: 3305655 - protein, 8 aa, Plasmodium falciparum
DNKKTQNV

SEQ ID NO: 3305656 - protein, 24 aa, Plasmodium falciparum
DNKKYSNEKYGDMTNHSKNSFKNR

SEQ ID NO: 3305657 - protein, 24 aa, Plasmodium falciparum
DNKLEERNYNDDNNKINKNTTTNK

SEQ ID NO: 3305658 - protein, 5 aa, Plasmodium falciparum
DNKLH

SEQ ID NO: 3305659 - protein, 50 aa, Plasmodium falciparum
DNKLNSDDNKLNSDDNKLNSDDNKLNSDDNKLYSDDNKLNSDDNKLYSDD

SEQ ID NO: 3305660 - protein, 14 aa, Plasmodium falciparum
DNKMDGMKRTKNNK

SEQ ID NO: 3305661 - protein, 8 aa, Plasmodium falciparum
DNKMDQGD

SEQ ID NO: 3305662 - protein, 28 aa, Plasmodium falciparum
DNKMRSQTKSVSNNNKSVDNNNNKCVEN

SEQ ID NO: 3305663 - protein, 13 aa, Plasmodium falciparum
DNKMTDDKSKDNM

SEQ ID NO: 3305664 - protein, 8 aa, Plasmodium falciparum
DNKNDENN

SEQ ID NO: 3305665 - protein, 22 aa, Plasmodium falciparum
DNKNDLYEENEYNNNNNISDDV

SEQ ID NO: 3305666 - protein, 10 aa, Plasmodium falciparum
DNKNDNNDKN

SEQ ID NO: 3305667 - protein, 24 aa, Plasmodium falciparum
DNKNDSSYQNFDQNKDTFNNSNNY

SEQ ID NO: 3305668 - protein, 14 aa, Plasmodium falciparum
DNKNGSNEATNKIN

SEQ ID NO: 3305669 - protein, 8 aa, Plasmodium falciparum
DNKNGTSN

SEQ ID NO: 3305670 - protein, 6 aa, Plasmodium falciparum
DNKNHN

SEQ ID NO: 3305671 - protein, 13 aa, Plasmodium falciparum
DNKNKEKDKTNQN

SEQ ID NO: 3305672 - protein, 7 aa, Plasmodium falciparum
DNKNKSI

SEQ ID NO: 3305673 - protein, 6 aa, Plasmodium falciparum
DNKNTN

SEQ ID NO: 3305674 - protein, 22 aa, Plasmodium falciparum
DNKNTVDKQKTLEKKEQISSHN

SEQ ID NO: 3305675 - protein, 5 aa, Plasmodium falciparum
DNKPE

SEQ ID NO: 3305676 - protein, 5 aa, Plasmodium falciparum
DNKPG

SEQ ID NO: 3305677 - protein, 4 aa, Plasmodium falciparum
DNKQ

SEQ ID NO: 3305678 - protein, 22 aa, Plasmodium falciparum
DNKQDDNKNFNEHENVKNKNNN

SEQ ID NO: 3305679 - protein, 11 aa, Plasmodium falciparum
DNKQEENGALN

SEQ ID NO: 3305680 - protein, 9 aa, Plasmodium falciparum
DNKQENFKT

SEQ ID NO: 3305681 - protein, 12 aa, Plasmodium falciparum
DNKQEPYNNNES

SEQ ID NO: 3305682 - protein, 31 aa, Plasmodium falciparum
DNKQKNEKDEKDEKDIPNMNDNSKSKYTKKN

SEQ ID NO: 3305683 - protein, 4 aa, Plasmodium falciparum
DNKR

SEQ ID NO: 3305684 - protein, 18 aa, Plasmodium falciparum
DNKREDKQYSNDNNNIQT

SEQ ID NO: 3305685 - protein, 9 aa, Plasmodium falciparum
DNKREDNNV

SEQ ID NO: 3305686 - protein, 6 aa, Plasmodium falciparum
DNKREK

SEQ ID NO: 3305687 - protein, 25 aa, Plasmodium falciparum
DNKRNDEIEKRNHDITKEDIKNDSS

SEQ ID NO: 3305688 - protein, 10 aa, Plasmodium falciparum
DNKSEDENNI

SEQ ID NO: 3305689 - protein, 31 aa, Plasmodium falciparum
DNKSIEESSISNGSSVEDTNENKTKKEEEYT

SEQ ID NO: 3305690 - protein, 11 aa, Plasmodium falciparum
DNKSNNNENYI

SEQ ID NO: 3305691 - protein, 9 aa, Plasmodium falciparum
DNKSTESFK

SEQ ID NO: 3305692 - protein, 6 aa, Plasmodium falciparum
DNKSWS

SEQ ID NO: 3305693 - protein, 4 aa, Plasmodium falciparum
DNKT

SEQ ID NO: 3305694 - protein, 8 aa, Plasmodium falciparum
DNKTASSF

SEQ ID NO: 3305695 - protein, 10 aa, Plasmodium falciparum
DNKTEEINSY

SEQ ID NO: 3305696 - protein, 8 aa, Plasmodium falciparum
DNKTEGTT

SEQ ID NO: 3305697 - protein, 18 aa, Plasmodium falciparum
DNKTKKKINTNKNEVDDE

SEQ ID NO: 3305698 - protein, 8 aa, Plasmodium falciparum
DNKTKNNV

SEQ ID NO: 3305699 - protein, 6 aa, Plasmodium falciparum
DNKTRL

SEQ ID NO: 3305700 - protein, 9 aa, Plasmodium falciparum
DNKTSHDRY

SEQ ID NO: 3305701 - protein, 13 aa, Plasmodium falciparum
DNKTSHVHNDTTN

SEQ ID NO: 3305702 - protein, 7 aa, Plasmodium falciparum
DNKTWDK

SEQ ID NO: 3305703 - protein, 22 aa, Plasmodium falciparum
DNKYNDDIKYSDDNKYKDDIKY

SEQ ID NO: 3305704 - protein, 14 aa, Plasmodium falciparum
DNKYNNTPGEHKND

SEQ ID NO: 3305705 - protein, 4 aa, Plasmodium falciparum
DNLD

SEQ ID NO: 3305706 - protein, 26 aa, Plasmodium falciparum
DNLDDSNDTRQVTKENVNGTNYNNNV

SEQ ID NO: 3305707 - protein, 14 aa, Plasmodium falciparum
DNLDEDEDEFEDEF

SEQ ID NO: 3305708 - protein, 7 aa, Plasmodium falciparum
DNLDKRE

SEQ ID NO: 3305709 - protein, 8 aa, Plasmodium falciparum
DNLDKSNI

SEQ ID NO: 3305710 - protein, 4 aa, Plasmodium falciparum
DNLF

SEQ ID NO: 3305711 - protein, 7 aa, Plasmodium falciparum
DNLGNNS

SEQ ID NO: 3305712 - protein, 9 aa, Plasmodium falciparum
DNLGRSGGD

SEQ ID NO: 3305713 - protein, 12 aa, Plasmodium falciparum
DNLKEKNDMPDD

SEQ ID NO: 3305714 - protein, 9 aa, Plasmodium falciparum
DNLKERFDD

SEQ ID NO: 3305715 - protein, 6 aa, Plasmodium falciparum
DNLKNK

SEQ ID NO: 3305716 - protein, 6 aa, Plasmodium falciparum
DNLKNT

SEQ ID NO: 3305717 - protein, 6 aa, Plasmodium falciparum
DNLNDE

SEQ ID NO: 3305718 - protein, 28 aa, Plasmodium falciparum
DNLNDNLKDNLKDNLKDNLNDKDKYSCD

SEQ ID NO: 3305719 - protein, 8 aa, Plasmodium falciparum
DNLPNDDK

SEQ ID NO: 3305720 - protein, 49 aa, Plasmodium falciparum
DNLQYDDKNDNLQYDDKNNNLQYDDKNNNLQYDDKNKNLQYDDKNDNLQ

SEQ ID NO: 3305721 - protein, 7 aa, Plasmodium falciparum
DNLSNTR

SEQ ID NO: 3305722 - protein, 10 aa, Plasmodium falciparum
DNLTEEESNY

SEQ ID NO: 3305723 - protein, 9 aa, Plasmodium falciparum
DNLYDNKDP

SEQ ID NO: 3305724 - protein, 12 aa, Plasmodium falciparum
DNMCEETNKEED

SEQ ID NO: 3305725 - protein, 4 aa, Plasmodium falciparum
DNMD

SEQ ID NO: 3305726 - protein, 25 aa, Plasmodium falciparum
DNMDNSRCKNKHNEPYPDKSCDGDD

SEQ ID NO: 3305727 - protein, 6 aa, Plasmodium falciparum
DNMHNK

SEQ ID NO: 3305728 - protein, 21 aa, Plasmodium falciparum
DNMKEKNENHNNDENKDNISS

SEQ ID NO: 3305729 - protein, 20 aa, Plasmodium falciparum
DNMNNEELKKKAEQENTHNN

SEQ ID NO: 3305730 - protein, 22 aa, Plasmodium falciparum
DNMQNYNNSANYNYTKTPKNYN

SEQ ID NO: 3305731 - protein, 49 aa, Plasmodium falciparum
DNMRNNNMGTNNMGTNNMGTNNMGTNNMGTNNMGTNNMGTNNMGNNNMG

SEQ ID NO: 3305732 - protein, 6 aa, Plasmodium falciparum
DNMSKD

SEQ ID NO: 3305733 - protein, 7 aa, Plasmodium falciparum
DNMTEEE

SEQ ID NO: 3305734 - protein, 6 aa, Plasmodium falciparum
DNNCDK

SEQ ID NO: 3305735 - protein, 19 aa, Plasmodium falciparum
DNNDDNNIQNNVSNNVEEN

SEQ ID NO: 3305736 - protein, 21 aa, Plasmodium falciparum
DNNDDYSKNKCNKGSLKNKNI

SEQ ID NO: 3305737 - protein, 15 aa, Plasmodium falciparum
DNNDINNNNNNNNNY

SEQ ID NO: 3305738 - protein, 12 aa, Plasmodium falciparum
DNNDNDSYHNDD

SEQ ID NO: 3305739 - protein, 16 aa, Plasmodium falciparum
DNNDNINNNNNLRNRK

SEQ ID NO: 3305740 - protein, 17 aa, Plasmodium falciparum
DNNDNNNNNNKYNNYNN

SEQ ID NO: 3305741 - protein, 9 aa, Plasmodium falciparum
DNNDNNYNS

SEQ ID NO: 3305742 - protein, 7 aa, Plasmodium falciparum
DNNDSDM

SEQ ID NO: 3305743 - protein, 17 aa, Plasmodium falciparum
DNNDYYNDDDDDDDDDG

SEQ ID NO: 3305744 - protein, 10 aa, Plasmodium falciparum
DNNEGQDKKN

SEQ ID NO: 3305745 - protein, 43 aa, Plasmodium falciparum
DNNEKEEDDEGGGTKFKDNEYNDDVDDDDDYDDDDDDDEIDPN

SEQ ID NO: 3305746 - protein, 7 aa, Plasmodium falciparum
DNNENLY

SEQ ID NO: 3305747 - protein, 17 aa, Plasmodium falciparum
DNNEQVNKQDDGSTKKK

SEQ ID NO: 3305748 - protein, 9 aa, Plasmodium falciparum
DNNESTDKI

SEQ ID NO: 3305749 - protein, 9 aa, Plasmodium falciparum
DNNETQDRL

SEQ ID NO: 3305750 - protein, 9 aa, Plasmodium falciparum
DNNFNDADN

SEQ ID NO: 3305751 - protein, 33 aa, Plasmodium falciparum
DNNGDDNGDDNGDDNDDDKGDDKGDGYDDDNNY

SEQ ID NO: 3305752 - protein, 30 aa, Plasmodium falciparum
DNNGGDDDDGGDMNNSKDKKNNLKKKSKQF

SEQ ID NO: 3305753 - protein, 6 aa, Plasmodium falciparum
DNNGHH

SEQ ID NO: 3305754 - protein, 5 aa, Plasmodium falciparum
DNNGK

SEQ ID NO: 3305755 - protein, 15 aa, Plasmodium falciparum
DNNGRITSSTSRGEL

SEQ ID NO: 3305756 - protein, 9 aa, Plasmodium falciparum
DNNHGNEKM

SEQ ID NO: 3305757 - protein, 7 aa, Plasmodium falciparum
DNNHIND

SEQ ID NO: 3305758 - protein, 24 aa, Plasmodium falciparum
DNNHSNNNHSNNNHSNNNHYNNNH

SEQ ID NO: 3305759 - protein, 16 aa, Plasmodium falciparum
DNNHTDKEATDNPDAS

SEQ ID NO: 3305760 - protein, 41 aa, Plasmodium falciparum
DNNIDDDDNNNVDNADNHHGKENKYKKKNSTISHDNDKMDE

SEQ ID NO: 3305761 - protein, 16 aa, Plasmodium falciparum
DNNIGRNKYHRDKNDY

SEQ ID NO: 3305762 - protein, 8 aa, Plasmodium falciparum
DNNIIDGD

SEQ ID NO: 3305763 - protein, 12 aa, Plasmodium falciparum
DNNINEDNIGNI

SEQ ID NO: 3305764 - protein, 6 aa, Plasmodium falciparum
DNNINK

SEQ ID NO: 3305765 - protein, 7 aa, Plasmodium falciparum
DNNINNN

SEQ ID NO: 3305766 - protein, 18 aa, Plasmodium falciparum
DNNINNNNNNNNNYNNNN

SEQ ID NO: 3305767 - protein, 20 aa, Plasmodium falciparum
DNNIPNNNENSESSDDYTDD

SEQ ID NO: 3305768 - protein, 12 aa, Plasmodium falciparum
DNNISKNNSTSN

SEQ ID NO: 3305769 - protein, 14 aa, Plasmodium falciparum
DNNISNNNISDNNI

SEQ ID NO: 3305770 - protein, 4 aa, Plasmodium falciparum
DNNK

SEQ ID NO: 3305771 - protein, 10 aa, Plasmodium falciparum
DNNKDSNSNI

SEQ ID NO: 3305772 - protein, 32 aa, Plasmodium falciparum
DNNKEKCSKENQTNKGNKVKKVKSQKKLGNVQ

SEQ ID NO: 3305773 - protein, 13 aa, Plasmodium falciparum
DNNKEKKKNAKRN

SEQ ID NO: 3305774 - protein, 7 aa, Plasmodium falciparum
DNNKEND

SEQ ID NO: 3305775 - protein, 32 aa, Plasmodium falciparum
DNNKEYEKNIQHNKDKLKQNNKNIRDNSSQNL

SEQ ID NO: 3305776 - protein, 42 aa, Plasmodium falciparum
DNNKHNQNKSNIPNDSKHVSRNIGKNKNSRYSFTTTTTSNCS

SEQ ID NO: 3305777 - protein, 5 aa, Plasmodium falciparum
DNNKI

SEQ ID NO: 3305778 - protein, 5 aa, Plasmodium falciparum
DNNKK

SEQ ID NO: 3305779 - protein, 20 aa, Plasmodium falciparum
DNNKKNCDDKNNTKNNINNT

SEQ ID NO: 3305780 - protein, 11 aa, Plasmodium falciparum
DNNKKNTTKQT

SEQ ID NO: 3305781 - protein, 5 aa, Plasmodium falciparum
DNNKM

SEQ ID NO: 3305782 - protein, 112 aa, Plasmodium falciparum
DNNKNKTLKGNNQLADQNNNNNNNAATDANSNNNNNNNNNGTTNEEDDDIKRQQQDDEDQAQAQQEQQEKEEQEKQQQKQQQTNDENNGNNNNNNNNNNEESKEKVDEDPDE

SEQ ID NO: 3305783 - protein, 9 aa, Plasmodium falciparum
DNNKNNITD

SEQ ID NO: 3305784 - protein, 24 aa, Plasmodium falciparum
DNNKNNKNDDNSDDEDDDEEEDEV

SEQ ID NO: 3305785 - protein, 41 aa, Plasmodium falciparum
DNNKNNTNGSNNSNSNSSNSSNNSNSNSNSNSSNNSSSREL

SEQ ID NO: 3305786 - protein, 22 aa, Plasmodium falciparum
DNNKTNKDINETDDNNTNKQTI

SEQ ID NO: 3305787 - protein, 4 aa, Plasmodium falciparum
DNNL

SEQ ID NO: 3305788 - protein, 5 aa, Plasmodium falciparum
DNNLE

SEQ ID NO: 3305789 - protein, 8 aa, Plasmodium falciparum
DNNMNNTQ

SEQ ID NO: 3305790 - protein, 4 aa, Plasmodium falciparum
DNNN

SEQ ID NO: 3305791 - protein, 26 aa, Plasmodium falciparum
DNNNDDDADEEEEEEEDNDNNKNVQE

SEQ ID NO: 3305792 - protein, 17 aa, Plasmodium falciparum
DNNNDDVHADNNDETHI

SEQ ID NO: 3305793 - protein, 11 aa, Plasmodium falciparum
DNNNDIRNSSN

SEQ ID NO: 3305794 - protein, 7 aa, Plasmodium falciparum
DNNNDMD

SEQ ID NO: 3305795 - protein, 6 aa, Plasmodium falciparum
DNNNDN

SEQ ID NO: 3305796 - protein, 12 aa, Plasmodium falciparum
DNNNDNSNNYSL

SEQ ID NO: 3305797 - protein, 8 aa, Plasmodium falciparum
DNNNENTK

SEQ ID NO: 3305798 - protein, 6 aa, Plasmodium falciparum
DNNNHT

SEQ ID NO: 3305799 - protein, 5 aa, Plasmodium falciparum
DNNNI

SEQ ID NO: 3305800 - protein, 56 aa, Plasmodium falciparum
DNNNIDHNKRNNYHNNNNNNKNNCSSNNSSNNNSSSNNNNNNGNNSDNHNNDNGNH

SEQ ID NO: 3305801 - protein, 8 aa, Plasmodium falciparum
DNNNINNY

SEQ ID NO: 3305802 - protein, 7 aa, Plasmodium falciparum
DNNNLTK

SEQ ID NO: 3305803 - protein, 8 aa, Plasmodium falciparum
DNNNMSEM

SEQ ID NO: 3305804 - protein, 5 aa, Plasmodium falciparum
DNNNN

SEQ ID NO: 3305805 - protein, 13 aa, Plasmodium falciparum
DNNNNDDDTDKHS

SEQ ID NO: 3305806 - protein, 31 aa, Plasmodium falciparum
DNNNNDNNNNNNDNNNNDNNNNNNNNSNNNN

SEQ ID NO: 3305807 - protein, 18 aa, Plasmodium falciparum
DNNNNDNNNNNNNNNNDI

SEQ ID NO: 3305808 - protein, 29 aa, Plasmodium falciparum
DNNNNDNNNNNNNNNNNNNNNNNNKNEDI

SEQ ID NO: 3305809 - protein, 22 aa, Plasmodium falciparum
DNNNNIKDNEVNKINNENNNNN

SEQ ID NO: 3305810 - protein, 10 aa, Plasmodium falciparum
DNNNNNDNYS

SEQ ID NO: 3305811 - protein, 28 aa, Plasmodium falciparum
DNNNNNGSNNNNDGNNNNGSNNNSSSYY

SEQ ID NO: 3305812 - protein, 7 aa, Plasmodium falciparum
DNNNNNH

SEQ ID NO: 3305813 - protein, 7 aa, Plasmodium falciparum
DNNNNNK

SEQ ID NO: 3305814 - protein, 7 aa, Plasmodium falciparum
DNNNNNN

SEQ ID NO: 3305815 - protein, 60 aa, Plasmodium falciparum
DNNNNNNKNNNNNNNNNNNNNNKNNNNNNNNSNSNKQNGGDDIDKTPKQNSSYRNSQTNH

SEQ ID NO: 3305816 - protein, 8 aa, Plasmodium falciparum
DNNNNNNL

SEQ ID NO: 3305817 - protein, 10 aa, Plasmodium falciparum
DNNNNNNNCN

SEQ ID NO: 3305818 - protein, 48 aa, Plasmodium falciparum
DNNNNNNNDNNNNNNNNNNNNNNYNCNNNNYNSDVQSKEPKNVREEYS

SEQ ID NO: 3305819 - protein, 10 aa, Plasmodium falciparum
DNNNNNNNDV

SEQ ID NO: 3305820 - protein, 10 aa, Plasmodium falciparum
DNNNNNNNKI

SEQ ID NO: 3305821 - protein, 15 aa, Plasmodium falciparum
DNNNNNNNKKKNVSN

SEQ ID NO: 3305822 - protein, 9 aa, Plasmodium falciparum
DNNNNNNNN

SEQ ID NO: 3305823 - protein, 10 aa, Plasmodium falciparum
DNNNNNNNNF

SEQ ID NO: 3305824 - protein, 12 aa, Plasmodium falciparum
DNNNNNNNNINN

SEQ ID NO: 3305825 - protein, 19 aa, Plasmodium falciparum
DNNNNNNNNKHNKKKEEIK

SEQ ID NO: 3305826 - protein, 11 aa, Plasmodium falciparum
DNNNNNNNNNN

SEQ ID NO: 3305827 - protein, 26 aa, Plasmodium falciparum
DNNNNNNNNNNNINNNSNNNNSCSGD

SEQ ID NO: 3305828 - protein, 39 aa, Plasmodium falciparum
DNNNNNNNNNNNNNNNYNNNNNNYNNNNNNYNNNNNYNY

SEQ ID NO: 3305829 - protein, 55 aa, Plasmodium falciparum
DNNNNNNNNNNNNNVNNISNNGTNLEENANNANNANNPNNANNPNNANNSNNADY

SEQ ID NO: 3305830 - protein, 15 aa, Plasmodium falciparum
DNNNNNNNNRDNIDG

SEQ ID NO: 3305831 - protein, 13 aa, Plasmodium falciparum
DNNNNNNNNVNNK

SEQ ID NO: 3305832 - protein, 11 aa, Plasmodium falciparum
DNNNNNNNSSY

SEQ ID NO: 3305833 - protein, 16 aa, Plasmodium falciparum
DNNNNNNSNDTNRDNN

SEQ ID NO: 3305834 - protein, 36 aa, Plasmodium falciparum
DNNNNNPCDNNNNNPCDNNNNNPCDNNNNNNNPICS

SEQ ID NO: 3305835 - protein, 9 aa, Plasmodium falciparum
DNNNNNSNK

SEQ ID NO: 3305836 - protein, 7 aa, Plasmodium falciparum
DNNNNNV

SEQ ID NO: 3305837 - protein, 27 aa, Plasmodium falciparum
DNNNNQGNSSNNEEHSDNEDYYDNGYE

SEQ ID NO: 3305838 - protein, 19 aa, Plasmodium falciparum
DNNNNSNNNNNNNNNNNTI

SEQ ID NO: 3305839 - protein, 13 aa, Plasmodium falciparum
DNNNNSTSNSRPS

SEQ ID NO: 3305840 - protein, 8 aa, Plasmodium falciparum
DNNNNVNN

SEQ ID NO: 3305841 - protein, 7 aa, Plasmodium falciparum
DNNNSYN

SEQ ID NO: 3305842 - protein, 15 aa, Plasmodium falciparum
DNNNTEPTKRNIPKR

SEQ ID NO: 3305843 - protein, 5 aa, Plasmodium falciparum
DNNNV

SEQ ID NO: 3305844 - protein, 22 aa, Plasmodium falciparum
DNNPKRNNEMDEKNDDENNIQS

SEQ ID NO: 3305845 - protein, 8 aa, Plasmodium falciparum
DNNPNNIK

SEQ ID NO: 3305846 - protein, 5 aa, Plasmodium falciparum
DNNQE

SEQ ID NO: 3305847 - protein, 10 aa, Plasmodium falciparum
DNNQNDEEQN

SEQ ID NO: 3305848 - protein, 4 aa, Plasmodium falciparum
DNNR

SEQ ID NO: 3305849 - protein, 5 aa, Plasmodium falciparum
DNNRK

SEQ ID NO: 3305850 - protein, 18 aa, Plasmodium falciparum
DNNRQKEKNNKLGEEDLE

SEQ ID NO: 3305851 - protein, 9 aa, Plasmodium falciparum
DNNRRRVDT

SEQ ID NO: 3305852 - protein, 5 aa, Plasmodium falciparum
DNNRS

SEQ ID NO: 3305853 - protein, 15 aa, Plasmodium falciparum
DNNRSNKSYKENEED

SEQ ID NO: 3305854 - protein, 5 aa, Plasmodium falciparum
DNNSD

SEQ ID NO: 3305855 - protein, 7 aa, Plasmodium falciparum
DNNSFDK

SEQ ID NO: 3305856 - protein, 32 aa, Plasmodium falciparum
DNNSKHEYSNKYGPHSKYNKHHSNKYDKYDQH

SEQ ID NO: 3305857 - protein, 10 aa, Plasmodium falciparum
DNNSKSNNNI

SEQ ID NO: 3305858 - protein, 6 aa, Plasmodium falciparum
DNNSTK

SEQ ID NO: 3305859 - protein, 7 aa, Plasmodium falciparum
DNNSVNT

SEQ ID NO: 3305860 - protein, 7 aa, Plasmodium falciparum
DNNTCND

SEQ ID NO: 3305861 - protein, 6 aa, Plasmodium falciparum
DNNTIT

SEQ ID NO: 3305862 - protein, 7 aa, Plasmodium falciparum
DNNTNHK

SEQ ID NO: 3305863 - protein, 14 aa, Plasmodium falciparum
DNNTSNAKSEGNST

SEQ ID NO: 3305864 - protein, 15 aa, Plasmodium falciparum
DNNTSRATSKFSREK

SEQ ID NO: 3305865 - protein, 5 aa, Plasmodium falciparum
DNNTT

SEQ ID NO: 3305866 - protein, 6 aa, Plasmodium falciparum
DNNTTC

SEQ ID NO: 3305867 - protein, 14 aa, Plasmodium falciparum
DNNVDMNEENNLNN

SEQ ID NO: 3305868 - protein, 29 aa, Plasmodium falciparum
DNNVHHNDNGDSDSDNNNNNNDNDGSHLN

SEQ ID NO: 3305869 - protein, 28 aa, Plasmodium falciparum
DNNVTTSNDNMNNNNNINISKKKKKINN

SEQ ID NO: 3305870 - protein, 4 aa, Plasmodium falciparum
DNNY

SEQ ID NO: 3305871 - protein, 6 aa, Plasmodium falciparum
DNNYAN

SEQ ID NO: 3305872 - protein, 8 aa, Plasmodium falciparum
DNNYDGGV

SEQ ID NO: 3305873 - protein, 27 aa, Plasmodium falciparum
DNNYEDYDDEDNNDNDDYNDGNIYDND

SEQ ID NO: 3305874 - protein, 13 aa, Plasmodium falciparum
DNNYEKNEKNIKE

SEQ ID NO: 3305875 - protein, 7 aa, Plasmodium falciparum
DNPEINN

SEQ ID NO: 3305876 - protein, 5 aa, Plasmodium falciparum
DNPHN

SEQ ID NO: 3305877 - protein, 6 aa, Plasmodium falciparum
DNPKDV

SEQ ID NO: 3305878 - protein, 9 aa, Plasmodium falciparum
DNPKKLNES

SEQ ID NO: 3305879 - protein, 4 aa, Plasmodium falciparum
DNPL

SEQ ID NO: 3305880 - protein, 6 aa, Plasmodium falciparum
DNPNDT

SEQ ID NO: 3305881 - protein, 25 aa, Plasmodium falciparum
DNPNEKENSLKKPFHQKKTTTLNEE

SEQ ID NO: 3305882 - protein, 6 aa, Plasmodium falciparum
DNPNHE

SEQ ID NO: 3305883 - protein, 6 aa, Plasmodium falciparum
DNPNLD

SEQ ID NO: 3305884 - protein, 12 aa, Plasmodium falciparum
DNPNPNSPAQAE

SEQ ID NO: 3305885 - protein, 14 aa, Plasmodium falciparum
DNPNVHKKKNEQHH

SEQ ID NO: 3305886 - protein, 6 aa, Plasmodium falciparum
DNPNYR

SEQ ID NO: 3305887 - protein, 17 aa, Plasmodium falciparum
DNPPDIENDWYCNSCLN

SEQ ID NO: 3305888 - protein, 7 aa, Plasmodium falciparum
DNPPKGE

SEQ ID NO: 3305889 - protein, 7 aa, Plasmodium falciparum
DNPPTLP

SEQ ID NO: 3305890 - protein, 7 aa, Plasmodium falciparum
DNPSADE

SEQ ID NO: 3305891 - protein, 12 aa, Plasmodium falciparum
DNPTYNNKNQQP

SEQ ID NO: 3305892 - protein, 8 aa, Plasmodium falciparum
DNPYDNYN

SEQ ID NO: 3305893 - protein, 6 aa, Plasmodium falciparum
DNPYET

SEQ ID NO: 3305894 - protein, 12 aa, Plasmodium falciparum
DNQAKNEENKND

SEQ ID NO: 3305895 - protein, 16 aa, Plasmodium falciparum
DNQEKVLPKGEHDKCT

SEQ ID NO: 3305896 - protein, 7 aa, Plasmodium falciparum
DNQELKN

SEQ ID NO: 3305897 - protein, 22 aa, Plasmodium falciparum
DNQETCSEKIDEREEVEQPEEN

SEQ ID NO: 3305898 - protein, 4 aa, Plasmodium falciparum
DNQF

SEQ ID NO: 3305899 - protein, 9 aa, Plasmodium falciparum
DNQKDNISN

SEQ ID NO: 3305900 - protein, 20 aa, Plasmodium falciparum
DNQKESKKKIKKKKNNDKQV

SEQ ID NO: 3305901 - protein, 7 aa, Plasmodium falciparum
DNQKGFN

SEQ ID NO: 3305902 - protein, 11 aa, Plasmodium falciparum
DNQKKDQVESN

SEQ ID NO: 3305903 - protein, 22 aa, Plasmodium falciparum
DNQKNNDINEKENIKSTSNQNN

SEQ ID NO: 3305904 - protein, 12 aa, Plasmodium falciparum
DNQKNNMDDHTY

SEQ ID NO: 3305905 - protein, 28 aa, Plasmodium falciparum
DNQKRKLKPEERSKKKINKWKSNSDEEN

SEQ ID NO: 3305906 - protein, 11 aa, Plasmodium falciparum
DNQMEGNNNNI

SEQ ID NO: 3305907 - protein, 4 aa, Plasmodium falciparum
DNQN

SEQ ID NO: 3305908 - protein, 8 aa, Plasmodium falciparum
DNQNHTNK

SEQ ID NO: 3305909 - protein, 11 aa, Plasmodium falciparum
DNQNKEKKIRI

SEQ ID NO: 3305910 - protein, 8 aa, Plasmodium falciparum
DNQNKKYS

SEQ ID NO: 3305911 - protein, 14 aa, Plasmodium falciparum
DNQNSSKHNVQTLQ

SEQ ID NO: 3305912 - protein, 10 aa, Plasmodium falciparum
DNQQNEEKVE

SEQ ID NO: 3305913 - protein, 14 aa, Plasmodium falciparum
DNQSEDNNMNKVKC

SEQ ID NO: 3305914 - protein, 14 aa, Plasmodium falciparum
DNQTNGDKQSIADS

SEQ ID NO: 3305915 - protein, 8 aa, Plasmodium falciparum
DNQTRKSD

SEQ ID NO: 3305916 - protein, 4 aa, Plasmodium falciparum
DNQY

SEQ ID NO: 3305917 - protein, 7 aa, Plasmodium falciparum
DNQYDKQ

SEQ ID NO: 3305918 - protein, 25 aa, Plasmodium falciparum
DNRIDKQQNYMDNNNNNNMDKPNRG

SEQ ID NO: 3305919 - protein, 13 aa, Plasmodium falciparum
DNRKTNKSEKHNI

SEQ ID NO: 3305920 - protein, 12 aa, Plasmodium falciparum
DNRLSPDNCESD

SEQ ID NO: 3305921 - protein, 4 aa, Plasmodium falciparum
DNRN

SEQ ID NO: 3305922 - protein, 5 aa, Plasmodium falciparum
DNRNI

SEQ ID NO: 3305923 - protein, 8 aa, Plasmodium falciparum
DNRSTRGS

SEQ ID NO: 3305924 - protein, 9 aa, Plasmodium falciparum
DNRTELEDK

SEQ ID NO: 3305925 - protein, 26 aa, Plasmodium falciparum
DNRYNNKDNPDFKKKDYKSNNNHYED

SEQ ID NO: 3305926 - protein, 56 aa, Plasmodium falciparum
DNSANQNDQNNDLTNNTNVNNQDIKSSQPSIKDGEFKNNNDNQNGDNKLENNVEQN

SEQ ID NO: 3305927 - protein, 4 aa, Plasmodium falciparum
DNSD

SEQ ID NO: 3305928 - protein, 14 aa, Plasmodium falciparum
DNSDINKDKDVPIR

SEQ ID NO: 3305929 - protein, 16 aa, Plasmodium falciparum
DNSEELTTNEKNKNIN

SEQ ID NO: 3305930 - protein, 5 aa, Plasmodium falciparum
DNSEN

SEQ ID NO: 3305931 - protein, 5 aa, Plasmodium falciparum
DNSFK

SEQ ID NO: 3305932 - protein, 5 aa, Plasmodium falciparum
DNSGN

SEQ ID NO: 3305933 - protein, 14 aa, Plasmodium falciparum
DNSHQQNDIDEKKN

SEQ ID NO: 3305934 - protein, 12 aa, Plasmodium falciparum
DNSIDNNIDNSI

SEQ ID NO: 3305935 - protein, 16 aa, Plasmodium falciparum
DNSIDTPKRKVKENGI

SEQ ID NO: 3305936 - protein, 17 aa, Plasmodium falciparum
DNSISPNDIKNKKSFNN

SEQ ID NO: 3305937 - protein, 5 aa, Plasmodium falciparum
DNSIY

SEQ ID NO: 3305938 - protein, 16 aa, Plasmodium falciparum
DNSKDKEEIQKETNKN

SEQ ID NO: 3305939 - protein, 7 aa, Plasmodium falciparum
DNSKKGV

SEQ ID NO: 3305940 - protein, 10 aa, Plasmodium falciparum
DNSKKNEELL

SEQ ID NO: 3305941 - protein, 6 aa, Plasmodium falciparum
DNSLEN

SEQ ID NO: 3305942 - protein, 24 aa, Plasmodium falciparum
DNSLSTNDTPSSFQSKEQKEQNIN

SEQ ID NO: 3305943 - protein, 34 aa, Plasmodium falciparum
DNSNDNKNNKGQNDNNNNNNNNNDENANQNNDNL

SEQ ID NO: 3305944 - protein, 7 aa, Plasmodium falciparum
DNSNEIM

SEQ ID NO: 3305945 - protein, 5 aa, Plasmodium falciparum
DNSNI

SEQ ID NO: 3305946 - protein, 20 aa, Plasmodium falciparum
DNSNKPVNPEVPEKKSRKKL

SEQ ID NO: 3305947 - protein, 21 aa, Plasmodium falciparum
DNSNLSNKEDTNKVSKNSTSF

SEQ ID NO: 3305948 - protein, 5 aa, Plasmodium falciparum
DNSNN

SEQ ID NO: 3305949 - protein, 10 aa, Plasmodium falciparum
DNSNNEEQIK

SEQ ID NO: 3305950 - protein, 6 aa, Plasmodium falciparum
DNSNNN

SEQ ID NO: 3305951 - protein, 9 aa, Plasmodium falciparum
DNSNNYNEN

SEQ ID NO: 3305952 - protein, 6 aa, Plasmodium falciparum
DNSNPT

SEQ ID NO: 3305953 - protein, 6 aa, Plasmodium falciparum
DNSNQL

SEQ ID NO: 3305954 - protein, 6 aa, Plasmodium falciparum
DNSNTA

SEQ ID NO: 3305955 - protein, 7 aa, Plasmodium falciparum
DNSNTQT

SEQ ID NO: 3305956 - protein, 5 aa, Plasmodium falciparum
DNSPN

SEQ ID NO: 3305957 - protein, 10 aa, Plasmodium falciparum
DNSPTDKNYK

SEQ ID NO: 3305958 - protein, 15 aa, Plasmodium falciparum
DNSPYSTSDINYNSN

SEQ ID NO: 3305959 - protein, 6 aa, Plasmodium falciparum
DNSQID

SEQ ID NO: 3305960 - protein, 8 aa, Plasmodium falciparum
DNSSASDI

SEQ ID NO: 3305961 - protein, 17 aa, Plasmodium falciparum
DNSSENNNESDMNTTST

SEQ ID NO: 3305962 - protein, 8 aa, Plasmodium falciparum
DNSSKYKD

SEQ ID NO: 3305963 - protein, 7 aa, Plasmodium falciparum
DNSSLTT

SEQ ID NO: 3305964 - protein, 8 aa, Plasmodium falciparum
DNSSNIIK

SEQ ID NO: 3305965 - protein, 8 aa, Plasmodium falciparum
DNSSNSIN

SEQ ID NO: 3305966 - protein, 8 aa, Plasmodium falciparum
DNSSSHMT

SEQ ID NO: 3305967 - protein, 7 aa, Plasmodium falciparum
DNSTNNF

SEQ ID NO: 3305968 - protein, 7 aa, Plasmodium falciparum
DNSTSNS

SEQ ID NO: 3305969 - protein, 16 aa, Plasmodium falciparum
DNSVDEKTLKKRAQSL

SEQ ID NO: 3305970 - protein, 9 aa, Plasmodium falciparum
DNSVDGKKE

SEQ ID NO: 3305971 - protein, 17 aa, Plasmodium falciparum
DNSYASDRKQKEDNDLE

SEQ ID NO: 3305972 - protein, 8 aa, Plasmodium falciparum
DNSYESKK

SEQ ID NO: 3305973 - protein, 49 aa, Plasmodium falciparum
DNSYNEEEENKKKKKKRDSKKYSVDDSYNKTKNKIYNDHKTDEYPSYAY

SEQ ID NO: 3305974 - protein, 18 aa, Plasmodium falciparum
DNTATTTTSSTTYKNNNN

SEQ ID NO: 3305975 - protein, 10 aa, Plasmodium falciparum
DNTDDGINGK

SEQ ID NO: 3305976 - protein, 6 aa, Plasmodium falciparum
DNTDDL

SEQ ID NO: 3305977 - protein, 23 aa, Plasmodium falciparum
DNTEEDNQESDTTNKYDESKRKE

SEQ ID NO: 3305978 - protein, 16 aa, Plasmodium falciparum
DNTEEKDNSSQPVEDK

SEQ ID NO: 3305979 - protein, 7 aa, Plasmodium falciparum
DNTENIY

SEQ ID NO: 3305980 - protein, 4 aa, Plasmodium falciparum
DNTF

SEQ ID NO: 3305981 - protein, 47 aa, Plasmodium falciparum
DNTFAEKKNEHLENKNGYLDNKNGYPYNKNGYPDNKNSYSKNEQKAN

SEQ ID NO: 3305982 - protein, 6 aa, Plasmodium falciparum
DNTFPD

SEQ ID NO: 3305983 - protein, 6 aa, Plasmodium falciparum
DNTGKI

SEQ ID NO: 3305984 - protein, 16 aa, Plasmodium falciparum
DNTIDNSSENGDAINN

SEQ ID NO: 3305985 - protein, 23 aa, Plasmodium falciparum
DNTINEGTKSPCKNSFTPDGNLS

SEQ ID NO: 3305986 - protein, 4 aa, Plasmodium falciparum
DNTK

SEQ ID NO: 3305987 - protein, 5 aa, Plasmodium falciparum
DNTKI

SEQ ID NO: 3305988 - protein, 9 aa, Plasmodium falciparum
DNTKKKSSE

SEQ ID NO: 3305989 - protein, 7 aa, Plasmodium falciparum
DNTKKMY

SEQ ID NO: 3305990 - protein, 7 aa, Plasmodium falciparum
DNTKKPI

SEQ ID NO: 3305991 - protein, 10 aa, Plasmodium falciparum
DNTKQPHNKM

SEQ ID NO: 3305992 - protein, 19 aa, Plasmodium falciparum
DNTKTKDINKNKNINESVK

SEQ ID NO: 3305993 - protein, 13 aa, Plasmodium falciparum
DNTKTPGKNISSV

SEQ ID NO: 3305994 - protein, 10 aa, Plasmodium falciparum
DNTLNETNKN

SEQ ID NO: 3305995 - protein, 8 aa, Plasmodium falciparum
DNTMEDND

SEQ ID NO: 3305996 - protein, 5 aa, Plasmodium falciparum
DNTMN

SEQ ID NO: 3305997 - protein, 7 aa, Plasmodium falciparum
DNTNASN

SEQ ID NO: 3305998 - protein, 7 aa, Plasmodium falciparum
DNTNEIK

SEQ ID NO: 3305999 - protein, 20 aa, Plasmodium falciparum
DNTNELNEKIDDTKTRSNSA

SEQ ID NO: 3306000 - protein, 7 aa, Plasmodium falciparum
DNTNKCK

SEQ ID NO: 3306001 - protein, 6 aa, Plasmodium falciparum
DNTNLN

SEQ ID NO: 3306002 - protein, 12 aa, Plasmodium falciparum
DNTNNDNNTSEN

SEQ ID NO: 3306003 - protein, 10 aa, Plasmodium falciparum
DNTNNPEKEI

SEQ ID NO: 3306004 - protein, 10 aa, Plasmodium falciparum
DNTNNQTDDN

SEQ ID NO: 3306005 - protein, 8 aa, Plasmodium falciparum
DNTNQEEM

SEQ ID NO: 3306006 - protein, 16 aa, Plasmodium falciparum
DNTNYDNTNYDNTNYD

SEQ ID NO: 3306007 - protein, 8 aa, Plasmodium falciparum
DNTQKNEN

SEQ ID NO: 3306008 - protein, 7 aa, Plasmodium falciparum
DNTQQQE

SEQ ID NO: 3306009 - protein, 5 aa, Plasmodium falciparum
DNTRE

SEQ ID NO: 3306010 - protein, 8 aa, Plasmodium falciparum
DNTSDQEY

SEQ ID NO: 3306011 - protein, 5 aa, Plasmodium falciparum
DNTSG

SEQ ID NO: 3306012 - protein, 16 aa, Plasmodium falciparum
DNTSPTNNVQPTNNNT

SEQ ID NO: 3306013 - protein, 13 aa, Plasmodium falciparum
DNTSSSSSSCSSY

SEQ ID NO: 3306014 - protein, 6 aa, Plasmodium falciparum
DNTTES

SEQ ID NO: 3306015 - protein, 8 aa, Plasmodium falciparum
DNTTKDTK

SEQ ID NO: 3306016 - protein, 7 aa, Plasmodium falciparum
DNTTRQG

SEQ ID NO: 3306017 - protein, 6 aa, Plasmodium falciparum
DNTTYN

SEQ ID NO: 3306018 - protein, 15 aa, Plasmodium falciparum
DNTVEGKHDINSTEG

SEQ ID NO: 3306019 - protein, 4 aa, Plasmodium falciparum
DNTY

SEQ ID NO: 3306020 - protein, 8 aa, Plasmodium falciparum
DNTYDERV

SEQ ID NO: 3306021 - protein, 15 aa, Plasmodium falciparum
DNTYDNNSNEEHSIE

SEQ ID NO: 3306022 - protein, 14 aa, Plasmodium falciparum
DNTYEYANSNKNIN

SEQ ID NO: 3306023 - protein, 10 aa, Plasmodium falciparum
DNTYHDNNTR

SEQ ID NO: 3306024 - protein, 6 aa, Plasmodium falciparum
DNVDNN

SEQ ID NO: 3306025 - protein, 4 aa, Plasmodium falciparum
DNVE

SEQ ID NO: 3306026 - protein, 6 aa, Plasmodium falciparum
DNVENN

SEQ ID NO: 3306027 - protein, 6 aa, Plasmodium falciparum
DNVEPS

SEQ ID NO: 3306028 - protein, 5 aa, Plasmodium falciparum
DNVGP

SEQ ID NO: 3306029 - protein, 25 aa, Plasmodium falciparum
DNVHNNNNNNNFNKDCNKDSIYNND

SEQ ID NO: 3306030 - protein, 4 aa, Plasmodium falciparum
DNVK

SEQ ID NO: 3306031 - protein, 23 aa, Plasmodium falciparum
DNVKKDSYGHKNISNESKDDIKK

SEQ ID NO: 3306032 - protein, 5 aa, Plasmodium falciparum
DNVMD

SEQ ID NO: 3306033 - protein, 41 aa, Plasmodium falciparum
DNVNDENDENDENDENDENDENDENDENDENDENNNDGNYN

SEQ ID NO: 3306034 - protein, 30 aa, Plasmodium falciparum
DNVNDSVSSSMNNNTHNSLDDNNISNEDKI

SEQ ID NO: 3306035 - protein, 7 aa, Plasmodium falciparum
DNVNNDD

SEQ ID NO: 3306036 - protein, 49 aa, Plasmodium falciparum
DNVNNNNNNNNNNNNKKEKGKKKKEKDADKNKKHKKKNIHDNNRKKKMT

SEQ ID NO: 3306037 - protein, 99 aa, Plasmodium falciparum
DNVNSNNDDTNDNNNDDTNDNNNDDNNDDNNDDTNDNNNDNNNDNNNDNNNDNNNDNNNDNNNDNNNDNNNDNNNDNNNDNNNYQNNYQNNDNNQNVEE

SEQ ID NO: 3306038 - protein, 36 aa, Plasmodium falciparum
DNVPKDKTYNDNNNNNNNNNNKEVEKNNSSAGSNSF

SEQ ID NO: 3306039 - protein, 101 aa, Plasmodium falciparum
DNVQEKKDNIQEKNENIQEKKDNVQEKNENIQEKKDNVQEKNENIQEKKDNVQEKNENIQEKNENIQEKNENIQEKNENIQRKKNNVQGKNENSQEKQENI

SEQ ID NO: 3306040 - protein, 9 aa, Plasmodium falciparum
DNVSDDDIN

SEQ ID NO: 3306041 - protein, 10 aa, Plasmodium falciparum
DNVSEEMNRQ

SEQ ID NO: 3306042 - protein, 4 aa, Plasmodium falciparum
DNVT

SEQ ID NO: 3306043 - protein, 9 aa, Plasmodium falciparum
DNVTNPEKS

SEQ ID NO: 3306044 - protein, 5 aa, Plasmodium falciparum
DNWEK

SEQ ID NO: 3306045 - protein, 13 aa, Plasmodium falciparum
DNWPTPPDQRAKR

SEQ ID NO: 3306046 - protein, 4 aa, Plasmodium falciparum
DNYD

SEQ ID NO: 3306047 - protein, 6 aa, Plasmodium falciparum
DNYDEE

SEQ ID NO: 3306048 - protein, 12 aa, Plasmodium falciparum
DNYDSYDDVDEE

SEQ ID NO: 3306049 - protein, 19 aa, Plasmodium falciparum
DNYDSYDNYEKGEKKEDTY

SEQ ID NO: 3306050 - protein, 4 aa, Plasmodium falciparum
DNYE

SEQ ID NO: 3306051 - protein, 12 aa, Plasmodium falciparum
DNYENANNHRQA

SEQ ID NO: 3306052 - protein, 4 aa, Plasmodium falciparum
DNYG

SEQ ID NO: 3306053 - protein, 4 aa, Plasmodium falciparum
DNYH

SEQ ID NO: 3306054 - protein, 17 aa, Plasmodium falciparum
DNYKSNEYFNNNGKAYN

SEQ ID NO: 3306055 - protein, 11 aa, Plasmodium falciparum
DNYLNDSPNHN

SEQ ID NO: 3306056 - protein, 12 aa, Plasmodium falciparum
DNYMKSSDNYVN

SEQ ID NO: 3306057 - protein, 4 aa, Plasmodium falciparum
DNYN

SEQ ID NO: 3306058 - protein, 7 aa, Plasmodium falciparum
DNYNDLK

SEQ ID NO: 3306059 - protein, 8 aa, Plasmodium falciparum
DNYNDNYN

SEQ ID NO: 3306060 - protein, 7 aa, Plasmodium falciparum
DNYNDTT

SEQ ID NO: 3306061 - protein, 6 aa, Plasmodium falciparum
DNYNEE

SEQ ID NO: 3306062 - protein, 9 aa, Plasmodium falciparum
DNYNNYDNS

SEQ ID NO: 3306063 - protein, 6 aa, Plasmodium falciparum
DNYNQI

SEQ ID NO: 3306064 - protein, 14 aa, Plasmodium falciparum
DNYNSNNNYNDDEQ

SEQ ID NO: 3306065 - protein, 4 aa, Plasmodium falciparum
DNYQ

SEQ ID NO: 3306066 - protein, 10 aa, Plasmodium falciparum
DNYSNDPNSI

SEQ ID NO: 3306067 - protein, 8 aa, Plasmodium falciparum
DNYSNNNS

SEQ ID NO: 3306068 - protein, 5 aa, Plasmodium falciparum
DNYSR

SEQ ID NO: 3306069 - protein, 13 aa, Plasmodium falciparum
DNYSRGKTQSYRS

SEQ ID NO: 3306070 - protein, 11 aa, Plasmodium falciparum
DNYTDNNTEIS

SEQ ID NO: 3306071 - protein, 6 aa, Plasmodium falciparum
DNYTEN

SEQ ID NO: 3306072 - protein, 7 aa, Plasmodium falciparum
DNYTENV

SEQ ID NO: 3306073 - protein, 5 aa, Plasmodium falciparum
DNYTN

SEQ ID NO: 3306074 - protein, 5 aa, Plasmodium falciparum
DNYYG

SEQ ID NO: 3306075 - protein, 26 aa, Plasmodium falciparum
DNYYTNRNSSNESKLSECSNTKGSTV

SEQ ID NO: 3306076 - protein, 12 aa, Plasmodium falciparum
DPAGPEDEITEG

SEQ ID NO: 3306077 - protein, 8 aa, Plasmodium falciparum
DPAGTENS

SEQ ID NO: 3306078 - protein, 9 aa, Plasmodium falciparum
DPAHNTSDA

SEQ ID NO: 3306079 - protein, 9 aa, Plasmodium falciparum
DPANSGGGH

SEQ ID NO: 3306080 - protein, 4 aa, Plasmodium falciparum
DPAP

SEQ ID NO: 3306081 - protein, 5 aa, Plasmodium falciparum
DPCEK

SEQ ID NO: 3306082 - protein, 5 aa, Plasmodium falciparum
DPDIK

SEQ ID NO: 3306083 - protein, 6 aa, Plasmodium falciparum
DPDLEQ

SEQ ID NO: 3306084 - protein, 11 aa, Plasmodium falciparum
DPDSVKTNAPN

SEQ ID NO: 3306085 - protein, 4 aa, Plasmodium falciparum
DPDT

SEQ ID NO: 3306086 - protein, 8 aa, Plasmodium falciparum
DPEAEKEA

SEQ ID NO: 3306087 - protein, 7 aa, Plasmodium falciparum
DPEAYNN

SEQ ID NO: 3306088 - protein, 24 aa, Plasmodium falciparum
DPEENSDITKDSTSQLNGCDNTED

SEQ ID NO: 3306089 - protein, 10 aa, Plasmodium falciparum
DPENNEDNIK

SEQ ID NO: 3306090 - protein, 4 aa, Plasmodium falciparum
DPES

SEQ ID NO: 3306091 - protein, 10 aa, Plasmodium falciparum
DPESTLGPYD

SEQ ID NO: 3306092 - protein, 4 aa, Plasmodium falciparum
DPEW

SEQ ID NO: 3306093 - protein, 4 aa, Plasmodium falciparum
DPEY

SEQ ID NO: 3306094 - protein, 12 aa, Plasmodium falciparum
DPFPSLSHNQGP

SEQ ID NO: 3306095 - protein, 6 aa, Plasmodium falciparum
DPGITQ

SEQ ID NO: 3306096 - protein, 8 aa, Plasmodium falciparum
DPGNIGEG

SEQ ID NO: 3306097 - protein, 4 aa, Plasmodium falciparum
DPGQ

SEQ ID NO: 3306098 - protein, 7 aa, Plasmodium falciparum
DPGRGAP

SEQ ID NO: 3306099 - protein, 5 aa, Plasmodium falciparum
DPGRV

SEQ ID NO: 3306100 - protein, 7 aa, Plasmodium falciparum
DPGTAKS

SEQ ID NO: 3306101 - protein, 8 aa, Plasmodium falciparum
DPGTGKSQ

SEQ ID NO: 3306102 - protein, 5 aa, Plasmodium falciparum
DPHKQ

SEQ ID NO: 3306103 - protein, 5 aa, Plasmodium falciparum
DPHPG

SEQ ID NO: 3306104 - protein, 10 aa, Plasmodium falciparum
DPHSRTKTSS

SEQ ID NO: 3306105 - protein, 5 aa, Plasmodium falciparum
DPIDD

SEQ ID NO: 3306106 - protein, 5 aa, Plasmodium falciparum
DPIGT

SEQ ID NO: 3306107 - protein, 4 aa, Plasmodium falciparum
DPIK

SEQ ID NO: 3306108 - protein, 4 aa, Plasmodium falciparum
DPIN

SEQ ID NO: 3306109 - protein, 81 aa, Plasmodium falciparum
DPINKKDDPINKNDDPINKNDDPINKNDDNINKNDDNINKNDDNICNSNDHTHNSNDHTHNSNDHTHNSNDHTHNSNDHTH

SEQ ID NO: 3306110 - protein, 12 aa, Plasmodium falciparum
DPINQKKKEANI

SEQ ID NO: 3306111 - protein, 7 aa, Plasmodium falciparum
DPITETD

SEQ ID NO: 3306112 - protein, 6 aa, Plasmodium falciparum
DPKDCS

SEQ ID NO: 3306113 - protein, 6 aa, Plasmodium falciparum
DPKDVK

SEQ ID NO: 3306114 - protein, 23 aa, Plasmodium falciparum
DPKENNTKKDNKSKLDEDTQKYP

SEQ ID NO: 3306115 - protein, 4 aa, Plasmodium falciparum
DPKG

SEQ ID NO: 3306116 - protein, 7 aa, Plasmodium falciparum
DPKNKVQ

SEQ ID NO: 3306117 - protein, 8 aa, Plasmodium falciparum
DPKPFSPP

SEQ ID NO: 3306118 - protein, 37 aa, Plasmodium falciparum
DPKQLAGTKDTKDAKDTKNTKDTKNTKDTKDTKNTKP

SEQ ID NO: 3306119 - protein, 7 aa, Plasmodium falciparum
DPKRRRK

SEQ ID NO: 3306120 - protein, 4 aa, Plasmodium falciparum
DPKS

SEQ ID NO: 3306121 - protein, 15 aa, Plasmodium falciparum
DPKSEEKEKTKKKEY

SEQ ID NO: 3306122 - protein, 10 aa, Plasmodium falciparum
DPKSRSMRED

SEQ ID NO: 3306123 - protein, 7 aa, Plasmodium falciparum
DPKTIGA

SEQ ID NO: 3306124 - protein, 7 aa, Plasmodium falciparum
DPKTRDT

SEQ ID NO: 3306125 - protein, 12 aa, Plasmodium falciparum
DPLKNNNNNNDN

SEQ ID NO: 3306126 - protein, 4 aa, Plasmodium falciparum
DPLL

SEQ ID NO: 3306127 - protein, 14 aa, Plasmodium falciparum
DPLNENKDNSSANL

SEQ ID NO: 3306128 - protein, 5 aa, Plasmodium falciparum
DPLNQ

SEQ ID NO: 3306129 - protein, 4 aa, Plasmodium falciparum
DPLQ

SEQ ID NO: 3306130 - protein, 9 aa, Plasmodium falciparum
DPLQNPEHN

SEQ ID NO: 3306131 - protein, 10 aa, Plasmodium falciparum
DPLSKEDYGK

SEQ ID NO: 3306132 - protein, 18 aa, Plasmodium falciparum
DPMNNEDVNNSVASSTDI

SEQ ID NO: 3306133 - protein, 5 aa, Plasmodium falciparum
DPNDD

SEQ ID NO: 3306134 - protein, 10 aa, Plasmodium falciparum
DPNDRNSPYS

SEQ ID NO: 3306135 - protein, 6 aa, Plasmodium falciparum
DPNDVN

SEQ ID NO: 3306136 - protein, 6 aa, Plasmodium falciparum
DPNDYN

SEQ ID NO: 3306137 - protein, 19 aa, Plasmodium falciparum
DPNEEGLKRKNEVDNEMKN

SEQ ID NO: 3306138 - protein, 14 aa, Plasmodium falciparum
DPNEEKGFKPSKRG

SEQ ID NO: 3306139 - protein, 4 aa, Plasmodium falciparum
DPNG

SEQ ID NO: 3306140 - protein, 6 aa, Plasmodium falciparum
DPNHVS

SEQ ID NO: 3306141 - protein, 6 aa, Plasmodium falciparum
DPNKNE

SEQ ID NO: 3306142 - protein, 5 aa, Plasmodium falciparum
DPNLE

SEQ ID NO: 3306143 - protein, 16 aa, Plasmodium falciparum
DPNMQENTQGDDEGGI

SEQ ID NO: 3306144 - protein, 6 aa, Plasmodium falciparum
DPNNDN

SEQ ID NO: 3306145 - protein, 5 aa, Plasmodium falciparum
DPNNI

SEQ ID NO: 3306146 - protein, 9 aa, Plasmodium falciparum
DPNNKSLQD

SEQ ID NO: 3306147 - protein, 10 aa, Plasmodium falciparum
DPNNNTPNLS

SEQ ID NO: 3306148 - protein, 6 aa, Plasmodium falciparum
DPNNST

SEQ ID NO: 3306149 - protein, 8 aa, Plasmodium falciparum
DPNNTKTI

SEQ ID NO: 3306150 - protein, 15 aa, Plasmodium falciparum
DPNRISTNSENKITE

SEQ ID NO: 3306151 - protein, 26 aa, Plasmodium falciparum
DPNYDDRDNDVNQDHYNEHNNNNNNN

SEQ ID NO: 3306152 - protein, 11 aa, Plasmodium falciparum
DPNYNSTHDEN

SEQ ID NO: 3306153 - protein, 5 aa, Plasmodium falciparum
DPNYR

SEQ ID NO: 3306154 - protein, 9 aa, Plasmodium falciparum
DPPAPLPLD

SEQ ID NO: 3306155 - protein, 8 aa, Plasmodium falciparum
DPPDDSKE

SEQ ID NO: 3306156 - protein, 5 aa, Plasmodium falciparum
DPPDH

SEQ ID NO: 3306157 - protein, 12 aa, Plasmodium falciparum
DPPGTGTPYDID

SEQ ID NO: 3306158 - protein, 4 aa, Plasmodium falciparum
DPPK

SEQ ID NO: 3306159 - protein, 8 aa, Plasmodium falciparum
DPPTRKYQ

SEQ ID NO: 3306160 - protein, 7 aa, Plasmodium falciparum
DPPYGNR

SEQ ID NO: 3306161 - protein, 4 aa, Plasmodium falciparum
DPQD

SEQ ID NO: 3306162 - protein, 4 aa, Plasmodium falciparum
DPQI

SEQ ID NO: 3306163 - protein, 15 aa, Plasmodium falciparum
DPQKKEGIGGNARGN

SEQ ID NO: 3306164 - protein, 9 aa, Plasmodium falciparum
DPQKNKDNT

SEQ ID NO: 3306165 - protein, 4 aa, Plasmodium falciparum
DPQN

SEQ ID NO: 3306166 - protein, 8 aa, Plasmodium falciparum
DPQTRPSA

SEQ ID NO: 3306167 - protein, 11 aa, Plasmodium falciparum
DPREYGSNSNY

SEQ ID NO: 3306168 - protein, 6 aa, Plasmodium falciparum
DPRHGR

SEQ ID NO: 3306169 - protein, 4 aa, Plasmodium falciparum
DPRI

SEQ ID NO: 3306170 - protein, 4 aa, Plasmodium falciparum
DPRM

SEQ ID NO: 3306171 - protein, 4 aa, Plasmodium falciparum
DPSE

SEQ ID NO: 3306172 - protein, 5 aa, Plasmodium falciparum
DPSIY

SEQ ID NO: 3306173 - protein, 22 aa, Plasmodium falciparum
DPSKKENEDNYSSKDKIEKNEL

SEQ ID NO: 3306174 - protein, 6 aa, Plasmodium falciparum
DPSKSI

SEQ ID NO: 3306175 - protein, 5 aa, Plasmodium falciparum
DPSLE

SEQ ID NO: 3306176 - protein, 5 aa, Plasmodium falciparum
DPSLR

SEQ ID NO: 3306177 - protein, 11 aa, Plasmodium falciparum
DPSLRKSGTGN

SEQ ID NO: 3306178 - protein, 5 aa, Plasmodium falciparum
DPSQN

SEQ ID NO: 3306179 - protein, 15 aa, Plasmodium falciparum
DPSQTNHNNPYDDND

SEQ ID NO: 3306180 - protein, 13 aa, Plasmodium falciparum
DPSRNGPPPASEE

SEQ ID NO: 3306181 - protein, 5 aa, Plasmodium falciparum
DPSRS

SEQ ID NO: 3306182 - protein, 4 aa, Plasmodium falciparum
DPSS

SEQ ID NO: 3306183 - protein, 7 aa, Plasmodium falciparum
DPSTAKS

SEQ ID NO: 3306184 - protein, 5 aa, Plasmodium falciparum
DPSYN

SEQ ID NO: 3306185 - protein, 4 aa, Plasmodium falciparum
DPTI

SEQ ID NO: 3306186 - protein, 9 aa, Plasmodium falciparum
DPTKADENF

SEQ ID NO: 3306187 - protein, 5 aa, Plasmodium falciparum
DPTTM

SEQ ID NO: 3306188 - protein, 8 aa, Plasmodium falciparum
DPTTSVQY

SEQ ID NO: 3306189 - protein, 4 aa, Plasmodium falciparum
DPTV

SEQ ID NO: 3306190 - protein, 5 aa, Plasmodium falciparum
DPTVN

SEQ ID NO: 3306191 - protein, 7 aa, Plasmodium falciparum
DPYHQKD

SEQ ID NO: 3306192 - protein, 6 aa, Plasmodium falciparum
DPYKNA

SEQ ID NO: 3306193 - protein, 4 aa, Plasmodium falciparum
DPYT

SEQ ID NO: 3306194 - protein, 8 aa, Plasmodium falciparum
DPYTGKSK

SEQ ID NO: 3306195 - protein, 6 aa, Plasmodium falciparum
DPYTGQ

SEQ ID NO: 3306196 - protein, 6 aa, Plasmodium falciparum
DPYYPS

SEQ ID NO: 3306197 - protein, 6 aa, Plasmodium falciparum
DQANNK

SEQ ID NO: 3306198 - protein, 16 aa, Plasmodium falciparum
DQATHSPKSSNTTQAH

SEQ ID NO: 3306199 - protein, 10 aa, Plasmodium falciparum
DQDDDNNNHP

SEQ ID NO: 3306200 - protein, 5 aa, Plasmodium falciparum
DQDDN

SEQ ID NO: 3306201 - protein, 6 aa, Plasmodium falciparum
DQDENG

SEQ ID NO: 3306202 - protein, 5 aa, Plasmodium falciparum
DQDIK

SEQ ID NO: 3306203 - protein, 20 aa, Plasmodium falciparum
DQDKANDPTLIQGPRKKNLE

SEQ ID NO: 3306204 - protein, 7 aa, Plasmodium falciparum
DQDKGKK

SEQ ID NO: 3306205 - protein, 54 aa, Plasmodium falciparum
DQDKYDDNDNNNVDNNNKNNVDNNVDNNNVDNNVDNNDKNNVDNNNVDNDDDDV

SEQ ID NO: 3306206 - protein, 5 aa, Plasmodium falciparum
DQDNK

SEQ ID NO: 3306207 - protein, 10 aa, Plasmodium falciparum
DQDSTQKEHN

SEQ ID NO: 3306208 - protein, 7 aa, Plasmodium falciparum
DQDYTRD

SEQ ID NO: 3306209 - protein, 4 aa, Plasmodium falciparum
DQEC

SEQ ID NO: 3306210 - protein, 4 aa, Plasmodium falciparum
DQED

SEQ ID NO: 3306211 - protein, 21 aa, Plasmodium falciparum
DQEDKNKKKDKHSNDDTEEKI

SEQ ID NO: 3306212 - protein, 9 aa, Plasmodium falciparum
DQEEADKDL

SEQ ID NO: 3306213 - protein, 19 aa, Plasmodium falciparum
DQEEEEKEEEKKGQEKGHK

SEQ ID NO: 3306214 - protein, 7 aa, Plasmodium falciparum
DQEEKEY

SEQ ID NO: 3306215 - protein, 4 aa, Plasmodium falciparum
DQEF

SEQ ID NO: 3306216 - protein, 4 aa, Plasmodium falciparum
DQEI

SEQ ID NO: 3306217 - protein, 18 aa, Plasmodium falciparum
DQEKNDEKNVDKSADKNV

SEQ ID NO: 3306218 - protein, 8 aa, Plasmodium falciparum
DQEKNNKK

SEQ ID NO: 3306219 - protein, 13 aa, Plasmodium falciparum
DQENKKPPPSKNK

SEQ ID NO: 3306220 - protein, 4 aa, Plasmodium falciparum
DQEP

SEQ ID NO: 3306221 - protein, 5 aa, Plasmodium falciparum
DQERE

SEQ ID NO: 3306222 - protein, 10 aa, Plasmodium falciparum
DQESLQAENV

SEQ ID NO: 3306223 - protein, 4 aa, Plasmodium falciparum
DQET

SEQ ID NO: 3306224 - protein, 9 aa, Plasmodium falciparum
DQGDNTNIY

SEQ ID NO: 3306225 - protein, 6 aa, Plasmodium falciparum
DQGEAK

SEQ ID NO: 3306226 - protein, 9 aa, Plasmodium falciparum
DQGEKENVD

SEQ ID NO: 3306227 - protein, 5 aa, Plasmodium falciparum
DQGEN

SEQ ID NO: 3306228 - protein, 4 aa, Plasmodium falciparum
DQGG

SEQ ID NO: 3306229 - protein, 7 aa, Plasmodium falciparum
DQGGESL

SEQ ID NO: 3306230 - protein, 11 aa, Plasmodium falciparum
DQGKGNNSECG

SEQ ID NO: 3306231 - protein, 69 aa, Plasmodium falciparum
DQGQNDDTDAIEKRDMEKKKKKKKSGKKNNKNKKNEKNQNDNNNNNNNNNNNNNNNNHIDGNQNNSEVI

SEQ ID NO: 3306232 - protein, 16 aa, Plasmodium falciparum
DQGVSKEINNKEIEEN

SEQ ID NO: 3306233 - protein, 5 aa, Plasmodium falciparum
DQHDN

SEQ ID NO: 3306234 - protein, 4 aa, Plasmodium falciparum
DQHE

SEQ ID NO: 3306235 - protein, 6 aa, Plasmodium falciparum
DQHENT

SEQ ID NO: 3306236 - protein, 7 aa, Plasmodium falciparum
DQHNQNE

SEQ ID NO: 3306237 - protein, 5 aa, Plasmodium falciparum
DQIPK

SEQ ID NO: 3306238 - protein, 18 aa, Plasmodium falciparum
DQIQKQKNKQNKQKKEYK

SEQ ID NO: 3306239 - protein, 14 aa, Plasmodium falciparum
DQIQSEASASLSGI

SEQ ID NO: 3306240 - protein, 29 aa, Plasmodium falciparum
DQISEGNKNQNENAEKSDSSDLKKKKKRK

SEQ ID NO: 3306241 - protein, 9 aa, Plasmodium falciparum
DQISESDMR

SEQ ID NO: 3306242 - protein, 6 aa, Plasmodium falciparum
DQITST

SEQ ID NO: 3306243 - protein, 4 aa, Plasmodium falciparum
DQKC

SEQ ID NO: 3306244 - protein, 9 aa, Plasmodium falciparum
DQKCSGSAF

SEQ ID NO: 3306245 - protein, 9 aa, Plasmodium falciparum
DQKDEEKLG

SEQ ID NO: 3306246 - protein, 8 aa, Plasmodium falciparum
DQKDKSTN

SEQ ID NO: 3306247 - protein, 5 aa, Plasmodium falciparum
DQKDL

SEQ ID NO: 3306248 - protein, 11 aa, Plasmodium falciparum
DQKDNVQNKEY

SEQ ID NO: 3306249 - protein, 49 aa, Plasmodium falciparum
DQKEEKKKNEKDIKNDHNVDNNNNNNNNNNNNNNNNNNNNNNNNNNNNN

SEQ ID NO: 3306250 - protein, 12 aa, Plasmodium falciparum
DQKEGNDEHGQD

SEQ ID NO: 3306251 - protein, 9 aa, Plasmodium falciparum
DQKENKTYN

SEQ ID NO: 3306252 - protein, 7 aa, Plasmodium falciparum
DQKERER

SEQ ID NO: 3306253 - protein, 4 aa, Plasmodium falciparum
DQKK

SEQ ID NO: 3306254 - protein, 14 aa, Plasmodium falciparum
DQKKGKEYKKEERE

SEQ ID NO: 3306255 - protein, 6 aa, Plasmodium falciparum
DQKKIG

SEQ ID NO: 3306256 - protein, 10 aa, Plasmodium falciparum
DQKKKDDIDI

SEQ ID NO: 3306257 - protein, 8 aa, Plasmodium falciparum
DQKKKGEN

SEQ ID NO: 3306258 - protein, 8 aa, Plasmodium falciparum
DQKKKHEK

SEQ ID NO: 3306259 - protein, 7 aa, Plasmodium falciparum
DQKKKNK

SEQ ID NO: 3306260 - protein, 23 aa, Plasmodium falciparum
DQKKNKNCKKKNGNEDEDEKDNI

SEQ ID NO: 3306261 - protein, 5 aa, Plasmodium falciparum
DQKKQ

SEQ ID NO: 3306262 - protein, 10 aa, Plasmodium falciparum
DQKLKIENEK

SEQ ID NO: 3306263 - protein, 15 aa, Plasmodium falciparum
DQKMNTDDSTKNDEN

SEQ ID NO: 3306264 - protein, 5 aa, Plasmodium falciparum
DQKPT

SEQ ID NO: 3306265 - protein, 7 aa, Plasmodium falciparum
DQKQNLD

SEQ ID NO: 3306266 - protein, 4 aa, Plasmodium falciparum
DQKV

SEQ ID NO: 3306267 - protein, 10 aa, Plasmodium falciparum
DQKWENGAPY

SEQ ID NO: 3306268 - protein, 20 aa, Plasmodium falciparum
DQLQNSKTPELTKEEENELN

SEQ ID NO: 3306269 - protein, 9 aa, Plasmodium falciparum
DQLSPMAQP

SEQ ID NO: 3306270 - protein, 5 aa, Plasmodium falciparum
DQLVQ

SEQ ID NO: 3306271 - protein, 15 aa, Plasmodium falciparum
DQNAEYTKKNNISDK

SEQ ID NO: 3306272 - protein, 12 aa, Plasmodium falciparum
DQNAVTNYNTSN

SEQ ID NO: 3306273 - protein, 10 aa, Plasmodium falciparum
DQNDGDKNKI

SEQ ID NO: 3306274 - protein, 17 aa, Plasmodium falciparum
DQNGYDPNDYDDEQRKK

SEQ ID NO: 3306275 - protein, 11 aa, Plasmodium falciparum
DQNICTNTEQE

SEQ ID NO: 3306276 - protein, 6 aa, Plasmodium falciparum
DQNIND

SEQ ID NO: 3306277 - protein, 12 aa, Plasmodium falciparum
DQNINQKSNNTK

SEQ ID NO: 3306278 - protein, 4 aa, Plasmodium falciparum
DQNK

SEQ ID NO: 3306279 - protein, 13 aa, Plasmodium falciparum
DQNKCAKDRYNEE

SEQ ID NO: 3306280 - protein, 21 aa, Plasmodium falciparum
DQNKHNNNSYDATRKEGNEKQ

SEQ ID NO: 3306281 - protein, 18 aa, Plasmodium falciparum
DQNKKEAHTTLQTQTQTQ

SEQ ID NO: 3306282 - protein, 9 aa, Plasmodium falciparum
DQNKKYKNH

SEQ ID NO: 3306283 - protein, 10 aa, Plasmodium falciparum
DQNNDAKRLQ

SEQ ID NO: 3306284 - protein, 15 aa, Plasmodium falciparum
DQNNKNKNKNKSSSI

SEQ ID NO: 3306285 - protein, 6 aa, Plasmodium falciparum
DQNNNK

SEQ ID NO: 3306286 - protein, 8 aa, Plasmodium falciparum
DQNNNQKN

SEQ ID NO: 3306287 - protein, 7 aa, Plasmodium falciparum
DQNQNVQ

SEQ ID NO: 3306288 - protein, 8 aa, Plasmodium falciparum
DQNVNDTN

SEQ ID NO: 3306289 - protein, 5 aa, Plasmodium falciparum
DQNYN

SEQ ID NO: 3306290 - protein, 14 aa, Plasmodium falciparum
DQNYNHKESTNNDY

SEQ ID NO: 3306291 - protein, 15 aa, Plasmodium falciparum
DQNYTRNERPTLKTG

SEQ ID NO: 3306292 - protein, 7 aa, Plasmodium falciparum
DQPIENY

SEQ ID NO: 3306293 - protein, 4 aa, Plasmodium falciparum
DQPK

SEQ ID NO: 3306294 - protein, 4 aa, Plasmodium falciparum
DQPN

SEQ ID NO: 3306295 - protein, 14 aa, Plasmodium falciparum
DQPQDDNASSVNKN

SEQ ID NO: 3306296 - protein, 9 aa, Plasmodium falciparum
DQPSTHSDV

SEQ ID NO: 3306297 - protein, 12 aa, Plasmodium falciparum
DQPVPNWLLHFR

SEQ ID NO: 3306298 - protein, 15 aa, Plasmodium falciparum
DQQCTGKNRALTPKS

SEQ ID NO: 3306299 - protein, 10 aa, Plasmodium falciparum
DQQDQNESNV

SEQ ID NO: 3306300 - protein, 7 aa, Plasmodium falciparum
DQQEGER

SEQ ID NO: 3306301 - protein, 8 aa, Plasmodium falciparum
DQQEVDQK

SEQ ID NO: 3306302 - protein, 19 aa, Plasmodium falciparum
DQQKCRNQNKNEPKISGSH

SEQ ID NO: 3306303 - protein, 12 aa, Plasmodium falciparum
DQQKGKENQEPS

SEQ ID NO: 3306304 - protein, 8 aa, Plasmodium falciparum
DQQKQNEE

SEQ ID NO: 3306305 - protein, 7 aa, Plasmodium falciparum
DQQNEHT

SEQ ID NO: 3306306 - protein, 9 aa, Plasmodium falciparum
DQQNKQSNY

SEQ ID NO: 3306307 - protein, 8 aa, Plasmodium falciparum
DQQRGERG

SEQ ID NO: 3306308 - protein, 6 aa, Plasmodium falciparum
DQQYCD

SEQ ID NO: 3306309 - protein, 8 aa, Plasmodium falciparum
DQRKGRHT

SEQ ID NO: 3306310 - protein, 14 aa, Plasmodium falciparum
DQRKNNKNKNTTYI

SEQ ID NO: 3306311 - protein, 6 aa, Plasmodium falciparum
DQRMKE

SEQ ID NO: 3306312 - protein, 8 aa, Plasmodium falciparum
DQRNDPSS

SEQ ID NO: 3306313 - protein, 5 aa, Plasmodium falciparum
DQRRM

SEQ ID NO: 3306314 - protein, 10 aa, Plasmodium falciparum
DQRSGKSKGV

SEQ ID NO: 3306315 - protein, 5 aa, Plasmodium falciparum
DQRTQ

SEQ ID NO: 3306316 - protein, 7 aa, Plasmodium falciparum
DQSFTYD

SEQ ID NO: 3306317 - protein, 36 aa, Plasmodium falciparum
DQSKTKYHQQDKSDHNNDGDNNNDDNNNDNNNNDDN

SEQ ID NO: 3306318 - protein, 8 aa, Plasmodium falciparum
DQSPFEEN

SEQ ID NO: 3306319 - protein, 8 aa, Plasmodium falciparum
DQSQKNHI

SEQ ID NO: 3306320 - protein, 9 aa, Plasmodium falciparum
DQSQSNENP

SEQ ID NO: 3306321 - protein, 6 aa, Plasmodium falciparum
DQSTEP

SEQ ID NO: 3306322 - protein, 4 aa, Plasmodium falciparum
DQTD

SEQ ID NO: 3306323 - protein, 11 aa, Plasmodium falciparum
DQTDETTQRDL

SEQ ID NO: 3306324 - protein, 6 aa, Plasmodium falciparum
DQTNNN

SEQ ID NO: 3306325 - protein, 9 aa, Plasmodium falciparum
DQTNSEHNN

SEQ ID NO: 3306326 - protein, 9 aa, Plasmodium falciparum
DQTNSYNNQ

SEQ ID NO: 3306327 - protein, 10 aa, Plasmodium falciparum
DQTNYSNKEN

SEQ ID NO: 3306328 - protein, 8 aa, Plasmodium falciparum
DQTPEYKK

SEQ ID NO: 3306329 - protein, 8 aa, Plasmodium falciparum
DQTTDQKE

SEQ ID NO: 3306330 - protein, 7 aa, Plasmodium falciparum
DQTYNHN

SEQ ID NO: 3306331 - protein, 4 aa, Plasmodium falciparum
DQYE

SEQ ID NO: 3306332 - protein, 18 aa, Plasmodium falciparum
DQYEDDNNNNNNNNNNNT

SEQ ID NO: 3306333 - protein, 7 aa, Plasmodium falciparum
DQYKQKS

SEQ ID NO: 3306334 - protein, 6 aa, Plasmodium falciparum
DQYPER

SEQ ID NO: 3306335 - protein, 4 aa, Plasmodium falciparum
DQYY

SEQ ID NO: 3306336 - protein, 4 aa, Plasmodium falciparum
DRAS

SEQ ID NO: 3306337 - protein, 5 aa, Plasmodium falciparum
DRDEF

SEQ ID NO: 3306338 - protein, 6 aa, Plasmodium falciparum
DRDGCP

SEQ ID NO: 3306339 - protein, 7 aa, Plasmodium falciparum
DRDGDSI

SEQ ID NO: 3306340 - protein, 6 aa, Plasmodium falciparum
DRDSAS

SEQ ID NO: 3306341 - protein, 19 aa, Plasmodium falciparum
DRDSYEKKVKKQAIEFRPK

SEQ ID NO: 3306342 - protein, 7 aa, Plasmodium falciparum
DREEDAS

SEQ ID NO: 3306343 - protein, 22 aa, Plasmodium falciparum
DREELNSSRSHHSYNSNNTSNY

SEQ ID NO: 3306344 - protein, 10 aa, Plasmodium falciparum
DREENSGNFE

SEQ ID NO: 3306345 - protein, 6 aa, Plasmodium falciparum
DREGDM

SEQ ID NO: 3306346 - protein, 8 aa, Plasmodium falciparum
DREKDKKL

SEQ ID NO: 3306347 - protein, 8 aa, Plasmodium falciparum
DREKGSNE

SEQ ID NO: 3306348 - protein, 27 aa, Plasmodium falciparum
DREKKSGKNSLLKSSSTKKSDYKKSSI

SEQ ID NO: 3306349 - protein, 10 aa, Plasmodium falciparum
DREKNLNKNN

SEQ ID NO: 3306350 - protein, 7 aa, Plasmodium falciparum
DREKQKG

SEQ ID NO: 3306351 - protein, 5 aa, Plasmodium falciparum
DREKW

SEQ ID NO: 3306352 - protein, 13 aa, Plasmodium falciparum
DRELRNEGTDTKV

SEQ ID NO: 3306353 - protein, 6 aa, Plasmodium falciparum
DREQKR

SEQ ID NO: 3306354 - protein, 7 aa, Plasmodium falciparum
DRERSLD

SEQ ID NO: 3306355 - protein, 24 aa, Plasmodium falciparum
DRESGGNSNSDDKSGSSSENDSNS

SEQ ID NO: 3306356 - protein, 7 aa, Plasmodium falciparum
DRGGTVR

SEQ ID NO: 3306357 - protein, 7 aa, Plasmodium falciparum
DRGKQSL

SEQ ID NO: 3306358 - protein, 4 aa, Plasmodium falciparum
DRGN

SEQ ID NO: 3306359 - protein, 16 aa, Plasmodium falciparum
DRGNYDETKNSTHPHH

SEQ ID NO: 3306360 - protein, 61 aa, Plasmodium falciparum
DRGTCKNTKDGDNNDGHNNDDNNDDDNNDDDNNDDDNNDGHNNDDNNDDDNDGHNNGHNNC

SEQ ID NO: 3306361 - protein, 14 aa, Plasmodium falciparum
DRHDRYGKYGKYNK

SEQ ID NO: 3306362 - protein, 6 aa, Plasmodium falciparum
DRHIEK

SEQ ID NO: 3306363 - protein, 5 aa, Plasmodium falciparum
DRHKN

SEQ ID NO: 3306364 - protein, 22 aa, Plasmodium falciparum
DRHTNQENNVSKDCNKNTTNEI

SEQ ID NO: 3306365 - protein, 47 aa, Plasmodium falciparum
DRIEGSYTNEISSTNNLPGDNQSNNNNKSNNNDNNNNNNNNNNNNNN

SEQ ID NO: 3306366 - protein, 21 aa, Plasmodium falciparum
DRIKGNKDSLISDNKKVDDKM

SEQ ID NO: 3306367 - protein, 25 aa, Plasmodium falciparum
DRITYDGKSKKGEEKNKYSKEKTNT

SEQ ID NO: 3306368 - protein, 4 aa, Plasmodium falciparum
DRKC

SEQ ID NO: 3306369 - protein, 8 aa, Plasmodium falciparum
DRKDTKKN

SEQ ID NO: 3306370 - protein, 8 aa, Plasmodium falciparum
DRKEEARE

SEQ ID NO: 3306371 - protein, 7 aa, Plasmodium falciparum
DRKGNSV

SEQ ID NO: 3306372 - protein, 15 aa, Plasmodium falciparum
DRKNDERNEEEKKNI

SEQ ID NO: 3306373 - protein, 7 aa, Plasmodium falciparum
DRKPKQK

SEQ ID NO: 3306374 - protein, 8 aa, Plasmodium falciparum
DRKRARKS

SEQ ID NO: 3306375 - protein, 18 aa, Plasmodium falciparum
DRKRGNVYDRNNEDNVYE

SEQ ID NO: 3306376 - protein, 4 aa, Plasmodium falciparum
DRKY

SEQ ID NO: 3306377 - protein, 11 aa, Plasmodium falciparum
DRLSSNNNKET

SEQ ID NO: 3306378 - protein, 5 aa, Plasmodium falciparum
DRMTT

SEQ ID NO: 3306379 - protein, 6 aa, Plasmodium falciparum
DRNEIS

SEQ ID NO: 3306380 - protein, 7 aa, Plasmodium falciparum
DRNGNDI

SEQ ID NO: 3306381 - protein, 5 aa, Plasmodium falciparum
DRNIK

SEQ ID NO: 3306382 - protein, 9 aa, Plasmodium falciparum
DRNKEPLDE

SEQ ID NO: 3306383 - protein, 5 aa, Plasmodium falciparum
DRNKI

SEQ ID NO: 3306384 - protein, 17 aa, Plasmodium falciparum
DRNNNNNNNNNNAIPGY

SEQ ID NO: 3306385 - protein, 7 aa, Plasmodium falciparum
DRNNYNK

SEQ ID NO: 3306386 - protein, 7 aa, Plasmodium falciparum
DRNNYNR

SEQ ID NO: 3306387 - protein, 8 aa, Plasmodium falciparum
DRNPTSVN

SEQ ID NO: 3306388 - protein, 6 aa, Plasmodium falciparum
DRNTSR

SEQ ID NO: 3306389 - protein, 4 aa, Plasmodium falciparum
DRNY

SEQ ID NO: 3306390 - protein, 5 aa, Plasmodium falciparum
DRNYD

SEQ ID NO: 3306391 - protein, 8 aa, Plasmodium falciparum
DRNYRQKQ

SEQ ID NO: 3306392 - protein, 9 aa, Plasmodium falciparum
DRPKKKHDD

SEQ ID NO: 3306393 - protein, 4 aa, Plasmodium falciparum
DRPN

SEQ ID NO: 3306394 - protein, 8 aa, Plasmodium falciparum
DRPTDSDS

SEQ ID NO: 3306395 - protein, 6 aa, Plasmodium falciparum
DRQIET

SEQ ID NO: 3306396 - protein, 9 aa, Plasmodium falciparum
DRQPDKYPL

SEQ ID NO: 3306397 - protein, 4 aa, Plasmodium falciparum
DRQR

SEQ ID NO: 3306398 - protein, 10 aa, Plasmodium falciparum
DRRDNKGSLL

SEQ ID NO: 3306399 - protein, 18 aa, Plasmodium falciparum
DRRESNKIDDSNIKKEKI

SEQ ID NO: 3306400 - protein, 6 aa, Plasmodium falciparum
DRRETS

SEQ ID NO: 3306401 - protein, 16 aa, Plasmodium falciparum
DRRKNKNDSKDDEKNM

SEQ ID NO: 3306402 - protein, 6 aa, Plasmodium falciparum
DRRLSN

SEQ ID NO: 3306403 - protein, 8 aa, Plasmodium falciparum
DRRNKSDV

SEQ ID NO: 3306404 - protein, 18 aa, Plasmodium falciparum
DRRRPNQSKLTSNRNEKD

SEQ ID NO: 3306405 - protein, 5 aa, Plasmodium falciparum
DRRSI

SEQ ID NO: 3306406 - protein, 7 aa, Plasmodium falciparum
DRSIKNE

SEQ ID NO: 3306407 - protein, 5 aa, Plasmodium falciparum
DRSKP

SEQ ID NO: 3306408 - protein, 5 aa, Plasmodium falciparum
DRSLP

SEQ ID NO: 3306409 - protein, 5 aa, Plasmodium falciparum
DRSMQ

SEQ ID NO: 3306410 - protein, 9 aa, Plasmodium falciparum
DRSRFDEAR

SEQ ID NO: 3306411 - protein, 7 aa, Plasmodium falciparum
DRSSEYC

SEQ ID NO: 3306412 - protein, 6 aa, Plasmodium falciparum
DRSWKS

SEQ ID NO: 3306413 - protein, 6 aa, Plasmodium falciparum
DRTKYH

SEQ ID NO: 3306414 - protein, 7 aa, Plasmodium falciparum
DRTPDHA

SEQ ID NO: 3306415 - protein, 4 aa, Plasmodium falciparum
DRTR

SEQ ID NO: 3306416 - protein, 8 aa, Plasmodium falciparum
DRTTHNYN

SEQ ID NO: 3306417 - protein, 10 aa, Plasmodium falciparum
DRTYKRANRE

SEQ ID NO: 3306418 - protein, 5 aa, Plasmodium falciparum
DRTYS

SEQ ID NO: 3306419 - protein, 14 aa, Plasmodium falciparum
DRYDKSVKGSSTPR

SEQ ID NO: 3306420 - protein, 8 aa, Plasmodium falciparum
DRYESSSE

SEQ ID NO: 3306421 - protein, 4 aa, Plasmodium falciparum
DRYK

SEQ ID NO: 3306422 - protein, 7 aa, Plasmodium falciparum
DRYKNST

SEQ ID NO: 3306423 - protein, 13 aa, Plasmodium falciparum
DRYNKPVKFIPPG

SEQ ID NO: 3306424 - protein, 4 aa, Plasmodium falciparum
DRYQ

SEQ ID NO: 3306425 - protein, 8 aa, Plasmodium falciparum
DRYYNGNR

SEQ ID NO: 3306426 - protein, 75 aa, Plasmodium falciparum
DSADEKKNKKTKKQKKKEKNESERENESENESESEKLGNDDLDENNNSSEDSEAEKSDSNDDDEDENNDSDNHEE

SEQ ID NO: 3306427 - protein, 7 aa, Plasmodium falciparum
DSADTAN

SEQ ID NO: 3306428 - protein, 8 aa, Plasmodium falciparum
DSAGNNDY

SEQ ID NO: 3306429 - protein, 7 aa, Plasmodium falciparum
DSAKKQA

SEQ ID NO: 3306430 - protein, 6 aa, Plasmodium falciparum
DSALNA

SEQ ID NO: 3306431 - protein, 14 aa, Plasmodium falciparum
DSANMNEEFNSNDN

SEQ ID NO: 3306432 - protein, 9 aa, Plasmodium falciparum
DSANSKKKY

SEQ ID NO: 3306433 - protein, 5 aa, Plasmodium falciparum
DSAPH

SEQ ID NO: 3306434 - protein, 7 aa, Plasmodium falciparum
DSASREL

SEQ ID NO: 3306435 - protein, 25 aa, Plasmodium falciparum
DSCKEKSSSSENSVYSPLSRKTSSR

SEQ ID NO: 3306436 - protein, 18 aa, Plasmodium falciparum
DSCNNDNNTTNEKTYQSY

SEQ ID NO: 3306437 - protein, 8 aa, Plasmodium falciparum
DSCNSSKG

SEQ ID NO: 3306438 - protein, 4 aa, Plasmodium falciparum
DSDD

SEQ ID NO: 3306439 - protein, 22 aa, Plasmodium falciparum
DSDDDEKNKDSVNYDKYEQNDN

SEQ ID NO: 3306440 - protein, 5 aa, Plasmodium falciparum
DSDEE

SEQ ID NO: 3306441 - protein, 6 aa, Plasmodium falciparum
DSDEEL

SEQ ID NO: 3306442 - protein, 9 aa, Plasmodium falciparum
DSDEESKDK

SEQ ID NO: 3306443 - protein, 36 aa, Plasmodium falciparum
DSDENDKKEKSIKGTKEKKESIEITSKQKKNSDINV

SEQ ID NO: 3306444 - protein, 6 aa, Plasmodium falciparum
DSDENK

SEQ ID NO: 3306445 - protein, 9 aa, Plasmodium falciparum
DSDGSGKID

SEQ ID NO: 3306446 - protein, 58 aa, Plasmodium falciparum
DSDKRHKTKIDEDQMDSTSNVHEKTKELKNSGSLENKENKENKQNKQNKQNKEYTQYT

SEQ ID NO: 3306447 - protein, 15 aa, Plasmodium falciparum
DSDKSKMGDVQPNDQ

SEQ ID NO: 3306448 - protein, 11 aa, Plasmodium falciparum
DSDMDENTNQL

SEQ ID NO: 3306449 - protein, 19 aa, Plasmodium falciparum
DSDNKNVENSKNTIPKNGK

SEQ ID NO: 3306450 - protein, 9 aa, Plasmodium falciparum
DSDNNDNLE

SEQ ID NO: 3306451 - protein, 6 aa, Plasmodium falciparum
DSDQYD

SEQ ID NO: 3306452 - protein, 9 aa, Plasmodium falciparum
DSDSLTGEE

SEQ ID NO: 3306453 - protein, 7 aa, Plasmodium falciparum
DSDSVKN

SEQ ID NO: 3306454 - protein, 26 aa, Plasmodium falciparum
DSDTNNNEKNNKYNHKYNNNNNNNMC

SEQ ID NO: 3306455 - protein, 4 aa, Plasmodium falciparum
DSDW

SEQ ID NO: 3306456 - protein, 4 aa, Plasmodium falciparum
DSDY

SEQ ID NO: 3306457 - protein, 77 aa, Plasmodium falciparum
DSEADLNEKPNEEPNEEPNEEPNEKPNEESNEKPNEESNEESSEKLNEEPNEKPNEKPNEKPNEKPNKKTNTEPVPD

SEQ ID NO: 3306458 - protein, 5 aa, Plasmodium falciparum
DSEDD

SEQ ID NO: 3306459 - protein, 6 aa, Plasmodium falciparum
DSEDEK

SEQ ID NO: 3306460 - protein, 5 aa, Plasmodium falciparum
DSEDI

SEQ ID NO: 3306461 - protein, 10 aa, Plasmodium falciparum
DSEDKDVKEA

SEQ ID NO: 3306462 - protein, 8 aa, Plasmodium falciparum
DSEDYNNK

SEQ ID NO: 3306463 - protein, 4 aa, Plasmodium falciparum
DSEE

SEQ ID NO: 3306464 - protein, 69 aa, Plasmodium falciparum
DSEEEKNIKNKDTINNDEKRKDNINDDEKRKDNINNDAEKNKSLSDDNNNNNNNNNNYDYDNDDEKKYS

SEQ ID NO: 3306465 - protein, 9 aa, Plasmodium falciparum
DSEEKDEFK

SEQ ID NO: 3306466 - protein, 6 aa, Plasmodium falciparum
DSEEKI

SEQ ID NO: 3306467 - protein, 14 aa, Plasmodium falciparum
DSEITHDKKKNNYD

SEQ ID NO: 3306468 - protein, 16 aa, Plasmodium falciparum
DSEITKENGYLGESNS

SEQ ID NO: 3306469 - protein, 4 aa, Plasmodium falciparum
DSEK

SEQ ID NO: 3306470 - protein, 13 aa, Plasmodium falciparum
DSEKGSASQENKY

SEQ ID NO: 3306471 - protein, 12 aa, Plasmodium falciparum
DSEKNKLSRGSA

SEQ ID NO: 3306472 - protein, 8 aa, Plasmodium falciparum
DSEKSRKV

SEQ ID NO: 3306473 - protein, 7 aa, Plasmodium falciparum
DSELQTN

SEQ ID NO: 3306474 - protein, 10 aa, Plasmodium falciparum
DSELSGDREV

SEQ ID NO: 3306475 - protein, 9 aa, Plasmodium falciparum
DSEMNDNNE

SEQ ID NO: 3306476 - protein, 8 aa, Plasmodium falciparum
DSENEKYN

SEQ ID NO: 3306477 - protein, 6 aa, Plasmodium falciparum
DSENMN

SEQ ID NO: 3306478 - protein, 72 aa, Plasmodium falciparum
DSENMNDDDDNNMNDDYNNNNIKGDYNNNNIKDDDVDDDDYDDDDDDNFDENKNCNDNCSSKHKRNVPSKKE

SEQ ID NO: 3306479 - protein, 7 aa, Plasmodium falciparum
DSENWTE

SEQ ID NO: 3306480 - protein, 5 aa, Plasmodium falciparum
DSEST

SEQ ID NO: 3306481 - protein, 6 aa, Plasmodium falciparum
DSEYNE

SEQ ID NO: 3306482 - protein, 8 aa, Plasmodium falciparum
DSEYNKKN

SEQ ID NO: 3306483 - protein, 8 aa, Plasmodium falciparum
DSEYSADG

SEQ ID NO: 3306484 - protein, 4 aa, Plasmodium falciparum
DSFC

SEQ ID NO: 3306485 - protein, 4 aa, Plasmodium falciparum
DSFE

SEQ ID NO: 3306486 - protein, 11 aa, Plasmodium falciparum
DSFSSSDTSLS

SEQ ID NO: 3306487 - protein, 4 aa, Plasmodium falciparum
DSFT

SEQ ID NO: 3306488 - protein, 9 aa, Plasmodium falciparum
DSGANDSIL

SEQ ID NO: 3306489 - protein, 10 aa, Plasmodium falciparum
DSGDTEVTHN

SEQ ID NO: 3306490 - protein, 8 aa, Plasmodium falciparum
DSGDVPPD

SEQ ID NO: 3306491 - protein, 7 aa, Plasmodium falciparum
DSGGAEN

SEQ ID NO: 3306492 - protein, 14 aa, Plasmodium falciparum
DSGGLVNSKRNSFN

SEQ ID NO: 3306493 - protein, 17 aa, Plasmodium falciparum
DSGISDSDDSDDEKETY

SEQ ID NO: 3306494 - protein, 9 aa, Plasmodium falciparum
DSGKKGSIS

SEQ ID NO: 3306495 - protein, 6 aa, Plasmodium falciparum
DSGKTS

SEQ ID NO: 3306496 - protein, 4 aa, Plasmodium falciparum
DSGM

SEQ ID NO: 3306497 - protein, 9 aa, Plasmodium falciparum
DSGNEIKDD

SEQ ID NO: 3306498 - protein, 6 aa, Plasmodium falciparum
DSGSHN

SEQ ID NO: 3306499 - protein, 9 aa, Plasmodium falciparum
DSGSVNKNN

SEQ ID NO: 3306500 - protein, 10 aa, Plasmodium falciparum
DSGTLAPPES

SEQ ID NO: 3306501 - protein, 7 aa, Plasmodium falciparum
DSHASRI

SEQ ID NO: 3306502 - protein, 28 aa, Plasmodium falciparum
DSHNNNDSHNNNDNHNNDSHNNNEQDGN

SEQ ID NO: 3306503 - protein, 12 aa, Plasmodium falciparum
DSHNNNNNNNNN

SEQ ID NO: 3306504 - protein, 8 aa, Plasmodium falciparum
DSHSKSSI

SEQ ID NO: 3306505 - protein, 8 aa, Plasmodium falciparum
DSIANNSQ

SEQ ID NO: 3306506 - protein, 17 aa, Plasmodium falciparum
DSIDYNNNNINNDSAIS

SEQ ID NO: 3306507 - protein, 8 aa, Plasmodium falciparum
DSINNHEE

SEQ ID NO: 3306508 - protein, 6 aa, Plasmodium falciparum
DSISNI

SEQ ID NO: 3306509 - protein, 16 aa, Plasmodium falciparum
DSISNNNSNNSNNNMN

SEQ ID NO: 3306510 - protein, 8 aa, Plasmodium falciparum
DSITEGTI

SEQ ID NO: 3306511 - protein, 16 aa, Plasmodium falciparum
DSKCDGSSKYGGSSKY

SEQ ID NO: 3306512 - protein, 13 aa, Plasmodium falciparum
DSKCEEKKNSIQN

SEQ ID NO: 3306513 - protein, 8 aa, Plasmodium falciparum
DSKDSTSN

SEQ ID NO: 3306514 - protein, 9 aa, Plasmodium falciparum
DSKDVSEPM

SEQ ID NO: 3306515 - protein, 14 aa, Plasmodium falciparum
DSKEIEKQNKKKNK

SEQ ID NO: 3306516 - protein, 6 aa, Plasmodium falciparum
DSKERI

SEQ ID NO: 3306517 - protein, 11 aa, Plasmodium falciparum
DSKGTDSTRTN

SEQ ID NO: 3306518 - protein, 7 aa, Plasmodium falciparum
DSKKEKW

SEQ ID NO: 3306519 - protein, 10 aa, Plasmodium falciparum
DSKKITEADR

SEQ ID NO: 3306520 - protein, 10 aa, Plasmodium falciparum
DSKKKQKNVH

SEQ ID NO: 3306521 - protein, 20 aa, Plasmodium falciparum
DSKKVKKKSGYFTTDPYDTS

SEQ ID NO: 3306522 - protein, 4 aa, Plasmodium falciparum
DSKN

SEQ ID NO: 3306523 - protein, 11 aa, Plasmodium falciparum
DSKNEESSQHM

SEQ ID NO: 3306524 - protein, 6 aa, Plasmodium falciparum
DSKNIA

SEQ ID NO: 3306525 - protein, 6 aa, Plasmodium falciparum
DSKNIN

SEQ ID NO: 3306526 - protein, 10 aa, Plasmodium falciparum
DSKNRKNRNT

SEQ ID NO: 3306527 - protein, 10 aa, Plasmodium falciparum
DSKQEQNNED

SEQ ID NO: 3306528 - protein, 8 aa, Plasmodium falciparum
DSKQSEVP

SEQ ID NO: 3306529 - protein, 9 aa, Plasmodium falciparum
DSKSDKSTS

SEQ ID NO: 3306530 - protein, 9 aa, Plasmodium falciparum
DSKTTRENY

SEQ ID NO: 3306531 - protein, 8 aa, Plasmodium falciparum
DSKYDKQN

SEQ ID NO: 3306532 - protein, 7 aa, Plasmodium falciparum
DSKYDNY

SEQ ID NO: 3306533 - protein, 6 aa, Plasmodium falciparum
DSKYPD

SEQ ID NO: 3306534 - protein, 10 aa, Plasmodium falciparum
DSLEKNKSDT

SEQ ID NO: 3306535 - protein, 4 aa, Plasmodium falciparum
DSLK

SEQ ID NO: 3306536 - protein, 5 aa, Plasmodium falciparum
DSLKK

SEQ ID NO: 3306537 - protein, 6 aa, Plasmodium falciparum
DSLKQN

SEQ ID NO: 3306538 - protein, 6 aa, Plasmodium falciparum
DSLNDD

SEQ ID NO: 3306539 - protein, 13 aa, Plasmodium falciparum
DSLNEKGKVSADI

SEQ ID NO: 3306540 - protein, 9 aa, Plasmodium falciparum
DSLNENYNE

SEQ ID NO: 3306541 - protein, 24 aa, Plasmodium falciparum
DSLNQNENTIENKNDYTKDIRTTQ

SEQ ID NO: 3306542 - protein, 6 aa, Plasmodium falciparum
DSLPRG

SEQ ID NO: 3306543 - protein, 7 aa, Plasmodium falciparum
DSLSEDQ

SEQ ID NO: 3306544 - protein, 10 aa, Plasmodium falciparum
DSLSNKDTYA

SEQ ID NO: 3306545 - protein, 7 aa, Plasmodium falciparum
DSLTGDR

SEQ ID NO: 3306546 - protein, 5 aa, Plasmodium falciparum
DSLTK

SEQ ID NO: 3306547 - protein, 40 aa, Plasmodium falciparum
DSMNEEGCNKSSIENNNIDNKNGLQNNNVEEKDENNHEKN

SEQ ID NO: 3306548 - protein, 8 aa, Plasmodium falciparum
DSMPPSEH

SEQ ID NO: 3306549 - protein, 12 aa, Plasmodium falciparum
DSMSNNSSTNYY

SEQ ID NO: 3306550 - protein, 11 aa, Plasmodium falciparum
DSNADGKSTYP

SEQ ID NO: 3306551 - protein, 6 aa, Plasmodium falciparum
DSNANA

SEQ ID NO: 3306552 - protein, 7 aa, Plasmodium falciparum
DSNASGQ

SEQ ID NO: 3306553 - protein, 4 aa, Plasmodium falciparum
DSND

SEQ ID NO: 3306554 - protein, 16 aa, Plasmodium falciparum
DSNDDSSSKYNDRDNI

SEQ ID NO: 3306555 - protein, 19 aa, Plasmodium falciparum
DSNDEETEVNTSEENEKPL

SEQ ID NO: 3306556 - protein, 9 aa, Plasmodium falciparum
DSNDITNYN

SEQ ID NO: 3306557 - protein, 45 aa, Plasmodium falciparum
DSNDMNNNNNNDNDNNDNNNNNNDNNNDDESQHNNSNNNDVDNNT

SEQ ID NO: 3306558 - protein, 7 aa, Plasmodium falciparum
DSNDSLI

SEQ ID NO: 3306559 - protein, 9 aa, Plasmodium falciparum
DSNDSSSYT

SEQ ID NO: 3306560 - protein, 6 aa, Plasmodium falciparum
DSNECE

SEQ ID NO: 3306561 - protein, 7 aa, Plasmodium falciparum
DSNEINK

SEQ ID NO: 3306562 - protein, 9 aa, Plasmodium falciparum
DSNEKNDME

SEQ ID NO: 3306563 - protein, 9 aa, Plasmodium falciparum
DSNEQVKES

SEQ ID NO: 3306564 - protein, 7 aa, Plasmodium falciparum
DSNFISN

SEQ ID NO: 3306565 - protein, 5 aa, Plasmodium falciparum
DSNFS

SEQ ID NO: 3306566 - protein, 7 aa, Plasmodium falciparum
DSNGDRR

SEQ ID NO: 3306567 - protein, 20 aa, Plasmodium falciparum
DSNHNEDSSNDNNESDDNVN

SEQ ID NO: 3306568 - protein, 5 aa, Plasmodium falciparum
DSNIE

SEQ ID NO: 3306569 - protein, 5 aa, Plasmodium falciparum
DSNIK

SEQ ID NO: 3306570 - protein, 6 aa, Plasmodium falciparum
DSNINN

SEQ ID NO: 3306571 - protein, 15 aa, Plasmodium falciparum
DSNKEDSEKNSLKSY

SEQ ID NO: 3306572 - protein, 7 aa, Plasmodium falciparum
DSNKKKQ

SEQ ID NO: 3306573 - protein, 10 aa, Plasmodium falciparum
DSNKQSSINA

SEQ ID NO: 3306574 - protein, 11 aa, Plasmodium falciparum
DSNLKKKKKIK

SEQ ID NO: 3306575 - protein, 23 aa, Plasmodium falciparum
DSNNINNNNNNNNNNNNNNGDGS

SEQ ID NO: 3306576 - protein, 7 aa, Plasmodium falciparum
DSNNKKH

SEQ ID NO: 3306577 - protein, 6 aa, Plasmodium falciparum
DSNNKN

SEQ ID NO: 3306578 - protein, 10 aa, Plasmodium falciparum
DSNNKSKGLN

SEQ ID NO: 3306579 - protein, 11 aa, Plasmodium falciparum
DSNNNESFKGG

SEQ ID NO: 3306580 - protein, 8 aa, Plasmodium falciparum
DSNNNMNN

SEQ ID NO: 3306581 - protein, 38 aa, Plasmodium falciparum
DSNNNNNDNNSNCNNDNSNIDSNHTMDNEKKEDFINSS

SEQ ID NO: 3306582 - protein, 11 aa, Plasmodium falciparum
DSNNNNNNNNN

SEQ ID NO: 3306583 - protein, 17 aa, Plasmodium falciparum
DSNNNYENKNKTNEKKD

SEQ ID NO: 3306584 - protein, 7 aa, Plasmodium falciparum
DSNNVNK

SEQ ID NO: 3306585 - protein, 7 aa, Plasmodium falciparum
DSNPHIK

SEQ ID NO: 3306586 - protein, 11 aa, Plasmodium falciparum
DSNPNLNVGKE

SEQ ID NO: 3306587 - protein, 24 aa, Plasmodium falciparum
DSNQGKELTGTQHTNEKRNYEDRG

SEQ ID NO: 3306588 - protein, 7 aa, Plasmodium falciparum
DSNQNDL

SEQ ID NO: 3306589 - protein, 7 aa, Plasmodium falciparum
DSNQRNK

SEQ ID NO: 3306590 - protein, 8 aa, Plasmodium falciparum
DSNSAQNF

SEQ ID NO: 3306591 - protein, 10 aa, Plasmodium falciparum
DSNSERRRNS

SEQ ID NO: 3306592 - protein, 82 aa, Plasmodium falciparum
DSNSIRKSNSNSTRKSNSNSTRNSIRKSYNSNNKNHRKSRSYDSYNDNSSYKRSKLKKSYKYDKHTQSKYNNNNNNNNNDRR

SEQ ID NO: 3306593 - protein, 5 aa, Plasmodium falciparum
DSNSL

SEQ ID NO: 3306594 - protein, 6 aa, Plasmodium falciparum
DSNSNI

SEQ ID NO: 3306595 - protein, 60 aa, Plasmodium falciparum
DSNSRCSKQNYKKNKNKKNNHNKDTVHGNNPLGDINTQTKKQTNKSININKNDDAQEDDL

SEQ ID NO: 3306596 - protein, 10 aa, Plasmodium falciparum
DSNSSSTCDD

SEQ ID NO: 3306597 - protein, 6 aa, Plasmodium falciparum
DSNTIY

SEQ ID NO: 3306598 - protein, 33 aa, Plasmodium falciparum
DSNTTTTTTTTTTTTNNNNNNNNNNNNNNKPTS

SEQ ID NO: 3306599 - protein, 6 aa, Plasmodium falciparum
DSNVKK

SEQ ID NO: 3306600 - protein, 35 aa, Plasmodium falciparum
DSNVSNTTHNNHNNNNNNNNNSKNKNNFSSSISSS

SEQ ID NO: 3306601 - protein, 6 aa, Plasmodium falciparum
DSNWSY

SEQ ID NO: 3306602 - protein, 7 aa, Plasmodium falciparum
DSNYQIE

SEQ ID NO: 3306603 - protein, 6 aa, Plasmodium falciparum
DSPEQI

SEQ ID NO: 3306604 - protein, 6 aa, Plasmodium falciparum
DSPGEA

SEQ ID NO: 3306605 - protein, 4 aa, Plasmodium falciparum
DSPH

SEQ ID NO: 3306606 - protein, 4 aa, Plasmodium falciparum
DSPL

SEQ ID NO: 3306607 - protein, 6 aa, Plasmodium falciparum
DSPNPI

SEQ ID NO: 3306608 - protein, 14 aa, Plasmodium falciparum
DSPNQMRYNTYSIS

SEQ ID NO: 3306609 - protein, 4 aa, Plasmodium falciparum
DSPQ

SEQ ID NO: 3306610 - protein, 13 aa, Plasmodium falciparum
DSPRNTKNKHRAS

SEQ ID NO: 3306611 - protein, 4 aa, Plasmodium falciparum
DSPS

SEQ ID NO: 3306612 - protein, 9 aa, Plasmodium falciparum
DSPSESNTG

SEQ ID NO: 3306613 - protein, 7 aa, Plasmodium falciparum
DSPSLYS

SEQ ID NO: 3306614 - protein, 6 aa, Plasmodium falciparum
DSPSND

SEQ ID NO: 3306615 - protein, 9 aa, Plasmodium falciparum
DSPSNGIDE

SEQ ID NO: 3306616 - protein, 6 aa, Plasmodium falciparum
DSQDDL

SEQ ID NO: 3306617 - protein, 4 aa, Plasmodium falciparum
DSQE

SEQ ID NO: 3306618 - protein, 13 aa, Plasmodium falciparum
DSQKKKNNIKKEY

SEQ ID NO: 3306619 - protein, 19 aa, Plasmodium falciparum
DSQKRNPLQTYNTSKNTNN

SEQ ID NO: 3306620 - protein, 5 aa, Plasmodium falciparum
DSQLK

SEQ ID NO: 3306621 - protein, 9 aa, Plasmodium falciparum
DSQNKNGKS

SEQ ID NO: 3306622 - protein, 17 aa, Plasmodium falciparum
DSQNKRDIKQDNISKKK

SEQ ID NO: 3306623 - protein, 72 aa, Plasmodium falciparum
DSQQEEDQDEEDNDEDEGEDDYDDEDDDDEDDEDDDDEDDEDDDDEDEEDSYDDDEDEEDSYDEDEQEEDSY

SEQ ID NO: 3306624 - protein, 13 aa, Plasmodium falciparum
DSQRQATKDAGAI

SEQ ID NO: 3306625 - protein, 13 aa, Plasmodium falciparum
DSQRQATKDAGKI

SEQ ID NO: 3306626 - protein, 13 aa, Plasmodium falciparum
DSQRQATKDAGTI

SEQ ID NO: 3306627 - protein, 5 aa, Plasmodium falciparum
DSQYL

SEQ ID NO: 3306628 - protein, 5 aa, Plasmodium falciparum
DSRDL

SEQ ID NO: 3306629 - protein, 10 aa, Plasmodium falciparum
DSRDRSRAIN

SEQ ID NO: 3306630 - protein, 11 aa, Plasmodium falciparum
DSREDEQKRQI

SEQ ID NO: 3306631 - protein, 7 aa, Plasmodium falciparum
DSRIPND

SEQ ID NO: 3306632 - protein, 5 aa, Plasmodium falciparum
DSSAT

SEQ ID NO: 3306633 - protein, 6 aa, Plasmodium falciparum
DSSAYE

SEQ ID NO: 3306634 - protein, 23 aa, Plasmodium falciparum
DSSCINASDEQKSSEEKDNLGEA

SEQ ID NO: 3306635 - protein, 10 aa, Plasmodium falciparum
DSSDADKEVT

SEQ ID NO: 3306636 - protein, 9 aa, Plasmodium falciparum
DSSDLSSSF

SEQ ID NO: 3306637 - protein, 14 aa, Plasmodium falciparum
DSSDNDSVNSYDDK

SEQ ID NO: 3306638 - protein, 77 aa, Plasmodium falciparum
DSSDSEYDEKFKKKEKKKKKERDRDRDKDRDKDKDKDRDRTRDRTRDRTREKSYKDNKDSKYKKKKKYDDSDDDFDD

SEQ ID NO: 3306639 - protein, 111 aa, Plasmodium falciparum
DSSEEGEEDDDENDDDDENDDDEEDDDDEEDDDDENDDDENDDDENDDDENDDDENDDDENDDDEEDDDDEEDDDDENDNDENDNDENDDDEEDDDDENDDEEDEGEDDDD

SEQ ID NO: 3306640 - protein, 16 aa, Plasmodium falciparum
DSSEEREGSSNTSSNV

SEQ ID NO: 3306641 - protein, 5 aa, Plasmodium falciparum
DSSHN

SEQ ID NO: 3306642 - protein, 10 aa, Plasmodium falciparum
DSSHNTNKHE

SEQ ID NO: 3306643 - protein, 4 aa, Plasmodium falciparum
DSSK

SEQ ID NO: 3306644 - protein, 10 aa, Plasmodium falciparum
DSSKKSHVSR

SEQ ID NO: 3306645 - protein, 4 aa, Plasmodium falciparum
DSSL

SEQ ID NO: 3306646 - protein, 14 aa, Plasmodium falciparum
DSSMEDHDNEINGS

SEQ ID NO: 3306647 - protein, 7 aa, Plasmodium falciparum
DSSNDCK

SEQ ID NO: 3306648 - protein, 66 aa, Plasmodium falciparum
DSSNENDENDENDENDENDENDENDENDENDENDENDEKDENDENDENDENFDNNNEGTLNEMNSE

SEQ ID NO: 3306649 - protein, 7 aa, Plasmodium falciparum
DSSNKPY

SEQ ID NO: 3306650 - protein, 7 aa, Plasmodium falciparum
DSSNMNT

SEQ ID NO: 3306651 - protein, 8 aa, Plasmodium falciparum
DSSPGTRY

SEQ ID NO: 3306652 - protein, 16 aa, Plasmodium falciparum
DSSPNRSPSKVNQEQE

SEQ ID NO: 3306653 - protein, 6 aa, Plasmodium falciparum
DSSQGK

SEQ ID NO: 3306654 - protein, 7 aa, Plasmodium falciparum
DSSRKKE

SEQ ID NO: 3306655 - protein, 5 aa, Plasmodium falciparum
DSSRY

SEQ ID NO: 3306656 - protein, 5 aa, Plasmodium falciparum
DSSSF

SEQ ID NO: 3306657 - protein, 55 aa, Plasmodium falciparum
DSSSNDKNYNNNKKDDEEEEEENNDDKEENNDDKEENNDDEEEENNNNNNNSNKC

SEQ ID NO: 3306658 - protein, 10 aa, Plasmodium falciparum
DSSSSEEEER

SEQ ID NO: 3306659 - protein, 19 aa, Plasmodium falciparum
DSSSSSSSSSSPSSSPYTS

SEQ ID NO: 3306660 - protein, 14 aa, Plasmodium falciparum
DSSTASVATSDNHY

SEQ ID NO: 3306661 - protein, 5 aa, Plasmodium falciparum
DSSTN

SEQ ID NO: 3306662 - protein, 27 aa, Plasmodium falciparum
DSSTNDPKSDMNGSNNNNSSSNNNNNI

SEQ ID NO: 3306663 - protein, 13 aa, Plasmodium falciparum
DSSTSSKDDNPYC

SEQ ID NO: 3306664 - protein, 14 aa, Plasmodium falciparum
DSSTSTQEKTKETR

SEQ ID NO: 3306665 - protein, 5 aa, Plasmodium falciparum
DSSVE

SEQ ID NO: 3306666 - protein, 8 aa, Plasmodium falciparum
DSSVSLSN

SEQ ID NO: 3306667 - protein, 4 aa, Plasmodium falciparum
DSSY

SEQ ID NO: 3306668 - protein, 53 aa, Plasmodium falciparum
DSSYSSSENNSNYNSYESNNSAYNDENSNVDTNEYDDNEEEEEGAKSNEDPLT

SEQ ID NO: 3306669 - protein, 7 aa, Plasmodium falciparum
DSTCTSE

SEQ ID NO: 3306670 - protein, 7 aa, Plasmodium falciparum
DSTDSIR

SEQ ID NO: 3306671 - protein, 17 aa, Plasmodium falciparum
DSTEKDKKTCLYNERKE

SEQ ID NO: 3306672 - protein, 9 aa, Plasmodium falciparum
DSTGNRNHA

SEQ ID NO: 3306673 - protein, 9 aa, Plasmodium falciparum
DSTKEKGTV

SEQ ID NO: 3306674 - protein, 12 aa, Plasmodium falciparum
DSTKEKNNKDTF

SEQ ID NO: 3306675 - protein, 8 aa, Plasmodium falciparum
DSTKGENK

SEQ ID NO: 3306676 - protein, 6 aa, Plasmodium falciparum
DSTKIT

SEQ ID NO: 3306677 - protein, 34 aa, Plasmodium falciparum
DSTKKYTSNHNNNKNNNHNNNHNNYHNNNHNNNH

SEQ ID NO: 3306678 - protein, 10 aa, Plasmodium falciparum
DSTKNNFGVT

SEQ ID NO: 3306679 - protein, 24 aa, Plasmodium falciparum
DSTKNNFGVTPSLDSTKNNFGVTP

SEQ ID NO: 3306680 - protein, 9 aa, Plasmodium falciparum
DSTKYGPNE

SEQ ID NO: 3306681 - protein, 25 aa, Plasmodium falciparum
DSTLPSNNNYNNSSNNNNNNNKYET

SEQ ID NO: 3306682 - protein, 24 aa, Plasmodium falciparum
DSTMRNEQDKYVQPNEQRYDKQDY

SEQ ID NO: 3306683 - protein, 15 aa, Plasmodium falciparum
DSTNNSCSKYKSDKT

SEQ ID NO: 3306684 - protein, 8 aa, Plasmodium falciparum
DSTNNVNK

SEQ ID NO: 3306685 - protein, 10 aa, Plasmodium falciparum
DSTPRQRVSD

SEQ ID NO: 3306686 - protein, 4 aa, Plasmodium falciparum
DSTQ

SEQ ID NO: 3306687 - protein, 30 aa, Plasmodium falciparum
DSTTNSYTPNNAIEKNNNGNCNRSNNNTQN

SEQ ID NO: 3306688 - protein, 17 aa, Plasmodium falciparum
DSTVPYYSNNNNKDNIF

SEQ ID NO: 3306689 - protein, 4 aa, Plasmodium falciparum
DSTY

SEQ ID NO: 3306690 - protein, 4 aa, Plasmodium falciparum
DSVC

SEQ ID NO: 3306691 - protein, 9 aa, Plasmodium falciparum
DSVEKNKRK

SEQ ID NO: 3306692 - protein, 7 aa, Plasmodium falciparum
DSVENAV

SEQ ID NO: 3306693 - protein, 18 aa, Plasmodium falciparum
DSVKDKEQKLNGTYFIID

SEQ ID NO: 3306694 - protein, 10 aa, Plasmodium falciparum
DSVQTDNYDQ

SEQ ID NO: 3306695 - protein, 4 aa, Plasmodium falciparum
DSVS

SEQ ID NO: 3306696 - protein, 65 aa, Plasmodium falciparum
DSVTIQEPTATQEPPTTQELTATQEPTTTQETVTEQEPTTTQETVTAQEPITTQEPVTAQEPVTT

SEQ ID NO: 3306697 - protein, 53 aa, Plasmodium falciparum
DSVTIQEPTATQEPTTTQETVTEQEPTTTQETVTAQEPITTQEPVTAQEPVTT

SEQ ID NO: 3306698 - protein, 39 aa, Plasmodium falciparum
DSYAAKNPKTNNEQCKRKKKKKKEREKENNNNPPDMDTY

SEQ ID NO: 3306699 - protein, 6 aa, Plasmodium falciparum
DSYDSG

SEQ ID NO: 3306700 - protein, 6 aa, Plasmodium falciparum
DSYDSS

SEQ ID NO: 3306701 - protein, 9 aa, Plasmodium falciparum
DSYEEDSLE

SEQ ID NO: 3306702 - protein, 18 aa, Plasmodium falciparum
DSYKDQNACEENDEMDIE

SEQ ID NO: 3306703 - protein, 4 aa, Plasmodium falciparum
DSYN

SEQ ID NO: 3306704 - protein, 6 aa, Plasmodium falciparum
DSYNQN

SEQ ID NO: 3306705 - protein, 14 aa, Plasmodium falciparum
DSYNTPSDNPNDHC

SEQ ID NO: 3306706 - protein, 13 aa, Plasmodium falciparum
DSYNYRRKENNMR

SEQ ID NO: 3306707 - protein, 6 aa, Plasmodium falciparum
DSYPLN

SEQ ID NO: 3306708 - protein, 8 aa, Plasmodium falciparum
DSYRDTHE

SEQ ID NO: 3306709 - protein, 9 aa, Plasmodium falciparum
DSYSRENTK

SEQ ID NO: 3306710 - protein, 13 aa, Plasmodium falciparum
DSYSSDKKKENME

SEQ ID NO: 3306711 - protein, 4 aa, Plasmodium falciparum
DTAA

SEQ ID NO: 3306712 - protein, 8 aa, Plasmodium falciparum
DTADHTKL

SEQ ID NO: 3306713 - protein, 15 aa, Plasmodium falciparum
DTAIGNAEKKGGLKQ

SEQ ID NO: 3306714 - protein, 4 aa, Plasmodium falciparum
DTCE

SEQ ID NO: 3306715 - protein, 11 aa, Plasmodium falciparum
DTCNNKDEKNI

SEQ ID NO: 3306716 - protein, 10 aa, Plasmodium falciparum
DTDDEDENMS

SEQ ID NO: 3306717 - protein, 17 aa, Plasmodium falciparum
DTDDEDNISDDNGKTDV

SEQ ID NO: 3306718 - protein, 10 aa, Plasmodium falciparum
DTDDNNSTYN

SEQ ID NO: 3306719 - protein, 10 aa, Plasmodium falciparum
DTDDTDDMDD

SEQ ID NO: 3306720 - protein, 9 aa, Plasmodium falciparum
DTDEDEDSD

SEQ ID NO: 3306721 - protein, 13 aa, Plasmodium falciparum
DTDEEDKANDYDD

SEQ ID NO: 3306722 - protein, 13 aa, Plasmodium falciparum
DTDFEEGQENNRN

SEQ ID NO: 3306723 - protein, 6 aa, Plasmodium falciparum
DTDGNG

SEQ ID NO: 3306724 - protein, 8 aa, Plasmodium falciparum
DTDGNGTI

SEQ ID NO: 3306725 - protein, 10 aa, Plasmodium falciparum
DTDMNSKDNV

SEQ ID NO: 3306726 - protein, 4 aa, Plasmodium falciparum
DTDN

SEQ ID NO: 3306727 - protein, 9 aa, Plasmodium falciparum
DTDNDPYVD

SEQ ID NO: 3306728 - protein, 6 aa, Plasmodium falciparum
DTDNNN

SEQ ID NO: 3306729 - protein, 181 aa, Plasmodium falciparum
DTDNNNNNNNNNNNNNKNDNDNNNNDNNNNNNNNDNNYNNDNNNDNNNESRSSSKNNKIKNNNSKGNNHNNNQDNNEKNNDDHNNGGDHDGNGSGQNSGNSNTRNNNNNNNNNNNNNNNNNNSSNNNNNSSNNNNNSSNNNNNNNNNNNNKKNNNNNSSSSNNNNHNANNNSSVKLNDGNN

SEQ ID NO: 3306730 - protein, 21 aa, Plasmodium falciparum
DTDSQIENDIDKNEKTQDNLN

SEQ ID NO: 3306731 - protein, 17 aa, Plasmodium falciparum
DTDTHTGKDRDSSSSEY

SEQ ID NO: 3306732 - protein, 7 aa, Plasmodium falciparum
DTDTNDN

SEQ ID NO: 3306733 - protein, 22 aa, Plasmodium falciparum
DTDTTNSKDLNLSKEKSSKLKN

SEQ ID NO: 3306734 - protein, 8 aa, Plasmodium falciparum
DTEDEKSY

SEQ ID NO: 3306735 - protein, 6 aa, Plasmodium falciparum
DTEDSK

SEQ ID NO: 3306736 - protein, 7 aa, Plasmodium falciparum
DTEDYEA

SEQ ID NO: 3306737 - protein, 4 aa, Plasmodium falciparum
DTEE

SEQ ID NO: 3306738 - protein, 10 aa, Plasmodium falciparum
DTEEDNINEQ

SEQ ID NO: 3306739 - protein, 9 aa, Plasmodium falciparum
DTEEEKKKV

SEQ ID NO: 3306740 - protein, 19 aa, Plasmodium falciparum
DTEESNDSISNSNTFGTEV

SEQ ID NO: 3306741 - protein, 4 aa, Plasmodium falciparum
DTEG

SEQ ID NO: 3306742 - protein, 25 aa, Plasmodium falciparum
DTEIDTKNIESKKNLTDFDEKTQGQ

SEQ ID NO: 3306743 - protein, 49 aa, Plasmodium falciparum
DTEKEKLKKKSQLMENSSKEQLPDLNKDKKTKNKKKKKEEGMDNTINNN

SEQ ID NO: 3306744 - protein, 12 aa, Plasmodium falciparum
DTEKKNKEEDIN

SEQ ID NO: 3306745 - protein, 9 aa, Plasmodium falciparum
DTEKSISRG

SEQ ID NO: 3306746 - protein, 13 aa, Plasmodium falciparum
DTELTTKDTNNSI

SEQ ID NO: 3306747 - protein, 7 aa, Plasmodium falciparum
DTENNKN

SEQ ID NO: 3306748 - protein, 36 aa, Plasmodium falciparum
DTENVDEETCKEDSVDEDMKDNSNSDSDSNKEEKKK

SEQ ID NO: 3306749 - protein, 6 aa, Plasmodium falciparum
DTERSI

SEQ ID NO: 3306750 - protein, 42 aa, Plasmodium falciparum
DTESKKVSNKNEKSQTTIKENTKAAGNLDVNNENKKSDRRTN

SEQ ID NO: 3306751 - protein, 18 aa, Plasmodium falciparum
DTETDSTDYYDEDDADYD

SEQ ID NO: 3306752 - protein, 6 aa, Plasmodium falciparum
DTETVD

SEQ ID NO: 3306753 - protein, 8 aa, Plasmodium falciparum
DTEYDENG

SEQ ID NO: 3306754 - protein, 5 aa, Plasmodium falciparum
DTFGS

SEQ ID NO: 3306755 - protein, 4 aa, Plasmodium falciparum
DTFN

SEQ ID NO: 3306756 - protein, 6 aa, Plasmodium falciparum
DTFNEC

SEQ ID NO: 3306757 - protein, 5 aa, Plasmodium falciparum
DTFSK

SEQ ID NO: 3306758 - protein, 4 aa, Plasmodium falciparum
DTFT

SEQ ID NO: 3306759 - protein, 18 aa, Plasmodium falciparum
DTFYSTKTQHDSKKNKNY

SEQ ID NO: 3306760 - protein, 6 aa, Plasmodium falciparum
DTGEDG

SEQ ID NO: 3306761 - protein, 9 aa, Plasmodium falciparum
DTGEKSQKV

SEQ ID NO: 3306762 - protein, 10 aa, Plasmodium falciparum
DTGKKTNGCI

SEQ ID NO: 3306763 - protein, 10 aa, Plasmodium falciparum
DTGSGKTTQI

SEQ ID NO: 3306764 - protein, 13 aa, Plasmodium falciparum
DTHDDDNNNNNNI

SEQ ID NO: 3306765 - protein, 7 aa, Plasmodium falciparum
DTHDKSD

SEQ ID NO: 3306766 - protein, 12 aa, Plasmodium falciparum
DTHNIRNKDPNI

SEQ ID NO: 3306767 - protein, 10 aa, Plasmodium falciparum
DTHNKGGDNF

SEQ ID NO: 3306768 - protein, 22 aa, Plasmodium falciparum
DTHNSKNYIGSNRYNTDKASYN

SEQ ID NO: 3306769 - protein, 4 aa, Plasmodium falciparum
DTHQ

SEQ ID NO: 3306770 - protein, 6 aa, Plasmodium falciparum
DTICNN

SEQ ID NO: 3306771 - protein, 19 aa, Plasmodium falciparum
DTIDQQNVAQDNLKKENDM

SEQ ID NO: 3306772 - protein, 8 aa, Plasmodium falciparum
DTIEEADN

SEQ ID NO: 3306773 - protein, 5 aa, Plasmodium falciparum
DTIKR

SEQ ID NO: 3306774 - protein, 9 aa, Plasmodium falciparum
DTINDTDKY

SEQ ID NO: 3306775 - protein, 10 aa, Plasmodium falciparum
DTINRNNQQE

SEQ ID NO: 3306776 - protein, 5 aa, Plasmodium falciparum
DTINT

SEQ ID NO: 3306777 - protein, 5 aa, Plasmodium falciparum
DTINW

SEQ ID NO: 3306778 - protein, 4 aa, Plasmodium falciparum
DTIS

SEQ ID NO: 3306779 - protein, 6 aa, Plasmodium falciparum
DTITEE

SEQ ID NO: 3306780 - protein, 5 aa, Plasmodium falciparum
DTITN

SEQ ID NO: 3306781 - protein, 5 aa, Plasmodium falciparum
DTITT

SEQ ID NO: 3306782 - protein, 14 aa, Plasmodium falciparum
DTIYEKKKKKVRRS

SEQ ID NO: 3306783 - protein, 14 aa, Plasmodium falciparum
DTKAKTLNRENENI

SEQ ID NO: 3306784 - protein, 15 aa, Plasmodium falciparum
DTKASSDKVELNRGP

SEQ ID NO: 3306785 - protein, 6 aa, Plasmodium falciparum
DTKDGY

SEQ ID NO: 3306786 - protein, 13 aa, Plasmodium falciparum
DTKDRKQNEEQPM

SEQ ID NO: 3306787 - protein, 4 aa, Plasmodium falciparum
DTKG

SEQ ID NO: 3306788 - protein, 15 aa, Plasmodium falciparum
DTKKETFQDKSKDDT

SEQ ID NO: 3306789 - protein, 10 aa, Plasmodium falciparum
DTKKNNLSEI

SEQ ID NO: 3306790 - protein, 8 aa, Plasmodium falciparum
DTKKTEED

SEQ ID NO: 3306791 - protein, 5 aa, Plasmodium falciparum
DTKLD

SEQ ID NO: 3306792 - protein, 4 aa, Plasmodium falciparum
DTKN

SEQ ID NO: 3306793 - protein, 8 aa, Plasmodium falciparum
DTKNDKRD

SEQ ID NO: 3306794 - protein, 6 aa, Plasmodium falciparum
DTKNEK

SEQ ID NO: 3306795 - protein, 10 aa, Plasmodium falciparum
DTKNELKNKN

SEQ ID NO: 3306796 - protein, 5 aa, Plasmodium falciparum
DTKNM

SEQ ID NO: 3306797 - protein, 12 aa, Plasmodium falciparum
DTKNNDSSKNFV

SEQ ID NO: 3306798 - protein, 8 aa, Plasmodium falciparum
DTKNSTYD

SEQ ID NO: 3306799 - protein, 47 aa, Plasmodium falciparum
DTKNVEKDTKNVEKDTKNVEKDTNNVEKGTNNVEKDTKNVDKYTNNE

SEQ ID NO: 3306800 - protein, 20 aa, Plasmodium falciparum
DTKPKSNKKSANSVSKNENK

SEQ ID NO: 3306801 - protein, 7 aa, Plasmodium falciparum
DTKPNND

SEQ ID NO: 3306802 - protein, 12 aa, Plasmodium falciparum
DTKQNQDNNQNY

SEQ ID NO: 3306803 - protein, 8 aa, Plasmodium falciparum
DTKRPDAL

SEQ ID NO: 3306804 - protein, 8 aa, Plasmodium falciparum
DTKSQNDV

SEQ ID NO: 3306805 - protein, 4 aa, Plasmodium falciparum
DTKT

SEQ ID NO: 3306806 - protein, 12 aa, Plasmodium falciparum
DTKTSGEESANS

SEQ ID NO: 3306807 - protein, 4 aa, Plasmodium falciparum
DTKY

SEQ ID NO: 3306808 - protein, 6 aa, Plasmodium falciparum
DTLDKK

SEQ ID NO: 3306809 - protein, 26 aa, Plasmodium falciparum
DTLEKTNNENISNSEKNKTYDDKTYS

SEQ ID NO: 3306810 - protein, 4 aa, Plasmodium falciparum
DTLN

SEQ ID NO: 3306811 - protein, 14 aa, Plasmodium falciparum
DTLNNQKENKKSTI

SEQ ID NO: 3306812 - protein, 11 aa, Plasmodium falciparum
DTLNNTSNQRV

SEQ ID NO: 3306813 - protein, 11 aa, Plasmodium falciparum
DTLNSNGSAYI

SEQ ID NO: 3306814 - protein, 7 aa, Plasmodium falciparum
DTLTNEQ

SEQ ID NO: 3306815 - protein, 4 aa, Plasmodium falciparum
DTLY

SEQ ID NO: 3306816 - protein, 6 aa, Plasmodium falciparum
DTMCNN

SEQ ID NO: 3306817 - protein, 4 aa, Plasmodium falciparum
DTMR

SEQ ID NO: 3306818 - protein, 37 aa, Plasmodium falciparum
DTNDNNKKEDNPMDNNNNNNNNNDDNINNNNNNNNNN

SEQ ID NO: 3306819 - protein, 9 aa, Plasmodium falciparum
DTNDSPDKI

SEQ ID NO: 3306820 - protein, 5 aa, Plasmodium falciparum
DTNEI

SEQ ID NO: 3306821 - protein, 7 aa, Plasmodium falciparum
DTNEKIN

SEQ ID NO: 3306822 - protein, 9 aa, Plasmodium falciparum
DTNENEKKN

SEQ ID NO: 3306823 - protein, 24 aa, Plasmodium falciparum
DTNENESIKRESIKRESIKRESIK

SEQ ID NO: 3306824 - protein, 24 aa, Plasmodium falciparum
DTNENQDMQDTKEMNNDNNNNGDN

SEQ ID NO: 3306825 - protein, 5 aa, Plasmodium falciparum
DTNES

SEQ ID NO: 3306826 - protein, 17 aa, Plasmodium falciparum
DTNESKNKNNNNEINRD

SEQ ID NO: 3306827 - protein, 7 aa, Plasmodium falciparum
DTNHDVN

SEQ ID NO: 3306828 - protein, 6 aa, Plasmodium falciparum
DTNHNE

SEQ ID NO: 3306829 - protein, 10 aa, Plasmodium falciparum
DTNIKENDNL

SEQ ID NO: 3306830 - protein, 13 aa, Plasmodium falciparum
DTNIKTNRGKKKK

SEQ ID NO: 3306831 - protein, 38 aa, Plasmodium falciparum
DTNINNGNNEDINNNNTNVNSNGNTTNNNNEQAQNNNN

SEQ ID NO: 3306832 - protein, 14 aa, Plasmodium falciparum
DTNINSTQNTSSNK

SEQ ID NO: 3306833 - protein, 7 aa, Plasmodium falciparum
DTNKDDI

SEQ ID NO: 3306834 - protein, 10 aa, Plasmodium falciparum
DTNKDGVSGE

SEQ ID NO: 3306835 - protein, 26 aa, Plasmodium falciparum
DTNKINNKNDDGNKYGDNEATNIEQE

SEQ ID NO: 3306836 - protein, 12 aa, Plasmodium falciparum
DTNKKKKQQYEE

SEQ ID NO: 3306837 - protein, 12 aa, Plasmodium falciparum
DTNKNEKKNDVN

SEQ ID NO: 3306838 - protein, 9 aa, Plasmodium falciparum
DTNKSNYNY

SEQ ID NO: 3306839 - protein, 4 aa, Plasmodium falciparum
DTNL

SEQ ID NO: 3306840 - protein, 5 aa, Plasmodium falciparum
DTNNE

SEQ ID NO: 3306841 - protein, 11 aa, Plasmodium falciparum
DTNNHNNNNNN

SEQ ID NO: 3306842 - protein, 5 aa, Plasmodium falciparum
DTNNI

SEQ ID NO: 3306843 - protein, 6 aa, Plasmodium falciparum
DTNNMN

SEQ ID NO: 3306844 - protein, 35 aa, Plasmodium falciparum
DTNNNMKDNTHEDEKNNPSEENQLNNNNNDDDDDM

SEQ ID NO: 3306845 - protein, 13 aa, Plasmodium falciparum
DTNNQKKQHYNEE

SEQ ID NO: 3306846 - protein, 29 aa, Plasmodium falciparum
DTNNTDNNNNNNNNNNNNNDKDKDYNTNI

SEQ ID NO: 3306847 - protein, 7 aa, Plasmodium falciparum
DTNPNAS

SEQ ID NO: 3306848 - protein, 7 aa, Plasmodium falciparum
DTNQNNR

SEQ ID NO: 3306849 - protein, 11 aa, Plasmodium falciparum
DTNRSENNEDD

SEQ ID NO: 3306850 - protein, 14 aa, Plasmodium falciparum
DTNRSTTNNKNNMN

SEQ ID NO: 3306851 - protein, 5 aa, Plasmodium falciparum
DTNSE

SEQ ID NO: 3306852 - protein, 10 aa, Plasmodium falciparum
DTNSKSLCDS

SEQ ID NO: 3306853 - protein, 5 aa, Plasmodium falciparum
DTNTL

SEQ ID NO: 3306854 - protein, 6 aa, Plasmodium falciparum
DTNTTQ

SEQ ID NO: 3306855 - protein, 7 aa, Plasmodium falciparum
DTNVSNN

SEQ ID NO: 3306856 - protein, 10 aa, Plasmodium falciparum
DTNYQNNGAY

SEQ ID NO: 3306857 - protein, 7 aa, Plasmodium falciparum
DTPCGST

SEQ ID NO: 3306858 - protein, 7 aa, Plasmodium falciparum
DTPEGES

SEQ ID NO: 3306859 - protein, 4 aa, Plasmodium falciparum
DTPI

SEQ ID NO: 3306860 - protein, 5 aa, Plasmodium falciparum
DTPIP

SEQ ID NO: 3306861 - protein, 5 aa, Plasmodium falciparum
DTPLN

SEQ ID NO: 3306862 - protein, 13 aa, Plasmodium falciparum
DTPLNKKEDSAKV

SEQ ID NO: 3306863 - protein, 12 aa, Plasmodium falciparum
DTPNKNNNLDKT

SEQ ID NO: 3306864 - protein, 27 aa, Plasmodium falciparum
DTPPEKKKVATKKISQRCQKNEKRKIS

SEQ ID NO: 3306865 - protein, 7 aa, Plasmodium falciparum
DTPPIKD

SEQ ID NO: 3306866 - protein, 6 aa, Plasmodium falciparum
DTPPPF

SEQ ID NO: 3306867 - protein, 15 aa, Plasmodium falciparum
DTPTYFPNNNNNNNI

SEQ ID NO: 3306868 - protein, 7 aa, Plasmodium falciparum
DTQDNDE

SEQ ID NO: 3306869 - protein, 13 aa, Plasmodium falciparum
DTQELENTIKMGT

SEQ ID NO: 3306870 - protein, 8 aa, Plasmodium falciparum
DTQENTND

SEQ ID NO: 3306871 - protein, 8 aa, Plasmodium falciparum
DTQGRSKG

SEQ ID NO: 3306872 - protein, 11 aa, Plasmodium falciparum
DTQINNETSDL

SEQ ID NO: 3306873 - protein, 8 aa, Plasmodium falciparum
DTQNLSDE

SEQ ID NO: 3306874 - protein, 15 aa, Plasmodium falciparum
DTQNNSSLNRETHQS

SEQ ID NO: 3306875 - protein, 7 aa, Plasmodium falciparum
DTQNYEK

SEQ ID NO: 3306876 - protein, 6 aa, Plasmodium falciparum
DTQSIT

SEQ ID NO: 3306877 - protein, 5 aa, Plasmodium falciparum
DTQSS

SEQ ID NO: 3306878 - protein, 9 aa, Plasmodium falciparum
DTRATEGPI

SEQ ID NO: 3306879 - protein, 27 aa, Plasmodium falciparum
DTRGDIENIEDKSGDMENMKEPNGDME

SEQ ID NO: 3306880 - protein, 15 aa, Plasmodium falciparum
DTRKDEENNVPDSNN

SEQ ID NO: 3306881 - protein, 4 aa, Plasmodium falciparum
DTRN

SEQ ID NO: 3306882 - protein, 15 aa, Plasmodium falciparum
DTRNQKKSDNTYNFN

SEQ ID NO: 3306883 - protein, 6 aa, Plasmodium falciparum
DTRPCE

SEQ ID NO: 3306884 - protein, 8 aa, Plasmodium falciparum
DTRQYGNE

SEQ ID NO: 3306885 - protein, 10 aa, Plasmodium falciparum
DTSCEQANDI

SEQ ID NO: 3306886 - protein, 6 aa, Plasmodium falciparum
DTSDEH

SEQ ID NO: 3306887 - protein, 7 aa, Plasmodium falciparum
DTSDFSS

SEQ ID NO: 3306888 - protein, 8 aa, Plasmodium falciparum
DTSDISTD

SEQ ID NO: 3306889 - protein, 6 aa, Plasmodium falciparum
DTSDNL

SEQ ID NO: 3306890 - protein, 7 aa, Plasmodium falciparum
DTSDSGY

SEQ ID NO: 3306891 - protein, 5 aa, Plasmodium falciparum
DTSDV

SEQ ID NO: 3306892 - protein, 6 aa, Plasmodium falciparum
DTSDVK

SEQ ID NO: 3306893 - protein, 5 aa, Plasmodium falciparum
DTSES

SEQ ID NO: 3306894 - protein, 8 aa, Plasmodium falciparum
DTSGDDDK

SEQ ID NO: 3306895 - protein, 9 aa, Plasmodium falciparum
DTSGEERNI

SEQ ID NO: 3306896 - protein, 39 aa, Plasmodium falciparum
DTSGIQDKGETKEYKKKMRKKKKNSEQVGETNKMEGTSQ

SEQ ID NO: 3306897 - protein, 7 aa, Plasmodium falciparum
DTSGLSV

SEQ ID NO: 3306898 - protein, 23 aa, Plasmodium falciparum
DTSHNNNNNNNNYVGDSSSSRTI

SEQ ID NO: 3306899 - protein, 4 aa, Plasmodium falciparum
DTSK

SEQ ID NO: 3306900 - protein, 10 aa, Plasmodium falciparum
DTSKNKTIYR

SEQ ID NO: 3306901 - protein, 7 aa, Plasmodium falciparum
DTSKYSD

SEQ ID NO: 3306902 - protein, 8 aa, Plasmodium falciparum
DTSLSSRE

SEQ ID NO: 3306903 - protein, 5 aa, Plasmodium falciparum
DTSME

SEQ ID NO: 3306904 - protein, 8 aa, Plasmodium falciparum
DTSNKNND

SEQ ID NO: 3306905 - protein, 44 aa, Plasmodium falciparum
DTSNNNNNNNNNNNDTTNGFNDNNIQSGEKNSNEHHDEEDNHHD

SEQ ID NO: 3306906 - protein, 6 aa, Plasmodium falciparum
DTSNNP

SEQ ID NO: 3306907 - protein, 11 aa, Plasmodium falciparum
DTSNNVNQMND

SEQ ID NO: 3306908 - protein, 8 aa, Plasmodium falciparum
DTSNPQKM

SEQ ID NO: 3306909 - protein, 6 aa, Plasmodium falciparum
DTSPSI

SEQ ID NO: 3306910 - protein, 6 aa, Plasmodium falciparum
DTSQIK

SEQ ID NO: 3306911 - protein, 8 aa, Plasmodium falciparum
DTSQNEDF

SEQ ID NO: 3306912 - protein, 5 aa, Plasmodium falciparum
DTSQW

SEQ ID NO: 3306913 - protein, 10 aa, Plasmodium falciparum
DTSRERISTT

SEQ ID NO: 3306914 - protein, 8 aa, Plasmodium falciparum
DTSSEDKN

SEQ ID NO: 3306915 - protein, 9 aa, Plasmodium falciparum
DTSSISKNT

SEQ ID NO: 3306916 - protein, 26 aa, Plasmodium falciparum
DTSSKKEEKKKKSNITYDDSSSNNVS

SEQ ID NO: 3306917 - protein, 36 aa, Plasmodium falciparum
DTSSNKKKENINGEDEKNENDENKKNVQEEEDEELK

SEQ ID NO: 3306918 - protein, 5 aa, Plasmodium falciparum
DTSSS

SEQ ID NO: 3306919 - protein, 6 aa, Plasmodium falciparum
DTSSYK

SEQ ID NO: 3306920 - protein, 14 aa, Plasmodium falciparum
DTSSYKPKSSPDIK

SEQ ID NO: 3306921 - protein, 6 aa, Plasmodium falciparum
DTSTCT

SEQ ID NO: 3306922 - protein, 5 aa, Plasmodium falciparum
DTSTH

SEQ ID NO: 3306923 - protein, 26 aa, Plasmodium falciparum
DTSTNTKDSYSSSSYTNKKKNKNKYY

SEQ ID NO: 3306924 - protein, 6 aa, Plasmodium falciparum
DTSYEE

SEQ ID NO: 3306925 - protein, 43 aa, Plasmodium falciparum
DTTHKEKKNNDDDNTDNYHNNKNNSNNNNNNNNNNQNNNNNNN

SEQ ID NO: 3306926 - protein, 39 aa, Plasmodium falciparum
DTTKSKHNQNIQNGQNIQNGQNIQNGQNIQNNQNNQNIQ

SEQ ID NO: 3306927 - protein, 8 aa, Plasmodium falciparum
DTTLNGQN

SEQ ID NO: 3306928 - protein, 7 aa, Plasmodium falciparum
DTTNDTD

SEQ ID NO: 3306929 - protein, 6 aa, Plasmodium falciparum
DTTNEA

SEQ ID NO: 3306930 - protein, 6 aa, Plasmodium falciparum
DTTNKH

SEQ ID NO: 3306931 - protein, 6 aa, Plasmodium falciparum
DTTNKL

SEQ ID NO: 3306932 - protein, 32 aa, Plasmodium falciparum
DTTNSDVKRKKPKNGEGNINKANKSKNDALEE

SEQ ID NO: 3306933 - protein, 15 aa, Plasmodium falciparum
DTTNVESTNEQKNGS

SEQ ID NO: 3306934 - protein, 10 aa, Plasmodium falciparum
DTTPKKISKD

SEQ ID NO: 3306935 - protein, 12 aa, Plasmodium falciparum
DTTQKKKERKNI

SEQ ID NO: 3306936 - protein, 10 aa, Plasmodium falciparum
DTTQTNNKYE

SEQ ID NO: 3306937 - protein, 11 aa, Plasmodium falciparum
DTTSNKNMKDL

SEQ ID NO: 3306938 - protein, 12 aa, Plasmodium falciparum
DTTTNKPTDNEW

SEQ ID NO: 3306939 - protein, 27 aa, Plasmodium falciparum
DTTTNNNNNSNNNNNNNNNNNNNSDDD

SEQ ID NO: 3306940 - protein, 13 aa, Plasmodium falciparum
DTTTNSSSSPSSV

SEQ ID NO: 3306941 - protein, 8 aa, Plasmodium falciparum
DTTYGPVK

SEQ ID NO: 3306942 - protein, 15 aa, Plasmodium falciparum
DTYDDDEKDGNVHNK

SEQ ID NO: 3306943 - protein, 7 aa, Plasmodium falciparum
DTYDEGN

SEQ ID NO: 3306944 - protein, 8 aa, Plasmodium falciparum
DTYDKEYD

SEQ ID NO: 3306945 - protein, 7 aa, Plasmodium falciparum
DTYEDAK

SEQ ID NO: 3306946 - protein, 5 aa, Plasmodium falciparum
DTYEK

SEQ ID NO: 3306947 - protein, 6 aa, Plasmodium falciparum
DTYEKT

SEQ ID NO: 3306948 - protein, 7 aa, Plasmodium falciparum
DTYKEEE

SEQ ID NO: 3306949 - protein, 8 aa, Plasmodium falciparum
DTYKEEVE

SEQ ID NO: 3306950 - protein, 10 aa, Plasmodium falciparum
DTYKERKSDK

SEQ ID NO: 3306951 - protein, 10 aa, Plasmodium falciparum
DTYKNDENNV

SEQ ID NO: 3306952 - protein, 21 aa, Plasmodium falciparum
DTYKNTKKEENIDEKSYLNDD

SEQ ID NO: 3306953 - protein, 7 aa, Plasmodium falciparum
DTYKQEK

SEQ ID NO: 3306954 - protein, 7 aa, Plasmodium falciparum
DTYNAFP

SEQ ID NO: 3306955 - protein, 18 aa, Plasmodium falciparum
DTYNDNATNINKEDDNNY

SEQ ID NO: 3306956 - protein, 6 aa, Plasmodium falciparum
DTYNND

SEQ ID NO: 3306957 - protein, 18 aa, Plasmodium falciparum
DTYNNKNQKNNHKKENME

SEQ ID NO: 3306958 - protein, 22 aa, Plasmodium falciparum
DTYNSYDTYNSYKSHEEHKNNK

SEQ ID NO: 3306959 - protein, 5 aa, Plasmodium falciparum
DTYQP

SEQ ID NO: 3306960 - protein, 6 aa, Plasmodium falciparum
DTYTDS

SEQ ID NO: 3306961 - protein, 28 aa, Plasmodium falciparum
DTYTNGIDKGGLQEENKKIKDKKKKSIF

SEQ ID NO: 3306962 - protein, 4 aa, Plasmodium falciparum
DTYY

SEQ ID NO: 3306963 - protein, 27 aa, Plasmodium falciparum
DTYYDDKNTEMGGEGKKKKNKKKKNID

SEQ ID NO: 3306964 - protein, 112 aa, Plasmodium falciparum
DVDDVDDVDDVDDVDDVDDDEDDEDDEDDEDDDEDDDEDDDDDEDEDDDDDEDEDDDEDDDDDEDYDDDDDEDYDEDEDDDDENYNLKDKNNLKGFENNKRIKGNKKGSEKP

SEQ ID NO: 3306965 - protein, 11 aa, Plasmodium falciparum
DVDNDDDHNIN

SEQ ID NO: 3306966 - protein, 7 aa, Plasmodium falciparum
DVDPETN

SEQ ID NO: 3306967 - protein, 7 aa, Plasmodium falciparum
DVDPRGS

SEQ ID NO: 3306968 - protein, 6 aa, Plasmodium falciparum
DVEAKD

SEQ ID NO: 3306969 - protein, 5 aa, Plasmodium falciparum
DVEEK

SEQ ID NO: 3306970 - protein, 11 aa, Plasmodium falciparum
DVEKENKRKIA

SEQ ID NO: 3306971 - protein, 108 aa, Plasmodium falciparum
DVEKGNDWNGNNNENSNNNNNDYNNNNNNNNNNNDYNNNNNNNNNDYNNNNNNNDYNNNNNNNDYNNNNKNYNNNKNYNNNKNYNNNNNDDNQSNDDNQNNDEDDKMD

SEQ ID NO: 3306972 - protein, 9 aa, Plasmodium falciparum
DVEKSLPNK

SEQ ID NO: 3306973 - protein, 15 aa, Plasmodium falciparum
DVEPYKDTLQKDEQS

SEQ ID NO: 3306974 - protein, 10 aa, Plasmodium falciparum
DVETLSEKYD

SEQ ID NO: 3306975 - protein, 9 aa, Plasmodium falciparum
DVETNEGQG

SEQ ID NO: 3306976 - protein, 4 aa, Plasmodium falciparum
DVEV

SEQ ID NO: 3306977 - protein, 5 aa, Plasmodium falciparum
DVEYD

SEQ ID NO: 3306978 - protein, 6 aa, Plasmodium falciparum
DVFKNE

SEQ ID NO: 3306979 - protein, 55 aa, Plasmodium falciparum
DVGDDDDEGGIYDDNDEDDYDNYNDNDKDSVEESTSISNDKKKKKKRKRKEYKKE

SEQ ID NO: 3306980 - protein, 7 aa, Plasmodium falciparum
DVGEKKG

SEQ ID NO: 3306981 - protein, 11 aa, Plasmodium falciparum
DVGGEKKKKLK

SEQ ID NO: 3306982 - protein, 6 aa, Plasmodium falciparum
DVGTQK

SEQ ID NO: 3306983 - protein, 5 aa, Plasmodium falciparum
DVGVS

SEQ ID NO: 3306984 - protein, 12 aa, Plasmodium falciparum
DVKAKEKKKEKI

SEQ ID NO: 3306985 - protein, 10 aa, Plasmodium falciparum
DVKDETKGKK

SEQ ID NO: 3306986 - protein, 14 aa, Plasmodium falciparum
DVKDGSLKNQNKKK

SEQ ID NO: 3306987 - protein, 8 aa, Plasmodium falciparum
DVKDNKNA

SEQ ID NO: 3306988 - protein, 22 aa, Plasmodium falciparum
DVKEEKVKERKVRKSRKNQNFV

SEQ ID NO: 3306989 - protein, 6 aa, Plasmodium falciparum
DVKEQQ

SEQ ID NO: 3306990 - protein, 10 aa, Plasmodium falciparum
DVKGEDKGED

SEQ ID NO: 3306991 - protein, 6 aa, Plasmodium falciparum
DVKKEE

SEQ ID NO: 3306992 - protein, 23 aa, Plasmodium falciparum
DVKKGNKNGDKNGDKNGDKKDIK

SEQ ID NO: 3306993 - protein, 9 aa, Plasmodium falciparum
DVKNEKKKK

SEQ ID NO: 3306994 - protein, 5 aa, Plasmodium falciparum
DVKNI

SEQ ID NO: 3306995 - protein, 17 aa, Plasmodium falciparum
DVKSDQLVQEDKNEIQN

SEQ ID NO: 3306996 - protein, 20 aa, Plasmodium falciparum
DVNCKTDDQYAREKNEENTK

SEQ ID NO: 3306997 - protein, 4 aa, Plasmodium falciparum
DVND

SEQ ID NO: 3306998 - protein, 13 aa, Plasmodium falciparum
DVNDDKNRKDKKH

SEQ ID NO: 3306999 - protein, 7 aa, Plasmodium falciparum
DVNDEED

SEQ ID NO: 3307000 - protein, 4 aa, Plasmodium falciparum
DVNI

SEQ ID NO: 3307001 - protein, 4 aa, Plasmodium falciparum
DVNK

SEQ ID NO: 3307002 - protein, 5 aa, Plasmodium falciparum
DVNKK

SEQ ID NO: 3307003 - protein, 9 aa, Plasmodium falciparum
DVNKKDDEN

SEQ ID NO: 3307004 - protein, 19 aa, Plasmodium falciparum
DVNKSKEKKKKKVQFSNNN

SEQ ID NO: 3307005 - protein, 11 aa, Plasmodium falciparum
DVNNANDVNNV

SEQ ID NO: 3307006 - protein, 9 aa, Plasmodium falciparum
DVNNMPEQF

SEQ ID NO: 3307007 - protein, 17 aa, Plasmodium falciparum
DVNNNITNENNNNSDDM

SEQ ID NO: 3307008 - protein, 26 aa, Plasmodium falciparum
DVNNNNDDDKDKDKENINEVRRDQKN

SEQ ID NO: 3307009 - protein, 7 aa, Plasmodium falciparum
DVNPDMR

SEQ ID NO: 3307010 - protein, 9 aa, Plasmodium falciparum
DVNSKNERE

SEQ ID NO: 3307011 - protein, 8 aa, Plasmodium falciparum
DVNTQKSF

SEQ ID NO: 3307012 - protein, 9 aa, Plasmodium falciparum
DVPDDEYKE

SEQ ID NO: 3307013 - protein, 6 aa, Plasmodium falciparum
DVPEVN

SEQ ID NO: 3307014 - protein, 6 aa, Plasmodium falciparum
DVPGIK

SEQ ID NO: 3307015 - protein, 8 aa, Plasmodium falciparum
DVPKEGKE

SEQ ID NO: 3307016 - protein, 10 aa, Plasmodium falciparum
DVPPGKDGTK

SEQ ID NO: 3307017 - protein, 13 aa, Plasmodium falciparum
DVPSQKAYLRFVQ

SEQ ID NO: 3307018 - protein, 9 aa, Plasmodium falciparum
DVPSQTDNN

SEQ ID NO: 3307019 - protein, 6 aa, Plasmodium falciparum
DVPTKL

SEQ ID NO: 3307020 - protein, 25 aa, Plasmodium falciparum
DVPTNENHEQKKNEESNKNGTNYKT

SEQ ID NO: 3307021 - protein, 4 aa, Plasmodium falciparum
DVQE

SEQ ID NO: 3307022 - protein, 33 aa, Plasmodium falciparum
DVQEDDVDKNTTTNNNNNDDDINDCDNKKSTVY

SEQ ID NO: 3307023 - protein, 11 aa, Plasmodium falciparum
DVQEDVQEEAM

SEQ ID NO: 3307024 - protein, 5 aa, Plasmodium falciparum
DVQKN

SEQ ID NO: 3307025 - protein, 5 aa, Plasmodium falciparum
DVRDN

SEQ ID NO: 3307026 - protein, 13 aa, Plasmodium falciparum
DVREENNTTPSDI

SEQ ID NO: 3307027 - protein, 4 aa, Plasmodium falciparum
DVRN

SEQ ID NO: 3307028 - protein, 13 aa, Plasmodium falciparum
DVRSKNSSTDDIN

SEQ ID NO: 3307029 - protein, 6 aa, Plasmodium falciparum
DVSKKS

SEQ ID NO: 3307030 - protein, 11 aa, Plasmodium falciparum
DVSKSDEYNNC

SEQ ID NO: 3307031 - protein, 9 aa, Plasmodium falciparum
DVSNTDDSL

SEQ ID NO: 3307032 - protein, 56 aa, Plasmodium falciparum
DVSRDDNKGDEDVSMDDNKGDEDVSRDDNKSDEDVSRDDENISSDNEKKKNRKEEK

SEQ ID NO: 3307033 - protein, 6 aa, Plasmodium falciparum
DVSSDG

SEQ ID NO: 3307034 - protein, 7 aa, Plasmodium falciparum
DVSTITS

SEQ ID NO: 3307035 - protein, 13 aa, Plasmodium falciparum
DVSVKSNKKNNTC

SEQ ID NO: 3307036 - protein, 5 aa, Plasmodium falciparum
DVSYD

SEQ ID NO: 3307037 - protein, 28 aa, Plasmodium falciparum
DVTDSTNDQDDKTNENHKRDDTNNISDD

SEQ ID NO: 3307038 - protein, 14 aa, Plasmodium falciparum
DVTGHNDHSSVNIN

SEQ ID NO: 3307039 - protein, 9 aa, Plasmodium falciparum
DVTKKGDIN

SEQ ID NO: 3307040 - protein, 19 aa, Plasmodium falciparum
DVTNKNDDTTKINDDNSNV

SEQ ID NO: 3307041 - protein, 5 aa, Plasmodium falciparum
DVTYD

SEQ ID NO: 3307042 - protein, 18 aa, Plasmodium falciparum
DVTYGRQKKELKKIIKNA

SEQ ID NO: 3307043 - protein, 13 aa, Plasmodium falciparum
DVVSSTPAATEEA

SEQ ID NO: 3307044 - protein, 15 aa, Plasmodium falciparum
DVYESTSSLSCSSSE

SEQ ID NO: 3307045 - protein, 13 aa, Plasmodium falciparum
DVYTNDESTTSSC

SEQ ID NO: 3307046 - protein, 4 aa, Plasmodium falciparum
DYAE

SEQ ID NO: 3307047 - protein, 12 aa, Plasmodium falciparum
DYATQENKSFEE

SEQ ID NO: 3307048 - protein, 14 aa, Plasmodium falciparum
DYDDDDDEYNKKEY

SEQ ID NO: 3307049 - protein, 11 aa, Plasmodium falciparum
DYDEEEEDDDE

SEQ ID NO: 3307050 - protein, 47 aa, Plasmodium falciparum
DYDEYAEDAYGEEDDEEDDEDADDEEDDEEDDEEEEEDDDDDNDIYE

SEQ ID NO: 3307051 - protein, 6 aa, Plasmodium falciparum
DYDGSH

SEQ ID NO: 3307052 - protein, 10 aa, Plasmodium falciparum
DYDKVNEEEY

SEQ ID NO: 3307053 - protein, 15 aa, Plasmodium falciparum
DYDNKKKTTKKENFT

SEQ ID NO: 3307054 - protein, 8 aa, Plasmodium falciparum
DYDNSKDS

SEQ ID NO: 3307055 - protein, 9 aa, Plasmodium falciparum
DYDNSSNKI

SEQ ID NO: 3307056 - protein, 8 aa, Plasmodium falciparum
DYDPNTPG

SEQ ID NO: 3307057 - protein, 14 aa, Plasmodium falciparum
DYDSDGNKKEKPYY

SEQ ID NO: 3307058 - protein, 16 aa, Plasmodium falciparum
DYDSDNKLKNDYSEGI

SEQ ID NO: 3307059 - protein, 9 aa, Plasmodium falciparum
DYEDEEQGD

SEQ ID NO: 3307060 - protein, 16 aa, Plasmodium falciparum
DYEENRNQKKNNDEFR

SEQ ID NO: 3307061 - protein, 11 aa, Plasmodium falciparum
DYEKKENEDKK

SEQ ID NO: 3307062 - protein, 7 aa, Plasmodium falciparum
DYEKSQN

SEQ ID NO: 3307063 - protein, 7 aa, Plasmodium falciparum
DYENISN

SEQ ID NO: 3307064 - protein, 8 aa, Plasmodium falciparum
DYENTPPK

SEQ ID NO: 3307065 - protein, 6 aa, Plasmodium falciparum
DYEQTA

SEQ ID NO: 3307066 - protein, 4 aa, Plasmodium falciparum
DYER

SEQ ID NO: 3307067 - protein, 16 aa, Plasmodium falciparum
DYERKQKELYKKMCNS

SEQ ID NO: 3307068 - protein, 9 aa, Plasmodium falciparum
DYEYEKGPE

SEQ ID NO: 3307069 - protein, 6 aa, Plasmodium falciparum
DYFDED

SEQ ID NO: 3307070 - protein, 5 aa, Plasmodium falciparum
DYGDS

SEQ ID NO: 3307071 - protein, 8 aa, Plasmodium falciparum
DYGTLGGT

SEQ ID NO: 3307072 - protein, 69 aa, Plasmodium falciparum
DYHDKDDDDYDDEDDDEDDDDYDDEDDDDYEDDDDDDYDDDEDNYNNSYDNSYDNQYNTKHNKKKINPM

SEQ ID NO: 3307073 - protein, 19 aa, Plasmodium falciparum
DYIPNEQTTQDDKNQTLKN

SEQ ID NO: 3307074 - protein, 8 aa, Plasmodium falciparum
DYIPTENK

SEQ ID NO: 3307075 - protein, 13 aa, Plasmodium falciparum
DYISNDESNNDSD

SEQ ID NO: 3307076 - protein, 14 aa, Plasmodium falciparum
DYITTSSNESDDEK

SEQ ID NO: 3307077 - protein, 4 aa, Plasmodium falciparum
DYKE

SEQ ID NO: 3307078 - protein, 5 aa, Plasmodium falciparum
DYKEK

SEQ ID NO: 3307079 - protein, 9 aa, Plasmodium falciparum
DYKEKSKQI

SEQ ID NO: 3307080 - protein, 32 aa, Plasmodium falciparum
DYKENNDDNNNNNNNENNNNNENNNNNENNNY

SEQ ID NO: 3307081 - protein, 12 aa, Plasmodium falciparum
DYKNKDEGYNNI

SEQ ID NO: 3307082 - protein, 9 aa, Plasmodium falciparum
DYKNKMKNK

SEQ ID NO: 3307083 - protein, 8 aa, Plasmodium falciparum
DYKNNDNI

SEQ ID NO: 3307084 - protein, 12 aa, Plasmodium falciparum
DYKRTKKNQAQE

SEQ ID NO: 3307085 - protein, 12 aa, Plasmodium falciparum
DYKYEQNYFIDF

SEQ ID NO: 3307086 - protein, 8 aa, Plasmodium falciparum
DYLRKKNE

SEQ ID NO: 3307087 - protein, 24 aa, Plasmodium falciparum
DYNDHSDNIESNNNNKNKKNEINN

SEQ ID NO: 3307088 - protein, 13 aa, Plasmodium falciparum
DYNDNTSKYDSMK

SEQ ID NO: 3307089 - protein, 11 aa, Plasmodium falciparum
DYNDYNNYNNY

SEQ ID NO: 3307090 - protein, 49 aa, Plasmodium falciparum
DYNEGENIKVSSQKQINNNNNNNNNNYNNNNNNNYNKNNYNKNNYNNNY

SEQ ID NO: 3307091 - protein, 10 aa, Plasmodium falciparum
DYNEQNYERF

SEQ ID NO: 3307092 - protein, 18 aa, Plasmodium falciparum
DYNGNNNNKEKKSTKNIY

SEQ ID NO: 3307093 - protein, 4 aa, Plasmodium falciparum
DYNK

SEQ ID NO: 3307094 - protein, 5 aa, Plasmodium falciparum
DYNKE

SEQ ID NO: 3307095 - protein, 5 aa, Plasmodium falciparum
DYNKI

SEQ ID NO: 3307096 - protein, 21 aa, Plasmodium falciparum
DYNKKKDAYMDKNNSSDYKNN

SEQ ID NO: 3307097 - protein, 9 aa, Plasmodium falciparum
DYNNCDDNN

SEQ ID NO: 3307098 - protein, 7 aa, Plasmodium falciparum
DYNNEAE

SEQ ID NO: 3307099 - protein, 10 aa, Plasmodium falciparum
DYNNINESND

SEQ ID NO: 3307100 - protein, 8 aa, Plasmodium falciparum
DYNNNTTN

SEQ ID NO: 3307101 - protein, 5 aa, Plasmodium falciparum
DYNNR

SEQ ID NO: 3307102 - protein, 7 aa, Plasmodium falciparum
DYNNSTT

SEQ ID NO: 3307103 - protein, 5 aa, Plasmodium falciparum
DYNPL

SEQ ID NO: 3307104 - protein, 5 aa, Plasmodium falciparum
DYNSD

SEQ ID NO: 3307105 - protein, 7 aa, Plasmodium falciparum
DYNSPNK

SEQ ID NO: 3307106 - protein, 46 aa, Plasmodium falciparum
DYNSSDNNSSDNNSSDNNSSDNNSSDYNSSDNNSSDDDESDEEEKE

SEQ ID NO: 3307107 - protein, 6 aa, Plasmodium falciparum
DYNTQS

SEQ ID NO: 3307108 - protein, 4 aa, Plasmodium falciparum
DYNY

SEQ ID NO: 3307109 - protein, 5 aa, Plasmodium falciparum
DYPEY

SEQ ID NO: 3307110 - protein, 14 aa, Plasmodium falciparum
DYPNNVKRNDIKNN

SEQ ID NO: 3307111 - protein, 5 aa, Plasmodium falciparum
DYPNS

SEQ ID NO: 3307112 - protein, 9 aa, Plasmodium falciparum
DYPSKPPKC

SEQ ID NO: 3307113 - protein, 13 aa, Plasmodium falciparum
DYPTETNHNNDDH

SEQ ID NO: 3307114 - protein, 4 aa, Plasmodium falciparum
DYPY

SEQ ID NO: 3307115 - protein, 5 aa, Plasmodium falciparum
DYPYE

SEQ ID NO: 3307116 - protein, 8 aa, Plasmodium falciparum
DYPYNPPK

SEQ ID NO: 3307117 - protein, 10 aa, Plasmodium falciparum
DYQNEEEKKF

SEQ ID NO: 3307118 - protein, 9 aa, Plasmodium falciparum
DYQNGIDNS

SEQ ID NO: 3307119 - protein, 5 aa, Plasmodium falciparum
DYQTK

SEQ ID NO: 3307120 - protein, 20 aa, Plasmodium falciparum
DYRHNDEKKVEEKNKDGDIN

SEQ ID NO: 3307121 - protein, 8 aa, Plasmodium falciparum
DYRNNNYD

SEQ ID NO: 3307122 - protein, 4 aa, Plasmodium falciparum
DYRS

SEQ ID NO: 3307123 - protein, 10 aa, Plasmodium falciparum
DYRTSKNQHG

SEQ ID NO: 3307124 - protein, 14 aa, Plasmodium falciparum
DYSEGDGKQTKKAS

SEQ ID NO: 3307125 - protein, 5 aa, Plasmodium falciparum
DYSEQ

SEQ ID NO: 3307126 - protein, 6 aa, Plasmodium falciparum
DYSKAN

SEQ ID NO: 3307127 - protein, 7 aa, Plasmodium falciparum
DYSNDIN

SEQ ID NO: 3307128 - protein, 13 aa, Plasmodium falciparum
DYSRNSYKYSTNN

SEQ ID NO: 3307129 - protein, 13 aa, Plasmodium falciparum
DYSSDNDSDDYDE

SEQ ID NO: 3307130 - protein, 7 aa, Plasmodium falciparum
DYSSGNS

SEQ ID NO: 3307131 - protein, 15 aa, Plasmodium falciparum
DYSSSDDNKSSHHDY

SEQ ID NO: 3307132 - protein, 27 aa, Plasmodium falciparum
DYTLATQQRSEQKQKQKQKQQNTKVEK

SEQ ID NO: 3307133 - protein, 5 aa, Plasmodium falciparum
DYTNN

SEQ ID NO: 3307134 - protein, 25 aa, Plasmodium falciparum
DYTNNKSYQEEIPYPNKEDNKHRSN

SEQ ID NO: 3307135 - protein, 19 aa, Plasmodium falciparum
DYTNSNDNNNNNNEEYTNN

SEQ ID NO: 3307136 - protein, 10 aa, Plasmodium falciparum
DYVENNSNNH

SEQ ID NO: 3307137 - protein, 4 aa, Plasmodium falciparum
DYYY

SEQ ID NO: 3307138 - protein, 7 aa, Plasmodium falciparum
EAAETAK

SEQ ID NO: 3307139 - protein, 4 aa, Plasmodium falciparum
EAAN

SEQ ID NO: 3307140 - protein, 21 aa, Plasmodium falciparum
EAATDDHDNDSDRKTSNVEKQ

SEQ ID NO: 3307141 - protein, 9 aa, Plasmodium falciparum
EADEKPNVI

SEQ ID NO: 3307142 - protein, 6 aa, Plasmodium falciparum
EADGND

SEQ ID NO: 3307143 - protein, 8 aa, Plasmodium falciparum
EADHKNES

SEQ ID NO: 3307144 - protein, 85 aa, Plasmodium falciparum
EADINDDKKLGDKNEDDDSRCGDKNEDDDSHCGDKNEDDDSHCGDKNEDDDSHCGDKNEDDDSHCGDKNEDDDSHYGDKNEDDDL

SEQ ID NO: 3307145 - protein, 6 aa, Plasmodium falciparum
EADINE

SEQ ID NO: 3307146 - protein, 7 aa, Plasmodium falciparum
EADKNEK

SEQ ID NO: 3307147 - protein, 8 aa, Plasmodium falciparum
EADKNKDN

SEQ ID NO: 3307148 - protein, 10 aa, Plasmodium falciparum
EADKWKRNSE

SEQ ID NO: 3307149 - protein, 6 aa, Plasmodium falciparum
EADNNV

SEQ ID NO: 3307150 - protein, 4 aa, Plasmodium falciparum
EADR

SEQ ID NO: 3307151 - protein, 8 aa, Plasmodium falciparum
EADRQEAL

SEQ ID NO: 3307152 - protein, 25 aa, Plasmodium falciparum
EAEADAEADIDVDEDEEEHEHDDDE

SEQ ID NO: 3307153 - protein, 6 aa, Plasmodium falciparum
EAEEEI

SEQ ID NO: 3307154 - protein, 10 aa, Plasmodium falciparum
EAEEKLSETN

SEQ ID NO: 3307155 - protein, 4 aa, Plasmodium falciparum
EAEG

SEQ ID NO: 3307156 - protein, 6 aa, Plasmodium falciparum
EAEGNN

SEQ ID NO: 3307157 - protein, 4 aa, Plasmodium falciparum
EAEI

SEQ ID NO: 3307158 - protein, 7 aa, Plasmodium falciparum
EAEKNSP

SEQ ID NO: 3307159 - protein, 15 aa, Plasmodium falciparum
EAEKSGREDKNYINS

SEQ ID NO: 3307160 - protein, 9 aa, Plasmodium falciparum
EAEKSLQKE

SEQ ID NO: 3307161 - protein, 15 aa, Plasmodium falciparum
EAENNDGKDNHTEET

SEQ ID NO: 3307162 - protein, 8 aa, Plasmodium falciparum
EAENNIER

SEQ ID NO: 3307163 - protein, 16 aa, Plasmodium falciparum
EAETQKLAEDARKDLQ

SEQ ID NO: 3307164 - protein, 11 aa, Plasmodium falciparum
EAETRVDGTPR

SEQ ID NO: 3307165 - protein, 8 aa, Plasmodium falciparum
EAGAHGKD

SEQ ID NO: 3307166 - protein, 4 aa, Plasmodium falciparum
EAGK

SEQ ID NO: 3307167 - protein, 7 aa, Plasmodium falciparum
EAGRGPV

SEQ ID NO: 3307168 - protein, 7 aa, Plasmodium falciparum
EAGTGTG

SEQ ID NO: 3307169 - protein, 4 aa, Plasmodium falciparum
EAGV

SEQ ID NO: 3307170 - protein, 4 aa, Plasmodium falciparum
EAHR

SEQ ID NO: 3307171 - protein, 5 aa, Plasmodium falciparum
EAIEK

SEQ ID NO: 3307172 - protein, 6 aa, Plasmodium falciparum
EAIKQG

SEQ ID NO: 3307173 - protein, 17 aa, Plasmodium falciparum
EAISNESNNKKLDEEEE

SEQ ID NO: 3307174 - protein, 12 aa, Plasmodium falciparum
EAKDKKSNNKLK

SEQ ID NO: 3307175 - protein, 11 aa, Plasmodium falciparum
EAKKQNDPDIS

SEQ ID NO: 3307176 - protein, 6 aa, Plasmodium falciparum
EAKKYV

SEQ ID NO: 3307177 - protein, 5 aa, Plasmodium falciparum
EAKNA

SEQ ID NO: 3307178 - protein, 33 aa, Plasmodium falciparum
EAKNISTTTTTTTINNDNNNDNNNDNNNTKKGY

SEQ ID NO: 3307179 - protein, 5 aa, Plasmodium falciparum
EAKNK

SEQ ID NO: 3307180 - protein, 9 aa, Plasmodium falciparum
EAKNRDCQN

SEQ ID NO: 3307181 - protein, 10 aa, Plasmodium falciparum
EAKSGHQGAP

SEQ ID NO: 3307182 - protein, 26 aa, Plasmodium falciparum
EALESTENNDKGNEENKNDINNERRV

SEQ ID NO: 3307183 - protein, 10 aa, Plasmodium falciparum
EALNNKNYGV

SEQ ID NO: 3307184 - protein, 4 aa, Plasmodium falciparum
EALS

SEQ ID NO: 3307185 - protein, 4 aa, Plasmodium falciparum
EANE

SEQ ID NO: 3307186 - protein, 15 aa, Plasmodium falciparum
EANEKKKKLKKKKMN

SEQ ID NO: 3307187 - protein, 6 aa, Plasmodium falciparum
EANEYD

SEQ ID NO: 3307188 - protein, 10 aa, Plasmodium falciparum
EANKTYHSSL

SEQ ID NO: 3307189 - protein, 17 aa, Plasmodium falciparum
EANNISGNNTSDSNNIT

SEQ ID NO: 3307190 - protein, 10 aa, Plasmodium falciparum
EANPNYRPTR

SEQ ID NO: 3307191 - protein, 4 aa, Plasmodium falciparum
EANR

SEQ ID NO: 3307192 - protein, 14 aa, Plasmodium falciparum
EANREDKSETHKKI

SEQ ID NO: 3307193 - protein, 25 aa, Plasmodium falciparum
EANSDSDSNSDDSSSHKKESRNENY

SEQ ID NO: 3307194 - protein, 6 aa, Plasmodium falciparum
EAPDTK

SEQ ID NO: 3307195 - protein, 5 aa, Plasmodium falciparum
EAPIG

SEQ ID NO: 3307196 - protein, 4 aa, Plasmodium falciparum
EAPN

SEQ ID NO: 3307197 - protein, 6 aa, Plasmodium falciparum
EAPPNY

SEQ ID NO: 3307198 - protein, 7 aa, Plasmodium falciparum
EAQETPV

SEQ ID NO: 3307199 - protein, 8 aa, Plasmodium falciparum
EAQKISGK

SEQ ID NO: 3307200 - protein, 4 aa, Plasmodium falciparum
EAQN

SEQ ID NO: 3307201 - protein, 14 aa, Plasmodium falciparum
EAQNSNNKSNDSLK

SEQ ID NO: 3307202 - protein, 4 aa, Plasmodium falciparum
EARA

SEQ ID NO: 3307203 - protein, 5 aa, Plasmodium falciparum
EARDS

SEQ ID NO: 3307204 - protein, 5 aa, Plasmodium falciparum
EARGG

SEQ ID NO: 3307205 - protein, 4 aa, Plasmodium falciparum
EARK

SEQ ID NO: 3307206 - protein, 10 aa, Plasmodium falciparum
EARKAGKVEA

SEQ ID NO: 3307207 - protein, 15 aa, Plasmodium falciparum
EARRKHTGGKVLGFF

SEQ ID NO: 3307208 - protein, 4 aa, Plasmodium falciparum
EASA

SEQ ID NO: 3307209 - protein, 16 aa, Plasmodium falciparum
EASDRCTREKRKTING

SEQ ID NO: 3307210 - protein, 8 aa, Plasmodium falciparum
EASEKGQL

SEQ ID NO: 3307211 - protein, 7 aa, Plasmodium falciparum
EASKGPI

SEQ ID NO: 3307212 - protein, 49 aa, Plasmodium falciparum
EASKKNPLNNNNNDDDDNNNDDNNNNYNSDNYNSDNYNNKQSKRKPKGT

SEQ ID NO: 3307213 - protein, 5 aa, Plasmodium falciparum
EASNK

SEQ ID NO: 3307214 - protein, 9 aa, Plasmodium falciparum
EASNTASTY

SEQ ID NO: 3307215 - protein, 9 aa, Plasmodium falciparum
EASPNEKNI

SEQ ID NO: 3307216 - protein, 4 aa, Plasmodium falciparum
EASY

SEQ ID NO: 3307217 - protein, 6 aa, Plasmodium falciparum
EATARK

SEQ ID NO: 3307218 - protein, 5 aa, Plasmodium falciparum
EATGV

SEQ ID NO: 3307219 - protein, 12 aa, Plasmodium falciparum
EATRRGSTDDKT

SEQ ID NO: 3307220 - protein, 21 aa, Plasmodium falciparum
EATYHKKEKRKKLNNNKNTYH

SEQ ID NO: 3307221 - protein, 5 aa, Plasmodium falciparum
EAVNT

SEQ ID NO: 3307222 - protein, 8 aa, Plasmodium falciparum
EAVPTGDM

SEQ ID NO: 3307223 - protein, 6 aa, Plasmodium falciparum
EAYGDW

SEQ ID NO: 3307224 - protein, 37 aa, Plasmodium falciparum
EAYKKKTKNKKEKADEDEEEANNNEDVEEQQTDVGEE

SEQ ID NO: 3307225 - protein, 10 aa, Plasmodium falciparum
EAYQESSEQN

SEQ ID NO: 3307226 - protein, 5 aa, Plasmodium falciparum
ECATK

SEQ ID NO: 3307227 - protein, 4 aa, Plasmodium falciparum
ECDH

SEQ ID NO: 3307228 - protein, 20 aa, Plasmodium falciparum
ECDKEQKDNDEKNNKSINSI

SEQ ID NO: 3307229 - protein, 6 aa, Plasmodium falciparum
ECDKYK

SEQ ID NO: 3307230 - protein, 11 aa, Plasmodium falciparum
ECDNNNNNNES

SEQ ID NO: 3307231 - protein, 6 aa, Plasmodium falciparum
ECEDDK

SEQ ID NO: 3307232 - protein, 20 aa, Plasmodium falciparum
ECEENDQEKTNEMEDNRNNE

SEQ ID NO: 3307233 - protein, 9 aa, Plasmodium falciparum
ECEKKKEED

SEQ ID NO: 3307234 - protein, 11 aa, Plasmodium falciparum
ECEPTNEPTDK

SEQ ID NO: 3307235 - protein, 25 aa, Plasmodium falciparum
ECGNGDKETNDYNTRRKKKDEKFSV

SEQ ID NO: 3307236 - protein, 6 aa, Plasmodium falciparum
ECGNSN

SEQ ID NO: 3307237 - protein, 6 aa, Plasmodium falciparum
ECHNQN

SEQ ID NO: 3307238 - protein, 12 aa, Plasmodium falciparum
ECKDRKKRKYDE

SEQ ID NO: 3307239 - protein, 13 aa, Plasmodium falciparum
ECKEENKDKYNYD

SEQ ID NO: 3307240 - protein, 6 aa, Plasmodium falciparum
ECKGTN

SEQ ID NO: 3307241 - protein, 8 aa, Plasmodium falciparum
ECKNEQVE

SEQ ID NO: 3307242 - protein, 9 aa, Plasmodium falciparum
ECKNRKDKT

SEQ ID NO: 3307243 - protein, 7 aa, Plasmodium falciparum
ECNEPNK

SEQ ID NO: 3307244 - protein, 13 aa, Plasmodium falciparum
ECNGSDDGKTQEC

SEQ ID NO: 3307245 - protein, 6 aa, Plasmodium falciparum
ECNKNG

SEQ ID NO: 3307246 - protein, 14 aa, Plasmodium falciparum
ECNKNLKKSKNENE

SEQ ID NO: 3307247 - protein, 11 aa, Plasmodium falciparum
ECNKSSTYTSH

SEQ ID NO: 3307248 - protein, 5 aa, Plasmodium falciparum
ECNSK

SEQ ID NO: 3307249 - protein, 12 aa, Plasmodium falciparum
ECNYDKNKNCNN

SEQ ID NO: 3307250 - protein, 11 aa, Plasmodium falciparum
ECPNKNADNLK

SEQ ID NO: 3307251 - protein, 4 aa, Plasmodium falciparum
ECPY

SEQ ID NO: 3307252 - protein, 6 aa, Plasmodium falciparum
ECQDEK

SEQ ID NO: 3307253 - protein, 7 aa, Plasmodium falciparum
ECRNKTK

SEQ ID NO: 3307254 - protein, 102 aa, Plasmodium falciparum
ECSDNHNNECSDNHNNKCSDNHNNDSSDNHNNDSSNNHNNDSSNNHNNDSSNNHNNDSSNNHNNDSSNNHNNDSSNNHNNNSSNNHNNDSSNNHNNNSSNNH

SEQ ID NO: 3307255 - protein, 25 aa, Plasmodium falciparum
ECSNNIDQTHNNKKKKISDNSNSYE

SEQ ID NO: 3307256 - protein, 10 aa, Plasmodium falciparum
ECTDPEEEFK

SEQ ID NO: 3307257 - protein, 9 aa, Plasmodium falciparum
ECTKTEPQE

SEQ ID NO: 3307258 - protein, 7 aa, Plasmodium falciparum
ECTNTDS

SEQ ID NO: 3307259 - protein, 5 aa, Plasmodium falciparum
ECTPR

SEQ ID NO: 3307260 - protein, 11 aa, Plasmodium falciparum
ECTSEKTGSYY

SEQ ID NO: 3307261 - protein, 5 aa, Plasmodium falciparum
ECTSI

SEQ ID NO: 3307262 - protein, 4 aa, Plasmodium falciparum
ECYN

SEQ ID NO: 3307263 - protein, 4 aa, Plasmodium falciparum
EDAD

SEQ ID NO: 3307264 - protein, 15 aa, Plasmodium falciparum
EDAEEKINKDQSTLE

SEQ ID NO: 3307265 - protein, 5 aa, Plasmodium falciparum
EDAKK

SEQ ID NO: 3307266 - protein, 8 aa, Plasmodium falciparum
EDAKLTKV

SEQ ID NO: 3307267 - protein, 21 aa, Plasmodium falciparum
EDAKSFRNKEGTKITNINNNR

SEQ ID NO: 3307268 - protein, 7 aa, Plasmodium falciparum
EDAKYNM

SEQ ID NO: 3307269 - protein, 12 aa, Plasmodium falciparum
EDANDAGSKYSQ

SEQ ID NO: 3307270 - protein, 5 aa, Plasmodium falciparum
EDASR

SEQ ID NO: 3307271 - protein, 21 aa, Plasmodium falciparum
EDCNTKEIKGYSKVGSEKNIK

SEQ ID NO: 3307272 - protein, 8 aa, Plasmodium falciparum
EDDAEGRR

SEQ ID NO: 3307273 - protein, 9 aa, Plasmodium falciparum
EDDANEENV

SEQ ID NO: 3307274 - protein, 4 aa, Plasmodium falciparum
EDDC

SEQ ID NO: 3307275 - protein, 12 aa, Plasmodium falciparum
EDDCESSSTGSE

SEQ ID NO: 3307276 - protein, 28 aa, Plasmodium falciparum
EDDDDDDDDDDDYDDEDDEINRDSEEMY

SEQ ID NO: 3307277 - protein, 19 aa, Plasmodium falciparum
EDDDDDNHNNNHNNNNNNN

SEQ ID NO: 3307278 - protein, 61 aa, Plasmodium falciparum
EDDDEEEETADDEDEDDEYEVDESELSAEEDSEYDDSEDESLATESDGDEEVEEDSEDEGL

SEQ ID NO: 3307279 - protein, 46 aa, Plasmodium falciparum
EDDDLSEEEDYYNEEEDDYIEEDDDYNEEEDDYNEEDDDYYDDTGE

SEQ ID NO: 3307280 - protein, 100 aa, Plasmodium falciparum
EDDDSDINKNESDDNKNENDDNKNESDDNKNDGDSNKNDGDSNKNDGDSNKNDGDSNKNDGDSNKNDGDSNKNDGDSNKNDGDSNKNDGDGNKSDNDMLG

SEQ ID NO: 3307281 - protein, 4 aa, Plasmodium falciparum
EDDE

SEQ ID NO: 3307282 - protein, 8 aa, Plasmodium falciparum
EDDEDEHH

SEQ ID NO: 3307283 - protein, 8 aa, Plasmodium falciparum
EDDEDKYN

SEQ ID NO: 3307284 - protein, 12 aa, Plasmodium falciparum
EDDEDYDDDNDH

SEQ ID NO: 3307285 - protein, 20 aa, Plasmodium falciparum
EDDEHDDDDDDDNDEENDDQ

SEQ ID NO: 3307286 - protein, 9 aa, Plasmodium falciparum
EDDEIKSNQ

SEQ ID NO: 3307287 - protein, 14 aa, Plasmodium falciparum
EDDENQEKKKEKNV

SEQ ID NO: 3307288 - protein, 14 aa, Plasmodium falciparum
EDDENYDENAEEVE

SEQ ID NO: 3307289 - protein, 11 aa, Plasmodium falciparum
EDDGDKETDRN

SEQ ID NO: 3307290 - protein, 50 aa, Plasmodium falciparum
EDDHGNNEDVHGNNEDVHGNNEDVHGNNEDVHGNNKDVHNNNKDDHNNND

SEQ ID NO: 3307291 - protein, 13 aa, Plasmodium falciparum
EDDISNEKNFNKN

SEQ ID NO: 3307292 - protein, 16 aa, Plasmodium falciparum
EDDKFKKDNKDKYNDM

SEQ ID NO: 3307293 - protein, 9 aa, Plasmodium falciparum
EDDKGVSNK

SEQ ID NO: 3307294 - protein, 33 aa, Plasmodium falciparum
EDDKNDTANNKVGRDVNTNVNKDSSKMNTSGNY

SEQ ID NO: 3307295 - protein, 36 aa, Plasmodium falciparum
EDDKNIQLQDKKKKKGKKKKELQEEKMKKKKKTQEY

SEQ ID NO: 3307296 - protein, 4 aa, Plasmodium falciparum
EDDL

SEQ ID NO: 3307297 - protein, 6 aa, Plasmodium falciparum
EDDLGN

SEQ ID NO: 3307298 - protein, 4 aa, Plasmodium falciparum
EDDN

SEQ ID NO: 3307299 - protein, 7 aa, Plasmodium falciparum
EDDNDSY

SEQ ID NO: 3307300 - protein, 11 aa, Plasmodium falciparum
EDDNKKDEKKY

SEQ ID NO: 3307301 - protein, 45 aa, Plasmodium falciparum
EDDNKSDHPISNSNNNNNNNDDDDVDDHVNKDDNNGEGAISPQIN

SEQ ID NO: 3307302 - protein, 7 aa, Plasmodium falciparum
EDDNNLT

SEQ ID NO: 3307303 - protein, 17 aa, Plasmodium falciparum
EDDNNNNNNNNNNDNNL

SEQ ID NO: 3307304 - protein, 8 aa, Plasmodium falciparum
EDDNYNNS

SEQ ID NO: 3307305 - protein, 8 aa, Plasmodium falciparum
EDDQNAYS

SEQ ID NO: 3307306 - protein, 11 aa, Plasmodium falciparum
EDDRKKNEDIK

SEQ ID NO: 3307307 - protein, 276 aa, Plasmodium falciparum
EDDSNDDEEEEDRSKKDICSRASEEKEQKIDKEEKEIKINDKSKNEDDKEHEESKSDYYSGDSSGLSSSKTESNYEQNENDKNKEKKDNINNDSIKSKEEEKENIKSSEEESEEKSDEGSDGESEEKNDEKSKEESDNKSDDESDNESDDESDNESDDESDDKRDNKCDDKSDVKSDVKSDVKSDNESDNESDDKSDDKSDDESDDESDYESDDKKDNKCDDKSSNRSLSESTSSDENKNIIDDKNKNENTSESESDNDNNDESDSTHDNDIESKK

SEQ ID NO: 3307308 - protein, 27 aa, Plasmodium falciparum
EDDSNIKKDDEVKMNDDETKKDKSREN

SEQ ID NO: 3307309 - protein, 37 aa, Plasmodium falciparum
EDDSPMKSYNDISNKENMSPYDDGKGKDGDRDQDDMS

SEQ ID NO: 3307310 - protein, 12 aa, Plasmodium falciparum
EDDTNDSYEESV

SEQ ID NO: 3307311 - protein, 8 aa, Plasmodium falciparum
EDDTNKKY

SEQ ID NO: 3307312 - protein, 12 aa, Plasmodium falciparum
EDDVKDKAKISM

SEQ ID NO: 3307313 - protein, 4 aa, Plasmodium falciparum
EDED

SEQ ID NO: 3307314 - protein, 8 aa, Plasmodium falciparum
EDEDEKKI

SEQ ID NO: 3307315 - protein, 8 aa, Plasmodium falciparum
EDEDLSNN

SEQ ID NO: 3307316 - protein, 5 aa, Plasmodium falciparum
EDEDP

SEQ ID NO: 3307317 - protein, 5 aa, Plasmodium falciparum
EDEEA

SEQ ID NO: 3307318 - protein, 11 aa, Plasmodium falciparum
EDEEEENEIKD

SEQ ID NO: 3307319 - protein, 12 aa, Plasmodium falciparum
EDEEEENNIGEK

SEQ ID NO: 3307320 - protein, 18 aa, Plasmodium falciparum
EDEEEKEKKKKKKSDNKD

SEQ ID NO: 3307321 - protein, 8 aa, Plasmodium falciparum
EDEEEKHK

SEQ ID NO: 3307322 - protein, 9 aa, Plasmodium falciparum
EDEEEKKKK

SEQ ID NO: 3307323 - protein, 6 aa, Plasmodium falciparum
EDEEEV

SEQ ID NO: 3307324 - protein, 9 aa, Plasmodium falciparum
EDEEGRSYK

SEQ ID NO: 3307325 - protein, 6 aa, Plasmodium falciparum
EDEEYE

SEQ ID NO: 3307326 - protein, 19 aa, Plasmodium falciparum
EDEFYNSSNDKNEEEYSSY

SEQ ID NO: 3307327 - protein, 9 aa, Plasmodium falciparum
EDEGKVSEN

SEQ ID NO: 3307328 - protein, 9 aa, Plasmodium falciparum
EDEGSYNKN

SEQ ID NO: 3307329 - protein, 5 aa, Plasmodium falciparum
EDEHT

SEQ ID NO: 3307330 - protein, 4 aa, Plasmodium falciparum
EDEI

SEQ ID NO: 3307331 - protein, 21 aa, Plasmodium falciparum
EDEIENKEKDNITSGNIDNTL

SEQ ID NO: 3307332 - protein, 21 aa, Plasmodium falciparum
EDEKDKKKKEKKEKRLNRKDY

SEQ ID NO: 3307333 - protein, 10 aa, Plasmodium falciparum
EDEKEENETY

SEQ ID NO: 3307334 - protein, 8 aa, Plasmodium falciparum
EDEKEERK

SEQ ID NO: 3307335 - protein, 8 aa, Plasmodium falciparum
EDEKGNTY

SEQ ID NO: 3307336 - protein, 34 aa, Plasmodium falciparum
EDEKIDKQKDIDKKEDKKNMSTNRKEYKKKKKKY

SEQ ID NO: 3307337 - protein, 11 aa, Plasmodium falciparum
EDEKIKENEEC

SEQ ID NO: 3307338 - protein, 11 aa, Plasmodium falciparum
EDEKKKYAEKI

SEQ ID NO: 3307339 - protein, 16 aa, Plasmodium falciparum
EDEKNVHSKDDKTMKD

SEQ ID NO: 3307340 - protein, 7 aa, Plasmodium falciparum
EDEKSDN

SEQ ID NO: 3307341 - protein, 37 aa, Plasmodium falciparum
EDEKSQKNKNKDKDNDHSDEDEDDDDDDDDNHNHYNS

SEQ ID NO: 3307342 - protein, 4 aa, Plasmodium falciparum
EDEN

SEQ ID NO: 3307343 - protein, 15 aa, Plasmodium falciparum
EDENGTKTTKTINEG

SEQ ID NO: 3307344 - protein, 6 aa, Plasmodium falciparum
EDENIT

SEQ ID NO: 3307345 - protein, 6 aa, Plasmodium falciparum
EDENKI

SEQ ID NO: 3307346 - protein, 9 aa, Plasmodium falciparum
EDENKNNNI

SEQ ID NO: 3307347 - protein, 24 aa, Plasmodium falciparum
EDENNNTGDYASNTSETKSGYSSY

SEQ ID NO: 3307348 - protein, 7 aa, Plasmodium falciparum
EDENRLA

SEQ ID NO: 3307349 - protein, 8 aa, Plasmodium falciparum
EDENYDDD

SEQ ID NO: 3307350 - protein, 10 aa, Plasmodium falciparum
EDEPDPLPDS

SEQ ID NO: 3307351 - protein, 13 aa, Plasmodium falciparum
EDEQEHTNEKNNT

SEQ ID NO: 3307352 - protein, 8 aa, Plasmodium falciparum
EDEQGLPI

SEQ ID NO: 3307353 - protein, 5 aa, Plasmodium falciparum
EDEQK

SEQ ID NO: 3307354 - protein, 5 aa, Plasmodium falciparum
EDEQL

SEQ ID NO: 3307355 - protein, 12 aa, Plasmodium falciparum
EDESKEKSISNY

SEQ ID NO: 3307356 - protein, 10 aa, Plasmodium falciparum
EDESKKNPKH

SEQ ID NO: 3307357 - protein, 8 aa, Plasmodium falciparum
EDESKNSI

SEQ ID NO: 3307358 - protein, 5 aa, Plasmodium falciparum
EDESL

SEQ ID NO: 3307359 - protein, 23 aa, Plasmodium falciparum
EDESPISSINNNNNNKVEDDCNQ

SEQ ID NO: 3307360 - protein, 5 aa, Plasmodium falciparum
EDEYY

SEQ ID NO: 3307361 - protein, 16 aa, Plasmodium falciparum
EDFEELKDEKNLDNYT

SEQ ID NO: 3307362 - protein, 5 aa, Plasmodium falciparum
EDFGK

SEQ ID NO: 3307363 - protein, 4 aa, Plasmodium falciparum
EDFS

SEQ ID NO: 3307364 - protein, 4 aa, Plasmodium falciparum
EDGE

SEQ ID NO: 3307365 - protein, 25 aa, Plasmodium falciparum
EDGEEKDQNGEKKKINTSEAYHEGK

SEQ ID NO: 3307366 - protein, 7 aa, Plasmodium falciparum
EDGEGKK

SEQ ID NO: 3307367 - protein, 7 aa, Plasmodium falciparum
EDGIGKN

SEQ ID NO: 3307368 - protein, 5 aa, Plasmodium falciparum
EDGKG

SEQ ID NO: 3307369 - protein, 7 aa, Plasmodium falciparum
EDGKNNN

SEQ ID NO: 3307370 - protein, 23 aa, Plasmodium falciparum
EDGNDNNNSNNNNNNNNNNISPN

SEQ ID NO: 3307371 - protein, 25 aa, Plasmodium falciparum
EDGNEEEKINSDVKNRDSSKEEEID

SEQ ID NO: 3307372 - protein, 7 aa, Plasmodium falciparum
EDGNKDY

SEQ ID NO: 3307373 - protein, 7 aa, Plasmodium falciparum
EDGSENL

SEQ ID NO: 3307374 - protein, 8 aa, Plasmodium falciparum
EDGSKIDK

SEQ ID NO: 3307375 - protein, 8 aa, Plasmodium falciparum
EDGSSNGL

SEQ ID NO: 3307376 - protein, 7 aa, Plasmodium falciparum
EDGYNNT

SEQ ID NO: 3307377 - protein, 7 aa, Plasmodium falciparum
EDHKNEI

SEQ ID NO: 3307378 - protein, 12 aa, Plasmodium falciparum
EDHQNKKLKNKN

SEQ ID NO: 3307379 - protein, 56 aa, Plasmodium falciparum
EDHVSNKSISSNTKSGKISKKKKAKKNKNNDNVDEENDSNESFNDKSNLSNNSSES

SEQ ID NO: 3307380 - protein, 4 aa, Plasmodium falciparum
EDID

SEQ ID NO: 3307381 - protein, 4 aa, Plasmodium falciparum
EDIE

SEQ ID NO: 3307382 - protein, 13 aa, Plasmodium falciparum
EDIEGGGNGNAYS

SEQ ID NO: 3307383 - protein, 7 aa, Plasmodium falciparum
EDIENEQ

SEQ ID NO: 3307384 - protein, 9 aa, Plasmodium falciparum
EDIEQQNDY

SEQ ID NO: 3307385 - protein, 5 aa, Plasmodium falciparum
EDIES

SEQ ID NO: 3307386 - protein, 40 aa, Plasmodium falciparum
EDIGYAEKKNKEDYPLNKKKKGNNNNNKNKRDKHNQCDDK

SEQ ID NO: 3307387 - protein, 4 aa, Plasmodium falciparum
EDII

SEQ ID NO: 3307388 - protein, 5 aa, Plasmodium falciparum
EDIIP

SEQ ID NO: 3307389 - protein, 4 aa, Plasmodium falciparum
EDIK

SEQ ID NO: 3307390 - protein, 14 aa, Plasmodium falciparum
EDIKGNDPNDQYDK

SEQ ID NO: 3307391 - protein, 10 aa, Plasmodium falciparum
EDIKKNVEEN

SEQ ID NO: 3307392 - protein, 10 aa, Plasmodium falciparum
EDIKNNNEPY

SEQ ID NO: 3307393 - protein, 8 aa, Plasmodium falciparum
EDIKNNNH

SEQ ID NO: 3307394 - protein, 8 aa, Plasmodium falciparum
EDIKNSKD

SEQ ID NO: 3307395 - protein, 4 aa, Plasmodium falciparum
EDIN

SEQ ID NO: 3307396 - protein, 5 aa, Plasmodium falciparum
EDIND

SEQ ID NO: 3307397 - protein, 13 aa, Plasmodium falciparum
EDINEEEKEKKLS

SEQ ID NO: 3307398 - protein, 7 aa, Plasmodium falciparum
EDINEKE

SEQ ID NO: 3307399 - protein, 13 aa, Plasmodium falciparum
EDINEKKKKVEEI

SEQ ID NO: 3307400 - protein, 7 aa, Plasmodium falciparum
EDINGTA

SEQ ID NO: 3307401 - protein, 5 aa, Plasmodium falciparum
EDINK

SEQ ID NO: 3307402 - protein, 6 aa, Plasmodium falciparum
EDINKM

SEQ ID NO: 3307403 - protein, 6 aa, Plasmodium falciparum
EDIPLG

SEQ ID NO: 3307404 - protein, 11 aa, Plasmodium falciparum
EDIPSKGSIKK

SEQ ID NO: 3307405 - protein, 7 aa, Plasmodium falciparum
EDIRTKN

SEQ ID NO: 3307406 - protein, 10 aa, Plasmodium falciparum
EDISNEENKQ

SEQ ID NO: 3307407 - protein, 17 aa, Plasmodium falciparum
EDISNYNYNNNNNSNIS

SEQ ID NO: 3307408 - protein, 14 aa, Plasmodium falciparum
EDISRGQTKSHIKK

SEQ ID NO: 3307409 - protein, 12 aa, Plasmodium falciparum
EDISSDSSPVEK

SEQ ID NO: 3307410 - protein, 7 aa, Plasmodium falciparum
EDISSKN

SEQ ID NO: 3307411 - protein, 6 aa, Plasmodium falciparum
EDISTN

SEQ ID NO: 3307412 - protein, 5 aa, Plasmodium falciparum
EDITN

SEQ ID NO: 3307413 - protein, 12 aa, Plasmodium falciparum
EDITQSNTLTED

SEQ ID NO: 3307414 - protein, 7 aa, Plasmodium falciparum
EDITTTT

SEQ ID NO: 3307415 - protein, 4 aa, Plasmodium falciparum
EDKD

SEQ ID NO: 3307416 - protein, 5 aa, Plasmodium falciparum
EDKDD

SEQ ID NO: 3307417 - protein, 32 aa, Plasmodium falciparum
EDKDDDDENNDENNDKESDEEDDHGDDHNDYN

SEQ ID NO: 3307418 - protein, 7 aa, Plasmodium falciparum
EDKDEDE

SEQ ID NO: 3307419 - protein, 27 aa, Plasmodium falciparum
EDKDEDSELDCGQSEKKYKISNGEEIN

SEQ ID NO: 3307420 - protein, 16 aa, Plasmodium falciparum
EDKDEKAENEEDEEEE

SEQ ID NO: 3307421 - protein, 7 aa, Plasmodium falciparum
EDKDESV

SEQ ID NO: 3307422 - protein, 12 aa, Plasmodium falciparum
EDKDVNDNYDMF

SEQ ID NO: 3307423 - protein, 4 aa, Plasmodium falciparum
EDKE

SEQ ID NO: 3307424 - protein, 10 aa, Plasmodium falciparum
EDKEDIDSQG

SEQ ID NO: 3307425 - protein, 8 aa, Plasmodium falciparum
EDKEKQYN

SEQ ID NO: 3307426 - protein, 12 aa, Plasmodium falciparum
EDKETDLNKKKE

SEQ ID NO: 3307427 - protein, 81 aa, Plasmodium falciparum
EDKGKKTKTNVKTKENKEKEQNKNKNEFGWGSDNDNDNDNNNNNNNDEKTLNKSEKKSNDKNDTSTNKDELNKSENKSVSN

SEQ ID NO: 3307428 - protein, 7 aa, Plasmodium falciparum
EDKHYED

SEQ ID NO: 3307429 - protein, 4 aa, Plasmodium falciparum
EDKK

SEQ ID NO: 3307430 - protein, 9 aa, Plasmodium falciparum
EDKKGEQIK

SEQ ID NO: 3307431 - protein, 9 aa, Plasmodium falciparum
EDKKKEKKS

SEQ ID NO: 3307432 - protein, 8 aa, Plasmodium falciparum
EDKKLGGT

SEQ ID NO: 3307433 - protein, 31 aa, Plasmodium falciparum
EDKKQKKKNSISFKEQEDEETNKEKKNYEKI

SEQ ID NO: 3307434 - protein, 8 aa, Plasmodium falciparum
EDKKSSNQ

SEQ ID NO: 3307435 - protein, 4 aa, Plasmodium falciparum
EDKN

SEQ ID NO: 3307436 - protein, 7 aa, Plasmodium falciparum
EDKNGYS

SEQ ID NO: 3307437 - protein, 6 aa, Plasmodium falciparum
EDKNIE

SEQ ID NO: 3307438 - protein, 20 aa, Plasmodium falciparum
EDKNINQKETNDEDTKNDDI

SEQ ID NO: 3307439 - protein, 9 aa, Plasmodium falciparum
EDKNKENKN

SEQ ID NO: 3307440 - protein, 7 aa, Plasmodium falciparum
EDKNKNI

SEQ ID NO: 3307441 - protein, 9 aa, Plasmodium falciparum
EDKNSLSNM

SEQ ID NO: 3307442 - protein, 14 aa, Plasmodium falciparum
EDKNSNLGKTNGYN

SEQ ID NO: 3307443 - protein, 6 aa, Plasmodium falciparum
EDKNSS

SEQ ID NO: 3307444 - protein, 26 aa, Plasmodium falciparum
EDKNSSNANKNMTNEKNLKATDNNVY

SEQ ID NO: 3307445 - protein, 10 aa, Plasmodium falciparum
EDKNTEQMYE

SEQ ID NO: 3307446 - protein, 7 aa, Plasmodium falciparum
EDKPSTL

SEQ ID NO: 3307447 - protein, 15 aa, Plasmodium falciparum
EDKSHELKKKHEKDL

SEQ ID NO: 3307448 - protein, 8 aa, Plasmodium falciparum
EDKSTIKK

SEQ ID NO: 3307449 - protein, 14 aa, Plasmodium falciparum
EDKTGDSQHNEHVD

SEQ ID NO: 3307450 - protein, 11 aa, Plasmodium falciparum
EDKTKSKGSFS

SEQ ID NO: 3307451 - protein, 8 aa, Plasmodium falciparum
EDKTNMEI

SEQ ID NO: 3307452 - protein, 8 aa, Plasmodium falciparum
EDKTNNEK

SEQ ID NO: 3307453 - protein, 4 aa, Plasmodium falciparum
EDKV

SEQ ID NO: 3307454 - protein, 16 aa, Plasmodium falciparum
EDKYNNRRDTKNSYHH

SEQ ID NO: 3307455 - protein, 6 aa, Plasmodium falciparum
EDLDEK

SEQ ID NO: 3307456 - protein, 4 aa, Plasmodium falciparum
EDLE

SEQ ID NO: 3307457 - protein, 4 aa, Plasmodium falciparum
EDLF

SEQ ID NO: 3307458 - protein, 5 aa, Plasmodium falciparum
EDLKN

SEQ ID NO: 3307459 - protein, 4 aa, Plasmodium falciparum
EDLQ

SEQ ID NO: 3307460 - protein, 9 aa, Plasmodium falciparum
EDLTSDPKK

SEQ ID NO: 3307461 - protein, 173 aa, Plasmodium falciparum
EDMDKKKKLKEKKRTKEEKRLKEEERIKEKKKIKEEKRLKEEERIKEEERIKEKKRTKEEKRLKEEERIKEKKKIKEEKRLKEEERIKEEERIKEKKKLKEQERLKEEQRLRQEEKLKEEKRLKKEKKLKKEKKLKEEERLKEETRIREEERLKEEERLKEETRIREEERIRE

SEQ ID NO: 3307462 - protein, 19 aa, Plasmodium falciparum
EDMEKEKKMNKSAPNDYSA

SEQ ID NO: 3307463 - protein, 11 aa, Plasmodium falciparum
EDMEKNEKREY

SEQ ID NO: 3307464 - protein, 7 aa, Plasmodium falciparum
EDMEQHD

SEQ ID NO: 3307465 - protein, 8 aa, Plasmodium falciparum
EDMEQSKT

SEQ ID NO: 3307466 - protein, 6 aa, Plasmodium falciparum
EDMGVD

SEQ ID NO: 3307467 - protein, 116 aa, Plasmodium falciparum
EDMKKKKEDHKKEVNDDNVDGDDNDDSEDNDGSEDNDDSKDNDDSEDNDDSKDNDDSEDNDDSEDNDGSENNDDSEDNEGSKDNDGSKDNDGSEDNDDSKDNDGSEDNDGSDDDEG

SEQ ID NO: 3307468 - protein, 21 aa, Plasmodium falciparum
EDMNEEEDVNEEEDVNEEEDL

SEQ ID NO: 3307469 - protein, 5 aa, Plasmodium falciparum
EDMTH

SEQ ID NO: 3307470 - protein, 8 aa, Plasmodium falciparum
EDNDDDNV

SEQ ID NO: 3307471 - protein, 13 aa, Plasmodium falciparum
EDNDDSENEKEID

SEQ ID NO: 3307472 - protein, 7 aa, Plasmodium falciparum
EDNDFND

SEQ ID NO: 3307473 - protein, 12 aa, Plasmodium falciparum
EDNDNDEEKKKK

SEQ ID NO: 3307474 - protein, 4 aa, Plasmodium falciparum
EDNE

SEQ ID NO: 3307475 - protein, 7 aa, Plasmodium falciparum
EDNEDES

SEQ ID NO: 3307476 - protein, 18 aa, Plasmodium falciparum
EDNEEKNNKSAQKCIDGN

SEQ ID NO: 3307477 - protein, 6 aa, Plasmodium falciparum
EDNEEV

SEQ ID NO: 3307478 - protein, 8 aa, Plasmodium falciparum
EDNENNTH

SEQ ID NO: 3307479 - protein, 17 aa, Plasmodium falciparum
EDNEPVSKEEKKNLHDK

SEQ ID NO: 3307480 - protein, 5 aa, Plasmodium falciparum
EDNER

SEQ ID NO: 3307481 - protein, 5 aa, Plasmodium falciparum
EDNHD

SEQ ID NO: 3307482 - protein, 5 aa, Plasmodium falciparum
EDNID

SEQ ID NO: 3307483 - protein, 13 aa, Plasmodium falciparum
EDNIDDDKRYYDD

SEQ ID NO: 3307484 - protein, 16 aa, Plasmodium falciparum
EDNINSSENFTSNSNL

SEQ ID NO: 3307485 - protein, 23 aa, Plasmodium falciparum
EDNKDENNHNNNNNNNNNNKNNE

SEQ ID NO: 3307486 - protein, 9 aa, Plasmodium falciparum
EDNKENDSH

SEQ ID NO: 3307487 - protein, 17 aa, Plasmodium falciparum
EDNKKAEDELKKGTIPD

SEQ ID NO: 3307488 - protein, 8 aa, Plasmodium falciparum
EDNKKKKI

SEQ ID NO: 3307489 - protein, 10 aa, Plasmodium falciparum
EDNKKKKKKT

SEQ ID NO: 3307490 - protein, 24 aa, Plasmodium falciparum
EDNKKKNYHNKNDNNEDDKKGFSN

SEQ ID NO: 3307491 - protein, 6 aa, Plasmodium falciparum
EDNKLS

SEQ ID NO: 3307492 - protein, 11 aa, Plasmodium falciparum
EDNKNEGSDVL

SEQ ID NO: 3307493 - protein, 9 aa, Plasmodium falciparum
EDNKNINSY

SEQ ID NO: 3307494 - protein, 5 aa, Plasmodium falciparum
EDNKT

SEQ ID NO: 3307495 - protein, 6 aa, Plasmodium falciparum
EDNKTV

SEQ ID NO: 3307496 - protein, 4 aa, Plasmodium falciparum
EDNL

SEQ ID NO: 3307497 - protein, 12 aa, Plasmodium falciparum
EDNLKKKKKNDV

SEQ ID NO: 3307498 - protein, 6 aa, Plasmodium falciparum
EDNLTN

SEQ ID NO: 3307499 - protein, 15 aa, Plasmodium falciparum
EDNMSDACTEKQPEE

SEQ ID NO: 3307500 - protein, 4 aa, Plasmodium falciparum
EDNN

SEQ ID NO: 3307501 - protein, 19 aa, Plasmodium falciparum
EDNNANEKNHNNLESEGKG

SEQ ID NO: 3307502 - protein, 10 aa, Plasmodium falciparum
EDNNETNINS

SEQ ID NO: 3307503 - protein, 9 aa, Plasmodium falciparum
EDNNHNEAN

SEQ ID NO: 3307504 - protein, 8 aa, Plasmodium falciparum
EDNNKTEL

SEQ ID NO: 3307505 - protein, 9 aa, Plasmodium falciparum
EDNNMNDTK

SEQ ID NO: 3307506 - protein, 9 aa, Plasmodium falciparum
EDNNNKDDV

SEQ ID NO: 3307507 - protein, 8 aa, Plasmodium falciparum
EDNNNNDY

SEQ ID NO: 3307508 - protein, 15 aa, Plasmodium falciparum
EDNNNNNNNNDNNIY

SEQ ID NO: 3307509 - protein, 11 aa, Plasmodium falciparum
EDNNNWKSRTI

SEQ ID NO: 3307510 - protein, 10 aa, Plasmodium falciparum
EDNNRATRNA

SEQ ID NO: 3307511 - protein, 18 aa, Plasmodium falciparum
EDNNTDNISEGLNTQETD

SEQ ID NO: 3307512 - protein, 8 aa, Plasmodium falciparum
EDNNTLKR

SEQ ID NO: 3307513 - protein, 21 aa, Plasmodium falciparum
EDNNTQCNKNHTSDHKNDQQI

SEQ ID NO: 3307514 - protein, 73 aa, Plasmodium falciparum
EDNNYEESDEDELEEDEYEEELEEDEYDEESDQDEYDEESDQDEYDEESDQDEYDEESDQDGYDEESNEDDLD

SEQ ID NO: 3307515 - protein, 7 aa, Plasmodium falciparum
EDNNYEI

SEQ ID NO: 3307516 - protein, 6 aa, Plasmodium falciparum
EDNPKL

SEQ ID NO: 3307517 - protein, 8 aa, Plasmodium falciparum
EDNQKNKY

SEQ ID NO: 3307518 - protein, 5 aa, Plasmodium falciparum
EDNRK

SEQ ID NO: 3307519 - protein, 9 aa, Plasmodium falciparum
EDNSENRID

SEQ ID NO: 3307520 - protein, 6 aa, Plasmodium falciparum
EDNSNM

SEQ ID NO: 3307521 - protein, 10 aa, Plasmodium falciparum
EDNSTTTEKN

SEQ ID NO: 3307522 - protein, 9 aa, Plasmodium falciparum
EDNTENNNL

SEQ ID NO: 3307523 - protein, 10 aa, Plasmodium falciparum
EDNTNINNDL

SEQ ID NO: 3307524 - protein, 9 aa, Plasmodium falciparum
EDNTTNNNI

SEQ ID NO: 3307525 - protein, 6 aa, Plasmodium falciparum
EDNTYN

SEQ ID NO: 3307526 - protein, 8 aa, Plasmodium falciparum
EDNVDNEE

SEQ ID NO: 3307527 - protein, 26 aa, Plasmodium falciparum
EDNVETSHNNSNNNKKKKKKNTHDKR

SEQ ID NO: 3307528 - protein, 5 aa, Plasmodium falciparum
EDNVR

SEQ ID NO: 3307529 - protein, 4 aa, Plasmodium falciparum
EDNY

SEQ ID NO: 3307530 - protein, 5 aa, Plasmodium falciparum
EDNYE

SEQ ID NO: 3307531 - protein, 15 aa, Plasmodium falciparum
EDNYGYKNNSRGGVY

SEQ ID NO: 3307532 - protein, 37 aa, Plasmodium falciparum
EDNYKKCEENKVKKNIEKDKSLKNDLSTKNNKSIHEN

SEQ ID NO: 3307533 - protein, 6 aa, Plasmodium falciparum
EDPDKI

SEQ ID NO: 3307534 - protein, 5 aa, Plasmodium falciparum
EDPIT

SEQ ID NO: 3307535 - protein, 13 aa, Plasmodium falciparum
EDPNLSNNPEKEY

SEQ ID NO: 3307536 - protein, 29 aa, Plasmodium falciparum
EDPNNGHNDNINNNDINNNNNNNDNNNTI

SEQ ID NO: 3307537 - protein, 22 aa, Plasmodium falciparum
EDPNNNNNDNNNTNISADNNYS

SEQ ID NO: 3307538 - protein, 10 aa, Plasmodium falciparum
EDPPFSNFSE

SEQ ID NO: 3307539 - protein, 5 aa, Plasmodium falciparum
EDPQP

SEQ ID NO: 3307540 - protein, 4 aa, Plasmodium falciparum
EDPR

SEQ ID NO: 3307541 - protein, 4 aa, Plasmodium falciparum
EDPS

SEQ ID NO: 3307542 - protein, 4 aa, Plasmodium falciparum
EDPY

SEQ ID NO: 3307543 - protein, 5 aa, Plasmodium falciparum
EDPYV

SEQ ID NO: 3307544 - protein, 5 aa, Plasmodium falciparum
EDQEK

SEQ ID NO: 3307545 - protein, 19 aa, Plasmodium falciparum
EDQENNIHSKEKDKYINNN

SEQ ID NO: 3307546 - protein, 5 aa, Plasmodium falciparum
EDQEY

SEQ ID NO: 3307547 - protein, 12 aa, Plasmodium falciparum
EDQFNNQEEDYN

SEQ ID NO: 3307548 - protein, 13 aa, Plasmodium falciparum
EDQGDIKEKKSYM

SEQ ID NO: 3307549 - protein, 10 aa, Plasmodium falciparum
EDQGKGNNLL

SEQ ID NO: 3307550 - protein, 17 aa, Plasmodium falciparum
EDQKNDDTCGHTNDHTN

SEQ ID NO: 3307551 - protein, 9 aa, Plasmodium falciparum
EDQKVGPLN

SEQ ID NO: 3307552 - protein, 5 aa, Plasmodium falciparum
EDQNI

SEQ ID NO: 3307553 - protein, 13 aa, Plasmodium falciparum
EDQQEYNNVEKEN

SEQ ID NO: 3307554 - protein, 17 aa, Plasmodium falciparum
EDQTTDHNKQNNEYSHS

SEQ ID NO: 3307555 - protein, 18 aa, Plasmodium falciparum
EDREDGAGHYGDDDDENM

SEQ ID NO: 3307556 - protein, 6 aa, Plasmodium falciparum
EDREEK

SEQ ID NO: 3307557 - protein, 6 aa, Plasmodium falciparum
EDRKKH

SEQ ID NO: 3307558 - protein, 7 aa, Plasmodium falciparum
EDRKNME

SEQ ID NO: 3307559 - protein, 9 aa, Plasmodium falciparum
EDRKSEELA

SEQ ID NO: 3307560 - protein, 6 aa, Plasmodium falciparum
EDRTYY

SEQ ID NO: 3307561 - protein, 9 aa, Plasmodium falciparum
EDSAIEKNS

SEQ ID NO: 3307562 - protein, 5 aa, Plasmodium falciparum
EDSDD

SEQ ID NO: 3307563 - protein, 7 aa, Plasmodium falciparum
EDSDINN

SEQ ID NO: 3307564 - protein, 9 aa, Plasmodium falciparum
EDSDNGDEN

SEQ ID NO: 3307565 - protein, 4 aa, Plasmodium falciparum
EDSE

SEQ ID NO: 3307566 - protein, 6 aa, Plasmodium falciparum
EDSEEQ

SEQ ID NO: 3307567 - protein, 9 aa, Plasmodium falciparum
EDSEIDDIQ

SEQ ID NO: 3307568 - protein, 24 aa, Plasmodium falciparum
EDSGDNVTESSESEVEEKKPIVSA

SEQ ID NO: 3307569 - protein, 6 aa, Plasmodium falciparum
EDSHSY

SEQ ID NO: 3307570 - protein, 7 aa, Plasmodium falciparum
EDSINND

SEQ ID NO: 3307571 - protein, 4 aa, Plasmodium falciparum
EDSL

SEQ ID NO: 3307572 - protein, 5 aa, Plasmodium falciparum
EDSLE

SEQ ID NO: 3307573 - protein, 12 aa, Plasmodium falciparum
EDSLENEKSNIL

SEQ ID NO: 3307574 - protein, 4 aa, Plasmodium falciparum
EDSN

SEQ ID NO: 3307575 - protein, 6 aa, Plasmodium falciparum
EDSNIS

SEQ ID NO: 3307576 - protein, 5 aa, Plasmodium falciparum
EDSNK

SEQ ID NO: 3307577 - protein, 13 aa, Plasmodium falciparum
EDSNNNNNNNNKM

SEQ ID NO: 3307578 - protein, 8 aa, Plasmodium falciparum
EDSQEHDH

SEQ ID NO: 3307579 - protein, 8 aa, Plasmodium falciparum
EDSQNYEN

SEQ ID NO: 3307580 - protein, 5 aa, Plasmodium falciparum
EDSSA

SEQ ID NO: 3307581 - protein, 17 aa, Plasmodium falciparum
EDSSDNDEVSTKKRKWT

SEQ ID NO: 3307582 - protein, 13 aa, Plasmodium falciparum
EDSSEESQKYKKG

SEQ ID NO: 3307583 - protein, 6 aa, Plasmodium falciparum
EDSSHT

SEQ ID NO: 3307584 - protein, 15 aa, Plasmodium falciparum
EDSTKNENKKDNIDE

SEQ ID NO: 3307585 - protein, 15 aa, Plasmodium falciparum
EDSTRTKGHMNDEQN

SEQ ID NO: 3307586 - protein, 17 aa, Plasmodium falciparum
EDSVDKSIQNMSSRKYE

SEQ ID NO: 3307587 - protein, 8 aa, Plasmodium falciparum
EDSYDDND

SEQ ID NO: 3307588 - protein, 5 aa, Plasmodium falciparum
EDSYT

SEQ ID NO: 3307589 - protein, 4 aa, Plasmodium falciparum
EDTD

SEQ ID NO: 3307590 - protein, 18 aa, Plasmodium falciparum
EDTDNGSSLNKNNNNSTS

SEQ ID NO: 3307591 - protein, 4 aa, Plasmodium falciparum
EDTE

SEQ ID NO: 3307592 - protein, 6 aa, Plasmodium falciparum
EDTEHV

SEQ ID NO: 3307593 - protein, 32 aa, Plasmodium falciparum
EDTGNSKKKMKNKNKKKTNEDENAESNLNPNE

SEQ ID NO: 3307594 - protein, 5 aa, Plasmodium falciparum
EDTIP

SEQ ID NO: 3307595 - protein, 8 aa, Plasmodium falciparum
EDTITKQE

SEQ ID NO: 3307596 - protein, 4 aa, Plasmodium falciparum
EDTK

SEQ ID NO: 3307597 - protein, 6 aa, Plasmodium falciparum
EDTKEK

SEQ ID NO: 3307598 - protein, 5 aa, Plasmodium falciparum
EDTKK

SEQ ID NO: 3307599 - protein, 8 aa, Plasmodium falciparum
EDTKKPRN

SEQ ID NO: 3307600 - protein, 9 aa, Plasmodium falciparum
EDTKNEGNL

SEQ ID NO: 3307601 - protein, 115 aa, Plasmodium falciparum
EDTKSDDEEGDDDERDDDDEKDDERDDERDDEKDDDEDDEKKKKKKKKNVKSEKGVSVKKEKKNKHNNSHKYDDNDDEEDDDEDDDDDNDDDDDDNNNNNNNNGLHKDKKKTGIS

SEQ ID NO: 3307602 - protein, 6 aa, Plasmodium falciparum
EDTNEK

SEQ ID NO: 3307603 - protein, 15 aa, Plasmodium falciparum
EDTNKENEGNDMKDN

SEQ ID NO: 3307604 - protein, 8 aa, Plasmodium falciparum
EDTNSTIK

SEQ ID NO: 3307605 - protein, 7 aa, Plasmodium falciparum
EDTPPSI

SEQ ID NO: 3307606 - protein, 8 aa, Plasmodium falciparum
EDTQDIEE

SEQ ID NO: 3307607 - protein, 14 aa, Plasmodium falciparum
EDTQQMEEENYINE

SEQ ID NO: 3307608 - protein, 13 aa, Plasmodium falciparum
EDTRDKTESTENK

SEQ ID NO: 3307609 - protein, 4 aa, Plasmodium falciparum
EDTS

SEQ ID NO: 3307610 - protein, 10 aa, Plasmodium falciparum
EDTSKQLEEK

SEQ ID NO: 3307611 - protein, 9 aa, Plasmodium falciparum
EDTSSETEK

SEQ ID NO: 3307612 - protein, 47 aa, Plasmodium falciparum
EDTTNSKEDINNDKNENEKSEQIKKNYENNPSLESSLGSDSENSENF

SEQ ID NO: 3307613 - protein, 6 aa, Plasmodium falciparum
EDTTNY

SEQ ID NO: 3307614 - protein, 19 aa, Plasmodium falciparum
EDTTSKARVDKKEDVQEEM

SEQ ID NO: 3307615 - protein, 13 aa, Plasmodium falciparum
EDTTTSNSMSPLK

SEQ ID NO: 3307616 - protein, 6 aa, Plasmodium falciparum
EDTVDE

SEQ ID NO: 3307617 - protein, 11 aa, Plasmodium falciparum
EDTYDNKISTD

SEQ ID NO: 3307618 - protein, 5 aa, Plasmodium falciparum
EDTYS

SEQ ID NO: 3307619 - protein, 41 aa, Plasmodium falciparum
EDTYYNDRNNKKFKDYKHNNNNNYDDHNNNTNDTYNKSQTQ

SEQ ID NO: 3307620 - protein, 11 aa, Plasmodium falciparum
EDVADNSPQMN

SEQ ID NO: 3307621 - protein, 6 aa, Plasmodium falciparum
EDVDDN

SEQ ID NO: 3307622 - protein, 4 aa, Plasmodium falciparum
EDVE

SEQ ID NO: 3307623 - protein, 17 aa, Plasmodium falciparum
EDVEEDLETSPLSSPRN

SEQ ID NO: 3307624 - protein, 19 aa, Plasmodium falciparum
EDVGSRLRAGNKKLKIEPL

SEQ ID NO: 3307625 - protein, 7 aa, Plasmodium falciparum
EDVNENE

SEQ ID NO: 3307626 - protein, 10 aa, Plasmodium falciparum
EDVNINNENN

SEQ ID NO: 3307627 - protein, 10 aa, Plasmodium falciparum
EDVNNSSKNY

SEQ ID NO: 3307628 - protein, 4 aa, Plasmodium falciparum
EDVP

SEQ ID NO: 3307629 - protein, 4 aa, Plasmodium falciparum
EDVQ

SEQ ID NO: 3307630 - protein, 4 aa, Plasmodium falciparum
EDVS

SEQ ID NO: 3307631 - protein, 6 aa, Plasmodium falciparum
EDVSGS

SEQ ID NO: 3307632 - protein, 29 aa, Plasmodium falciparum
EDVSNKSNDYNTNKNIEKNNYEKKGEYNP

SEQ ID NO: 3307633 - protein, 16 aa, Plasmodium falciparum
EDVSSKNHFNKRNTNV

SEQ ID NO: 3307634 - protein, 14 aa, Plasmodium falciparum
EDVTDEKSKKSNYI

SEQ ID NO: 3307635 - protein, 8 aa, Plasmodium falciparum
EDVTPKVQ

SEQ ID NO: 3307636 - protein, 21 aa, Plasmodium falciparum
EDVYDNKRNKKNVASSIDSYG

SEQ ID NO: 3307637 - protein, 4 aa, Plasmodium falciparum
EDYD

SEQ ID NO: 3307638 - protein, 5 aa, Plasmodium falciparum
EDYDN

SEQ ID NO: 3307639 - protein, 12 aa, Plasmodium falciparum
EDYKKKKKWKNE

SEQ ID NO: 3307640 - protein, 9 aa, Plasmodium falciparum
EDYKTNNMY

SEQ ID NO: 3307641 - protein, 10 aa, Plasmodium falciparum
EDYNKNESKE

SEQ ID NO: 3307642 - protein, 5 aa, Plasmodium falciparum
EDYPI

SEQ ID NO: 3307643 - protein, 8 aa, Plasmodium falciparum
EDYSDKDV

SEQ ID NO: 3307644 - protein, 4 aa, Plasmodium falciparum
EDYT

SEQ ID NO: 3307645 - protein, 5 aa, Plasmodium falciparum
EDYVN

SEQ ID NO: 3307646 - protein, 5 aa, Plasmodium falciparum
EEADE

SEQ ID NO: 3307647 - protein, 28 aa, Plasmodium falciparum
EEAEAEENVEMDGEEDNDDGVNNGKNKY

SEQ ID NO: 3307648 - protein, 22 aa, Plasmodium falciparum
EEAGKNNIHDEGNEGKTKYQKF

SEQ ID NO: 3307649 - protein, 14 aa, Plasmodium falciparum
EEAGRVDNRKTERQ

SEQ ID NO: 3307650 - protein, 4 aa, Plasmodium falciparum
EEAK

SEQ ID NO: 3307651 - protein, 6 aa, Plasmodium falciparum
EEAKEE

SEQ ID NO: 3307652 - protein, 6 aa, Plasmodium falciparum
EEAKIQ

SEQ ID NO: 3307653 - protein, 5 aa, Plasmodium falciparum
EEAKK

SEQ ID NO: 3307654 - protein, 9 aa, Plasmodium falciparum
EEAKQDEYG

SEQ ID NO: 3307655 - protein, 6 aa, Plasmodium falciparum
EEANKY

SEQ ID NO: 3307656 - protein, 5 aa, Plasmodium falciparum
EEAQE

SEQ ID NO: 3307657 - protein, 15 aa, Plasmodium falciparum
EEAQEAISSLNDSKL

SEQ ID NO: 3307658 - protein, 7 aa, Plasmodium falciparum
EEAQSSY

SEQ ID NO: 3307659 - protein, 7 aa, Plasmodium falciparum
EEAQTNV

SEQ ID NO: 3307660 - protein, 4 aa, Plasmodium falciparum
EECN

SEQ ID NO: 3307661 - protein, 16 aa, Plasmodium falciparum
EECSGTGDQKRNNFET

SEQ ID NO: 3307662 - protein, 11 aa, Plasmodium falciparum
EECSKKEEQLK

SEQ ID NO: 3307663 - protein, 6 aa, Plasmodium falciparum
EECSKY

SEQ ID NO: 3307664 - protein, 4 aa, Plasmodium falciparum
EEDA

SEQ ID NO: 3307665 - protein, 4 aa, Plasmodium falciparum
EEDD

SEQ ID NO: 3307666 - protein, 7 aa, Plasmodium falciparum
EEDDINT

SEQ ID NO: 3307667 - protein, 9 aa, Plasmodium falciparum
EEDDKKSLT

SEQ ID NO: 3307668 - protein, 5 aa, Plasmodium falciparum
EEDDN

SEQ ID NO: 3307669 - protein, 21 aa, Plasmodium falciparum
EEDDNEEESTQNDNPNDKTDD

SEQ ID NO: 3307670 - protein, 16 aa, Plasmodium falciparum
EEDEEHEEDNERYGTM

SEQ ID NO: 3307671 - protein, 28 aa, Plasmodium falciparum
EEDEENDQKRDEDLNEEEEYEHDSNHNN

SEQ ID NO: 3307672 - protein, 15 aa, Plasmodium falciparum
EEDEKHEFKNNDNNI

SEQ ID NO: 3307673 - protein, 16 aa, Plasmodium falciparum
EEDENGESESSSDNSL

SEQ ID NO: 3307674 - protein, 41 aa, Plasmodium falciparum
EEDEQEDQENSDDNKKNTHDDHNEMKKDTPKINQEKTQEEL

SEQ ID NO: 3307675 - protein, 7 aa, Plasmodium falciparum
EEDERER

SEQ ID NO: 3307676 - protein, 11 aa, Plasmodium falciparum
EEDESKKKYNI

SEQ ID NO: 3307677 - protein, 9 aa, Plasmodium falciparum
EEDFEEKYS

SEQ ID NO: 3307678 - protein, 5 aa, Plasmodium falciparum
EEDFN

SEQ ID NO: 3307679 - protein, 43 aa, Plasmodium falciparum
EEDFTQAEDAPESETAGVEDENEGEIKYTEDENEKKNDKNEIV

SEQ ID NO: 3307680 - protein, 6 aa, Plasmodium falciparum
EEDGKE

SEQ ID NO: 3307681 - protein, 8 aa, Plasmodium falciparum
EEDHSDDK

SEQ ID NO: 3307682 - protein, 29 aa, Plasmodium falciparum
EEDHTKDHDGKDEQEGEKEKTKNVNSDHM

SEQ ID NO: 3307683 - protein, 15 aa, Plasmodium falciparum
EEDIDESKRKLSAEE

SEQ ID NO: 3307684 - protein, 12 aa, Plasmodium falciparum
EEDINKKQNDKV

SEQ ID NO: 3307685 - protein, 9 aa, Plasmodium falciparum
EEDKDNITG

SEQ ID NO: 3307686 - protein, 10 aa, Plasmodium falciparum
EEDKDVRSVS

SEQ ID NO: 3307687 - protein, 8 aa, Plasmodium falciparum
EEDKERMQ

SEQ ID NO: 3307688 - protein, 18 aa, Plasmodium falciparum
EEDKIENEEKISAPPKMN

SEQ ID NO: 3307689 - protein, 10 aa, Plasmodium falciparum
EEDKKQRKKK

SEQ ID NO: 3307690 - protein, 5 aa, Plasmodium falciparum
EEDKN

SEQ ID NO: 3307691 - protein, 17 aa, Plasmodium falciparum
EEDKNKNEDINKYNKNH

SEQ ID NO: 3307692 - protein, 7 aa, Plasmodium falciparum
EEDKYKD

SEQ ID NO: 3307693 - protein, 7 aa, Plasmodium falciparum
EEDMYDN

SEQ ID NO: 3307694 - protein, 44 aa, Plasmodium falciparum
EEDNEHSNDDEDEEEEDNEHSNDDEDEEEEDNEHSNDDEEKEDV

SEQ ID NO: 3307695 - protein, 22 aa, Plasmodium falciparum
EEDNEIKNNSNYVKESDKNVVD

SEQ ID NO: 3307696 - protein, 35 aa, Plasmodium falciparum
EEDNKENNNNNKKNEYNNNQHNNNDENNNNEHNNN

SEQ ID NO: 3307697 - protein, 9 aa, Plasmodium falciparum
EEDNNGKQI

SEQ ID NO: 3307698 - protein, 6 aa, Plasmodium falciparum
EEDNNI

SEQ ID NO: 3307699 - protein, 12 aa, Plasmodium falciparum
EEDNNPTDIYEY

SEQ ID NO: 3307700 - protein, 44 aa, Plasmodium falciparum
EEDNTSDEDNTLDDDNTSDDDNTSDDDNTSGDDNTSDDDNTSDE

SEQ ID NO: 3307701 - protein, 23 aa, Plasmodium falciparum
EEDPGEVNNINDDNNVEKNNNME

SEQ ID NO: 3307702 - protein, 8 aa, Plasmodium falciparum
EEDQDVPL

SEQ ID NO: 3307703 - protein, 11 aa, Plasmodium falciparum
EEDQKHPPGYL

SEQ ID NO: 3307704 - protein, 9 aa, Plasmodium falciparum
EEDQKSKKE

SEQ ID NO: 3307705 - protein, 4 aa, Plasmodium falciparum
EEDR

SEQ ID NO: 3307706 - protein, 10 aa, Plasmodium falciparum
EEDSRRTGKG

SEQ ID NO: 3307707 - protein, 7 aa, Plasmodium falciparum
EEDTNEH

SEQ ID NO: 3307708 - protein, 10 aa, Plasmodium falciparum
EEDTNKYDAN

SEQ ID NO: 3307709 - protein, 8 aa, Plasmodium falciparum
EEDTTSST

SEQ ID NO: 3307710 - protein, 4 aa, Plasmodium falciparum
EEDV

SEQ ID NO: 3307711 - protein, 15 aa, Plasmodium falciparum
EEDVEEDNKYNDDNM

SEQ ID NO: 3307712 - protein, 7 aa, Plasmodium falciparum
EEDVQKS

SEQ ID NO: 3307713 - protein, 9 aa, Plasmodium falciparum
EEDYGPPVG

SEQ ID NO: 3307714 - protein, 4 aa, Plasmodium falciparum
EEEA

SEQ ID NO: 3307715 - protein, 9 aa, Plasmodium falciparum
EEEANNIEN

SEQ ID NO: 3307716 - protein, 7 aa, Plasmodium falciparum
EEEARNA

SEQ ID NO: 3307717 - protein, 4 aa, Plasmodium falciparum
EEEC

SEQ ID NO: 3307718 - protein, 21 aa, Plasmodium falciparum
EEEDAEDDEEPLNDEDNWDID

SEQ ID NO: 3307719 - protein, 8 aa, Plasmodium falciparum
EEEDDKDI

SEQ ID NO: 3307720 - protein, 8 aa, Plasmodium falciparum
EEEDDSLN

SEQ ID NO: 3307721 - protein, 11 aa, Plasmodium falciparum
EEEDEDDYEDE

SEQ ID NO: 3307722 - protein, 35 aa, Plasmodium falciparum
EEEDEEEEDDNEGINEDINEDVEEDIEEDVEEDIE

SEQ ID NO: 3307723 - protein, 66 aa, Plasmodium falciparum
EEEDNYEEKKDYQQTGKEISNTKNMGKEEENSRKKKNKQKEKHNECRDANDKELSVQQRNDQNNIN

SEQ ID NO: 3307724 - protein, 7 aa, Plasmodium falciparum
EEEDSCL

SEQ ID NO: 3307725 - protein, 8 aa, Plasmodium falciparum
EEEEAKKK

SEQ ID NO: 3307726 - protein, 23 aa, Plasmodium falciparum
EEEEAQGKGERDKEKKKEMDTNM

SEQ ID NO: 3307727 - protein, 9 aa, Plasmodium falciparum
EEEEDINEN

SEQ ID NO: 3307728 - protein, 7 aa, Plasmodium falciparum
EEEEDVP

SEQ ID NO: 3307729 - protein, 5 aa, Plasmodium falciparum
EEEEE

SEQ ID NO: 3307730 - protein, 11 aa, Plasmodium falciparum
EEEEEDDNCDE

SEQ ID NO: 3307731 - protein, 41 aa, Plasmodium falciparum
EEEEEEEQEQEQEQEHEQEQEEEQEEDYEQEQEEEQEEEQV

SEQ ID NO: 3307732 - protein, 7 aa, Plasmodium falciparum
EEEEEKK

SEQ ID NO: 3307733 - protein, 7 aa, Plasmodium falciparum
EEEEEYK

SEQ ID NO: 3307734 - protein, 14 aa, Plasmodium falciparum
EEEEKKNKEEDLES

SEQ ID NO: 3307735 - protein, 6 aa, Plasmodium falciparum
EEEEKN

SEQ ID NO: 3307736 - protein, 10 aa, Plasmodium falciparum
EEEEKQNLEN

SEQ ID NO: 3307737 - protein, 19 aa, Plasmodium falciparum
EEEEKSEGEYRNDGDEKVE

SEQ ID NO: 3307738 - protein, 6 aa, Plasmodium falciparum
EEEELY

SEQ ID NO: 3307739 - protein, 14 aa, Plasmodium falciparum
EEEEQNEEKKIQQN

SEQ ID NO: 3307740 - protein, 6 aa, Plasmodium falciparum
EEEERN

SEQ ID NO: 3307741 - protein, 16 aa, Plasmodium falciparum
EEEEYEKEKEKGKANY

SEQ ID NO: 3307742 - protein, 4 aa, Plasmodium falciparum
EEEF

SEQ ID NO: 3307743 - protein, 6 aa, Plasmodium falciparum
EEEFTN

SEQ ID NO: 3307744 - protein, 11 aa, Plasmodium falciparum
EEEGEEEKNEL

SEQ ID NO: 3307745 - protein, 7 aa, Plasmodium falciparum
EEEGTQT

SEQ ID NO: 3307746 - protein, 13 aa, Plasmodium falciparum
EEEHNNDNNEYDK

SEQ ID NO: 3307747 - protein, 5 aa, Plasmodium falciparum
EEEIE

SEQ ID NO: 3307748 - protein, 5 aa, Plasmodium falciparum
EEEIN

SEQ ID NO: 3307749 - protein, 11 aa, Plasmodium falciparum
EEEINVDPDDS

SEQ ID NO: 3307750 - protein, 24 aa, Plasmodium falciparum
EEEITQKCGRTKGQERAKAAPQKL

SEQ ID NO: 3307751 - protein, 23 aa, Plasmodium falciparum
EEEIYDESNKINDPLESNNGYDE

SEQ ID NO: 3307752 - protein, 37 aa, Plasmodium falciparum
EEEKDEEEKEKKKKKEKLKGEETRQDYHDDYDKQSQM

SEQ ID NO: 3307753 - protein, 11 aa, Plasmodium falciparum
EEEKDQEEEID

SEQ ID NO: 3307754 - protein, 9 aa, Plasmodium falciparum
EEEKDTIKS

SEQ ID NO: 3307755 - protein, 5 aa, Plasmodium falciparum
EEEKE

SEQ ID NO: 3307756 - protein, 7 aa, Plasmodium falciparum
EEEKEIR

SEQ ID NO: 3307757 - protein, 7 aa, Plasmodium falciparum
EEEKEQG

SEQ ID NO: 3307758 - protein, 7 aa, Plasmodium falciparum
EEEKERE

SEQ ID NO: 3307759 - protein, 6 aa, Plasmodium falciparum
EEEKGS

SEQ ID NO: 3307760 - protein, 5 aa, Plasmodium falciparum
EEEKI

SEQ ID NO: 3307761 - protein, 31 aa, Plasmodium falciparum
EEEKIKNEEMTNVEEEKIKNEEMTNVEEEDI

SEQ ID NO: 3307762 - protein, 5 aa, Plasmodium falciparum
EEEKK

SEQ ID NO: 3307763 - protein, 13 aa, Plasmodium falciparum
EEEKKKENKNEKY

SEQ ID NO: 3307764 - protein, 20 aa, Plasmodium falciparum
EEEKKKWNKEKKRIEGEVEK

SEQ ID NO: 3307765 - protein, 10 aa, Plasmodium falciparum
EEEKKQSKIT

SEQ ID NO: 3307766 - protein, 9 aa, Plasmodium falciparum
EEEKNIKND

SEQ ID NO: 3307767 - protein, 9 aa, Plasmodium falciparum
EEEKNKDNL

SEQ ID NO: 3307768 - protein, 15 aa, Plasmodium falciparum
EEEKNNNNNNNNNKN

SEQ ID NO: 3307769 - protein, 21 aa, Plasmodium falciparum
EEEKNRTNQDKHKKKKEKKCH

SEQ ID NO: 3307770 - protein, 7 aa, Plasmodium falciparum
EEEKRKE

SEQ ID NO: 3307771 - protein, 11 aa, Plasmodium falciparum
EEEKRKRKLSS

SEQ ID NO: 3307772 - protein, 8 aa, Plasmodium falciparum
EEEKTAYN

SEQ ID NO: 3307773 - protein, 9 aa, Plasmodium falciparum
EEELEKDNN

SEQ ID NO: 3307774 - protein, 6 aa, Plasmodium falciparum
EEELNK

SEQ ID NO: 3307775 - protein, 4 aa, Plasmodium falciparum
EEEN

SEQ ID NO: 3307776 - protein, 10 aa, Plasmodium falciparum
EEENEELEED

SEQ ID NO: 3307777 - protein, 13 aa, Plasmodium falciparum
EEENIKNNEPLKK

SEQ ID NO: 3307778 - protein, 9 aa, Plasmodium falciparum
EEENKDKRE

SEQ ID NO: 3307779 - protein, 19 aa, Plasmodium falciparum
EEENKFKGKGQRTDGKSCH

SEQ ID NO: 3307780 - protein, 12 aa, Plasmodium falciparum
EEENKKKTTSPF

SEQ ID NO: 3307781 - protein, 8 aa, Plasmodium falciparum
EEENKRDA

SEQ ID NO: 3307782 - protein, 11 aa, Plasmodium falciparum
EEENKRKRAER

SEQ ID NO: 3307783 - protein, 6 aa, Plasmodium falciparum
EEENMG

SEQ ID NO: 3307784 - protein, 13 aa, Plasmodium falciparum
EEENNKTNSNENI

SEQ ID NO: 3307785 - protein, 8 aa, Plasmodium falciparum
EEENSLNE

SEQ ID NO: 3307786 - protein, 18 aa, Plasmodium falciparum
EEEPNRNSGFYKGACKHD

SEQ ID NO: 3307787 - protein, 5 aa, Plasmodium falciparum
EEEQE

SEQ ID NO: 3307788 - protein, 84 aa, Plasmodium falciparum
EEEQEENGQDVDENEQYEEEYEQDEEEYEQEEGEYEQEEEEYEQDEEKYEQDEEKCEQDEEKCEQDEEKYEQDGDQNGQDDEYV

SEQ ID NO: 3307789 - protein, 7 aa, Plasmodium falciparum
EEEQNID

SEQ ID NO: 3307790 - protein, 11 aa, Plasmodium falciparum
EEEQSSADDSL

SEQ ID NO: 3307791 - protein, 4 aa, Plasmodium falciparum
EEER

SEQ ID NO: 3307792 - protein, 7 aa, Plasmodium falciparum
EEERNNI

SEQ ID NO: 3307793 - protein, 11 aa, Plasmodium falciparum
EEERQKGKTVE

SEQ ID NO: 3307794 - protein, 7 aa, Plasmodium falciparum
EEERQRN

SEQ ID NO: 3307795 - protein, 5 aa, Plasmodium falciparum
EEERS

SEQ ID NO: 3307796 - protein, 4 aa, Plasmodium falciparum
EEES

SEQ ID NO: 3307797 - protein, 5 aa, Plasmodium falciparum
EEESN

SEQ ID NO: 3307798 - protein, 5 aa, Plasmodium falciparum
EEESP

SEQ ID NO: 3307799 - protein, 4 aa, Plasmodium falciparum
EEET

SEQ ID NO: 3307800 - protein, 11 aa, Plasmodium falciparum
EEETGEQKQVT

SEQ ID NO: 3307801 - protein, 17 aa, Plasmodium falciparum
EEETKEAEKNIVTEDTE

SEQ ID NO: 3307802 - protein, 7 aa, Plasmodium falciparum
EEETNHD

SEQ ID NO: 3307803 - protein, 17 aa, Plasmodium falciparum
EEEVEEEEKNKQKNDYQ

SEQ ID NO: 3307804 - protein, 23 aa, Plasmodium falciparum
EEEVKNEKDATLQDDDDAGHTLK

SEQ ID NO: 3307805 - protein, 12 aa, Plasmodium falciparum
EEEYKNNSSKVC

SEQ ID NO: 3307806 - protein, 6 aa, Plasmodium falciparum
EEEYQK

SEQ ID NO: 3307807 - protein, 38 aa, Plasmodium falciparum
EEFDDDDDDDDDDDDDDDDDDKDDDLDGDDDGNNDDND

SEQ ID NO: 3307808 - protein, 5 aa, Plasmodium falciparum
EEFEP

SEQ ID NO: 3307809 - protein, 19 aa, Plasmodium falciparum
EEFNTNKNEHRNDKTSSKF

SEQ ID NO: 3307810 - protein, 4 aa, Plasmodium falciparum
EEGD

SEQ ID NO: 3307811 - protein, 19 aa, Plasmodium falciparum
EEGDEDEKEEDDDYDDENN

SEQ ID NO: 3307812 - protein, 7 aa, Plasmodium falciparum
EEGDYAD

SEQ ID NO: 3307813 - protein, 4 aa, Plasmodium falciparum
EEGE

SEQ ID NO: 3307814 - protein, 15 aa, Plasmodium falciparum
EEGEEEKKNETNMNV

SEQ ID NO: 3307815 - protein, 108 aa, Plasmodium falciparum
EEGEGEGEGDEEENDKKKKKKLSKEKKKKSDKNKKHDEGVDEDVDEDDGDEKDEEDDEEDEADEEDEDEEDEEDEDDDEEDDDDDDDDDDDDDDDDEDDKDDEDDKDD

SEQ ID NO: 3307816 - protein, 6 aa, Plasmodium falciparum
EEGEGP

SEQ ID NO: 3307817 - protein, 6 aa, Plasmodium falciparum
EEGFGQ

SEQ ID NO: 3307818 - protein, 30 aa, Plasmodium falciparum
EEGIKNNISNNKYNNNNKYNNNNKYNNNNK

SEQ ID NO: 3307819 - protein, 8 aa, Plasmodium falciparum
EEGIQPNN

SEQ ID NO: 3307820 - protein, 9 aa, Plasmodium falciparum
EEGKADSNL

SEQ ID NO: 3307821 - protein, 5 aa, Plasmodium falciparum
EEGKD

SEQ ID NO: 3307822 - protein, 26 aa, Plasmodium falciparum
EEGKENDQKYDYDKNSVENDTYPLSQ

SEQ ID NO: 3307823 - protein, 22 aa, Plasmodium falciparum
EEGKGVDANGNKVKANKEDVEK

SEQ ID NO: 3307824 - protein, 5 aa, Plasmodium falciparum
EEGKT

SEQ ID NO: 3307825 - protein, 48 aa, Plasmodium falciparum
EEGKTTDEGKTTDEGKTIDECKTTDECKTTDECKTTDECKTTDEGKTI

SEQ ID NO: 3307826 - protein, 5 aa, Plasmodium falciparum
EEGNE

SEQ ID NO: 3307827 - protein, 11 aa, Plasmodium falciparum
EEGNHRDTQHN

SEQ ID NO: 3307828 - protein, 17 aa, Plasmodium falciparum
EEGNNYRYKNKKSKDDL

SEQ ID NO: 3307829 - protein, 12 aa, Plasmodium falciparum
EEGNYNNEHEHT

SEQ ID NO: 3307830 - protein, 6 aa, Plasmodium falciparum
EEGPTF

SEQ ID NO: 3307831 - protein, 5 aa, Plasmodium falciparum
EEGPY

SEQ ID NO: 3307832 - protein, 8 aa, Plasmodium falciparum
EEGQHEKN

SEQ ID NO: 3307833 - protein, 8 aa, Plasmodium falciparum
EEGQKIEP

SEQ ID NO: 3307834 - protein, 12 aa, Plasmodium falciparum
EEGRNDNNINSD

SEQ ID NO: 3307835 - protein, 14 aa, Plasmodium falciparum
EEGTLTNQQSLGDI

SEQ ID NO: 3307836 - protein, 7 aa, Plasmodium falciparum
EEGTYPR

SEQ ID NO: 3307837 - protein, 5 aa, Plasmodium falciparum
EEHAK

SEQ ID NO: 3307838 - protein, 4 aa, Plasmodium falciparum
EEHD

SEQ ID NO: 3307839 - protein, 9 aa, Plasmodium falciparum
EEHEENSTE

SEQ ID NO: 3307840 - protein, 13 aa, Plasmodium falciparum
EEHHDKSDQNNIS

SEQ ID NO: 3307841 - protein, 6 aa, Plasmodium falciparum
EEHIPS

SEQ ID NO: 3307842 - protein, 52 aa, Plasmodium falciparum
EEHKKNNDMEDEKKKNEINNDNQDNDKDKEKDNDQNDQNEQKNMKEKKNHVG

SEQ ID NO: 3307843 - protein, 6 aa, Plasmodium falciparum
EEHKKT

SEQ ID NO: 3307844 - protein, 6 aa, Plasmodium falciparum
EEHLGS

SEQ ID NO: 3307845 - protein, 19 aa, Plasmodium falciparum
EEHNINKKTERDKKKTIPY

SEQ ID NO: 3307846 - protein, 17 aa, Plasmodium falciparum
EEHNKNDVSKTKTQQQT

SEQ ID NO: 3307847 - protein, 27 aa, Plasmodium falciparum
EEHREEKEYEEEEDERSYSSDDTASTI

SEQ ID NO: 3307848 - protein, 12 aa, Plasmodium falciparum
EEHTSADEKIEK

SEQ ID NO: 3307849 - protein, 5 aa, Plasmodium falciparum
EEHVE

SEQ ID NO: 3307850 - protein, 5 aa, Plasmodium falciparum
EEHVG

SEQ ID NO: 3307851 - protein, 10 aa, Plasmodium falciparum
EEHYKGSESY

SEQ ID NO: 3307852 - protein, 4 aa, Plasmodium falciparum
EEID

SEQ ID NO: 3307853 - protein, 10 aa, Plasmodium falciparum
EEIDDNLEKE

SEQ ID NO: 3307854 - protein, 10 aa, Plasmodium falciparum
EEIDEKEKQE

SEQ ID NO: 3307855 - protein, 9 aa, Plasmodium falciparum
EEIDKKEKS

SEQ ID NO: 3307856 - protein, 9 aa, Plasmodium falciparum
EEIEEEASK

SEQ ID NO: 3307857 - protein, 7 aa, Plasmodium falciparum
EEIEEYE

SEQ ID NO: 3307858 - protein, 9 aa, Plasmodium falciparum
EEIEKRTTN

SEQ ID NO: 3307859 - protein, 5 aa, Plasmodium falciparum
EEIER

SEQ ID NO: 3307860 - protein, 6 aa, Plasmodium falciparum
EEIERN

SEQ ID NO: 3307861 - protein, 5 aa, Plasmodium falciparum
EEIGK

SEQ ID NO: 3307862 - protein, 4 aa, Plasmodium falciparum
EEII

SEQ ID NO: 3307863 - protein, 46 aa, Plasmodium falciparum
EEIKEEHKERDMQYEENEKSEENEKSEENEKNEENEKSEENEENEK

SEQ ID NO: 3307864 - protein, 13 aa, Plasmodium falciparum
EEIKEEVKEEIKE

SEQ ID NO: 3307865 - protein, 7 aa, Plasmodium falciparum
EEIKEND

SEQ ID NO: 3307866 - protein, 6 aa, Plasmodium falciparum
EEIKER

SEQ ID NO: 3307867 - protein, 7 aa, Plasmodium falciparum
EEIKKKD

SEQ ID NO: 3307868 - protein, 4 aa, Plasmodium falciparum
EEIN

SEQ ID NO: 3307869 - protein, 10 aa, Plasmodium falciparum
EEINKEKELE

SEQ ID NO: 3307870 - protein, 5 aa, Plasmodium falciparum
EEINN

SEQ ID NO: 3307871 - protein, 18 aa, Plasmodium falciparum
EEINNNNNNINDNNNHNY

SEQ ID NO: 3307872 - protein, 6 aa, Plasmodium falciparum
EEIPEE

SEQ ID NO: 3307873 - protein, 4 aa, Plasmodium falciparum
EEIQ

SEQ ID NO: 3307874 - protein, 11 aa, Plasmodium falciparum
EEIQEKKTTMK

SEQ ID NO: 3307875 - protein, 11 aa, Plasmodium falciparum
EEIQKKSDDPL

SEQ ID NO: 3307876 - protein, 12 aa, Plasmodium falciparum
EEIQNSNSTNNK

SEQ ID NO: 3307877 - protein, 9 aa, Plasmodium falciparum
EEIRKENSD

SEQ ID NO: 3307878 - protein, 20 aa, Plasmodium falciparum
EEIRNQTRYSSKGNDKNVEN

SEQ ID NO: 3307879 - protein, 4 aa, Plasmodium falciparum
EEIS

SEQ ID NO: 3307880 - protein, 7 aa, Plasmodium falciparum
EEISKND

SEQ ID NO: 3307881 - protein, 7 aa, Plasmodium falciparum
EEISTKK

SEQ ID NO: 3307882 - protein, 76 aa, Plasmodium falciparum
EEISTTKGKLNNIKKSKNNNKCDDNNINNNNNNNCDDNNNNNFDDNNNNNNFDDNNNNNNCDDNINNNNCHDNNYD

SEQ ID NO: 3307883 - protein, 5 aa, Plasmodium falciparum
EEITN

SEQ ID NO: 3307884 - protein, 7 aa, Plasmodium falciparum
EEITQNE

SEQ ID NO: 3307885 - protein, 26 aa, Plasmodium falciparum
EEIYEEETDAGRSDDNNKENKPDYNK

SEQ ID NO: 3307886 - protein, 4 aa, Plasmodium falciparum
EEKD

SEQ ID NO: 3307887 - protein, 9 aa, Plasmodium falciparum
EEKDKDESY

SEQ ID NO: 3307888 - protein, 10 aa, Plasmodium falciparum
EEKDKEINTV

SEQ ID NO: 3307889 - protein, 5 aa, Plasmodium falciparum
EEKDN

SEQ ID NO: 3307890 - protein, 24 aa, Plasmodium falciparum
EEKDNEKEKIEEPFKNKEDEEINR

SEQ ID NO: 3307891 - protein, 9 aa, Plasmodium falciparum
EEKDNINSL

SEQ ID NO: 3307892 - protein, 9 aa, Plasmodium falciparum
EEKDREKDD

SEQ ID NO: 3307893 - protein, 4 aa, Plasmodium falciparum
EEKE

SEQ ID NO: 3307894 - protein, 14 aa, Plasmodium falciparum
EEKEEEKKKKNEIN

SEQ ID NO: 3307895 - protein, 7 aa, Plasmodium falciparum
EEKEEFS

SEQ ID NO: 3307896 - protein, 15 aa, Plasmodium falciparum
EEKEENEEPGPHNKN

SEQ ID NO: 3307897 - protein, 15 aa, Plasmodium falciparum
EEKEENSMQILPKIV

SEQ ID NO: 3307898 - protein, 19 aa, Plasmodium falciparum
EEKEEQEQQQQQQEQHDKL

SEQ ID NO: 3307899 - protein, 17 aa, Plasmodium falciparum
EEKEEVVPKKKKKNSNN

SEQ ID NO: 3307900 - protein, 22 aa, Plasmodium falciparum
EEKEKEKEKKKKKKKKTDNDGY

SEQ ID NO: 3307901 - protein, 12 aa, Plasmodium falciparum
EEKEKKKKNSSH

SEQ ID NO: 3307902 - protein, 11 aa, Plasmodium falciparum
EEKEKKKTYRK

SEQ ID NO: 3307903 - protein, 9 aa, Plasmodium falciparum
EEKEKYQQN

SEQ ID NO: 3307904 - protein, 8 aa, Plasmodium falciparum
EEKENIKK

SEQ ID NO: 3307905 - protein, 9 aa, Plasmodium falciparum
EEKENINKK

SEQ ID NO: 3307906 - protein, 13 aa, Plasmodium falciparum
EEKENNLTRNNKK

SEQ ID NO: 3307907 - protein, 8 aa, Plasmodium falciparum
EEKENTKN

SEQ ID NO: 3307908 - protein, 5 aa, Plasmodium falciparum
EEKEQ

SEQ ID NO: 3307909 - protein, 6 aa, Plasmodium falciparum
EEKESI

SEQ ID NO: 3307910 - protein, 8 aa, Plasmodium falciparum
EEKESKNS

SEQ ID NO: 3307911 - protein, 5 aa, Plasmodium falciparum
EEKET

SEQ ID NO: 3307912 - protein, 22 aa, Plasmodium falciparum
EEKEYEKKEKEKQEKDDKKNKI

SEQ ID NO: 3307913 - protein, 82 aa, Plasmodium falciparum
EEKGEKKKNKMNDDDNDVNNDDDNNNNNNNNNNNNNNNNNNNNNNNNNNDSFNYGGGSKYGNNNLGKNINNNHRNNIQDDTY

SEQ ID NO: 3307914 - protein, 8 aa, Plasmodium falciparum
EEKGGKKY

SEQ ID NO: 3307915 - protein, 11 aa, Plasmodium falciparum
EEKGRKRANKI

SEQ ID NO: 3307916 - protein, 7 aa, Plasmodium falciparum
EEKHDKD

SEQ ID NO: 3307917 - protein, 5 aa, Plasmodium falciparum
EEKHQ

SEQ ID NO: 3307918 - protein, 13 aa, Plasmodium falciparum
EEKIDTKNGNNTY

SEQ ID NO: 3307919 - protein, 11 aa, Plasmodium falciparum
EEKINEEKKEN

SEQ ID NO: 3307920 - protein, 4 aa, Plasmodium falciparum
EEKK

SEQ ID NO: 3307921 - protein, 7 aa, Plasmodium falciparum
EEKKDRL

SEQ ID NO: 3307922 - protein, 8 aa, Plasmodium falciparum
EEKKDSIH

SEQ ID NO: 3307923 - protein, 15 aa, Plasmodium falciparum
EEKKGDMKNKIPSES

SEQ ID NO: 3307924 - protein, 7 aa, Plasmodium falciparum
EEKKGRI

SEQ ID NO: 3307925 - protein, 11 aa, Plasmodium falciparum
EEKKHEEINPN

SEQ ID NO: 3307926 - protein, 6 aa, Plasmodium falciparum
EEKKIN

SEQ ID NO: 3307927 - protein, 5 aa, Plasmodium falciparum
EEKKK

SEQ ID NO: 3307928 - protein, 19 aa, Plasmodium falciparum
EEKKKEKEKDDENVDGDEE

SEQ ID NO: 3307929 - protein, 9 aa, Plasmodium falciparum
EEKKKENIS

SEQ ID NO: 3307930 - protein, 18 aa, Plasmodium falciparum
EEKKKESNEKKKKIQEDS

SEQ ID NO: 3307931 - protein, 21 aa, Plasmodium falciparum
EEKKKGNDNKKKRGRKSKKDI

SEQ ID NO: 3307932 - protein, 20 aa, Plasmodium falciparum
EEKKKHKNNDTSKLKNNPNY

SEQ ID NO: 3307933 - protein, 9 aa, Plasmodium falciparum
EEKKKIKNK

SEQ ID NO: 3307934 - protein, 13 aa, Plasmodium falciparum
EEKKKKEEEKKNI

SEQ ID NO: 3307935 - protein, 27 aa, Plasmodium falciparum
EEKKKKELENQEKRNEDCYNNNNNNNI

SEQ ID NO: 3307936 - protein, 11 aa, Plasmodium falciparum
EEKKKKKKKDY

SEQ ID NO: 3307937 - protein, 21 aa, Plasmodium falciparum
EEKKKKKKKMDSSSSSNDSTF

SEQ ID NO: 3307938 - protein, 9 aa, Plasmodium falciparum
EEKKKKKKY

SEQ ID NO: 3307939 - protein, 27 aa, Plasmodium falciparum
EEKKKKKNNYNNNNNNNNYNHNNNDEI

SEQ ID NO: 3307940 - protein, 13 aa, Plasmodium falciparum
EEKKKKNDEKNVN

SEQ ID NO: 3307941 - protein, 14 aa, Plasmodium falciparum
EEKKKQDRKGRKYR

SEQ ID NO: 3307942 - protein, 66 aa, Plasmodium falciparum
EEKKKRKAEDLKKQYEKKSVKKKKTHDNNDDNNNGDNNNDDDEKSSSESENLDESSNEDNKLKPDI

SEQ ID NO: 3307943 - protein, 8 aa, Plasmodium falciparum
EEKKKRKI

SEQ ID NO: 3307944 - protein, 10 aa, Plasmodium falciparum
EEKKKTENEI

SEQ ID NO: 3307945 - protein, 20 aa, Plasmodium falciparum
EEKKNEKKNNDQNKLSSDVN

SEQ ID NO: 3307946 - protein, 11 aa, Plasmodium falciparum
EEKKNKTELEN

SEQ ID NO: 3307947 - protein, 14 aa, Plasmodium falciparum
EEKKNNKKNKINKN

SEQ ID NO: 3307948 - protein, 8 aa, Plasmodium falciparum
EEKKPDRV

SEQ ID NO: 3307949 - protein, 5 aa, Plasmodium falciparum
EEKKQ

SEQ ID NO: 3307950 - protein, 8 aa, Plasmodium falciparum
EEKKRNSK

SEQ ID NO: 3307951 - protein, 28 aa, Plasmodium falciparum
EEKKYSSDKYSTIDNRKVQKKKKTQSMK

SEQ ID NO: 3307952 - protein, 8 aa, Plasmodium falciparum
EEKLNSKK

SEQ ID NO: 3307953 - protein, 15 aa, Plasmodium falciparum
EEKLQNDRMKKEEED

SEQ ID NO: 3307954 - protein, 13 aa, Plasmodium falciparum
EEKLTKKKNYFSK

SEQ ID NO: 3307955 - protein, 52 aa, Plasmodium falciparum
EEKMEENNDEHTEQINEETTKQNVEQSMEETAEENIEGNKEEYIEENNDEYM

SEQ ID NO: 3307956 - protein, 20 aa, Plasmodium falciparum
EEKMKSKYEKIKNKKEQWQK

SEQ ID NO: 3307957 - protein, 5 aa, Plasmodium falciparum
EEKND

SEQ ID NO: 3307958 - protein, 72 aa, Plasmodium falciparum
EEKNENDDDDNDDDNDDDNDDDNDDYNEEEEDDNYEKKNFEEEQKGNYNNDNINHNEKKKKVPTANDNLSSS

SEQ ID NO: 3307959 - protein, 9 aa, Plasmodium falciparum
EEKNEPNDN

SEQ ID NO: 3307960 - protein, 5 aa, Plasmodium falciparum
EEKNG

SEQ ID NO: 3307961 - protein, 5 aa, Plasmodium falciparum
EEKNI

SEQ ID NO: 3307962 - protein, 8 aa, Plasmodium falciparum
EEKNINNS

SEQ ID NO: 3307963 - protein, 11 aa, Plasmodium falciparum
EEKNKEDSTAL

SEQ ID NO: 3307964 - protein, 11 aa, Plasmodium falciparum
EEKNKKKNKNM

SEQ ID NO: 3307965 - protein, 12 aa, Plasmodium falciparum
EEKNKLEREEYN

SEQ ID NO: 3307966 - protein, 16 aa, Plasmodium falciparum
EEKNKNKINNNNNNNI

SEQ ID NO: 3307967 - protein, 6 aa, Plasmodium falciparum
EEKNKY

SEQ ID NO: 3307968 - protein, 12 aa, Plasmodium falciparum
EEKNLEDENKES

SEQ ID NO: 3307969 - protein, 12 aa, Plasmodium falciparum
EEKNLNSSGEKK

SEQ ID NO: 3307970 - protein, 9 aa, Plasmodium falciparum
EEKNNEKSK

SEQ ID NO: 3307971 - protein, 15 aa, Plasmodium falciparum
EEKNNNNNNNVNTEN

SEQ ID NO: 3307972 - protein, 7 aa, Plasmodium falciparum
EEKNNNQ

SEQ ID NO: 3307973 - protein, 8 aa, Plasmodium falciparum
EEKNSKYS

SEQ ID NO: 3307974 - protein, 9 aa, Plasmodium falciparum
EEKNTEEIE

SEQ ID NO: 3307975 - protein, 7 aa, Plasmodium falciparum
EEKNTNK

SEQ ID NO: 3307976 - protein, 12 aa, Plasmodium falciparum
EEKNYDNTMENK

SEQ ID NO: 3307977 - protein, 10 aa, Plasmodium falciparum
EEKQGSKLEG

SEQ ID NO: 3307978 - protein, 9 aa, Plasmodium falciparum
EEKQKEEEK

SEQ ID NO: 3307979 - protein, 8 aa, Plasmodium falciparum
EEKQKEGS

SEQ ID NO: 3307980 - protein, 7 aa, Plasmodium falciparum
EEKQNRN

SEQ ID NO: 3307981 - protein, 118 aa, Plasmodium falciparum
EEKREDDVKANENEENEPTKMSKSKKKKEKLKQKKEQMKNKEDDEKDDQKGIDGEKDTDQKKDQDDQKDDDNQNEADNQNEADNQNEGENQKKKKNKKKKDKEKKAGGAAGAATGGMS

SEQ ID NO: 3307982 - protein, 16 aa, Plasmodium falciparum
EEKRERSTEKNTKEGD

SEQ ID NO: 3307983 - protein, 29 aa, Plasmodium falciparum
EEKRKKKKNNVNDDSSSNNNNNNNNYNSN

SEQ ID NO: 3307984 - protein, 10 aa, Plasmodium falciparum
EEKRKRNGTF

SEQ ID NO: 3307985 - protein, 30 aa, Plasmodium falciparum
EEKRNKIDEKMNDEENVKKRLNKKGDDGKL

SEQ ID NO: 3307986 - protein, 14 aa, Plasmodium falciparum
EEKRSKGNKENNIN

SEQ ID NO: 3307987 - protein, 8 aa, Plasmodium falciparum
EEKSESNN

SEQ ID NO: 3307988 - protein, 5 aa, Plasmodium falciparum
EEKSI

SEQ ID NO: 3307989 - protein, 11 aa, Plasmodium falciparum
EEKSIGSDDTN

SEQ ID NO: 3307990 - protein, 13 aa, Plasmodium falciparum
EEKSTKEIENKDD

SEQ ID NO: 3307991 - protein, 8 aa, Plasmodium falciparum
EEKTDKKK

SEQ ID NO: 3307992 - protein, 5 aa, Plasmodium falciparum
EEKTE

SEQ ID NO: 3307993 - protein, 4 aa, Plasmodium falciparum
EEKY

SEQ ID NO: 3307994 - protein, 8 aa, Plasmodium falciparum
EEKYASQQ

SEQ ID NO: 3307995 - protein, 8 aa, Plasmodium falciparum
EEKYDEKM

SEQ ID NO: 3307996 - protein, 7 aa, Plasmodium falciparum
EEKYEEA

SEQ ID NO: 3307997 - protein, 12 aa, Plasmodium falciparum
EEKYKNTQKNFD

SEQ ID NO: 3307998 - protein, 5 aa, Plasmodium falciparum
EEKYT

SEQ ID NO: 3307999 - protein, 25 aa, Plasmodium falciparum
EELEANKCKNENNEKNKKKDEKKEL

SEQ ID NO: 3308000 - protein, 10 aa, Plasmodium falciparum
EELEEDISSN

SEQ ID NO: 3308001 - protein, 17 aa, Plasmodium falciparum
EELEEKERYKKDDEIDN

SEQ ID NO: 3308002 - protein, 5 aa, Plasmodium falciparum
EELEN

SEQ ID NO: 3308003 - protein, 26 aa, Plasmodium falciparum
EELESRNNNTNNNNNNNDGTGGSGEM

SEQ ID NO: 3308004 - protein, 6 aa, Plasmodium falciparum
EELETN

SEQ ID NO: 3308005 - protein, 289 aa, Plasmodium falciparum
EELKDNEEEEVEEEVEEEIEDDEEEDEEIEDDEEEEEDEEVEDDEEEEEDEEVDDEEEEVEESDEEVECDEEVDDDEEEEEEVDDEEEEEEVEESDEEVEDDEEEEEELEDGEEEEEELEDNEEGDEEVDDEEEEEEVEESDEEVEVDEEEEEELDGDEEGDEEEDNEEDDEEVGDEEEEEEVEESDEEVEDDEGEEEELEGDEEEEEEVEESDEEEEELDSDEEDNEEDDEEEEDLEVEDDEDVEEGELEGDEEEEEELKDGEESDEELEDSEESDEEVEDVEDNEEE

SEQ ID NO: 3308006 - protein, 10 aa, Plasmodium falciparum
EELKNKDNEL

SEQ ID NO: 3308007 - protein, 16 aa, Plasmodium falciparum
EELKNKYEEETKDKVE

SEQ ID NO: 3308008 - protein, 4 aa, Plasmodium falciparum
EELN

SEQ ID NO: 3308009 - protein, 16 aa, Plasmodium falciparum
EELNDSKSFGRKYTGR

SEQ ID NO: 3308010 - protein, 5 aa, Plasmodium falciparum
EELNE

SEQ ID NO: 3308011 - protein, 6 aa, Plasmodium falciparum
EELRKE

SEQ ID NO: 3308012 - protein, 16 aa, Plasmodium falciparum
EELRSKMSRKRKEKEG

SEQ ID NO: 3308013 - protein, 11 aa, Plasmodium falciparum
EELRSSSEELQ

SEQ ID NO: 3308014 - protein, 8 aa, Plasmodium falciparum
EELSGDTQ

SEQ ID NO: 3308015 - protein, 5 aa, Plasmodium falciparum
EELYE

SEQ ID NO: 3308016 - protein, 99 aa, Plasmodium falciparum
EEMDKNRKENDNKKGIDDNKKGIDDDEKKINDNEKKINNDEKKINDNEKKINNDEKKINDNEKKINNDEKKINDNEKKRSDNEKRINDDEKKINDNNNN

SEQ ID NO: 3308017 - protein, 4 aa, Plasmodium falciparum
EEME

SEQ ID NO: 3308018 - protein, 10 aa, Plasmodium falciparum
EEMEEAKRDD

SEQ ID NO: 3308019 - protein, 6 aa, Plasmodium falciparum
EEMKEI

SEQ ID NO: 3308020 - protein, 9 aa, Plasmodium falciparum
EEMKQKNKE

SEQ ID NO: 3308021 - protein, 9 aa, Plasmodium falciparum
EEMNESKGN

SEQ ID NO: 3308022 - protein, 6 aa, Plasmodium falciparum
EEMNNK

SEQ ID NO: 3308023 - protein, 12 aa, Plasmodium falciparum
EEMQEENKKELK

SEQ ID NO: 3308024 - protein, 10 aa, Plasmodium falciparum
EEMQKSNDGN

SEQ ID NO: 3308025 - protein, 6 aa, Plasmodium falciparum
EEMRPS

SEQ ID NO: 3308026 - protein, 26 aa, Plasmodium falciparum
EENAKGTYDKNKNNKKKKNSKKCDPV

SEQ ID NO: 3308027 - protein, 11 aa, Plasmodium falciparum
EENAPEQFSYP

SEQ ID NO: 3308028 - protein, 8 aa, Plasmodium falciparum
EENDEEYK

SEQ ID NO: 3308029 - protein, 45 aa, Plasmodium falciparum
EENDEKYSNKGSFNISDDDEMDNKSSNYNISGKNYSTENNDNKNN

SEQ ID NO: 3308030 - protein, 5 aa, Plasmodium falciparum
EENDI

SEQ ID NO: 3308031 - protein, 12 aa, Plasmodium falciparum
EENDKENNVKGD

SEQ ID NO: 3308032 - protein, 20 aa, Plasmodium falciparum
EENDKRNKKNKRNIKNKRNI

SEQ ID NO: 3308033 - protein, 46 aa, Plasmodium falciparum
EENDNDDEDDDDNNNNNNNNEHNNNEHNNDQHNNNVHNNDQHNNNH

SEQ ID NO: 3308034 - protein, 10 aa, Plasmodium falciparum
EENDNNPLRK

SEQ ID NO: 3308035 - protein, 8 aa, Plasmodium falciparum
EENDQEEI

SEQ ID NO: 3308036 - protein, 10 aa, Plasmodium falciparum
EENDQESDDE

SEQ ID NO: 3308037 - protein, 11 aa, Plasmodium falciparum
EENDQNNTSRN

SEQ ID NO: 3308038 - protein, 8 aa, Plasmodium falciparum
EENDSPSI

SEQ ID NO: 3308039 - protein, 5 aa, Plasmodium falciparum
EENED

SEQ ID NO: 3308040 - protein, 5 aa, Plasmodium falciparum
EENEE

SEQ ID NO: 3308041 - protein, 19 aa, Plasmodium falciparum
EENEEDEKDVKGKIYERSD

SEQ ID NO: 3308042 - protein, 68 aa, Plasmodium falciparum
EENEEDNNINDDDNNKYDDDNNKYDDDNNKYDDDNNKNDDDNNKNGDDNICDDDNKYDDDNKNNMYEE

SEQ ID NO: 3308043 - protein, 45 aa, Plasmodium falciparum
EENEGNEENEENGKNEENGKNEGNEKFDKNEKNEKFDKNEKNQNI

SEQ ID NO: 3308044 - protein, 8 aa, Plasmodium falciparum
EENEGNRN

SEQ ID NO: 3308045 - protein, 7 aa, Plasmodium falciparum
EENEIKK

SEQ ID NO: 3308046 - protein, 5 aa, Plasmodium falciparum
EENEK

SEQ ID NO: 3308047 - protein, 8 aa, Plasmodium falciparum
EENEKDYD

SEQ ID NO: 3308048 - protein, 8 aa, Plasmodium falciparum
EENEKENV

SEQ ID NO: 3308049 - protein, 27 aa, Plasmodium falciparum
EENEKGEKKEKKVEKINEDENDNNDEN

SEQ ID NO: 3308050 - protein, 8 aa, Plasmodium falciparum
EENEKKNI

SEQ ID NO: 3308051 - protein, 112 aa, Plasmodium falciparum
EENEKKNNDDNKNNDDNKNNDDNKNNGDNKNNGDNKNNGDNKNYGDNKNYDDNKNYGDNKNYDDNKNYGDNKNYDDNKNYDDNKNYDNNDNDICNDNERKQGEEENNKDNNY

SEQ ID NO: 3308052 - protein, 25 aa, Plasmodium falciparum
EENEMGSNNGKDISTESSKDERSNV

SEQ ID NO: 3308053 - protein, 6 aa, Plasmodium falciparum
EENEND

SEQ ID NO: 3308054 - protein, 11 aa, Plasmodium falciparum
EENENQKSNIE

SEQ ID NO: 3308055 - protein, 21 aa, Plasmodium falciparum
EENEYSNTYNNYSNNNRRNQN

SEQ ID NO: 3308056 - protein, 26 aa, Plasmodium falciparum
EENGDKNKKVSSNKKETRRTQNEKPM

SEQ ID NO: 3308057 - protein, 6 aa, Plasmodium falciparum
EENGEI

SEQ ID NO: 3308058 - protein, 5 aa, Plasmodium falciparum
EENGK

SEQ ID NO: 3308059 - protein, 13 aa, Plasmodium falciparum
EENHIHSKKKNKY

SEQ ID NO: 3308060 - protein, 4 aa, Plasmodium falciparum
EENI

SEQ ID NO: 3308061 - protein, 8 aa, Plasmodium falciparum
EENIEDKN

SEQ ID NO: 3308062 - protein, 23 aa, Plasmodium falciparum
EENIKKEDDVTKKVSENTEDNDI

SEQ ID NO: 3308063 - protein, 5 aa, Plasmodium falciparum
EENIT

SEQ ID NO: 3308064 - protein, 21 aa, Plasmodium falciparum
EENKEGDNITTVENTATEGNI

SEQ ID NO: 3308065 - protein, 12 aa, Plasmodium falciparum
EENKKEDTNTLY

SEQ ID NO: 3308066 - protein, 16 aa, Plasmodium falciparum
EENKKHHNKYETKKEY

SEQ ID NO: 3308067 - protein, 12 aa, Plasmodium falciparum
EENKKKEDIHNK

SEQ ID NO: 3308068 - protein, 16 aa, Plasmodium falciparum
EENKKKLQENKNKKEI

SEQ ID NO: 3308069 - protein, 17 aa, Plasmodium falciparum
EENKKKNIYEQDTTYGD

SEQ ID NO: 3308070 - protein, 10 aa, Plasmodium falciparum
EENKKRNEEL

SEQ ID NO: 3308071 - protein, 7 aa, Plasmodium falciparum
EENKKSK

SEQ ID NO: 3308072 - protein, 5 aa, Plasmodium falciparum
EENKN

SEQ ID NO: 3308073 - protein, 40 aa, Plasmodium falciparum
EENKNEEISNSEKKSVSSKDDINTSSSLYSSSDDDEDIDD

SEQ ID NO: 3308074 - protein, 7 aa, Plasmodium falciparum
EENKNNN

SEQ ID NO: 3308075 - protein, 9 aa, Plasmodium falciparum
EENKNSDYI

SEQ ID NO: 3308076 - protein, 10 aa, Plasmodium falciparum
EENKNSFNNM

SEQ ID NO: 3308077 - protein, 6 aa, Plasmodium falciparum
EENKNV

SEQ ID NO: 3308078 - protein, 27 aa, Plasmodium falciparum
EENKNVKQSEENCKNLPGYENEPHSDG

SEQ ID NO: 3308079 - protein, 13 aa, Plasmodium falciparum
EENKSKVNEDDDN

SEQ ID NO: 3308080 - protein, 16 aa, Plasmodium falciparum
EENKTEIQDAETKFKN

SEQ ID NO: 3308081 - protein, 23 aa, Plasmodium falciparum
EENKTNHNDHNDHNGHNDHNGDN

SEQ ID NO: 3308082 - protein, 11 aa, Plasmodium falciparum
EENLEGNGNTF

SEQ ID NO: 3308083 - protein, 8 aa, Plasmodium falciparum
EENLENGE

SEQ ID NO: 3308084 - protein, 9 aa, Plasmodium falciparum
EENMEDTSK

SEQ ID NO: 3308085 - protein, 4 aa, Plasmodium falciparum
EENN

SEQ ID NO: 3308086 - protein, 15 aa, Plasmodium falciparum
EENNDTYEKNLETKN

SEQ ID NO: 3308087 - protein, 11 aa, Plasmodium falciparum
EENNENDGDKN

SEQ ID NO: 3308088 - protein, 5 aa, Plasmodium falciparum
EENNF

SEQ ID NO: 3308089 - protein, 5 aa, Plasmodium falciparum
EENNI

SEQ ID NO: 3308090 - protein, 7 aa, Plasmodium falciparum
EENNIDT

SEQ ID NO: 3308091 - protein, 12 aa, Plasmodium falciparum
EENNIKQNSNIN

SEQ ID NO: 3308092 - protein, 7 aa, Plasmodium falciparum
EENNKLK

SEQ ID NO: 3308093 - protein, 6 aa, Plasmodium falciparum
EENNKT

SEQ ID NO: 3308094 - protein, 37 aa, Plasmodium falciparum
EENNNEDREYNTNESNCNRYDDEEDKKVENFDNNNIN

SEQ ID NO: 3308095 - protein, 14 aa, Plasmodium falciparum
EENNNEKDKKTKQK

SEQ ID NO: 3308096 - protein, 20 aa, Plasmodium falciparum
EENNNINNNINNNNNNNNNN

SEQ ID NO: 3308097 - protein, 24 aa, Plasmodium falciparum
EENNNIQDDNSMNMTNNEQENHNE

SEQ ID NO: 3308098 - protein, 16 aa, Plasmodium falciparum
EENNSHCESIKEKNKN

SEQ ID NO: 3308099 - protein, 9 aa, Plasmodium falciparum
EENNSIVKE

SEQ ID NO: 3308100 - protein, 9 aa, Plasmodium falciparum
EENNSRPPL

SEQ ID NO: 3308101 - protein, 26 aa, Plasmodium falciparum
EENNSYEKCNNENVYKGNDNDNDDIN

SEQ ID NO: 3308102 - protein, 9 aa, Plasmodium falciparum
EENNTNSIK

SEQ ID NO: 3308103 - protein, 7 aa, Plasmodium falciparum
EENNYKE

SEQ ID NO: 3308104 - protein, 19 aa, Plasmodium falciparum
EENNYNNNNTNGHQMKSPT

SEQ ID NO: 3308105 - protein, 8 aa, Plasmodium falciparum
EENNYPKK

SEQ ID NO: 3308106 - protein, 13 aa, Plasmodium falciparum
EENPNVDDMKPDK

SEQ ID NO: 3308107 - protein, 9 aa, Plasmodium falciparum
EENQEDTDE

SEQ ID NO: 3308108 - protein, 18 aa, Plasmodium falciparum
EENQKEYSQQIKKKEESL

SEQ ID NO: 3308109 - protein, 12 aa, Plasmodium falciparum
EENQKKKDKEKN

SEQ ID NO: 3308110 - protein, 9 aa, Plasmodium falciparum
EENQNESNL

SEQ ID NO: 3308111 - protein, 11 aa, Plasmodium falciparum
EENRGTQSPNN

SEQ ID NO: 3308112 - protein, 18 aa, Plasmodium falciparum
EENRRKQKLQKRREKEKW

SEQ ID NO: 3308113 - protein, 4 aa, Plasmodium falciparum
EENS

SEQ ID NO: 3308114 - protein, 7 aa, Plasmodium falciparum
EENSHYS

SEQ ID NO: 3308115 - protein, 19 aa, Plasmodium falciparum
EENSIQQDTHQHDSTNNTM

SEQ ID NO: 3308116 - protein, 8 aa, Plasmodium falciparum
EENSNDEI

SEQ ID NO: 3308117 - protein, 7 aa, Plasmodium falciparum
EENSNNT

SEQ ID NO: 3308118 - protein, 34 aa, Plasmodium falciparum
EENSSFEESRNYESSDNSSDLFEEPSPKKRKKVI

SEQ ID NO: 3308119 - protein, 15 aa, Plasmodium falciparum
EENSSKEKTSNTQYN

SEQ ID NO: 3308120 - protein, 4 aa, Plasmodium falciparum
EENT

SEQ ID NO: 3308121 - protein, 7 aa, Plasmodium falciparum
EENTDMN

SEQ ID NO: 3308122 - protein, 8 aa, Plasmodium falciparum
EENTDTEK

SEQ ID NO: 3308123 - protein, 8 aa, Plasmodium falciparum
EENTKDIT

SEQ ID NO: 3308124 - protein, 6 aa, Plasmodium falciparum
EENTNM

SEQ ID NO: 3308125 - protein, 23 aa, Plasmodium falciparum
EENTQNLKTKNNEHMENKEDLNN

SEQ ID NO: 3308126 - protein, 12 aa, Plasmodium falciparum
EENTRNENEKRK

SEQ ID NO: 3308127 - protein, 6 aa, Plasmodium falciparum
EENTTK

SEQ ID NO: 3308128 - protein, 15 aa, Plasmodium falciparum
EENVEEDNNADLENE

SEQ ID NO: 3308129 - protein, 7 aa, Plasmodium falciparum
EENVGNT

SEQ ID NO: 3308130 - protein, 8 aa, Plasmodium falciparum
EENVKSVN

SEQ ID NO: 3308131 - protein, 28 aa, Plasmodium falciparum
EENVRKKHKGNNSSDFDEREKKKDSLDG

SEQ ID NO: 3308132 - protein, 24 aa, Plasmodium falciparum
EENYIGPDEGSEVELEGKKKKKKS

SEQ ID NO: 3308133 - protein, 8 aa, Plasmodium falciparum
EENYMKEE

SEQ ID NO: 3308134 - protein, 7 aa, Plasmodium falciparum
EENYNNN

SEQ ID NO: 3308135 - protein, 8 aa, Plasmodium falciparum
EENYSRHE

SEQ ID NO: 3308136 - protein, 11 aa, Plasmodium falciparum
EENYSSSSTNV

SEQ ID NO: 3308137 - protein, 5 aa, Plasmodium falciparum
EEPCP

SEQ ID NO: 3308138 - protein, 5 aa, Plasmodium falciparum
EEPDE

SEQ ID NO: 3308139 - protein, 6 aa, Plasmodium falciparum
EEPENI

SEQ ID NO: 3308140 - protein, 4 aa, Plasmodium falciparum
EEPF

SEQ ID NO: 3308141 - protein, 5 aa, Plasmodium falciparum
EEPIN

SEQ ID NO: 3308142 - protein, 10 aa, Plasmodium falciparum
EEPKEGHSND

SEQ ID NO: 3308143 - protein, 8 aa, Plasmodium falciparum
EEPKRKTD

SEQ ID NO: 3308144 - protein, 4 aa, Plasmodium falciparum
EEPN

SEQ ID NO: 3308145 - protein, 7 aa, Plasmodium falciparum
EEPTQKK

SEQ ID NO: 3308146 - protein, 8 aa, Plasmodium falciparum
EEQADDSF

SEQ ID NO: 3308147 - protein, 6 aa, Plasmodium falciparum
EEQARL

SEQ ID NO: 3308148 - protein, 10 aa, Plasmodium falciparum
EEQASSSCKK

SEQ ID NO: 3308149 - protein, 22 aa, Plasmodium falciparum
EEQDETEEESEMNVDESSENEY

SEQ ID NO: 3308150 - protein, 14 aa, Plasmodium falciparum
EEQDEYKRDGQTLG

SEQ ID NO: 3308151 - protein, 6 aa, Plasmodium falciparum
EEQDLY

SEQ ID NO: 3308152 - protein, 5 aa, Plasmodium falciparum
EEQDN

SEQ ID NO: 3308153 - protein, 7 aa, Plasmodium falciparum
EEQDNSS

SEQ ID NO: 3308154 - protein, 9 aa, Plasmodium falciparum
EEQDREYQE

SEQ ID NO: 3308155 - protein, 29 aa, Plasmodium falciparum
EEQDYNKDNANLNDAYEDRRSHNDVEEGK

SEQ ID NO: 3308156 - protein, 6 aa, Plasmodium falciparum
EEQEGD

SEQ ID NO: 3308157 - protein, 5 aa, Plasmodium falciparum
EEQEK

SEQ ID NO: 3308158 - protein, 4 aa, Plasmodium falciparum
EEQG

SEQ ID NO: 3308159 - protein, 12 aa, Plasmodium falciparum
EEQGEGEDQRNV

SEQ ID NO: 3308160 - protein, 26 aa, Plasmodium falciparum
EEQIKQEEMSKQVGHSEGNGNGNGNE

SEQ ID NO: 3308161 - protein, 10 aa, Plasmodium falciparum
EEQKKKEQLN

SEQ ID NO: 3308162 - protein, 11 aa, Plasmodium falciparum
EEQKKKLKEDH

SEQ ID NO: 3308163 - protein, 5 aa, Plasmodium falciparum
EEQKN

SEQ ID NO: 3308164 - protein, 21 aa, Plasmodium falciparum
EEQKNNLYDRKKQKYKKKAED

SEQ ID NO: 3308165 - protein, 10 aa, Plasmodium falciparum
EEQLKNNSES

SEQ ID NO: 3308166 - protein, 4 aa, Plasmodium falciparum
EEQM

SEQ ID NO: 3308167 - protein, 18 aa, Plasmodium falciparum
EEQNNGDSLDERKEKNMK

SEQ ID NO: 3308168 - protein, 16 aa, Plasmodium falciparum
EEQNNTQKDNIKEQSD

SEQ ID NO: 3308169 - protein, 8 aa, Plasmodium falciparum
EEQNSNIN

SEQ ID NO: 3308170 - protein, 16 aa, Plasmodium falciparum
EEQQKQEEGYKQKEDD

SEQ ID NO: 3308171 - protein, 5 aa, Plasmodium falciparum
EEQQN

SEQ ID NO: 3308172 - protein, 18 aa, Plasmodium falciparum
EEQQNEKSNSKCCNYFCD

SEQ ID NO: 3308173 - protein, 5 aa, Plasmodium falciparum
EEQRK

SEQ ID NO: 3308174 - protein, 9 aa, Plasmodium falciparum
EEQRKREEI

SEQ ID NO: 3308175 - protein, 5 aa, Plasmodium falciparum
EEQTL

SEQ ID NO: 3308176 - protein, 31 aa, Plasmodium falciparum
EERAKKDDKKRFAYKSDEDDEGYNKRKKKKK

SEQ ID NO: 3308177 - protein, 18 aa, Plasmodium falciparum
EERDKRRDVLNSSNDKDK

SEQ ID NO: 3308178 - protein, 7 aa, Plasmodium falciparum
EERDNIQ

SEQ ID NO: 3308179 - protein, 19 aa, Plasmodium falciparum
EEREDEKGKENGKERNDKN

SEQ ID NO: 3308180 - protein, 6 aa, Plasmodium falciparum
EEREDN

SEQ ID NO: 3308181 - protein, 5 aa, Plasmodium falciparum
EERER

SEQ ID NO: 3308182 - protein, 6 aa, Plasmodium falciparum
EERESL

SEQ ID NO: 3308183 - protein, 4 aa, Plasmodium falciparum
EERI

SEQ ID NO: 3308184 - protein, 7 aa, Plasmodium falciparum
EERIREE

SEQ ID NO: 3308185 - protein, 16 aa, Plasmodium falciparum
EERKDEVDENRKSHEE

SEQ ID NO: 3308186 - protein, 12 aa, Plasmodium falciparum
EERKEKKKLPYS

SEQ ID NO: 3308187 - protein, 34 aa, Plasmodium falciparum
EERKKSTDKHSKTERNKSKKYKDTKEEHKKNNSF

SEQ ID NO: 3308188 - protein, 10 aa, Plasmodium falciparum
EERKNNNKKN

SEQ ID NO: 3308189 - protein, 5 aa, Plasmodium falciparum
EERKT

SEQ ID NO: 3308190 - protein, 4 aa, Plasmodium falciparum
EERL

SEQ ID NO: 3308191 - protein, 130 aa, Plasmodium falciparum
EERLEEERSNTCEETEQVEETSNNKRGRKQKEKDEKAKSVEDNLDEEYDVGKNKTQEKKKRKYTRKTGATATTNNTTTTTKRGRKSKKEKDEEIEENEKKNEVKDENVNNIGKSDDNEEKDNKENKDENY

SEQ ID NO: 3308192 - protein, 9 aa, Plasmodium falciparum
EERNEKERY

SEQ ID NO: 3308193 - protein, 8 aa, Plasmodium falciparum
EERNKELQ

SEQ ID NO: 3308194 - protein, 5 aa, Plasmodium falciparum
EERNN

SEQ ID NO: 3308195 - protein, 9 aa, Plasmodium falciparum
EERNTKNNN

SEQ ID NO: 3308196 - protein, 5 aa, Plasmodium falciparum
EERRG

SEQ ID NO: 3308197 - protein, 6 aa, Plasmodium falciparum
EERRKQ

SEQ ID NO: 3308198 - protein, 11 aa, Plasmodium falciparum
EERRRKREALK

SEQ ID NO: 3308199 - protein, 5 aa, Plasmodium falciparum
EERSR

SEQ ID NO: 3308200 - protein, 8 aa, Plasmodium falciparum
EERSSSIM

SEQ ID NO: 3308201 - protein, 6 aa, Plasmodium falciparum
EERSYN

SEQ ID NO: 3308202 - protein, 6 aa, Plasmodium falciparum
EERVEE

SEQ ID NO: 3308203 - protein, 37 aa, Plasmodium falciparum
EESDEKKNEQQSAEDEEEYDEEDDNEEKKKKEKISQK

SEQ ID NO: 3308204 - protein, 35 aa, Plasmodium falciparum
EESDIRKHRKKRTYEDISKDDNCVSKNKKEDMDNY

SEQ ID NO: 3308205 - protein, 8 aa, Plasmodium falciparum
EESDTINN

SEQ ID NO: 3308206 - protein, 5 aa, Plasmodium falciparum
EESEE

SEQ ID NO: 3308207 - protein, 6 aa, Plasmodium falciparum
EESEGI

SEQ ID NO: 3308208 - protein, 6 aa, Plasmodium falciparum
EESEKD

SEQ ID NO: 3308209 - protein, 10 aa, Plasmodium falciparum
EESEPVKNGV

SEQ ID NO: 3308210 - protein, 5 aa, Plasmodium falciparum
EESEV

SEQ ID NO: 3308211 - protein, 4 aa, Plasmodium falciparum
EESF

SEQ ID NO: 3308212 - protein, 4 aa, Plasmodium falciparum
EESI

SEQ ID NO: 3308213 - protein, 12 aa, Plasmodium falciparum
EESIKQKQKQKM

SEQ ID NO: 3308214 - protein, 7 aa, Plasmodium falciparum
EESKDEM

SEQ ID NO: 3308215 - protein, 5 aa, Plasmodium falciparum
EESKK

SEQ ID NO: 3308216 - protein, 6 aa, Plasmodium falciparum
EESKKH

SEQ ID NO: 3308217 - protein, 30 aa, Plasmodium falciparum
EESKSKGNEGEKEFGSANTIDEANKSNKNM

SEQ ID NO: 3308218 - protein, 19 aa, Plasmodium falciparum
EESKYTNIKEDNEQNICPS

SEQ ID NO: 3308219 - protein, 23 aa, Plasmodium falciparum
EESLKDSDDAALSSFGNKSNDLI

SEQ ID NO: 3308220 - protein, 11 aa, Plasmodium falciparum
EESMDKSDEML

SEQ ID NO: 3308221 - protein, 5 aa, Plasmodium falciparum
EESNI

SEQ ID NO: 3308222 - protein, 21 aa, Plasmodium falciparum
EESNIKNKESNHNNSKYPFDG

SEQ ID NO: 3308223 - protein, 14 aa, Plasmodium falciparum
EESNNISEAVKEEE

SEQ ID NO: 3308224 - protein, 9 aa, Plasmodium falciparum
EESQKTKSN

SEQ ID NO: 3308225 - protein, 9 aa, Plasmodium falciparum
EESSDYDSS

SEQ ID NO: 3308226 - protein, 18 aa, Plasmodium falciparum
EESSDYENADDDIRNREP

SEQ ID NO: 3308227 - protein, 22 aa, Plasmodium falciparum
EESSSHNDNKSKESNEQNDLNT

SEQ ID NO: 3308228 - protein, 7 aa, Plasmodium falciparum
EESSSLS

SEQ ID NO: 3308229 - protein, 4 aa, Plasmodium falciparum
EEST

SEQ ID NO: 3308230 - protein, 6 aa, Plasmodium falciparum
EESTNK

SEQ ID NO: 3308231 - protein, 4 aa, Plasmodium falciparum
EESV

SEQ ID NO: 3308232 - protein, 6 aa, Plasmodium falciparum
EESVEK

SEQ ID NO: 3308233 - protein, 13 aa, Plasmodium falciparum
EESVSVSSGSNDV

SEQ ID NO: 3308234 - protein, 44 aa, Plasmodium falciparum
EETAEQKARNMGRGRGGRGRGRGGMNRGTYGRGRGGSMRRGGRG

SEQ ID NO: 3308235 - protein, 7 aa, Plasmodium falciparum
EETCNTN

SEQ ID NO: 3308236 - protein, 7 aa, Plasmodium falciparum
EETDIPD

SEQ ID NO: 3308237 - protein, 10 aa, Plasmodium falciparum
EETEENKKNE

SEQ ID NO: 3308238 - protein, 5 aa, Plasmodium falciparum
EETER

SEQ ID NO: 3308239 - protein, 5 aa, Plasmodium falciparum
EETGL

SEQ ID NO: 3308240 - protein, 11 aa, Plasmodium falciparum
EETGVSKEDKE

SEQ ID NO: 3308241 - protein, 32 aa, Plasmodium falciparum
EETHEEPLEQEQELDEQKIEEEEEEPEQVPKE

SEQ ID NO: 3308242 - protein, 9 aa, Plasmodium falciparum
EETKDKKEQ

SEQ ID NO: 3308243 - protein, 9 aa, Plasmodium falciparum
EETKKNKNL

SEQ ID NO: 3308244 - protein, 13 aa, Plasmodium falciparum
EETLIDTKEDDNL

SEQ ID NO: 3308245 - protein, 11 aa, Plasmodium falciparum
EETLKKDRPNK

SEQ ID NO: 3308246 - protein, 6 aa, Plasmodium falciparum
EETLRK

SEQ ID NO: 3308247 - protein, 6 aa, Plasmodium falciparum
EETNFR

SEQ ID NO: 3308248 - protein, 10 aa, Plasmodium falciparum
EETNKKIKKR

SEQ ID NO: 3308249 - protein, 16 aa, Plasmodium falciparum
EETNKYDDQDNNRNEF

SEQ ID NO: 3308250 - protein, 10 aa, Plasmodium falciparum
EETNSINSDN

SEQ ID NO: 3308251 - protein, 9 aa, Plasmodium falciparum
EETNYNDNN

SEQ ID NO: 3308252 - protein, 5 aa, Plasmodium falciparum
EETPI

SEQ ID NO: 3308253 - protein, 9 aa, Plasmodium falciparum
EETPKSYKE

SEQ ID NO: 3308254 - protein, 6 aa, Plasmodium falciparum
EETPLE

SEQ ID NO: 3308255 - protein, 5 aa, Plasmodium falciparum
EETQC

SEQ ID NO: 3308256 - protein, 8 aa, Plasmodium falciparum
EETSSIKN

SEQ ID NO: 3308257 - protein, 6 aa, Plasmodium falciparum
EETTHD

SEQ ID NO: 3308258 - protein, 14 aa, Plasmodium falciparum
EETVDATDSKMEEV

SEQ ID NO: 3308259 - protein, 9 aa, Plasmodium falciparum
EETYEEDKE

SEQ ID NO: 3308260 - protein, 12 aa, Plasmodium falciparum
EETYENNGNYEY

SEQ ID NO: 3308261 - protein, 23 aa, Plasmodium falciparum
EETYEQKKNNESSNSDDDDNKKE

SEQ ID NO: 3308262 - protein, 6 aa, Plasmodium falciparum
EEVEGE

SEQ ID NO: 3308263 - protein, 11 aa, Plasmodium falciparum
EEVEQKNISQR

SEQ ID NO: 3308264 - protein, 6 aa, Plasmodium falciparum
EEVGNY

SEQ ID NO: 3308265 - protein, 4 aa, Plasmodium falciparum
EEVK

SEQ ID NO: 3308266 - protein, 9 aa, Plasmodium falciparum
EEVKGENDQ

SEQ ID NO: 3308267 - protein, 17 aa, Plasmodium falciparum
EEVKSTTKSTLADSDED

SEQ ID NO: 3308268 - protein, 10 aa, Plasmodium falciparum
EEVNDNNNKC

SEQ ID NO: 3308269 - protein, 53 aa, Plasmodium falciparum
EEVPKEQDVPKKHGVPKEQDVPKEQEVPKEQEVPKEQEEMKKRKKENPNDQQI

SEQ ID NO: 3308270 - protein, 74 aa, Plasmodium falciparum
EEVQNGGQNGNQNGSQNEGQNEGQNEGRVQSQDQRQNQSQDQRQNQSLDQRQDQRQDQRQDQRQYQSKEPNEDK

SEQ ID NO: 3308271 - protein, 15 aa, Plasmodium falciparum
EEVSGGTNLMKVVQI

SEQ ID NO: 3308272 - protein, 17 aa, Plasmodium falciparum
EEVTDGNIKDDNEKDNN

SEQ ID NO: 3308273 - protein, 45 aa, Plasmodium falciparum
EEVTGEDDENGKNNEKAQTDEKTEDENVKNNEVVENNNNDNNNNI

SEQ ID NO: 3308274 - protein, 7 aa, Plasmodium falciparum
EEVTNEE

SEQ ID NO: 3308275 - protein, 9 aa, Plasmodium falciparum
EEVTNQNEL

SEQ ID NO: 3308276 - protein, 6 aa, Plasmodium falciparum
EEVTTL

SEQ ID NO: 3308277 - protein, 88 aa, Plasmodium falciparum
EEYDKKSINNIENQNENQNENQNENQNENQNENQNENQNENQNENQNENQNENQNENQNENQNENQNENQNENQNENQNENQKNNNNI

SEQ ID NO: 3308278 - protein, 37 aa, Plasmodium falciparum
EEYDNKDDITGEEKRDSLKKSPLQSEDINSNDSVYKR

SEQ ID NO: 3308279 - protein, 8 aa, Plasmodium falciparum
EEYDNTPF

SEQ ID NO: 3308280 - protein, 4 aa, Plasmodium falciparum
EEYE

SEQ ID NO: 3308281 - protein, 35 aa, Plasmodium falciparum
EEYEEYEEEETKNNQKKSEKREDDLTTNETKRESS

SEQ ID NO: 3308282 - protein, 12 aa, Plasmodium falciparum
EEYEKKKKRHLE

SEQ ID NO: 3308283 - protein, 10 aa, Plasmodium falciparum
EEYEKKNKAH

SEQ ID NO: 3308284 - protein, 8 aa, Plasmodium falciparum
EEYEKRND

SEQ ID NO: 3308285 - protein, 7 aa, Plasmodium falciparum
EEYESER

SEQ ID NO: 3308286 - protein, 20 aa, Plasmodium falciparum
EEYHNDNQERARKNSENSKK

SEQ ID NO: 3308287 - protein, 7 aa, Plasmodium falciparum
EEYIRDP

SEQ ID NO: 3308288 - protein, 6 aa, Plasmodium falciparum
EEYKER

SEQ ID NO: 3308289 - protein, 32 aa, Plasmodium falciparum
EEYKSNKKNDTNHNKYTNKKKISKEKKTNNVS

SEQ ID NO: 3308290 - protein, 7 aa, Plasmodium falciparum
EEYNEMD

SEQ ID NO: 3308291 - protein, 5 aa, Plasmodium falciparum
EEYNN

SEQ ID NO: 3308292 - protein, 35 aa, Plasmodium falciparum
EEYNNDNEKISSNGYLTTTESQSKGTTDGNTERGS

SEQ ID NO: 3308293 - protein, 16 aa, Plasmodium falciparum
EEYNNKNDDKSSSSSS

SEQ ID NO: 3308294 - protein, 9 aa, Plasmodium falciparum
EEYNNRNTE

SEQ ID NO: 3308295 - protein, 8 aa, Plasmodium falciparum
EEYNSDND

SEQ ID NO: 3308296 - protein, 4 aa, Plasmodium falciparum
EEYP

SEQ ID NO: 3308297 - protein, 6 aa, Plasmodium falciparum
EEYPDE

SEQ ID NO: 3308298 - protein, 5 aa, Plasmodium falciparum
EEYRK

SEQ ID NO: 3308299 - protein, 26 aa, Plasmodium falciparum
EEYRRKYKNKKKYNRKIKNNKNNKMD

SEQ ID NO: 3308300 - protein, 10 aa, Plasmodium falciparum
EEYSRDVSNT

SEQ ID NO: 3308301 - protein, 13 aa, Plasmodium falciparum
EEYTNYSSYSTQH

SEQ ID NO: 3308302 - protein, 9 aa, Plasmodium falciparum
EFDDDTSEF

SEQ ID NO: 3308303 - protein, 5 aa, Plasmodium falciparum
EFDDM

SEQ ID NO: 3308304 - protein, 9 aa, Plasmodium falciparum
EFDDNDYQK

SEQ ID NO: 3308305 - protein, 4 aa, Plasmodium falciparum
EFDE

SEQ ID NO: 3308306 - protein, 4 aa, Plasmodium falciparum
EFDS

SEQ ID NO: 3308307 - protein, 41 aa, Plasmodium falciparum
EFDSKGTYAQHDQKDTKDTNKKKAQTNNNVNNNNNNDYVNE

SEQ ID NO: 3308308 - protein, 4 aa, Plasmodium falciparum
EFED

SEQ ID NO: 3308309 - protein, 4 aa, Plasmodium falciparum
EFEE

SEQ ID NO: 3308310 - protein, 13 aa, Plasmodium falciparum
EFEKKKKKNEEIQ

SEQ ID NO: 3308311 - protein, 5 aa, Plasmodium falciparum
EFEKT

SEQ ID NO: 3308312 - protein, 5 aa, Plasmodium falciparum
EFESY

SEQ ID NO: 3308313 - protein, 14 aa, Plasmodium falciparum
EFGKKNKNKLNEYN

SEQ ID NO: 3308314 - protein, 9 aa, Plasmodium falciparum
EFKGSRISP

SEQ ID NO: 3308315 - protein, 4 aa, Plasmodium falciparum
EFKN

SEQ ID NO: 3308316 - protein, 5 aa, Plasmodium falciparum
EFKPQ

SEQ ID NO: 3308317 - protein, 9 aa, Plasmodium falciparum
EFKSGGSAL

SEQ ID NO: 3308318 - protein, 11 aa, Plasmodium falciparum
EFKSNNNNNNN

SEQ ID NO: 3308319 - protein, 10 aa, Plasmodium falciparum
EFPKGIPECG

SEQ ID NO: 3308320 - protein, 7 aa, Plasmodium falciparum
EFPNPPS

SEQ ID NO: 3308321 - protein, 6 aa, Plasmodium falciparum
EFPSNR

SEQ ID NO: 3308322 - protein, 6 aa, Plasmodium falciparum
EFPTHT

SEQ ID NO: 3308323 - protein, 16 aa, Plasmodium falciparum
EFRRGGGEFRRSSKRN

SEQ ID NO: 3308324 - protein, 7 aa, Plasmodium falciparum
EFSDNKN

SEQ ID NO: 3308325 - protein, 5 aa, Plasmodium falciparum
EFSEE

SEQ ID NO: 3308326 - protein, 22 aa, Plasmodium falciparum
EFSGKKKSHKGEHNNNNHHTDQ

SEQ ID NO: 3308327 - protein, 17 aa, Plasmodium falciparum
EFSTGGKKKKKKRRRKK

SEQ ID NO: 3308328 - protein, 5 aa, Plasmodium falciparum
EFTNY

SEQ ID NO: 3308329 - protein, 5 aa, Plasmodium falciparum
EFTTI

SEQ ID NO: 3308330 - protein, 7 aa, Plasmodium falciparum
EGAKNNM

SEQ ID NO: 3308331 - protein, 10 aa, Plasmodium falciparum
EGAKQIEKDL

SEQ ID NO: 3308332 - protein, 5 aa, Plasmodium falciparum
EGATG

SEQ ID NO: 3308333 - protein, 69 aa, Plasmodium falciparum
EGAVGGRNVDEEVEGAVGGRNVDEEVEGAVGGRNVEEYEGTYKDEKYKYSQYRGDSHKGKYVEKRDNTS

SEQ ID NO: 3308334 - protein, 6 aa, Plasmodium falciparum
EGCLPN

SEQ ID NO: 3308335 - protein, 9 aa, Plasmodium falciparum
EGDAKDEEK

SEQ ID NO: 3308336 - protein, 104 aa, Plasmodium falciparum
EGDEDEYEEKEHNQDKENDEHEIGGNKYDEDQDQNKEEQKEEQESEDQNEDEDYEEDEDDEEDDEEDENDDDENDDDEEEEYDHEEDDHGEDDHEDDDNEDDVD

SEQ ID NO: 3308337 - protein, 18 aa, Plasmodium falciparum
EGDENENNMNNATNNNIN

SEQ ID NO: 3308338 - protein, 5 aa, Plasmodium falciparum
EGDER

SEQ ID NO: 3308339 - protein, 17 aa, Plasmodium falciparum
EGDEREEDTEYSEEIGK

SEQ ID NO: 3308340 - protein, 82 aa, Plasmodium falciparum
EGDKNKQRDDKNNQRDDKNKQRDDKNKQRDDKNKQRDDKNKQRDDKNKQRDDKNKQRDDKNKQRDDKNNQRDDIHNTSREPL

SEQ ID NO: 3308341 - protein, 9 aa, Plasmodium falciparum
EGDKRGVHD

SEQ ID NO: 3308342 - protein, 5 aa, Plasmodium falciparum
EGDNI

SEQ ID NO: 3308343 - protein, 6 aa, Plasmodium falciparum
EGDNYI

SEQ ID NO: 3308344 - protein, 4 aa, Plasmodium falciparum
EGDP

SEQ ID NO: 3308345 - protein, 8 aa, Plasmodium falciparum
EGDYKKGA

SEQ ID NO: 3308346 - protein, 7 aa, Plasmodium falciparum
EGDYPND

SEQ ID NO: 3308347 - protein, 10 aa, Plasmodium falciparum
EGEAHSERYP

SEQ ID NO: 3308348 - protein, 8 aa, Plasmodium falciparum
EGEAPPKI

SEQ ID NO: 3308349 - protein, 10 aa, Plasmodium falciparum
EGEASSSLRK

SEQ ID NO: 3308350 - protein, 9 aa, Plasmodium falciparum
EGEDEYSDE

SEQ ID NO: 3308351 - protein, 6 aa, Plasmodium falciparum
EGEEGD

SEQ ID NO: 3308352 - protein, 9 aa, Plasmodium falciparum
EGEEHVQNK

SEQ ID NO: 3308353 - protein, 7 aa, Plasmodium falciparum
EGEETEI

SEQ ID NO: 3308354 - protein, 29 aa, Plasmodium falciparum
EGEHKENKTEDDKNIVNKSDEDKNNDDKK

SEQ ID NO: 3308355 - protein, 4 aa, Plasmodium falciparum
EGEI

SEQ ID NO: 3308356 - protein, 9 aa, Plasmodium falciparum
EGEKERKNK

SEQ ID NO: 3308357 - protein, 8 aa, Plasmodium falciparum
EGEKGKDL

SEQ ID NO: 3308358 - protein, 8 aa, Plasmodium falciparum
EGEKQKKD

SEQ ID NO: 3308359 - protein, 4 aa, Plasmodium falciparum
EGEN

SEQ ID NO: 3308360 - protein, 5 aa, Plasmodium falciparum
EGENI

SEQ ID NO: 3308361 - protein, 66 aa, Plasmodium falciparum
EGENKKYDEVEEGEEYEDENEDENEGEDEGEDEGEDEGEDEGEDEGEDEEEDEEEDEEEDEEEDDD

SEQ ID NO: 3308362 - protein, 11 aa, Plasmodium falciparum
EGENNSNEIND

SEQ ID NO: 3308363 - protein, 18 aa, Plasmodium falciparum
EGEYDNDDSPNFDEDSSQ

SEQ ID NO: 3308364 - protein, 6 aa, Plasmodium falciparum
EGFNKS

SEQ ID NO: 3308365 - protein, 6 aa, Plasmodium falciparum
EGFPRN

SEQ ID NO: 3308366 - protein, 5 aa, Plasmodium falciparum
EGGEK

SEQ ID NO: 3308367 - protein, 8 aa, Plasmodium falciparum
EGGEYETA

SEQ ID NO: 3308368 - protein, 8 aa, Plasmodium falciparum
EGGGAGNN

SEQ ID NO: 3308369 - protein, 10 aa, Plasmodium falciparum
EGGGNGLSKR

SEQ ID NO: 3308370 - protein, 14 aa, Plasmodium falciparum
EGGKTVASGVITKL

SEQ ID NO: 3308371 - protein, 8 aa, Plasmodium falciparum
EGGNDLDN

SEQ ID NO: 3308372 - protein, 13 aa, Plasmodium falciparum
EGGNKNKSKNNDI

SEQ ID NO: 3308373 - protein, 22 aa, Plasmodium falciparum
EGGNTSKIDQANTKKPKKKEVI

SEQ ID NO: 3308374 - protein, 8 aa, Plasmodium falciparum
EGGSGKSS

SEQ ID NO: 3308375 - protein, 5 aa, Plasmodium falciparum
EGGSL

SEQ ID NO: 3308376 - protein, 14 aa, Plasmodium falciparum
EGGTKGGGEGEGFD

SEQ ID NO: 3308377 - protein, 5 aa, Plasmodium falciparum
EGHET

SEQ ID NO: 3308378 - protein, 47 aa, Plasmodium falciparum
EGHKNDNVYNNNDRRRGSLDNYERRRNEENHIGDRNRNISKGRRDYH

SEQ ID NO: 3308379 - protein, 9 aa, Plasmodium falciparum
EGHTTTDDT

SEQ ID NO: 3308380 - protein, 8 aa, Plasmodium falciparum
EGHTYEEE

SEQ ID NO: 3308381 - protein, 4 aa, Plasmodium falciparum
EGID

SEQ ID NO: 3308382 - protein, 5 aa, Plasmodium falciparum
EGIER

SEQ ID NO: 3308383 - protein, 9 aa, Plasmodium falciparum
EGIKEGEYK

SEQ ID NO: 3308384 - protein, 4 aa, Plasmodium falciparum
EGIN

SEQ ID NO: 3308385 - protein, 27 aa, Plasmodium falciparum
EGINKREKKNIEQNKQTGVQKVNTNKK

SEQ ID NO: 3308386 - protein, 21 aa, Plasmodium falciparum
EGISTKTTSKNKYNNKEYPSH

SEQ ID NO: 3308387 - protein, 5 aa, Plasmodium falciparum
EGITP

SEQ ID NO: 3308388 - protein, 4 aa, Plasmodium falciparum
EGKA

SEQ ID NO: 3308389 - protein, 8 aa, Plasmodium falciparum
EGKASKSI

SEQ ID NO: 3308390 - protein, 4 aa, Plasmodium falciparum
EGKD

SEQ ID NO: 3308391 - protein, 89 aa, Plasmodium falciparum
EGKDSHKEKDIQKHKSRERSTSISERKRRRRRRNSSSKSTSRRKSRHSRSSSRRKRKRRQRDESRSSSRTRRRSHNRSHKRSSSYEKDY

SEQ ID NO: 3308392 - protein, 8 aa, Plasmodium falciparum
EGKEEEYD

SEQ ID NO: 3308393 - protein, 9 aa, Plasmodium falciparum
EGKEEISND

SEQ ID NO: 3308394 - protein, 8 aa, Plasmodium falciparum
EGKEKNIE

SEQ ID NO: 3308395 - protein, 9 aa, Plasmodium falciparum
EGKEKTHKI

SEQ ID NO: 3308396 - protein, 7 aa, Plasmodium falciparum
EGKENVT

SEQ ID NO: 3308397 - protein, 7 aa, Plasmodium falciparum
EGKGTFN

SEQ ID NO: 3308398 - protein, 4 aa, Plasmodium falciparum
EGKI

SEQ ID NO: 3308399 - protein, 5 aa, Plasmodium falciparum
EGKKK

SEQ ID NO: 3308400 - protein, 9 aa, Plasmodium falciparum
EGKKKEWDA

SEQ ID NO: 3308401 - protein, 8 aa, Plasmodium falciparum
EGKKKQKL

SEQ ID NO: 3308402 - protein, 4 aa, Plasmodium falciparum
EGKN

SEQ ID NO: 3308403 - protein, 5 aa, Plasmodium falciparum
EGKND

SEQ ID NO: 3308404 - protein, 9 aa, Plasmodium falciparum
EGKNKNTFS

SEQ ID NO: 3308405 - protein, 10 aa, Plasmodium falciparum
EGKNNNNYYH

SEQ ID NO: 3308406 - protein, 7 aa, Plasmodium falciparum
EGKNPIA

SEQ ID NO: 3308407 - protein, 7 aa, Plasmodium falciparum
EGKPDLD

SEQ ID NO: 3308408 - protein, 4 aa, Plasmodium falciparum
EGKQ

SEQ ID NO: 3308409 - protein, 16 aa, Plasmodium falciparum
EGKQDNEKENHINEPN

SEQ ID NO: 3308410 - protein, 4 aa, Plasmodium falciparum
EGKS

SEQ ID NO: 3308411 - protein, 6 aa, Plasmodium falciparum
EGKTLE

SEQ ID NO: 3308412 - protein, 16 aa, Plasmodium falciparum
EGKVYDKNKNPRHLRP

SEQ ID NO: 3308413 - protein, 5 aa, Plasmodium falciparum
EGKYE

SEQ ID NO: 3308414 - protein, 9 aa, Plasmodium falciparum
EGKYEPYEQ

SEQ ID NO: 3308415 - protein, 14 aa, Plasmodium falciparum
EGKYKTGKNKQNDM

SEQ ID NO: 3308416 - protein, 6 aa, Plasmodium falciparum
EGKYQD

SEQ ID NO: 3308417 - protein, 12 aa, Plasmodium falciparum
EGLKSSSTSKGI

SEQ ID NO: 3308418 - protein, 9 aa, Plasmodium falciparum
EGLLNSSSV

SEQ ID NO: 3308419 - protein, 10 aa, Plasmodium falciparum
EGLNNKINNE

SEQ ID NO: 3308420 - protein, 6 aa, Plasmodium falciparum
EGLSNS

SEQ ID NO: 3308421 - protein, 18 aa, Plasmodium falciparum
EGMDTYGGQISPNEKKIS

SEQ ID NO: 3308422 - protein, 12 aa, Plasmodium falciparum
EGMPSSKYPSMK

SEQ ID NO: 3308423 - protein, 18 aa, Plasmodium falciparum
EGNDNVEREMDDKENDNV

SEQ ID NO: 3308424 - protein, 7 aa, Plasmodium falciparum
EGNDPTS

SEQ ID NO: 3308425 - protein, 60 aa, Plasmodium falciparum
EGNEDLESEVNEENQNEENESEENESVENESVENESEENVNEENVNEENKNEENKNKDNM

SEQ ID NO: 3308426 - protein, 10 aa, Plasmodium falciparum
EGNEKSQEGD

SEQ ID NO: 3308427 - protein, 6 aa, Plasmodium falciparum
EGNENY

SEQ ID NO: 3308428 - protein, 6 aa, Plasmodium falciparum
EGNKEI

SEQ ID NO: 3308429 - protein, 4 aa, Plasmodium falciparum
EGNN

SEQ ID NO: 3308430 - protein, 14 aa, Plasmodium falciparum
EGNNDYKNKNYEKA

SEQ ID NO: 3308431 - protein, 8 aa, Plasmodium falciparum
EGNNEEDE

SEQ ID NO: 3308432 - protein, 5 aa, Plasmodium falciparum
EGNNG

SEQ ID NO: 3308433 - protein, 10 aa, Plasmodium falciparum
EGNNVGNKNV

SEQ ID NO: 3308434 - protein, 4 aa, Plasmodium falciparum
EGNS

SEQ ID NO: 3308435 - protein, 8 aa, Plasmodium falciparum
EGNSSDTF

SEQ ID NO: 3308436 - protein, 7 aa, Plasmodium falciparum
EGPDTEK

SEQ ID NO: 3308437 - protein, 16 aa, Plasmodium falciparum
EGPISNTKEPTGESES

SEQ ID NO: 3308438 - protein, 5 aa, Plasmodium falciparum
EGPNK

SEQ ID NO: 3308439 - protein, 6 aa, Plasmodium falciparum
EGPNTT

SEQ ID NO: 3308440 - protein, 4 aa, Plasmodium falciparum
EGPR

SEQ ID NO: 3308441 - protein, 9 aa, Plasmodium falciparum
EGPTTETKG

SEQ ID NO: 3308442 - protein, 8 aa, Plasmodium falciparum
EGQEERDK

SEQ ID NO: 3308443 - protein, 8 aa, Plasmodium falciparum
EGQGNKEI

SEQ ID NO: 3308444 - protein, 4 aa, Plasmodium falciparum
EGQI

SEQ ID NO: 3308445 - protein, 4 aa, Plasmodium falciparum
EGQN

SEQ ID NO: 3308446 - protein, 5 aa, Plasmodium falciparum
EGQNG

SEQ ID NO: 3308447 - protein, 8 aa, Plasmodium falciparum
EGQNKAKE

SEQ ID NO: 3308448 - protein, 8 aa, Plasmodium falciparum
EGQTRERP

SEQ ID NO: 3308449 - protein, 6 aa, Plasmodium falciparum
EGRAYD

SEQ ID NO: 3308450 - protein, 4 aa, Plasmodium falciparum
EGRC

SEQ ID NO: 3308451 - protein, 18 aa, Plasmodium falciparum
EGRESSEEKNSGKQKYAY

SEQ ID NO: 3308452 - protein, 8 aa, Plasmodium falciparum
EGRGNGIR

SEQ ID NO: 3308453 - protein, 13 aa, Plasmodium falciparum
EGRKINDDVNNGM

SEQ ID NO: 3308454 - protein, 5 aa, Plasmodium falciparum
EGRNN

SEQ ID NO: 3308455 - protein, 9 aa, Plasmodium falciparum
EGRSRNHEH

SEQ ID NO: 3308456 - protein, 6 aa, Plasmodium falciparum
EGSFTS

SEQ ID NO: 3308457 - protein, 14 aa, Plasmodium falciparum
EGSNKNEEGYSNTD

SEQ ID NO: 3308458 - protein, 9 aa, Plasmodium falciparum
EGSNNHGVS

SEQ ID NO: 3308459 - protein, 6 aa, Plasmodium falciparum
EGSQKL

SEQ ID NO: 3308460 - protein, 56 aa, Plasmodium falciparum
EGSSDYSEDMKSDADNHTQEDDTGKEQITNNNSKTPKKKKGKKNIDEKNSEEEEKL

SEQ ID NO: 3308461 - protein, 6 aa, Plasmodium falciparum
EGSTTN

SEQ ID NO: 3308462 - protein, 4 aa, Plasmodium falciparum
EGSY

SEQ ID NO: 3308463 - protein, 5 aa, Plasmodium falciparum
EGSYG

SEQ ID NO: 3308464 - protein, 5 aa, Plasmodium falciparum
EGTCK

SEQ ID NO: 3308465 - protein, 5 aa, Plasmodium falciparum
EGTDR

SEQ ID NO: 3308466 - protein, 7 aa, Plasmodium falciparum
EGTEDNT

SEQ ID NO: 3308467 - protein, 6 aa, Plasmodium falciparum
EGTEFR

SEQ ID NO: 3308468 - protein, 8 aa, Plasmodium falciparum
EGTERAKR

SEQ ID NO: 3308469 - protein, 9 aa, Plasmodium falciparum
EGTKQKKRK

SEQ ID NO: 3308470 - protein, 5 aa, Plasmodium falciparum
EGTNA

SEQ ID NO: 3308471 - protein, 7 aa, Plasmodium falciparum
EGTNDDL

SEQ ID NO: 3308472 - protein, 5 aa, Plasmodium falciparum
EGTNS

SEQ ID NO: 3308473 - protein, 6 aa, Plasmodium falciparum
EGTPSV

SEQ ID NO: 3308474 - protein, 14 aa, Plasmodium falciparum
EGTQEISNPFITEE

SEQ ID NO: 3308475 - protein, 10 aa, Plasmodium falciparum
EGTSTSSLGI

SEQ ID NO: 3308476 - protein, 29 aa, Plasmodium falciparum
EGTTNNLPKKKKRNKKNKKKNNENNEEVA

SEQ ID NO: 3308477 - protein, 4 aa, Plasmodium falciparum
EGTY

SEQ ID NO: 3308478 - protein, 11 aa, Plasmodium falciparum
EGTYESLRKGS

SEQ ID NO: 3308479 - protein, 6 aa, Plasmodium falciparum
EGTYSQ

SEQ ID NO: 3308480 - protein, 16 aa, Plasmodium falciparum
EGVDSNHNNKNNKKEL

SEQ ID NO: 3308481 - protein, 48 aa, Plasmodium falciparum
EGVGSSSSSKLTKESSDKKQNKNKHKQLKESDNNNNNMNNSYNGGNNK

SEQ ID NO: 3308482 - protein, 12 aa, Plasmodium falciparum
EGVNESVSENIN

SEQ ID NO: 3308483 - protein, 4 aa, Plasmodium falciparum
EGVQ

SEQ ID NO: 3308484 - protein, 8 aa, Plasmodium falciparum
EGVSNNSI

SEQ ID NO: 3308485 - protein, 7 aa, Plasmodium falciparum
EGVYEES

SEQ ID NO: 3308486 - protein, 5 aa, Plasmodium falciparum
EGYAP

SEQ ID NO: 3308487 - protein, 11 aa, Plasmodium falciparum
EGYNPKDATNL

SEQ ID NO: 3308488 - protein, 4 aa, Plasmodium falciparum
EGYS

SEQ ID NO: 3308489 - protein, 10 aa, Plasmodium falciparum
EGYVQSDEKK

SEQ ID NO: 3308490 - protein, 19 aa, Plasmodium falciparum
EHAGTTDKEEEDNENITHG

SEQ ID NO: 3308491 - protein, 5 aa, Plasmodium falciparum
EHAPS

SEQ ID NO: 3308492 - protein, 4 aa, Plasmodium falciparum
EHDA

SEQ ID NO: 3308493 - protein, 6 aa, Plasmodium falciparum
EHDAKT

SEQ ID NO: 3308494 - protein, 11 aa, Plasmodium falciparum
EHDDGDKTENN

SEQ ID NO: 3308495 - protein, 4 aa, Plasmodium falciparum
EHDE

SEQ ID NO: 3308496 - protein, 8 aa, Plasmodium falciparum
EHDEEEQN

SEQ ID NO: 3308497 - protein, 9 aa, Plasmodium falciparum
EHDEGFPDS

SEQ ID NO: 3308498 - protein, 4 aa, Plasmodium falciparum
EHDP

SEQ ID NO: 3308499 - protein, 5 aa, Plasmodium falciparum
EHDQK

SEQ ID NO: 3308500 - protein, 13 aa, Plasmodium falciparum
EHDQYTKNHNNHS

SEQ ID NO: 3308501 - protein, 5 aa, Plasmodium falciparum
EHDVE

SEQ ID NO: 3308502 - protein, 25 aa, Plasmodium falciparum
EHEDIKKKKRKKEYKEEKHGAKEGF

SEQ ID NO: 3308503 - protein, 17 aa, Plasmodium falciparum
EHEDPTKNVRKNSNAKV

SEQ ID NO: 3308504 - protein, 7 aa, Plasmodium falciparum
EHEENNN

SEQ ID NO: 3308505 - protein, 39 aa, Plasmodium falciparum
EHEEQDDEYDEDDDEYDEDDGKYDEDDDEYDEDDDDDDL

SEQ ID NO: 3308506 - protein, 6 aa, Plasmodium falciparum
EHEGPV

SEQ ID NO: 3308507 - protein, 14 aa, Plasmodium falciparum
EHEKAENEKMEKEE

SEQ ID NO: 3308508 - protein, 7 aa, Plasmodium falciparum
EHEKRLQ

SEQ ID NO: 3308509 - protein, 10 aa, Plasmodium falciparum
EHEKTKEDRT

SEQ ID NO: 3308510 - protein, 12 aa, Plasmodium falciparum
EHENEKKKFDSI

SEQ ID NO: 3308511 - protein, 5 aa, Plasmodium falciparum
EHENK

SEQ ID NO: 3308512 - protein, 42 aa, Plasmodium falciparum
EHENLTKGEEEKEGIDNEKYEQNEKYEQNEQNEESGNHKNNN

SEQ ID NO: 3308513 - protein, 13 aa, Plasmodium falciparum
EHEQNGKEEETNG

SEQ ID NO: 3308514 - protein, 8 aa, Plasmodium falciparum
EHETTDGK

SEQ ID NO: 3308515 - protein, 12 aa, Plasmodium falciparum
EHFDQSKKNSSF

SEQ ID NO: 3308516 - protein, 5 aa, Plasmodium falciparum
EHFSK

SEQ ID NO: 3308517 - protein, 11 aa, Plasmodium falciparum
EHGHSASLNDD

SEQ ID NO: 3308518 - protein, 5 aa, Plasmodium falciparum
EHGNN

SEQ ID NO: 3308519 - protein, 4 aa, Plasmodium falciparum
EHIE

SEQ ID NO: 3308520 - protein, 9 aa, Plasmodium falciparum
EHIKNGNSL

SEQ ID NO: 3308521 - protein, 4 aa, Plasmodium falciparum
EHIN

SEQ ID NO: 3308522 - protein, 30 aa, Plasmodium falciparum
EHISSDKENSPNNNNNNDLKKHKKRNEKSV

SEQ ID NO: 3308523 - protein, 18 aa, Plasmodium falciparum
EHISTKGDIHDESFSRDD

SEQ ID NO: 3308524 - protein, 5 aa, Plasmodium falciparum
EHKDK

SEQ ID NO: 3308525 - protein, 8 aa, Plasmodium falciparum
EHKEEEKQ

SEQ ID NO: 3308526 - protein, 25 aa, Plasmodium falciparum
EHKENQKNEHENEYHNDNPSEENDN

SEQ ID NO: 3308527 - protein, 18 aa, Plasmodium falciparum
EHKETNDEKQPTKKRKQD

SEQ ID NO: 3308528 - protein, 4 aa, Plasmodium falciparum
EHKG

SEQ ID NO: 3308529 - protein, 7 aa, Plasmodium falciparum
EHKKEED

SEQ ID NO: 3308530 - protein, 8 aa, Plasmodium falciparum
EHKKGNSR

SEQ ID NO: 3308531 - protein, 6 aa, Plasmodium falciparum
EHKKLT

SEQ ID NO: 3308532 - protein, 8 aa, Plasmodium falciparum
EHKNEDIT

SEQ ID NO: 3308533 - protein, 52 aa, Plasmodium falciparum
EHKNERINEEHKNERINEEHKNEGINEEHKNEGINEEHKNERINEEHKNEGI

SEQ ID NO: 3308534 - protein, 13 aa, Plasmodium falciparum
EHKVNRKSDEHIK

SEQ ID NO: 3308535 - protein, 5 aa, Plasmodium falciparum
EHLDE

SEQ ID NO: 3308536 - protein, 13 aa, Plasmodium falciparum
EHLQSGKNEGDQF

SEQ ID NO: 3308537 - protein, 5 aa, Plasmodium falciparum
EHMQD

SEQ ID NO: 3308538 - protein, 18 aa, Plasmodium falciparum
EHNDSKADHTESTCDQKT

SEQ ID NO: 3308539 - protein, 7 aa, Plasmodium falciparum
EHNEERE

SEQ ID NO: 3308540 - protein, 15 aa, Plasmodium falciparum
EHNENDKEKEQRYNN

SEQ ID NO: 3308541 - protein, 10 aa, Plasmodium falciparum
EHNETNNENY

SEQ ID NO: 3308542 - protein, 100 aa, Plasmodium falciparum
EHNGNHGNNENDNNDNNNNNKNDNNNNDTTNNNNNNDNNDNNNNNNNNNNNNNNNNNNSGDDSSDDNNNEESMKKRRKEKNKKKKKFNKNISGKRKNNYS

SEQ ID NO: 3308543 - protein, 14 aa, Plasmodium falciparum
EHNIESDHNSYTNS

SEQ ID NO: 3308544 - protein, 13 aa, Plasmodium falciparum
EHNIQSDNKKRYY

SEQ ID NO: 3308545 - protein, 5 aa, Plasmodium falciparum
EHNKK

SEQ ID NO: 3308546 - protein, 9 aa, Plasmodium falciparum
EHNKKRKEL

SEQ ID NO: 3308547 - protein, 7 aa, Plasmodium falciparum
EHNKSEH

SEQ ID NO: 3308548 - protein, 12 aa, Plasmodium falciparum
EHNKTKDMDNNL

SEQ ID NO: 3308549 - protein, 16 aa, Plasmodium falciparum
EHNNNHTDKGNNEDIN

SEQ ID NO: 3308550 - protein, 18 aa, Plasmodium falciparum
EHNNNNNKSIRNQNDEND

SEQ ID NO: 3308551 - protein, 9 aa, Plasmodium falciparum
EHNNSLEDS

SEQ ID NO: 3308552 - protein, 33 aa, Plasmodium falciparum
EHNNYNDNIRNNKKGINNNNNNNNNNNNSTYVN

SEQ ID NO: 3308553 - protein, 8 aa, Plasmodium falciparum
EHNNYSND

SEQ ID NO: 3308554 - protein, 7 aa, Plasmodium falciparum
EHNPNNA

SEQ ID NO: 3308555 - protein, 5 aa, Plasmodium falciparum
EHNTT

SEQ ID NO: 3308556 - protein, 6 aa, Plasmodium falciparum
EHPDDL

SEQ ID NO: 3308557 - protein, 17 aa, Plasmodium falciparum
EHPECDTDNIEKDEIEK

SEQ ID NO: 3308558 - protein, 22 aa, Plasmodium falciparum
EHPPTKHDNNNNNNDNNNNNIN

SEQ ID NO: 3308559 - protein, 7 aa, Plasmodium falciparum
EHPTNPF

SEQ ID NO: 3308560 - protein, 7 aa, Plasmodium falciparum
EHPTRIS

SEQ ID NO: 3308561 - protein, 11 aa, Plasmodium falciparum
EHQGKGDTTKT

SEQ ID NO: 3308562 - protein, 5 aa, Plasmodium falciparum
EHQKN

SEQ ID NO: 3308563 - protein, 6 aa, Plasmodium falciparum
EHQTLE

SEQ ID NO: 3308564 - protein, 23 aa, Plasmodium falciparum
EHREYEEEQIEKSRNKEGEKEYE

SEQ ID NO: 3308565 - protein, 4 aa, Plasmodium falciparum
EHRN

SEQ ID NO: 3308566 - protein, 9 aa, Plasmodium falciparum
EHSKTNPNF

SEQ ID NO: 3308567 - protein, 10 aa, Plasmodium falciparum
EHSKYKDDNQ

SEQ ID NO: 3308568 - protein, 12 aa, Plasmodium falciparum
EHSNTSRNTNIN

SEQ ID NO: 3308569 - protein, 25 aa, Plasmodium falciparum
EHSSTKTQDNNPYNNSTCRNKNNIS

SEQ ID NO: 3308570 - protein, 8 aa, Plasmodium falciparum
EHSTDEQE

SEQ ID NO: 3308571 - protein, 8 aa, Plasmodium falciparum
EHTDDKKG

SEQ ID NO: 3308572 - protein, 15 aa, Plasmodium falciparum
EHTIDGKDATNEHAY

SEQ ID NO: 3308573 - protein, 33 aa, Plasmodium falciparum
EHTKGDKSFDGNNKSFDGNNKSFDGNNKTSYCN

SEQ ID NO: 3308574 - protein, 11 aa, Plasmodium falciparum
EHTKINEKKCK

SEQ ID NO: 3308575 - protein, 4 aa, Plasmodium falciparum
EHTN

SEQ ID NO: 3308576 - protein, 66 aa, Plasmodium falciparum
EHTNKKEDGDDDDGDDDDGDDDDDDDDDDGDDDGDDDGDDDGDDGDDDSNSNDDIKNNHKYNNDDY

SEQ ID NO: 3308577 - protein, 8 aa, Plasmodium falciparum
EHTNNPSD

SEQ ID NO: 3308578 - protein, 4 aa, Plasmodium falciparum
EHTR

SEQ ID NO: 3308579 - protein, 23 aa, Plasmodium falciparum
EHVDGNKNKNVDGNKNKNVDGNK

SEQ ID NO: 3308580 - protein, 13 aa, Plasmodium falciparum
EHVSDKNSKIYDP

SEQ ID NO: 3308581 - protein, 28 aa, Plasmodium falciparum
EHYEENNNDYYKGREKIGTQSKGTEDSV

SEQ ID NO: 3308582 - protein, 10 aa, Plasmodium falciparum
EHYEKSPEQV

SEQ ID NO: 3308583 - protein, 9 aa, Plasmodium falciparum
EIAGKNKGI

SEQ ID NO: 3308584 - protein, 4 aa, Plasmodium falciparum
EIDD

SEQ ID NO: 3308585 - protein, 73 aa, Plasmodium falciparum
EIDDNDDNDDGDDDGDDDDEDEDEDSDDNDDEDNDEDEDNDDNDDNDDSDNNDDDHNDVKKSSKNKKKNNEEM

SEQ ID NO: 3308586 - protein, 14 aa, Plasmodium falciparum
EIDDNNKKEKLKNS

SEQ ID NO: 3308587 - protein, 7 aa, Plasmodium falciparum
EIDENDI

SEQ ID NO: 3308588 - protein, 16 aa, Plasmodium falciparum
EIDGKNKKNNKRLKRS

SEQ ID NO: 3308589 - protein, 5 aa, Plasmodium falciparum
EIDKN

SEQ ID NO: 3308590 - protein, 8 aa, Plasmodium falciparum
EIDNDKNN

SEQ ID NO: 3308591 - protein, 24 aa, Plasmodium falciparum
EIDPAPESKPARADPVDMDEDEKE

SEQ ID NO: 3308592 - protein, 7 aa, Plasmodium falciparum
EIDQKKK

SEQ ID NO: 3308593 - protein, 7 aa, Plasmodium falciparum
EIDQQYK

SEQ ID NO: 3308594 - protein, 4 aa, Plasmodium falciparum
EIDR

SEQ ID NO: 3308595 - protein, 5 aa, Plasmodium falciparum
EIDSN

SEQ ID NO: 3308596 - protein, 27 aa, Plasmodium falciparum
EIDSNDDNNNHNDNNNKRSHSKGDQDA

SEQ ID NO: 3308597 - protein, 11 aa, Plasmodium falciparum
EIEDNAGDNIK

SEQ ID NO: 3308598 - protein, 10 aa, Plasmodium falciparum
EIEDNTESAH

SEQ ID NO: 3308599 - protein, 18 aa, Plasmodium falciparum
EIEEEKKLEQQKIQQDKA

SEQ ID NO: 3308600 - protein, 14 aa, Plasmodium falciparum
EIEEKKAQEESKIE

SEQ ID NO: 3308601 - protein, 5 aa, Plasmodium falciparum
EIEEN

SEQ ID NO: 3308602 - protein, 6 aa, Plasmodium falciparum
EIEENQ

SEQ ID NO: 3308603 - protein, 6 aa, Plasmodium falciparum
EIEEPS

SEQ ID NO: 3308604 - protein, 29 aa, Plasmodium falciparum
EIEESQNDITNVKEEDTIDNQDTFENEKE

SEQ ID NO: 3308605 - protein, 5 aa, Plasmodium falciparum
EIEKD

SEQ ID NO: 3308606 - protein, 6 aa, Plasmodium falciparum
EIEKDE

SEQ ID NO: 3308607 - protein, 28 aa, Plasmodium falciparum
EIEKDGEEKEEEEDDKNEEVEEQNEEVV

SEQ ID NO: 3308608 - protein, 20 aa, Plasmodium falciparum
EIEKKNEAKIDTEKNIRDSK

SEQ ID NO: 3308609 - protein, 6 aa, Plasmodium falciparum
EIEKKR

SEQ ID NO: 3308610 - protein, 19 aa, Plasmodium falciparum
EIENKNKEKDNTPRSCNDY

SEQ ID NO: 3308611 - protein, 5 aa, Plasmodium falciparum
EIEQS

SEQ ID NO: 3308612 - protein, 10 aa, Plasmodium falciparum
EIERNSQNSI

SEQ ID NO: 3308613 - protein, 13 aa, Plasmodium falciparum
EIETTNNDNNNMN

SEQ ID NO: 3308614 - protein, 4 aa, Plasmodium falciparum
EIEV

SEQ ID NO: 3308615 - protein, 8 aa, Plasmodium falciparum
EIEVEEKR

SEQ ID NO: 3308616 - protein, 5 aa, Plasmodium falciparum
EIGKK

SEQ ID NO: 3308617 - protein, 14 aa, Plasmodium falciparum
EIGNDKNKKNENTY

SEQ ID NO: 3308618 - protein, 12 aa, Plasmodium falciparum
EIGNEEHNRKNK

SEQ ID NO: 3308619 - protein, 19 aa, Plasmodium falciparum
EIGNEEKNQDEDNTKNNYM

SEQ ID NO: 3308620 - protein, 12 aa, Plasmodium falciparum
EIHTNNENNYVG

SEQ ID NO: 3308621 - protein, 22 aa, Plasmodium falciparum
EIIQNGSDEIVQNGSDEIIQNG

SEQ ID NO: 3308622 - protein, 10 aa, Plasmodium falciparum
EIKEDEEKEF

SEQ ID NO: 3308623 - protein, 7 aa, Plasmodium falciparum
EIKEDEK

SEQ ID NO: 3308624 - protein, 6 aa, Plasmodium falciparum
EIKENS

SEQ ID NO: 3308625 - protein, 25 aa, Plasmodium falciparum
EIKKKSDNSDFKKSAQKKNKKNEEN

SEQ ID NO: 3308626 - protein, 5 aa, Plasmodium falciparum
EIKKS

SEQ ID NO: 3308627 - protein, 6 aa, Plasmodium falciparum
EIKKTS

SEQ ID NO: 3308628 - protein, 7 aa, Plasmodium falciparum
EIKNAEE

SEQ ID NO: 3308629 - protein, 13 aa, Plasmodium falciparum
EIKNEKNNTRVEK

SEQ ID NO: 3308630 - protein, 30 aa, Plasmodium falciparum
EIKNETEKEKTENVNESTDKKENVEEEKND

SEQ ID NO: 3308631 - protein, 13 aa, Plasmodium falciparum
EIKNGEGKIKNGE

SEQ ID NO: 3308632 - protein, 33 aa, Plasmodium falciparum
EIKNKQDEIDDKKKTIEKKKKKIEEKQKEIEQI

SEQ ID NO: 3308633 - protein, 5 aa, Plasmodium falciparum
EIKNN

SEQ ID NO: 3308634 - protein, 7 aa, Plasmodium falciparum
EIKQNND

SEQ ID NO: 3308635 - protein, 25 aa, Plasmodium falciparum
EIKSDDQENDTTEIQNNEHYEESNI

SEQ ID NO: 3308636 - protein, 8 aa, Plasmodium falciparum
EIKSDDSK

SEQ ID NO: 3308637 - protein, 10 aa, Plasmodium falciparum
EIKSDDSNSL

SEQ ID NO: 3308638 - protein, 5 aa, Plasmodium falciparum
EILPE

SEQ ID NO: 3308639 - protein, 5 aa, Plasmodium falciparum
EILPN

SEQ ID NO: 3308640 - protein, 4 aa, Plasmodium falciparum
EILQ

SEQ ID NO: 3308641 - protein, 6 aa, Plasmodium falciparum
EINANK

SEQ ID NO: 3308642 - protein, 7 aa, Plasmodium falciparum
EINDDMK

SEQ ID NO: 3308643 - protein, 6 aa, Plasmodium falciparum
EINDNR

SEQ ID NO: 3308644 - protein, 21 aa, Plasmodium falciparum
EINDSNENKLSNDEKDTKPIK

SEQ ID NO: 3308645 - protein, 5 aa, Plasmodium falciparum
EINED

SEQ ID NO: 3308646 - protein, 11 aa, Plasmodium falciparum
EINEQERRDGE

SEQ ID NO: 3308647 - protein, 11 aa, Plasmodium falciparum
EINEQNKKDLE

SEQ ID NO: 3308648 - protein, 8 aa, Plasmodium falciparum
EINEYSNE

SEQ ID NO: 3308649 - protein, 13 aa, Plasmodium falciparum
EINIKNDRTNKSF

SEQ ID NO: 3308650 - protein, 10 aa, Plasmodium falciparum
EINKKHHQGH

SEQ ID NO: 3308651 - protein, 10 aa, Plasmodium falciparum
EINKKTDGKV

SEQ ID NO: 3308652 - protein, 9 aa, Plasmodium falciparum
EINKSEEQK

SEQ ID NO: 3308653 - protein, 11 aa, Plasmodium falciparum
EINKSGSTSRI

SEQ ID NO: 3308654 - protein, 7 aa, Plasmodium falciparum
EINKSRS

SEQ ID NO: 3308655 - protein, 4 aa, Plasmodium falciparum
EINN

SEQ ID NO: 3308656 - protein, 12 aa, Plasmodium falciparum
EINNDKKKDENI

SEQ ID NO: 3308657 - protein, 11 aa, Plasmodium falciparum
EINNERNEDQY

SEQ ID NO: 3308658 - protein, 6 aa, Plasmodium falciparum
EINNET

SEQ ID NO: 3308659 - protein, 13 aa, Plasmodium falciparum
EINNKKRKDCTYS

SEQ ID NO: 3308660 - protein, 7 aa, Plasmodium falciparum
EINNKSP

SEQ ID NO: 3308661 - protein, 7 aa, Plasmodium falciparum
EINNNRT

SEQ ID NO: 3308662 - protein, 43 aa, Plasmodium falciparum
EINNTNKKNTQKNKKDYDNTIEENCESNRYNQNINSPNKSIDM

SEQ ID NO: 3308663 - protein, 5 aa, Plasmodium falciparum
EINNY

SEQ ID NO: 3308664 - protein, 91 aa, Plasmodium falciparum
EINPMDDENNYDDHDDEQMDSDSDESDSYYTNNDDSNNYSDETDDYYGDEKKKKKKKKTKKKKKKKNSTKKKKKKKKNKINNNNKKNKHNN

SEQ ID NO: 3308665 - protein, 6 aa, Plasmodium falciparum
EINQND

SEQ ID NO: 3308666 - protein, 5 aa, Plasmodium falciparum
EINQT

SEQ ID NO: 3308667 - protein, 7 aa, Plasmodium falciparum
EINRKEK

SEQ ID NO: 3308668 - protein, 22 aa, Plasmodium falciparum
EINTYEKNSTFSNNNDMETNDQ

SEQ ID NO: 3308669 - protein, 44 aa, Plasmodium falciparum
EIPDDPNNSLDNTENSEHMNTNNNSDQNEKLKSEDQNNINNEQE

SEQ ID NO: 3308670 - protein, 26 aa, Plasmodium falciparum
EIPDEQEDNINDNKNENKNKNKNKNI

SEQ ID NO: 3308671 - protein, 6 aa, Plasmodium falciparum
EIPEKR

SEQ ID NO: 3308672 - protein, 4 aa, Plasmodium falciparum
EIPN

SEQ ID NO: 3308673 - protein, 12 aa, Plasmodium falciparum
EIPNYKNKNNNI

SEQ ID NO: 3308674 - protein, 7 aa, Plasmodium falciparum
EIPPDEY

SEQ ID NO: 3308675 - protein, 7 aa, Plasmodium falciparum
EIPTPNR

SEQ ID NO: 3308676 - protein, 7 aa, Plasmodium falciparum
EIQKSYS

SEQ ID NO: 3308677 - protein, 4 aa, Plasmodium falciparum
EIQN

SEQ ID NO: 3308678 - protein, 12 aa, Plasmodium falciparum
EIQNDDGKKEDD

SEQ ID NO: 3308679 - protein, 91 aa, Plasmodium falciparum
EIQNDTTTTTTTNNNNNNNNNNNNNNNNNNINNNNINNNNINNNNNNNNNNNINNNNINNNNINNNNNNNNNNNYYDRTNDGNFSNGKKKN

SEQ ID NO: 3308680 - protein, 11 aa, Plasmodium falciparum
EIQNSEKSEYF

SEQ ID NO: 3308681 - protein, 14 aa, Plasmodium falciparum
EIQSKTLEKSINDK

SEQ ID NO: 3308682 - protein, 8 aa, Plasmodium falciparum
EIRNTSGS

SEQ ID NO: 3308683 - protein, 6 aa, Plasmodium falciparum
EISASH

SEQ ID NO: 3308684 - protein, 5 aa, Plasmodium falciparum
EISDE

SEQ ID NO: 3308685 - protein, 29 aa, Plasmodium falciparum
EISDEETNDLSNDDNMAKNQNVDNDQYNN

SEQ ID NO: 3308686 - protein, 5 aa, Plasmodium falciparum
EISDK

SEQ ID NO: 3308687 - protein, 17 aa, Plasmodium falciparum
EISDKFTKQNQRKDTSF

SEQ ID NO: 3308688 - protein, 5 aa, Plasmodium falciparum
EISDT

SEQ ID NO: 3308689 - protein, 7 aa, Plasmodium falciparum
EISEKSN

SEQ ID NO: 3308690 - protein, 7 aa, Plasmodium falciparum
EISGKNL

SEQ ID NO: 3308691 - protein, 24 aa, Plasmodium falciparum
EISNDKDNHEHMKNEKKKKKDHSN

SEQ ID NO: 3308692 - protein, 8 aa, Plasmodium falciparum
EISNERND

SEQ ID NO: 3308693 - protein, 26 aa, Plasmodium falciparum
EISNNNISNEYNKQISEKYTDKKYET

SEQ ID NO: 3308694 - protein, 10 aa, Plasmodium falciparum
EISNTSENMR

SEQ ID NO: 3308695 - protein, 9 aa, Plasmodium falciparum
EISPETNSV

SEQ ID NO: 3308696 - protein, 6 aa, Plasmodium falciparum
EISPHH

SEQ ID NO: 3308697 - protein, 11 aa, Plasmodium falciparum
EISRQNNKKGV

SEQ ID NO: 3308698 - protein, 4 aa, Plasmodium falciparum
EISS

SEQ ID NO: 3308699 - protein, 5 aa, Plasmodium falciparum
EISTE

SEQ ID NO: 3308700 - protein, 31 aa, Plasmodium falciparum
EISTTNDVNNVPRESISSNNKKRKVLQQTLL

SEQ ID NO: 3308701 - protein, 6 aa, Plasmodium falciparum
EITDKG

SEQ ID NO: 3308702 - protein, 48 aa, Plasmodium falciparum
EITDKKNNNMSNNNNNNNNDSYNNNNSYNNNNSYNNNDSYSYNNNNSY

SEQ ID NO: 3308703 - protein, 6 aa, Plasmodium falciparum
EITGGN

SEQ ID NO: 3308704 - protein, 6 aa, Plasmodium falciparum
EITNEK

SEQ ID NO: 3308705 - protein, 7 aa, Plasmodium falciparum
EITNEYN

SEQ ID NO: 3308706 - protein, 5 aa, Plasmodium falciparum
EITNK

SEQ ID NO: 3308707 - protein, 20 aa, Plasmodium falciparum
EITNNSNQKKNKDNKQNVLS

SEQ ID NO: 3308708 - protein, 8 aa, Plasmodium falciparum
EITPQPSN

SEQ ID NO: 3308709 - protein, 5 aa, Plasmodium falciparum
EITQE

SEQ ID NO: 3308710 - protein, 5 aa, Plasmodium falciparum
EITSE

SEQ ID NO: 3308711 - protein, 5 aa, Plasmodium falciparum
EIYEN

SEQ ID NO: 3308712 - protein, 12 aa, Plasmodium falciparum
EIYENNKKNNLD

SEQ ID NO: 3308713 - protein, 17 aa, Plasmodium falciparum
EIYNEGNEKCDTYDKND

SEQ ID NO: 3308714 - protein, 24 aa, Plasmodium falciparum
EIYSNKKDNDLRERTQDDKHTKQK

SEQ ID NO: 3308715 - protein, 8 aa, Plasmodium falciparum
EIYSSGPL

SEQ ID NO: 3308716 - protein, 7 aa, Plasmodium falciparum
EKAALPN

SEQ ID NO: 3308717 - protein, 32 aa, Plasmodium falciparum
EKADMENNTINEGNNNNNNNNNGNNNNNGSNY

SEQ ID NO: 3308718 - protein, 4 aa, Plasmodium falciparum
EKAE

SEQ ID NO: 3308719 - protein, 56 aa, Plasmodium falciparum
EKAEKYKDGEKKDGEKNKDENSSKNKENDELANGNEENENDEVKKNDDEEASDGGD

SEQ ID NO: 3308720 - protein, 6 aa, Plasmodium falciparum
EKAFER

SEQ ID NO: 3308721 - protein, 10 aa, Plasmodium falciparum
EKAGDDNSQV

SEQ ID NO: 3308722 - protein, 4 aa, Plasmodium falciparum
EKAH

SEQ ID NO: 3308723 - protein, 6 aa, Plasmodium falciparum
EKAIKR

SEQ ID NO: 3308724 - protein, 38 aa, Plasmodium falciparum
EKAISDDNQNKNISKNIKKKKSSKNSNQMGEIKEEEKD

SEQ ID NO: 3308725 - protein, 4 aa, Plasmodium falciparum
EKAK

SEQ ID NO: 3308726 - protein, 9 aa, Plasmodium falciparum
EKAKENKNI

SEQ ID NO: 3308727 - protein, 9 aa, Plasmodium falciparum
EKAKGDGAN

SEQ ID NO: 3308728 - protein, 12 aa, Plasmodium falciparum
EKAKTNVEEKRS

SEQ ID NO: 3308729 - protein, 5 aa, Plasmodium falciparum
EKALQ

SEQ ID NO: 3308730 - protein, 6 aa, Plasmodium falciparum
EKANEY

SEQ ID NO: 3308731 - protein, 8 aa, Plasmodium falciparum
EKANQEKV

SEQ ID NO: 3308732 - protein, 25 aa, Plasmodium falciparum
EKAQKKKQNKNQKNLKKKNFKKEHN

SEQ ID NO: 3308733 - protein, 5 aa, Plasmodium falciparum
EKASW

SEQ ID NO: 3308734 - protein, 55 aa, Plasmodium falciparum
EKAVASKKEEKTARPTKPPKKVEQPPTGIRAPTRTPRAAPQARTRRSTPTTTASD

SEQ ID NO: 3308735 - protein, 4 aa, Plasmodium falciparum
EKCA

SEQ ID NO: 3308736 - protein, 5 aa, Plasmodium falciparum
EKCDK

SEQ ID NO: 3308737 - protein, 4 aa, Plasmodium falciparum
EKCE

SEQ ID NO: 3308738 - protein, 5 aa, Plasmodium falciparum
EKCEK

SEQ ID NO: 3308739 - protein, 9 aa, Plasmodium falciparum
EKCKSNDQL

SEQ ID NO: 3308740 - protein, 4 aa, Plasmodium falciparum
EKCN

SEQ ID NO: 3308741 - protein, 5 aa, Plasmodium falciparum
EKCPK

SEQ ID NO: 3308742 - protein, 13 aa, Plasmodium falciparum
EKCQNTQKDNNHN

SEQ ID NO: 3308743 - protein, 6 aa, Plasmodium falciparum
EKCSDT

SEQ ID NO: 3308744 - protein, 6 aa, Plasmodium falciparum
EKCSQY

SEQ ID NO: 3308745 - protein, 5 aa, Plasmodium falciparum
EKCSS

SEQ ID NO: 3308746 - protein, 7 aa, Plasmodium falciparum
EKCTDEK

SEQ ID NO: 3308747 - protein, 5 aa, Plasmodium falciparum
EKDAE

SEQ ID NO: 3308748 - protein, 5 aa, Plasmodium falciparum
EKDDF

SEQ ID NO: 3308749 - protein, 44 aa, Plasmodium falciparum
EKDDINEKNGQKLDAPSKKEDLTRSTMKDKDNENVDDKKEIPHR

SEQ ID NO: 3308750 - protein, 5 aa, Plasmodium falciparum
EKDDM

SEQ ID NO: 3308751 - protein, 6 aa, Plasmodium falciparum
EKDDNV

SEQ ID NO: 3308752 - protein, 8 aa, Plasmodium falciparum
EKDDSMGT

SEQ ID NO: 3308753 - protein, 8 aa, Plasmodium falciparum
EKDDTKNK

SEQ ID NO: 3308754 - protein, 4 aa, Plasmodium falciparum
EKDE

SEQ ID NO: 3308755 - protein, 6 aa, Plasmodium falciparum
EKDEDS

SEQ ID NO: 3308756 - protein, 7 aa, Plasmodium falciparum
EKDEEMK

SEQ ID NO: 3308757 - protein, 7 aa, Plasmodium falciparum
EKDEKLK

SEQ ID NO: 3308758 - protein, 24 aa, Plasmodium falciparum
EKDEKNEEINKAEEHVTDESSFEY

SEQ ID NO: 3308759 - protein, 5 aa, Plasmodium falciparum
EKDEN

SEQ ID NO: 3308760 - protein, 7 aa, Plasmodium falciparum
EKDENKM

SEQ ID NO: 3308761 - protein, 5 aa, Plasmodium falciparum
EKDGK

SEQ ID NO: 3308762 - protein, 7 aa, Plasmodium falciparum
EKDGYSS

SEQ ID NO: 3308763 - protein, 44 aa, Plasmodium falciparum
EKDINAKDEKMKENNKRHKQNIHDKNDNNYKQDEPSENAKQNIN

SEQ ID NO: 3308764 - protein, 6 aa, Plasmodium falciparum
EKDINE

SEQ ID NO: 3308765 - protein, 8 aa, Plasmodium falciparum
EKDIQKNY

SEQ ID NO: 3308766 - protein, 7 aa, Plasmodium falciparum
EKDISRQ

SEQ ID NO: 3308767 - protein, 4 aa, Plasmodium falciparum
EKDK

SEQ ID NO: 3308768 - protein, 7 aa, Plasmodium falciparum
EKDKDGN

SEQ ID NO: 3308769 - protein, 7 aa, Plasmodium falciparum
EKDKEHN

SEQ ID NO: 3308770 - protein, 30 aa, Plasmodium falciparum
EKDKEKKKDSNENRKKKQKEKDKKNPNDNK

SEQ ID NO: 3308771 - protein, 9 aa, Plasmodium falciparum
EKDKIQKQN

SEQ ID NO: 3308772 - protein, 6 aa, Plasmodium falciparum
EKDKND

SEQ ID NO: 3308773 - protein, 102 aa, Plasmodium falciparum
EKDKNDKHNYENNDELHPSVDARKNNEKNNEKNNEKNNEKNNEKNNEQNNEKNNEQNNEKNNEQNNEKNNEKNNEQKNEQKNQQKNQQNNEQTNQQNNQHNN

SEQ ID NO: 3308774 - protein, 21 aa, Plasmodium falciparum
EKDKTDDHNSNSYDNSNSNSN

SEQ ID NO: 3308775 - protein, 6 aa, Plasmodium falciparum
EKDKTR

SEQ ID NO: 3308776 - protein, 14 aa, Plasmodium falciparum
EKDKVENNNIYPNQ

SEQ ID NO: 3308777 - protein, 5 aa, Plasmodium falciparum
EKDKY

SEQ ID NO: 3308778 - protein, 5 aa, Plasmodium falciparum
EKDME

SEQ ID NO: 3308779 - protein, 15 aa, Plasmodium falciparum
EKDNLNQEINDKSEE

SEQ ID NO: 3308780 - protein, 27 aa, Plasmodium falciparum
EKDNNKKKKKNMTNTFEQDNNYNMNDN

SEQ ID NO: 3308781 - protein, 7 aa, Plasmodium falciparum
EKDNRKI

SEQ ID NO: 3308782 - protein, 8 aa, Plasmodium falciparum
EKDPKEEF

SEQ ID NO: 3308783 - protein, 25 aa, Plasmodium falciparum
EKDPLNNNSNSIKKNGQHMKDGDNK

SEQ ID NO: 3308784 - protein, 14 aa, Plasmodium falciparum
EKDPNRNVVPDASG

SEQ ID NO: 3308785 - protein, 8 aa, Plasmodium falciparum
EKDPSQIP

SEQ ID NO: 3308786 - protein, 9 aa, Plasmodium falciparum
EKDQAKRIE

SEQ ID NO: 3308787 - protein, 7 aa, Plasmodium falciparum
EKDQNIN

SEQ ID NO: 3308788 - protein, 8 aa, Plasmodium falciparum
EKDREYNE

SEQ ID NO: 3308789 - protein, 40 aa, Plasmodium falciparum
EKDSPENNMNENNNMNNNNNNEKDSPQNNNDNTSKSKTRK

SEQ ID NO: 3308790 - protein, 11 aa, Plasmodium falciparum
EKDSVEDSKEL

SEQ ID NO: 3308791 - protein, 9 aa, Plasmodium falciparum
EKDSYRSPY

SEQ ID NO: 3308792 - protein, 5 aa, Plasmodium falciparum
EKDTC

SEQ ID NO: 3308793 - protein, 8 aa, Plasmodium falciparum
EKDTKHRR

SEQ ID NO: 3308794 - protein, 9 aa, Plasmodium falciparum
EKDTKTKDL

SEQ ID NO: 3308795 - protein, 6 aa, Plasmodium falciparum
EKDTNA

SEQ ID NO: 3308796 - protein, 34 aa, Plasmodium falciparum
EKDVNTNKGEQNVTDVQNNKNNQQDDELDNLEDF

SEQ ID NO: 3308797 - protein, 5 aa, Plasmodium falciparum
EKDYA

SEQ ID NO: 3308798 - protein, 7 aa, Plasmodium falciparum
EKEAAIE

SEQ ID NO: 3308799 - protein, 9 aa, Plasmodium falciparum
EKEACEDKI

SEQ ID NO: 3308800 - protein, 7 aa, Plasmodium falciparum
EKEADED

SEQ ID NO: 3308801 - protein, 9 aa, Plasmodium falciparum
EKEAEEKKL

SEQ ID NO: 3308802 - protein, 22 aa, Plasmodium falciparum
EKEASEESTDEEDSSGSGEETI

SEQ ID NO: 3308803 - protein, 11 aa, Plasmodium falciparum
EKEDEGIPSTT

SEQ ID NO: 3308804 - protein, 21 aa, Plasmodium falciparum
EKEDEISVSDDNSSSSDEDHE

SEQ ID NO: 3308805 - protein, 6 aa, Plasmodium falciparum
EKEDEN

SEQ ID NO: 3308806 - protein, 8 aa, Plasmodium falciparum
EKEDNEYY

SEQ ID NO: 3308807 - protein, 16 aa, Plasmodium falciparum
EKEDNINKRSDREKKY

SEQ ID NO: 3308808 - protein, 9 aa, Plasmodium falciparum
EKEDNNNGR

SEQ ID NO: 3308809 - protein, 6 aa, Plasmodium falciparum
EKEDSL

SEQ ID NO: 3308810 - protein, 5 aa, Plasmodium falciparum
EKEDW

SEQ ID NO: 3308811 - protein, 7 aa, Plasmodium falciparum
EKEEEEV

SEQ ID NO: 3308812 - protein, 17 aa, Plasmodium falciparum
EKEEERLKEEMEKEKEK

SEQ ID NO: 3308813 - protein, 9 aa, Plasmodium falciparum
EKEEETNEN

SEQ ID NO: 3308814 - protein, 8 aa, Plasmodium falciparum
EKEEIGKK

SEQ ID NO: 3308815 - protein, 6 aa, Plasmodium falciparum
EKEEKH

SEQ ID NO: 3308816 - protein, 12 aa, Plasmodium falciparum
EKEEKNKNSIHP

SEQ ID NO: 3308817 - protein, 18 aa, Plasmodium falciparum
EKEEKNNFKDKEEEEKLN

SEQ ID NO: 3308818 - protein, 88 aa, Plasmodium falciparum
EKEEKSDEMKDDKKDDKKDNKKDHKKNDKKIDKKIDKKIDKKNDKKNDKKNNKKNNKKVEKKNEIKNDKKNNKKNNKKVAKKNEIKNE

SEQ ID NO: 3308819 - protein, 5 aa, Plasmodium falciparum
EKEEN

SEQ ID NO: 3308820 - protein, 6 aa, Plasmodium falciparum
EKEENE

SEQ ID NO: 3308821 - protein, 10 aa, Plasmodium falciparum
EKEENNLSNN

SEQ ID NO: 3308822 - protein, 6 aa, Plasmodium falciparum
EKEENV

SEQ ID NO: 3308823 - protein, 8 aa, Plasmodium falciparum
EKEFEDKG

SEQ ID NO: 3308824 - protein, 10 aa, Plasmodium falciparum
EKEGAKSGYV

SEQ ID NO: 3308825 - protein, 17 aa, Plasmodium falciparum
EKEGKEVNKNNNIEKNQ

SEQ ID NO: 3308826 - protein, 49 aa, Plasmodium falciparum
EKEGKHINSYNNENEYNNENEYNNKNEYNNKNEYNNKNNVKKNYSSNNN

SEQ ID NO: 3308827 - protein, 6 aa, Plasmodium falciparum
EKEGRK

SEQ ID NO: 3308828 - protein, 15 aa, Plasmodium falciparum
EKEGTNHDNKNKWNN

SEQ ID NO: 3308829 - protein, 9 aa, Plasmodium falciparum
EKEHKNENI

SEQ ID NO: 3308830 - protein, 53 aa, Plasmodium falciparum
EKEIEKEKIKEESNLNEKNDQYNEDYGDNIDQEDYSSLNNYSSSTNSPKNTKS

SEQ ID NO: 3308831 - protein, 7 aa, Plasmodium falciparum
EKEIEQI

SEQ ID NO: 3308832 - protein, 6 aa, Plasmodium falciparum
EKEIGQ

SEQ ID NO: 3308833 - protein, 20 aa, Plasmodium falciparum
EKEIKEKKKKKKEERKPSAH

SEQ ID NO: 3308834 - protein, 7 aa, Plasmodium falciparum
EKEIKKN

SEQ ID NO: 3308835 - protein, 13 aa, Plasmodium falciparum
EKEIQDNISRENN

SEQ ID NO: 3308836 - protein, 17 aa, Plasmodium falciparum
EKEITQQRKKNSVTTKN

SEQ ID NO: 3308837 - protein, 4 aa, Plasmodium falciparum
EKEK

SEQ ID NO: 3308838 - protein, 6 aa, Plasmodium falciparum
EKEKAK

SEQ ID NO: 3308839 - protein, 88 aa, Plasmodium falciparum
EKEKALKDEEDKGNKTNYNNNKEKIYDDNNKEKIYDDNNKEKIYDDNNKEKIYDDNNKEKIYDDNNKEKIYDDNNKEKIYDDNNNNVN

SEQ ID NO: 3308840 - protein, 12 aa, Plasmodium falciparum
EKEKDDNEKTTK

SEQ ID NO: 3308841 - protein, 7 aa, Plasmodium falciparum
EKEKDIK

SEQ ID NO: 3308842 - protein, 15 aa, Plasmodium falciparum
EKEKDKEKKNIFSES

SEQ ID NO: 3308843 - protein, 7 aa, Plasmodium falciparum
EKEKEIR

SEQ ID NO: 3308844 - protein, 15 aa, Plasmodium falciparum
EKEKEKKKDNKKKIS

SEQ ID NO: 3308845 - protein, 13 aa, Plasmodium falciparum
EKEKEKKNSHENN

SEQ ID NO: 3308846 - protein, 31 aa, Plasmodium falciparum
EKEKEKNEKKEKKEKKVTNDSTNNKNKNNSV

SEQ ID NO: 3308847 - protein, 6 aa, Plasmodium falciparum
EKEKEL

SEQ ID NO: 3308848 - protein, 6 aa, Plasmodium falciparum
EKEKEN

SEQ ID NO: 3308849 - protein, 9 aa, Plasmodium falciparum
EKEKENTCR

SEQ ID NO: 3308850 - protein, 7 aa, Plasmodium falciparum
EKEKFSG

SEQ ID NO: 3308851 - protein, 10 aa, Plasmodium falciparum
EKEKGGDENI

SEQ ID NO: 3308852 - protein, 12 aa, Plasmodium falciparum
EKEKGNKSNVSE

SEQ ID NO: 3308853 - protein, 9 aa, Plasmodium falciparum
EKEKKEKGY

SEQ ID NO: 3308854 - protein, 39 aa, Plasmodium falciparum
EKEKKKEEGENQIDGEDRISGGNHNSGEYHSEEKKKEEN

SEQ ID NO: 3308855 - protein, 30 aa, Plasmodium falciparum
EKEKKKKINENGDEKYDEEEEDNIYDDENN

SEQ ID NO: 3308856 - protein, 8 aa, Plasmodium falciparum
EKEKKKKK

SEQ ID NO: 3308857 - protein, 10 aa, Plasmodium falciparum
EKEKKKKKNV

SEQ ID NO: 3308858 - protein, 9 aa, Plasmodium falciparum
EKEKKKKNL

SEQ ID NO: 3308859 - protein, 20 aa, Plasmodium falciparum
EKEKKKNENENENNDEESDN

SEQ ID NO: 3308860 - protein, 13 aa, Plasmodium falciparum
EKEKKKNKVFSPE

SEQ ID NO: 3308861 - protein, 10 aa, Plasmodium falciparum
EKEKLRKENM

SEQ ID NO: 3308862 - protein, 7 aa, Plasmodium falciparum
EKEKQKI

SEQ ID NO: 3308863 - protein, 7 aa, Plasmodium falciparum
EKEKSRN

SEQ ID NO: 3308864 - protein, 6 aa, Plasmodium falciparum
EKEKTL

SEQ ID NO: 3308865 - protein, 10 aa, Plasmodium falciparum
EKEKTNEDVH

SEQ ID NO: 3308866 - protein, 8 aa, Plasmodium falciparum
EKEKTRLE

SEQ ID NO: 3308867 - protein, 6 aa, Plasmodium falciparum
EKEKYD

SEQ ID NO: 3308868 - protein, 13 aa, Plasmodium falciparum
EKEKYEEYKNESY

SEQ ID NO: 3308869 - protein, 4 aa, Plasmodium falciparum
EKEL

SEQ ID NO: 3308870 - protein, 6 aa, Plasmodium falciparum
EKELEQ

SEQ ID NO: 3308871 - protein, 9 aa, Plasmodium falciparum
EKELKNEMN

SEQ ID NO: 3308872 - protein, 6 aa, Plasmodium falciparum
EKELQN

SEQ ID NO: 3308873 - protein, 6 aa, Plasmodium falciparum
EKELRS

SEQ ID NO: 3308874 - protein, 20 aa, Plasmodium falciparum
EKELSSKKNKKTYLDEQEEL

SEQ ID NO: 3308875 - protein, 10 aa, Plasmodium falciparum
EKEMEDDKNS

SEQ ID NO: 3308876 - protein, 7 aa, Plasmodium falciparum
EKENDED

SEQ ID NO: 3308877 - protein, 23 aa, Plasmodium falciparum
EKENDQGKDQGKDQGKDQGKDQE

SEQ ID NO: 3308878 - protein, 8 aa, Plasmodium falciparum
EKENEDKI

SEQ ID NO: 3308879 - protein, 9 aa, Plasmodium falciparum
EKENEGKEN

SEQ ID NO: 3308880 - protein, 15 aa, Plasmodium falciparum
EKENEIDSLKKNEQN

SEQ ID NO: 3308881 - protein, 9 aa, Plasmodium falciparum
EKENEKDGV

SEQ ID NO: 3308882 - protein, 15 aa, Plasmodium falciparum
EKENEKLKDEIEKER

SEQ ID NO: 3308883 - protein, 8 aa, Plasmodium falciparum
EKENEKLR

SEQ ID NO: 3308884 - protein, 8 aa, Plasmodium falciparum
EKENESQY

SEQ ID NO: 3308885 - protein, 11 aa, Plasmodium falciparum
EKENGENYNDK

SEQ ID NO: 3308886 - protein, 7 aa, Plasmodium falciparum
EKENGKI

SEQ ID NO: 3308887 - protein, 6 aa, Plasmodium falciparum
EKENIL

SEQ ID NO: 3308888 - protein, 13 aa, Plasmodium falciparum
EKENKKDENECSQ

SEQ ID NO: 3308889 - protein, 49 aa, Plasmodium falciparum
EKENKKTKNQNKNNNNNNNNNKKNDINKNIKNNNKRNNNINNKNETQTV

SEQ ID NO: 3308890 - protein, 8 aa, Plasmodium falciparum
EKENKNDM

SEQ ID NO: 3308891 - protein, 9 aa, Plasmodium falciparum
EKENKTNQP

SEQ ID NO: 3308892 - protein, 30 aa, Plasmodium falciparum
EKENKTNTINNNNNNKRNNCSNLQKNSKYF

SEQ ID NO: 3308893 - protein, 6 aa, Plasmodium falciparum
EKENLD

SEQ ID NO: 3308894 - protein, 13 aa, Plasmodium falciparum
EKENLGKNNSYVE

SEQ ID NO: 3308895 - protein, 8 aa, Plasmodium falciparum
EKENLSDK

SEQ ID NO: 3308896 - protein, 12 aa, Plasmodium falciparum
EKENMEKKHRED

SEQ ID NO: 3308897 - protein, 15 aa, Plasmodium falciparum
EKENNEEWVDEFLED

SEQ ID NO: 3308898 - protein, 10 aa, Plasmodium falciparum
EKENNNDNLK

SEQ ID NO: 3308899 - protein, 10 aa, Plasmodium falciparum
EKENNNENRS

SEQ ID NO: 3308900 - protein, 17 aa, Plasmodium falciparum
EKENNNNNNNNNSTNQM

SEQ ID NO: 3308901 - protein, 8 aa, Plasmodium falciparum
EKENNYNN

SEQ ID NO: 3308902 - protein, 15 aa, Plasmodium falciparum
EKENQKKERKKYTHN

SEQ ID NO: 3308903 - protein, 14 aa, Plasmodium falciparum
EKENQNNELVTNTN

SEQ ID NO: 3308904 - protein, 9 aa, Plasmodium falciparum
EKENSTLQN

SEQ ID NO: 3308905 - protein, 13 aa, Plasmodium falciparum
EKENTKQNKAKNV

SEQ ID NO: 3308906 - protein, 7 aa, Plasmodium falciparum
EKENVKK

SEQ ID NO: 3308907 - protein, 9 aa, Plasmodium falciparum
EKENYEEKH

SEQ ID NO: 3308908 - protein, 7 aa, Plasmodium falciparum
EKENYPH

SEQ ID NO: 3308909 - protein, 5 aa, Plasmodium falciparum
EKEPA

SEQ ID NO: 3308910 - protein, 9 aa, Plasmodium falciparum
EKEQDNSNN

SEQ ID NO: 3308911 - protein, 10 aa, Plasmodium falciparum
EKEQDRGNSK

SEQ ID NO: 3308912 - protein, 10 aa, Plasmodium falciparum
EKEQEANQRI

SEQ ID NO: 3308913 - protein, 10 aa, Plasmodium falciparum
EKEQEEKDIK

SEQ ID NO: 3308914 - protein, 7 aa, Plasmodium falciparum
EKEQHKF

SEQ ID NO: 3308915 - protein, 15 aa, Plasmodium falciparum
EKEQKDNQMDDPQKS

SEQ ID NO: 3308916 - protein, 9 aa, Plasmodium falciparum
EKEQKRKIN

SEQ ID NO: 3308917 - protein, 8 aa, Plasmodium falciparum
EKEQNKKI

SEQ ID NO: 3308918 - protein, 6 aa, Plasmodium falciparum
EKERDI

SEQ ID NO: 3308919 - protein, 5 aa, Plasmodium falciparum
EKERE

SEQ ID NO: 3308920 - protein, 6 aa, Plasmodium falciparum
EKEREL

SEQ ID NO: 3308921 - protein, 70 aa, Plasmodium falciparum
EKERINKEKKINEKEEKNDEGNKKEEESQKEEESQKEEESQKEEESKNEEESKNEENNIKDNEQKRKNKI

SEQ ID NO: 3308922 - protein, 19 aa, Plasmodium falciparum
EKERKNKEQVCSNGNDNIN

SEQ ID NO: 3308923 - protein, 8 aa, Plasmodium falciparum
EKERKTKI

SEQ ID NO: 3308924 - protein, 20 aa, Plasmodium falciparum
EKERLNKGHKEKSTAEDEAV

SEQ ID NO: 3308925 - protein, 22 aa, Plasmodium falciparum
EKERNNVPLSPSSSPNQNNDHS

SEQ ID NO: 3308926 - protein, 6 aa, Plasmodium falciparum
EKERRK

SEQ ID NO: 3308927 - protein, 5 aa, Plasmodium falciparum
EKESG

SEQ ID NO: 3308928 - protein, 10 aa, Plasmodium falciparum
EKESKNKKSS

SEQ ID NO: 3308929 - protein, 8 aa, Plasmodium falciparum
EKESKNTI

SEQ ID NO: 3308930 - protein, 37 aa, Plasmodium falciparum
EKESNHEKGHRRNGLNKKNKEKNMEKNKGKNKDKKNY

SEQ ID NO: 3308931 - protein, 13 aa, Plasmodium falciparum
EKESNKGNASIDN

SEQ ID NO: 3308932 - protein, 10 aa, Plasmodium falciparum
EKESSQDSCT

SEQ ID NO: 3308933 - protein, 7 aa, Plasmodium falciparum
EKESYNM

SEQ ID NO: 3308934 - protein, 8 aa, Plasmodium falciparum
EKETEYYK

SEQ ID NO: 3308935 - protein, 5 aa, Plasmodium falciparum
EKETK

SEQ ID NO: 3308936 - protein, 17 aa, Plasmodium falciparum
EKETKEGTDKKKQINRN

SEQ ID NO: 3308937 - protein, 10 aa, Plasmodium falciparum
EKETKEKELK

SEQ ID NO: 3308938 - protein, 6 aa, Plasmodium falciparum
EKETLD

SEQ ID NO: 3308939 - protein, 8 aa, Plasmodium falciparum
EKETLNKE

SEQ ID NO: 3308940 - protein, 15 aa, Plasmodium falciparum
EKETNKHHNIEGKPG

SEQ ID NO: 3308941 - protein, 14 aa, Plasmodium falciparum
EKETNNNELTTNSN

SEQ ID NO: 3308942 - protein, 14 aa, Plasmodium falciparum
EKETSQKNEASPNT

SEQ ID NO: 3308943 - protein, 8 aa, Plasmodium falciparum
EKETYKKK

SEQ ID NO: 3308944 - protein, 4 aa, Plasmodium falciparum
EKEV

SEQ ID NO: 3308945 - protein, 10 aa, Plasmodium falciparum
EKEWEENYDN

SEQ ID NO: 3308946 - protein, 18 aa, Plasmodium falciparum
EKEYEKNKSLNLNDDTCE

SEQ ID NO: 3308947 - protein, 7 aa, Plasmodium falciparum
EKEYKSD

SEQ ID NO: 3308948 - protein, 19 aa, Plasmodium falciparum
EKEYNKKLEESNKKKESLN

SEQ ID NO: 3308949 - protein, 15 aa, Plasmodium falciparum
EKEYTKKYNNSITSL

SEQ ID NO: 3308950 - protein, 7 aa, Plasmodium falciparum
EKEYTKN

SEQ ID NO: 3308951 - protein, 4 aa, Plasmodium falciparum
EKFK

SEQ ID NO: 3308952 - protein, 5 aa, Plasmodium falciparum
EKFNI

SEQ ID NO: 3308953 - protein, 7 aa, Plasmodium falciparum
EKFNNDK

SEQ ID NO: 3308954 - protein, 5 aa, Plasmodium falciparum
EKGDD

SEQ ID NO: 3308955 - protein, 18 aa, Plasmodium falciparum
EKGDENIFPQNDDEKLQQ

SEQ ID NO: 3308956 - protein, 5 aa, Plasmodium falciparum
EKGDI

SEQ ID NO: 3308957 - protein, 9 aa, Plasmodium falciparum
EKGEDNYNE

SEQ ID NO: 3308958 - protein, 5 aa, Plasmodium falciparum
EKGEK

SEQ ID NO: 3308959 - protein, 17 aa, Plasmodium falciparum
EKGENKKRIEEKDEEYI

SEQ ID NO: 3308960 - protein, 14 aa, Plasmodium falciparum
EKGENVQGEEEKYK

SEQ ID NO: 3308961 - protein, 8 aa, Plasmodium falciparum
EKGFEENK

SEQ ID NO: 3308962 - protein, 8 aa, Plasmodium falciparum
EKGGGMNG

SEQ ID NO: 3308963 - protein, 13 aa, Plasmodium falciparum
EKGGKSNCSELDD

SEQ ID NO: 3308964 - protein, 15 aa, Plasmodium falciparum
EKGGYAYRKNPDNKI

SEQ ID NO: 3308965 - protein, 11 aa, Plasmodium falciparum
EKGIEQQSYEQ

SEQ ID NO: 3308966 - protein, 21 aa, Plasmodium falciparum
EKGIQNKEEEINEDMEKENLN

SEQ ID NO: 3308967 - protein, 9 aa, Plasmodium falciparum
EKGKFKNNE

SEQ ID NO: 3308968 - protein, 6 aa, Plasmodium falciparum
EKGKGK

SEQ ID NO: 3308969 - protein, 14 aa, Plasmodium falciparum
EKGKKTNKNLKPVS

SEQ ID NO: 3308970 - protein, 9 aa, Plasmodium falciparum
EKGKNDENH

SEQ ID NO: 3308971 - protein, 6 aa, Plasmodium falciparum
EKGKNE

SEQ ID NO: 3308972 - protein, 10 aa, Plasmodium falciparum
EKGKNNNDAF

SEQ ID NO: 3308973 - protein, 7 aa, Plasmodium falciparum
EKGKRKD

SEQ ID NO: 3308974 - protein, 8 aa, Plasmodium falciparum
EKGKTNNN

SEQ ID NO: 3308975 - protein, 9 aa, Plasmodium falciparum
EKGNTDCQT

SEQ ID NO: 3308976 - protein, 7 aa, Plasmodium falciparum
EKGNYKN

SEQ ID NO: 3308977 - protein, 7 aa, Plasmodium falciparum
EKGRDNN

SEQ ID NO: 3308978 - protein, 9 aa, Plasmodium falciparum
EKGREEHKQ

SEQ ID NO: 3308979 - protein, 6 aa, Plasmodium falciparum
EKGRPE

SEQ ID NO: 3308980 - protein, 6 aa, Plasmodium falciparum
EKGSDD

SEQ ID NO: 3308981 - protein, 5 aa, Plasmodium falciparum
EKGSR

SEQ ID NO: 3308982 - protein, 4 aa, Plasmodium falciparum
EKGT

SEQ ID NO: 3308983 - protein, 5 aa, Plasmodium falciparum
EKHDD

SEQ ID NO: 3308984 - protein, 8 aa, Plasmodium falciparum
EKHDDTTK

SEQ ID NO: 3308985 - protein, 7 aa, Plasmodium falciparum
EKHDKIT

SEQ ID NO: 3308986 - protein, 10 aa, Plasmodium falciparum
EKHDLKKDEK

SEQ ID NO: 3308987 - protein, 17 aa, Plasmodium falciparum
EKHEEKKEKFKEKEESD

SEQ ID NO: 3308988 - protein, 15 aa, Plasmodium falciparum
EKHHPQGIPKEQPYN

SEQ ID NO: 3308989 - protein, 4 aa, Plasmodium falciparum
EKHI

SEQ ID NO: 3308990 - protein, 14 aa, Plasmodium falciparum
EKHISDDNNNNNNI

SEQ ID NO: 3308991 - protein, 11 aa, Plasmodium falciparum
EKHKKNYNDYK

SEQ ID NO: 3308992 - protein, 5 aa, Plasmodium falciparum
EKHMQ

SEQ ID NO: 3308993 - protein, 32 aa, Plasmodium falciparum
EKHNDSKEDDMYDPQYENDDDDDDDGDNDLNK

SEQ ID NO: 3308994 - protein, 5 aa, Plasmodium falciparum
EKHNR

SEQ ID NO: 3308995 - protein, 8 aa, Plasmodium falciparum
EKHPNSSN

SEQ ID NO: 3308996 - protein, 6 aa, Plasmodium falciparum
EKHPPK

SEQ ID NO: 3308997 - protein, 40 aa, Plasmodium falciparum
EKHQGEHNVNDNVTSQKSKKKKGTSTHNDIKNSTNENANN

SEQ ID NO: 3308998 - protein, 54 aa, Plasmodium falciparum
EKHQNSDDKNDDDSLNDNPDNDYGANDDKENNRTFDETENNDFKGKRRKTKNSK

SEQ ID NO: 3308999 - protein, 9 aa, Plasmodium falciparum
EKHQTTNEQ

SEQ ID NO: 3309000 - protein, 17 aa, Plasmodium falciparum
EKHRKSEKNEKDDTSLD

SEQ ID NO: 3309001 - protein, 7 aa, Plasmodium falciparum
EKHSYNN

SEQ ID NO: 3309002 - protein, 6 aa, Plasmodium falciparum
EKIDDT

SEQ ID NO: 3309003 - protein, 5 aa, Plasmodium falciparum
EKIDE

SEQ ID NO: 3309004 - protein, 6 aa, Plasmodium falciparum
EKIDEE

SEQ ID NO: 3309005 - protein, 11 aa, Plasmodium falciparum
EKIDKNKKIEE

SEQ ID NO: 3309006 - protein, 14 aa, Plasmodium falciparum
EKIEDVKNNNTNNN

SEQ ID NO: 3309007 - protein, 7 aa, Plasmodium falciparum
EKIEGTV

SEQ ID NO: 3309008 - protein, 13 aa, Plasmodium falciparum
EKIEKQEKQKVDE

SEQ ID NO: 3309009 - protein, 11 aa, Plasmodium falciparum
EKIENNNKNEK

SEQ ID NO: 3309010 - protein, 9 aa, Plasmodium falciparum
EKIGSRGKN

SEQ ID NO: 3309011 - protein, 4 aa, Plasmodium falciparum
EKIK

SEQ ID NO: 3309012 - protein, 9 aa, Plasmodium falciparum
EKIKKDDLE

SEQ ID NO: 3309013 - protein, 93 aa, Plasmodium falciparum
EKIKSQELKEKNKEETKCKQDGEKNEKEEQQNEQDDEKNKEQQKCKQDDEKNKEQQNEQRDDEQNKEQQKCKQDDEQNKEQQNEQRDDEQINM

SEQ ID NO: 3309014 - protein, 4 aa, Plasmodium falciparum
EKIN

SEQ ID NO: 3309015 - protein, 7 aa, Plasmodium falciparum
EKINDNK

SEQ ID NO: 3309016 - protein, 22 aa, Plasmodium falciparum
EKINEENKVEKEDSNEEREKIK

SEQ ID NO: 3309017 - protein, 12 aa, Plasmodium falciparum
EKINEKGKKKKN

SEQ ID NO: 3309018 - protein, 15 aa, Plasmodium falciparum
EKINNNNNNNNNNNN

SEQ ID NO: 3309019 - protein, 6 aa, Plasmodium falciparum
EKINRG

SEQ ID NO: 3309020 - protein, 11 aa, Plasmodium falciparum
EKINSNAPSNV

SEQ ID NO: 3309021 - protein, 8 aa, Plasmodium falciparum
EKINSRNT

SEQ ID NO: 3309022 - protein, 12 aa, Plasmodium falciparum
EKIQEEDKTIKS

SEQ ID NO: 3309023 - protein, 11 aa, Plasmodium falciparum
EKIQKTTEECY

SEQ ID NO: 3309024 - protein, 6 aa, Plasmodium falciparum
EKIQPE

SEQ ID NO: 3309025 - protein, 44 aa, Plasmodium falciparum
EKIRRNESLDKKKDAHSVKNKTGNRNSTSRSRSRNRNRSKDRYL

SEQ ID NO: 3309026 - protein, 4 aa, Plasmodium falciparum
EKIS

SEQ ID NO: 3309027 - protein, 6 aa, Plasmodium falciparum
EKISKR

SEQ ID NO: 3309028 - protein, 53 aa, Plasmodium falciparum
EKISNSDEKTKKISNSHEKREEISNSHEKREEISNSHEKREEISNSHEKREEI

SEQ ID NO: 3309029 - protein, 11 aa, Plasmodium falciparum
EKISRSKSEGI

SEQ ID NO: 3309030 - protein, 7 aa, Plasmodium falciparum
EKITDDN

SEQ ID NO: 3309031 - protein, 6 aa, Plasmodium falciparum
EKITDE

SEQ ID NO: 3309032 - protein, 13 aa, Plasmodium falciparum
EKITNSKKKNNYK

SEQ ID NO: 3309033 - protein, 7 aa, Plasmodium falciparum
EKIYKDN

SEQ ID NO: 3309034 - protein, 13 aa, Plasmodium falciparum
EKIYKNKNKSDQE

SEQ ID NO: 3309035 - protein, 7 aa, Plasmodium falciparum
EKKAFTK

SEQ ID NO: 3309036 - protein, 25 aa, Plasmodium falciparum
EKKANARTYANDSTNIHGDNNTDLN

SEQ ID NO: 3309037 - protein, 4 aa, Plasmodium falciparum
EKKD

SEQ ID NO: 3309038 - protein, 8 aa, Plasmodium falciparum
EKKDAKIE

SEQ ID NO: 3309039 - protein, 8 aa, Plasmodium falciparum
EKKDNAAV

SEQ ID NO: 3309040 - protein, 7 aa, Plasmodium falciparum
EKKDPIK

SEQ ID NO: 3309041 - protein, 7 aa, Plasmodium falciparum
EKKDYKD

SEQ ID NO: 3309042 - protein, 22 aa, Plasmodium falciparum
EKKEDNEDDNYNNNNNNNKDDN

SEQ ID NO: 3309043 - protein, 12 aa, Plasmodium falciparum
EKKEEEEDKGKL

SEQ ID NO: 3309044 - protein, 7 aa, Plasmodium falciparum
EKKEEEK

SEQ ID NO: 3309045 - protein, 7 aa, Plasmodium falciparum
EKKEEHI

SEQ ID NO: 3309046 - protein, 9 aa, Plasmodium falciparum
EKKEEKIKE

SEQ ID NO: 3309047 - protein, 13 aa, Plasmodium falciparum
EKKEEMNQNHEQE

SEQ ID NO: 3309048 - protein, 7 aa, Plasmodium falciparum
EKKEERI

SEQ ID NO: 3309049 - protein, 5 aa, Plasmodium falciparum
EKKEI

SEQ ID NO: 3309050 - protein, 28 aa, Plasmodium falciparum
EKKEINNNNNNNNNNNNNNNNNNNNSNN

SEQ ID NO: 3309051 - protein, 5 aa, Plasmodium falciparum
EKKEK

SEQ ID NO: 3309052 - protein, 8 aa, Plasmodium falciparum
EKKEKEEH

SEQ ID NO: 3309053 - protein, 8 aa, Plasmodium falciparum
EKKEKKKN

SEQ ID NO: 3309054 - protein, 12 aa, Plasmodium falciparum
EKKEKKNENEEL

SEQ ID NO: 3309055 - protein, 11 aa, Plasmodium falciparum
EKKEKKTPSYI

SEQ ID NO: 3309056 - protein, 14 aa, Plasmodium falciparum
EKKEKQKKENKDNN

SEQ ID NO: 3309057 - protein, 6 aa, Plasmodium falciparum
EKKEKY

SEQ ID NO: 3309058 - protein, 6 aa, Plasmodium falciparum
EKKEMK

SEQ ID NO: 3309059 - protein, 8 aa, Plasmodium falciparum
EKKENDFM

SEQ ID NO: 3309060 - protein, 9 aa, Plasmodium falciparum
EKKENEKKS

SEQ ID NO: 3309061 - protein, 8 aa, Plasmodium falciparum
EKKENQER

SEQ ID NO: 3309062 - protein, 10 aa, Plasmodium falciparum
EKKENRSVDN

SEQ ID NO: 3309063 - protein, 7 aa, Plasmodium falciparum
EKKENTL

SEQ ID NO: 3309064 - protein, 8 aa, Plasmodium falciparum
EKKENVTG

SEQ ID NO: 3309065 - protein, 6 aa, Plasmodium falciparum
EKKEQD

SEQ ID NO: 3309066 - protein, 7 aa, Plasmodium falciparum
EKKEREK

SEQ ID NO: 3309067 - protein, 13 aa, Plasmodium falciparum
EKKESTTQNLNSK

SEQ ID NO: 3309068 - protein, 14 aa, Plasmodium falciparum
EKKETKKKQRYKQK

SEQ ID NO: 3309069 - protein, 8 aa, Plasmodium falciparum
EKKEYERN

SEQ ID NO: 3309070 - protein, 187 aa, Plasmodium falciparum
EKKGCEKNEVEKKGCEKNEVEKKGCEKNEVEKKGCEKNEVEKKGCEKNEVEKKGCENKGCENKGCEKNEVENKGCEKNEVENKGCENKGCEKKEVEKKGCENKGCENKGCEKNEVEKKGCENKGCEKNEVEKKGCEKKEVEKKGCENKGCEKKEVEKKGCENKGCEKNEVEKTSYEQNEVEKTSYEQ

SEQ ID NO: 3309071 - protein, 13 aa, Plasmodium falciparum
EKKGESTGKKDYY

SEQ ID NO: 3309072 - protein, 8 aa, Plasmodium falciparum
EKKGGLHN

SEQ ID NO: 3309073 - protein, 7 aa, Plasmodium falciparum
EKKGGYG

SEQ ID NO: 3309074 - protein, 8 aa, Plasmodium falciparum
EKKGHNTS

SEQ ID NO: 3309075 - protein, 20 aa, Plasmodium falciparum
EKKGINDERQKNQTRGKNDM

SEQ ID NO: 3309076 - protein, 10 aa, Plasmodium falciparum
EKKGMDKDNN

SEQ ID NO: 3309077 - protein, 18 aa, Plasmodium falciparum
EKKGNQINTYEEDKKKNT

SEQ ID NO: 3309078 - protein, 10 aa, Plasmodium falciparum
EKKGTDRDVE

SEQ ID NO: 3309079 - protein, 8 aa, Plasmodium falciparum
EKKHEKDY

SEQ ID NO: 3309080 - protein, 51 aa, Plasmodium falciparum
EKKHKKKKKEKEKDKDKDKLDALNKNSKKKNKKNDKSNKKEGKKLENNDEM

SEQ ID NO: 3309081 - protein, 18 aa, Plasmodium falciparum
EKKINEAIQEAKKKGTFI

SEQ ID NO: 3309082 - protein, 12 aa, Plasmodium falciparum
EKKINNDNNDNN

SEQ ID NO: 3309083 - protein, 28 aa, Plasmodium falciparum
EKKINNKNNNNNNKNNNNNNNNNNNNNK

SEQ ID NO: 3309084 - protein, 4 aa, Plasmodium falciparum
EKKK

SEQ ID NO: 3309085 - protein, 21 aa, Plasmodium falciparum
EKKKADKIDEQNKEKNQQEEI

SEQ ID NO: 3309086 - protein, 32 aa, Plasmodium falciparum
EKKKADPSFSFSSSSSSSFSSYPSHSSYPYSS

SEQ ID NO: 3309087 - protein, 10 aa, Plasmodium falciparum
EKKKANKEAY

SEQ ID NO: 3309088 - protein, 9 aa, Plasmodium falciparum
EKKKAYDDI

SEQ ID NO: 3309089 - protein, 6 aa, Plasmodium falciparum
EKKKCD

SEQ ID NO: 3309090 - protein, 5 aa, Plasmodium falciparum
EKKKD

SEQ ID NO: 3309091 - protein, 7 aa, Plasmodium falciparum
EKKKDAL

SEQ ID NO: 3309092 - protein, 71 aa, Plasmodium falciparum
EKKKDQVTNKNDNKPEAKNKNKESSKDKKNEGCNVNNKKDEKNNNNNNDDPDNNNNNNSNYNTGTTPLTNT

SEQ ID NO: 3309093 - protein, 29 aa, Plasmodium falciparum
EKKKEDNNENENKNKNKNNNNNNNNNTYN

SEQ ID NO: 3309094 - protein, 29 aa, Plasmodium falciparum
EKKKEEEPEKKSDSDDEDLNKPKIPEQDH

SEQ ID NO: 3309095 - protein, 7 aa, Plasmodium falciparum
EKKKEEI

SEQ ID NO: 3309096 - protein, 10 aa, Plasmodium falciparum
EKKKEFSENK

SEQ ID NO: 3309097 - protein, 20 aa, Plasmodium falciparum
EKKKEKDKDYIPDEDGGHTW

SEQ ID NO: 3309098 - protein, 8 aa, Plasmodium falciparum
EKKKENQK

SEQ ID NO: 3309099 - protein, 13 aa, Plasmodium falciparum
EKKKEQQEGTDKY

SEQ ID NO: 3309100 - protein, 7 aa, Plasmodium falciparum
EKKKEYH

SEQ ID NO: 3309101 - protein, 7 aa, Plasmodium falciparum
EKKKITS

SEQ ID NO: 3309102 - protein, 5 aa, Plasmodium falciparum
EKKKK

SEQ ID NO: 3309103 - protein, 43 aa, Plasmodium falciparum
EKKKKEIIEKKDEEKKKGEIEKSEHANDSKKMDEQLDDAKPTM

SEQ ID NO: 3309104 - protein, 22 aa, Plasmodium falciparum
EKKKKEISEGEKMNDKNMNDTL

SEQ ID NO: 3309105 - protein, 9 aa, Plasmodium falciparum
EKKKKENSK

SEQ ID NO: 3309106 - protein, 18 aa, Plasmodium falciparum
EKKKKIKTIEKKNKSSSI

SEQ ID NO: 3309107 - protein, 15 aa, Plasmodium falciparum
EKKKKKEQAKKKLNR

SEQ ID NO: 3309108 - protein, 8 aa, Plasmodium falciparum
EKKKKKIL

SEQ ID NO: 3309109 - protein, 8 aa, Plasmodium falciparum
EKKKKKKK

SEQ ID NO: 3309110 - protein, 12 aa, Plasmodium falciparum
EKKKKKKKELKY

SEQ ID NO: 3309111 - protein, 12 aa, Plasmodium falciparum
EKKKKKKKKEVV

SEQ ID NO: 3309112 - protein, 12 aa, Plasmodium falciparum
EKKKKKKKNIYE

SEQ ID NO: 3309113 - protein, 8 aa, Plasmodium falciparum
EKKKKKKY

SEQ ID NO: 3309114 - protein, 8 aa, Plasmodium falciparum
EKKKKNDD

SEQ ID NO: 3309115 - protein, 23 aa, Plasmodium falciparum
EKKKKNKEKKRTWKNEKHEDTSK

SEQ ID NO: 3309116 - protein, 13 aa, Plasmodium falciparum
EKKKKNSDTIERN

SEQ ID NO: 3309117 - protein, 12 aa, Plasmodium falciparum
EKKKKQGDNTYT

SEQ ID NO: 3309118 - protein, 24 aa, Plasmodium falciparum
EKKKKQKKKKQKKKKQKKKQTSLT

SEQ ID NO: 3309119 - protein, 21 aa, Plasmodium falciparum
EKKKKQTKKETSQNNNNHNIN

SEQ ID NO: 3309120 - protein, 9 aa, Plasmodium falciparum
EKKKKRAER

SEQ ID NO: 3309121 - protein, 6 aa, Plasmodium falciparum
EKKKKS

SEQ ID NO: 3309122 - protein, 15 aa, Plasmodium falciparum
EKKKKTEEKKKIENK

SEQ ID NO: 3309123 - protein, 5 aa, Plasmodium falciparum
EKKKL

SEQ ID NO: 3309124 - protein, 10 aa, Plasmodium falciparum
EKKKLEKEKN

SEQ ID NO: 3309125 - protein, 6 aa, Plasmodium falciparum
EKKKND

SEQ ID NO: 3309126 - protein, 22 aa, Plasmodium falciparum
EKKKNEQINDDLENERKRNNQL

SEQ ID NO: 3309127 - protein, 30 aa, Plasmodium falciparum
EKKKNKINNYNNNNNNNDDELSTTDTGDDM

SEQ ID NO: 3309128 - protein, 28 aa, Plasmodium falciparum
EKKKNKKKRKRSCKKKKLTDTNTANLNP

SEQ ID NO: 3309129 - protein, 11 aa, Plasmodium falciparum
EKKKNKNDNVI

SEQ ID NO: 3309130 - protein, 9 aa, Plasmodium falciparum
EKKKNNENV

SEQ ID NO: 3309131 - protein, 7 aa, Plasmodium falciparum
EKKKNNK

SEQ ID NO: 3309132 - protein, 9 aa, Plasmodium falciparum
EKKKNPSFE

SEQ ID NO: 3309133 - protein, 9 aa, Plasmodium falciparum
EKKKNYKKE

SEQ ID NO: 3309134 - protein, 43 aa, Plasmodium falciparum
EKKKQEKKVKKVKKEKKKVNAKEVKKTATDNKKAKKVADKKKG

SEQ ID NO: 3309135 - protein, 8 aa, Plasmodium falciparum
EKKKQFDK

SEQ ID NO: 3309136 - protein, 18 aa, Plasmodium falciparum
EKKKQIKEIRTSNNESYP

SEQ ID NO: 3309137 - protein, 17 aa, Plasmodium falciparum
EKKKQKNINIENNEDHN

SEQ ID NO: 3309138 - protein, 9 aa, Plasmodium falciparum
EKKKQSNSA

SEQ ID NO: 3309139 - protein, 17 aa, Plasmodium falciparum
EKKKRIPKKKKKKRNLI

SEQ ID NO: 3309140 - protein, 18 aa, Plasmodium falciparum
EKKKSYKKKKKKNMSEEH

SEQ ID NO: 3309141 - protein, 9 aa, Plasmodium falciparum
EKKKTGHKE

SEQ ID NO: 3309142 - protein, 25 aa, Plasmodium falciparum
EKKKTKTDMDNNNNNNNNNNNDNNN

SEQ ID NO: 3309143 - protein, 8 aa, Plasmodium falciparum
EKKKTSNI

SEQ ID NO: 3309144 - protein, 7 aa, Plasmodium falciparum
EKKKYNL

SEQ ID NO: 3309145 - protein, 30 aa, Plasmodium falciparum
EKKLKSKKKTSNAKEGDNHLNDEYNSSNKN

SEQ ID NO: 3309146 - protein, 8 aa, Plasmodium falciparum
EKKLNKNK

SEQ ID NO: 3309147 - protein, 8 aa, Plasmodium falciparum
EKKLNNHQ

SEQ ID NO: 3309148 - protein, 5 aa, Plasmodium falciparum
EKKLT

SEQ ID NO: 3309149 - protein, 6 aa, Plasmodium falciparum
EKKMNN

SEQ ID NO: 3309150 - protein, 4 aa, Plasmodium falciparum
EKKN

SEQ ID NO: 3309151 - protein, 9 aa, Plasmodium falciparum
EKKNDHSKN

SEQ ID NO: 3309152 - protein, 33 aa, Plasmodium falciparum
EKKNEENINEYKNKKNIANENIKEGKSSIYNDE

SEQ ID NO: 3309153 - protein, 11 aa, Plasmodium falciparum
EKKNEERNKCD

SEQ ID NO: 3309154 - protein, 8 aa, Plasmodium falciparum
EKKNEKEH

SEQ ID NO: 3309155 - protein, 14 aa, Plasmodium falciparum
EKKNGAKPPSGDLE

SEQ ID NO: 3309156 - protein, 32 aa, Plasmodium falciparum
EKKNGEDLHTNEKKKNNCNDNKMDDDKGNIKS

SEQ ID NO: 3309157 - protein, 5 aa, Plasmodium falciparum
EKKNK

SEQ ID NO: 3309158 - protein, 34 aa, Plasmodium falciparum
EKKNKEEEQEQEQNEKAENKIEDIKNKEDDEITT

SEQ ID NO: 3309159 - protein, 9 aa, Plasmodium falciparum
EKKNKENSL

SEQ ID NO: 3309160 - protein, 37 aa, Plasmodium falciparum
EKKNKKKEKKNKKKEKKNKKKEKNKKEESNKKEEKNN

SEQ ID NO: 3309161 - protein, 63 aa, Plasmodium falciparum
EKKNKKKKEDKNYEHEEKKDANDSINDKEDKKYSNNNNDNNNNNNNNNNNNNNNICDDNNDGF

SEQ ID NO: 3309162 - protein, 18 aa, Plasmodium falciparum
EKKNKKRKTFKRKTKNVN

SEQ ID NO: 3309163 - protein, 12 aa, Plasmodium falciparum
EKKNKNNNNNNN

SEQ ID NO: 3309164 - protein, 15 aa, Plasmodium falciparum
EKKNKSQEKSIDRNG

SEQ ID NO: 3309165 - protein, 11 aa, Plasmodium falciparum
EKKNKSTKVRE

SEQ ID NO: 3309166 - protein, 8 aa, Plasmodium falciparum
EKKNLEND

SEQ ID NO: 3309167 - protein, 8 aa, Plasmodium falciparum
EKKNLENQ

SEQ ID NO: 3309168 - protein, 21 aa, Plasmodium falciparum
EKKNLKKESKKNDKDKNNNNI

SEQ ID NO: 3309169 - protein, 10 aa, Plasmodium falciparum
EKKNNEADSK

SEQ ID NO: 3309170 - protein, 7 aa, Plasmodium falciparum
EKKNNGN

SEQ ID NO: 3309171 - protein, 9 aa, Plasmodium falciparum
EKKNNSINS

SEQ ID NO: 3309172 - protein, 24 aa, Plasmodium falciparum
EKKNNTPKSYDMENDVSKSDKSHA

SEQ ID NO: 3309173 - protein, 28 aa, Plasmodium falciparum
EKKNQIQNEDDKMDKTYKVNKNKGKDHT

SEQ ID NO: 3309174 - protein, 14 aa, Plasmodium falciparum
EKKNQKQSADRSHK

SEQ ID NO: 3309175 - protein, 14 aa, Plasmodium falciparum
EKKNQRSDSEENSY

SEQ ID NO: 3309176 - protein, 7 aa, Plasmodium falciparum
EKKNQSI

SEQ ID NO: 3309177 - protein, 7 aa, Plasmodium falciparum
EKKNRDL

SEQ ID NO: 3309178 - protein, 9 aa, Plasmodium falciparum
EKKNRKGDV

SEQ ID NO: 3309179 - protein, 8 aa, Plasmodium falciparum
EKKNSELK

SEQ ID NO: 3309180 - protein, 12 aa, Plasmodium falciparum
EKKNSIENNSKK

SEQ ID NO: 3309181 - protein, 12 aa, Plasmodium falciparum
EKKNSKTKEEKI

SEQ ID NO: 3309182 - protein, 7 aa, Plasmodium falciparum
EKKNSLD

SEQ ID NO: 3309183 - protein, 6 aa, Plasmodium falciparum
EKKNSY

SEQ ID NO: 3309184 - protein, 9 aa, Plasmodium falciparum
EKKNVDDDN

SEQ ID NO: 3309185 - protein, 10 aa, Plasmodium falciparum
EKKNVNEENV

SEQ ID NO: 3309186 - protein, 9 aa, Plasmodium falciparum
EKKNVYEEN

SEQ ID NO: 3309187 - protein, 9 aa, Plasmodium falciparum
EKKNYKKYS

SEQ ID NO: 3309188 - protein, 9 aa, Plasmodium falciparum
EKKPAKAPT

SEQ ID NO: 3309189 - protein, 7 aa, Plasmodium falciparum
EKKPAKT

SEQ ID NO: 3309190 - protein, 7 aa, Plasmodium falciparum
EKKPEKT

SEQ ID NO: 3309191 - protein, 7 aa, Plasmodium falciparum
EKKQEQV

SEQ ID NO: 3309192 - protein, 6 aa, Plasmodium falciparum
EKKQIE

SEQ ID NO: 3309193 - protein, 22 aa, Plasmodium falciparum
EKKQKKDYKDEKDEKDDENHKY

SEQ ID NO: 3309194 - protein, 9 aa, Plasmodium falciparum
EKKQKKIER

SEQ ID NO: 3309195 - protein, 5 aa, Plasmodium falciparum
EKKQN

SEQ ID NO: 3309196 - protein, 10 aa, Plasmodium falciparum
EKKQNKEKEI

SEQ ID NO: 3309197 - protein, 7 aa, Plasmodium falciparum
EKKQQYR

SEQ ID NO: 3309198 - protein, 12 aa, Plasmodium falciparum
EKKQRTKQISNK

SEQ ID NO: 3309199 - protein, 11 aa, Plasmodium falciparum
EKKREEANKEN

SEQ ID NO: 3309200 - protein, 8 aa, Plasmodium falciparum
EKKRIKGI

SEQ ID NO: 3309201 - protein, 5 aa, Plasmodium falciparum
EKKRK

SEQ ID NO: 3309202 - protein, 15 aa, Plasmodium falciparum
EKKRKDKKGKNNKSI

SEQ ID NO: 3309203 - protein, 7 aa, Plasmodium falciparum
EKKRKEK

SEQ ID NO: 3309204 - protein, 21 aa, Plasmodium falciparum
EKKRKENNKEKDRDREKLDAR

SEQ ID NO: 3309205 - protein, 8 aa, Plasmodium falciparum
EKKRKHPK

SEQ ID NO: 3309206 - protein, 6 aa, Plasmodium falciparum
EKKRKL

SEQ ID NO: 3309207 - protein, 7 aa, Plasmodium falciparum
EKKRMDN

SEQ ID NO: 3309208 - protein, 19 aa, Plasmodium falciparum
EKKRPPKLSNNKNNENYKN

SEQ ID NO: 3309209 - protein, 9 aa, Plasmodium falciparum
EKKRVRDSL

SEQ ID NO: 3309210 - protein, 10 aa, Plasmodium falciparum
EKKSERPIAK

SEQ ID NO: 3309211 - protein, 31 aa, Plasmodium falciparum
EKKSKKNKTHPLDSKNTTDRKYNKYRRNEQN

SEQ ID NO: 3309212 - protein, 11 aa, Plasmodium falciparum
EKKSKNPNNYN

SEQ ID NO: 3309213 - protein, 30 aa, Plasmodium falciparum
EKKSNDKLQNEVQSEGENDYDINVEEYFCE

SEQ ID NO: 3309214 - protein, 8 aa, Plasmodium falciparum
EKKSPNEL

SEQ ID NO: 3309215 - protein, 5 aa, Plasmodium falciparum
EKKSV

SEQ ID NO: 3309216 - protein, 9 aa, Plasmodium falciparum
EKKTEGNLS

SEQ ID NO: 3309217 - protein, 9 aa, Plasmodium falciparum
EKKTEKENV

SEQ ID NO: 3309218 - protein, 7 aa, Plasmodium falciparum
EKKTERK

SEQ ID NO: 3309219 - protein, 7 aa, Plasmodium falciparum
EKKTESL

SEQ ID NO: 3309220 - protein, 13 aa, Plasmodium falciparum
EKKTFEDKNKMNR

SEQ ID NO: 3309221 - protein, 5 aa, Plasmodium falciparum
EKKTK

SEQ ID NO: 3309222 - protein, 10 aa, Plasmodium falciparum
EKKTKPKDIH

SEQ ID NO: 3309223 - protein, 8 aa, Plasmodium falciparum
EKKTNDDQ

SEQ ID NO: 3309224 - protein, 9 aa, Plasmodium falciparum
EKKTNDNFD

SEQ ID NO: 3309225 - protein, 7 aa, Plasmodium falciparum
EKKTNNM

SEQ ID NO: 3309226 - protein, 15 aa, Plasmodium falciparum
EKKTQNKKETHSNSR

SEQ ID NO: 3309227 - protein, 13 aa, Plasmodium falciparum
EKKTYDEKSEKKE

SEQ ID NO: 3309228 - protein, 14 aa, Plasmodium falciparum
EKKTYKKKRKNQIN

SEQ ID NO: 3309229 - protein, 9 aa, Plasmodium falciparum
EKKVSTHNN

SEQ ID NO: 3309230 - protein, 84 aa, Plasmodium falciparum
EKKYDDENGDEENKDDNNSNNIVNGETGNEKHYKDDKYHDDKKLDNTNESVKSNDNYTYESDVSDTNNTIDNNNNNNKDITSTN

SEQ ID NO: 3309231 - protein, 7 aa, Plasmodium falciparum
EKKYDNI

SEQ ID NO: 3309232 - protein, 7 aa, Plasmodium falciparum
EKKYDTH

SEQ ID NO: 3309233 - protein, 12 aa, Plasmodium falciparum
EKKYEDKKKAYD

SEQ ID NO: 3309234 - protein, 9 aa, Plasmodium falciparum
EKKYEEEKN

SEQ ID NO: 3309235 - protein, 9 aa, Plasmodium falciparum
EKKYNQDSI

SEQ ID NO: 3309236 - protein, 28 aa, Plasmodium falciparum
EKLDNNPIYKTKEKNRNNNNKKNNNSNN

SEQ ID NO: 3309237 - protein, 4 aa, Plasmodium falciparum
EKLE

SEQ ID NO: 3309238 - protein, 9 aa, Plasmodium falciparum
EKLEEQDKY

SEQ ID NO: 3309239 - protein, 9 aa, Plasmodium falciparum
EKLEKEKCK

SEQ ID NO: 3309240 - protein, 6 aa, Plasmodium falciparum
EKLENS

SEQ ID NO: 3309241 - protein, 8 aa, Plasmodium falciparum
EKLEQRPS

SEQ ID NO: 3309242 - protein, 8 aa, Plasmodium falciparum
EKLGKSEY

SEQ ID NO: 3309243 - protein, 6 aa, Plasmodium falciparum
EKLKDK

SEQ ID NO: 3309244 - protein, 24 aa, Plasmodium falciparum
EKLKDNKTEKYNELSKKNNKILEG

SEQ ID NO: 3309245 - protein, 6 aa, Plasmodium falciparum
EKLKEE

SEQ ID NO: 3309246 - protein, 33 aa, Plasmodium falciparum
EKLKEEKKKKEKENEKENEKEKEKKKKDKNQNL

SEQ ID NO: 3309247 - protein, 14 aa, Plasmodium falciparum
EKLKKNKSHNKKRK

SEQ ID NO: 3309248 - protein, 20 aa, Plasmodium falciparum
EKLKTNDKNDEDKEKVNTIS

SEQ ID NO: 3309249 - protein, 6 aa, Plasmodium falciparum
EKLNDM

SEQ ID NO: 3309250 - protein, 20 aa, Plasmodium falciparum
EKLNEENKKENKKKKEENSV

SEQ ID NO: 3309251 - protein, 6 aa, Plasmodium falciparum
EKLNNN

SEQ ID NO: 3309252 - protein, 27 aa, Plasmodium falciparum
EKLNNTNENIDETHEESDPSNSTEETV

SEQ ID NO: 3309253 - protein, 4 aa, Plasmodium falciparum
EKLQ

SEQ ID NO: 3309254 - protein, 6 aa, Plasmodium falciparum
EKLQNS

SEQ ID NO: 3309255 - protein, 7 aa, Plasmodium falciparum
EKLQPAE

SEQ ID NO: 3309256 - protein, 10 aa, Plasmodium falciparum
EKLRGRESSS

SEQ ID NO: 3309257 - protein, 20 aa, Plasmodium falciparum
EKLRSKSDTKSKEHKKKDKK

SEQ ID NO: 3309258 - protein, 9 aa, Plasmodium falciparum
EKMEATNYD

SEQ ID NO: 3309259 - protein, 13 aa, Plasmodium falciparum
EKMEKSQNVQQEN

SEQ ID NO: 3309260 - protein, 5 aa, Plasmodium falciparum
EKMKN

SEQ ID NO: 3309261 - protein, 8 aa, Plasmodium falciparum
EKMKNDGL

SEQ ID NO: 3309262 - protein, 10 aa, Plasmodium falciparum
EKMKNEKMKN

SEQ ID NO: 3309263 - protein, 7 aa, Plasmodium falciparum
EKMNDGM

SEQ ID NO: 3309264 - protein, 8 aa, Plasmodium falciparum
EKMPNTGI

SEQ ID NO: 3309265 - protein, 30 aa, Plasmodium falciparum
EKMRRKKSDMNNNNPYSVPPTKSYQKNDRS

SEQ ID NO: 3309266 - protein, 9 aa, Plasmodium falciparum
EKMSKSKGN

SEQ ID NO: 3309267 - protein, 8 aa, Plasmodium falciparum
EKNDDKRI

SEQ ID NO: 3309268 - protein, 7 aa, Plasmodium falciparum
EKNDEFL

SEQ ID NO: 3309269 - protein, 8 aa, Plasmodium falciparum
EKNDEVNN

SEQ ID NO: 3309270 - protein, 15 aa, Plasmodium falciparum
EKNDIDKKKRDKETI

SEQ ID NO: 3309271 - protein, 6 aa, Plasmodium falciparum
EKNDKI

SEQ ID NO: 3309272 - protein, 9 aa, Plasmodium falciparum
EKNDKMCNE

SEQ ID NO: 3309273 - protein, 6 aa, Plasmodium falciparum
EKNDNI

SEQ ID NO: 3309274 - protein, 13 aa, Plasmodium falciparum
EKNDNNDNNDKNN

SEQ ID NO: 3309275 - protein, 6 aa, Plasmodium falciparum
EKNDRI

SEQ ID NO: 3309276 - protein, 7 aa, Plasmodium falciparum
EKNDRIY

SEQ ID NO: 3309277 - protein, 6 aa, Plasmodium falciparum
EKNDRN

SEQ ID NO: 3309278 - protein, 37 aa, Plasmodium falciparum
EKNDSNNNNNNNNNNNNNNNNNSSSSSSSSSSNNSNS

SEQ ID NO: 3309279 - protein, 16 aa, Plasmodium falciparum
EKNDSSEFNKNENNPY

SEQ ID NO: 3309280 - protein, 8 aa, Plasmodium falciparum
EKNDTNNM

SEQ ID NO: 3309281 - protein, 12 aa, Plasmodium falciparum
EKNDYTRNDTQK

SEQ ID NO: 3309282 - protein, 4 aa, Plasmodium falciparum
EKNE

SEQ ID NO: 3309283 - protein, 6 aa, Plasmodium falciparum
EKNEDY

SEQ ID NO: 3309284 - protein, 5 aa, Plasmodium falciparum
EKNEE

SEQ ID NO: 3309285 - protein, 8 aa, Plasmodium falciparum
EKNEEDIT

SEQ ID NO: 3309286 - protein, 9 aa, Plasmodium falciparum
EKNEEISEK

SEQ ID NO: 3309287 - protein, 19 aa, Plasmodium falciparum
EKNEEKNVDGQEKNENIQE

SEQ ID NO: 3309288 - protein, 31 aa, Plasmodium falciparum
EKNEENDNNDNASRGNNNMHTNNKPGNPTKN

SEQ ID NO: 3309289 - protein, 9 aa, Plasmodium falciparum
EKNEETKED

SEQ ID NO: 3309290 - protein, 5 aa, Plasmodium falciparum
EKNEI

SEQ ID NO: 3309291 - protein, 6 aa, Plasmodium falciparum
EKNEIM

SEQ ID NO: 3309292 - protein, 29 aa, Plasmodium falciparum
EKNEKHEKNEKNEKNEKDEKDEKDEKDEK

SEQ ID NO: 3309293 - protein, 11 aa, Plasmodium falciparum
EKNEKKKIKEK

SEQ ID NO: 3309294 - protein, 5 aa, Plasmodium falciparum
EKNEM

SEQ ID NO: 3309295 - protein, 8 aa, Plasmodium falciparum
EKNENEKM

SEQ ID NO: 3309296 - protein, 6 aa, Plasmodium falciparum
EKNENR

SEQ ID NO: 3309297 - protein, 7 aa, Plasmodium falciparum
EKNEPFD

SEQ ID NO: 3309298 - protein, 7 aa, Plasmodium falciparum
EKNEQNI

SEQ ID NO: 3309299 - protein, 9 aa, Plasmodium falciparum
EKNESASDA

SEQ ID NO: 3309300 - protein, 7 aa, Plasmodium falciparum
EKNESRI

SEQ ID NO: 3309301 - protein, 4 aa, Plasmodium falciparum
EKNG

SEQ ID NO: 3309302 - protein, 6 aa, Plasmodium falciparum
EKNGDV

SEQ ID NO: 3309303 - protein, 7 aa, Plasmodium falciparum
EKNGHGK

SEQ ID NO: 3309304 - protein, 10 aa, Plasmodium falciparum
EKNGKQKNEV

SEQ ID NO: 3309305 - protein, 18 aa, Plasmodium falciparum
EKNGKTNVEMSELHKSTV

SEQ ID NO: 3309306 - protein, 6 aa, Plasmodium falciparum
EKNGNM

SEQ ID NO: 3309307 - protein, 7 aa, Plasmodium falciparum
EKNGNRV

SEQ ID NO: 3309308 - protein, 14 aa, Plasmodium falciparum
EKNGTYDDDDKGYI

SEQ ID NO: 3309309 - protein, 9 aa, Plasmodium falciparum
EKNGYKEEI

SEQ ID NO: 3309310 - protein, 6 aa, Plasmodium falciparum
EKNHEN

SEQ ID NO: 3309311 - protein, 8 aa, Plasmodium falciparum
EKNHGTLR

SEQ ID NO: 3309312 - protein, 28 aa, Plasmodium falciparum
EKNHQSDCSNNNNNNNNNNNNNNNNNAS

SEQ ID NO: 3309313 - protein, 4 aa, Plasmodium falciparum
EKNI

SEQ ID NO: 3309314 - protein, 31 aa, Plasmodium falciparum
EKNIENQEDDENEEETHEGKHTNSNSENYYE

SEQ ID NO: 3309315 - protein, 61 aa, Plasmodium falciparum
EKNIKEKEKNKDNDKDDDKGNDKGNDKGNDKDNDKGNDKGNDKDNDKGNDKGNDKGNHNIN

SEQ ID NO: 3309316 - protein, 6 aa, Plasmodium falciparum
EKNINE

SEQ ID NO: 3309317 - protein, 5 aa, Plasmodium falciparum
EKNIS

SEQ ID NO: 3309318 - protein, 14 aa, Plasmodium falciparum
EKNISEYPNLSNNS

SEQ ID NO: 3309319 - protein, 5 aa, Plasmodium falciparum
EKNIT

SEQ ID NO: 3309320 - protein, 13 aa, Plasmodium falciparum
EKNKDSKKKRNLK

SEQ ID NO: 3309321 - protein, 5 aa, Plasmodium falciparum
EKNKE

SEQ ID NO: 3309322 - protein, 7 aa, Plasmodium falciparum
EKNKELK

SEQ ID NO: 3309323 - protein, 8 aa, Plasmodium falciparum
EKNKERET

SEQ ID NO: 3309324 - protein, 25 aa, Plasmodium falciparum
EKNKGYYKDSSNKNMNNNNIGNNNT

SEQ ID NO: 3309325 - protein, 8 aa, Plasmodium falciparum
EKNKHNKI

SEQ ID NO: 3309326 - protein, 9 aa, Plasmodium falciparum
EKNKKDKDC

SEQ ID NO: 3309327 - protein, 10 aa, Plasmodium falciparum
EKNKKDNETM

SEQ ID NO: 3309328 - protein, 9 aa, Plasmodium falciparum
EKNKKGNID

SEQ ID NO: 3309329 - protein, 10 aa, Plasmodium falciparum
EKNKKNKKKL

SEQ ID NO: 3309330 - protein, 9 aa, Plasmodium falciparum
EKNKKYTDF

SEQ ID NO: 3309331 - protein, 17 aa, Plasmodium falciparum
EKNKMSEKKRSNHKTKD

SEQ ID NO: 3309332 - protein, 5 aa, Plasmodium falciparum
EKNKN

SEQ ID NO: 3309333 - protein, 10 aa, Plasmodium falciparum
EKNKNEETIN

SEQ ID NO: 3309334 - protein, 10 aa, Plasmodium falciparum
EKNKNEVETN

SEQ ID NO: 3309335 - protein, 20 aa, Plasmodium falciparum
EKNKNEYNNLSKNEDEKSII

SEQ ID NO: 3309336 - protein, 28 aa, Plasmodium falciparum
EKNKNINLKGNGNLNNMNNKKGNDLSKN

SEQ ID NO: 3309337 - protein, 9 aa, Plasmodium falciparum
EKNKNKINA

SEQ ID NO: 3309338 - protein, 5 aa, Plasmodium falciparum
EKNKQ

SEQ ID NO: 3309339 - protein, 40 aa, Plasmodium falciparum
EKNKQEIENNKNNKNNKNNKNNKNTYKKNSDKNDNPRNDL

SEQ ID NO: 3309340 - protein, 9 aa, Plasmodium falciparum
EKNKQRKEY

SEQ ID NO: 3309341 - protein, 21 aa, Plasmodium falciparum
EKNKQTNKKKKKLPKIPEKKK

SEQ ID NO: 3309342 - protein, 21 aa, Plasmodium falciparum
EKNKRDKKKGTHINNKNDAEE

SEQ ID NO: 3309343 - protein, 13 aa, Plasmodium falciparum
EKNKRDNRINEEK

SEQ ID NO: 3309344 - protein, 36 aa, Plasmodium falciparum
EKNKSEQLNETQDTNNENDITSNQKEEAKDPNGSIS

SEQ ID NO: 3309345 - protein, 12 aa, Plasmodium falciparum
EKNKSINELKKI

SEQ ID NO: 3309346 - protein, 9 aa, Plasmodium falciparum
EKNKTQTNL

SEQ ID NO: 3309347 - protein, 21 aa, Plasmodium falciparum
EKNKYNEETNADYKKKEISIP

SEQ ID NO: 3309348 - protein, 8 aa, Plasmodium falciparum
EKNKYNKH

SEQ ID NO: 3309349 - protein, 4 aa, Plasmodium falciparum
EKNL

SEQ ID NO: 3309350 - protein, 5 aa, Plasmodium falciparum
EKNLS

SEQ ID NO: 3309351 - protein, 21 aa, Plasmodium falciparum
EKNMKEDNIPDDTHYKEKRRN

SEQ ID NO: 3309352 - protein, 16 aa, Plasmodium falciparum
EKNMSTKKDDSNNKCV

SEQ ID NO: 3309353 - protein, 4 aa, Plasmodium falciparum
EKNN

SEQ ID NO: 3309354 - protein, 8 aa, Plasmodium falciparum
EKNNDINE

SEQ ID NO: 3309355 - protein, 7 aa, Plasmodium falciparum
EKNNDSL

SEQ ID NO: 3309356 - protein, 8 aa, Plasmodium falciparum
EKNNEQDI

SEQ ID NO: 3309357 - protein, 11 aa, Plasmodium falciparum
EKNNGEQNGRC

SEQ ID NO: 3309358 - protein, 9 aa, Plasmodium falciparum
EKNNGGSKI

SEQ ID NO: 3309359 - protein, 7 aa, Plasmodium falciparum
EKNNGNT

SEQ ID NO: 3309360 - protein, 10 aa, Plasmodium falciparum
EKNNHIPSNN

SEQ ID NO: 3309361 - protein, 5 aa, Plasmodium falciparum
EKNNI

SEQ ID NO: 3309362 - protein, 13 aa, Plasmodium falciparum
EKNNKEKTNKYSR

SEQ ID NO: 3309363 - protein, 10 aa, Plasmodium falciparum
EKNNKKENKI

SEQ ID NO: 3309364 - protein, 9 aa, Plasmodium falciparum
EKNNKNTAK

SEQ ID NO: 3309365 - protein, 8 aa, Plasmodium falciparum
EKNNKQTY

SEQ ID NO: 3309366 - protein, 9 aa, Plasmodium falciparum
EKNNKTDHH

SEQ ID NO: 3309367 - protein, 51 aa, Plasmodium falciparum
EKNNLSSNKSDSSDKTNNSKKEKRKKKSNHNNHNNNNNNKRTDTQRKDTLN

SEQ ID NO: 3309368 - protein, 7 aa, Plasmodium falciparum
EKNNMNS

SEQ ID NO: 3309369 - protein, 5 aa, Plasmodium falciparum
EKNNN

SEQ ID NO: 3309370 - protein, 7 aa, Plasmodium falciparum
EKNNNCM

SEQ ID NO: 3309371 - protein, 15 aa, Plasmodium falciparum
EKNNNDNDNNNNNNI

SEQ ID NO: 3309372 - protein, 16 aa, Plasmodium falciparum
EKNNNEEKSDKRNGHY

SEQ ID NO: 3309373 - protein, 8 aa, Plasmodium falciparum
EKNNNLEC

SEQ ID NO: 3309374 - protein, 8 aa, Plasmodium falciparum
EKNNNTND

SEQ ID NO: 3309375 - protein, 10 aa, Plasmodium falciparum
EKNNQCESNE

SEQ ID NO: 3309376 - protein, 7 aa, Plasmodium falciparum
EKNNQHT

SEQ ID NO: 3309377 - protein, 5 aa, Plasmodium falciparum
EKNNS

SEQ ID NO: 3309378 - protein, 8 aa, Plasmodium falciparum
EKNNSIPL

SEQ ID NO: 3309379 - protein, 9 aa, Plasmodium falciparum
EKNNSNNIG

SEQ ID NO: 3309380 - protein, 8 aa, Plasmodium falciparum
EKNNSRKL

SEQ ID NO: 3309381 - protein, 14 aa, Plasmodium falciparum
EKNNSTEKNSTHSI

SEQ ID NO: 3309382 - protein, 9 aa, Plasmodium falciparum
EKNNTNKKY

SEQ ID NO: 3309383 - protein, 8 aa, Plasmodium falciparum
EKNNTNNW

SEQ ID NO: 3309384 - protein, 7 aa, Plasmodium falciparum
EKNNYEN

SEQ ID NO: 3309385 - protein, 22 aa, Plasmodium falciparum
EKNPDETNTRKLRKKSVKKNKN

SEQ ID NO: 3309386 - protein, 7 aa, Plasmodium falciparum
EKNPDIS

SEQ ID NO: 3309387 - protein, 8 aa, Plasmodium falciparum
EKNPDKNN

SEQ ID NO: 3309388 - protein, 6 aa, Plasmodium falciparum
EKNPDM

SEQ ID NO: 3309389 - protein, 10 aa, Plasmodium falciparum
EKNPQKKDKI

SEQ ID NO: 3309390 - protein, 35 aa, Plasmodium falciparum
EKNQDTSLSNSYDNHDNTSDDNSSDDYKIKETDLN

SEQ ID NO: 3309391 - protein, 14 aa, Plasmodium falciparum
EKNQESHDEYNEEA

SEQ ID NO: 3309392 - protein, 32 aa, Plasmodium falciparum
EKNREREKEMDRERDMDRNREKERNMDREREM

SEQ ID NO: 3309393 - protein, 10 aa, Plasmodium falciparum
EKNRKRKSEQ

SEQ ID NO: 3309394 - protein, 6 aa, Plasmodium falciparum
EKNRQI

SEQ ID NO: 3309395 - protein, 14 aa, Plasmodium falciparum
EKNRQKQSKVSSNS

SEQ ID NO: 3309396 - protein, 15 aa, Plasmodium falciparum
EKNRSKIKKELSKEE

SEQ ID NO: 3309397 - protein, 5 aa, Plasmodium falciparum
EKNSK

SEQ ID NO: 3309398 - protein, 7 aa, Plasmodium falciparum
EKNSKIQ

SEQ ID NO: 3309399 - protein, 11 aa, Plasmodium falciparum
EKNSKPDSNNI

SEQ ID NO: 3309400 - protein, 5 aa, Plasmodium falciparum
EKNSN

SEQ ID NO: 3309401 - protein, 7 aa, Plasmodium falciparum
EKNSNIG

SEQ ID NO: 3309402 - protein, 18 aa, Plasmodium falciparum
EKNSNNSLDDKSKGGKCL

SEQ ID NO: 3309403 - protein, 5 aa, Plasmodium falciparum
EKNSS

SEQ ID NO: 3309404 - protein, 10 aa, Plasmodium falciparum
EKNSSEPSDV

SEQ ID NO: 3309405 - protein, 23 aa, Plasmodium falciparum
EKNSTTKLEKPNHKNKCSEKDAY

SEQ ID NO: 3309406 - protein, 5 aa, Plasmodium falciparum
EKNSY

SEQ ID NO: 3309407 - protein, 7 aa, Plasmodium falciparum
EKNTDMK

SEQ ID NO: 3309408 - protein, 5 aa, Plasmodium falciparum
EKNTE

SEQ ID NO: 3309409 - protein, 7 aa, Plasmodium falciparum
EKNTKPF

SEQ ID NO: 3309410 - protein, 9 aa, Plasmodium falciparum
EKNTKRKSY

SEQ ID NO: 3309411 - protein, 8 aa, Plasmodium falciparum
EKNTLRKK

SEQ ID NO: 3309412 - protein, 5 aa, Plasmodium falciparum
EKNTN

SEQ ID NO: 3309413 - protein, 45 aa, Plasmodium falciparum
EKNTNISNNKTSSNHSNISNISNKSNKSNISNKSNISKISNESFN

SEQ ID NO: 3309414 - protein, 7 aa, Plasmodium falciparum
EKNTNLT

SEQ ID NO: 3309415 - protein, 9 aa, Plasmodium falciparum
EKNTSNMKN

SEQ ID NO: 3309416 - protein, 5 aa, Plasmodium falciparum
EKNVE

SEQ ID NO: 3309417 - protein, 9 aa, Plasmodium falciparum
EKNVHSTKK

SEQ ID NO: 3309418 - protein, 10 aa, Plasmodium falciparum
EKNVKETKEE

SEQ ID NO: 3309419 - protein, 8 aa, Plasmodium falciparum
EKNVKNEK

SEQ ID NO: 3309420 - protein, 17 aa, Plasmodium falciparum
EKNVNTSDQCNDKINAP

SEQ ID NO: 3309421 - protein, 9 aa, Plasmodium falciparum
EKNVQSKKY

SEQ ID NO: 3309422 - protein, 16 aa, Plasmodium falciparum
EKNYHPEKKNFNNNLE

SEQ ID NO: 3309423 - protein, 5 aa, Plasmodium falciparum
EKNYN

SEQ ID NO: 3309424 - protein, 6 aa, Plasmodium falciparum
EKPARF

SEQ ID NO: 3309425 - protein, 4 aa, Plasmodium falciparum
EKPD

SEQ ID NO: 3309426 - protein, 6 aa, Plasmodium falciparum
EKPEEV

SEQ ID NO: 3309427 - protein, 7 aa, Plasmodium falciparum
EKPIDAY

SEQ ID NO: 3309428 - protein, 14 aa, Plasmodium falciparum
EKPINNEQEEDHSL

SEQ ID NO: 3309429 - protein, 4 aa, Plasmodium falciparum
EKPK

SEQ ID NO: 3309430 - protein, 5 aa, Plasmodium falciparum
EKPLA

SEQ ID NO: 3309431 - protein, 5 aa, Plasmodium falciparum
EKPLN

SEQ ID NO: 3309432 - protein, 7 aa, Plasmodium falciparum
EKPNDVY

SEQ ID NO: 3309433 - protein, 5 aa, Plasmodium falciparum
EKPNL

SEQ ID NO: 3309434 - protein, 8 aa, Plasmodium falciparum
EKPNQNGG

SEQ ID NO: 3309435 - protein, 5 aa, Plasmodium falciparum
EKPNV

SEQ ID NO: 3309436 - protein, 7 aa, Plasmodium falciparum
EKPPDIT

SEQ ID NO: 3309437 - protein, 7 aa, Plasmodium falciparum
EKPQNLT

SEQ ID NO: 3309438 - protein, 10 aa, Plasmodium falciparum
EKPSIPKSKN

SEQ ID NO: 3309439 - protein, 7 aa, Plasmodium falciparum
EKPSNEL

SEQ ID NO: 3309440 - protein, 10 aa, Plasmodium falciparum
EKPTNQKEAT

SEQ ID NO: 3309441 - protein, 11 aa, Plasmodium falciparum
EKPVNKNSGVV

SEQ ID NO: 3309442 - protein, 9 aa, Plasmodium falciparum
EKPWSNHGD

SEQ ID NO: 3309443 - protein, 6 aa, Plasmodium falciparum
EKPYYK

SEQ ID NO: 3309444 - protein, 7 aa, Plasmodium falciparum
EKQANKK

SEQ ID NO: 3309445 - protein, 13 aa, Plasmodium falciparum
EKQDDNEKQNIGS

SEQ ID NO: 3309446 - protein, 7 aa, Plasmodium falciparum
EKQDYNK

SEQ ID NO: 3309447 - protein, 34 aa, Plasmodium falciparum
EKQEANNKNTKQITSGSNNTSSNLKKNNNYYDSK

SEQ ID NO: 3309448 - protein, 10 aa, Plasmodium falciparum
EKQEDEHKGD

SEQ ID NO: 3309449 - protein, 10 aa, Plasmodium falciparum
EKQEIDKNNS

SEQ ID NO: 3309450 - protein, 9 aa, Plasmodium falciparum
EKQENKGVS

SEQ ID NO: 3309451 - protein, 5 aa, Plasmodium falciparum
EKQES

SEQ ID NO: 3309452 - protein, 7 aa, Plasmodium falciparum
EKQIEDL

SEQ ID NO: 3309453 - protein, 5 aa, Plasmodium falciparum
EKQIN

SEQ ID NO: 3309454 - protein, 14 aa, Plasmodium falciparum
EKQINKSKENETNN

SEQ ID NO: 3309455 - protein, 6 aa, Plasmodium falciparum
EKQITN

SEQ ID NO: 3309456 - protein, 7 aa, Plasmodium falciparum
EKQKDCT

SEQ ID NO: 3309457 - protein, 14 aa, Plasmodium falciparum
EKQKELKSVEENNK

SEQ ID NO: 3309458 - protein, 7 aa, Plasmodium falciparum
EKQKEYQ

SEQ ID NO: 3309459 - protein, 11 aa, Plasmodium falciparum
EKQKKKTNQCT

SEQ ID NO: 3309460 - protein, 9 aa, Plasmodium falciparum
EKQKKYNSF

SEQ ID NO: 3309461 - protein, 15 aa, Plasmodium falciparum
EKQKYNDEDGKENVS

SEQ ID NO: 3309462 - protein, 10 aa, Plasmodium falciparum
EKQLNKNDQQ

SEQ ID NO: 3309463 - protein, 7 aa, Plasmodium falciparum
EKQNDNL

SEQ ID NO: 3309464 - protein, 12 aa, Plasmodium falciparum
EKQNKEKPEAVK

SEQ ID NO: 3309465 - protein, 10 aa, Plasmodium falciparum
EKQNKKYNTY

SEQ ID NO: 3309466 - protein, 13 aa, Plasmodium falciparum
EKQNMDDEKINDN

SEQ ID NO: 3309467 - protein, 10 aa, Plasmodium falciparum
EKQNNNNNNN

SEQ ID NO: 3309468 - protein, 7 aa, Plasmodium falciparum
EKQNNSD

SEQ ID NO: 3309469 - protein, 7 aa, Plasmodium falciparum
EKQNSHK

SEQ ID NO: 3309470 - protein, 36 aa, Plasmodium falciparum
EKQNSLSDSSEVDKKKNKKEKEKEKDKEKEKRKIKK

SEQ ID NO: 3309471 - protein, 6 aa, Plasmodium falciparum
EKQQED

SEQ ID NO: 3309472 - protein, 12 aa, Plasmodium falciparum
EKQQNKGNYRNT

SEQ ID NO: 3309473 - protein, 7 aa, Plasmodium falciparum
EKQRSEI

SEQ ID NO: 3309474 - protein, 10 aa, Plasmodium falciparum
EKQRTEEKWK

SEQ ID NO: 3309475 - protein, 19 aa, Plasmodium falciparum
EKQTENEKNSYIKEENSSI

SEQ ID NO: 3309476 - protein, 8 aa, Plasmodium falciparum
EKQTNDDN

SEQ ID NO: 3309477 - protein, 20 aa, Plasmodium falciparum
EKQTTNQGCNEKRKDNQYDN

SEQ ID NO: 3309478 - protein, 4 aa, Plasmodium falciparum
EKQV

SEQ ID NO: 3309479 - protein, 6 aa, Plasmodium falciparum
EKQYTN

SEQ ID NO: 3309480 - protein, 4 aa, Plasmodium falciparum
EKRD

SEQ ID NO: 3309481 - protein, 44 aa, Plasmodium falciparum
EKRDEEKKNDRKKEEKGSKKLINDSNSKPHKNDMGKHEKNVENK

SEQ ID NO: 3309482 - protein, 6 aa, Plasmodium falciparum
EKRDKI

SEQ ID NO: 3309483 - protein, 13 aa, Plasmodium falciparum
EKRDLEKENLKKR

SEQ ID NO: 3309484 - protein, 8 aa, Plasmodium falciparum
EKRDRVKE

SEQ ID NO: 3309485 - protein, 10 aa, Plasmodium falciparum
EKREEDTNKN

SEQ ID NO: 3309486 - protein, 30 aa, Plasmodium falciparum
EKREEENKNYEKDEHEYESDNYDKEKINKK

SEQ ID NO: 3309487 - protein, 6 aa, Plasmodium falciparum
EKREEF

SEQ ID NO: 3309488 - protein, 12 aa, Plasmodium falciparum
EKREKNKSNGVG

SEQ ID NO: 3309489 - protein, 8 aa, Plasmodium falciparum
EKREKPLA

SEQ ID NO: 3309490 - protein, 12 aa, Plasmodium falciparum
EKREMNNGDGKE

SEQ ID NO: 3309491 - protein, 9 aa, Plasmodium falciparum
EKRFTNNDT

SEQ ID NO: 3309492 - protein, 10 aa, Plasmodium falciparum
EKRGNNKNKI

SEQ ID NO: 3309493 - protein, 9 aa, Plasmodium falciparum
EKRHSSNFD

SEQ ID NO: 3309494 - protein, 4 aa, Plasmodium falciparum
EKRI

SEQ ID NO: 3309495 - protein, 39 aa, Plasmodium falciparum
EKRIQYKKGKKDRRDFEEDDDDDDEDDEEEDDDENNDEM

SEQ ID NO: 3309496 - protein, 39 aa, Plasmodium falciparum
EKRKEELKKLEEQKKREERKKMEEEEKKREEEKKREEEI

SEQ ID NO: 3309497 - protein, 17 aa, Plasmodium falciparum
EKRKEKKNQKKTQTKRQ

SEQ ID NO: 3309498 - protein, 7 aa, Plasmodium falciparum
EKRKGKD

SEQ ID NO: 3309499 - protein, 17 aa, Plasmodium falciparum
EKRKHEKSKKSKYDKDY

SEQ ID NO: 3309500 - protein, 5 aa, Plasmodium falciparum
EKRKK

SEQ ID NO: 3309501 - protein, 14 aa, Plasmodium falciparum
EKRKKKEKQKNSID

SEQ ID NO: 3309502 - protein, 9 aa, Plasmodium falciparum
EKRKKNESE

SEQ ID NO: 3309503 - protein, 18 aa, Plasmodium falciparum
EKRKLEERINKNENIKNL

SEQ ID NO: 3309504 - protein, 14 aa, Plasmodium falciparum
EKRKNKNNKNKMND

SEQ ID NO: 3309505 - protein, 11 aa, Plasmodium falciparum
EKRKRKKSSGH

SEQ ID NO: 3309506 - protein, 10 aa, Plasmodium falciparum
EKRKSDHPSY

SEQ ID NO: 3309507 - protein, 99 aa, Plasmodium falciparum
EKRNDFTTTKGNNNNYENKDENNEKKNEKKNEKKNEKKNKNKNEKKNKNKNENNEKKNENKNKNKNENNENTNENNKNNKNNKNNKNNKNNSNSNNNNN

SEQ ID NO: 3309508 - protein, 6 aa, Plasmodium falciparum
EKRNEQ

SEQ ID NO: 3309509 - protein, 11 aa, Plasmodium falciparum
EKRNKTYKINN

SEQ ID NO: 3309510 - protein, 7 aa, Plasmodium falciparum
EKRNNDK

SEQ ID NO: 3309511 - protein, 11 aa, Plasmodium falciparum
EKRNNSQDVHS

SEQ ID NO: 3309512 - protein, 18 aa, Plasmodium falciparum
EKRNRERERADNKNKENI

SEQ ID NO: 3309513 - protein, 24 aa, Plasmodium falciparum
EKRNTNGGDIKNENGSTKKGKCES

SEQ ID NO: 3309514 - protein, 22 aa, Plasmodium falciparum
EKRQKQIKQENKKIQKNGTKEL

SEQ ID NO: 3309515 - protein, 13 aa, Plasmodium falciparum
EKRRLEKKQQLKE

SEQ ID NO: 3309516 - protein, 14 aa, Plasmodium falciparum
EKRRNSVHNPTGRI

SEQ ID NO: 3309517 - protein, 6 aa, Plasmodium falciparum
EKRRQT

SEQ ID NO: 3309518 - protein, 54 aa, Plasmodium falciparum
EKRRTNRYVSSSSNSSDSSTSNSSDSSSFSTSSDDSDSDSDSDMDSDSYDKKRK

SEQ ID NO: 3309519 - protein, 11 aa, Plasmodium falciparum
EKRSTFNKTNG

SEQ ID NO: 3309520 - protein, 10 aa, Plasmodium falciparum
EKRTCSDKNN

SEQ ID NO: 3309521 - protein, 6 aa, Plasmodium falciparum
EKRTKH

SEQ ID NO: 3309522 - protein, 20 aa, Plasmodium falciparum
EKRTKKSDNSNEHKNDNIYD

SEQ ID NO: 3309523 - protein, 10 aa, Plasmodium falciparum
EKRTTPYQKN

SEQ ID NO: 3309524 - protein, 7 aa, Plasmodium falciparum
EKSADDL

SEQ ID NO: 3309525 - protein, 7 aa, Plasmodium falciparum
EKSDDEI

SEQ ID NO: 3309526 - protein, 5 aa, Plasmodium falciparum
EKSDE

SEQ ID NO: 3309527 - protein, 8 aa, Plasmodium falciparum
EKSDEKNT

SEQ ID NO: 3309528 - protein, 11 aa, Plasmodium falciparum
EKSDKKKTNYN

SEQ ID NO: 3309529 - protein, 13 aa, Plasmodium falciparum
EKSDNKLNNSTNH

SEQ ID NO: 3309530 - protein, 5 aa, Plasmodium falciparum
EKSDS

SEQ ID NO: 3309531 - protein, 8 aa, Plasmodium falciparum
EKSEDGKN

SEQ ID NO: 3309532 - protein, 30 aa, Plasmodium falciparum
EKSENKEPCINESNQKKKKKKNNKKKYNNM

SEQ ID NO: 3309533 - protein, 16 aa, Plasmodium falciparum
EKSENKKKDDDKSNIV

SEQ ID NO: 3309534 - protein, 10 aa, Plasmodium falciparum
EKSENSNKNL

SEQ ID NO: 3309535 - protein, 9 aa, Plasmodium falciparum
EKSETEEDL

SEQ ID NO: 3309536 - protein, 7 aa, Plasmodium falciparum
EKSEVGL

SEQ ID NO: 3309537 - protein, 6 aa, Plasmodium falciparum
EKSFNK

SEQ ID NO: 3309538 - protein, 18 aa, Plasmodium falciparum
EKSFNKDEKKKKKSILET

SEQ ID NO: 3309539 - protein, 4 aa, Plasmodium falciparum
EKSI

SEQ ID NO: 3309540 - protein, 6 aa, Plasmodium falciparum
EKSIEN

SEQ ID NO: 3309541 - protein, 5 aa, Plasmodium falciparum
EKSIH

SEQ ID NO: 3309542 - protein, 9 aa, Plasmodium falciparum
EKSISETKE

SEQ ID NO: 3309543 - protein, 7 aa, Plasmodium falciparum
EKSISQA

SEQ ID NO: 3309544 - protein, 6 aa, Plasmodium falciparum
EKSKCY

SEQ ID NO: 3309545 - protein, 6 aa, Plasmodium falciparum
EKSKLE

SEQ ID NO: 3309546 - protein, 15 aa, Plasmodium falciparum
EKSKNKKEKRVQKQI

SEQ ID NO: 3309547 - protein, 7 aa, Plasmodium falciparum
EKSKQGI

SEQ ID NO: 3309548 - protein, 10 aa, Plasmodium falciparum
EKSLEGSLKE

SEQ ID NO: 3309549 - protein, 9 aa, Plasmodium falciparum
EKSLRGKKS

SEQ ID NO: 3309550 - protein, 6 aa, Plasmodium falciparum
EKSLSN

SEQ ID NO: 3309551 - protein, 7 aa, Plasmodium falciparum
EKSLTEN

SEQ ID NO: 3309552 - protein, 16 aa, Plasmodium falciparum
EKSNEDIKNKDAESVR

SEQ ID NO: 3309553 - protein, 28 aa, Plasmodium falciparum
EKSNIKGNIKSNTNNNTNNNTNNITNNI

SEQ ID NO: 3309554 - protein, 7 aa, Plasmodium falciparum
EKSNKTN

SEQ ID NO: 3309555 - protein, 5 aa, Plasmodium falciparum
EKSNN

SEQ ID NO: 3309556 - protein, 6 aa, Plasmodium falciparum
EKSNNF

SEQ ID NO: 3309557 - protein, 8 aa, Plasmodium falciparum
EKSNQKNS

SEQ ID NO: 3309558 - protein, 14 aa, Plasmodium falciparum
EKSNSSKAINVDYI

SEQ ID NO: 3309559 - protein, 13 aa, Plasmodium falciparum
EKSQGKKKKNMSE

SEQ ID NO: 3309560 - protein, 8 aa, Plasmodium falciparum
EKSQKDRQ

SEQ ID NO: 3309561 - protein, 4 aa, Plasmodium falciparum
EKSR

SEQ ID NO: 3309562 - protein, 10 aa, Plasmodium falciparum
EKSRAKEFKG

SEQ ID NO: 3309563 - protein, 7 aa, Plasmodium falciparum
EKSSKRI

SEQ ID NO: 3309564 - protein, 4 aa, Plasmodium falciparum
EKST

SEQ ID NO: 3309565 - protein, 8 aa, Plasmodium falciparum
EKSTEYNN

SEQ ID NO: 3309566 - protein, 8 aa, Plasmodium falciparum
EKSTGKQN

SEQ ID NO: 3309567 - protein, 7 aa, Plasmodium falciparum
EKSTMQD

SEQ ID NO: 3309568 - protein, 7 aa, Plasmodium falciparum
EKSWDDE

SEQ ID NO: 3309569 - protein, 4 aa, Plasmodium falciparum
EKSY

SEQ ID NO: 3309570 - protein, 7 aa, Plasmodium falciparum
EKSYSLK

SEQ ID NO: 3309571 - protein, 9 aa, Plasmodium falciparum
EKTASQNDI

SEQ ID NO: 3309572 - protein, 10 aa, Plasmodium falciparum
EKTDEENKNS

SEQ ID NO: 3309573 - protein, 36 aa, Plasmodium falciparum
EKTDKGNHRRDSYKEQKGKNKNDEKSKKKESTVNEE

SEQ ID NO: 3309574 - protein, 15 aa, Plasmodium falciparum
EKTDMSKTKCSNDDV

SEQ ID NO: 3309575 - protein, 12 aa, Plasmodium falciparum
EKTDSQKEYKNK

SEQ ID NO: 3309576 - protein, 4 aa, Plasmodium falciparum
EKTE

SEQ ID NO: 3309577 - protein, 7 aa, Plasmodium falciparum
EKTEESV

SEQ ID NO: 3309578 - protein, 19 aa, Plasmodium falciparum
EKTENEKIKQNEEDISGND

SEQ ID NO: 3309579 - protein, 32 aa, Plasmodium falciparum
EKTESASKKKKKKDDDMSEPEEDEQKINEVED

SEQ ID NO: 3309580 - protein, 29 aa, Plasmodium falciparum
EKTETKKKLENNIEDTNVNDDIKKNNNIN

SEQ ID NO: 3309581 - protein, 8 aa, Plasmodium falciparum
EKTFEDED

SEQ ID NO: 3309582 - protein, 6 aa, Plasmodium falciparum
EKTFGE

SEQ ID NO: 3309583 - protein, 13 aa, Plasmodium falciparum
EKTFNNEKNKHLD

SEQ ID NO: 3309584 - protein, 7 aa, Plasmodium falciparum
EKTGKID

SEQ ID NO: 3309585 - protein, 12 aa, Plasmodium falciparum
EKTGRSPSDKRI

SEQ ID NO: 3309586 - protein, 8 aa, Plasmodium falciparum
EKTGSTPA

SEQ ID NO: 3309587 - protein, 22 aa, Plasmodium falciparum
EKTGVSQGVSTANNNDNNVNNM

SEQ ID NO: 3309588 - protein, 6 aa, Plasmodium falciparum
EKTHET

SEQ ID NO: 3309589 - protein, 9 aa, Plasmodium falciparum
EKTKDEIKK

SEQ ID NO: 3309590 - protein, 6 aa, Plasmodium falciparum
EKTKEK

SEQ ID NO: 3309591 - protein, 12 aa, Plasmodium falciparum
EKTKKKTKKCYC

SEQ ID NO: 3309592 - protein, 13 aa, Plasmodium falciparum
EKTKNNKKEDKKF

SEQ ID NO: 3309593 - protein, 7 aa, Plasmodium falciparum
EKTKNQY

SEQ ID NO: 3309594 - protein, 10 aa, Plasmodium falciparum
EKTKNTSDLN

SEQ ID NO: 3309595 - protein, 9 aa, Plasmodium falciparum
EKTKPKNDS

SEQ ID NO: 3309596 - protein, 17 aa, Plasmodium falciparum
EKTKSVKAAYKKYEEEN

SEQ ID NO: 3309597 - protein, 12 aa, Plasmodium falciparum
EKTLEEGDDELQ

SEQ ID NO: 3309598 - protein, 9 aa, Plasmodium falciparum
EKTNDTLEE

SEQ ID NO: 3309599 - protein, 17 aa, Plasmodium falciparum
EKTNEEKISTNDLDTYE

SEQ ID NO: 3309600 - protein, 9 aa, Plasmodium falciparum
EKTNKNNTS

SEQ ID NO: 3309601 - protein, 6 aa, Plasmodium falciparum
EKTNMN

SEQ ID NO: 3309602 - protein, 11 aa, Plasmodium falciparum
EKTNQDKPLND

SEQ ID NO: 3309603 - protein, 7 aa, Plasmodium falciparum
EKTNRSS

SEQ ID NO: 3309604 - protein, 10 aa, Plasmodium falciparum
EKTNVKGGME

SEQ ID NO: 3309605 - protein, 4 aa, Plasmodium falciparum
EKTP

SEQ ID NO: 3309606 - protein, 6 aa, Plasmodium falciparum
EKTQIT

SEQ ID NO: 3309607 - protein, 39 aa, Plasmodium falciparum
EKTQTKYKHEKDTEKKKKKNEYKNENNSISNNKNESHET

SEQ ID NO: 3309608 - protein, 8 aa, Plasmodium falciparum
EKTRDNTY

SEQ ID NO: 3309609 - protein, 13 aa, Plasmodium falciparum
EKTRDTSNNGVSR

SEQ ID NO: 3309610 - protein, 4 aa, Plasmodium falciparum
EKTS

SEQ ID NO: 3309611 - protein, 6 aa, Plasmodium falciparum
EKTSND

SEQ ID NO: 3309612 - protein, 9 aa, Plasmodium falciparum
EKTSSIDGN

SEQ ID NO: 3309613 - protein, 5 aa, Plasmodium falciparum
EKTTI

SEQ ID NO: 3309614 - protein, 9 aa, Plasmodium falciparum
EKTTRETYS

SEQ ID NO: 3309615 - protein, 6 aa, Plasmodium falciparum
EKTTTF

SEQ ID NO: 3309616 - protein, 4 aa, Plasmodium falciparum
EKTY

SEQ ID NO: 3309617 - protein, 6 aa, Plasmodium falciparum
EKVDES

SEQ ID NO: 3309618 - protein, 59 aa, Plasmodium falciparum
EKVENKKEADTNEKEKNMKKKKKKRNEEKNDNNGDDYKEDNYDDDDDDDDDDDEKNNLY

SEQ ID NO: 3309619 - protein, 8 aa, Plasmodium falciparum
EKVGTTSK

SEQ ID NO: 3309620 - protein, 8 aa, Plasmodium falciparum
EKVHNSNN

SEQ ID NO: 3309621 - protein, 14 aa, Plasmodium falciparum
EKVKEEKKNNNKIN

SEQ ID NO: 3309622 - protein, 57 aa, Plasmodium falciparum
EKVKSNTSNNNNNNNNNNNNNNNNNNNNNNNNNNNNNNNNNNNNNNNNNDNNNNNIS

SEQ ID NO: 3309623 - protein, 6 aa, Plasmodium falciparum
EKVNSN

SEQ ID NO: 3309624 - protein, 10 aa, Plasmodium falciparum
EKVQDQDNTL

SEQ ID NO: 3309625 - protein, 17 aa, Plasmodium falciparum
EKVSSHTDYSRAKHSSH

SEQ ID NO: 3309626 - protein, 8 aa, Plasmodium falciparum
EKVTASSA

SEQ ID NO: 3309627 - protein, 4 aa, Plasmodium falciparum
EKWE

SEQ ID NO: 3309628 - protein, 7 aa, Plasmodium falciparum
EKWQPKL

SEQ ID NO: 3309629 - protein, 7 aa, Plasmodium falciparum
EKYADKK

SEQ ID NO: 3309630 - protein, 4 aa, Plasmodium falciparum
EKYD

SEQ ID NO: 3309631 - protein, 9 aa, Plasmodium falciparum
EKYDDQTKS

SEQ ID NO: 3309632 - protein, 7 aa, Plasmodium falciparum
EKYDEKV

SEQ ID NO: 3309633 - protein, 11 aa, Plasmodium falciparum
EKYDKDNNYTH

SEQ ID NO: 3309634 - protein, 23 aa, Plasmodium falciparum
EKYEEDKYYEKENNNEINNAENY

SEQ ID NO: 3309635 - protein, 63 aa, Plasmodium falciparum
EKYEEEKKKNEEERKKNEEERKKNEEERKKNEEEKKKNEEERKKNEEEKKKLEKDKHQFEEEK

SEQ ID NO: 3309636 - protein, 7 aa, Plasmodium falciparum
EKYEEER

SEQ ID NO: 3309637 - protein, 9 aa, Plasmodium falciparum
EKYEEERKN

SEQ ID NO: 3309638 - protein, 10 aa, Plasmodium falciparum
EKYEKRDNEF

SEQ ID NO: 3309639 - protein, 20 aa, Plasmodium falciparum
EKYEKYEKYEKSDNTSHGNK

SEQ ID NO: 3309640 - protein, 9 aa, Plasmodium falciparum
EKYENSGHT

SEQ ID NO: 3309641 - protein, 6 aa, Plasmodium falciparum
EKYEQN

SEQ ID NO: 3309642 - protein, 13 aa, Plasmodium falciparum
EKYEREAKEKSRE

SEQ ID NO: 3309643 - protein, 16 aa, Plasmodium falciparum
EKYETEKKEKEKEQQM

SEQ ID NO: 3309644 - protein, 13 aa, Plasmodium falciparum
EKYETNQSYNSTK

SEQ ID NO: 3309645 - protein, 7 aa, Plasmodium falciparum
EKYGEED

SEQ ID NO: 3309646 - protein, 6 aa, Plasmodium falciparum
EKYGNI

SEQ ID NO: 3309647 - protein, 7 aa, Plasmodium falciparum
EKYKDKD

SEQ ID NO: 3309648 - protein, 8 aa, Plasmodium falciparum
EKYKENTQ

SEQ ID NO: 3309649 - protein, 9 aa, Plasmodium falciparum
EKYKEYGPH

SEQ ID NO: 3309650 - protein, 12 aa, Plasmodium falciparum
EKYKKKKKKKLH

SEQ ID NO: 3309651 - protein, 6 aa, Plasmodium falciparum
EKYKND

SEQ ID NO: 3309652 - protein, 6 aa, Plasmodium falciparum
EKYKNE

SEQ ID NO: 3309653 - protein, 20 aa, Plasmodium falciparum
EKYKNNNNNYRNDDSESNHN

SEQ ID NO: 3309654 - protein, 9 aa, Plasmodium falciparum
EKYKNRKKN

SEQ ID NO: 3309655 - protein, 7 aa, Plasmodium falciparum
EKYKNSR

SEQ ID NO: 3309656 - protein, 10 aa, Plasmodium falciparum
EKYKNVKNNK

SEQ ID NO: 3309657 - protein, 110 aa, Plasmodium falciparum
EKYNDDNKKYDADNNKTYDDDDNNKTYDDDDNNKTYDDDNDNNKKCDGDDNNKKYDGDDNNKKYDDDDDDNNKKYDDDDDDNNKKYDDDDDDNNNKYDNDNDNNKKYDHD

SEQ ID NO: 3309658 - protein, 19 aa, Plasmodium falciparum
EKYNENQKTKTKLNTINKT

SEQ ID NO: 3309659 - protein, 16 aa, Plasmodium falciparum
EKYNSEDDKDEKINKD

SEQ ID NO: 3309660 - protein, 9 aa, Plasmodium falciparum
EKYNTKDNR

SEQ ID NO: 3309661 - protein, 4 aa, Plasmodium falciparum
EKYP

SEQ ID NO: 3309662 - protein, 16 aa, Plasmodium falciparum
EKYPERYKDKKENDED

SEQ ID NO: 3309663 - protein, 4 aa, Plasmodium falciparum
EKYQ

SEQ ID NO: 3309664 - protein, 27 aa, Plasmodium falciparum
EKYQNNINTNEQHNKNEENKNKNVINN

SEQ ID NO: 3309665 - protein, 9 aa, Plasmodium falciparum
EKYSDQNDN

SEQ ID NO: 3309666 - protein, 19 aa, Plasmodium falciparum
EKYSKDNITKNQITSEQDK

SEQ ID NO: 3309667 - protein, 7 aa, Plasmodium falciparum
EKYSKNN

SEQ ID NO: 3309668 - protein, 13 aa, Plasmodium falciparum
EKYSSMDDECSED

SEQ ID NO: 3309669 - protein, 6 aa, Plasmodium falciparum
ELAEQT

SEQ ID NO: 3309670 - protein, 5 aa, Plasmodium falciparum
ELAIP

SEQ ID NO: 3309671 - protein, 17 aa, Plasmodium falciparum
ELARKSSLASQILTKKK

SEQ ID NO: 3309672 - protein, 9 aa, Plasmodium falciparum
ELDDDDNNM

SEQ ID NO: 3309673 - protein, 13 aa, Plasmodium falciparum
ELDDTEEKNISDV

SEQ ID NO: 3309674 - protein, 17 aa, Plasmodium falciparum
ELDKEADKEIKKKQNNL

SEQ ID NO: 3309675 - protein, 4 aa, Plasmodium falciparum
ELDN

SEQ ID NO: 3309676 - protein, 7 aa, Plasmodium falciparum
ELDNNEN

SEQ ID NO: 3309677 - protein, 12 aa, Plasmodium falciparum
ELDNSHDPESIQ

SEQ ID NO: 3309678 - protein, 7 aa, Plasmodium falciparum
ELDPNNK

SEQ ID NO: 3309679 - protein, 5 aa, Plasmodium falciparum
ELDQL

SEQ ID NO: 3309680 - protein, 5 aa, Plasmodium falciparum
ELDRK

SEQ ID NO: 3309681 - protein, 19 aa, Plasmodium falciparum
ELDTPTNSEVFKGFRKVQE

SEQ ID NO: 3309682 - protein, 11 aa, Plasmodium falciparum
ELEADEKKNKM

SEQ ID NO: 3309683 - protein, 4 aa, Plasmodium falciparum
ELEE

SEQ ID NO: 3309684 - protein, 17 aa, Plasmodium falciparum
ELEEDEENLNDDSLKGD

SEQ ID NO: 3309685 - protein, 9 aa, Plasmodium falciparum
ELEENQIDK

SEQ ID NO: 3309686 - protein, 10 aa, Plasmodium falciparum
ELEETNNTLE

SEQ ID NO: 3309687 - protein, 6 aa, Plasmodium falciparum
ELENEF

SEQ ID NO: 3309688 - protein, 11 aa, Plasmodium falciparum
ELENEKKQNKE

SEQ ID NO: 3309689 - protein, 5 aa, Plasmodium falciparum
ELENQ

SEQ ID NO: 3309690 - protein, 6 aa, Plasmodium falciparum
ELEQNY

SEQ ID NO: 3309691 - protein, 8 aa, Plasmodium falciparum
ELESAENK

SEQ ID NO: 3309692 - protein, 9 aa, Plasmodium falciparum
ELETPIPEK

SEQ ID NO: 3309693 - protein, 11 aa, Plasmodium falciparum
ELGEDGPTHQP

SEQ ID NO: 3309694 - protein, 9 aa, Plasmodium falciparum
ELGENEDIN

SEQ ID NO: 3309695 - protein, 7 aa, Plasmodium falciparum
ELGETKA

SEQ ID NO: 3309696 - protein, 6 aa, Plasmodium falciparum
ELGTTE

SEQ ID NO: 3309697 - protein, 7 aa, Plasmodium falciparum
ELHSSTS

SEQ ID NO: 3309698 - protein, 4 aa, Plasmodium falciparum
ELKA

SEQ ID NO: 3309699 - protein, 4 aa, Plasmodium falciparum
ELKD

SEQ ID NO: 3309700 - protein, 11 aa, Plasmodium falciparum
ELKDKDAKASA

SEQ ID NO: 3309701 - protein, 12 aa, Plasmodium falciparum
ELKEEKSNKQNK

SEQ ID NO: 3309702 - protein, 5 aa, Plasmodium falciparum
ELKEK

SEQ ID NO: 3309703 - protein, 8 aa, Plasmodium falciparum
ELKEKDIP

SEQ ID NO: 3309704 - protein, 10 aa, Plasmodium falciparum
ELKEKENLKK

SEQ ID NO: 3309705 - protein, 26 aa, Plasmodium falciparum
ELKEQEDQYSEKNKMNSSLSNNECEQ

SEQ ID NO: 3309706 - protein, 5 aa, Plasmodium falciparum
ELKGD

SEQ ID NO: 3309707 - protein, 5 aa, Plasmodium falciparum
ELKGG

SEQ ID NO: 3309708 - protein, 12 aa, Plasmodium falciparum
ELKGKGGMYPNK

SEQ ID NO: 3309709 - protein, 4 aa, Plasmodium falciparum
ELKI

SEQ ID NO: 3309710 - protein, 4 aa, Plasmodium falciparum
ELKK

SEQ ID NO: 3309711 - protein, 7 aa, Plasmodium falciparum
ELKKKSK

SEQ ID NO: 3309712 - protein, 7 aa, Plasmodium falciparum
ELKKNQS

SEQ ID NO: 3309713 - protein, 17 aa, Plasmodium falciparum
ELKKQNKKKNKIKNYDQ

SEQ ID NO: 3309714 - protein, 16 aa, Plasmodium falciparum
ELKKRKKKKYSNESKV

SEQ ID NO: 3309715 - protein, 12 aa, Plasmodium falciparum
ELKNKTQDEDNH

SEQ ID NO: 3309716 - protein, 5 aa, Plasmodium falciparum
ELKNQ

SEQ ID NO: 3309717 - protein, 6 aa, Plasmodium falciparum
ELKPGD

SEQ ID NO: 3309718 - protein, 25 aa, Plasmodium falciparum
ELKQDDNQEYITEENNKKENEEINV

SEQ ID NO: 3309719 - protein, 12 aa, Plasmodium falciparum
ELKQESKNNIQS

SEQ ID NO: 3309720 - protein, 11 aa, Plasmodium falciparum
ELKRSEEHSDE

SEQ ID NO: 3309721 - protein, 4 aa, Plasmodium falciparum
ELKS

SEQ ID NO: 3309722 - protein, 7 aa, Plasmodium falciparum
ELKSDRS

SEQ ID NO: 3309723 - protein, 4 aa, Plasmodium falciparum
ELKT

SEQ ID NO: 3309724 - protein, 6 aa, Plasmodium falciparum
ELKTEG

SEQ ID NO: 3309725 - protein, 8 aa, Plasmodium falciparum
ELKTKEGD

SEQ ID NO: 3309726 - protein, 6 aa, Plasmodium falciparum
ELKTNN

SEQ ID NO: 3309727 - protein, 5 aa, Plasmodium falciparum
ELLDD

SEQ ID NO: 3309728 - protein, 5 aa, Plasmodium falciparum
ELNDD

SEQ ID NO: 3309729 - protein, 120 aa, Plasmodium falciparum
ELNEKDHKQISSKKMSNSVATARSEYTSESKEYQANDINKKKNEFNRNDTCKNDVKTNDVKTNDVKTNDVKTNDGQTNDVKTNDVKTNDMKTNDMKTNDMKTNDMKTNDIRPMNKDQNMK

SEQ ID NO: 3309730 - protein, 5 aa, Plasmodium falciparum
ELNET

SEQ ID NO: 3309731 - protein, 45 aa, Plasmodium falciparum
ELNETQNNNNNKDKNEYKKIDTNDKINNNNSNNNSNNNSKSNHNN

SEQ ID NO: 3309732 - protein, 4 aa, Plasmodium falciparum
ELNG

SEQ ID NO: 3309733 - protein, 8 aa, Plasmodium falciparum
ELNKKGDD

SEQ ID NO: 3309734 - protein, 22 aa, Plasmodium falciparum
ELNKKKDYETKSEEELKNDNNV

SEQ ID NO: 3309735 - protein, 10 aa, Plasmodium falciparum
ELNKKTKKQI

SEQ ID NO: 3309736 - protein, 6 aa, Plasmodium falciparum
ELNNAT

SEQ ID NO: 3309737 - protein, 13 aa, Plasmodium falciparum
ELNNEEKKKQVES

SEQ ID NO: 3309738 - protein, 23 aa, Plasmodium falciparum
ELNNHNNINNNNNNNNNNNNNSE

SEQ ID NO: 3309739 - protein, 5 aa, Plasmodium falciparum
ELNNK

SEQ ID NO: 3309740 - protein, 9 aa, Plasmodium falciparum
ELNNNDSHI

SEQ ID NO: 3309741 - protein, 8 aa, Plasmodium falciparum
ELNNNNEE

SEQ ID NO: 3309742 - protein, 7 aa, Plasmodium falciparum
ELNNNNN

SEQ ID NO: 3309743 - protein, 9 aa, Plasmodium falciparum
ELNNQQNKD

SEQ ID NO: 3309744 - protein, 6 aa, Plasmodium falciparum
ELNNSC

SEQ ID NO: 3309745 - protein, 10 aa, Plasmodium falciparum
ELNNSNNYHE

SEQ ID NO: 3309746 - protein, 8 aa, Plasmodium falciparum
ELNNSTNQ

SEQ ID NO: 3309747 - protein, 33 aa, Plasmodium falciparum
ELNNVESDKYKSENEDNDSKIKNDEDKKQGNVQ

SEQ ID NO: 3309748 - protein, 9 aa, Plasmodium falciparum
ELNQGNEDN

SEQ ID NO: 3309749 - protein, 22 aa, Plasmodium falciparum
ELNREKDQLKKNLTDSKNEAET

SEQ ID NO: 3309750 - protein, 11 aa, Plasmodium falciparum
ELNSNNNNKLN

SEQ ID NO: 3309751 - protein, 5 aa, Plasmodium falciparum
ELNSS

SEQ ID NO: 3309752 - protein, 4 aa, Plasmodium falciparum
ELNT

SEQ ID NO: 3309753 - protein, 5 aa, Plasmodium falciparum
ELNTR

SEQ ID NO: 3309754 - protein, 10 aa, Plasmodium falciparum
ELPEKKKENM

SEQ ID NO: 3309755 - protein, 6 aa, Plasmodium falciparum
ELPENA

SEQ ID NO: 3309756 - protein, 5 aa, Plasmodium falciparum
ELPHH

SEQ ID NO: 3309757 - protein, 21 aa, Plasmodium falciparum
ELPNDTIKKDSVHKKESLSQE

SEQ ID NO: 3309758 - protein, 14 aa, Plasmodium falciparum
ELPPEKEKINNESI

SEQ ID NO: 3309759 - protein, 5 aa, Plasmodium falciparum
ELQDP

SEQ ID NO: 3309760 - protein, 7 aa, Plasmodium falciparum
ELQEERR

SEQ ID NO: 3309761 - protein, 9 aa, Plasmodium falciparum
ELQEKVEDK

SEQ ID NO: 3309762 - protein, 12 aa, Plasmodium falciparum
ELQERGDRSVRR

SEQ ID NO: 3309763 - protein, 4 aa, Plasmodium falciparum
ELQN

SEQ ID NO: 3309764 - protein, 7 aa, Plasmodium falciparum
ELQNEEK

SEQ ID NO: 3309765 - protein, 16 aa, Plasmodium falciparum
ELSDEEVSSENEYNKK

SEQ ID NO: 3309766 - protein, 7 aa, Plasmodium falciparum
ELSDYTG

SEQ ID NO: 3309767 - protein, 5 aa, Plasmodium falciparum
ELSGA

SEQ ID NO: 3309768 - protein, 9 aa, Plasmodium falciparum
ELSGSNNLT

SEQ ID NO: 3309769 - protein, 5 aa, Plasmodium falciparum
ELSGT

SEQ ID NO: 3309770 - protein, 8 aa, Plasmodium falciparum
ELSQPPNQ

SEQ ID NO: 3309771 - protein, 5 aa, Plasmodium falciparum
ELSSD

SEQ ID NO: 3309772 - protein, 5 aa, Plasmodium falciparum
ELSTD

SEQ ID NO: 3309773 - protein, 9 aa, Plasmodium falciparum
ELSTTECDK

SEQ ID NO: 3309774 - protein, 6 aa, Plasmodium falciparum
ELTEED

SEQ ID NO: 3309775 - protein, 11 aa, Plasmodium falciparum
ELTKKNRQRNT

SEQ ID NO: 3309776 - protein, 14 aa, Plasmodium falciparum
ELTKNKSTNIAKDQ

SEQ ID NO: 3309777 - protein, 6 aa, Plasmodium falciparum
ELTNEE

SEQ ID NO: 3309778 - protein, 13 aa, Plasmodium falciparum
ELTSSAEENNEDI

SEQ ID NO: 3309779 - protein, 10 aa, Plasmodium falciparum
ELTSSNNNKL

SEQ ID NO: 3309780 - protein, 12 aa, Plasmodium falciparum
ELYKSKKDSTLS

SEQ ID NO: 3309781 - protein, 29 aa, Plasmodium falciparum
EMASSHNRKRKKTGDNNNNNNNNNNVTTA

SEQ ID NO: 3309782 - protein, 13 aa, Plasmodium falciparum
EMCNESDVNNNNI

SEQ ID NO: 3309783 - protein, 6 aa, Plasmodium falciparum
EMDNEN

SEQ ID NO: 3309784 - protein, 4 aa, Plasmodium falciparum
EMDY

SEQ ID NO: 3309785 - protein, 5 aa, Plasmodium falciparum
EMEDE

SEQ ID NO: 3309786 - protein, 18 aa, Plasmodium falciparum
EMEEREKEIDNERRNIER

SEQ ID NO: 3309787 - protein, 16 aa, Plasmodium falciparum
EMETGRINQEDKSDIS

SEQ ID NO: 3309788 - protein, 15 aa, Plasmodium falciparum
EMGNIEKEEQDNDMY

SEQ ID NO: 3309789 - protein, 9 aa, Plasmodium falciparum
EMGTSGNMK

SEQ ID NO: 3309790 - protein, 10 aa, Plasmodium falciparum
EMKDQNNSYH

SEQ ID NO: 3309791 - protein, 6 aa, Plasmodium falciparum
EMKETN

SEQ ID NO: 3309792 - protein, 13 aa, Plasmodium falciparum
EMKGAKNDSLNQN

SEQ ID NO: 3309793 - protein, 10 aa, Plasmodium falciparum
EMKGNNDNID

SEQ ID NO: 3309794 - protein, 14 aa, Plasmodium falciparum
EMKKSSNKNKKSET

SEQ ID NO: 3309795 - protein, 5 aa, Plasmodium falciparum
EMKNE

SEQ ID NO: 3309796 - protein, 10 aa, Plasmodium falciparum
EMKNQNENVP

SEQ ID NO: 3309797 - protein, 5 aa, Plasmodium falciparum
EMMNN

SEQ ID NO: 3309798 - protein, 4 aa, Plasmodium falciparum
EMNE

SEQ ID NO: 3309799 - protein, 8 aa, Plasmodium falciparum
EMNKMGPN

SEQ ID NO: 3309800 - protein, 4 aa, Plasmodium falciparum
EMNN

SEQ ID NO: 3309801 - protein, 5 aa, Plasmodium falciparum
EMNNN

SEQ ID NO: 3309802 - protein, 6 aa, Plasmodium falciparum
EMNNNT

SEQ ID NO: 3309803 - protein, 14 aa, Plasmodium falciparum
EMNSQNINEHNEEY

SEQ ID NO: 3309804 - protein, 8 aa, Plasmodium falciparum
EMNSSPSI

SEQ ID NO: 3309805 - protein, 5 aa, Plasmodium falciparum
EMNTQ

SEQ ID NO: 3309806 - protein, 15 aa, Plasmodium falciparum
EMQNEDNEEQGSNSF

SEQ ID NO: 3309807 - protein, 48 aa, Plasmodium falciparum
EMSGELSDEMSDEMSDEMSDEMSDEMSDEMSDEMSDEMSDKTSDEMSN

SEQ ID NO: 3309808 - protein, 26 aa, Plasmodium falciparum
EMSNNTDKINEDSTVGVTDKGDNKLD

SEQ ID NO: 3309809 - protein, 31 aa, Plasmodium falciparum
EMSSNDEYKNVQKKKQVYNNSDDHKNSNEDQ

SEQ ID NO: 3309810 - protein, 6 aa, Plasmodium falciparum
EMTQGT

SEQ ID NO: 3309811 - protein, 7 aa, Plasmodium falciparum
ENAADCG

SEQ ID NO: 3309812 - protein, 5 aa, Plasmodium falciparum
ENADT

SEQ ID NO: 3309813 - protein, 8 aa, Plasmodium falciparum
ENADTNVN

SEQ ID NO: 3309814 - protein, 4 aa, Plasmodium falciparum
ENAE

SEQ ID NO: 3309815 - protein, 16 aa, Plasmodium falciparum
ENAEESNNYSSPYNEK

SEQ ID NO: 3309816 - protein, 19 aa, Plasmodium falciparum
ENAGGFPNYPKEGPPPNHF

SEQ ID NO: 3309817 - protein, 8 aa, Plasmodium falciparum
ENAGHEGS

SEQ ID NO: 3309818 - protein, 9 aa, Plasmodium falciparum
ENAKGNGTS

SEQ ID NO: 3309819 - protein, 6 aa, Plasmodium falciparum
ENAKKR

SEQ ID NO: 3309820 - protein, 4 aa, Plasmodium falciparum
ENAN

SEQ ID NO: 3309821 - protein, 10 aa, Plasmodium falciparum
ENANGTIENE

SEQ ID NO: 3309822 - protein, 5 aa, Plasmodium falciparum
ENANM

SEQ ID NO: 3309823 - protein, 7 aa, Plasmodium falciparum
ENASSIN

SEQ ID NO: 3309824 - protein, 269 aa, Plasmodium falciparum
ENAVTNDKGSHYSSRRSRSHSNKVSRGSSRRREGSSRRRDSSRRRDSSRRRDRYSRRYERRSERKDDSRREERRGDSRRDSSRRDSSRRNDRRDESRRDESRRDESRRDESRRDESRRDESRRDESRRDESRRDESRRDESRRDESRREESRRDESRREESRRDESRRTADDRKDDHADSVTTKKDDYKRRGTDDSKKEENNRGGSSYDYNNRKHRTYDKHSSSRNNYDRKRNSRYSVSDKKNYDNKSYISDDKRKHRDSYDKSFRNSH

SEQ ID NO: 3309825 - protein, 6 aa, Plasmodium falciparum
ENCRGS

SEQ ID NO: 3309826 - protein, 22 aa, Plasmodium falciparum
ENDDDEEVEENDEDDDDDNNNK

SEQ ID NO: 3309827 - protein, 12 aa, Plasmodium falciparum
ENDDDNINNENV

SEQ ID NO: 3309828 - protein, 8 aa, Plasmodium falciparum
ENDDGTTN

SEQ ID NO: 3309829 - protein, 24 aa, Plasmodium falciparum
ENDDKNNNNDNNNYMDSNNYAKNN

SEQ ID NO: 3309830 - protein, 16 aa, Plasmodium falciparum
ENDDVEDTEEDANKNY

SEQ ID NO: 3309831 - protein, 5 aa, Plasmodium falciparum
ENDDY

SEQ ID NO: 3309832 - protein, 6 aa, Plasmodium falciparum
ENDDYD

SEQ ID NO: 3309833 - protein, 4 aa, Plasmodium falciparum
ENDE

SEQ ID NO: 3309834 - protein, 60 aa, Plasmodium falciparum
ENDEEEATDDNEEKNEEEKNDDNEEEEEYENNDNEKYNKNNSDDVNEDNKSLEDAEEEDT

SEQ ID NO: 3309835 - protein, 7 aa, Plasmodium falciparum
ENDEHLE

SEQ ID NO: 3309836 - protein, 12 aa, Plasmodium falciparum
ENDEKDNQNEKQ

SEQ ID NO: 3309837 - protein, 6 aa, Plasmodium falciparum
ENDEKI

SEQ ID NO: 3309838 - protein, 8 aa, Plasmodium falciparum
ENDELRDN

SEQ ID NO: 3309839 - protein, 24 aa, Plasmodium falciparum
ENDENEKKKRRKRSNNNDNYNSHD

SEQ ID NO: 3309840 - protein, 8 aa, Plasmodium falciparum
ENDENMSK

SEQ ID NO: 3309841 - protein, 9 aa, Plasmodium falciparum
ENDENQNFQ

SEQ ID NO: 3309842 - protein, 5 aa, Plasmodium falciparum
ENDEP

SEQ ID NO: 3309843 - protein, 6 aa, Plasmodium falciparum
ENDEPV

SEQ ID NO: 3309844 - protein, 4 aa, Plasmodium falciparum
ENDF

SEQ ID NO: 3309845 - protein, 14 aa, Plasmodium falciparum
ENDFTDRKKGNNKI

SEQ ID NO: 3309846 - protein, 6 aa, Plasmodium falciparum
ENDGCI

SEQ ID NO: 3309847 - protein, 10 aa, Plasmodium falciparum
ENDGDDYKKN

SEQ ID NO: 3309848 - protein, 5 aa, Plasmodium falciparum
ENDGQ

SEQ ID NO: 3309849 - protein, 5 aa, Plasmodium falciparum
ENDGT

SEQ ID NO: 3309850 - protein, 23 aa, Plasmodium falciparum
ENDGVEGREKQKISSQEYRGDKS

SEQ ID NO: 3309851 - protein, 4 aa, Plasmodium falciparum
ENDI

SEQ ID NO: 3309852 - protein, 6 aa, Plasmodium falciparum
ENDIGG

SEQ ID NO: 3309853 - protein, 21 aa, Plasmodium falciparum
ENDIKDDNNDDNNNNNNNNVN

SEQ ID NO: 3309854 - protein, 13 aa, Plasmodium falciparum
ENDINNEDNNTHS

SEQ ID NO: 3309855 - protein, 8 aa, Plasmodium falciparum
ENDKDKDI

SEQ ID NO: 3309856 - protein, 6 aa, Plasmodium falciparum
ENDKDL

SEQ ID NO: 3309857 - protein, 28 aa, Plasmodium falciparum
ENDKEENNKNSLNNKEYKEDIKNKTYKS

SEQ ID NO: 3309858 - protein, 6 aa, Plasmodium falciparum
ENDKIE

SEQ ID NO: 3309859 - protein, 10 aa, Plasmodium falciparum
ENDKKAETFD

SEQ ID NO: 3309860 - protein, 6 aa, Plasmodium falciparum
ENDKKE

SEQ ID NO: 3309861 - protein, 8 aa, Plasmodium falciparum
ENDKTENI

SEQ ID NO: 3309862 - protein, 4 aa, Plasmodium falciparum
ENDL

SEQ ID NO: 3309863 - protein, 7 aa, Plasmodium falciparum
ENDLKNM

SEQ ID NO: 3309864 - protein, 5 aa, Plasmodium falciparum
ENDLT

SEQ ID NO: 3309865 - protein, 7 aa, Plasmodium falciparum
ENDMNGN

SEQ ID NO: 3309866 - protein, 5 aa, Plasmodium falciparum
ENDNC

SEQ ID NO: 3309867 - protein, 12 aa, Plasmodium falciparum
ENDNDNKISSEK

SEQ ID NO: 3309868 - protein, 8 aa, Plasmodium falciparum
ENDNKDDW

SEQ ID NO: 3309869 - protein, 24 aa, Plasmodium falciparum
ENDNNNNNKNNNKNESNNNRNEKK

SEQ ID NO: 3309870 - protein, 12 aa, Plasmodium falciparum
ENDNNNNNNNDN

SEQ ID NO: 3309871 - protein, 6 aa, Plasmodium falciparum
ENDNSI

SEQ ID NO: 3309872 - protein, 7 aa, Plasmodium falciparum
ENDNSQL

SEQ ID NO: 3309873 - protein, 13 aa, Plasmodium falciparum
ENDNVGKEHETNI

SEQ ID NO: 3309874 - protein, 30 aa, Plasmodium falciparum
ENDNVKDEKSEEIKPMEKKTSKKNKKEIRI

SEQ ID NO: 3309875 - protein, 29 aa, Plasmodium falciparum
ENDNVNDDEDNYYDEEENNYNNDDNYDEE

SEQ ID NO: 3309876 - protein, 12 aa, Plasmodium falciparum
ENDPNGKVETNE

SEQ ID NO: 3309877 - protein, 7 aa, Plasmodium falciparum
ENDPPNV

SEQ ID NO: 3309878 - protein, 14 aa, Plasmodium falciparum
ENDQREDEDEYENK

SEQ ID NO: 3309879 - protein, 10 aa, Plasmodium falciparum
ENDQSKESVE

SEQ ID NO: 3309880 - protein, 9 aa, Plasmodium falciparum
ENDRSETTF

SEQ ID NO: 3309881 - protein, 21 aa, Plasmodium falciparum
ENDSDYIDDNYNSDDNNNNNY

SEQ ID NO: 3309882 - protein, 9 aa, Plasmodium falciparum
ENDSKEKYF

SEQ ID NO: 3309883 - protein, 10 aa, Plasmodium falciparum
ENDSKSLKGN

SEQ ID NO: 3309884 - protein, 10 aa, Plasmodium falciparum
ENDSPEPCKD

SEQ ID NO: 3309885 - protein, 12 aa, Plasmodium falciparum
ENDSSSNDEQKP

SEQ ID NO: 3309886 - protein, 6 aa, Plasmodium falciparum
ENDVDN

SEQ ID NO: 3309887 - protein, 14 aa, Plasmodium falciparum
ENDVTNKNQSNEEN

SEQ ID NO: 3309888 - protein, 4 aa, Plasmodium falciparum
ENDY

SEQ ID NO: 3309889 - protein, 18 aa, Plasmodium falciparum
ENDYNNDEQEKQNIGKYT

SEQ ID NO: 3309890 - protein, 21 aa, Plasmodium falciparum
ENDYRNNNNKEKNKIKNNKRD

SEQ ID NO: 3309891 - protein, 6 aa, Plasmodium falciparum
ENDYSL

SEQ ID NO: 3309892 - protein, 13 aa, Plasmodium falciparum
ENDYVEKRNKNNV

SEQ ID NO: 3309893 - protein, 6 aa, Plasmodium falciparum
ENEAQT

SEQ ID NO: 3309894 - protein, 4 aa, Plasmodium falciparum
ENED

SEQ ID NO: 3309895 - protein, 7 aa, Plasmodium falciparum
ENEDDLE

SEQ ID NO: 3309896 - protein, 7 aa, Plasmodium falciparum
ENEDNIK

SEQ ID NO: 3309897 - protein, 7 aa, Plasmodium falciparum
ENEDPSS

SEQ ID NO: 3309898 - protein, 17 aa, Plasmodium falciparum
ENEDRKDKYTNSSHTSE

SEQ ID NO: 3309899 - protein, 13 aa, Plasmodium falciparum
ENEEDEVRKPDNT

SEQ ID NO: 3309900 - protein, 7 aa, Plasmodium falciparum
ENEEDIE

SEQ ID NO: 3309901 - protein, 20 aa, Plasmodium falciparum
ENEEDNKNKQKKKKNDTTIQ

SEQ ID NO: 3309902 - protein, 9 aa, Plasmodium falciparum
ENEEEREKI

SEQ ID NO: 3309903 - protein, 7 aa, Plasmodium falciparum
ENEEESE

SEQ ID NO: 3309904 - protein, 6 aa, Plasmodium falciparum
ENEEKA

SEQ ID NO: 3309905 - protein, 20 aa, Plasmodium falciparum
ENEEKRKTINYQQEQERITA

SEQ ID NO: 3309906 - protein, 15 aa, Plasmodium falciparum
ENEELPKEVQNNERV

SEQ ID NO: 3309907 - protein, 8 aa, Plasmodium falciparum
ENEELPRK

SEQ ID NO: 3309908 - protein, 9 aa, Plasmodium falciparum
ENEENEESG

SEQ ID NO: 3309909 - protein, 6 aa, Plasmodium falciparum
ENEENS

SEQ ID NO: 3309910 - protein, 81 aa, Plasmodium falciparum
ENEGGKKKVQRQKKYHQENDERDAYKRNNAKYEEDDNREQVEKNNEGEKNDEGGKKGEGEKKGEGEKKGEGEKKDEQEEQI

SEQ ID NO: 3309911 - protein, 21 aa, Plasmodium falciparum
ENEGNSKNIKKGKKKKSKIKI

SEQ ID NO: 3309912 - protein, 7 aa, Plasmodium falciparum
ENEHGKI

SEQ ID NO: 3309913 - protein, 8 aa, Plasmodium falciparum
ENEHHTTK

SEQ ID NO: 3309914 - protein, 4 aa, Plasmodium falciparum
ENEI

SEQ ID NO: 3309915 - protein, 5 aa, Plasmodium falciparum
ENEID

SEQ ID NO: 3309916 - protein, 12 aa, Plasmodium falciparum
ENEIEEKNEEAT

SEQ ID NO: 3309917 - protein, 7 aa, Plasmodium falciparum
ENEISEE

SEQ ID NO: 3309918 - protein, 4 aa, Plasmodium falciparum
ENEK

SEQ ID NO: 3309919 - protein, 8 aa, Plasmodium falciparum
ENEKAEDI

SEQ ID NO: 3309920 - protein, 8 aa, Plasmodium falciparum
ENEKDNDN

SEQ ID NO: 3309921 - protein, 121 aa, Plasmodium falciparum
ENEKDTEKKEADGGEDKEKEGKEEEDKEEEDKEEEDKKEEDKKEECKEEYKEDCKDKEEDKKECKDKEEGKKECKEEGKKECKEECKEEGKKECKEEGKEEDKEKDKEENNEKEDKEEEIN

SEQ ID NO: 3309922 - protein, 5 aa, Plasmodium falciparum
ENEKE

SEQ ID NO: 3309923 - protein, 9 aa, Plasmodium falciparum
ENEKEENEK

SEQ ID NO: 3309924 - protein, 12 aa, Plasmodium falciparum
ENEKEKDEDKSV

SEQ ID NO: 3309925 - protein, 12 aa, Plasmodium falciparum
ENEKEKKNRKSV

SEQ ID NO: 3309926 - protein, 6 aa, Plasmodium falciparum
ENEKEY

SEQ ID NO: 3309927 - protein, 8 aa, Plasmodium falciparum
ENEKGATK

SEQ ID NO: 3309928 - protein, 7 aa, Plasmodium falciparum
ENEKHSE

SEQ ID NO: 3309929 - protein, 5 aa, Plasmodium falciparum
ENEKK

SEQ ID NO: 3309930 - protein, 14 aa, Plasmodium falciparum
ENEKKELDELEDKE

SEQ ID NO: 3309931 - protein, 28 aa, Plasmodium falciparum
ENEKKQREKKNENAENNIYEEKENNKIQ

SEQ ID NO: 3309932 - protein, 13 aa, Plasmodium falciparum
ENEKKRKEEEEKY

SEQ ID NO: 3309933 - protein, 9 aa, Plasmodium falciparum
ENEKKRTHI

SEQ ID NO: 3309934 - protein, 16 aa, Plasmodium falciparum
ENEKKTEKKNSKSTML

SEQ ID NO: 3309935 - protein, 5 aa, Plasmodium falciparum
ENEKN

SEQ ID NO: 3309936 - protein, 10 aa, Plasmodium falciparum
ENEKNEKDHI

SEQ ID NO: 3309937 - protein, 9 aa, Plasmodium falciparum
ENEKQENGN

SEQ ID NO: 3309938 - protein, 10 aa, Plasmodium falciparum
ENEKQKEEEK

SEQ ID NO: 3309939 - protein, 7 aa, Plasmodium falciparum
ENEKQYN

SEQ ID NO: 3309940 - protein, 16 aa, Plasmodium falciparum
ENEKSDDYSSLSNNQN

SEQ ID NO: 3309941 - protein, 9 aa, Plasmodium falciparum
ENEKTDTNF

SEQ ID NO: 3309942 - protein, 9 aa, Plasmodium falciparum
ENEKTNDIN

SEQ ID NO: 3309943 - protein, 7 aa, Plasmodium falciparum
ENEKYRN

SEQ ID NO: 3309944 - protein, 10 aa, Plasmodium falciparum
ENEMESDKEK

SEQ ID NO: 3309945 - protein, 5 aa, Plasmodium falciparum
ENEMN

SEQ ID NO: 3309946 - protein, 21 aa, Plasmodium falciparum
ENENDNDDVNTGNNNEEGFEN

SEQ ID NO: 3309947 - protein, 9 aa, Plasmodium falciparum
ENENEEEKI

SEQ ID NO: 3309948 - protein, 12 aa, Plasmodium falciparum
ENENEKRTDNVN

SEQ ID NO: 3309949 - protein, 6 aa, Plasmodium falciparum
ENENEN

SEQ ID NO: 3309950 - protein, 9 aa, Plasmodium falciparum
ENENEYKSS

SEQ ID NO: 3309951 - protein, 7 aa, Plasmodium falciparum
ENENIPK

SEQ ID NO: 3309952 - protein, 19 aa, Plasmodium falciparum
ENENKKYLPDGSSKSFDID

SEQ ID NO: 3309953 - protein, 5 aa, Plasmodium falciparum
ENENL

SEQ ID NO: 3309954 - protein, 6 aa, Plasmodium falciparum
ENENLD

SEQ ID NO: 3309955 - protein, 6 aa, Plasmodium falciparum
ENENLR

SEQ ID NO: 3309956 - protein, 17 aa, Plasmodium falciparum
ENENNEWKEKNQKMHEE

SEQ ID NO: 3309957 - protein, 6 aa, Plasmodium falciparum
ENENNS

SEQ ID NO: 3309958 - protein, 11 aa, Plasmodium falciparum
ENENSKEPKIS

SEQ ID NO: 3309959 - protein, 9 aa, Plasmodium falciparum
ENENSNEAF

SEQ ID NO: 3309960 - protein, 8 aa, Plasmodium falciparum
ENENSNMS

SEQ ID NO: 3309961 - protein, 10 aa, Plasmodium falciparum
ENENSYEEEE

SEQ ID NO: 3309962 - protein, 12 aa, Plasmodium falciparum
ENENYKSSKELS

SEQ ID NO: 3309963 - protein, 7 aa, Plasmodium falciparum
ENEPSDF

SEQ ID NO: 3309964 - protein, 9 aa, Plasmodium falciparum
ENEQPPKLQ

SEQ ID NO: 3309965 - protein, 18 aa, Plasmodium falciparum
ENERAQIDDNKNGYEKNI

SEQ ID NO: 3309966 - protein, 5 aa, Plasmodium falciparum
ENERN

SEQ ID NO: 3309967 - protein, 7 aa, Plasmodium falciparum
ENERQEY

SEQ ID NO: 3309968 - protein, 46 aa, Plasmodium falciparum
ENERTNQHNNCNNNNNNNYYDDDDNNNNNDNNYNNNNNNNNDNNLN

SEQ ID NO: 3309969 - protein, 23 aa, Plasmodium falciparum
ENERYDSKRGTNNNISGEYQNAS

SEQ ID NO: 3309970 - protein, 16 aa, Plasmodium falciparum
ENESDDYDNNNNDEFY

SEQ ID NO: 3309971 - protein, 9 aa, Plasmodium falciparum
ENESEQSYS

SEQ ID NO: 3309972 - protein, 12 aa, Plasmodium falciparum
ENESHTERTEGD

SEQ ID NO: 3309973 - protein, 7 aa, Plasmodium falciparum
ENETEEL

SEQ ID NO: 3309974 - protein, 5 aa, Plasmodium falciparum
ENETK

SEQ ID NO: 3309975 - protein, 5 aa, Plasmodium falciparum
ENETL

SEQ ID NO: 3309976 - protein, 6 aa, Plasmodium falciparum
ENETLR

SEQ ID NO: 3309977 - protein, 5 aa, Plasmodium falciparum
ENETN

SEQ ID NO: 3309978 - protein, 11 aa, Plasmodium falciparum
ENETNDSIKKI

SEQ ID NO: 3309979 - protein, 11 aa, Plasmodium falciparum
ENEVRKNKKDT

SEQ ID NO: 3309980 - protein, 5 aa, Plasmodium falciparum
ENEYN

SEQ ID NO: 3309981 - protein, 12 aa, Plasmodium falciparum
ENFKNDNKKKNI

SEQ ID NO: 3309982 - protein, 118 aa, Plasmodium falciparum
ENFNASETINSNSNSNSNINSNINSNSNSNSNSNSNINSNSNSNSNINSNSNNNCFEPTGNNLNESDDTTNQINESDHSTNPFNESDDTNNEHKTLEKKEKEINPYRNNNDNKKDNDV

SEQ ID NO: 3309983 - protein, 5 aa, Plasmodium falciparum
ENFQG

SEQ ID NO: 3309984 - protein, 5 aa, Plasmodium falciparum
ENFQN

SEQ ID NO: 3309985 - protein, 11 aa, Plasmodium falciparum
ENFSNNSPDNL

SEQ ID NO: 3309986 - protein, 9 aa, Plasmodium falciparum
ENFSSDSSN

SEQ ID NO: 3309987 - protein, 12 aa, Plasmodium falciparum
ENFSTSEKLSSK

SEQ ID NO: 3309988 - protein, 103 aa, Plasmodium falciparum
ENGEETKVEKKVKKKKDKKKVNKEDKKKVNKEDKKKVNKEDKKKVNKEDKKKDKKKDKKKDKKKDKKKVNKKDKKKVNKKDKEKDNKLNRNTHTELDETSIQN

SEQ ID NO: 3309989 - protein, 9 aa, Plasmodium falciparum
ENGEQEPIG

SEQ ID NO: 3309990 - protein, 8 aa, Plasmodium falciparum
ENGGKHSG

SEQ ID NO: 3309991 - protein, 6 aa, Plasmodium falciparum
ENGGYN

SEQ ID NO: 3309992 - protein, 58 aa, Plasmodium falciparum
ENGHNVNNNKNNDGGDADGDADGDDNGDDNGDDNGDDNGDDNGDDNGDDNGDDYDEDN

SEQ ID NO: 3309993 - protein, 4 aa, Plasmodium falciparum
ENGI

SEQ ID NO: 3309994 - protein, 7 aa, Plasmodium falciparum
ENGKAIP

SEQ ID NO: 3309995 - protein, 8 aa, Plasmodium falciparum
ENGKDGNL

SEQ ID NO: 3309996 - protein, 5 aa, Plasmodium falciparum
ENGKE

SEQ ID NO: 3309997 - protein, 25 aa, Plasmodium falciparum
ENGKEETVKKGENVYGEKQILFDED

SEQ ID NO: 3309998 - protein, 9 aa, Plasmodium falciparum
ENGKIQTKG

SEQ ID NO: 3309999 - protein, 7 aa, Plasmodium falciparum
ENGKNSF

SEQ ID NO: 3310000 - protein, 13 aa, Plasmodium falciparum
ENGKNTKLNPVPS

SEQ ID NO: 3310001 - protein, 7 aa, Plasmodium falciparum
ENGKRRK

SEQ ID NO: 3310002 - protein, 22 aa, Plasmodium falciparum
ENGNCDDNNNIDDNNNIDDNNY

SEQ ID NO: 3310003 - protein, 9 aa, Plasmodium falciparum
ENGNDKSVN

SEQ ID NO: 3310004 - protein, 5 aa, Plasmodium falciparum
ENGNN

SEQ ID NO: 3310005 - protein, 10 aa, Plasmodium falciparum
ENGNNKDNFN

SEQ ID NO: 3310006 - protein, 19 aa, Plasmodium falciparum
ENGNNNNNNNNKNDKLKNS

SEQ ID NO: 3310007 - protein, 6 aa, Plasmodium falciparum
ENGNNY

SEQ ID NO: 3310008 - protein, 10 aa, Plasmodium falciparum
ENGPKNNYVS

SEQ ID NO: 3310009 - protein, 9 aa, Plasmodium falciparum
ENGSGKTTI

SEQ ID NO: 3310010 - protein, 6 aa, Plasmodium falciparum
ENGSLR

SEQ ID NO: 3310011 - protein, 5 aa, Plasmodium falciparum
ENGTY

SEQ ID NO: 3310012 - protein, 8 aa, Plasmodium falciparum
ENHEEDKN

SEQ ID NO: 3310013 - protein, 17 aa, Plasmodium falciparum
ENHEKKKCDRTKQCNDV

SEQ ID NO: 3310014 - protein, 16 aa, Plasmodium falciparum
ENHINNGTIENEQNNF

SEQ ID NO: 3310015 - protein, 8 aa, Plasmodium falciparum
ENHKKEEK

SEQ ID NO: 3310016 - protein, 4 aa, Plasmodium falciparum
ENHM

SEQ ID NO: 3310017 - protein, 5 aa, Plasmodium falciparum
ENHNN

SEQ ID NO: 3310018 - protein, 22 aa, Plasmodium falciparum
ENHPNKISDGNYNKNNQKDNHM

SEQ ID NO: 3310019 - protein, 11 aa, Plasmodium falciparum
ENHSKDHEIPN

SEQ ID NO: 3310020 - protein, 6 aa, Plasmodium falciparum
ENHSNN

SEQ ID NO: 3310021 - protein, 11 aa, Plasmodium falciparum
ENHSNYSSGTT

SEQ ID NO: 3310022 - protein, 35 aa, Plasmodium falciparum
ENHSTMNNNNNNNNNNNNNDNNNYNYDYNNNNKKY

SEQ ID NO: 3310023 - protein, 5 aa, Plasmodium falciparum
ENHSV

SEQ ID NO: 3310024 - protein, 15 aa, Plasmodium falciparum
ENHTEDETDHEQNYE

SEQ ID NO: 3310025 - protein, 7 aa, Plasmodium falciparum
ENHTIDP

SEQ ID NO: 3310026 - protein, 5 aa, Plasmodium falciparum
ENHTK

SEQ ID NO: 3310027 - protein, 7 aa, Plasmodium falciparum
ENHTSNT

SEQ ID NO: 3310028 - protein, 11 aa, Plasmodium falciparum
ENIDNDKNKLV

SEQ ID NO: 3310029 - protein, 12 aa, Plasmodium falciparum
ENIEDDEIEENV

SEQ ID NO: 3310030 - protein, 40 aa, Plasmodium falciparum
ENIEENTNEIKKNANNANDTNDANDANDANDAKANKQSQI

SEQ ID NO: 3310031 - protein, 12 aa, Plasmodium falciparum
ENIEKKPPKGSI

SEQ ID NO: 3310032 - protein, 6 aa, Plasmodium falciparum
ENIEME

SEQ ID NO: 3310033 - protein, 6 aa, Plasmodium falciparum
ENIENV

SEQ ID NO: 3310034 - protein, 5 aa, Plasmodium falciparum
ENIEQ

SEQ ID NO: 3310035 - protein, 8 aa, Plasmodium falciparum
ENIGENEK

SEQ ID NO: 3310036 - protein, 7 aa, Plasmodium falciparum
ENIGNNR

SEQ ID NO: 3310037 - protein, 4 aa, Plasmodium falciparum
ENIK

SEQ ID NO: 3310038 - protein, 5 aa, Plasmodium falciparum
ENIKE

SEQ ID NO: 3310039 - protein, 10 aa, Plasmodium falciparum
ENIKKENKNI

SEQ ID NO: 3310040 - protein, 7 aa, Plasmodium falciparum
ENIKKES

SEQ ID NO: 3310041 - protein, 15 aa, Plasmodium falciparum
ENIKKKKEKYTDNLD

SEQ ID NO: 3310042 - protein, 16 aa, Plasmodium falciparum
ENIKSSNNKMNKEQKL

SEQ ID NO: 3310043 - protein, 16 aa, Plasmodium falciparum
ENIKTDKKVKNEKEDI

SEQ ID NO: 3310044 - protein, 9 aa, Plasmodium falciparum
ENIKTQHPL

SEQ ID NO: 3310045 - protein, 4 aa, Plasmodium falciparum
ENIL

SEQ ID NO: 3310046 - protein, 5 aa, Plasmodium falciparum
ENIND

SEQ ID NO: 3310047 - protein, 18 aa, Plasmodium falciparum
ENINDDNNNENNDNIEDM

SEQ ID NO: 3310048 - protein, 7 aa, Plasmodium falciparum
ENINEEL

SEQ ID NO: 3310049 - protein, 7 aa, Plasmodium falciparum
ENINKQN

SEQ ID NO: 3310050 - protein, 53 aa, Plasmodium falciparum
ENINKTNDNPAPPVKRKRGRPKMKKNTPEETQPTDLASNSNASSSYQATNTNI

SEQ ID NO: 3310051 - protein, 31 aa, Plasmodium falciparum
ENINNTEIKEDSNGKEINENINNKEINENIN

SEQ ID NO: 3310052 - protein, 5 aa, Plasmodium falciparum
ENINS

SEQ ID NO: 3310053 - protein, 16 aa, Plasmodium falciparum
ENINSNSNLKKKKGTY

SEQ ID NO: 3310054 - protein, 10 aa, Plasmodium falciparum
ENINTNEREY

SEQ ID NO: 3310055 - protein, 12 aa, Plasmodium falciparum
ENINTSGSFNTE

SEQ ID NO: 3310056 - protein, 12 aa, Plasmodium falciparum
ENIPEDKKHEQN

SEQ ID NO: 3310057 - protein, 4 aa, Plasmodium falciparum
ENIQ

SEQ ID NO: 3310058 - protein, 6 aa, Plasmodium falciparum
ENIQDC

SEQ ID NO: 3310059 - protein, 5 aa, Plasmodium falciparum
ENIQE

SEQ ID NO: 3310060 - protein, 8 aa, Plasmodium falciparum
ENIQEEKD

SEQ ID NO: 3310061 - protein, 6 aa, Plasmodium falciparum
ENIQGG

SEQ ID NO: 3310062 - protein, 6 aa, Plasmodium falciparum
ENIQNR

SEQ ID NO: 3310063 - protein, 4 aa, Plasmodium falciparum
ENIS

SEQ ID NO: 3310064 - protein, 22 aa, Plasmodium falciparum
ENISDDEQNTCDNDSELSDLND

SEQ ID NO: 3310065 - protein, 7 aa, Plasmodium falciparum
ENISNKQ

SEQ ID NO: 3310066 - protein, 6 aa, Plasmodium falciparum
ENISSS

SEQ ID NO: 3310067 - protein, 10 aa, Plasmodium falciparum
ENISTSPGIK

SEQ ID NO: 3310068 - protein, 5 aa, Plasmodium falciparum
ENITA

SEQ ID NO: 3310069 - protein, 6 aa, Plasmodium falciparum
ENITDD

SEQ ID NO: 3310070 - protein, 10 aa, Plasmodium falciparum
ENITKEKNEV

SEQ ID NO: 3310071 - protein, 6 aa, Plasmodium falciparum
ENITNK

SEQ ID NO: 3310072 - protein, 21 aa, Plasmodium falciparum
ENITNKNNTCNNNQKRKNTYN

SEQ ID NO: 3310073 - protein, 6 aa, Plasmodium falciparum
ENITRY

SEQ ID NO: 3310074 - protein, 13 aa, Plasmodium falciparum
ENITTSNKYYPND

SEQ ID NO: 3310075 - protein, 19 aa, Plasmodium falciparum
ENKDEMKKKGKKGKDENVN

SEQ ID NO: 3310076 - protein, 18 aa, Plasmodium falciparum
ENKDHTVRQKKNSIEEYN

SEQ ID NO: 3310077 - protein, 5 aa, Plasmodium falciparum
ENKDI

SEQ ID NO: 3310078 - protein, 5 aa, Plasmodium falciparum
ENKDK

SEQ ID NO: 3310079 - protein, 8 aa, Plasmodium falciparum
ENKDMQEE

SEQ ID NO: 3310080 - protein, 6 aa, Plasmodium falciparum
ENKDNV

SEQ ID NO: 3310081 - protein, 5 aa, Plasmodium falciparum
ENKDS

SEQ ID NO: 3310082 - protein, 5 aa, Plasmodium falciparum
ENKED

SEQ ID NO: 3310083 - protein, 9 aa, Plasmodium falciparum
ENKEDKDKI

SEQ ID NO: 3310084 - protein, 13 aa, Plasmodium falciparum
ENKEDKYTSRSSQ

SEQ ID NO: 3310085 - protein, 10 aa, Plasmodium falciparum
ENKEEEKYNN

SEQ ID NO: 3310086 - protein, 83 aa, Plasmodium falciparum
ENKEEREDKDNMDRESDMKDHKSGNNIDSDIESGSDNDSDNKSDSNIDSDNESGNNIDSNIDSDNKSGSNIDSGEDDETHNKK

SEQ ID NO: 3310087 - protein, 55 aa, Plasmodium falciparum
ENKEITKNQSNNITHKSGETNNNLEKKENQNIETKNEKTSKKKDKKKNENYNKNN

SEQ ID NO: 3310088 - protein, 11 aa, Plasmodium falciparum
ENKEKEIKTSN

SEQ ID NO: 3310089 - protein, 7 aa, Plasmodium falciparum
ENKEKKN

SEQ ID NO: 3310090 - protein, 15 aa, Plasmodium falciparum
ENKELNENENENDNI

SEQ ID NO: 3310091 - protein, 9 aa, Plasmodium falciparum
ENKENTSEK

SEQ ID NO: 3310092 - protein, 6 aa, Plasmodium falciparum
ENKENY

SEQ ID NO: 3310093 - protein, 5 aa, Plasmodium falciparum
ENKES

SEQ ID NO: 3310094 - protein, 13 aa, Plasmodium falciparum
ENKESINNTTTNI

SEQ ID NO: 3310095 - protein, 8 aa, Plasmodium falciparum
ENKETNTN

SEQ ID NO: 3310096 - protein, 19 aa, Plasmodium falciparum
ENKEVEEEKEKEFEESEYN

SEQ ID NO: 3310097 - protein, 4 aa, Plasmodium falciparum
ENKF

SEQ ID NO: 3310098 - protein, 4 aa, Plasmodium falciparum
ENKG

SEQ ID NO: 3310099 - protein, 7 aa, Plasmodium falciparum
ENKGIPI

SEQ ID NO: 3310100 - protein, 6 aa, Plasmodium falciparum
ENKGVD

SEQ ID NO: 3310101 - protein, 17 aa, Plasmodium falciparum
ENKHKSKKGRKPKESNL

SEQ ID NO: 3310102 - protein, 7 aa, Plasmodium falciparum
ENKHNHT

SEQ ID NO: 3310103 - protein, 21 aa, Plasmodium falciparum
ENKIHNNNNNNNKKKTHVNNK

SEQ ID NO: 3310104 - protein, 5 aa, Plasmodium falciparum
ENKIS

SEQ ID NO: 3310105 - protein, 18 aa, Plasmodium falciparum
ENKIYKNNKNNKNDKTHI

SEQ ID NO: 3310106 - protein, 14 aa, Plasmodium falciparum
ENKKEEEEAKSDIS

SEQ ID NO: 3310107 - protein, 14 aa, Plasmodium falciparum
ENKKEIDKKSTNYD

SEQ ID NO: 3310108 - protein, 6 aa, Plasmodium falciparum
ENKKEN

SEQ ID NO: 3310109 - protein, 10 aa, Plasmodium falciparum
ENKKEQVNYK

SEQ ID NO: 3310110 - protein, 9 aa, Plasmodium falciparum
ENKKEVMQN

SEQ ID NO: 3310111 - protein, 10 aa, Plasmodium falciparum
ENKKFKGKYY

SEQ ID NO: 3310112 - protein, 13 aa, Plasmodium falciparum
ENKKGEKKNSVKN

SEQ ID NO: 3310113 - protein, 24 aa, Plasmodium falciparum
ENKKINDKDIKNNDELNTNKLEQK

SEQ ID NO: 3310114 - protein, 21 aa, Plasmodium falciparum
ENKKKDEKEKKNKIHNNDENN

SEQ ID NO: 3310115 - protein, 12 aa, Plasmodium falciparum
ENKKKKNKKIKK

SEQ ID NO: 3310116 - protein, 14 aa, Plasmodium falciparum
ENKKKNKKENKYKN

SEQ ID NO: 3310117 - protein, 6 aa, Plasmodium falciparum
ENKKKQ

SEQ ID NO: 3310118 - protein, 11 aa, Plasmodium falciparum
ENKKLKKRGDL

SEQ ID NO: 3310119 - protein, 5 aa, Plasmodium falciparum
ENKKN

SEQ ID NO: 3310120 - protein, 10 aa, Plasmodium falciparum
ENKKNEENKS

SEQ ID NO: 3310121 - protein, 14 aa, Plasmodium falciparum
ENKKNEGEHQNKKI

SEQ ID NO: 3310122 - protein, 10 aa, Plasmodium falciparum
ENKKNISNIQ

SEQ ID NO: 3310123 - protein, 25 aa, Plasmodium falciparum
ENKKNKRKRKKKKKKKKKENNIQNE

SEQ ID NO: 3310124 - protein, 6 aa, Plasmodium falciparum
ENKKNM

SEQ ID NO: 3310125 - protein, 9 aa, Plasmodium falciparum
ENKKNQDMT

SEQ ID NO: 3310126 - protein, 10 aa, Plasmodium falciparum
ENKKNQEKMK

SEQ ID NO: 3310127 - protein, 9 aa, Plasmodium falciparum
ENKKNSTSS

SEQ ID NO: 3310128 - protein, 9 aa, Plasmodium falciparum
ENKKNVNEE

SEQ ID NO: 3310129 - protein, 10 aa, Plasmodium falciparum
ENKKPKTGKL

SEQ ID NO: 3310130 - protein, 9 aa, Plasmodium falciparum
ENKKPYTNY

SEQ ID NO: 3310131 - protein, 7 aa, Plasmodium falciparum
ENKKQGI

SEQ ID NO: 3310132 - protein, 13 aa, Plasmodium falciparum
ENKKTAQNSPSLE

SEQ ID NO: 3310133 - protein, 8 aa, Plasmodium falciparum
ENKKTNDV

SEQ ID NO: 3310134 - protein, 9 aa, Plasmodium falciparum
ENKKTNHND

SEQ ID NO: 3310135 - protein, 6 aa, Plasmodium falciparum
ENKKYI

SEQ ID NO: 3310136 - protein, 8 aa, Plasmodium falciparum
ENKNAYPK

SEQ ID NO: 3310137 - protein, 9 aa, Plasmodium falciparum
ENKNAYPPI

SEQ ID NO: 3310138 - protein, 8 aa, Plasmodium falciparum
ENKNDEIN

SEQ ID NO: 3310139 - protein, 32 aa, Plasmodium falciparum
ENKNDEYEKNMDNRTSDNIKPESLSKQNDYEN

SEQ ID NO: 3310140 - protein, 25 aa, Plasmodium falciparum
ENKNDTVDTSDLEKKNIPDLSNDNN

SEQ ID NO: 3310141 - protein, 28 aa, Plasmodium falciparum
ENKNDVDRSGCNKREGDNNINNNNNNNI

SEQ ID NO: 3310142 - protein, 8 aa, Plasmodium falciparum
ENKNDVSQ

SEQ ID NO: 3310143 - protein, 18 aa, Plasmodium falciparum
ENKNEDIKENEPNNFNKT

SEQ ID NO: 3310144 - protein, 8 aa, Plasmodium falciparum
ENKNEEKE

SEQ ID NO: 3310145 - protein, 7 aa, Plasmodium falciparum
ENKNEKI

SEQ ID NO: 3310146 - protein, 19 aa, Plasmodium falciparum
ENKNENEKVYNSESELKER

SEQ ID NO: 3310147 - protein, 18 aa, Plasmodium falciparum
ENKNEQDVKKSSSSPLSI

SEQ ID NO: 3310148 - protein, 10 aa, Plasmodium falciparum
ENKNGDLSDD

SEQ ID NO: 3310149 - protein, 9 aa, Plasmodium falciparum
ENKNHYNGS

SEQ ID NO: 3310150 - protein, 12 aa, Plasmodium falciparum
ENKNKGKNKINP

SEQ ID NO: 3310151 - protein, 8 aa, Plasmodium falciparum
ENKNKHQG

SEQ ID NO: 3310152 - protein, 16 aa, Plasmodium falciparum
ENKNKIISNEEDPNNI

SEQ ID NO: 3310153 - protein, 21 aa, Plasmodium falciparum
ENKNKKKQNNQNYMEGTSNVQ

SEQ ID NO: 3310154 - protein, 23 aa, Plasmodium falciparum
ENKNKNIKKKNNNNKKKKASNDN

SEQ ID NO: 3310155 - protein, 9 aa, Plasmodium falciparum
ENKNKNKNF

SEQ ID NO: 3310156 - protein, 19 aa, Plasmodium falciparum
ENKNKNKRRKKEDFPTEEE

SEQ ID NO: 3310157 - protein, 6 aa, Plasmodium falciparum
ENKNME

SEQ ID NO: 3310158 - protein, 5 aa, Plasmodium falciparum
ENKNN

SEQ ID NO: 3310159 - protein, 11 aa, Plasmodium falciparum
ENKNNGALSSQ

SEQ ID NO: 3310160 - protein, 6 aa, Plasmodium falciparum
ENKNNI

SEQ ID NO: 3310161 - protein, 115 aa, Plasmodium falciparum
ENKNNKKKINKLRKEKKIDKENKQNDDNKENIQNDDNKENKQNDDNKLNIQNDDNKENIQNDDNKVNIQNDDNKVNIQNDDNKENIQNDDNKVNIQNDDNKVNIQNDDNKENIQI

SEQ ID NO: 3310162 - protein, 9 aa, Plasmodium falciparum
ENKNNLNSA

SEQ ID NO: 3310163 - protein, 27 aa, Plasmodium falciparum
ENKNNNKNDDGDDDDVNKREDNNNNEY

SEQ ID NO: 3310164 - protein, 8 aa, Plasmodium falciparum
ENKNNSIA

SEQ ID NO: 3310165 - protein, 27 aa, Plasmodium falciparum
ENKNQKDKKRQINKLGEQDSNNEELTS

SEQ ID NO: 3310166 - protein, 12 aa, Plasmodium falciparum
ENKNQTKKEKKR

SEQ ID NO: 3310167 - protein, 6 aa, Plasmodium falciparum
ENKNRM

SEQ ID NO: 3310168 - protein, 31 aa, Plasmodium falciparum
ENKNRNKNGDTDIDNDTRNNKSYKENNPMTR

SEQ ID NO: 3310169 - protein, 6 aa, Plasmodium falciparum
ENKNSQ

SEQ ID NO: 3310170 - protein, 15 aa, Plasmodium falciparum
ENKNTDDYRVNDDSN

SEQ ID NO: 3310171 - protein, 5 aa, Plasmodium falciparum
ENKNY

SEQ ID NO: 3310172 - protein, 7 aa, Plasmodium falciparum
ENKNYDV

SEQ ID NO: 3310173 - protein, 6 aa, Plasmodium falciparum
ENKPED

SEQ ID NO: 3310174 - protein, 7 aa, Plasmodium falciparum
ENKPQNL

SEQ ID NO: 3310175 - protein, 22 aa, Plasmodium falciparum
ENKQKRENISSNTYKDKYENFE

SEQ ID NO: 3310176 - protein, 5 aa, Plasmodium falciparum
ENKQV

SEQ ID NO: 3310177 - protein, 4 aa, Plasmodium falciparum
ENKR

SEQ ID NO: 3310178 - protein, 25 aa, Plasmodium falciparum
ENKRIDKEEKEKEKKINNNNNNNNN

SEQ ID NO: 3310179 - protein, 8 aa, Plasmodium falciparum
ENKRKLEN

SEQ ID NO: 3310180 - protein, 7 aa, Plasmodium falciparum
ENKRREQ

SEQ ID NO: 3310181 - protein, 24 aa, Plasmodium falciparum
ENKRRRRKNIKRKKKEKKKRNNHD

SEQ ID NO: 3310182 - protein, 4 aa, Plasmodium falciparum
ENKS

SEQ ID NO: 3310183 - protein, 31 aa, Plasmodium falciparum
ENKSDHNNNVENTQNVKTTSNNNTQNNYRTK

SEQ ID NO: 3310184 - protein, 7 aa, Plasmodium falciparum
ENKSHDN

SEQ ID NO: 3310185 - protein, 14 aa, Plasmodium falciparum
ENKSIRYEEVFRKR

SEQ ID NO: 3310186 - protein, 7 aa, Plasmodium falciparum
ENKSKSF

SEQ ID NO: 3310187 - protein, 5 aa, Plasmodium falciparum
ENKSL

SEQ ID NO: 3310188 - protein, 9 aa, Plasmodium falciparum
ENKSREEKH

SEQ ID NO: 3310189 - protein, 12 aa, Plasmodium falciparum
ENKSVEKKRKRN

SEQ ID NO: 3310190 - protein, 8 aa, Plasmodium falciparum
ENKTENNI

SEQ ID NO: 3310191 - protein, 7 aa, Plasmodium falciparum
ENKTHTG

SEQ ID NO: 3310192 - protein, 7 aa, Plasmodium falciparum
ENKTLGT

SEQ ID NO: 3310193 - protein, 5 aa, Plasmodium falciparum
ENKTN

SEQ ID NO: 3310194 - protein, 27 aa, Plasmodium falciparum
ENKVKEKNKIGEYKKDNTLHKDDEKVS

SEQ ID NO: 3310195 - protein, 7 aa, Plasmodium falciparum
ENKYPFN

SEQ ID NO: 3310196 - protein, 6 aa, Plasmodium falciparum
ENKYPL

SEQ ID NO: 3310197 - protein, 7 aa, Plasmodium falciparum
ENKYYGN

SEQ ID NO: 3310198 - protein, 10 aa, Plasmodium falciparum
ENLEKEKKEH

SEQ ID NO: 3310199 - protein, 16 aa, Plasmodium falciparum
ENLEKKNIQEKKEFNE

SEQ ID NO: 3310200 - protein, 11 aa, Plasmodium falciparum
ENLKDKERKIT

SEQ ID NO: 3310201 - protein, 6 aa, Plasmodium falciparum
ENLKNN

SEQ ID NO: 3310202 - protein, 13 aa, Plasmodium falciparum
ENLKRDDSSDYNV

SEQ ID NO: 3310203 - protein, 7 aa, Plasmodium falciparum
ENLKRSY

SEQ ID NO: 3310204 - protein, 9 aa, Plasmodium falciparum
ENLNEGKKV

SEQ ID NO: 3310205 - protein, 6 aa, Plasmodium falciparum
ENLNFD

SEQ ID NO: 3310206 - protein, 9 aa, Plasmodium falciparum
ENLNSGDDA

SEQ ID NO: 3310207 - protein, 9 aa, Plasmodium falciparum
ENLPEQPNS

SEQ ID NO: 3310208 - protein, 8 aa, Plasmodium falciparum
ENLPRTKG

SEQ ID NO: 3310209 - protein, 10 aa, Plasmodium falciparum
ENLSKSKKRK

SEQ ID NO: 3310210 - protein, 5 aa, Plasmodium falciparum
ENLSL

SEQ ID NO: 3310211 - protein, 12 aa, Plasmodium falciparum
ENLSSDKYTKNS

SEQ ID NO: 3310212 - protein, 4 aa, Plasmodium falciparum
ENLT

SEQ ID NO: 3310213 - protein, 6 aa, Plasmodium falciparum
ENMEGK

SEQ ID NO: 3310214 - protein, 6 aa, Plasmodium falciparum
ENMGEN

SEQ ID NO: 3310215 - protein, 9 aa, Plasmodium falciparum
ENMKDENEE

SEQ ID NO: 3310216 - protein, 13 aa, Plasmodium falciparum
ENMKEENKSPQFI

SEQ ID NO: 3310217 - protein, 12 aa, Plasmodium falciparum
ENMKKEKNKLRN

SEQ ID NO: 3310218 - protein, 11 aa, Plasmodium falciparum
ENMNEEEKDNK

SEQ ID NO: 3310219 - protein, 50 aa, Plasmodium falciparum
ENMNKEKINKENVNKEKINKEKINKEKINKEKINKENMNKENMNKENMNK

SEQ ID NO: 3310220 - protein, 21 aa, Plasmodium falciparum
ENMNNNSSKNVNTLSDNNYNN

SEQ ID NO: 3310221 - protein, 18 aa, Plasmodium falciparum
ENMNNSNTMHSRNSNVEE

SEQ ID NO: 3310222 - protein, 5 aa, Plasmodium falciparum
ENMNQ

SEQ ID NO: 3310223 - protein, 4 aa, Plasmodium falciparum
ENMQ

SEQ ID NO: 3310224 - protein, 6 aa, Plasmodium falciparum
ENMQDS

SEQ ID NO: 3310225 - protein, 5 aa, Plasmodium falciparum
ENMSP

SEQ ID NO: 3310226 - protein, 4 aa, Plasmodium falciparum
ENNA

SEQ ID NO: 3310227 - protein, 6 aa, Plasmodium falciparum
ENNATL

SEQ ID NO: 3310228 - protein, 4 aa, Plasmodium falciparum
ENND

SEQ ID NO: 3310229 - protein, 10 aa, Plasmodium falciparum
ENNDAEAATL

SEQ ID NO: 3310230 - protein, 11 aa, Plasmodium falciparum
ENNDEKKKKKK

SEQ ID NO: 3310231 - protein, 19 aa, Plasmodium falciparum
ENNDKDKESNNNNKTNVDI

SEQ ID NO: 3310232 - protein, 6 aa, Plasmodium falciparum
ENNDKE

SEQ ID NO: 3310233 - protein, 7 aa, Plasmodium falciparum
ENNDKQK

SEQ ID NO: 3310234 - protein, 9 aa, Plasmodium falciparum
ENNDNIRSK

SEQ ID NO: 3310235 - protein, 18 aa, Plasmodium falciparum
ENNDNNDLSDNQSSQSDF

SEQ ID NO: 3310236 - protein, 12 aa, Plasmodium falciparum
ENNDNNMNDDMN

SEQ ID NO: 3310237 - protein, 6 aa, Plasmodium falciparum
ENNDSS

SEQ ID NO: 3310238 - protein, 4 aa, Plasmodium falciparum
ENNE

SEQ ID NO: 3310239 - protein, 18 aa, Plasmodium falciparum
ENNEGIDQNTEKNNNISV

SEQ ID NO: 3310240 - protein, 5 aa, Plasmodium falciparum
ENNEK

SEQ ID NO: 3310241 - protein, 11 aa, Plasmodium falciparum
ENNEKDEEIER

SEQ ID NO: 3310242 - protein, 12 aa, Plasmodium falciparum
ENNEKDTSNEEI

SEQ ID NO: 3310243 - protein, 16 aa, Plasmodium falciparum
ENNERHNSERRKRSSV

SEQ ID NO: 3310244 - protein, 12 aa, Plasmodium falciparum
ENNESKNEDLKK

SEQ ID NO: 3310245 - protein, 7 aa, Plasmodium falciparum
ENNEVES

SEQ ID NO: 3310246 - protein, 6 aa, Plasmodium falciparum
ENNEYS

SEQ ID NO: 3310247 - protein, 7 aa, Plasmodium falciparum
ENNFDKE

SEQ ID NO: 3310248 - protein, 5 aa, Plasmodium falciparum
ENNFN

SEQ ID NO: 3310249 - protein, 8 aa, Plasmodium falciparum
ENNFQNNQ

SEQ ID NO: 3310250 - protein, 17 aa, Plasmodium falciparum
ENNFTSPMSRNPDAPFV

SEQ ID NO: 3310251 - protein, 37 aa, Plasmodium falciparum
ENNGKKKNRKRNKTNDKSDNKNCNQYDNNKKDYQDGI

SEQ ID NO: 3310252 - protein, 11 aa, Plasmodium falciparum
ENNGKKNKTQE

SEQ ID NO: 3310253 - protein, 8 aa, Plasmodium falciparum
ENNGNYEN

SEQ ID NO: 3310254 - protein, 23 aa, Plasmodium falciparum
ENNGRKKSGKGKGGRSKSKQLND

SEQ ID NO: 3310255 - protein, 8 aa, Plasmodium falciparum
ENNGTTLR

SEQ ID NO: 3310256 - protein, 7 aa, Plasmodium falciparum
ENNHDNI

SEQ ID NO: 3310257 - protein, 5 aa, Plasmodium falciparum
ENNHK

SEQ ID NO: 3310258 - protein, 6 aa, Plasmodium falciparum
ENNHPI

SEQ ID NO: 3310259 - protein, 26 aa, Plasmodium falciparum
ENNIADSDNYNKDDNNNDNNQHAKKN

SEQ ID NO: 3310260 - protein, 8 aa, Plasmodium falciparum
ENNIDDND

SEQ ID NO: 3310261 - protein, 7 aa, Plasmodium falciparum
ENNIEKD

SEQ ID NO: 3310262 - protein, 35 aa, Plasmodium falciparum
ENNINGDDNNINGDENNINGDDNNINGDDNNINVD

SEQ ID NO: 3310263 - protein, 6 aa, Plasmodium falciparum
ENNINN

SEQ ID NO: 3310264 - protein, 6 aa, Plasmodium falciparum
ENNIQD

SEQ ID NO: 3310265 - protein, 5 aa, Plasmodium falciparum
ENNIS

SEQ ID NO: 3310266 - protein, 14 aa, Plasmodium falciparum
ENNITHTKNETNYI

SEQ ID NO: 3310267 - protein, 13 aa, Plasmodium falciparum
ENNITKNSAYNNN

SEQ ID NO: 3310268 - protein, 5 aa, Plasmodium falciparum
ENNKD

SEQ ID NO: 3310269 - protein, 8 aa, Plasmodium falciparum
ENNKDDIK

SEQ ID NO: 3310270 - protein, 18 aa, Plasmodium falciparum
ENNKIDKNKNVDKEKDEF

SEQ ID NO: 3310271 - protein, 7 aa, Plasmodium falciparum
ENNKINV

SEQ ID NO: 3310272 - protein, 15 aa, Plasmodium falciparum
ENNKKKQDKKKDEEL

SEQ ID NO: 3310273 - protein, 5 aa, Plasmodium falciparum
ENNKN

SEQ ID NO: 3310274 - protein, 13 aa, Plasmodium falciparum
ENNKNIYDKDEDN

SEQ ID NO: 3310275 - protein, 10 aa, Plasmodium falciparum
ENNKNKKSHH

SEQ ID NO: 3310276 - protein, 22 aa, Plasmodium falciparum
ENNKNKNNCNWKDGNENFNNSS

SEQ ID NO: 3310277 - protein, 6 aa, Plasmodium falciparum
ENNKNY

SEQ ID NO: 3310278 - protein, 6 aa, Plasmodium falciparum
ENNKPE

SEQ ID NO: 3310279 - protein, 6 aa, Plasmodium falciparum
ENNKQI

SEQ ID NO: 3310280 - protein, 13 aa, Plasmodium falciparum
ENNKTNQKKSIKS

SEQ ID NO: 3310281 - protein, 12 aa, Plasmodium falciparum
ENNLESDNVKYN

SEQ ID NO: 3310282 - protein, 12 aa, Plasmodium falciparum
ENNNCSKKENLK

SEQ ID NO: 3310283 - protein, 37 aa, Plasmodium falciparum
ENNNDDNNDNNNDDNNEDNNDDNNDNNNNNNNNDNND

SEQ ID NO: 3310284 - protein, 7 aa, Plasmodium falciparum
ENNNDKL

SEQ ID NO: 3310285 - protein, 80 aa, Plasmodium falciparum
ENNNDVNGDNGDNGDNDDDNGDNDDNNDDNNDEDNNDDNNDEDNNNDDNNDEDNNNDEDNNNDDNNNNDDNNNDGNNVST

SEQ ID NO: 3310286 - protein, 6 aa, Plasmodium falciparum
ENNNEC

SEQ ID NO: 3310287 - protein, 5 aa, Plasmodium falciparum
ENNNG

SEQ ID NO: 3310288 - protein, 13 aa, Plasmodium falciparum
ENNNHDDSEKEEI

SEQ ID NO: 3310289 - protein, 6 aa, Plasmodium falciparum
ENNNHN

SEQ ID NO: 3310290 - protein, 19 aa, Plasmodium falciparum
ENNNHRNTYHPSNNNTRNS

SEQ ID NO: 3310291 - protein, 6 aa, Plasmodium falciparum
ENNNIG

SEQ ID NO: 3310292 - protein, 9 aa, Plasmodium falciparum
ENNNKDDQR

SEQ ID NO: 3310293 - protein, 6 aa, Plasmodium falciparum
ENNNKE

SEQ ID NO: 3310294 - protein, 8 aa, Plasmodium falciparum
ENNNKKGV

SEQ ID NO: 3310295 - protein, 13 aa, Plasmodium falciparum
ENNNKQNEIVDET

SEQ ID NO: 3310296 - protein, 8 aa, Plasmodium falciparum
ENNNKTMP

SEQ ID NO: 3310297 - protein, 19 aa, Plasmodium falciparum
ENNNKYDNDNDNNNYDGYE

SEQ ID NO: 3310298 - protein, 7 aa, Plasmodium falciparum
ENNNLKE

SEQ ID NO: 3310299 - protein, 19 aa, Plasmodium falciparum
ENNNLKKKKKNVGNITNDN

SEQ ID NO: 3310300 - protein, 5 aa, Plasmodium falciparum
ENNNM

SEQ ID NO: 3310301 - protein, 13 aa, Plasmodium falciparum
ENNNNHNRNNNNN

SEQ ID NO: 3310302 - protein, 8 aa, Plasmodium falciparum
ENNNNKTD

SEQ ID NO: 3310303 - protein, 9 aa, Plasmodium falciparum
ENNNNNDDN

SEQ ID NO: 3310304 - protein, 9 aa, Plasmodium falciparum
ENNNNNNNN

SEQ ID NO: 3310305 - protein, 37 aa, Plasmodium falciparum
ENNNNNNNNNNKIDDDDDDNNNNNNIDDRNNNNNNYE

SEQ ID NO: 3310306 - protein, 25 aa, Plasmodium falciparum
ENNNNNNNNNNNKTQSKYEETSDGH

SEQ ID NO: 3310307 - protein, 23 aa, Plasmodium falciparum
ENNNNNNNNNNNNNIPKKNSMND

SEQ ID NO: 3310308 - protein, 26 aa, Plasmodium falciparum
ENNNNNNNNNNNNNNNNNSNVDDGNN

SEQ ID NO: 3310309 - protein, 23 aa, Plasmodium falciparum
ENNNNNNVNPSPFTSSNDIPLTN

SEQ ID NO: 3310310 - protein, 27 aa, Plasmodium falciparum
ENNNNSNNNNNNNNNNNNNNRRKTYTS

SEQ ID NO: 3310311 - protein, 7 aa, Plasmodium falciparum
ENNNQIQ

SEQ ID NO: 3310312 - protein, 13 aa, Plasmodium falciparum
ENNNRNKKEVDDE

SEQ ID NO: 3310313 - protein, 7 aa, Plasmodium falciparum
ENNNSRY

SEQ ID NO: 3310314 - protein, 4 aa, Plasmodium falciparum
ENNQ

SEQ ID NO: 3310315 - protein, 7 aa, Plasmodium falciparum
ENNQDVN

SEQ ID NO: 3310316 - protein, 6 aa, Plasmodium falciparum
ENNQKA

SEQ ID NO: 3310317 - protein, 5 aa, Plasmodium falciparum
ENNQN

SEQ ID NO: 3310318 - protein, 11 aa, Plasmodium falciparum
ENNQNKLEDTK

SEQ ID NO: 3310319 - protein, 7 aa, Plasmodium falciparum
ENNQQNK

SEQ ID NO: 3310320 - protein, 5 aa, Plasmodium falciparum
ENNRG

SEQ ID NO: 3310321 - protein, 6 aa, Plasmodium falciparum
ENNRKE

SEQ ID NO: 3310322 - protein, 5 aa, Plasmodium falciparum
ENNRR

SEQ ID NO: 3310323 - protein, 13 aa, Plasmodium falciparum
ENNRTDDKNTKFN

SEQ ID NO: 3310324 - protein, 8 aa, Plasmodium falciparum
ENNSCDEE

SEQ ID NO: 3310325 - protein, 5 aa, Plasmodium falciparum
ENNSE

SEQ ID NO: 3310326 - protein, 13 aa, Plasmodium falciparum
ENNSEKNESSKLN

SEQ ID NO: 3310327 - protein, 9 aa, Plasmodium falciparum
ENNSENVRK

SEQ ID NO: 3310328 - protein, 18 aa, Plasmodium falciparum
ENNSGQIYSKDKSTDEHI

SEQ ID NO: 3310329 - protein, 5 aa, Plasmodium falciparum
ENNSI

SEQ ID NO: 3310330 - protein, 7 aa, Plasmodium falciparum
ENNSIKQ

SEQ ID NO: 3310331 - protein, 10 aa, Plasmodium falciparum
ENNSKAKKKS

SEQ ID NO: 3310332 - protein, 12 aa, Plasmodium falciparum
ENNSKSTKNVSA

SEQ ID NO: 3310333 - protein, 6 aa, Plasmodium falciparum
ENNSQK

SEQ ID NO: 3310334 - protein, 11 aa, Plasmodium falciparum
ENNSQQNVEQY

SEQ ID NO: 3310335 - protein, 6 aa, Plasmodium falciparum
ENNSTI

SEQ ID NO: 3310336 - protein, 6 aa, Plasmodium falciparum
ENNSTM

SEQ ID NO: 3310337 - protein, 7 aa, Plasmodium falciparum
ENNSTPV

SEQ ID NO: 3310338 - protein, 20 aa, Plasmodium falciparum
ENNTIGGNNTISGNKTISGN

SEQ ID NO: 3310339 - protein, 18 aa, Plasmodium falciparum
ENNTKDDHKGDSKTSNLT

SEQ ID NO: 3310340 - protein, 19 aa, Plasmodium falciparum
ENNTKVIEGENNDMNVPSQ

SEQ ID NO: 3310341 - protein, 22 aa, Plasmodium falciparum
ENNTNDNNNHHHNDKESKEQVN

SEQ ID NO: 3310342 - protein, 17 aa, Plasmodium falciparum
ENNTNNQGNGKDEYASD

SEQ ID NO: 3310343 - protein, 19 aa, Plasmodium falciparum
ENNTRGKDITNNNNISGDP

SEQ ID NO: 3310344 - protein, 13 aa, Plasmodium falciparum
ENNTTQEKTENNK

SEQ ID NO: 3310345 - protein, 6 aa, Plasmodium falciparum
ENNTYG

SEQ ID NO: 3310346 - protein, 15 aa, Plasmodium falciparum
ENNVDKKNQIKENEL

SEQ ID NO: 3310347 - protein, 14 aa, Plasmodium falciparum
ENNVQSNDTPDNNY

SEQ ID NO: 3310348 - protein, 5 aa, Plasmodium falciparum
ENNVS

SEQ ID NO: 3310349 - protein, 26 aa, Plasmodium falciparum
ENNYDRDDNYNNNNYDDGEKHGNRSF

SEQ ID NO: 3310350 - protein, 7 aa, Plasmodium falciparum
ENNYENP

SEQ ID NO: 3310351 - protein, 8 aa, Plasmodium falciparum
ENNYGEKE

SEQ ID NO: 3310352 - protein, 23 aa, Plasmodium falciparum
ENNYNDNNDNNNNDNSNNDNNNN

SEQ ID NO: 3310353 - protein, 10 aa, Plasmodium falciparum
ENNYNSNNRN

SEQ ID NO: 3310354 - protein, 12 aa, Plasmodium falciparum
ENNYQKNRNSYN

SEQ ID NO: 3310355 - protein, 6 aa, Plasmodium falciparum
ENNYSL

SEQ ID NO: 3310356 - protein, 7 aa, Plasmodium falciparum
ENNYYEE

SEQ ID NO: 3310357 - protein, 4 aa, Plasmodium falciparum
ENPA

SEQ ID NO: 3310358 - protein, 4 aa, Plasmodium falciparum
ENPD

SEQ ID NO: 3310359 - protein, 7 aa, Plasmodium falciparum
ENPDDNI

SEQ ID NO: 3310360 - protein, 5 aa, Plasmodium falciparum
ENPDF

SEQ ID NO: 3310361 - protein, 9 aa, Plasmodium falciparum
ENPDPNNEN

SEQ ID NO: 3310362 - protein, 8 aa, Plasmodium falciparum
ENPFEEPS

SEQ ID NO: 3310363 - protein, 8 aa, Plasmodium falciparum
ENPKKPIY

SEQ ID NO: 3310364 - protein, 6 aa, Plasmodium falciparum
ENPNEY

SEQ ID NO: 3310365 - protein, 22 aa, Plasmodium falciparum
ENPNYTEDKNINDDKENYPGDN

SEQ ID NO: 3310366 - protein, 8 aa, Plasmodium falciparum
ENPPEYTK

SEQ ID NO: 3310367 - protein, 6 aa, Plasmodium falciparum
ENPPVV

SEQ ID NO: 3310368 - protein, 5 aa, Plasmodium falciparum
ENPQR

SEQ ID NO: 3310369 - protein, 5 aa, Plasmodium falciparum
ENPQS

SEQ ID NO: 3310370 - protein, 6 aa, Plasmodium falciparum
ENPREH

SEQ ID NO: 3310371 - protein, 9 aa, Plasmodium falciparum
ENPRENKNI

SEQ ID NO: 3310372 - protein, 7 aa, Plasmodium falciparum
ENPSRAK

SEQ ID NO: 3310373 - protein, 5 aa, Plasmodium falciparum
ENPSS

SEQ ID NO: 3310374 - protein, 9 aa, Plasmodium falciparum
ENPSSLNEN

SEQ ID NO: 3310375 - protein, 7 aa, Plasmodium falciparum
ENPVSSP

SEQ ID NO: 3310376 - protein, 5 aa, Plasmodium falciparum
ENPYY

SEQ ID NO: 3310377 - protein, 5 aa, Plasmodium falciparum
ENQDI

SEQ ID NO: 3310378 - protein, 7 aa, Plasmodium falciparum
ENQEEEG

SEQ ID NO: 3310379 - protein, 7 aa, Plasmodium falciparum
ENQEGTI

SEQ ID NO: 3310380 - protein, 13 aa, Plasmodium falciparum
ENQENKNQHNHNN

SEQ ID NO: 3310381 - protein, 5 aa, Plasmodium falciparum
ENQKE

SEQ ID NO: 3310382 - protein, 11 aa, Plasmodium falciparum
ENQKETQDEKR

SEQ ID NO: 3310383 - protein, 8 aa, Plasmodium falciparum
ENQKGKTN

SEQ ID NO: 3310384 - protein, 10 aa, Plasmodium falciparum
ENQKKDEEDY

SEQ ID NO: 3310385 - protein, 5 aa, Plasmodium falciparum
ENQKL

SEQ ID NO: 3310386 - protein, 9 aa, Plasmodium falciparum
ENQMNSPTR

SEQ ID NO: 3310387 - protein, 6 aa, Plasmodium falciparum
ENQNDI

SEQ ID NO: 3310388 - protein, 16 aa, Plasmodium falciparum
ENQNENYEQEENTLAQ

SEQ ID NO: 3310389 - protein, 9 aa, Plasmodium falciparum
ENQNEQKHT

SEQ ID NO: 3310390 - protein, 33 aa, Plasmodium falciparum
ENQNKNQYQYQNKNKNDLNNNNNNNNTCNHNTN

SEQ ID NO: 3310391 - protein, 8 aa, Plasmodium falciparum
ENQNQQNK

SEQ ID NO: 3310392 - protein, 16 aa, Plasmodium falciparum
ENQQSYTKNMKTDDPI

SEQ ID NO: 3310393 - protein, 4 aa, Plasmodium falciparum
ENQR

SEQ ID NO: 3310394 - protein, 6 aa, Plasmodium falciparum
ENQTDI

SEQ ID NO: 3310395 - protein, 5 aa, Plasmodium falciparum
ENQTI

SEQ ID NO: 3310396 - protein, 6 aa, Plasmodium falciparum
ENQYNN

SEQ ID NO: 3310397 - protein, 7 aa, Plasmodium falciparum
ENRANEN

SEQ ID NO: 3310398 - protein, 5 aa, Plasmodium falciparum
ENRGG

SEQ ID NO: 3310399 - protein, 10 aa, Plasmodium falciparum
ENRKNEKLKE

SEQ ID NO: 3310400 - protein, 37 aa, Plasmodium falciparum
ENRKRTKENNKSKESAYTSKSRKNNKIKGEEKKTKRS

SEQ ID NO: 3310401 - protein, 16 aa, Plasmodium falciparum
ENRKTLPQNEHNEHNE

SEQ ID NO: 3310402 - protein, 5 aa, Plasmodium falciparum
ENRNK

SEQ ID NO: 3310403 - protein, 134 aa, Plasmodium falciparum
ENRNKKNMDNTYEDNNNNNKYNVDEDNNNKYNVDEDNNNKYNVDEDNNNKYNVDEDNNNKYNVDEDNNNKYNVDEDNNNKYNVDEDNNNKYNVDEDNNNKYNVDEDNNNKYNVDEDNNNKYNVDEDNNSLDSFS

SEQ ID NO: 3310404 - protein, 36 aa, Plasmodium falciparum
ENRNNNRDIKNNKIEGESTDSLYTSSSEDEYNDRHD

SEQ ID NO: 3310405 - protein, 9 aa, Plasmodium falciparum
ENRNQTSFS

SEQ ID NO: 3310406 - protein, 23 aa, Plasmodium falciparum
ENRNSRKNRRRKKKKGKLKQPFP

SEQ ID NO: 3310407 - protein, 20 aa, Plasmodium falciparum
ENRNTKKNIKKNEKKKNKLN

SEQ ID NO: 3310408 - protein, 31 aa, Plasmodium falciparum
ENRRKVKKKNQMKEANYEDVNNQKRKKNKKL

SEQ ID NO: 3310409 - protein, 39 aa, Plasmodium falciparum
ENRTDNITNNNNNNNSSSSSSSNNNNSNNFYNKSNRDAP

SEQ ID NO: 3310410 - protein, 5 aa, Plasmodium falciparum
ENRTP

SEQ ID NO: 3310411 - protein, 8 aa, Plasmodium falciparum
ENRTYNSK

SEQ ID NO: 3310412 - protein, 8 aa, Plasmodium falciparum
ENSEELDT

SEQ ID NO: 3310413 - protein, 9 aa, Plasmodium falciparum
ENSEIESDI

SEQ ID NO: 3310414 - protein, 15 aa, Plasmodium falciparum
ENSEIKKEKESDISC

SEQ ID NO: 3310415 - protein, 7 aa, Plasmodium falciparum
ENSERNI

SEQ ID NO: 3310416 - protein, 7 aa, Plasmodium falciparum
ENSESFT

SEQ ID NO: 3310417 - protein, 5 aa, Plasmodium falciparum
ENSHD

SEQ ID NO: 3310418 - protein, 28 aa, Plasmodium falciparum
ENSIKKKESNHNHTTRHNNNNNNTSYIT

SEQ ID NO: 3310419 - protein, 4 aa, Plasmodium falciparum
ENSK

SEQ ID NO: 3310420 - protein, 17 aa, Plasmodium falciparum
ENSKEHDFTPPSRKRGT

SEQ ID NO: 3310421 - protein, 5 aa, Plasmodium falciparum
ENSKK

SEQ ID NO: 3310422 - protein, 8 aa, Plasmodium falciparum
ENSKNEKI

SEQ ID NO: 3310423 - protein, 10 aa, Plasmodium falciparum
ENSKNMSENL

SEQ ID NO: 3310424 - protein, 10 aa, Plasmodium falciparum
ENSKNSSLSD

SEQ ID NO: 3310425 - protein, 17 aa, Plasmodium falciparum
ENSLDTPMRGDNIGQPS

SEQ ID NO: 3310426 - protein, 14 aa, Plasmodium falciparum
ENSLNSYNKNDTSF

SEQ ID NO: 3310427 - protein, 4 aa, Plasmodium falciparum
ENSN

SEQ ID NO: 3310428 - protein, 5 aa, Plasmodium falciparum
ENSNI

SEQ ID NO: 3310429 - protein, 9 aa, Plasmodium falciparum
ENSNIENKS

SEQ ID NO: 3310430 - protein, 9 aa, Plasmodium falciparum
ENSNKTDEM

SEQ ID NO: 3310431 - protein, 25 aa, Plasmodium falciparum
ENSNNNNNNNNNNNNNNDCKNEAHK

SEQ ID NO: 3310432 - protein, 10 aa, Plasmodium falciparum
ENSNNNYLSD

SEQ ID NO: 3310433 - protein, 7 aa, Plasmodium falciparum
ENSNTDV

SEQ ID NO: 3310434 - protein, 8 aa, Plasmodium falciparum
ENSNTGKF

SEQ ID NO: 3310435 - protein, 6 aa, Plasmodium falciparum
ENSNTY

SEQ ID NO: 3310436 - protein, 7 aa, Plasmodium falciparum
ENSPCSN

SEQ ID NO: 3310437 - protein, 6 aa, Plasmodium falciparum
ENSPKK

SEQ ID NO: 3310438 - protein, 10 aa, Plasmodium falciparum
ENSPSHKSGL

SEQ ID NO: 3310439 - protein, 12 aa, Plasmodium falciparum
ENSPTSSEKKRR

SEQ ID NO: 3310440 - protein, 9 aa, Plasmodium falciparum
ENSQKGDHI

SEQ ID NO: 3310441 - protein, 11 aa, Plasmodium falciparum
ENSQNEKEKSY

SEQ ID NO: 3310442 - protein, 48 aa, Plasmodium falciparum
ENSSDDYDMNNENNNLTNDMRKDKNIKKKKKNKHYNNNNNNNNNKKKK

SEQ ID NO: 3310443 - protein, 15 aa, Plasmodium falciparum
ENSSFKSSTLKSNNL

SEQ ID NO: 3310444 - protein, 6 aa, Plasmodium falciparum
ENSSKI

SEQ ID NO: 3310445 - protein, 20 aa, Plasmodium falciparum
ENSSLNNNMRNSYENNIHKK

SEQ ID NO: 3310446 - protein, 20 aa, Plasmodium falciparum
ENSSNAESSCYSDEESEYSL

SEQ ID NO: 3310447 - protein, 10 aa, Plasmodium falciparum
ENSSNNLNEY

SEQ ID NO: 3310448 - protein, 10 aa, Plasmodium falciparum
ENSSQEDVYN

SEQ ID NO: 3310449 - protein, 6 aa, Plasmodium falciparum
ENSSTE

SEQ ID NO: 3310450 - protein, 7 aa, Plasmodium falciparum
ENSSTIN

SEQ ID NO: 3310451 - protein, 6 aa, Plasmodium falciparum
ENSSYS

SEQ ID NO: 3310452 - protein, 7 aa, Plasmodium falciparum
ENSTDKY

SEQ ID NO: 3310453 - protein, 7 aa, Plasmodium falciparum
ENSTNNK

SEQ ID NO: 3310454 - protein, 8 aa, Plasmodium falciparum
ENSTSKEK

SEQ ID NO: 3310455 - protein, 7 aa, Plasmodium falciparum
ENSVYDS

SEQ ID NO: 3310456 - protein, 6 aa, Plasmodium falciparum
ENSYAA

SEQ ID NO: 3310457 - protein, 8 aa, Plasmodium falciparum
ENSYQHDK

SEQ ID NO: 3310458 - protein, 20 aa, Plasmodium falciparum
ENSYSNSEQIRSDGIKDSKR

SEQ ID NO: 3310459 - protein, 15 aa, Plasmodium falciparum
ENTAGLGTSNSNVSY

SEQ ID NO: 3310460 - protein, 6 aa, Plasmodium falciparum
ENTDKL

SEQ ID NO: 3310461 - protein, 10 aa, Plasmodium falciparum
ENTEGDKDNN

SEQ ID NO: 3310462 - protein, 9 aa, Plasmodium falciparum
ENTENKNRY

SEQ ID NO: 3310463 - protein, 12 aa, Plasmodium falciparum
ENTENYDKESNG

SEQ ID NO: 3310464 - protein, 4 aa, Plasmodium falciparum
ENTG

SEQ ID NO: 3310465 - protein, 6 aa, Plasmodium falciparum
ENTHCK

SEQ ID NO: 3310466 - protein, 5 aa, Plasmodium falciparum
ENTIS

SEQ ID NO: 3310467 - protein, 10 aa, Plasmodium falciparum
ENTKANEYDK

SEQ ID NO: 3310468 - protein, 6 aa, Plasmodium falciparum
ENTKET

SEQ ID NO: 3310469 - protein, 9 aa, Plasmodium falciparum
ENTKKVDEY

SEQ ID NO: 3310470 - protein, 8 aa, Plasmodium falciparum
ENTKLREH

SEQ ID NO: 3310471 - protein, 12 aa, Plasmodium falciparum
ENTKRKENDNCK

SEQ ID NO: 3310472 - protein, 27 aa, Plasmodium falciparum
ENTLDHQTEHSDKNDHDDKEESNNYPM

SEQ ID NO: 3310473 - protein, 4 aa, Plasmodium falciparum
ENTN

SEQ ID NO: 3310474 - protein, 6 aa, Plasmodium falciparum
ENTNDV

SEQ ID NO: 3310475 - protein, 5 aa, Plasmodium falciparum
ENTNI

SEQ ID NO: 3310476 - protein, 26 aa, Plasmodium falciparum
ENTNKDIRRKKKKKKNKLKDNIDKSP

SEQ ID NO: 3310477 - protein, 45 aa, Plasmodium falciparum
ENTNKEDHKDDNKNSSNDNIPNVNNSDNCNLTSDDRIKSSIQENN

SEQ ID NO: 3310478 - protein, 15 aa, Plasmodium falciparum
ENTNMDDNNNNEIYS

SEQ ID NO: 3310479 - protein, 7 aa, Plasmodium falciparum
ENTNNIK

SEQ ID NO: 3310480 - protein, 37 aa, Plasmodium falciparum
ENTNTNANTNTNTNTNTNTNKKTNTNANTNTSTTFSC

SEQ ID NO: 3310481 - protein, 18 aa, Plasmodium falciparum
ENTNTNHNNHNNHNNHNN

SEQ ID NO: 3310482 - protein, 8 aa, Plasmodium falciparum
ENTNTYTN

SEQ ID NO: 3310483 - protein, 8 aa, Plasmodium falciparum
ENTNVNMN

SEQ ID NO: 3310484 - protein, 13 aa, Plasmodium falciparum
ENTNYEEGSSKYD

SEQ ID NO: 3310485 - protein, 4 aa, Plasmodium falciparum
ENTP

SEQ ID NO: 3310486 - protein, 8 aa, Plasmodium falciparum
ENTPDLPS

SEQ ID NO: 3310487 - protein, 5 aa, Plasmodium falciparum
ENTQD

SEQ ID NO: 3310488 - protein, 7 aa, Plasmodium falciparum
ENTQVDK

SEQ ID NO: 3310489 - protein, 6 aa, Plasmodium falciparum
ENTRTI

SEQ ID NO: 3310490 - protein, 6 aa, Plasmodium falciparum
ENTSEW

SEQ ID NO: 3310491 - protein, 16 aa, Plasmodium falciparum
ENTTQDEQTNDFEKET

SEQ ID NO: 3310492 - protein, 31 aa, Plasmodium falciparum
ENTTTNNSKNYAHNNNNKDNNIDSASGSIPP

SEQ ID NO: 3310493 - protein, 27 aa, Plasmodium falciparum
ENVAKKRNKSKNKNTLKRNKKCDDNNI

SEQ ID NO: 3310494 - protein, 9 aa, Plasmodium falciparum
ENVDDEKGL

SEQ ID NO: 3310495 - protein, 11 aa, Plasmodium falciparum
ENVDKDEKKKK

SEQ ID NO: 3310496 - protein, 7 aa, Plasmodium falciparum
ENVEEPN

SEQ ID NO: 3310497 - protein, 104 aa, Plasmodium falciparum
ENVEEYDEENVEEVEENVEENVEENVEENVEEYDEENVEEVEENVEENVEENVEENVEENVEEVEENVEENVEENVEENVEENVEENVEEYDEENVEEHNEEYD

SEQ ID NO: 3310498 - protein, 17 aa, Plasmodium falciparum
ENVEGSNKNEYENDFDE

SEQ ID NO: 3310499 - protein, 14 aa, Plasmodium falciparum
ENVEKGSKLKKKYQ

SEQ ID NO: 3310500 - protein, 6 aa, Plasmodium falciparum
ENVEKP

SEQ ID NO: 3310501 - protein, 15 aa, Plasmodium falciparum
ENVENEKEENTENKI

SEQ ID NO: 3310502 - protein, 12 aa, Plasmodium falciparum
ENVERGKKGTTL

SEQ ID NO: 3310503 - protein, 5 aa, Plasmodium falciparum
ENVHK

SEQ ID NO: 3310504 - protein, 4 aa, Plasmodium falciparum
ENVK

SEQ ID NO: 3310505 - protein, 9 aa, Plasmodium falciparum
ENVKEKEKF

SEQ ID NO: 3310506 - protein, 10 aa, Plasmodium falciparum
ENVKGDESNN

SEQ ID NO: 3310507 - protein, 9 aa, Plasmodium falciparum
ENVKGEDSK

SEQ ID NO: 3310508 - protein, 4 aa, Plasmodium falciparum
ENVN

SEQ ID NO: 3310509 - protein, 26 aa, Plasmodium falciparum
ENVNENTNNINDNKKERLKRNYEKDD

SEQ ID NO: 3310510 - protein, 9 aa, Plasmodium falciparum
ENVNLTEGG

SEQ ID NO: 3310511 - protein, 6 aa, Plasmodium falciparum
ENVNNN

SEQ ID NO: 3310512 - protein, 80 aa, Plasmodium falciparum
ENVPNEQNITNETNITNGEYVSSGPNVSGGPNMPGGSNMPGGPNMPGGSNMPGGPNMPGGSNMPGGPNIPGGPSPPSIPQ

SEQ ID NO: 3310513 - protein, 8 aa, Plasmodium falciparum
ENVQNKDK

SEQ ID NO: 3310514 - protein, 42 aa, Plasmodium falciparum
ENVQNKKKTNISNKEIKPKSSNNKNNSNNSNNNNSENSNKLN

SEQ ID NO: 3310515 - protein, 5 aa, Plasmodium falciparum
ENVQS

SEQ ID NO: 3310516 - protein, 7 aa, Plasmodium falciparum
ENVQSDK

SEQ ID NO: 3310517 - protein, 17 aa, Plasmodium falciparum
ENVSKREGEQSKENLEK

SEQ ID NO: 3310518 - protein, 7 aa, Plasmodium falciparum
ENVSPSF

SEQ ID NO: 3310519 - protein, 7 aa, Plasmodium falciparum
ENVSRKR

SEQ ID NO: 3310520 - protein, 7 aa, Plasmodium falciparum
ENVSSTI

SEQ ID NO: 3310521 - protein, 6 aa, Plasmodium falciparum
ENVTES

SEQ ID NO: 3310522 - protein, 29 aa, Plasmodium falciparum
ENVTKKEGSSNIDNADSYTKKSSYNENQD

SEQ ID NO: 3310523 - protein, 6 aa, Plasmodium falciparum
ENWSPD

SEQ ID NO: 3310524 - protein, 14 aa, Plasmodium falciparum
ENYAQEQENLEKQE

SEQ ID NO: 3310525 - protein, 6 aa, Plasmodium falciparum
ENYASY

SEQ ID NO: 3310526 - protein, 62 aa, Plasmodium falciparum
ENYDGDNNDNDGDNDGDNDGDNDGDNDGDNDGDNDGDNDGDNDGDNDGGNNDYDDDNNNIEK

SEQ ID NO: 3310527 - protein, 20 aa, Plasmodium falciparum
ENYDGKQDMDNMKPSKSSVR

SEQ ID NO: 3310528 - protein, 11 aa, Plasmodium falciparum
ENYDGYKNYEQ

SEQ ID NO: 3310529 - protein, 43 aa, Plasmodium falciparum
ENYDKKKGKNNNLEPYDDDHDDNDNDSNNNDDDMGEKKMNDKN

SEQ ID NO: 3310530 - protein, 4 aa, Plasmodium falciparum
ENYE

SEQ ID NO: 3310531 - protein, 31 aa, Plasmodium falciparum
ENYEDDENDENNLESPEGEENPFTNNPNRRN

SEQ ID NO: 3310532 - protein, 9 aa, Plasmodium falciparum
ENYEDEEKR

SEQ ID NO: 3310533 - protein, 11 aa, Plasmodium falciparum
ENYEDGSDDYM

SEQ ID NO: 3310534 - protein, 26 aa, Plasmodium falciparum
ENYEKGNYTIPNPTAPGIGYCPVPML

SEQ ID NO: 3310535 - protein, 13 aa, Plasmodium falciparum
ENYEKSKVNNKKY

SEQ ID NO: 3310536 - protein, 6 aa, Plasmodium falciparum
ENYEQK

SEQ ID NO: 3310537 - protein, 7 aa, Plasmodium falciparum
ENYGENN

SEQ ID NO: 3310538 - protein, 35 aa, Plasmodium falciparum
ENYHNNNNNNFYGNNNYNNASNSSSNSSRSNSSCK

SEQ ID NO: 3310539 - protein, 5 aa, Plasmodium falciparum
ENYKE

SEQ ID NO: 3310540 - protein, 8 aa, Plasmodium falciparum
ENYKNSRI

SEQ ID NO: 3310541 - protein, 4 aa, Plasmodium falciparum
ENYN

SEQ ID NO: 3310542 - protein, 7 aa, Plasmodium falciparum
ENYNETI

SEQ ID NO: 3310543 - protein, 7 aa, Plasmodium falciparum
ENYNGNK

SEQ ID NO: 3310544 - protein, 5 aa, Plasmodium falciparum
ENYNH

SEQ ID NO: 3310545 - protein, 16 aa, Plasmodium falciparum
ENYNKNRNGKNTDHAK

SEQ ID NO: 3310546 - protein, 23 aa, Plasmodium falciparum
ENYNNEENNSSNSTLPTSENSSN

SEQ ID NO: 3310547 - protein, 13 aa, Plasmodium falciparum
ENYNNGDKMNNPS

SEQ ID NO: 3310548 - protein, 8 aa, Plasmodium falciparum
ENYNNNES

SEQ ID NO: 3310549 - protein, 13 aa, Plasmodium falciparum
ENYNNTKEKSSIN

SEQ ID NO: 3310550 - protein, 11 aa, Plasmodium falciparum
ENYNQENDKYN

SEQ ID NO: 3310551 - protein, 11 aa, Plasmodium falciparum
ENYNTDKQTHV

SEQ ID NO: 3310552 - protein, 10 aa, Plasmodium falciparum
ENYPNDNTKI

SEQ ID NO: 3310553 - protein, 16 aa, Plasmodium falciparum
ENYPNNLKNKNDIEKE

SEQ ID NO: 3310554 - protein, 7 aa, Plasmodium falciparum
ENYPNNN

SEQ ID NO: 3310555 - protein, 6 aa, Plasmodium falciparum
ENYPSI

SEQ ID NO: 3310556 - protein, 7 aa, Plasmodium falciparum
ENYQGPE

SEQ ID NO: 3310557 - protein, 8 aa, Plasmodium falciparum
ENYRNQNS

SEQ ID NO: 3310558 - protein, 20 aa, Plasmodium falciparum
ENYSKIKKEEYEKIHEKNIN

SEQ ID NO: 3310559 - protein, 6 aa, Plasmodium falciparum
ENYSNQ

SEQ ID NO: 3310560 - protein, 4 aa, Plasmodium falciparum
ENYT

SEQ ID NO: 3310561 - protein, 7 aa, Plasmodium falciparum
ENYTEED

SEQ ID NO: 3310562 - protein, 5 aa, Plasmodium falciparum
ENYTG

SEQ ID NO: 3310563 - protein, 6 aa, Plasmodium falciparum
ENYTSE

SEQ ID NO: 3310564 - protein, 5 aa, Plasmodium falciparum
ENYYD

SEQ ID NO: 3310565 - protein, 6 aa, Plasmodium falciparum
EPAKTP

SEQ ID NO: 3310566 - protein, 9 aa, Plasmodium falciparum
EPAQSEGSF

SEQ ID NO: 3310567 - protein, 31 aa, Plasmodium falciparum
EPCDNKNKNKNKNDGIRDRGKIKNSDQKSLA

SEQ ID NO: 3310568 - protein, 5 aa, Plasmodium falciparum
EPDDE

SEQ ID NO: 3310569 - protein, 4 aa, Plasmodium falciparum
EPDN

SEQ ID NO: 3310570 - protein, 15 aa, Plasmodium falciparum
EPDNNKNGKKNEGQQ

SEQ ID NO: 3310571 - protein, 6 aa, Plasmodium falciparum
EPDTTE

SEQ ID NO: 3310572 - protein, 7 aa, Plasmodium falciparum
EPENEQA

SEQ ID NO: 3310573 - protein, 5 aa, Plasmodium falciparum
EPESL

SEQ ID NO: 3310574 - protein, 6 aa, Plasmodium falciparum
EPETAE

SEQ ID NO: 3310575 - protein, 20 aa, Plasmodium falciparum
EPETEREKTIEDKNESELEK

SEQ ID NO: 3310576 - protein, 15 aa, Plasmodium falciparum
EPGDVHNKNEDSNHD

SEQ ID NO: 3310577 - protein, 6 aa, Plasmodium falciparum
EPGNES

SEQ ID NO: 3310578 - protein, 5 aa, Plasmodium falciparum
EPGPM

SEQ ID NO: 3310579 - protein, 8 aa, Plasmodium falciparum
EPGRVQDG

SEQ ID NO: 3310580 - protein, 8 aa, Plasmodium falciparum
EPGTNGQH

SEQ ID NO: 3310581 - protein, 4 aa, Plasmodium falciparum
EPGY

SEQ ID NO: 3310582 - protein, 9 aa, Plasmodium falciparum
EPHTRNGKG

SEQ ID NO: 3310583 - protein, 4 aa, Plasmodium falciparum
EPIG

SEQ ID NO: 3310584 - protein, 15 aa, Plasmodium falciparum
EPIHKKNNDDNNSTC

SEQ ID NO: 3310585 - protein, 4 aa, Plasmodium falciparum
EPIN

SEQ ID NO: 3310586 - protein, 6 aa, Plasmodium falciparum
EPINNN

SEQ ID NO: 3310587 - protein, 13 aa, Plasmodium falciparum
EPINTDNDKTSRL

SEQ ID NO: 3310588 - protein, 4 aa, Plasmodium falciparum
EPIQ

SEQ ID NO: 3310589 - protein, 4 aa, Plasmodium falciparum
EPIS

SEQ ID NO: 3310590 - protein, 5 aa, Plasmodium falciparum
EPISE

SEQ ID NO: 3310591 - protein, 7 aa, Plasmodium falciparum
EPKAGEE

SEQ ID NO: 3310592 - protein, 8 aa, Plasmodium falciparum
EPKGNEHT

SEQ ID NO: 3310593 - protein, 4 aa, Plasmodium falciparum
EPKI

SEQ ID NO: 3310594 - protein, 5 aa, Plasmodium falciparum
EPKKE

SEQ ID NO: 3310595 - protein, 12 aa, Plasmodium falciparum
EPKKKKKKKNIK

SEQ ID NO: 3310596 - protein, 11 aa, Plasmodium falciparum
EPKKKKKWKEE

SEQ ID NO: 3310597 - protein, 8 aa, Plasmodium falciparum
EPKRKDID

SEQ ID NO: 3310598 - protein, 10 aa, Plasmodium falciparum
EPKSSKQPQI

SEQ ID NO: 3310599 - protein, 24 aa, Plasmodium falciparum
EPKVKTTNDTHVDYNDDNNDDSNI

SEQ ID NO: 3310600 - protein, 7 aa, Plasmodium falciparum
EPLASAS

SEQ ID NO: 3310601 - protein, 4 aa, Plasmodium falciparum
EPLD

SEQ ID NO: 3310602 - protein, 10 aa, Plasmodium falciparum
EPLGNSDGMY

SEQ ID NO: 3310603 - protein, 8 aa, Plasmodium falciparum
EPLGTGGP

SEQ ID NO: 3310604 - protein, 7 aa, Plasmodium falciparum
EPLYSDS

SEQ ID NO: 3310605 - protein, 7 aa, Plasmodium falciparum
EPNDDIS

SEQ ID NO: 3310606 - protein, 4 aa, Plasmodium falciparum
EPNE

SEQ ID NO: 3310607 - protein, 6 aa, Plasmodium falciparum
EPNEDL

SEQ ID NO: 3310608 - protein, 7 aa, Plasmodium falciparum
EPNEKDE

SEQ ID NO: 3310609 - protein, 11 aa, Plasmodium falciparum
EPNKTDRKYRE

SEQ ID NO: 3310610 - protein, 7 aa, Plasmodium falciparum
EPNMNTK

SEQ ID NO: 3310611 - protein, 7 aa, Plasmodium falciparum
EPNSQES

SEQ ID NO: 3310612 - protein, 6 aa, Plasmodium falciparum
EPPANL

SEQ ID NO: 3310613 - protein, 7 aa, Plasmodium falciparum
EPPINSY

SEQ ID NO: 3310614 - protein, 7 aa, Plasmodium falciparum
EPPKPKI

SEQ ID NO: 3310615 - protein, 5 aa, Plasmodium falciparum
EPPNV

SEQ ID NO: 3310616 - protein, 6 aa, Plasmodium falciparum
EPPPLK

SEQ ID NO: 3310617 - protein, 9 aa, Plasmodium falciparum
EPPQAGNRA

SEQ ID NO: 3310618 - protein, 4 aa, Plasmodium falciparum
EPPY

SEQ ID NO: 3310619 - protein, 17 aa, Plasmodium falciparum
EPQECKENKKGNKLNEA

SEQ ID NO: 3310620 - protein, 4 aa, Plasmodium falciparum
EPQG

SEQ ID NO: 3310621 - protein, 5 aa, Plasmodium falciparum
EPRPP

SEQ ID NO: 3310622 - protein, 8 aa, Plasmodium falciparum
EPRQTTSN

SEQ ID NO: 3310623 - protein, 6 aa, Plasmodium falciparum
EPRRKN

SEQ ID NO: 3310624 - protein, 5 aa, Plasmodium falciparum
EPRSA

SEQ ID NO: 3310625 - protein, 32 aa, Plasmodium falciparum
EPRSSFRGGRGSGYGGNFGRGGYRSGGGMGGG

SEQ ID NO: 3310626 - protein, 6 aa, Plasmodium falciparum
EPRTAS

SEQ ID NO: 3310627 - protein, 49 aa, Plasmodium falciparum
EPSAPGTTLEDENENNFSEESKEELENEEDTTEDTDADGWSSSPEEEID

SEQ ID NO: 3310628 - protein, 11 aa, Plasmodium falciparum
EPSDQKIKEEY

SEQ ID NO: 3310629 - protein, 9 aa, Plasmodium falciparum
EPSGTNTRF

SEQ ID NO: 3310630 - protein, 8 aa, Plasmodium falciparum
EPSTDDPF

SEQ ID NO: 3310631 - protein, 8 aa, Plasmodium falciparum
EPSTSSAV

SEQ ID NO: 3310632 - protein, 4 aa, Plasmodium falciparum
EPTA

SEQ ID NO: 3310633 - protein, 13 aa, Plasmodium falciparum
EPTDSTTNNQNKN

SEQ ID NO: 3310634 - protein, 5 aa, Plasmodium falciparum
EPTKK

SEQ ID NO: 3310635 - protein, 4 aa, Plasmodium falciparum
EPTL

SEQ ID NO: 3310636 - protein, 16 aa, Plasmodium falciparum
EPTLEHETTKEHNDLS

SEQ ID NO: 3310637 - protein, 15 aa, Plasmodium falciparum
EPTNKMKKKNKEKKN

SEQ ID NO: 3310638 - protein, 5 aa, Plasmodium falciparum
EPTNL

SEQ ID NO: 3310639 - protein, 4 aa, Plasmodium falciparum
EPTP

SEQ ID NO: 3310640 - protein, 15 aa, Plasmodium falciparum
EPTSFSQDNENVNAS

SEQ ID NO: 3310641 - protein, 7 aa, Plasmodium falciparum
EPTSNNE

SEQ ID NO: 3310642 - protein, 6 aa, Plasmodium falciparum
EPTTAR

SEQ ID NO: 3310643 - protein, 5 aa, Plasmodium falciparum
EPTTF

SEQ ID NO: 3310644 - protein, 14 aa, Plasmodium falciparum
EPTTNLDKANSRNL

SEQ ID NO: 3310645 - protein, 210 aa, Plasmodium falciparum
EPVATQEPVATQEPVATQEPVATQEPVATQEPVTTQEPVTTQEPVTTQEPATTQEPATTQETVTTQEAVTTQEPVTTQEPVTTQEPVTTQEPVTTQEPVTTQEPVAPQATVTTQETVAPQETVTTQEPVTTQEPVTTQEPVTTQEPVTTQEPVTTQEPVTTQEPVTTQEPVTPQQPVTPQQPVTPQQPVTPQQPATPQQPATPQQPVTPV

SEQ ID NO: 3310646 - protein, 5 aa, Plasmodium falciparum
EPVEN

SEQ ID NO: 3310647 - protein, 5 aa, Plasmodium falciparum
EPVPK

SEQ ID NO: 3310648 - protein, 86 aa, Plasmodium falciparum
EPVTPQEPVTPQEPVTPQEPVTPQEPVTPQEPVTTQESVTTQEPVTTQEPVTTQEPATTQEPVTTQEPVTPQEPVTTQEPVTTQEP

SEQ ID NO: 3310649 - protein, 68 aa, Plasmodium falciparum
EPVTTQEAVTTQEPVTTQEPVTTQEPVTTQEPVTTQEPVTTQEPVTTQEPVTTQEPVTTQEPVTTQEP

SEQ ID NO: 3310650 - protein, 14 aa, Plasmodium falciparum
EPVTTQEPVTTQEP

SEQ ID NO: 3310651 - protein, 4 aa, Plasmodium falciparum
EPVY

SEQ ID NO: 3310652 - protein, 5 aa, Plasmodium falciparum
EPWKN

SEQ ID NO: 3310653 - protein, 6 aa, Plasmodium falciparum
EPYKNS

SEQ ID NO: 3310654 - protein, 11 aa, Plasmodium falciparum
EQAEVRENNKL

SEQ ID NO: 3310655 - protein, 14 aa, Plasmodium falciparum
EQAGATTTENRTKR

SEQ ID NO: 3310656 - protein, 10 aa, Plasmodium falciparum
EQAKIAEEAG

SEQ ID NO: 3310657 - protein, 9 aa, Plasmodium falciparum
EQAPINKKS

SEQ ID NO: 3310658 - protein, 5 aa, Plasmodium falciparum
EQARK

SEQ ID NO: 3310659 - protein, 4 aa, Plasmodium falciparum
EQCG

SEQ ID NO: 3310660 - protein, 4 aa, Plasmodium falciparum
EQCP

SEQ ID NO: 3310661 - protein, 14 aa, Plasmodium falciparum
EQDASSELKDKKEE

SEQ ID NO: 3310662 - protein, 5 aa, Plasmodium falciparum
EQDCC

SEQ ID NO: 3310663 - protein, 4 aa, Plasmodium falciparum
EQDE

SEQ ID NO: 3310664 - protein, 7 aa, Plasmodium falciparum
EQDENMK

SEQ ID NO: 3310665 - protein, 5 aa, Plasmodium falciparum
EQDIN

SEQ ID NO: 3310666 - protein, 6 aa, Plasmodium falciparum
EQDITN

SEQ ID NO: 3310667 - protein, 5 aa, Plasmodium falciparum
EQDKN

SEQ ID NO: 3310668 - protein, 6 aa, Plasmodium falciparum
EQDKTK

SEQ ID NO: 3310669 - protein, 4 aa, Plasmodium falciparum
EQDL

SEQ ID NO: 3310670 - protein, 26 aa, Plasmodium falciparum
EQDNIHQEQNDITQQSNNIYEQKNDN

SEQ ID NO: 3310671 - protein, 5 aa, Plasmodium falciparum
EQDNR

SEQ ID NO: 3310672 - protein, 6 aa, Plasmodium falciparum
EQDPYQ

SEQ ID NO: 3310673 - protein, 4 aa, Plasmodium falciparum
EQDR

SEQ ID NO: 3310674 - protein, 14 aa, Plasmodium falciparum
EQDSKYKPSKIFKK

SEQ ID NO: 3310675 - protein, 16 aa, Plasmodium falciparum
EQDTEEKNKEKEREKQ

SEQ ID NO: 3310676 - protein, 54 aa, Plasmodium falciparum
EQDYEEKYNNDNNNNNDNNNDNNNDNNNDNNNNNNNDNNNNNNNNNSNNNNNNN

SEQ ID NO: 3310677 - protein, 4 aa, Plasmodium falciparum
EQEA

SEQ ID NO: 3310678 - protein, 9 aa, Plasmodium falciparum
EQEDINRES

SEQ ID NO: 3310679 - protein, 13 aa, Plasmodium falciparum
EQEDKNKKNTLLP

SEQ ID NO: 3310680 - protein, 7 aa, Plasmodium falciparum
EQEDNEI

SEQ ID NO: 3310681 - protein, 9 aa, Plasmodium falciparum
EQEDSEEQR

SEQ ID NO: 3310682 - protein, 75 aa, Plasmodium falciparum
EQEEEEEEEEEEEEEEEGAEDNKEDFDNEESDEDEEGIDDEIERNKKYNNEENIGKDENNNSRDGSKRIDENSKT

SEQ ID NO: 3310683 - protein, 7 aa, Plasmodium falciparum
EQEEKNE

SEQ ID NO: 3310684 - protein, 12 aa, Plasmodium falciparum
EQEEKNINDVSS

SEQ ID NO: 3310685 - protein, 13 aa, Plasmodium falciparum
EQEEQKKIKESVN

SEQ ID NO: 3310686 - protein, 5 aa, Plasmodium falciparum
EQEHK

SEQ ID NO: 3310687 - protein, 5 aa, Plasmodium falciparum
EQEHN

SEQ ID NO: 3310688 - protein, 16 aa, Plasmodium falciparum
EQEHNKKENDENSKNI

SEQ ID NO: 3310689 - protein, 10 aa, Plasmodium falciparum
EQEKDNSIKL

SEQ ID NO: 3310690 - protein, 17 aa, Plasmodium falciparum
EQEKEKEVPEKKDEEKC

SEQ ID NO: 3310691 - protein, 10 aa, Plasmodium falciparum
EQEKKDNPEH

SEQ ID NO: 3310692 - protein, 13 aa, Plasmodium falciparum
EQEKKKRKVESSP

SEQ ID NO: 3310693 - protein, 15 aa, Plasmodium falciparum
EQEKQKKKQNDNNKM

SEQ ID NO: 3310694 - protein, 6 aa, Plasmodium falciparum
EQEKYN

SEQ ID NO: 3310695 - protein, 82 aa, Plasmodium falciparum
EQENDQGGNNNNNDDNNDDNNDNNDDNNDNNDDNNDNNDNNDDNNNDNNNNNNNDNNDNNNNNNNNNNNNDNDNNNNNNCDE

SEQ ID NO: 3310696 - protein, 19 aa, Plasmodium falciparum
EQENGIPSSEMKKGKDQLL

SEQ ID NO: 3310697 - protein, 5 aa, Plasmodium falciparum
EQENI

SEQ ID NO: 3310698 - protein, 8 aa, Plasmodium falciparum
EQENKYKQ

SEQ ID NO: 3310699 - protein, 16 aa, Plasmodium falciparum
EQENNKMDENQHIDKN

SEQ ID NO: 3310700 - protein, 12 aa, Plasmodium falciparum
EQENNKRKYEEL

SEQ ID NO: 3310701 - protein, 4 aa, Plasmodium falciparum
EQER

SEQ ID NO: 3310702 - protein, 7 aa, Plasmodium falciparum
EQESSQL

SEQ ID NO: 3310703 - protein, 6 aa, Plasmodium falciparum
EQEYNQ

SEQ ID NO: 3310704 - protein, 7 aa, Plasmodium falciparum
EQFDPEK

SEQ ID NO: 3310705 - protein, 6 aa, Plasmodium falciparum
EQFSDG

SEQ ID NO: 3310706 - protein, 10 aa, Plasmodium falciparum
EQGGVTEESS

SEQ ID NO: 3310707 - protein, 35 aa, Plasmodium falciparum
EQGKADDIDKTKKEKTEENEIENIDNEKKKDEQIE

SEQ ID NO: 3310708 - protein, 6 aa, Plasmodium falciparum
EQGKGK

SEQ ID NO: 3310709 - protein, 8 aa, Plasmodium falciparum
EQGLNPKK

SEQ ID NO: 3310710 - protein, 4 aa, Plasmodium falciparum
EQGN

SEQ ID NO: 3310711 - protein, 5 aa, Plasmodium falciparum
EQGNY

SEQ ID NO: 3310712 - protein, 7 aa, Plasmodium falciparum
EQGPRTK

SEQ ID NO: 3310713 - protein, 8 aa, Plasmodium falciparum
EQGRDERV

SEQ ID NO: 3310714 - protein, 9 aa, Plasmodium falciparum
EQGSKGNPS

SEQ ID NO: 3310715 - protein, 4 aa, Plasmodium falciparum
EQGY

SEQ ID NO: 3310716 - protein, 6 aa, Plasmodium falciparum
EQGYMK

SEQ ID NO: 3310717 - protein, 28 aa, Plasmodium falciparum
EQHDTNLDKNGDKNDDGNKNDDKNDDKV

SEQ ID NO: 3310718 - protein, 10 aa, Plasmodium falciparum
EQHGKDGKYN

SEQ ID NO: 3310719 - protein, 6 aa, Plasmodium falciparum
EQHNSD

SEQ ID NO: 3310720 - protein, 5 aa, Plasmodium falciparum
EQHSE

SEQ ID NO: 3310721 - protein, 26 aa, Plasmodium falciparum
EQIDKSRQNGGKREEDQINYAFTCTN

SEQ ID NO: 3310722 - protein, 6 aa, Plasmodium falciparum
EQIENM

SEQ ID NO: 3310723 - protein, 4 aa, Plasmodium falciparum
EQIK

SEQ ID NO: 3310724 - protein, 5 aa, Plasmodium falciparum
EQIKD

SEQ ID NO: 3310725 - protein, 13 aa, Plasmodium falciparum
EQIKEKNDQQNHN

SEQ ID NO: 3310726 - protein, 5 aa, Plasmodium falciparum
EQIKK

SEQ ID NO: 3310727 - protein, 11 aa, Plasmodium falciparum
EQIKSSDDKNY

SEQ ID NO: 3310728 - protein, 4 aa, Plasmodium falciparum
EQIN

SEQ ID NO: 3310729 - protein, 11 aa, Plasmodium falciparum
EQINNSTNNNI

SEQ ID NO: 3310730 - protein, 4 aa, Plasmodium falciparum
EQIP

SEQ ID NO: 3310731 - protein, 19 aa, Plasmodium falciparum
EQKDIDQNNNISKKYDAKE

SEQ ID NO: 3310732 - protein, 5 aa, Plasmodium falciparum
EQKDN

SEQ ID NO: 3310733 - protein, 8 aa, Plasmodium falciparum
EQKEEGEE

SEQ ID NO: 3310734 - protein, 8 aa, Plasmodium falciparum
EQKEGTME

SEQ ID NO: 3310735 - protein, 13 aa, Plasmodium falciparum
EQKEKEKEKNYIN

SEQ ID NO: 3310736 - protein, 9 aa, Plasmodium falciparum
EQKEKKEAQ

SEQ ID NO: 3310737 - protein, 12 aa, Plasmodium falciparum
EQKEMSKANVHN

SEQ ID NO: 3310738 - protein, 10 aa, Plasmodium falciparum
EQKENNNDNN

SEQ ID NO: 3310739 - protein, 7 aa, Plasmodium falciparum
EQKGDDQ

SEQ ID NO: 3310740 - protein, 19 aa, Plasmodium falciparum
EQKHETGSGVTKEEEEGRK

SEQ ID NO: 3310741 - protein, 18 aa, Plasmodium falciparum
EQKHRDKNAKLRKETELK

SEQ ID NO: 3310742 - protein, 10 aa, Plasmodium falciparum
EQKIKNNPKK

SEQ ID NO: 3310743 - protein, 6 aa, Plasmodium falciparum
EQKINS

SEQ ID NO: 3310744 - protein, 4 aa, Plasmodium falciparum
EQKK

SEQ ID NO: 3310745 - protein, 7 aa, Plasmodium falciparum
EQKKEMK

SEQ ID NO: 3310746 - protein, 9 aa, Plasmodium falciparum
EQKKENQIK

SEQ ID NO: 3310747 - protein, 8 aa, Plasmodium falciparum
EQKKKRNN

SEQ ID NO: 3310748 - protein, 12 aa, Plasmodium falciparum
EQKKNEKEEKNL

SEQ ID NO: 3310749 - protein, 13 aa, Plasmodium falciparum
EQKKNKENEDQLD

SEQ ID NO: 3310750 - protein, 10 aa, Plasmodium falciparum
EQKKNSIKDV

SEQ ID NO: 3310751 - protein, 8 aa, Plasmodium falciparum
EQKKSFEE

SEQ ID NO: 3310752 - protein, 11 aa, Plasmodium falciparum
EQKKSSDETLE

SEQ ID NO: 3310753 - protein, 25 aa, Plasmodium falciparum
EQKKSSNNNNNNNNNITYTSTNNYE

SEQ ID NO: 3310754 - protein, 4 aa, Plasmodium falciparum
EQKL

SEQ ID NO: 3310755 - protein, 6 aa, Plasmodium falciparum
EQKLKG

SEQ ID NO: 3310756 - protein, 9 aa, Plasmodium falciparum
EQKNDILSP

SEQ ID NO: 3310757 - protein, 8 aa, Plasmodium falciparum
EQKNDNNI

SEQ ID NO: 3310758 - protein, 19 aa, Plasmodium falciparum
EQKNESSFEKKKNKTNNTN

SEQ ID NO: 3310759 - protein, 11 aa, Plasmodium falciparum
EQKNGKKICDE

SEQ ID NO: 3310760 - protein, 10 aa, Plasmodium falciparum
EQKNKLKQNK

SEQ ID NO: 3310761 - protein, 20 aa, Plasmodium falciparum
EQKNNLSEHNEDKDKDRNVN

SEQ ID NO: 3310762 - protein, 4 aa, Plasmodium falciparum
EQKQ

SEQ ID NO: 3310763 - protein, 5 aa, Plasmodium falciparum
EQKRN

SEQ ID NO: 3310764 - protein, 11 aa, Plasmodium falciparum
EQKSFSKEVQN

SEQ ID NO: 3310765 - protein, 13 aa, Plasmodium falciparum
EQKSNSNNDKRNQ

SEQ ID NO: 3310766 - protein, 9 aa, Plasmodium falciparum
EQKTKPTQH

SEQ ID NO: 3310767 - protein, 5 aa, Plasmodium falciparum
EQLER

SEQ ID NO: 3310768 - protein, 15 aa, Plasmodium falciparum
EQLKEEEKEKNTMKN

SEQ ID NO: 3310769 - protein, 5 aa, Plasmodium falciparum
EQLKK

SEQ ID NO: 3310770 - protein, 4 aa, Plasmodium falciparum
EQLQ

SEQ ID NO: 3310771 - protein, 17 aa, Plasmodium falciparum
EQLSDNDKNPNEQITED

SEQ ID NO: 3310772 - protein, 8 aa, Plasmodium falciparum
EQLSYEEK

SEQ ID NO: 3310773 - protein, 17 aa, Plasmodium falciparum
EQMASNSDTHKNSCTNS

SEQ ID NO: 3310774 - protein, 9 aa, Plasmodium falciparum
EQMENTKRK

SEQ ID NO: 3310775 - protein, 5 aa, Plasmodium falciparum
EQMGK

SEQ ID NO: 3310776 - protein, 4 aa, Plasmodium falciparum
EQMK

SEQ ID NO: 3310777 - protein, 5 aa, Plasmodium falciparum
EQMKE

SEQ ID NO: 3310778 - protein, 5 aa, Plasmodium falciparum
EQMNK

SEQ ID NO: 3310779 - protein, 4 aa, Plasmodium falciparum
EQND

SEQ ID NO: 3310780 - protein, 8 aa, Plasmodium falciparum
EQNDDDNN

SEQ ID NO: 3310781 - protein, 12 aa, Plasmodium falciparum
EQNDKKKKNSLD

SEQ ID NO: 3310782 - protein, 5 aa, Plasmodium falciparum
EQNDM

SEQ ID NO: 3310783 - protein, 6 aa, Plasmodium falciparum
EQNDMN

SEQ ID NO: 3310784 - protein, 4 aa, Plasmodium falciparum
EQNE

SEQ ID NO: 3310785 - protein, 17 aa, Plasmodium falciparum
EQNEEGERLKEKNDYVE

SEQ ID NO: 3310786 - protein, 9 aa, Plasmodium falciparum
EQNEENNND

SEQ ID NO: 3310787 - protein, 7 aa, Plasmodium falciparum
EQNEEPK

SEQ ID NO: 3310788 - protein, 6 aa, Plasmodium falciparum
EQNEHF

SEQ ID NO: 3310789 - protein, 9 aa, Plasmodium falciparum
EQNEKAQKK

SEQ ID NO: 3310790 - protein, 8 aa, Plasmodium falciparum
EQNEKKNK

SEQ ID NO: 3310791 - protein, 6 aa, Plasmodium falciparum
EQNENV

SEQ ID NO: 3310792 - protein, 23 aa, Plasmodium falciparum
EQNEQDLNSDYSSSLSENSSSTI

SEQ ID NO: 3310793 - protein, 7 aa, Plasmodium falciparum
EQNETNR

SEQ ID NO: 3310794 - protein, 6 aa, Plasmodium falciparum
EQNEYE

SEQ ID NO: 3310795 - protein, 4 aa, Plasmodium falciparum
EQNG

SEQ ID NO: 3310796 - protein, 6 aa, Plasmodium falciparum
EQNGLN

SEQ ID NO: 3310797 - protein, 10 aa, Plasmodium falciparum
EQNHYDNNAG

SEQ ID NO: 3310798 - protein, 4 aa, Plasmodium falciparum
EQNI

SEQ ID NO: 3310799 - protein, 13 aa, Plasmodium falciparum
EQNISEEQNISEE

SEQ ID NO: 3310800 - protein, 7 aa, Plasmodium falciparum
EQNKEKQ

SEQ ID NO: 3310801 - protein, 11 aa, Plasmodium falciparum
EQNKKLENEYK

SEQ ID NO: 3310802 - protein, 9 aa, Plasmodium falciparum
EQNKKSNRN

SEQ ID NO: 3310803 - protein, 10 aa, Plasmodium falciparum
EQNKNDQINN

SEQ ID NO: 3310804 - protein, 19 aa, Plasmodium falciparum
EQNKNDSKKHRNNKHVRDS

SEQ ID NO: 3310805 - protein, 11 aa, Plasmodium falciparum
EQNKNTKCSSL

SEQ ID NO: 3310806 - protein, 7 aa, Plasmodium falciparum
EQNKSSF

SEQ ID NO: 3310807 - protein, 4 aa, Plasmodium falciparum
EQNM

SEQ ID NO: 3310808 - protein, 28 aa, Plasmodium falciparum
EQNNDERKKKMKDNNKGNKVDKKKKDEE

SEQ ID NO: 3310809 - protein, 8 aa, Plasmodium falciparum
EQNNDNEY

SEQ ID NO: 3310810 - protein, 7 aa, Plasmodium falciparum
EQNNEEI

SEQ ID NO: 3310811 - protein, 5 aa, Plasmodium falciparum
EQNNK

SEQ ID NO: 3310812 - protein, 14 aa, Plasmodium falciparum
EQNNLTSNLEEKRE

SEQ ID NO: 3310813 - protein, 12 aa, Plasmodium falciparum
EQNNNDKGQDKN

SEQ ID NO: 3310814 - protein, 20 aa, Plasmodium falciparum
EQNNNLENSNITYEDDEVQN

SEQ ID NO: 3310815 - protein, 60 aa, Plasmodium falciparum
EQNNNNSKDNNNNIDNNNNIDNNNNIDNNNNIDNNNNIDNNNNNIDNNNNIDNHHNNNQH

SEQ ID NO: 3310816 - protein, 15 aa, Plasmodium falciparum
EQNNNYNNEDDNNNI

SEQ ID NO: 3310817 - protein, 8 aa, Plasmodium falciparum
EQNNQEDE

SEQ ID NO: 3310818 - protein, 17 aa, Plasmodium falciparum
EQNNQENELQSNKWSAQ

SEQ ID NO: 3310819 - protein, 6 aa, Plasmodium falciparum
EQNNST

SEQ ID NO: 3310820 - protein, 6 aa, Plasmodium falciparum
EQNNTI

SEQ ID NO: 3310821 - protein, 8 aa, Plasmodium falciparum
EQNNTKNV

SEQ ID NO: 3310822 - protein, 19 aa, Plasmodium falciparum
EQNPKKKGRRLTTKGENAI

SEQ ID NO: 3310823 - protein, 6 aa, Plasmodium falciparum
EQNQKA

SEQ ID NO: 3310824 - protein, 8 aa, Plasmodium falciparum
EQNQPKRL

SEQ ID NO: 3310825 - protein, 9 aa, Plasmodium falciparum
EQNREEQKI

SEQ ID NO: 3310826 - protein, 23 aa, Plasmodium falciparum
EQNREKRKHKIPKYQKKKKKKKL

SEQ ID NO: 3310827 - protein, 10 aa, Plasmodium falciparum
EQNSNNNQDN

SEQ ID NO: 3310828 - protein, 9 aa, Plasmodium falciparum
EQNSSLEKV

SEQ ID NO: 3310829 - protein, 4 aa, Plasmodium falciparum
EQNT

SEQ ID NO: 3310830 - protein, 15 aa, Plasmodium falciparum
EQNTCQTSDDNTTYR

SEQ ID NO: 3310831 - protein, 14 aa, Plasmodium falciparum
EQNTPGDLKNTPNI

SEQ ID NO: 3310832 - protein, 7 aa, Plasmodium falciparum
EQNTVTQ

SEQ ID NO: 3310833 - protein, 4 aa, Plasmodium falciparum
EQNV

SEQ ID NO: 3310834 - protein, 5 aa, Plasmodium falciparum
EQNYD

SEQ ID NO: 3310835 - protein, 5 aa, Plasmodium falciparum
EQNYE

SEQ ID NO: 3310836 - protein, 7 aa, Plasmodium falciparum
EQNYSKN

SEQ ID NO: 3310837 - protein, 8 aa, Plasmodium falciparum
EQPEQGQE

SEQ ID NO: 3310838 - protein, 6 aa, Plasmodium falciparum
EQPKRS

SEQ ID NO: 3310839 - protein, 22 aa, Plasmodium falciparum
EQPMKKRKRGEGPQANSEKGEL

SEQ ID NO: 3310840 - protein, 7 aa, Plasmodium falciparum
EQPPPNL

SEQ ID NO: 3310841 - protein, 13 aa, Plasmodium falciparum
EQQEGKKKMTEEI

SEQ ID NO: 3310842 - protein, 6 aa, Plasmodium falciparum
EQQERI

SEQ ID NO: 3310843 - protein, 10 aa, Plasmodium falciparum
EQQGGEGKEY

SEQ ID NO: 3310844 - protein, 9 aa, Plasmodium falciparum
EQQKEVDKT

SEQ ID NO: 3310845 - protein, 18 aa, Plasmodium falciparum
EQQKKEKKPSNINGNISP

SEQ ID NO: 3310846 - protein, 14 aa, Plasmodium falciparum
EQQKNTQKSASDGI

SEQ ID NO: 3310847 - protein, 4 aa, Plasmodium falciparum
EQQN

SEQ ID NO: 3310848 - protein, 149 aa, Plasmodium falciparum
EQQNEKLDEQLNEQPNENFDEQPNENFDEQPNENFDEQPNENFDEQPNENFDEQPNENFDEQPNENFDEQPNENFDEQPNENFDEQPNENFDEQPNENFDEQPNENFDEQPNENFDEQPNENFDEQPNENSDEQSNNTNKDEPNTSNYV

SEQ ID NO: 3310849 - protein, 12 aa, Plasmodium falciparum
EQQNKKDFSSDV

SEQ ID NO: 3310850 - protein, 11 aa, Plasmodium falciparum
EQQNNDETNNM

SEQ ID NO: 3310851 - protein, 22 aa, Plasmodium falciparum
EQQNSHETETERDDLQTMQDYR

SEQ ID NO: 3310852 - protein, 5 aa, Plasmodium falciparum
EQQPK

SEQ ID NO: 3310853 - protein, 49 aa, Plasmodium falciparum
EQQQEKDEEEKGEGEEDEEEKGKGEEEEEEEEEEEEGEEEVEEEGEEGV

SEQ ID NO: 3310854 - protein, 4 aa, Plasmodium falciparum
EQQR

SEQ ID NO: 3310855 - protein, 5 aa, Plasmodium falciparum
EQQTD

SEQ ID NO: 3310856 - protein, 7 aa, Plasmodium falciparum
EQQTKES

SEQ ID NO: 3310857 - protein, 5 aa, Plasmodium falciparum
EQQVN

SEQ ID NO: 3310858 - protein, 4 aa, Plasmodium falciparum
EQRE

SEQ ID NO: 3310859 - protein, 5 aa, Plasmodium falciparum
EQREN

SEQ ID NO: 3310860 - protein, 8 aa, Plasmodium falciparum
EQREQNKT

SEQ ID NO: 3310861 - protein, 28 aa, Plasmodium falciparum
EQRMNEQSINEDYTSEDYTSEEYTDEDY

SEQ ID NO: 3310862 - protein, 7 aa, Plasmodium falciparum
EQRNTSN

SEQ ID NO: 3310863 - protein, 5 aa, Plasmodium falciparum
EQRRH

SEQ ID NO: 3310864 - protein, 19 aa, Plasmodium falciparum
EQSATLSKSLNNGGRFSSG

SEQ ID NO: 3310865 - protein, 14 aa, Plasmodium falciparum
EQSCKKNKERSNIK

SEQ ID NO: 3310866 - protein, 5 aa, Plasmodium falciparum
EQSEM

SEQ ID NO: 3310867 - protein, 7 aa, Plasmodium falciparum
EQSGGEG

SEQ ID NO: 3310868 - protein, 8 aa, Plasmodium falciparum
EQSGSQIQ

SEQ ID NO: 3310869 - protein, 8 aa, Plasmodium falciparum
EQSKEGKN

SEQ ID NO: 3310870 - protein, 15 aa, Plasmodium falciparum
EQSNDDHDNNNNNNN

SEQ ID NO: 3310871 - protein, 26 aa, Plasmodium falciparum
EQSNEKKSSKINTYNNNSYRRKSTNE

SEQ ID NO: 3310872 - protein, 7 aa, Plasmodium falciparum
EQSRNPV

SEQ ID NO: 3310873 - protein, 27 aa, Plasmodium falciparum
EQSSMHEKEENELNDNNVNDENNNMNG

SEQ ID NO: 3310874 - protein, 6 aa, Plasmodium falciparum
EQTDNK

SEQ ID NO: 3310875 - protein, 4 aa, Plasmodium falciparum
EQTE

SEQ ID NO: 3310876 - protein, 9 aa, Plasmodium falciparum
EQTGQENMS

SEQ ID NO: 3310877 - protein, 14 aa, Plasmodium falciparum
EQTHAKEENNESNI

SEQ ID NO: 3310878 - protein, 16 aa, Plasmodium falciparum
EQTKGPIEKKTTDNNE

SEQ ID NO: 3310879 - protein, 5 aa, Plasmodium falciparum
EQTKK

SEQ ID NO: 3310880 - protein, 16 aa, Plasmodium falciparum
EQTKKKNDHKENNNID

SEQ ID NO: 3310881 - protein, 6 aa, Plasmodium falciparum
EQTKKS

SEQ ID NO: 3310882 - protein, 24 aa, Plasmodium falciparum
EQTKSYEDDNINDNEKDSSSPSYS

SEQ ID NO: 3310883 - protein, 13 aa, Plasmodium falciparum
EQTNERDQPTQEM

SEQ ID NO: 3310884 - protein, 36 aa, Plasmodium falciparum
EQTNTDNTHDKKETIKTKNRDNHNISNNEKQKPTFE

SEQ ID NO: 3310885 - protein, 8 aa, Plasmodium falciparum
EQTNTTQW

SEQ ID NO: 3310886 - protein, 5 aa, Plasmodium falciparum
EQTNY

SEQ ID NO: 3310887 - protein, 14 aa, Plasmodium falciparum
EQTTENNKTETNQI

SEQ ID NO: 3310888 - protein, 10 aa, Plasmodium falciparum
EQVGKKKKNR

SEQ ID NO: 3310889 - protein, 4 aa, Plasmodium falciparum
EQVK

SEQ ID NO: 3310890 - protein, 14 aa, Plasmodium falciparum
EQVKEENEKNKMSP

SEQ ID NO: 3310891 - protein, 4 aa, Plasmodium falciparum
EQVN

SEQ ID NO: 3310892 - protein, 11 aa, Plasmodium falciparum
EQVNDKNDTKY

SEQ ID NO: 3310893 - protein, 9 aa, Plasmodium falciparum
EQVPINSNK

SEQ ID NO: 3310894 - protein, 11 aa, Plasmodium falciparum
EQVQKNNLPNS

SEQ ID NO: 3310895 - protein, 5 aa, Plasmodium falciparum
EQWTD

SEQ ID NO: 3310896 - protein, 7 aa, Plasmodium falciparum
EQYDENS

SEQ ID NO: 3310897 - protein, 20 aa, Plasmodium falciparum
EQYNENGNENVYKESGNYEI

SEQ ID NO: 3310898 - protein, 30 aa, Plasmodium falciparum
EQYNYDEKHNYDEHNNDEQYNYDENNHDEH

SEQ ID NO: 3310899 - protein, 20 aa, Plasmodium falciparum
EQYTNNNKMKENYDRNANMN

SEQ ID NO: 3310900 - protein, 6 aa, Plasmodium falciparum
ERAKIG

SEQ ID NO: 3310901 - protein, 8 aa, Plasmodium falciparum
ERALTKDN

SEQ ID NO: 3310902 - protein, 8 aa, Plasmodium falciparum
ERAMTKDN

SEQ ID NO: 3310903 - protein, 7 aa, Plasmodium falciparum
ERANREN

SEQ ID NO: 3310904 - protein, 7 aa, Plasmodium falciparum
ERASHGS

SEQ ID NO: 3310905 - protein, 7 aa, Plasmodium falciparum
ERASKYS

SEQ ID NO: 3310906 - protein, 4 aa, Plasmodium falciparum
ERAY

SEQ ID NO: 3310907 - protein, 5 aa, Plasmodium falciparum
ERCES

SEQ ID NO: 3310908 - protein, 4 aa, Plasmodium falciparum
ERCS

SEQ ID NO: 3310909 - protein, 4 aa, Plasmodium falciparum
ERDE

SEQ ID NO: 3310910 - protein, 24 aa, Plasmodium falciparum
ERDEEEVEKEENNKKEEDGESDLS

SEQ ID NO: 3310911 - protein, 7 aa, Plasmodium falciparum
ERDGELP

SEQ ID NO: 3310912 - protein, 41 aa, Plasmodium falciparum
ERDHKKCDDKKYSDNTNETYDDQKCDDNTNETYDNEKCDEA

SEQ ID NO: 3310913 - protein, 4 aa, Plasmodium falciparum
ERDI

SEQ ID NO: 3310914 - protein, 11 aa, Plasmodium falciparum
ERDINNKNKKL

SEQ ID NO: 3310915 - protein, 5 aa, Plasmodium falciparum
ERDIQ

SEQ ID NO: 3310916 - protein, 10 aa, Plasmodium falciparum
ERDITNNKSC

SEQ ID NO: 3310917 - protein, 4 aa, Plasmodium falciparum
ERDK

SEQ ID NO: 3310918 - protein, 14 aa, Plasmodium falciparum
ERDKDIIKDNEWLK

SEQ ID NO: 3310919 - protein, 18 aa, Plasmodium falciparum
ERDKLRKENLEKDENHTM

SEQ ID NO: 3310920 - protein, 4 aa, Plasmodium falciparum
ERDN

SEQ ID NO: 3310921 - protein, 10 aa, Plasmodium falciparum
ERDTKHEKSI

SEQ ID NO: 3310922 - protein, 6 aa, Plasmodium falciparum
ERDTKS

SEQ ID NO: 3310923 - protein, 11 aa, Plasmodium falciparum
ERDVKAKKGIQ

SEQ ID NO: 3310924 - protein, 11 aa, Plasmodium falciparum
ERECQNNNSYS

SEQ ID NO: 3310925 - protein, 7 aa, Plasmodium falciparum
ERECSDY

SEQ ID NO: 3310926 - protein, 7 aa, Plasmodium falciparum
EREDTEE

SEQ ID NO: 3310927 - protein, 4 aa, Plasmodium falciparum
EREE

SEQ ID NO: 3310928 - protein, 8 aa, Plasmodium falciparum
EREEDNIN

SEQ ID NO: 3310929 - protein, 10 aa, Plasmodium falciparum
EREEGDQNGY

SEQ ID NO: 3310930 - protein, 9 aa, Plasmodium falciparum
EREEKEMEK

SEQ ID NO: 3310931 - protein, 6 aa, Plasmodium falciparum
EREGID

SEQ ID NO: 3310932 - protein, 14 aa, Plasmodium falciparum
EREHERESEHEHEH

SEQ ID NO: 3310933 - protein, 24 aa, Plasmodium falciparum
EREKKNSYHSKYKTEKYLKQKNEF

SEQ ID NO: 3310934 - protein, 7 aa, Plasmodium falciparum
EREKKRP

SEQ ID NO: 3310935 - protein, 8 aa, Plasmodium falciparum
EREKNINN

SEQ ID NO: 3310936 - protein, 6 aa, Plasmodium falciparum
EREKNK

SEQ ID NO: 3310937 - protein, 5 aa, Plasmodium falciparum
EREKP

SEQ ID NO: 3310938 - protein, 7 aa, Plasmodium falciparum
EREMASD

SEQ ID NO: 3310939 - protein, 11 aa, Plasmodium falciparum
ERENETHTNNI

SEQ ID NO: 3310940 - protein, 6 aa, Plasmodium falciparum
ERENIE

SEQ ID NO: 3310941 - protein, 11 aa, Plasmodium falciparum
ERENKTNQPTM

SEQ ID NO: 3310942 - protein, 7 aa, Plasmodium falciparum
ERENNAP

SEQ ID NO: 3310943 - protein, 7 aa, Plasmodium falciparum
ERENNQN

SEQ ID NO: 3310944 - protein, 5 aa, Plasmodium falciparum
ERENY

SEQ ID NO: 3310945 - protein, 5 aa, Plasmodium falciparum
EREQK

SEQ ID NO: 3310946 - protein, 7 aa, Plasmodium falciparum
EREQKQK

SEQ ID NO: 3310947 - protein, 5 aa, Plasmodium falciparum
EREQT

SEQ ID NO: 3310948 - protein, 6 aa, Plasmodium falciparum
ERERGI

SEQ ID NO: 3310949 - protein, 12 aa, Plasmodium falciparum
ERERKDSDVTSF

SEQ ID NO: 3310950 - protein, 10 aa, Plasmodium falciparum
ERERKKEECI

SEQ ID NO: 3310951 - protein, 5 aa, Plasmodium falciparum
ERERR

SEQ ID NO: 3310952 - protein, 8 aa, Plasmodium falciparum
ERERSQRK

SEQ ID NO: 3310953 - protein, 17 aa, Plasmodium falciparum
ERETKKPSVKNSTLGNY

SEQ ID NO: 3310954 - protein, 7 aa, Plasmodium falciparum
ERFKKNG

SEQ ID NO: 3310955 - protein, 21 aa, Plasmodium falciparum
ERFNGNDKDLSSASSYNSSYN

SEQ ID NO: 3310956 - protein, 26 aa, Plasmodium falciparum
ERGEQKQNKKKIYNNNNINSHNNSCN

SEQ ID NO: 3310957 - protein, 8 aa, Plasmodium falciparum
ERGGQTRE

SEQ ID NO: 3310958 - protein, 49 aa, Plasmodium falciparum
ERGKGNDNRLGVSSTSNDKKKNNKKRYNNNNNNDNNNDINNDCNNNKYN

SEQ ID NO: 3310959 - protein, 10 aa, Plasmodium falciparum
ERGKMKKDKM

SEQ ID NO: 3310960 - protein, 5 aa, Plasmodium falciparum
ERGKY

SEQ ID NO: 3310961 - protein, 6 aa, Plasmodium falciparum
ERGLGE

SEQ ID NO: 3310962 - protein, 4 aa, Plasmodium falciparum
ERGN

SEQ ID NO: 3310963 - protein, 5 aa, Plasmodium falciparum
ERGNE

SEQ ID NO: 3310964 - protein, 4 aa, Plasmodium falciparum
ERGQ

SEQ ID NO: 3310965 - protein, 11 aa, Plasmodium falciparum
ERGQKGNVSEG

SEQ ID NO: 3310966 - protein, 7 aa, Plasmodium falciparum
ERGSRGR

SEQ ID NO: 3310967 - protein, 51 aa, Plasmodium falciparum
ERGYINRDKEGKHIRRDKEGKHIRRDKEEKHIRRDKEGKHIRGEQERRHQI

SEQ ID NO: 3310968 - protein, 5 aa, Plasmodium falciparum
ERGYS

SEQ ID NO: 3310969 - protein, 6 aa, Plasmodium falciparum
ERHDEN

SEQ ID NO: 3310970 - protein, 8 aa, Plasmodium falciparum
ERHGNQSR

SEQ ID NO: 3310971 - protein, 5 aa, Plasmodium falciparum
ERHTK

SEQ ID NO: 3310972 - protein, 9 aa, Plasmodium falciparum
ERIKPNTSI

SEQ ID NO: 3310973 - protein, 4 aa, Plasmodium falciparum
ERIN

SEQ ID NO: 3310974 - protein, 21 aa, Plasmodium falciparum
ERITEKNQNGNENGNENEKKN

SEQ ID NO: 3310975 - protein, 6 aa, Plasmodium falciparum
ERKDID

SEQ ID NO: 3310976 - protein, 16 aa, Plasmodium falciparum
ERKEKEKEKEKDYGME

SEQ ID NO: 3310977 - protein, 7 aa, Plasmodium falciparum
ERKENDS

SEQ ID NO: 3310978 - protein, 6 aa, Plasmodium falciparum
ERKENH

SEQ ID NO: 3310979 - protein, 7 aa, Plasmodium falciparum
ERKEQHN

SEQ ID NO: 3310980 - protein, 5 aa, Plasmodium falciparum
ERKIN

SEQ ID NO: 3310981 - protein, 11 aa, Plasmodium falciparum
ERKKKKKRKLY

SEQ ID NO: 3310982 - protein, 8 aa, Plasmodium falciparum
ERKKNNSI

SEQ ID NO: 3310983 - protein, 6 aa, Plasmodium falciparum
ERKKPQ

SEQ ID NO: 3310984 - protein, 7 aa, Plasmodium falciparum
ERKNNNS

SEQ ID NO: 3310985 - protein, 9 aa, Plasmodium falciparum
ERKNNQKTT

SEQ ID NO: 3310986 - protein, 9 aa, Plasmodium falciparum
ERKQNEYNN

SEQ ID NO: 3310987 - protein, 19 aa, Plasmodium falciparum
ERKSLKEKSQLAKSEEEKI

SEQ ID NO: 3310988 - protein, 28 aa, Plasmodium falciparum
ERKSNDNDNDNIKNNDNINSNNNINSNN

SEQ ID NO: 3310989 - protein, 28 aa, Plasmodium falciparum
ERKSNNVSTSTITNTNTNTNTNTNTKTN

SEQ ID NO: 3310990 - protein, 8 aa, Plasmodium falciparum
ERKSRRSN

SEQ ID NO: 3310991 - protein, 8 aa, Plasmodium falciparum
ERKTDVSQ

SEQ ID NO: 3310992 - protein, 13 aa, Plasmodium falciparum
ERKTGKTYGPIGN

SEQ ID NO: 3310993 - protein, 11 aa, Plasmodium falciparum
ERKYKKSYTAS

SEQ ID NO: 3310994 - protein, 4 aa, Plasmodium falciparum
ERLE

SEQ ID NO: 3310995 - protein, 4 aa, Plasmodium falciparum
ERLK

SEQ ID NO: 3310996 - protein, 6 aa, Plasmodium falciparum
ERLSRN

SEQ ID NO: 3310997 - protein, 7 aa, Plasmodium falciparum
ERNDDGN

SEQ ID NO: 3310998 - protein, 23 aa, Plasmodium falciparum
ERNDNNDSNDNHHNNHNNHNINN

SEQ ID NO: 3310999 - protein, 5 aa, Plasmodium falciparum
ERNET

SEQ ID NO: 3311000 - protein, 10 aa, Plasmodium falciparum
ERNHDEKDDS

SEQ ID NO: 3311001 - protein, 5 aa, Plasmodium falciparum
ERNHN

SEQ ID NO: 3311002 - protein, 6 aa, Plasmodium falciparum
ERNHSE

SEQ ID NO: 3311003 - protein, 4 aa, Plasmodium falciparum
ERNI

SEQ ID NO: 3311004 - protein, 6 aa, Plasmodium falciparum
ERNKDI

SEQ ID NO: 3311005 - protein, 19 aa, Plasmodium falciparum
ERNKDMKYNKRESLQPNAS

SEQ ID NO: 3311006 - protein, 6 aa, Plasmodium falciparum
ERNKKK

SEQ ID NO: 3311007 - protein, 6 aa, Plasmodium falciparum
ERNKLE

SEQ ID NO: 3311008 - protein, 5 aa, Plasmodium falciparum
ERNKN

SEQ ID NO: 3311009 - protein, 7 aa, Plasmodium falciparum
ERNKNQI

SEQ ID NO: 3311010 - protein, 5 aa, Plasmodium falciparum
ERNKR

SEQ ID NO: 3311011 - protein, 4 aa, Plasmodium falciparum
ERNN

SEQ ID NO: 3311012 - protein, 16 aa, Plasmodium falciparum
ERNNDDDEDDGISSTM

SEQ ID NO: 3311013 - protein, 9 aa, Plasmodium falciparum
ERNNDSLSD

SEQ ID NO: 3311014 - protein, 36 aa, Plasmodium falciparum
ERNNETNCTKGNNNDDDKSNNINNNNYNNNYNNNYN

SEQ ID NO: 3311015 - protein, 8 aa, Plasmodium falciparum
ERNNNSSL

SEQ ID NO: 3311016 - protein, 7 aa, Plasmodium falciparum
ERNPNTL

SEQ ID NO: 3311017 - protein, 27 aa, Plasmodium falciparum
ERNREKNNIPSYTSDSTQQQKKKKDYK

SEQ ID NO: 3311018 - protein, 7 aa, Plasmodium falciparum
ERNSIPE

SEQ ID NO: 3311019 - protein, 7 aa, Plasmodium falciparum
ERNSSPN

SEQ ID NO: 3311020 - protein, 11 aa, Plasmodium falciparum
ERNTTNGNVDS

SEQ ID NO: 3311021 - protein, 8 aa, Plasmodium falciparum
ERNTTYNN

SEQ ID NO: 3311022 - protein, 13 aa, Plasmodium falciparum
ERNVTSTSDPRRS

SEQ ID NO: 3311023 - protein, 15 aa, Plasmodium falciparum
ERNYKPDLRRYLHIS

SEQ ID NO: 3311024 - protein, 5 aa, Plasmodium falciparum
ERPDH

SEQ ID NO: 3311025 - protein, 7 aa, Plasmodium falciparum
ERPDIDK

SEQ ID NO: 3311026 - protein, 10 aa, Plasmodium falciparum
ERPGKLDATP

SEQ ID NO: 3311027 - protein, 5 aa, Plasmodium falciparum
ERPKD

SEQ ID NO: 3311028 - protein, 7 aa, Plasmodium falciparum
ERPREKF

SEQ ID NO: 3311029 - protein, 12 aa, Plasmodium falciparum
ERPTNYQDTRNY

SEQ ID NO: 3311030 - protein, 5 aa, Plasmodium falciparum
ERPTY

SEQ ID NO: 3311031 - protein, 31 aa, Plasmodium falciparum
ERQAEENTHDKKNHGNDQDSDNDEDEDDDDI

SEQ ID NO: 3311032 - protein, 4 aa, Plasmodium falciparum
ERQY

SEQ ID NO: 3311033 - protein, 7 aa, Plasmodium falciparum
ERRDELK

SEQ ID NO: 3311034 - protein, 29 aa, Plasmodium falciparum
ERRKEKEEKEAYIDPDKAEEHKNKGNEYF

SEQ ID NO: 3311035 - protein, 4 aa, Plasmodium falciparum
ERRN

SEQ ID NO: 3311036 - protein, 6 aa, Plasmodium falciparum
ERRNKV

SEQ ID NO: 3311037 - protein, 5 aa, Plasmodium falciparum
ERRNR

SEQ ID NO: 3311038 - protein, 4 aa, Plasmodium falciparum
ERRP

SEQ ID NO: 3311039 - protein, 8 aa, Plasmodium falciparum
ERRQNSEK

SEQ ID NO: 3311040 - protein, 6 aa, Plasmodium falciparum
ERRRER

SEQ ID NO: 3311041 - protein, 7 aa, Plasmodium falciparum
ERRRERE

SEQ ID NO: 3311042 - protein, 7 aa, Plasmodium falciparum
ERSDHTY

SEQ ID NO: 3311043 - protein, 12 aa, Plasmodium falciparum
ERSHNKSSDNIS

SEQ ID NO: 3311044 - protein, 4 aa, Plasmodium falciparum
ERSI

SEQ ID NO: 3311045 - protein, 4 aa, Plasmodium falciparum
ERSL

SEQ ID NO: 3311046 - protein, 11 aa, Plasmodium falciparum
ERSLEKDGTIY

SEQ ID NO: 3311047 - protein, 8 aa, Plasmodium falciparum
ERSNGECD

SEQ ID NO: 3311048 - protein, 8 aa, Plasmodium falciparum
ERSRREKE

SEQ ID NO: 3311049 - protein, 18 aa, Plasmodium falciparum
ERSSTFEKDQKKPKNYSN

SEQ ID NO: 3311050 - protein, 9 aa, Plasmodium falciparum
ERSTDNDDL

SEQ ID NO: 3311051 - protein, 7 aa, Plasmodium falciparum
ERSVSEN

SEQ ID NO: 3311052 - protein, 10 aa, Plasmodium falciparum
ERTFNKEENR

SEQ ID NO: 3311053 - protein, 4 aa, Plasmodium falciparum
ERTI

SEQ ID NO: 3311054 - protein, 4 aa, Plasmodium falciparum
ERTN

SEQ ID NO: 3311055 - protein, 6 aa, Plasmodium falciparum
ERTNID

SEQ ID NO: 3311056 - protein, 5 aa, Plasmodium falciparum
ERTNN

SEQ ID NO: 3311057 - protein, 7 aa, Plasmodium falciparum
ERTPPNI

SEQ ID NO: 3311058 - protein, 8 aa, Plasmodium falciparum
ERTSENAH

SEQ ID NO: 3311059 - protein, 6 aa, Plasmodium falciparum
ERTYED

SEQ ID NO: 3311060 - protein, 15 aa, Plasmodium falciparum
ERVPDDSVSLKDGDK

SEQ ID NO: 3311061 - protein, 6 aa, Plasmodium falciparum
ERVSGN

SEQ ID NO: 3311062 - protein, 5 aa, Plasmodium falciparum
ERVSL

SEQ ID NO: 3311063 - protein, 14 aa, Plasmodium falciparum
ERYSENSTMKYEGK

SEQ ID NO: 3311064 - protein, 12 aa, Plasmodium falciparum
ESADNAESMENG

SEQ ID NO: 3311065 - protein, 10 aa, Plasmodium falciparum
ESAHTKGDND

SEQ ID NO: 3311066 - protein, 4 aa, Plasmodium falciparum
ESAI

SEQ ID NO: 3311067 - protein, 6 aa, Plasmodium falciparum
ESAKGL

SEQ ID NO: 3311068 - protein, 5 aa, Plasmodium falciparum
ESAKI

SEQ ID NO: 3311069 - protein, 13 aa, Plasmodium falciparum
ESANEKESDNMKN

SEQ ID NO: 3311070 - protein, 5 aa, Plasmodium falciparum
ESAPK

SEQ ID NO: 3311071 - protein, 34 aa, Plasmodium falciparum
ESATTCKDNNANEACSSSQKSSPNPCADKSGGKL

SEQ ID NO: 3311072 - protein, 10 aa, Plasmodium falciparum
ESATTKEDDI

SEQ ID NO: 3311073 - protein, 4 aa, Plasmodium falciparum
ESCA

SEQ ID NO: 3311074 - protein, 6 aa, Plasmodium falciparum
ESCEKI

SEQ ID NO: 3311075 - protein, 12 aa, Plasmodium falciparum
ESCHKDEKEEEK

SEQ ID NO: 3311076 - protein, 9 aa, Plasmodium falciparum
ESCKDNKCS

SEQ ID NO: 3311077 - protein, 5 aa, Plasmodium falciparum
ESCNA

SEQ ID NO: 3311078 - protein, 10 aa, Plasmodium falciparum
ESCPQPQTSE

SEQ ID NO: 3311079 - protein, 24 aa, Plasmodium falciparum
ESCYESDYSSKYGTDGSIKDNKTN

SEQ ID NO: 3311080 - protein, 8 aa, Plasmodium falciparum
ESDAAKEL

SEQ ID NO: 3311081 - protein, 8 aa, Plasmodium falciparum
ESDDNSSL

SEQ ID NO: 3311082 - protein, 5 aa, Plasmodium falciparum
ESDEN

SEQ ID NO: 3311083 - protein, 7 aa, Plasmodium falciparum
ESDENVS

SEQ ID NO: 3311084 - protein, 5 aa, Plasmodium falciparum
ESDER

SEQ ID NO: 3311085 - protein, 7 aa, Plasmodium falciparum
ESDFSNK

SEQ ID NO: 3311086 - protein, 7 aa, Plasmodium falciparum
ESDGTRN

SEQ ID NO: 3311087 - protein, 13 aa, Plasmodium falciparum
ESDGYSDEEYDTN

SEQ ID NO: 3311088 - protein, 37 aa, Plasmodium falciparum
ESDIEREDESKEISSNKNDDTEYIENEEKNDKDQNNY

SEQ ID NO: 3311089 - protein, 8 aa, Plasmodium falciparum
ESDKCNGD

SEQ ID NO: 3311090 - protein, 7 aa, Plasmodium falciparum
ESDLADI

SEQ ID NO: 3311091 - protein, 8 aa, Plasmodium falciparum
ESDNDEVE

SEQ ID NO: 3311092 - protein, 13 aa, Plasmodium falciparum
ESDNGCYDNTYDN

SEQ ID NO: 3311093 - protein, 12 aa, Plasmodium falciparum
ESDNISSSKSFK

SEQ ID NO: 3311094 - protein, 6 aa, Plasmodium falciparum
ESDNKE

SEQ ID NO: 3311095 - protein, 17 aa, Plasmodium falciparum
ESDSSLENDKKKKENVK

SEQ ID NO: 3311096 - protein, 4 aa, Plasmodium falciparum
ESDT

SEQ ID NO: 3311097 - protein, 76 aa, Plasmodium falciparum
ESDTYENNKNDKEINSQSDKKLNSQSDKKLNSQSDKKLNSQSDKEINSQNDKEVNSQSDKEINSQSDKGINSQSDN

SEQ ID NO: 3311098 - protein, 4 aa, Plasmodium falciparum
ESED

SEQ ID NO: 3311099 - protein, 12 aa, Plasmodium falciparum
ESEDIKEQVKND

SEQ ID NO: 3311100 - protein, 6 aa, Plasmodium falciparum
ESEETN

SEQ ID NO: 3311101 - protein, 8 aa, Plasmodium falciparum
ESEHNQNE

SEQ ID NO: 3311102 - protein, 5 aa, Plasmodium falciparum
ESEHT

SEQ ID NO: 3311103 - protein, 4 aa, Plasmodium falciparum
ESEK

SEQ ID NO: 3311104 - protein, 11 aa, Plasmodium falciparum
ESEKMQEEMNE

SEQ ID NO: 3311105 - protein, 10 aa, Plasmodium falciparum
ESEKNLENDK

SEQ ID NO: 3311106 - protein, 7 aa, Plasmodium falciparum
ESEKRGN

SEQ ID NO: 3311107 - protein, 6 aa, Plasmodium falciparum
ESELNK

SEQ ID NO: 3311108 - protein, 11 aa, Plasmodium falciparum
ESENDRNESIQ

SEQ ID NO: 3311109 - protein, 8 aa, Plasmodium falciparum
ESENPRKM

SEQ ID NO: 3311110 - protein, 6 aa, Plasmodium falciparum
ESEQKN

SEQ ID NO: 3311111 - protein, 5 aa, Plasmodium falciparum
ESEQV

SEQ ID NO: 3311112 - protein, 5 aa, Plasmodium falciparum
ESERE

SEQ ID NO: 3311113 - protein, 11 aa, Plasmodium falciparum
ESETRKYKPYP

SEQ ID NO: 3311114 - protein, 4 aa, Plasmodium falciparum
ESFC

SEQ ID NO: 3311115 - protein, 33 aa, Plasmodium falciparum
ESFEKNKDDNNIMSTKSSASSYPYGDDEDGDNI

SEQ ID NO: 3311116 - protein, 6 aa, Plasmodium falciparum
ESFEPY

SEQ ID NO: 3311117 - protein, 4 aa, Plasmodium falciparum
ESFS

SEQ ID NO: 3311118 - protein, 6 aa, Plasmodium falciparum
ESGEID

SEQ ID NO: 3311119 - protein, 5 aa, Plasmodium falciparum
ESGEK

SEQ ID NO: 3311120 - protein, 4 aa, Plasmodium falciparum
ESGG

SEQ ID NO: 3311121 - protein, 4 aa, Plasmodium falciparum
ESGK

SEQ ID NO: 3311122 - protein, 24 aa, Plasmodium falciparum
ESGLGKRVDNNNNNCSSSSSSSAF

SEQ ID NO: 3311123 - protein, 4 aa, Plasmodium falciparum
ESGN

SEQ ID NO: 3311124 - protein, 10 aa, Plasmodium falciparum
ESGNNKLTND

SEQ ID NO: 3311125 - protein, 5 aa, Plasmodium falciparum
ESGRY

SEQ ID NO: 3311126 - protein, 6 aa, Plasmodium falciparum
ESGSKG

SEQ ID NO: 3311127 - protein, 7 aa, Plasmodium falciparum
ESGSNNS

SEQ ID NO: 3311128 - protein, 6 aa, Plasmodium falciparum
ESGTEI

SEQ ID NO: 3311129 - protein, 5 aa, Plasmodium falciparum
ESGTY

SEQ ID NO: 3311130 - protein, 5 aa, Plasmodium falciparum
ESGVD

SEQ ID NO: 3311131 - protein, 24 aa, Plasmodium falciparum
ESHDKKHKSEDSKYGEKRSNELYE

SEQ ID NO: 3311132 - protein, 4 aa, Plasmodium falciparum
ESHH

SEQ ID NO: 3311133 - protein, 21 aa, Plasmodium falciparum
ESHKGGKNMKKKNKKKKKKKD

SEQ ID NO: 3311134 - protein, 8 aa, Plasmodium falciparum
ESHKKCKN

SEQ ID NO: 3311135 - protein, 4 aa, Plasmodium falciparum
ESHL

SEQ ID NO: 3311136 - protein, 4 aa, Plasmodium falciparum
ESHM

SEQ ID NO: 3311137 - protein, 4 aa, Plasmodium falciparum
ESHN

SEQ ID NO: 3311138 - protein, 22 aa, Plasmodium falciparum
ESHTEKDEIKDDNNNNNNNNKH

SEQ ID NO: 3311139 - protein, 4 aa, Plasmodium falciparum
ESHY

SEQ ID NO: 3311140 - protein, 5 aa, Plasmodium falciparum
ESIDE

SEQ ID NO: 3311141 - protein, 7 aa, Plasmodium falciparum
ESIDNNN

SEQ ID NO: 3311142 - protein, 6 aa, Plasmodium falciparum
ESIDSD

SEQ ID NO: 3311143 - protein, 22 aa, Plasmodium falciparum
ESIDTTQTETFDDKNYNNEKKP

SEQ ID NO: 3311144 - protein, 5 aa, Plasmodium falciparum
ESIEK

SEQ ID NO: 3311145 - protein, 6 aa, Plasmodium falciparum
ESIEKQ

SEQ ID NO: 3311146 - protein, 8 aa, Plasmodium falciparum
ESIKEKNL

SEQ ID NO: 3311147 - protein, 4 aa, Plasmodium falciparum
ESIN

SEQ ID NO: 3311148 - protein, 6 aa, Plasmodium falciparum
ESINDD

SEQ ID NO: 3311149 - protein, 13 aa, Plasmodium falciparum
ESINESQTPEKVD

SEQ ID NO: 3311150 - protein, 13 aa, Plasmodium falciparum
ESINNNKKKYINK

SEQ ID NO: 3311151 - protein, 4 aa, Plasmodium falciparum
ESIQ

SEQ ID NO: 3311152 - protein, 5 aa, Plasmodium falciparum
ESIQS

SEQ ID NO: 3311153 - protein, 5 aa, Plasmodium falciparum
ESIQY

SEQ ID NO: 3311154 - protein, 14 aa, Plasmodium falciparum
ESIRHNSKSPNYYN

SEQ ID NO: 3311155 - protein, 5 aa, Plasmodium falciparum
ESIRR

SEQ ID NO: 3311156 - protein, 4 aa, Plasmodium falciparum
ESIY

SEQ ID NO: 3311157 - protein, 8 aa, Plasmodium falciparum
ESKDEALK

SEQ ID NO: 3311158 - protein, 10 aa, Plasmodium falciparum
ESKDQAQNAL

SEQ ID NO: 3311159 - protein, 5 aa, Plasmodium falciparum
ESKDY

SEQ ID NO: 3311160 - protein, 8 aa, Plasmodium falciparum
ESKEDKLK

SEQ ID NO: 3311161 - protein, 27 aa, Plasmodium falciparum
ESKEENKKDTNETKKKEEESKHYEDRH

SEQ ID NO: 3311162 - protein, 22 aa, Plasmodium falciparum
ESKEKEEKKEGVETNAKEKRSV

SEQ ID NO: 3311163 - protein, 9 aa, Plasmodium falciparum
ESKGADTSI

SEQ ID NO: 3311164 - protein, 4 aa, Plasmodium falciparum
ESKH

SEQ ID NO: 3311165 - protein, 7 aa, Plasmodium falciparum
ESKIGQD

SEQ ID NO: 3311166 - protein, 9 aa, Plasmodium falciparum
ESKKEENEK

SEQ ID NO: 3311167 - protein, 12 aa, Plasmodium falciparum
ESKKNKKESYIN

SEQ ID NO: 3311168 - protein, 45 aa, Plasmodium falciparum
ESKKQQNAAKKINGEVETNENKDDNKTKNENNNKKAKSKKDKQKT

SEQ ID NO: 3311169 - protein, 8 aa, Plasmodium falciparum
ESKKSLVE

SEQ ID NO: 3311170 - protein, 6 aa, Plasmodium falciparum
ESKLED

SEQ ID NO: 3311171 - protein, 6 aa, Plasmodium falciparum
ESKLGK

SEQ ID NO: 3311172 - protein, 10 aa, Plasmodium falciparum
ESKNEGKKNE

SEQ ID NO: 3311173 - protein, 54 aa, Plasmodium falciparum
ESKNKNVNQKEDNKEINKENNKDDNKENNKEDNKEYNKEDDKEDDKEDDKEDDK

SEQ ID NO: 3311174 - protein, 5 aa, Plasmodium falciparum
ESKNM

SEQ ID NO: 3311175 - protein, 8 aa, Plasmodium falciparum
ESKNNIDG

SEQ ID NO: 3311176 - protein, 8 aa, Plasmodium falciparum
ESKNNNGM

SEQ ID NO: 3311177 - protein, 6 aa, Plasmodium falciparum
ESKNRP

SEQ ID NO: 3311178 - protein, 13 aa, Plasmodium falciparum
ESKNVGKNIGQNI

SEQ ID NO: 3311179 - protein, 8 aa, Plasmodium falciparum
ESKRNRNR

SEQ ID NO: 3311180 - protein, 7 aa, Plasmodium falciparum
ESKRTKH

SEQ ID NO: 3311181 - protein, 9 aa, Plasmodium falciparum
ESKSKNETN

SEQ ID NO: 3311182 - protein, 5 aa, Plasmodium falciparum
ESKSM

SEQ ID NO: 3311183 - protein, 5 aa, Plasmodium falciparum
ESKTK

SEQ ID NO: 3311184 - protein, 5 aa, Plasmodium falciparum
ESKYE

SEQ ID NO: 3311185 - protein, 9 aa, Plasmodium falciparum
ESKYEENKE

SEQ ID NO: 3311186 - protein, 8 aa, Plasmodium falciparum
ESKYSTQR

SEQ ID NO: 3311187 - protein, 26 aa, Plasmodium falciparum
ESLCNKSSSSIQNVEGTKKRETNIKS

SEQ ID NO: 3311188 - protein, 4 aa, Plasmodium falciparum
ESLD

SEQ ID NO: 3311189 - protein, 7 aa, Plasmodium falciparum
ESLEKEK

SEQ ID NO: 3311190 - protein, 12 aa, Plasmodium falciparum
ESLEKKNKVKTS

SEQ ID NO: 3311191 - protein, 12 aa, Plasmodium falciparum
ESLETKKERRLG

SEQ ID NO: 3311192 - protein, 5 aa, Plasmodium falciparum
ESLKE

SEQ ID NO: 3311193 - protein, 20 aa, Plasmodium falciparum
ESLKENEKKMKRRKKGELDK

SEQ ID NO: 3311194 - protein, 6 aa, Plasmodium falciparum
ESLKES

SEQ ID NO: 3311195 - protein, 19 aa, Plasmodium falciparum
ESLNKESYKECDNKKSVNE

SEQ ID NO: 3311196 - protein, 4 aa, Plasmodium falciparum
ESLP

SEQ ID NO: 3311197 - protein, 4 aa, Plasmodium falciparum
ESLQ

SEQ ID NO: 3311198 - protein, 5 aa, Plasmodium falciparum
ESLQQ

SEQ ID NO: 3311199 - protein, 5 aa, Plasmodium falciparum
ESLSD

SEQ ID NO: 3311200 - protein, 9 aa, Plasmodium falciparum
ESLSKTKEA

SEQ ID NO: 3311201 - protein, 16 aa, Plasmodium falciparum
ESLTSEEEKLKESDEQ

SEQ ID NO: 3311202 - protein, 4 aa, Plasmodium falciparum
ESMD

SEQ ID NO: 3311203 - protein, 42 aa, Plasmodium falciparum
ESMNDEERVSSEDENKKRKNKEDDKDIREREKSKKHDEDKMK

SEQ ID NO: 3311204 - protein, 12 aa, Plasmodium falciparum
ESMNDLSDDKME

SEQ ID NO: 3311205 - protein, 12 aa, Plasmodium falciparum
ESNDKKKKETNK

SEQ ID NO: 3311206 - protein, 20 aa, Plasmodium falciparum
ESNDSIEGNKNKYDKNKVKE

SEQ ID NO: 3311207 - protein, 15 aa, Plasmodium falciparum
ESNEAEGEDEGYEAD

SEQ ID NO: 3311208 - protein, 7 aa, Plasmodium falciparum
ESNEDIS

SEQ ID NO: 3311209 - protein, 8 aa, Plasmodium falciparum
ESNEMKGK

SEQ ID NO: 3311210 - protein, 13 aa, Plasmodium falciparum
ESNESQNETNPEQ

SEQ ID NO: 3311211 - protein, 7 aa, Plasmodium falciparum
ESNETIR

SEQ ID NO: 3311212 - protein, 18 aa, Plasmodium falciparum
ESNFSHSKTNNDDINEKL

SEQ ID NO: 3311213 - protein, 13 aa, Plasmodium falciparum
ESNGKSVDRNNQP

SEQ ID NO: 3311214 - protein, 11 aa, Plasmodium falciparum
ESNINKEKENY

SEQ ID NO: 3311215 - protein, 4 aa, Plasmodium falciparum
ESNK

SEQ ID NO: 3311216 - protein, 5 aa, Plasmodium falciparum
ESNKC

SEQ ID NO: 3311217 - protein, 8 aa, Plasmodium falciparum
ESNKIHKS

SEQ ID NO: 3311218 - protein, 10 aa, Plasmodium falciparum
ESNKYDDNYE

SEQ ID NO: 3311219 - protein, 8 aa, Plasmodium falciparum
ESNKYDID

SEQ ID NO: 3311220 - protein, 5 aa, Plasmodium falciparum
ESNLD

SEQ ID NO: 3311221 - protein, 5 aa, Plasmodium falciparum
ESNLS

SEQ ID NO: 3311222 - protein, 6 aa, Plasmodium falciparum
ESNLSD

SEQ ID NO: 3311223 - protein, 10 aa, Plasmodium falciparum
ESNLSPKESE

SEQ ID NO: 3311224 - protein, 4 aa, Plasmodium falciparum
ESNN

SEQ ID NO: 3311225 - protein, 13 aa, Plasmodium falciparum
ESNNFDSNSEEFA

SEQ ID NO: 3311226 - protein, 10 aa, Plasmodium falciparum
ESNNMSGNKN

SEQ ID NO: 3311227 - protein, 5 aa, Plasmodium falciparum
ESNNN

SEQ ID NO: 3311228 - protein, 9 aa, Plasmodium falciparum
ESNNNNNNN

SEQ ID NO: 3311229 - protein, 10 aa, Plasmodium falciparum
ESNNNQKDFV

SEQ ID NO: 3311230 - protein, 15 aa, Plasmodium falciparum
ESNNSIKKKEEIKKK

SEQ ID NO: 3311231 - protein, 11 aa, Plasmodium falciparum
ESNNYNSRNNN

SEQ ID NO: 3311232 - protein, 8 aa, Plasmodium falciparum
ESNQQNNV

SEQ ID NO: 3311233 - protein, 7 aa, Plasmodium falciparum
ESNQTNI

SEQ ID NO: 3311234 - protein, 28 aa, Plasmodium falciparum
ESNRGKRRSVKSKNKNENEKKGKTKDEL

SEQ ID NO: 3311235 - protein, 7 aa, Plasmodium falciparum
ESNRNNN

SEQ ID NO: 3311236 - protein, 6 aa, Plasmodium falciparum
ESNSIV

SEQ ID NO: 3311237 - protein, 5 aa, Plasmodium falciparum
ESNSN

SEQ ID NO: 3311238 - protein, 10 aa, Plasmodium falciparum
ESNTDNVQTN

SEQ ID NO: 3311239 - protein, 7 aa, Plasmodium falciparum
ESNTELH

SEQ ID NO: 3311240 - protein, 14 aa, Plasmodium falciparum
ESNTISHNNNNHNN

SEQ ID NO: 3311241 - protein, 5 aa, Plasmodium falciparum
ESNVT

SEQ ID NO: 3311242 - protein, 7 aa, Plasmodium falciparum
ESNYSDL

SEQ ID NO: 3311243 - protein, 9 aa, Plasmodium falciparum
ESNYTTKDT

SEQ ID NO: 3311244 - protein, 9 aa, Plasmodium falciparum
ESPFSSNSS

SEQ ID NO: 3311245 - protein, 4 aa, Plasmodium falciparum
ESPI

SEQ ID NO: 3311246 - protein, 12 aa, Plasmodium falciparum
ESPIGEKGKNIA

SEQ ID NO: 3311247 - protein, 10 aa, Plasmodium falciparum
ESPIKENKNG

SEQ ID NO: 3311248 - protein, 7 aa, Plasmodium falciparum
ESPPDID

SEQ ID NO: 3311249 - protein, 5 aa, Plasmodium falciparum
ESPQK

SEQ ID NO: 3311250 - protein, 8 aa, Plasmodium falciparum
ESPRRGET

SEQ ID NO: 3311251 - protein, 9 aa, Plasmodium falciparum
ESPSENNTI

SEQ ID NO: 3311252 - protein, 8 aa, Plasmodium falciparum
ESPTGTGK

SEQ ID NO: 3311253 - protein, 59 aa, Plasmodium falciparum
ESQDGKKGKGHKNGKREEDEDEDEFDGDEEDNDEEDEFDDDDDEEEEENDDDNDEEDEF

SEQ ID NO: 3311254 - protein, 6 aa, Plasmodium falciparum
ESQETD

SEQ ID NO: 3311255 - protein, 4 aa, Plasmodium falciparum
ESQH

SEQ ID NO: 3311256 - protein, 23 aa, Plasmodium falciparum
ESQKALATGKDYARRPTSYKSSL

SEQ ID NO: 3311257 - protein, 5 aa, Plasmodium falciparum
ESQKK

SEQ ID NO: 3311258 - protein, 12 aa, Plasmodium falciparum
ESQKKKNSIETY

SEQ ID NO: 3311259 - protein, 6 aa, Plasmodium falciparum
ESQKKS

SEQ ID NO: 3311260 - protein, 8 aa, Plasmodium falciparum
ESQLEVSE

SEQ ID NO: 3311261 - protein, 6 aa, Plasmodium falciparum
ESQRIK

SEQ ID NO: 3311262 - protein, 5 aa, Plasmodium falciparum
ESRDI

SEQ ID NO: 3311263 - protein, 7 aa, Plasmodium falciparum
ESREKQL

SEQ ID NO: 3311264 - protein, 68 aa, Plasmodium falciparum
ESRENHSSKESTKCQDGEAANVEENEENEKNEKKEKNEKNENIEQNKNVEQNKNIEQNKNIEQNKNVE

SEQ ID NO: 3311265 - protein, 21 aa, Plasmodium falciparum
ESRENQQNKYDINKTNSRPIK

SEQ ID NO: 3311266 - protein, 5 aa, Plasmodium falciparum
ESRGH

SEQ ID NO: 3311267 - protein, 14 aa, Plasmodium falciparum
ESRHPNKEWTATSG

SEQ ID NO: 3311268 - protein, 8 aa, Plasmodium falciparum
ESRKKKCS

SEQ ID NO: 3311269 - protein, 5 aa, Plasmodium falciparum
ESRKR

SEQ ID NO: 3311270 - protein, 9 aa, Plasmodium falciparum
ESRKRKEMS

SEQ ID NO: 3311271 - protein, 14 aa, Plasmodium falciparum
ESRRTGGKDTLAND

SEQ ID NO: 3311272 - protein, 5 aa, Plasmodium falciparum
ESSAI

SEQ ID NO: 3311273 - protein, 8 aa, Plasmodium falciparum
ESSATCGG

SEQ ID NO: 3311274 - protein, 7 aa, Plasmodium falciparum
ESSCSNK

SEQ ID NO: 3311275 - protein, 5 aa, Plasmodium falciparum
ESSDN

SEQ ID NO: 3311276 - protein, 8 aa, Plasmodium falciparum
ESSDPLEN

SEQ ID NO: 3311277 - protein, 24 aa, Plasmodium falciparum
ESSEEEYEKRDVRKKSQDYQKNNS

SEQ ID NO: 3311278 - protein, 4 aa, Plasmodium falciparum
ESSF

SEQ ID NO: 3311279 - protein, 6 aa, Plasmodium falciparum
ESSGIN

SEQ ID NO: 3311280 - protein, 55 aa, Plasmodium falciparum
ESSGSKEKADNNTEEESKKQREKEENVADNNNRNVDDKKKEGDKNVEETNKISST

SEQ ID NO: 3311281 - protein, 7 aa, Plasmodium falciparum
ESSGTKL

SEQ ID NO: 3311282 - protein, 8 aa, Plasmodium falciparum
ESSINSNK

SEQ ID NO: 3311283 - protein, 20 aa, Plasmodium falciparum
ESSKCEVTNEDAPSDEDISY

SEQ ID NO: 3311284 - protein, 9 aa, Plasmodium falciparum
ESSKDLNIS

SEQ ID NO: 3311285 - protein, 7 aa, Plasmodium falciparum
ESSKKEF

SEQ ID NO: 3311286 - protein, 6 aa, Plasmodium falciparum
ESSKNF

SEQ ID NO: 3311287 - protein, 9 aa, Plasmodium falciparum
ESSKSISDD

SEQ ID NO: 3311288 - protein, 8 aa, Plasmodium falciparum
ESSMNNND

SEQ ID NO: 3311289 - protein, 104 aa, Plasmodium falciparum
ESSNDNNRGHNNNSDDNNGGDNNNGGDNNNGGDNNNGGDNNNGGVNTNGGDNNNGGDNNNGGDNTNSSNDTNRSDDDNTDPSNNSDYSSNDVDNYEDDDYNNYS

SEQ ID NO: 3311290 - protein, 20 aa, Plasmodium falciparum
ESSNNSTNQLDNKIGNKNKY

SEQ ID NO: 3311291 - protein, 6 aa, Plasmodium falciparum
ESSNRK

SEQ ID NO: 3311292 - protein, 16 aa, Plasmodium falciparum
ESSNSRDRMTYASSKQ

SEQ ID NO: 3311293 - protein, 5 aa, Plasmodium falciparum
ESSQL

SEQ ID NO: 3311294 - protein, 9 aa, Plasmodium falciparum
ESSQSLEKT

SEQ ID NO: 3311295 - protein, 5 aa, Plasmodium falciparum
ESSQT

SEQ ID NO: 3311296 - protein, 8 aa, Plasmodium falciparum
ESSTGVNR

SEQ ID NO: 3311297 - protein, 10 aa, Plasmodium falciparum
ESSTNSNNNK

SEQ ID NO: 3311298 - protein, 15 aa, Plasmodium falciparum
ESSTQTDNTNCNDRD

SEQ ID NO: 3311299 - protein, 5 aa, Plasmodium falciparum
ESSVG

SEQ ID NO: 3311300 - protein, 6 aa, Plasmodium falciparum
ESSVQS

SEQ ID NO: 3311301 - protein, 7 aa, Plasmodium falciparum
ESSYNGA

SEQ ID NO: 3311302 - protein, 7 aa, Plasmodium falciparum
ESTDNDV

SEQ ID NO: 3311303 - protein, 9 aa, Plasmodium falciparum
ESTEESNNK

SEQ ID NO: 3311304 - protein, 15 aa, Plasmodium falciparum
ESTENLNSQHNENIS

SEQ ID NO: 3311305 - protein, 5 aa, Plasmodium falciparum
ESTGK

SEQ ID NO: 3311306 - protein, 7 aa, Plasmodium falciparum
ESTGPHT

SEQ ID NO: 3311307 - protein, 6 aa, Plasmodium falciparum
ESTGYL

SEQ ID NO: 3311308 - protein, 8 aa, Plasmodium falciparum
ESTIRSPT

SEQ ID NO: 3311309 - protein, 8 aa, Plasmodium falciparum
ESTKGTII

SEQ ID NO: 3311310 - protein, 7 aa, Plasmodium falciparum
ESTKPDY

SEQ ID NO: 3311311 - protein, 5 aa, Plasmodium falciparum
ESTKT

SEQ ID NO: 3311312 - protein, 6 aa, Plasmodium falciparum
ESTLEN

SEQ ID NO: 3311313 - protein, 7 aa, Plasmodium falciparum
ESTLPRT

SEQ ID NO: 3311314 - protein, 34 aa, Plasmodium falciparum
ESTNEEERDSDNTTLNDKTKSDNKSSKKKESNTK

SEQ ID NO: 3311315 - protein, 5 aa, Plasmodium falciparum
ESTPA

SEQ ID NO: 3311316 - protein, 12 aa, Plasmodium falciparum
ESTQQKEKKEAQ

SEQ ID NO: 3311317 - protein, 4 aa, Plasmodium falciparum
ESTR

SEQ ID NO: 3311318 - protein, 7 aa, Plasmodium falciparum
ESTSDRN

SEQ ID NO: 3311319 - protein, 7 aa, Plasmodium falciparum
ESTSFEK

SEQ ID NO: 3311320 - protein, 7 aa, Plasmodium falciparum
ESTSKEI

SEQ ID NO: 3311321 - protein, 11 aa, Plasmodium falciparum
ESTSNKKPKEY

SEQ ID NO: 3311322 - protein, 18 aa, Plasmodium falciparum
ESTSSKLDKNSPNNSEST

SEQ ID NO: 3311323 - protein, 7 aa, Plasmodium falciparum
ESTWNKE

SEQ ID NO: 3311324 - protein, 5 aa, Plasmodium falciparum
ESTYE

SEQ ID NO: 3311325 - protein, 6 aa, Plasmodium falciparum
ESVGNY

SEQ ID NO: 3311326 - protein, 17 aa, Plasmodium falciparum
ESVKEYSPNDDTNYDAT

SEQ ID NO: 3311327 - protein, 28 aa, Plasmodium falciparum
ESVNHNNNNNNNNNSSSSSSGSNKFRKG

SEQ ID NO: 3311328 - protein, 6 aa, Plasmodium falciparum
ESVNIS

SEQ ID NO: 3311329 - protein, 5 aa, Plasmodium falciparum
ESVNS

SEQ ID NO: 3311330 - protein, 39 aa, Plasmodium falciparum
ESVQKKKKKKKTNNNNNNNNNNDDDNNENNSSEDQYSSE

SEQ ID NO: 3311331 - protein, 5 aa, Plasmodium falciparum
ESVSK

SEQ ID NO: 3311332 - protein, 5 aa, Plasmodium falciparum
ESYEA

SEQ ID NO: 3311333 - protein, 6 aa, Plasmodium falciparum
ESYETY

SEQ ID NO: 3311334 - protein, 52 aa, Plasmodium falciparum
ESYEYDDEEGADYDDDGDDDGDDDGDDDDDDDDDNDDDDDNNNDDEDNYYDD

SEQ ID NO: 3311335 - protein, 7 aa, Plasmodium falciparum
ESYGEHK

SEQ ID NO: 3311336 - protein, 5 aa, Plasmodium falciparum
ESYGP

SEQ ID NO: 3311337 - protein, 15 aa, Plasmodium falciparum
ESYNESDLYKGNSEH

SEQ ID NO: 3311338 - protein, 7 aa, Plasmodium falciparum
ESYNNSI

SEQ ID NO: 3311339 - protein, 4 aa, Plasmodium falciparum
ESYR

SEQ ID NO: 3311340 - protein, 5 aa, Plasmodium falciparum
ESYRN

SEQ ID NO: 3311341 - protein, 40 aa, Plasmodium falciparum
ESYSSKNDEYISEEKKESLAASHKNDEREENVEEKEVKDV

SEQ ID NO: 3311342 - protein, 22 aa, Plasmodium falciparum
ESYYKSNKKHSSSRQISEDIPS

SEQ ID NO: 3311343 - protein, 6 aa, Plasmodium falciparum
ETADFG

SEQ ID NO: 3311344 - protein, 6 aa, Plasmodium falciparum
ETAENY

SEQ ID NO: 3311345 - protein, 7 aa, Plasmodium falciparum
ETAGGKF

SEQ ID NO: 3311346 - protein, 5 aa, Plasmodium falciparum
ETAKE

SEQ ID NO: 3311347 - protein, 5 aa, Plasmodium falciparum
ETAKK

SEQ ID NO: 3311348 - protein, 5 aa, Plasmodium falciparum
ETAKN

SEQ ID NO: 3311349 - protein, 30 aa, Plasmodium falciparum
ETCDDTTSCTHSKNTRSDKKTDASISGKDD

SEQ ID NO: 3311350 - protein, 19 aa, Plasmodium falciparum
ETDDDLKSENNKSDDFNDI

SEQ ID NO: 3311351 - protein, 5 aa, Plasmodium falciparum
ETDDK

SEQ ID NO: 3311352 - protein, 5 aa, Plasmodium falciparum
ETDDL

SEQ ID NO: 3311353 - protein, 20 aa, Plasmodium falciparum
ETDDNIGGKKENVIDEEKDE

SEQ ID NO: 3311354 - protein, 4 aa, Plasmodium falciparum
ETDE

SEQ ID NO: 3311355 - protein, 11 aa, Plasmodium falciparum
ETDEEDKRVDE

SEQ ID NO: 3311356 - protein, 11 aa, Plasmodium falciparum
ETDEKDEHYES

SEQ ID NO: 3311357 - protein, 6 aa, Plasmodium falciparum
ETDELN

SEQ ID NO: 3311358 - protein, 5 aa, Plasmodium falciparum
ETDEP

SEQ ID NO: 3311359 - protein, 22 aa, Plasmodium falciparum
ETDESNSSNLSNVSYKSSSSYE

SEQ ID NO: 3311360 - protein, 13 aa, Plasmodium falciparum
ETDGYGKQKAKKG

SEQ ID NO: 3311361 - protein, 25 aa, Plasmodium falciparum
ETDINEEKKEEDSKRKRGESKYYAP

SEQ ID NO: 3311362 - protein, 11 aa, Plasmodium falciparum
ETDNNHNMNSG

SEQ ID NO: 3311363 - protein, 4 aa, Plasmodium falciparum
ETDQ

SEQ ID NO: 3311364 - protein, 7 aa, Plasmodium falciparum
ETDTPKN

SEQ ID NO: 3311365 - protein, 11 aa, Plasmodium falciparum
ETDYSSDDLED

SEQ ID NO: 3311366 - protein, 14 aa, Plasmodium falciparum
ETECSISQSETNNN

SEQ ID NO: 3311367 - protein, 93 aa, Plasmodium falciparum
ETEDGEEDDDVEDDDVEDDDVEDDDVEDDDVEDDDVEDDDVEDDDEEDDDDEEDDDDEEDDDDEEDNEDEDDDNNDDDNNNDEDNEEDQNNLQ

SEQ ID NO: 3311368 - protein, 5 aa, Plasmodium falciparum
ETEDT

SEQ ID NO: 3311369 - protein, 8 aa, Plasmodium falciparum
ETEGRSCN

SEQ ID NO: 3311370 - protein, 12 aa, Plasmodium falciparum
ETEHSYKQNVEE

SEQ ID NO: 3311371 - protein, 19 aa, Plasmodium falciparum
ETEIKKTNDIEKEKNTKLS

SEQ ID NO: 3311372 - protein, 14 aa, Plasmodium falciparum
ETEKGQGVYQQTKR

SEQ ID NO: 3311373 - protein, 23 aa, Plasmodium falciparum
ETELSSDEESKEDENNDERKKKR

SEQ ID NO: 3311374 - protein, 15 aa, Plasmodium falciparum
ETEQNIYDNNKPEEL

SEQ ID NO: 3311375 - protein, 10 aa, Plasmodium falciparum
ETESNKNGVA

SEQ ID NO: 3311376 - protein, 7 aa, Plasmodium falciparum
ETEYGQN

SEQ ID NO: 3311377 - protein, 17 aa, Plasmodium falciparum
ETFAKGKKHTLQQTPRN

SEQ ID NO: 3311378 - protein, 18 aa, Plasmodium falciparum
ETFDEEEQREKKRNNLED

SEQ ID NO: 3311379 - protein, 15 aa, Plasmodium falciparum
ETFEKSKQGDQHSDK

SEQ ID NO: 3311380 - protein, 14 aa, Plasmodium falciparum
ETFEPNNKLDSYED

SEQ ID NO: 3311381 - protein, 91 aa, Plasmodium falciparum
ETGDITIPGDDKNEEGNKNGKGNKNGKGNKYGKGNKYGKGNKYGKGNKNEKNNKNNNDNNIEENDNYNDKEKITKKKNINHNNSNRNNNNN

SEQ ID NO: 3311382 - protein, 7 aa, Plasmodium falciparum
ETGHSSR

SEQ ID NO: 3311383 - protein, 4 aa, Plasmodium falciparum
ETGI

SEQ ID NO: 3311384 - protein, 11 aa, Plasmodium falciparum
ETGKQGSRLTH

SEQ ID NO: 3311385 - protein, 7 aa, Plasmodium falciparum
ETGNHNN

SEQ ID NO: 3311386 - protein, 10 aa, Plasmodium falciparum
ETGSGKSTQL

SEQ ID NO: 3311387 - protein, 7 aa, Plasmodium falciparum
ETGSGKT

SEQ ID NO: 3311388 - protein, 8 aa, Plasmodium falciparum
ETGSGKTA

SEQ ID NO: 3311389 - protein, 10 aa, Plasmodium falciparum
ETGSGKTTQI

SEQ ID NO: 3311390 - protein, 8 aa, Plasmodium falciparum
ETGTEDKL

SEQ ID NO: 3311391 - protein, 6 aa, Plasmodium falciparum
ETGTGK

SEQ ID NO: 3311392 - protein, 6 aa, Plasmodium falciparum
ETGTPY

SEQ ID NO: 3311393 - protein, 10 aa, Plasmodium falciparum
ETGVTKTNAR

SEQ ID NO: 3311394 - protein, 4 aa, Plasmodium falciparum
ETGY

SEQ ID NO: 3311395 - protein, 6 aa, Plasmodium falciparum
ETHEND

SEQ ID NO: 3311396 - protein, 13 aa, Plasmodium falciparum
ETHHKQNKGTDYI

SEQ ID NO: 3311397 - protein, 22 aa, Plasmodium falciparum
ETHNNKEKYKKIETQSGKKNTH

SEQ ID NO: 3311398 - protein, 4 aa, Plasmodium falciparum
ETHQ

SEQ ID NO: 3311399 - protein, 20 aa, Plasmodium falciparum
ETHTNDMSNKNTKKKEESKQ

SEQ ID NO: 3311400 - protein, 5 aa, Plasmodium falciparum
ETIDE

SEQ ID NO: 3311401 - protein, 6 aa, Plasmodium falciparum
ETIGSS

SEQ ID NO: 3311402 - protein, 21 aa, Plasmodium falciparum
ETIKKKEINRRENKNDVNRNE

SEQ ID NO: 3311403 - protein, 6 aa, Plasmodium falciparum
ETINEK

SEQ ID NO: 3311404 - protein, 15 aa, Plasmodium falciparum
ETINGTNSEPSNSKR

SEQ ID NO: 3311405 - protein, 5 aa, Plasmodium falciparum
ETIRK

SEQ ID NO: 3311406 - protein, 19 aa, Plasmodium falciparum
ETIRRNEKYNKSLNSTSSF

SEQ ID NO: 3311407 - protein, 7 aa, Plasmodium falciparum
ETISENE

SEQ ID NO: 3311408 - protein, 17 aa, Plasmodium falciparum
ETITEKQRNDALTFEIL

SEQ ID NO: 3311409 - protein, 8 aa, Plasmodium falciparum
ETKATDSK

SEQ ID NO: 3311410 - protein, 6 aa, Plasmodium falciparum
ETKDSN

SEQ ID NO: 3311411 - protein, 8 aa, Plasmodium falciparum
ETKEDNKN

SEQ ID NO: 3311412 - protein, 7 aa, Plasmodium falciparum
ETKEKNK

SEQ ID NO: 3311413 - protein, 20 aa, Plasmodium falciparum
ETKGKSKTKYKNDNSLDDNI

SEQ ID NO: 3311414 - protein, 15 aa, Plasmodium falciparum
ETKGTLRNNENTKDM

SEQ ID NO: 3311415 - protein, 6 aa, Plasmodium falciparum
ETKKCN

SEQ ID NO: 3311416 - protein, 17 aa, Plasmodium falciparum
ETKKEDVHSKGDNQRNC

SEQ ID NO: 3311417 - protein, 24 aa, Plasmodium falciparum
ETKKGHNNNNNQNDYNNDNSLNYS

SEQ ID NO: 3311418 - protein, 10 aa, Plasmodium falciparum
ETKKKEKELN

SEQ ID NO: 3311419 - protein, 10 aa, Plasmodium falciparum
ETKKKKKKKK

SEQ ID NO: 3311420 - protein, 11 aa, Plasmodium falciparum
ETKKKKRRDTL

SEQ ID NO: 3311421 - protein, 21 aa, Plasmodium falciparum
ETKKLKEGKQIGTTKRGIGPC

SEQ ID NO: 3311422 - protein, 11 aa, Plasmodium falciparum
ETKKNEKREDL

SEQ ID NO: 3311423 - protein, 8 aa, Plasmodium falciparum
ETKKNKPL

SEQ ID NO: 3311424 - protein, 8 aa, Plasmodium falciparum
ETKKTDNI

SEQ ID NO: 3311425 - protein, 6 aa, Plasmodium falciparum
ETKNDM

SEQ ID NO: 3311426 - protein, 16 aa, Plasmodium falciparum
ETKNKKDDNKPSPRSG

SEQ ID NO: 3311427 - protein, 7 aa, Plasmodium falciparum
ETKNNIN

SEQ ID NO: 3311428 - protein, 10 aa, Plasmodium falciparum
ETKNVENKDV

SEQ ID NO: 3311429 - protein, 9 aa, Plasmodium falciparum
ETKPAFGAE

SEQ ID NO: 3311430 - protein, 20 aa, Plasmodium falciparum
ETKPLNYKNKEAQYEQKEKM

SEQ ID NO: 3311431 - protein, 10 aa, Plasmodium falciparum
ETKSEEEKSY

SEQ ID NO: 3311432 - protein, 9 aa, Plasmodium falciparum
ETKSSIEAD

SEQ ID NO: 3311433 - protein, 7 aa, Plasmodium falciparum
ETKSVNV

SEQ ID NO: 3311434 - protein, 6 aa, Plasmodium falciparum
ETKTNQ

SEQ ID NO: 3311435 - protein, 19 aa, Plasmodium falciparum
ETKTTLKQNKLQNLKKRRK

SEQ ID NO: 3311436 - protein, 5 aa, Plasmodium falciparum
ETKVT

SEQ ID NO: 3311437 - protein, 6 aa, Plasmodium falciparum
ETKYEG

SEQ ID NO: 3311438 - protein, 6 aa, Plasmodium falciparum
ETLDSL

SEQ ID NO: 3311439 - protein, 10 aa, Plasmodium falciparum
ETLGDGSSSN

SEQ ID NO: 3311440 - protein, 5 aa, Plasmodium falciparum
ETLKE

SEQ ID NO: 3311441 - protein, 8 aa, Plasmodium falciparum
ETLKEERR

SEQ ID NO: 3311442 - protein, 21 aa, Plasmodium falciparum
ETLKKEEKKLKENDINDKEED

SEQ ID NO: 3311443 - protein, 6 aa, Plasmodium falciparum
ETLPSA

SEQ ID NO: 3311444 - protein, 6 aa, Plasmodium falciparum
ETLSNA

SEQ ID NO: 3311445 - protein, 9 aa, Plasmodium falciparum
ETMGKKNES

SEQ ID NO: 3311446 - protein, 4 aa, Plasmodium falciparum
ETMK

SEQ ID NO: 3311447 - protein, 7 aa, Plasmodium falciparum
ETMNSNA

SEQ ID NO: 3311448 - protein, 16 aa, Plasmodium falciparum
ETNDETNNEEEGRNVE

SEQ ID NO: 3311449 - protein, 10 aa, Plasmodium falciparum
ETNDHNENRK

SEQ ID NO: 3311450 - protein, 5 aa, Plasmodium falciparum
ETNDK

SEQ ID NO: 3311451 - protein, 17 aa, Plasmodium falciparum
ETNDKVKSFKKKKNKKI

SEQ ID NO: 3311452 - protein, 28 aa, Plasmodium falciparum
ETNDNIDTSNINNNNNNNNNNDNSQENN

SEQ ID NO: 3311453 - protein, 7 aa, Plasmodium falciparum
ETNDTNI

SEQ ID NO: 3311454 - protein, 8 aa, Plasmodium falciparum
ETNEDDPE

SEQ ID NO: 3311455 - protein, 6 aa, Plasmodium falciparum
ETNEFK

SEQ ID NO: 3311456 - protein, 5 aa, Plasmodium falciparum
ETNEK

SEQ ID NO: 3311457 - protein, 5 aa, Plasmodium falciparum
ETNEL

SEQ ID NO: 3311458 - protein, 5 aa, Plasmodium falciparum
ETNEN

SEQ ID NO: 3311459 - protein, 7 aa, Plasmodium falciparum
ETNGNTL

SEQ ID NO: 3311460 - protein, 4 aa, Plasmodium falciparum
ETNI

SEQ ID NO: 3311461 - protein, 12 aa, Plasmodium falciparum
ETNIENKKSIRK

SEQ ID NO: 3311462 - protein, 33 aa, Plasmodium falciparum
ETNILSSDGEQESDISKNCDTQDPKHNRNNDYT

SEQ ID NO: 3311463 - protein, 10 aa, Plasmodium falciparum
ETNKEGNKQI

SEQ ID NO: 3311464 - protein, 9 aa, Plasmodium falciparum
ETNKEKEQI

SEQ ID NO: 3311465 - protein, 9 aa, Plasmodium falciparum
ETNKENEEL

SEQ ID NO: 3311466 - protein, 8 aa, Plasmodium falciparum
ETNKKHEY

SEQ ID NO: 3311467 - protein, 5 aa, Plasmodium falciparum
ETNKL

SEQ ID NO: 3311468 - protein, 20 aa, Plasmodium falciparum
ETNKPKSKSYNYNSNNNSSH

SEQ ID NO: 3311469 - protein, 21 aa, Plasmodium falciparum
ETNNEKRTNKKIYKKSKAQSL

SEQ ID NO: 3311470 - protein, 12 aa, Plasmodium falciparum
ETNPLTSNTGTI

SEQ ID NO: 3311471 - protein, 18 aa, Plasmodium falciparum
ETNQDNNATFSASQNVKN

SEQ ID NO: 3311472 - protein, 6 aa, Plasmodium falciparum
ETNQLN

SEQ ID NO: 3311473 - protein, 13 aa, Plasmodium falciparum
ETNRNDDVNNGEH

SEQ ID NO: 3311474 - protein, 7 aa, Plasmodium falciparum
ETNSKTL

SEQ ID NO: 3311475 - protein, 7 aa, Plasmodium falciparum
ETNSNPY

SEQ ID NO: 3311476 - protein, 6 aa, Plasmodium falciparum
ETNSNQ

SEQ ID NO: 3311477 - protein, 12 aa, Plasmodium falciparum
ETNTIPTSNTDV

SEQ ID NO: 3311478 - protein, 5 aa, Plasmodium falciparum
ETNTN

SEQ ID NO: 3311479 - protein, 40 aa, Plasmodium falciparum
ETNTNLSSDVSEDDSSNTDSEDDSSNTDSEDSGKDNFDEN

SEQ ID NO: 3311480 - protein, 22 aa, Plasmodium falciparum
ETNTSNNNHNNNNNNDDTSSCS

SEQ ID NO: 3311481 - protein, 10 aa, Plasmodium falciparum
ETNTTVNDNL

SEQ ID NO: 3311482 - protein, 12 aa, Plasmodium falciparum
ETPALKNHQENS

SEQ ID NO: 3311483 - protein, 4 aa, Plasmodium falciparum
ETPE

SEQ ID NO: 3311484 - protein, 11 aa, Plasmodium falciparum
ETPEDAPTGQM

SEQ ID NO: 3311485 - protein, 6 aa, Plasmodium falciparum
ETPIKS

SEQ ID NO: 3311486 - protein, 8 aa, Plasmodium falciparum
ETPNAIGT

SEQ ID NO: 3311487 - protein, 7 aa, Plasmodium falciparum
ETPNISS

SEQ ID NO: 3311488 - protein, 7 aa, Plasmodium falciparum
ETPNKKN

SEQ ID NO: 3311489 - protein, 9 aa, Plasmodium falciparum
ETPNSSNDF

SEQ ID NO: 3311490 - protein, 10 aa, Plasmodium falciparum
ETPPDKASKL

SEQ ID NO: 3311491 - protein, 18 aa, Plasmodium falciparum
ETPVKQMNTNKNKTPTNI

SEQ ID NO: 3311492 - protein, 7 aa, Plasmodium falciparum
ETQEING

SEQ ID NO: 3311493 - protein, 9 aa, Plasmodium falciparum
ETQEQENVT

SEQ ID NO: 3311494 - protein, 18 aa, Plasmodium falciparum
ETQNGEIAKKNKMRKGSF

SEQ ID NO: 3311495 - protein, 8 aa, Plasmodium falciparum
ETRGDGSI

SEQ ID NO: 3311496 - protein, 6 aa, Plasmodium falciparum
ETRGEK

SEQ ID NO: 3311497 - protein, 5 aa, Plasmodium falciparum
ETRKK

SEQ ID NO: 3311498 - protein, 18 aa, Plasmodium falciparum
ETRKKEKIYPRDNNINST

SEQ ID NO: 3311499 - protein, 5 aa, Plasmodium falciparum
ETRNY

SEQ ID NO: 3311500 - protein, 80 aa, Plasmodium falciparum
ETRSDYNESHDETNENNEKEEINREEGNEEEKRSKRKKTNDYDDNKDVYNNASGSNSNHSNHSNNNNNNKGNEKNERKED

SEQ ID NO: 3311501 - protein, 6 aa, Plasmodium falciparum
ETSDKN

SEQ ID NO: 3311502 - protein, 5 aa, Plasmodium falciparum
ETSDT

SEQ ID NO: 3311503 - protein, 10 aa, Plasmodium falciparum
ETSEKGNNNE

SEQ ID NO: 3311504 - protein, 5 aa, Plasmodium falciparum
ETSID

SEQ ID NO: 3311505 - protein, 11 aa, Plasmodium falciparum
ETSKEITINEE

SEQ ID NO: 3311506 - protein, 11 aa, Plasmodium falciparum
ETSKEKNNSGL

SEQ ID NO: 3311507 - protein, 12 aa, Plasmodium falciparum
ETSKENYNQTQI

SEQ ID NO: 3311508 - protein, 10 aa, Plasmodium falciparum
ETSKFDDNKE

SEQ ID NO: 3311509 - protein, 13 aa, Plasmodium falciparum
ETSNNKRNIMEKN

SEQ ID NO: 3311510 - protein, 10 aa, Plasmodium falciparum
ETSNQDTEDC

SEQ ID NO: 3311511 - protein, 5 aa, Plasmodium falciparum
ETSNV

SEQ ID NO: 3311512 - protein, 4 aa, Plasmodium falciparum
ETSP

SEQ ID NO: 3311513 - protein, 7 aa, Plasmodium falciparum
ETSPGLS

SEQ ID NO: 3311514 - protein, 18 aa, Plasmodium falciparum
ETSPLERHNKDKDTITSS

SEQ ID NO: 3311515 - protein, 12 aa, Plasmodium falciparum
ETSQEEKKNMSN

SEQ ID NO: 3311516 - protein, 6 aa, Plasmodium falciparum
ETSSNF

SEQ ID NO: 3311517 - protein, 17 aa, Plasmodium falciparum
ETSSSDKRGVVIDLNIG

SEQ ID NO: 3311518 - protein, 6 aa, Plasmodium falciparum
ETSSST

SEQ ID NO: 3311519 - protein, 4 aa, Plasmodium falciparum
ETST

SEQ ID NO: 3311520 - protein, 10 aa, Plasmodium falciparum
ETSTSNGGKF

SEQ ID NO: 3311521 - protein, 5 aa, Plasmodium falciparum
ETSYN

SEQ ID NO: 3311522 - protein, 5 aa, Plasmodium falciparum
ETTAT

SEQ ID NO: 3311523 - protein, 5 aa, Plasmodium falciparum
ETTEE

SEQ ID NO: 3311524 - protein, 7 aa, Plasmodium falciparum
ETTEEIQ

SEQ ID NO: 3311525 - protein, 6 aa, Plasmodium falciparum
ETTESF

SEQ ID NO: 3311526 - protein, 13 aa, Plasmodium falciparum
ETTHNSNNYDGQI

SEQ ID NO: 3311527 - protein, 10 aa, Plasmodium falciparum
ETTKGDNKQH

SEQ ID NO: 3311528 - protein, 10 aa, Plasmodium falciparum
ETTKNETHKE

SEQ ID NO: 3311529 - protein, 6 aa, Plasmodium falciparum
ETTNKQ

SEQ ID NO: 3311530 - protein, 10 aa, Plasmodium falciparum
ETTNNKNHIE

SEQ ID NO: 3311531 - protein, 14 aa, Plasmodium falciparum
ETTQDNFTSITFNF

SEQ ID NO: 3311532 - protein, 16 aa, Plasmodium falciparum
ETTSGEKFGRCSSTSN

SEQ ID NO: 3311533 - protein, 18 aa, Plasmodium falciparum
ETTSKQNTTTEKNKKIND

SEQ ID NO: 3311534 - protein, 7 aa, Plasmodium falciparum
ETTSTMK

SEQ ID NO: 3311535 - protein, 5 aa, Plasmodium falciparum
ETTVQ

SEQ ID NO: 3311536 - protein, 16 aa, Plasmodium falciparum
ETTYQEDNKKVDDNNI

SEQ ID NO: 3311537 - protein, 16 aa, Plasmodium falciparum
ETVAPETEHLNTSTNN

SEQ ID NO: 3311538 - protein, 5 aa, Plasmodium falciparum
ETVDN

SEQ ID NO: 3311539 - protein, 26 aa, Plasmodium falciparum
ETVENIPNNNDNNNDSSSNNKEEECL

SEQ ID NO: 3311540 - protein, 11 aa, Plasmodium falciparum
ETVEPKEPVEE

SEQ ID NO: 3311541 - protein, 21 aa, Plasmodium falciparum
ETVHNNNNIEDESIKENKNEL

SEQ ID NO: 3311542 - protein, 11 aa, Plasmodium falciparum
ETVSTDYDESD

SEQ ID NO: 3311543 - protein, 13 aa, Plasmodium falciparum
ETYAGEKTTIKKK

SEQ ID NO: 3311544 - protein, 27 aa, Plasmodium falciparum
ETYDEKGDNEKEQRNLERADSEKKNIV

SEQ ID NO: 3311545 - protein, 6 aa, Plasmodium falciparum
ETYDET

SEQ ID NO: 3311546 - protein, 13 aa, Plasmodium falciparum
ETYDGVDSSTDDM

SEQ ID NO: 3311547 - protein, 49 aa, Plasmodium falciparum
ETYEDNESEYNAEQNEVYTEQQTSSSNVEPEKEKENEHEHENDNNVYSK

SEQ ID NO: 3311548 - protein, 26 aa, Plasmodium falciparum
ETYEEDQRIKKKNSLENKIENGEEQK

SEQ ID NO: 3311549 - protein, 6 aa, Plasmodium falciparum
ETYEEN

SEQ ID NO: 3311550 - protein, 5 aa, Plasmodium falciparum
ETYEH

SEQ ID NO: 3311551 - protein, 28 aa, Plasmodium falciparum
ETYGSKNNEVSPNKKKMKVNEKKDVSKE

SEQ ID NO: 3311552 - protein, 10 aa, Plasmodium falciparum
ETYKNNHEEK

SEQ ID NO: 3311553 - protein, 11 aa, Plasmodium falciparum
ETYSENPNDDN

SEQ ID NO: 3311554 - protein, 4 aa, Plasmodium falciparum
EVAE

SEQ ID NO: 3311555 - protein, 6 aa, Plasmodium falciparum
EVAENN

SEQ ID NO: 3311556 - protein, 7 aa, Plasmodium falciparum
EVDDEDK

SEQ ID NO: 3311557 - protein, 14 aa, Plasmodium falciparum
EVDDTQKSDKNHSN

SEQ ID NO: 3311558 - protein, 4 aa, Plasmodium falciparum
EVDE

SEQ ID NO: 3311559 - protein, 49 aa, Plasmodium falciparum
EVDEEENDGYDDEEDGNENFDDEEDRPRINNNNNNDISNNNNNDDEYTN

SEQ ID NO: 3311560 - protein, 5 aa, Plasmodium falciparum
EVDIS

SEQ ID NO: 3311561 - protein, 6 aa, Plasmodium falciparum
EVDNNN

SEQ ID NO: 3311562 - protein, 50 aa, Plasmodium falciparum
EVDNNNNNNNSNSSSSSSSSSSSSSSSSSSSSSSSSSSSSSSSSNRSSNF

SEQ ID NO: 3311563 - protein, 8 aa, Plasmodium falciparum
EVDNSSLQ

SEQ ID NO: 3311564 - protein, 5 aa, Plasmodium falciparum
EVDYE

SEQ ID NO: 3311565 - protein, 11 aa, Plasmodium falciparum
EVEDDEETGVH

SEQ ID NO: 3311566 - protein, 9 aa, Plasmodium falciparum
EVEDKEEIP

SEQ ID NO: 3311567 - protein, 8 aa, Plasmodium falciparum
EVEEDHKN

SEQ ID NO: 3311568 - protein, 5 aa, Plasmodium falciparum
EVEEQ

SEQ ID NO: 3311569 - protein, 9 aa, Plasmodium falciparum
EVEKNNSKV

SEQ ID NO: 3311570 - protein, 7 aa, Plasmodium falciparum
EVEKTNR

SEQ ID NO: 3311571 - protein, 16 aa, Plasmodium falciparum
EVELPSNQRARRKTAE

SEQ ID NO: 3311572 - protein, 12 aa, Plasmodium falciparum
EVENTEDEGQEL

SEQ ID NO: 3311573 - protein, 36 aa, Plasmodium falciparum
EVEQKEKKNNNNKKIKKIKNKKKNKKKKNKKINKKI

SEQ ID NO: 3311574 - protein, 9 aa, Plasmodium falciparum
EVEQNKSNM

SEQ ID NO: 3311575 - protein, 6 aa, Plasmodium falciparum
EVGNYS

SEQ ID NO: 3311576 - protein, 5 aa, Plasmodium falciparum
EVGTK

SEQ ID NO: 3311577 - protein, 12 aa, Plasmodium falciparum
EVHHEQKEEKKV

SEQ ID NO: 3311578 - protein, 26 aa, Plasmodium falciparum
EVKEQGSKNNNNKNNNDNNNNNNNVD

SEQ ID NO: 3311579 - protein, 10 aa, Plasmodium falciparum
EVKGNDQNDL

SEQ ID NO: 3311580 - protein, 12 aa, Plasmodium falciparum
EVKKSKTSEYGC

SEQ ID NO: 3311581 - protein, 11 aa, Plasmodium falciparum
EVKNKSDENWD

SEQ ID NO: 3311582 - protein, 10 aa, Plasmodium falciparum
EVKTKYDKTH

SEQ ID NO: 3311583 - protein, 7 aa, Plasmodium falciparum
EVLTDNG

SEQ ID NO: 3311584 - protein, 12 aa, Plasmodium falciparum
EVNDEEIKTREN

SEQ ID NO: 3311585 - protein, 14 aa, Plasmodium falciparum
EVNDIRNANDTFNK

SEQ ID NO: 3311586 - protein, 8 aa, Plasmodium falciparum
EVNEASAG

SEQ ID NO: 3311587 - protein, 11 aa, Plasmodium falciparum
EVNENGEAKKT

SEQ ID NO: 3311588 - protein, 8 aa, Plasmodium falciparum
EVNKKNEK

SEQ ID NO: 3311589 - protein, 15 aa, Plasmodium falciparum
EVNKKQTKKPTKNVS

SEQ ID NO: 3311590 - protein, 18 aa, Plasmodium falciparum
EVNQNYTNSINNNDQNNV

SEQ ID NO: 3311591 - protein, 9 aa, Plasmodium falciparum
EVNSGSPEL

SEQ ID NO: 3311592 - protein, 6 aa, Plasmodium falciparum
EVNSTC

SEQ ID NO: 3311593 - protein, 23 aa, Plasmodium falciparum
EVNTNVTSNVKENKPSKNNTDTN

SEQ ID NO: 3311594 - protein, 4 aa, Plasmodium falciparum
EVPP

SEQ ID NO: 3311595 - protein, 9 aa, Plasmodium falciparum
EVPTNNEIQ

SEQ ID NO: 3311596 - protein, 11 aa, Plasmodium falciparum
EVQDDSDEDIL

SEQ ID NO: 3311597 - protein, 5 aa, Plasmodium falciparum
EVQNI

SEQ ID NO: 3311598 - protein, 5 aa, Plasmodium falciparum
EVQNK

SEQ ID NO: 3311599 - protein, 18 aa, Plasmodium falciparum
EVQSKDSHDNQNEHEQNY

SEQ ID NO: 3311600 - protein, 13 aa, Plasmodium falciparum
EVQSTDISDTNDI

SEQ ID NO: 3311601 - protein, 4 aa, Plasmodium falciparum
EVRS

SEQ ID NO: 3311602 - protein, 11 aa, Plasmodium falciparum
EVSAEEGAQFA

SEQ ID NO: 3311603 - protein, 14 aa, Plasmodium falciparum
EVSDKKKNFNTTDK

SEQ ID NO: 3311604 - protein, 4 aa, Plasmodium falciparum
EVSE

SEQ ID NO: 3311605 - protein, 16 aa, Plasmodium falciparum
EVSKNKDEWDSTLNGD

SEQ ID NO: 3311606 - protein, 6 aa, Plasmodium falciparum
EVSQKK

SEQ ID NO: 3311607 - protein, 7 aa, Plasmodium falciparum
EVTDSLG

SEQ ID NO: 3311608 - protein, 5 aa, Plasmodium falciparum
EVTED

SEQ ID NO: 3311609 - protein, 8 aa, Plasmodium falciparum
EVTGSSYE

SEQ ID NO: 3311610 - protein, 29 aa, Plasmodium falciparum
EVTHKNSNCNIENDHSNNNINEKNSLNHK

SEQ ID NO: 3311611 - protein, 10 aa, Plasmodium falciparum
EVTNVNKNES

SEQ ID NO: 3311612 - protein, 4 aa, Plasmodium falciparum
EVTS

SEQ ID NO: 3311613 - protein, 5 aa, Plasmodium falciparum
EVYDN

SEQ ID NO: 3311614 - protein, 5 aa, Plasmodium falciparum
EVYNT

SEQ ID NO: 3311615 - protein, 13 aa, Plasmodium falciparum
EWEDKNISSCSSS

SEQ ID NO: 3311616 - protein, 5 aa, Plasmodium falciparum
EWNND

SEQ ID NO: 3311617 - protein, 88 aa, Plasmodium falciparum
EWNNSSENENSDNNNNDREDNIKEKVDNNNKNDDNNNNDREDNIKEKVDNNNNNDDNNNDNNNNNKSDNNNNKSDNNNNKSDNYNNKI

SEQ ID NO: 3311618 - protein, 7 aa, Plasmodium falciparum
EWNPKDN

SEQ ID NO: 3311619 - protein, 15 aa, Plasmodium falciparum
EWRKKTHKDTAKGLN

SEQ ID NO: 3311620 - protein, 6 aa, Plasmodium falciparum
EWTTEH

SEQ ID NO: 3311621 - protein, 5 aa, Plasmodium falciparum
EYAEK

SEQ ID NO: 3311622 - protein, 11 aa, Plasmodium falciparum
EYATDNKNPLK

SEQ ID NO: 3311623 - protein, 11 aa, Plasmodium falciparum
EYDDTNDNIND

SEQ ID NO: 3311624 - protein, 9 aa, Plasmodium falciparum
EYDEESNKL

SEQ ID NO: 3311625 - protein, 9 aa, Plasmodium falciparum
EYDEKKVPK

SEQ ID NO: 3311626 - protein, 5 aa, Plasmodium falciparum
EYDEL

SEQ ID NO: 3311627 - protein, 5 aa, Plasmodium falciparum
EYDEN

SEQ ID NO: 3311628 - protein, 14 aa, Plasmodium falciparum
EYDESGPSIVHRKC

SEQ ID NO: 3311629 - protein, 12 aa, Plasmodium falciparum
EYDGNRNKSMTS

SEQ ID NO: 3311630 - protein, 5 aa, Plasmodium falciparum
EYDGS

SEQ ID NO: 3311631 - protein, 4 aa, Plasmodium falciparum
EYDK

SEQ ID NO: 3311632 - protein, 10 aa, Plasmodium falciparum
EYDKNDGNIL

SEQ ID NO: 3311633 - protein, 8 aa, Plasmodium falciparum
EYDKPNVT

SEQ ID NO: 3311634 - protein, 4 aa, Plasmodium falciparum
EYDL

SEQ ID NO: 3311635 - protein, 4 aa, Plasmodium falciparum
EYDN

SEQ ID NO: 3311636 - protein, 5 aa, Plasmodium falciparum
EYDNY

SEQ ID NO: 3311637 - protein, 10 aa, Plasmodium falciparum
EYDTSNKNYE

SEQ ID NO: 3311638 - protein, 11 aa, Plasmodium falciparum
EYDYTGNINDQ

SEQ ID NO: 3311639 - protein, 11 aa, Plasmodium falciparum
EYEDDEMNPNI

SEQ ID NO: 3311640 - protein, 14 aa, Plasmodium falciparum
EYEDSGPSIVHRKC

SEQ ID NO: 3311641 - protein, 4 aa, Plasmodium falciparum
EYEE

SEQ ID NO: 3311642 - protein, 17 aa, Plasmodium falciparum
EYEEDKSKIINEKEKTI

SEQ ID NO: 3311643 - protein, 8 aa, Plasmodium falciparum
EYEEENKN

SEQ ID NO: 3311644 - protein, 5 aa, Plasmodium falciparum
EYEEI

SEQ ID NO: 3311645 - protein, 7 aa, Plasmodium falciparum
EYEETYK

SEQ ID NO: 3311646 - protein, 9 aa, Plasmodium falciparum
EYEGANNKR

SEQ ID NO: 3311647 - protein, 4 aa, Plasmodium falciparum
EYEK

SEQ ID NO: 3311648 - protein, 7 aa, Plasmodium falciparum
EYEKGSK

SEQ ID NO: 3311649 - protein, 5 aa, Plasmodium falciparum
EYEKQ

SEQ ID NO: 3311650 - protein, 4 aa, Plasmodium falciparum
EYEN

SEQ ID NO: 3311651 - protein, 10 aa, Plasmodium falciparum
EYENDKKYEH

SEQ ID NO: 3311652 - protein, 6 aa, Plasmodium falciparum
EYENPA

SEQ ID NO: 3311653 - protein, 4 aa, Plasmodium falciparum
EYEP

SEQ ID NO: 3311654 - protein, 6 aa, Plasmodium falciparum
EYERKR

SEQ ID NO: 3311655 - protein, 22 aa, Plasmodium falciparum
EYESESSKHNIPRKSLSKKHSI

SEQ ID NO: 3311656 - protein, 7 aa, Plasmodium falciparum
EYESGRQ

SEQ ID NO: 3311657 - protein, 13 aa, Plasmodium falciparum
EYESPLNSEQEKT

SEQ ID NO: 3311658 - protein, 13 aa, Plasmodium falciparum
EYFSGSENINSQS

SEQ ID NO: 3311659 - protein, 17 aa, Plasmodium falciparum
EYGEEGLENGEQPADAT

SEQ ID NO: 3311660 - protein, 5 aa, Plasmodium falciparum
EYGEN

SEQ ID NO: 3311661 - protein, 5 aa, Plasmodium falciparum
EYGER

SEQ ID NO: 3311662 - protein, 11 aa, Plasmodium falciparum
EYGKDQPLKNA

SEQ ID NO: 3311663 - protein, 15 aa, Plasmodium falciparum
EYGKEDQNEDDDNIR

SEQ ID NO: 3311664 - protein, 25 aa, Plasmodium falciparum
EYGKKRRAHTNRINTEQQKKRDSNK

SEQ ID NO: 3311665 - protein, 14 aa, Plasmodium falciparum
EYGMPTKPSPNRYV

SEQ ID NO: 3311666 - protein, 14 aa, Plasmodium falciparum
EYHESGHNIILDRC

SEQ ID NO: 3311667 - protein, 4 aa, Plasmodium falciparum
EYIE

SEQ ID NO: 3311668 - protein, 12 aa, Plasmodium falciparum
EYIKEKKKKKYK

SEQ ID NO: 3311669 - protein, 9 aa, Plasmodium falciparum
EYKDDEHQI

SEQ ID NO: 3311670 - protein, 8 aa, Plasmodium falciparum
EYKEATKE

SEQ ID NO: 3311671 - protein, 10 aa, Plasmodium falciparum
EYKEEKKKIS

SEQ ID NO: 3311672 - protein, 40 aa, Plasmodium falciparum
EYKENKKEQKEQKKEDQEEEKEEEKGEEEEKEEKEKETYS

SEQ ID NO: 3311673 - protein, 15 aa, Plasmodium falciparum
EYKEQQKNLQTKETN

SEQ ID NO: 3311674 - protein, 8 aa, Plasmodium falciparum
EYKGQEAN

SEQ ID NO: 3311675 - protein, 9 aa, Plasmodium falciparum
EYKGSAKNK

SEQ ID NO: 3311676 - protein, 4 aa, Plasmodium falciparum
EYKK

SEQ ID NO: 3311677 - protein, 17 aa, Plasmodium falciparum
EYKKDEGKQPNCEMPGN

SEQ ID NO: 3311678 - protein, 11 aa, Plasmodium falciparum
EYKKERNDTEM

SEQ ID NO: 3311679 - protein, 13 aa, Plasmodium falciparum
EYKKKQPSYKRDR

SEQ ID NO: 3311680 - protein, 7 aa, Plasmodium falciparum
EYKKKSN

SEQ ID NO: 3311681 - protein, 21 aa, Plasmodium falciparum
EYKKQKDIPTNHSNNNNNNNN

SEQ ID NO: 3311682 - protein, 5 aa, Plasmodium falciparum
EYKKY

SEQ ID NO: 3311683 - protein, 11 aa, Plasmodium falciparum
EYKKYGSNNKM

SEQ ID NO: 3311684 - protein, 5 aa, Plasmodium falciparum
EYKLP

SEQ ID NO: 3311685 - protein, 5 aa, Plasmodium falciparum
EYKND

SEQ ID NO: 3311686 - protein, 11 aa, Plasmodium falciparum
EYKNNKGTSNY

SEQ ID NO: 3311687 - protein, 7 aa, Plasmodium falciparum
EYKNTPI

SEQ ID NO: 3311688 - protein, 10 aa, Plasmodium falciparum
EYKPTKQKKK

SEQ ID NO: 3311689 - protein, 17 aa, Plasmodium falciparum
EYKQNVNNNISNDNNSF

SEQ ID NO: 3311690 - protein, 8 aa, Plasmodium falciparum
EYKQSGEN

SEQ ID NO: 3311691 - protein, 10 aa, Plasmodium falciparum
EYKQTNNQNF

SEQ ID NO: 3311692 - protein, 10 aa, Plasmodium falciparum
EYKRSPMKGK

SEQ ID NO: 3311693 - protein, 7 aa, Plasmodium falciparum
EYKTTKD

SEQ ID NO: 3311694 - protein, 6 aa, Plasmodium falciparum
EYKYND

SEQ ID NO: 3311695 - protein, 6 aa, Plasmodium falciparum
EYKYNG

SEQ ID NO: 3311696 - protein, 28 aa, Plasmodium falciparum
EYLKKKGDEGVSKEECENMSSEGRRNYS

SEQ ID NO: 3311697 - protein, 5 aa, Plasmodium falciparum
EYLKR

SEQ ID NO: 3311698 - protein, 11 aa, Plasmodium falciparum
EYNAYKDKNTL

SEQ ID NO: 3311699 - protein, 12 aa, Plasmodium falciparum
EYNDKPKVKQLE

SEQ ID NO: 3311700 - protein, 22 aa, Plasmodium falciparum
EYNDNHSDEDNNNNNNNNFSYN

SEQ ID NO: 3311701 - protein, 4 aa, Plasmodium falciparum
EYNE

SEQ ID NO: 3311702 - protein, 6 aa, Plasmodium falciparum
EYNEES

SEQ ID NO: 3311703 - protein, 5 aa, Plasmodium falciparum
EYNEK

SEQ ID NO: 3311704 - protein, 16 aa, Plasmodium falciparum
EYNEKIKKNKKQDYSN

SEQ ID NO: 3311705 - protein, 11 aa, Plasmodium falciparum
EYNEKNLTAQD

SEQ ID NO: 3311706 - protein, 5 aa, Plasmodium falciparum
EYNEN

SEQ ID NO: 3311707 - protein, 15 aa, Plasmodium falciparum
EYNENENNDIKGNKN

SEQ ID NO: 3311708 - protein, 10 aa, Plasmodium falciparum
EYNEQLDAGG

SEQ ID NO: 3311709 - protein, 12 aa, Plasmodium falciparum
EYNESSSKGHLK

SEQ ID NO: 3311710 - protein, 10 aa, Plasmodium falciparum
EYNIEDNENN

SEQ ID NO: 3311711 - protein, 19 aa, Plasmodium falciparum
EYNKETKVITESNNELENK

SEQ ID NO: 3311712 - protein, 8 aa, Plasmodium falciparum
EYNKKRGK

SEQ ID NO: 3311713 - protein, 67 aa, Plasmodium falciparum
EYNKNDAGDYNDDHENDDENDNEDDEEDDDEEDDEDDDEDDDEDDDEDDDEDDPASDDDYMNEGNNE

SEQ ID NO: 3311714 - protein, 9 aa, Plasmodium falciparum
EYNKNENNI

SEQ ID NO: 3311715 - protein, 29 aa, Plasmodium falciparum
EYNKNVDKNEKESRYEKQYEDKNEDEEKL

SEQ ID NO: 3311716 - protein, 8 aa, Plasmodium falciparum
EYNNNNNM

SEQ ID NO: 3311717 - protein, 5 aa, Plasmodium falciparum
EYNNS

SEQ ID NO: 3311718 - protein, 11 aa, Plasmodium falciparum
EYNNSNNNKTY

SEQ ID NO: 3311719 - protein, 13 aa, Plasmodium falciparum
EYNNSSNKKTSKN

SEQ ID NO: 3311720 - protein, 6 aa, Plasmodium falciparum
EYNQNN

SEQ ID NO: 3311721 - protein, 6 aa, Plasmodium falciparum
EYNTKN

SEQ ID NO: 3311722 - protein, 12 aa, Plasmodium falciparum
EYNTSEKNNDMN

SEQ ID NO: 3311723 - protein, 5 aa, Plasmodium falciparum
EYNYD

SEQ ID NO: 3311724 - protein, 7 aa, Plasmodium falciparum
EYNYDGQ

SEQ ID NO: 3311725 - protein, 6 aa, Plasmodium falciparum
EYPDDA

SEQ ID NO: 3311726 - protein, 5 aa, Plasmodium falciparum
EYPDP

SEQ ID NO: 3311727 - protein, 8 aa, Plasmodium falciparum
EYPKSGIK

SEQ ID NO: 3311728 - protein, 5 aa, Plasmodium falciparum
EYPKT

SEQ ID NO: 3311729 - protein, 5 aa, Plasmodium falciparum
EYPNL

SEQ ID NO: 3311730 - protein, 13 aa, Plasmodium falciparum
EYPSRKKRKNKKK

SEQ ID NO: 3311731 - protein, 17 aa, Plasmodium falciparum
EYQQNDDQNRGSHNKNT

SEQ ID NO: 3311732 - protein, 4 aa, Plasmodium falciparum
EYQS

SEQ ID NO: 3311733 - protein, 12 aa, Plasmodium falciparum
EYRDQDEYQDEY

SEQ ID NO: 3311734 - protein, 10 aa, Plasmodium falciparum
EYRETGQTKI

SEQ ID NO: 3311735 - protein, 5 aa, Plasmodium falciparum
EYRKN

SEQ ID NO: 3311736 - protein, 6 aa, Plasmodium falciparum
EYSAQE

SEQ ID NO: 3311737 - protein, 4 aa, Plasmodium falciparum
EYSK

SEQ ID NO: 3311738 - protein, 5 aa, Plasmodium falciparum
EYSKQ

SEQ ID NO: 3311739 - protein, 4 aa, Plasmodium falciparum
EYSL

SEQ ID NO: 3311740 - protein, 15 aa, Plasmodium falciparum
EYSNYNLSDKGKIKP

SEQ ID NO: 3311741 - protein, 6 aa, Plasmodium falciparum
EYSPSI

SEQ ID NO: 3311742 - protein, 4 aa, Plasmodium falciparum
EYSR

SEQ ID NO: 3311743 - protein, 6 aa, Plasmodium falciparum
EYSRTP

SEQ ID NO: 3311744 - protein, 26 aa, Plasmodium falciparum
EYSSDENIDDNGDVYENNDNGDGNSN

SEQ ID NO: 3311745 - protein, 6 aa, Plasmodium falciparum
EYSSDN

SEQ ID NO: 3311746 - protein, 10 aa, Plasmodium falciparum
EYSSKTNNNM

SEQ ID NO: 3311747 - protein, 8 aa, Plasmodium falciparum
EYSSSSKE

SEQ ID NO: 3311748 - protein, 19 aa, Plasmodium falciparum
EYSTEDSSDESSNESNDLS

SEQ ID NO: 3311749 - protein, 11 aa, Plasmodium falciparum
EYSTNDDKKFP

SEQ ID NO: 3311750 - protein, 5 aa, Plasmodium falciparum
EYTED

SEQ ID NO: 3311751 - protein, 15 aa, Plasmodium falciparum
EYTEESNITNLSESQ

SEQ ID NO: 3311752 - protein, 4 aa, Plasmodium falciparum
EYTF

SEQ ID NO: 3311753 - protein, 8 aa, Plasmodium falciparum
EYTKDDTN

SEQ ID NO: 3311754 - protein, 8 aa, Plasmodium falciparum
EYTNKNPK

SEQ ID NO: 3311755 - protein, 5 aa, Plasmodium falciparum
EYTNS

SEQ ID NO: 3311756 - protein, 5 aa, Plasmodium falciparum
EYVTD

SEQ ID NO: 3311757 - protein, 12 aa, Plasmodium falciparum
EYYDSDTSSISF

SEQ ID NO: 3311758 - protein, 4 aa, Plasmodium falciparum
EYYN

SEQ ID NO: 3311759 - protein, 22 aa, Plasmodium falciparum
EYYNKNNIKSNTHFNDEQQMNN

SEQ ID NO: 3311760 - protein, 14 aa, Plasmodium falciparum
EYYSNNKPNHLNSK

SEQ ID NO: 3311761 - protein, 5 aa, Plasmodium falciparum
FAGED

SEQ ID NO: 3311762 - protein, 9 aa, Plasmodium falciparum
FAGTGSPKI

SEQ ID NO: 3311763 - protein, 10 aa, Plasmodium falciparum
FAKSKKNSSD

SEQ ID NO: 3311764 - protein, 8 aa, Plasmodium falciparum
FANENSRT

SEQ ID NO: 3311765 - protein, 9 aa, Plasmodium falciparum
FAPKATKIS

SEQ ID NO: 3311766 - protein, 12 aa, Plasmodium falciparum
FAQDDDKNIEDV

SEQ ID NO: 3311767 - protein, 8 aa, Plasmodium falciparum
FAQENKVP

SEQ ID NO: 3311768 - protein, 11 aa, Plasmodium falciparum
FAQNKENEKYD

SEQ ID NO: 3311769 - protein, 11 aa, Plasmodium falciparum
FARSKDYDAMD

SEQ ID NO: 3311770 - protein, 12 aa, Plasmodium falciparum
FASSYNSQNSDV

SEQ ID NO: 3311771 - protein, 13 aa, Plasmodium falciparum
FATEEEYETLENN

SEQ ID NO: 3311772 - protein, 10 aa, Plasmodium falciparum
FATTKGNSLS

SEQ ID NO: 3311773 - protein, 4 aa, Plasmodium falciparum
FCSD

SEQ ID NO: 3311774 - protein, 4 aa, Plasmodium falciparum
FDAP

SEQ ID NO: 3311775 - protein, 11 aa, Plasmodium falciparum
FDDENTTRQIG

SEQ ID NO: 3311776 - protein, 34 aa, Plasmodium falciparum
FDDMNNRNNSLNNNDMNNNNNNNNMNNSDNSKLS

SEQ ID NO: 3311777 - protein, 5 aa, Plasmodium falciparum
FDDND

SEQ ID NO: 3311778 - protein, 17 aa, Plasmodium falciparum
FDDPKNSHIEAENRTSL

SEQ ID NO: 3311779 - protein, 21 aa, Plasmodium falciparum
FDDRKDNLKNNNKSMNNTDDV

SEQ ID NO: 3311780 - protein, 9 aa, Plasmodium falciparum
FDDSSNDEF

SEQ ID NO: 3311781 - protein, 7 aa, Plasmodium falciparum
FDDTEGG

SEQ ID NO: 3311782 - protein, 6 aa, Plasmodium falciparum
FDDTKQ

SEQ ID NO: 3311783 - protein, 7 aa, Plasmodium falciparum
FDDTQKI

SEQ ID NO: 3311784 - protein, 110 aa, Plasmodium falciparum
FDEDNDENVDKNVDKNVDKNVDKNDDEDDGEDDGEDDGEDDGEHDGEDDGEDDSDEDKHENIPKNKADTLKEESDVSDNHHNNRKSKNIKNSIRSKSSNSKTKKEDDDNN

SEQ ID NO: 3311785 - protein, 9 aa, Plasmodium falciparum
FDEDNDQQY

SEQ ID NO: 3311786 - protein, 11 aa, Plasmodium falciparum
FDEDSSSSKYI

SEQ ID NO: 3311787 - protein, 21 aa, Plasmodium falciparum
FDEEEEDDDDDEEEDDEEKNL

SEQ ID NO: 3311788 - protein, 7 aa, Plasmodium falciparum
FDEGEPK

SEQ ID NO: 3311789 - protein, 11 aa, Plasmodium falciparum
FDEHKNNSFSD

SEQ ID NO: 3311790 - protein, 4 aa, Plasmodium falciparum
FDEK

SEQ ID NO: 3311791 - protein, 10 aa, Plasmodium falciparum
FDEKAKKRSL

SEQ ID NO: 3311792 - protein, 4 aa, Plasmodium falciparum
FDEN

SEQ ID NO: 3311793 - protein, 6 aa, Plasmodium falciparum
FDENNN

SEQ ID NO: 3311794 - protein, 7 aa, Plasmodium falciparum
FDESDSD

SEQ ID NO: 3311795 - protein, 5 aa, Plasmodium falciparum
FDESS

SEQ ID NO: 3311796 - protein, 5 aa, Plasmodium falciparum
FDESY

SEQ ID NO: 3311797 - protein, 4 aa, Plasmodium falciparum
FDGD

SEQ ID NO: 3311798 - protein, 29 aa, Plasmodium falciparum
FDGDNNKNNNDNKNNNNNNNNNNNNNGRH

SEQ ID NO: 3311799 - protein, 5 aa, Plasmodium falciparum
FDGSN

SEQ ID NO: 3311800 - protein, 6 aa, Plasmodium falciparum
FDGTKT

SEQ ID NO: 3311801 - protein, 7 aa, Plasmodium falciparum
FDGTTNE

SEQ ID NO: 3311802 - protein, 9 aa, Plasmodium falciparum
FDKDDESQM

SEQ ID NO: 3311803 - protein, 4 aa, Plasmodium falciparum
FDKK

SEQ ID NO: 3311804 - protein, 5 aa, Plasmodium falciparum
FDKNG

SEQ ID NO: 3311805 - protein, 41 aa, Plasmodium falciparum
FDKNSKTINVNEDKGEEYAEKEEFDPEDQYEEDEYDEEDDL

SEQ ID NO: 3311806 - protein, 8 aa, Plasmodium falciparum
FDKSESKN

SEQ ID NO: 3311807 - protein, 6 aa, Plasmodium falciparum
FDKSGS

SEQ ID NO: 3311808 - protein, 5 aa, Plasmodium falciparum
FDKST

SEQ ID NO: 3311809 - protein, 4 aa, Plasmodium falciparum
FDND

SEQ ID NO: 3311810 - protein, 15 aa, Plasmodium falciparum
FDNEDEKNNMEPNDC

SEQ ID NO: 3311811 - protein, 11 aa, Plasmodium falciparum
FDNENNISKEI

SEQ ID NO: 3311812 - protein, 10 aa, Plasmodium falciparum
FDNKNRKTNN

SEQ ID NO: 3311813 - protein, 8 aa, Plasmodium falciparum
FDNNANTK

SEQ ID NO: 3311814 - protein, 64 aa, Plasmodium falciparum
FDNNDNNDDNNDNNNDDNNDNNKNNNNDNNKNNNNNNNNNNNNNNNNNNNNNNNNNNDNNKQNI

SEQ ID NO: 3311815 - protein, 5 aa, Plasmodium falciparum
FDNNM

SEQ ID NO: 3311816 - protein, 15 aa, Plasmodium falciparum
FDNNNKKKTCDNNNK

SEQ ID NO: 3311817 - protein, 23 aa, Plasmodium falciparum
FDNNNKNNNNSNNSSNHMNSGVS

SEQ ID NO: 3311818 - protein, 5 aa, Plasmodium falciparum
FDNRG

SEQ ID NO: 3311819 - protein, 15 aa, Plasmodium falciparum
FDNSSNGESNRYSNA

SEQ ID NO: 3311820 - protein, 10 aa, Plasmodium falciparum
FDPDDDLKKE

SEQ ID NO: 3311821 - protein, 6 aa, Plasmodium falciparum
FDPDTD

SEQ ID NO: 3311822 - protein, 40 aa, Plasmodium falciparum
FDPKEKDKKKKNKKHKNYNKNNTHYEKSENNTTVNNTNKG

SEQ ID NO: 3311823 - protein, 6 aa, Plasmodium falciparum
FDPQGL

SEQ ID NO: 3311824 - protein, 4 aa, Plasmodium falciparum
FDQD

SEQ ID NO: 3311825 - protein, 9 aa, Plasmodium falciparum
FDQKGISTE

SEQ ID NO: 3311826 - protein, 7 aa, Plasmodium falciparum
FDQQQSD

SEQ ID NO: 3311827 - protein, 18 aa, Plasmodium falciparum
FDRGGKTTDGNSTEFNDK

SEQ ID NO: 3311828 - protein, 7 aa, Plasmodium falciparum
FDSDDDQ

SEQ ID NO: 3311829 - protein, 11 aa, Plasmodium falciparum
FDSEGSNKEDY

SEQ ID NO: 3311830 - protein, 5 aa, Plasmodium falciparum
FDSGG

SEQ ID NO: 3311831 - protein, 12 aa, Plasmodium falciparum
FDSKDSDDNYVR

SEQ ID NO: 3311832 - protein, 6 aa, Plasmodium falciparum
FDSNET

SEQ ID NO: 3311833 - protein, 26 aa, Plasmodium falciparum
FDSPAKDHHNNNPHQNNDENNNRHSN

SEQ ID NO: 3311834 - protein, 12 aa, Plasmodium falciparum
FDSPLKASDEFP

SEQ ID NO: 3311835 - protein, 15 aa, Plasmodium falciparum
FDSQTKETLTTKPVK

SEQ ID NO: 3311836 - protein, 5 aa, Plasmodium falciparum
FDSRG

SEQ ID NO: 3311837 - protein, 30 aa, Plasmodium falciparum
FDSTYEKKYDSAYEKKYDGAYEKKNDHRYA

SEQ ID NO: 3311838 - protein, 4 aa, Plasmodium falciparum
FDTE

SEQ ID NO: 3311839 - protein, 70 aa, Plasmodium falciparum
FDTNNSSSISNHNNNNNNTHNHNNNNNNNNNNNNNNNNNNNNNNNNNNNNNNNNNNNNNNNSSSSCSNRR

SEQ ID NO: 3311840 - protein, 9 aa, Plasmodium falciparum
FDYSGTQAI

SEQ ID NO: 3311841 - protein, 4 aa, Plasmodium falciparum
FDYT

SEQ ID NO: 3311842 - protein, 14 aa, Plasmodium falciparum
FEANKKKNNEMDET

SEQ ID NO: 3311843 - protein, 4 aa, Plasmodium falciparum
FEDE

SEQ ID NO: 3311844 - protein, 5 aa, Plasmodium falciparum
FEDNN

SEQ ID NO: 3311845 - protein, 19 aa, Plasmodium falciparum
FEDSESDDNDEEDEHRNSM

SEQ ID NO: 3311846 - protein, 4 aa, Plasmodium falciparum
FEEG

SEQ ID NO: 3311847 - protein, 7 aa, Plasmodium falciparum
FEEKRKK

SEQ ID NO: 3311848 - protein, 4 aa, Plasmodium falciparum
FEEN

SEQ ID NO: 3311849 - protein, 44 aa, Plasmodium falciparum
FEEPKKKFNNNNNNNNKNKSNNNNNNNNNNNNNNNNNNNLDNIK

SEQ ID NO: 3311850 - protein, 4 aa, Plasmodium falciparum
FEES

SEQ ID NO: 3311851 - protein, 20 aa, Plasmodium falciparum
FEGESNYRSEFGPKALPELP

SEQ ID NO: 3311852 - protein, 10 aa, Plasmodium falciparum
FEGESSYRTE

SEQ ID NO: 3311853 - protein, 12 aa, Plasmodium falciparum
FEGKNKKHIGEQ

SEQ ID NO: 3311854 - protein, 11 aa, Plasmodium falciparum
FEGSSSKEENF

SEQ ID NO: 3311855 - protein, 5 aa, Plasmodium falciparum
FEGTL

SEQ ID NO: 3311856 - protein, 10 aa, Plasmodium falciparum
FEKAKNKEKL

SEQ ID NO: 3311857 - protein, 11 aa, Plasmodium falciparum
FEKDNNERKNY

SEQ ID NO: 3311858 - protein, 12 aa, Plasmodium falciparum
FEKEQNQQRKDK

SEQ ID NO: 3311859 - protein, 10 aa, Plasmodium falciparum
FEKGKREGKN

SEQ ID NO: 3311860 - protein, 16 aa, Plasmodium falciparum
FEKGRKVSGPRALQPS

SEQ ID NO: 3311861 - protein, 10 aa, Plasmodium falciparum
FEKKNEENLC

SEQ ID NO: 3311862 - protein, 11 aa, Plasmodium falciparum
FEKNEKVQNDI

SEQ ID NO: 3311863 - protein, 10 aa, Plasmodium falciparum
FEKNESKESI

SEQ ID NO: 3311864 - protein, 17 aa, Plasmodium falciparum
FEKSSTNNSEINTNTET

SEQ ID NO: 3311865 - protein, 4 aa, Plasmodium falciparum
FEKT

SEQ ID NO: 3311866 - protein, 23 aa, Plasmodium falciparum
FEKTDTHNHNNNDTNDQNNHNLQ

SEQ ID NO: 3311867 - protein, 11 aa, Plasmodium falciparum
FENDDKRCNNK

SEQ ID NO: 3311868 - protein, 8 aa, Plasmodium falciparum
FENDKGNE

SEQ ID NO: 3311869 - protein, 6 aa, Plasmodium falciparum
FENDKK

SEQ ID NO: 3311870 - protein, 9 aa, Plasmodium falciparum
FENDTNDVL

SEQ ID NO: 3311871 - protein, 8 aa, Plasmodium falciparum
FENKADRN

SEQ ID NO: 3311872 - protein, 5 aa, Plasmodium falciparum
FENKD

SEQ ID NO: 3311873 - protein, 14 aa, Plasmodium falciparum
FENKRSSKKNKNNI

SEQ ID NO: 3311874 - protein, 10 aa, Plasmodium falciparum
FENKSYPNDI

SEQ ID NO: 3311875 - protein, 9 aa, Plasmodium falciparum
FENNEKKLY

SEQ ID NO: 3311876 - protein, 6 aa, Plasmodium falciparum
FENNHK

SEQ ID NO: 3311877 - protein, 8 aa, Plasmodium falciparum
FENNSDPT

SEQ ID NO: 3311878 - protein, 6 aa, Plasmodium falciparum
FENRTG

SEQ ID NO: 3311879 - protein, 11 aa, Plasmodium falciparum
FENSEESEESV

SEQ ID NO: 3311880 - protein, 6 aa, Plasmodium falciparum
FEPKSD

SEQ ID NO: 3311881 - protein, 6 aa, Plasmodium falciparum
FEPPKK

SEQ ID NO: 3311882 - protein, 16 aa, Plasmodium falciparum
FEPPPKPRFKGDKNGR

SEQ ID NO: 3311883 - protein, 6 aa, Plasmodium falciparum
FEPPQP

SEQ ID NO: 3311884 - protein, 7 aa, Plasmodium falciparum
FEQQKKE

SEQ ID NO: 3311885 - protein, 8 aa, Plasmodium falciparum
FERDKEKN

SEQ ID NO: 3311886 - protein, 21 aa, Plasmodium falciparum
FESCSSNKDHREVCSSDTSDS

SEQ ID NO: 3311887 - protein, 14 aa, Plasmodium falciparum
FESEEQKKLFFMYL

SEQ ID NO: 3311888 - protein, 5 aa, Plasmodium falciparum
FESES

SEQ ID NO: 3311889 - protein, 6 aa, Plasmodium falciparum
FESKDK

SEQ ID NO: 3311890 - protein, 5 aa, Plasmodium falciparum
FESSG

SEQ ID NO: 3311891 - protein, 5 aa, Plasmodium falciparum
FESTQ

SEQ ID NO: 3311892 - protein, 4 aa, Plasmodium falciparum
FETA

SEQ ID NO: 3311893 - protein, 18 aa, Plasmodium falciparum
FETDNESDLDLEDDEGDD

SEQ ID NO: 3311894 - protein, 14 aa, Plasmodium falciparum
FETGRATNDPVEGR

SEQ ID NO: 3311895 - protein, 6 aa, Plasmodium falciparum
FETPEQ

SEQ ID NO: 3311896 - protein, 4 aa, Plasmodium falciparum
FEYG

SEQ ID NO: 3311897 - protein, 14 aa, Plasmodium falciparum
FFSSSDANLDSPDK

SEQ ID NO: 3311898 - protein, 4 aa, Plasmodium falciparum
FGAN

SEQ ID NO: 3311899 - protein, 15 aa, Plasmodium falciparum
FGASSDNEDENEELP

SEQ ID NO: 3311900 - protein, 21 aa, Plasmodium falciparum
FGDNEKKKKNHDNNNDINNDD

SEQ ID NO: 3311901 - protein, 5 aa, Plasmodium falciparum
FGEEK

SEQ ID NO: 3311902 - protein, 4 aa, Plasmodium falciparum
FGEN

SEQ ID NO: 3311903 - protein, 6 aa, Plasmodium falciparum
FGEPAT

SEQ ID NO: 3311904 - protein, 9 aa, Plasmodium falciparum
FGEPTAEEK

SEQ ID NO: 3311905 - protein, 11 aa, Plasmodium falciparum
FGESKNETFPR

SEQ ID NO: 3311906 - protein, 4 aa, Plasmodium falciparum
FGGE

SEQ ID NO: 3311907 - protein, 4 aa, Plasmodium falciparum
FGGI

SEQ ID NO: 3311908 - protein, 4 aa, Plasmodium falciparum
FGGK

SEQ ID NO: 3311909 - protein, 11 aa, Plasmodium falciparum
FGGKNKSSKGN

SEQ ID NO: 3311910 - protein, 8 aa, Plasmodium falciparum
FGGNTYDE

SEQ ID NO: 3311911 - protein, 4 aa, Plasmodium falciparum
FGGS

SEQ ID NO: 3311912 - protein, 5 aa, Plasmodium falciparum
FGGSN

SEQ ID NO: 3311913 - protein, 6 aa, Plasmodium falciparum
FGHKEG

SEQ ID NO: 3311914 - protein, 11 aa, Plasmodium falciparum
FGKDNKKENKL

SEQ ID NO: 3311915 - protein, 5 aa, Plasmodium falciparum
FGKER

SEQ ID NO: 3311916 - protein, 6 aa, Plasmodium falciparum
FGKPNG

SEQ ID NO: 3311917 - protein, 8 aa, Plasmodium falciparum
FGKTKDQI

SEQ ID NO: 3311918 - protein, 5 aa, Plasmodium falciparum
FGKTR

SEQ ID NO: 3311919 - protein, 19 aa, Plasmodium falciparum
FGNEPNSDNRPFEYQNNFP

SEQ ID NO: 3311920 - protein, 11 aa, Plasmodium falciparum
FGNGSYTGEVS

SEQ ID NO: 3311921 - protein, 11 aa, Plasmodium falciparum
FGNKKNRRTLN

SEQ ID NO: 3311922 - protein, 21 aa, Plasmodium falciparum
FGNNKEESALPTDTYNDKNDM

SEQ ID NO: 3311923 - protein, 30 aa, Plasmodium falciparum
FGNSNDNNTKQSDNVLKGNNKNGSKNDKYE

SEQ ID NO: 3311924 - protein, 10 aa, Plasmodium falciparum
FGNSSTCGKE

SEQ ID NO: 3311925 - protein, 7 aa, Plasmodium falciparum
FGPETTD

SEQ ID NO: 3311926 - protein, 11 aa, Plasmodium falciparum
FGQNENKQIIG

SEQ ID NO: 3311927 - protein, 5 aa, Plasmodium falciparum
FGQPG

SEQ ID NO: 3311928 - protein, 11 aa, Plasmodium falciparum
FGSASSSSREV

SEQ ID NO: 3311929 - protein, 11 aa, Plasmodium falciparum
FGSGYPGDPVT

SEQ ID NO: 3311930 - protein, 16 aa, Plasmodium falciparum
FGSKKQKEKVDKETKK

SEQ ID NO: 3311931 - protein, 8 aa, Plasmodium falciparum
FGSSGPKE

SEQ ID NO: 3311932 - protein, 9 aa, Plasmodium falciparum
FGSSGTPNI

SEQ ID NO: 3311933 - protein, 15 aa, Plasmodium falciparum
FGTEGRRQPDIAPSN

SEQ ID NO: 3311934 - protein, 6 aa, Plasmodium falciparum
FGTKSC

SEQ ID NO: 3311935 - protein, 9 aa, Plasmodium falciparum
FGTNTSTNL

SEQ ID NO: 3311936 - protein, 4 aa, Plasmodium falciparum
FGTT

SEQ ID NO: 3311937 - protein, 12 aa, Plasmodium falciparum
FGTTTNSTTIGG

SEQ ID NO: 3311938 - protein, 19 aa, Plasmodium falciparum
FGVPSSSPPAQQQVGGSVT

SEQ ID NO: 3311939 - protein, 28 aa, Plasmodium falciparum
FHANKQDTTMEKNNNSLHKETKSYYKNK

SEQ ID NO: 3311940 - protein, 9 aa, Plasmodium falciparum
FHENTNTTI

SEQ ID NO: 3311941 - protein, 9 aa, Plasmodium falciparum
FHSDDSNEF

SEQ ID NO: 3311942 - protein, 6 aa, Plasmodium falciparum
FIPKKN

SEQ ID NO: 3311943 - protein, 6 aa, Plasmodium falciparum
FKDDEK

SEQ ID NO: 3311944 - protein, 5 aa, Plasmodium falciparum
FKDEN

SEQ ID NO: 3311945 - protein, 8 aa, Plasmodium falciparum
FKDKNTCP

SEQ ID NO: 3311946 - protein, 8 aa, Plasmodium falciparum
FKDNEENI

SEQ ID NO: 3311947 - protein, 5 aa, Plasmodium falciparum
FKDNR

SEQ ID NO: 3311948 - protein, 8 aa, Plasmodium falciparum
FKDSYAEE

SEQ ID NO: 3311949 - protein, 8 aa, Plasmodium falciparum
FKEDTCEE

SEQ ID NO: 3311950 - protein, 24 aa, Plasmodium falciparum
FKEDTNQCVTNQKGVEEKINEEEN

SEQ ID NO: 3311951 - protein, 41 aa, Plasmodium falciparum
FKEEEEKEEKEKEKEKKKIEKKDNEKEKEKLPNEQEEEQQR

SEQ ID NO: 3311952 - protein, 9 aa, Plasmodium falciparum
FKEEEKDTH

SEQ ID NO: 3311953 - protein, 31 aa, Plasmodium falciparum
FKEGDRDQSSSSEHSSINTEKKKKDNDNTKQ

SEQ ID NO: 3311954 - protein, 12 aa, Plasmodium falciparum
FKEGNKKDNISK

SEQ ID NO: 3311955 - protein, 9 aa, Plasmodium falciparum
FKEKGSKLN

SEQ ID NO: 3311956 - protein, 13 aa, Plasmodium falciparum
FKENKKEGKSNSL

SEQ ID NO: 3311957 - protein, 9 aa, Plasmodium falciparum
FKEQEKHDI

SEQ ID NO: 3311958 - protein, 14 aa, Plasmodium falciparum
FKERKEKKKKEKMA

SEQ ID NO: 3311959 - protein, 4 aa, Plasmodium falciparum
FKET

SEQ ID NO: 3311960 - protein, 9 aa, Plasmodium falciparum
FKGAEPKTI

SEQ ID NO: 3311961 - protein, 7 aa, Plasmodium falciparum
FKGDQRR

SEQ ID NO: 3311962 - protein, 18 aa, Plasmodium falciparum
FKGGGSTYNFSGTQNNIN

SEQ ID NO: 3311963 - protein, 7 aa, Plasmodium falciparum
FKGGNKD

SEQ ID NO: 3311964 - protein, 14 aa, Plasmodium falciparum
FKGKKDNKKIEKTN

SEQ ID NO: 3311965 - protein, 16 aa, Plasmodium falciparum
FKGNKKKEFKKKTRRR

SEQ ID NO: 3311966 - protein, 12 aa, Plasmodium falciparum
FKIDNNKNNQIN

SEQ ID NO: 3311967 - protein, 21 aa, Plasmodium falciparum
FKKDKDNKKYKDYPSTERDIE

SEQ ID NO: 3311968 - protein, 13 aa, Plasmodium falciparum
FKKDNTKVNKTNS

SEQ ID NO: 3311969 - protein, 9 aa, Plasmodium falciparum
FKKDSNESL

SEQ ID NO: 3311970 - protein, 5 aa, Plasmodium falciparum
FKKEA

SEQ ID NO: 3311971 - protein, 5 aa, Plasmodium falciparum
FKKGI

SEQ ID NO: 3311972 - protein, 7 aa, Plasmodium falciparum
FKKKDNL

SEQ ID NO: 3311973 - protein, 8 aa, Plasmodium falciparum
FKKKEGEL

SEQ ID NO: 3311974 - protein, 4 aa, Plasmodium falciparum
FKKN

SEQ ID NO: 3311975 - protein, 8 aa, Plasmodium falciparum
FKKNSYNN

SEQ ID NO: 3311976 - protein, 7 aa, Plasmodium falciparum
FKKSSTI

SEQ ID NO: 3311977 - protein, 10 aa, Plasmodium falciparum
FKNDDYDTEM

SEQ ID NO: 3311978 - protein, 33 aa, Plasmodium falciparum
FKNDQTDEMGEYTATTTNNVKHTNNTNNNDTHI

SEQ ID NO: 3311979 - protein, 7 aa, Plasmodium falciparum
FKNENNE

SEQ ID NO: 3311980 - protein, 24 aa, Plasmodium falciparum
FKNKDRKRKAQKENLKEDSQTNHH

SEQ ID NO: 3311981 - protein, 15 aa, Plasmodium falciparum
FKNKEIEQDEDDAIT

SEQ ID NO: 3311982 - protein, 10 aa, Plasmodium falciparum
FKNKEREENY

SEQ ID NO: 3311983 - protein, 5 aa, Plasmodium falciparum
FKNKQ

SEQ ID NO: 3311984 - protein, 5 aa, Plasmodium falciparum
FKNNK

SEQ ID NO: 3311985 - protein, 54 aa, Plasmodium falciparum
FKNNTVGNNNIGNNHNIGNNNNIGNNHNIGNNNNNIGNNNNNTQSYTDINKSSS

SEQ ID NO: 3311986 - protein, 8 aa, Plasmodium falciparum
FKNQEKKE

SEQ ID NO: 3311987 - protein, 10 aa, Plasmodium falciparum
FKNSSDNNDI

SEQ ID NO: 3311988 - protein, 8 aa, Plasmodium falciparum
FKNTSGQL

SEQ ID NO: 3311989 - protein, 7 aa, Plasmodium falciparum
FKPGEGV

SEQ ID NO: 3311990 - protein, 4 aa, Plasmodium falciparum
FKPY

SEQ ID NO: 3311991 - protein, 8 aa, Plasmodium falciparum
FKQEQEKG

SEQ ID NO: 3311992 - protein, 19 aa, Plasmodium falciparum
FKQKDDKNENDMENQSHNN

SEQ ID NO: 3311993 - protein, 25 aa, Plasmodium falciparum
FKQNNNQDNINQDTREENKSDPGYS

SEQ ID NO: 3311994 - protein, 4 aa, Plasmodium falciparum
FKQY

SEQ ID NO: 3311995 - protein, 18 aa, Plasmodium falciparum
FKREDNMDPLKKDNNENF

SEQ ID NO: 3311996 - protein, 22 aa, Plasmodium falciparum
FKRNSNNFGKGNNNAVRKGSNW

SEQ ID NO: 3311997 - protein, 9 aa, Plasmodium falciparum
FKSDEDDSD

SEQ ID NO: 3311998 - protein, 4 aa, Plasmodium falciparum
FKSE

SEQ ID NO: 3311999 - protein, 12 aa, Plasmodium falciparum
FKSESTDVTERT

SEQ ID NO: 3312000 - protein, 10 aa, Plasmodium falciparum
FKSKKQKKYI

SEQ ID NO: 3312001 - protein, 5 aa, Plasmodium falciparum
FKSKQ

SEQ ID NO: 3312002 - protein, 4 aa, Plasmodium falciparum
FKSN

SEQ ID NO: 3312003 - protein, 9 aa, Plasmodium falciparum
FKSNTDTEV

SEQ ID NO: 3312004 - protein, 5 aa, Plasmodium falciparum
FKSPS

SEQ ID NO: 3312005 - protein, 23 aa, Plasmodium falciparum
FKSSSKKKKKIIEESSDYASSEK

SEQ ID NO: 3312006 - protein, 8 aa, Plasmodium falciparum
FKTEPPKH

SEQ ID NO: 3312007 - protein, 12 aa, Plasmodium falciparum
FKTETKSKLESK

SEQ ID NO: 3312008 - protein, 4 aa, Plasmodium falciparum
FKTG

SEQ ID NO: 3312009 - protein, 26 aa, Plasmodium falciparum
FKTRRSKFTNGNNYGKSGNNKNSEDL

SEQ ID NO: 3312010 - protein, 4 aa, Plasmodium falciparum
FKTT

SEQ ID NO: 3312011 - protein, 5 aa, Plasmodium falciparum
FKTTK

SEQ ID NO: 3312012 - protein, 11 aa, Plasmodium falciparum
FKYNDEDSYKL

SEQ ID NO: 3312013 - protein, 4 aa, Plasmodium falciparum
FMGN

SEQ ID NO: 3312014 - protein, 10 aa, Plasmodium falciparum
FMPNPKKNID

SEQ ID NO: 3312015 - protein, 12 aa, Plasmodium falciparum
FMPPKNDKNFNN

SEQ ID NO: 3312016 - protein, 10 aa, Plasmodium falciparum
FNAPQDNTLT

SEQ ID NO: 3312017 - protein, 12 aa, Plasmodium falciparum
FNDDNNCSEPTN

SEQ ID NO: 3312018 - protein, 8 aa, Plasmodium falciparum
FNDDSNED

SEQ ID NO: 3312019 - protein, 20 aa, Plasmodium falciparum
FNDGDNKNGEENSNLTTQHD

SEQ ID NO: 3312020 - protein, 11 aa, Plasmodium falciparum
FNDNRKNNVDY

SEQ ID NO: 3312021 - protein, 10 aa, Plasmodium falciparum
FNDRDNNNAY

SEQ ID NO: 3312022 - protein, 7 aa, Plasmodium falciparum
FNDSDDE

SEQ ID NO: 3312023 - protein, 21 aa, Plasmodium falciparum
FNDTHNNNNNNNNNNNYNYNG

SEQ ID NO: 3312024 - protein, 7 aa, Plasmodium falciparum
FNDYSED

SEQ ID NO: 3312025 - protein, 5 aa, Plasmodium falciparum
FNEAN

SEQ ID NO: 3312026 - protein, 4 aa, Plasmodium falciparum
FNED

SEQ ID NO: 3312027 - protein, 12 aa, Plasmodium falciparum
FNEDVLKKKKSI

SEQ ID NO: 3312028 - protein, 5 aa, Plasmodium falciparum
FNEEE

SEQ ID NO: 3312029 - protein, 17 aa, Plasmodium falciparum
FNEESDDEELKELIGEM

SEQ ID NO: 3312030 - protein, 16 aa, Plasmodium falciparum
FNEISGKEKNQNNIEY

SEQ ID NO: 3312031 - protein, 6 aa, Plasmodium falciparum
FNEKEK

SEQ ID NO: 3312032 - protein, 14 aa, Plasmodium falciparum
FNEKKEDSNDRGVS

SEQ ID NO: 3312033 - protein, 8 aa, Plasmodium falciparum
FNENEENS

SEQ ID NO: 3312034 - protein, 12 aa, Plasmodium falciparum
FNEPRPGDWGNR

SEQ ID NO: 3312035 - protein, 8 aa, Plasmodium falciparum
FNEQEKEQ

SEQ ID NO: 3312036 - protein, 10 aa, Plasmodium falciparum
FNEREEDQRG

SEQ ID NO: 3312037 - protein, 25 aa, Plasmodium falciparum
FNETNKTKYIQGTGGRKSKSTGKNK

SEQ ID NO: 3312038 - protein, 9 aa, Plasmodium falciparum
FNETSSRSH

SEQ ID NO: 3312039 - protein, 4 aa, Plasmodium falciparum
FNEY

SEQ ID NO: 3312040 - protein, 14 aa, Plasmodium falciparum
FNFPPGQDDHDKSI

SEQ ID NO: 3312041 - protein, 21 aa, Plasmodium falciparum
FNGNKKDINNKYEEGSYYKSQ

SEQ ID NO: 3312042 - protein, 9 aa, Plasmodium falciparum
FNGTNSTGS

SEQ ID NO: 3312043 - protein, 12 aa, Plasmodium falciparum
FNHNNNNNNNNN

SEQ ID NO: 3312044 - protein, 5 aa, Plasmodium falciparum
FNHSK

SEQ ID NO: 3312045 - protein, 9 aa, Plasmodium falciparum
FNKAPTSRT

SEQ ID NO: 3312046 - protein, 7 aa, Plasmodium falciparum
FNKEENN

SEQ ID NO: 3312047 - protein, 14 aa, Plasmodium falciparum
FNKEEYKDDQFDED

SEQ ID NO: 3312048 - protein, 29 aa, Plasmodium falciparum
FNKGTQKKGLLSKKDFKKKRTSSKNNNSI

SEQ ID NO: 3312049 - protein, 8 aa, Plasmodium falciparum
FNKKNDNS

SEQ ID NO: 3312050 - protein, 4 aa, Plasmodium falciparum
FNKN

SEQ ID NO: 3312051 - protein, 32 aa, Plasmodium falciparum
FNKNEKENENEIEKQQTHANNYSNVNTQDIRQ

SEQ ID NO: 3312052 - protein, 22 aa, Plasmodium falciparum
FNKNKEKKQVSADDKDVSNSSE

SEQ ID NO: 3312053 - protein, 7 aa, Plasmodium falciparum
FNKNNET

SEQ ID NO: 3312054 - protein, 6 aa, Plasmodium falciparum
FNKNRN

SEQ ID NO: 3312055 - protein, 7 aa, Plasmodium falciparum
FNKNRNN

SEQ ID NO: 3312056 - protein, 7 aa, Plasmodium falciparum
FNKSKRK

SEQ ID NO: 3312057 - protein, 21 aa, Plasmodium falciparum
FNKSSKGENSEIGKIGGRSKS

SEQ ID NO: 3312058 - protein, 11 aa, Plasmodium falciparum
FNNDEGNKYLR

SEQ ID NO: 3312059 - protein, 23 aa, Plasmodium falciparum
FNNDNSCDGEYDSNKGKNKSTQK

SEQ ID NO: 3312060 - protein, 7 aa, Plasmodium falciparum
FNNDTVE

SEQ ID NO: 3312061 - protein, 7 aa, Plasmodium falciparum
FNNEEAK

SEQ ID NO: 3312062 - protein, 10 aa, Plasmodium falciparum
FNNERNDIKQ

SEQ ID NO: 3312063 - protein, 5 aa, Plasmodium falciparum
FNNGE

SEQ ID NO: 3312064 - protein, 6 aa, Plasmodium falciparum
FNNGNE

SEQ ID NO: 3312065 - protein, 10 aa, Plasmodium falciparum
FNNKKNENKY

SEQ ID NO: 3312066 - protein, 13 aa, Plasmodium falciparum
FNNKKRKTSTCST

SEQ ID NO: 3312067 - protein, 9 aa, Plasmodium falciparum
FNNKKTHDY

SEQ ID NO: 3312068 - protein, 15 aa, Plasmodium falciparum
FNNKQVDNDNNKNSL

SEQ ID NO: 3312069 - protein, 4 aa, Plasmodium falciparum
FNNN

SEQ ID NO: 3312070 - protein, 6 aa, Plasmodium falciparum
FNNNNN

SEQ ID NO: 3312071 - protein, 26 aa, Plasmodium falciparum
FNNNNNNKNNNNNSSNNNNNNNNKPF

SEQ ID NO: 3312072 - protein, 12 aa, Plasmodium falciparum
FNNNNNNNNNSK

SEQ ID NO: 3312073 - protein, 30 aa, Plasmodium falciparum
FNNNNRDNKNKEKKMKSRTNKQDDRSQNNM

SEQ ID NO: 3312074 - protein, 8 aa, Plasmodium falciparum
FNNNNSTI

SEQ ID NO: 3312075 - protein, 11 aa, Plasmodium falciparum
FNNNSNKNFKA

SEQ ID NO: 3312076 - protein, 9 aa, Plasmodium falciparum
FNNNSRNTI

SEQ ID NO: 3312077 - protein, 8 aa, Plasmodium falciparum
FNNNVENT

SEQ ID NO: 3312078 - protein, 6 aa, Plasmodium falciparum
FNNPNN

SEQ ID NO: 3312079 - protein, 41 aa, Plasmodium falciparum
FNNQNKNHANSEYEQNIREEKNSTYKPMDDNTKEENKSDVP

SEQ ID NO: 3312080 - protein, 9 aa, Plasmodium falciparum
FNNSNNNIN

SEQ ID NO: 3312081 - protein, 19 aa, Plasmodium falciparum
FNNTKKNSVTDNLNNNGNV

SEQ ID NO: 3312082 - protein, 10 aa, Plasmodium falciparum
FNNTNDNNYN

SEQ ID NO: 3312083 - protein, 18 aa, Plasmodium falciparum
FNNTSDDISSHSSVNKKE

SEQ ID NO: 3312084 - protein, 19 aa, Plasmodium falciparum
FNNTSNTNHMDNTNHTNHM

SEQ ID NO: 3312085 - protein, 13 aa, Plasmodium falciparum
FNNYGEKNNSIFP

SEQ ID NO: 3312086 - protein, 9 aa, Plasmodium falciparum
FNPNDNINN

SEQ ID NO: 3312087 - protein, 22 aa, Plasmodium falciparum
FNPNDNKKKNSYNNNNNNNNNN

SEQ ID NO: 3312088 - protein, 6 aa, Plasmodium falciparum
FNPQSV

SEQ ID NO: 3312089 - protein, 11 aa, Plasmodium falciparum
FNPTKKMKNQP

SEQ ID NO: 3312090 - protein, 12 aa, Plasmodium falciparum
FNPTYKNSTPVV

SEQ ID NO: 3312091 - protein, 15 aa, Plasmodium falciparum
FNPYPNNNITTNDEY

SEQ ID NO: 3312092 - protein, 7 aa, Plasmodium falciparum
FNPYTEP

SEQ ID NO: 3312093 - protein, 10 aa, Plasmodium falciparum
FNQENNVKPY

SEQ ID NO: 3312094 - protein, 7 aa, Plasmodium falciparum
FNQPNQE

SEQ ID NO: 3312095 - protein, 4 aa, Plasmodium falciparum
FNQS

SEQ ID NO: 3312096 - protein, 5 aa, Plasmodium falciparum
FNRGG

SEQ ID NO: 3312097 - protein, 4 aa, Plasmodium falciparum
FNRN

SEQ ID NO: 3312098 - protein, 22 aa, Plasmodium falciparum
FNSDKKDDLKDRLKNTKESIDC

SEQ ID NO: 3312099 - protein, 52 aa, Plasmodium falciparum
FNSEKDDAKKKNDNTSERDNSNDWKGSEQRKEEEDEEVEKEKENEEEEEAIY

SEQ ID NO: 3312100 - protein, 7 aa, Plasmodium falciparum
FNSESGS

SEQ ID NO: 3312101 - protein, 11 aa, Plasmodium falciparum
FNSHDKNITNP

SEQ ID NO: 3312102 - protein, 8 aa, Plasmodium falciparum
FNSKENPN

SEQ ID NO: 3312103 - protein, 22 aa, Plasmodium falciparum
FNSKEYDKTSDCDKNNTPLKNG

SEQ ID NO: 3312104 - protein, 11 aa, Plasmodium falciparum
FNSKNQSKQIN

SEQ ID NO: 3312105 - protein, 5 aa, Plasmodium falciparum
FNSKS

SEQ ID NO: 3312106 - protein, 5 aa, Plasmodium falciparum
FNSLN

SEQ ID NO: 3312107 - protein, 6 aa, Plasmodium falciparum
FNSNED

SEQ ID NO: 3312108 - protein, 5 aa, Plasmodium falciparum
FNSQE

SEQ ID NO: 3312109 - protein, 18 aa, Plasmodium falciparum
FNSSDNIYNEDKNEHVDG

SEQ ID NO: 3312110 - protein, 15 aa, Plasmodium falciparum
FNSSKSSVIENTSKN

SEQ ID NO: 3312111 - protein, 9 aa, Plasmodium falciparum
FNSTNVKRR

SEQ ID NO: 3312112 - protein, 12 aa, Plasmodium falciparum
FNSYANKNTMEN

SEQ ID NO: 3312113 - protein, 4 aa, Plasmodium falciparum
FNTN

SEQ ID NO: 3312114 - protein, 15 aa, Plasmodium falciparum
FNTYGKSEASENLSK

SEQ ID NO: 3312115 - protein, 12 aa, Plasmodium falciparum
FNVEKNNKNLIL

SEQ ID NO: 3312116 - protein, 9 aa, Plasmodium falciparum
FNYEENQNK

SEQ ID NO: 3312117 - protein, 14 aa, Plasmodium falciparum
FNYPTSIKGKDKKV

SEQ ID NO: 3312118 - protein, 7 aa, Plasmodium falciparum
FPDKEKD

SEQ ID NO: 3312119 - protein, 5 aa, Plasmodium falciparum
FPDKK

SEQ ID NO: 3312120 - protein, 20 aa, Plasmodium falciparum
FPDKNNTDKYESNTLKQENK

SEQ ID NO: 3312121 - protein, 5 aa, Plasmodium falciparum
FPDLS

SEQ ID NO: 3312122 - protein, 5 aa, Plasmodium falciparum
FPEET

SEQ ID NO: 3312123 - protein, 4 aa, Plasmodium falciparum
FPEH

SEQ ID NO: 3312124 - protein, 6 aa, Plasmodium falciparum
FPEPTA

SEQ ID NO: 3312125 - protein, 9 aa, Plasmodium falciparum
FPESSEVNY

SEQ ID NO: 3312126 - protein, 8 aa, Plasmodium falciparum
FPHKKEKN

SEQ ID NO: 3312127 - protein, 4 aa, Plasmodium falciparum
FPHP

SEQ ID NO: 3312128 - protein, 10 aa, Plasmodium falciparum
FPKKASPALK

SEQ ID NO: 3312129 - protein, 5 aa, Plasmodium falciparum
FPKKE

SEQ ID NO: 3312130 - protein, 5 aa, Plasmodium falciparum
FPKNL

SEQ ID NO: 3312131 - protein, 8 aa, Plasmodium falciparum
FPLSGEND

SEQ ID NO: 3312132 - protein, 11 aa, Plasmodium falciparum
FPNDNKSTKQD

SEQ ID NO: 3312133 - protein, 4 aa, Plasmodium falciparum
FPNE

SEQ ID NO: 3312134 - protein, 5 aa, Plasmodium falciparum
FPNEN

SEQ ID NO: 3312135 - protein, 9 aa, Plasmodium falciparum
FPNPEEKGA

SEQ ID NO: 3312136 - protein, 10 aa, Plasmodium falciparum
FPNTQTKNEN

SEQ ID NO: 3312137 - protein, 4 aa, Plasmodium falciparum
FPPD

SEQ ID NO: 3312138 - protein, 7 aa, Plasmodium falciparum
FPPEPSG

SEQ ID NO: 3312139 - protein, 6 aa, Plasmodium falciparum
FPPKKE

SEQ ID NO: 3312140 - protein, 5 aa, Plasmodium falciparum
FPPNV

SEQ ID NO: 3312141 - protein, 31 aa, Plasmodium falciparum
FPQNEKEITDKTLKKKRNNYSYKKPKNVKDS

SEQ ID NO: 3312142 - protein, 9 aa, Plasmodium falciparum
FPQPTAQNA

SEQ ID NO: 3312143 - protein, 8 aa, Plasmodium falciparum
FPQTNKQN

SEQ ID NO: 3312144 - protein, 5 aa, Plasmodium falciparum
FPSDN

SEQ ID NO: 3312145 - protein, 8 aa, Plasmodium falciparum
FPSDPDTL

SEQ ID NO: 3312146 - protein, 5 aa, Plasmodium falciparum
FPSGQ

SEQ ID NO: 3312147 - protein, 4 aa, Plasmodium falciparum
FPSN

SEQ ID NO: 3312148 - protein, 9 aa, Plasmodium falciparum
FPSNEGNYE

SEQ ID NO: 3312149 - protein, 6 aa, Plasmodium falciparum
FPSNRN

SEQ ID NO: 3312150 - protein, 6 aa, Plasmodium falciparum
FPSTNY

SEQ ID NO: 3312151 - protein, 9 aa, Plasmodium falciparum
FPSTSGGNN

SEQ ID NO: 3312152 - protein, 5 aa, Plasmodium falciparum
FPTDV

SEQ ID NO: 3312153 - protein, 4 aa, Plasmodium falciparum
FPTE

SEQ ID NO: 3312154 - protein, 4 aa, Plasmodium falciparum
FPYE

SEQ ID NO: 3312155 - protein, 4 aa, Plasmodium falciparum
FQAN

SEQ ID NO: 3312156 - protein, 14 aa, Plasmodium falciparum
FQDKPKSLKNKKDT

SEQ ID NO: 3312157 - protein, 9 aa, Plasmodium falciparum
FQDQNYNNN

SEQ ID NO: 3312158 - protein, 8 aa, Plasmodium falciparum
FQDYRTKR

SEQ ID NO: 3312159 - protein, 7 aa, Plasmodium falciparum
FQGGGAY

SEQ ID NO: 3312160 - protein, 8 aa, Plasmodium falciparum
FQGNGKGY

SEQ ID NO: 3312161 - protein, 4 aa, Plasmodium falciparum
FQGR

SEQ ID NO: 3312162 - protein, 5 aa, Plasmodium falciparum
FQGRE

SEQ ID NO: 3312163 - protein, 7 aa, Plasmodium falciparum
FQKEKKE

SEQ ID NO: 3312164 - protein, 12 aa, Plasmodium falciparum
FQKESNVKPDMP

SEQ ID NO: 3312165 - protein, 28 aa, Plasmodium falciparum
FQKGKQKKKQMQKKKQMQKKKQIQEQIQ

SEQ ID NO: 3312166 - protein, 8 aa, Plasmodium falciparum
FQKKNEAL

SEQ ID NO: 3312167 - protein, 5 aa, Plasmodium falciparum
FQNDL

SEQ ID NO: 3312168 - protein, 9 aa, Plasmodium falciparum
FQNDNANVP

SEQ ID NO: 3312169 - protein, 6 aa, Plasmodium falciparum
FQNSKG

SEQ ID NO: 3312170 - protein, 15 aa, Plasmodium falciparum
FQNSTIGAHEKNDMS

SEQ ID NO: 3312171 - protein, 8 aa, Plasmodium falciparum
FQNTNDEN

SEQ ID NO: 3312172 - protein, 8 aa, Plasmodium falciparum
FQTNEEQI

SEQ ID NO: 3312173 - protein, 7 aa, Plasmodium falciparum
FQTSEEK

SEQ ID NO: 3312174 - protein, 34 aa, Plasmodium falciparum
FRGGRDGGYRGGNRGGSRSGFRGGRGGFRGGRAL

SEQ ID NO: 3312175 - protein, 5 aa, Plasmodium falciparum
FRGRS

SEQ ID NO: 3312176 - protein, 6 aa, Plasmodium falciparum
FRGRSK

SEQ ID NO: 3312177 - protein, 6 aa, Plasmodium falciparum
FRGRTG

SEQ ID NO: 3312178 - protein, 18 aa, Plasmodium falciparum
FRKNSKAKKNKKKRSTSH

SEQ ID NO: 3312179 - protein, 9 aa, Plasmodium falciparum
FRNDKEEIK

SEQ ID NO: 3312180 - protein, 4 aa, Plasmodium falciparum
FRPG

SEQ ID NO: 3312181 - protein, 8 aa, Plasmodium falciparum
FRPNNRNQ

SEQ ID NO: 3312182 - protein, 8 aa, Plasmodium falciparum
FRSDPENR

SEQ ID NO: 3312183 - protein, 5 aa, Plasmodium falciparum
FSAQS

SEQ ID NO: 3312184 - protein, 9 aa, Plasmodium falciparum
FSCEDDKGT

SEQ ID NO: 3312185 - protein, 11 aa, Plasmodium falciparum
FSDDDESEESF

SEQ ID NO: 3312186 - protein, 31 aa, Plasmodium falciparum
FSDDEKDDSYEREKQVYSGSETQNAENEYSK

SEQ ID NO: 3312187 - protein, 9 aa, Plasmodium falciparum
FSDDEYKNK

SEQ ID NO: 3312188 - protein, 9 aa, Plasmodium falciparum
FSDEDSEKN

SEQ ID NO: 3312189 - protein, 25 aa, Plasmodium falciparum
FSDEEGMKMDNDNKIDDNTLNNNKI

SEQ ID NO: 3312190 - protein, 9 aa, Plasmodium falciparum
FSDEKKNDC

SEQ ID NO: 3312191 - protein, 6 aa, Plasmodium falciparum
FSDEQK

SEQ ID NO: 3312192 - protein, 17 aa, Plasmodium falciparum
FSDKYTDKNDNKYYNNN

SEQ ID NO: 3312193 - protein, 9 aa, Plasmodium falciparum
FSDNEDDKE

SEQ ID NO: 3312194 - protein, 5 aa, Plasmodium falciparum
FSDPN

SEQ ID NO: 3312195 - protein, 9 aa, Plasmodium falciparum
FSDPNTSVK

SEQ ID NO: 3312196 - protein, 4 aa, Plasmodium falciparum
FSDS

SEQ ID NO: 3312197 - protein, 8 aa, Plasmodium falciparum
FSDTEKEN

SEQ ID NO: 3312198 - protein, 4 aa, Plasmodium falciparum
FSED

SEQ ID NO: 3312199 - protein, 18 aa, Plasmodium falciparum
FSEDTQQKFNDDKDTCNK

SEQ ID NO: 3312200 - protein, 21 aa, Plasmodium falciparum
FSEGSKESTITNNSKRDKKTC

SEQ ID NO: 3312201 - protein, 4 aa, Plasmodium falciparum
FSEK

SEQ ID NO: 3312202 - protein, 5 aa, Plasmodium falciparum
FSEND

SEQ ID NO: 3312203 - protein, 9 aa, Plasmodium falciparum
FSENKEKKE

SEQ ID NO: 3312204 - protein, 7 aa, Plasmodium falciparum
FSENPSS

SEQ ID NO: 3312205 - protein, 6 aa, Plasmodium falciparum
FSEPQR

SEQ ID NO: 3312206 - protein, 6 aa, Plasmodium falciparum
FSEPTA

SEQ ID NO: 3312207 - protein, 6 aa, Plasmodium falciparum
FSESNE

SEQ ID NO: 3312208 - protein, 5 aa, Plasmodium falciparum
FSETD

SEQ ID NO: 3312209 - protein, 8 aa, Plasmodium falciparum
FSGGKQHP

SEQ ID NO: 3312210 - protein, 5 aa, Plasmodium falciparum
FSGKE

SEQ ID NO: 3312211 - protein, 18 aa, Plasmodium falciparum
FSGKNKSHGTESKAHRSL

SEQ ID NO: 3312212 - protein, 5 aa, Plasmodium falciparum
FSGPQ

SEQ ID NO: 3312213 - protein, 19 aa, Plasmodium falciparum
FSGRSGGLKRKKKRKEERI

SEQ ID NO: 3312214 - protein, 14 aa, Plasmodium falciparum
FSHKENSQNKRDDQ

SEQ ID NO: 3312215 - protein, 6 aa, Plasmodium falciparum
FSKAKN

SEQ ID NO: 3312216 - protein, 39 aa, Plasmodium falciparum
FSKDDDSEYKEIKRKNKDNANKKESSNYKKKKEDKYNKR

SEQ ID NO: 3312217 - protein, 26 aa, Plasmodium falciparum
FSKEGEQQKDDAIKSNETYEEENEEI

SEQ ID NO: 3312218 - protein, 12 aa, Plasmodium falciparum
FSKEQNNTTNSL

SEQ ID NO: 3312219 - protein, 7 aa, Plasmodium falciparum
FSKKEYS

SEQ ID NO: 3312220 - protein, 9 aa, Plasmodium falciparum
FSKKRKHYD

SEQ ID NO: 3312221 - protein, 6 aa, Plasmodium falciparum
FSKNEL

SEQ ID NO: 3312222 - protein, 18 aa, Plasmodium falciparum
FSKNNSQSINDSQNKYNT

SEQ ID NO: 3312223 - protein, 7 aa, Plasmodium falciparum
FSKPPHN

SEQ ID NO: 3312224 - protein, 16 aa, Plasmodium falciparum
FSKPTSSNDNSSVGRI

SEQ ID NO: 3312225 - protein, 9 aa, Plasmodium falciparum
FSKQKKRKA

SEQ ID NO: 3312226 - protein, 8 aa, Plasmodium falciparum
FSLSDEKK

SEQ ID NO: 3312227 - protein, 14 aa, Plasmodium falciparum
FSNDKSNDKKTSPF

SEQ ID NO: 3312228 - protein, 5 aa, Plasmodium falciparum
FSNDN

SEQ ID NO: 3312229 - protein, 18 aa, Plasmodium falciparum
FSNEKNEGEQKKKNMKNY

SEQ ID NO: 3312230 - protein, 10 aa, Plasmodium falciparum
FSNEPSHGYV

SEQ ID NO: 3312231 - protein, 21 aa, Plasmodium falciparum
FSNGTLNKNKKTGIDNNEQFN

SEQ ID NO: 3312232 - protein, 4 aa, Plasmodium falciparum
FSNK

SEQ ID NO: 3312233 - protein, 16 aa, Plasmodium falciparum
FSNKAENNNNSTYTNK

SEQ ID NO: 3312234 - protein, 8 aa, Plasmodium falciparum
FSNKSKQW

SEQ ID NO: 3312235 - protein, 7 aa, Plasmodium falciparum
FSNNPAN

SEQ ID NO: 3312236 - protein, 10 aa, Plasmodium falciparum
FSNNSNMTEN

SEQ ID NO: 3312237 - protein, 6 aa, Plasmodium falciparum
FSNPDR

SEQ ID NO: 3312238 - protein, 15 aa, Plasmodium falciparum
FSNPQGQNNISSYNP

SEQ ID NO: 3312239 - protein, 11 aa, Plasmodium falciparum
FSNQYDNKKNL

SEQ ID NO: 3312240 - protein, 4 aa, Plasmodium falciparum
FSNR

SEQ ID NO: 3312241 - protein, 29 aa, Plasmodium falciparum
FSNSADDKNNGVIPEQRTQYSGTNEYKDF

SEQ ID NO: 3312242 - protein, 12 aa, Plasmodium falciparum
FSNSSNNNNCDN

SEQ ID NO: 3312243 - protein, 7 aa, Plasmodium falciparum
FSNTSEN

SEQ ID NO: 3312244 - protein, 5 aa, Plasmodium falciparum
FSPDN

SEQ ID NO: 3312245 - protein, 5 aa, Plasmodium falciparum
FSPEG

SEQ ID NO: 3312246 - protein, 4 aa, Plasmodium falciparum
FSPF

SEQ ID NO: 3312247 - protein, 7 aa, Plasmodium falciparum
FSPSTSV

SEQ ID NO: 3312248 - protein, 5 aa, Plasmodium falciparum
FSPTG

SEQ ID NO: 3312249 - protein, 11 aa, Plasmodium falciparum
FSQGTSADREI

SEQ ID NO: 3312250 - protein, 9 aa, Plasmodium falciparum
FSQNEEKKN

SEQ ID NO: 3312251 - protein, 12 aa, Plasmodium falciparum
FSQSSRDKITQV

SEQ ID NO: 3312252 - protein, 9 aa, Plasmodium falciparum
FSQSTNKKI

SEQ ID NO: 3312253 - protein, 21 aa, Plasmodium falciparum
FSRKNNDGFYRNNDNNYNNET

SEQ ID NO: 3312254 - protein, 5 aa, Plasmodium falciparum
FSRQD

SEQ ID NO: 3312255 - protein, 19 aa, Plasmodium falciparum
FSRTSKTDSFIDESDDGIY

SEQ ID NO: 3312256 - protein, 8 aa, Plasmodium falciparum
FSSDDNTK

SEQ ID NO: 3312257 - protein, 11 aa, Plasmodium falciparum
FSSDENSNNDN

SEQ ID NO: 3312258 - protein, 17 aa, Plasmodium falciparum
FSSDSNSNLLSDTTQNV

SEQ ID NO: 3312259 - protein, 5 aa, Plasmodium falciparum
FSSEE

SEQ ID NO: 3312260 - protein, 9 aa, Plasmodium falciparum
FSSESGKLE

SEQ ID NO: 3312261 - protein, 7 aa, Plasmodium falciparum
FSSGSKR

SEQ ID NO: 3312262 - protein, 10 aa, Plasmodium falciparum
FSSGSMKSGN

SEQ ID NO: 3312263 - protein, 5 aa, Plasmodium falciparum
FSSNE

SEQ ID NO: 3312264 - protein, 18 aa, Plasmodium falciparum
FSSNKKKKYDLTKKHGKD

SEQ ID NO: 3312265 - protein, 10 aa, Plasmodium falciparum
FSSNKTNEVS

SEQ ID NO: 3312266 - protein, 5 aa, Plasmodium falciparum
FSSNN

SEQ ID NO: 3312267 - protein, 10 aa, Plasmodium falciparum
FSSNNERERS

SEQ ID NO: 3312268 - protein, 9 aa, Plasmodium falciparum
FSSNNNMES

SEQ ID NO: 3312269 - protein, 6 aa, Plasmodium falciparum
FSSNQK

SEQ ID NO: 3312270 - protein, 18 aa, Plasmodium falciparum
FSSREEKTLNTKNQKKEN

SEQ ID NO: 3312271 - protein, 9 aa, Plasmodium falciparum
FSSRHGQKG

SEQ ID NO: 3312272 - protein, 6 aa, Plasmodium falciparum
FSSRTM

SEQ ID NO: 3312273 - protein, 4 aa, Plasmodium falciparum
FSSS

SEQ ID NO: 3312274 - protein, 10 aa, Plasmodium falciparum
FSSSESEYEE

SEQ ID NO: 3312275 - protein, 5 aa, Plasmodium falciparum
FSSSH

SEQ ID NO: 3312276 - protein, 18 aa, Plasmodium falciparum
FSSSNNQNNNNNNNNNND

SEQ ID NO: 3312277 - protein, 7 aa, Plasmodium falciparum
FSSSPQK

SEQ ID NO: 3312278 - protein, 20 aa, Plasmodium falciparum
FSSSSSMDDDDDDNNNNNNV

SEQ ID NO: 3312279 - protein, 5 aa, Plasmodium falciparum
FSSTC

SEQ ID NO: 3312280 - protein, 5 aa, Plasmodium falciparum
FSTDD

SEQ ID NO: 3312281 - protein, 7 aa, Plasmodium falciparum
FSTGKRG

SEQ ID NO: 3312282 - protein, 6 aa, Plasmodium falciparum
FSTGRR

SEQ ID NO: 3312283 - protein, 11 aa, Plasmodium falciparum
FSTKEPSTPMR

SEQ ID NO: 3312284 - protein, 11 aa, Plasmodium falciparum
FSTQHGQYDKS

SEQ ID NO: 3312285 - protein, 8 aa, Plasmodium falciparum
FSTSAEKE

SEQ ID NO: 3312286 - protein, 17 aa, Plasmodium falciparum
FSTSKMSDNAHYKGEDM

SEQ ID NO: 3312287 - protein, 7 aa, Plasmodium falciparum
FSTTSSD

SEQ ID NO: 3312288 - protein, 6 aa, Plasmodium falciparum
FSVSKG

SEQ ID NO: 3312289 - protein, 15 aa, Plasmodium falciparum
FSYDGYDDKYSYDQN

SEQ ID NO: 3312290 - protein, 4 aa, Plasmodium falciparum
FSYG

SEQ ID NO: 3312291 - protein, 4 aa, Plasmodium falciparum
FSYK

SEQ ID NO: 3312292 - protein, 4 aa, Plasmodium falciparum
FTAQ

SEQ ID NO: 3312293 - protein, 6 aa, Plasmodium falciparum
FTDDTQ

SEQ ID NO: 3312294 - protein, 4 aa, Plasmodium falciparum
FTEE

SEQ ID NO: 3312295 - protein, 9 aa, Plasmodium falciparum
FTERPGFTE

SEQ ID NO: 3312296 - protein, 5 aa, Plasmodium falciparum
FTGEA

SEQ ID NO: 3312297 - protein, 12 aa, Plasmodium falciparum
FTGEENQEVEPS

SEQ ID NO: 3312298 - protein, 5 aa, Plasmodium falciparum
FTGTP

SEQ ID NO: 3312299 - protein, 4 aa, Plasmodium falciparum
FTKD

SEQ ID NO: 3312300 - protein, 7 aa, Plasmodium falciparum
FTKEDPT

SEQ ID NO: 3312301 - protein, 4 aa, Plasmodium falciparum
FTKQ

SEQ ID NO: 3312302 - protein, 6 aa, Plasmodium falciparum
FTKSRK

SEQ ID NO: 3312303 - protein, 7 aa, Plasmodium falciparum
FTNDEKK

SEQ ID NO: 3312304 - protein, 7 aa, Plasmodium falciparum
FTNDKEK

SEQ ID NO: 3312305 - protein, 12 aa, Plasmodium falciparum
FTNEYKSNNVNT

SEQ ID NO: 3312306 - protein, 45 aa, Plasmodium falciparum
FTNFSSSSSFNMSNNNNNNNNNSNNNNNNNNNNNYNNNNNNNNHT

SEQ ID NO: 3312307 - protein, 26 aa, Plasmodium falciparum
FTNNNNNNDNNNNNNNNNNSDGHYDD

SEQ ID NO: 3312308 - protein, 4 aa, Plasmodium falciparum
FTNQ

SEQ ID NO: 3312309 - protein, 8 aa, Plasmodium falciparum
FTPDTNNY

SEQ ID NO: 3312310 - protein, 12 aa, Plasmodium falciparum
FTPNFEKKTGSI

SEQ ID NO: 3312311 - protein, 6 aa, Plasmodium falciparum
FTQEDN

SEQ ID NO: 3312312 - protein, 5 aa, Plasmodium falciparum
FTQKQ

SEQ ID NO: 3312313 - protein, 26 aa, Plasmodium falciparum
FTQNNNDNMNTNEDNNNNNNNNNNGV

SEQ ID NO: 3312314 - protein, 25 aa, Plasmodium falciparum
FTSDQSANYFSEDEEEDDDDYYDDD

SEQ ID NO: 3312315 - protein, 19 aa, Plasmodium falciparum
FTSEKNQKINDEENNSKEL

SEQ ID NO: 3312316 - protein, 4 aa, Plasmodium falciparum
FTSN

SEQ ID NO: 3312317 - protein, 15 aa, Plasmodium falciparum
FTSNDDEEQRKSYDK

SEQ ID NO: 3312318 - protein, 6 aa, Plasmodium falciparum
FTSNYE

SEQ ID NO: 3312319 - protein, 14 aa, Plasmodium falciparum
FTSPSGKRRGGKYT

SEQ ID NO: 3312320 - protein, 6 aa, Plasmodium falciparum
FTSTQE

SEQ ID NO: 3312321 - protein, 11 aa, Plasmodium falciparum
FTTKDNKRETY

SEQ ID NO: 3312322 - protein, 4 aa, Plasmodium falciparum
FTTL

SEQ ID NO: 3312323 - protein, 5 aa, Plasmodium falciparum
FTTTA

SEQ ID NO: 3312324 - protein, 4 aa, Plasmodium falciparum
FVNS

SEQ ID NO: 3312325 - protein, 5 aa, Plasmodium falciparum
FVTSA

SEQ ID NO: 3312326 - protein, 4 aa, Plasmodium falciparum
FYDS

SEQ ID NO: 3312327 - protein, 6 aa, Plasmodium falciparum
FYGDEN

SEQ ID NO: 3312328 - protein, 4 aa, Plasmodium falciparum
FYKS

SEQ ID NO: 3312329 - protein, 7 aa, Plasmodium falciparum
FYNDRKD

SEQ ID NO: 3312330 - protein, 9 aa, Plasmodium falciparum
FYNSENKTY

SEQ ID NO: 3312331 - protein, 13 aa, Plasmodium falciparum
FYNTTKKKGYSFS

SEQ ID NO: 3312332 - protein, 25 aa, Plasmodium falciparum
FYRNKPSSNIINNDDDKKKKMVPSK

SEQ ID NO: 3312333 - protein, 6 aa, Plasmodium falciparum
GAAANK

SEQ ID NO: 3312334 - protein, 7 aa, Plasmodium falciparum
GADNINN

SEQ ID NO: 3312335 - protein, 6 aa, Plasmodium falciparum
GADPNY

SEQ ID NO: 3312336 - protein, 6 aa, Plasmodium falciparum
GADPSY

SEQ ID NO: 3312337 - protein, 4 aa, Plasmodium falciparum
GADT

SEQ ID NO: 3312338 - protein, 9 aa, Plasmodium falciparum
GAESGPTIE

SEQ ID NO: 3312339 - protein, 7 aa, Plasmodium falciparum
GAGDMGN

SEQ ID NO: 3312340 - protein, 7 aa, Plasmodium falciparum
GAGDNSN

SEQ ID NO: 3312341 - protein, 7 aa, Plasmodium falciparum
GAGEKPC

SEQ ID NO: 3312342 - protein, 11 aa, Plasmodium falciparum
GAGISGQSVHQ

SEQ ID NO: 3312343 - protein, 25 aa, Plasmodium falciparum
GAGNGYIPSGRTNNTNENQAPRTIE

SEQ ID NO: 3312344 - protein, 8 aa, Plasmodium falciparum
GAGQNDMP

SEQ ID NO: 3312345 - protein, 15 aa, Plasmodium falciparum
GAGRALSRNKSRNTL

SEQ ID NO: 3312346 - protein, 5 aa, Plasmodium falciparum
GAGSI

SEQ ID NO: 3312347 - protein, 5 aa, Plasmodium falciparum
GAGTT

SEQ ID NO: 3312348 - protein, 19 aa, Plasmodium falciparum
GAHGGGAFSGKDASKVDRS

SEQ ID NO: 3312349 - protein, 11 aa, Plasmodium falciparum
GAHTPKERITN

SEQ ID NO: 3312350 - protein, 8 aa, Plasmodium falciparum
GAKDGFGQ

SEQ ID NO: 3312351 - protein, 11 aa, Plasmodium falciparum
GAKDGKGRGKQ

SEQ ID NO: 3312352 - protein, 6 aa, Plasmodium falciparum
GAKEGD

SEQ ID NO: 3312353 - protein, 6 aa, Plasmodium falciparum
GAKGNI

SEQ ID NO: 3312354 - protein, 7 aa, Plasmodium falciparum
GAKGTGK

SEQ ID NO: 3312355 - protein, 22 aa, Plasmodium falciparum
GAKKKKKKVYKKPKKEKHKKKK

SEQ ID NO: 3312356 - protein, 16 aa, Plasmodium falciparum
GAKNPSIIESQNSPRN

SEQ ID NO: 3312357 - protein, 8 aa, Plasmodium falciparum
GAKNQVKG

SEQ ID NO: 3312358 - protein, 5 aa, Plasmodium falciparum
GANAR

SEQ ID NO: 3312359 - protein, 7 aa, Plasmodium falciparum
GANATNN

SEQ ID NO: 3312360 - protein, 45 aa, Plasmodium falciparum
GANDEYKYEDGDNLERKKRSSKKDKKKKKNKLKEKKNKRKRKRRK

SEQ ID NO: 3312361 - protein, 52 aa, Plasmodium falciparum
GANEREDDSTNRNYNNGKSSNEEENEGTPADNEDENDDSNNSNNSNQEQKEK

SEQ ID NO: 3312362 - protein, 9 aa, Plasmodium falciparum
GANNPYPSS

SEQ ID NO: 3312363 - protein, 6 aa, Plasmodium falciparum
GANPNL

SEQ ID NO: 3312364 - protein, 4 aa, Plasmodium falciparum
GANR

SEQ ID NO: 3312365 - protein, 7 aa, Plasmodium falciparum
GANTSFR

SEQ ID NO: 3312366 - protein, 16 aa, Plasmodium falciparum
GAPAGPAGTGKTETVK

SEQ ID NO: 3312367 - protein, 9 aa, Plasmodium falciparum
GAPDTEGSI

SEQ ID NO: 3312368 - protein, 9 aa, Plasmodium falciparum
GAPNVGTTY

SEQ ID NO: 3312369 - protein, 6 aa, Plasmodium falciparum
GAPQKR

SEQ ID NO: 3312370 - protein, 15 aa, Plasmodium falciparum
GAPTNDEKYNNNNNN

SEQ ID NO: 3312371 - protein, 6 aa, Plasmodium falciparum
GAPTTK

SEQ ID NO: 3312372 - protein, 9 aa, Plasmodium falciparum
GAQEDKGEI

SEQ ID NO: 3312373 - protein, 9 aa, Plasmodium falciparum
GAQKNNDSL

SEQ ID NO: 3312374 - protein, 6 aa, Plasmodium falciparum
GAQSSI

SEQ ID NO: 3312375 - protein, 6 aa, Plasmodium falciparum
GARDIK

SEQ ID NO: 3312376 - protein, 14 aa, Plasmodium falciparum
GARRREKKNMQREM

SEQ ID NO: 3312377 - protein, 7 aa, Plasmodium falciparum
GASAHSQ

SEQ ID NO: 3312378 - protein, 35 aa, Plasmodium falciparum
GASAQEPQKAEATNLRGRNSENKEAQNNGPTVEEV

SEQ ID NO: 3312379 - protein, 10 aa, Plasmodium falciparum
GASDRQRDDD

SEQ ID NO: 3312380 - protein, 10 aa, Plasmodium falciparum
GASEGRGRGR

SEQ ID NO: 3312381 - protein, 5 aa, Plasmodium falciparum
GASID

SEQ ID NO: 3312382 - protein, 8 aa, Plasmodium falciparum
GASIDGAS

SEQ ID NO: 3312383 - protein, 7 aa, Plasmodium falciparum
GASMQSA

SEQ ID NO: 3312384 - protein, 7 aa, Plasmodium falciparum
GASNEKH

SEQ ID NO: 3312385 - protein, 32 aa, Plasmodium falciparum
GASNNKEAGIRNKKNKKKNNNRKSDINENEES

SEQ ID NO: 3312386 - protein, 5 aa, Plasmodium falciparum
GASPS

SEQ ID NO: 3312387 - protein, 11 aa, Plasmodium falciparum
GASSASNSLSH

SEQ ID NO: 3312388 - protein, 7 aa, Plasmodium falciparum
GASTGRL

SEQ ID NO: 3312389 - protein, 6 aa, Plasmodium falciparum
GASTTL

SEQ ID NO: 3312390 - protein, 7 aa, Plasmodium falciparum
GATESNN

SEQ ID NO: 3312391 - protein, 11 aa, Plasmodium falciparum
GATNIGNGKNK

SEQ ID NO: 3312392 - protein, 16 aa, Plasmodium falciparum
GATRSFSNTKSFNEQN

SEQ ID NO: 3312393 - protein, 6 aa, Plasmodium falciparum
GATTTI

SEQ ID NO: 3312394 - protein, 11 aa, Plasmodium falciparum
GAVRTNPVSSE

SEQ ID NO: 3312395 - protein, 46 aa, Plasmodium falciparum
GCDDTKSDDSKDKNINTKRTTSPKHYTTTNNNDDDANNDSSCTSNN

SEQ ID NO: 3312396 - protein, 5 aa, Plasmodium falciparum
GCEEA

SEQ ID NO: 3312397 - protein, 5 aa, Plasmodium falciparum
GCEEM

SEQ ID NO: 3312398 - protein, 14 aa, Plasmodium falciparum
GCEKSTADARASDK

SEQ ID NO: 3312399 - protein, 5 aa, Plasmodium falciparum
GCESV

SEQ ID NO: 3312400 - protein, 5 aa, Plasmodium falciparum
GCGKS

SEQ ID NO: 3312401 - protein, 5 aa, Plasmodium falciparum
GCGKT

SEQ ID NO: 3312402 - protein, 10 aa, Plasmodium falciparum
GCGNNDIPKR

SEQ ID NO: 3312403 - protein, 4 aa, Plasmodium falciparum
GCGT

SEQ ID NO: 3312404 - protein, 8 aa, Plasmodium falciparum
GCKGNNSI

SEQ ID NO: 3312405 - protein, 7 aa, Plasmodium falciparum
GCKQNTS

SEQ ID NO: 3312406 - protein, 11 aa, Plasmodium falciparum
GCNKSDDSSMI

SEQ ID NO: 3312407 - protein, 10 aa, Plasmodium falciparum
GCRKKNDPFT

SEQ ID NO: 3312408 - protein, 11 aa, Plasmodium falciparum
GCTKKSSIEKN

SEQ ID NO: 3312409 - protein, 19 aa, Plasmodium falciparum
GDAASGDVEAADVEGAGVE

SEQ ID NO: 3312410 - protein, 10 aa, Plasmodium falciparum
GDANTQGIDP

SEQ ID NO: 3312411 - protein, 9 aa, Plasmodium falciparum
GDASQDVNN

SEQ ID NO: 3312412 - protein, 106 aa, Plasmodium falciparum
GDDDKKKKSTSKSRKHSKHSDADDNRYDKGYRKYRKSSSSYKSFKRDKRKSTNSSNDKDIDEEDYNSGVSSIDNNDNSDTYISSSKYNSNNMSSRTSKNKDETYEI

SEQ ID NO: 3312413 - protein, 45 aa, Plasmodium falciparum
GDDFEDDGNGNNNNNNNNNNNNNSNNSNNNNNNNKDEVSDEGNKN

SEQ ID NO: 3312414 - protein, 85 aa, Plasmodium falciparum
GDDGGDGNEEEENEENNNNEDKDNNENDEEGDVQGEGEGEGEGDEEKTADTDKEKPKKSSTSTQKKKGSVSSTISKKSVKKSNKV

SEQ ID NO: 3312415 - protein, 20 aa, Plasmodium falciparum
GDDKNKRDKSYTCSHKNNTN

SEQ ID NO: 3312416 - protein, 20 aa, Plasmodium falciparum
GDDKREDDVDSHDREGSLNK

SEQ ID NO: 3312417 - protein, 15 aa, Plasmodium falciparum
GDDNCTDINSKEQKD

SEQ ID NO: 3312418 - protein, 7 aa, Plasmodium falciparum
GDDNMEG

SEQ ID NO: 3312419 - protein, 11 aa, Plasmodium falciparum
GDDTESDNSFN

SEQ ID NO: 3312420 - protein, 6 aa, Plasmodium falciparum
GDDTSM

SEQ ID NO: 3312421 - protein, 9 aa, Plasmodium falciparum
GDEAQNKRG

SEQ ID NO: 3312422 - protein, 9 aa, Plasmodium falciparum
GDEAQTKRG

SEQ ID NO: 3312423 - protein, 10 aa, Plasmodium falciparum
GDEDKKSIKI

SEQ ID NO: 3312424 - protein, 7 aa, Plasmodium falciparum
GDEEDDI

SEQ ID NO: 3312425 - protein, 88 aa, Plasmodium falciparum
GDEEENKKESNNNDGDKGDHISDDKGDHMSDDKGDHKDDDKGDHMSDDKGDHKDDDKGDHMSDDKGDHKDDDKGDHMSDDKDKSNVNL

SEQ ID NO: 3312426 - protein, 7 aa, Plasmodium falciparum
GDEEQRK

SEQ ID NO: 3312427 - protein, 11 aa, Plasmodium falciparum
GDEGCGESIPG

SEQ ID NO: 3312428 - protein, 9 aa, Plasmodium falciparum
GDEKNKKIN

SEQ ID NO: 3312429 - protein, 9 aa, Plasmodium falciparum
GDEKTKDTL

SEQ ID NO: 3312430 - protein, 7 aa, Plasmodium falciparum
GDENKKT

SEQ ID NO: 3312431 - protein, 5 aa, Plasmodium falciparum
GDENM

SEQ ID NO: 3312432 - protein, 7 aa, Plasmodium falciparum
GDEPPFT

SEQ ID NO: 3312433 - protein, 5 aa, Plasmodium falciparum
GDETD

SEQ ID NO: 3312434 - protein, 4 aa, Plasmodium falciparum
GDFA

SEQ ID NO: 3312435 - protein, 7 aa, Plasmodium falciparum
GDFIKPN

SEQ ID NO: 3312436 - protein, 94 aa, Plasmodium falciparum
GDFPGGMPGGMPGGMPGGMPGGFPGGFPGGMPGGMPGGFPGGMPGGMPGGMPGGMPGGMPGGMPSGMPGGMPSGMPGGMPGGMPGGMPDLNSPE

SEQ ID NO: 3312437 - protein, 12 aa, Plasmodium falciparum
GDFPPNAEKGKS

SEQ ID NO: 3312438 - protein, 13 aa, Plasmodium falciparum
GDFSGSKNYGSYE

SEQ ID NO: 3312439 - protein, 6 aa, Plasmodium falciparum
GDGIHK

SEQ ID NO: 3312440 - protein, 16 aa, Plasmodium falciparum
GDGKAYKGTVESLKEN

SEQ ID NO: 3312441 - protein, 5 aa, Plasmodium falciparum
GDGNC

SEQ ID NO: 3312442 - protein, 9 aa, Plasmodium falciparum
GDGNDCEEA

SEQ ID NO: 3312443 - protein, 7 aa, Plasmodium falciparum
GDGNNIH

SEQ ID NO: 3312444 - protein, 5 aa, Plasmodium falciparum
GDGPK

SEQ ID NO: 3312445 - protein, 21 aa, Plasmodium falciparum
GDGSGTQALKRSKRSKSNSKY

SEQ ID NO: 3312446 - protein, 8 aa, Plasmodium falciparum
GDGSNSNA

SEQ ID NO: 3312447 - protein, 9 aa, Plasmodium falciparum
GDGSSSEGD

SEQ ID NO: 3312448 - protein, 4 aa, Plasmodium falciparum
GDGT

SEQ ID NO: 3312449 - protein, 5 aa, Plasmodium falciparum
GDGTY

SEQ ID NO: 3312450 - protein, 5 aa, Plasmodium falciparum
GDHQK

SEQ ID NO: 3312451 - protein, 8 aa, Plasmodium falciparum
GDHTNTGL

SEQ ID NO: 3312452 - protein, 9 aa, Plasmodium falciparum
GDIKNYSKG

SEQ ID NO: 3312453 - protein, 5 aa, Plasmodium falciparum
GDINN

SEQ ID NO: 3312454 - protein, 47 aa, Plasmodium falciparum
GDINNENKNNDNKNKNNDNKNKNNDNKNKNNDNKNKNNDNIHNNNHN

SEQ ID NO: 3312455 - protein, 4 aa, Plasmodium falciparum
GDIS

SEQ ID NO: 3312456 - protein, 28 aa, Plasmodium falciparum
GDITGKTNMTTNNFSNNTTNDEGYTNEE

SEQ ID NO: 3312457 - protein, 13 aa, Plasmodium falciparum
GDITNNNRNGGDV

SEQ ID NO: 3312458 - protein, 14 aa, Plasmodium falciparum
GDKDPSDSNLPQQP

SEQ ID NO: 3312459 - protein, 10 aa, Plasmodium falciparum
GDKDSHAEEE

SEQ ID NO: 3312460 - protein, 24 aa, Plasmodium falciparum
GDKEKIKKKEENDADNNTKQNLNE

SEQ ID NO: 3312461 - protein, 4 aa, Plasmodium falciparum
GDKG

SEQ ID NO: 3312462 - protein, 4 aa, Plasmodium falciparum
GDKI

SEQ ID NO: 3312463 - protein, 9 aa, Plasmodium falciparum
GDKIGEENH

SEQ ID NO: 3312464 - protein, 4 aa, Plasmodium falciparum
GDKK

SEQ ID NO: 3312465 - protein, 9 aa, Plasmodium falciparum
GDKKEQTND

SEQ ID NO: 3312466 - protein, 4 aa, Plasmodium falciparum
GDKM

SEQ ID NO: 3312467 - protein, 8 aa, Plasmodium falciparum
GDKNDKTF

SEQ ID NO: 3312468 - protein, 11 aa, Plasmodium falciparum
GDKPEDIKEDH

SEQ ID NO: 3312469 - protein, 9 aa, Plasmodium falciparum
GDKQQRERD

SEQ ID NO: 3312470 - protein, 4 aa, Plasmodium falciparum
GDKR

SEQ ID NO: 3312471 - protein, 7 aa, Plasmodium falciparum
GDKRNNV

SEQ ID NO: 3312472 - protein, 7 aa, Plasmodium falciparum
GDKYEGE

SEQ ID NO: 3312473 - protein, 10 aa, Plasmodium falciparum
GDKYNEKKDD

SEQ ID NO: 3312474 - protein, 11 aa, Plasmodium falciparum
GDLKKDGPSAG

SEQ ID NO: 3312475 - protein, 4 aa, Plasmodium falciparum
GDLN

SEQ ID NO: 3312476 - protein, 6 aa, Plasmodium falciparum
GDLQKQ

SEQ ID NO: 3312477 - protein, 7 aa, Plasmodium falciparum
GDMDRQA

SEQ ID NO: 3312478 - protein, 7 aa, Plasmodium falciparum
GDMHSQN

SEQ ID NO: 3312479 - protein, 5 aa, Plasmodium falciparum
GDMNP

SEQ ID NO: 3312480 - protein, 8 aa, Plasmodium falciparum
GDNDDMDD

SEQ ID NO: 3312481 - protein, 4 aa, Plasmodium falciparum
GDNE

SEQ ID NO: 3312482 - protein, 8 aa, Plasmodium falciparum
GDNETRKF

SEQ ID NO: 3312483 - protein, 7 aa, Plasmodium falciparum
GDNIGSS

SEQ ID NO: 3312484 - protein, 14 aa, Plasmodium falciparum
GDNIKKSKENKRVE

SEQ ID NO: 3312485 - protein, 12 aa, Plasmodium falciparum
GDNIKRDDNEYV

SEQ ID NO: 3312486 - protein, 41 aa, Plasmodium falciparum
GDNKNDNNNNNNNNNNNDGNNNATTINNNNNNNNNITNNSN

SEQ ID NO: 3312487 - protein, 26 aa, Plasmodium falciparum
GDNKVRNVKKQTNKYNNVDNNKNNYY

SEQ ID NO: 3312488 - protein, 24 aa, Plasmodium falciparum
GDNMENEKYQQNEQNDGSPKNVES

SEQ ID NO: 3312489 - protein, 19 aa, Plasmodium falciparum
GDNMSRDEFDDKRKLKEEK

SEQ ID NO: 3312490 - protein, 4 aa, Plasmodium falciparum
GDNN

SEQ ID NO: 3312491 - protein, 8 aa, Plasmodium falciparum
GDNNDLGT

SEQ ID NO: 3312492 - protein, 9 aa, Plasmodium falciparum
GDNNEDDDL

SEQ ID NO: 3312493 - protein, 5 aa, Plasmodium falciparum
GDNNI

SEQ ID NO: 3312494 - protein, 87 aa, Plasmodium falciparum
GDNNINGDNNINGDNNINGENNINGENNINGENNINGENNINGENNINGENNINGENNINGDNNINGDNKKNGDNNNNNMEEGDETK

SEQ ID NO: 3312495 - protein, 14 aa, Plasmodium falciparum
GDNNKKNIENDPNV

SEQ ID NO: 3312496 - protein, 17 aa, Plasmodium falciparum
GDNNKNDDKCDDKCDDK

SEQ ID NO: 3312497 - protein, 19 aa, Plasmodium falciparum
GDNNKNVTSHGESRDIQNK

SEQ ID NO: 3312498 - protein, 7 aa, Plasmodium falciparum
GDNNMNN

SEQ ID NO: 3312499 - protein, 13 aa, Plasmodium falciparum
GDNNNNNNRRDQF

SEQ ID NO: 3312500 - protein, 12 aa, Plasmodium falciparum
GDNNNNNSSSSS

SEQ ID NO: 3312501 - protein, 27 aa, Plasmodium falciparum
GDNNQEHVGKDDECYNKNEENNFRKNT

SEQ ID NO: 3312502 - protein, 9 aa, Plasmodium falciparum
GDNNTSDRM

SEQ ID NO: 3312503 - protein, 8 aa, Plasmodium falciparum
GDNQTSHL

SEQ ID NO: 3312504 - protein, 6 aa, Plasmodium falciparum
GDNTND

SEQ ID NO: 3312505 - protein, 8 aa, Plasmodium falciparum
GDNTNDNN

SEQ ID NO: 3312506 - protein, 9 aa, Plasmodium falciparum
GDNTNVGKL

SEQ ID NO: 3312507 - protein, 5 aa, Plasmodium falciparum
GDNVN

SEQ ID NO: 3312508 - protein, 4 aa, Plasmodium falciparum
GDNY

SEQ ID NO: 3312509 - protein, 8 aa, Plasmodium falciparum
GDNYTEEA

SEQ ID NO: 3312510 - protein, 11 aa, Plasmodium falciparum
GDPGAGKRSIE

SEQ ID NO: 3312511 - protein, 5 aa, Plasmodium falciparum
GDPHT

SEQ ID NO: 3312512 - protein, 4 aa, Plasmodium falciparum
GDPL

SEQ ID NO: 3312513 - protein, 9 aa, Plasmodium falciparum
GDPNFSGSK

SEQ ID NO: 3312514 - protein, 12 aa, Plasmodium falciparum
GDPSGDGTGGES

SEQ ID NO: 3312515 - protein, 41 aa, Plasmodium falciparum
GDQKNDDMSDDSNSCDDKGNDKNGDSIDSTDKKKGSKCDSE

SEQ ID NO: 3312516 - protein, 7 aa, Plasmodium falciparum
GDQSPFK

SEQ ID NO: 3312517 - protein, 19 aa, Plasmodium falciparum
GDRETEGKNDINSDNENKV

SEQ ID NO: 3312518 - protein, 8 aa, Plasmodium falciparum
GDSAKTSC

SEQ ID NO: 3312519 - protein, 5 aa, Plasmodium falciparum
GDSKG

SEQ ID NO: 3312520 - protein, 14 aa, Plasmodium falciparum
GDSKGNIVFWRRSF

SEQ ID NO: 3312521 - protein, 15 aa, Plasmodium falciparum
GDSKKTGKVGSDIQN

SEQ ID NO: 3312522 - protein, 9 aa, Plasmodium falciparum
GDSKSFSRK

SEQ ID NO: 3312523 - protein, 15 aa, Plasmodium falciparum
GDSKYPKSGNNKYYD

SEQ ID NO: 3312524 - protein, 7 aa, Plasmodium falciparum
GDSNLPE

SEQ ID NO: 3312525 - protein, 6 aa, Plasmodium falciparum
GDSNYS

SEQ ID NO: 3312526 - protein, 6 aa, Plasmodium falciparum
GDSSSA

SEQ ID NO: 3312527 - protein, 7 aa, Plasmodium falciparum
GDSYKNW

SEQ ID NO: 3312528 - protein, 9 aa, Plasmodium falciparum
GDTANQETD

SEQ ID NO: 3312529 - protein, 13 aa, Plasmodium falciparum
GDTCTHDNKTYKK

SEQ ID NO: 3312530 - protein, 7 aa, Plasmodium falciparum
GDTDEEK

SEQ ID NO: 3312531 - protein, 7 aa, Plasmodium falciparum
GDTDNEV

SEQ ID NO: 3312532 - protein, 14 aa, Plasmodium falciparum
GDTENNISNNKITP

SEQ ID NO: 3312533 - protein, 8 aa, Plasmodium falciparum
GDTGEIKN

SEQ ID NO: 3312534 - protein, 12 aa, Plasmodium falciparum
GDTGVGKSETIK

SEQ ID NO: 3312535 - protein, 19 aa, Plasmodium falciparum
GDTHKSYEEKNVESDQLDE

SEQ ID NO: 3312536 - protein, 5 aa, Plasmodium falciparum
GDTNE

SEQ ID NO: 3312537 - protein, 10 aa, Plasmodium falciparum
GDTNHNEENF

SEQ ID NO: 3312538 - protein, 63 aa, Plasmodium falciparum
GDTNSDDENDYDEDNNHNNNHNNNHNNNHNNYHNNNHNNNHNYNHNNNHNNYHNNNQNKYDNR

SEQ ID NO: 3312539 - protein, 19 aa, Plasmodium falciparum
GDTRSSSSDKYPLSSTKQD

SEQ ID NO: 3312540 - protein, 4 aa, Plasmodium falciparum
GDTT

SEQ ID NO: 3312541 - protein, 116 aa, Plasmodium falciparum
GDVGKTDMKSKNHTNDKNGDSVKNDDSFKNDDSFKNDDSVKNGDSVKNDDSAKNDDRVKNGDSVKNGDSVKNGDSVKNDDIYKNDDRVKNDDNYKNDDNVINDDSVKNDKNNTSDH

SEQ ID NO: 3312542 - protein, 9 aa, Plasmodium falciparum
GDVKSDKDF

SEQ ID NO: 3312543 - protein, 9 aa, Plasmodium falciparum
GDVLEPSGN

SEQ ID NO: 3312544 - protein, 6 aa, Plasmodium falciparum
GDVPRS

SEQ ID NO: 3312545 - protein, 9 aa, Plasmodium falciparum
GDVSNNKTV

SEQ ID NO: 3312546 - protein, 6 aa, Plasmodium falciparum
GDYEEN

SEQ ID NO: 3312547 - protein, 4 aa, Plasmodium falciparum
GDYK

SEQ ID NO: 3312548 - protein, 4 aa, Plasmodium falciparum
GDYV

SEQ ID NO: 3312549 - protein, 4 aa, Plasmodium falciparum
GDYY

SEQ ID NO: 3312550 - protein, 6 aa, Plasmodium falciparum
GEAEAN

SEQ ID NO: 3312551 - protein, 4 aa, Plasmodium falciparum
GEAK

SEQ ID NO: 3312552 - protein, 6 aa, Plasmodium falciparum
GEARDD

SEQ ID NO: 3312553 - protein, 5 aa, Plasmodium falciparum
GEARG

SEQ ID NO: 3312554 - protein, 6 aa, Plasmodium falciparum
GEATKM

SEQ ID NO: 3312555 - protein, 5 aa, Plasmodium falciparum
GECYE

SEQ ID NO: 3312556 - protein, 16 aa, Plasmodium falciparum
GEDDDKKNTSDNDLTS

SEQ ID NO: 3312557 - protein, 23 aa, Plasmodium falciparum
GEDDQNECKKKNKVNNHNNNNNL

SEQ ID NO: 3312558 - protein, 5 aa, Plasmodium falciparum
GEDGD

SEQ ID NO: 3312559 - protein, 8 aa, Plasmodium falciparum
GEDKPRDI

SEQ ID NO: 3312560 - protein, 7 aa, Plasmodium falciparum
GEDNDNI

SEQ ID NO: 3312561 - protein, 11 aa, Plasmodium falciparum
GEDNNKINEKT

SEQ ID NO: 3312562 - protein, 17 aa, Plasmodium falciparum
GEDQNLNEEEYERTYEQ

SEQ ID NO: 3312563 - protein, 7 aa, Plasmodium falciparum
GEDSAEK

SEQ ID NO: 3312564 - protein, 21 aa, Plasmodium falciparum
GEDSNQNKSNSKKKKEKKTGY

SEQ ID NO: 3312565 - protein, 4 aa, Plasmodium falciparum
GEDY

SEQ ID NO: 3312566 - protein, 11 aa, Plasmodium falciparum
GEEDESEKIKK

SEQ ID NO: 3312567 - protein, 5 aa, Plasmodium falciparum
GEEDY

SEQ ID NO: 3312568 - protein, 4 aa, Plasmodium falciparum
GEEE

SEQ ID NO: 3312569 - protein, 22 aa, Plasmodium falciparum
GEEEEEGENKKKKKKKKKKNTL

SEQ ID NO: 3312570 - protein, 9 aa, Plasmodium falciparum
GEEEGCKGE

SEQ ID NO: 3312571 - protein, 4 aa, Plasmodium falciparum
GEEG

SEQ ID NO: 3312572 - protein, 12 aa, Plasmodium falciparum
GEEGPRNATTTN

SEQ ID NO: 3312573 - protein, 34 aa, Plasmodium falciparum
GEEIPDDSMSSSNISSSNMSSSNKSSHNSATSYD

SEQ ID NO: 3312574 - protein, 5 aa, Plasmodium falciparum
GEEKA

SEQ ID NO: 3312575 - protein, 29 aa, Plasmodium falciparum
GEEKKGKANLDTTYKNYDNNDNYNNYDNY

SEQ ID NO: 3312576 - protein, 10 aa, Plasmodium falciparum
GEEKKTEDNI

SEQ ID NO: 3312577 - protein, 12 aa, Plasmodium falciparum
GEENDDNNSAQC

SEQ ID NO: 3312578 - protein, 17 aa, Plasmodium falciparum
GEERKSRCTGQNRASSV

SEQ ID NO: 3312579 - protein, 9 aa, Plasmodium falciparum
GEESKEDIK

SEQ ID NO: 3312580 - protein, 7 aa, Plasmodium falciparum
GEETDDY

SEQ ID NO: 3312581 - protein, 374 aa, Plasmodium falciparum
GEETKDDEKEDKEGTDDEEDTDDEEDTDDEEDTDDEEDTSDEETTGDQENKEETEVDEKKTEKAEEELEEDKEESEKDKEESEKDKEESEKDKEESEKDKEKTEEDEEKTEDEKGTEVYKKETDVDEKKEKGEYGEGTDDEEDKEKEEDDEETKVEEKKTEKDEEGTDYEEDTDDSDKDEETKVEEKKTERDEEETEEDEKETEVEKKKTEKDEEGTDYEEDTDDSDKDVETEVEETDAEDKEENEEGTDDEEDKVEETDLDDQEEDGEEDKEDDKEKDKEDDKEDDKEKDKEDDKEKYKEDDKEDDKEDDKEKDKEDNKEKDKEDNKEKDKEDDKEKDKEDDKEKDKEDNKEKDKEDNKEKDKEDDKEKHDKH

SEQ ID NO: 3312582 - protein, 76 aa, Plasmodium falciparum
GEETLNNDSKNKEAENKSNIKNNKSNQSNQSNKKTKNNNNNKNNNNNNNNNNNNNNNNNKNSTSNKKNSKNKKKVD

SEQ ID NO: 3312583 - protein, 13 aa, Plasmodium falciparum
GEFDEEKEGNQEM

SEQ ID NO: 3312584 - protein, 5 aa, Plasmodium falciparum
GEFGR

SEQ ID NO: 3312585 - protein, 21 aa, Plasmodium falciparum
GEFPHDKEKKKKKKNQKENSL

SEQ ID NO: 3312586 - protein, 6 aa, Plasmodium falciparum
GEGDGS

SEQ ID NO: 3312587 - protein, 5 aa, Plasmodium falciparum
GEGDQ

SEQ ID NO: 3312588 - protein, 21 aa, Plasmodium falciparum
GEGEELPSSDGESSDGSFGPV

SEQ ID NO: 3312589 - protein, 10 aa, Plasmodium falciparum
GEGKKEEINE

SEQ ID NO: 3312590 - protein, 53 aa, Plasmodium falciparum
GEGNDAEERQRQQREEEERRKKKEEEERKKKEEEEMKKQNRTPEQIQGDEHKL

SEQ ID NO: 3312591 - protein, 8 aa, Plasmodium falciparum
GEGNLNNP

SEQ ID NO: 3312592 - protein, 7 aa, Plasmodium falciparum
GEGSDEI

SEQ ID NO: 3312593 - protein, 5 aa, Plasmodium falciparum
GEHEY

SEQ ID NO: 3312594 - protein, 4 aa, Plasmodium falciparum
GEHG

SEQ ID NO: 3312595 - protein, 11 aa, Plasmodium falciparum
GEHGSTYGGNP

SEQ ID NO: 3312596 - protein, 5 aa, Plasmodium falciparum
GEHVN

SEQ ID NO: 3312597 - protein, 11 aa, Plasmodium falciparum
GEIEKKNSEIK

SEQ ID NO: 3312598 - protein, 17 aa, Plasmodium falciparum
GEIENNEDKEDEEGRKP

SEQ ID NO: 3312599 - protein, 6 aa, Plasmodium falciparum
GEINTP

SEQ ID NO: 3312600 - protein, 13 aa, Plasmodium falciparum
GEIPQAVDSKQDI

SEQ ID NO: 3312601 - protein, 11 aa, Plasmodium falciparum
GEKDIDEEADT

SEQ ID NO: 3312602 - protein, 4 aa, Plasmodium falciparum
GEKE

SEQ ID NO: 3312603 - protein, 11 aa, Plasmodium falciparum
GEKEEPLNEQQ

SEQ ID NO: 3312604 - protein, 13 aa, Plasmodium falciparum
GEKEKNPKGENGC

SEQ ID NO: 3312605 - protein, 8 aa, Plasmodium falciparum
GEKENAYK

SEQ ID NO: 3312606 - protein, 34 aa, Plasmodium falciparum
GEKENEKKSSTNDKKYDIANDENYKKLKEDKKRL

SEQ ID NO: 3312607 - protein, 10 aa, Plasmodium falciparum
GEKGCKQESY

SEQ ID NO: 3312608 - protein, 5 aa, Plasmodium falciparum
GEKGF

SEQ ID NO: 3312609 - protein, 7 aa, Plasmodium falciparum
GEKGIKR

SEQ ID NO: 3312610 - protein, 9 aa, Plasmodium falciparum
GEKGKKPGF

SEQ ID NO: 3312611 - protein, 4 aa, Plasmodium falciparum
GEKK

SEQ ID NO: 3312612 - protein, 13 aa, Plasmodium falciparum
GEKKKTEEKCVSN

SEQ ID NO: 3312613 - protein, 5 aa, Plasmodium falciparum
GEKKN

SEQ ID NO: 3312614 - protein, 22 aa, Plasmodium falciparum
GEKKNRNINYNNNNNNNNNNNM

SEQ ID NO: 3312615 - protein, 5 aa, Plasmodium falciparum
GEKKS

SEQ ID NO: 3312616 - protein, 11 aa, Plasmodium falciparum
GEKKSAARNIS

SEQ ID NO: 3312617 - protein, 14 aa, Plasmodium falciparum
GEKMNDKDDKNSYL

SEQ ID NO: 3312618 - protein, 4 aa, Plasmodium falciparum
GEKN

SEQ ID NO: 3312619 - protein, 59 aa, Plasmodium falciparum
GEKNDNQLNSKDGNNSPSKLNSNQNNNNNNNNNNKQKKKKKKNEKDNKLTKNVEDNDVN

SEQ ID NO: 3312620 - protein, 9 aa, Plasmodium falciparum
GEKNKMPEK

SEQ ID NO: 3312621 - protein, 10 aa, Plasmodium falciparum
GEKNNSDNIN

SEQ ID NO: 3312622 - protein, 9 aa, Plasmodium falciparum
GEKNSWGKE

SEQ ID NO: 3312623 - protein, 7 aa, Plasmodium falciparum
GEKSDNY

SEQ ID NO: 3312624 - protein, 17 aa, Plasmodium falciparum
GEKSEERLKYENKKNKK

SEQ ID NO: 3312625 - protein, 8 aa, Plasmodium falciparum
GEKTKEKK

SEQ ID NO: 3312626 - protein, 6 aa, Plasmodium falciparum
GELEDE

SEQ ID NO: 3312627 - protein, 8 aa, Plasmodium falciparum
GELENNNN

SEQ ID NO: 3312628 - protein, 4 aa, Plasmodium falciparum
GELG

SEQ ID NO: 3312629 - protein, 4 aa, Plasmodium falciparum
GELN

SEQ ID NO: 3312630 - protein, 117 aa, Plasmodium falciparum
GELNNEKVKKNETNDDKAKKNETYDDKAKKNETYDDKAKKNETYDDKAKKNETYDDKAKKNETYDDKAKKNETYDEKVKKNETYDEKVKKNETYDEKVKKNETYDEKVKKNEQKCED

SEQ ID NO: 3312631 - protein, 6 aa, Plasmodium falciparum
GELNPI

SEQ ID NO: 3312632 - protein, 9 aa, Plasmodium falciparum
GELPETAKI

SEQ ID NO: 3312633 - protein, 5 aa, Plasmodium falciparum
GELQK

SEQ ID NO: 3312634 - protein, 15 aa, Plasmodium falciparum
GEMKTGYSGECTPRY

SEQ ID NO: 3312635 - protein, 27 aa, Plasmodium falciparum
GEMQTSTNKYNSDSGIGVTAKTNTDIN

SEQ ID NO: 3312636 - protein, 7 aa, Plasmodium falciparum
GEMSEED

SEQ ID NO: 3312637 - protein, 8 aa, Plasmodium falciparum
GEMSPNHL

SEQ ID NO: 3312638 - protein, 9 aa, Plasmodium falciparum
GENDTEDDI

SEQ ID NO: 3312639 - protein, 14 aa, Plasmodium falciparum
GENDVSQNTMHKQD

SEQ ID NO: 3312640 - protein, 4 aa, Plasmodium falciparum
GENE

SEQ ID NO: 3312641 - protein, 6 aa, Plasmodium falciparum
GENEEK

SEQ ID NO: 3312642 - protein, 13 aa, Plasmodium falciparum
GENENFNDKGNSN

SEQ ID NO: 3312643 - protein, 19 aa, Plasmodium falciparum
GENESVKKEEGDSSNNSLY

SEQ ID NO: 3312644 - protein, 10 aa, Plasmodium falciparum
GENGREQKVE

SEQ ID NO: 3312645 - protein, 23 aa, Plasmodium falciparum
GENHLNSSSINPSSELNEKSDEL

SEQ ID NO: 3312646 - protein, 13 aa, Plasmodium falciparum
GENIYTKHESKIF

SEQ ID NO: 3312647 - protein, 6 aa, Plasmodium falciparum
GENKTR

SEQ ID NO: 3312648 - protein, 4 aa, Plasmodium falciparum
GENN

SEQ ID NO: 3312649 - protein, 33 aa, Plasmodium falciparum
GENNKPLSYNNKSTNSNNNMSENYHETDSPVQN

SEQ ID NO: 3312650 - protein, 11 aa, Plasmodium falciparum
GENNKTLDKEN

SEQ ID NO: 3312651 - protein, 10 aa, Plasmodium falciparum
GENNMKNSGD

SEQ ID NO: 3312652 - protein, 6 aa, Plasmodium falciparum
GENNNS

SEQ ID NO: 3312653 - protein, 9 aa, Plasmodium falciparum
GENNPDTKT

SEQ ID NO: 3312654 - protein, 11 aa, Plasmodium falciparum
GENNTNDDYKK

SEQ ID NO: 3312655 - protein, 18 aa, Plasmodium falciparum
GENTDDDTKLSKKKQKEV

SEQ ID NO: 3312656 - protein, 10 aa, Plasmodium falciparum
GENTGINDNQ

SEQ ID NO: 3312657 - protein, 6 aa, Plasmodium falciparum
GENVEK

SEQ ID NO: 3312658 - protein, 6 aa, Plasmodium falciparum
GEPINP

SEQ ID NO: 3312659 - protein, 4 aa, Plasmodium falciparum
GEPK

SEQ ID NO: 3312660 - protein, 7 aa, Plasmodium falciparum
GEPRKPF

SEQ ID NO: 3312661 - protein, 8 aa, Plasmodium falciparum
GEPSNTSD

SEQ ID NO: 3312662 - protein, 4 aa, Plasmodium falciparum
GEQE

SEQ ID NO: 3312663 - protein, 34 aa, Plasmodium falciparum
GEQEMNTDQNYMDSNEDNYVDSNTNNNFKNPTNN

SEQ ID NO: 3312664 - protein, 10 aa, Plasmodium falciparum
GEQENINKDN

SEQ ID NO: 3312665 - protein, 4 aa, Plasmodium falciparum
GEQF

SEQ ID NO: 3312666 - protein, 7 aa, Plasmodium falciparum
GEQIKSR

SEQ ID NO: 3312667 - protein, 4 aa, Plasmodium falciparum
GEQQ

SEQ ID NO: 3312668 - protein, 23 aa, Plasmodium falciparum
GEQQLTKKNKNIEQKDNVSNEEK

SEQ ID NO: 3312669 - protein, 15 aa, Plasmodium falciparum
GEQRNKGHHMNDDGS

SEQ ID NO: 3312670 - protein, 11 aa, Plasmodium falciparum
GERKKEIRGDN

SEQ ID NO: 3312671 - protein, 8 aa, Plasmodium falciparum
GERTREGN

SEQ ID NO: 3312672 - protein, 6 aa, Plasmodium falciparum
GESEKK

SEQ ID NO: 3312673 - protein, 7 aa, Plasmodium falciparum
GESEKSI

SEQ ID NO: 3312674 - protein, 8 aa, Plasmodium falciparum
GESELQPK

SEQ ID NO: 3312675 - protein, 18 aa, Plasmodium falciparum
GESFSEENHIGKAGDRYR

SEQ ID NO: 3312676 - protein, 12 aa, Plasmodium falciparum
GESGAGKTEATK

SEQ ID NO: 3312677 - protein, 13 aa, Plasmodium falciparum
GESGAGKTESSKQ

SEQ ID NO: 3312678 - protein, 12 aa, Plasmodium falciparum
GESGAGKTESTK

SEQ ID NO: 3312679 - protein, 11 aa, Plasmodium falciparum
GESGSGKTEAS

SEQ ID NO: 3312680 - protein, 10 aa, Plasmodium falciparum
GESGSRVTPV

SEQ ID NO: 3312681 - protein, 4 aa, Plasmodium falciparum
GESN

SEQ ID NO: 3312682 - protein, 10 aa, Plasmodium falciparum
GESSEGGANA

SEQ ID NO: 3312683 - protein, 10 aa, Plasmodium falciparum
GESTGTASEK

SEQ ID NO: 3312684 - protein, 5 aa, Plasmodium falciparum
GESYN

SEQ ID NO: 3312685 - protein, 8 aa, Plasmodium falciparum
GETDPTQV

SEQ ID NO: 3312686 - protein, 19 aa, Plasmodium falciparum
GETELHKSKKRKSSHLTSD

SEQ ID NO: 3312687 - protein, 17 aa, Plasmodium falciparum
GETNDEKNKEEQNRSYN

SEQ ID NO: 3312688 - protein, 8 aa, Plasmodium falciparum
GETPSNHN

SEQ ID NO: 3312689 - protein, 42 aa, Plasmodium falciparum
GETREYASNKGKNNNDDDNNNSYYSDAKSYTSESSDESYQGD

SEQ ID NO: 3312690 - protein, 4 aa, Plasmodium falciparum
GETS

SEQ ID NO: 3312691 - protein, 6 aa, Plasmodium falciparum
GEVGAS

SEQ ID NO: 3312692 - protein, 8 aa, Plasmodium falciparum
GEVPSSTL

SEQ ID NO: 3312693 - protein, 5 aa, Plasmodium falciparum
GEVSD

SEQ ID NO: 3312694 - protein, 4 aa, Plasmodium falciparum
GEVY

SEQ ID NO: 3312695 - protein, 8 aa, Plasmodium falciparum
GEVYTGTK

SEQ ID NO: 3312696 - protein, 4 aa, Plasmodium falciparum
GEYI

SEQ ID NO: 3312697 - protein, 14 aa, Plasmodium falciparum
GEYKKENDKNVIDT

SEQ ID NO: 3312698 - protein, 4 aa, Plasmodium falciparum
GEYL

SEQ ID NO: 3312699 - protein, 5 aa, Plasmodium falciparum
GEYTN

SEQ ID NO: 3312700 - protein, 13 aa, Plasmodium falciparum
GFDLPPDETEELN

SEQ ID NO: 3312701 - protein, 5 aa, Plasmodium falciparum
GFDQE

SEQ ID NO: 3312702 - protein, 5 aa, Plasmodium falciparum
GFDQT

SEQ ID NO: 3312703 - protein, 6 aa, Plasmodium falciparum
GFDSSE

SEQ ID NO: 3312704 - protein, 5 aa, Plasmodium falciparum
GFEES

SEQ ID NO: 3312705 - protein, 7 aa, Plasmodium falciparum
GFEGTKN

SEQ ID NO: 3312706 - protein, 4 aa, Plasmodium falciparum
GFGG

SEQ ID NO: 3312707 - protein, 9 aa, Plasmodium falciparum
GFKGENHYS

SEQ ID NO: 3312708 - protein, 55 aa, Plasmodium falciparum
GFNGGRGGGGGGRGGGGGGRGGGGGGRGGGGGRGGGGGRGNKDRKSFKKDNKSGK

SEQ ID NO: 3312709 - protein, 12 aa, Plasmodium falciparum
GFNNNNNNNNMN

SEQ ID NO: 3312710 - protein, 7 aa, Plasmodium falciparum
GFPREGG

SEQ ID NO: 3312711 - protein, 6 aa, Plasmodium falciparum
GFQGTE

SEQ ID NO: 3312712 - protein, 7 aa, Plasmodium falciparum
GFSSNGM

SEQ ID NO: 3312713 - protein, 5 aa, Plasmodium falciparum
GFTNE

SEQ ID NO: 3312714 - protein, 5 aa, Plasmodium falciparum
GGAGL

SEQ ID NO: 3312715 - protein, 4 aa, Plasmodium falciparum
GGAK

SEQ ID NO: 3312716 - protein, 9 aa, Plasmodium falciparum
GGANAGHTI

SEQ ID NO: 3312717 - protein, 15 aa, Plasmodium falciparum
GGAPQNGAAEDKKTE

SEQ ID NO: 3312718 - protein, 9 aa, Plasmodium falciparum
GGATEEEIT

SEQ ID NO: 3312719 - protein, 5 aa, Plasmodium falciparum
GGDDN

SEQ ID NO: 3312720 - protein, 6 aa, Plasmodium falciparum
GGDGNL

SEQ ID NO: 3312721 - protein, 7 aa, Plasmodium falciparum
GGDLNNE

SEQ ID NO: 3312722 - protein, 5 aa, Plasmodium falciparum
GGDNC

SEQ ID NO: 3312723 - protein, 7 aa, Plasmodium falciparum
GGDNFSE

SEQ ID NO: 3312724 - protein, 13 aa, Plasmodium falciparum
GGDNQGGNRKVSQ

SEQ ID NO: 3312725 - protein, 5 aa, Plasmodium falciparum
GGDNT

SEQ ID NO: 3312726 - protein, 15 aa, Plasmodium falciparum
GGDPTGTGKGGKSIY

SEQ ID NO: 3312727 - protein, 7 aa, Plasmodium falciparum
GGDRDGN

SEQ ID NO: 3312728 - protein, 5 aa, Plasmodium falciparum
GGDRG

SEQ ID NO: 3312729 - protein, 7 aa, Plasmodium falciparum
GGDSEEQ

SEQ ID NO: 3312730 - protein, 15 aa, Plasmodium falciparum
GGDSNEELVNNKGGT

SEQ ID NO: 3312731 - protein, 10 aa, Plasmodium falciparum
GGDSSNSNMN

SEQ ID NO: 3312732 - protein, 27 aa, Plasmodium falciparum
GGDTASLVEQQNKKNEISHVSTGGGAS

SEQ ID NO: 3312733 - protein, 23 aa, Plasmodium falciparum
GGDTQNYEHEEDAKHNEHNEYNE

SEQ ID NO: 3312734 - protein, 7 aa, Plasmodium falciparum
GGEITNN

SEQ ID NO: 3312735 - protein, 15 aa, Plasmodium falciparum
GGEKEGNLKEGEEEK

SEQ ID NO: 3312736 - protein, 9 aa, Plasmodium falciparum
GGELPTPDK

SEQ ID NO: 3312737 - protein, 7 aa, Plasmodium falciparum
GGENGEV

SEQ ID NO: 3312738 - protein, 7 aa, Plasmodium falciparum
GGESSGP

SEQ ID NO: 3312739 - protein, 7 aa, Plasmodium falciparum
GGESTTV

SEQ ID NO: 3312740 - protein, 14 aa, Plasmodium falciparum
GGETGGSSNGFTRE

SEQ ID NO: 3312741 - protein, 4 aa, Plasmodium falciparum
GGEV

SEQ ID NO: 3312742 - protein, 13 aa, Plasmodium falciparum
GGFSSSSSTFAKS

SEQ ID NO: 3312743 - protein, 5 aa, Plasmodium falciparum
GGGDG

SEQ ID NO: 3312744 - protein, 5 aa, Plasmodium falciparum
GGGDV

SEQ ID NO: 3312745 - protein, 12 aa, Plasmodium falciparum
GGGGEDIDKTSA

SEQ ID NO: 3312746 - protein, 7 aa, Plasmodium falciparum
GGGKGDL

SEQ ID NO: 3312747 - protein, 14 aa, Plasmodium falciparum
GGGKGPARGSEEKK

SEQ ID NO: 3312748 - protein, 13 aa, Plasmodium falciparum
GGGKKKKKKLQSN

SEQ ID NO: 3312749 - protein, 9 aa, Plasmodium falciparum
GGGKTSPKV

SEQ ID NO: 3312750 - protein, 4 aa, Plasmodium falciparum
GGGL

SEQ ID NO: 3312751 - protein, 54 aa, Plasmodium falciparum
GGGMDNKNVKGNSGNSERGINSSRTSTNNKNNNNNNHNHNSNSSSSIKTSEYDE

SEQ ID NO: 3312752 - protein, 8 aa, Plasmodium falciparum
GGGPTGVE

SEQ ID NO: 3312753 - protein, 13 aa, Plasmodium falciparum
GGGQERGLRSGTL

SEQ ID NO: 3312754 - protein, 7 aa, Plasmodium falciparum
GGGRTKG

SEQ ID NO: 3312755 - protein, 7 aa, Plasmodium falciparum
GGGSANK

SEQ ID NO: 3312756 - protein, 14 aa, Plasmodium falciparum
GGGSFSTGGPGKGM

SEQ ID NO: 3312757 - protein, 5 aa, Plasmodium falciparum
GGGSY

SEQ ID NO: 3312758 - protein, 5 aa, Plasmodium falciparum
GGHNN

SEQ ID NO: 3312759 - protein, 7 aa, Plasmodium falciparum
GGHNSNQ

SEQ ID NO: 3312760 - protein, 5 aa, Plasmodium falciparum
GGIDS

SEQ ID NO: 3312761 - protein, 14 aa, Plasmodium falciparum
GGIEENKNEKSNYS

SEQ ID NO: 3312762 - protein, 4 aa, Plasmodium falciparum
GGIG

SEQ ID NO: 3312763 - protein, 19 aa, Plasmodium falciparum
GGIKKKGKNENDREEEERK

SEQ ID NO: 3312764 - protein, 11 aa, Plasmodium falciparum
GGISGQSKAAR

SEQ ID NO: 3312765 - protein, 6 aa, Plasmodium falciparum
GGKDSS

SEQ ID NO: 3312766 - protein, 14 aa, Plasmodium falciparum
GGKDTDDKDSISNV

SEQ ID NO: 3312767 - protein, 6 aa, Plasmodium falciparum
GGKGCR

SEQ ID NO: 3312768 - protein, 7 aa, Plasmodium falciparum
GGKGGIS

SEQ ID NO: 3312769 - protein, 23 aa, Plasmodium falciparum
GGKIGTIGTTGDKDTRDTTPTVY

SEQ ID NO: 3312770 - protein, 7 aa, Plasmodium falciparum
GGKKTNQ

SEQ ID NO: 3312771 - protein, 7 aa, Plasmodium falciparum
GGKLSAD

SEQ ID NO: 3312772 - protein, 5 aa, Plasmodium falciparum
GGKNE

SEQ ID NO: 3312773 - protein, 9 aa, Plasmodium falciparum
GGKNISNKM

SEQ ID NO: 3312774 - protein, 5 aa, Plasmodium falciparum
GGKRE

SEQ ID NO: 3312775 - protein, 5 aa, Plasmodium falciparum
GGKST

SEQ ID NO: 3312776 - protein, 6 aa, Plasmodium falciparum
GGKTEE

SEQ ID NO: 3312777 - protein, 8 aa, Plasmodium falciparum
GGKVTDDL

SEQ ID NO: 3312778 - protein, 5 aa, Plasmodium falciparum
GGLKA

SEQ ID NO: 3312779 - protein, 9 aa, Plasmodium falciparum
GGLKNSNHN

SEQ ID NO: 3312780 - protein, 6 aa, Plasmodium falciparum
GGMNES

SEQ ID NO: 3312781 - protein, 23 aa, Plasmodium falciparum
GGMPGAGMPGNAPAGSGPTVEEV

SEQ ID NO: 3312782 - protein, 10 aa, Plasmodium falciparum
GGMSSNDGPF

SEQ ID NO: 3312783 - protein, 5 aa, Plasmodium falciparum
GGMTK

SEQ ID NO: 3312784 - protein, 6 aa, Plasmodium falciparum
GGNAQS

SEQ ID NO: 3312785 - protein, 6 aa, Plasmodium falciparum
GGNDGN

SEQ ID NO: 3312786 - protein, 8 aa, Plasmodium falciparum
GGNDKQGF

SEQ ID NO: 3312787 - protein, 4 aa, Plasmodium falciparum
GGNE

SEQ ID NO: 3312788 - protein, 8 aa, Plasmodium falciparum
GGNEFDEN

SEQ ID NO: 3312789 - protein, 12 aa, Plasmodium falciparum
GGNEKNENDEKF

SEQ ID NO: 3312790 - protein, 5 aa, Plasmodium falciparum
GGNFK

SEQ ID NO: 3312791 - protein, 7 aa, Plasmodium falciparum
GGNGGNV

SEQ ID NO: 3312792 - protein, 28 aa, Plasmodium falciparum
GGNKHSEEDLSNKNNIPIEENKKEINNK

SEQ ID NO: 3312793 - protein, 6 aa, Plasmodium falciparum
GGNKKE

SEQ ID NO: 3312794 - protein, 14 aa, Plasmodium falciparum
GGNKNTSTRGEDIQ

SEQ ID NO: 3312795 - protein, 35 aa, Plasmodium falciparum
GGNKSISNSNSNGHSNSISHSNSHSNSHSNGHSNN

SEQ ID NO: 3312796 - protein, 6 aa, Plasmodium falciparum
GGNPDH

SEQ ID NO: 3312797 - protein, 4 aa, Plasmodium falciparum
GGNY

SEQ ID NO: 3312798 - protein, 8 aa, Plasmodium falciparum
GGPAPGGH

SEQ ID NO: 3312799 - protein, 54 aa, Plasmodium falciparum
GGPEKNEKNEKNEKNEKNEKNEENEKNEKNEENEKNEKNEENEKNEKKENLPSN

SEQ ID NO: 3312800 - protein, 5 aa, Plasmodium falciparum
GGPEL

SEQ ID NO: 3312801 - protein, 5 aa, Plasmodium falciparum
GGPGA

SEQ ID NO: 3312802 - protein, 5 aa, Plasmodium falciparum
GGPGG

SEQ ID NO: 3312803 - protein, 16 aa, Plasmodium falciparum
GGPGGMASAKEAAAHG

SEQ ID NO: 3312804 - protein, 4 aa, Plasmodium falciparum
GGQD

SEQ ID NO: 3312805 - protein, 6 aa, Plasmodium falciparum
GGQERF

SEQ ID NO: 3312806 - protein, 6 aa, Plasmodium falciparum
GGQKMS

SEQ ID NO: 3312807 - protein, 6 aa, Plasmodium falciparum
GGQKSK

SEQ ID NO: 3312808 - protein, 13 aa, Plasmodium falciparum
GGQQARRKREVNN

SEQ ID NO: 3312809 - protein, 9 aa, Plasmodium falciparum
GGQSANQPV

SEQ ID NO: 3312810 - protein, 10 aa, Plasmodium falciparum
GGQSEEEASV

SEQ ID NO: 3312811 - protein, 4 aa, Plasmodium falciparum
GGQT

SEQ ID NO: 3312812 - protein, 5 aa, Plasmodium falciparum
GGQVE

SEQ ID NO: 3312813 - protein, 4 aa, Plasmodium falciparum
GGRE

SEQ ID NO: 3312814 - protein, 4 aa, Plasmodium falciparum
GGRG

SEQ ID NO: 3312815 - protein, 5 aa, Plasmodium falciparum
GGRPH

SEQ ID NO: 3312816 - protein, 6 aa, Plasmodium falciparum
GGRTPI

SEQ ID NO: 3312817 - protein, 13 aa, Plasmodium falciparum
GGRTTEANSQSLS

SEQ ID NO: 3312818 - protein, 6 aa, Plasmodium falciparum
GGSDTL

SEQ ID NO: 3312819 - protein, 8 aa, Plasmodium falciparum
GGSGKRSL

SEQ ID NO: 3312820 - protein, 8 aa, Plasmodium falciparum
GGSGSGLS

SEQ ID NO: 3312821 - protein, 8 aa, Plasmodium falciparum
GGSHAGNK

SEQ ID NO: 3312822 - protein, 4 aa, Plasmodium falciparum
GGSK

SEQ ID NO: 3312823 - protein, 4 aa, Plasmodium falciparum
GGSM

SEQ ID NO: 3312824 - protein, 4 aa, Plasmodium falciparum
GGSN

SEQ ID NO: 3312825 - protein, 11 aa, Plasmodium falciparum
GGSNEEKEKLK

SEQ ID NO: 3312826 - protein, 9 aa, Plasmodium falciparum
GGSQREDNL

SEQ ID NO: 3312827 - protein, 10 aa, Plasmodium falciparum
GGSSGGSASC

SEQ ID NO: 3312828 - protein, 8 aa, Plasmodium falciparum
GGSTGVKN

SEQ ID NO: 3312829 - protein, 6 aa, Plasmodium falciparum
GGSTKF

SEQ ID NO: 3312830 - protein, 18 aa, Plasmodium falciparum
GGSVRNKMKQKKQPLNEE

SEQ ID NO: 3312831 - protein, 11 aa, Plasmodium falciparum
GGSVSRGGGPQ

SEQ ID NO: 3312832 - protein, 5 aa, Plasmodium falciparum
GGTGD

SEQ ID NO: 3312833 - protein, 7 aa, Plasmodium falciparum
GGTGENE

SEQ ID NO: 3312834 - protein, 4 aa, Plasmodium falciparum
GGTK

SEQ ID NO: 3312835 - protein, 15 aa, Plasmodium falciparum
GGTKIEGRWNKNDAE

SEQ ID NO: 3312836 - protein, 6 aa, Plasmodium falciparum
GGTKVP

SEQ ID NO: 3312837 - protein, 8 aa, Plasmodium falciparum
GGTPGYAD

SEQ ID NO: 3312838 - protein, 6 aa, Plasmodium falciparum
GGTSLR

SEQ ID NO: 3312839 - protein, 11 aa, Plasmodium falciparum
GGTSTNKCQPI

SEQ ID NO: 3312840 - protein, 5 aa, Plasmodium falciparum
GGVAG

SEQ ID NO: 3312841 - protein, 4 aa, Plasmodium falciparum
GGVG

SEQ ID NO: 3312842 - protein, 10 aa, Plasmodium falciparum
GGVGGSGGPC

SEQ ID NO: 3312843 - protein, 6 aa, Plasmodium falciparum
GGVGKT

SEQ ID NO: 3312844 - protein, 20 aa, Plasmodium falciparum
GGVGRTNQAKEFNHTQGRWP

SEQ ID NO: 3312845 - protein, 8 aa, Plasmodium falciparum
GGVPKSGQ

SEQ ID NO: 3312846 - protein, 11 aa, Plasmodium falciparum
GGVTGGNKKNI

SEQ ID NO: 3312847 - protein, 4 aa, Plasmodium falciparum
GGWT

SEQ ID NO: 3312848 - protein, 4 aa, Plasmodium falciparum
GGYD

SEQ ID NO: 3312849 - protein, 9 aa, Plasmodium falciparum
GGYDRSSYN

SEQ ID NO: 3312850 - protein, 4 aa, Plasmodium falciparum
GGYG

SEQ ID NO: 3312851 - protein, 17 aa, Plasmodium falciparum
GGYIDKTNDVDNIGTSV

SEQ ID NO: 3312852 - protein, 10 aa, Plasmodium falciparum
GGYKKSGRRS

SEQ ID NO: 3312853 - protein, 4 aa, Plasmodium falciparum
GGYN

SEQ ID NO: 3312854 - protein, 7 aa, Plasmodium falciparum
GGYPEEL

SEQ ID NO: 3312855 - protein, 24 aa, Plasmodium falciparum
GGYRPKDKSKYLPYDDGKKLLPRI

SEQ ID NO: 3312856 - protein, 4 aa, Plasmodium falciparum
GGYT

SEQ ID NO: 3312857 - protein, 10 aa, Plasmodium falciparum
GGYTSSEKSI

SEQ ID NO: 3312858 - protein, 10 aa, Plasmodium falciparum
GHAKGGGALS

SEQ ID NO: 3312859 - protein, 14 aa, Plasmodium falciparum
GHASHENKQNVSRG

SEQ ID NO: 3312860 - protein, 5 aa, Plasmodium falciparum
GHDEI

SEQ ID NO: 3312861 - protein, 15 aa, Plasmodium falciparum
GHDHDENNNNTSGIC

SEQ ID NO: 3312862 - protein, 4 aa, Plasmodium falciparum
GHDP

SEQ ID NO: 3312863 - protein, 13 aa, Plasmodium falciparum
GHDQLNGGNISDD

SEQ ID NO: 3312864 - protein, 10 aa, Plasmodium falciparum
GHDTDSTFYE

SEQ ID NO: 3312865 - protein, 15 aa, Plasmodium falciparum
GHEESGYIDDNDDNI

SEQ ID NO: 3312866 - protein, 11 aa, Plasmodium falciparum
GHENKQSAEES

SEQ ID NO: 3312867 - protein, 25 aa, Plasmodium falciparum
GHENYNHNNNVNNVKNDNIHNNSNI

SEQ ID NO: 3312868 - protein, 5 aa, Plasmodium falciparum
GHETA

SEQ ID NO: 3312869 - protein, 13 aa, Plasmodium falciparum
GHEYGTTTKRPRR

SEQ ID NO: 3312870 - protein, 8 aa, Plasmodium falciparum
GHGESDGI

SEQ ID NO: 3312871 - protein, 8 aa, Plasmodium falciparum
GHGESDGL

SEQ ID NO: 3312872 - protein, 9 aa, Plasmodium falciparum
GHGESDGYD

SEQ ID NO: 3312873 - protein, 10 aa, Plasmodium falciparum
GHGGPKDAKV

SEQ ID NO: 3312874 - protein, 7 aa, Plasmodium falciparum
GHGGSNC

SEQ ID NO: 3312875 - protein, 9 aa, Plasmodium falciparum
GHGKSDGWN

SEQ ID NO: 3312876 - protein, 6 aa, Plasmodium falciparum
GHGTYK

SEQ ID NO: 3312877 - protein, 11 aa, Plasmodium falciparum
GHHHSDNNTNL

SEQ ID NO: 3312878 - protein, 12 aa, Plasmodium falciparum
GHHTTNKSEIST

SEQ ID NO: 3312879 - protein, 9 aa, Plasmodium falciparum
GHINDTQKD

SEQ ID NO: 3312880 - protein, 10 aa, Plasmodium falciparum
GHKDDPPVDD

SEQ ID NO: 3312881 - protein, 9 aa, Plasmodium falciparum
GHKNIPYNK

SEQ ID NO: 3312882 - protein, 12 aa, Plasmodium falciparum
GHKSTDKEEIEE

SEQ ID NO: 3312883 - protein, 5 aa, Plasmodium falciparum
GHLDE

SEQ ID NO: 3312884 - protein, 70 aa, Plasmodium falciparum
GHMNDANNNNNNNINCGDDGNNNNNNNNSFDADINSSSHVGNEPTGDKHETSKKEDTENEEAINAKTEGN

SEQ ID NO: 3312885 - protein, 7 aa, Plasmodium falciparum
GHNGDNA

SEQ ID NO: 3312886 - protein, 18 aa, Plasmodium falciparum
GHNNCNDNTSLSSKDSNN

SEQ ID NO: 3312887 - protein, 25 aa, Plasmodium falciparum
GHNNNNENNQHVNKDDGDSKLTPSH

SEQ ID NO: 3312888 - protein, 6 aa, Plasmodium falciparum
GHNPDI

SEQ ID NO: 3312889 - protein, 10 aa, Plasmodium falciparum
GHNYNGDPLT

SEQ ID NO: 3312890 - protein, 5 aa, Plasmodium falciparum
GHPQS

SEQ ID NO: 3312891 - protein, 4 aa, Plasmodium falciparum
GHSF

SEQ ID NO: 3312892 - protein, 6 aa, Plasmodium falciparum
GHSLGS

SEQ ID NO: 3312893 - protein, 30 aa, Plasmodium falciparum
GHSQWEKPKEMSATNFPGKGSAPSFGPPGA

SEQ ID NO: 3312894 - protein, 10 aa, Plasmodium falciparum
GHSSVDTGEH

SEQ ID NO: 3312895 - protein, 5 aa, Plasmodium falciparum
GHTIR

SEQ ID NO: 3312896 - protein, 5 aa, Plasmodium falciparum
GHTND

SEQ ID NO: 3312897 - protein, 10 aa, Plasmodium falciparum
GHTNSHTHGL

SEQ ID NO: 3312898 - protein, 5 aa, Plasmodium falciparum
GHTPY

SEQ ID NO: 3312899 - protein, 6 aa, Plasmodium falciparum
GHTQPV

SEQ ID NO: 3312900 - protein, 4 aa, Plasmodium falciparum
GHTV

SEQ ID NO: 3312901 - protein, 6 aa, Plasmodium falciparum
GHYTEG

SEQ ID NO: 3312902 - protein, 8 aa, Plasmodium falciparum
GICTPKKN

SEQ ID NO: 3312903 - protein, 14 aa, Plasmodium falciparum
GIDATNVGDEGGFA

SEQ ID NO: 3312904 - protein, 5 aa, Plasmodium falciparum
GIDDD

SEQ ID NO: 3312905 - protein, 5 aa, Plasmodium falciparum
GIDDS

SEQ ID NO: 3312906 - protein, 4 aa, Plasmodium falciparum
GIDE

SEQ ID NO: 3312907 - protein, 5 aa, Plasmodium falciparum
GIDGD

SEQ ID NO: 3312908 - protein, 11 aa, Plasmodium falciparum
GIDQSNNIKND

SEQ ID NO: 3312909 - protein, 11 aa, Plasmodium falciparum
GIENNNNNNIH

SEQ ID NO: 3312910 - protein, 8 aa, Plasmodium falciparum
GIERNGSY

SEQ ID NO: 3312911 - protein, 6 aa, Plasmodium falciparum
GIETGG

SEQ ID NO: 3312912 - protein, 6 aa, Plasmodium falciparum
GIGDYT

SEQ ID NO: 3312913 - protein, 5 aa, Plasmodium falciparum
GIGKS

SEQ ID NO: 3312914 - protein, 4 aa, Plasmodium falciparum
GIGM

SEQ ID NO: 3312915 - protein, 10 aa, Plasmodium falciparum
GIGNKDNLDN

SEQ ID NO: 3312916 - protein, 4 aa, Plasmodium falciparum
GIGS

SEQ ID NO: 3312917 - protein, 7 aa, Plasmodium falciparum
GIGSKTA

SEQ ID NO: 3312918 - protein, 7 aa, Plasmodium falciparum
GIGSSTQ

SEQ ID NO: 3312919 - protein, 5 aa, Plasmodium falciparum
GIGTG

SEQ ID NO: 3312920 - protein, 14 aa, Plasmodium falciparum
GIHNGNKNNNNNIN

SEQ ID NO: 3312921 - protein, 10 aa, Plasmodium falciparum
GIKKSDGIKN

SEQ ID NO: 3312922 - protein, 4 aa, Plasmodium falciparum
GIKN

SEQ ID NO: 3312923 - protein, 9 aa, Plasmodium falciparum
GIKSNDKNN

SEQ ID NO: 3312924 - protein, 4 aa, Plasmodium falciparum
GINH

SEQ ID NO: 3312925 - protein, 35 aa, Plasmodium falciparum
GINIDNNNNDKENNNNNKKKNNKKNKKNSNDHNNH

SEQ ID NO: 3312926 - protein, 11 aa, Plasmodium falciparum
GINKEDKDYEE

SEQ ID NO: 3312927 - protein, 4 aa, Plasmodium falciparum
GINN

SEQ ID NO: 3312928 - protein, 10 aa, Plasmodium falciparum
GINNEQKEND

SEQ ID NO: 3312929 - protein, 10 aa, Plasmodium falciparum
GINSEDKKKK

SEQ ID NO: 3312930 - protein, 122 aa, Plasmodium falciparum
GINSENERGSYSDSRSASYRSESYRSESNRRSESDGRSESDGRSEGDRRSESDRRSEGDKRSEGDKRSEGDKRSESDKKSESDKSSNDDDKRSNDGNTSESERSEVSEKSSYVSSEKPKKRP

SEQ ID NO: 3312931 - protein, 5 aa, Plasmodium falciparum
GINTT

SEQ ID NO: 3312932 - protein, 5 aa, Plasmodium falciparum
GIPGQ

SEQ ID NO: 3312933 - protein, 12 aa, Plasmodium falciparum
GIPNQPNKPGPV

SEQ ID NO: 3312934 - protein, 5 aa, Plasmodium falciparum
GIPPP

SEQ ID NO: 3312935 - protein, 6 aa, Plasmodium falciparum
GIPQGK

SEQ ID NO: 3312936 - protein, 4 aa, Plasmodium falciparum
GIPT

SEQ ID NO: 3312937 - protein, 8 aa, Plasmodium falciparum
GIPTKAGS

SEQ ID NO: 3312938 - protein, 7 aa, Plasmodium falciparum
GIQGNKH

SEQ ID NO: 3312939 - protein, 15 aa, Plasmodium falciparum
GIQKGANGLTGATEN

SEQ ID NO: 3312940 - protein, 9 aa, Plasmodium falciparum
GIQKNEKKQ

SEQ ID NO: 3312941 - protein, 14 aa, Plasmodium falciparum
GIQKRKKNVPFNNK

SEQ ID NO: 3312942 - protein, 25 aa, Plasmodium falciparum
GIQPPHRDTTTVPEKSYNAKTKDHI

SEQ ID NO: 3312943 - protein, 4 aa, Plasmodium falciparum
GIQS

SEQ ID NO: 3312944 - protein, 4 aa, Plasmodium falciparum
GIRA

SEQ ID NO: 3312945 - protein, 9 aa, Plasmodium falciparum
GISNENNMK

SEQ ID NO: 3312946 - protein, 10 aa, Plasmodium falciparum
GISNGNSQSV

SEQ ID NO: 3312947 - protein, 11 aa, Plasmodium falciparum
GISNKHKTNNI

SEQ ID NO: 3312948 - protein, 11 aa, Plasmodium falciparum
GITKNDDPILG

SEQ ID NO: 3312949 - protein, 6 aa, Plasmodium falciparum
GITPQD

SEQ ID NO: 3312950 - protein, 16 aa, Plasmodium falciparum
GITSPRNNGNTNDTYI

SEQ ID NO: 3312951 - protein, 10 aa, Plasmodium falciparum
GIYKDSQNNM

SEQ ID NO: 3312952 - protein, 4 aa, Plasmodium falciparum
GIYN

SEQ ID NO: 3312953 - protein, 24 aa, Plasmodium falciparum
GIYNENNDGNEIDEGYDTKNDNME

SEQ ID NO: 3312954 - protein, 24 aa, Plasmodium falciparum
GIYSSTDHNSSDEYSFNDNKDIKK

SEQ ID NO: 3312955 - protein, 8 aa, Plasmodium falciparum
GKAEKYKQ

SEQ ID NO: 3312956 - protein, 9 aa, Plasmodium falciparum
GKAETGSGK

SEQ ID NO: 3312957 - protein, 16 aa, Plasmodium falciparum
GKAHEGKYKRKGRENY

SEQ ID NO: 3312958 - protein, 4 aa, Plasmodium falciparum
GKAI

SEQ ID NO: 3312959 - protein, 16 aa, Plasmodium falciparum
GKAPGKPKSKARPYVR

SEQ ID NO: 3312960 - protein, 8 aa, Plasmodium falciparum
GKAQEIRE

SEQ ID NO: 3312961 - protein, 4 aa, Plasmodium falciparum
GKAY

SEQ ID NO: 3312962 - protein, 4 aa, Plasmodium falciparum
GKCQ

SEQ ID NO: 3312963 - protein, 6 aa, Plasmodium falciparum
GKCSYN

SEQ ID NO: 3312964 - protein, 7 aa, Plasmodium falciparum
GKDDNTL

SEQ ID NO: 3312965 - protein, 4 aa, Plasmodium falciparum
GKDI

SEQ ID NO: 3312966 - protein, 4 aa, Plasmodium falciparum
GKDK

SEQ ID NO: 3312967 - protein, 10 aa, Plasmodium falciparum
GKDKKNNINS

SEQ ID NO: 3312968 - protein, 19 aa, Plasmodium falciparum
GKDKNKDEQKKIDNIKDQN

SEQ ID NO: 3312969 - protein, 8 aa, Plasmodium falciparum
GKDKQTKI

SEQ ID NO: 3312970 - protein, 21 aa, Plasmodium falciparum
GKDMNKRKSMAQQQNKRKSNY

SEQ ID NO: 3312971 - protein, 8 aa, Plasmodium falciparum
GKDNKTAD

SEQ ID NO: 3312972 - protein, 6 aa, Plasmodium falciparum
GKDNMN

SEQ ID NO: 3312973 - protein, 7 aa, Plasmodium falciparum
GKDNNYI

SEQ ID NO: 3312974 - protein, 4 aa, Plasmodium falciparum
GKDS

SEQ ID NO: 3312975 - protein, 16 aa, Plasmodium falciparum
GKECQHNNSCGNNRNS

SEQ ID NO: 3312976 - protein, 8 aa, Plasmodium falciparum
GKEDDSIK

SEQ ID NO: 3312977 - protein, 12 aa, Plasmodium falciparum
GKEETLNNENDE

SEQ ID NO: 3312978 - protein, 4 aa, Plasmodium falciparum
GKEF

SEQ ID NO: 3312979 - protein, 7 aa, Plasmodium falciparum
GKEFDHP

SEQ ID NO: 3312980 - protein, 4 aa, Plasmodium falciparum
GKEG

SEQ ID NO: 3312981 - protein, 5 aa, Plasmodium falciparum
GKEGR

SEQ ID NO: 3312982 - protein, 10 aa, Plasmodium falciparum
GKEGTSKKNI

SEQ ID NO: 3312983 - protein, 5 aa, Plasmodium falciparum
GKEHL

SEQ ID NO: 3312984 - protein, 5 aa, Plasmodium falciparum
GKEIL

SEQ ID NO: 3312985 - protein, 8 aa, Plasmodium falciparum
GKEKEAEN

SEQ ID NO: 3312986 - protein, 40 aa, Plasmodium falciparum
GKEKNELGNNECNNNNNNYISKNGDEDDDNIEDSYNDDEI

SEQ ID NO: 3312987 - protein, 9 aa, Plasmodium falciparum
GKEKQRKKN

SEQ ID NO: 3312988 - protein, 5 aa, Plasmodium falciparum
GKELN

SEQ ID NO: 3312989 - protein, 8 aa, Plasmodium falciparum
GKENIERE

SEQ ID NO: 3312990 - protein, 14 aa, Plasmodium falciparum
GKENKTNHNKENNV

SEQ ID NO: 3312991 - protein, 6 aa, Plasmodium falciparum
GKENMY

SEQ ID NO: 3312992 - protein, 9 aa, Plasmodium falciparum
GKENNKKEL

SEQ ID NO: 3312993 - protein, 4 aa, Plasmodium falciparum
GKEP

SEQ ID NO: 3312994 - protein, 7 aa, Plasmodium falciparum
GKEPLRQ

SEQ ID NO: 3312995 - protein, 8 aa, Plasmodium falciparum
GKEPSKNK

SEQ ID NO: 3312996 - protein, 34 aa, Plasmodium falciparum
GKEQNVNDMNNKKNTNNLNDNFERDKENIERNKK

SEQ ID NO: 3312997 - protein, 4 aa, Plasmodium falciparum
GKES

SEQ ID NO: 3312998 - protein, 12 aa, Plasmodium falciparum
GKESNEKTNNLK

SEQ ID NO: 3312999 - protein, 25 aa, Plasmodium falciparum
GKETIEYSSENKNIKKSSSSKWKPP

SEQ ID NO: 3313000 - protein, 21 aa, Plasmodium falciparum
GKETKRHDDNNNNNINDGDEN

SEQ ID NO: 3313001 - protein, 6 aa, Plasmodium falciparum
GKETQV

SEQ ID NO: 3313002 - protein, 9 aa, Plasmodium falciparum
GKFDKSSKV

SEQ ID NO: 3313003 - protein, 12 aa, Plasmodium falciparum
GKFKKKKSNEYY

SEQ ID NO: 3313004 - protein, 4 aa, Plasmodium falciparum
GKGA
